United States Patent 8,461,315 (MICRORNAS AND USES THEREOF) - sequence listing, part 23

SEQ ID NO: 658119 - RNA, 64 nt, Homo Sapiens; identical to SEQ ID NO: 132681

SEQ ID NO: 658120 - RNA, 64 nt, Homo Sapiens; identical to SEQ ID NO: 132682

SEQ ID NO: 658121 - RNA, 64 nt, Homo Sapiens; identical to SEQ ID NO: 132683

SEQ ID NO: 658122 - RNA, 64 nt, Homo Sapiens; identical to SEQ ID NO: 132684

SEQ ID NO: 658123 - RNA, 64 nt, Homo Sapiens; identical to SEQ ID NO: 132685

SEQ ID NO: 658124 - RNA, 64 nt, Homo Sapiens; identical to SEQ ID NO: 132686

SEQ ID NO: 658125 - RNA, 64 nt, Homo Sapiens; identical to SEQ ID NO: 132687

SEQ ID NO: 658126 - RNA, 64 nt, Homo Sapiens; identical to SEQ ID NO: 132688

SEQ ID NO: 658127 - RNA, 64 nt, Homo Sapiens; identical to SEQ ID NO: 132689

SEQ ID NO: 658128 - RNA, 64 nt, Homo Sapiens; identical to SEQ ID NO: 132690

SEQ ID NO: 658129 - RNA, 55 nt, Homo Sapiens; identical to SEQ ID NO: 132691

SEQ ID NO: 658130 - RNA, 64 nt, Homo Sapiens; identical to SEQ ID NO: 132692

SEQ ID NO: 658131 - RNA, 64 nt, Homo Sapiens; identical to SEQ ID NO: 132693

SEQ ID NO: 658132 - RNA, 64 nt, Homo Sapiens; identical to SEQ ID NO: 132694

SEQ ID NO: 658133 - RNA, 64 nt, Homo Sapiens; identical to SEQ ID NO: 132695

SEQ ID NO: 658134 - RNA, 64 nt, Homo Sapiens; identical to SEQ ID NO: 132696

SEQ ID NO: 658135 - RNA, 64 nt, Homo Sapiens; identical to SEQ ID NO: 132697

SEQ ID NO: 658136 - RNA, 64 nt, Homo Sapiens; identical to SEQ ID NO: 132698

SEQ ID NO: 658137 - RNA, 64 nt, Homo Sapiens; identical to SEQ ID NO: 132699

SEQ ID NO: 658138 - RNA, 64 nt, Homo Sapiens; identical to SEQ ID NO: 132700

SEQ ID NO: 658139 - RNA, 64 nt, Homo Sapiens; identical to SEQ ID NO: 132701

SEQ ID NO: 658140 - RNA, 64 nt, Homo Sapiens; identical to SEQ ID NO: 132702

SEQ ID NO: 658141 - RNA, 64 nt, Homo Sapiens; identical to SEQ ID NO: 132703

SEQ ID NO: 658142 - RNA, 64 nt, Homo Sapiens; identical to SEQ ID NO: 132704

SEQ ID NO: 658143 - RNA, 64 nt, Homo Sapiens; identical to SEQ ID NO: 132705

SEQ ID NO: 658144 - RNA, 64 nt, Homo Sapiens; identical to SEQ ID NO: 132706

SEQ ID NO: 658145 - RNA, 64 nt, Homo Sapiens; identical to SEQ ID NO: 132707

SEQ ID NO: 658146 - RNA, 64 nt, Homo Sapiens; identical to SEQ ID NO: 132708

SEQ ID NO: 658147 - RNA, 64 nt, Homo Sapiens; identical to SEQ ID NO: 132709

SEQ ID NO: 658148 - RNA, 64 nt, Homo Sapiens; identical to SEQ ID NO: 132710

SEQ ID NO: 658149 - RNA, 64 nt, Homo Sapiens; identical to SEQ ID NO: 132711

SEQ ID NO: 658150 - RNA, 64 nt, Homo Sapiens; identical to SEQ ID NO: 132712

SEQ ID NO: 658151 - RNA, 64 nt, Homo Sapiens
auacuguaaagcuuaagccaaagugguacuagggaacuacaagauaugacaauauuuaaauacu

SEQ ID NO: 658152 - RNA, 64 nt, Homo Sapiens
uccaaugagccacuagccacucucaaacgucuacaacuacaaugguccaacuuaaaaccaacag

SEQ ID NO: 658153 - RNA, 64 nt, Homo Sapiens
acacacaaccuaauaauuucuuauaaaaauuuuaaacuacaaagcuacauuuuuacuugcuugu

SEQ ID NO: 658154 - RNA, 64 nt, Homo Sapiens
uucuguauuaauauauuagcagauauuuggucuuaacuacaacauagcuuuguuuguaaacuua

SEQ ID NO: 658155 - RNA, 64 nt, Homo Sapiens
aaucacuuacuaagccuuaaauuugguucagggcaacuacaaaugugcaacauugagaauaaug

SEQ ID NO: 658156 - RNA, 64 nt, Homo Sapiens
ugucagauuucuuaaaaggaaaugucuguuaucuaacuacaaauaauuaugaaagugaaaugca

SEQ ID NO: 658157 - RNA, 64 nt, Homo Sapiens
aaaagagcgauuugcugaagagcauuuuagcaucaacuacaaucaaccacagauugcaaagcau

SEQ ID NO: 658158 - RNA, 64 nt, Homo Sapiens
uggaguguaggaauugacuaccugaaacaaagaaaacuacaagcgaauggguucugugucuaau

SEQ ID NO: 658159 - RNA, 64 nt, Homo Sapiens
augucagauaaaguaagcauaguaauguagcaggaacuacaauagaagacauuuucacuggaau

SEQ ID NO: 658160 - RNA, 64 nt, Homo Sapiens
cuuugcuaaggaguaagugaaugugaagaguaccaacuacaacaauucuacagauaauuagugg

SEQ ID NO: 658161 - RNA, 64 nt, Homo Sapiens
uagacaacaccagaggguucaaaaaguuuuccaaaacuacaacucaaauguaauaaauuugaaa

SEQ ID NO: 658162 - RNA, 64 nt, Homo Sapiens
cuggaagacaucacaguaauuuaaacuggagagaaacuacaaagcuuacuaaacauaaaaaaac

SEQ ID NO: 658163 - RNA, 59 nt, Homo Sapiens
ccgccagccgugagccguaagccggcguccccgcccagccgagagggccggcgccuacc

SEQ ID NO: 658164 - RNA, 64 nt, Homo Sapiens
ccuggcgggaccccgcagcagccccggccccauccccgcccagagccgggcgucgugugggucc

SEQ ID NO: 658165 - RNA, 64 nt, Homo Sapiens
ugggcauucaggaccuugaggacacgugaccccacccgcccaccgccacuaucaggccccggga

SEQ ID NO: 658166 - RNA, 64 nt, Homo Sapiens
cccgccccagccccugcucaagggagaggcccaccccgcccagcccucccuccccagaccccag

SEQ ID NO: 658167 - RNA, 64 nt, Homo Sapiens
cucugccuggucgcgcucuuaggacccuaggcuccccgcccacccgucgcugugcuuggugugu

SEQ ID NO: 658168 - RNA, 64 nt, Homo Sapiens
caacgaaggcgccaucuaggccgcgcuggcugcacccgcccaggcccgcacccgcccagucccg

SEQ ID NO: 658169 - RNA, 64 nt, Homo Sapiens
uaggccgcgcuggcugcacccgcccaggcccgcacccgcccagucccgagggcccggcccuguc

SEQ ID NO: 658170 - RNA, 50 nt, Homo Sapiens
gcagugccaacggccucugacccgcccacccgccuuuuauaaaccucuaa

SEQ ID NO: 658171 - RNA, 64 nt, Homo Sapiens
cagugugccccccauccuggcccaucaguguacccccgcccaggcuggccagccccacagccca

SEQ ID NO: 658172 - RNA, 64 nt, Homo Sapiens
agcggacucggcccccaaggugcuccccuugggucccgcccacccgcccaacuucccuacuggc

SEQ ID NO: 658173 - RNA, 52 nt, Homo Sapiens
ccacggaggccacagccacagccccgcccaccggguggugcccggcauguaa

SEQ ID NO: 658174 - RNA, 64 nt, Homo Sapiens
cucugcccacccgagccccaccacucucagaacccccgcccagcgcacggcgaccucgcgccuc

SEQ ID NO: 658175 - RNA, 64 nt, Homo Sapiens
cggguggggguguggccgagccccggcaggaagccccgcccagacgguguucagggaacccgga

SEQ ID NO: 658176 - RNA, 64 nt, Homo Sapiens
uuggggggcugcucguacgaauaggccugggacccccgcccagccugcccagggcuccccaacu

SEQ ID NO: 658177 - RNA, 64 nt, Homo Sapiens
cgcccccaccccaccggcaguguccgucuauccacccgcccaccugcacaccaggcugcugcuu

SEQ ID NO: 658178 - RNA, 64 nt, Homo Sapiens
agaagcuccuggagauugccaccaagcccacguacccgcccaugaacccaauuccagcaccguu

SEQ ID NO: 658179 - RNA, 64 nt, Homo Sapiens
ugaagcccugagaagccagugccaucauccccaccccgcccaggguuccggaacauucauuccc

SEQ ID NO: 658180 - RNA, 64 nt, Homo Sapiens
ccagcacgccugccggcuucucaucgucagggagcccgcccagagcucgugacgagcaagugcu

SEQ ID NO: 658181 - RNA, 64 nt, Homo Sapiens; identical to SEQ ID NO: 236284

SEQ ID NO: 658182 - RNA, 64 nt, Homo Sapiens; identical to SEQ ID NO: 236285

SEQ ID NO: 658183 - RNA, 64 nt, Homo Sapiens; identical to SEQ ID NO: 236286

SEQ ID NO: 658184 - RNA, 64 nt, Homo Sapiens; identical to SEQ ID NO: 236287

SEQ ID NO: 658185 - RNA, 64 nt, Homo Sapiens; identical to SEQ ID NO: 236288

SEQ ID NO: 658186 - RNA, 64 nt, Homo Sapiens; identical to SEQ ID NO: 236289

SEQ ID NO: 658187 - RNA, 64 nt, Homo Sapiens; identical to SEQ ID NO: 189516

SEQ ID NO: 658188 - RNA, 64 nt, Homo Sapiens; identical to SEQ ID NO: 189517

SEQ ID NO: 658189 - RNA, 64 nt, Homo Sapiens; identical to SEQ ID NO: 245345

SEQ ID NO: 658190 - RNA, 64 nt, Homo Sapiens; identical to SEQ ID NO: 245346

SEQ ID NO: 658191 - RNA, 64 nt, Homo Sapiens; identical to SEQ ID NO: 245347

SEQ ID NO: 658192 - RNA, 64 nt, Homo Sapiens; identical to SEQ ID NO: 245348

SEQ ID NO: 658193 - RNA, 64 nt, Homo Sapiens; identical to SEQ ID NO: 245349

SEQ ID NO: 658194 - RNA, 64 nt, Homo Sapiens; identical to SEQ ID NO: 245350

SEQ ID NO: 658195 - RNA, 64 nt, Homo Sapiens; identical to SEQ ID NO: 245351

SEQ ID NO: 658196 - RNA, 64 nt, Homo Sapiens; identical to SEQ ID NO: 245352

SEQ ID NO: 658197 - RNA, 64 nt, Homo Sapiens; identical to SEQ ID NO: 245353

SEQ ID NO: 658198 - RNA, 64 nt, Homo Sapiens; identical to SEQ ID NO: 245354

SEQ ID NO: 658199 - RNA, 64 nt, Homo Sapiens; identical to SEQ ID NO: 245355

SEQ ID NO: 658200 - RNA, 64 nt, Homo Sapiens; identical to SEQ ID NO: 245356

SEQ ID NO: 658201 - RNA, 64 nt, Homo Sapiens; identical to SEQ ID NO: 245357

SEQ ID NO: 658202 - RNA, 64 nt, Homo Sapiens; identical to SEQ ID NO: 245358

SEQ ID NO: 658203 - RNA, 64 nt, Homo Sapiens; identical to SEQ ID NO: 245359

SEQ ID NO: 658204 - RNA, 64 nt, Homo Sapiens; identical to SEQ ID NO: 245360

SEQ ID NO: 658205 - RNA, 64 nt, Homo Sapiens; identical to SEQ ID NO: 245361

SEQ ID NO: 658206 - RNA, 64 nt, Homo Sapiens; identical to SEQ ID NO: 245362

SEQ ID NO: 658207 - RNA, 64 nt, Homo Sapiens; identical to SEQ ID NO: 245363

SEQ ID NO: 658208 - RNA, 64 nt, Homo Sapiens; identical to SEQ ID NO: 245364

SEQ ID NO: 658209 - RNA, 64 nt, Homo Sapiens; identical to SEQ ID NO: 245365

SEQ ID NO: 658210 - RNA, 64 nt, Homo Sapiens; identical to SEQ ID NO: 245366

SEQ ID NO: 658211 - RNA, 64 nt, Homo Sapiens; identical to SEQ ID NO: 245367

SEQ ID NO: 658212 - RNA, 64 nt, Homo Sapiens; identical to SEQ ID NO: 245368

SEQ ID NO: 658213 - RNA, 64 nt, Homo Sapiens; identical to SEQ ID NO: 245369

SEQ ID NO: 658214 - RNA, 64 nt, Homo Sapiens; identical to SEQ ID NO: 245370

SEQ ID NO: 658215 - RNA, 64 nt, Homo Sapiens; identical to SEQ ID NO: 245371

SEQ ID NO: 658216 - RNA, 64 nt, Homo Sapiens; identical to SEQ ID NO: 245372

SEQ ID NO: 658217 - RNA, 64 nt, Homo Sapiens; identical to SEQ ID NO: 245373

SEQ ID NO: 658218 - RNA, 64 nt, Homo Sapiens; identical to SEQ ID NO: 245374

SEQ ID NO: 658219 - RNA, 64 nt, Homo Sapiens; identical to SEQ ID NO: 245375

SEQ ID NO: 658220 - RNA, 64 nt, Homo Sapiens; identical to SEQ ID NO: 245376

SEQ ID NO: 658221 - RNA, 64 nt, Homo Sapiens; identical to SEQ ID NO: 245377

SEQ ID NO: 658222 - RNA, 64 nt, Homo Sapiens; identical to SEQ ID NO: 245378

SEQ ID NO: 658223 - RNA, 64 nt, Homo Sapiens; identical to SEQ ID NO: 245379

SEQ ID NO: 658224 - RNA, 64 nt, Homo Sapiens; identical to SEQ ID NO: 245380

SEQ ID NO: 658225 - RNA, 64 nt, Homo Sapiens; identical to SEQ ID NO: 245381

SEQ ID NO: 658226 - RNA, 64 nt, Homo Sapiens; identical to SEQ ID NO: 245382

SEQ ID NO: 658227 - RNA, 64 nt, Homo Sapiens; identical to SEQ ID NO: 245383

SEQ ID NO: 658228 - RNA, 64 nt, Homo Sapiens; identical to SEQ ID NO: 245384

SEQ ID NO: 658229 - RNA, 64 nt, Homo Sapiens; identical to SEQ ID NO: 245385

SEQ ID NO: 658230 - RNA, 51 nt, Homo Sapiens; identical to SEQ ID NO: 245386

SEQ ID NO: 658231 - RNA, 64 nt, Homo Sapiens; identical to SEQ ID NO: 245387

SEQ ID NO: 658232 - RNA, 64 nt, Homo Sapiens; identical to SEQ ID NO: 245388

SEQ ID NO: 658233 - RNA, 64 nt, Homo Sapiens; identical to SEQ ID NO: 245389

SEQ ID NO: 658234 - RNA, 64 nt, Homo Sapiens; identical to SEQ ID NO: 245390

SEQ ID NO: 658235 - RNA, 64 nt, Homo Sapiens; identical to SEQ ID NO: 245391

SEQ ID NO: 658236 - RNA, 64 nt, Homo Sapiens; identical to SEQ ID NO: 245392

SEQ ID NO: 658237 - RNA, 57 nt, Homo Sapiens; identical to SEQ ID NO: 245393

SEQ ID NO: 658238 - RNA, 64 nt, Homo Sapiens; identical to SEQ ID NO: 245394

SEQ ID NO: 658239 - RNA, 64 nt, Homo Sapiens; identical to SEQ ID NO: 245395

SEQ ID NO: 658240 - RNA, 64 nt, Homo Sapiens; identical to SEQ ID NO: 245396

SEQ ID NO: 658241 - RNA, 64 nt, Homo Sapiens; identical to SEQ ID NO: 245397

SEQ ID NO: 658242 - RNA, 64 nt, Homo Sapiens; identical to SEQ ID NO: 245398

SEQ ID NO: 658243 - RNA, 64 nt, Homo Sapiens; identical to SEQ ID NO: 245399

SEQ ID NO: 658244 - RNA, 64 nt, Homo Sapiens; identical to SEQ ID NO: 245400

SEQ ID NO: 658245 - RNA, 64 nt, Homo Sapiens; identical to SEQ ID NO: 245401

SEQ ID NO: 658246 - RNA, 64 nt, Homo Sapiens; identical to SEQ ID NO: 245402

SEQ ID NO: 658247 - RNA, 64 nt, Homo Sapiens; identical to SEQ ID NO: 245403

SEQ ID NO: 658248 - RNA, 64 nt, Homo Sapiens; identical to SEQ ID NO: 245404

SEQ ID NO: 658249 - RNA, 64 nt, Homo Sapiens; identical to SEQ ID NO: 245405

SEQ ID NO: 658250 - RNA, 64 nt, Homo Sapiens; identical to SEQ ID NO: 96836

SEQ ID NO: 658251 - RNA, 64 nt, Homo Sapiens; identical to SEQ ID NO: 96837

SEQ ID NO: 658252 - RNA, 64 nt, Homo Sapiens; identical to SEQ ID NO: 96838

SEQ ID NO: 658253 - RNA, 64 nt, Homo Sapiens; identical to SEQ ID NO: 96839

SEQ ID NO: 658254 - RNA, 64 nt, Homo Sapiens; identical to SEQ ID NO: 96840

SEQ ID NO: 658255 - RNA, 64 nt, Homo Sapiens; identical to SEQ ID NO: 96841

SEQ ID NO: 658256 - RNA, 64 nt, Homo Sapiens; identical to SEQ ID NO: 96842

SEQ ID NO: 658257 - RNA, 64 nt, Homo Sapiens; identical to SEQ ID NO: 96843

SEQ ID NO: 658258 - RNA, 64 nt, Homo Sapiens; identical to SEQ ID NO: 96844

SEQ ID NO: 658259 - RNA, 64 nt, Homo Sapiens; identical to SEQ ID NO: 96845

SEQ ID NO: 658260 - RNA, 64 nt, Homo Sapiens; identical to SEQ ID NO: 96846

SEQ ID NO: 658261 - RNA, 64 nt, Homo Sapiens; identical to SEQ ID NO: 96847

SEQ ID NO: 658262 - RNA, 64 nt, Homo Sapiens; identical to SEQ ID NO: 96848

SEQ ID NO: 658263 - RNA, 64 nt, Homo Sapiens; identical to SEQ ID NO: 96849

SEQ ID NO: 658264 - RNA, 64 nt, Homo Sapiens; identical to SEQ ID NO: 96850

SEQ ID NO: 658265 - RNA, 64 nt, Homo Sapiens; identical to SEQ ID NO: 96851

SEQ ID NO: 658266 - RNA, 64 nt, Homo Sapiens; identical to SEQ ID NO: 96852

SEQ ID NO: 658267 - RNA, 64 nt, Homo Sapiens; identical to SEQ ID NO: 96853

SEQ ID NO: 658268 - RNA, 64 nt, Homo Sapiens; identical to SEQ ID NO: 96854

SEQ ID NO: 658269 - RNA, 64 nt, Homo Sapiens; identical to SEQ ID NO: 96855

SEQ ID NO: 658270 - RNA, 64 nt, Homo Sapiens; identical to SEQ ID NO: 96856

SEQ ID NO: 658271 - RNA, 64 nt, Homo Sapiens; identical to SEQ ID NO: 96857

SEQ ID NO: 658272 - RNA, 64 nt, Homo Sapiens; identical to SEQ ID NO: 96858

SEQ ID NO: 658273 - RNA, 64 nt, Homo Sapiens; identical to SEQ ID NO: 96859

SEQ ID NO: 658274 - RNA, 64 nt, Homo Sapiens; identical to SEQ ID NO: 96860

SEQ ID NO: 658275 - RNA, 64 nt, Homo Sapiens; identical to SEQ ID NO: 96861

SEQ ID NO: 658276 - RNA, 64 nt, Homo Sapiens; identical to SEQ ID NO: 96862

SEQ ID NO: 658277 - RNA, 64 nt, Homo Sapiens; identical to SEQ ID NO: 96863

SEQ ID NO: 658278 - RNA, 64 nt, Homo Sapiens; identical to SEQ ID NO: 96864

SEQ ID NO: 658279 - RNA, 64 nt, Homo Sapiens; identical to SEQ ID NO: 96865

SEQ ID NO: 658280 - RNA, 64 nt, Homo Sapiens; identical to SEQ ID NO: 96866

SEQ ID NO: 658281 - RNA, 64 nt, Homo Sapiens; identical to SEQ ID NO: 96867

SEQ ID NO: 658282 - RNA, 64 nt, Homo Sapiens; identical to SEQ ID NO: 96868

SEQ ID NO: 658283 - RNA, 64 nt, Homo Sapiens; identical to SEQ ID NO: 96869

SEQ ID NO: 658284 - RNA, 64 nt, Homo Sapiens; identical to SEQ ID NO: 96870

SEQ ID NO: 658285 - RNA, 64 nt, Homo Sapiens; identical to SEQ ID NO: 96871

SEQ ID NO: 658286 - RNA, 64 nt, Homo Sapiens; identical to SEQ ID NO: 96872

SEQ ID NO: 658287 - RNA, 64 nt, Homo Sapiens; identical to SEQ ID NO: 96873

SEQ ID NO: 658288 - RNA, 64 nt, Homo Sapiens; identical to SEQ ID NO: 96874

SEQ ID NO: 658289 - RNA, 64 nt, Homo Sapiens; identical to SEQ ID NO: 96875

SEQ ID NO: 658290 - RNA, 64 nt, Homo Sapiens; identical to SEQ ID NO: 169676

SEQ ID NO: 658291 - RNA, 64 nt, Homo Sapiens; identical to SEQ ID NO: 169677

SEQ ID NO: 658292 - RNA, 64 nt, Homo Sapiens; identical to SEQ ID NO: 169678

SEQ ID NO: 658293 - RNA, 64 nt, Homo Sapiens; identical to SEQ ID NO: 169679

SEQ ID NO: 658294 - RNA, 64 nt, Homo Sapiens; identical to SEQ ID NO: 169680

SEQ ID NO: 658295 - RNA, 64 nt, Homo Sapiens; identical to SEQ ID NO: 169681

SEQ ID NO: 658296 - RNA, 64 nt, Homo Sapiens; identical to SEQ ID NO: 169682

SEQ ID NO: 658297 - RNA, 64 nt, Homo Sapiens; identical to SEQ ID NO: 169683

SEQ ID NO: 658298 - RNA, 64 nt, Homo Sapiens; identical to SEQ ID NO: 169684

SEQ ID NO: 658299 - RNA, 64 nt, Homo Sapiens; identical to SEQ ID NO: 169685

SEQ ID NO: 658300 - RNA, 64 nt, Homo Sapiens; identical to SEQ ID NO: 169686

SEQ ID NO: 658301 - RNA, 64 nt, Homo Sapiens; identical to SEQ ID NO: 169687

SEQ ID NO: 658302 - RNA, 64 nt, Homo Sapiens; identical to SEQ ID NO: 169688

SEQ ID NO: 658303 - RNA, 64 nt, Homo Sapiens; identical to SEQ ID NO: 169689

SEQ ID NO: 658304 - RNA, 64 nt, Homo Sapiens; identical to SEQ ID NO: 169690

SEQ ID NO: 658305 - RNA, 64 nt, Homo Sapiens; identical to SEQ ID NO: 169691

SEQ ID NO: 658306 - RNA, 64 nt, Homo Sapiens; identical to SEQ ID NO: 169692

SEQ ID NO: 658307 - RNA, 64 nt, Homo Sapiens; identical to SEQ ID NO: 169693

SEQ ID NO: 658308 - RNA, 64 nt, Homo Sapiens; identical to SEQ ID NO: 169694

SEQ ID NO: 658309 - RNA, 64 nt, Homo Sapiens; identical to SEQ ID NO: 169695

SEQ ID NO: 658310 - RNA, 64 nt, Homo Sapiens; identical to SEQ ID NO: 169696

SEQ ID NO: 658311 - RNA, 64 nt, Homo Sapiens; identical to SEQ ID NO: 169697

SEQ ID NO: 658312 - RNA, 64 nt, Homo Sapiens; identical to SEQ ID NO: 169698

SEQ ID NO: 658313 - RNA, 64 nt, Homo Sapiens; identical to SEQ ID NO: 169699

SEQ ID NO: 658314 - RNA, 64 nt, Homo Sapiens; identical to SEQ ID NO: 169700

SEQ ID NO: 658315 - RNA, 64 nt, Homo Sapiens; identical to SEQ ID NO: 169701

SEQ ID NO: 658316 - RNA, 64 nt, Homo Sapiens; identical to SEQ ID NO: 169702

SEQ ID NO: 658317 - RNA, 64 nt, Homo Sapiens; identical to SEQ ID NO: 169703

SEQ ID NO: 658318 - RNA, 64 nt, Homo Sapiens; identical to SEQ ID NO: 169704

SEQ ID NO: 658319 - RNA, 64 nt, Homo Sapiens; identical to SEQ ID NO: 169705

SEQ ID NO: 658320 - RNA, 64 nt, Homo Sapiens; identical to SEQ ID NO: 169706

SEQ ID NO: 658321 - RNA, 64 nt, Homo Sapiens; identical to SEQ ID NO: 169707

SEQ ID NO: 658322 - RNA, 64 nt, Homo Sapiens; identical to SEQ ID NO: 169708

SEQ ID NO: 658323 - RNA, 64 nt, Homo Sapiens; identical to SEQ ID NO: 169709

SEQ ID NO: 658324 - RNA, 64 nt, Homo Sapiens; identical to SEQ ID NO: 169710

SEQ ID NO: 658325 - RNA, 64 nt, Homo Sapiens; identical to SEQ ID NO: 169711

SEQ ID NO: 658326 - RNA, 64 nt, Homo Sapiens; identical to SEQ ID NO: 169712

SEQ ID NO: 658327 - RNA, 64 nt, Homo Sapiens; identical to SEQ ID NO: 169713

SEQ ID NO: 658328 - RNA, 64 nt, Homo Sapiens; identical to SEQ ID NO: 169714

SEQ ID NO: 658329 - RNA, 64 nt, Homo Sapiens; identical to SEQ ID NO: 169715

SEQ ID NO: 658330 - RNA, 64 nt, Homo Sapiens; identical to SEQ ID NO: 169716

SEQ ID NO: 658331 - RNA, 64 nt, Homo Sapiens; identical to SEQ ID NO: 169717

SEQ ID NO: 658332 - RNA, 64 nt, Homo Sapiens; identical to SEQ ID NO: 169718

SEQ ID NO: 658333 - RNA, 64 nt, Homo Sapiens; identical to SEQ ID NO: 169719

SEQ ID NO: 658334 - RNA, 64 nt, Homo Sapiens; identical to SEQ ID NO: 169720

SEQ ID NO: 658335 - RNA, 62 nt, Homo Sapiens; identical to SEQ ID NO: 169721

SEQ ID NO: 658336 - RNA, 64 nt, Homo Sapiens; identical to SEQ ID NO: 169722

SEQ ID NO: 658337 - RNA, 64 nt, Homo Sapiens; identical to SEQ ID NO: 169723

SEQ ID NO: 658338 - RNA, 64 nt, Homo Sapiens; identical to SEQ ID NO: 169724

SEQ ID NO: 658339 - RNA, 64 nt, Homo Sapiens; identical to SEQ ID NO: 169725

SEQ ID NO: 658340 - RNA, 64 nt, Homo Sapiens; identical to SEQ ID NO: 169726

SEQ ID NO: 658341 - RNA, 64 nt, Homo Sapiens; identical to SEQ ID NO: 169727

SEQ ID NO: 658342 - RNA, 64 nt, Homo Sapiens; identical to SEQ ID NO: 169728

SEQ ID NO: 658343 - RNA, 64 nt, Homo Sapiens; identical to SEQ ID NO: 169729

SEQ ID NO: 658344 - RNA, 64 nt, Homo Sapiens; identical to SEQ ID NO: 169730

SEQ ID NO: 658345 - RNA, 64 nt, Homo Sapiens; identical to SEQ ID NO: 169731

SEQ ID NO: 658346 - RNA, 64 nt, Homo Sapiens; identical to SEQ ID NO: 169732

SEQ ID NO: 658347 - RNA, 64 nt, Homo Sapiens; identical to SEQ ID NO: 169733

SEQ ID NO: 658348 - RNA, 64 nt, Homo Sapiens; identical to SEQ ID NO: 169734

SEQ ID NO: 658349 - RNA, 64 nt, Homo Sapiens; identical to SEQ ID NO: 281104

SEQ ID NO: 658350 - RNA, 64 nt, Homo Sapiens; identical to SEQ ID NO: 281105

SEQ ID NO: 658351 - RNA, 64 nt, Homo Sapiens; identical to SEQ ID NO: 281106

SEQ ID NO: 658352 - RNA, 64 nt, Homo Sapiens; identical to SEQ ID NO: 281107

SEQ ID NO: 658353 - RNA, 64 nt, Homo Sapiens; identical to SEQ ID NO: 281108

SEQ ID NO: 658354 - RNA, 64 nt, Homo Sapiens; identical to SEQ ID NO: 281109

SEQ ID NO: 658355 - RNA, 64 nt, Homo Sapiens; identical to SEQ ID NO: 281110

SEQ ID NO: 658356 - RNA, 64 nt, Homo Sapiens; identical to SEQ ID NO: 281111

SEQ ID NO: 658357 - RNA, 64 nt, Homo Sapiens; identical to SEQ ID NO: 281112

SEQ ID NO: 658358 - RNA, 64 nt, Homo Sapiens; identical to SEQ ID NO: 281113

SEQ ID NO: 658359 - RNA, 64 nt, Homo Sapiens; identical to SEQ ID NO: 281114

SEQ ID NO: 658360 - RNA, 64 nt, Homo Sapiens; identical to SEQ ID NO: 281115

SEQ ID NO: 658361 - RNA, 64 nt, Homo Sapiens; identical to SEQ ID NO: 281116

SEQ ID NO: 658362 - RNA, 64 nt, Homo Sapiens; identical to SEQ ID NO: 281117

SEQ ID NO: 658363 - RNA, 64 nt, Homo Sapiens; identical to SEQ ID NO: 281118

SEQ ID NO: 658364 - RNA, 64 nt, Homo Sapiens; identical to SEQ ID NO: 281119

SEQ ID NO: 658365 - RNA, 64 nt, Homo Sapiens; identical to SEQ ID NO: 303055

SEQ ID NO: 658366 - RNA, 64 nt, Homo Sapiens; identical to SEQ ID NO: 303056

SEQ ID NO: 658367 - RNA, 64 nt, Homo Sapiens; identical to SEQ ID NO: 303057

SEQ ID NO: 658368 - RNA, 64 nt, Homo Sapiens; identical to SEQ ID NO: 303058

SEQ ID NO: 658369 - RNA, 64 nt, Homo Sapiens; identical to SEQ ID NO: 303059

SEQ ID NO: 658370 - RNA, 64 nt, Homo Sapiens; identical to SEQ ID NO: 303060

SEQ ID NO: 658371 - RNA, 64 nt, Homo Sapiens; identical to SEQ ID NO: 303061

SEQ ID NO: 658372 - RNA, 64 nt, Homo Sapiens; identical to SEQ ID NO: 303062

SEQ ID NO: 658373 - RNA, 64 nt, Homo Sapiens; identical to SEQ ID NO: 303063

SEQ ID NO: 658374 - RNA, 64 nt, Homo Sapiens; identical to SEQ ID NO: 303064

SEQ ID NO: 658375 - RNA, 64 nt, Homo Sapiens; identical to SEQ ID NO: 303065

SEQ ID NO: 658376 - RNA, 64 nt, Homo Sapiens; identical to SEQ ID NO: 303066

SEQ ID NO: 658377 - RNA, 64 nt, Homo Sapiens; identical to SEQ ID NO: 303067

SEQ ID NO: 658378 - RNA, 64 nt, Homo Sapiens; identical to SEQ ID NO: 303068

SEQ ID NO: 658379 - RNA, 64 nt, Homo Sapiens; identical to SEQ ID NO: 303069

SEQ ID NO: 658380 - RNA, 64 nt, Homo Sapiens; identical to SEQ ID NO: 303070

SEQ ID NO: 658381 - RNA, 64 nt, Homo Sapiens; identical to SEQ ID NO: 303071

SEQ ID NO: 658382 - RNA, 64 nt, Homo Sapiens; identical to SEQ ID NO: 303072

SEQ ID NO: 658383 - RNA, 64 nt, Homo Sapiens; identical to SEQ ID NO: 303073

SEQ ID NO: 658384 - RNA, 64 nt, Homo Sapiens; identical to SEQ ID NO: 303074

SEQ ID NO: 658385 - RNA, 64 nt, Homo Sapiens; identical to SEQ ID NO: 303075

SEQ ID NO: 658386 - RNA, 64 nt, Homo Sapiens; identical to SEQ ID NO: 303076

SEQ ID NO: 658387 - RNA, 64 nt, Homo Sapiens; identical to SEQ ID NO: 303077

SEQ ID NO: 658388 - RNA, 64 nt, Homo Sapiens; identical to SEQ ID NO: 303078

SEQ ID NO: 658389 - RNA, 64 nt, Homo Sapiens; identical to SEQ ID NO: 303079

SEQ ID NO: 658390 - RNA, 64 nt, Homo Sapiens; identical to SEQ ID NO: 303080

SEQ ID NO: 658391 - RNA, 64 nt, Homo Sapiens; identical to SEQ ID NO: 303081

SEQ ID NO: 658392 - RNA, 64 nt, Homo Sapiens; identical to SEQ ID NO: 303082

SEQ ID NO: 658393 - RNA, 64 nt, Homo Sapiens; identical to SEQ ID NO: 303083

SEQ ID NO: 658394 - RNA, 64 nt, Homo Sapiens; identical to SEQ ID NO: 303084

SEQ ID NO: 658395 - RNA, 64 nt, Homo Sapiens; identical to SEQ ID NO: 303085

SEQ ID NO: 658396 - RNA, 64 nt, Homo Sapiens; identical to SEQ ID NO: 303086

SEQ ID NO: 658397 - RNA, 64 nt, Homo Sapiens; identical to SEQ ID NO: 303087

SEQ ID NO: 658398 - RNA, 64 nt, Homo Sapiens; identical to SEQ ID NO: 303088

SEQ ID NO: 658399 - RNA, 64 nt, Homo Sapiens; identical to SEQ ID NO: 303089

SEQ ID NO: 658400 - RNA, 64 nt, Homo Sapiens; identical to SEQ ID NO: 303090

SEQ ID NO: 658401 - RNA, 64 nt, Homo Sapiens; identical to SEQ ID NO: 303091

SEQ ID NO: 658402 - RNA, 64 nt, Homo Sapiens; identical to SEQ ID NO: 303092

SEQ ID NO: 658403 - RNA, 64 nt, Homo Sapiens; identical to SEQ ID NO: 303093

SEQ ID NO: 658404 - RNA, 64 nt, Homo Sapiens; identical to SEQ ID NO: 303094

SEQ ID NO: 658405 - RNA, 64 nt, Homo Sapiens; identical to SEQ ID NO: 303095

SEQ ID NO: 658406 - RNA, 64 nt, Homo Sapiens; identical to SEQ ID NO: 303096

SEQ ID NO: 658407 - RNA, 64 nt, Homo Sapiens; identical to SEQ ID NO: 303097

SEQ ID NO: 658408 - RNA, 64 nt, Homo Sapiens; identical to SEQ ID NO: 303098

SEQ ID NO: 658409 - RNA, 64 nt, Homo Sapiens; identical to SEQ ID NO: 303099

SEQ ID NO: 658410 - RNA, 64 nt, Homo Sapiens; identical to SEQ ID NO: 303100

SEQ ID NO: 658411 - RNA, 64 nt, Homo Sapiens; identical to SEQ ID NO: 303101

SEQ ID NO: 658412 - RNA, 64 nt, Homo Sapiens; identical to SEQ ID NO: 303102

SEQ ID NO: 658413 - RNA, 64 nt, Homo Sapiens; identical to SEQ ID NO: 303103

SEQ ID NO: 658414 - RNA, 64 nt, Homo Sapiens; identical to SEQ ID NO: 303104

SEQ ID NO: 658415 - RNA, 64 nt, Homo Sapiens; identical to SEQ ID NO: 303105

SEQ ID NO: 658416 - RNA, 64 nt, Homo Sapiens; identical to SEQ ID NO: 303106

SEQ ID NO: 658417 - RNA, 64 nt, Homo Sapiens; identical to SEQ ID NO: 303107

SEQ ID NO: 658418 - RNA, 64 nt, Homo Sapiens; identical to SEQ ID NO: 303108

SEQ ID NO: 658419 - RNA, 64 nt, Homo Sapiens; identical to SEQ ID NO: 303109

SEQ ID NO: 658420 - RNA, 64 nt, Homo Sapiens; identical to SEQ ID NO: 303110

SEQ ID NO: 658421 - RNA, 64 nt, Homo Sapiens; identical to SEQ ID NO: 303111

SEQ ID NO: 658422 - RNA, 64 nt, Homo Sapiens; identical to SEQ ID NO: 303112

SEQ ID NO: 658423 - RNA, 64 nt, Homo Sapiens; identical to SEQ ID NO: 303113

SEQ ID NO: 658424 - RNA, 64 nt, Homo Sapiens; identical to SEQ ID NO: 303114

SEQ ID NO: 658425 - RNA, 64 nt, Homo Sapiens; identical to SEQ ID NO: 303115

SEQ ID NO: 658426 - RNA, 64 nt, Homo Sapiens; identical to SEQ ID NO: 303116

SEQ ID NO: 658427 - RNA, 64 nt, Homo Sapiens; identical to SEQ ID NO: 303117

SEQ ID NO: 658428 - RNA, 64 nt, Homo Sapiens; identical to SEQ ID NO: 303118

SEQ ID NO: 658429 - RNA, 64 nt, Homo Sapiens; identical to SEQ ID NO: 303119

SEQ ID NO: 658430 - RNA, 64 nt, Homo Sapiens; identical to SEQ ID NO: 303120

SEQ ID NO: 658431 - RNA, 64 nt, Homo Sapiens; identical to SEQ ID NO: 303121

SEQ ID NO: 658432 - RNA, 64 nt, Homo Sapiens; identical to SEQ ID NO: 303122

SEQ ID NO: 658433 - RNA, 64 nt, Homo Sapiens; identical to SEQ ID NO: 303123

SEQ ID NO: 658434 - RNA, 64 nt, Homo Sapiens; identical to SEQ ID NO: 303124

SEQ ID NO: 658435 - RNA, 64 nt, Homo Sapiens; identical to SEQ ID NO: 303125

SEQ ID NO: 658436 - RNA, 64 nt, Homo Sapiens; identical to SEQ ID NO: 303126

SEQ ID NO: 658437 - RNA, 64 nt, Homo Sapiens; identical to SEQ ID NO: 303127

SEQ ID NO: 658438 - RNA, 64 nt, Homo Sapiens; identical to SEQ ID NO: 303128

SEQ ID NO: 658439 - RNA, 64 nt, Homo Sapiens; identical to SEQ ID NO: 303129

SEQ ID NO: 658440 - RNA, 62 nt, Homo Sapiens; identical to SEQ ID NO: 303130

SEQ ID NO: 658441 - RNA, 64 nt, Homo Sapiens; identical to SEQ ID NO: 303131

SEQ ID NO: 658442 - RNA, 64 nt, Homo Sapiens; identical to SEQ ID NO: 303132

SEQ ID NO: 658443 - RNA, 64 nt, Homo Sapiens; identical to SEQ ID NO: 303133

SEQ ID NO: 658444 - RNA, 64 nt, Homo Sapiens; identical to SEQ ID NO: 303134

SEQ ID NO: 658445 - RNA, 64 nt, Homo Sapiens; identical to SEQ ID NO: 303135

SEQ ID NO: 658446 - RNA, 64 nt, Homo Sapiens; identical to SEQ ID NO: 303136

SEQ ID NO: 658447 - RNA, 64 nt, Homo Sapiens; identical to SEQ ID NO: 303137

SEQ ID NO: 658448 - RNA, 64 nt, Homo Sapiens; identical to SEQ ID NO: 303138

SEQ ID NO: 658449 - RNA, 64 nt, Homo Sapiens; identical to SEQ ID NO: 303139

SEQ ID NO: 658450 - RNA, 64 nt, Homo Sapiens; identical to SEQ ID NO: 303140

SEQ ID NO: 658451 - RNA, 64 nt, Homo Sapiens; identical to SEQ ID NO: 303141

SEQ ID NO: 658452 - RNA, 64 nt, Homo Sapiens; identical to SEQ ID NO: 303142

SEQ ID NO: 658453 - RNA, 64 nt, Homo Sapiens; identical to SEQ ID NO: 303143

SEQ ID NO: 658454 - RNA, 64 nt, Homo Sapiens; identical to SEQ ID NO: 303144

SEQ ID NO: 658455 - RNA, 64 nt, Homo Sapiens; identical to SEQ ID NO: 303145

SEQ ID NO: 658456 - RNA, 64 nt, Homo Sapiens; identical to SEQ ID NO: 303146

SEQ ID NO: 658457 - RNA, 64 nt, Homo Sapiens; identical to SEQ ID NO: 303147

SEQ ID NO: 658458 - RNA, 64 nt, Homo Sapiens; identical to SEQ ID NO: 303148

SEQ ID NO: 658459 - RNA, 64 nt, Homo Sapiens; identical to SEQ ID NO: 303149

SEQ ID NO: 658460 - RNA, 64 nt, Homo Sapiens; identical to SEQ ID NO: 303150

SEQ ID NO: 658461 - RNA, 64 nt, Homo Sapiens; identical to SEQ ID NO: 303151

SEQ ID NO: 658462 - RNA, 64 nt, Homo Sapiens; identical to SEQ ID NO: 303152

SEQ ID NO: 658463 - RNA, 64 nt, Homo Sapiens; identical to SEQ ID NO: 303153

SEQ ID NO: 658464 - RNA, 64 nt, Homo Sapiens; identical to SEQ ID NO: 303154

SEQ ID NO: 658465 - RNA, 64 nt, Homo Sapiens; identical to SEQ ID NO: 303155

SEQ ID NO: 658466 - RNA, 64 nt, Homo Sapiens; identical to SEQ ID NO: 303156

SEQ ID NO: 658467 - RNA, 64 nt, Homo Sapiens; identical to SEQ ID NO: 303157

SEQ ID NO: 658468 - RNA, 64 nt, Homo Sapiens; identical to SEQ ID NO: 303158

SEQ ID NO: 658469 - RNA, 64 nt, Homo Sapiens; identical to SEQ ID NO: 303159

SEQ ID NO: 658470 - RNA, 63 nt, Homo Sapiens; identical to SEQ ID NO: 303160

SEQ ID NO: 658471 - RNA, 64 nt, Homo Sapiens; identical to SEQ ID NO: 303161

SEQ ID NO: 658472 - RNA, 64 nt, Homo Sapiens; identical to SEQ ID NO: 303162

SEQ ID NO: 658473 - RNA, 64 nt, Homo Sapiens; identical to SEQ ID NO: 303163

SEQ ID NO: 658474 - RNA, 64 nt, Homo Sapiens; identical to SEQ ID NO: 303164

SEQ ID NO: 658475 - RNA, 64 nt, Homo Sapiens; identical to SEQ ID NO: 303165

SEQ ID NO: 658476 - RNA, 64 nt, Homo Sapiens; identical to SEQ ID NO: 303166

SEQ ID NO: 658477 - RNA, 64 nt, Homo Sapiens; identical to SEQ ID NO: 303167

SEQ ID NO: 658478 - RNA, 64 nt, Homo Sapiens; identical to SEQ ID NO: 303168

SEQ ID NO: 658479 - RNA, 64 nt, Homo Sapiens; identical to SEQ ID NO: 303169

SEQ ID NO: 658480 - RNA, 64 nt, Homo Sapiens; identical to SEQ ID NO: 303170

SEQ ID NO: 658481 - RNA, 64 nt, Homo Sapiens; identical to SEQ ID NO: 303171

SEQ ID NO: 658482 - RNA, 64 nt, Homo Sapiens; identical to SEQ ID NO: 303172

SEQ ID NO: 658483 - RNA, 64 nt, Homo Sapiens; identical to SEQ ID NO: 303173

SEQ ID NO: 658484 - RNA, 64 nt, Homo Sapiens; identical to SEQ ID NO: 303174

SEQ ID NO: 658485 - RNA, 64 nt, Homo Sapiens; identical to SEQ ID NO: 303175

SEQ ID NO: 658486 - RNA, 64 nt, Homo Sapiens; identical to SEQ ID NO: 303176

SEQ ID NO: 658487 - RNA, 64 nt, Homo Sapiens; identical to SEQ ID NO: 303177

SEQ ID NO: 658488 - RNA, 64 nt, Homo Sapiens; identical to SEQ ID NO: 303178

SEQ ID NO: 658489 - RNA, 64 nt, Homo Sapiens; identical to SEQ ID NO: 303179

SEQ ID NO: 658490 - RNA, 64 nt, Homo Sapiens; identical to SEQ ID NO: 303180

SEQ ID NO: 658491 - RNA, 64 nt, Homo Sapiens; identical to SEQ ID NO: 303181

SEQ ID NO: 658492 - RNA, 64 nt, Homo Sapiens; identical to SEQ ID NO: 303182

SEQ ID NO: 658493 - RNA, 64 nt, Homo Sapiens; identical to SEQ ID NO: 303183

SEQ ID NO: 658494 - RNA, 64 nt, Homo Sapiens; identical to SEQ ID NO: 303184

SEQ ID NO: 658495 - RNA, 64 nt, Homo Sapiens; identical to SEQ ID NO: 303185

SEQ ID NO: 658496 - RNA, 64 nt, Homo Sapiens; identical to SEQ ID NO: 303186

SEQ ID NO: 658497 - RNA, 64 nt, Homo Sapiens; identical to SEQ ID NO: 303187

SEQ ID NO: 658498 - RNA, 64 nt, Homo Sapiens; identical to SEQ ID NO: 303188

SEQ ID NO: 658499 - RNA, 64 nt, Homo Sapiens; identical to SEQ ID NO: 303189

SEQ ID NO: 658500 - RNA, 64 nt, Homo Sapiens; identical to SEQ ID NO: 303190

SEQ ID NO: 658501 - RNA, 64 nt, Homo Sapiens; identical to SEQ ID NO: 303191

SEQ ID NO: 658502 - RNA, 64 nt, Homo Sapiens; identical to SEQ ID NO: 303192

SEQ ID NO: 658503 - RNA, 64 nt, Homo Sapiens; identical to SEQ ID NO: 303193

SEQ ID NO: 658504 - RNA, 64 nt, Homo Sapiens; identical to SEQ ID NO: 303194

SEQ ID NO: 658505 - RNA, 64 nt, Homo Sapiens; identical to SEQ ID NO: 303195

SEQ ID NO: 658506 - RNA, 64 nt, Homo Sapiens; identical to SEQ ID NO: 303196

SEQ ID NO: 658507 - RNA, 64 nt, Homo Sapiens; identical to SEQ ID NO: 303197

SEQ ID NO: 658508 - RNA, 64 nt, Homo Sapiens; identical to SEQ ID NO: 303198

SEQ ID NO: 658509 - RNA, 64 nt, Homo Sapiens; identical to SEQ ID NO: 303199

SEQ ID NO: 658510 - RNA, 64 nt, Homo Sapiens; identical to SEQ ID NO: 303200

SEQ ID NO: 658511 - RNA, 64 nt, Homo Sapiens; identical to SEQ ID NO: 303201

SEQ ID NO: 658512 - RNA, 64 nt, Homo Sapiens; identical to SEQ ID NO: 303202

SEQ ID NO: 658513 - RNA, 64 nt, Homo Sapiens; identical to SEQ ID NO: 303203

SEQ ID NO: 658514 - RNA, 64 nt, Homo Sapiens; identical to SEQ ID NO: 303204

SEQ ID NO: 658515 - RNA, 64 nt, Homo Sapiens; identical to SEQ ID NO: 303205

SEQ ID NO: 658516 - RNA, 64 nt, Homo Sapiens; identical to SEQ ID NO: 303206

SEQ ID NO: 658517 - RNA, 64 nt, Homo Sapiens; identical to SEQ ID NO: 303207

SEQ ID NO: 658518 - RNA, 64 nt, Homo Sapiens; identical to SEQ ID NO: 303208

SEQ ID NO: 658519 - RNA, 64 nt, Homo Sapiens; identical to SEQ ID NO: 303209

SEQ ID NO: 658520 - RNA, 64 nt, Homo Sapiens; identical to SEQ ID NO: 303210

SEQ ID NO: 658521 - RNA, 64 nt, Homo Sapiens; identical to SEQ ID NO: 303211

SEQ ID NO: 658522 - RNA, 64 nt, Homo Sapiens; identical to SEQ ID NO: 303212

SEQ ID NO: 658523 - RNA, 64 nt, Homo Sapiens; identical to SEQ ID NO: 303213

SEQ ID NO: 658524 - RNA, 64 nt, Homo Sapiens; identical to SEQ ID NO: 303214

SEQ ID NO: 658525 - RNA, 64 nt, Homo Sapiens; identical to SEQ ID NO: 303215

SEQ ID NO: 658526 - RNA, 64 nt, Homo Sapiens; identical to SEQ ID NO: 303216

SEQ ID NO: 658527 - RNA, 64 nt, Homo Sapiens; identical to SEQ ID NO: 303217

SEQ ID NO: 658528 - RNA, 64 nt, Homo Sapiens; identical to SEQ ID NO: 303218

SEQ ID NO: 658529 - RNA, 64 nt, Homo Sapiens; identical to SEQ ID NO: 303219

SEQ ID NO: 658530 - RNA, 64 nt, Homo Sapiens; identical to SEQ ID NO: 303220

SEQ ID NO: 658531 - RNA, 64 nt, Homo Sapiens; identical to SEQ ID NO: 303221

SEQ ID NO: 658532 - RNA, 64 nt, Homo Sapiens; identical to SEQ ID NO: 303222

SEQ ID NO: 658533 - RNA, 64 nt, Homo Sapiens; identical to SEQ ID NO: 303223

SEQ ID NO: 658534 - RNA, 64 nt, Homo Sapiens; identical to SEQ ID NO: 303224

SEQ ID NO: 658535 - RNA, 64 nt, Homo Sapiens; identical to SEQ ID NO: 303225

SEQ ID NO: 658536 - RNA, 64 nt, Homo Sapiens; identical to SEQ ID NO: 303226

SEQ ID NO: 658537 - RNA, 64 nt, Homo Sapiens; identical to SEQ ID NO: 303227

SEQ ID NO: 658538 - RNA, 64 nt, Homo Sapiens; identical to SEQ ID NO: 303228

SEQ ID NO: 658539 - RNA, 64 nt, Homo Sapiens; identical to SEQ ID NO: 303229

SEQ ID NO: 658540 - RNA, 64 nt, Homo Sapiens; identical to SEQ ID NO: 303230

SEQ ID NO: 658541 - RNA, 64 nt, Homo Sapiens; identical to SEQ ID NO: 303231

SEQ ID NO: 658542 - RNA, 64 nt, Homo Sapiens; identical to SEQ ID NO: 303232

SEQ ID NO: 658543 - RNA, 64 nt, Homo Sapiens; identical to SEQ ID NO: 303233

SEQ ID NO: 658544 - RNA, 64 nt, Homo Sapiens; identical to SEQ ID NO: 303234

SEQ ID NO: 658545 - RNA, 64 nt, Homo Sapiens; identical to SEQ ID NO: 303235

SEQ ID NO: 658546 - RNA, 64 nt, Homo Sapiens; identical to SEQ ID NO: 303236

SEQ ID NO: 658547 - RNA, 64 nt, Homo Sapiens; identical to SEQ ID NO: 303237

SEQ ID NO: 658548 - RNA, 64 nt, Homo Sapiens; identical to SEQ ID NO: 303238

SEQ ID NO: 658549 - RNA, 64 nt, Homo Sapiens; identical to SEQ ID NO: 303239

SEQ ID NO: 658550 - RNA, 64 nt, Homo Sapiens; identical to SEQ ID NO: 303240

SEQ ID NO: 658551 - RNA, 64 nt, Homo Sapiens; identical to SEQ ID NO: 303241

SEQ ID NO: 658552 - RNA, 64 nt, Homo Sapiens; identical to SEQ ID NO: 303242

SEQ ID NO: 658553 - RNA, 64 nt, Homo Sapiens; identical to SEQ ID NO: 303243

SEQ ID NO: 658554 - RNA, 64 nt, Homo Sapiens; identical to SEQ ID NO: 303244

SEQ ID NO: 658555 - RNA, 64 nt, Homo Sapiens; identical to SEQ ID NO: 303245

SEQ ID NO: 658556 - RNA, 64 nt, Homo Sapiens; identical to SEQ ID NO: 303246

SEQ ID NO: 658557 - RNA, 64 nt, Homo Sapiens; identical to SEQ ID NO: 303247

SEQ ID NO: 658558 - RNA, 64 nt, Homo Sapiens; identical to SEQ ID NO: 303248

SEQ ID NO: 658559 - RNA, 64 nt, Homo Sapiens; identical to SEQ ID NO: 303249

SEQ ID NO: 658560 - RNA, 64 nt, Homo Sapiens; identical to SEQ ID NO: 303250

SEQ ID NO: 658561 - RNA, 64 nt, Homo Sapiens; identical to SEQ ID NO: 303251

SEQ ID NO: 658562 - RNA, 64 nt, Homo Sapiens; identical to SEQ ID NO: 303252

SEQ ID NO: 658563 - RNA, 64 nt, Homo Sapiens; identical to SEQ ID NO: 303253

SEQ ID NO: 658564 - RNA, 64 nt, Homo Sapiens; identical to SEQ ID NO: 303254

SEQ ID NO: 658565 - RNA, 64 nt, Homo Sapiens; identical to SEQ ID NO: 303255

SEQ ID NO: 658566 - RNA, 64 nt, Homo Sapiens; identical to SEQ ID NO: 303256

SEQ ID NO: 658567 - RNA, 64 nt, Homo Sapiens; identical to SEQ ID NO: 303257

SEQ ID NO: 658568 - RNA, 64 nt, Homo Sapiens; identical to SEQ ID NO: 303258

SEQ ID NO: 658569 - RNA, 64 nt, Homo Sapiens; identical to SEQ ID NO: 303259

SEQ ID NO: 658570 - RNA, 64 nt, Homo Sapiens; identical to SEQ ID NO: 303260

SEQ ID NO: 658571 - RNA, 64 nt, Homo Sapiens; identical to SEQ ID NO: 303261

SEQ ID NO: 658572 - RNA, 64 nt, Homo Sapiens; identical to SEQ ID NO: 303262

SEQ ID NO: 658573 - RNA, 64 nt, Homo Sapiens; identical to SEQ ID NO: 303263

SEQ ID NO: 658574 - RNA, 64 nt, Homo Sapiens; identical to SEQ ID NO: 303264

SEQ ID NO: 658575 - RNA, 64 nt, Homo Sapiens; identical to SEQ ID NO: 303265

SEQ ID NO: 658576 - RNA, 64 nt, Homo Sapiens; identical to SEQ ID NO: 303266

SEQ ID NO: 658577 - RNA, 64 nt, Homo Sapiens; identical to SEQ ID NO: 303267

SEQ ID NO: 658578 - RNA, 64 nt, Homo Sapiens; identical to SEQ ID NO: 303268

SEQ ID NO: 658579 - RNA, 64 nt, Homo Sapiens; identical to SEQ ID NO: 303269

SEQ ID NO: 658580 - RNA, 64 nt, Homo Sapiens; identical to SEQ ID NO: 303270

SEQ ID NO: 658581 - RNA, 64 nt, Homo Sapiens; identical to SEQ ID NO: 303271

SEQ ID NO: 658582 - RNA, 64 nt, Homo Sapiens; identical to SEQ ID NO: 303272

SEQ ID NO: 658583 - RNA, 64 nt, Homo Sapiens; identical to SEQ ID NO: 303273

SEQ ID NO: 658584 - RNA, 64 nt, Homo Sapiens; identical to SEQ ID NO: 303274

SEQ ID NO: 658585 - RNA, 64 nt, Homo Sapiens; identical to SEQ ID NO: 303275

SEQ ID NO: 658586 - RNA, 64 nt, Homo Sapiens; identical to SEQ ID NO: 303276

SEQ ID NO: 658587 - RNA, 64 nt, Homo Sapiens; identical to SEQ ID NO: 303277

SEQ ID NO: 658588 - RNA, 64 nt, Homo Sapiens; identical to SEQ ID NO: 303278

SEQ ID NO: 658589 - RNA, 64 nt, Homo Sapiens; identical to SEQ ID NO: 303279

SEQ ID NO: 658590 - RNA, 64 nt, Homo Sapiens; identical to SEQ ID NO: 303280

SEQ ID NO: 658591 - RNA, 64 nt, Homo Sapiens; identical to SEQ ID NO: 303281

SEQ ID NO: 658592 - RNA, 64 nt, Homo Sapiens; identical to SEQ ID NO: 303282

SEQ ID NO: 658593 - RNA, 64 nt, Homo Sapiens; identical to SEQ ID NO: 303283

SEQ ID NO: 658594 - RNA, 64 nt, Homo Sapiens; identical to SEQ ID NO: 303284

SEQ ID NO: 658595 - RNA, 64 nt, Homo Sapiens; identical to SEQ ID NO: 303285

SEQ ID NO: 658596 - RNA, 64 nt, Homo Sapiens; identical to SEQ ID NO: 303286

SEQ ID NO: 658597 - RNA, 64 nt, Homo Sapiens; identical to SEQ ID NO: 144190

SEQ ID NO: 658598 - RNA, 64 nt, Homo Sapiens; identical to SEQ ID NO: 144191

SEQ ID NO: 658599 - RNA, 64 nt, Homo Sapiens; identical to SEQ ID NO: 144192

SEQ ID NO: 658600 - RNA, 64 nt, Homo Sapiens; identical to SEQ ID NO: 144193

SEQ ID NO: 658601 - RNA, 64 nt, Homo Sapiens; identical to SEQ ID NO: 144194

SEQ ID NO: 658602 - RNA, 64 nt, Homo Sapiens; identical to SEQ ID NO: 144195

SEQ ID NO: 658603 - RNA, 64 nt, Homo Sapiens; identical to SEQ ID NO: 144196

SEQ ID NO: 658604 - RNA, 64 nt, Homo Sapiens; identical to SEQ ID NO: 144197

SEQ ID NO: 658605 - RNA, 64 nt, Homo Sapiens; identical to SEQ ID NO: 144198

SEQ ID NO: 658606 - RNA, 64 nt, Homo Sapiens; identical to SEQ ID NO: 144199

SEQ ID NO: 658607 - RNA, 64 nt, Homo Sapiens; identical to SEQ ID NO: 144200

SEQ ID NO: 658608 - RNA, 64 nt, Homo Sapiens; identical to SEQ ID NO: 144201

SEQ ID NO: 658609 - RNA, 64 nt, Homo Sapiens; identical to SEQ ID NO: 144202

SEQ ID NO: 658610 - RNA, 64 nt, Homo Sapiens; identical to SEQ ID NO: 144203

SEQ ID NO: 658611 - RNA, 64 nt, Homo Sapiens; identical to SEQ ID NO: 144204

SEQ ID NO: 658612 - RNA, 64 nt, Homo Sapiens; identical to SEQ ID NO: 144205

SEQ ID NO: 658613 - RNA, 64 nt, Homo Sapiens; identical to SEQ ID NO: 144206

SEQ ID NO: 658614 - RNA, 64 nt, Homo Sapiens; identical to SEQ ID NO: 144207

SEQ ID NO: 658615 - RNA, 64 nt, Homo Sapiens; identical to SEQ ID NO: 144208

SEQ ID NO: 658616 - RNA, 64 nt, Homo Sapiens; identical to SEQ ID NO: 144209

SEQ ID NO: 658617 - RNA, 64 nt, Homo Sapiens; identical to SEQ ID NO: 144210

SEQ ID NO: 658618 - RNA, 64 nt, Homo Sapiens; identical to SEQ ID NO: 144211

SEQ ID NO: 658619 - RNA, 64 nt, Homo Sapiens; identical to SEQ ID NO: 144212

SEQ ID NO: 658620 - RNA, 64 nt, Homo Sapiens; identical to SEQ ID NO: 144213

SEQ ID NO: 658621 - RNA, 64 nt, Homo Sapiens; identical to SEQ ID NO: 144214

SEQ ID NO: 658622 - RNA, 64 nt, Homo Sapiens; identical to SEQ ID NO: 144215

SEQ ID NO: 658623 - RNA, 64 nt, Homo Sapiens; identical to SEQ ID NO: 144216

SEQ ID NO: 658624 - RNA, 64 nt, Homo Sapiens; identical to SEQ ID NO: 144217

SEQ ID NO: 658625 - RNA, 64 nt, Homo Sapiens; identical to SEQ ID NO: 144218

SEQ ID NO: 658626 - RNA, 64 nt, Homo Sapiens; identical to SEQ ID NO: 144219

SEQ ID NO: 658627 - RNA, 64 nt, Homo Sapiens; identical to SEQ ID NO: 144220

SEQ ID NO: 658628 - RNA, 64 nt, Homo Sapiens; identical to SEQ ID NO: 144221

SEQ ID NO: 658629 - RNA, 64 nt, Homo Sapiens; identical to SEQ ID NO: 144222

SEQ ID NO: 658630 - RNA, 64 nt, Homo Sapiens; identical to SEQ ID NO: 144223

SEQ ID NO: 658631 - RNA, 64 nt, Homo Sapiens; identical to SEQ ID NO: 144224

SEQ ID NO: 658632 - RNA, 64 nt, Homo Sapiens; identical to SEQ ID NO: 144225

SEQ ID NO: 658633 - RNA, 64 nt, Homo Sapiens; identical to SEQ ID NO: 144226

SEQ ID NO: 658634 - RNA, 64 nt, Homo Sapiens; identical to SEQ ID NO: 144227

SEQ ID NO: 658635 - RNA, 64 nt, Homo Sapiens; identical to SEQ ID NO: 144228

SEQ ID NO: 658636 - RNA, 64 nt, Homo Sapiens; identical to SEQ ID NO: 144229

SEQ ID NO: 658637 - RNA, 64 nt, Homo Sapiens; identical to SEQ ID NO: 144230

SEQ ID NO: 658638 - RNA, 64 nt, Homo Sapiens; identical to SEQ ID NO: 144231

SEQ ID NO: 658639 - RNA, 64 nt, Homo Sapiens; identical to SEQ ID NO: 144232

SEQ ID NO: 658640 - RNA, 64 nt, Homo Sapiens; identical to SEQ ID NO: 144233

SEQ ID NO: 658641 - RNA, 64 nt, Homo Sapiens; identical to SEQ ID NO: 144234

SEQ ID NO: 658642 - RNA, 64 nt, Homo Sapiens; identical to SEQ ID NO: 144235

SEQ ID NO: 658643 - RNA, 64 nt, Homo Sapiens; identical to SEQ ID NO: 144236

SEQ ID NO: 658644 - RNA, 64 nt, Homo Sapiens; identical to SEQ ID NO: 144237

SEQ ID NO: 658645 - RNA, 64 nt, Homo Sapiens; identical to SEQ ID NO: 144238

SEQ ID NO: 658646 - RNA, 64 nt, Homo Sapiens; identical to SEQ ID NO: 144239

SEQ ID NO: 658647 - RNA, 64 nt, Homo Sapiens; identical to SEQ ID NO: 144240

SEQ ID NO: 658648 - RNA, 64 nt, Homo Sapiens; identical to SEQ ID NO: 144241

SEQ ID NO: 658649 - RNA, 64 nt, Homo Sapiens; identical to SEQ ID NO: 144242

SEQ ID NO: 658650 - RNA, 64 nt, Homo Sapiens; identical to SEQ ID NO: 144243

SEQ ID NO: 658651 - RNA, 64 nt, Homo Sapiens; identical to SEQ ID NO: 144244

SEQ ID NO: 658652 - RNA, 64 nt, Homo Sapiens; identical to SEQ ID NO: 144245

SEQ ID NO: 658653 - RNA, 64 nt, Homo Sapiens; identical to SEQ ID NO: 144246

SEQ ID NO: 658654 - RNA, 64 nt, Homo Sapiens; identical to SEQ ID NO: 144247

SEQ ID NO: 658655 - RNA, 64 nt, Homo Sapiens; identical to SEQ ID NO: 144248

SEQ ID NO: 658656 - RNA, 64 nt, Homo Sapiens; identical to SEQ ID NO: 144249

SEQ ID NO: 658657 - RNA, 64 nt, Homo Sapiens; identical to SEQ ID NO: 144250

SEQ ID NO: 658658 - RNA, 64 nt, Homo Sapiens; identical to SEQ ID NO: 144251

SEQ ID NO: 658659 - RNA, 64 nt, Homo Sapiens; identical to SEQ ID NO: 144252

SEQ ID NO: 658660 - RNA, 64 nt, Homo Sapiens; identical to SEQ ID NO: 144253

SEQ ID NO: 658661 - RNA, 64 nt, Homo Sapiens; identical to SEQ ID NO: 144254

SEQ ID NO: 658662 - RNA, 64 nt, Homo Sapiens; identical to SEQ ID NO: 144255

SEQ ID NO: 658663 - RNA, 64 nt, Homo Sapiens; identical to SEQ ID NO: 519046

SEQ ID NO: 658664 - RNA, 64 nt, Homo Sapiens; identical to SEQ ID NO: 519047

SEQ ID NO: 658665 - RNA, 64 nt, Homo Sapiens; identical to SEQ ID NO: 519048

SEQ ID NO: 658666 - RNA, 64 nt, Homo Sapiens; identical to SEQ ID NO: 519049

SEQ ID NO: 658667 - RNA, 64 nt, Homo Sapiens; identical to SEQ ID NO: 519050

SEQ ID NO: 658668 - RNA, 64 nt, Homo Sapiens; identical to SEQ ID NO: 519051

SEQ ID NO: 658669 - RNA, 64 nt, Homo Sapiens; identical to SEQ ID NO: 519052

SEQ ID NO: 658670 - RNA, 64 nt, Homo Sapiens; identical to SEQ ID NO: 519053

SEQ ID NO: 658671 - RNA, 64 nt, Homo Sapiens; identical to SEQ ID NO: 519054

SEQ ID NO: 658672 - RNA, 64 nt, Homo Sapiens; identical to SEQ ID NO: 519055

SEQ ID NO: 658673 - RNA, 64 nt, Homo Sapiens; identical to SEQ ID NO: 519056

SEQ ID NO: 658674 - RNA, 64 nt, Homo Sapiens; identical to SEQ ID NO: 519057

SEQ ID NO: 658675 - RNA, 64 nt, Homo Sapiens; identical to SEQ ID NO: 519058

SEQ ID NO: 658676 - RNA, 64 nt, Homo Sapiens; identical to SEQ ID NO: 519059

SEQ ID NO: 658677 - RNA, 64 nt, Homo Sapiens; identical to SEQ ID NO: 519060

SEQ ID NO: 658678 - RNA, 64 nt, Homo Sapiens; identical to SEQ ID NO: 519061

SEQ ID NO: 658679 - RNA, 64 nt, Homo Sapiens; identical to SEQ ID NO: 519062

SEQ ID NO: 658680 - RNA, 64 nt, Homo Sapiens; identical to SEQ ID NO: 519063

SEQ ID NO: 658681 - RNA, 64 nt, Homo Sapiens; identical to SEQ ID NO: 519064

SEQ ID NO: 658682 - RNA, 64 nt, Homo Sapiens; identical to SEQ ID NO: 519065

SEQ ID NO: 658683 - RNA, 64 nt, Homo Sapiens; identical to SEQ ID NO: 519066

SEQ ID NO: 658684 - RNA, 64 nt, Homo Sapiens; identical to SEQ ID NO: 519067

SEQ ID NO: 658685 - RNA, 64 nt, Homo Sapiens; identical to SEQ ID NO: 519068

SEQ ID NO: 658686 - RNA, 64 nt, Homo Sapiens; identical to SEQ ID NO: 519069

SEQ ID NO: 658687 - RNA, 64 nt, Homo Sapiens; identical to SEQ ID NO: 519070

SEQ ID NO: 658688 - RNA, 64 nt, Homo Sapiens; identical to SEQ ID NO: 519071

SEQ ID NO: 658689 - RNA, 64 nt, Homo Sapiens; identical to SEQ ID NO: 519072

SEQ ID NO: 658690 - RNA, 64 nt, Homo Sapiens; identical to SEQ ID NO: 519073

SEQ ID NO: 658691 - RNA, 64 nt, Homo Sapiens; identical to SEQ ID NO: 519074

SEQ ID NO: 658692 - RNA, 64 nt, Homo Sapiens; identical to SEQ ID NO: 519075

SEQ ID NO: 658693 - RNA, 64 nt, Homo Sapiens; identical to SEQ ID NO: 519076

SEQ ID NO: 658694 - RNA, 64 nt, Homo Sapiens; identical to SEQ ID NO: 519077

SEQ ID NO: 658695 - RNA, 64 nt, Homo Sapiens; identical to SEQ ID NO: 519078

SEQ ID NO: 658696 - RNA, 64 nt, Homo Sapiens; identical to SEQ ID NO: 519079

SEQ ID NO: 658697 - RNA, 64 nt, Homo Sapiens; identical to SEQ ID NO: 519080

SEQ ID NO: 658698 - RNA, 64 nt, Homo Sapiens; identical to SEQ ID NO: 519081

SEQ ID NO: 658699 - RNA, 64 nt, Homo Sapiens; identical to SEQ ID NO: 519082

SEQ ID NO: 658700 - RNA, 64 nt, Homo Sapiens; identical to SEQ ID NO: 519083

SEQ ID NO: 658701 - RNA, 64 nt, Homo Sapiens; identical to SEQ ID NO: 519084

SEQ ID NO: 658702 - RNA, 64 nt, Homo Sapiens; identical to SEQ ID NO: 519085

SEQ ID NO: 658703 - RNA, 64 nt, Homo Sapiens; identical to SEQ ID NO: 519086

SEQ ID NO: 658704 - RNA, 64 nt, Homo Sapiens; identical to SEQ ID NO: 519087

SEQ ID NO: 658705 - RNA, 64 nt, Homo Sapiens; identical to SEQ ID NO: 519088

SEQ ID NO: 658706 - RNA, 64 nt, Homo Sapiens; identical to SEQ ID NO: 519089

SEQ ID NO: 658707 - RNA, 64 nt, Homo Sapiens; identical to SEQ ID NO: 519090

SEQ ID NO: 658708 - RNA, 64 nt, Homo Sapiens; identical to SEQ ID NO: 519091

SEQ ID NO: 658709 - RNA, 64 nt, Homo Sapiens; identical to SEQ ID NO: 519092

SEQ ID NO: 658710 - RNA, 64 nt, Homo Sapiens; identical to SEQ ID NO: 519093

SEQ ID NO: 658711 - RNA, 64 nt, Homo Sapiens; identical to SEQ ID NO: 519094

SEQ ID NO: 658712 - RNA, 64 nt, Homo Sapiens; identical to SEQ ID NO: 519095

SEQ ID NO: 658713 - RNA, 64 nt, Homo Sapiens; identical to SEQ ID NO: 519096

SEQ ID NO: 658714 - RNA, 64 nt, Homo Sapiens; identical to SEQ ID NO: 519097

SEQ ID NO: 658715 - RNA, 64 nt, Homo Sapiens; identical to SEQ ID NO: 519098

SEQ ID NO: 658716 - RNA, 64 nt, Homo Sapiens; identical to SEQ ID NO: 519099

SEQ ID NO: 658717 - RNA, 64 nt, Homo Sapiens; identical to SEQ ID NO: 519100

SEQ ID NO: 658718 - RNA, 64 nt, Homo Sapiens; identical to SEQ ID NO: 519101

SEQ ID NO: 658719 - RNA, 64 nt, Homo Sapiens; identical to SEQ ID NO: 519102

SEQ ID NO: 658720 - RNA, 64 nt, Homo Sapiens; identical to SEQ ID NO: 519103

SEQ ID NO: 658721 - RNA, 64 nt, Homo Sapiens; identical to SEQ ID NO: 519104

SEQ ID NO: 658722 - RNA, 64 nt, Homo Sapiens; identical to SEQ ID NO: 519105

SEQ ID NO: 658723 - RNA, 64 nt, Homo Sapiens; identical to SEQ ID NO: 519106

SEQ ID NO: 658724 - RNA, 64 nt, Homo Sapiens; identical to SEQ ID NO: 519107

SEQ ID NO: 658725 - RNA, 64 nt, Homo Sapiens; identical to SEQ ID NO: 519108

SEQ ID NO: 658726 - RNA, 64 nt, Homo Sapiens; identical to SEQ ID NO: 519109

SEQ ID NO: 658727 - RNA, 64 nt, Homo Sapiens; identical to SEQ ID NO: 519110

SEQ ID NO: 658728 - RNA, 64 nt, Homo Sapiens; identical to SEQ ID NO: 519111

SEQ ID NO: 658729 - RNA, 64 nt, Homo Sapiens; identical to SEQ ID NO: 519112

SEQ ID NO: 658730 - RNA, 64 nt, Homo Sapiens; identical to SEQ ID NO: 519113

SEQ ID NO: 658731 - RNA, 64 nt, Homo Sapiens; identical to SEQ ID NO: 519114

SEQ ID NO: 658732 - RNA, 64 nt, Homo Sapiens; identical to SEQ ID NO: 519115

SEQ ID NO: 658733 - RNA, 64 nt, Homo Sapiens; identical to SEQ ID NO: 519116

SEQ ID NO: 658734 - RNA, 64 nt, Homo Sapiens; identical to SEQ ID NO: 519117

SEQ ID NO: 658735 - RNA, 64 nt, Homo Sapiens; identical to SEQ ID NO: 519118

SEQ ID NO: 658736 - RNA, 64 nt, Homo Sapiens; identical to SEQ ID NO: 519119

SEQ ID NO: 658737 - RNA, 64 nt, Homo Sapiens; identical to SEQ ID NO: 519120

SEQ ID NO: 658738 - RNA, 64 nt, Homo Sapiens; identical to SEQ ID NO: 519121

SEQ ID NO: 658739 - RNA, 64 nt, Homo Sapiens; identical to SEQ ID NO: 519122

SEQ ID NO: 658740 - RNA, 64 nt, Homo Sapiens; identical to SEQ ID NO: 519123

SEQ ID NO: 658741 - RNA, 64 nt, Homo Sapiens; identical to SEQ ID NO: 519124

SEQ ID NO: 658742 - RNA, 64 nt, Homo Sapiens; identical to SEQ ID NO: 519125

SEQ ID NO: 658743 - RNA, 64 nt, Homo Sapiens; identical to SEQ ID NO: 519126

SEQ ID NO: 658744 - RNA, 64 nt, Homo Sapiens; identical to SEQ ID NO: 655264

SEQ ID NO: 658745 - RNA, 64 nt, Homo Sapiens; identical to SEQ ID NO: 655265

SEQ ID NO: 658746 - RNA, 64 nt, Homo Sapiens; identical to SEQ ID NO: 655266

SEQ ID NO: 658747 - RNA, 64 nt, Homo Sapiens; identical to SEQ ID NO: 655267

SEQ ID NO: 658748 - RNA, 64 nt, Homo Sapiens; identical to SEQ ID NO: 655268

SEQ ID NO: 658749 - RNA, 64 nt, Homo Sapiens; identical to SEQ ID NO: 655269

SEQ ID NO: 658750 - RNA, 64 nt, Homo Sapiens; identical to SEQ ID NO: 655270

SEQ ID NO: 658751 - RNA, 64 nt, Homo Sapiens; identical to SEQ ID NO: 655271

SEQ ID NO: 658752 - RNA, 64 nt, Homo Sapiens; identical to SEQ ID NO: 655272

SEQ ID NO: 658753 - RNA, 64 nt, Homo Sapiens; identical to SEQ ID NO: 655273

SEQ ID NO: 658754 - RNA, 64 nt, Homo Sapiens; identical to SEQ ID NO: 655274

SEQ ID NO: 658755 - RNA, 64 nt, Homo Sapiens; identical to SEQ ID NO: 655275

SEQ ID NO: 658756 - RNA, 64 nt, Homo Sapiens; identical to SEQ ID NO: 655276

SEQ ID NO: 658757 - RNA, 64 nt, Homo Sapiens; identical to SEQ ID NO: 655277

SEQ ID NO: 658758 - RNA, 64 nt, Homo Sapiens; identical to SEQ ID NO: 655278

SEQ ID NO: 658759 - RNA, 64 nt, Homo Sapiens; identical to SEQ ID NO: 655279

SEQ ID NO: 658760 - RNA, 64 nt, Homo Sapiens; identical to SEQ ID NO: 655280

SEQ ID NO: 658761 - RNA, 64 nt, Homo Sapiens; identical to SEQ ID NO: 655281

SEQ ID NO: 658762 - RNA, 64 nt, Homo Sapiens; identical to SEQ ID NO: 655282

SEQ ID NO: 658763 - RNA, 64 nt, Homo Sapiens; identical to SEQ ID NO: 655283

SEQ ID NO: 658764 - RNA, 64 nt, Homo Sapiens; identical to SEQ ID NO: 655284

SEQ ID NO: 658765 - RNA, 64 nt, Homo Sapiens; identical to SEQ ID NO: 655285

SEQ ID NO: 658766 - RNA, 64 nt, Homo Sapiens; identical to SEQ ID NO: 655286

SEQ ID NO: 658767 - RNA, 64 nt, Homo Sapiens; identical to SEQ ID NO: 655287

SEQ ID NO: 658768 - RNA, 64 nt, Homo Sapiens; identical to SEQ ID NO: 655288

SEQ ID NO: 658769 - RNA, 64 nt, Homo Sapiens; identical to SEQ ID NO: 655289

SEQ ID NO: 658770 - RNA, 64 nt, Homo Sapiens; identical to SEQ ID NO: 655290

SEQ ID NO: 658771 - RNA, 64 nt, Homo Sapiens; identical to SEQ ID NO: 342652

SEQ ID NO: 658772 - RNA, 64 nt, Homo Sapiens; identical to SEQ ID NO: 342653

SEQ ID NO: 658773 - RNA, 64 nt, Homo Sapiens; identical to SEQ ID NO: 342654

SEQ ID NO: 658774 - RNA, 64 nt, Homo Sapiens; identical to SEQ ID NO: 342655

SEQ ID NO: 658775 - RNA, 64 nt, Homo Sapiens; identical to SEQ ID NO: 342656

SEQ ID NO: 658776 - RNA, 64 nt, Homo Sapiens; identical to SEQ ID NO: 342657

SEQ ID NO: 658777 - RNA, 64 nt, Homo Sapiens; identical to SEQ ID NO: 342658

SEQ ID NO: 658778 - RNA, 64 nt, Homo Sapiens; identical to SEQ ID NO: 342659

SEQ ID NO: 658779 - RNA, 64 nt, Homo Sapiens; identical to SEQ ID NO: 342660

SEQ ID NO: 658780 - RNA, 64 nt, Homo Sapiens; identical to SEQ ID NO: 342661

SEQ ID NO: 658781 - RNA, 64 nt, Homo Sapiens; identical to SEQ ID NO: 342662

SEQ ID NO: 658782 - RNA, 64 nt, Homo Sapiens; identical to SEQ ID NO: 342663

SEQ ID NO: 658783 - RNA, 64 nt, Homo Sapiens; identical to SEQ ID NO: 342664

SEQ ID NO: 658784 - RNA, 64 nt, Homo Sapiens; identical to SEQ ID NO: 342665

SEQ ID NO: 658785 - RNA, 64 nt, Homo Sapiens; identical to SEQ ID NO: 342666

SEQ ID NO: 658786 - RNA, 64 nt, Homo Sapiens; identical to SEQ ID NO: 342667

SEQ ID NO: 658787 - RNA, 64 nt, Homo Sapiens; identical to SEQ ID NO: 342668

SEQ ID NO: 658788 - RNA, 64 nt, Homo Sapiens; identical to SEQ ID NO: 342669

SEQ ID NO: 658789 - RNA, 64 nt, Homo Sapiens; identical to SEQ ID NO: 342670

SEQ ID NO: 658790 - RNA, 64 nt, Homo Sapiens; identical to SEQ ID NO: 342671

SEQ ID NO: 658791 - RNA, 64 nt, Homo Sapiens; identical to SEQ ID NO: 622464

SEQ ID NO: 658792 - RNA, 64 nt, Homo Sapiens; identical to SEQ ID NO: 622465

SEQ ID NO: 658793 - RNA, 64 nt, Homo Sapiens; identical to SEQ ID NO: 622466

SEQ ID NO: 658794 - RNA, 64 nt, Homo Sapiens; identical to SEQ ID NO: 622467

SEQ ID NO: 658795 - RNA, 64 nt, Homo Sapiens; identical to SEQ ID NO: 622468

SEQ ID NO: 658796 - RNA, 64 nt, Homo Sapiens; identical to SEQ ID NO: 622469

SEQ ID NO: 658797 - RNA, 64 nt, Homo Sapiens; identical to SEQ ID NO: 622470

SEQ ID NO: 658798 - RNA, 64 nt, Homo Sapiens; identical to SEQ ID NO: 622471

SEQ ID NO: 658799 - RNA, 64 nt, Homo Sapiens; identical to SEQ ID NO: 622472

SEQ ID NO: 658800 - RNA, 64 nt, Homo Sapiens; identical to SEQ ID NO: 622473

SEQ ID NO: 658801 - RNA, 64 nt, Homo Sapiens; identical to SEQ ID NO: 622474

SEQ ID NO: 658802 - RNA, 64 nt, Homo Sapiens; identical to SEQ ID NO: 622475

SEQ ID NO: 658803 - RNA, 64 nt, Homo Sapiens; identical to SEQ ID NO: 622476

SEQ ID NO: 658804 - RNA, 64 nt, Homo Sapiens; identical to SEQ ID NO: 622477

SEQ ID NO: 658805 - RNA, 64 nt, Homo Sapiens; identical to SEQ ID NO: 538220

SEQ ID NO: 658806 - RNA, 64 nt, Homo Sapiens; identical to SEQ ID NO: 538221

SEQ ID NO: 658807 - RNA, 64 nt, Homo Sapiens; identical to SEQ ID NO: 538222

SEQ ID NO: 658808 - RNA, 64 nt, Homo Sapiens; identical to SEQ ID NO: 538223

SEQ ID NO: 658809 - RNA, 64 nt, Homo Sapiens; identical to SEQ ID NO: 538224

SEQ ID NO: 658810 - RNA, 64 nt, Homo Sapiens; identical to SEQ ID NO: 538225

SEQ ID NO: 658811 - RNA, 64 nt, Homo Sapiens; identical to SEQ ID NO: 538226

SEQ ID NO: 658812 - RNA, 64 nt, Homo Sapiens; identical to SEQ ID NO: 538227

SEQ ID NO: 658813 - RNA, 64 nt, Homo Sapiens; identical to SEQ ID NO: 538228

SEQ ID NO: 658814 - RNA, 64 nt, Homo Sapiens; identical to SEQ ID NO: 538229

SEQ ID NO: 658815 - RNA, 64 nt, Homo Sapiens; identical to SEQ ID NO: 538230

SEQ ID NO: 658816 - RNA, 64 nt, Homo Sapiens; identical to SEQ ID NO: 538231

SEQ ID NO: 658817 - RNA, 64 nt, Homo Sapiens; identical to SEQ ID NO: 538232

SEQ ID NO: 658818 - RNA, 64 nt, Homo Sapiens; identical to SEQ ID NO: 538233

SEQ ID NO: 658819 - RNA, 64 nt, Homo Sapiens; identical to SEQ ID NO: 538234

SEQ ID NO: 658820 - RNA, 57 nt, Homo Sapiens; identical to SEQ ID NO: 538235

SEQ ID NO: 658821 - RNA, 64 nt, Homo Sapiens; identical to SEQ ID NO: 538236

SEQ ID NO: 658822 - RNA, 64 nt, Homo Sapiens; identical to SEQ ID NO: 538237

SEQ ID NO: 658823 - RNA, 64 nt, Homo Sapiens; identical to SEQ ID NO: 538238

SEQ ID NO: 658824 - RNA, 64 nt, Homo Sapiens; identical to SEQ ID NO: 538239

SEQ ID NO: 658825 - RNA, 64 nt, Homo Sapiens; identical to SEQ ID NO: 538240

SEQ ID NO: 658826 - RNA, 64 nt, Homo Sapiens; identical to SEQ ID NO: 538241

SEQ ID NO: 658827 - RNA, 64 nt, Homo Sapiens; identical to SEQ ID NO: 538242

SEQ ID NO: 658828 - RNA, 64 nt, Homo Sapiens; identical to SEQ ID NO: 538243

SEQ ID NO: 658829 - RNA, 64 nt, Homo Sapiens; identical to SEQ ID NO: 538243

SEQ ID NO: 658830 - RNA, 64 nt, Homo Sapiens; identical to SEQ ID NO: 538245

SEQ ID NO: 658831 - RNA, 64 nt, Homo Sapiens; identical to SEQ ID NO: 538246

SEQ ID NO: 658832 - RNA, 64 nt, Homo Sapiens; identical to SEQ ID NO: 538247

SEQ ID NO: 658833 - RNA, 64 nt, Homo Sapiens; identical to SEQ ID NO: 538248

SEQ ID NO: 658834 - RNA, 64 nt, Homo Sapiens; identical to SEQ ID NO: 538249

SEQ ID NO: 658835 - RNA, 64 nt, Homo Sapiens; identical to SEQ ID NO: 538250

SEQ ID NO: 658836 - RNA, 64 nt, Homo Sapiens; identical to SEQ ID NO: 538251

SEQ ID NO: 658837 - RNA, 64 nt, Homo Sapiens; identical to SEQ ID NO: 538252

SEQ ID NO: 658838 - RNA, 64 nt, Homo Sapiens; identical to SEQ ID NO: 538253

SEQ ID NO: 658839 - RNA, 64 nt, Homo Sapiens; identical to SEQ ID NO: 538254

SEQ ID NO: 658840 - RNA, 64 nt, Homo Sapiens; identical to SEQ ID NO: 538255

SEQ ID NO: 658841 - RNA, 64 nt, Homo Sapiens; identical to SEQ ID NO: 538256

SEQ ID NO: 658842 - RNA, 64 nt, Homo Sapiens; identical to SEQ ID NO: 538257

SEQ ID NO: 658843 - RNA, 64 nt, Homo Sapiens; identical to SEQ ID NO: 538258

SEQ ID NO: 658844 - RNA, 64 nt, Homo Sapiens; identical to SEQ ID NO: 538259

SEQ ID NO: 658845 - RNA, 64 nt, Homo Sapiens; identical to SEQ ID NO: 538260

SEQ ID NO: 658846 - RNA, 64 nt, Homo Sapiens; identical to SEQ ID NO: 291360

SEQ ID NO: 658847 - RNA, 64 nt, Homo Sapiens; identical to SEQ ID NO: 291361

SEQ ID NO: 658848 - RNA, 64 nt, Homo Sapiens; identical to SEQ ID NO: 291362

SEQ ID NO: 658849 - RNA, 64 nt, Homo Sapiens; identical to SEQ ID NO: 291363

SEQ ID NO: 658850 - RNA, 64 nt, Homo Sapiens; identical to SEQ ID NO: 291364

SEQ ID NO: 658851 - RNA, 64 nt, Homo Sapiens; identical to SEQ ID NO: 291365

SEQ ID NO: 658852 - RNA, 64 nt, Homo Sapiens; identical to SEQ ID NO: 291366

SEQ ID NO: 658853 - RNA, 64 nt, Homo Sapiens; identical to SEQ ID NO: 291367

SEQ ID NO: 658854 - RNA, 64 nt, Homo Sapiens; identical to SEQ ID NO: 291368

SEQ ID NO: 658855 - RNA, 64 nt, Homo Sapiens; identical to SEQ ID NO: 291369

SEQ ID NO: 658856 - RNA, 64 nt, Homo Sapiens; identical to SEQ ID NO: 291370

SEQ ID NO: 658857 - RNA, 64 nt, Homo Sapiens; identical to SEQ ID NO: 291371

SEQ ID NO: 658858 - RNA, 64 nt, Homo Sapiens; identical to SEQ ID NO: 291372

SEQ ID NO: 658859 - RNA, 64 nt, Homo Sapiens; identical to SEQ ID NO: 291373

SEQ ID NO: 658860 - RNA, 64 nt, Homo Sapiens; identical to SEQ ID NO: 291374

SEQ ID NO: 658861 - RNA, 64 nt, Homo Sapiens; identical to SEQ ID NO: 291375

SEQ ID NO: 658862 - RNA, 64 nt, Homo Sapiens; identical to SEQ ID NO: 291376

SEQ ID NO: 658863 - RNA, 64 nt, Homo Sapiens; identical to SEQ ID NO: 291377

SEQ ID NO: 658864 - RNA, 64 nt, Homo Sapiens; identical to SEQ ID NO: 291378

SEQ ID NO: 658865 - RNA, 64 nt, Homo Sapiens; identical to SEQ ID NO: 81945

SEQ ID NO: 658866 - RNA, 64 nt, Homo Sapiens; identical to SEQ ID NO: 81946

SEQ ID NO: 658867 - RNA, 64 nt, Homo Sapiens; identical to SEQ ID NO: 81947

SEQ ID NO: 658868 - RNA, 64 nt, Homo Sapiens; identical to SEQ ID NO: 81948

SEQ ID NO: 658869 - RNA, 64 nt, Homo Sapiens; identical to SEQ ID NO: 81949

SEQ ID NO: 658870 - RNA, 64 nt, Homo Sapiens; identical to SEQ ID NO: 81950

SEQ ID NO: 658871 - RNA, 64 nt, Homo Sapiens; identical to SEQ ID NO: 81951

SEQ ID NO: 658872 - RNA, 64 nt, Homo Sapiens; identical to SEQ ID NO: 81952

SEQ ID NO: 658873 - RNA, 64 nt, Homo Sapiens; identical to SEQ ID NO: 81953

SEQ ID NO: 658874 - RNA, 64 nt, Homo Sapiens; identical to SEQ ID NO: 81954

SEQ ID NO: 658875 - RNA, 64 nt, Homo Sapiens; identical to SEQ ID NO: 81955

SEQ ID NO: 658876 - RNA, 64 nt, Homo Sapiens; identical to SEQ ID NO: 81956

SEQ ID NO: 658877 - RNA, 64 nt, Homo Sapiens; identical to SEQ ID NO: 81957

SEQ ID NO: 658878 - RNA, 64 nt, Homo Sapiens; identical to SEQ ID NO: 81958

SEQ ID NO: 658879 - RNA, 64 nt, Homo Sapiens; identical to SEQ ID NO: 81959

SEQ ID NO: 658880 - RNA, 64 nt, Homo Sapiens; identical to SEQ ID NO: 81960

SEQ ID NO: 658881 - RNA, 64 nt, Homo Sapiens; identical to SEQ ID NO: 81961

SEQ ID NO: 658882 - RNA, 64 nt, Homo Sapiens; identical to SEQ ID NO: 81962

SEQ ID NO: 658883 - RNA, 64 nt, Homo Sapiens; identical to SEQ ID NO: 511663

SEQ ID NO: 658884 - RNA, 64 nt, Homo Sapiens; identical to SEQ ID NO: 511664

SEQ ID NO: 658885 - RNA, 64 nt, Homo Sapiens; identical to SEQ ID NO: 511665

SEQ ID NO: 658886 - RNA, 64 nt, Homo Sapiens; identical to SEQ ID NO: 511666

SEQ ID NO: 658887 - RNA, 64 nt, Homo Sapiens; identical to SEQ ID NO: 511667

SEQ ID NO: 658888 - RNA, 64 nt, Homo Sapiens; identical to SEQ ID NO: 511668

SEQ ID NO: 658889 - RNA, 64 nt, Homo Sapiens; identical to SEQ ID NO: 511669

SEQ ID NO: 658890 - RNA, 64 nt, Homo Sapiens; identical to SEQ ID NO: 511670

SEQ ID NO: 658891 - RNA, 64 nt, Homo Sapiens; identical to SEQ ID NO: 511671

SEQ ID NO: 658892 - RNA, 64 nt, Homo Sapiens; identical to SEQ ID NO: 511672

SEQ ID NO: 658893 - RNA, 61 nt, Homo Sapiens
ucacacuaggcaaugccauuucaaugcauuacuaaaugacauuuguaguuccuagcuccuc

SEQ ID NO: 658894 - RNA, 61 nt, Homo Sapiens
gguuguuuuuggucucuguugucacuaaagacuaaaugaggguuugcaguugggaaagagg

SEQ ID NO: 658895 - RNA, 61 nt, Homo Sapiens
uacuuucauuuauguuugcuagaaacauuuucuaaaugauagugauuagcugguuagccau

SEQ ID NO: 658896 - RNA, 61 nt, Homo Sapiens
uuagaauccuuugaaucuaaguauuuguuuccuaaaugaaacauuuguacaacauuugaug

SEQ ID NO: 658897 - RNA, 61 nt, Homo Sapiens
aaucaaacauucauauccacaaaauuuucugcuaaaugacuccacacucagccuucucuac

SEQ ID NO: 658898 - RNA, 61 nt, Homo Sapiens
acugaagcuccagaguuaagguuucagauuucuaaaugaaacuaucuuuuucaauuacauc

SEQ ID NO: 658899 - RNA, 61 nt, Homo Sapiens
uuggguuuugaacucuccauauuuucacauucuaaaugacuuaagugagaauuucuaaaug

SEQ ID NO: 658900 - RNA, 61 nt, Homo Sapiens
uucacauucuaaaugacuuuagugagaauuucuaaaugauucuaauucugugggugccuua

SEQ ID NO: 658901 - RNA, 61 nt, Homo Sapiens
uaucacuguguauacagacagauguagaaaucuaaaugaauucauauguuaaaaauaaaga

SEQ ID NO: 658902 - RNA, 61 nt, Homo Sapiens
ugugcauuuccucauuuaaaaaaaguuuaaucuaaaugauaggucaucuggugaugaagag

SEQ ID NO: 658903 - RNA, 61 nt, Homo Sapiens
ccucuugggaaauuagcagauagucuuugcucuaaaugauaucugaguaaauagacuugag

SEQ ID NO: 658904 - RNA, 61 nt, Homo Sapiens
cauuuuaaguauuuuuaaauagaugaaaauucuaaaugauuuucccucaaaucuaucuaga

SEQ ID NO: 658905 - RNA, 61 nt, Homo Sapiens
auuuucugaauucccauuuucuuguucgcggcuaaaugacaguuucugucauuacuuagau

SEQ ID NO: 658906 - RNA, 61 nt, Homo Sapiens
gguucuggcacuucaaugccaggcaggucuccuaaaugaacagaaugaucugugugagccg

SEQ ID NO: 658907 - RNA, 61 nt, Homo Sapiens
cugauuuuguuuuaucaaucuuaaagaauaacuaaaugacuguauuuuaaaguaauaauga

SEQ ID NO: 658908 - RNA, 61 nt, Homo Sapiens
uuucguugaugaaauguugcccuuuugaaaccuaaaugagugcauucuguacuacauccug

SEQ ID NO: 658909 - RNA, 61 nt, Homo Sapiens
ugagagaagcuauaauuuaaucugugaggaacuaaaugacaggagauuggugcuaauacgg

SEQ ID NO: 658910 - RNA, 61 nt, Homo Sapiens
uaguacaugauuuuaaagguuagaaccccuucuaaaugaauggucuguggaagauuuuagu

SEQ ID NO: 658911 - RNA, 61 nt, Homo Sapiens
gcgaagcuggaauacugcuacagaagaggaacuaaaugacuaacacuuccaaaaagauaca

SEQ ID NO: 658912 - RNA, 61 nt, Homo Sapiens
aaaaaaagaauggacuguaauuuuaauggaacuaaaugaucugcuuaaaguacauuaugcu

SEQ ID NO: 658913 - RNA, 61 nt, Homo Sapiens
aaaguauguuuguguugguuuuuuaagaagucuaaaugaaguuauuaauaccugaagcuuu

SEQ ID NO: 658914 - RNA, 61 nt, Homo Sapiens
aaauugacuaccuggaggaaugauuaggaaucuaaaugaagccagcccucgguaucugcag

SEQ ID NO: 658915 - RNA, 61 nt, Homo Sapiens
cuggaauauguuuaguagauauguaaaacuacuaaaugacaccaaguauagugcagauucu

SEQ ID NO: 658916 - RNA, 61 nt, Homo Sapiens
uguguugcagagaacucccaaggugcaacuccuaaaugaauuauuuaucugagugagucca

SEQ ID NO: 658917 - RNA, 64 nt, Homo Sapiens; identical to SEQ ID NO: 418746

SEQ ID NO: 658918 - RNA, 64 nt, Homo Sapiens; identical to SEQ ID NO: 418747

SEQ ID NO: 658919 - RNA, 64 nt, Homo Sapiens; identical to SEQ ID NO: 418748

SEQ ID NO: 658920 - RNA, 64 nt, Homo Sapiens; identical to SEQ ID NO: 418749

SEQ ID NO: 658921 - RNA, 64 nt, Homo Sapiens; identical to SEQ ID NO: 418750

SEQ ID NO: 658922 - RNA, 64 nt, Homo Sapiens; identical to SEQ ID NO: 418751

SEQ ID NO: 658923 - RNA, 64 nt, Homo Sapiens; identical to SEQ ID NO: 418752

SEQ ID NO: 658924 - RNA, 64 nt, Homo Sapiens; identical to SEQ ID NO: 418753

SEQ ID NO: 658925 - RNA, 64 nt, Homo Sapiens; identical to SEQ ID NO: 418754

SEQ ID NO: 658926 - RNA, 64 nt, Homo Sapiens; identical to SEQ ID NO: 418755

SEQ ID NO: 658927 - RNA, 64 nt, Homo Sapiens; identical to SEQ ID NO: 418756

SEQ ID NO: 658928 - RNA, 64 nt, Homo Sapiens; identical to SEQ ID NO: 418757

SEQ ID NO: 658929 - RNA, 64 nt, Homo Sapiens; identical to SEQ ID NO: 418758

SEQ ID NO: 658930 - RNA, 64 nt, Homo Sapiens; identical to SEQ ID NO: 418759

SEQ ID NO: 658931 - RNA, 64 nt, Homo Sapiens; identical to SEQ ID NO: 418760

SEQ ID NO: 658932 - RNA, 64 nt, Homo Sapiens; identical to SEQ ID NO: 418761

SEQ ID NO: 658933 - RNA, 64 nt, Homo Sapiens; identical to SEQ ID NO: 418762

SEQ ID NO: 658934 - RNA, 64 nt, Homo Sapiens; identical to SEQ ID NO: 418763

SEQ ID NO: 658935 - RNA, 64 nt, Homo Sapiens; identical to SEQ ID NO: 418764

SEQ ID NO: 658936 - RNA, 64 nt, Homo Sapiens; identical to SEQ ID NO: 418765

SEQ ID NO: 658937 - RNA, 64 nt, Homo Sapiens; identical to SEQ ID NO: 418766

SEQ ID NO: 658938 - RNA, 64 nt, Homo Sapiens; identical to SEQ ID NO: 418767

SEQ ID NO: 658939 - RNA, 64 nt, Homo Sapiens; identical to SEQ ID NO: 418768

SEQ ID NO: 658940 - RNA, 64 nt, Homo Sapiens; identical to SEQ ID NO: 418769

SEQ ID NO: 658941 - RNA, 64 nt, Homo Sapiens; identical to SEQ ID NO: 418770

SEQ ID NO: 658942 - RNA, 64 nt, Homo Sapiens; identical to SEQ ID NO: 418771

SEQ ID NO: 658943 - RNA, 64 nt, Homo Sapiens; identical to SEQ ID NO: 418772

SEQ ID NO: 658944 - RNA, 64 nt, Homo Sapiens; identical to SEQ ID NO: 418773

SEQ ID NO: 658945 - RNA, 64 nt, Homo Sapiens; identical to SEQ ID NO: 418774

SEQ ID NO: 658946 - RNA, 64 nt, Homo Sapiens; identical to SEQ ID NO: 418775

SEQ ID NO: 658947 - RNA, 64 nt, Homo Sapiens; identical to SEQ ID NO: 418776

SEQ ID NO: 658948 - RNA, 64 nt, Homo Sapiens; identical to SEQ ID NO: 418777

SEQ ID NO: 658949 - RNA, 64 nt, Homo Sapiens; identical to SEQ ID NO: 418778

SEQ ID NO: 658950 - RNA, 64 nt, Homo Sapiens; identical to SEQ ID NO: 418779

SEQ ID NO: 658951 - RNA, 64 nt, Homo Sapiens; identical to SEQ ID NO: 418780

SEQ ID NO: 658952 - RNA, 64 nt, Homo Sapiens; identical to SEQ ID NO: 418781

SEQ ID NO: 658953 - RNA, 64 nt, Homo Sapiens; identical to SEQ ID NO: 418782

SEQ ID NO: 658954 - RNA, 64 nt, Homo Sapiens; identical to SEQ ID NO: 418783

SEQ ID NO: 658955 - RNA, 64 nt, Homo Sapiens; identical to SEQ ID NO: 418784

SEQ ID NO: 658956 - RNA, 64 nt, Homo Sapiens; identical to SEQ ID NO: 418785

SEQ ID NO: 658957 - RNA, 64 nt, Homo Sapiens; identical to SEQ ID NO: 418786

SEQ ID NO: 658958 - RNA, 64 nt, Homo Sapiens; identical to SEQ ID NO: 418787

SEQ ID NO: 658959 - RNA, 64 nt, Homo Sapiens; identical to SEQ ID NO: 418788

SEQ ID NO: 658960 - RNA, 64 nt, Homo Sapiens; identical to SEQ ID NO: 418789

SEQ ID NO: 658961 - RNA, 64 nt, Homo Sapiens; identical to SEQ ID NO: 418790

SEQ ID NO: 658962 - RNA, 64 nt, Homo Sapiens; identical to SEQ ID NO: 418791

SEQ ID NO: 658963 - RNA, 64 nt, Homo Sapiens; identical to SEQ ID NO: 418792

SEQ ID NO: 658964 - RNA, 64 nt, Homo Sapiens; identical to SEQ ID NO: 418793

SEQ ID NO: 658965 - RNA, 64 nt, Homo Sapiens; identical to SEQ ID NO: 418794

SEQ ID NO: 658966 - RNA, 64 nt, Homo Sapiens; identical to SEQ ID NO: 418795

SEQ ID NO: 658967 - RNA, 64 nt, Homo Sapiens; identical to SEQ ID NO: 418796

SEQ ID NO: 658968 - RNA, 64 nt, Homo Sapiens; identical to SEQ ID NO: 418797

SEQ ID NO: 658969 - RNA, 64 nt, Homo Sapiens; identical to SEQ ID NO: 418798

SEQ ID NO: 658970 - RNA, 64 nt, Homo Sapiens; identical to SEQ ID NO: 418799

SEQ ID NO: 658971 - RNA, 64 nt, Homo Sapiens; identical to SEQ ID NO: 418800

SEQ ID NO: 658972 - RNA, 64 nt, Homo Sapiens
ccaaucucauuagcaggugauagaaagguuuugugguagcaaaugcaugauuucucugugacca

SEQ ID NO: 658973 - RNA, 64 nt, Homo Sapiens
auggcagcuauuuccugagcaugugaggccacuugguagcaagaagagaugccuuaagauaauu

SEQ ID NO: 658974 - RNA, 64 nt, Homo Sapiens
ccacuggguugcuauccucuacugggcccuuggagguagcaaggagagcuuggucccaagcucu

SEQ ID NO: 658975 - RNA, 64 nt, Homo Sapiens
ugcacuuuaaacaauuuggaguuuuaauugcuuggguagcaaugaaaauagcuguuuugaaacu

SEQ ID NO: 658976 - RNA, 64 nt, Homo Sapiens
ugcuucucuacgcccaugacguagagggggagaggguagcaaggcuacccacugggccuggugu

SEQ ID NO: 658977 - RNA, 64 nt, Homo Sapiens
cugagaaaaucagcuucaggcaagauauguuuuugguagcaaaaaaaucuugagcauacuccag

SEQ ID NO: 658978 - RNA, 64 nt, Homo Sapiens
gggcaccugagguucacgcuuggaaggaaaaagagguagcaaagcuagcacugagacuugugcc

SEQ ID NO: 658979 - RNA, 64 nt, Homo Sapiens
gaugggggaaagaaguagguaggagggaaugauugguagcaaaguuaccaauagccugaauuug

SEQ ID NO: 658980 - RNA, 64 nt, Homo Sapiens
gauauaaauuguauauguuuaauagcuaucuuuugguagcaaaaaaaaguaaucaaugaaauau

SEQ ID NO: 658981 - RNA, 64 nt, Homo Sapiens
aaauagucccacaaaauaccuuuugugacuaauggguagcaaucguauuauuugcuggccugaa

SEQ ID NO: 658982 - RNA, 64 nt, Homo Sapiens
aaaaaaaagaauguucuggucccaccgaauuugagguagcaaaagaaaguguuaacuaucguug

SEQ ID NO: 658983 - RNA, 64 nt, Homo Sapiens
uacagauaaagaguacuuuaaauagacauaaaaagguagcaaugaaaagaagucauguaaauaa

SEQ ID NO: 658984 - RNA, 64 nt, Homo Sapiens
cuacccagagccuucuccuggaggaaaggacauggguagcaauugggugcugcagccaggagga

SEQ ID NO: 658985 - RNA, 64 nt, Homo Sapiens
ggggugauauuuuuauagaaucucucauaugcuagguagcaaaucgugacaggcuagucuuguc

SEQ ID NO: 658986 - RNA, 64 nt, Homo Sapiens
gugcuaaauaaaauguguaaccugauuuuuaaaugguagcaauucaccaugccuggccaaaaca

SEQ ID NO: 658987 - RNA, 64 nt, Homo Sapiens
uuuuuuucaaguucucucaagugucccaaaucaggguagcaaucuuguugccacaugugcagca

SEQ ID NO: 658988 - RNA, 64 nt, Homo Sapiens
uaggaggcagcuuuacuaagcuggugcuuugcaugguagcaagugcugcccuuuaucagcaccc

SEQ ID NO: 658989 - RNA, 64 nt, Homo Sapiens
aagucuuaagacugaauaugcauuaaaguaugcagguagcaaagauguaauaaauuugcuuaaa

SEQ ID NO: 658990 - RNA, 64 nt, Homo Sapiens
guuuggugaauaugcuguuuccucaguucagagagguagcaacuagguaaacuccuuauaaaaa

SEQ ID NO: 658991 - RNA, 64 nt, Homo Sapiens
uuuguaaggaauauggaauugcuaagauaucauugguagcaaacaucucugguaaggugcauau

SEQ ID NO: 658992 - RNA, 64 nt, Homo Sapiens
auauuuuuuuaggaaaccuccuacccaugucugagguagcaagugcagccucacgacagauacc

SEQ ID NO: 658993 - RNA, 64 nt, Homo Sapiens
ggauauaauaccuuucuaagccaaacccuggaacgguagcaaugugagcagagcaguucaaggg

SEQ ID NO: 658994 - RNA, 64 nt, Homo Sapiens
cauggaaaaagaugugucagcuucaaugccuaucgguagcaagcgggaaguaacaguugcuagg

SEQ ID NO: 658995 - RNA, 64 nt, Homo Sapiens
gacagcucagaaaggagcugaggccugcuacugggguagcaacucagccuugacuucuugccca

SEQ ID NO: 658996 - RNA, 64 nt, Homo Sapiens
ugcaaugcgaaauugaaugacccauuuaguuugugguagcaaagucagcacucaaaaauguaca

SEQ ID NO: 658997 - RNA, 64 nt, Homo Sapiens
ccgcguucauagcagcauuacucaaaagucaaacgguagcaacaacccaaauguccauccacag

SEQ ID NO: 658998 - RNA, 64 nt, Homo Sapiens
uuaacuucaagaucugccccaguaauuuaccaaagguagcaaaauaauagugaagauggaauau

SEQ ID NO: 658999 - RNA, 64 nt, Homo Sapiens
uuuucaucugccaggcguuguuaugugcuaugaggguagcaaguacgucuuugucuuaaugauc

SEQ ID NO: 659000 - RNA, 64 nt, Homo Sapiens
uguucauuuagauaaaaguagaaggcacaggagagguagcaaaggccaggcuuuucuuugguuu

SEQ ID NO: 659001 - RNA, 64 nt, Homo Sapiens
uuauaaauguugcuuucugaaugaaaagugaugugguagcaauuacagauuucgguucccugcu

SEQ ID NO: 659002 - RNA, 64 nt, Homo Sapiens
cauauugaaugcaaaguucugugucauccauuuagguagcaagaaagacagcaauaaaagacca

SEQ ID NO: 659003 - RNA, 64 nt, Homo Sapiens
acagaagggaaauuucaauaaaagcaacugguuagguagcaacaauugucuaguaauugggaaa

SEQ ID NO: 659004 - RNA, 64 nt, Homo Sapiens
aagauuuugcccuuuaguuuugccucaagguauugguagcaagcaugacaaaauguagacaaga

SEQ ID NO: 659005 - RNA, 64 nt, Homo Sapiens
ggcagcccuauuucaguuuaaaacccacucuguugguagcaauugcuaaauaaauguaauagcc

SEQ ID NO: 659006 - RNA, 64 nt, Homo Sapiens
augcacgaagucuguuuuaaugacaaggugauaugguagcaacacugugaagacaaucauggga

SEQ ID NO: 659007 - RNA, 64 nt, Homo Sapiens
aaaauugucuuuccuuaucauuggugggaggcuugguagcaaaguaacauuuuuuggaaaagag

SEQ ID NO: 659008 - RNA, 64 nt, Homo Sapiens
cuugcuuaacuaaaaccuaaggaccacuguuuuugguagcaauuauaugguuacuauccacugc

SEQ ID NO: 659009 - RNA, 64 nt, Homo Sapiens
auaaagucacgaggacauagaccuagccaggagggguagcaaaaacucggcucccaucucuguc

SEQ ID NO: 659010 - RNA, 64 nt, Homo Sapiens
aaugauuacaacccagaggaguugcauguaaauugguagcaaguaaaugucaguccuagcagau

SEQ ID NO: 659011 - RNA, 64 nt, Homo Sapiens
uguagagcagagcuggaaaagcuggggaggauuugguagcaaugacauccagacucaucugaag

SEQ ID NO: 659012 - RNA, 64 nt, Homo Sapiens
ucuggaucuuauacccaacauuucuccucaggcugguagcaaguuccuuucuccauguguuuga

SEQ ID NO: 659013 - RNA, 64 nt, Homo Sapiens
cccucccagagaaaagauugggaacugggucuuggguagcaaaggcgcuuccgcgagcacccug

SEQ ID NO: 659014 - RNA, 64 nt, Homo Sapiens
aaagauuccaguguuugagcaagccagcugauaugguagcaaccaugguuggcuucuugucugc

SEQ ID NO: 659015 - RNA, 64 nt, Homo Sapiens
acggcuuuuggugaauuuguuuaagguuaauuaugguagcaaauuuuggaccuaaacauuauuu

SEQ ID NO: 659016 - RNA, 64 nt, Homo Sapiens
ucucuugcaacacccaugugccuuugaugagucagguagcaagcuguaguagauaaugagaaag

SEQ ID NO: 659017 - RNA, 64 nt, Homo Sapiens
uaacccaguggagguuagaaagaaguuauauucugguagcaaauuaacuuuacauccuuuuucc

SEQ ID NO: 659018 - RNA, 64 nt, Homo Sapiens
ccccugauuuuaagcuuugcuggucgucguccucgguagcaagagcuaguuauacuccauucuu

SEQ ID NO: 659019 - RNA, 64 nt, Homo Sapiens
uguguguaugucuugucuaaaugcccuccauccagguagcaagaauggcuaacugauguuuaua

SEQ ID NO: 659020 - RNA, 64 nt, Homo Sapiens
ggggacucgaaccagauguccgcaauuucuaggugguagcaaagggaaaggaccaaaaucaaac

SEQ ID NO: 659021 - RNA, 64 nt, Homo Sapiens
gucuggggcccguuuuccccccagggggugucuagguagcaacagguaucgaggacucuccaaa

SEQ ID NO: 659022 - RNA, 64 nt, Homo Sapiens
cagccgagagcaucucccugggagccgaccccuggguagcaaggucacaccugggccucuccuc

SEQ ID NO: 659023 - RNA, 64 nt, Homo Sapiens
ucuauaguuuuggccuuaacuugaagauaaauaagguagcaauguugccucuuaaaggcaaggg

SEQ ID NO: 659024 - RNA, 64 nt, Homo Sapiens
acaauuaucuuuaaaaaaaagucaaguaaguguggguagcaaaaaaaauucuaaaaauuugcaa

SEQ ID NO: 659025 - RNA, 64 nt, Homo Sapiens
gugcuuccgucaagauaccaauccccaggugugggguagcaaguucuucuuucaacuauaagua

SEQ ID NO: 659026 - RNA, 64 nt, Homo Sapiens
uaucacauacacccccaaaaacacauuguagacagguagcaaaaauuacccugaugugacaauu

SEQ ID NO: 659027 - RNA, 64 nt, Homo Sapiens
gacacaugcacgcacacacaugaaacauucaccugguagcaaaugacuaaacagaaaccagaac

SEQ ID NO: 659028 - RNA, 64 nt, Homo Sapiens
ugcggucugaaugcaugcaucccacauuccauuugguagcaauaccugaggugcauagcauauu

SEQ ID NO: 659029 - RNA, 64 nt, Homo Sapiens
augaaguuucgaaguuucauguuggcuuuggaaugguagcaaaagccuuuccuggcugagauga

SEQ ID NO: 659030 - RNA, 64 nt, Homo Sapiens
aaugcauaaccugccauaucuuuacauauuuguugguagcaauuuguauuaaagaaaucacaag

SEQ ID NO: 659031 - RNA, 64 nt, Homo Sapiens
uauauuuuuaaaaaguucccuuaaucuaugacaugguagcaaugauuucccuuuggugucuuaa

SEQ ID NO: 659032 - RNA, 64 nt, Homo Sapiens
gaaauacaguauaacuuaaugcccugugguucuggguagcaaagucaauauguguugacaacca

SEQ ID NO: 659033 - RNA, 64 nt, Homo Sapiens
ccuggauagugaagcaugagaaaugauauugaaagguagcaaugcuuuuacauauuguuuaggg

SEQ ID NO: 659034 - RNA, 64 nt, Homo Sapiens
ucaaaugcugacaggggccaaaaguauugaucaggguagcaaacuuucuuaguaaaaugaaauc

SEQ ID NO: 659035 - RNA, 64 nt, Homo Sapiens
ccaguuucaaacuuggugacacaguuguuggcaagguagcaauaggccuccucucauaaaagag

SEQ ID NO: 659036 - RNA, 64 nt, Homo Sapiens
accuguugggaguucacaagugcugcauauacuggguagcaaaagaaaauggaaaaaaacccac

SEQ ID NO: 659037 - RNA, 64 nt, Homo Sapiens
ugggaggaguaaagguagccuugaggccagagcagguagcaaggcauuguggaaagaggggacc

SEQ ID NO: 659038 - RNA, 64 nt, Homo Sapiens
auuucugacccacuagguuuucuuuccagaaauagguagcaaggacaagaacuaaacaauccca

SEQ ID NO: 659039 - RNA, 64 nt, Homo Sapiens
acaaacuaaagacugcggcuccauugggauauaagguagcaaucaaacaaaacaaacaaaccac

SEQ ID NO: 659040 - RNA, 64 nt, Homo Sapiens
agggaaugcuuugcuugaggccacacagcagguugguagcaaagaucuugucuagccagggcag

SEQ ID NO: 659041 - RNA, 64 nt, Homo Sapiens
gggcaggggccuuggugggcagauggcaauugaggguagcaaccuauuagggugggggagggac

SEQ ID NO: 659042 - RNA, 64 nt, Homo Sapiens
guugauuggaccucaggggaaaaaagugaaaaaggguagcaaaggccaaugucuucuagcugcu

SEQ ID NO: 659043 - RNA, 64 nt, Homo Sapiens
aguuucugugagcccaaaaugugaggugaggugagguagcaagauuagguuacaugguuacaca

SEQ ID NO: 659044 - RNA, 64 nt, Homo Sapiens
acauguaccacuuaaauuauacauauugugaucagguagcaaugauuagagucagagccuguuc

SEQ ID NO: 659045 - RNA, 64 nt, Homo Sapiens
guguaauauuucuuuugcuuuuaaaaaaauuccugguagcaaaucaagauaaauaauugcuuca

SEQ ID NO: 659046 - RNA, 64 nt, Homo Sapiens
auuaaauaaaggacuuuauuuacauacuacauaagguagcaaacuguugaaugaguuugaaggu

SEQ ID NO: 659047 - RNA, 64 nt, Homo Sapiens
aguaaaagugauggcaucucucauugacuuaucugguagcaaacugguucuuucggagccaucc

SEQ ID NO: 659048 - RNA, 64 nt, Homo Sapiens
uuggggagucggagaguuggggcccugagacugggguagcaacccccccuuuuaucuuuuaaga

SEQ ID NO: 659049 - RNA, 64 nt, Homo Sapiens
ugaaucaaaaugauggcugguaauacggcaauaagguagcaaaggcaggugcuuugcagaaaga

SEQ ID NO: 659050 - RNA, 64 nt, Homo Sapiens
aaauuggaauuuuguuuaaaauuuuacacuuuaagguagcaaaugucaauuauuagaccgagca

SEQ ID NO: 659051 - RNA, 64 nt, Homo Sapiens
gaaagaagacauccugagcagcaguaugcuuaaugguagcaacuguuauggccgaaaaggauau

SEQ ID NO: 659052 - RNA, 64 nt, Homo Sapiens
gaccugggauuuuaucaugcagaugaaacauccagguagcaagcuucagagagaauagacugug

SEQ ID NO: 659053 - RNA, 64 nt, Homo Sapiens
uucucaugaguuuuguucaaauauucugggauaagguagcaagaucuuguuuuuaaacaaucuc

SEQ ID NO: 659054 - RNA, 64 nt, Homo Sapiens
aauucucuuacccugaggcugagggcgaacaguagguagcaagggaguguaaaggaauuuaucu

SEQ ID NO: 659055 - RNA, 64 nt, Homo Sapiens
gcucccucuccccuucaucuucugcuccaaaggugguagcaagaggaguacccaguuagggguu

SEQ ID NO: 659056 - RNA, 64 nt, Homo Sapiens
ccuugguagcugugcuucagcaaacgucaaccaugguagcaaauuggugaggcugugaccaaua

SEQ ID NO: 659057 - RNA, 64 nt, Homo Sapiens
aaccagauaacuuccuaaguggagauggccuguagguagcaaaugcaggauuuuguuuacuuuc

SEQ ID NO: 659058 - RNA, 64 nt, Homo Sapiens
ggccaaaugaggccuacugagugcaguccaauaggguagcaacucaauaauggaaacguucuau

SEQ ID NO: 659059 - RNA, 64 nt, Homo Sapiens
ggagggagaggaguccuuuugugggauggggugugguagcaaaagaugcccagguugcacagga

SEQ ID NO: 659060 - RNA, 64 nt, Homo Sapiens
gggccggccucagagagagcuaagauggaggccagguagcaaugugcugaguuugggugcaccc

SEQ ID NO: 659061 - RNA, 64 nt, Homo Sapiens
ggauuuccuggcgggugggauuugucaggacaaagguagcaagacccuggucacuguccuaacc

SEQ ID NO: 659062 - RNA, 64 nt, Homo Sapiens
gcaucuuccacaguuuuccaaacagaacaaucuggguagcaacaggcuucaggcccacuuguug

SEQ ID NO: 659063 - RNA, 64 nt, Homo Sapiens
gcaacagaggaaacagugaaggggaacagaaggggguagcaaaguguuacagaaaagcggacug

SEQ ID NO: 659064 - RNA, 64 nt, Homo Sapiens
guuaauucugugguccuguuuaucacagacuuuggguagcaauaggaagagaguguuauucuga

SEQ ID NO: 659065 - RNA, 64 nt, Homo Sapiens
caagcuccucauuuacggcucugugcuaccccuagguagcaagagagaggcugggaaaagugug

SEQ ID NO: 659066 - RNA, 64 nt, Homo Sapiens
ggaauagaacuuacuuaaaacauaaguucagauggguagcaaauugguuuguagaauuuguguu

SEQ ID NO: 659067 - RNA, 64 nt, Homo Sapiens
acuuuaauuugcacuaccagggggauaaauguuggguagcaagauucaagagucauuuauuaca

SEQ ID NO: 659068 - RNA, 64 nt, Homo Sapiens
cugugcugguauaaaucuuaggcugcgauccuaugguagcaauuuaaugucacucuagugcuua

SEQ ID NO: 659069 - RNA, 64 nt, Homo Sapiens
cuaggguggugaguuccugcggaugucccugagagguagcaaguguugugguugaugcagugug

SEQ ID NO: 659070 - RNA, 64 nt, Homo Sapiens
gagaaaaaaucaacagcaaaggcauagccaugcugguagcaagacgggacugggggguuugucu

SEQ ID NO: 659071 - RNA, 64 nt, Homo Sapiens
uuaggcucucuucgaaauuauguagaagcagggggguagcaaauagcaaaaaucugguauaccc

SEQ ID NO: 659072 - RNA, 64 nt, Homo Sapiens
uaauaauaguacauacaauacuaauuguauauaagguagcaaccaaaagagguuguuaauuagc

SEQ ID NO: 659073 - RNA, 64 nt, Homo Sapiens
uaacccacaaauguagcaucaagccagacucacagguagcaaaaugaauuacacaccuacuuuu

SEQ ID NO: 659074 - RNA, 64 nt, Homo Sapiens
uucccacacuuacugaguacagaugaaggaaagugguagcaauuuaaucauaacuuucauuugc

SEQ ID NO: 659075 - RNA, 64 nt, Homo Sapiens
agauugucauggccagagaucauaggucacuucagguagcaagaccccuggcaaacugggcacu

SEQ ID NO: 659076 - RNA, 64 nt, Homo Sapiens
guuccugauacaaauagaugcagaguauuaacuugguagcaagaguggucucacucuagcugag

SEQ ID NO: 659077 - RNA, 61 nt, Homo Sapiens
uuauuaacuuuuucaucugaugagaugucgcgguagcaaaaauagagaaaggguagaaaaa

SEQ ID NO: 659078 - RNA, 64 nt, Homo Sapiens
gagcagcgcccaggccugcucuugccccaggccagguagcaagacagaggccuugucauccucc

SEQ ID NO: 659079 - RNA, 64 nt, Homo Sapiens
gauggcuguauucugacuuugaagccuguuaagagguagcaagggggcuagaggagggagauuc

SEQ ID NO: 659080 - RNA, 64 nt, Homo Sapiens
cagauucccaggugagcugaugcuggugguuaaggguagcaaaucucuaaagcacgaagcccuc

SEQ ID NO: 659081 - RNA, 64 nt, Homo Sapiens
uguugugccccuuuccaagauacagccugcaagugguagcaagaagugauuagaggcagaucug

SEQ ID NO: 659082 - RNA, 64 nt, Homo Sapiens
uguuugauaaugguuacuggguccuucucucaaggguagcaaggccaagcugauggcugcuugu

SEQ ID NO: 659083 - RNA, 64 nt, Homo Sapiens
cauucuacuuugccugucuguacagcaaauaaaugguagcaaaacaugccuugaguacauacca

SEQ ID NO: 659084 - RNA, 64 nt, Homo Sapiens
cuucuuuuuagaaaagaaaggugaacagugaggugguagcaagauagaccgcauaaaaaauaaa

SEQ ID NO: 659085 - RNA, 64 nt, Homo Sapiens
caaggacuagagcucaggccugacacagagcaaugguagcaaaagaggcagugauuugccaaag

SEQ ID NO: 659086 - RNA, 64 nt, Homo Sapiens
ccaguaaacuuaaauuacguuuuagacuuagguggguagcaaugaugggagcauuagauuuagu

SEQ ID NO: 659087 - RNA, 64 nt, Homo Sapiens
accuguccacuucaaacacagcuucuccaacagggguagcaaugagccuacuccuucuuacaua

SEQ ID NO: 659088 - RNA, 64 nt, Homo Sapiens
aaaagguugguugaaggaaacaaggacaagaaaugguagcaaccagcacuaggagcaccuuucu

SEQ ID NO: 659089 - RNA, 64 nt, Homo Sapiens
ggcugaucugaagucagucggaauuuguaaacaggguagcaaacaagauauuuuucuuccaugu

SEQ ID NO: 659090 - RNA, 64 nt, Homo Sapiens
gccuauaauaccagcugaggaauuagccaagcaugguagcaagugucuccgcuagaaauacaaa

SEQ ID NO: 659091 - RNA, 64 nt, Homo Sapiens
guccagagaugagguguuuuguucccugcuuuuugguagcaagggaauacucgcugcagcuggg

SEQ ID NO: 659092 - RNA, 64 nt, Homo Sapiens
agugauguugauggaaugagaacuaagaagcuaugguagcaaacagcauaaaaucuagcuggac

SEQ ID NO: 659093 - RNA, 64 nt, Homo Sapiens
aagaaagcagaaacuacuguuacaauugcaugcagguagcaagcgaucugaucaagguaggaau

SEQ ID NO: 659094 - RNA, 64 nt, Homo Sapiens
agcaaaguugggagcuggaccccaauugaguggggguagcaauuggaguccuugugucucuuuu

SEQ ID NO: 659095 - RNA, 64 nt, Homo Sapiens
auguccccuuccccguguaugcccccuuccccaagguagcaagauggagggauggggcucucuc

SEQ ID NO: 659096 - RNA, 64 nt, Homo Sapiens
aaaucaccuuuuaguuuuaggucuccacagacuggguagcaaaauaacacgcguuucauucaau

SEQ ID NO: 659097 - RNA, 64 nt, Homo Sapiens
auuuacagaaugucaacauccgccagucaucacugguagcaaagcuguucucaaccacguagug

SEQ ID NO: 659098 - RNA, 64 nt, Homo Sapiens
uuuuucuucuccuaaaacuuuaaaacuugaaguagguagcaacguggcuuuuuuuuuuucccuu

SEQ ID NO: 659099 - RNA, 64 nt, Homo Sapiens
gggaggacacucugaucucgaagccugccauaaagguagcaaauagacucuugggauuccccuc

SEQ ID NO: 659100 - RNA, 64 nt, Homo Sapiens
acuaaggugaaaagauaauguuaguaaaauuggagguagcaaacaggcuaaagugcuguauccu

SEQ ID NO: 659101 - RNA, 64 nt, Homo Sapiens
caaccacacacuguucuguacuuuuaaaacaaaugguagcaaacacauauauauucuuuccccu

SEQ ID NO: 659102 - RNA, 64 nt, Homo Sapiens
gguacuuuuaccuggcuccauccaagacgucacagguagcaagaccccaaaaggugggaacuug

SEQ ID NO: 659103 - RNA, 64 nt, Homo Sapiens
cuuuaccacugaugaggggccucugccggcugaggguagcaagcagggguugugagucaggcug

SEQ ID NO: 659104 - RNA, 64 nt, Homo Sapiens
gaaacuuuggauacauuuuuauuuagaacacuuugguagcaauagcuuucuguaacuuguuuua

SEQ ID NO: 659105 - RNA, 64 nt, Homo Sapiens
uauguuacucuaacucugaaaagugauguaaucugguagcaauguaguaguucaaauaaaggca

SEQ ID NO: 659106 - RNA, 64 nt, Homo Sapiens
gugaccgaugucaagaacgaugugucccuguuuugguagcaagagaggugcucacccuccaccc

SEQ ID NO: 659107 - RNA, 64 nt, Homo Sapiens
cuguaugagcaguucaaaggccaagccguggaaugguagcaaugggauauaauaccuuucuaag

SEQ ID NO: 659108 - RNA, 64 nt, Homo Sapiens; identical to SEQ ID NO: 659107

SEQ ID NO: 659109 - RNA, 64 nt, Homo Sapiens
gaguucgacaccaucuugggcaacauggugaaacccugucuacuaaaauacaaaaaaauuagcu

SEQ ID NO: 659110 - RNA, 64 nt, Homo Sapiens
uacuuagacauauuaauaaacaauaaagacuuuaccugucuaauggaaaaccuggagaagucgu

SEQ ID NO: 659111 - RNA, 64 nt, Homo Sapiens
ggggggagacaaauguguaguagcaaauaagaccccugucuaauucaucccuuuacucuuacag

SEQ ID NO: 659112 - RNA, 64 nt, Homo Sapiens
ggggguagacaggugcagauagcaagcauagaccccugucuaaccaacccuuuacccuuacagu

SEQ ID NO: 659113 - RNA, 64 nt, Homo Sapiens
gcucaggcucucccacuucgccgcucgccucuucccugucuacugucuaccuccugcagugggg

SEQ ID NO: 659114 - RNA, 64 nt, Homo Sapiens
uccugcaguggggccgcucgauaaguaucuguagccugucuaccagccucaguguggcugcugc

SEQ ID NO: 659115 - RNA, 64 nt, Homo Sapiens
acaauuaaagaaacaaaugacuuuuuggaauagcccugucuagggcaaacuguggcccccagga

SEQ ID NO: 659116 - RNA, 64 nt, Homo Sapiens
agugauggagagaaaccaacaagagaucucgaacccugucuagaaggaauguauuuguugcuaa

SEQ ID NO: 659117 - RNA, 64 nt, Homo Sapiens
cuggggcagcuguugggauucugauuaaaagaggggaaacgaucauccuggacaggaagugaga

SEQ ID NO: 659118 - RNA, 64 nt, Homo Sapiens
cagucacuaaucucugagacuccauuuucuccagggaaacgaggcuugcccagauagacuaaca

SEQ ID NO: 659119 - RNA, 64 nt, Homo Sapiens
gcgagcuucuuauaaauguggugauuuuuaccaaggaaacgauugacuuaaugcuuaaaaguau

SEQ ID NO: 659120 - RNA, 64 nt, Homo Sapiens
auguuagacaucuguugaaauaagcucauaugguggaaacgacaacuauauuaugaauuauuuu

SEQ ID NO: 659121 - RNA, 64 nt, Homo Sapiens
ugaaauucuucuguaagccugucugaguguauguggaaacgauugucaaaucuaaaauaucuau

SEQ ID NO: 659122 - RNA, 64 nt, Homo Sapiens
agaacauggugagggcaugguccggaaaugggccggaaacgaaaugggcagucccugcagaucu

SEQ ID NO: 659123 - RNA, 64 nt, Homo Sapiens
uccuuugacuuguaucagcuuuugaaaagcagcaggaaacgaaauccguuuauccugccauugc

SEQ ID NO: 659124 - RNA, 64 nt, Homo Sapiens
uggaauucgaagggaccuuuuuuuguuuuuuaagggaaacgaaacaaaguaugggcuuuuuugu

SEQ ID NO: 659125 - RNA, 64 nt, Homo Sapiens
cgugucagaucgcacaucccuccacgcaucugcuggaaacgagcagagcgaggcaucccugaau

SEQ ID NO: 659126 - RNA, 64 nt, Homo Sapiens
ugaccaagugauguacauccaagugauguauucuggaaacgauggaauuuuacaguuacaguuc

SEQ ID NO: 659127 - RNA, 64 nt, Homo Sapiens
agcaagcugccgcuuuuuuaaaauaaaacuguauggaaacgaugccaugguuccaacaaauugc

SEQ ID NO: 659128 - RNA, 64 nt, Homo Sapiens
cggagccauuuucauuuuccuaauaaagccaacuggaaacgaauaaacaacuucugccaaacaa

SEQ ID NO: 659129 - RNA, 64 nt, Homo Sapiens
cucgaacauguuuuaaccuuauuagauuacacuaggaaacgauucuuguuuccuuauuugucaa

SEQ ID NO: 659130 - RNA, 64 nt, Homo Sapiens
ccacugugcuuacagugacuuuucaccauuuccgggaaacgaaccaugauuagaggcacgccag

SEQ ID NO: 659131 - RNA, 64 nt, Homo Sapiens
caccaucauucccguugaaccuuugcaccuccauggaaacgaagagguaccuccaaggaccggc

SEQ ID NO: 659132 - RNA, 64 nt, Homo Sapiens
ucguuaagucagaauauaauaugaaguuccccaaggaaacgaacaaaaugaacucuagaauauc

SEQ ID NO: 659133 - RNA, 64 nt, Homo Sapiens
uauggaaaagaaaacagacaguuuaguucagaauggaaacgaacguucugaugacacuguuuca

SEQ ID NO: 659134 - RNA, 64 nt, Homo Sapiens
guucuuucaaagaccaggaugugguaccaacuuuggaaacgaaaggucucuugccaacaguauc

SEQ ID NO: 659135 - RNA, 64 nt, Homo Sapiens
aacaauagagauugcuuuggugaccaugauaggaggaaacgaaacuuguaagauuggaacaguu

SEQ ID NO: 659136 - RNA, 64 nt, Homo Sapiens
aagcucccucucaccacccuaaauaaagagaaaaggaaacgaaggacccagacaagcaaacuca

SEQ ID NO: 659137 - RNA, 64 nt, Homo Sapiens
gaggaaggugaaggggaagggcagagcucauuguggaaacgauguuggagaagccaccugcaca

SEQ ID NO: 659138 - RNA, 64 nt, Homo Sapiens
acuuuagugcaaagagcugagcacauuccagcagggaaacgaacuccgaugugcgcccauugua

SEQ ID NO: 659139 - RNA, 64 nt, Homo Sapiens
auucucuagacaaaauccaucagggaaugcugcaggaaacgauugccaacuauacgaauggcuu

SEQ ID NO: 659140 - RNA, 64 nt, Homo Sapiens
guuucaaaucuacuucugcucugagcuaauaaagggaaacgaauugcaguacacaucagccuca

SEQ ID NO: 659141 - RNA, 64 nt, Homo Sapiens
gcaaauuacauccuugcugaauucaggagguuaaggaaacgauccaugcaagagaggcccaauc

SEQ ID NO: 659142 - RNA, 64 nt, Homo Sapiens
uccaaacucguggugcagcaagucacaccagacaggaaacgaauauggacguaauugcagaagg

SEQ ID NO: 659143 - RNA, 64 nt, Homo Sapiens
cucugcugggcgugguggcucaacuucuagauugggaaacgaaguuucuguuguuugaagcccc

SEQ ID NO: 659144 - RNA, 64 nt, Homo Sapiens
agaaggccgaggaauccucacggccaccccgccaggaaacgacggggucucuugcccaucucuc

SEQ ID NO: 659145 - RNA, 64 nt, Homo Sapiens
agguacugaaauaaugaucuuauagauuuagaggggaaacgagaguucugcaaaacauuuuaug

SEQ ID NO: 659146 - RNA, 64 nt, Homo Sapiens
cuuacagaaccaauucacuuuagagugacuaaaaggaaacgauagccuagcuuucuaaagccac

SEQ ID NO: 659147 - RNA, 64 nt, Homo Sapiens
cugagaggaugacgacaacgcaaagguccaguuaggaaacgacgagcacggagauucucuccaa

SEQ ID NO: 659148 - RNA, 64 nt, Homo Sapiens
gcccgaggaaugcggucggauaguagggagcuggggaaacgacuauuuuaccaucugacguuuu

SEQ ID NO: 659149 - RNA, 64 nt, Homo Sapiens
ugcugggacccuugagaaacuuaaauuaacgaggggaaacgacaauuguaccuaggauuguaac

SEQ ID NO: 659150 - RNA, 64 nt, Homo Sapiens
acacuccaguggcagacaaacagaccauaaauaaggaaacgaugaaauaagauauauacaaggu

SEQ ID NO: 659151 - RNA, 64 nt, Homo Sapiens
ugccgcggaaaccugauuuuguacucucuuuuauggaaacgaucuguggcuguuuagaggcagc

SEQ ID NO: 659152 - RNA, 64 nt, Homo Sapiens
caggagccgcggaggaggacagugagggaggaauggaaacgagagaugugaaguuggcagccgg

SEQ ID NO: 659153 - RNA, 64 nt, Homo Sapiens
ucacugaaaguuaccgaaagagucgguuuaggaaggaaacgaagggucagugaacagagucaaa

SEQ ID NO: 659154 - RNA, 64 nt, Homo Sapiens
ugucaucagaagcugugagggacccacagauuuuggaaacgaccuggacacacuauugggaagg

SEQ ID NO: 659155 - RNA, 64 nt, Homo Sapiens
uauuuccuaaauaaccaggcaaagaugcacuuuaggaaacgaaauuuuacuaggcaaaucuuca

SEQ ID NO: 659156 - RNA, 64 nt, Homo Sapiens
gcucacuauuugugaggcagagaaucuguguagaggaaacgagacugagauccuggcccauagu

SEQ ID NO: 659157 - RNA, 64 nt, Homo Sapiens
gacuacauuaaacccaaaacuccugcacaacaaaggaaacgaucaccaaaaugaaaagguggac

SEQ ID NO: 659158 - RNA, 64 nt, Homo Sapiens
aaauuauaaguucauauauuugaaauaagauccuggaaacgaauuuaaauggugucaaacugca

SEQ ID NO: 659159 - RNA, 64 nt, Homo Sapiens
gccugcuggcugagauauggcucgaagcgcccgaggaaacgaggagcgucccaggcauagaaac

SEQ ID NO: 659160 - RNA, 64 nt, Homo Sapiens
ucgagucaagaagacuuuuauucaucacgaugcaggaaacgauuucuuaguuuucugcauacuu

SEQ ID NO: 659161 - RNA, 64 nt, Homo Sapiens
acguagggugugacugaaugcgcugaaagcaugaggaaacgaggagugcacugaggugucggaa

SEQ ID NO: 659162 - RNA, 64 nt, Homo Sapiens
agcuacaagcaagcagcguggcuggaagcugaugggaaacgacccggcacgggcauccugugug

SEQ ID NO: 659163 - RNA, 64 nt, Homo Sapiens
acagcugaacuuuucaucaucucauucacauuugggaaacgaacaggagaugagcaaagcugcu

SEQ ID NO: 659164 - RNA, 64 nt, Homo Sapiens
gagagaaauugauaagcuuuugcaagacugccggggaaacgacccuguggcugugagaaaguga

SEQ ID NO: 659165 - RNA, 64 nt, Homo Sapiens
cuuuccauuacaaguauuuuauauggacugcucaggaaacgagagucuuuucccauuuaucuaa

SEQ ID NO: 659166 - RNA, 64 nt, Homo Sapiens
acaggagcagaagcugggugggcugaagaggccuggaaacgagagucuuaauugaggagauggg

SEQ ID NO: 659167 - RNA, 64 nt, Homo Sapiens
cgaucuacacacauccacgcacaugcgaccccgaggaaacgaaacccacucuagaaaacgcgac

SEQ ID NO: 659168 - RNA, 64 nt, Homo Sapiens
gguaugacuguguucuggacaauggaaugugaggggaaacgauuuuuuguguccuuaaaauggc

SEQ ID NO: 659169 - RNA, 64 nt, Homo Sapiens
gacuccaaaguacaagggaggagcauugggaguaggaaacgaugauuuuauuuacugucuguga

SEQ ID NO: 659170 - RNA, 64 nt, Homo Sapiens
gccaacacauacuucuacuuuuucugacugauauggaaacgauuauugugaaaccggccuaauu

SEQ ID NO: 659171 - RNA, 64 nt, Homo Sapiens
cuuuggucaguuaccugggaauucugggcugccaggaaacgauuugggccucugucaguuucuu

SEQ ID NO: 659172 - RNA, 64 nt, Homo Sapiens
uaaaggaaaaugaaauacaauuagcagaauaaggggaaacgaguggucugcucugcucgggcaa

SEQ ID NO: 659173 - RNA, 64 nt, Homo Sapiens
agcaaauacacacacacacacauacucucacacaggaaacgaccuggaagaauauuuggugcuu

SEQ ID NO: 659174 - RNA, 64 nt, Homo Sapiens
auucaggcucuccuacuuggcagaaugaucuuggggaaacgacuucaucugaacuucagauauu

SEQ ID NO: 659175 - RNA, 64 nt, Homo Sapiens
gucuucacuccagccagcauucagcucuugauacggaaacgaguacgaugagcauuucuuaggc

SEQ ID NO: 659176 - RNA, 62 nt, Homo Sapiens
ccucuuucguuccuucuagaugcaccaggcgaggaaacgagacacaggaaacuucgcaguga

SEQ ID NO: 659177 - RNA, 64 nt, Homo Sapiens
gcagcacacagcgacuugcguugacaaaggaggaggaaacgauuacucuguaaacaaaguuauc

SEQ ID NO: 659178 - RNA, 64 nt, Homo Sapiens
uugggaagacaaaauugagccauuaucuccucuuggaaacgaaucuugccagaaaaacgggauu

SEQ ID NO: 659179 - RNA, 64 nt, Homo Sapiens
uggauauuccagcucaauuagugccacauaugggggaaacgacacaucccagugggauuuccaa

SEQ ID NO: 659180 - RNA, 64 nt, Homo Sapiens
ccaugcugccuccuccuggugaggcuacagcuguggaaacgaggagcguggaagcaggagggca

SEQ ID NO: 659181 - RNA, 64 nt, Homo Sapiens
cgguucaggggccugcggagcggguuggggcgggggaaacgauaguucugcagucugcgccuuu

SEQ ID NO: 659182 - RNA, 64 nt, Homo Sapiens
ccaacaccaccucuccagaggccaaggaggccuuggaaacgauucccccagucauucugggaac

SEQ ID NO: 659183 - RNA, 64 nt, Homo Sapiens
agaguuaagcucucggcuucagcagguugucucuggaaacgaccgggcgcaucccaagacagcc

SEQ ID NO: 659184 - RNA, 64 nt, Homo Sapiens
ggaccucagucuucuucagcugaccugcgacacaggaaacgaugucagccaccuggugaagaag

SEQ ID NO: 659185 - RNA, 64 nt, Homo Sapiens
uugugagugagcagagcagguuaugugcagacagggaaacgagaacuuuggaccuggcuuucug

SEQ ID NO: 659186 - RNA, 64 nt, Homo Sapiens
gggcgcauuguuguccgcuuccucggacgucuacggaaacgagccgucgugguugagaugauua

SEQ ID NO: 659187 - RNA, 64 nt, Homo Sapiens
gguaacuguuuacuacgacagagacguggcauuuggaaacgaaacuuagauguuucauggagcu

SEQ ID NO: 659188 - RNA, 64 nt, Homo Sapiens
uuguacagaagucagaacuugaccucugagaacuggaaacgaguuugggauggaacucccuacu

SEQ ID NO: 659189 - RNA, 64 nt, Homo Sapiens
ucccuauucccuuacccugucgcaccagucuugaggaaacgaucaauuauggcacagauugaug

SEQ ID NO: 659190 - RNA, 64 nt, Homo Sapiens
cccgcuuuccuaaccuugcugcuuucacagggugggaaacgaaauucgagggaaauuccccgga

SEQ ID NO: 659191 - RNA, 64 nt, Homo Sapiens; identical to SEQ ID NO: 482355

SEQ ID NO: 659192 - RNA, 64 nt, Homo Sapiens; identical to SEQ ID NO: 482356

SEQ ID NO: 659193 - RNA, 64 nt, Homo Sapiens; identical to SEQ ID NO: 482357

SEQ ID NO: 659194 - RNA, 64 nt, Homo Sapiens; identical to SEQ ID NO: 482358

SEQ ID NO: 659195 - RNA, 64 nt, Homo Sapiens; identical to SEQ ID NO: 482359

SEQ ID NO: 659196 - RNA, 64 nt, Homo Sapiens; identical to SEQ ID NO: 482360

SEQ ID NO: 659197 - RNA, 64 nt, Homo Sapiens; identical to SEQ ID NO: 482361

SEQ ID NO: 659198 - RNA, 64 nt, Homo Sapiens; identical to SEQ ID NO: 482362

SEQ ID NO: 659199 - RNA, 64 nt, Homo Sapiens; identical to SEQ ID NO: 482363

SEQ ID NO: 659200 - RNA, 64 nt, Homo Sapiens; identical to SEQ ID NO: 482364

SEQ ID NO: 659201 - RNA, 64 nt, Homo Sapiens; identical to SEQ ID NO: 482365

SEQ ID NO: 659202 - RNA, 64 nt, Homo Sapiens; identical to SEQ ID NO: 482366

SEQ ID NO: 659203 - RNA, 64 nt, Homo Sapiens; identical to SEQ ID NO: 482367

SEQ ID NO: 659204 - RNA, 64 nt, Homo Sapiens; identical to SEQ ID NO: 482368

SEQ ID NO: 659205 - RNA, 64 nt, Homo Sapiens; identical to SEQ ID NO: 482369

SEQ ID NO: 659206 - RNA, 64 nt, Homo Sapiens; identical to SEQ ID NO: 482370

SEQ ID NO: 659207 - RNA, 64 nt, Homo Sapiens; identical to SEQ ID NO: 482371

SEQ ID NO: 659208 - RNA, 64 nt, Homo Sapiens; identical to SEQ ID NO: 482372

SEQ ID NO: 659209 - RNA, 64 nt, Homo Sapiens; identical to SEQ ID NO: 482373

SEQ ID NO: 659210 - RNA, 64 nt, Homo Sapiens; identical to SEQ ID NO: 482374

SEQ ID NO: 659211 - RNA, 64 nt, Homo Sapiens; identical to SEQ ID NO: 482375

SEQ ID NO: 659212 - RNA, 64 nt, Homo Sapiens; identical to SEQ ID NO: 482376

SEQ ID NO: 659213 - RNA, 64 nt, Homo Sapiens; identical to SEQ ID NO: 482377

SEQ ID NO: 659214 - RNA, 64 nt, Homo Sapiens; identical to SEQ ID NO: 482378

SEQ ID NO: 659215 - RNA, 64 nt, Homo Sapiens; identical to SEQ ID NO: 482379

SEQ ID NO: 659216 - RNA, 64 nt, Homo Sapiens; identical to SEQ ID NO: 482380

SEQ ID NO: 659217 - RNA, 64 nt, Homo Sapiens; identical to SEQ ID NO: 482381

SEQ ID NO: 659218 - RNA, 64 nt, Homo Sapiens; identical to SEQ ID NO: 482382

SEQ ID NO: 659219 - RNA, 64 nt, Homo Sapiens; identical to SEQ ID NO: 482383

SEQ ID NO: 659220 - RNA, 64 nt, Homo Sapiens; identical to SEQ ID NO: 482384

SEQ ID NO: 659221 - RNA, 64 nt, Homo Sapiens; identical to SEQ ID NO: 482385

SEQ ID NO: 659222 - RNA, 64 nt, Homo Sapiens; identical to SEQ ID NO: 482386

SEQ ID NO: 659223 - RNA, 64 nt, Homo Sapiens; identical to SEQ ID NO: 482387

SEQ ID NO: 659224 - RNA, 64 nt, Homo Sapiens; identical to SEQ ID NO: 482388

SEQ ID NO: 659225 - RNA, 64 nt, Homo Sapiens; identical to SEQ ID NO: 482389

SEQ ID NO: 659226 - RNA, 64 nt, Homo Sapiens; identical to SEQ ID NO: 482390

SEQ ID NO: 659227 - RNA, 64 nt, Homo Sapiens; identical to SEQ ID NO: 482391

SEQ ID NO: 659228 - RNA, 64 nt, Homo Sapiens; identical to SEQ ID NO: 482392

SEQ ID NO: 659229 - RNA, 64 nt, Homo Sapiens; identical to SEQ ID NO: 482393

SEQ ID NO: 659230 - RNA, 64 nt, Homo Sapiens; identical to SEQ ID NO: 482394

SEQ ID NO: 659231 - RNA, 64 nt, Homo Sapiens; identical to SEQ ID NO: 482395

SEQ ID NO: 659232 - RNA, 64 nt, Homo Sapiens; identical to SEQ ID NO: 482396

SEQ ID NO: 659233 - RNA, 64 nt, Homo Sapiens; identical to SEQ ID NO: 482397

SEQ ID NO: 659234 - RNA, 64 nt, Homo Sapiens; identical to SEQ ID NO: 482398

SEQ ID NO: 659235 - RNA, 64 nt, Homo Sapiens; identical to SEQ ID NO: 482399

SEQ ID NO: 659236 - RNA, 64 nt, Homo Sapiens; identical to SEQ ID NO: 482400

SEQ ID NO: 659237 - RNA, 64 nt, Homo Sapiens; identical to SEQ ID NO: 482401

SEQ ID NO: 659238 - RNA, 64 nt, Homo Sapiens; identical to SEQ ID NO: 482402

SEQ ID NO: 659239 - RNA, 64 nt, Homo Sapiens; identical to SEQ ID NO: 482403

SEQ ID NO: 659240 - RNA, 64 nt, Homo Sapiens; identical to SEQ ID NO: 482404

SEQ ID NO: 659241 - RNA, 64 nt, Homo Sapiens; identical to SEQ ID NO: 482405

SEQ ID NO: 659242 - RNA, 64 nt, Homo Sapiens; identical to SEQ ID NO: 482406

SEQ ID NO: 659243 - RNA, 62 nt, Homo Sapiens
agagaugugcauguggguauuguuaggaaaugucaucaaacuccacccaccuggcuucauac

SEQ ID NO: 659244 - RNA, 62 nt, Homo Sapiens
cacacaaugcccaacuuacugucuucuucaugucaucaaaaucugcacagucacuggcccaa

SEQ ID NO: 659245 - RNA, 62 nt, Homo Sapiens
uacuauaaaaaacauucaagacuggcugcucuucaucaaacccccuaugacauuucuacauc

SEQ ID NO: 659246 - RNA, 62 nt, Homo Sapiens
uguauagaauauuauaguuuaauacauggcuaucaucaaaagaaaaacauaaauaauaccau

SEQ ID NO: 659247 - RNA, 62 nt, Homo Sapiens
uaauuuguguagauuuuugcaagcuuuccauaucaucaaaacugaauguuugaugcuaugaa

SEQ ID NO: 659248 - RNA, 62 nt, Homo Sapiens
gagaucauaaguguuaauguuaaccuaguaaaucaucaaaauauucaccuucagggggcuga

SEQ ID NO: 659249 - RNA, 62 nt, Homo Sapiens
uagcuaacauggguauuuuuugugcacagacaucaucaaaauugguuaguuuguucagaugu

SEQ ID NO: 659250 - RNA, 62 nt, Homo Sapiens
auacuauauagagaaucuuagcuguauaaaugucaucaaacuguaguacuucaaagaagaua

SEQ ID NO: 659251 - RNA, 62 nt, Homo Sapiens
aaagcugugauuauaucaaaaauccagauaaaucaucaaauauaucagauuaagaccagggu

SEQ ID NO: 659252 - RNA, 62 nt, Homo Sapiens
auucucacaauauagguuuuggggcuuccauaucaucaaaagacugaaaaauuauaauuuua

SEQ ID NO: 659253 - RNA, 62 nt, Homo Sapiens
aacuccuagcaccacggggaagaauagagguaucaucaaacguggcaaauuuucuuucagga

SEQ ID NO: 659254 - RNA, 62 nt, Homo Sapiens
cuugacaauuuacuuaacaaguaaccaguaguucaucaaaaccaacuuguacagacuaauaa

SEQ ID NO: 659255 - RNA, 62 nt, Homo Sapiens
uguuacuaaaccagccuagugaagaggcacguucaucaaaccgcuaccaguaagacaagugg

SEQ ID NO: 659256 - RNA, 62 nt, Homo Sapiens
uucccacucccuacuucugcugaggaaacugaucaucaaaaguucccucucuccugccuuua

SEQ ID NO: 659257 - RNA, 62 nt, Homo Sapiens
cccacucugaccccacuaaaaugaccccugauucaucaaaagugaggccuagaauuacccua

SEQ ID NO: 659258 - RNA, 62 nt, Homo Sapiens
guaucauuaucaguuacaaauugaguuauucuucaucaaaugacuuuuggaguagagauuuu

SEQ ID NO: 659259 - RNA, 62 nt, Homo Sapiens
gcaagugggguuuaaacagacccacagucuacucaucaaaccagguguccuuggcauugugu

SEQ ID NO: 659260 - RNA, 62 nt, Homo Sapiens
ucucagaggauacauuuguaaccauuacacagucaucaaaggaauaauuuuuuuuaaucacc

SEQ ID NO: 659261 - RNA, 62 nt, Homo Sapiens
aaaacacagcaaacauaaaaaguuguuacacuucaucaaaaguacaaaguucuguucaucaa

SEQ ID NO: 659262 - RNA, 62 nt, Homo Sapiens
uguuacacuucaucaaaaguacaaaguucuguucaucaaaugaugcuguuaagauagggaaa

SEQ ID NO: 659263 - RNA, 62 nt, Homo Sapiens
caggugguuaaucugacauaucaaaaauauugucaucaaauauguuuaaaaaauugagcuca

SEQ ID NO: 659264 - RNA, 62 nt, Homo Sapiens
uauugucaucaaauacagguaaaaaauugagcucaucaaaaaaguaauaguauugacuguuu

SEQ ID NO: 659265 - RNA, 64 nt, Homo Sapiens; identical to SEQ ID NO: 86193

SEQ ID NO: 659266 - RNA, 64 nt, Homo Sapiens; identical to SEQ ID NO: 86194

SEQ ID NO: 659267 - RNA, 64 nt, Homo Sapiens; identical to SEQ ID NO: 86195

SEQ ID NO: 659268 - RNA, 64 nt, Homo Sapiens; identical to SEQ ID NO: 86196

SEQ ID NO: 659269 - RNA, 64 nt, Homo Sapiens; identical to SEQ ID NO: 86197

SEQ ID NO: 659270 - RNA, 64 nt, Homo Sapiens; identical to SEQ ID NO: 86198

SEQ ID NO: 659271 - RNA, 64 nt, Homo Sapiens; identical to SEQ ID NO: 86199

SEQ ID NO: 659272 - RNA, 64 nt, Homo Sapiens; identical to SEQ ID NO: 86200

SEQ ID NO: 659273 - RNA, 61 nt, Homo Sapiens
uacccaugugagacaugaacaacaggagggagggaaagagcccaggugggacgugggacag

SEQ ID NO: 659274 - RNA, 61 nt, Homo Sapiens
agagcccaggugggacgugggacaggcuuaggggaaagagcuuguccuaucucaggaacaa

SEQ ID NO: 659275 - RNA, 61 nt, Homo Sapiens
acacacacacacacacuuuugcaagagugaugggaaagacccuaggugcucauaacuagag

SEQ ID NO: 659276 - RNA, 61 nt, Homo Sapiens
cuauaugccuauauuuauaaaccagcagcaggggaaagauuauauuuuauaagagggaaca

SEQ ID NO: 659277 - RNA, 61 nt, Homo Sapiens
uugcuaagugugcuuaguuuaagauaggauugggaaagaaguggcaccaggcaaacgaaua

SEQ ID NO: 659278 - RNA, 61 nt, Homo Sapiens
uagguucuguuuuguuuugugcaaaggaugggggaaagaagugaggagggaaugauuggua

SEQ ID NO: 659279 - RNA, 61 nt, Homo Sapiens
ccuuuaaaacuaucaugguuauaauucuauugggaaagacuuuuagauaacaaagauuuca

SEQ ID NO: 659280 - RNA, 61 nt, Homo Sapiens
aaacuuacugauauauuggacuuugagccaagggaaagaaugaguacuaucuuuccagaua

SEQ ID NO: 659281 - RNA, 61 nt, Homo Sapiens
acuggauugcucuuuauccagcccacagcaggggaaagaaaggcaacucgcaaagaugaga

SEQ ID NO: 659282 - RNA, 61 nt, Homo Sapiens
auccugccugaauggggaagucuucuaaaaugggaaagaagugguuucaucuccacacagu

SEQ ID NO: 659283 - RNA, 61 nt, Homo Sapiens
caccacuggacgggaaggagaacagaggagagggaaagagaagcccaaccucugugaucau

SEQ ID NO: 659284 - RNA, 61 nt, Homo Sapiens
caaggaauaagcaugaaugacaagaaaacaagggaaagaguuaaccugucacauagcaggu

SEQ ID NO: 659285 - RNA, 61 nt, Homo Sapiens
ggcccccaugauucaauuacgagaauagcacgggaaagacuugagacuuauucacugucac

SEQ ID NO: 659286 - RNA, 61 nt, Homo Sapiens
ggcccccaugauucaauuacaagaauagcaugggaaagacuugaaacuuauucacuaucac

SEQ ID NO: 659287 - RNA, 61 nt, Homo Sapiens
aaacucgcccuaggcccuagguucagucccagggaaagagacccuuuagugcuuugugaua

SEQ ID NO: 659288 - RNA, 61 nt, Homo Sapiens
ucugaauucaacacagagaagccccgacugugggaaagacaagagagggacgacauccugu

SEQ ID NO: 659289 - RNA, 61 nt, Homo Sapiens
cugcucagcagcucagcugauucagaucagagggaaagaaauaccaacccugcaauaagug

SEQ ID NO: 659290 - RNA, 61 nt, Homo Sapiens
aaaaagcaaaauuggccugaauauucucuuggggaaagagggcaccaaagaaaaggguaag

SEQ ID NO: 659291 - RNA, 61 nt, Homo Sapiens
ucuuccugccaucauuccuccuuuucccacagggaaagaaaaguuggaucacuaguggcca

SEQ ID NO: 659292 - RNA, 61 nt, Homo Sapiens
ucuucaccugcucuaggugcaaaggcauguugggaaagagauggauguuggggaggaagag

SEQ ID NO: 659293 - RNA, 61 nt, Homo Sapiens
guagacuucuuuauguggcucaguggagagagggaaagaauguugcaccugcucuaguacc

SEQ ID NO: 659294 - RNA, 61 nt, Homo Sapiens
gcaggaggcagugaugucccuggucuauucagggaaagauuucagugugaaaugguaaaca

SEQ ID NO: 659295 - RNA, 61 nt, Homo Sapiens
aguugaugauagauugccuuggagcauaucagggaaagaaacacccaccccucuuuauucu

SEQ ID NO: 659296 - RNA, 61 nt, Homo Sapiens
ucagguuccuuuaaucacagauguaggcugagggaaagacgaggccuggagcugggaugca

SEQ ID NO: 659297 - RNA, 55 nt, Homo Sapiens; identical to SEQ ID NO: 235846

SEQ ID NO: 659298 - RNA, 61 nt, Homo Sapiens
ccuucaucugggacaaaacuggagaugcaucgggaaagaagaaacuccgaagaaaagaauu

SEQ ID NO: 659299 - RNA, 61 nt, Homo Sapiens
uuuucuucuaguaagugucaauuagagaaaagggaaagaccuaccucagcagaagacuaga

SEQ ID NO: 659300 - RNA, 61 nt, Homo Sapiens
acacuacaugccuguugauuuucacuguggugggaaagaucuuggacaaagaaucccucug

SEQ ID NO: 659301 - RNA, 61 nt, Homo Sapiens
aaggggacggggucugugagagucaauucaggggaaagauacaagauugauuuguaaaacc

SEQ ID NO: 659302 - RNA, 61 nt, Homo Sapiens
ggaaauggcccaaugaacgugguugugggaggggaaagaggaaacagagcuagucagaugu

SEQ ID NO: 659303 - RNA, 61 nt, Homo Sapiens
cauuuguaggauuauuucgagggcagggcaggggaaagaaacgcguuaaagggccaugaca

SEQ ID NO: 659304 - RNA, 61 nt, Homo Sapiens
ggagggcaggauucucagguccccauagagagggaaagagaagaccagaugugcauagaag

SEQ ID NO: 659305 - RNA, 61 nt, Homo Sapiens
caaguugggcaggauauggccaggaggaauggggaaagaagaagaacccuugugaaguaac

SEQ ID NO: 659306 - RNA, 61 nt, Homo Sapiens
cuaaagacuucgugugauugcuguuugccaggggaaagaacuccucccaaucccacaccuc

SEQ ID NO: 659307 - RNA, 61 nt, Homo Sapiens
auauuccauagguuuagggccucccuuuauagggaaagaccaggucccucagaccugggac

SEQ ID NO: 659308 - RNA, 61 nt, Homo Sapiens
cuuuauggaauguaagaagaggacaagagaggggaaagaugugacauccuucagcacccag

SEQ ID NO: 659309 - RNA, 61 nt, Homo Sapiens
auguuauuucucccuaagucaacacaaaaaagggaaagaaacugcuuuggaaauuauucua

SEQ ID NO: 659310 - RNA, 61 nt, Homo Sapiens
gggcaggggcugcugggacagcagaggggcugggaaagaggggaggagggacucuggagua

SEQ ID NO: 659311 - RNA, 61 nt, Homo Sapiens
aaugacuauccugaacaggguggaggggugugggaaagaaaccagccauauugguuuuggu

SEQ ID NO: 659312 - RNA, 61 nt, Homo Sapiens
cccuagaaauuggcucaccuugggaaacccagggaaagaaucagcagguucucugcccucc

SEQ ID NO: 659313 - RNA, 61 nt, Homo Sapiens
aauuuucagcagaaaacauucccuuaugauugggaaagaugcaaguugcauauuugguuuc

SEQ ID NO: 659314 - RNA, 61 nt, Homo Sapiens
aacaagugacugagaagucugaaaagugaaagggaaagagauuguuuucaaaagcacaaag

SEQ ID NO: 659315 - RNA, 61 nt, Homo Sapiens
cucgggccgcuccccugcgcagaccuacagagggaaagaccggauguuccuacagagggaa

SEQ ID NO: 659316 - RNA, 61 nt, Homo Sapiens
uacagagggaaagacccucgguuccuacagagggaaagaccgcuuccagaaucuucuggau

SEQ ID NO: 659317 - RNA, 61 nt, Homo Sapiens
agagcagaaaagaagcacauccuaagauucagggaaagacuaacugugaaaaggaaggcug

SEQ ID NO: 659318 - RNA, 61 nt, Homo Sapiens
gugccucugaggauuaggguugagcacucaagggaaagauggaguagagggcaaauagcaa

SEQ ID NO: 659319 - RNA, 61 nt, Homo Sapiens
agcagaauacuugagaugaaguuugucuguggggaaagaaaugcuguaaagaacaacacuu

SEQ ID NO: 659320 - RNA, 61 nt, Homo Sapiens
ucugcuguaaagaacaacacugguauguagagggaaagaggaguuaugcgaguggauagau

SEQ ID NO: 659321 - RNA, 61 nt, Homo Sapiens
auuacugauaaaugaaggggaagaagggacagggaaagauacagaugaugggaaggcaagg

SEQ ID NO: 659322 - RNA, 61 nt, Homo Sapiens
ggguguguguccgcaucccccuaggggaguugggaaagagucaagucagcucugccaacug

SEQ ID NO: 659323 - RNA, 61 nt, Homo Sapiens
aucuuucccguggagcaacuuccugcuccacgggaaagaggucgauggauuuaccccugga

SEQ ID NO: 659324 - RNA, 61 nt, Homo Sapiens
aauuguacauuuauuuuuuaaaacucaaagagggaaagagccuuguaucauaugugaacau

SEQ ID NO: 659325 - RNA, 61 nt, Homo Sapiens
cagcacagcggccugcuggacucugagaacugggaaagaucagagcaagccuugccucuua

SEQ ID NO: 659326 - RNA, 61 nt, Homo Sapiens
uggaguugaccagagaaaggggagagaauucgggaaagacccaaaguguuuguaauucuuc

SEQ ID NO: 659327 - RNA, 61 nt, Homo Sapiens
aagggcaccguggguguaagagguggagagggggaaagaggugccugcagguugccuggcc

SEQ ID NO: 659328 - RNA, 61 nt, Homo Sapiens
cugauaugaggaagggucuggccaggcagaggggaaagaagagaagcccagcagaagcuga

SEQ ID NO: 659329 - RNA, 61 nt, Homo Sapiens
gcugccauuccugacagccuaugaaggaagagggaaagaggagacccagucuguuggagcc

SEQ ID NO: 659330 - RNA, 61 nt, Homo Sapiens
caccucauucggcaccaaaaaguucacacuagggaaagaacuuacaaaugcagcaaaugug

SEQ ID NO: 659331 - RNA, 61 nt, Homo Sapiens
ccagauaaagaauguauauauaaagcagauggggaaagacuucacacagaaaucuacucug

SEQ ID NO: 659332 - RNA, 61 nt, Homo Sapiens
aagcccuggugguaccagaggccagaauggugggaaagacagauccagauaaugcugggaa

SEQ ID NO: 659333 - RNA, 61 nt, Homo Sapiens
uucgauggccccaaagcugggccagaguuaagggaaagaggaggaaguccuaagcagagaa

SEQ ID NO: 659334 - RNA, 61 nt, Homo Sapiens
agagccacagaaaaagaagaauuccaggagagggaaagaucguaaggaugagagaggagac

SEQ ID NO: 659335 - RNA, 61 nt, Homo Sapiens
guccucucccaaguggcugaggcaggcuuaggggaaagaaccagaggggcaggggaggacu

SEQ ID NO: 659336 - RNA, 61 nt, Homo Sapiens
ucuucucuagaauaaaucaggagacaaaauggggaaagaugaaaauauccaguguaaaguu

SEQ ID NO: 659337 - RNA, 61 nt, Homo Sapiens
ugacaggaauguaaaaugguacagccacucugggaaagaguuuaugaauuucuuaucaagu

SEQ ID NO: 659338 - RNA, 64 nt, Homo Sapiens; identical to SEQ ID NO: 118878

SEQ ID NO: 659339 - RNA, 64 nt, Homo Sapiens; identical to SEQ ID NO: 118879

SEQ ID NO: 659340 - RNA, 64 nt, Homo Sapiens; identical to SEQ ID NO: 118880

SEQ ID NO: 659341 - RNA, 64 nt, Homo Sapiens; identical to SEQ ID NO: 118881

SEQ ID NO: 659342 - RNA, 64 nt, Homo Sapiens; identical to SEQ ID NO: 118882

SEQ ID NO: 659343 - RNA, 64 nt, Homo Sapiens; identical to SEQ ID NO: 118883

SEQ ID NO: 659344 - RNA, 64 nt, Homo Sapiens; identical to SEQ ID NO: 118884

SEQ ID NO: 659345 - RNA, 64 nt, Homo Sapiens; identical to SEQ ID NO: 118885

SEQ ID NO: 659346 - RNA, 64 nt, Homo Sapiens; identical to SEQ ID NO: 118886

SEQ ID NO: 659347 - RNA, 64 nt, Homo Sapiens; identical to SEQ ID NO: 118887

SEQ ID NO: 659348 - RNA, 64 nt, Homo Sapiens; identical to SEQ ID NO: 118888

SEQ ID NO: 659349 - RNA, 64 nt, Homo Sapiens; identical to SEQ ID NO: 118889

SEQ ID NO: 659350 - RNA, 64 nt, Homo Sapiens; identical to SEQ ID NO: 118890

SEQ ID NO: 659351 - RNA, 56 nt, Homo Sapiens; identical to SEQ ID NO: 118891

SEQ ID NO: 659352 - RNA, 64 nt, Homo Sapiens; identical to SEQ ID NO: 302004

SEQ ID NO: 659353 - RNA, 64 nt, Homo Sapiens; identical to SEQ ID NO: 302005

SEQ ID NO: 659354 - RNA, 64 nt, Homo Sapiens; identical to SEQ ID NO: 302006

SEQ ID NO: 659355 - RNA, 64 nt, Homo Sapiens; identical to SEQ ID NO: 302007

SEQ ID NO: 659356 - RNA, 64 nt, Homo Sapiens; identical to SEQ ID NO: 302008

SEQ ID NO: 659357 - RNA, 64 nt, Homo Sapiens; identical to SEQ ID NO: 302009

SEQ ID NO: 659358 - RNA, 64 nt, Homo Sapiens; identical to SEQ ID NO: 302010

SEQ ID NO: 659359 - RNA, 64 nt, Homo Sapiens; identical to SEQ ID NO: 302011

SEQ ID NO: 659360 - RNA, 64 nt, Homo Sapiens; identical to SEQ ID NO: 196466

SEQ ID NO: 659361 - RNA, 64 nt, Homo Sapiens; identical to SEQ ID NO: 196467

SEQ ID NO: 659362 - RNA, 64 nt, Homo Sapiens; identical to SEQ ID NO: 196468

SEQ ID NO: 659363 - RNA, 64 nt, Homo Sapiens; identical to SEQ ID NO: 196469

SEQ ID NO: 659364 - RNA, 64 nt, Homo Sapiens; identical to SEQ ID NO: 196470

SEQ ID NO: 659365 - RNA, 64 nt, Homo Sapiens; identical to SEQ ID NO: 196471

SEQ ID NO: 659366 - RNA, 64 nt, Homo Sapiens; identical to SEQ ID NO: 196472

SEQ ID NO: 659367 - RNA, 64 nt, Homo Sapiens; identical to SEQ ID NO: 196473

SEQ ID NO: 659368 - RNA, 64 nt, Homo Sapiens; identical to SEQ ID NO: 196474

SEQ ID NO: 659369 - RNA, 64 nt, Homo Sapiens; identical to SEQ ID NO: 196475

SEQ ID NO: 659370 - RNA, 64 nt, Homo Sapiens; identical to SEQ ID NO: 196476

SEQ ID NO: 659371 - RNA, 64 nt, Homo Sapiens; identical to SEQ ID NO: 196477

SEQ ID NO: 659372 - RNA, 64 nt, Homo Sapiens; identical to SEQ ID NO: 196478

SEQ ID NO: 659373 - RNA, 64 nt, Homo Sapiens; identical to SEQ ID NO: 196479

SEQ ID NO: 659374 - RNA, 64 nt, Homo Sapiens; identical to SEQ ID NO: 196480

SEQ ID NO: 659375 - RNA, 64 nt, Homo Sapiens; identical to SEQ ID NO: 196481

SEQ ID NO: 659376 - RNA, 64 nt, Homo Sapiens; identical to SEQ ID NO: 196482

SEQ ID NO: 659377 - RNA, 64 nt, Homo Sapiens; identical to SEQ ID NO: 196483

SEQ ID NO: 659378 - RNA, 64 nt, Homo Sapiens; identical to SEQ ID NO: 196484

SEQ ID NO: 659379 - RNA, 64 nt, Homo Sapiens; identical to SEQ ID NO: 302562

SEQ ID NO: 659380 - RNA, 64 nt, Homo Sapiens; identical to SEQ ID NO: 302563

SEQ ID NO: 659381 - RNA, 64 nt, Homo Sapiens; identical to SEQ ID NO: 302564

SEQ ID NO: 659382 - RNA, 64 nt, Homo Sapiens; identical to SEQ ID NO: 302565

SEQ ID NO: 659383 - RNA, 64 nt, Homo Sapiens; identical to SEQ ID NO: 302566

SEQ ID NO: 659384 - RNA, 64 nt, Homo Sapiens; identical to SEQ ID NO: 302567

SEQ ID NO: 659385 - RNA, 64 nt, Homo Sapiens; identical to SEQ ID NO: 302568

SEQ ID NO: 659386 - RNA, 64 nt, Homo Sapiens; identical to SEQ ID NO: 302569

SEQ ID NO: 659387 - RNA, 64 nt, Homo Sapiens; identical to SEQ ID NO: 302570

SEQ ID NO: 659388 - RNA, 64 nt, Homo Sapiens; identical to SEQ ID NO: 302571

SEQ ID NO: 659389 - RNA, 64 nt, Homo Sapiens; identical to SEQ ID NO: 302572

SEQ ID NO: 659390 - RNA, 64 nt, Homo Sapiens; identical to SEQ ID NO: 302573

SEQ ID NO: 659391 - RNA, 64 nt, Homo Sapiens; identical to SEQ ID NO: 302574

SEQ ID NO: 659392 - RNA, 64 nt, Homo Sapiens; identical to SEQ ID NO: 302575

SEQ ID NO: 659393 - RNA, 64 nt, Homo Sapiens; identical to SEQ ID NO: 302576

SEQ ID NO: 659394 - RNA, 64 nt, Homo Sapiens; identical to SEQ ID NO: 302577

SEQ ID NO: 659395 - RNA, 64 nt, Homo Sapiens; identical to SEQ ID NO: 302578

SEQ ID NO: 659396 - RNA, 64 nt, Homo Sapiens; identical to SEQ ID NO: 302579

SEQ ID NO: 659397 - RNA, 64 nt, Homo Sapiens; identical to SEQ ID NO: 302580

SEQ ID NO: 659398 - RNA, 64 nt, Homo Sapiens; identical to SEQ ID NO: 302581

SEQ ID NO: 659399 - RNA, 64 nt, Homo Sapiens; identical to SEQ ID NO: 196466

SEQ ID NO: 659400 - RNA, 64 nt, Homo Sapiens; identical to SEQ ID NO: 196467

SEQ ID NO: 659401 - RNA, 64 nt, Homo Sapiens; identical to SEQ ID NO: 196468

SEQ ID NO: 659402 - RNA, 64 nt, Homo Sapiens; identical to SEQ ID NO: 196469

SEQ ID NO: 659403 - RNA, 64 nt, Homo Sapiens; identical to SEQ ID NO: 196470

SEQ ID NO: 659404 - RNA, 64 nt, Homo Sapiens; identical to SEQ ID NO: 196471

SEQ ID NO: 659405 - RNA, 64 nt, Homo Sapiens; identical to SEQ ID NO: 196472

SEQ ID NO: 659406 - RNA, 64 nt, Homo Sapiens; identical to SEQ ID NO: 196473

SEQ ID NO: 659407 - RNA, 64 nt, Homo Sapiens; identical to SEQ ID NO: 196474

SEQ ID NO: 659408 - RNA, 64 nt, Homo Sapiens; identical to SEQ ID NO: 196475

SEQ ID NO: 659409 - RNA, 64 nt, Homo Sapiens; identical to SEQ ID NO: 196476

SEQ ID NO: 659410 - RNA, 64 nt, Homo Sapiens; identical to SEQ ID NO: 196477

SEQ ID NO: 659411 - RNA, 64 nt, Homo Sapiens; identical to SEQ ID NO: 196478

SEQ ID NO: 659412 - RNA, 64 nt, Homo Sapiens; identical to SEQ ID NO: 196479

SEQ ID NO: 659413 - RNA, 64 nt, Homo Sapiens; identical to SEQ ID NO: 196480

SEQ ID NO: 659414 - RNA, 64 nt, Homo Sapiens; identical to SEQ ID NO: 196481

SEQ ID NO: 659415 - RNA, 64 nt, Homo Sapiens; identical to SEQ ID NO: 196482

SEQ ID NO: 659416 - RNA, 64 nt, Homo Sapiens; identical to SEQ ID NO: 196483

SEQ ID NO: 659417 - RNA, 64 nt, Homo Sapiens; identical to SEQ ID NO: 196484

SEQ ID NO: 659418 - RNA, 64 nt, Homo Sapiens; identical to SEQ ID NO: 302562

SEQ ID NO: 659419 - RNA, 64 nt, Homo Sapiens; identical to SEQ ID NO: 302563

SEQ ID NO: 659420 - RNA, 64 nt, Homo Sapiens; identical to SEQ ID NO: 302564

SEQ ID NO: 659421 - RNA, 64 nt, Homo Sapiens; identical to SEQ ID NO: 302565

SEQ ID NO: 659422 - RNA, 64 nt, Homo Sapiens; identical to SEQ ID NO: 302566

SEQ ID NO: 659423 - RNA, 64 nt, Homo Sapiens; identical to SEQ ID NO: 302567

SEQ ID NO: 659424 - RNA, 64 nt, Homo Sapiens; identical to SEQ ID NO: 302568

SEQ ID NO: 659425 - RNA, 64 nt, Homo Sapiens; identical to SEQ ID NO: 302569

SEQ ID NO: 659426 - RNA, 64 nt, Homo Sapiens; identical to SEQ ID NO: 302570

SEQ ID NO: 659427 - RNA, 64 nt, Homo Sapiens; identical to SEQ ID NO: 302571

SEQ ID NO: 659428 - RNA, 64 nt, Homo Sapiens; identical to SEQ ID NO: 302572

SEQ ID NO: 659429 - RNA, 64 nt, Homo Sapiens; identical to SEQ ID NO: 302573

SEQ ID NO: 659430 - RNA, 64 nt, Homo Sapiens; identical to SEQ ID NO: 302574

SEQ ID NO: 659431 - RNA, 64 nt, Homo Sapiens; identical to SEQ ID NO: 302575

SEQ ID NO: 659432 - RNA, 64 nt, Homo Sapiens; identical to SEQ ID NO: 302576

SEQ ID NO: 659433 - RNA, 64 nt, Homo Sapiens; identical to SEQ ID NO: 302577

SEQ ID NO: 659434 - RNA, 64 nt, Homo Sapiens; identical to SEQ ID NO: 302578

SEQ ID NO: 659435 - RNA, 64 nt, Homo Sapiens; identical to SEQ ID NO: 302579

SEQ ID NO: 659436 - RNA, 64 nt, Homo Sapiens; identical to SEQ ID NO: 302580

SEQ ID NO: 659437 - RNA, 64 nt, Homo Sapiens; identical to SEQ ID NO: 302581

SEQ ID NO: 659438 - RNA, 64 nt, Homo Sapiens; identical to SEQ ID NO: 196466

SEQ ID NO: 659439 - RNA, 64 nt, Homo Sapiens; identical to SEQ ID NO: 196467

SEQ ID NO: 659440 - RNA, 64 nt, Homo Sapiens; identical to SEQ ID NO: 196468

SEQ ID NO: 659441 - RNA, 64 nt, Homo Sapiens; identical to SEQ ID NO: 196469

SEQ ID NO: 659442 - RNA, 64 nt, Homo Sapiens; identical to SEQ ID NO: 196470

SEQ ID NO: 659443 - RNA, 64 nt, Homo Sapiens; identical to SEQ ID NO: 196471

SEQ ID NO: 659444 - RNA, 64 nt, Homo Sapiens; identical to SEQ ID NO: 196472

SEQ ID NO: 659445 - RNA, 64 nt, Homo Sapiens; identical to SEQ ID NO: 196473

SEQ ID NO: 659446 - RNA, 64 nt, Homo Sapiens; identical to SEQ ID NO: 196474

SEQ ID NO: 659447 - RNA, 64 nt, Homo Sapiens; identical to SEQ ID NO: 196475

SEQ ID NO: 659448 - RNA, 64 nt, Homo Sapiens; identical to SEQ ID NO: 196476

SEQ ID NO: 659449 - RNA, 64 nt, Homo Sapiens; identical to SEQ ID NO: 196477

SEQ ID NO: 659450 - RNA, 64 nt, Homo Sapiens; identical to SEQ ID NO: 196478

SEQ ID NO: 659451 - RNA, 64 nt, Homo Sapiens; identical to SEQ ID NO: 196479

SEQ ID NO: 659452 - RNA, 64 nt, Homo Sapiens; identical to SEQ ID NO: 196480

SEQ ID NO: 659453 - RNA, 64 nt, Homo Sapiens; identical to SEQ ID NO: 196481

SEQ ID NO: 659454 - RNA, 64 nt, Homo Sapiens; identical to SEQ ID NO: 196482

SEQ ID NO: 659455 - RNA, 64 nt, Homo Sapiens; identical to SEQ ID NO: 196483

SEQ ID NO: 659456 - RNA, 64 nt, Homo Sapiens; identical to SEQ ID NO: 196484

SEQ ID NO: 659457 - RNA, 64 nt, Homo Sapiens; identical to SEQ ID NO: 302562

SEQ ID NO: 659458 - RNA, 64 nt, Homo Sapiens; identical to SEQ ID NO: 302563

SEQ ID NO: 659459 - RNA, 64 nt, Homo Sapiens; identical to SEQ ID NO: 302564

SEQ ID NO: 659460 - RNA, 64 nt, Homo Sapiens; identical to SEQ ID NO: 302565

SEQ ID NO: 659461 - RNA, 64 nt, Homo Sapiens; identical to SEQ ID NO: 302566

SEQ ID NO: 659462 - RNA, 64 nt, Homo Sapiens; identical to SEQ ID NO: 302567

SEQ ID NO: 659463 - RNA, 64 nt, Homo Sapiens; identical to SEQ ID NO: 302568

SEQ ID NO: 659464 - RNA, 64 nt, Homo Sapiens; identical to SEQ ID NO: 302569

SEQ ID NO: 659465 - RNA, 64 nt, Homo Sapiens; identical to SEQ ID NO: 302570

SEQ ID NO: 659466 - RNA, 64 nt, Homo Sapiens; identical to SEQ ID NO: 302571

SEQ ID NO: 659467 - RNA, 64 nt, Homo Sapiens; identical to SEQ ID NO: 302572

SEQ ID NO: 659468 - RNA, 64 nt, Homo Sapiens; identical to SEQ ID NO: 302573

SEQ ID NO: 659469 - RNA, 64 nt, Homo Sapiens; identical to SEQ ID NO: 302574

SEQ ID NO: 659470 - RNA, 64 nt, Homo Sapiens; identical to SEQ ID NO: 302575

SEQ ID NO: 659471 - RNA, 64 nt, Homo Sapiens; identical to SEQ ID NO: 302576

SEQ ID NO: 659472 - RNA, 64 nt, Homo Sapiens; identical to SEQ ID NO: 302577

SEQ ID NO: 659473 - RNA, 64 nt, Homo Sapiens; identical to SEQ ID NO: 302578

SEQ ID NO: 659474 - RNA, 64 nt, Homo Sapiens; identical to SEQ ID NO: 302579

SEQ ID NO: 659475 - RNA, 64 nt, Homo Sapiens; identical to SEQ ID NO: 302580

SEQ ID NO: 659476 - RNA, 64 nt, Homo Sapiens; identical to SEQ ID NO: 302581

SEQ ID NO: 659477 - RNA, 64 nt, Homo Sapiens; identical to SEQ ID NO: 196466

SEQ ID NO: 659478 - RNA, 64 nt, Homo Sapiens; identical to SEQ ID NO: 196467

SEQ ID NO: 659479 - RNA, 64 nt, Homo Sapiens; identical to SEQ ID NO: 196468

SEQ ID NO: 659480 - RNA, 64 nt, Homo Sapiens; identical to SEQ ID NO: 196469

SEQ ID NO: 659481 - RNA, 64 nt, Homo Sapiens; identical to SEQ ID NO: 196470

SEQ ID NO: 659482 - RNA, 64 nt, Homo Sapiens; identical to SEQ ID NO: 196471

SEQ ID NO: 659483 - RNA, 64 nt, Homo Sapiens; identical to SEQ ID NO: 196472

SEQ ID NO: 659484 - RNA, 64 nt, Homo Sapiens; identical to SEQ ID NO: 196473

SEQ ID NO: 659485 - RNA, 64 nt, Homo Sapiens; identical to SEQ ID NO: 196474

SEQ ID NO: 659486 - RNA, 64 nt, Homo Sapiens; identical to SEQ ID NO: 196475

SEQ ID NO: 659487 - RNA, 64 nt, Homo Sapiens; identical to SEQ ID NO: 196476

SEQ ID NO: 659488 - RNA, 64 nt, Homo Sapiens; identical to SEQ ID NO: 196477

SEQ ID NO: 659489 - RNA, 64 nt, Homo Sapiens; identical to SEQ ID NO: 196478

SEQ ID NO: 659490 - RNA, 64 nt, Homo Sapiens; identical to SEQ ID NO: 196479

SEQ ID NO: 659491 - RNA, 64 nt, Homo Sapiens; identical to SEQ ID NO: 196480

SEQ ID NO: 659492 - RNA, 64 nt, Homo Sapiens; identical to SEQ ID NO: 196481

SEQ ID NO: 659493 - RNA, 64 nt, Homo Sapiens; identical to SEQ ID NO: 196482

SEQ ID NO: 659494 - RNA, 64 nt, Homo Sapiens; identical to SEQ ID NO: 196483

SEQ ID NO: 659495 - RNA, 64 nt, Homo Sapiens; identical to SEQ ID NO: 196484

SEQ ID NO: 659496 - RNA, 64 nt, Homo Sapiens; identical to SEQ ID NO: 302562

SEQ ID NO: 659497 - RNA, 64 nt, Homo Sapiens; identical to SEQ ID NO: 302563

SEQ ID NO: 659498 - RNA, 64 nt, Homo Sapiens; identical to SEQ ID NO: 302564

SEQ ID NO: 659499 - RNA, 64 nt, Homo Sapiens; identical to SEQ ID NO: 302565

SEQ ID NO: 659500 - RNA, 64 nt, Homo Sapiens; identical to SEQ ID NO: 302566

SEQ ID NO: 659501 - RNA, 64 nt, Homo Sapiens; identical to SEQ ID NO: 302567

SEQ ID NO: 659502 - RNA, 64 nt, Homo Sapiens; identical to SEQ ID NO: 302568

SEQ ID NO: 659503 - RNA, 64 nt, Homo Sapiens; identical to SEQ ID NO: 302569

SEQ ID NO: 659504 - RNA, 64 nt, Homo Sapiens; identical to SEQ ID NO: 302570

SEQ ID NO: 659505 - RNA, 64 nt, Homo Sapiens; identical to SEQ ID NO: 302571

SEQ ID NO: 659506 - RNA, 64 nt, Homo Sapiens; identical to SEQ ID NO: 302572

SEQ ID NO: 659507 - RNA, 64 nt, Homo Sapiens; identical to SEQ ID NO: 302573

SEQ ID NO: 659508 - RNA, 64 nt, Homo Sapiens; identical to SEQ ID NO: 302574

SEQ ID NO: 659509 - RNA, 64 nt, Homo Sapiens; identical to SEQ ID NO: 302575

SEQ ID NO: 659510 - RNA, 64 nt, Homo Sapiens; identical to SEQ ID NO: 302576

SEQ ID NO: 659511 - RNA, 64 nt, Homo Sapiens; identical to SEQ ID NO: 302577

SEQ ID NO: 659512 - RNA, 64 nt, Homo Sapiens; identical to SEQ ID NO: 302578

SEQ ID NO: 659513 - RNA, 64 nt, Homo Sapiens; identical to SEQ ID NO: 302579

SEQ ID NO: 659514 - RNA, 64 nt, Homo Sapiens; identical to SEQ ID NO: 302580

SEQ ID NO: 659515 - RNA, 64 nt, Homo Sapiens; identical to SEQ ID NO: 302581

SEQ ID NO: 659516 - RNA, 64 nt, Homo Sapiens; identical to SEQ ID NO: 196466

SEQ ID NO: 659517 - RNA, 64 nt, Homo Sapiens; identical to SEQ ID NO: 196467

SEQ ID NO: 659518 - RNA, 64 nt, Homo Sapiens; identical to SEQ ID NO: 196468

SEQ ID NO: 659519 - RNA, 64 nt, Homo Sapiens; identical to SEQ ID NO: 196469

SEQ ID NO: 659520 - RNA, 64 nt, Homo Sapiens; identical to SEQ ID NO: 196470

SEQ ID NO: 659521 - RNA, 64 nt, Homo Sapiens; identical to SEQ ID NO: 196471

SEQ ID NO: 659522 - RNA, 64 nt, Homo Sapiens; identical to SEQ ID NO: 196472

SEQ ID NO: 659523 - RNA, 64 nt, Homo Sapiens; identical to SEQ ID NO: 196473

SEQ ID NO: 659524 - RNA, 64 nt, Homo Sapiens; identical to SEQ ID NO: 196474

SEQ ID NO: 659525 - RNA, 64 nt, Homo Sapiens; identical to SEQ ID NO: 196475

SEQ ID NO: 659526 - RNA, 64 nt, Homo Sapiens; identical to SEQ ID NO: 196476

SEQ ID NO: 659527 - RNA, 64 nt, Homo Sapiens; identical to SEQ ID NO: 196477

SEQ ID NO: 659528 - RNA, 64 nt, Homo Sapiens; identical to SEQ ID NO: 196478

SEQ ID NO: 659529 - RNA, 64 nt, Homo Sapiens; identical to SEQ ID NO: 196479

SEQ ID NO: 659530 - RNA, 64 nt, Homo Sapiens; identical to SEQ ID NO: 196480

SEQ ID NO: 659531 - RNA, 64 nt, Homo Sapiens; identical to SEQ ID NO: 196481

SEQ ID NO: 659532 - RNA, 64 nt, Homo Sapiens; identical to SEQ ID NO: 196482

SEQ ID NO: 659533 - RNA, 64 nt, Homo Sapiens; identical to SEQ ID NO: 196483

SEQ ID NO: 659534 - RNA, 64 nt, Homo Sapiens; identical to SEQ ID NO: 196484

SEQ ID NO: 659535 - RNA, 64 nt, Homo Sapiens; identical to SEQ ID NO: 71812

SEQ ID NO: 659536 - RNA, 64 nt, Homo Sapiens; identical to SEQ ID NO: 71813

SEQ ID NO: 659537 - RNA, 64 nt, Homo Sapiens; identical to SEQ ID NO: 71814

SEQ ID NO: 659538 - RNA, 64 nt, Homo Sapiens; identical to SEQ ID NO: 71815

SEQ ID NO: 659539 - RNA, 64 nt, Homo Sapiens; identical to SEQ ID NO: 71816

SEQ ID NO: 659540 - RNA, 64 nt, Homo Sapiens; identical to SEQ ID NO: 71817

SEQ ID NO: 659541 - RNA, 64 nt, Homo Sapiens; identical to SEQ ID NO: 71818

SEQ ID NO: 659542 - RNA, 64 nt, Homo Sapiens; identical to SEQ ID NO: 71819

SEQ ID NO: 659543 - RNA, 64 nt, Homo Sapiens; identical to SEQ ID NO: 71820

SEQ ID NO: 659544 - RNA, 64 nt, Homo Sapiens; identical to SEQ ID NO: 71821

SEQ ID NO: 659545 - RNA, 64 nt, Homo Sapiens; identical to SEQ ID NO: 71822

SEQ ID NO: 659546 - RNA, 64 nt, Homo Sapiens; identical to SEQ ID NO: 71823

SEQ ID NO: 659547 - RNA, 64 nt, Homo Sapiens; identical to SEQ ID NO: 71824

SEQ ID NO: 659548 - RNA, 64 nt, Homo Sapiens; identical to SEQ ID NO: 71825

SEQ ID NO: 659549 - RNA, 64 nt, Homo Sapiens; identical to SEQ ID NO: 71826

SEQ ID NO: 659550 - RNA, 64 nt, Homo Sapiens; identical to SEQ ID NO: 71827

SEQ ID NO: 659551 - RNA, 64 nt, Homo Sapiens; identical to SEQ ID NO: 71828

SEQ ID NO: 659552 - RNA, 64 nt, Homo Sapiens; identical to SEQ ID NO: 71829

SEQ ID NO: 659553 - RNA, 64 nt, Homo Sapiens; identical to SEQ ID NO: 71830

SEQ ID NO: 659554 - RNA, 64 nt, Homo Sapiens; identical to SEQ ID NO: 71831

SEQ ID NO: 659555 - RNA, 64 nt, Homo Sapiens; identical to SEQ ID NO: 71832

SEQ ID NO: 659556 - RNA, 64 nt, Homo Sapiens; identical to SEQ ID NO: 71833

SEQ ID NO: 659557 - RNA, 64 nt, Homo Sapiens; identical to SEQ ID NO: 71834

SEQ ID NO: 659558 - RNA, 64 nt, Homo Sapiens; identical to SEQ ID NO: 71835

SEQ ID NO: 659559 - RNA, 64 nt, Homo Sapiens; identical to SEQ ID NO: 71836

SEQ ID NO: 659560 - RNA, 64 nt, Homo Sapiens; identical to SEQ ID NO: 71837

SEQ ID NO: 659561 - RNA, 64 nt, Homo Sapiens; identical to SEQ ID NO: 71838

SEQ ID NO: 659562 - RNA, 64 nt, Homo Sapiens; identical to SEQ ID NO: 71839

SEQ ID NO: 659563 - RNA, 64 nt, Homo Sapiens; identical to SEQ ID NO: 71840

SEQ ID NO: 659564 - RNA, 64 nt, Homo Sapiens; identical to SEQ ID NO: 71841

SEQ ID NO: 659565 - RNA, 64 nt, Homo Sapiens; identical to SEQ ID NO: 71842

SEQ ID NO: 659566 - RNA, 64 nt, Homo Sapiens; identical to SEQ ID NO: 71843

SEQ ID NO: 659567 - RNA, 64 nt, Homo Sapiens; identical to SEQ ID NO: 71844

SEQ ID NO: 659568 - RNA, 64 nt, Homo Sapiens; identical to SEQ ID NO: 71845

SEQ ID NO: 659569 - RNA, 64 nt, Homo Sapiens; identical to SEQ ID NO: 71846

SEQ ID NO: 659570 - RNA, 64 nt, Homo Sapiens; identical to SEQ ID NO: 71847

SEQ ID NO: 659571 - RNA, 64 nt, Homo Sapiens; identical to SEQ ID NO: 71847

SEQ ID NO: 659572 - RNA, 64 nt, Homo Sapiens; identical to SEQ ID NO: 71849

SEQ ID NO: 659573 - RNA, 64 nt, Homo Sapiens; identical to SEQ ID NO: 71850

SEQ ID NO: 659574 - RNA, 64 nt, Homo Sapiens; identical to SEQ ID NO: 71851

SEQ ID NO: 659575 - RNA, 64 nt, Homo Sapiens; identical to SEQ ID NO: 71852

SEQ ID NO: 659576 - RNA, 64 nt, Homo Sapiens; identical to SEQ ID NO: 71853

SEQ ID NO: 659577 - RNA, 64 nt, Homo Sapiens; identical to SEQ ID NO: 71854

SEQ ID NO: 659578 - RNA, 64 nt, Homo Sapiens; identical to SEQ ID NO: 71855

SEQ ID NO: 659579 - RNA, 64 nt, Homo Sapiens; identical to SEQ ID NO: 71856

SEQ ID NO: 659580 - RNA, 57 nt, Homo Sapiens; identical to SEQ ID NO: 71857

SEQ ID NO: 659581 - RNA, 64 nt, Homo Sapiens; identical to SEQ ID NO: 71858

SEQ ID NO: 659582 - RNA, 64 nt, Homo Sapiens; identical to SEQ ID NO: 195100

SEQ ID NO: 659583 - RNA, 64 nt, Homo Sapiens; identical to SEQ ID NO: 195101

SEQ ID NO: 659584 - RNA, 64 nt, Homo Sapiens; identical to SEQ ID NO: 195102

SEQ ID NO: 659585 - RNA, 64 nt, Homo Sapiens; identical to SEQ ID NO: 195103

SEQ ID NO: 659586 - RNA, 64 nt, Homo Sapiens; identical to SEQ ID NO: 195104

SEQ ID NO: 659587 - RNA, 64 nt, Homo Sapiens; identical to SEQ ID NO: 195105

SEQ ID NO: 659588 - RNA, 64 nt, Homo Sapiens; identical to SEQ ID NO: 195106

SEQ ID NO: 659589 - RNA, 64 nt, Homo Sapiens; identical to SEQ ID NO: 195107

SEQ ID NO: 659590 - RNA, 64 nt, Homo Sapiens; identical to SEQ ID NO: 195108

SEQ ID NO: 659591 - RNA, 64 nt, Homo Sapiens; identical to SEQ ID NO: 195109

SEQ ID NO: 659592 - RNA, 64 nt, Homo Sapiens; identical to SEQ ID NO: 195110

SEQ ID NO: 659593 - RNA, 64 nt, Homo Sapiens; identical to SEQ ID NO: 195111

SEQ ID NO: 659594 - RNA, 64 nt, Homo Sapiens; identical to SEQ ID NO: 195112

SEQ ID NO: 659595 - RNA, 64 nt, Homo Sapiens; identical to SEQ ID NO: 195113

SEQ ID NO: 659596 - RNA, 64 nt, Homo Sapiens; identical to SEQ ID NO: 195114

SEQ ID NO: 659597 - RNA, 64 nt, Homo Sapiens; identical to SEQ ID NO: 195115

SEQ ID NO: 659598 - RNA, 64 nt, Homo Sapiens; identical to SEQ ID NO: 195116

SEQ ID NO: 659599 - RNA, 64 nt, Homo Sapiens; identical to SEQ ID NO: 195117

SEQ ID NO: 659600 - RNA, 64 nt, Homo Sapiens; identical to SEQ ID NO: 195118

SEQ ID NO: 659601 - RNA, 64 nt, Homo Sapiens; identical to SEQ ID NO: 195119

SEQ ID NO: 659602 - RNA, 64 nt, Homo Sapiens; identical to SEQ ID NO: 96774

SEQ ID NO: 659603 - RNA, 64 nt, Homo Sapiens; identical to SEQ ID NO: 96775

SEQ ID NO: 659604 - RNA, 64 nt, Homo Sapiens; identical to SEQ ID NO: 96776

SEQ ID NO: 659605 - RNA, 64 nt, Homo Sapiens; identical to SEQ ID NO: 96777

SEQ ID NO: 659606 - RNA, 64 nt, Homo Sapiens; identical to SEQ ID NO: 96778

SEQ ID NO: 659607 - RNA, 64 nt, Homo Sapiens; identical to SEQ ID NO: 96779

SEQ ID NO: 659608 - RNA, 64 nt, Homo Sapiens; identical to SEQ ID NO: 96780

SEQ ID NO: 659609 - RNA, 64 nt, Homo Sapiens; identical to SEQ ID NO: 96781

SEQ ID NO: 659610 - RNA, 64 nt, Homo Sapiens; identical to SEQ ID NO: 96782

SEQ ID NO: 659611 - RNA, 64 nt, Homo Sapiens; identical to SEQ ID NO: 96783

SEQ ID NO: 659612 - RNA, 64 nt, Homo Sapiens; identical to SEQ ID NO: 96784

SEQ ID NO: 659613 - RNA, 64 nt, Homo Sapiens; identical to SEQ ID NO: 96785

SEQ ID NO: 659614 - RNA, 64 nt, Homo Sapiens; identical to SEQ ID NO: 96786

SEQ ID NO: 659615 - RNA, 64 nt, Homo Sapiens; identical to SEQ ID NO: 96787

SEQ ID NO: 659616 - RNA, 64 nt, Homo Sapiens; identical to SEQ ID NO: 96788

SEQ ID NO: 659617 - RNA, 64 nt, Homo Sapiens; identical to SEQ ID NO: 96789

SEQ ID NO: 659618 - RNA, 64 nt, Homo Sapiens; identical to SEQ ID NO: 96790

SEQ ID NO: 659619 - RNA, 64 nt, Homo Sapiens; identical to SEQ ID NO: 96791

SEQ ID NO: 659620 - RNA, 64 nt, Homo Sapiens; identical to SEQ ID NO: 96792

SEQ ID NO: 659621 - RNA, 64 nt, Homo Sapiens; identical to SEQ ID NO: 96793

SEQ ID NO: 659622 - RNA, 64 nt, Homo Sapiens; identical to SEQ ID NO: 96794

SEQ ID NO: 659623 - RNA, 64 nt, Homo Sapiens; identical to SEQ ID NO: 96795

SEQ ID NO: 659624 - RNA, 64 nt, Homo Sapiens; identical to SEQ ID NO: 96796

SEQ ID NO: 659625 - RNA, 64 nt, Homo Sapiens; identical to SEQ ID NO: 96797

SEQ ID NO: 659626 - RNA, 64 nt, Homo Sapiens; identical to SEQ ID NO: 96798

SEQ ID NO: 659627 - RNA, 64 nt, Homo Sapiens; identical to SEQ ID NO: 96799

SEQ ID NO: 659628 - RNA, 64 nt, Homo Sapiens; identical to SEQ ID NO: 96800

SEQ ID NO: 659629 - RNA, 64 nt, Homo Sapiens; identical to SEQ ID NO: 96801

SEQ ID NO: 659630 - RNA, 64 nt, Homo Sapiens; identical to SEQ ID NO: 96802

SEQ ID NO: 659631 - RNA, 64 nt, Homo Sapiens; identical to SEQ ID NO: 96803

SEQ ID NO: 659632 - RNA, 64 nt, Homo Sapiens; identical to SEQ ID NO: 96804

SEQ ID NO: 659633 - RNA, 64 nt, Homo Sapiens; identical to SEQ ID NO: 96805

SEQ ID NO: 659634 - RNA, 64 nt, Homo Sapiens; identical to SEQ ID NO: 96806

SEQ ID NO: 659635 - RNA, 64 nt, Homo Sapiens; identical to SEQ ID NO: 96807

SEQ ID NO: 659636 - RNA, 64 nt, Homo Sapiens; identical to SEQ ID NO: 96808

SEQ ID NO: 659637 - RNA, 64 nt, Homo Sapiens; identical to SEQ ID NO: 96809

SEQ ID NO: 659638 - RNA, 64 nt, Homo Sapiens; identical to SEQ ID NO: 96810

SEQ ID NO: 659639 - RNA, 64 nt, Homo Sapiens; identical to SEQ ID NO: 96811

SEQ ID NO: 659640 - RNA, 64 nt, Homo Sapiens; identical to SEQ ID NO: 96812

SEQ ID NO: 659641 - RNA, 64 nt, Homo Sapiens; identical to SEQ ID NO: 96813

SEQ ID NO: 659642 - RNA, 64 nt, Homo Sapiens; identical to SEQ ID NO: 96814

SEQ ID NO: 659643 - RNA, 64 nt, Homo Sapiens; identical to SEQ ID NO: 96815

SEQ ID NO: 659644 - RNA, 64 nt, Homo Sapiens; identical to SEQ ID NO: 96816

SEQ ID NO: 659645 - RNA, 64 nt, Homo Sapiens; identical to SEQ ID NO: 96817

SEQ ID NO: 659646 - RNA, 64 nt, Homo Sapiens; identical to SEQ ID NO: 96818

SEQ ID NO: 659647 - RNA, 64 nt, Homo Sapiens; identical to SEQ ID NO: 96819

SEQ ID NO: 659648 - RNA, 64 nt, Homo Sapiens; identical to SEQ ID NO: 96820

SEQ ID NO: 659649 - RNA, 64 nt, Homo Sapiens; identical to SEQ ID NO: 96821

SEQ ID NO: 659650 - RNA, 64 nt, Homo Sapiens; identical to SEQ ID NO: 96822

SEQ ID NO: 659651 - RNA, 64 nt, Homo Sapiens; identical to SEQ ID NO: 96823

SEQ ID NO: 659652 - RNA, 64 nt, Homo Sapiens; identical to SEQ ID NO: 96824

SEQ ID NO: 659653 - RNA, 64 nt, Homo Sapiens; identical to SEQ ID NO: 369930

SEQ ID NO: 659654 - RNA, 64 nt, Homo Sapiens; identical to SEQ ID NO: 369931

SEQ ID NO: 659655 - RNA, 64 nt, Homo Sapiens; identical to SEQ ID NO: 369932

SEQ ID NO: 659656 - RNA, 64 nt, Homo Sapiens; identical to SEQ ID NO: 369933

SEQ ID NO: 659657 - RNA, 64 nt, Homo Sapiens; identical to SEQ ID NO: 369934

SEQ ID NO: 659658 - RNA, 64 nt, Homo Sapiens; identical to SEQ ID NO: 369935

SEQ ID NO: 659659 - RNA, 64 nt, Homo Sapiens; identical to SEQ ID NO: 369936

SEQ ID NO: 659660 - RNA, 64 nt, Homo Sapiens; identical to SEQ ID NO: 369937

SEQ ID NO: 659661 - RNA, 64 nt, Homo Sapiens; identical to SEQ ID NO: 369938

SEQ ID NO: 659662 - RNA, 64 nt, Homo Sapiens; identical to SEQ ID NO: 369939

SEQ ID NO: 659663 - RNA, 64 nt, Homo Sapiens; identical to SEQ ID NO: 369940

SEQ ID NO: 659664 - RNA, 64 nt, Homo Sapiens; identical to SEQ ID NO: 369941

SEQ ID NO: 659665 - RNA, 64 nt, Homo Sapiens; identical to SEQ ID NO: 369942

SEQ ID NO: 659666 - RNA, 64 nt, Homo Sapiens; identical to SEQ ID NO: 369943

SEQ ID NO: 659667 - RNA, 64 nt, Homo Sapiens; identical to SEQ ID NO: 369944

SEQ ID NO: 659668 - RNA, 64 nt, Homo Sapiens; identical to SEQ ID NO: 369945

SEQ ID NO: 659669 - RNA, 64 nt, Homo Sapiens; identical to SEQ ID NO: 369946

SEQ ID NO: 659670 - RNA, 64 nt, Homo Sapiens; identical to SEQ ID NO: 369947

SEQ ID NO: 659671 - RNA, 64 nt, Homo Sapiens; identical to SEQ ID NO: 369948

SEQ ID NO: 659672 - RNA, 64 nt, Homo Sapiens; identical to SEQ ID NO: 369949

SEQ ID NO: 659673 - RNA, 64 nt, Homo Sapiens; identical to SEQ ID NO: 369950

SEQ ID NO: 659674 - RNA, 64 nt, Homo Sapiens; identical to SEQ ID NO: 369951

SEQ ID NO: 659675 - RNA, 64 nt, Homo Sapiens; identical to SEQ ID NO: 369952

SEQ ID NO: 659676 - RNA, 64 nt, Homo Sapiens; identical to SEQ ID NO: 369953

SEQ ID NO: 659677 - RNA, 64 nt, Homo Sapiens; identical to SEQ ID NO: 369954

SEQ ID NO: 659678 - RNA, 64 nt, Homo Sapiens; identical to SEQ ID NO: 369955

SEQ ID NO: 659679 - RNA, 64 nt, Homo Sapiens; identical to SEQ ID NO: 369956

SEQ ID NO: 659680 - RNA, 64 nt, Homo Sapiens; identical to SEQ ID NO: 369957

SEQ ID NO: 659681 - RNA, 64 nt, Homo Sapiens; identical to SEQ ID NO: 369958

SEQ ID NO: 659682 - RNA, 64 nt, Homo Sapiens; identical to SEQ ID NO: 369959

SEQ ID NO: 659683 - RNA, 64 nt, Homo Sapiens; identical to SEQ ID NO: 369960

SEQ ID NO: 659684 - RNA, 64 nt, Homo Sapiens
aguauuauguucagaagccacucaccagccccucccucugaagacauaauuuaggcuucagcau

SEQ ID NO: 659685 - RNA, 64 nt, Homo Sapiens
gaccaugucuuuuuaaaaucguuguauuuggaagccucugaagaugaugguuauagcggguggg

SEQ ID NO: 659686 - RNA, 64 nt, Homo Sapiens
uugauguaagaucuauauaguuaucugacuaauuccucugaauuaauuuauaacuaaaauagug

SEQ ID NO: 659687 - RNA, 64 nt, Homo Sapiens
cuccacccugaugauuggaaauuagggauaggcaccucugaaaugggcucauguucucuacugg

SEQ ID NO: 659688 - RNA, 64 nt, Homo Sapiens
aauuuuuaguucaaguuuaguucauugauauuauccucugaaugcaguuaaggcugggcagaaa

SEQ ID NO: 659689 - RNA, 64 nt, Homo Sapiens
uuuuuuauuuccuucccucauaccuugcccauucccucugaauauuaggugugaugucaacagc

SEQ ID NO: 659690 - RNA, 64 nt, Homo Sapiens
cucaagauaaauauggguuaaugccugcaugaugccucugaauucaggaauugcagggaaaacu

SEQ ID NO: 659691 - RNA, 64 nt, Homo Sapiens
agcagcagggaucaucacaugcagccaaacuuggccucugaagggggaagguagugggaauagg

SEQ ID NO: 659692 - RNA, 64 nt, Homo Sapiens
ccaaaccaguaccuggggagguuuucuagguggaccucugaaaaugccugaaguuuuaguauuu

SEQ ID NO: 659693 - RNA, 64 nt, Homo Sapiens
aaacauauuuacaauccaaaacucugacugauuuccucugaaguuggguuuugcugagccaucc

SEQ ID NO: 659694 - RNA, 64 nt, Homo Sapiens
cauuaugcuggggcaucucugaucccaguagguaccucugaauauaccaggugucuggaguuag

SEQ ID NO: 659695 - RNA, 64 nt, Homo Sapiens
acugaggguaggggacaggaggcucaggacgcgcccucugaaucgaguguuucuucuucacaag

SEQ ID NO: 659696 - RNA, 64 nt, Homo Sapiens
cgccggcccgcccacuccuaccacaaggacuuugccucugaaggccaguggcagcagguggugg

SEQ ID NO: 659697 - RNA, 64 nt, Homo Sapiens
aucugcuccuuuuccauccccugacauaccuuaaccucugaacucugaccucaggaggcucugg

SEQ ID NO: 659698 - RNA, 64 nt, Homo Sapiens
accagucagcccucuguggagucauugugcuggaccucugaaaagaucugcaggggccaagaug

SEQ ID NO: 659699 - RNA, 64 nt, Homo Sapiens
cuggcaugcugcagcccucugccggcugugguguccucugaauuuggacccagguugccugcuc

SEQ ID NO: 659700 - RNA, 64 nt, Homo Sapiens
guuuuggucaaaaugggugaaaugacagcaucucccucugaaggcuugaagagguacccaucau

SEQ ID NO: 659701 - RNA, 64 nt, Homo Sapiens
auguuucgcagaaaagugucagccagcuccgugcccucugaauugcuggaccuccucucagcac

SEQ ID NO: 659702 - RNA, 64 nt, Homo Sapiens
gcaggucuucuccuccucuccaucccuauucccuccucugaaaugcaccccuuuguaauugagg

SEQ ID NO: 659703 - RNA, 64 nt, Homo Sapiens
ccucugcaugccagccugaaaauuccaaaucuagccucugaaugucuuggcuccaucucuucag

SEQ ID NO: 659704 - RNA, 64 nt, Homo Sapiens
ggcuccuucccagucaagguauagaaaauucaccccucugaacuuuugcuauugauguagugug

SEQ ID NO: 659705 - RNA, 64 nt, Homo Sapiens
acuggaagagcuaguaaauuugaaacccuguaucccucugaaacucccauucauguuagaucgu

SEQ ID NO: 659706 - RNA, 64 nt, Homo Sapiens; identical to SEQ ID NO: 239468

SEQ ID NO: 659707 - RNA, 64 nt, Homo Sapiens; identical to SEQ ID NO: 239469

SEQ ID NO: 659708 - RNA, 64 nt, Homo Sapiens; identical to SEQ ID NO: 239470

SEQ ID NO: 659709 - RNA, 64 nt, Homo Sapiens; identical to SEQ ID NO: 239471

SEQ ID NO: 659710 - RNA, 64 nt, Homo Sapiens; identical to SEQ ID NO: 239472

SEQ ID NO: 659711 - RNA, 64 nt, Homo Sapiens; identical to SEQ ID NO: 239473

SEQ ID NO: 659712 - RNA, 64 nt, Homo Sapiens; identical to SEQ ID NO: 239474

SEQ ID NO: 659713 - RNA, 64 nt, Homo Sapiens; identical to SEQ ID NO: 239475

SEQ ID NO: 659714 - RNA, 64 nt, Homo Sapiens; identical to SEQ ID NO: 239476

SEQ ID NO: 659715 - RNA, 64 nt, Homo Sapiens; identical to SEQ ID NO: 239477

SEQ ID NO: 659716 - RNA, 64 nt, Homo Sapiens; identical to SEQ ID NO: 239478

SEQ ID NO: 659717 - RNA, 64 nt, Homo Sapiens; identical to SEQ ID NO: 239479

SEQ ID NO: 659718 - RNA, 64 nt, Homo Sapiens; identical to SEQ ID NO: 239480

SEQ ID NO: 659719 - RNA, 64 nt, Homo Sapiens; identical to SEQ ID NO: 239481

SEQ ID NO: 659720 - RNA, 64 nt, Homo Sapiens; identical to SEQ ID NO: 239482

SEQ ID NO: 659721 - RNA, 64 nt, Homo Sapiens; identical to SEQ ID NO: 239483

SEQ ID NO: 659722 - RNA, 64 nt, Homo Sapiens; identical to SEQ ID NO: 239484

SEQ ID NO: 659723 - RNA, 64 nt, Homo Sapiens; identical to SEQ ID NO: 239485

SEQ ID NO: 659724 - RNA, 64 nt, Homo Sapiens; identical to SEQ ID NO: 239486

SEQ ID NO: 659725 - RNA, 64 nt, Homo Sapiens; identical to SEQ ID NO: 239487

SEQ ID NO: 659726 - RNA, 64 nt, Homo Sapiens; identical to SEQ ID NO: 239488

SEQ ID NO: 659727 - RNA, 64 nt, Homo Sapiens; identical to SEQ ID NO: 239489

SEQ ID NO: 659728 - RNA, 64 nt, Homo Sapiens; identical to SEQ ID NO: 239490

SEQ ID NO: 659729 - RNA, 64 nt, Homo Sapiens; identical to SEQ ID NO: 239491

SEQ ID NO: 659730 - RNA, 64 nt, Homo Sapiens; identical to SEQ ID NO: 239492

SEQ ID NO: 659731 - RNA, 64 nt, Homo Sapiens; identical to SEQ ID NO: 239493

SEQ ID NO: 659732 - RNA, 64 nt, Homo Sapiens; identical to SEQ ID NO: 239494

SEQ ID NO: 659733 - RNA, 64 nt, Homo Sapiens; identical to SEQ ID NO: 239495

SEQ ID NO: 659734 - RNA, 64 nt, Homo Sapiens; identical to SEQ ID NO: 239496

SEQ ID NO: 659735 - RNA, 64 nt, Homo Sapiens; identical to SEQ ID NO: 239497

SEQ ID NO: 659736 - RNA, 64 nt, Homo Sapiens; identical to SEQ ID NO: 239498

SEQ ID NO: 659737 - RNA, 64 nt, Homo Sapiens; identical to SEQ ID NO: 239499

SEQ ID NO: 659738 - RNA, 64 nt, Homo Sapiens; identical to SEQ ID NO: 239500

SEQ ID NO: 659739 - RNA, 64 nt, Homo Sapiens; identical to SEQ ID NO: 239501

SEQ ID NO: 659740 - RNA, 64 nt, Homo Sapiens; identical to SEQ ID NO: 239502

SEQ ID NO: 659741 - RNA, 64 nt, Homo Sapiens; identical to SEQ ID NO: 239503

SEQ ID NO: 659742 - RNA, 64 nt, Homo Sapiens; identical to SEQ ID NO: 239504

SEQ ID NO: 659743 - RNA, 64 nt, Homo Sapiens; identical to SEQ ID NO: 239505

SEQ ID NO: 659744 - RNA, 64 nt, Homo Sapiens; identical to SEQ ID NO: 239506

SEQ ID NO: 659745 - RNA, 64 nt, Homo Sapiens; identical to SEQ ID NO: 239507

SEQ ID NO: 659746 - RNA, 64 nt, Homo Sapiens; identical to SEQ ID NO: 239508

SEQ ID NO: 659747 - RNA, 64 nt, Homo Sapiens; identical to SEQ ID NO: 239509

SEQ ID NO: 659748 - RNA, 64 nt, Homo Sapiens; identical to SEQ ID NO: 239510

SEQ ID NO: 659749 - RNA, 64 nt, Homo Sapiens; identical to SEQ ID NO: 239511

SEQ ID NO: 659750 - RNA, 64 nt, Homo Sapiens; identical to SEQ ID NO: 239512

SEQ ID NO: 659751 - RNA, 64 nt, Homo Sapiens; identical to SEQ ID NO: 239513

SEQ ID NO: 659752 - RNA, 64 nt, Homo Sapiens; identical to SEQ ID NO: 239514

SEQ ID NO: 659753 - RNA, 64 nt, Homo Sapiens; identical to SEQ ID NO: 412246

SEQ ID NO: 659754 - RNA, 64 nt, Homo Sapiens; identical to SEQ ID NO: 412247

SEQ ID NO: 659755 - RNA, 64 nt, Homo Sapiens; identical to SEQ ID NO: 412248

SEQ ID NO: 659756 - RNA, 64 nt, Homo Sapiens; identical to SEQ ID NO: 412249

SEQ ID NO: 659757 - RNA, 64 nt, Homo Sapiens; identical to SEQ ID NO: 412250

SEQ ID NO: 659758 - RNA, 64 nt, Homo Sapiens; identical to SEQ ID NO: 412251

SEQ ID NO: 659759 - RNA, 64 nt, Homo Sapiens
gcaaucugccacaacugccacaguagccucccaggcaaaauauaauacucccagauccuaaauc

SEQ ID NO: 659760 - RNA, 64 nt, Homo Sapiens
acauggcuucucccgcauauucccuaacauggaggcaaaauaccagcagccccaaccacagcau

SEQ ID NO: 659761 - RNA, 64 nt, Homo Sapiens
uaaaccuguacauauuccauauuuaccucaaggugcaaaauaauguaguaguugcuauguacug

SEQ ID NO: 659762 - RNA, 64 nt, Homo Sapiens
uugcacucaaaauguuuuuaaaaaaccgucacuugcaaaauacuuaguaauuauccagugccag

SEQ ID NO: 659763 - RNA, 64 nt, Homo Sapiens
aaaaccuuugauauuuauaaaaucauuuuuacgugcaaaauauaaccuuaauauuugaagugac

SEQ ID NO: 659764 - RNA, 64 nt, Homo Sapiens
uuagagggcacuuccgaaaaacacagcccugacagcaaaauaaaggucugauauguuggccccu

SEQ ID NO: 659765 - RNA, 64 nt, Homo Sapiens
uuguaaauacugcuugaccguacucucacauguggcaaaauaugguuugguuuuucuuuuuuuu

SEQ ID NO: 659766 - RNA, 64 nt, Homo Sapiens
ggcagggagugaugauuugggggaggcuuugggagcaaaauaaggaagagggcugagcugagcu

SEQ ID NO: 659767 - RNA, 64 nt, Homo Sapiens
uucagacauucagugggcaaguaaauuauggacugcaaaauaaugauuuuuauucaagaaagcu

SEQ ID NO: 659768 - RNA, 64 nt, Homo Sapiens
aaaguuuuauauccagauauacaaccacaauaaagcaaaauaaccuacuaucaaaauagaaaug

SEQ ID NO: 659769 - RNA, 64 nt, Homo Sapiens
ucuuguaagcuuuaacuauaucucucuuuaaaaugcaaaauaaugucuuaagauucaaagucug

SEQ ID NO: 659770 - RNA, 64 nt, Homo Sapiens
aaagucuguauuuuuaaagcauggcuuuggcuuugcaaaauaaaaaauguguuuuguacaugaa

SEQ ID NO: 659771 - RNA, 64 nt, Homo Sapiens
gugcaaugauuuuuauacaauacuuuucaaacgagcaaaauaauauuuuguaaauacacuuuuu

SEQ ID NO: 659772 - RNA, 64 nt, Homo Sapiens
uuguaaauacacuuuuuuacuuauaauuuugacugcaaaauauucuucgagauauccauucacu

SEQ ID NO: 659773 - RNA, 64 nt, Homo Sapiens
cuauggaaaucauaauugucgugcuuaggcaagugcaaaauacucuugcucuguuuuugcuuuu

SEQ ID NO: 659774 - RNA, 64 nt, Homo Sapiens
aauuuaacaaccaaggaauaauucuucuaauacagcaaaauaaacaucccuaauaacaaccuuc

SEQ ID NO: 659775 - RNA, 64 nt, Homo Sapiens
ugauuguuuuggauaacucauuuguaaaaguuuagcaaaauaacauuccacacagcaguuugac

SEQ ID NO: 659776 - RNA, 64 nt, Homo Sapiens
ggagcacuaaugcccaugagugaauuuuauaaaggcaaaauacuugauuccugcuacugcaaag

SEQ ID NO: 659777 - RNA, 64 nt, Homo Sapiens
aauugucgauuuuuagcuauuugacagauuaaaagcaaaauaaucaugccauauuuaguccugg

SEQ ID NO: 659778 - RNA, 64 nt, Homo Sapiens
caccuucucuuccuucuuggucugucauuauauugcaaaauauuuuuccucugaaugaaauuau

SEQ ID NO: 659779 - RNA, 64 nt, Homo Sapiens
uuuugugagcaguuugccauucagaaaccauugagcaaaauaagucuauagaugggacugaaac

SEQ ID NO: 659780 - RNA, 64 nt, Homo Sapiens
uaaguuuuguuuuucacaaagcucuuauuaugaagcaaaauaaaaauucuaguuucuuguauga

SEQ ID NO: 659781 - RNA, 64 nt, Homo Sapiens
auuuaacaucugcaguguucugugaauagcaguggcaaaauauuauguuaugaaaacccucgau

SEQ ID NO: 659782 - RNA, 64 nt, Homo Sapiens
aaauuucuggcaaauauuuugucacugcuguaaagcaaaauauuugugaaagugccaaaauaaa

SEQ ID NO: 659783 - RNA, 64 nt, Homo Sapiens
uuaucagcuguuauuggaaaugcaugacaaaccugcaaaauauugccaccuaauaaauaaaccu

SEQ ID NO: 659784 - RNA, 64 nt, Homo Sapiens
cacugacccaaaacucuuuaguguuauuccuucagcaaaauauuaagugcucaguuaaauguaa

SEQ ID NO: 659785 - RNA, 64 nt, Homo Sapiens
auccaucuaaauagaaggguauauaauaaauauugcaaaauaaaugaguacauuugaauugaau

SEQ ID NO: 659786 - RNA, 64 nt, Homo Sapiens
uuccuuuuauacuacagaaaaauacgagauaacugcaaaauauucucuauggcaaagucuuuca

SEQ ID NO: 659787 - RNA, 64 nt, Homo Sapiens
gaaaauauauauugcuagcccaaaaaucccaggggcaaaauaaaguucaacaaaagugcaaaau

SEQ ID NO: 659788 - RNA, 64 nt, Homo Sapiens
aaaucccaggggcaaaauaaaguucaacaaaagugcaaaauaugacaaaaauagguacauuuuu

SEQ ID NO: 659789 - RNA, 64 nt, Homo Sapiens
cuucauagaacccagcaugacauaacagugcagggcaaaauauucacugggccaauucaauaca

SEQ ID NO: 659790 - RNA, 64 nt, Homo Sapiens
uuaugaacccuuccugagcuuuaugguccuaaaagcaaaauaaaaacuauucgaaugaaaagac

SEQ ID NO: 659791 - RNA, 64 nt, Homo Sapiens
cacugaggcccuaaaaauagauuuuuuucuuccagcaaaauaaaggcauacuuuucauguuuua

SEQ ID NO: 659792 - RNA, 64 nt, Homo Sapiens
aacugcuauuuauaaaaaugcucagcaguugaaagcaaaauaauagggcauguuauuugaagug

SEQ ID NO: 659793 - RNA, 64 nt, Homo Sapiens
uugauauuuauuaaucauuguuuuauuuuaaaaugcaaaauacaguaaaauuaaauuaguuaua

SEQ ID NO: 659794 - RNA, 64 nt, Homo Sapiens
uuuaaaaacauauugguaaauuaaagcuagcuuagcaaaauacugauuguauuugcccugagua

SEQ ID NO: 659795 - RNA, 64 nt, Homo Sapiens
caaacccaggguaguuuacaguuaaaaggaggaggcaaaauaguuauauaagaugaugugcccu

SEQ ID NO: 659796 - RNA, 64 nt, Homo Sapiens
gcacuaaagcuggcacucccccagccguucucaugcaaaauaccugugucagaauacuccuuuc

SEQ ID NO: 659797 - RNA, 64 nt, Homo Sapiens
guagauauuguaaagcuuuuugugaauuaaaagugcaaaauaaagcaaccacauuuaaguagau

SEQ ID NO: 659798 - RNA, 64 nt, Homo Sapiens
ccuucaaacaaauaauauuuuuacagaagcaggagcaaaauauggccuuucuucuaagagauau

SEQ ID NO: 659799 - RNA, 64 nt, Homo Sapiens
aauauaagaaaagguuaucuuaaauagaucuuaggcaaaauaccagcugaugaaggcaucugau

SEQ ID NO: 659800 - RNA, 64 nt, Homo Sapiens
acauagcaaauggcaucacuuuaauaagcuacuagcaaaauaaaugauuauuugcauguuaugu

SEQ ID NO: 659801 - RNA, 64 nt, Homo Sapiens
ugaagcuucaugcacuuaaaaggccaagaauauugcaaaauacaaaaauaggugguagauauug

SEQ ID NO: 659802 - RNA, 64 nt, Homo Sapiens
aauagaacugagauuuuuauguaauuaguuauaggcaaaauacuuucauauuuuuagauuagac

SEQ ID NO: 659803 - RNA, 64 nt, Homo Sapiens
cuuuuauagaauaugauauuauaaaguuaaauuugcaaaauaauucuaacauccacuauuguuc

SEQ ID NO: 659804 - RNA, 63 nt, Homo Sapiens
ugguuaaauaacguuuaaaaacauguacugagaugaaucuaauuuuuagauugcccuguauuu

SEQ ID NO: 659805 - RNA, 63 nt, Homo Sapiens
uggucuucuaccagcagcucggaauaguugcacugaaucuauacuuugcagcacugucugaug

SEQ ID NO: 659806 - RNA, 63 nt, Homo Sapiens
gaagaaaauggaaaugugaguuccugcgaacgcugaaucuaggugggacgcuugccuugaaca

SEQ ID NO: 659807 - RNA, 63 nt, Homo Sapiens
auagacauuuguaucugaauccacaagaagaucugaaucuaagaaggaauuaccuuugacaau

SEQ ID NO: 659808 - RNA, 63 nt, Homo Sapiens
gagagacagagaaagagagagaauucuuucaagugaaucuaaaagcuuuugcuuuuccuuugu

SEQ ID NO: 659809 - RNA, 63 nt, Homo Sapiens
guuuagauuaaaacuaguuuaaaaaauuauaaaugaaucuaaucaaaaugugaauaguaguca

SEQ ID NO: 659810 - RNA, 63 nt, Homo Sapiens
gauuuguaguaucagcuuguugagcaaugacuuugaaucuaguuuucagugaucagaagcagc

SEQ ID NO: 659811 - RNA, 63 nt, Homo Sapiens
acuaauuuuuaagaauuacaaagcucauucuucugaaucuaauaucacuaacuccuagacuuu

SEQ ID NO: 659812 - RNA, 63 nt, Homo Sapiens
cuuccucuuuggaugugaacuguucuugucaccugaaucuagggguaugaaaagcccauauuc

SEQ ID NO: 659813 - RNA, 63 nt, Homo Sapiens
ggcucgguguguguaacacaccucuuuaaucuaugaaucuauagucagcucuccauccauccc

SEQ ID NO: 659814 - RNA, 63 nt, Homo Sapiens
gguuaacgcuauucagauuuaccauuugagauuugaaucuaauacaacuagacuugaaaagaa

SEQ ID NO: 659815 - RNA, 63 nt, Homo Sapiens
cuaauucgcaaccacacagaucccugcaaaugcugaaucuagcuuucacuaagugagguuccu

SEQ ID NO: 659816 - RNA, 63 nt, Homo Sapiens
cuugacugccccugguggaagaagagagcaccgugaaucuaguacacauuuugugcgcaugau

SEQ ID NO: 659817 - RNA, 63 nt, Homo Sapiens
agcauuccacaucagauuuagacuucuaaaaagugaaucuaucccaacuuccuaaaggcuuau

SEQ ID NO: 659818 - RNA, 63 nt, Homo Sapiens
aguaguaaaucagaaaguaaggcaucuucaauaugaaucuauacucauuuaucuccucuucau

SEQ ID NO: 659819 - RNA, 63 nt, Homo Sapiens
aauaucuuuauauguauauaucccuauauaucuugaaucuacauaauauauauagauauauaa

SEQ ID NO: 659820 - RNA, 63 nt, Homo Sapiens
gcgugucuuuacucauuguguuggauuugcuuuugaaucuagaucgagguccccagugcguca

SEQ ID NO: 659821 - RNA, 63 nt, Homo Sapiens
gccauggauucauucuuucaguucaggugcagcugaaucuaucaaauuuaugacucugcucau

SEQ ID NO: 659822 - RNA, 63 nt, Homo Sapiens
uuauuugugcugaacauuucuugcuuaaauauuugaaucuaaaaaaaacuucggaguuuuucc

SEQ ID NO: 659823 - RNA, 63 nt, Homo Sapiens
acacugacguuuggaaaacuuucuuuuuguguuugaaucuaaccuuaacacaaucagaaauuu

SEQ ID NO: 659824 - RNA, 63 nt, Homo Sapiens
accagagacaggcaaaaacuacaauacuuuuugugaaucuacacugucuaacacacaauaguc

SEQ ID NO: 659825 - RNA, 63 nt, Homo Sapiens
ucaggccacugcacugcaagugggguggguuggugaaucuaucuugaagagcaaggauugggg

SEQ ID NO: 659826 - RNA, 63 nt, Homo Sapiens
caguuguagucguuugagugcaguaaugaaaucugaaucuaaaauaaaaacaagauuauuuuu

SEQ ID NO: 659827 - RNA, 63 nt, Homo Sapiens
gugacuaugaaacgaauauaagcuuaaaauaagugaaucuaauaaaauggcuauuccucuuuu

SEQ ID NO: 659828 - RNA, 63 nt, Homo Sapiens
aacucuuuguuuuauacauauauaauuuauaacugaaucuaaguauuagacugcuacucauau

SEQ ID NO: 659829 - RNA, 63 nt, Homo Sapiens
uuuuuaacaacuuuccauuuuuagauguuucguugaaucuauuuagagcuucaccauggcaau

SEQ ID NO: 659830 - RNA, 63 nt, Homo Sapiens
aagacauaguucaccuaaaauggcauccugcucugaaucuagacuuuuuagaaauggcauaug

SEQ ID NO: 659831 - RNA, 63 nt, Homo Sapiens
uuucuuauaauguugaaauguuuuagaauccuuugaaucuaaguauuuguuuccuaaaugaaa

SEQ ID NO: 659832 - RNA, 63 nt, Homo Sapiens
agaaagucaucgguagcuugauggggauggcauugaaucuauaaauuaccuugggcaguaugg

SEQ ID NO: 659833 - RNA, 63 nt, Homo Sapiens
uaugaauguauuugcuucuaaaaccucccaaagugaaucuaaucuuaaaacuacaaguuguaa

SEQ ID NO: 659834 - RNA, 63 nt, Homo Sapiens
uaugaauuuagcauugggaaaagcccuuauucuugaaucuagaguuacuauuuuuguauauau

SEQ ID NO: 659835 - RNA, 63 nt, Homo Sapiens
ccauguuuuaaguagcuacaggagcuauagauuugaaucuaauguugcauuagucuuuucagu

SEQ ID NO: 659836 - RNA, 63 nt, Homo Sapiens
ggauguguacaguacaguacugaacuuguaauuugaaucuaguaugguguucuguuuucagcu

SEQ ID NO: 659837 - RNA, 63 nt, Homo Sapiens
uuauuuugaggcuuucaggugguaaggugaaggugaaucuagcggcccuucuccuuuugaaaa

SEQ ID NO: 659838 - RNA, 63 nt, Homo Sapiens
gcuuccaaaaauguuguuugagaaucuauggacugaaucuaauacuguaguuaauuuugucac

SEQ ID NO: 659839 - RNA, 63 nt, Homo Sapiens
ucuuuucucuugcuaccaagugcuguucugugaugaaucuaaaguuguuagaaauguuuaagu

SEQ ID NO: 659840 - RNA, 63 nt, Homo Sapiens
uucuauguaagauuaaccuauccaaggcagccaugaaucuacuugcuuuccuaacuccugcag

SEQ ID NO: 659841 - RNA, 63 nt, Homo Sapiens
gauaaugcauguuuuacagugcuugcuccuuuuugaaucuacauugacagugaggacaaugug

SEQ ID NO: 659842 - RNA, 63 nt, Homo Sapiens
gauguggaaccugugcauauaucugcgguugauugaaucuaugaagccugacuacaucuuuuu

SEQ ID NO: 659843 - RNA, 63 nt, Homo Sapiens
uauuauucuuuaaguguugaccaccguacucugugaaucuaauaccgguaauauauuguauuu

SEQ ID NO: 659844 - RNA, 63 nt, Homo Sapiens
uuuuucuuuaaaaagucaagauucugauugauuugaaucuauagaaaaggccuagcgaggcaa

SEQ ID NO: 659845 - RNA, 63 nt, Homo Sapiens
cugaacacauuaggcauaugagcagauuuccagugaaucuauuuauguuuauuuucugaguuu

SEQ ID NO: 659846 - RNA, 63 nt, Homo Sapiens
gaaaaaugugcaaaacagcguuuaagacuguaaugaaucuaagcagcauuucugaaguggacu

SEQ ID NO: 659847 - RNA, 63 nt, Homo Sapiens
gcaucaugaagaacgaucaacuaucuucuaauuugaaucuauaguuacuuuguaccauuugaa

SEQ ID NO: 659848 - RNA, 63 nt, Homo Sapiens
gcauuucauaaacuaauagaaguugaggauuguugaaucuauuucacuuauuuuggcuguggu

SEQ ID NO: 659849 - RNA, 63 nt, Homo Sapiens
gcacagggaccguguucuuagguucuuagucugugaaucuagcaauaggcaguccagauuucu

SEQ ID NO: 659850 - RNA, 63 nt, Homo Sapiens
ucugcuaggcuggucuaccuccuaaauauacucugaaucuaucaccucuauugccuucuugca

SEQ ID NO: 659851 - RNA, 63 nt, Homo Sapiens
auuguaaaugaauaaaacauucucaacuccucuugaaucuaucccccaagaaaccaucuuauc

SEQ ID NO: 659852 - RNA, 63 nt, Homo Sapiens
aaucuuaagcaacaaagaaaaaacccuaauauuugaaucuauuuaugucuuucaauuuaaauu

SEQ ID NO: 659853 - RNA, 63 nt, Homo Sapiens
auaaauuuuaugggcgggugccaaauacugcugugaaucuauuuguauaguauccaugaauga

SEQ ID NO: 659854 - RNA, 63 nt, Homo Sapiens
ugaaugaacacuuuggauuuaaugaagucauuuugaaucuacauauuuuauaauuuaugacag

SEQ ID NO: 659855 - RNA, 63 nt, Homo Sapiens
uuuuauaaaaaaaaaaaaauuuggaugugcuccugaaucuacuuuccuaacaaucauuuauaa

SEQ ID NO: 659856 - RNA, 63 nt, Homo Sapiens
auucauagccagauguguauguuuuaucacguuugaaucuaccgugaugcauuucaaguggca

SEQ ID NO: 659857 - RNA, 63 nt, Homo Sapiens
aaguauguguguaccguaaauaagaaacgugcuugaaucuaaugagucauuacugccugccac

SEQ ID NO: 659858 - RNA, 63 nt, Homo Sapiens
uguucuguauauaugaaugaaaucaacuagaaaugaaucuauauaaauacauaaauaggauug

SEQ ID NO: 659859 - RNA, 63 nt, Homo Sapiens
agauccugauagcuucauguucugauaucucuuugaaucuaagugaagaaaguccccuugaau

SEQ ID NO: 659860 - RNA, 63 nt, Homo Sapiens
acauuucauagccuacauuuggucucuaucuccugaaucuaacuauuuguuuuguguuucauu

SEQ ID NO: 659861 - RNA, 63 nt, Homo Sapiens
ucuccggagauaauuucauaagggcaaacauggugaaucuaucggcagaggccucuaaaucuc

SEQ ID NO: 659862 - RNA, 63 nt, Homo Sapiens
gugagguauugcaaauguucaaaaaagcucucuugaaucuagguagcaugaacaaauuauaaa

SEQ ID NO: 659863 - RNA, 63 nt, Homo Sapiens
gaaagcuuuggcgaccccaauauauguauuuuuugaaucuaugaaccugaaaagggucagaag

SEQ ID NO: 659864 - RNA, 63 nt, Homo Sapiens
cagaacauacuuauauguaaaguauuauuuauuugaaucuacaaaaaacaacaaauaauuuuu

SEQ ID NO: 659865 - RNA, 63 nt, Homo Sapiens
guuaauguauucaaauguuagaguuuaauuuugugaaucuauuguuucuccucugaagcauuu

SEQ ID NO: 659866 - RNA, 63 nt, Homo Sapiens
uuucaccuuuaggguuaaaaaaaacucuucuacugaaucuauaaaaacugcaguuuuacaucu

SEQ ID NO: 659867 - RNA, 63 nt, Homo Sapiens
auuuuuuuacauauuuuuauuaucugguaauuaugaaucuagauagcuauauggauauuagca

SEQ ID NO: 659868 - RNA, 63 nt, Homo Sapiens
uaugguuuuuugucauauugcugucuaugcagcugaaucuaagcuuacuugagaauuuugcaa

SEQ ID NO: 659869 - RNA, 63 nt, Homo Sapiens
uuucucuuuggcuucaaaagaaaagaaaaaaaaugaaucuauuaacuuucccuccuauaguua

SEQ ID NO: 659870 - RNA, 63 nt, Homo Sapiens
ugcacacucucccauuauauauaagguuaugauugaaucuacuguuaauauuuuauguguaaa

SEQ ID NO: 659871 - RNA, 63 nt, Homo Sapiens
cauagcugaccuuuguaguaagguaaaacucacugaaucuaacuguuuuaagccaauauuuua

SEQ ID NO: 659872 - RNA, 63 nt, Homo Sapiens
uuaauucuaauguucaaaucacugcgugcuguaugaaucuagaaagccuuaauuuacuaccaa

SEQ ID NO: 659873 - RNA, 63 nt, Homo Sapiens
agccauggugucuucagaauuguagcgcauuucugaaucuagcaaauccuccuuuuacccguu

SEQ ID NO: 659874 - RNA, 63 nt, Homo Sapiens
caauguuuauuucauaaagaauugugaacuucuugaaucuagggagggggaauguagugaagg

SEQ ID NO: 659875 - RNA, 63 nt, Homo Sapiens
uaauuugacauugaugucacucuucauaccaagugaaucuauucucaugaacuuugaacccau

SEQ ID NO: 659876 - RNA, 63 nt, Homo Sapiens
ugggcuuguccaggcucauaauaaaugcuccauugaaucuacuauucuuguuuuccacugcug

SEQ ID NO: 659877 - RNA, 63 nt, Homo Sapiens
cauaauugugaccaauacauuuguauuuugugaugaaucuacauuuguuuguauucauguuca

SEQ ID NO: 659878 - RNA, 63 nt, Homo Sapiens
cccagauugcuauuuuuauuguuauuuuuaacaugaaucuaaaguuuaugguuccagggacuu

SEQ ID NO: 659879 - RNA, 63 nt, Homo Sapiens
aagaaaugacucugggagaggauuucccuuaugugaaucuagguaaaaagauggaaaaaaauu

SEQ ID NO: 659880 - RNA, 63 nt, Homo Sapiens
gcuuuaaauaaauuaagaucguuaaagcuaaacugaaucuauggcuuuucacuuucugucuag

SEQ ID NO: 659881 - RNA, 63 nt, Homo Sapiens
aggagaaaugaaugcauaaaauaacugauaauaugaaucuauacauagaacuuaggaagucuc

SEQ ID NO: 659882 - RNA, 63 nt, Homo Sapiens
uaguucauaaacaaacuguguaacuucucaaaaugaaucuauuucauaacucggacaauuucu

SEQ ID NO: 659883 - RNA, 63 nt, Homo Sapiens
gaaaauaaugauaaauguaaaauaucuaaagcaugaaucuaagagcacgcaauauauaauuuu

SEQ ID NO: 659884 - RNA, 63 nt, Homo Sapiens
uucuccuacguauuagagaaacaaauccaucuuugaaucuaaugguguacucauagcaacuau

SEQ ID NO: 659885 - RNA, 63 nt, Homo Sapiens
uuaccaucccuuggaaauucucuugaccagaccugaaucuaagucuucaaacaucauuauuau

SEQ ID NO: 659886 - RNA, 63 nt, Homo Sapiens
acuaggcaaaaacuucucuuccugaaagaguuaugaaucuaucccuucuagaagaauguaaga

SEQ ID NO: 659887 - RNA, 63 nt, Homo Sapiens
caaagugauggaagcuggugcucaauacaggugugaaucuauaauaugcuuaauggccugggg

SEQ ID NO: 659888 - RNA, 63 nt, Homo Sapiens
uccuugcaggauuccuucguuuuuaaaugcccuugaaucuagcuuugccuuggagaccccagu

SEQ ID NO: 659889 - RNA, 63 nt, Homo Sapiens
agugacauucaauugguucuauugcauaguacaugaaucuauugucacuaaaaauuagguuac

SEQ ID NO: 659890 - RNA, 63 nt, Homo Sapiens
ucuauuaagaguauuuaaaaucauauuuaaauaugaaucuauucaugcuaacauuauuuuuca

SEQ ID NO: 659891 - RNA, 63 nt, Homo Sapiens
auuguauaggauugcaugugaagucuuuucuacugaaucuauauuuccauuuguaagugauuu

SEQ ID NO: 659892 - RNA, 63 nt, Homo Sapiens
acuguuaucugaugucuuccugcauauuaaggaugaaucuacagaauuagaucaauaaggauc

SEQ ID NO: 659893 - RNA, 63 nt, Homo Sapiens
uuaguauguuguaaguagaucauuuuaaaaaacugaaucuauauuauguuuaacuucagaagg

SEQ ID NO: 659894 - RNA, 63 nt, Homo Sapiens
ugcauucaauugguaacuauuuuuuauuaaggaugaaucuaaauaaaaagcuaugcaauuuuc

SEQ ID NO: 659895 - RNA, 55 nt, Homo Sapiens
ugaguugcuggcauugggagcugcaugaaucuaccuacagagagaagaggaauga

SEQ ID NO: 659896 - RNA, 63 nt, Homo Sapiens
agaagaacccacuuccugcuuaguugagauaguugaaucuagcauucguuccuauaaaagaga

SEQ ID NO: 659897 - RNA, 63 nt, Homo Sapiens
cuaaugggcauuauaauuguuucaucuacucugugaaucuacauaggucuuuuuuuuuagaug

SEQ ID NO: 659898 - RNA, 63 nt, Homo Sapiens
auacucagcuaacaaaccugcccauguguuuccugaaucuaaaauaaaaaucgaaauaauuuu

SEQ ID NO: 659899 - RNA, 63 nt, Homo Sapiens
uuauauggugcuuuguauaugccacuaauaaaaugaaucuaaacauugaaugugaauggcccu

SEQ ID NO: 659900 - RNA, 63 nt, Homo Sapiens
auggacuggucaccaguuuuuauuuuauuuuuaugaaucuaccuuuccauugauugauuuaag

SEQ ID NO: 659901 - RNA, 63 nt, Homo Sapiens
auuuggggucugguuagucgugacuaucuauccugaaucuaacagugacuucauaacuaggag

SEQ ID NO: 659902 - RNA, 63 nt, Homo Sapiens
cacagauuuuacugugacuucacucgccuccacugaaucuacaacacacacacacacacacac

SEQ ID NO: 659903 - RNA, 63 nt, Homo Sapiens
ccuuuacagaaacuuucuuaagcacuuucaaaaugaaucuaaacuacacauauuacaagauau

SEQ ID NO: 659904 - RNA, 63 nt, Homo Sapiens
cauuuagaaaugucugagagaacugcuuauuuaugaaucuaauaauugugaugaaaagaaauu

SEQ ID NO: 659905 - RNA, 63 nt, Homo Sapiens
auacuguauuaagagugaaauuauggcucacuaugaaucuauugcuuuacugucaaaauaauu

SEQ ID NO: 659906 - RNA, 63 nt, Homo Sapiens
uguuagauucucaaaauuccugauacaguacuuugaaucuaguaccuuaaaggguauacuaag

SEQ ID NO: 659907 - RNA, 63 nt, Homo Sapiens
acuacacuguuaagaguauauaauagacuauagugaaucuaaaugaaaguggaauaauuuuua

SEQ ID NO: 659908 - RNA, 63 nt, Homo Sapiens
auuaaagaucuaaauacaaaggauauacagucuugaaucuaaaauaauuugcuaacuaacuau

SEQ ID NO: 659909 - RNA, 63 nt, Homo Sapiens
uuuguuuuuaaacaaaagauauuauuuuguguaugaaucuaaaucaagcccaucugucauuau

SEQ ID NO: 659910 - RNA, 63 nt, Homo Sapiens
acagcacagaggguaggggggcccucuaggugcugaaucuacacaucuguggggucuccuggg

SEQ ID NO: 659911 - RNA, 63 nt, Homo Sapiens
uuaaaaauguagauuuuucauauuuuuaaaauuugaaucuauuugagcuuuaguucagcagaa

SEQ ID NO: 659912 - RNA, 63 nt, Homo Sapiens
agaacauaaauauugugaauaaugaaaauccacugaaucuaauaagggacuuguaucgguaag

SEQ ID NO: 659913 - RNA, 63 nt, Homo Sapiens
acugcugcucucccaaggguuuuauuuuauuucugaaucuagagaacaguauugggcaggagg

SEQ ID NO: 659914 - RNA, 63 nt, Homo Sapiens
uauagaaucuaagaguugauuguggaaaacacgugaaucuauugcgcgcauuugucauuuagc

SEQ ID NO: 659915 - RNA, 63 nt, Homo Sapiens
accaaauauuaguuuuuauugaaaggaugguauugaaucuaaaaaguuucauaccaaauauuu

SEQ ID NO: 659916 - RNA, 63 nt, Homo Sapiens
aggaaaccguuuauuguuugaaagccacaauauugaaucuaaagggaacaugcugguucugga

SEQ ID NO: 659917 - RNA, 63 nt, Homo Sapiens
gaaagaagaacaugaaagaaaaguuauaaaaggugaaucuauuccuuuaaaauaaacgauuuu

SEQ ID NO: 659918 - RNA, 63 nt, Homo Sapiens
acaaggaaguccuauagaagcucuugcuguuuaugaaucuaagcccucaagcauccucaguuc

SEQ ID NO: 659919 - RNA, 63 nt, Homo Sapiens
ucaaacugcagaaaaaaucaugggaguguuacuugaaucuaucuaguuuugcacauauuuucu

SEQ ID NO: 659920 - RNA, 63 nt, Homo Sapiens
auggauuuauggaguauguggguauagaaaucaugaaucuagcauuuguuuucagagauucaa

SEQ ID NO: 659921 - RNA, 63 nt, Homo Sapiens
aaacugccaaaaugugaauaugcaaagccuuucugaaucuauaauaaugguacuucuacuggg

SEQ ID NO: 659922 - RNA, 63 nt, Homo Sapiens
ugauauaaaugcaauauuaaugccuuuaaaguaugaaucuaugccaaagaucacuuguuguuu

SEQ ID NO: 659923 - RNA, 63 nt, Homo Sapiens
cucuuuuuuuuuuuaacuaaaacaaaucugcaaugaaucuagaugcaauuaauuuuauuccuu

SEQ ID NO: 659924 - RNA, 63 nt, Homo Sapiens
auuaaaauaguuuuauauuugggaaggcaaaaaugaaucuauuguuuugcaauauagguuaua

SEQ ID NO: 659925 - RNA, 63 nt, Homo Sapiens
aaaaggaauaaauuagcaauuguuaaaaauuagugaaucuaacaguguacaagucauuuuuaa

SEQ ID NO: 659926 - RNA, 63 nt, Homo Sapiens
ucauuguguuuguuuuucauauaagauuuuuuuugaaucuauuuuaacagaguuuuuuaaucu

SEQ ID NO: 659927 - RNA, 63 nt, Homo Sapiens
caacuuaauuugcuuguauugacagccugucauugaaucuaaaguuuuuguauggugcaauau

SEQ ID NO: 659928 - RNA, 63 nt, Homo Sapiens
uaacuuaaucacaguugugcuaaaaugaagaagugaaucuaagauucuccuguuuguauuuug

SEQ ID NO: 659929 - RNA, 63 nt, Homo Sapiens
cagaagugcaauguauuuuucuccugugaaaccugaaucuacaaguuuuccugccaagccacu

SEQ ID NO: 659930 - RNA, 63 nt, Homo Sapiens
uugacuagauuugaaaauacaagauugauuagaugaaucuacaaaaaaguuguccuccucuca

SEQ ID NO: 659931 - RNA, 63 nt, Homo Sapiens
aaagugaaccaucucagaccaaauacacugaauugaaucuacaugucagccuuuguuaaccuu

SEQ ID NO: 659932 - RNA, 63 nt, Homo Sapiens
acccaggaaucucaaacucccauccuugggaccugaaucuaucacacuacacacaccagaugg

SEQ ID NO: 659933 - RNA, 63 nt, Homo Sapiens
uuuaaaaucauaacauugauuguauggaauuuuugaaucuauuaaaagccuuucagauucagg

SEQ ID NO: 659934 - RNA, 63 nt, Homo Sapiens
uagagcuucaccauggcaauucagauguuucguugaaucuauuuuuuuaacaacuuucaaucu

SEQ ID NO: 659935 - RNA, 63 nt, Homo Sapiens
uguucugaccuaaagauguaauacaagauacugugaaucuagaugugagaugacaacaggaac

SEQ ID NO: 659936 - RNA, 63 nt, Homo Sapiens
cugugaaggacaguauagaauuuaaggaaagauugaaucuaagccuguguaucccggcuacac

SEQ ID NO: 659937 - RNA, 63 nt, Homo Sapiens
uuauuggacuaauuugcuucuaaccaugauggaugaaucuaugaaaggccagaaaaaauuaau

SEQ ID NO: 659938 - RNA, 63 nt, Homo Sapiens
aacugcuacaguucuccaacuucauugugccagugaaucuauugaaaagcuguuaauauuucc

SEQ ID NO: 659939 - RNA, 63 nt, Homo Sapiens
cugguuuauguguggucaacuugaaaaacuaauugaaucuaggucucuguauuguuccuguuu

SEQ ID NO: 659940 - RNA, 63 nt, Homo Sapiens
aaaauagcaaaagccucucucagcccacuggccugaaucuacacuggaagccaacuugcuggc

SEQ ID NO: 659941 - RNA, 63 nt, Homo Sapiens
augauuuguaacauucacacaacaccucacuuuugaaucuauaaaagaauugcacguaugaga

SEQ ID NO: 659942 - RNA, 63 nt, Homo Sapiens
guauucuucccccucacccaagggcagugggcaugaaucuacuuuuuaaaaaugauuaauuuu

SEQ ID NO: 659943 - RNA, 63 nt, Homo Sapiens
agaggggagggucaaagcacucguggucaauuuugaaucuaucuuaaaauacugaggugugga

SEQ ID NO: 659944 - RNA, 61 nt, Homo Sapiens
gauuguaccaugcaauacuauucguuaaauaucugaaucuaaccccguggcugcuuuguca

SEQ ID NO: 659945 - RNA, 63 nt, Homo Sapiens
auuggagaacuccuggagauaagcuguacaaauugaaucuauguggaaaugcuuucagucuug

SEQ ID NO: 659946 - RNA, 63 nt, Homo Sapiens
gaaaucacuauaaugcacauaaagauuugagugugaaucuacuuaauaaauguaugacacuga

SEQ ID NO: 659947 - RNA, 63 nt, Homo Sapiens
uuaaauguuguuuuaacugcucauccagcgaaaugaaucuacagauauuuuaaaugguugaca

SEQ ID NO: 659948 - RNA, 63 nt, Homo Sapiens
uaaaacagaaaugggaauuaggccauagaaguaugaaucuaaucuugucccaaacuuauccag

SEQ ID NO: 659949 - RNA, 63 nt, Homo Sapiens
cacaucccccuucccugucucccacccucucccugaaucuacccuccccagucccccaccaga

SEQ ID NO: 659950 - RNA, 63 nt, Homo Sapiens
augcuuaucacaguacuuucuaaaaugauacaaugaaucuaaaaaugaguugcccuguaaauu

SEQ ID NO: 659951 - RNA, 63 nt, Homo Sapiens
aacuugauuguauaauuuuccuacuucuuugguugaaucuaugugucuuaauuucccuuauuu

SEQ ID NO: 659952 - RNA, 63 nt, Homo Sapiens
uaccaaguuuacauuucucauaacuuuuauacuugaaucuaccugguacaagagucgggggua

SEQ ID NO: 659953 - RNA, 63 nt, Homo Sapiens
caucgccauuccccgaggugucucacugcagucugaaucuagaagagcaagaacugcacugca

SEQ ID NO: 659954 - RNA, 63 nt, Homo Sapiens
uaucuucauuugaaugucuuuuaucgaccaguuugaaucuauuccucaaagcaccugaacagu

SEQ ID NO: 659955 - RNA, 63 nt, Homo Sapiens
agagaaugcugucaauauugguguacuguaaugugaaucuaugcuggugaaaacaauuuuuug

SEQ ID NO: 659956 - RNA, 63 nt, Homo Sapiens
agaaaacuauuuugaagaugggaaaaccuuaacugaaucuaaauuaugaacaugaauaccaac

SEQ ID NO: 659957 - RNA, 63 nt, Homo Sapiens
gacagucauacacauacaucaaccaauaccuggugaaucuaugaauuacucaaaaaguaagca

SEQ ID NO: 659958 - RNA, 63 nt, Homo Sapiens
auuugcugggagaauuuuuuguauuguugggauugaaucuagugauuuuuuaagacugugucu

SEQ ID NO: 659959 - RNA, 63 nt, Homo Sapiens
cuggauaagaaaugguggaagucaagggcagaaugaaucuaugacacacacaccuagccagcu

SEQ ID NO: 659960 - RNA, 63 nt, Homo Sapiens
acucuggaagaagucuucugaagcagccagcagugaaucuaaaggccgugaacgcuauuuucu

SEQ ID NO: 659961 - RNA, 63 nt, Homo Sapiens
aguuaccauccuuaucugaguuaucacaguucaugaaucuaagaggcggaacucuacaucauu

SEQ ID NO: 659962 - RNA, 63 nt, Homo Sapiens
ucuucuauucccacguuagccaguuguucuugaugaaucuauaugagucauagaacacaaauc

SEQ ID NO: 659963 - RNA, 63 nt, Homo Sapiens
auuuuagauuguacuugucuuuauuuaaaaugaugaaucuagucugaaucagcuguuauucca

SEQ ID NO: 659964 - RNA, 63 nt, Homo Sapiens
cuuccucgagaccauacagccaggaaauagcggugaaucuagugaucucgggucccuagauuu

SEQ ID NO: 659965 - RNA, 63 nt, Homo Sapiens
acugagaaguuuuacuacucagcuuugggagaaugaaucuaucgcguuagcucugcagagcua

SEQ ID NO: 659966 - RNA, 63 nt, Homo Sapiens
uuaauaacacuuuauuuauauucuagacaguuuugaaucuaggcuucauuccuuuuaugucau

SEQ ID NO: 659967 - RNA, 63 nt, Homo Sapiens
ggaagugagaggcaugauggggagagaccagacugaaucuacgggugagcccuguaaccuggc

SEQ ID NO: 659968 - RNA, 63 nt, Homo Sapiens
auuuuuauuaguuuaaagguaaauaaagucagcugaaucuacaugucucuuguuuuauuucuc

SEQ ID NO: 659969 - RNA, 63 nt, Homo Sapiens
cuugugaucccagaauuuucuaagaggaugaguugaaucuauagcagcauugucaguacagac

SEQ ID NO: 659970 - RNA, 63 nt, Homo Sapiens
gggcauucuguagucccaggcccacuggaaaaaugaaucuauauuuugguuccuggaccgaag

SEQ ID NO: 659971 - RNA, 63 nt, Homo Sapiens
guucuuacagaaauuuuucaugagcauuucugaugaaucuaugacauguauagaucuguccug

SEQ ID NO: 659972 - RNA, 63 nt, Homo Sapiens
uaugacauaaguauuuguggacuuugaugcaacugaaucuaaauuuuuucaccauuugcaaua

SEQ ID NO: 659973 - RNA, 63 nt, Homo Sapiens
acucugaaagagaaaucaauagauguuguuuauugaaucuacacugugagcuggagagaaccc

SEQ ID NO: 659974 - RNA, 63 nt, Homo Sapiens
uuggcugaaagaaaaaaaaaaaaauguaacugaugaaucuaaacgacccacugcaccaacaau

SEQ ID NO: 659975 - RNA, 63 nt, Homo Sapiens
uuuuuagagcaaaauuguuggaaagcauuuggcugaaucuaaagaccugcagucagauucuuc

SEQ ID NO: 659976 - RNA, 63 nt, Homo Sapiens
agacauuugauuuaauguaccauucaaaaguaaugaaucuaacuuuccagaauugucacugug

SEQ ID NO: 659977 - RNA, 63 nt, Homo Sapiens
ugcccuaagggacuuaacuuagaaggaaaagacugaaucuaccggcagaagggaauugcucag

SEQ ID NO: 659978 - RNA, 63 nt, Homo Sapiens
ggcaucuuguaaaaaaaaaaaaaaaguuuaaucugaaucuaaccaugaggaaauaaucagaca

SEQ ID NO: 659979 - RNA, 63 nt, Homo Sapiens
aucucuauguauauucuauuuuauuaaauuaauugaaucuaguauaugcgggauguacgacau

SEQ ID NO: 659980 - RNA, 63 nt, Homo Sapiens
gcaauaccugucuguaauaugagaaaaaaaaaaugaaucuauuuaaucauuucuacuugcagu

SEQ ID NO: 659981 - RNA, 63 nt, Homo Sapiens
uuuugcauguuuauaauaaaccuuaauaacaagugaaucuauauuauugauauaaucguauca

SEQ ID NO: 659982 - RNA, 63 nt, Homo Sapiens
agcauuacagggguaaaugccuagauucuucugugaaucuaaaguauauguauuugguucuau

SEQ ID NO: 659983 - RNA, 63 nt, Homo Sapiens
uuaauaaauuuuccauuuuuuuucaaacaaguaugaaucuaguugguugaugccuuuuuuuuc

SEQ ID NO: 659984 - RNA, 63 nt, Homo Sapiens
ccuucauaguaauaaaaucucaaucuuaaagcaugaaucuaaaacauaaauauuuauauuaca

SEQ ID NO: 659985 - RNA, 63 nt, Homo Sapiens
ggaagagaauuaacuagaauuaaauuuaauguuugaaucuaaaucauugggcaaacuucuaau

SEQ ID NO: 659986 - RNA, 63 nt, Homo Sapiens
ugauauuuucugaagaugcuuuuuggaaagcucugaaucuauaccuaaugcucuuaauuauug

SEQ ID NO: 659987 - RNA, 63 nt, Homo Sapiens
uaguauuccacuguguggcuggauuucuauaauugaaucuaauuuuagacaguuugaguaauu

SEQ ID NO: 659988 - RNA, 63 nt, Homo Sapiens
auugguuaauugacuguuuaaggccuuaacaggugaaucuagagccuacuuuuauuuugguua

SEQ ID NO: 659989 - RNA, 63 nt, Homo Sapiens
uucacuuuuuuuuguuuucuuucaaaucauguuugaaucuacaacauuuuuagaacuccaguu

SEQ ID NO: 659990 - RNA, 63 nt, Homo Sapiens
cuaguaaucucaagaaagauggcacugaagaccugaaucuacaaugugaauguagguugagag

SEQ ID NO: 659991 - RNA, 63 nt, Homo Sapiens
ggaagaacauagguaucauuaucucuuaauaagugaaucuaguuuacuuccauauaaagacag

SEQ ID NO: 659992 - RNA, 63 nt, Homo Sapiens
guguuuguguuuguguguguuuguucuuuuuauugaaucuauuuaaguaaaaaaaaaauuggu

SEQ ID NO: 659993 - RNA, 63 nt, Homo Sapiens
cacguaggggugggcuaugggcuguauuuauugugaaucuaguuugugaggcuguggccccga

SEQ ID NO: 659994 - RNA, 63 nt, Homo Sapiens
auaguccugauaggguuugaauugggauuucugugaaucuauagaucaaucugaggagacuua

SEQ ID NO: 659995 - RNA, 63 nt, Homo Sapiens
uucuaggguccaacaccagcuuaccuuggaguaugaaucuacccaugaaggaugagagauguu

SEQ ID NO: 659996 - RNA, 56 nt, Homo Sapiens
auucaucagagaguccaugauggugaugaaucuauuaaucaugaugagugugauag

SEQ ID NO: 659997 - RNA, 63 nt, Homo Sapiens
aggacacaagagagaaaagcucacuaagaagcuugaaucuacuuuuuuuuuuuuuugagacag

SEQ ID NO: 659998 - RNA, 63 nt, Homo Sapiens
agcugcucgggaggcugaggcaggagaaucacuugaaucuaggaggcagaguuugcagugagc

SEQ ID NO: 659999 - RNA, 61 nt, Homo Sapiens
gccgcugccuaugugcuugugucauuaaaaagaugaaucuaccuccucugaauuuuaggau

SEQ ID NO: 660000 - RNA, 63 nt, Homo Sapiens
aagguucacuguugacacaguucgaugacaccgugaaucuaaugauuuuuaucuugcuauaag

SEQ ID NO: 660001 - RNA, 63 nt, Homo Sapiens
cugucuucuucuguuccucaauguauguguacaugaaucuaaaaauauacccaaauaaaauau

SEQ ID NO: 660002 - RNA, 63 nt, Homo Sapiens
ccauuucugauauacugaauguuuuuccucauuugaaucuaacaacaaaauuuaccaacuaca

SEQ ID NO: 660003 - RNA, 63 nt, Homo Sapiens
ucacauucgguuauauaaucaugaguauuguguugaaucuaaaaaaaaguuauggggauuucu

SEQ ID NO: 660004 - RNA, 63 nt, Homo Sapiens
ucacauucaguuauaaucaucuggguauuguguugaaucuacaaaaaaguuauagaaauuucu

SEQ ID NO: 660005 - RNA, 63 nt, Homo Sapiens
guagauugggguuggggagggaugaagggcgagugaaucuaaggauaaugaaauaaucaguga

SEQ ID NO: 660006 - RNA, 63 nt, Homo Sapiens
cuguguuuccagcccugugcacuaguaucuucuugaaucuaggacacacacacacacacccua

SEQ ID NO: 660007 - RNA, 63 nt, Homo Sapiens
ggacuuuccccuuuuuauauuuguggaugucauugaaucuagaugguguaaauaauguacaau

SEQ ID NO: 660008 - RNA, 63 nt, Homo Sapiens
aaaaaaaucuguaugccugaguaccauccuggaugaaucuagaagguaugggguagagcuuga

SEQ ID NO: 660009 - RNA, 63 nt, Homo Sapiens
gcgugucucugacaucucucacuuccuuuuagaugaaucuacuuuagguucauuccuauauuu

SEQ ID NO: 660010 - RNA, 63 nt, Homo Sapiens
aauauuuauuucaaagacuucacuucuguuuccugaaucuaaagaaagacaacaugcugcuuu

SEQ ID NO: 660011 - RNA, 63 nt, Homo Sapiens
uuucuucagacugaggccuuccagaguuuucuaugaaucuauuggcaggcccccggggagggg

SEQ ID NO: 660012 - RNA, 63 nt, Homo Sapiens
agagguauuaucaggguugacaacuccuaugauugaaucuaugggaauuauuccucagaagag

SEQ ID NO: 660013 - RNA, 63 nt, Homo Sapiens
aaaauuaauauaaaaauuggcauaauguuggauugaaucuacauuuuggcagaaguuaaacau

SEQ ID NO: 660014 - RNA, 63 nt, Homo Sapiens
uuuuuuuucaugaaaaugucaacaugguucuucugaaucuaucacagugaaaaguucuaacuu

SEQ ID NO: 660015 - RNA, 63 nt, Homo Sapiens
aagcaucacaaaugauauuaaaaauuggcuaguugaaucuauugggauuuucuacaaguauuc

SEQ ID NO: 660016 - RNA, 63 nt, Homo Sapiens
caguuauucugguaaaaauaggcaaaagugaccugaaucuacaaugaugucccaaaguaacca

SEQ ID NO: 660017 - RNA, 63 nt, Homo Sapiens
gucuuccccgaaaagcccagaacuuuacagaauugaaucuagagaaggagaaaacugcaucau

SEQ ID NO: 660018 - RNA, 63 nt, Homo Sapiens
ugugggugugcuauagcuuuagacaaccaaguaugaaucuauucauacucaugcaugcaaauu

SEQ ID NO: 660019 - RNA, 63 nt, Homo Sapiens
uuaagaucuaaauuagcaucaauugaagaugacugaaucuauucccucucuccaaucaucuaa

SEQ ID NO: 660020 - RNA, 64 nt, Homo Sapiens; identical to SEQ ID NO: 432969

SEQ ID NO: 660021 - RNA, 64 nt, Homo Sapiens; identical to SEQ ID NO: 432970

SEQ ID NO: 660022 - RNA, 64 nt, Homo Sapiens; identical to SEQ ID NO: 432971

SEQ ID NO: 660023 - RNA, 64 nt, Homo Sapiens; identical to SEQ ID NO: 432972

SEQ ID NO: 660024 - RNA, 64 nt, Homo Sapiens; identical to SEQ ID NO: 432973

SEQ ID NO: 660025 - RNA, 64 nt, Homo Sapiens; identical to SEQ ID NO: 432974

SEQ ID NO: 660026 - RNA, 64 nt, Homo Sapiens; identical to SEQ ID NO: 432975

SEQ ID NO: 660027 - RNA, 64 nt, Homo Sapiens; identical to SEQ ID NO: 432976

SEQ ID NO: 660028 - RNA, 64 nt, Homo Sapiens; identical to SEQ ID NO: 432977

SEQ ID NO: 660029 - RNA, 64 nt, Homo Sapiens; identical to SEQ ID NO: 432978

SEQ ID NO: 660030 - RNA, 64 nt, Homo Sapiens; identical to SEQ ID NO: 432979

SEQ ID NO: 660031 - RNA, 64 nt, Homo Sapiens; identical to SEQ ID NO: 432980

SEQ ID NO: 660032 - RNA, 64 nt, Homo Sapiens; identical to SEQ ID NO: 432981

SEQ ID NO: 660033 - RNA, 64 nt, Homo Sapiens; identical to SEQ ID NO: 432982

SEQ ID NO: 660034 - RNA, 64 nt, Homo Sapiens; identical to SEQ ID NO: 432983

SEQ ID NO: 660035 - RNA, 64 nt, Homo Sapiens; identical to SEQ ID NO: 432984

SEQ ID NO: 660036 - RNA, 64 nt, Homo Sapiens; identical to SEQ ID NO: 432985

SEQ ID NO: 660037 - RNA, 64 nt, Homo Sapiens; identical to SEQ ID NO: 432986

SEQ ID NO: 660038 - RNA, 64 nt, Homo Sapiens; identical to SEQ ID NO: 432987

SEQ ID NO: 660039 - RNA, 64 nt, Homo Sapiens; identical to SEQ ID NO: 432988

SEQ ID NO: 660040 - RNA, 64 nt, Homo Sapiens; identical to SEQ ID NO: 432989

SEQ ID NO: 660041 - RNA, 64 nt, Homo Sapiens; identical to SEQ ID NO: 432990

SEQ ID NO: 660042 - RNA, 64 nt, Homo Sapiens; identical to SEQ ID NO: 432991

SEQ ID NO: 660043 - RNA, 64 nt, Homo Sapiens; identical to SEQ ID NO: 432992

SEQ ID NO: 660044 - RNA, 64 nt, Homo Sapiens; identical to SEQ ID NO: 432993

SEQ ID NO: 660045 - RNA, 64 nt, Homo Sapiens; identical to SEQ ID NO: 432994

SEQ ID NO: 660046 - RNA, 64 nt, Homo Sapiens; identical to SEQ ID NO: 432995

SEQ ID NO: 660047 - RNA, 64 nt, Homo Sapiens; identical to SEQ ID NO: 432996

SEQ ID NO: 660048 - RNA, 64 nt, Homo Sapiens; identical to SEQ ID NO: 432997

SEQ ID NO: 660049 - RNA, 64 nt, Homo Sapiens; identical to SEQ ID NO: 154777

SEQ ID NO: 660050 - RNA, 64 nt, Homo Sapiens; identical to SEQ ID NO: 154778

SEQ ID NO: 660051 - RNA, 64 nt, Homo Sapiens; identical to SEQ ID NO: 154779

SEQ ID NO: 660052 - RNA, 64 nt, Homo Sapiens; identical to SEQ ID NO: 154780

SEQ ID NO: 660053 - RNA, 64 nt, Homo Sapiens; identical to SEQ ID NO: 154781

SEQ ID NO: 660054 - RNA, 64 nt, Homo Sapiens; identical to SEQ ID NO: 154782

SEQ ID NO: 660055 - RNA, 64 nt, Homo Sapiens; identical to SEQ ID NO: 154783

SEQ ID NO: 660056 - RNA, 64 nt, Homo Sapiens; identical to SEQ ID NO: 154784

SEQ ID NO: 660057 - RNA, 64 nt, Homo Sapiens; identical to SEQ ID NO: 154785

SEQ ID NO: 660058 - RNA, 64 nt, Homo Sapiens; identical to SEQ ID NO: 154786

SEQ ID NO: 660059 - RNA, 64 nt, Homo Sapiens; identical to SEQ ID NO: 154787

SEQ ID NO: 660060 - RNA, 64 nt, Homo Sapiens; identical to SEQ ID NO: 154788

SEQ ID NO: 660061 - RNA, 64 nt, Homo Sapiens; identical to SEQ ID NO: 154789

SEQ ID NO: 660062 - RNA, 64 nt, Homo Sapiens; identical to SEQ ID NO: 154790

SEQ ID NO: 660063 - RNA, 64 nt, Homo Sapiens; identical to SEQ ID NO: 154791

SEQ ID NO: 660064 - RNA, 64 nt, Homo Sapiens; identical to SEQ ID NO: 154792

SEQ ID NO: 660065 - RNA, 64 nt, Homo Sapiens; identical to SEQ ID NO: 154793

SEQ ID NO: 660066 - RNA, 64 nt, Homo Sapiens; identical to SEQ ID NO: 154794

SEQ ID NO: 660067 - RNA, 64 nt, Homo Sapiens; identical to SEQ ID NO: 154795

SEQ ID NO: 660068 - RNA, 64 nt, Homo Sapiens; identical to SEQ ID NO: 154796

SEQ ID NO: 660069 - RNA, 64 nt, Homo Sapiens; identical to SEQ ID NO: 154797

SEQ ID NO: 660070 - RNA, 64 nt, Homo Sapiens; identical to SEQ ID NO: 154798

SEQ ID NO: 660071 - RNA, 64 nt, Homo Sapiens; identical to SEQ ID NO: 154799

SEQ ID NO: 660072 - RNA, 64 nt, Homo Sapiens; identical to SEQ ID NO: 154800

SEQ ID NO: 660073 - RNA, 64 nt, Homo Sapiens; identical to SEQ ID NO: 315044

SEQ ID NO: 660074 - RNA, 64 nt, Homo Sapiens; identical to SEQ ID NO: 315045

SEQ ID NO: 660075 - RNA, 64 nt, Homo Sapiens; identical to SEQ ID NO: 315046

SEQ ID NO: 660076 - RNA, 64 nt, Homo Sapiens; identical to SEQ ID NO: 315047

SEQ ID NO: 660077 - RNA, 64 nt, Homo Sapiens; identical to SEQ ID NO: 315048

SEQ ID NO: 660078 - RNA, 64 nt, Homo Sapiens; identical to SEQ ID NO: 315049

SEQ ID NO: 660079 - RNA, 64 nt, Homo Sapiens; identical to SEQ ID NO: 315050

SEQ ID NO: 660080 - RNA, 64 nt, Homo Sapiens; identical to SEQ ID NO: 315051

SEQ ID NO: 660081 - RNA, 64 nt, Homo Sapiens; identical to SEQ ID NO: 315052

SEQ ID NO: 660082 - RNA, 64 nt, Homo Sapiens; identical to SEQ ID NO: 315053

SEQ ID NO: 660083 - RNA, 64 nt, Homo Sapiens; identical to SEQ ID NO: 315054

SEQ ID NO: 660084 - RNA, 64 nt, Homo Sapiens; identical to SEQ ID NO: 315055

SEQ ID NO: 660085 - RNA, 64 nt, Homo Sapiens; identical to SEQ ID NO: 315056

SEQ ID NO: 660086 - RNA, 64 nt, Homo Sapiens; identical to SEQ ID NO: 315057

SEQ ID NO: 660087 - RNA, 64 nt, Homo Sapiens; identical to SEQ ID NO: 315058

SEQ ID NO: 660088 - RNA, 64 nt, Homo Sapiens; identical to SEQ ID NO: 315059

SEQ ID NO: 660089 - RNA, 64 nt, Homo Sapiens; identical to SEQ ID NO: 315060

SEQ ID NO: 660090 - RNA, 64 nt, Homo Sapiens; identical to SEQ ID NO: 315061

SEQ ID NO: 660091 - RNA, 64 nt, Homo Sapiens; identical to SEQ ID NO: 315062

SEQ ID NO: 660092 - RNA, 64 nt, Homo Sapiens; identical to SEQ ID NO: 315063

SEQ ID NO: 660093 - RNA, 64 nt, Homo Sapiens; identical to SEQ ID NO: 315064

SEQ ID NO: 660094 - RNA, 64 nt, Homo Sapiens; identical to SEQ ID NO: 315065

SEQ ID NO: 660095 - RNA, 64 nt, Homo Sapiens; identical to SEQ ID NO: 315066

SEQ ID NO: 660096 - RNA, 64 nt, Homo Sapiens; identical to SEQ ID NO: 315067

SEQ ID NO: 660097 - RNA, 57 nt, Homo Sapiens; identical to SEQ ID NO: 315068

SEQ ID NO: 660098 - RNA, 64 nt, Homo Sapiens; identical to SEQ ID NO: 315069

SEQ ID NO: 660099 - RNA, 64 nt, Homo Sapiens; identical to SEQ ID NO: 315070

SEQ ID NO: 660100 - RNA, 64 nt, Homo Sapiens; identical to SEQ ID NO: 315071

SEQ ID NO: 660101 - RNA, 64 nt, Homo Sapiens; identical to SEQ ID NO: 315072

SEQ ID NO: 660102 - RNA, 64 nt, Homo Sapiens; identical to SEQ ID NO: 315073

SEQ ID NO: 660103 - RNA, 64 nt, Homo Sapiens; identical to SEQ ID NO: 315074

SEQ ID NO: 660104 - RNA, 64 nt, Homo Sapiens; identical to SEQ ID NO: 315075

SEQ ID NO: 660105 - RNA, 64 nt, Homo Sapiens; identical to SEQ ID NO: 194715

SEQ ID NO: 660106 - RNA, 64 nt, Homo Sapiens; identical to SEQ ID NO: 194716

SEQ ID NO: 660107 - RNA, 64 nt, Homo Sapiens; identical to SEQ ID NO: 194717

SEQ ID NO: 660108 - RNA, 64 nt, Homo Sapiens; identical to SEQ ID NO: 194718

SEQ ID NO: 660109 - RNA, 64 nt, Homo Sapiens; identical to SEQ ID NO: 194719

SEQ ID NO: 660110 - RNA, 64 nt, Homo Sapiens; identical to SEQ ID NO: 194720

SEQ ID NO: 660111 - RNA, 64 nt, Homo Sapiens; identical to SEQ ID NO: 194721

SEQ ID NO: 660112 - RNA, 64 nt, Homo Sapiens; identical to SEQ ID NO: 194722

SEQ ID NO: 660113 - RNA, 64 nt, Homo Sapiens; identical to SEQ ID NO: 194723

SEQ ID NO: 660114 - RNA, 64 nt, Homo Sapiens; identical to SEQ ID NO: 194724

SEQ ID NO: 660115 - RNA, 64 nt, Homo Sapiens; identical to SEQ ID NO: 194725

SEQ ID NO: 660116 - RNA, 64 nt, Homo Sapiens; identical to SEQ ID NO: 194726

SEQ ID NO: 660117 - RNA, 64 nt, Homo Sapiens; identical to SEQ ID NO: 194727

SEQ ID NO: 660118 - RNA, 64 nt, Homo Sapiens; identical to SEQ ID NO: 194728

SEQ ID NO: 660119 - RNA, 64 nt, Homo Sapiens; identical to SEQ ID NO: 194729

SEQ ID NO: 660120 - RNA, 64 nt, Homo Sapiens; identical to SEQ ID NO: 194730

SEQ ID NO: 660121 - RNA, 64 nt, Homo Sapiens; identical to SEQ ID NO: 194731

SEQ ID NO: 660122 - RNA, 64 nt, Homo Sapiens; identical to SEQ ID NO: 194732

SEQ ID NO: 660123 - RNA, 64 nt, Homo Sapiens; identical to SEQ ID NO: 194733

SEQ ID NO: 660124 - RNA, 64 nt, Homo Sapiens; identical to SEQ ID NO: 194734

SEQ ID NO: 660125 - RNA, 64 nt, Homo Sapiens; identical to SEQ ID NO: 194735

SEQ ID NO: 660126 - RNA, 64 nt, Homo Sapiens; identical to SEQ ID NO: 194736

SEQ ID NO: 660127 - RNA, 64 nt, Homo Sapiens; identical to SEQ ID NO: 194737

SEQ ID NO: 660128 - RNA, 64 nt, Homo Sapiens; identical to SEQ ID NO: 194738

SEQ ID NO: 660129 - RNA, 64 nt, Homo Sapiens; identical to SEQ ID NO: 194739

SEQ ID NO: 660130 - RNA, 64 nt, Homo Sapiens; identical to SEQ ID NO: 194740

SEQ ID NO: 660131 - RNA, 64 nt, Homo Sapiens; identical to SEQ ID NO: 194741

SEQ ID NO: 660132 - RNA, 64 nt, Homo Sapiens; identical to SEQ ID NO: 194742

SEQ ID NO: 660133 - RNA, 64 nt, Homo Sapiens; identical to SEQ ID NO: 194743

SEQ ID NO: 660134 - RNA, 64 nt, Homo Sapiens; identical to SEQ ID NO: 194744

SEQ ID NO: 660135 - RNA, 64 nt, Homo Sapiens; identical to SEQ ID NO: 194745

SEQ ID NO: 660136 - RNA, 64 nt, Homo Sapiens; identical to SEQ ID NO: 194746

SEQ ID NO: 660137 - RNA, 64 nt, Homo Sapiens; identical to SEQ ID NO: 194747

SEQ ID NO: 660138 - RNA, 64 nt, Homo Sapiens
uaaauaauugaaacaaucugaaucccuugcaauuggagguaaauuaugucuuaguuauaauuag

SEQ ID NO: 660139 - RNA, 64 nt, Homo Sapiens
cauaauccccacauguugugggagggacccagugggagguaauuaaaucaugggggugguuacc

SEQ ID NO: 660140 - RNA, 64 nt, Homo Sapiens
uuuuucuuuggcagaggcccgauuuucugaaacaggagguaaaaaacaggcugguugcugguua

SEQ ID NO: 660141 - RNA, 64 nt, Homo Sapiens
caucccccgggagaccuugcacagggagacagagggagguaagcgggggacuccguuuacuacc

SEQ ID NO: 660142 - RNA, 64 nt, Homo Sapiens; identical to SEQ ID NO: 323664

SEQ ID NO: 660143 - RNA, 64 nt, Homo Sapiens; identical to SEQ ID NO: 323665

SEQ ID NO: 660144 - RNA, 64 nt, Homo Sapiens; identical to SEQ ID NO: 323666

SEQ ID NO: 660145 - RNA, 64 nt, Homo Sapiens; identical to SEQ ID NO: 323667

SEQ ID NO: 660146 - RNA, 64 nt, Homo Sapiens; identical to SEQ ID NO: 323668

SEQ ID NO: 660147 - RNA, 64 nt, Homo Sapiens; identical to SEQ ID NO: 323669

SEQ ID NO: 660148 - RNA, 64 nt, Homo Sapiens; identical to SEQ ID NO: 323670

SEQ ID NO: 660149 - RNA, 64 nt, Homo Sapiens; identical to SEQ ID NO: 323671

SEQ ID NO: 660150 - RNA, 64 nt, Homo Sapiens; identical to SEQ ID NO: 323672

SEQ ID NO: 660151 - RNA, 64 nt, Homo Sapiens; identical to SEQ ID NO: 323673

SEQ ID NO: 660152 - RNA, 64 nt, Homo Sapiens; identical to SEQ ID NO: 323674

SEQ ID NO: 660153 - RNA, 64 nt, Homo Sapiens; identical to SEQ ID NO: 323675

SEQ ID NO: 660154 - RNA, 64 nt, Homo Sapiens; identical to SEQ ID NO: 323676

SEQ ID NO: 660155 - RNA, 64 nt, Homo Sapiens; identical to SEQ ID NO: 323677

SEQ ID NO: 660156 - RNA, 64 nt, Homo Sapiens; identical to SEQ ID NO: 323678

SEQ ID NO: 660157 - RNA, 64 nt, Homo Sapiens; identical to SEQ ID NO: 323679

SEQ ID NO: 660158 - RNA, 64 nt, Homo Sapiens; identical to SEQ ID NO: 323680

SEQ ID NO: 660159 - RNA, 64 nt, Homo Sapiens; identical to SEQ ID NO: 323681

SEQ ID NO: 660160 - RNA, 64 nt, Homo Sapiens; identical to SEQ ID NO: 323682

SEQ ID NO: 660161 - RNA, 64 nt, Homo Sapiens; identical to SEQ ID NO: 323683

SEQ ID NO: 660162 - RNA, 64 nt, Homo Sapiens; identical to SEQ ID NO: 323684

SEQ ID NO: 660163 - RNA, 64 nt, Homo Sapiens; identical to SEQ ID NO: 323685

SEQ ID NO: 660164 - RNA, 64 nt, Homo Sapiens; identical to SEQ ID NO: 323686

SEQ ID NO: 660165 - RNA, 64 nt, Homo Sapiens; identical to SEQ ID NO: 323687

SEQ ID NO: 660166 - RNA, 64 nt, Homo Sapiens; identical to SEQ ID NO: 323688

SEQ ID NO: 660167 - RNA, 64 nt, Homo Sapiens; identical to SEQ ID NO: 323689

SEQ ID NO: 660168 - RNA, 64 nt, Homo Sapiens; identical to SEQ ID NO: 323690

SEQ ID NO: 660169 - RNA, 64 nt, Homo Sapiens; identical to SEQ ID NO: 323691

SEQ ID NO: 660170 - RNA, 64 nt, Homo Sapiens; identical to SEQ ID NO: 323691

SEQ ID NO: 660171 - RNA, 64 nt, Homo Sapiens; identical to SEQ ID NO: 323693

SEQ ID NO: 660172 - RNA, 64 nt, Homo Sapiens; identical to SEQ ID NO: 323694

SEQ ID NO: 660173 - RNA, 64 nt, Homo Sapiens; identical to SEQ ID NO: 323695

SEQ ID NO: 660174 - RNA, 64 nt, Homo Sapiens; identical to SEQ ID NO: 323696

SEQ ID NO: 660175 - RNA, 64 nt, Homo Sapiens; identical to SEQ ID NO: 323697

SEQ ID NO: 660176 - RNA, 64 nt, Homo Sapiens; identical to SEQ ID NO: 323698

SEQ ID NO: 660177 - RNA, 64 nt, Homo Sapiens; identical to SEQ ID NO: 323699

SEQ ID NO: 660178 - RNA, 64 nt, Homo Sapiens; identical to SEQ ID NO: 323700

SEQ ID NO: 660179 - RNA, 64 nt, Homo Sapiens; identical to SEQ ID NO: 323701

SEQ ID NO: 660180 - RNA, 64 nt, Homo Sapiens; identical to SEQ ID NO: 426252

SEQ ID NO: 660181 - RNA, 64 nt, Homo Sapiens; identical to SEQ ID NO: 426253

SEQ ID NO: 660182 - RNA, 64 nt, Homo Sapiens; identical to SEQ ID NO: 426254

SEQ ID NO: 660183 - RNA, 64 nt, Homo Sapiens; identical to SEQ ID NO: 426255

SEQ ID NO: 660184 - RNA, 64 nt, Homo Sapiens; identical to SEQ ID NO: 426256

SEQ ID NO: 660185 - RNA, 64 nt, Homo Sapiens; identical to SEQ ID NO: 426257

SEQ ID NO: 660186 - RNA, 64 nt, Homo Sapiens; identical to SEQ ID NO: 426258

SEQ ID NO: 660187 - RNA, 64 nt, Homo Sapiens; identical to SEQ ID NO: 426259

SEQ ID NO: 660188 - RNA, 64 nt, Homo Sapiens; identical to SEQ ID NO: 426260

SEQ ID NO: 660189 - RNA, 64 nt, Homo Sapiens; identical to SEQ ID NO: 426261

SEQ ID NO: 660190 - RNA, 64 nt, Homo Sapiens; identical to SEQ ID NO: 426262

SEQ ID NO: 660191 - RNA, 64 nt, Homo Sapiens; identical to SEQ ID NO: 426263

SEQ ID NO: 660192 - RNA, 64 nt, Homo Sapiens; identical to SEQ ID NO: 426264

SEQ ID NO: 660193 - RNA, 64 nt, Homo Sapiens; identical to SEQ ID NO: 426265

SEQ ID NO: 660194 - RNA, 64 nt, Homo Sapiens; identical to SEQ ID NO: 426266

SEQ ID NO: 660195 - RNA, 64 nt, Homo Sapiens; identical to SEQ ID NO: 426267

SEQ ID NO: 660196 - RNA, 64 nt, Homo Sapiens; identical to SEQ ID NO: 426268

SEQ ID NO: 660197 - RNA, 64 nt, Homo Sapiens; identical to SEQ ID NO: 426269

SEQ ID NO: 660198 - RNA, 64 nt, Homo Sapiens; identical to SEQ ID NO: 426270

SEQ ID NO: 660199 - RNA, 64 nt, Homo Sapiens; identical to SEQ ID NO: 426271

SEQ ID NO: 660200 - RNA, 64 nt, Homo Sapiens; identical to SEQ ID NO: 426272

SEQ ID NO: 660201 - RNA, 64 nt, Homo Sapiens; identical to SEQ ID NO: 426273

SEQ ID NO: 660202 - RNA, 64 nt, Homo Sapiens; identical to SEQ ID NO: 426274

SEQ ID NO: 660203 - RNA, 64 nt, Homo Sapiens; identical to SEQ ID NO: 426275

SEQ ID NO: 660204 - RNA, 60 nt, Homo Sapiens; identical to SEQ ID NO: 90161

SEQ ID NO: 660205 - RNA, 64 nt, Homo Sapiens; identical to SEQ ID NO: 426277

SEQ ID NO: 660206 - RNA, 64 nt, Homo Sapiens; identical to SEQ ID NO: 426278

SEQ ID NO: 660207 - RNA, 64 nt, Homo Sapiens; identical to SEQ ID NO: 426279

SEQ ID NO: 660208 - RNA, 64 nt, Homo Sapiens; identical to SEQ ID NO: 426280

SEQ ID NO: 660209 - RNA, 64 nt, Homo Sapiens; identical to SEQ ID NO: 426281

SEQ ID NO: 660210 - RNA, 64 nt, Homo Sapiens; identical to SEQ ID NO: 426282

SEQ ID NO: 660211 - RNA, 64 nt, Homo Sapiens; identical to SEQ ID NO: 426283

SEQ ID NO: 660212 - RNA, 64 nt, Homo Sapiens; identical to SEQ ID NO: 426284

SEQ ID NO: 660213 - RNA, 64 nt, Homo Sapiens; identical to SEQ ID NO: 426285

SEQ ID NO: 660214 - RNA, 64 nt, Homo Sapiens; identical to SEQ ID NO: 426286

SEQ ID NO: 660215 - RNA, 64 nt, Homo Sapiens; identical to SEQ ID NO: 426287

SEQ ID NO: 660216 - RNA, 64 nt, Homo Sapiens; identical to SEQ ID NO: 426288

SEQ ID NO: 660217 - RNA, 64 nt, Homo Sapiens; identical to SEQ ID NO: 426289

SEQ ID NO: 660218 - RNA, 64 nt, Homo Sapiens; identical to SEQ ID NO: 426290

SEQ ID NO: 660219 - RNA, 64 nt, Homo Sapiens; identical to SEQ ID NO: 426291

SEQ ID NO: 660220 - RNA, 64 nt, Homo Sapiens; identical to SEQ ID NO: 426292

SEQ ID NO: 660221 - RNA, 64 nt, Homo Sapiens; identical to SEQ ID NO: 426293

SEQ ID NO: 660222 - RNA, 64 nt, Homo Sapiens; identical to SEQ ID NO: 426294

SEQ ID NO: 660223 - RNA, 64 nt, Homo Sapiens; identical to SEQ ID NO: 426295

SEQ ID NO: 660224 - RNA, 64 nt, Homo Sapiens; identical to SEQ ID NO: 426296

SEQ ID NO: 660225 - RNA, 64 nt, Homo Sapiens; identical to SEQ ID NO: 426297

SEQ ID NO: 660226 - RNA, 64 nt, Homo Sapiens; identical to SEQ ID NO: 426298

SEQ ID NO: 660227 - RNA, 64 nt, Homo Sapiens; identical to SEQ ID NO: 426299

SEQ ID NO: 660228 - RNA, 64 nt, Homo Sapiens; identical to SEQ ID NO: 426300

SEQ ID NO: 660229 - RNA, 64 nt, Homo Sapiens; identical to SEQ ID NO: 426301

SEQ ID NO: 660230 - RNA, 64 nt, Homo Sapiens; identical to SEQ ID NO: 426302

SEQ ID NO: 660231 - RNA, 64 nt, Homo Sapiens; identical to SEQ ID NO: 426303

SEQ ID NO: 660232 - RNA, 64 nt, Homo Sapiens; identical to SEQ ID NO: 618496

SEQ ID NO: 660233 - RNA, 64 nt, Homo Sapiens; identical to SEQ ID NO: 618497

SEQ ID NO: 660234 - RNA, 64 nt, Homo Sapiens; identical to SEQ ID NO: 618498

SEQ ID NO: 660235 - RNA, 64 nt, Homo Sapiens; identical to SEQ ID NO: 618499

SEQ ID NO: 660236 - RNA, 64 nt, Homo Sapiens; identical to SEQ ID NO: 618500

SEQ ID NO: 660237 - RNA, 64 nt, Homo Sapiens; identical to SEQ ID NO: 618501

SEQ ID NO: 660238 - RNA, 64 nt, Homo Sapiens; identical to SEQ ID NO: 618502

SEQ ID NO: 660239 - RNA, 64 nt, Homo Sapiens; identical to SEQ ID NO: 618503

SEQ ID NO: 660240 - RNA, 64 nt, Homo Sapiens; identical to SEQ ID NO: 618504

SEQ ID NO: 660241 - RNA, 64 nt, Homo Sapiens; identical to SEQ ID NO: 618505

SEQ ID NO: 660242 - RNA, 64 nt, Homo Sapiens; identical to SEQ ID NO: 618506

SEQ ID NO: 660243 - RNA, 64 nt, Homo Sapiens; identical to SEQ ID NO: 618507

SEQ ID NO: 660244 - RNA, 54 nt, Homo Sapiens; identical to SEQ ID NO: 618508

SEQ ID NO: 660245 - RNA, 64 nt, Homo Sapiens; identical to SEQ ID NO: 618509

SEQ ID NO: 660246 - RNA, 64 nt, Homo Sapiens; identical to SEQ ID NO: 618510

SEQ ID NO: 660247 - RNA, 64 nt, Homo Sapiens; identical to SEQ ID NO: 618511

SEQ ID NO: 660248 - RNA, 64 nt, Homo Sapiens; identical to SEQ ID NO: 618512

SEQ ID NO: 660249 - RNA, 64 nt, Homo Sapiens; identical to SEQ ID NO: 618513

SEQ ID NO: 660250 - RNA, 64 nt, Homo Sapiens; identical to SEQ ID NO: 618514

SEQ ID NO: 660251 - RNA, 64 nt, Homo Sapiens; identical to SEQ ID NO: 618515

SEQ ID NO: 660252 - RNA, 64 nt, Homo Sapiens; identical to SEQ ID NO: 618516

SEQ ID NO: 660253 - RNA, 64 nt, Homo Sapiens; identical to SEQ ID NO: 618517

SEQ ID NO: 660254 - RNA, 64 nt, Homo Sapiens; identical to SEQ ID NO: 618518

SEQ ID NO: 660255 - RNA, 64 nt, Homo Sapiens; identical to SEQ ID NO: 618519

SEQ ID NO: 660256 - RNA, 64 nt, Homo Sapiens; identical to SEQ ID NO: 618520

SEQ ID NO: 660257 - RNA, 64 nt, Homo Sapiens; identical to SEQ ID NO: 618521

SEQ ID NO: 660258 - RNA, 64 nt, Homo Sapiens; identical to SEQ ID NO: 618522

SEQ ID NO: 660259 - RNA, 64 nt, Homo Sapiens; identical to SEQ ID NO: 618523

SEQ ID NO: 660260 - RNA, 64 nt, Homo Sapiens; identical to SEQ ID NO: 618524

SEQ ID NO: 660261 - RNA, 64 nt, Homo Sapiens; identical to SEQ ID NO: 618525

SEQ ID NO: 660262 - RNA, 57 nt, Homo Sapiens; identical to SEQ ID NO: 618526

SEQ ID NO: 660263 - RNA, 64 nt, Homo Sapiens; identical to SEQ ID NO: 618527

SEQ ID NO: 660264 - RNA, 51 nt, Homo Sapiens; identical to SEQ ID NO: 618528

SEQ ID NO: 660265 - RNA, 64 nt, Homo Sapiens; identical to SEQ ID NO: 618529

SEQ ID NO: 660266 - RNA, 64 nt, Homo Sapiens; identical to SEQ ID NO: 618530

SEQ ID NO: 660267 - RNA, 64 nt, Homo Sapiens; identical to SEQ ID NO: 618531

SEQ ID NO: 660268 - RNA, 64 nt, Homo Sapiens; identical to SEQ ID NO: 618532

SEQ ID NO: 660269 - RNA, 64 nt, Homo Sapiens; identical to SEQ ID NO: 618533

SEQ ID NO: 660270 - RNA, 64 nt, Homo Sapiens; identical to SEQ ID NO: 618534

SEQ ID NO: 660271 - RNA, 64 nt, Homo Sapiens; identical to SEQ ID NO: 618535

SEQ ID NO: 660272 - RNA, 64 nt, Homo Sapiens; identical to SEQ ID NO: 618536

SEQ ID NO: 660273 - RNA, 64 nt, Homo Sapiens; identical to SEQ ID NO: 618537

SEQ ID NO: 660274 - RNA, 64 nt, Homo Sapiens; identical to SEQ ID NO: 618538

SEQ ID NO: 660275 - RNA, 64 nt, Homo Sapiens; identical to SEQ ID NO: 618539

SEQ ID NO: 660276 - RNA, 64 nt, Homo Sapiens; identical to SEQ ID NO: 618540

SEQ ID NO: 660277 - RNA, 64 nt, Homo Sapiens; identical to SEQ ID NO: 618541

SEQ ID NO: 660278 - RNA, 64 nt, Homo Sapiens; identical to SEQ ID NO: 618542

SEQ ID NO: 660279 - RNA, 64 nt, Homo Sapiens; identical to SEQ ID NO: 618543

SEQ ID NO: 660280 - RNA, 64 nt, Homo Sapiens; identical to SEQ ID NO: 618544

SEQ ID NO: 660281 - RNA, 64 nt, Homo Sapiens; identical to SEQ ID NO: 618545

SEQ ID NO: 660282 - RNA, 64 nt, Homo Sapiens; identical to SEQ ID NO: 618546

SEQ ID NO: 660283 - RNA, 64 nt, Homo Sapiens; identical to SEQ ID NO: 618547

SEQ ID NO: 660284 - RNA, 64 nt, Homo Sapiens; identical to SEQ ID NO: 618548

SEQ ID NO: 660285 - RNA, 64 nt, Homo Sapiens; identical to SEQ ID NO: 618549

SEQ ID NO: 660286 - RNA, 64 nt, Homo Sapiens; identical to SEQ ID NO: 618550

SEQ ID NO: 660287 - RNA, 63 nt, Homo Sapiens; identical to SEQ ID NO: 618551

SEQ ID NO: 660288 - RNA, 64 nt, Homo Sapiens; identical to SEQ ID NO: 618552

SEQ ID NO: 660289 - RNA, 64 nt, Homo Sapiens; identical to SEQ ID NO: 618553

SEQ ID NO: 660290 - RNA, 64 nt, Homo Sapiens; identical to SEQ ID NO: 618554

SEQ ID NO: 660291 - RNA, 64 nt, Homo Sapiens; identical to SEQ ID NO: 618555

SEQ ID NO: 660292 - RNA, 64 nt, Homo Sapiens; identical to SEQ ID NO: 618556

SEQ ID NO: 660293 - RNA, 64 nt, Homo Sapiens; identical to SEQ ID NO: 618557

SEQ ID NO: 660294 - RNA, 64 nt, Homo Sapiens; identical to SEQ ID NO: 618558

SEQ ID NO: 660295 - RNA, 64 nt, Homo Sapiens; identical to SEQ ID NO: 618559

SEQ ID NO: 660296 - RNA, 64 nt, Homo Sapiens; identical to SEQ ID NO: 618560

SEQ ID NO: 660297 - RNA, 64 nt, Homo Sapiens; identical to SEQ ID NO: 618561

SEQ ID NO: 660298 - RNA, 64 nt, Homo Sapiens; identical to SEQ ID NO: 618562

SEQ ID NO: 660299 - RNA, 64 nt, Homo Sapiens; identical to SEQ ID NO: 618563

SEQ ID NO: 660300 - RNA, 64 nt, Homo Sapiens; identical to SEQ ID NO: 618564

SEQ ID NO: 660301 - RNA, 64 nt, Homo Sapiens; identical to SEQ ID NO: 618565

SEQ ID NO: 660302 - RNA, 64 nt, Homo Sapiens; identical to SEQ ID NO: 618566

SEQ ID NO: 660303 - RNA, 64 nt, Homo Sapiens; identical to SEQ ID NO: 618567

SEQ ID NO: 660304 - RNA, 64 nt, Homo Sapiens; identical to SEQ ID NO: 618568

SEQ ID NO: 660305 - RNA, 64 nt, Homo Sapiens; identical to SEQ ID NO: 107011

SEQ ID NO: 660306 - RNA, 64 nt, Homo Sapiens; identical to SEQ ID NO: 107012

SEQ ID NO: 660307 - RNA, 64 nt, Homo Sapiens; identical to SEQ ID NO: 107013

SEQ ID NO: 660308 - RNA, 64 nt, Homo Sapiens; identical to SEQ ID NO: 107014

SEQ ID NO: 660309 - RNA, 64 nt, Homo Sapiens; identical to SEQ ID NO: 107015

SEQ ID NO: 660310 - RNA, 64 nt, Homo Sapiens; identical to SEQ ID NO: 107016

SEQ ID NO: 660311 - RNA, 64 nt, Homo Sapiens; identical to SEQ ID NO: 107017

SEQ ID NO: 660312 - RNA, 64 nt, Homo Sapiens; identical to SEQ ID NO: 107018

SEQ ID NO: 660313 - RNA, 64 nt, Homo Sapiens; identical to SEQ ID NO: 107019

SEQ ID NO: 660314 - RNA, 64 nt, Homo Sapiens; identical to SEQ ID NO: 107020

SEQ ID NO: 660315 - RNA, 64 nt, Homo Sapiens; identical to SEQ ID NO: 107021

SEQ ID NO: 660316 - RNA, 64 nt, Homo Sapiens; identical to SEQ ID NO: 107022

SEQ ID NO: 660317 - RNA, 64 nt, Homo Sapiens; identical to SEQ ID NO: 107023

SEQ ID NO: 660318 - RNA, 64 nt, Homo Sapiens; identical to SEQ ID NO: 107024

SEQ ID NO: 660319 - RNA, 64 nt, Homo Sapiens; identical to SEQ ID NO: 107025

SEQ ID NO: 660320 - RNA, 64 nt, Homo Sapiens; identical to SEQ ID NO: 107026

SEQ ID NO: 660321 - RNA, 64 nt, Homo Sapiens; identical to SEQ ID NO: 107027

SEQ ID NO: 660322 - RNA, 64 nt, Homo Sapiens; identical to SEQ ID NO: 107028

SEQ ID NO: 660323 - RNA, 64 nt, Homo Sapiens; identical to SEQ ID NO: 107029

SEQ ID NO: 660324 - RNA, 64 nt, Homo Sapiens; identical to SEQ ID NO: 107030

SEQ ID NO: 660325 - RNA, 64 nt, Homo Sapiens; identical to SEQ ID NO: 107031

SEQ ID NO: 660326 - RNA, 64 nt, Homo Sapiens; identical to SEQ ID NO: 107032

SEQ ID NO: 660327 - RNA, 64 nt, Homo Sapiens; identical to SEQ ID NO: 264513

SEQ ID NO: 660328 - RNA, 64 nt, Homo Sapiens; identical to SEQ ID NO: 264514

SEQ ID NO: 660329 - RNA, 64 nt, Homo Sapiens; identical to SEQ ID NO: 264515

SEQ ID NO: 660330 - RNA, 64 nt, Homo Sapiens; identical to SEQ ID NO: 264516

SEQ ID NO: 660331 - RNA, 64 nt, Homo Sapiens; identical to SEQ ID NO: 264517

SEQ ID NO: 660332 - RNA, 64 nt, Homo Sapiens; identical to SEQ ID NO: 264518

SEQ ID NO: 660333 - RNA, 64 nt, Homo Sapiens; identical to SEQ ID NO: 264519

SEQ ID NO: 660334 - RNA, 64 nt, Homo Sapiens; identical to SEQ ID NO: 264520

SEQ ID NO: 660335 - RNA, 64 nt, Homo Sapiens; identical to SEQ ID NO: 264521

SEQ ID NO: 660336 - RNA, 64 nt, Homo Sapiens; identical to SEQ ID NO: 264522

SEQ ID NO: 660337 - RNA, 64 nt, Homo Sapiens; identical to SEQ ID NO: 264523

SEQ ID NO: 660338 - RNA, 64 nt, Homo Sapiens; identical to SEQ ID NO: 264524

SEQ ID NO: 660339 - RNA, 64 nt, Homo Sapiens; identical to SEQ ID NO: 264525

SEQ ID NO: 660340 - RNA, 64 nt, Homo Sapiens; identical to SEQ ID NO: 264526

SEQ ID NO: 660341 - RNA, 64 nt, Homo Sapiens; identical to SEQ ID NO: 264527

SEQ ID NO: 660342 - RNA, 64 nt, Homo Sapiens; identical to SEQ ID NO: 264528

SEQ ID NO: 660343 - RNA, 64 nt, Homo Sapiens; identical to SEQ ID NO: 264529

SEQ ID NO: 660344 - RNA, 64 nt, Homo Sapiens; identical to SEQ ID NO: 264530

SEQ ID NO: 660345 - RNA, 64 nt, Homo Sapiens; identical to SEQ ID NO: 264531

SEQ ID NO: 660346 - RNA, 64 nt, Homo Sapiens; identical to SEQ ID NO: 264532

SEQ ID NO: 660347 - RNA, 64 nt, Homo Sapiens; identical to SEQ ID NO: 264533

SEQ ID NO: 660348 - RNA, 64 nt, Homo Sapiens; identical to SEQ ID NO: 264534

SEQ ID NO: 660349 - RNA, 64 nt, Homo Sapiens; identical to SEQ ID NO: 264535

SEQ ID NO: 660350 - RNA, 64 nt, Homo Sapiens; identical to SEQ ID NO: 264536

SEQ ID NO: 660351 - RNA, 64 nt, Homo Sapiens; identical to SEQ ID NO: 264537

SEQ ID NO: 660352 - RNA, 64 nt, Homo Sapiens; identical to SEQ ID NO: 264538

SEQ ID NO: 660353 - RNA, 64 nt, Homo Sapiens; identical to SEQ ID NO: 264539

SEQ ID NO: 660354 - RNA, 64 nt, Homo Sapiens; identical to SEQ ID NO: 264540

SEQ ID NO: 660355 - RNA, 64 nt, Homo Sapiens; identical to SEQ ID NO: 264541

SEQ ID NO: 660356 - RNA, 64 nt, Homo Sapiens; identical to SEQ ID NO: 264542

SEQ ID NO: 660357 - RNA, 64 nt, Homo Sapiens; identical to SEQ ID NO: 379522

SEQ ID NO: 660358 - RNA, 64 nt, Homo Sapiens; identical to SEQ ID NO: 379523

SEQ ID NO: 660359 - RNA, 64 nt, Homo Sapiens; identical to SEQ ID NO: 379524

SEQ ID NO: 660360 - RNA, 64 nt, Homo Sapiens; identical to SEQ ID NO: 379525

SEQ ID NO: 660361 - RNA, 64 nt, Homo Sapiens; identical to SEQ ID NO: 379526

SEQ ID NO: 660362 - RNA, 64 nt, Homo Sapiens; identical to SEQ ID NO: 379527

SEQ ID NO: 660363 - RNA, 64 nt, Homo Sapiens; identical to SEQ ID NO: 379528

SEQ ID NO: 660364 - RNA, 64 nt, Homo Sapiens; identical to SEQ ID NO: 379529

SEQ ID NO: 660365 - RNA, 64 nt, Homo Sapiens; identical to SEQ ID NO: 379530

SEQ ID NO: 660366 - RNA, 64 nt, Homo Sapiens; identical to SEQ ID NO: 379531

SEQ ID NO: 660367 - RNA, 64 nt, Homo Sapiens; identical to SEQ ID NO: 379532

SEQ ID NO: 660368 - RNA, 64 nt, Homo Sapiens; identical to SEQ ID NO: 379533

SEQ ID NO: 660369 - RNA, 64 nt, Homo Sapiens; identical to SEQ ID NO: 379534

SEQ ID NO: 660370 - RNA, 64 nt, Homo Sapiens; identical to SEQ ID NO: 379535

SEQ ID NO: 660371 - RNA, 64 nt, Homo Sapiens; identical to SEQ ID NO: 379536

SEQ ID NO: 660372 - RNA, 64 nt, Homo Sapiens; identical to SEQ ID NO: 379537

SEQ ID NO: 660373 - RNA, 64 nt, Homo Sapiens; identical to SEQ ID NO: 379538

SEQ ID NO: 660374 - RNA, 64 nt, Homo Sapiens; identical to SEQ ID NO: 379539

SEQ ID NO: 660375 - RNA, 64 nt, Homo Sapiens; identical to SEQ ID NO: 379540

SEQ ID NO: 660376 - RNA, 64 nt, Homo Sapiens; identical to SEQ ID NO: 379541

SEQ ID NO: 660377 - RNA, 64 nt, Homo Sapiens; identical to SEQ ID NO: 379542

SEQ ID NO: 660378 - RNA, 64 nt, Homo Sapiens; identical to SEQ ID NO: 379543

SEQ ID NO: 660379 - RNA, 64 nt, Homo Sapiens; identical to SEQ ID NO: 379544

SEQ ID NO: 660380 - RNA, 64 nt, Homo Sapiens; identical to SEQ ID NO: 379545

SEQ ID NO: 660381 - RNA, 64 nt, Homo Sapiens; identical to SEQ ID NO: 379546

SEQ ID NO: 660382 - RNA, 64 nt, Homo Sapiens; identical to SEQ ID NO: 379547

SEQ ID NO: 660383 - RNA, 64 nt, Homo Sapiens; identical to SEQ ID NO: 379548

SEQ ID NO: 660384 - RNA, 64 nt, Homo Sapiens; identical to SEQ ID NO: 379549

SEQ ID NO: 660385 - RNA, 64 nt, Homo Sapiens; identical to SEQ ID NO: 379550

SEQ ID NO: 660386 - RNA, 64 nt, Homo Sapiens
auuuccauguaaucauugagguuaucacccagauuagaaagacauauuuguuaucaguguacgu

SEQ ID NO: 660387 - RNA, 64 nt, Homo Sapiens
cacuucaugcugaugauguaucaaauucauuuuauagaaagauuuaaaguuuuuuucuggaagu

SEQ ID NO: 660388 - RNA, 64 nt, Homo Sapiens
guuuaccaugauucagagaaguucuucaggccuguagaaagaggaguauggaacaaccuuacau

SEQ ID NO: 660389 - RNA, 64 nt, Homo Sapiens
auuuccugguaaggcuaacuccugaucguuucuguagaaagaugacaaauaaagaaaaaguuau

SEQ ID NO: 660390 - RNA, 64 nt, Homo Sapiens
augagcaugucucuauaauuaucaaaaauauacauagaaagagacacugccacccagggagugg

SEQ ID NO: 660391 - RNA, 64 nt, Homo Sapiens
uuuagggcaaaauaaaguguauuuaauuccuuuuuagaaagaaauuuaaaucuggcuuuacuug

SEQ ID NO: 660392 - RNA, 64 nt, Homo Sapiens
aggacuuuugaggaaugaugugauguguagagaauagaaagauuuagauauaugccugugacag

SEQ ID NO: 660393 - RNA, 64 nt, Homo Sapiens
uaaagcauuuguuuguuaguaucaaucacauagguagaaagaguuugaguuuuacuguggauua

SEQ ID NO: 660394 - RNA, 64 nt, Homo Sapiens
acuaauggucaaguggaacaauuuccucauguucuagaaagaucggcuuuucuaaccagacuug

SEQ ID NO: 660395 - RNA, 64 nt, Homo Sapiens
cccaaaggcuuugugauuguugcggcaguuaucuuagaaagaccauuucucaugcucauuuucu

SEQ ID NO: 660396 - RNA, 64 nt, Homo Sapiens
cacguucagggaaugacguugaaguaaacauggcuagaaagaacggacuuuucuuuuauuggaa

SEQ ID NO: 660397 - RNA, 64 nt, Homo Sapiens
ucaggaaaaugaguuucucugccuggguuggguuuagaaagaucgauguaccccugggggaaaa

SEQ ID NO: 660398 - RNA, 64 nt, Homo Sapiens
gugucucaauaugaauagggggugaguagcuucauagaaagaauggggaacucccuuggccuca

SEQ ID NO: 660399 - RNA, 64 nt, Homo Sapiens
ucuagguuaugaaaacuaucuuagaaggugcuuuuagaaagaaccaggagaacaaccaaagcag

SEQ ID NO: 660400 - RNA, 64 nt, Homo Sapiens
ugaguaguugcuuacgugaagcucaagauaccuguagaaagaaauaugguauauuuguauaguu

SEQ ID NO: 660401 - RNA, 64 nt, Homo Sapiens
agaaagaaauaugguauauuuguauaguuuuuaauagaaagaucuauguuuauaaaccagcacu

SEQ ID NO: 660402 - RNA, 64 nt, Homo Sapiens
ugcuuuaaaaugcuauguaaauauacaaaaaaacuagaaagaaauauauauaaccuuguuauug

SEQ ID NO: 660403 - RNA, 64 nt, Homo Sapiens
aauaguaaaguuguuguaaaaauaaaaguggauuuagaaagauccaguucuugaaaacacuguu

SEQ ID NO: 660404 - RNA, 64 nt, Homo Sapiens
cagcauaauaaucccgggagaaugauuccccucauagaaagacaaaagcauccauccccucaua

SEQ ID NO: 660405 - RNA, 64 nt, Homo Sapiens
gaacuaugaaaagacccuguuugugaauauauuuuagaaagagaggaaggaugucugcagaacu

SEQ ID NO: 660406 - RNA, 64 nt, Homo Sapiens
uuaucuuaaaguauagguggaaggauacaaaugcuagaaagagggaaucaaaucagccccguuu

SEQ ID NO: 660407 - RNA, 64 nt, Homo Sapiens
ggccccacuuuuuguugcuuucuagacuuguguguagaaagaagauuaaugaucacuuaaagua

SEQ ID NO: 660408 - RNA, 64 nt, Homo Sapiens
aaucaagcaucaauuaauuaauuuuuaaaagauguagaaagaagaaacacuaguguccaauuuc

SEQ ID NO: 660409 - RNA, 64 nt, Homo Sapiens
ggguuguuuuccaaaguuuauccucaaugugccauagaaagaugaugagguaaaguacuucagu

SEQ ID NO: 660410 - RNA, 64 nt, Homo Sapiens
gaaaaaguaugaauggucaacucaauuaucuucuuagaaagaaaaucauuugcaaagcacucag

SEQ ID NO: 660411 - RNA, 64 nt, Homo Sapiens
ugauuuggccugggaccaguuugaaucagugaacuagaaagauccaaguagaaguucucuacca

SEQ ID NO: 660412 - RNA, 64 nt, Homo Sapiens
uggggauuuggccccuggcucuuuaagcaguuacuagaaagagacacuucauagcaagggaagg

SEQ ID NO: 660413 - RNA, 64 nt, Homo Sapiens
gagaaugucuuucauuugaaugaauguggcagguuagaaagagagagucacuucaaggccuguu

SEQ ID NO: 660414 - RNA, 64 nt, Homo Sapiens
uaugaagucuuuuacuaccucuccucuucaguaauagaaagacugacuugcaguuauuacuaag

SEQ ID NO: 660415 - RNA, 64 nt, Homo Sapiens
aguuuuuaaaaagcaaacagcacuaagcagaauuuagaaagagaugaauugaggagucaagagu

SEQ ID NO: 660416 - RNA, 64 nt, Homo Sapiens
ccaaauauuuuguacuauaugauaauuuucacaauagaaagagauuuauauacuuuuccagcuu

SEQ ID NO: 660417 - RNA, 64 nt, Homo Sapiens
aguagaccagucaaggucuaaaaaaccuaaugcauagaaagauauuauuuccauuugacagaug

SEQ ID NO: 660418 - RNA, 64 nt, Homo Sapiens
gagcuaugugccuuccaaccagagggagacccaguagaaagaaaaacauccugggaaauccagc

SEQ ID NO: 660419 - RNA, 64 nt, Homo Sapiens
uacuguauaaaacuuguugacaaugcacugacuuuagaaagauguuaauguacauaaauagagu

SEQ ID NO: 660420 - RNA, 64 nt, Homo Sapiens
gcauuaacuaaaugcucauacacaguuaaauaaauagaaagaguucuauggagacuuugcuguu

SEQ ID NO: 660421 - RNA, 64 nt, Homo Sapiens
uuagggaaaauggauauagaaaaucuuaguauaguagaaagacaucugccuguaauuaaacuag

SEQ ID NO: 660422 - RNA, 64 nt, Homo Sapiens
uuaaugugcauaaauagagucaaugcacugacuuuagaaagauggacuguauaaaacuuguuga

SEQ ID NO: 660423 - RNA, 64 nt, Homo Sapiens
aacauccugggaaauccagcagagggagacccaguagaaagaaagagcuaugugccuuccaccc

SEQ ID NO: 660424 - RNA, 64 nt, Homo Sapiens
uuaauguacauaaauagagucaaugcacugacuuuagaaagauguacuguauaaaacuuguuga

SEQ ID NO: 660425 - RNA, 64 nt, Homo Sapiens
cagcauccugggaaauccagugugggagacccaguagaaagaaagugccuuccacccagagccu

SEQ ID NO: 660426 - RNA, 64 nt, Homo Sapiens
uguuugugauaucacuuuaauuuuucuuggguggcuuagagacuaagggaggagacaucuggcc

SEQ ID NO: 660427 - RNA, 64 nt, Homo Sapiens
ccgguucuauucaaaccagcaggaucugucggugcuuagagauggcugccuggacuggaaucaa

SEQ ID NO: 660428 - RNA, 64 nt, Homo Sapiens
gacaaucacuacaagucagcuggaaaaacugaggcuuagagauagaacacuccccauuaacaga

SEQ ID NO: 660429 - RNA, 64 nt, Homo Sapiens
acaauacugggguuggacugggugaggguuggcgcuuagagaggccaggggacaagggauuuga

SEQ ID NO: 660430 - RNA, 64 nt, Homo Sapiens
guuuugcuagguauaaaaaauaaguaaaguuccacuuagagaacaaagggccaaauagaguuuu

SEQ ID NO: 660431 - RNA, 64 nt, Homo Sapiens
aucuacucuuuggcacuuuuucacauaagccagccuuagagacuagacaaauaacuacugcaaa

SEQ ID NO: 660432 - RNA, 64 nt, Homo Sapiens
aaggaagguuuauucuugucgaaauaauaugacacuuagagaaaagcuuagagaaaauguggag

SEQ ID NO: 660433 - RNA, 64 nt, Homo Sapiens
auguggaggaaauaauaugacaggaaagaagcagcuuagagaaaagagagguaggugaacauuc

SEQ ID NO: 660434 - RNA, 64 nt, Homo Sapiens
auaagcuucuugguggugaaugcaaauucaaaagcuuagagagacacacacacaauuaaguugc

SEQ ID NO: 660435 - RNA, 64 nt, Homo Sapiens
uggucuaaccauguugucuaucucucucucucuucuuagagacagguuguuuucucucucucuc

SEQ ID NO: 660436 - RNA, 64 nt, Homo Sapiens
uguuucaucaaaugguuaaauggaccacugguuucuuagagaaauguuuuuaggcuuaauucau

SEQ ID NO: 660437 - RNA, 64 nt, Homo Sapiens
aauuuucaagguuauaguacuuauuucaacaauucuuagagaugcuagcuaguguugaagcuaa

SEQ ID NO: 660438 - RNA, 64 nt, Homo Sapiens
cucugggcgaugaaggacaauggugguagggccacuuagagagcaguagggcccaggcuggugc

SEQ ID NO: 660439 - RNA, 64 nt, Homo Sapiens
gguguuuauaacuauuuuguauuauaaagugggccuuagagauaggaagaagaaugauggauuc

SEQ ID NO: 660440 - RNA, 64 nt, Homo Sapiens
cugcacuucguacuuuccgagaguuuaacuggugcuuagagagaaaugcaucacuuccaaaccc

SEQ ID NO: 660441 - RNA, 64 nt, Homo Sapiens
uaauaucuuuuaauauuauucucuuggguguugccuuagagauuucauacaugcccuugaguuc

SEQ ID NO: 660442 - RNA, 64 nt, Homo Sapiens
ucuuacuaaauucagaggaauaggauaaagaucacuuagagaaagggugcuuauggacauagcc

SEQ ID NO: 660443 - RNA, 64 nt, Homo Sapiens
ggguucugccccuugugaaggcccauuccuggcacuuagagacagaaagaacucagcaaucuuu

SEQ ID NO: 660444 - RNA, 64 nt, Homo Sapiens
cgccuccugucagacacuucuagguguuggcuuccuuagagagccugggguuagguuagcuuuc

SEQ ID NO: 660445 - RNA, 64 nt, Homo Sapiens
uggagcggguugcuuggggggcguuggccgacuucuuagagaaggcccuccaugugacuuccuc

SEQ ID NO: 660446 - RNA, 64 nt, Homo Sapiens; identical to SEQ ID NO: 53018

SEQ ID NO: 660447 - RNA, 64 nt, Homo Sapiens; identical to SEQ ID NO: 53019

SEQ ID NO: 660448 - RNA, 64 nt, Homo Sapiens; identical to SEQ ID NO: 53020

SEQ ID NO: 660449 - RNA, 64 nt, Homo Sapiens; identical to SEQ ID NO: 53021

SEQ ID NO: 660450 - RNA, 64 nt, Homo Sapiens; identical to SEQ ID NO: 53022

SEQ ID NO: 660451 - RNA, 64 nt, Homo Sapiens; identical to SEQ ID NO: 53023

SEQ ID NO: 660452 - RNA, 64 nt, Homo Sapiens; identical to SEQ ID NO: 53024

SEQ ID NO: 660453 - RNA, 64 nt, Homo Sapiens; identical to SEQ ID NO: 53025

SEQ ID NO: 660454 - RNA, 64 nt, Homo Sapiens; identical to SEQ ID NO: 53026

SEQ ID NO: 660455 - RNA, 64 nt, Homo Sapiens; identical to SEQ ID NO: 53027

SEQ ID NO: 660456 - RNA, 64 nt, Homo Sapiens; identical to SEQ ID NO: 53028

SEQ ID NO: 660457 - RNA, 64 nt, Homo Sapiens; identical to SEQ ID NO: 53029

SEQ ID NO: 660458 - RNA, 64 nt, Homo Sapiens; identical to SEQ ID NO: 53030

SEQ ID NO: 660459 - RNA, 64 nt, Homo Sapiens; identical to SEQ ID NO: 53031

SEQ ID NO: 660460 - RNA, 64 nt, Homo Sapiens; identical to SEQ ID NO: 53032

SEQ ID NO: 660461 - RNA, 64 nt, Homo Sapiens; identical to SEQ ID NO: 53033

SEQ ID NO: 660462 - RNA, 64 nt, Homo Sapiens; identical to SEQ ID NO: 53034

SEQ ID NO: 660463 - RNA, 64 nt, Homo Sapiens; identical to SEQ ID NO: 53035

SEQ ID NO: 660464 - RNA, 64 nt, Homo Sapiens; identical to SEQ ID NO: 53036

SEQ ID NO: 660465 - RNA, 64 nt, Homo Sapiens; identical to SEQ ID NO: 53037

SEQ ID NO: 660466 - RNA, 64 nt, Homo Sapiens; identical to SEQ ID NO: 53038

SEQ ID NO: 660467 - RNA, 64 nt, Homo Sapiens; identical to SEQ ID NO: 53039

SEQ ID NO: 660468 - RNA, 64 nt, Homo Sapiens; identical to SEQ ID NO: 53040

SEQ ID NO: 660469 - RNA, 64 nt, Homo Sapiens; identical to SEQ ID NO: 53041

SEQ ID NO: 660470 - RNA, 64 nt, Homo Sapiens; identical to SEQ ID NO: 53042

SEQ ID NO: 660471 - RNA, 64 nt, Homo Sapiens; identical to SEQ ID NO: 53043

SEQ ID NO: 660472 - RNA, 64 nt, Homo Sapiens; identical to SEQ ID NO: 53044

SEQ ID NO: 660473 - RNA, 64 nt, Homo Sapiens; identical to SEQ ID NO: 53045

SEQ ID NO: 660474 - RNA, 64 nt, Homo Sapiens; identical to SEQ ID NO: 53046

SEQ ID NO: 660475 - RNA, 64 nt, Homo Sapiens; identical to SEQ ID NO: 53047

SEQ ID NO: 660476 - RNA, 64 nt, Homo Sapiens; identical to SEQ ID NO: 53048

SEQ ID NO: 660477 - RNA, 64 nt, Homo Sapiens; identical to SEQ ID NO: 53049

SEQ ID NO: 660478 - RNA, 64 nt, Homo Sapiens; identical to SEQ ID NO: 53050

SEQ ID NO: 660479 - RNA, 64 nt, Homo Sapiens; identical to SEQ ID NO: 53051

SEQ ID NO: 660480 - RNA, 64 nt, Homo Sapiens; identical to SEQ ID NO: 53052

SEQ ID NO: 660481 - RNA, 64 nt, Homo Sapiens; identical to SEQ ID NO: 53053

SEQ ID NO: 660482 - RNA, 64 nt, Homo Sapiens; identical to SEQ ID NO: 53054

SEQ ID NO: 660483 - RNA, 64 nt, Homo Sapiens; identical to SEQ ID NO: 53055

SEQ ID NO: 660484 - RNA, 64 nt, Homo Sapiens; identical to SEQ ID NO: 53056

SEQ ID NO: 660485 - RNA, 64 nt, Homo Sapiens; identical to SEQ ID NO: 53057

SEQ ID NO: 660486 - RNA, 64 nt, Homo Sapiens; identical to SEQ ID NO: 53058

SEQ ID NO: 660487 - RNA, 64 nt, Homo Sapiens; identical to SEQ ID NO: 53059

SEQ ID NO: 660488 - RNA, 64 nt, Homo Sapiens
gcucccagcucgcuguagccuuggagagggaagugauggaaaaagaauauagcagcuuauuagg

SEQ ID NO: 660489 - RNA, 64 nt, Homo Sapiens
cuagagguuggaaagagaagagaggcugggagcggauggaaagcaugacugcaucuggagcccc

SEQ ID NO: 660490 - RNA, 64 nt, Homo Sapiens
uguccuucuugcucccccucgcuguuuguccugagauggaaaaggaagcacuacaccuugccuu

SEQ ID NO: 660491 - RNA, 64 nt, Homo Sapiens
cugaggcuuagagauagacaacuccccauuaacagauggaaaaaacagggagggaagaaugaac

SEQ ID NO: 660492 - RNA, 64 nt, Homo Sapiens
gcucucuacucugcuuuuuugggcacaggccauggauggaaaacgauacugcugcgucauuaca

SEQ ID NO: 660493 - RNA, 64 nt, Homo Sapiens
agccuaggccaggugcaacccgggcagaggggcagauggaaaggugccucccuggugagagggc

SEQ ID NO: 660494 - RNA, 64 nt, Homo Sapiens
cuagaggacaccuuuguaucgaugccagcaaagggauggaaaguuucuuuuucuuuauagauau

SEQ ID NO: 660495 - RNA, 64 nt, Homo Sapiens
acuccuacccuccagguaacuagaguggauuguggauggaaagcugaauuaauagaggccuuau

SEQ ID NO: 660496 - RNA, 64 nt, Homo Sapiens
cucugcaucuccugucuuuucagguuugucaucagauggaaauauuuugauaauaaauugaaau

SEQ ID NO: 660497 - RNA, 64 nt, Homo Sapiens
caugcugcaguguucgaguggauuguaggugcaagauggaaaggauuguaggugcaagcugucc

SEQ ID NO: 660498 - RNA, 64 nt, Homo Sapiens
gaaauaaagagucuguuuuugcucaaaccaucaggauggaaacagucaggcacugacuggggug

SEQ ID NO: 660499 - RNA, 64 nt, Homo Sapiens
aaaugaaacggauugcagagggaauaaauacaaagauggaaagccaguaaagaagucaguauag

SEQ ID NO: 660500 - RNA, 64 nt, Homo Sapiens
cuuuuaugcuguacugaaggaagaggaaaacgaggauggaaaacuuuucccccuuucuagcucc

SEQ ID NO: 660501 - RNA, 64 nt, Homo Sapiens
agaguaaguaucaugcguuguucaugcagauauggauggaaagauggauucuuggcucggaaaa

SEQ ID NO: 660502 - RNA, 64 nt, Homo Sapiens
caucugugcacaccauccauuccgcucgcugagcgauggaaaagcuugccuggaagacuaugug

SEQ ID NO: 660503 - RNA, 64 nt, Homo Sapiens
uugugcagcuguugguuuucauguagugcccugcgauggaaauuagauauauuucauguauuuu

SEQ ID NO: 660504 - RNA, 64 nt, Homo Sapiens
cuuuaacuucucguaaaaguauuucuguccuucagauggaaacucuguacguuaccucuuaaca

SEQ ID NO: 660505 - RNA, 64 nt, Homo Sapiens
uuuauuuuuuuaagcguaauuauauauaugccaugauggaaauagugcagguuuguuacauagg

SEQ ID NO: 660506 - RNA, 64 nt, Homo Sapiens
gcuuguuggguggguaagcaugggcaaacccaaagauggaaaguuucauuuaugguaaacaucu

SEQ ID NO: 660507 - RNA, 64 nt, Homo Sapiens
auguucauggaaacugcuguauaacaaagaggaagauggaaacaaaaucugugucucugugugu

SEQ ID NO: 660508 - RNA, 64 nt, Homo Sapiens
uguguuuuggcagaugagcuuucagcugaggccugauggaaauugagauaaccugcaaagacau

SEQ ID NO: 660509 - RNA, 64 nt, Homo Sapiens
aaauguauuuuugcccugaauuaaguguuaauuugauggaaacucugcuuuuaaaaucaucauu

SEQ ID NO: 660510 - RNA, 64 nt, Homo Sapiens
auacuucucaccucuacuuagcccauucuuguaggauggaaauauuugagaacuacugaguuag

SEQ ID NO: 660511 - RNA, 64 nt, Homo Sapiens
augcuacuaucauucacgauggccaugaggagaagauggaaaauggucagaucacaccugaugg

SEQ ID NO: 660512 - RNA, 64 nt, Homo Sapiens
aaauacauuuuuaaaagaaaacugagaccaaucagauggaaauggaguuuuaaggcaagaggcc

SEQ ID NO: 660513 - RNA, 64 nt, Homo Sapiens
auagaaggcuuguuggugguggugauguuaaacugauggaaauucuuuuucgccuuagugguga

SEQ ID NO: 660514 - RNA, 64 nt, Homo Sapiens
uaaaaaaugaacaaaauuacacauagugagaccccaucucuauuguuugagacuagccugggca

SEQ ID NO: 660515 - RNA, 64 nt, Homo Sapiens
accauguuugagcaccucugcauuacuuuggaugcaucucuaauuuuaaaccacuaaccagaaa

SEQ ID NO: 660516 - RNA, 64 nt, Homo Sapiens
cuucggaggggacuucauguuccguguacguuugcaucucuauuuauaccucuguccugcuagg

SEQ ID NO: 660517 - RNA, 64 nt, Homo Sapiens
auuugagaccagccuaggugacauagugagaccccaucucuacaaaaaauaaaaaauuaaccag

SEQ ID NO: 660518 - RNA, 64 nt, Homo Sapiens
ggccuagaccagccugggcaacauggugaaaccccaucucuacaaaaaauuuuuaaaaaguugg

SEQ ID NO: 660519 - RNA, 64 nt, Homo Sapiens
gaucaagaccauccuggccaacauggugaaaccccaucucuacugaauacacaaaaauuggcug

SEQ ID NO: 660520 - RNA, 64 nt, Homo Sapiens
ggugguucuuugguuuuuuguguguuuuccccuucaucucuaccugugaaagugaaauucuauu

SEQ ID NO: 660521 - RNA, 64 nt, Homo Sapiens
gguuuaacagacaaaauaaacuuacucuaguuuccaucucuaucauuuuauaauaaccguagcc

SEQ ID NO: 660522 - RNA, 64 nt, Homo Sapiens
cuuuuugguuaggacacuaguguguuccucagaccaucucuacucaaggacugcuguguguggg

SEQ ID NO: 660523 - RNA, 64 nt, Homo Sapiens
aaggaauuuaucuucagguguguaugccagagcucaucucuagcacacccucugccuaggaggc

SEQ ID NO: 660524 - RNA, 64 nt, Homo Sapiens
aaaaccaccaaagaucaguuauaggauaaaauggcaucucuaaccauaacacaggagaauugga

SEQ ID NO: 660525 - RNA, 64 nt, Homo Sapiens
guucaagaccaacaugggcaauguggcgaaacuccaucucuacaaaaaaugcaaaaauaaaaaa

SEQ ID NO: 660526 - RNA, 64 nt, Homo Sapiens
auacuggguuucuguaaguuuuuccucauggcuucaucucuaucuuuacuuucucuugaauaug

SEQ ID NO: 660527 - RNA, 64 nt, Homo Sapiens
uaacucauccauaugggucaggauaagacauugccaucucuauuuggaaucuucuuuaaaggaa

SEQ ID NO: 660528 - RNA, 64 nt, Homo Sapiens
acuaccugaaggcucuccuacucagaggcuccagcaucucuaguggaaucucagugcagagguc

SEQ ID NO: 660529 - RNA, 64 nt, Homo Sapiens
cucuccucuguaaagcgagagggcuaaauggguccaucucuaggggccuucccucccaggucug

SEQ ID NO: 660530 - RNA, 64 nt, Homo Sapiens
auaaccuaugcacauccuccuguauacuuuaaaucaucucuagauuacuuauaauaccuaauac

SEQ ID NO: 660531 - RNA, 64 nt, Homo Sapiens
gaguuugagaccagccuggccaacauggcaaaaccaucucuacuaaaaauagaaaaauuagcca

SEQ ID NO: 660532 - RNA, 64 nt, Homo Sapiens
aggucaggaguuucagaccaauauggugaaaccccaucucuacuaaaauuacaaaaaaaauuau

SEQ ID NO: 660533 - RNA, 64 nt, Homo Sapiens
aaaaauacaaaaaauuagguacauggugaaaccccaucucuacuguucaagaccagccuggcca

SEQ ID NO: 660534 - RNA, 64 nt, Homo Sapiens
ugcagaaacacuaagucucauacuaccuugacuucaucucuagcgccccgucaggggccaaacu

SEQ ID NO: 660535 - RNA, 64 nt, Homo Sapiens
guucgagaccagccagggcaacauggugaaaccccaucucuacuaaaauacaaaaaguuagcug

SEQ ID NO: 660536 - RNA, 64 nt, Homo Sapiens
ccugcacuccagccugggcaacagagcgagacuccaucucuaaauaaauaaauaaauaaauaaa

SEQ ID NO: 660537 - RNA, 64 nt, Homo Sapiens
aaaauucaaaaacaaaauuaucauagcaagaccucaucucuacuguuugagaccaggcugggca

SEQ ID NO: 660538 - RNA, 64 nt, Homo Sapiens
aaaaauaccaaaaauuagcccauggugaaacccccaucucuacuuucaagaccagccuguccaa

SEQ ID NO: 660539 - RNA, 64 nt, Homo Sapiens
aaaaauacaaaaauucacagacauggcaaaaucccaucucuacuguucaagaccagccuggcca

SEQ ID NO: 660540 - RNA, 64 nt, Homo Sapiens
aaaaauagaaaaaucagcugacguggugaaaccccaucucuacugaucgagaccauccugacca

SEQ ID NO: 660541 - RNA, 64 nt, Homo Sapiens
guucgagaccagccuggucaagauggugaaaccccaucucuacuaaaauuacaaaaauuagccg

SEQ ID NO: 660542 - RNA, 64 nt, Homo Sapiens
guuugaaaccagccuggccaacauggugaaaccccaucucuacuaaaaaaacaaaacuagcugg

SEQ ID NO: 660543 - RNA, 64 nt, Homo Sapiens
cucuuuguaauuuacuuuacuuguaugaauuuaacaucucuagcauguauccuuacuugauauu

SEQ ID NO: 660544 - RNA, 64 nt, Homo Sapiens
guucgagaccagccugaccaacauggugaaacgccaucucuacuaaaaauacaaaaauuagccg

SEQ ID NO: 660545 - RNA, 64 nt, Homo Sapiens
aaaaguacaaaaauuagcugacauggugaaacuccaucucuacuguuugaaaccagccuggacu

SEQ ID NO: 660546 - RNA, 64 nt, Homo Sapiens
cccacccuccccccggcaaacauagugaggaucccaucucuacguucaagaccggccugagcaa

SEQ ID NO: 660547 - RNA, 64 nt, Homo Sapiens
aaaaaaaaauacaaaaauuaacacggugaaaccccaucucuacugcucgagaccagccuggcca

SEQ ID NO: 660548 - RNA, 64 nt, Homo Sapiens
aaaaaaaaaaaaaaaauuagacauggugaaaccccaucucuacugcucaagaccagccuggcca

SEQ ID NO: 660549 - RNA, 64 nt, Homo Sapiens
guuccagaccagccuggccaacauggcgaaaccccaucucuacuaaaaauacaaaaauuagccg

SEQ ID NO: 660550 - RNA, 64 nt, Homo Sapiens
guucgagaccagccuggccaauauggugaaaccccaucucuacuaaaaauauaaaaaucagcaa

SEQ ID NO: 660551 - RNA, 64 nt, Homo Sapiens
aaaaaaaaaaaaaaaaaaaaacacagugaaaccccaucucuacugaucgagaccauccuggcua

SEQ ID NO: 660552 - RNA, 64 nt, Homo Sapiens
uuuaccagcaggcucuguaugcuuauaacuuacucaucucuauccucaggcugcagcuuuauua

SEQ ID NO: 660553 - RNA, 64 nt, Homo Sapiens
guucgagaccauccugucuaacacggugaaaccccaucucuacuaaaaauacaaaaaaauuagu

SEQ ID NO: 660554 - RNA, 64 nt, Homo Sapiens
guucaagaccagccuggccaacauggugaaaccccaucucuacuaaaaauacaaaaauuagcua

SEQ ID NO: 660555 - RNA, 64 nt, Homo Sapiens
aaaauuacaaaaauuagcugacuaagcgaaaacccaucucuacucuggcaaacaccccaucucu

SEQ ID NO: 660556 - RNA, 64 nt, Homo Sapiens
aagcgaaaacccaucucuacccuggcaaacaccccaucucuacuagucaggaguucgggaccag

SEQ ID NO: 660557 - RNA, 64 nt, Homo Sapiens
ccucacaggugcucugcucguggccccaaagaaccaucucuacuugccagaguauguuccacca

SEQ ID NO: 660558 - RNA, 64 nt, Homo Sapiens
guuuauguacguaugagauuucaaguuaauaaaucaucucuauggcuauuuuccccaugugggu

SEQ ID NO: 660559 - RNA, 64 nt, Homo Sapiens
ugaacuuaaauggaaauuaauuuauuguagacuacaucucuauuuggaaugaugagguaaaugu

SEQ ID NO: 660560 - RNA, 64 nt, Homo Sapiens
cccugggguggacgauguuugaugauuagacggucaucucuaacuacuaaacuaauaucugcau

SEQ ID NO: 660561 - RNA, 64 nt, Homo Sapiens
guucaacaccagccugagcaacaugguaaaaccccaucucuaccaaaaauacaaaaauuagcug

SEQ ID NO: 660562 - RNA, 64 nt, Homo Sapiens
guuugggaccagccugggcaacauagggggaucccaucucuacacacaaaaaaauuuuuuaaug

SEQ ID NO: 660563 - RNA, 64 nt, Homo Sapiens
aaaacaaaaauuagccaggcacauggugaaaccccaucucuacuguuugagaccacccuggcca

SEQ ID NO: 660564 - RNA, 64 nt, Homo Sapiens
aaaaauacagaaauuagccgacauagugaaaccccaucucuacuguucgagaccagccuggcca

SEQ ID NO: 660565 - RNA, 64 nt, Homo Sapiens
ugcccccacggggccagggcggaguaaccucccucaucucuaacucuaaccacuccugggcuaa

SEQ ID NO: 660566 - RNA, 64 nt, Homo Sapiens
agccccacugucucuaaccaaaggcuuaaacaggcaucucuaccucuaacaccuccuagaggcc

SEQ ID NO: 660567 - RNA, 64 nt, Homo Sapiens
aaaaauacaaaaguuagccgacauggugaaaccccaucucuacuguucaagagcacccuggcua

SEQ ID NO: 660568 - RNA, 64 nt, Homo Sapiens
aaaaauauaaaauauuagccacacggugaaaccccaucucuacugaucgagaccguccuggcua

SEQ ID NO: 660569 - RNA, 64 nt, Homo Sapiens
uaaaauaaagaagauaaaaaacauagugagaccccaucucuacuguucaagaccagccugggca

SEQ ID NO: 660570 - RNA, 64 nt, Homo Sapiens
aacaaaacaaaaaaacacaaacauggugaaaccucaucucuaccaaacaagaucagccugugca

SEQ ID NO: 660571 - RNA, 64 nt, Homo Sapiens
gaucgagaccagccuggccaacguggugaaaccccaucucuacuaaaaauacaaaaauuagccg

SEQ ID NO: 660572 - RNA, 64 nt, Homo Sapiens
aagaucaaccaaccuggguaacauggccagaccccaucucuauuuauauauauauauauaaaac

SEQ ID NO: 660573 - RNA, 64 nt, Homo Sapiens
aaaauacaaaaauuaggugucauggcaaaacccccaucucuacuuucgagaccagccuggccaa

SEQ ID NO: 660574 - RNA, 64 nt, Homo Sapiens
uaaaaaaaaagauguuaaaagcauagcgagaccccaucucuauaguucgagaccgaccugggca

SEQ ID NO: 660575 - RNA, 64 nt, Homo Sapiens
aaauacaaaaaaauuagccgacguggugagaccucaucucuacaguuggagaccagucugggaa

SEQ ID NO: 660576 - RNA, 64 nt, Homo Sapiens
aaaaauacaaaaauuagcugacauggugaaaccccaucucuacuguucaagaccagccuggcca

SEQ ID NO: 660577 - RNA, 64 nt, Homo Sapiens
aaaauacaaaaauuagccggacauagcaaaaccucaucucuacuuuugagaacuggccuggcca

SEQ ID NO: 660578 - RNA, 64 nt, Homo Sapiens
gcccaggaguucaauaccugucugggaaacaccucaucucuacaaaauacaaaaaaguuaacug

SEQ ID NO: 660579 - RNA, 64 nt, Homo Sapiens
guuugagacuggccugggcagcauagcgagaccccaucucuauauaaaaaaaaagauguuaaaa

SEQ ID NO: 660580 - RNA, 64 nt, Homo Sapiens; identical to SEQ ID NO: 415214

SEQ ID NO: 660581 - RNA, 64 nt, Homo Sapiens; identical to SEQ ID NO: 415215

SEQ ID NO: 660582 - RNA, 64 nt, Homo Sapiens; identical to SEQ ID NO: 415216

SEQ ID NO: 660583 - RNA, 64 nt, Homo Sapiens; identical to SEQ ID NO: 415217

SEQ ID NO: 660584 - RNA, 64 nt, Homo Sapiens; identical to SEQ ID NO: 415218

SEQ ID NO: 660585 - RNA, 64 nt, Homo Sapiens; identical to SEQ ID NO: 415219

SEQ ID NO: 660586 - RNA, 64 nt, Homo Sapiens; identical to SEQ ID NO: 415220

SEQ ID NO: 660587 - RNA, 64 nt, Homo Sapiens; identical to SEQ ID NO: 415221

SEQ ID NO: 660588 - RNA, 55 nt, Homo Sapiens; identical to SEQ ID NO: 415222

SEQ ID NO: 660589 - RNA, 64 nt, Homo Sapiens; identical to SEQ ID NO: 415223

SEQ ID NO: 660590 - RNA, 64 nt, Homo Sapiens; identical to SEQ ID NO: 415224

SEQ ID NO: 660591 - RNA, 64 nt, Homo Sapiens; identical to SEQ ID NO: 415225

SEQ ID NO: 660592 - RNA, 64 nt, Homo Sapiens; identical to SEQ ID NO: 415226

SEQ ID NO: 660593 - RNA, 64 nt, Homo Sapiens; identical to SEQ ID NO: 415227

SEQ ID NO: 660594 - RNA, 64 nt, Homo Sapiens; identical to SEQ ID NO: 415228

SEQ ID NO: 660595 - RNA, 50 nt, Homo Sapiens; identical to SEQ ID NO: 415229

SEQ ID NO: 660596 - RNA, 64 nt, Homo Sapiens; identical to SEQ ID NO: 415230

SEQ ID NO: 660597 - RNA, 64 nt, Homo Sapiens; identical to SEQ ID NO: 415231

SEQ ID NO: 660598 - RNA, 64 nt, Homo Sapiens; identical to SEQ ID NO: 415232

SEQ ID NO: 660599 - RNA, 64 nt, Homo Sapiens; identical to SEQ ID NO: 415233

SEQ ID NO: 660600 - RNA, 64 nt, Homo Sapiens; identical to SEQ ID NO: 415234

SEQ ID NO: 660601 - RNA, 64 nt, Homo Sapiens; identical to SEQ ID NO: 415235

SEQ ID NO: 660602 - RNA, 64 nt, Homo Sapiens; identical to SEQ ID NO: 415236

SEQ ID NO: 660603 - RNA, 64 nt, Homo Sapiens; identical to SEQ ID NO: 415237

SEQ ID NO: 660604 - RNA, 64 nt, Homo Sapiens; identical to SEQ ID NO: 415238

SEQ ID NO: 660605 - RNA, 64 nt, Homo Sapiens; identical to SEQ ID NO: 415239

SEQ ID NO: 660606 - RNA, 64 nt, Homo Sapiens; identical to SEQ ID NO: 415240

SEQ ID NO: 660607 - RNA, 64 nt, Homo Sapiens; identical to SEQ ID NO: 415241

SEQ ID NO: 660608 - RNA, 64 nt, Homo Sapiens; identical to SEQ ID NO: 415242

SEQ ID NO: 660609 - RNA, 64 nt, Homo Sapiens; identical to SEQ ID NO: 415243

SEQ ID NO: 660610 - RNA, 64 nt, Homo Sapiens; identical to SEQ ID NO: 415244

SEQ ID NO: 660611 - RNA, 64 nt, Homo Sapiens; identical to SEQ ID NO: 415245

SEQ ID NO: 660612 - RNA, 64 nt, Homo Sapiens; identical to SEQ ID NO: 415246

SEQ ID NO: 660613 - RNA, 64 nt, Homo Sapiens; identical to SEQ ID NO: 415247

SEQ ID NO: 660614 - RNA, 64 nt, Homo Sapiens; identical to SEQ ID NO: 415248

SEQ ID NO: 660615 - RNA, 64 nt, Homo Sapiens; identical to SEQ ID NO: 415249

SEQ ID NO: 660616 - RNA, 64 nt, Homo Sapiens; identical to SEQ ID NO: 415250

SEQ ID NO: 660617 - RNA, 64 nt, Homo Sapiens; identical to SEQ ID NO: 415251

SEQ ID NO: 660618 - RNA, 64 nt, Homo Sapiens; identical to SEQ ID NO: 415252

SEQ ID NO: 660619 - RNA, 64 nt, Homo Sapiens; identical to SEQ ID NO: 415253

SEQ ID NO: 660620 - RNA, 64 nt, Homo Sapiens; identical to SEQ ID NO: 415254

SEQ ID NO: 660621 - RNA, 64 nt, Homo Sapiens; identical to SEQ ID NO: 415255

SEQ ID NO: 660622 - RNA, 64 nt, Homo Sapiens; identical to SEQ ID NO: 415256

SEQ ID NO: 660623 - RNA, 64 nt, Homo Sapiens; identical to SEQ ID NO: 370933

SEQ ID NO: 660624 - RNA, 64 nt, Homo Sapiens; identical to SEQ ID NO: 370934

SEQ ID NO: 660625 - RNA, 64 nt, Homo Sapiens; identical to SEQ ID NO: 370935

SEQ ID NO: 660626 - RNA, 64 nt, Homo Sapiens; identical to SEQ ID NO: 370936

SEQ ID NO: 660627 - RNA, 64 nt, Homo Sapiens; identical to SEQ ID NO: 370937

SEQ ID NO: 660628 - RNA, 64 nt, Homo Sapiens; identical to SEQ ID NO: 370938

SEQ ID NO: 660629 - RNA, 64 nt, Homo Sapiens; identical to SEQ ID NO: 370939

SEQ ID NO: 660630 - RNA, 64 nt, Homo Sapiens; identical to SEQ ID NO: 370940

SEQ ID NO: 660631 - RNA, 64 nt, Homo Sapiens; identical to SEQ ID NO: 370941

SEQ ID NO: 660632 - RNA, 64 nt, Homo Sapiens; identical to SEQ ID NO: 370942

SEQ ID NO: 660633 - RNA, 64 nt, Homo Sapiens; identical to SEQ ID NO: 370943

SEQ ID NO: 660634 - RNA, 64 nt, Homo Sapiens; identical to SEQ ID NO: 370944

SEQ ID NO: 660635 - RNA, 64 nt, Homo Sapiens; identical to SEQ ID NO: 370945

SEQ ID NO: 660636 - RNA, 58 nt, Homo Sapiens; identical to SEQ ID NO: 370946

SEQ ID NO: 660637 - RNA, 64 nt, Homo Sapiens; identical to SEQ ID NO: 370947

SEQ ID NO: 660638 - RNA, 64 nt, Homo Sapiens; identical to SEQ ID NO: 370948

SEQ ID NO: 660639 - RNA, 64 nt, Homo Sapiens; identical to SEQ ID NO: 370949

SEQ ID NO: 660640 - RNA, 64 nt, Homo Sapiens; identical to SEQ ID NO: 370950

SEQ ID NO: 660641 - RNA, 64 nt, Homo Sapiens; identical to SEQ ID NO: 370951

SEQ ID NO: 660642 - RNA, 64 nt, Homo Sapiens; identical to SEQ ID NO: 370952

SEQ ID NO: 660643 - RNA, 64 nt, Homo Sapiens; identical to SEQ ID NO: 370953

SEQ ID NO: 660644 - RNA, 64 nt, Homo Sapiens; identical to SEQ ID NO: 370954

SEQ ID NO: 660645 - RNA, 64 nt, Homo Sapiens; identical to SEQ ID NO: 370955

SEQ ID NO: 660646 - RNA, 64 nt, Homo Sapiens; identical to SEQ ID NO: 370956

SEQ ID NO: 660647 - RNA, 64 nt, Homo Sapiens; identical to SEQ ID NO: 370957

SEQ ID NO: 660648 - RNA, 64 nt, Homo Sapiens; identical to SEQ ID NO: 370958

SEQ ID NO: 660649 - RNA, 64 nt, Homo Sapiens; identical to SEQ ID NO: 370959

SEQ ID NO: 660650 - RNA, 64 nt, Homo Sapiens; identical to SEQ ID NO: 370960

SEQ ID NO: 660651 - RNA, 64 nt, Homo Sapiens; identical to SEQ ID NO: 370961

SEQ ID NO: 660652 - RNA, 64 nt, Homo Sapiens; identical to SEQ ID NO: 370962

SEQ ID NO: 660653 - RNA, 64 nt, Homo Sapiens; identical to SEQ ID NO: 370963

SEQ ID NO: 660654 - RNA, 64 nt, Homo Sapiens; identical to SEQ ID NO: 370964

SEQ ID NO: 660655 - RNA, 64 nt, Homo Sapiens; identical to SEQ ID NO: 370965

SEQ ID NO: 660656 - RNA, 64 nt, Homo Sapiens; identical to SEQ ID NO: 370966

SEQ ID NO: 660657 - RNA, 64 nt, Homo Sapiens; identical to SEQ ID NO: 370967

SEQ ID NO: 660658 - RNA, 64 nt, Homo Sapiens; identical to SEQ ID NO: 370968

SEQ ID NO: 660659 - RNA, 64 nt, Homo Sapiens; identical to SEQ ID NO: 370969

SEQ ID NO: 660660 - RNA, 64 nt, Homo Sapiens; identical to SEQ ID NO: 370970

SEQ ID NO: 660661 - RNA, 64 nt, Homo Sapiens; identical to SEQ ID NO: 370971

SEQ ID NO: 660662 - RNA, 64 nt, Homo Sapiens; identical to SEQ ID NO: 370972

SEQ ID NO: 660663 - RNA, 64 nt, Homo Sapiens; identical to SEQ ID NO: 370973

SEQ ID NO: 660664 - RNA, 64 nt, Homo Sapiens; identical to SEQ ID NO: 370974

SEQ ID NO: 660665 - RNA, 64 nt, Homo Sapiens; identical to SEQ ID NO: 370975

SEQ ID NO: 660666 - RNA, 64 nt, Homo Sapiens; identical to SEQ ID NO: 370976

SEQ ID NO: 660667 - RNA, 64 nt, Homo Sapiens; identical to SEQ ID NO: 370977

SEQ ID NO: 660668 - RNA, 64 nt, Homo Sapiens; identical to SEQ ID NO: 370978

SEQ ID NO: 660669 - RNA, 64 nt, Homo Sapiens; identical to SEQ ID NO: 370979

SEQ ID NO: 660670 - RNA, 64 nt, Homo Sapiens; identical to SEQ ID NO: 370980

SEQ ID NO: 660671 - RNA, 64 nt, Homo Sapiens; identical to SEQ ID NO: 370981

SEQ ID NO: 660672 - RNA, 64 nt, Homo Sapiens; identical to SEQ ID NO: 370982

SEQ ID NO: 660673 - RNA, 64 nt, Homo Sapiens; identical to SEQ ID NO: 370983

SEQ ID NO: 660674 - RNA, 64 nt, Homo Sapiens; identical to SEQ ID NO: 370984

SEQ ID NO: 660675 - RNA, 64 nt, Homo Sapiens; identical to SEQ ID NO: 370985

SEQ ID NO: 660676 - RNA, 64 nt, Homo Sapiens; identical to SEQ ID NO: 370986

SEQ ID NO: 660677 - RNA, 64 nt, Homo Sapiens; identical to SEQ ID NO: 370987

SEQ ID NO: 660678 - RNA, 64 nt, Homo Sapiens; identical to SEQ ID NO: 370988

SEQ ID NO: 660679 - RNA, 64 nt, Homo Sapiens; identical to SEQ ID NO: 108382

SEQ ID NO: 660680 - RNA, 64 nt, Homo Sapiens; identical to SEQ ID NO: 108383

SEQ ID NO: 660681 - RNA, 64 nt, Homo Sapiens; identical to SEQ ID NO: 108384

SEQ ID NO: 660682 - RNA, 64 nt, Homo Sapiens; identical to SEQ ID NO: 108385

SEQ ID NO: 660683 - RNA, 64 nt, Homo Sapiens; identical to SEQ ID NO: 108386

SEQ ID NO: 660684 - RNA, 64 nt, Homo Sapiens; identical to SEQ ID NO: 108387

SEQ ID NO: 660685 - RNA, 64 nt, Homo Sapiens; identical to SEQ ID NO: 108388

SEQ ID NO: 660686 - RNA, 64 nt, Homo Sapiens; identical to SEQ ID NO: 108389

SEQ ID NO: 660687 - RNA, 64 nt, Homo Sapiens; identical to SEQ ID NO: 108390

SEQ ID NO: 660688 - RNA, 64 nt, Homo Sapiens; identical to SEQ ID NO: 108391

SEQ ID NO: 660689 - RNA, 64 nt, Homo Sapiens; identical to SEQ ID NO: 108392

SEQ ID NO: 660690 - RNA, 64 nt, Homo Sapiens; identical to SEQ ID NO: 108393

SEQ ID NO: 660691 - RNA, 64 nt, Homo Sapiens; identical to SEQ ID NO: 108394

SEQ ID NO: 660692 - RNA, 64 nt, Homo Sapiens; identical to SEQ ID NO: 108395

SEQ ID NO: 660693 - RNA, 64 nt, Homo Sapiens
gguugaaaucugugcugugugugugugucucugcauguguaaaagaaggguaaaaaagagaugg

SEQ ID NO: 660694 - RNA, 64 nt, Homo Sapiens
uuugaaaucugcacagaagcuguuuuagucauuaauguguaacaaaaguagcuuauagaauaug

SEQ ID NO: 660695 - RNA, 64 nt, Homo Sapiens
uguuagaucuguagggacuuguacaacauuguggauguguaaacaggcaccacugcuuuaaaaa

SEQ ID NO: 660696 - RNA, 64 nt, Homo Sapiens
uccagcaaacucuugcauguggccacuaggaggaauguguaagaauguucauaguuacauauuu

SEQ ID NO: 660697 - RNA, 64 nt, Homo Sapiens
aagucuauagaaaauuaaaacucguaacauaauaauguguaauauaagaauuaucugcauuugu

SEQ ID NO: 660698 - RNA, 64 nt, Homo Sapiens
cuuuuguaaaggcaagaauacuaaucucauuuggauguguaagucuaaaaaccucuauucuaaa

SEQ ID NO: 660699 - RNA, 64 nt, Homo Sapiens
uuuauuccccauuaauaacuaucaguugaguaaaauguguaauaaauagagcuaggaauuaaga

SEQ ID NO: 660700 - RNA, 64 nt, Homo Sapiens
aucuaguuacugccuguaaagagagaaaauugagauguguaaaaccuguaauuuccuucaauau

SEQ ID NO: 660701 - RNA, 64 nt, Homo Sapiens
uuguucuaguuuucaguuugcugcagaaggaaaaauguguaauuaacaaaaagaacaaaaaaau

SEQ ID NO: 660702 - RNA, 64 nt, Homo Sapiens
ugaaccaugucagcaaaaaguugcuucuucuccuauguguaaggaaaacauuaagaaaaucaua

SEQ ID NO: 660703 - RNA, 64 nt, Homo Sapiens
uagacgccuauggccacuggacaugaggucagacauguguaagguugucccagacuguuuguaa

SEQ ID NO: 660704 - RNA, 64 nt, Homo Sapiens
cacagugugccuguaaaaugaguuguuuguugagauguguaagucucuuaggccacuaguuacu

SEQ ID NO: 660705 - RNA, 64 nt, Homo Sapiens
guguauaauuacauacugaagucauaguuuugugauguguaacauggacagaggaaugccugug

SEQ ID NO: 660706 - RNA, 64 nt, Homo Sapiens
uuaaagauuauucaacaccuuuuuagugugguuuauguguaauacuuuuacuuauugaaaggca

SEQ ID NO: 660707 - RNA, 64 nt, Homo Sapiens
gaaugguuugugaaaaauauuaaaagcauacacaauguguaacuguaauacauauuuuaaauuc

SEQ ID NO: 660708 - RNA, 64 nt, Homo Sapiens
auuuuaagagcaugcagccauaaauggcagagcuauguguaaaucacucuuaaugggagagcua

SEQ ID NO: 660709 - RNA, 64 nt, Homo Sapiens
auuguuauauaucuuuucucuaaguuauuaaagcauguguaaacauguaaguuguacagugaaa

SEQ ID NO: 660710 - RNA, 50 nt, Homo Sapiens
uaauaagccuauuccaucacauguguaacuauguucuaaugacuuuuuaa

SEQ ID NO: 660711 - RNA, 64 nt, Homo Sapiens
auggaauaaaaaaaaaaaaauggcaaacagguggauguguaaaagauaaaauguugugacuuca

SEQ ID NO: 660712 - RNA, 64 nt, Homo Sapiens
ggcuggggggccagcccuggauuccuaucuguggauguguaaauucacuaacccguuuuauucu

SEQ ID NO: 660713 - RNA, 64 nt, Homo Sapiens
auguaguguuguaauaaacuguuuaauggggcugauguguaaagcuguucaaguuauuugaugu

SEQ ID NO: 660714 - RNA, 64 nt, Homo Sapiens
aaauagagauuugacagacauagcaaucuagucaauguguaaggggucaaaaaaacagagguuu

SEQ ID NO: 660715 - RNA, 64 nt, Homo Sapiens
uuuuaacacauaaguaaaaacccguacauauuugauguguaaugcagguuaauuacaacacaga

SEQ ID NO: 660716 - RNA, 64 nt, Homo Sapiens
ggaagagggcauuuguuugacugguuuuagagauauguguaauuuugagcuuaaggcaaaaggc

SEQ ID NO: 660717 - RNA, 64 nt, Homo Sapiens
ucaccgcacaucccacuuuuuaugauuuauguugauguguaaguaagguccaaguaaaaugagg

SEQ ID NO: 660718 - RNA, 64 nt, Homo Sapiens
uuaaauguacaagauacaugaaauauuaaagaaaauguguaacuuuuuguguaaauacaucuug

SEQ ID NO: 660719 - RNA, 64 nt, Homo Sapiens
uaaauuuagagagaaugccgcucuguuuaaagcaauguguaaagaugaguuuuuuuaagcaugg

SEQ ID NO: 660720 - RNA, 64 nt, Homo Sapiens
uaagugagccauauauuuucgccucuuauguguaauguguaaguaaguacuuggagaaacugag

SEQ ID NO: 660721 - RNA, 64 nt, Homo Sapiens
uguaaguuaagugagccauaaacugaggccucuuauguguaaugaaugugaaaguacuuggaga

SEQ ID NO: 660722 - RNA, 64 nt, Homo Sapiens
aucuacucucacaauauacuaaugaaagcccgauauguguaaaguuuguacaggugagaagccu

SEQ ID NO: 660723 - RNA, 64 nt, Homo Sapiens
accuuuacuuggcuuucaaauaugaauguaaggaauguguaaaguucauaccagugugaaaccc

SEQ ID NO: 660724 - RNA, 64 nt, Homo Sapiens
ucaaaaacacucagucaaaaauuuaaaaucuuaaauguguaagucacccccaccaaaaacaaaa

SEQ ID NO: 660725 - RNA, 64 nt, Homo Sapiens
uggucugaagaagaaaaagaaauuuuauguauguauguguaaauauguguauauauuucuaucu

SEQ ID NO: 660726 - RNA, 64 nt, Homo Sapiens
gucugcccuuuggcccaaaauuuaugucugucucauguguaaaagacauucaucccauccuaac

SEQ ID NO: 660727 - RNA, 64 nt, Homo Sapiens
uguacuaccuaaaagucccagugcaugucucugaauguguaagcuauauaaaugcuauuuauau

SEQ ID NO: 660728 - RNA, 64 nt, Homo Sapiens
agagaauggugguuucagagaucucucuucccaaauguguaaauauucuauaccagauaaguuu

SEQ ID NO: 660729 - RNA, 64 nt, Homo Sapiens
uaaaauauaccagcgaauuuauuuuuaaaugaaaauguguaaucgaucauuuuuauccuaggug

SEQ ID NO: 660730 - RNA, 64 nt, Homo Sapiens
uuguugaacuucggccacgagugaaauugcacagauguguaagcaaacuguucaaaaagauuuu

SEQ ID NO: 660731 - RNA, 64 nt, Homo Sapiens; identical to SEQ ID NO: 211620

SEQ ID NO: 660732 - RNA, 64 nt, Homo Sapiens; identical to SEQ ID NO: 211621

SEQ ID NO: 660733 - RNA, 64 nt, Homo Sapiens; identical to SEQ ID NO: 211622

SEQ ID NO: 660734 - RNA, 64 nt, Homo Sapiens; identical to SEQ ID NO: 211623

SEQ ID NO: 660735 - RNA, 64 nt, Homo Sapiens; identical to SEQ ID NO: 211624

SEQ ID NO: 660736 - RNA, 64 nt, Homo Sapiens; identical to SEQ ID NO: 211625

SEQ ID NO: 660737 - RNA, 64 nt, Homo Sapiens; identical to SEQ ID NO: 211626

SEQ ID NO: 660738 - RNA, 64 nt, Homo Sapiens; identical to SEQ ID NO: 211627

SEQ ID NO: 660739 - RNA, 64 nt, Homo Sapiens; identical to SEQ ID NO: 211628

SEQ ID NO: 660740 - RNA, 64 nt, Homo Sapiens; identical to SEQ ID NO: 211629

SEQ ID NO: 660741 - RNA, 64 nt, Homo Sapiens; identical to SEQ ID NO: 211630

SEQ ID NO: 660742 - RNA, 64 nt, Homo Sapiens; identical to SEQ ID NO: 211631

SEQ ID NO: 660743 - RNA, 64 nt, Homo Sapiens; identical to SEQ ID NO: 211632

SEQ ID NO: 660744 - RNA, 64 nt, Homo Sapiens; identical to SEQ ID NO: 211633

SEQ ID NO: 660745 - RNA, 64 nt, Homo Sapiens; identical to SEQ ID NO: 211634

SEQ ID NO: 660746 - RNA, 64 nt, Homo Sapiens; identical to SEQ ID NO: 211635

SEQ ID NO: 660747 - RNA, 64 nt, Homo Sapiens; identical to SEQ ID NO: 211636

SEQ ID NO: 660748 - RNA, 64 nt, Homo Sapiens; identical to SEQ ID NO: 211637

SEQ ID NO: 660749 - RNA, 64 nt, Homo Sapiens; identical to SEQ ID NO: 211638

SEQ ID NO: 660750 - RNA, 64 nt, Homo Sapiens; identical to SEQ ID NO: 96939

SEQ ID NO: 660751 - RNA, 64 nt, Homo Sapiens; identical to SEQ ID NO: 96940

SEQ ID NO: 660752 - RNA, 64 nt, Homo Sapiens; identical to SEQ ID NO: 96941

SEQ ID NO: 660753 - RNA, 64 nt, Homo Sapiens; identical to SEQ ID NO: 96942

SEQ ID NO: 660754 - RNA, 64 nt, Homo Sapiens; identical to SEQ ID NO: 96943

SEQ ID NO: 660755 - RNA, 64 nt, Homo Sapiens; identical to SEQ ID NO: 96944

SEQ ID NO: 660756 - RNA, 64 nt, Homo Sapiens; identical to SEQ ID NO: 96945

SEQ ID NO: 660757 - RNA, 64 nt, Homo Sapiens; identical to SEQ ID NO: 96946

SEQ ID NO: 660758 - RNA, 64 nt, Homo Sapiens; identical to SEQ ID NO: 96947

SEQ ID NO: 660759 - RNA, 64 nt, Homo Sapiens; identical to SEQ ID NO: 96948

SEQ ID NO: 660760 - RNA, 64 nt, Homo Sapiens; identical to SEQ ID NO: 96949

SEQ ID NO: 660761 - RNA, 64 nt, Homo Sapiens; identical to SEQ ID NO: 96950

SEQ ID NO: 660762 - RNA, 64 nt, Homo Sapiens; identical to SEQ ID NO: 96951

SEQ ID NO: 660763 - RNA, 64 nt, Homo Sapiens; identical to SEQ ID NO: 96952

SEQ ID NO: 660764 - RNA, 64 nt, Homo Sapiens; identical to SEQ ID NO: 96953

SEQ ID NO: 660765 - RNA, 64 nt, Homo Sapiens; identical to SEQ ID NO: 96954

SEQ ID NO: 660766 - RNA, 64 nt, Homo Sapiens; identical to SEQ ID NO: 96955

SEQ ID NO: 660767 - RNA, 64 nt, Homo Sapiens; identical to SEQ ID NO: 96956

SEQ ID NO: 660768 - RNA, 64 nt, Homo Sapiens
cucaugcugccuccuaagugacuccgauuuucagcccugguagaauaaggaagacagcugaugc

SEQ ID NO: 660769 - RNA, 64 nt, Homo Sapiens
acaggguggggcgggugagugaaaagguggaaaucccugguaccuugccuggugguuacacagu

SEQ ID NO: 660770 - RNA, 64 nt, Homo Sapiens; identical to SEQ ID NO: 154299

SEQ ID NO: 660771 - RNA, 64 nt, Homo Sapiens; identical to SEQ ID NO: 154300

SEQ ID NO: 660772 - RNA, 64 nt, Homo Sapiens; identical to SEQ ID NO: 154301

SEQ ID NO: 660773 - RNA, 64 nt, Homo Sapiens; identical to SEQ ID NO: 154302

SEQ ID NO: 660774 - RNA, 64 nt, Homo Sapiens; identical to SEQ ID NO: 154303

SEQ ID NO: 660775 - RNA, 64 nt, Homo Sapiens; identical to SEQ ID NO: 154304

SEQ ID NO: 660776 - RNA, 64 nt, Homo Sapiens; identical to SEQ ID NO: 154305

SEQ ID NO: 660777 - RNA, 64 nt, Homo Sapiens; identical to SEQ ID NO: 154306

SEQ ID NO: 660778 - RNA, 64 nt, Homo Sapiens; identical to SEQ ID NO: 154307

SEQ ID NO: 660779 - RNA, 64 nt, Homo Sapiens; identical to SEQ ID NO: 154308

SEQ ID NO: 660780 - RNA, 64 nt, Homo Sapiens; identical to SEQ ID NO: 154309

SEQ ID NO: 660781 - RNA, 64 nt, Homo Sapiens; identical to SEQ ID NO: 154310

SEQ ID NO: 660782 - RNA, 64 nt, Homo Sapiens; identical to SEQ ID NO: 154311

SEQ ID NO: 660783 - RNA, 64 nt, Homo Sapiens; identical to SEQ ID NO: 154312

SEQ ID NO: 660784 - RNA, 64 nt, Homo Sapiens; identical to SEQ ID NO: 154313

SEQ ID NO: 660785 - RNA, 54 nt, Homo Sapiens; identical to SEQ ID NO: 154314

SEQ ID NO: 660786 - RNA, 64 nt, Homo Sapiens; identical to SEQ ID NO: 154315

SEQ ID NO: 660787 - RNA, 64 nt, Homo Sapiens; identical to SEQ ID NO: 154316

SEQ ID NO: 660788 - RNA, 64 nt, Homo Sapiens; identical to SEQ ID NO: 154317

SEQ ID NO: 660789 - RNA, 64 nt, Homo Sapiens; identical to SEQ ID NO: 154318

SEQ ID NO: 660790 - RNA, 64 nt, Homo Sapiens; identical to SEQ ID NO: 154319

SEQ ID NO: 660791 - RNA, 64 nt, Homo Sapiens; identical to SEQ ID NO: 154320

SEQ ID NO: 660792 - RNA, 64 nt, Homo Sapiens; identical to SEQ ID NO: 154321

SEQ ID NO: 660793 - RNA, 64 nt, Homo Sapiens; identical to SEQ ID NO: 154322

SEQ ID NO: 660794 - RNA, 64 nt, Homo Sapiens; identical to SEQ ID NO: 154323

SEQ ID NO: 660795 - RNA, 64 nt, Homo Sapiens; identical to SEQ ID NO: 154324

SEQ ID NO: 660796 - RNA, 64 nt, Homo Sapiens; identical to SEQ ID NO: 154325

SEQ ID NO: 660797 - RNA, 64 nt, Homo Sapiens; identical to SEQ ID NO: 154326

SEQ ID NO: 660798 - RNA, 64 nt, Homo Sapiens; identical to SEQ ID NO: 154327

SEQ ID NO: 660799 - RNA, 64 nt, Homo Sapiens; identical to SEQ ID NO: 154328

SEQ ID NO: 660800 - RNA, 64 nt, Homo Sapiens; identical to SEQ ID NO: 154329

SEQ ID NO: 660801 - RNA, 64 nt, Homo Sapiens; identical to SEQ ID NO: 154330

SEQ ID NO: 660802 - RNA, 64 nt, Homo Sapiens; identical to SEQ ID NO: 154331

SEQ ID NO: 660803 - RNA, 64 nt, Homo Sapiens; identical to SEQ ID NO: 154332

SEQ ID NO: 660804 - RNA, 64 nt, Homo Sapiens; identical to SEQ ID NO: 154333

SEQ ID NO: 660805 - RNA, 64 nt, Homo Sapiens; identical to SEQ ID NO: 154334

SEQ ID NO: 660806 - RNA, 64 nt, Homo Sapiens; identical to SEQ ID NO: 154335

SEQ ID NO: 660807 - RNA, 64 nt, Homo Sapiens; identical to SEQ ID NO: 154336

SEQ ID NO: 660808 - RNA, 64 nt, Homo Sapiens; identical to SEQ ID NO: 154337

SEQ ID NO: 660809 - RNA, 64 nt, Homo Sapiens; identical to SEQ ID NO: 154338

SEQ ID NO: 660810 - RNA, 64 nt, Homo Sapiens; identical to SEQ ID NO: 154339

SEQ ID NO: 660811 - RNA, 64 nt, Homo Sapiens; identical to SEQ ID NO: 154340

SEQ ID NO: 660812 - RNA, 64 nt, Homo Sapiens; identical to SEQ ID NO: 154341

SEQ ID NO: 660813 - RNA, 64 nt, Homo Sapiens; identical to SEQ ID NO: 154342

SEQ ID NO: 660814 - RNA, 64 nt, Homo Sapiens; identical to SEQ ID NO: 154343

SEQ ID NO: 660815 - RNA, 64 nt, Homo Sapiens; identical to SEQ ID NO: 154344

SEQ ID NO: 660816 - RNA, 64 nt, Homo Sapiens; identical to SEQ ID NO: 154345

SEQ ID NO: 660817 - RNA, 55 nt, Homo Sapiens; identical to SEQ ID NO: 154346

SEQ ID NO: 660818 - RNA, 64 nt, Homo Sapiens; identical to SEQ ID NO: 154347

SEQ ID NO: 660819 - RNA, 64 nt, Homo Sapiens; identical to SEQ ID NO: 154348

SEQ ID NO: 660820 - RNA, 64 nt, Homo Sapiens; identical to SEQ ID NO: 154349

SEQ ID NO: 660821 - RNA, 64 nt, Homo Sapiens; identical to SEQ ID NO: 154350

SEQ ID NO: 660822 - RNA, 64 nt, Homo Sapiens; identical to SEQ ID NO: 154351

SEQ ID NO: 660823 - RNA, 64 nt, Homo Sapiens; identical to SEQ ID NO: 154352

SEQ ID NO: 660824 - RNA, 64 nt, Homo Sapiens; identical to SEQ ID NO: 154353

SEQ ID NO: 660825 - RNA, 64 nt, Homo Sapiens; identical to SEQ ID NO: 154354

SEQ ID NO: 660826 - RNA, 64 nt, Homo Sapiens; identical to SEQ ID NO: 154355

SEQ ID NO: 660827 - RNA, 64 nt, Homo Sapiens; identical to SEQ ID NO: 154356

SEQ ID NO: 660828 - RNA, 64 nt, Homo Sapiens
gauggcagaacgaugccugcaggcauggaacuuuuuccguuaucacccaggccugauucacugg

SEQ ID NO: 660829 - RNA, 64 nt, Homo Sapiens
augcuaauuguuguaugaaaaaaauauuuuccauuuccguuauuagaaauggaauuuauauaca

SEQ ID NO: 660830 - RNA, 64 nt, Homo Sapiens
caauuugucauuacuguaguaaugacuugcuacguuccguuauucacuuaaaaugacucaauaa

SEQ ID NO: 660831 - RNA, 64 nt, Homo Sapiens
ggauaugguaucuccuaaaguaaaguacuucuacuuccguuauuuuucuaaaaucaguuuucgu

SEQ ID NO: 660832 - RNA, 64 nt, Homo Sapiens
aaaguuggaucacuaguggccagcauccccagaguuccguuaguaaacuuacuucauauguccc

SEQ ID NO: 660833 - RNA, 64 nt, Homo Sapiens
uguaauauugcuucucuuguaauuuuuuggaaguuuccguuaaaugcagcaucauguuguaauu

SEQ ID NO: 660834 - RNA, 64 nt, Homo Sapiens
aauaacacugcagcccucucggagcuguccuucauuccguuaggcaggagcuagcccagucccu

SEQ ID NO: 660835 - RNA, 64 nt, Homo Sapiens
acccuugaaacaauuagcuucuuacuuaaaauucuuccguuaccuagauguauuuaauauaauc

SEQ ID NO: 660836 - RNA, 64 nt, Homo Sapiens
uacuguggccugaaauaauucaaauagcaauaaguuccguuauaaccuauuuuuaaugaaacuu

SEQ ID NO: 660837 - RNA, 64 nt, Homo Sapiens
uuauauaugauaauuuauauaaaaccacuaauuguuccguuaagcuucacagaaaauaaaaccu

SEQ ID NO: 660838 - RNA, 64 nt, Homo Sapiens
ucccaguauucucagagcaugugucagaguguuguuccguuaaccuuuuuguaaauacugcuug

SEQ ID NO: 660839 - RNA, 64 nt, Homo Sapiens
uaucaucuaacagucuaaaaaacugcuuucugcauuccguuaaaagcauuggucacaauguacc

SEQ ID NO: 660840 - RNA, 64 nt, Homo Sapiens
gacaggcacuaggacgucugccuuuuuaaggcaguuccguuaaggguuuuuguuuuuaaacuuu

SEQ ID NO: 660841 - RNA, 64 nt, Homo Sapiens
cauucuugaacuuagaguauguaaauguaauaaauuccguuauccaggaguauaaauuauuugc

SEQ ID NO: 660842 - RNA, 64 nt, Homo Sapiens
ccaauaaaagaagggccucaauuguucauuaaucuuccguuagguuggcccgaaagcaguaaaa

SEQ ID NO: 660843 - RNA, 64 nt, Homo Sapiens
uuugccaaaggaaacuguuaacaucagcauucacuuccguuaaauaauuauuuuuucuauguuc

SEQ ID NO: 660844 - RNA, 64 nt, Homo Sapiens
guguugauucauaagaaauacuccuauuuuuaccuuccguuacacuuauuccuaguuguaggga

SEQ ID NO: 660845 - RNA, 64 nt, Homo Sapiens
uuccacguuucuauagcaaccacauuugacuaauuuccguuaguugaauaagagguauuaugau

SEQ ID NO: 660846 - RNA, 64 nt, Homo Sapiens
uuauguguuauaguuaauauaugcaccuaccuucuuccguuagugcaucaguaaauguguuauu

SEQ ID NO: 660847 - RNA, 64 nt, Homo Sapiens
ugugcguaccacacucuguucauauaauggaauguuccguuacagauuuccuuccuguauuaua

SEQ ID NO: 660848 - RNA, 64 nt, Homo Sapiens
agaaacaucacaauucaaaaguaacguauuguccuuccguuaacauuacacuaaaaguauuaua

SEQ ID NO: 660849 - RNA, 64 nt, Homo Sapiens
ggauccuuccuuaggcuuaauguuggaucggagguuccguuaggagugacaacugaacacacug

SEQ ID NO: 660850 - RNA, 64 nt, Homo Sapiens
uaguacuaauuaaguggauaauuuaauaacuuuguuccguuaauuugacuuagcacugagagcu

SEQ ID NO: 660851 - RNA, 64 nt, Homo Sapiens
uucuacauaggcaaagagaaugcuugauuuuuuuuuccguuauucuuaggaccugguaguuauu

SEQ ID NO: 660852 - RNA, 64 nt, Homo Sapiens
ugguaugugccauuggguuggauguccccacuacuuccguuaacccuucccauugucaagaugu

SEQ ID NO: 660853 - RNA, 64 nt, Homo Sapiens
uaaagaugugcaaccuaugcgcccccugcccuacuuccguuacccugagagucgguguguggcc

SEQ ID NO: 660854 - RNA, 64 nt, Homo Sapiens
augugugugucaagauacggcugauuuuuuuuuuuuccguuaaaaggacaugaauggccuaaaa

SEQ ID NO: 660855 - RNA, 64 nt, Homo Sapiens
uuucugguacaaccauucccuuccaguuuuuacauuccguuaucaauaacuccagauuucauaa

SEQ ID NO: 660856 - RNA, 64 nt, Homo Sapiens
ccccaucaggaccauuuuaucaaaguucguucauuuccguuaaccacauaacuaauaauuuaau

SEQ ID NO: 660857 - RNA, 64 nt, Homo Sapiens
auaccagccaguaaauggggcuucacauauugauuuccguuaaauuuuuaucgucacugcuuaa

SEQ ID NO: 660858 - RNA, 64 nt, Homo Sapiens
cccuaaaaaaaaaauguagaauaucucuuaagauuuccguuaugguaaaaaccauaugcaauaa

SEQ ID NO: 660859 - RNA, 64 nt, Homo Sapiens
ccacagacucuucaccuggcgcgcuccuuucuguuuccguuaggaagaggaguggggguugggg

SEQ ID NO: 660860 - RNA, 64 nt, Homo Sapiens
aauuacuuggaaaacaguggguauugauaguuaauuccguuaaacuucuuuuguauuaggcugu

SEQ ID NO: 660861 - RNA, 64 nt, Homo Sapiens
ucuggggauuuuuuuccagccgaaggaaaaucacuuccguuaugucccccucuaauuuagccgc

SEQ ID NO: 660862 - RNA, 64 nt, Homo Sapiens
auucuuaauucuguaaaagugaaauaaaauaacuuuccguuaauuauauauuuuugucaaaaca

SEQ ID NO: 660863 - RNA, 64 nt, Homo Sapiens
gcuccaaagaagacaauaguucccacucaugauuuuccguuacaaacaggcagcuggggcaugg

SEQ ID NO: 660864 - RNA, 64 nt, Homo Sapiens
gaagccccgcugcugagaugggcgcucccgacacagcgcagacccaccaggaggaaagaggccc

SEQ ID NO: 660865 - RNA, 64 nt, Homo Sapiens
gugaauggugagggugggagucaggagacaagacagcgcagagagggcugguuagccggaaaag

SEQ ID NO: 660866 - RNA, 64 nt, Homo Sapiens
uugcucccacauggucaggucucacccugcuugaagcgcagaaggcacagccuuacugaccagc

SEQ ID NO: 660867 - RNA, 64 nt, Homo Sapiens
gucccuggcugaagggaauuaacagauaguaucaagcgcagaaggaaugugccaguauggcucc

SEQ ID NO: 660868 - RNA, 64 nt, Homo Sapiens
ccuacuaacccuuuaacauacaguuuaggguccuagcgcagaguccuuguuuaaaggucauuga

SEQ ID NO: 660869 - RNA, 64 nt, Homo Sapiens
uccugauuccaagucaccugagugacauagcuagagcgcagaguucaaggucacacaauuggau

SEQ ID NO: 660870 - RNA, 64 nt, Homo Sapiens
caaggucagaaagagacggcagaauggcagccucagcgcagaggcucaggauggggaauagcca

SEQ ID NO: 660871 - RNA, 64 nt, Homo Sapiens
aagagacccucccauguacgggccuccaugugcaagcgcagaggccuccaccuggaccagggag

SEQ ID NO: 660872 - RNA, 64 nt, Homo Sapiens
uuccuaugucucccuagugcgccuuuauuuaaagagcgcagagaucuccagcucucuuggcagg

SEQ ID NO: 660873 - RNA, 64 nt, Homo Sapiens
cuagcacaugcccuaaugucaaguccccagagaaagcgcagaugguuguugagucuguuuugua

SEQ ID NO: 660874 - RNA, 64 nt, Homo Sapiens
agcccagaaaaggcggugcugcagccaggagagcagcgcagaaccaacaaugccccgaguggug

SEQ ID NO: 660875 - RNA, 64 nt, Homo Sapiens
aaagacaccagccacucagaguucuauacuguaaagcgcagauaacauuuguguguuauaccuu

SEQ ID NO: 660876 - RNA, 64 nt, Homo Sapiens
ucagagcugugagcggggggcgccguccaggccgagcgcagacuguuuaggacucagcagaccc

SEQ ID NO: 660877 - RNA, 64 nt, Homo Sapiens
cugggucccuagaccucgccagcgggaggcuucaagcgcagaccgaagucaauaauuuccagug

SEQ ID NO: 660878 - RNA, 64 nt, Homo Sapiens
ugguguuuguuuguugggcucuucgucuucggccagcgcagaccucccaccuccagggaggacg

SEQ ID NO: 660879 - RNA, 64 nt, Homo Sapiens
ucuuggccuucucucacagggaccgggcgucggcagcgcagaccagggcccggggcggaggugc

SEQ ID NO: 660880 - RNA, 64 nt, Homo Sapiens
uccaggcaagcauacuaaaauggcauugggauggagcgcagauaguaugccaucauggaagggg

SEQ ID NO: 660881 - RNA, 64 nt, Homo Sapiens
auagcuuuucccuguccugacaccaggcaagaaaagcgcagagaaaucggugucugacgauuuu

SEQ ID NO: 660882 - RNA, 64 nt, Homo Sapiens
gggcauucaggcaagugcaagugguucaggggccagcgcagagcagagugcugaguaaagaugu

SEQ ID NO: 660883 - RNA, 64 nt, Homo Sapiens
cauuaacuggaucauugcuuccccagggcaggagagcgcagagcuagggaaagugaaagguaau

SEQ ID NO: 660884 - RNA, 64 nt, Homo Sapiens
cucuagcuggggcagaacaaccucuggcuggggcagcgcagaccucagcagggacagcacagac

SEQ ID NO: 660885 - RNA, 64 nt, Homo Sapiens
ugugcucuggugacccgaggaggucgugcagcacagcgcagaagccccugcccacgggauccgg

SEQ ID NO: 660886 - RNA, 64 nt, Homo Sapiens
ccugcuuggggccagcacggaacuuccaggccucagcgcagagcccgcccaccacggcuguggg

SEQ ID NO: 660887 - RNA, 64 nt, Homo Sapiens
cggcgccagagcugggcucuucaacacggcauuuagcgcagaaagucgugguucaggcaguaug

SEQ ID NO: 660888 - RNA, 64 nt, Homo Sapiens
cuguuuuguccuuugagaaagaaauaauuguuugagcgcagaguaaaauaaggcuccuucaugu

SEQ ID NO: 660889 - RNA, 64 nt, Homo Sapiens
cacgcuggaagcccacccaagccggcggggcccuagcgcagaaauucagaacccccuguccuga

SEQ ID NO: 660890 - RNA, 64 nt, Homo Sapiens
uugcugcccgccgcacgcacaaggagcgcaccaaagcgcagagcacucgagagggggagggggu

SEQ ID NO: 660891 - RNA, 64 nt, Homo Sapiens
gaagggccaggcuuacugagcagaggaagaacacagcgcagaauuaagagguauuggauuuuca

SEQ ID NO: 660892 - RNA, 61 nt, Homo Sapiens
ugcgaaggggaacuguuugcugggcgagcugagcgcagagcgagaggcaguggcacacuga

SEQ ID NO: 660893 - RNA, 64 nt, Homo Sapiens
gagcuucucugggaugcuggagccauggcuuugcagcgcagacaccagcuucccugaugucugc

SEQ ID NO: 660894 - RNA, 64 nt, Homo Sapiens
ggcacagcccuggagcaggcagggagucugcaggagcgcagacagaccccagccuuccuggaac

SEQ ID NO: 660895 - RNA, 64 nt, Homo Sapiens
cgcugaggcccaggcagguggacgagaaaccacaagcgcagagacagcucagucagcccucggg

SEQ ID NO: 660896 - RNA, 64 nt, Homo Sapiens
agggggcaccgacagcgcugcuagccccacccagagcgcagaggguacauagaggaaaccuggg

SEQ ID NO: 660897 - RNA, 64 nt, Homo Sapiens
cagguccccacggcuguugcacaguagagcacuuagcgcagaauaugacaaccugugaugucuc

SEQ ID NO: 660898 - RNA, 64 nt, Homo Sapiens
acaguucuggaugcugggaaguccaaguucaaggagcgcagauucaaugucuggugagggccca

SEQ ID NO: 660899 - RNA, 64 nt, Homo Sapiens
cccuccucucccgcaggucugaaguuggccccccagcgcagaguagcugcuuccuggacgugcg

SEQ ID NO: 660900 - RNA, 64 nt, Homo Sapiens
uccuugcgcucaccuugccagaaagucugguggcagcgcagagcccaaucauuccaaccaaagc

SEQ ID NO: 660901 - RNA, 64 nt, Homo Sapiens
gguggguggucaggcccugaugagaccacaugagagcgcagagaggccugggugggggccggaa

SEQ ID NO: 660902 - RNA, 64 nt, Homo Sapiens
ggauggauggucuuuuauaaugcacacagucaaaagcgcagacuaaagcauuauuacugauacu

SEQ ID NO: 660903 - RNA, 64 nt, Homo Sapiens
ccugggccaugccggguaccguuagaauuuuauuagcgcagauuccccaccuuuccgauagucu

SEQ ID NO: 660904 - RNA, 64 nt, Homo Sapiens
ucagccgugggcccgggcgcggggaggccggcgcagcgcagagcgggcucgaagaaaauaauuc

SEQ ID NO: 660905 - RNA, 64 nt, Homo Sapiens
cucagggagucaccacagcucugcugcuagcgccagcgcagacuaaaugcugcuuccauaucag

SEQ ID NO: 660906 - RNA, 64 nt, Homo Sapiens
cggcaaagugagaugcacgcagaagagaaggaagagcgcagagcagccgcagccuuugggaggg

SEQ ID NO: 660907 - RNA, 64 nt, Homo Sapiens
aaacaggccagcccagugacccacuccuccccacagcgcagaggcaugagaguacuagccuccu

SEQ ID NO: 660908 - RNA, 64 nt, Homo Sapiens
ggcggagaaggagaggaacggccguggcagccgcagcgcagacuaccccaucccucugguguga

SEQ ID NO: 660909 - RNA, 64 nt, Homo Sapiens
aacacuccaccgcgaucugccugcgggggaucucagcgcagagaaguugagaggacccaugaag

SEQ ID NO: 660910 - RNA, 64 nt, Homo Sapiens
aaauggaaccacccauccguaguaggagcuacacagcgcagagagucgagaaucgucagcugua

SEQ ID NO: 660911 - RNA, 64 nt, Homo Sapiens
ccacacgcccgcggugaucccagccagggccccgagcgcagaggcggagcugugcucagcacag

SEQ ID NO: 660912 - RNA, 64 nt, Homo Sapiens
gugcugcugcgcgcgcuucgccugugcgggagccagcgcagagcuuggcugcgccggggguucc

SEQ ID NO: 660913 - RNA, 64 nt, Homo Sapiens
gggagagaauucuccacaaaaucaaggaaucucaagcgcagagaccagacucccucauuuuacc

SEQ ID NO: 660914 - RNA, 64 nt, Homo Sapiens
accugggccuggaggggcagggaaaucccacagcagcgcagaggacagaguguucuggcaaaga

SEQ ID NO: 660915 - RNA, 64 nt, Homo Sapiens
ucaggaaagaggucggggcuggacagauggggagagcgcagauagauuuaagagaguccuguga

SEQ ID NO: 660916 - RNA, 64 nt, Homo Sapiens
uggggacguggggcagccaccccugcccagcgagagcgcagacaccgugugaggggacagcagc

SEQ ID NO: 660917 - RNA, 64 nt, Homo Sapiens
ccgcacagggaccgggaccgggaccgugagcgggagcgcagagagcggagccgggagcgagaca

SEQ ID NO: 660918 - RNA, 64 nt, Homo Sapiens
auaccagcguguaacacggaacuuccaaaugcugagcgcagauccaaaguugucuucuguccac

SEQ ID NO: 660919 - RNA, 64 nt, Homo Sapiens
gcacuuuaggagccccagacaggaggaucacuuaagcgcagaagaucaagaccagccugggaaa

SEQ ID NO: 660920 - RNA, 51 nt, Homo Sapiens
cccuucuucacacccgggacgagcgcagacagccuggagccugaccgcuga

SEQ ID NO: 660921 - RNA, 64 nt, Homo Sapiens
gaagcaaaauucuuguauacuucaaaguggccacagcgcagaccggguuuucuuggcuccccug

SEQ ID NO: 660922 - RNA, 64 nt, Homo Sapiens
gccacgcccacacccggccucugucccacgcugcagcgcagacgguugccacccacgugcccag

SEQ ID NO: 660923 - RNA, 64 nt, Homo Sapiens
aaauggaauucuguauuuauuauuauuuaaguguagcgcagaugugugugcuugggcguguuuc

SEQ ID NO: 660924 - RNA, 64 nt, Homo Sapiens
uucagauauauuuuaguaaccaguucuucugggaagcgcagaauuaguacuuucuuccugaugc

SEQ ID NO: 660925 - RNA, 64 nt, Homo Sapiens
guuggggcuggcaggccacuggcaugugcugaguagcgcagagcuacccagugagaggccuugu

SEQ ID NO: 660926 - RNA, 64 nt, Homo Sapiens
guuuuaacucuuggugacaguagaugcucucuggagcgcagacgaggcacaugugucuucauag

SEQ ID NO: 660927 - RNA, 64 nt, Homo Sapiens
cuggggccgucugccuacacgcuccagaagggccagcgcagagcugggauggccacugagagcc

SEQ ID NO: 660928 - RNA, 64 nt, Homo Sapiens
cgguagagaugggaggaaacguggcaguuggcacagcgcagauggggaccugaguuuggguggg

SEQ ID NO: 660929 - RNA, 64 nt, Homo Sapiens
aagcacaacgggucauuuuccuuuguauguuccuagcgcagaacuguuucuaaaacaacuugaa

SEQ ID NO: 660930 - RNA, 64 nt, Homo Sapiens
aauauaaauuguggacugcugaaaaguauauuggagcgcagauaauaaauaggaugagguugaa

SEQ ID NO: 660931 - RNA, 64 nt, Homo Sapiens; identical to SEQ ID NO: 262453

SEQ ID NO: 660932 - RNA, 64 nt, Homo Sapiens; identical to SEQ ID NO: 262454

SEQ ID NO: 660933 - RNA, 64 nt, Homo Sapiens; identical to SEQ ID NO: 262455

SEQ ID NO: 660934 - RNA, 64 nt, Homo Sapiens; identical to SEQ ID NO: 262456

SEQ ID NO: 660935 - RNA, 64 nt, Homo Sapiens; identical to SEQ ID NO: 262457

SEQ ID NO: 660936 - RNA, 64 nt, Homo Sapiens; identical to SEQ ID NO: 262458

SEQ ID NO: 660937 - RNA, 64 nt, Homo Sapiens; identical to SEQ ID NO: 262459

SEQ ID NO: 660938 - RNA, 64 nt, Homo Sapiens; identical to SEQ ID NO: 262460

SEQ ID NO: 660939 - RNA, 64 nt, Homo Sapiens; identical to SEQ ID NO: 262461

SEQ ID NO: 660940 - RNA, 64 nt, Homo Sapiens; identical to SEQ ID NO: 262462

SEQ ID NO: 660941 - RNA, 64 nt, Homo Sapiens; identical to SEQ ID NO: 262463

SEQ ID NO: 660942 - RNA, 64 nt, Homo Sapiens; identical to SEQ ID NO: 262464

SEQ ID NO: 660943 - RNA, 64 nt, Homo Sapiens; identical to SEQ ID NO: 262465

SEQ ID NO: 660944 - RNA, 64 nt, Homo Sapiens; identical to SEQ ID NO: 262466

SEQ ID NO: 660945 - RNA, 64 nt, Homo Sapiens; identical to SEQ ID NO: 262467

SEQ ID NO: 660946 - RNA, 64 nt, Homo Sapiens; identical to SEQ ID NO: 262468

SEQ ID NO: 660947 - RNA, 64 nt, Homo Sapiens; identical to SEQ ID NO: 262469

SEQ ID NO: 660948 - RNA, 64 nt, Homo Sapiens; identical to SEQ ID NO: 262470

SEQ ID NO: 660949 - RNA, 64 nt, Homo Sapiens; identical to SEQ ID NO: 262471

SEQ ID NO: 660950 - RNA, 64 nt, Homo Sapiens; identical to SEQ ID NO: 262472

SEQ ID NO: 660951 - RNA, 64 nt, Homo Sapiens; identical to SEQ ID NO: 262473

SEQ ID NO: 660952 - RNA, 64 nt, Homo Sapiens; identical to SEQ ID NO: 262474

SEQ ID NO: 660953 - RNA, 64 nt, Homo Sapiens; identical to SEQ ID NO: 262475

SEQ ID NO: 660954 - RNA, 64 nt, Homo Sapiens; identical to SEQ ID NO: 262476

SEQ ID NO: 660955 - RNA, 64 nt, Homo Sapiens; identical to SEQ ID NO: 262477

SEQ ID NO: 660956 - RNA, 64 nt, Homo Sapiens; identical to SEQ ID NO: 262478

SEQ ID NO: 660957 - RNA, 64 nt, Homo Sapiens; identical to SEQ ID NO: 262479

SEQ ID NO: 660958 - RNA, 64 nt, Homo Sapiens; identical to SEQ ID NO: 262480

SEQ ID NO: 660959 - RNA, 64 nt, Homo Sapiens; identical to SEQ ID NO: 262481

SEQ ID NO: 660960 - RNA, 64 nt, Homo Sapiens; identical to SEQ ID NO: 262482

SEQ ID NO: 660961 - RNA, 64 nt, Homo Sapiens; identical to SEQ ID NO: 262483

SEQ ID NO: 660962 - RNA, 64 nt, Homo Sapiens
cugcccccugccccagggcuggagcuccgaugugaggggcaaggaaccagcucauuucaacaaa

SEQ ID NO: 660963 - RNA, 64 nt, Homo Sapiens
acuguuggaggagaguuagcccaucugggcagucaggggcaaggugggcaagguugggacaaag

SEQ ID NO: 660964 - RNA, 64 nt, Homo Sapiens
ccuggaugaaguuaucuggcuucaaauauuaugcaggggcaaacaccugcugauguggcaacug

SEQ ID NO: 660965 - RNA, 64 nt, Homo Sapiens
uuccuagccaaguuuaagaggcaaguaaaaauauaggggcaaugucagaugaagucuuguucag

SEQ ID NO: 660966 - RNA, 64 nt, Homo Sapiens
guuuugagcagaggacccuccaacuuauggcaucaggggcaaaaagucacagcuuaucccaggc

SEQ ID NO: 660967 - RNA, 64 nt, Homo Sapiens
guccugcagccucauauggcucaauaaaacagaaaggggcaaguauagaagauuaggaugacua

SEQ ID NO: 660968 - RNA, 64 nt, Homo Sapiens
cugagcagcaggugugccccagagagagcuggaaaggggcaaccaugggacuuugggggcagug

SEQ ID NO: 660969 - RNA, 64 nt, Homo Sapiens
acccuccccaggaaggaggacugcacaaccucagaggggcaaaaagaaacuguucuucugguuc

SEQ ID NO: 660970 - RNA, 64 nt, Homo Sapiens
aauuggggauccaggugucagagguaggggaaccaggggcaagcuggggcugagcuggaggugg

SEQ ID NO: 660971 - RNA, 64 nt, Homo Sapiens
gggccgcuugggggagggaagaggcagcccggcgaggggcaagcgggggacccagccgggcugg

SEQ ID NO: 660972 - RNA, 64 nt, Homo Sapiens
cugcucugagcccaucuguucucccccugcaagaaggggcaaugcucuuguguugucccucugu

SEQ ID NO: 660973 - RNA, 64 nt, Homo Sapiens
ccccagagcgaaugagggcagagaugcccggggcaggggcaaacgcccuccgcucccucugcuc

SEQ ID NO: 660974 - RNA, 64 nt, Homo Sapiens
cuggggcuccaacuggguacuuucccggcaagagaggggcaaguaagcugcuugucaagaagca

SEQ ID NO: 660975 - RNA, 64 nt, Homo Sapiens
agagcccagagagaagcgccggagcucucuacccaggggcaagggaauguccugggcuccuuca

SEQ ID NO: 660976 - RNA, 64 nt, Homo Sapiens
aggcgggcaggccuucacugucuggcugcggggaaggggcaagaguuccggcugugucuggugg

SEQ ID NO: 660977 - RNA, 64 nt, Homo Sapiens
uacggccugggcuaggugaggccagggcugugggaggggcaagcugggagcugaugaagcaggu

SEQ ID NO: 660978 - RNA, 64 nt, Homo Sapiens
augggaagaagccaggaaaaccucugaguguugaaggggcaacccaaggcaucacaguucacag

SEQ ID NO: 660979 - RNA, 64 nt, Homo Sapiens
auucuugccuugaggcucugcaguggcaaaugguaggggcaauagcgcucccuuuucaccugaa

SEQ ID NO: 660980 - RNA, 66 nt, Homo Sapiens; identical to SEQ ID NO: 551902

SEQ ID NO: 660981 - RNA, 66 nt, Homo Sapiens; identical to SEQ ID NO: 551903

SEQ ID NO: 660982 - RNA, 66 nt, Homo Sapiens; identical to SEQ ID NO: 551904

SEQ ID NO: 660983 - RNA, 66 nt, Homo Sapiens; identical to SEQ ID NO: 551905

SEQ ID NO: 660984 - RNA, 66 nt, Homo Sapiens; identical to SEQ ID NO: 551906

SEQ ID NO: 660985 - RNA, 66 nt, Homo Sapiens; identical to SEQ ID NO: 551907

SEQ ID NO: 660986 - RNA, 66 nt, Homo Sapiens; identical to SEQ ID NO: 551908

SEQ ID NO: 660987 - RNA, 66 nt, Homo Sapiens; identical to SEQ ID NO: 551909

SEQ ID NO: 660988 - RNA, 66 nt, Homo Sapiens; identical to SEQ ID NO: 551910

SEQ ID NO: 660989 - RNA, 66 nt, Homo Sapiens; identical to SEQ ID NO: 551911

SEQ ID NO: 660990 - RNA, 66 nt, Homo Sapiens; identical to SEQ ID NO: 551912

SEQ ID NO: 660991 - RNA, 66 nt, Homo Sapiens; identical to SEQ ID NO: 551913

SEQ ID NO: 660992 - RNA, 66 nt, Homo Sapiens; identical to SEQ ID NO: 551914

SEQ ID NO: 660993 - RNA, 66 nt, Homo Sapiens; identical to SEQ ID NO: 551915

SEQ ID NO: 660994 - RNA, 66 nt, Homo Sapiens; identical to SEQ ID NO: 551916

SEQ ID NO: 660995 - RNA, 66 nt, Homo Sapiens; identical to SEQ ID NO: 551917

SEQ ID NO: 660996 - RNA, 66 nt, Homo Sapiens; identical to SEQ ID NO: 551918

SEQ ID NO: 660997 - RNA, 66 nt, Homo Sapiens; identical to SEQ ID NO: 551919

SEQ ID NO: 660998 - RNA, 66 nt, Homo Sapiens; identical to SEQ ID NO: 551920

SEQ ID NO: 660999 - RNA, 66 nt, Homo Sapiens; identical to SEQ ID NO: 551921

SEQ ID NO: 661000 - RNA, 66 nt, Homo Sapiens; identical to SEQ ID NO: 551922

SEQ ID NO: 661001 - RNA, 66 nt, Homo Sapiens; identical to SEQ ID NO: 551923

SEQ ID NO: 661002 - RNA, 66 nt, Homo Sapiens; identical to SEQ ID NO: 551924

SEQ ID NO: 661003 - RNA, 66 nt, Homo Sapiens; identical to SEQ ID NO: 551925

SEQ ID NO: 661004 - RNA, 66 nt, Homo Sapiens; identical to SEQ ID NO: 551926

SEQ ID NO: 661005 - RNA, 66 nt, Homo Sapiens; identical to SEQ ID NO: 551927

SEQ ID NO: 661006 - RNA, 66 nt, Homo Sapiens; identical to SEQ ID NO: 551928

SEQ ID NO: 661007 - RNA, 66 nt, Homo Sapiens; identical to SEQ ID NO: 551929

SEQ ID NO: 661008 - RNA, 66 nt, Homo Sapiens; identical to SEQ ID NO: 551930

SEQ ID NO: 661009 - RNA, 66 nt, Homo Sapiens; identical to SEQ ID NO: 551931

SEQ ID NO: 661010 - RNA, 66 nt, Homo Sapiens; identical to SEQ ID NO: 551932

SEQ ID NO: 661011 - RNA, 66 nt, Homo Sapiens; identical to SEQ ID NO: 551933

SEQ ID NO: 661012 - RNA, 66 nt, Homo Sapiens; identical to SEQ ID NO: 551934

SEQ ID NO: 661013 - RNA, 64 nt, Homo Sapiens; identical to SEQ ID NO: 219884

SEQ ID NO: 661014 - RNA, 64 nt, Homo Sapiens; identical to SEQ ID NO: 219885

SEQ ID NO: 661015 - RNA, 64 nt, Homo Sapiens; identical to SEQ ID NO: 219886

SEQ ID NO: 661016 - RNA, 64 nt, Homo Sapiens; identical to SEQ ID NO: 219887

SEQ ID NO: 661017 - RNA, 64 nt, Homo Sapiens; identical to SEQ ID NO: 219888

SEQ ID NO: 661018 - RNA, 64 nt, Homo Sapiens; identical to SEQ ID NO: 219889

SEQ ID NO: 661019 - RNA, 64 nt, Homo Sapiens; identical to SEQ ID NO: 219890

SEQ ID NO: 661020 - RNA, 64 nt, Homo Sapiens; identical to SEQ ID NO: 219891

SEQ ID NO: 661021 - RNA, 64 nt, Homo Sapiens; identical to SEQ ID NO: 219892

SEQ ID NO: 661022 - RNA, 64 nt, Homo Sapiens; identical to SEQ ID NO: 219893

SEQ ID NO: 661023 - RNA, 64 nt, Homo Sapiens; identical to SEQ ID NO: 219894

SEQ ID NO: 661024 - RNA, 64 nt, Homo Sapiens; identical to SEQ ID NO: 219895

SEQ ID NO: 661025 - RNA, 64 nt, Homo Sapiens; identical to SEQ ID NO: 219896

SEQ ID NO: 661026 - RNA, 64 nt, Homo Sapiens; identical to SEQ ID NO: 219897

SEQ ID NO: 661027 - RNA, 64 nt, Homo Sapiens; identical to SEQ ID NO: 614144

SEQ ID NO: 661028 - RNA, 64 nt, Homo Sapiens; identical to SEQ ID NO: 614145

SEQ ID NO: 661029 - RNA, 64 nt, Homo Sapiens; identical to SEQ ID NO: 614146

SEQ ID NO: 661030 - RNA, 64 nt, Homo Sapiens; identical to SEQ ID NO: 614147

SEQ ID NO: 661031 - RNA, 64 nt, Homo Sapiens; identical to SEQ ID NO: 614148

SEQ ID NO: 661032 - RNA, 64 nt, Homo Sapiens; identical to SEQ ID NO: 614149

SEQ ID NO: 661033 - RNA, 64 nt, Homo Sapiens; identical to SEQ ID NO: 614150

SEQ ID NO: 661034 - RNA, 64 nt, Homo Sapiens; identical to SEQ ID NO: 614151

SEQ ID NO: 661035 - RNA, 64 nt, Homo Sapiens; identical to SEQ ID NO: 614152

SEQ ID NO: 661036 - RNA, 64 nt, Homo Sapiens; identical to SEQ ID NO: 614153

SEQ ID NO: 661037 - RNA, 64 nt, Homo Sapiens; identical to SEQ ID NO: 614154

SEQ ID NO: 661038 - RNA, 64 nt, Homo Sapiens; identical to SEQ ID NO: 614155

SEQ ID NO: 661039 - RNA, 64 nt, Homo Sapiens; identical to SEQ ID NO: 614156

SEQ ID NO: 661040 - RNA, 64 nt, Homo Sapiens; identical to SEQ ID NO: 614157

SEQ ID NO: 661041 - RNA, 64 nt, Homo Sapiens; identical to SEQ ID NO: 614158

SEQ ID NO: 661042 - RNA, 64 nt, Homo Sapiens; identical to SEQ ID NO: 614159

SEQ ID NO: 661043 - RNA, 64 nt, Homo Sapiens; identical to SEQ ID NO: 614160

SEQ ID NO: 661044 - RNA, 64 nt, Homo Sapiens; identical to SEQ ID NO: 614161

SEQ ID NO: 661045 - RNA, 64 nt, Homo Sapiens; identical to SEQ ID NO: 614162

SEQ ID NO: 661046 - RNA, 64 nt, Homo Sapiens; identical to SEQ ID NO: 614163

SEQ ID NO: 661047 - RNA, 64 nt, Homo Sapiens; identical to SEQ ID NO: 614164

SEQ ID NO: 661048 - RNA, 64 nt, Homo Sapiens; identical to SEQ ID NO: 614165

SEQ ID NO: 661049 - RNA, 64 nt, Homo Sapiens; identical to SEQ ID NO: 614166

SEQ ID NO: 661050 - RNA, 64 nt, Homo Sapiens; identical to SEQ ID NO: 614167

SEQ ID NO: 661051 - RNA, 64 nt, Homo Sapiens; identical to SEQ ID NO: 614168

SEQ ID NO: 661052 - RNA, 64 nt, Homo Sapiens; identical to SEQ ID NO: 614169

SEQ ID NO: 661053 - RNA, 64 nt, Homo Sapiens; identical to SEQ ID NO: 614170

SEQ ID NO: 661054 - RNA, 64 nt, Homo Sapiens; identical to SEQ ID NO: 614171

SEQ ID NO: 661055 - RNA, 64 nt, Homo Sapiens; identical to SEQ ID NO: 614172

SEQ ID NO: 661056 - RNA, 64 nt, Homo Sapiens; identical to SEQ ID NO: 614173

SEQ ID NO: 661057 - RNA, 64 nt, Homo Sapiens; identical to SEQ ID NO: 614174

SEQ ID NO: 661058 - RNA, 64 nt, Homo Sapiens; identical to SEQ ID NO: 614175

SEQ ID NO: 661059 - RNA, 64 nt, Homo Sapiens
agagccccagauucccccuaagaagcaaaggaucgucuuuuaugccucuggcuaaggcagguuc

SEQ ID NO: 661060 - RNA, 64 nt, Homo Sapiens
uaucaguauguaccuuuguaauuguuauuuuuaugucuuuuaugcccuugauuauuaguugggc

SEQ ID NO: 661061 - RNA, 64 nt, Homo Sapiens
cuggugcuuaguacuguuuucccugcacguaggggucuuuuaaaaauauaaagcuugugauaaa

SEQ ID NO: 661062 - RNA, 64 nt, Homo Sapiens
gccaagauaugcuguuggugccugauagggauuagucuuuuaggugcccuguucuccuaccaua

SEQ ID NO: 661063 - RNA, 64 nt, Homo Sapiens
cuguuuuccuuuaguuuagaaauacauagacauugucuuuuaugaauucugaucauauuuaguc

SEQ ID NO: 661064 - RNA, 64 nt, Homo Sapiens
auaaggcaccucccacuuuuauguauagaaagaggucuuuuaauuuuuuuuuaaugugagaagg

SEQ ID NO: 661065 - RNA, 64 nt, Homo Sapiens
uauauacuuuucugaaagguuccugacgucuugggucuuuuaagauaaauacagagcuuuauua

SEQ ID NO: 661066 - RNA, 64 nt, Homo Sapiens
cuguuuauaauaucaaguaucacuacuauaucaugucuuuuacuauuuuuuuuuuuuuaguaau

SEQ ID NO: 661067 - RNA, 64 nt, Homo Sapiens
uaaggguacuaagcaaggucgagguaaauguuuugucuuuuacuuuuuaccuucauuuuuagau

SEQ ID NO: 661068 - RNA, 64 nt, Homo Sapiens
augcuuccaacccaaaggccccuaaaacacuguugucuuuuaaaugggcucaaacaauucucag

SEQ ID NO: 661069 - RNA, 64 nt, Homo Sapiens
uggcuuucauuuuuauaguuauuauggaaauguugucuuuuauacuuaguuauauaagaaaaaa

SEQ ID NO: 661070 - RNA, 64 nt, Homo Sapiens
uggucaaauccaacacuuggcuuaucaauauuaagucuuuuaccuaaaggcccagccgucacca

SEQ ID NO: 661071 - RNA, 64 nt, Homo Sapiens
uacuuuuugguaauauuaacacauaacuuuuuaugucuuuuauuaauuauucucuuaaaagaca

SEQ ID NO: 661072 - RNA, 64 nt, Homo Sapiens
auugaacaugaaauuuguucagaggacuuuuuuggucuuuuagugauaaaacauggacaauggc

SEQ ID NO: 661073 - RNA, 64 nt, Homo Sapiens
ggauuaaaaguucuguugcagccaaauauauugagucuuuuauggaguacuauaaaaugagggu

SEQ ID NO: 661074 - RNA, 64 nt, Homo Sapiens
cuauaaucauuccaaauuuuuucagaaaaaccaugucuuuuaugccacaccucccuguccacuu

SEQ ID NO: 661075 - RNA, 64 nt, Homo Sapiens
ggugguuuauucucagaagaaaaagauauguaaggucuuuuagcuccuuagagugaagcaaaag

SEQ ID NO: 661076 - RNA, 64 nt, Homo Sapiens
uuuguacucagaggaauuuuuuuuguuuuguuuugucuuuuaagaaaggaaagaaaggaugaaa

SEQ ID NO: 661077 - RNA, 64 nt, Homo Sapiens
caauggacaaaucaaguuaaauuaaauccauccugucuuuuacaauagagauuucuuuggagua

SEQ ID NO: 661078 - RNA, 64 nt, Homo Sapiens
uuuuggccuuguuuccaaauaaaaaaaagguuaagucuuuuaaauucuguggcucauuuaaaag

SEQ ID NO: 661079 - RNA, 64 nt, Homo Sapiens
uuugcucuugccauuuuaagguagcccucucaucgucuuuuaguuccaacaaagaaaggugcca

SEQ ID NO: 661080 - RNA, 64 nt, Homo Sapiens
acguaggauauuuucccuaccuaagaauuucacugucuuuuaaaaaacaaaaaguaaaguaaug

SEQ ID NO: 661081 - RNA, 64 nt, Homo Sapiens
guacuauauucuucuuaguccucaccucuuccuugucuuuuagaucuuaauuucaugcugauua

SEQ ID NO: 661082 - RNA, 64 nt, Homo Sapiens
cuuuaaaccuuuaacuucaaacauuaaaauacaagucuuuuaaguacaugagugcuuagaaaug

SEQ ID NO: 661083 - RNA, 64 nt, Homo Sapiens
uuuuuucacaauuuauuuugguuugaagaugaaagucuuuuaucucauuuuagaaaaauggguu

SEQ ID NO: 661084 - RNA, 64 nt, Homo Sapiens
auaaguauuuccuauuaaacuuacaaaggggucagucuuuuaaauuuccuacaaaucagcguag

SEQ ID NO: 661085 - RNA, 64 nt, Homo Sapiens; identical to SEQ ID NO: 313125

SEQ ID NO: 661086 - RNA, 64 nt, Homo Sapiens; identical to SEQ ID NO: 313126

SEQ ID NO: 661087 - RNA, 64 nt, Homo Sapiens; identical to SEQ ID NO: 313127

SEQ ID NO: 661088 - RNA, 64 nt, Homo Sapiens; identical to SEQ ID NO: 313128

SEQ ID NO: 661089 - RNA, 64 nt, Homo Sapiens; identical to SEQ ID NO: 313129

SEQ ID NO: 661090 - RNA, 64 nt, Homo Sapiens; identical to SEQ ID NO: 313130

SEQ ID NO: 661091 - RNA, 64 nt, Homo Sapiens; identical to SEQ ID NO: 313131

SEQ ID NO: 661092 - RNA, 64 nt, Homo Sapiens; identical to SEQ ID NO: 313132

SEQ ID NO: 661093 - RNA, 64 nt, Homo Sapiens; identical to SEQ ID NO: 313133

SEQ ID NO: 661094 - RNA, 64 nt, Homo Sapiens; identical to SEQ ID NO: 313134

SEQ ID NO: 661095 - RNA, 64 nt, Homo Sapiens; identical to SEQ ID NO: 313135

SEQ ID NO: 661096 - RNA, 51 nt, Homo Sapiens; identical to SEQ ID NO: 313136

SEQ ID NO: 661097 - RNA, 64 nt, Homo Sapiens; identical to SEQ ID NO: 313137

SEQ ID NO: 661098 - RNA, 64 nt, Homo Sapiens; identical to SEQ ID NO: 313138

SEQ ID NO: 661099 - RNA, 64 nt, Homo Sapiens; identical to SEQ ID NO: 313139

SEQ ID NO: 661100 - RNA, 64 nt, Homo Sapiens; identical to SEQ ID NO: 313140

SEQ ID NO: 661101 - RNA, 64 nt, Homo Sapiens; identical to SEQ ID NO: 313141

SEQ ID NO: 661102 - RNA, 64 nt, Homo Sapiens; identical to SEQ ID NO: 313142

SEQ ID NO: 661103 - RNA, 64 nt, Homo Sapiens; identical to SEQ ID NO: 313143

SEQ ID NO: 661104 - RNA, 64 nt, Homo Sapiens; identical to SEQ ID NO: 313144

SEQ ID NO: 661105 - RNA, 64 nt, Homo Sapiens; identical to SEQ ID NO: 313145

SEQ ID NO: 661106 - RNA, 64 nt, Homo Sapiens; identical to SEQ ID NO: 313146

SEQ ID NO: 661107 - RNA, 64 nt, Homo Sapiens; identical to SEQ ID NO: 313147

SEQ ID NO: 661108 - RNA, 64 nt, Homo Sapiens; identical to SEQ ID NO: 313148

SEQ ID NO: 661109 - RNA, 64 nt, Homo Sapiens; identical to SEQ ID NO: 313149

SEQ ID NO: 661110 - RNA, 64 nt, Homo Sapiens; identical to SEQ ID NO: 313150

SEQ ID NO: 661111 - RNA, 64 nt, Homo Sapiens; identical to SEQ ID NO: 313151

SEQ ID NO: 661112 - RNA, 64 nt, Homo Sapiens; identical to SEQ ID NO: 517844

SEQ ID NO: 661113 - RNA, 64 nt, Homo Sapiens; identical to SEQ ID NO: 517845

SEQ ID NO: 661114 - RNA, 64 nt, Homo Sapiens; identical to SEQ ID NO: 517846

SEQ ID NO: 661115 - RNA, 64 nt, Homo Sapiens; identical to SEQ ID NO: 517847

SEQ ID NO: 661116 - RNA, 64 nt, Homo Sapiens; identical to SEQ ID NO: 517848

SEQ ID NO: 661117 - RNA, 64 nt, Homo Sapiens; identical to SEQ ID NO: 517849

SEQ ID NO: 661118 - RNA, 64 nt, Homo Sapiens; identical to SEQ ID NO: 517850

SEQ ID NO: 661119 - RNA, 64 nt, Homo Sapiens; identical to SEQ ID NO: 517851

SEQ ID NO: 661120 - RNA, 64 nt, Homo Sapiens; identical to SEQ ID NO: 313125

SEQ ID NO: 661121 - RNA, 64 nt, Homo Sapiens; identical to SEQ ID NO: 313126

SEQ ID NO: 661122 - RNA, 64 nt, Homo Sapiens; identical to SEQ ID NO: 313127

SEQ ID NO: 661123 - RNA, 64 nt, Homo Sapiens; identical to SEQ ID NO: 313128

SEQ ID NO: 661124 - RNA, 64 nt, Homo Sapiens; identical to SEQ ID NO: 313129

SEQ ID NO: 661125 - RNA, 64 nt, Homo Sapiens; identical to SEQ ID NO: 313130

SEQ ID NO: 661126 - RNA, 64 nt, Homo Sapiens; identical to SEQ ID NO: 313131

SEQ ID NO: 661127 - RNA, 64 nt, Homo Sapiens; identical to SEQ ID NO: 313132

SEQ ID NO: 661128 - RNA, 64 nt, Homo Sapiens; identical to SEQ ID NO: 313133

SEQ ID NO: 661129 - RNA, 64 nt, Homo Sapiens; identical to SEQ ID NO: 313134

SEQ ID NO: 661130 - RNA, 64 nt, Homo Sapiens; identical to SEQ ID NO: 313135

SEQ ID NO: 661131 - RNA, 51 nt, Homo Sapiens; identical to SEQ ID NO: 313136

SEQ ID NO: 661132 - RNA, 64 nt, Homo Sapiens; identical to SEQ ID NO: 313137

SEQ ID NO: 661133 - RNA, 64 nt, Homo Sapiens; identical to SEQ ID NO: 313138

SEQ ID NO: 661134 - RNA, 64 nt, Homo Sapiens; identical to SEQ ID NO: 313139

SEQ ID NO: 661135 - RNA, 64 nt, Homo Sapiens; identical to SEQ ID NO: 313140

SEQ ID NO: 661136 - RNA, 64 nt, Homo Sapiens; identical to SEQ ID NO: 313141

SEQ ID NO: 661137 - RNA, 64 nt, Homo Sapiens; identical to SEQ ID NO: 313142

SEQ ID NO: 661138 - RNA, 64 nt, Homo Sapiens; identical to SEQ ID NO: 313143

SEQ ID NO: 661139 - RNA, 64 nt, Homo Sapiens; identical to SEQ ID NO: 313144

SEQ ID NO: 661140 - RNA, 64 nt, Homo Sapiens; identical to SEQ ID NO: 313145

SEQ ID NO: 661141 - RNA, 64 nt, Homo Sapiens; identical to SEQ ID NO: 313146

SEQ ID NO: 661142 - RNA, 64 nt, Homo Sapiens; identical to SEQ ID NO: 313147

SEQ ID NO: 661143 - RNA, 64 nt, Homo Sapiens; identical to SEQ ID NO: 313148

SEQ ID NO: 661144 - RNA, 64 nt, Homo Sapiens; identical to SEQ ID NO: 313149

SEQ ID NO: 661145 - RNA, 64 nt, Homo Sapiens; identical to SEQ ID NO: 313150

SEQ ID NO: 661146 - RNA, 64 nt, Homo Sapiens; identical to SEQ ID NO: 313151

SEQ ID NO: 661147 - RNA, 64 nt, Homo Sapiens; identical to SEQ ID NO: 517844

SEQ ID NO: 661148 - RNA, 64 nt, Homo Sapiens; identical to SEQ ID NO: 517845

SEQ ID NO: 661149 - RNA, 64 nt, Homo Sapiens; identical to SEQ ID NO: 517846

SEQ ID NO: 661150 - RNA, 64 nt, Homo Sapiens; identical to SEQ ID NO: 517847

SEQ ID NO: 661151 - RNA, 64 nt, Homo Sapiens; identical to SEQ ID NO: 517848

SEQ ID NO: 661152 - RNA, 64 nt, Homo Sapiens; identical to SEQ ID NO: 517849

SEQ ID NO: 661153 - RNA, 64 nt, Homo Sapiens; identical to SEQ ID NO: 517850

SEQ ID NO: 661154 - RNA, 64 nt, Homo Sapiens; identical to SEQ ID NO: 517851

SEQ ID NO: 661155 - RNA, 64 nt, Homo Sapiens; identical to SEQ ID NO: 563891

SEQ ID NO: 661156 - RNA, 64 nt, Homo Sapiens; identical to SEQ ID NO: 563892

SEQ ID NO: 661157 - RNA, 64 nt, Homo Sapiens; identical to SEQ ID NO: 563893

SEQ ID NO: 661158 - RNA, 64 nt, Homo Sapiens; identical to SEQ ID NO: 563894

SEQ ID NO: 661159 - RNA, 64 nt, Homo Sapiens; identical to SEQ ID NO: 563895

SEQ ID NO: 661160 - RNA, 64 nt, Homo Sapiens; identical to SEQ ID NO: 563896

SEQ ID NO: 661161 - RNA, 64 nt, Homo Sapiens; identical to SEQ ID NO: 563897

SEQ ID NO: 661162 - RNA, 64 nt, Homo Sapiens; identical to SEQ ID NO: 563898

SEQ ID NO: 661163 - RNA, 64 nt, Homo Sapiens; identical to SEQ ID NO: 563899

SEQ ID NO: 661164 - RNA, 64 nt, Homo Sapiens; identical to SEQ ID NO: 563900

SEQ ID NO: 661165 - RNA, 64 nt, Homo Sapiens; identical to SEQ ID NO: 563901

SEQ ID NO: 661166 - RNA, 64 nt, Homo Sapiens; identical to SEQ ID NO: 563902

SEQ ID NO: 661167 - RNA, 64 nt, Homo Sapiens; identical to SEQ ID NO: 563903

SEQ ID NO: 661168 - RNA, 64 nt, Homo Sapiens; identical to SEQ ID NO: 563904

SEQ ID NO: 661169 - RNA, 64 nt, Homo Sapiens; identical to SEQ ID NO: 563905

SEQ ID NO: 661170 - RNA, 64 nt, Homo Sapiens; identical to SEQ ID NO: 563906

SEQ ID NO: 661171 - RNA, 64 nt, Homo Sapiens; identical to SEQ ID NO: 563907

SEQ ID NO: 661172 - RNA, 64 nt, Homo Sapiens; identical to SEQ ID NO: 563908

SEQ ID NO: 661173 - RNA, 64 nt, Homo Sapiens; identical to SEQ ID NO: 563909

SEQ ID NO: 661174 - RNA, 64 nt, Homo Sapiens; identical to SEQ ID NO: 563910

SEQ ID NO: 661175 - RNA, 64 nt, Homo Sapiens; identical to SEQ ID NO: 563911

SEQ ID NO: 661176 - RNA, 64 nt, Homo Sapiens; identical to SEQ ID NO: 563912

SEQ ID NO: 661177 - RNA, 64 nt, Homo Sapiens; identical to SEQ ID NO: 563913

SEQ ID NO: 661178 - RNA, 64 nt, Homo Sapiens; identical to SEQ ID NO: 563914

SEQ ID NO: 661179 - RNA, 64 nt, Homo Sapiens; identical to SEQ ID NO: 563915

SEQ ID NO: 661180 - RNA, 64 nt, Homo Sapiens; identical to SEQ ID NO: 563916

SEQ ID NO: 661181 - RNA, 64 nt, Homo Sapiens; identical to SEQ ID NO: 563917

SEQ ID NO: 661182 - RNA, 64 nt, Homo Sapiens; identical to SEQ ID NO: 563918

SEQ ID NO: 661183 - RNA, 64 nt, Homo Sapiens; identical to SEQ ID NO: 563919

SEQ ID NO: 661184 - RNA, 64 nt, Homo Sapiens; identical to SEQ ID NO: 563920

SEQ ID NO: 661185 - RNA, 64 nt, Homo Sapiens; identical to SEQ ID NO: 563921

SEQ ID NO: 661186 - RNA, 64 nt, Homo Sapiens; identical to SEQ ID NO: 563922

SEQ ID NO: 661187 - RNA, 64 nt, Homo Sapiens; identical to SEQ ID NO: 563923

SEQ ID NO: 661188 - RNA, 64 nt, Homo Sapiens; identical to SEQ ID NO: 563924

SEQ ID NO: 661189 - RNA, 64 nt, Homo Sapiens; identical to SEQ ID NO: 563925

SEQ ID NO: 661190 - RNA, 64 nt, Homo Sapiens; identical to SEQ ID NO: 563926

SEQ ID NO: 661191 - RNA, 64 nt, Homo Sapiens; identical to SEQ ID NO: 563927

SEQ ID NO: 661192 - RNA, 64 nt, Homo Sapiens; identical to SEQ ID NO: 563928

SEQ ID NO: 661193 - RNA, 64 nt, Homo Sapiens; identical to SEQ ID NO: 563929

SEQ ID NO: 661194 - RNA, 64 nt, Homo Sapiens; identical to SEQ ID NO: 138011

SEQ ID NO: 661195 - RNA, 64 nt, Homo Sapiens; identical to SEQ ID NO: 138012

SEQ ID NO: 661196 - RNA, 64 nt, Homo Sapiens; identical to SEQ ID NO: 138013

SEQ ID NO: 661197 - RNA, 64 nt, Homo Sapiens; identical to SEQ ID NO: 138014

SEQ ID NO: 661198 - RNA, 64 nt, Homo Sapiens; identical to SEQ ID NO: 138015

SEQ ID NO: 661199 - RNA, 59 nt, Homo Sapiens; identical to SEQ ID NO: 138016

SEQ ID NO: 661200 - RNA, 64 nt, Homo Sapiens; identical to SEQ ID NO: 138017

SEQ ID NO: 661201 - RNA, 64 nt, Homo Sapiens; identical to SEQ ID NO: 138018

SEQ ID NO: 661202 - RNA, 64 nt, Homo Sapiens; identical to SEQ ID NO: 138019

SEQ ID NO: 661203 - RNA, 64 nt, Homo Sapiens; identical to SEQ ID NO: 138020

SEQ ID NO: 661204 - RNA, 64 nt, Homo Sapiens; identical to SEQ ID NO: 138021

SEQ ID NO: 661205 - RNA, 64 nt, Homo Sapiens; identical to SEQ ID NO: 138022

SEQ ID NO: 661206 - RNA, 64 nt, Homo Sapiens; identical to SEQ ID NO: 138023

SEQ ID NO: 661207 - RNA, 64 nt, Homo Sapiens; identical to SEQ ID NO: 138024

SEQ ID NO: 661208 - RNA, 64 nt, Homo Sapiens; identical to SEQ ID NO: 138025

SEQ ID NO: 661209 - RNA, 64 nt, Homo Sapiens; identical to SEQ ID NO: 138026

SEQ ID NO: 661210 - RNA, 64 nt, Homo Sapiens; identical to SEQ ID NO: 138027

SEQ ID NO: 661211 - RNA, 64 nt, Homo Sapiens; identical to SEQ ID NO: 138028

SEQ ID NO: 661212 - RNA, 64 nt, Homo Sapiens; identical to SEQ ID NO: 138029

SEQ ID NO: 661213 - RNA, 64 nt, Homo Sapiens; identical to SEQ ID NO: 138030

SEQ ID NO: 661214 - RNA, 64 nt, Homo Sapiens; identical to SEQ ID NO: 138031

SEQ ID NO: 661215 - RNA, 64 nt, Homo Sapiens; identical to SEQ ID NO: 138032

SEQ ID NO: 661216 - RNA, 64 nt, Homo Sapiens; identical to SEQ ID NO: 138033

SEQ ID NO: 661217 - RNA, 64 nt, Homo Sapiens; identical to SEQ ID NO: 138034

SEQ ID NO: 661218 - RNA, 64 nt, Homo Sapiens; identical to SEQ ID NO: 138035

SEQ ID NO: 661219 - RNA, 64 nt, Homo Sapiens; identical to SEQ ID NO: 138036

SEQ ID NO: 661220 - RNA, 64 nt, Homo Sapiens; identical to SEQ ID NO: 138037

SEQ ID NO: 661221 - RNA, 64 nt, Homo Sapiens; identical to SEQ ID NO: 138038

SEQ ID NO: 661222 - RNA, 64 nt, Homo Sapiens; identical to SEQ ID NO: 138039

SEQ ID NO: 661223 - RNA, 64 nt, Homo Sapiens; identical to SEQ ID NO: 138040

SEQ ID NO: 661224 - RNA, 64 nt, Homo Sapiens; identical to SEQ ID NO: 138041

SEQ ID NO: 661225 - RNA, 64 nt, Homo Sapiens; identical to SEQ ID NO: 138042

SEQ ID NO: 661226 - RNA, 64 nt, Homo Sapiens; identical to SEQ ID NO: 138043

SEQ ID NO: 661227 - RNA, 64 nt, Homo Sapiens; identical to SEQ ID NO: 138044

SEQ ID NO: 661228 - RNA, 64 nt, Homo Sapiens; identical to SEQ ID NO: 138045

SEQ ID NO: 661229 - RNA, 64 nt, Homo Sapiens; identical to SEQ ID NO: 138046

SEQ ID NO: 661230 - RNA, 64 nt, Homo Sapiens; identical to SEQ ID NO: 138047

SEQ ID NO: 661231 - RNA, 64 nt, Homo Sapiens; identical to SEQ ID NO: 138048

SEQ ID NO: 661232 - RNA, 64 nt, Homo Sapiens; identical to SEQ ID NO: 138049

SEQ ID NO: 661233 - RNA, 64 nt, Homo Sapiens; identical to SEQ ID NO: 138050

SEQ ID NO: 661234 - RNA, 64 nt, Homo Sapiens; identical to SEQ ID NO: 138051

SEQ ID NO: 661235 - RNA, 64 nt, Homo Sapiens; identical to SEQ ID NO: 138052

SEQ ID NO: 661236 - RNA, 64 nt, Homo Sapiens; identical to SEQ ID NO: 138053

SEQ ID NO: 661237 - RNA, 64 nt, Homo Sapiens; identical to SEQ ID NO: 138054

SEQ ID NO: 661238 - RNA, 64 nt, Homo Sapiens; identical to SEQ ID NO: 138055

SEQ ID NO: 661239 - RNA, 64 nt, Homo Sapiens; identical to SEQ ID NO: 138056

SEQ ID NO: 661240 - RNA, 64 nt, Homo Sapiens; identical to SEQ ID NO: 138057

SEQ ID NO: 661241 - RNA, 64 nt, Homo Sapiens; identical to SEQ ID NO: 138058

SEQ ID NO: 661242 - RNA, 64 nt, Homo Sapiens; identical to SEQ ID NO: 138059

SEQ ID NO: 661243 - RNA, 64 nt, Homo Sapiens; identical to SEQ ID NO: 138060

SEQ ID NO: 661244 - RNA, 64 nt, Homo Sapiens; identical to SEQ ID NO: 138061

SEQ ID NO: 661245 - RNA, 64 nt, Homo Sapiens; identical to SEQ ID NO: 138062

SEQ ID NO: 661246 - RNA, 64 nt, Homo Sapiens; identical to SEQ ID NO: 138063

SEQ ID NO: 661247 - RNA, 64 nt, Homo Sapiens; identical to SEQ ID NO: 138064

SEQ ID NO: 661248 - RNA, 64 nt, Homo Sapiens; identical to SEQ ID NO: 138065

SEQ ID NO: 661249 - RNA, 64 nt, Homo Sapiens; identical to SEQ ID NO: 138066

SEQ ID NO: 661250 - RNA, 64 nt, Homo Sapiens; identical to SEQ ID NO: 433911

SEQ ID NO: 661251 - RNA, 64 nt, Homo Sapiens; identical to SEQ ID NO: 433912

SEQ ID NO: 661252 - RNA, 64 nt, Homo Sapiens; identical to SEQ ID NO: 433913

SEQ ID NO: 661253 - RNA, 64 nt, Homo Sapiens; identical to SEQ ID NO: 433914

SEQ ID NO: 661254 - RNA, 64 nt, Homo Sapiens; identical to SEQ ID NO: 433915

SEQ ID NO: 661255 - RNA, 64 nt, Homo Sapiens; identical to SEQ ID NO: 433916

SEQ ID NO: 661256 - RNA, 64 nt, Homo Sapiens; identical to SEQ ID NO: 433917

SEQ ID NO: 661257 - RNA, 64 nt, Homo Sapiens; identical to SEQ ID NO: 433918

SEQ ID NO: 661258 - RNA, 64 nt, Homo Sapiens; identical to SEQ ID NO: 433919

SEQ ID NO: 661259 - RNA, 64 nt, Homo Sapiens; identical to SEQ ID NO: 433920

SEQ ID NO: 661260 - RNA, 64 nt, Homo Sapiens; identical to SEQ ID NO: 433921

SEQ ID NO: 661261 - RNA, 64 nt, Homo Sapiens; identical to SEQ ID NO: 433922

SEQ ID NO: 661262 - RNA, 64 nt, Homo Sapiens; identical to SEQ ID NO: 433923

SEQ ID NO: 661263 - RNA, 61 nt, Homo Sapiens; identical to SEQ ID NO: 433924

SEQ ID NO: 661264 - RNA, 64 nt, Homo Sapiens; identical to SEQ ID NO: 433925

SEQ ID NO: 661265 - RNA, 60 nt, Homo Sapiens; identical to SEQ ID NO: 433926

SEQ ID NO: 661266 - RNA, 64 nt, Homo Sapiens; identical to SEQ ID NO: 433927

SEQ ID NO: 661267 - RNA, 64 nt, Homo Sapiens; identical to SEQ ID NO: 433928

SEQ ID NO: 661268 - RNA, 64 nt, Homo Sapiens; identical to SEQ ID NO: 433929

SEQ ID NO: 661269 - RNA, 64 nt, Homo Sapiens; identical to SEQ ID NO: 433930

SEQ ID NO: 661270 - RNA, 64 nt, Homo Sapiens; identical to SEQ ID NO: 433931

SEQ ID NO: 661271 - RNA, 64 nt, Homo Sapiens; identical to SEQ ID NO: 433932

SEQ ID NO: 661272 - RNA, 64 nt, Homo Sapiens; identical to SEQ ID NO: 433933

SEQ ID NO: 661273 - RNA, 64 nt, Homo Sapiens; identical to SEQ ID NO: 433934

SEQ ID NO: 661274 - RNA, 64 nt, Homo Sapiens; identical to SEQ ID NO: 433935

SEQ ID NO: 661275 - RNA, 64 nt, Homo Sapiens; identical to SEQ ID NO: 433936

SEQ ID NO: 661276 - RNA, 64 nt, Homo Sapiens; identical to SEQ ID NO: 433937

SEQ ID NO: 661277 - RNA, 64 nt, Homo Sapiens; identical to SEQ ID NO: 433938

SEQ ID NO: 661278 - RNA, 64 nt, Homo Sapiens; identical to SEQ ID NO: 433939

SEQ ID NO: 661279 - RNA, 64 nt, Homo Sapiens; identical to SEQ ID NO: 433940

SEQ ID NO: 661280 - RNA, 64 nt, Homo Sapiens; identical to SEQ ID NO: 433941

SEQ ID NO: 661281 - RNA, 64 nt, Homo Sapiens; identical to SEQ ID NO: 433942

SEQ ID NO: 661282 - RNA, 64 nt, Homo Sapiens
agaaaaugucagccacauuacugucuguguagugccaggugaaggguuaucagaaggcugguug

SEQ ID NO: 661283 - RNA, 64 nt, Homo Sapiens
cugccacucuacccccagcccuacccaccagcccccaggugaggcuuccagcugggaccugccc

SEQ ID NO: 661284 - RNA, 64 nt, Homo Sapiens
ccccaggcugggcucauucccaucgugagugagcccaggugaggacauagucggcucccguuug

SEQ ID NO: 661285 - RNA, 64 nt, Homo Sapiens
cccccagaggcuuccccacccuccauugccuggcccaggugagcagcuuggcaggucuccaagu

SEQ ID NO: 661286 - RNA, 64 nt, Homo Sapiens
ccaggcuacaccaucuucuuuagaaugagaacugccaggugacgcccucgcugcuccuaccugg

SEQ ID NO: 661287 - RNA, 64 nt, Homo Sapiens
gcaggggcccagaacaccugcucucaccugagccccaggugaaggggcccgggaacaccugcuc

SEQ ID NO: 661288 - RNA, 64 nt, Homo Sapiens
aaggggcccgggaacaccugcucucaccugagccccaggugaaggggcccgggaacaccugcuc

SEQ ID NO: 661289 - RNA, 64 nt, Homo Sapiens
aaggggcccgggaacaccugcucucaccugaaccccaggugaaggggcccggaacaccugcucu

SEQ ID NO: 661290 - RNA, 64 nt, Homo Sapiens
gaaggggcccggaacaccugcucucaccugagccccaggugaaggggcccggaacaccugcucu

SEQ ID NO: 661291 - RNA, 64 nt, Homo Sapiens
gaaggggcccggaacaccugcucucaccugagccccaggugaaggggcccgggaacaccugcuc

SEQ ID NO: 661292 - RNA, 64 nt, Homo Sapiens; identical to SEQ ID NO: 661288

SEQ ID NO: 661293 - RNA, 64 nt, Homo Sapiens
aaggggcccgggaacaccugcucucaccugaaccccaggugaaggggcccagaacaccugcucu

SEQ ID NO: 661294 - RNA, 64 nt, Homo Sapiens
gaaggggcccagaacaccugcucucaccugagccccaggugaaggggcccggaacaccugcucu

SEQ ID NO: 661295 - RNA, 64 nt, Homo Sapiens; identical to SEQ ID NO: 661291

SEQ ID NO: 661296 - RNA, 64 nt, Homo Sapiens
gaaggggcccggaacacuugcucucaccugagccccaggugaaggggcccggaacaccugcucu

SEQ ID NO: 661297 - RNA, 64 nt, Homo Sapiens
gaaggggcccggaacacuugcucucaccugagccccaggugaaggggcccggaacaccuccucu

SEQ ID NO: 661298 - RNA, 64 nt, Homo Sapiens
gaaggggcccggaacaccuccucucaccugagccccaggugaaggggcccggaacaccuccugu

SEQ ID NO: 661299 - RNA, 64 nt, Homo Sapiens
gaaggggcccggaacaccuccugucaccugagccccaggugaaggggcccgggaacaccucuca

SEQ ID NO: 661300 - RNA, 64 nt, Homo Sapiens
gaaagggcucuagacagcugcagcaugacucucuccaggugacacauaaaaucuuaucuaugug

SEQ ID NO: 661301 - RNA, 64 nt, Homo Sapiens
uacugauuucuaaguccaaagaagaacccacagaccaggugaaucccaguguucagggaucucu

SEQ ID NO: 661302 - RNA, 64 nt, Homo Sapiens
ugcaugcaggcccauguuucagccucagcccacgccaggugaaaggaucagcaaugcucuguug

SEQ ID NO: 661303 - RNA, 64 nt, Homo Sapiens
gucucuucuguuccaaagccaggagagcugacuuccaggugaagggaugggaaaaguggacucu

SEQ ID NO: 661304 - RNA, 64 nt, Homo Sapiens
aguuacugcacagcuucuguucucugucacaaccccaggugauuugguccggucaaaggccaua

SEQ ID NO: 661305 - RNA, 64 nt, Homo Sapiens
cuaagaguguucaguauugaaugcugaucagcugccaggugaggagucagaagagggagccccc

SEQ ID NO: 661306 - RNA, 64 nt, Homo Sapiens
ggcugacacaggugugaagaggccauccuggaacccaggugagggcaagaugaaggcuuccagg

SEQ ID NO: 661307 - RNA, 64 nt, Homo Sapiens
uaaaguguuuagggcagugggaggagaaaauucuccaggugaauggggaagggucuguuccagc

SEQ ID NO: 661308 - RNA, 64 nt, Homo Sapiens
ucucuguaagucaggcuggggggagguuggagagccaggugaggggagaacagccaggugaggu

SEQ ID NO: 661309 - RNA, 64 nt, Homo Sapiens
ugggagguuggagagccagggccagggagaacagccaggugagguuuggagaugagcccaaagu

SEQ ID NO: 661310 - RNA, 64 nt, Homo Sapiens
gucuggggagcgggucugcuagauucugccuuugccaggugacugcuucugagacgucaugagg

SEQ ID NO: 661311 - RNA, 64 nt, Homo Sapiens
ucagcacaucucaacaggccuccccuugccugugccaggugaggccugaccagcucccccuccc

SEQ ID NO: 661312 - RNA, 64 nt, Homo Sapiens
gggcaugcugagaaauagaggguggaccaguacuccaggugauguugggggaggugcccaggug

SEQ ID NO: 661313 - RNA, 64 nt, Homo Sapiens
gaaggaagugaggccauagauuggacccauggucccaggugagaggaagaauauucccuugggu

SEQ ID NO: 661314 - RNA, 64 nt, Homo Sapiens
ugguggaacaaaaggccaggguuaguugcauggaccaggugagggcagggaguugcgagguggg

SEQ ID NO: 661315 - RNA, 64 nt, Homo Sapiens
gaggcagugugguccugggaaugugaccaacaugccaggugacauuggccccuagacccucucu

SEQ ID NO: 661316 - RNA, 64 nt, Homo Sapiens
auuuagacgcccacgacagcacuacacagcaucuccaggugaugcccaaggcacagggcugcag

SEQ ID NO: 661317 - RNA, 64 nt, Homo Sapiens
aucaagggauuuccuauggaaguccugcuuuauuccaggugaagggaaggaaguguauauacuu

SEQ ID NO: 661318 - RNA, 64 nt, Homo Sapiens
gugauccagugaucuauggaagucgugucuuacuccaggugaagggggaaaaaaaaagccuaua

SEQ ID NO: 661319 - RNA, 64 nt, Homo Sapiens
guggggccuaggacucugcauuucuuacagauucccaggugagcugaugcuggugguuaagggu

SEQ ID NO: 661320 - RNA, 64 nt, Homo Sapiens
cuggcgcccccagccccacucuuggcugugcuggccaggugacuccuaguucuuggccacauca

SEQ ID NO: 661321 - RNA, 64 nt, Homo Sapiens
gggccugggucuacacacguaauaaacgugacucccaggugagggugacacuuuuuacuuuuuc

SEQ ID NO: 661322 - RNA, 64 nt, Homo Sapiens
uuuuuacugugacacuuuuugccuggcuuuguccccaggugaaugaccccgccaccccuccuag

SEQ ID NO: 661323 - RNA, 64 nt, Homo Sapiens
gaacagugcuucucuaaaaugcaauaauaaugggccaggugaaguggcucacaccuguaauccc

SEQ ID NO: 661324 - RNA, 64 nt, Homo Sapiens
ggcucacaccuguaaucccagcacuaugggaggcccaggugagcagaucaccugaggucaggag

SEQ ID NO: 661325 - RNA, 64 nt, Homo Sapiens
gggaaggaggaggaaacugugguguuccuuucuuccaggugacaucaccuaugcacauucccag

SEQ ID NO: 661326 - RNA, 64 nt, Homo Sapiens
gagcugcaaagcaggcaggaagggaggaggagagccaggugagcaguggagagaaggggggccc

SEQ ID NO: 661327 - RNA, 64 nt, Homo Sapiens
cuguugucuuugauguguccgccguuacuugugaaaaaucuauuuuccagcaugugacuuuggu

SEQ ID NO: 661328 - RNA, 64 nt, Homo Sapiens
ucuugagagugcagcagggggaccaugucuuuuuaaaaucuaacuauuuggaagccucugaaga

SEQ ID NO: 661329 - RNA, 64 nt, Homo Sapiens
uuuugaguauagccagagaaaacaaggauggagaaaaaucuaggacagguaauuuugaaaagag

SEQ ID NO: 661330 - RNA, 64 nt, Homo Sapiens
uuuuggguauagccagagaaaacaaggauggagaaaaaucuaggacagguaauuuugaaaacag

SEQ ID NO: 661331 - RNA, 64 nt, Homo Sapiens
uuuaaauugucuuuuucuuuuaacacccuucaacaaaaucuaauuauggauaaaguugcacuua

SEQ ID NO: 661332 - RNA, 64 nt, Homo Sapiens
cauuuauauuuaguuguguagcuaaguguuagccaaaaucuagccauguuugcuuaaugcuucu

SEQ ID NO: 661333 - RNA, 64 nt, Homo Sapiens
guaaaauucacuuuggaagguuaucaggcuuuuaaaaaucuaguuuauggcaaaaauagccauu

SEQ ID NO: 661334 - RNA, 64 nt, Homo Sapiens
ccagcugugaacccaggaggucaagugggcuauuaaaaucuaacguugaguaaaugugauagug

SEQ ID NO: 661335 - RNA, 64 nt, Homo Sapiens
aguuaauaguuuuaaaaaugaucucacuggauguaaaaucuaucgugcucucuaaauucuuagc

SEQ ID NO: 661336 - RNA, 64 nt, Homo Sapiens
cauuuuauucucugcuucauugaaaaaaucagguaaaaucuaaccauuuuuuaagaaugcaaga

SEQ ID NO: 661337 - RNA, 64 nt, Homo Sapiens
uuuuaaccuacuuguauguuuuuuaauaaauuaaaaaaucuaaacaugguaacagaaauuuacc

SEQ ID NO: 661338 - RNA, 64 nt, Homo Sapiens
ugacuuuuuauuauuguguguuuccgaacuaauaaaaaucuauagaccuuccugugauacuuua

SEQ ID NO: 661339 - RNA, 64 nt, Homo Sapiens
aagguaaucagaccagaguccaaguuguaugcaaaaaaucuauaauuugauucucauaaacaua

SEQ ID NO: 661340 - RNA, 64 nt, Homo Sapiens
uuuauguaacaucuugcuguacuaaauacagcagaaaaucuacucuuuagcaauauauaacaca

SEQ ID NO: 661341 - RNA, 64 nt, Homo Sapiens
uuaugaauuuuacuugcaccugcuacacuggauaaaaaucuaauaaguuuucaguacaaaucug

SEQ ID NO: 661342 - RNA, 64 nt, Homo Sapiens
ccaaauuauuuucaagagagcugacaaagcagauaaaaucuacuaagauuucagcuugguagag

SEQ ID NO: 661343 - RNA, 64 nt, Homo Sapiens
uuuggacuacuugcaaaugaugaaagugauuuauaaaaucuaaagucugguuuacuuaauaaau

SEQ ID NO: 661344 - RNA, 64 nt, Homo Sapiens
gcguauaggagacugauagcgucucuaaguaaguaaaaucuaaucaucuuuugagaauguaugu

SEQ ID NO: 661345 - RNA, 64 nt, Homo Sapiens
auuucuucuuuaaaaauauucuaaugaagcuuuuaaaaucuacauuuguaugugucacuagugu

SEQ ID NO: 661346 - RNA, 64 nt, Homo Sapiens
ccaguucucucauuuaaaaaguagguacuuauauaaaaucuagucugcaaaacacuaggcuuua

SEQ ID NO: 661347 - RNA, 64 nt, Homo Sapiens
ugcuguuugggaaaaaacuuagaaaucaggacaaaaaaucuaauaucaaaaauaaauggcaaag

SEQ ID NO: 661348 - RNA, 64 nt, Homo Sapiens
aaguguggggaaacuuuaaagcucuguacuaugcaaaaucuagacugcuuagaaauacggcugg

SEQ ID NO: 661349 - RNA, 64 nt, Homo Sapiens
ugaaacauggaugaaacucuacucuaaauuuccaaaaaucuaagauuuuucaguucugucagaa

SEQ ID NO: 661350 - RNA, 64 nt, Homo Sapiens
acuguguggcaccugaaaggagcucacauaccucaaaaucuacuuuuacuuaccuacugucuug

SEQ ID NO: 661351 - RNA, 64 nt, Homo Sapiens
uaaaggaauauguuugccuacuaaaugugaauauaaaaucuaaauuaaaugugugcauaaaaaa

SEQ ID NO: 661352 - RNA, 64 nt, Homo Sapiens
uacccuucuggaauugcuaaguaauuauauuuaaaaaaucuaccuauuucuuccuuuuauaaga

SEQ ID NO: 661353 - RNA, 64 nt, Homo Sapiens
uguguaacuuuguuuuuauuuuaacucuuacuagaaaaucuaaucuuaaaacauuugaauucua

SEQ ID NO: 661354 - RNA, 64 nt, Homo Sapiens
uuaaguacaagaucucucuaaaaauaaacagaugaaaaucuauccccauuaucgauacagaauu

SEQ ID NO: 661355 - RNA, 64 nt, Homo Sapiens
cuaguagauuacaacuucacaaaaaaaaaaaaaaaaaaucuaugcagagugagacuccaucuca

SEQ ID NO: 661356 - RNA, 64 nt, Homo Sapiens
cagcugggugcaguggcucaauuguacuguuaaaaaaaucuaugacaucagucuuuguuuuaau

SEQ ID NO: 661357 - RNA, 64 nt, Homo Sapiens
aucaaaaacauuuucauauauaccagaguacuguaaaaucuagguuuuuuucaacauuagcagu

SEQ ID NO: 661358 - RNA, 64 nt, Homo Sapiens
cugauguaauugacauuacauuucuuaacauuuuaaaaucuagaauuucuaaaauggaauuuaa

SEQ ID NO: 661359 - RNA, 64 nt, Homo Sapiens
aagcgaagucaaaacugaugaaaauuuauuuagaaaaaucuaaaaauucugguuuuaaauauga

SEQ ID NO: 661360 - RNA, 64 nt, Homo Sapiens
gccugugucaaagauuuuaaaaucauggaaaguuaaaaucuagaaagaccuuagagaaccagcc

SEQ ID NO: 661361 - RNA, 64 nt, Homo Sapiens
aauaguuaagcacugugucauacaguuuaaaaaaaaaaucuaaacucuccuuccucccuuccuu

SEQ ID NO: 661362 - RNA, 64 nt, Homo Sapiens
ggauauuauuguuugaauuuaauaaaugacauuaaaaaucuaaaucuguuaugauugccauuuc

SEQ ID NO: 661363 - RNA, 64 nt, Homo Sapiens
uagaauuuccaaauaaaacagcagaacaguuuuaaaaaucuaauaaugcuuuuuguaaacaaga

SEQ ID NO: 661364 - RNA, 64 nt, Homo Sapiens
acugugaagcuuaauucagaauaaaacauuuaacaaaaucuauaaguauagaaaacucuuaaug

SEQ ID NO: 661365 - RNA, 64 nt, Homo Sapiens
gacuuuguauuuaaaaguuaaaaaggacaaaaaaaaaaucuaaagcauuuaaaaucuagugaaa

SEQ ID NO: 661366 - RNA, 64 nt, Homo Sapiens
guuaaaaaggacaaaaaaaaaaucuaaagcauuuaaaaucuagugaaauaacugaagggccugc

SEQ ID NO: 661367 - RNA, 64 nt, Homo Sapiens
cucaaaggaucuugcuuuaacuuucaacacuuagaaaaucuacaaacauucagaccugucuggg

SEQ ID NO: 661368 - RNA, 64 nt, Homo Sapiens
uuuaaacuggacuuagcuugaguuaaaggcaaagaaaaucuaaaaacauaaauguuauauuuca

SEQ ID NO: 661369 - RNA, 64 nt, Homo Sapiens
aucucugagugaaucccuuuguucucuguuuaaaaaaaucuaaaaagaaaaaggaaaaaaaaaa

SEQ ID NO: 661370 - RNA, 64 nt, Homo Sapiens
guuuuaaauauuuugauugaauuaguaccaauguaaaaucuaguuucuuccugaaggaggaucc

SEQ ID NO: 661371 - RNA, 64 nt, Homo Sapiens
aaaggaaguagucugcauugggucaugucuucucaaaaucuagcgaaagcacaaaugcgaaaga

SEQ ID NO: 661372 - RNA, 64 nt, Homo Sapiens
caguuucgauuuugccugugguuguccaugauucaaaaucuaagcacugcaacaaagcaacaau

SEQ ID NO: 661373 - RNA, 64 nt, Homo Sapiens
cuaaacaucgagaaacuaugggaaaaaaaauugcaaaaucuaaaauaaaaaaugcaaaaucuaa

SEQ ID NO: 661374 - RNA, 64 nt, Homo Sapiens
gaaaaaaaauugcaaaaucuaaaauaaaaaaugcaaaaucuaaaauaaaaaauggaaaggaaac

SEQ ID NO: 661375 - RNA, 64 nt, Homo Sapiens
uuguuugauuucuuugggauaccucacaacuuagaaaaucuaaguguacacccccccaucacca

SEQ ID NO: 661376 - RNA, 64 nt, Homo Sapiens
uauauuccuauuguacuaaaauuucuuaauuuaaaaaaucuaaguuuccacaccauaggcaaua

SEQ ID NO: 661377 - RNA, 64 nt, Homo Sapiens
cuuuuuaacaaacauaguuucucuaauaaagaauaaaaucuauggaauuuuaaaaaugugauug

SEQ ID NO: 661378 - RNA, 64 nt, Homo Sapiens
gcagcucuuaugggcuucuaacaucucccuuaaaaaaaucuaaaagauggugauucugaagcuu

SEQ ID NO: 661379 - RNA, 64 nt, Homo Sapiens; identical to SEQ ID NO: 188955

SEQ ID NO: 661380 - RNA, 64 nt, Homo Sapiens; identical to SEQ ID NO: 188956

SEQ ID NO: 661381 - RNA, 64 nt, Homo Sapiens; identical to SEQ ID NO: 188957

SEQ ID NO: 661382 - RNA, 64 nt, Homo Sapiens; identical to SEQ ID NO: 188958

SEQ ID NO: 661383 - RNA, 64 nt, Homo Sapiens; identical to SEQ ID NO: 193524

SEQ ID NO: 661384 - RNA, 64 nt, Homo Sapiens; identical to SEQ ID NO: 193525

SEQ ID NO: 661385 - RNA, 64 nt, Homo Sapiens; identical to SEQ ID NO: 193526

SEQ ID NO: 661386 - RNA, 64 nt, Homo Sapiens; identical to SEQ ID NO: 193527

SEQ ID NO: 661387 - RNA, 64 nt, Homo Sapiens; identical to SEQ ID NO: 193528

SEQ ID NO: 661388 - RNA, 64 nt, Homo Sapiens; identical to SEQ ID NO: 193529

SEQ ID NO: 661389 - RNA, 64 nt, Homo Sapiens; identical to SEQ ID NO: 193530

SEQ ID NO: 661390 - RNA, 64 nt, Homo Sapiens; identical to SEQ ID NO: 193531

SEQ ID NO: 661391 - RNA, 64 nt, Homo Sapiens; identical to SEQ ID NO: 193532

SEQ ID NO: 661392 - RNA, 64 nt, Homo Sapiens; identical to SEQ ID NO: 193533

SEQ ID NO: 661393 - RNA, 64 nt, Homo Sapiens; identical to SEQ ID NO: 193534

SEQ ID NO: 661394 - RNA, 64 nt, Homo Sapiens; identical to SEQ ID NO: 193535

SEQ ID NO: 661395 - RNA, 64 nt, Homo Sapiens; identical to SEQ ID NO: 193536

SEQ ID NO: 661396 - RNA, 64 nt, Homo Sapiens; identical to SEQ ID NO: 193537

SEQ ID NO: 661397 - RNA, 64 nt, Homo Sapiens; identical to SEQ ID NO: 193538

SEQ ID NO: 661398 - RNA, 64 nt, Homo Sapiens; identical to SEQ ID NO: 193539

SEQ ID NO: 661399 - RNA, 64 nt, Homo Sapiens; identical to SEQ ID NO: 193540

SEQ ID NO: 661400 - RNA, 64 nt, Homo Sapiens; identical to SEQ ID NO: 193541

SEQ ID NO: 661401 - RNA, 64 nt, Homo Sapiens; identical to SEQ ID NO: 193542

SEQ ID NO: 661402 - RNA, 64 nt, Homo Sapiens; identical to SEQ ID NO: 193543

SEQ ID NO: 661403 - RNA, 64 nt, Homo Sapiens; identical to SEQ ID NO: 193544

SEQ ID NO: 661404 - RNA, 64 nt, Homo Sapiens; identical to SEQ ID NO: 193545

SEQ ID NO: 661405 - RNA, 64 nt, Homo Sapiens; identical to SEQ ID NO: 193546

SEQ ID NO: 661406 - RNA, 64 nt, Homo Sapiens; identical to SEQ ID NO: 193547

SEQ ID NO: 661407 - RNA, 64 nt, Homo Sapiens; identical to SEQ ID NO: 193548

SEQ ID NO: 661408 - RNA, 64 nt, Homo Sapiens; identical to SEQ ID NO: 193549

SEQ ID NO: 661409 - RNA, 64 nt, Homo Sapiens; identical to SEQ ID NO: 193550

SEQ ID NO: 661410 - RNA, 64 nt, Homo Sapiens; identical to SEQ ID NO: 193551

SEQ ID NO: 661411 - RNA, 64 nt, Homo Sapiens; identical to SEQ ID NO: 193552

SEQ ID NO: 661412 - RNA, 64 nt, Homo Sapiens; identical to SEQ ID NO: 193553

SEQ ID NO: 661413 - RNA, 64 nt, Homo Sapiens; identical to SEQ ID NO: 193554

SEQ ID NO: 661414 - RNA, 64 nt, Homo Sapiens; identical to SEQ ID NO: 193555

SEQ ID NO: 661415 - RNA, 64 nt, Homo Sapiens; identical to SEQ ID NO: 193556

SEQ ID NO: 661416 - RNA, 64 nt, Homo Sapiens; identical to SEQ ID NO: 193557

SEQ ID NO: 661417 - RNA, 64 nt, Homo Sapiens; identical to SEQ ID NO: 193558

SEQ ID NO: 661418 - RNA, 64 nt, Homo Sapiens; identical to SEQ ID NO: 193559

SEQ ID NO: 661419 - RNA, 64 nt, Homo Sapiens; identical to SEQ ID NO: 193560

SEQ ID NO: 661420 - RNA, 64 nt, Homo Sapiens; identical to SEQ ID NO: 193561

SEQ ID NO: 661421 - RNA, 64 nt, Homo Sapiens; identical to SEQ ID NO: 193562

SEQ ID NO: 661422 - RNA, 64 nt, Homo Sapiens; identical to SEQ ID NO: 193563

SEQ ID NO: 661423 - RNA, 64 nt, Homo Sapiens; identical to SEQ ID NO: 193564

SEQ ID NO: 661424 - RNA, 64 nt, Homo Sapiens; identical to SEQ ID NO: 193565

SEQ ID NO: 661425 - RNA, 64 nt, Homo Sapiens; identical to SEQ ID NO: 193566

SEQ ID NO: 661426 - RNA, 64 nt, Homo Sapiens; identical to SEQ ID NO: 193567

SEQ ID NO: 661427 - RNA, 64 nt, Homo Sapiens; identical to SEQ ID NO: 193568

SEQ ID NO: 661428 - RNA, 64 nt, Homo Sapiens; identical to SEQ ID NO: 193569

SEQ ID NO: 661429 - RNA, 64 nt, Homo Sapiens; identical to SEQ ID NO: 193570

SEQ ID NO: 661430 - RNA, 64 nt, Homo Sapiens; identical to SEQ ID NO: 193571

SEQ ID NO: 661431 - RNA, 64 nt, Homo Sapiens; identical to SEQ ID NO: 193572

SEQ ID NO: 661432 - RNA, 64 nt, Homo Sapiens; identical to SEQ ID NO: 193573

SEQ ID NO: 661433 - RNA, 64 nt, Homo Sapiens; identical to SEQ ID NO: 193574

SEQ ID NO: 661434 - RNA, 64 nt, Homo Sapiens; identical to SEQ ID NO: 193575

SEQ ID NO: 661435 - RNA, 64 nt, Homo Sapiens; identical to SEQ ID NO: 193576

SEQ ID NO: 661436 - RNA, 64 nt, Homo Sapiens; identical to SEQ ID NO: 193577

SEQ ID NO: 661437 - RNA, 64 nt, Homo Sapiens; identical to SEQ ID NO: 193578

SEQ ID NO: 661438 - RNA, 64 nt, Homo Sapiens; identical to SEQ ID NO: 193579

SEQ ID NO: 661439 - RNA, 64 nt, Homo Sapiens; identical to SEQ ID NO: 193580

SEQ ID NO: 661440 - RNA, 64 nt, Homo Sapiens; identical to SEQ ID NO: 193581

SEQ ID NO: 661441 - RNA, 64 nt, Homo Sapiens; identical to SEQ ID NO: 193582

SEQ ID NO: 661442 - RNA, 64 nt, Homo Sapiens; identical to SEQ ID NO: 193583

SEQ ID NO: 661443 - RNA, 64 nt, Homo Sapiens; identical to SEQ ID NO: 193584

SEQ ID NO: 661444 - RNA, 64 nt, Homo Sapiens; identical to SEQ ID NO: 193585

SEQ ID NO: 661445 - RNA, 64 nt, Homo Sapiens; identical to SEQ ID NO: 193586

SEQ ID NO: 661446 - RNA, 64 nt, Homo Sapiens; identical to SEQ ID NO: 193587

SEQ ID NO: 661447 - RNA, 64 nt, Homo Sapiens; identical to SEQ ID NO: 193588

SEQ ID NO: 661448 - RNA, 64 nt, Homo Sapiens; identical to SEQ ID NO: 193589

SEQ ID NO: 661449 - RNA, 64 nt, Homo Sapiens; identical to SEQ ID NO: 193590

SEQ ID NO: 661450 - RNA, 64 nt, Homo Sapiens; identical to SEQ ID NO: 193591

SEQ ID NO: 661451 - RNA, 64 nt, Homo Sapiens; identical to SEQ ID NO: 193592

SEQ ID NO: 661452 - RNA, 64 nt, Homo Sapiens; identical to SEQ ID NO: 193593

SEQ ID NO: 661453 - RNA, 64 nt, Homo Sapiens; identical to SEQ ID NO: 193594

SEQ ID NO: 661454 - RNA, 64 nt, Homo Sapiens; identical to SEQ ID NO: 193595

SEQ ID NO: 661455 - RNA, 64 nt, Homo Sapiens; identical to SEQ ID NO: 193596

SEQ ID NO: 661456 - RNA, 52 nt, Homo Sapiens; identical to SEQ ID NO: 482720

SEQ ID NO: 661457 - RNA, 64 nt, Homo Sapiens; identical to SEQ ID NO: 482721

SEQ ID NO: 661458 - RNA, 64 nt, Homo Sapiens; identical to SEQ ID NO: 482722

SEQ ID NO: 661459 - RNA, 64 nt, Homo Sapiens; identical to SEQ ID NO: 482723

SEQ ID NO: 661460 - RNA, 64 nt, Homo Sapiens; identical to SEQ ID NO: 482724

SEQ ID NO: 661461 - RNA, 64 nt, Homo Sapiens; identical to SEQ ID NO: 482725

SEQ ID NO: 661462 - RNA, 64 nt, Homo Sapiens; identical to SEQ ID NO: 482726

SEQ ID NO: 661463 - RNA, 64 nt, Homo Sapiens; identical to SEQ ID NO: 482727

SEQ ID NO: 661464 - RNA, 64 nt, Homo Sapiens; identical to SEQ ID NO: 482728

SEQ ID NO: 661465 - RNA, 64 nt, Homo Sapiens; identical to SEQ ID NO: 482729

SEQ ID NO: 661466 - RNA, 64 nt, Homo Sapiens; identical to SEQ ID NO: 482730

SEQ ID NO: 661467 - RNA, 64 nt, Homo Sapiens; identical to SEQ ID NO: 482731

SEQ ID NO: 661468 - RNA, 64 nt, Homo Sapiens; identical to SEQ ID NO: 482732

SEQ ID NO: 661469 - RNA, 64 nt, Homo Sapiens; identical to SEQ ID NO: 482733

SEQ ID NO: 661470 - RNA, 64 nt, Homo Sapiens; identical to SEQ ID NO: 482734

SEQ ID NO: 661471 - RNA, 64 nt, Homo Sapiens; identical to SEQ ID NO: 482735

SEQ ID NO: 661472 - RNA, 64 nt, Homo Sapiens; identical to SEQ ID NO: 482736

SEQ ID NO: 661473 - RNA, 64 nt, Homo Sapiens; identical to SEQ ID NO: 482737

SEQ ID NO: 661474 - RNA, 64 nt, Homo Sapiens; identical to SEQ ID NO: 482738

SEQ ID NO: 661475 - RNA, 64 nt, Homo Sapiens; identical to SEQ ID NO: 482739

SEQ ID NO: 661476 - RNA, 64 nt, Homo Sapiens; identical to SEQ ID NO: 482740

SEQ ID NO: 661477 - RNA, 64 nt, Homo Sapiens; identical to SEQ ID NO: 482741

SEQ ID NO: 661478 - RNA, 64 nt, Homo Sapiens; identical to SEQ ID NO: 482742

SEQ ID NO: 661479 - RNA, 64 nt, Homo Sapiens; identical to SEQ ID NO: 482743

SEQ ID NO: 661480 - RNA, 64 nt, Homo Sapiens; identical to SEQ ID NO: 482744

SEQ ID NO: 661481 - RNA, 64 nt, Homo Sapiens; identical to SEQ ID NO: 482745

SEQ ID NO: 661482 - RNA, 64 nt, Homo Sapiens; identical to SEQ ID NO: 482746

SEQ ID NO: 661483 - RNA, 64 nt, Homo Sapiens; identical to SEQ ID NO: 482747

SEQ ID NO: 661484 - RNA, 64 nt, Homo Sapiens; identical to SEQ ID NO: 52917

SEQ ID NO: 661485 - RNA, 64 nt, Homo Sapiens; identical to SEQ ID NO: 52918

SEQ ID NO: 661486 - RNA, 64 nt, Homo Sapiens; identical to SEQ ID NO: 52919

SEQ ID NO: 661487 - RNA, 64 nt, Homo Sapiens; identical to SEQ ID NO: 52920

SEQ ID NO: 661488 - RNA, 64 nt, Homo Sapiens; identical to SEQ ID NO: 52921

SEQ ID NO: 661489 - RNA, 64 nt, Homo Sapiens; identical to SEQ ID NO: 52922

SEQ ID NO: 661490 - RNA, 64 nt, Homo Sapiens; identical to SEQ ID NO: 52923

SEQ ID NO: 661491 - RNA, 64 nt, Homo Sapiens; identical to SEQ ID NO: 52924

SEQ ID NO: 661492 - RNA, 64 nt, Homo Sapiens; identical to SEQ ID NO: 52925

SEQ ID NO: 661493 - RNA, 64 nt, Homo Sapiens; identical to SEQ ID NO: 52926

SEQ ID NO: 661494 - RNA, 64 nt, Homo Sapiens; identical to SEQ ID NO: 52927

SEQ ID NO: 661495 - RNA, 64 nt, Homo Sapiens; identical to SEQ ID NO: 52928

SEQ ID NO: 661496 - RNA, 64 nt, Homo Sapiens; identical to SEQ ID NO: 52929

SEQ ID NO: 661497 - RNA, 64 nt, Homo Sapiens; identical to SEQ ID NO: 52930

SEQ ID NO: 661498 - RNA, 64 nt, Homo Sapiens; identical to SEQ ID NO: 52931

SEQ ID NO: 661499 - RNA, 64 nt, Homo Sapiens; identical to SEQ ID NO: 52932

SEQ ID NO: 661500 - RNA, 64 nt, Homo Sapiens; identical to SEQ ID NO: 52933

SEQ ID NO: 661501 - RNA, 64 nt, Homo Sapiens; identical to SEQ ID NO: 52934

SEQ ID NO: 661502 - RNA, 64 nt, Homo Sapiens; identical to SEQ ID NO: 52935

SEQ ID NO: 661503 - RNA, 64 nt, Homo Sapiens; identical to SEQ ID NO: 52936

SEQ ID NO: 661504 - RNA, 64 nt, Homo Sapiens; identical to SEQ ID NO: 52937

SEQ ID NO: 661505 - RNA, 64 nt, Homo Sapiens; identical to SEQ ID NO: 52938

SEQ ID NO: 661506 - RNA, 64 nt, Homo Sapiens; identical to SEQ ID NO: 52939

SEQ ID NO: 661507 - RNA, 64 nt, Homo Sapiens; identical to SEQ ID NO: 52940

SEQ ID NO: 661508 - RNA, 64 nt, Homo Sapiens; identical to SEQ ID NO: 52941

SEQ ID NO: 661509 - RNA, 64 nt, Homo Sapiens; identical to SEQ ID NO: 52942

SEQ ID NO: 661510 - RNA, 64 nt, Homo Sapiens; identical to SEQ ID NO: 52943

SEQ ID NO: 661511 - RNA, 64 nt, Homo Sapiens; identical to SEQ ID NO: 52944

SEQ ID NO: 661512 - RNA, 64 nt, Homo Sapiens; identical to SEQ ID NO: 52945

SEQ ID NO: 661513 - RNA, 64 nt, Homo Sapiens; identical to SEQ ID NO: 52946

SEQ ID NO: 661514 - RNA, 64 nt, Homo Sapiens; identical to SEQ ID NO: 52947

SEQ ID NO: 661515 - RNA, 64 nt, Homo Sapiens; identical to SEQ ID NO: 52948

SEQ ID NO: 661516 - RNA, 64 nt, Homo Sapiens; identical to SEQ ID NO: 52949

SEQ ID NO: 661517 - RNA, 64 nt, Homo Sapiens; identical to SEQ ID NO: 52950

SEQ ID NO: 661518 - RNA, 64 nt, Homo Sapiens; identical to SEQ ID NO: 52951

SEQ ID NO: 661519 - RNA, 64 nt, Homo Sapiens; identical to SEQ ID NO: 52952

SEQ ID NO: 661520 - RNA, 64 nt, Homo Sapiens; identical to SEQ ID NO: 52953

SEQ ID NO: 661521 - RNA, 64 nt, Homo Sapiens; identical to SEQ ID NO: 52954

SEQ ID NO: 661522 - RNA, 64 nt, Homo Sapiens; identical to SEQ ID NO: 52955

SEQ ID NO: 661523 - RNA, 64 nt, Homo Sapiens; identical to SEQ ID NO: 52956

SEQ ID NO: 661524 - RNA, 64 nt, Homo Sapiens; identical to SEQ ID NO: 52957

SEQ ID NO: 661525 - RNA, 64 nt, Homo Sapiens; identical to SEQ ID NO: 52958

SEQ ID NO: 661526 - RNA, 64 nt, Homo Sapiens; identical to SEQ ID NO: 52959

SEQ ID NO: 661527 - RNA, 64 nt, Homo Sapiens; identical to SEQ ID NO: 52960

SEQ ID NO: 661528 - RNA, 64 nt, Homo Sapiens; identical to SEQ ID NO: 52961

SEQ ID NO: 661529 - RNA, 64 nt, Homo Sapiens; identical to SEQ ID NO: 52962

SEQ ID NO: 661530 - RNA, 64 nt, Homo Sapiens; identical to SEQ ID NO: 52963

SEQ ID NO: 661531 - RNA, 64 nt, Homo Sapiens; identical to SEQ ID NO: 52964

SEQ ID NO: 661532 - RNA, 64 nt, Homo Sapiens; identical to SEQ ID NO: 52965

SEQ ID NO: 661533 - RNA, 64 nt, Homo Sapiens; identical to SEQ ID NO: 52966

SEQ ID NO: 661534 - RNA, 64 nt, Homo Sapiens; identical to SEQ ID NO: 52967

SEQ ID NO: 661535 - RNA, 64 nt, Homo Sapiens; identical to SEQ ID NO: 52968

SEQ ID NO: 661536 - RNA, 64 nt, Homo Sapiens; identical to SEQ ID NO: 52969

SEQ ID NO: 661537 - RNA, 64 nt, Homo Sapiens; identical to SEQ ID NO: 52970

SEQ ID NO: 661538 - RNA, 64 nt, Homo Sapiens; identical to SEQ ID NO: 52971

SEQ ID NO: 661539 - RNA, 64 nt, Homo Sapiens; identical to SEQ ID NO: 52972

SEQ ID NO: 661540 - RNA, 64 nt, Homo Sapiens; identical to SEQ ID NO: 52973

SEQ ID NO: 661541 - RNA, 64 nt, Homo Sapiens; identical to SEQ ID NO: 52974

SEQ ID NO: 661542 - RNA, 64 nt, Homo Sapiens; identical to SEQ ID NO: 52975

SEQ ID NO: 661543 - RNA, 64 nt, Homo Sapiens; identical to SEQ ID NO: 52976

SEQ ID NO: 661544 - RNA, 64 nt, Homo Sapiens; identical to SEQ ID NO: 52977

SEQ ID NO: 661545 - RNA, 64 nt, Homo Sapiens; identical to SEQ ID NO: 52978

SEQ ID NO: 661546 - RNA, 64 nt, Homo Sapiens
ucucccugaaccagagugugaaggccagaguccuuuguccuacaaaccagcccagaucaguccc

SEQ ID NO: 661547 - RNA, 64 nt, Homo Sapiens
aucagaguggggaggggacagagguccaaggucuuuguccuagacugauccccagcauccagcu

SEQ ID NO: 661548 - RNA, 64 nt, Homo Sapiens
cgaacaaucuguauuuuuugcuuuucauguguuuuuguccuagggguucgaucuaaaauguuuc

SEQ ID NO: 661549 - RNA, 64 nt, Homo Sapiens
uuuucuggcgcgugcugcaaagaagcuauuucuguuguccuacauauuuuaguauaaaucacua

SEQ ID NO: 661550 - RNA, 64 nt, Homo Sapiens
acaggcccuuauacuucaacggaaguaggagggauuguccuacaccauuguaugggggggauua

SEQ ID NO: 661551 - RNA, 64 nt, Homo Sapiens
cuauggauugagaacuugaaagcaauaaagugacuuguccuaaugaccuuccaugaauguugcc

SEQ ID NO: 661552 - RNA, 64 nt, Homo Sapiens
ucugaagaaaggaucccugagagucucuguuucaucaggacauucugaaauuuacccacaguga

SEQ ID NO: 661553 - RNA, 64 nt, Homo Sapiens
gggccagcgugcuucuucuggcuacacaaccuucucaggacaagcccacugucuuaagccacuu

SEQ ID NO: 661554 - RNA, 64 nt, Homo Sapiens
caaacaucaguucuucaaauaaggacgcaaaucuucaggacaguaagcagaacaaucagaaugg

SEQ ID NO: 661555 - RNA, 64 nt, Homo Sapiens
ugucauguaaauucccacuuuacauaaaaacccaucaggacagaaugaugcucaauauuuuaaa

SEQ ID NO: 661556 - RNA, 64 nt, Homo Sapiens
uuuugcugcuuccucggcccagggagaaagcaugucaggacagagcuguuggauuggcuuugau

SEQ ID NO: 661557 - RNA, 64 nt, Homo Sapiens
cacucuuagcaucuccucuaguauuuuccauguaucaggacagaggugucuuauguagggaggg

SEQ ID NO: 661558 - RNA, 64 nt, Homo Sapiens
uggcgugauugcugcagcaguggcgccuccuagcucaggacaguggcgacugcccggcugcaug

SEQ ID NO: 661559 - RNA, 64 nt, Homo Sapiens
cugccacacaucccgcccccucccggaggcagcuucaggacaggacaccaggcuggcugcuuuu

SEQ ID NO: 661560 - RNA, 64 nt, Homo Sapiens
caguggagcuagaccugaguagggggcagggaguucaggacaacccuccuguaaguugggggug

SEQ ID NO: 661561 - RNA, 64 nt, Homo Sapiens
ucccuugcucacaaaguuacaggguaggcaccugucaggacagaacagcagcagcgcuacagcc

SEQ ID NO: 661562 - RNA, 64 nt, Homo Sapiens
gguggagcugggucuugaacucuugggagucugcucaggacaguugacgaggcagcuggcccag

SEQ ID NO: 661563 - RNA, 64 nt, Homo Sapiens
augugagugucuggagacagacggaugccacuugucaggacagucuggagagagaaguugcuug

SEQ ID NO: 661564 - RNA, 64 nt, Homo Sapiens; identical to SEQ ID NO: 153216

SEQ ID NO: 661565 - RNA, 64 nt, Homo Sapiens; identical to SEQ ID NO: 153217

SEQ ID NO: 661566 - RNA, 64 nt, Homo Sapiens; identical to SEQ ID NO: 153218

SEQ ID NO: 661567 - RNA, 64 nt, Homo Sapiens; identical to SEQ ID NO: 153219

SEQ ID NO: 661568 - RNA, 64 nt, Homo Sapiens; identical to SEQ ID NO: 153220

SEQ ID NO: 661569 - RNA, 64 nt, Homo Sapiens; identical to SEQ ID NO: 153221

SEQ ID NO: 661570 - RNA, 64 nt, Homo Sapiens; identical to SEQ ID NO: 153222

SEQ ID NO: 661571 - RNA, 64 nt, Homo Sapiens; identical to SEQ ID NO: 153223

SEQ ID NO: 661572 - RNA, 64 nt, Homo Sapiens; identical to SEQ ID NO: 153224

SEQ ID NO: 661573 - RNA, 64 nt, Homo Sapiens; identical to SEQ ID NO: 153225

SEQ ID NO: 661574 - RNA, 64 nt, Homo Sapiens; identical to SEQ ID NO: 153226

SEQ ID NO: 661575 - RNA, 64 nt, Homo Sapiens; identical to SEQ ID NO: 153227

SEQ ID NO: 661576 - RNA, 64 nt, Homo Sapiens; identical to SEQ ID NO: 153228

SEQ ID NO: 661577 - RNA, 64 nt, Homo Sapiens; identical to SEQ ID NO: 153229

SEQ ID NO: 661578 - RNA, 64 nt, Homo Sapiens; identical to SEQ ID NO: 153230

SEQ ID NO: 661579 - RNA, 64 nt, Homo Sapiens; identical to SEQ ID NO: 153231

SEQ ID NO: 661580 - RNA, 64 nt, Homo Sapiens; identical to SEQ ID NO: 153232

SEQ ID NO: 661581 - RNA, 64 nt, Homo Sapiens; identical to SEQ ID NO: 153233

SEQ ID NO: 661582 - RNA, 64 nt, Homo Sapiens; identical to SEQ ID NO: 153234

SEQ ID NO: 661583 - RNA, 64 nt, Homo Sapiens; identical to SEQ ID NO: 153235

SEQ ID NO: 661584 - RNA, 64 nt, Homo Sapiens; identical to SEQ ID NO: 153236

SEQ ID NO: 661585 - RNA, 64 nt, Homo Sapiens; identical to SEQ ID NO: 276199

SEQ ID NO: 661586 - RNA, 64 nt, Homo Sapiens; identical to SEQ ID NO: 276200

SEQ ID NO: 661587 - RNA, 64 nt, Homo Sapiens; identical to SEQ ID NO: 276201

SEQ ID NO: 661588 - RNA, 64 nt, Homo Sapiens; identical to SEQ ID NO: 276202

SEQ ID NO: 661589 - RNA, 64 nt, Homo Sapiens; identical to SEQ ID NO: 276203

SEQ ID NO: 661590 - RNA, 64 nt, Homo Sapiens; identical to SEQ ID NO: 276204

SEQ ID NO: 661591 - RNA, 64 nt, Homo Sapiens; identical to SEQ ID NO: 276205

SEQ ID NO: 661592 - RNA, 64 nt, Homo Sapiens; identical to SEQ ID NO: 276206

SEQ ID NO: 661593 - RNA, 64 nt, Homo Sapiens; identical to SEQ ID NO: 276207

SEQ ID NO: 661594 - RNA, 64 nt, Homo Sapiens; identical to SEQ ID NO: 276208

SEQ ID NO: 661595 - RNA, 64 nt, Homo Sapiens; identical to SEQ ID NO: 276209

SEQ ID NO: 661596 - RNA, 56 nt, Homo Sapiens; identical to SEQ ID NO: 276210

SEQ ID NO: 661597 - RNA, 64 nt, Homo Sapiens; identical to SEQ ID NO: 276211

SEQ ID NO: 661598 - RNA, 64 nt, Homo Sapiens; identical to SEQ ID NO: 276212

SEQ ID NO: 661599 - RNA, 64 nt, Homo Sapiens; identical to SEQ ID NO: 276213

SEQ ID NO: 661600 - RNA, 64 nt, Homo Sapiens; identical to SEQ ID NO: 276214

SEQ ID NO: 661601 - RNA, 64 nt, Homo Sapiens; identical to SEQ ID NO: 276215

SEQ ID NO: 661602 - RNA, 64 nt, Homo Sapiens; identical to SEQ ID NO: 276216

SEQ ID NO: 661603 - RNA, 64 nt, Homo Sapiens; identical to SEQ ID NO: 276217

SEQ ID NO: 661604 - RNA, 64 nt, Homo Sapiens; identical to SEQ ID NO: 276218

SEQ ID NO: 661605 - RNA, 64 nt, Homo Sapiens; identical to SEQ ID NO: 276219

SEQ ID NO: 661606 - RNA, 64 nt, Homo Sapiens; identical to SEQ ID NO: 276220

SEQ ID NO: 661607 - RNA, 64 nt, Homo Sapiens; identical to SEQ ID NO: 276221

SEQ ID NO: 661608 - RNA, 64 nt, Homo Sapiens; identical to SEQ ID NO: 276222

SEQ ID NO: 661609 - RNA, 64 nt, Homo Sapiens; identical to SEQ ID NO: 276222

SEQ ID NO: 661610 - RNA, 64 nt, Homo Sapiens; identical to SEQ ID NO: 276224

SEQ ID NO: 661611 - RNA, 64 nt, Homo Sapiens; identical to SEQ ID NO: 276225

SEQ ID NO: 661612 - RNA, 64 nt, Homo Sapiens; identical to SEQ ID NO: 276226

SEQ ID NO: 661613 - RNA, 64 nt, Homo Sapiens; identical to SEQ ID NO: 276227

SEQ ID NO: 661614 - RNA, 58 nt, Homo Sapiens
auucccaagauugaggaggcaguaguuaaucugggaaggcaguagaauggccagcauu

SEQ ID NO: 661615 - RNA, 58 nt, Homo Sapiens
gggaggcugaguugggaggauugcugcaaucugggagguggaaguugcagugagccga

SEQ ID NO: 661616 - RNA, 58 nt, Homo Sapiens
uagccacagaaauaaaggagggaccaauaucugggacagguaauuuugcaaaacacau

SEQ ID NO: 661617 - RNA, 58 nt, Homo Sapiens
uagccacagaaauaaagaagggacaacaaucugggacagguaauuuugcaaaacacau

SEQ ID NO: 661618 - RNA, 58 nt, Homo Sapiens
uagccacagaaauaaaggauggagaaaaaucugggacagguaauuuugcaaaacacau

SEQ ID NO: 661619 - RNA, 58 nt, Homo Sapiens
uagccacagaaauaaaggauggagaaaaaucugggacagguaauuuugcaaaagacau

SEQ ID NO: 661620 - RNA, 58 nt, Homo Sapiens
cccaggucuccugccucacaucacaauaaucugggacccaggcuugugcccuuucagu

SEQ ID NO: 661621 - RNA, 58 nt, Homo Sapiens
ugaaucagaaaggcuuagccaaggccacaucugggaagaguggagaaauuugccacuu

SEQ ID NO: 661622 - RNA, 58 nt, Homo Sapiens
aggagccccuccgcccggcagccaccccaucugggaagugaggagcgucuacgcccgg

SEQ ID NO: 661623 - RNA, 58 nt, Homo Sapiens
aggagccccucugccuggccaccaccccaucugggaggugugcccagcagcucauuga

SEQ ID NO: 661624 - RNA, 58 nt, Homo Sapiens
cuccaacccuaagaaggucgaccucaucaucugggagaucgaggugccaaagguaggg

SEQ ID NO: 661625 - RNA, 58 nt, Homo Sapiens
gacaggugacuguaugguagagacugugaucugggaacuuuuugcuguacaaaucugu

SEQ ID NO: 661626 - RNA, 58 nt, Homo Sapiens
cugauacugacagggagaugagaagauuaucugggacaugggaaaugucccagucaga

SEQ ID NO: 661627 - RNA, 58 nt, Homo Sapiens
caucagaaugucugcucuccugcugucaaucugggaaacuggagaaaggccuuaugag

SEQ ID NO: 661628 - RNA, 64 nt, Homo Sapiens; identical to SEQ ID NO: 99154

SEQ ID NO: 661629 - RNA, 64 nt, Homo Sapiens; identical to SEQ ID NO: 99155

SEQ ID NO: 661630 - RNA, 64 nt, Homo Sapiens; identical to SEQ ID NO: 99156

SEQ ID NO: 661631 - RNA, 64 nt, Homo Sapiens; identical to SEQ ID NO: 99157

SEQ ID NO: 661632 - RNA, 64 nt, Homo Sapiens; identical to SEQ ID NO: 99158

SEQ ID NO: 661633 - RNA, 64 nt, Homo Sapiens; identical to SEQ ID NO: 99159

SEQ ID NO: 661634 - RNA, 64 nt, Homo Sapiens; identical to SEQ ID NO: 99160

SEQ ID NO: 661635 - RNA, 64 nt, Homo Sapiens; identical to SEQ ID NO: 99161

SEQ ID NO: 661636 - RNA, 64 nt, Homo Sapiens; identical to SEQ ID NO: 99162

SEQ ID NO: 661637 - RNA, 64 nt, Homo Sapiens; identical to SEQ ID NO: 99163

SEQ ID NO: 661638 - RNA, 64 nt, Homo Sapiens; identical to SEQ ID NO: 99164

SEQ ID NO: 661639 - RNA, 64 nt, Homo Sapiens; identical to SEQ ID NO: 99165

SEQ ID NO: 661640 - RNA, 64 nt, Homo Sapiens; identical to SEQ ID NO: 99166

SEQ ID NO: 661641 - RNA, 64 nt, Homo Sapiens; identical to SEQ ID NO: 99167

SEQ ID NO: 661642 - RNA, 64 nt, Homo Sapiens; identical to SEQ ID NO: 99168

SEQ ID NO: 661643 - RNA, 64 nt, Homo Sapiens; identical to SEQ ID NO: 99169

SEQ ID NO: 661644 - RNA, 64 nt, Homo Sapiens; identical to SEQ ID NO: 99170

SEQ ID NO: 661645 - RNA, 64 nt, Homo Sapiens; identical to SEQ ID NO: 99171

SEQ ID NO: 661646 - RNA, 64 nt, Homo Sapiens; identical to SEQ ID NO: 99172

SEQ ID NO: 661647 - RNA, 64 nt, Homo Sapiens; identical to SEQ ID NO: 99173

SEQ ID NO: 661648 - RNA, 64 nt, Homo Sapiens; identical to SEQ ID NO: 99174

SEQ ID NO: 661649 - RNA, 64 nt, Homo Sapiens; identical to SEQ ID NO: 99175

SEQ ID NO: 661650 - RNA, 64 nt, Homo Sapiens; identical to SEQ ID NO: 99176

SEQ ID NO: 661651 - RNA, 64 nt, Homo Sapiens; identical to SEQ ID NO: 99177

SEQ ID NO: 661652 - RNA, 64 nt, Homo Sapiens; identical to SEQ ID NO: 99178

SEQ ID NO: 661653 - RNA, 64 nt, Homo Sapiens; identical to SEQ ID NO: 99179

SEQ ID NO: 661654 - RNA, 63 nt, Homo Sapiens
ucaccugaauucagucuguuuggugucugcacagacuggaauucaaucugucaaauuuguuuu

SEQ ID NO: 661655 - RNA, 63 nt, Homo Sapiens
aagguagaaaagaaaagccaagaucauacuaaggacuggaaauauuuuguucuauggaaucaa

SEQ ID NO: 661656 - RNA, 63 nt, Homo Sapiens
uggcucugggugagucaguaaacaaguuggcaggacuggaagcuauuuaggacauuuaccaug

SEQ ID NO: 661657 - RNA, 63 nt, Homo Sapiens
augguuguguuuuuauugccgauauuuugaccugacuggaaaggguagaaaggcaaaaaguag

SEQ ID NO: 661658 - RNA, 63 nt, Homo Sapiens
auuucuuuacauuugcauucgggaacauguucggacuggaaacgaucugguuuuuuggucaaa

SEQ ID NO: 661659 - RNA, 63 nt, Homo Sapiens
uuagcaaacaauuguaagucuuuugaaagacuggacuggaaucccaaaggggcacccacauuu

SEQ ID NO: 661660 - RNA, 64 nt, Homo Sapiens; identical to SEQ ID NO: 154420

SEQ ID NO: 661661 - RNA, 64 nt, Homo Sapiens; identical to SEQ ID NO: 154421

SEQ ID NO: 661662 - RNA, 64 nt, Homo Sapiens; identical to SEQ ID NO: 154422

SEQ ID NO: 661663 - RNA, 64 nt, Homo Sapiens; identical to SEQ ID NO: 154423

SEQ ID NO: 661664 - RNA, 64 nt, Homo Sapiens; identical to SEQ ID NO: 154424

SEQ ID NO: 661665 - RNA, 64 nt, Homo Sapiens; identical to SEQ ID NO: 154425

SEQ ID NO: 661666 - RNA, 64 nt, Homo Sapiens; identical to SEQ ID NO: 154426

SEQ ID NO: 661667 - RNA, 64 nt, Homo Sapiens; identical to SEQ ID NO: 154427

SEQ ID NO: 661668 - RNA, 64 nt, Homo Sapiens; identical to SEQ ID NO: 154428

SEQ ID NO: 661669 - RNA, 64 nt, Homo Sapiens; identical to SEQ ID NO: 154429

SEQ ID NO: 661670 - RNA, 64 nt, Homo Sapiens; identical to SEQ ID NO: 154430

SEQ ID NO: 661671 - RNA, 64 nt, Homo Sapiens; identical to SEQ ID NO: 154431

SEQ ID NO: 661672 - RNA, 64 nt, Homo Sapiens; identical to SEQ ID NO: 154432

SEQ ID NO: 661673 - RNA, 64 nt, Homo Sapiens; identical to SEQ ID NO: 154433

SEQ ID NO: 661674 - RNA, 64 nt, Homo Sapiens; identical to SEQ ID NO: 154434

SEQ ID NO: 661675 - RNA, 64 nt, Homo Sapiens; identical to SEQ ID NO: 154435

SEQ ID NO: 661676 - RNA, 64 nt, Homo Sapiens; identical to SEQ ID NO: 154436

SEQ ID NO: 661677 - RNA, 64 nt, Homo Sapiens; identical to SEQ ID NO: 237342

SEQ ID NO: 661678 - RNA, 64 nt, Homo Sapiens; identical to SEQ ID NO: 237343

SEQ ID NO: 661679 - RNA, 64 nt, Homo Sapiens; identical to SEQ ID NO: 237344

SEQ ID NO: 661680 - RNA, 64 nt, Homo Sapiens; identical to SEQ ID NO: 237345

SEQ ID NO: 661681 - RNA, 64 nt, Homo Sapiens; identical to SEQ ID NO: 237346

SEQ ID NO: 661682 - RNA, 64 nt, Homo Sapiens; identical to SEQ ID NO: 237347

SEQ ID NO: 661683 - RNA, 64 nt, Homo Sapiens; identical to SEQ ID NO: 237348

SEQ ID NO: 661684 - RNA, 64 nt, Homo Sapiens; identical to SEQ ID NO: 237349

SEQ ID NO: 661685 - RNA, 64 nt, Homo Sapiens; identical to SEQ ID NO: 237350

SEQ ID NO: 661686 - RNA, 64 nt, Homo Sapiens; identical to SEQ ID NO: 237351

SEQ ID NO: 661687 - RNA, 64 nt, Homo Sapiens; identical to SEQ ID NO: 237352

SEQ ID NO: 661688 - RNA, 64 nt, Homo Sapiens; identical to SEQ ID NO: 237353

SEQ ID NO: 661689 - RNA, 64 nt, Homo Sapiens; identical to SEQ ID NO: 333348

SEQ ID NO: 661690 - RNA, 64 nt, Homo Sapiens; identical to SEQ ID NO: 333349

SEQ ID NO: 661691 - RNA, 64 nt, Homo Sapiens; identical to SEQ ID NO: 333350

SEQ ID NO: 661692 - RNA, 64 nt, Homo Sapiens; identical to SEQ ID NO: 333351

SEQ ID NO: 661693 - RNA, 64 nt, Homo Sapiens; identical to SEQ ID NO: 333352

SEQ ID NO: 661694 - RNA, 64 nt, Homo Sapiens; identical to SEQ ID NO: 333353

SEQ ID NO: 661695 - RNA, 64 nt, Homo Sapiens; identical to SEQ ID NO: 333354

SEQ ID NO: 661696 - RNA, 64 nt, Homo Sapiens; identical to SEQ ID NO: 333355

SEQ ID NO: 661697 - RNA, 64 nt, Homo Sapiens; identical to SEQ ID NO: 333356

SEQ ID NO: 661698 - RNA, 64 nt, Homo Sapiens; identical to SEQ ID NO: 333357

SEQ ID NO: 661699 - RNA, 64 nt, Homo Sapiens; identical to SEQ ID NO: 333358

SEQ ID NO: 661700 - RNA, 64 nt, Homo Sapiens; identical to SEQ ID NO: 333359

SEQ ID NO: 661701 - RNA, 64 nt, Homo Sapiens; identical to SEQ ID NO: 333360

SEQ ID NO: 661702 - RNA, 64 nt, Homo Sapiens; identical to SEQ ID NO: 333361

SEQ ID NO: 661703 - RNA, 64 nt, Homo Sapiens; identical to SEQ ID NO: 333362

SEQ ID NO: 661704 - RNA, 64 nt, Homo Sapiens; identical to SEQ ID NO: 333363

SEQ ID NO: 661705 - RNA, 64 nt, Homo Sapiens; identical to SEQ ID NO: 333364

SEQ ID NO: 661706 - RNA, 64 nt, Homo Sapiens; identical to SEQ ID NO: 333365

SEQ ID NO: 661707 - RNA, 64 nt, Homo Sapiens; identical to SEQ ID NO: 333366

SEQ ID NO: 661708 - RNA, 64 nt, Homo Sapiens; identical to SEQ ID NO: 333367

SEQ ID NO: 661709 - RNA, 64 nt, Homo Sapiens; identical to SEQ ID NO: 333368

SEQ ID NO: 661710 - RNA, 64 nt, Homo Sapiens; identical to SEQ ID NO: 333369

SEQ ID NO: 661711 - RNA, 64 nt, Homo Sapiens; identical to SEQ ID NO: 333370

SEQ ID NO: 661712 - RNA, 64 nt, Homo Sapiens; identical to SEQ ID NO: 333371

SEQ ID NO: 661713 - RNA, 64 nt, Homo Sapiens; identical to SEQ ID NO: 333372

SEQ ID NO: 661714 - RNA, 64 nt, Homo Sapiens; identical to SEQ ID NO: 333373

SEQ ID NO: 661715 - RNA, 64 nt, Homo Sapiens; identical to SEQ ID NO: 333374

SEQ ID NO: 661716 - RNA, 64 nt, Homo Sapiens; identical to SEQ ID NO: 333375

SEQ ID NO: 661717 - RNA, 64 nt, Homo Sapiens; identical to SEQ ID NO: 333376

SEQ ID NO: 661718 - RNA, 64 nt, Homo Sapiens; identical to SEQ ID NO: 333377

SEQ ID NO: 661719 - RNA, 64 nt, Homo Sapiens; identical to SEQ ID NO: 333378

SEQ ID NO: 661720 - RNA, 64 nt, Homo Sapiens; identical to SEQ ID NO: 333379

SEQ ID NO: 661721 - RNA, 64 nt, Homo Sapiens; identical to SEQ ID NO: 333380

SEQ ID NO: 661722 - RNA, 64 nt, Homo Sapiens; identical to SEQ ID NO: 333381

SEQ ID NO: 661723 - RNA, 64 nt, Homo Sapiens; identical to SEQ ID NO: 333382

SEQ ID NO: 661724 - RNA, 64 nt, Homo Sapiens; identical to SEQ ID NO: 333383

SEQ ID NO: 661725 - RNA, 64 nt, Homo Sapiens; identical to SEQ ID NO: 333384

SEQ ID NO: 661726 - RNA, 64 nt, Homo Sapiens; identical to SEQ ID NO: 333385

SEQ ID NO: 661727 - RNA, 64 nt, Homo Sapiens; identical to SEQ ID NO: 333386

SEQ ID NO: 661728 - RNA, 64 nt, Homo Sapiens; identical to SEQ ID NO: 333387

SEQ ID NO: 661729 - RNA, 64 nt, Homo Sapiens; identical to SEQ ID NO: 333388

SEQ ID NO: 661730 - RNA, 64 nt, Homo Sapiens; identical to SEQ ID NO: 333389

SEQ ID NO: 661731 - RNA, 64 nt, Homo Sapiens; identical to SEQ ID NO: 333390

SEQ ID NO: 661732 - RNA, 64 nt, Homo Sapiens; identical to SEQ ID NO: 333391

SEQ ID NO: 661733 - RNA, 64 nt, Homo Sapiens; identical to SEQ ID NO: 333392

SEQ ID NO: 661734 - RNA, 64 nt, Homo Sapiens; identical to SEQ ID NO: 333393

SEQ ID NO: 661735 - RNA, 64 nt, Homo Sapiens; identical to SEQ ID NO: 333394

SEQ ID NO: 661736 - RNA, 64 nt, Homo Sapiens; identical to SEQ ID NO: 333395

SEQ ID NO: 661737 - RNA, 64 nt, Homo Sapiens; identical to SEQ ID NO: 333396

SEQ ID NO: 661738 - RNA, 64 nt, Homo Sapiens; identical to SEQ ID NO: 333397

SEQ ID NO: 661739 - RNA, 64 nt, Homo Sapiens; identical to SEQ ID NO: 333398

SEQ ID NO: 661740 - RNA, 64 nt, Homo Sapiens; identical to SEQ ID NO: 333399

SEQ ID NO: 661741 - RNA, 64 nt, Homo Sapiens; identical to SEQ ID NO: 333400

SEQ ID NO: 661742 - RNA, 64 nt, Homo Sapiens; identical to SEQ ID NO: 333401

SEQ ID NO: 661743 - RNA, 64 nt, Homo Sapiens; identical to SEQ ID NO: 333402

SEQ ID NO: 661744 - RNA, 64 nt, Homo Sapiens; identical to SEQ ID NO: 333403

SEQ ID NO: 661745 - RNA, 64 nt, Homo Sapiens; identical to SEQ ID NO: 333404

SEQ ID NO: 661746 - RNA, 64 nt, Homo Sapiens; identical to SEQ ID NO: 333405

SEQ ID NO: 661747 - RNA, 64 nt, Homo Sapiens; identical to SEQ ID NO: 333406

SEQ ID NO: 661748 - RNA, 64 nt, Homo Sapiens; identical to SEQ ID NO: 333407

SEQ ID NO: 661749 - RNA, 64 nt, Homo Sapiens; identical to SEQ ID NO: 333408

SEQ ID NO: 661750 - RNA, 64 nt, Homo Sapiens; identical to SEQ ID NO: 333409

SEQ ID NO: 661751 - RNA, 64 nt, Homo Sapiens; identical to SEQ ID NO: 333410

SEQ ID NO: 661752 - RNA, 64 nt, Homo Sapiens; identical to SEQ ID NO: 333411

SEQ ID NO: 661753 - RNA, 64 nt, Homo Sapiens; identical to SEQ ID NO: 333412

SEQ ID NO: 661754 - RNA, 64 nt, Homo Sapiens; identical to SEQ ID NO: 333413

SEQ ID NO: 661755 - RNA, 64 nt, Homo Sapiens; identical to SEQ ID NO: 333414

SEQ ID NO: 661756 - RNA, 64 nt, Homo Sapiens; identical to SEQ ID NO: 333415

SEQ ID NO: 661757 - RNA, 64 nt, Homo Sapiens; identical to SEQ ID NO: 333416

SEQ ID NO: 661758 - RNA, 64 nt, Homo Sapiens; identical to SEQ ID NO: 333417

SEQ ID NO: 661759 - RNA, 64 nt, Homo Sapiens; identical to SEQ ID NO: 333418

SEQ ID NO: 661760 - RNA, 64 nt, Homo Sapiens; identical to SEQ ID NO: 333419

SEQ ID NO: 661761 - RNA, 64 nt, Homo Sapiens; identical to SEQ ID NO: 333420

SEQ ID NO: 661762 - RNA, 64 nt, Homo Sapiens; identical to SEQ ID NO: 333421

SEQ ID NO: 661763 - RNA, 64 nt, Homo Sapiens; identical to SEQ ID NO: 333422

SEQ ID NO: 661764 - RNA, 64 nt, Homo Sapiens; identical to SEQ ID NO: 333423

SEQ ID NO: 661765 - RNA, 64 nt, Homo Sapiens; identical to SEQ ID NO: 333424

SEQ ID NO: 661766 - RNA, 64 nt, Homo Sapiens; identical to SEQ ID NO: 333425

SEQ ID NO: 661767 - RNA, 64 nt, Homo Sapiens; identical to SEQ ID NO: 333426

SEQ ID NO: 661768 - RNA, 64 nt, Homo Sapiens; identical to SEQ ID NO: 333427

SEQ ID NO: 661769 - RNA, 64 nt, Homo Sapiens; identical to SEQ ID NO: 333428

SEQ ID NO: 661770 - RNA, 64 nt, Homo Sapiens; identical to SEQ ID NO: 333429

SEQ ID NO: 661771 - RNA, 64 nt, Homo Sapiens; identical to SEQ ID NO: 333430

SEQ ID NO: 661772 - RNA, 64 nt, Homo Sapiens; identical to SEQ ID NO: 333431

SEQ ID NO: 661773 - RNA, 64 nt, Homo Sapiens; identical to SEQ ID NO: 333432

SEQ ID NO: 661774 - RNA, 64 nt, Homo Sapiens; identical to SEQ ID NO: 333433

SEQ ID NO: 661775 - RNA, 64 nt, Homo Sapiens; identical to SEQ ID NO: 333434

SEQ ID NO: 661776 - RNA, 64 nt, Homo Sapiens; identical to SEQ ID NO: 333435

SEQ ID NO: 661777 - RNA, 64 nt, Homo Sapiens; identical to SEQ ID NO: 333436

SEQ ID NO: 661778 - RNA, 64 nt, Homo Sapiens; identical to SEQ ID NO: 333437

SEQ ID NO: 661779 - RNA, 64 nt, Homo Sapiens; identical to SEQ ID NO: 333438

SEQ ID NO: 661780 - RNA, 64 nt, Homo Sapiens; identical to SEQ ID NO: 333439

SEQ ID NO: 661781 - RNA, 64 nt, Homo Sapiens; identical to SEQ ID NO: 333440

SEQ ID NO: 661782 - RNA, 64 nt, Homo Sapiens; identical to SEQ ID NO: 333441

SEQ ID NO: 661783 - RNA, 64 nt, Homo Sapiens; identical to SEQ ID NO: 333442

SEQ ID NO: 661784 - RNA, 64 nt, Homo Sapiens; identical to SEQ ID NO: 333443

SEQ ID NO: 661785 - RNA, 64 nt, Homo Sapiens; identical to SEQ ID NO: 333444

SEQ ID NO: 661786 - RNA, 64 nt, Homo Sapiens; identical to SEQ ID NO: 333445

SEQ ID NO: 661787 - RNA, 64 nt, Homo Sapiens; identical to SEQ ID NO: 333446

SEQ ID NO: 661788 - RNA, 64 nt, Homo Sapiens; identical to SEQ ID NO: 333447

SEQ ID NO: 661789 - RNA, 64 nt, Homo Sapiens; identical to SEQ ID NO: 333448

SEQ ID NO: 661790 - RNA, 64 nt, Homo Sapiens; identical to SEQ ID NO: 333449

SEQ ID NO: 661791 - RNA, 64 nt, Homo Sapiens; identical to SEQ ID NO: 333450

SEQ ID NO: 661792 - RNA, 64 nt, Homo Sapiens; identical to SEQ ID NO: 333451

SEQ ID NO: 661793 - RNA, 64 nt, Homo Sapiens; identical to SEQ ID NO: 333452

SEQ ID NO: 661794 - RNA, 64 nt, Homo Sapiens; identical to SEQ ID NO: 333453

SEQ ID NO: 661795 - RNA, 64 nt, Homo Sapiens; identical to SEQ ID NO: 333454

SEQ ID NO: 661796 - RNA, 55 nt, Homo Sapiens; identical to SEQ ID NO: 333455

SEQ ID NO: 661797 - RNA, 64 nt, Homo Sapiens; identical to SEQ ID NO: 333456

SEQ ID NO: 661798 - RNA, 64 nt, Homo Sapiens; identical to SEQ ID NO: 333457

SEQ ID NO: 661799 - RNA, 64 nt, Homo Sapiens; identical to SEQ ID NO: 333458

SEQ ID NO: 661800 - RNA, 64 nt, Homo Sapiens; identical to SEQ ID NO: 237342

SEQ ID NO: 661801 - RNA, 64 nt, Homo Sapiens; identical to SEQ ID NO: 237343

SEQ ID NO: 661802 - RNA, 64 nt, Homo Sapiens; identical to SEQ ID NO: 237344

SEQ ID NO: 661803 - RNA, 64 nt, Homo Sapiens; identical to SEQ ID NO: 237345

SEQ ID NO: 661804 - RNA, 64 nt, Homo Sapiens; identical to SEQ ID NO: 237346

SEQ ID NO: 661805 - RNA, 64 nt, Homo Sapiens; identical to SEQ ID NO: 237347

SEQ ID NO: 661806 - RNA, 64 nt, Homo Sapiens; identical to SEQ ID NO: 237348

SEQ ID NO: 661807 - RNA, 64 nt, Homo Sapiens; identical to SEQ ID NO: 237349

SEQ ID NO: 661808 - RNA, 64 nt, Homo Sapiens; identical to SEQ ID NO: 237350

SEQ ID NO: 661809 - RNA, 64 nt, Homo Sapiens; identical to SEQ ID NO: 237351

SEQ ID NO: 661810 - RNA, 64 nt, Homo Sapiens; identical to SEQ ID NO: 237352

SEQ ID NO: 661811 - RNA, 64 nt, Homo Sapiens; identical to SEQ ID NO: 237353

SEQ ID NO: 661812 - RNA, 64 nt, Homo Sapiens; identical to SEQ ID NO: 333348

SEQ ID NO: 661813 - RNA, 64 nt, Homo Sapiens; identical to SEQ ID NO: 333349

SEQ ID NO: 661814 - RNA, 64 nt, Homo Sapiens; identical to SEQ ID NO: 333350

SEQ ID NO: 661815 - RNA, 64 nt, Homo Sapiens; identical to SEQ ID NO: 333351

SEQ ID NO: 661816 - RNA, 64 nt, Homo Sapiens; identical to SEQ ID NO: 333352

SEQ ID NO: 661817 - RNA, 64 nt, Homo Sapiens; identical to SEQ ID NO: 333353

SEQ ID NO: 661818 - RNA, 64 nt, Homo Sapiens; identical to SEQ ID NO: 333354

SEQ ID NO: 661819 - RNA, 64 nt, Homo Sapiens; identical to SEQ ID NO: 333355

SEQ ID NO: 661820 - RNA, 64 nt, Homo Sapiens; identical to SEQ ID NO: 333356

SEQ ID NO: 661821 - RNA, 64 nt, Homo Sapiens; identical to SEQ ID NO: 333357

SEQ ID NO: 661822 - RNA, 64 nt, Homo Sapiens; identical to SEQ ID NO: 333358

SEQ ID NO: 661823 - RNA, 64 nt, Homo Sapiens; identical to SEQ ID NO: 333359

SEQ ID NO: 661824 - RNA, 64 nt, Homo Sapiens; identical to SEQ ID NO: 333360

SEQ ID NO: 661825 - RNA, 64 nt, Homo Sapiens; identical to SEQ ID NO: 333361

SEQ ID NO: 661826 - RNA, 64 nt, Homo Sapiens; identical to SEQ ID NO: 333362

SEQ ID NO: 661827 - RNA, 64 nt, Homo Sapiens; identical to SEQ ID NO: 333363

SEQ ID NO: 661828 - RNA, 64 nt, Homo Sapiens; identical to SEQ ID NO: 333364

SEQ ID NO: 661829 - RNA, 64 nt, Homo Sapiens; identical to SEQ ID NO: 333365

SEQ ID NO: 661830 - RNA, 64 nt, Homo Sapiens; identical to SEQ ID NO: 333366

SEQ ID NO: 661831 - RNA, 64 nt, Homo Sapiens; identical to SEQ ID NO: 333367

SEQ ID NO: 661832 - RNA, 64 nt, Homo Sapiens; identical to SEQ ID NO: 333368

SEQ ID NO: 661833 - RNA, 64 nt, Homo Sapiens; identical to SEQ ID NO: 333369

SEQ ID NO: 661834 - RNA, 64 nt, Homo Sapiens; identical to SEQ ID NO: 333370

SEQ ID NO: 661835 - RNA, 64 nt, Homo Sapiens; identical to SEQ ID NO: 333371

SEQ ID NO: 661836 - RNA, 64 nt, Homo Sapiens; identical to SEQ ID NO: 333372

SEQ ID NO: 661837 - RNA, 64 nt, Homo Sapiens; identical to SEQ ID NO: 333373

SEQ ID NO: 661838 - RNA, 64 nt, Homo Sapiens; identical to SEQ ID NO: 333374

SEQ ID NO: 661839 - RNA, 64 nt, Homo Sapiens; identical to SEQ ID NO: 333375

SEQ ID NO: 661840 - RNA, 64 nt, Homo Sapiens; identical to SEQ ID NO: 333376

SEQ ID NO: 661841 - RNA, 64 nt, Homo Sapiens; identical to SEQ ID NO: 333377

SEQ ID NO: 661842 - RNA, 64 nt, Homo Sapiens; identical to SEQ ID NO: 333378

SEQ ID NO: 661843 - RNA, 64 nt, Homo Sapiens; identical to SEQ ID NO: 333379

SEQ ID NO: 661844 - RNA, 64 nt, Homo Sapiens; identical to SEQ ID NO: 333380

SEQ ID NO: 661845 - RNA, 64 nt, Homo Sapiens; identical to SEQ ID NO: 333381

SEQ ID NO: 661846 - RNA, 64 nt, Homo Sapiens; identical to SEQ ID NO: 333382

SEQ ID NO: 661847 - RNA, 64 nt, Homo Sapiens; identical to SEQ ID NO: 333383

SEQ ID NO: 661848 - RNA, 64 nt, Homo Sapiens; identical to SEQ ID NO: 333384

SEQ ID NO: 661849 - RNA, 64 nt, Homo Sapiens; identical to SEQ ID NO: 333385

SEQ ID NO: 661850 - RNA, 64 nt, Homo Sapiens; identical to SEQ ID NO: 333386

SEQ ID NO: 661851 - RNA, 64 nt, Homo Sapiens; identical to SEQ ID NO: 333387

SEQ ID NO: 661852 - RNA, 64 nt, Homo Sapiens; identical to SEQ ID NO: 333388

SEQ ID NO: 661853 - RNA, 64 nt, Homo Sapiens; identical to SEQ ID NO: 333389

SEQ ID NO: 661854 - RNA, 64 nt, Homo Sapiens; identical to SEQ ID NO: 333390

SEQ ID NO: 661855 - RNA, 64 nt, Homo Sapiens; identical to SEQ ID NO: 333391

SEQ ID NO: 661856 - RNA, 64 nt, Homo Sapiens; identical to SEQ ID NO: 333392

SEQ ID NO: 661857 - RNA, 64 nt, Homo Sapiens; identical to SEQ ID NO: 333393

SEQ ID NO: 661858 - RNA, 64 nt, Homo Sapiens; identical to SEQ ID NO: 333394

SEQ ID NO: 661859 - RNA, 64 nt, Homo Sapiens; identical to SEQ ID NO: 333395

SEQ ID NO: 661860 - RNA, 64 nt, Homo Sapiens; identical to SEQ ID NO: 333396

SEQ ID NO: 661861 - RNA, 64 nt, Homo Sapiens; identical to SEQ ID NO: 333397

SEQ ID NO: 661862 - RNA, 64 nt, Homo Sapiens; identical to SEQ ID NO: 333398

SEQ ID NO: 661863 - RNA, 64 nt, Homo Sapiens; identical to SEQ ID NO: 333399

SEQ ID NO: 661864 - RNA, 64 nt, Homo Sapiens; identical to SEQ ID NO: 333400

SEQ ID NO: 661865 - RNA, 64 nt, Homo Sapiens; identical to SEQ ID NO: 333401

SEQ ID NO: 661866 - RNA, 64 nt, Homo Sapiens; identical to SEQ ID NO: 333402

SEQ ID NO: 661867 - RNA, 64 nt, Homo Sapiens; identical to SEQ ID NO: 333403

SEQ ID NO: 661868 - RNA, 64 nt, Homo Sapiens; identical to SEQ ID NO: 333404

SEQ ID NO: 661869 - RNA, 64 nt, Homo Sapiens; identical to SEQ ID NO: 333405

SEQ ID NO: 661870 - RNA, 64 nt, Homo Sapiens; identical to SEQ ID NO: 333406

SEQ ID NO: 661871 - RNA, 64 nt, Homo Sapiens; identical to SEQ ID NO: 333407

SEQ ID NO: 661872 - RNA, 64 nt, Homo Sapiens; identical to SEQ ID NO: 333408

SEQ ID NO: 661873 - RNA, 64 nt, Homo Sapiens; identical to SEQ ID NO: 333409

SEQ ID NO: 661874 - RNA, 64 nt, Homo Sapiens; identical to SEQ ID NO: 333410

SEQ ID NO: 661875 - RNA, 64 nt, Homo Sapiens; identical to SEQ ID NO: 333411

SEQ ID NO: 661876 - RNA, 64 nt, Homo Sapiens; identical to SEQ ID NO: 333412

SEQ ID NO: 661877 - RNA, 64 nt, Homo Sapiens; identical to SEQ ID NO: 333413

SEQ ID NO: 661878 - RNA, 64 nt, Homo Sapiens; identical to SEQ ID NO: 333414

SEQ ID NO: 661879 - RNA, 64 nt, Homo Sapiens; identical to SEQ ID NO: 333415

SEQ ID NO: 661880 - RNA, 64 nt, Homo Sapiens; identical to SEQ ID NO: 333416

SEQ ID NO: 661881 - RNA, 64 nt, Homo Sapiens; identical to SEQ ID NO: 333417

SEQ ID NO: 661882 - RNA, 64 nt, Homo Sapiens; identical to SEQ ID NO: 333418

SEQ ID NO: 661883 - RNA, 64 nt, Homo Sapiens; identical to SEQ ID NO: 333419

SEQ ID NO: 661884 - RNA, 64 nt, Homo Sapiens; identical to SEQ ID NO: 333420

SEQ ID NO: 661885 - RNA, 64 nt, Homo Sapiens; identical to SEQ ID NO: 333421

SEQ ID NO: 661886 - RNA, 64 nt, Homo Sapiens; identical to SEQ ID NO: 333422

SEQ ID NO: 661887 - RNA, 64 nt, Homo Sapiens; identical to SEQ ID NO: 333423

SEQ ID NO: 661888 - RNA, 64 nt, Homo Sapiens; identical to SEQ ID NO: 333424

SEQ ID NO: 661889 - RNA, 64 nt, Homo Sapiens; identical to SEQ ID NO: 333425

SEQ ID NO: 661890 - RNA, 64 nt, Homo Sapiens; identical to SEQ ID NO: 333426

SEQ ID NO: 661891 - RNA, 64 nt, Homo Sapiens; identical to SEQ ID NO: 333427

SEQ ID NO: 661892 - RNA, 64 nt, Homo Sapiens; identical to SEQ ID NO: 333428

SEQ ID NO: 661893 - RNA, 64 nt, Homo Sapiens; identical to SEQ ID NO: 333429

SEQ ID NO: 661894 - RNA, 64 nt, Homo Sapiens; identical to SEQ ID NO: 333430

SEQ ID NO: 661895 - RNA, 64 nt, Homo Sapiens; identical to SEQ ID NO: 333431

SEQ ID NO: 661896 - RNA, 64 nt, Homo Sapiens; identical to SEQ ID NO: 333432

SEQ ID NO: 661897 - RNA, 64 nt, Homo Sapiens; identical to SEQ ID NO: 333433

SEQ ID NO: 661898 - RNA, 64 nt, Homo Sapiens; identical to SEQ ID NO: 333434

SEQ ID NO: 661899 - RNA, 64 nt, Homo Sapiens; identical to SEQ ID NO: 333435

SEQ ID NO: 661900 - RNA, 64 nt, Homo Sapiens; identical to SEQ ID NO: 333436

SEQ ID NO: 661901 - RNA, 64 nt, Homo Sapiens; identical to SEQ ID NO: 333437

SEQ ID NO: 661902 - RNA, 64 nt, Homo Sapiens; identical to SEQ ID NO: 333438

SEQ ID NO: 661903 - RNA, 64 nt, Homo Sapiens; identical to SEQ ID NO: 333439

SEQ ID NO: 661904 - RNA, 64 nt, Homo Sapiens; identical to SEQ ID NO: 333440

SEQ ID NO: 661905 - RNA, 64 nt, Homo Sapiens; identical to SEQ ID NO: 333441

SEQ ID NO: 661906 - RNA, 64 nt, Homo Sapiens; identical to SEQ ID NO: 333442

SEQ ID NO: 661907 - RNA, 64 nt, Homo Sapiens; identical to SEQ ID NO: 333443

SEQ ID NO: 661908 - RNA, 64 nt, Homo Sapiens; identical to SEQ ID NO: 333444

SEQ ID NO: 661909 - RNA, 64 nt, Homo Sapiens; identical to SEQ ID NO: 333445

SEQ ID NO: 661910 - RNA, 64 nt, Homo Sapiens; identical to SEQ ID NO: 333446

SEQ ID NO: 661911 - RNA, 64 nt, Homo Sapiens; identical to SEQ ID NO: 333447

SEQ ID NO: 661912 - RNA, 64 nt, Homo Sapiens; identical to SEQ ID NO: 333448

SEQ ID NO: 661913 - RNA, 64 nt, Homo Sapiens; identical to SEQ ID NO: 333449

SEQ ID NO: 661914 - RNA, 64 nt, Homo Sapiens; identical to SEQ ID NO: 333450

SEQ ID NO: 661915 - RNA, 64 nt, Homo Sapiens; identical to SEQ ID NO: 333451

SEQ ID NO: 661916 - RNA, 64 nt, Homo Sapiens; identical to SEQ ID NO: 333452

SEQ ID NO: 661917 - RNA, 64 nt, Homo Sapiens; identical to SEQ ID NO: 333453

SEQ ID NO: 661918 - RNA, 64 nt, Homo Sapiens; identical to SEQ ID NO: 333454

SEQ ID NO: 661919 - RNA, 55 nt, Homo Sapiens; identical to SEQ ID NO: 333455

SEQ ID NO: 661920 - RNA, 64 nt, Homo Sapiens; identical to SEQ ID NO: 333456

SEQ ID NO: 661921 - RNA, 64 nt, Homo Sapiens; identical to SEQ ID NO: 333457

SEQ ID NO: 661922 - RNA, 64 nt, Homo Sapiens; identical to SEQ ID NO: 333458

SEQ ID NO: 661923 - RNA, 64 nt, Homo Sapiens; identical to SEQ ID NO: 237342

SEQ ID NO: 661924 - RNA, 64 nt, Homo Sapiens; identical to SEQ ID NO: 237343

SEQ ID NO: 661925 - RNA, 64 nt, Homo Sapiens; identical to SEQ ID NO: 237344

SEQ ID NO: 661926 - RNA, 64 nt, Homo Sapiens; identical to SEQ ID NO: 237345

SEQ ID NO: 661927 - RNA, 64 nt, Homo Sapiens; identical to SEQ ID NO: 237346

SEQ ID NO: 661928 - RNA, 64 nt, Homo Sapiens; identical to SEQ ID NO: 237347

SEQ ID NO: 661929 - RNA, 64 nt, Homo Sapiens; identical to SEQ ID NO: 237348

SEQ ID NO: 661930 - RNA, 64 nt, Homo Sapiens; identical to SEQ ID NO: 237349

SEQ ID NO: 661931 - RNA, 64 nt, Homo Sapiens; identical to SEQ ID NO: 237350

SEQ ID NO: 661932 - RNA, 64 nt, Homo Sapiens; identical to SEQ ID NO: 237351

SEQ ID NO: 661933 - RNA, 64 nt, Homo Sapiens; identical to SEQ ID NO: 237352

SEQ ID NO: 661934 - RNA, 64 nt, Homo Sapiens; identical to SEQ ID NO: 237353

SEQ ID NO: 661935 - RNA, 64 nt, Homo Sapiens; identical to SEQ ID NO: 333348

SEQ ID NO: 661936 - RNA, 64 nt, Homo Sapiens; identical to SEQ ID NO: 333349

SEQ ID NO: 661937 - RNA, 64 nt, Homo Sapiens; identical to SEQ ID NO: 333350

SEQ ID NO: 661938 - RNA, 64 nt, Homo Sapiens; identical to SEQ ID NO: 333351

SEQ ID NO: 661939 - RNA, 64 nt, Homo Sapiens; identical to SEQ ID NO: 333352

SEQ ID NO: 661940 - RNA, 64 nt, Homo Sapiens; identical to SEQ ID NO: 333353

SEQ ID NO: 661941 - RNA, 64 nt, Homo Sapiens; identical to SEQ ID NO: 333354

SEQ ID NO: 661942 - RNA, 64 nt, Homo Sapiens; identical to SEQ ID NO: 333355

SEQ ID NO: 661943 - RNA, 64 nt, Homo Sapiens; identical to SEQ ID NO: 333356

SEQ ID NO: 661944 - RNA, 64 nt, Homo Sapiens; identical to SEQ ID NO: 333357

SEQ ID NO: 661945 - RNA, 64 nt, Homo Sapiens; identical to SEQ ID NO: 333358

SEQ ID NO: 661946 - RNA, 64 nt, Homo Sapiens; identical to SEQ ID NO: 333359

SEQ ID NO: 661947 - RNA, 64 nt, Homo Sapiens; identical to SEQ ID NO: 333360

SEQ ID NO: 661948 - RNA, 64 nt, Homo Sapiens; identical to SEQ ID NO: 333361

SEQ ID NO: 661949 - RNA, 64 nt, Homo Sapiens; identical to SEQ ID NO: 333362

SEQ ID NO: 661950 - RNA, 64 nt, Homo Sapiens; identical to SEQ ID NO: 333363

SEQ ID NO: 661951 - RNA, 64 nt, Homo Sapiens; identical to SEQ ID NO: 333364

SEQ ID NO: 661952 - RNA, 64 nt, Homo Sapiens; identical to SEQ ID NO: 333365

SEQ ID NO: 661953 - RNA, 64 nt, Homo Sapiens; identical to SEQ ID NO: 333366

SEQ ID NO: 661954 - RNA, 64 nt, Homo Sapiens; identical to SEQ ID NO: 333367

SEQ ID NO: 661955 - RNA, 64 nt, Homo Sapiens; identical to SEQ ID NO: 333368

SEQ ID NO: 661956 - RNA, 64 nt, Homo Sapiens; identical to SEQ ID NO: 333369

SEQ ID NO: 661957 - RNA, 64 nt, Homo Sapiens; identical to SEQ ID NO: 333370

SEQ ID NO: 661958 - RNA, 64 nt, Homo Sapiens; identical to SEQ ID NO: 333371

SEQ ID NO: 661959 - RNA, 64 nt, Homo Sapiens; identical to SEQ ID NO: 333372

SEQ ID NO: 661960 - RNA, 64 nt, Homo Sapiens; identical to SEQ ID NO: 333373

SEQ ID NO: 661961 - RNA, 64 nt, Homo Sapiens; identical to SEQ ID NO: 333374

SEQ ID NO: 661962 - RNA, 64 nt, Homo Sapiens; identical to SEQ ID NO: 333375

SEQ ID NO: 661963 - RNA, 64 nt, Homo Sapiens; identical to SEQ ID NO: 333376

SEQ ID NO: 661964 - RNA, 64 nt, Homo Sapiens; identical to SEQ ID NO: 333377

SEQ ID NO: 661965 - RNA, 64 nt, Homo Sapiens; identical to SEQ ID NO: 333378

SEQ ID NO: 661966 - RNA, 64 nt, Homo Sapiens; identical to SEQ ID NO: 333379

SEQ ID NO: 661967 - RNA, 64 nt, Homo Sapiens; identical to SEQ ID NO: 333380

SEQ ID NO: 661968 - RNA, 64 nt, Homo Sapiens; identical to SEQ ID NO: 333381

SEQ ID NO: 661969 - RNA, 64 nt, Homo Sapiens; identical to SEQ ID NO: 333382

SEQ ID NO: 661970 - RNA, 64 nt, Homo Sapiens; identical to SEQ ID NO: 333383

SEQ ID NO: 661971 - RNA, 64 nt, Homo Sapiens; identical to SEQ ID NO: 333384

SEQ ID NO: 661972 - RNA, 64 nt, Homo Sapiens; identical to SEQ ID NO: 333385

SEQ ID NO: 661973 - RNA, 64 nt, Homo Sapiens; identical to SEQ ID NO: 333386

SEQ ID NO: 661974 - RNA, 64 nt, Homo Sapiens; identical to SEQ ID NO: 333387

SEQ ID NO: 661975 - RNA, 64 nt, Homo Sapiens; identical to SEQ ID NO: 333388

SEQ ID NO: 661976 - RNA, 64 nt, Homo Sapiens; identical to SEQ ID NO: 333389

SEQ ID NO: 661977 - RNA, 64 nt, Homo Sapiens; identical to SEQ ID NO: 333390

SEQ ID NO: 661978 - RNA, 64 nt, Homo Sapiens; identical to SEQ ID NO: 333391

SEQ ID NO: 661979 - RNA, 64 nt, Homo Sapiens; identical to SEQ ID NO: 333392

SEQ ID NO: 661980 - RNA, 64 nt, Homo Sapiens; identical to SEQ ID NO: 333393

SEQ ID NO: 661981 - RNA, 64 nt, Homo Sapiens; identical to SEQ ID NO: 333394

SEQ ID NO: 661982 - RNA, 64 nt, Homo Sapiens; identical to SEQ ID NO: 333395

SEQ ID NO: 661983 - RNA, 64 nt, Homo Sapiens; identical to SEQ ID NO: 333396

SEQ ID NO: 661984 - RNA, 64 nt, Homo Sapiens; identical to SEQ ID NO: 333397

SEQ ID NO: 661985 - RNA, 64 nt, Homo Sapiens; identical to SEQ ID NO: 333398

SEQ ID NO: 661986 - RNA, 64 nt, Homo Sapiens; identical to SEQ ID NO: 333399

SEQ ID NO: 661987 - RNA, 64 nt, Homo Sapiens; identical to SEQ ID NO: 333400

SEQ ID NO: 661988 - RNA, 64 nt, Homo Sapiens; identical to SEQ ID NO: 333401

SEQ ID NO: 661989 - RNA, 64 nt, Homo Sapiens; identical to SEQ ID NO: 333402

SEQ ID NO: 661990 - RNA, 64 nt, Homo Sapiens; identical to SEQ ID NO: 333403

SEQ ID NO: 661991 - RNA, 64 nt, Homo Sapiens; identical to SEQ ID NO: 333404

SEQ ID NO: 661992 - RNA, 64 nt, Homo Sapiens; identical to SEQ ID NO: 333405

SEQ ID NO: 661993 - RNA, 64 nt, Homo Sapiens; identical to SEQ ID NO: 333406

SEQ ID NO: 661994 - RNA, 64 nt, Homo Sapiens; identical to SEQ ID NO: 333407

SEQ ID NO: 661995 - RNA, 64 nt, Homo Sapiens; identical to SEQ ID NO: 333408

SEQ ID NO: 661996 - RNA, 64 nt, Homo Sapiens; identical to SEQ ID NO: 333409

SEQ ID NO: 661997 - RNA, 64 nt, Homo Sapiens; identical to SEQ ID NO: 333410

SEQ ID NO: 661998 - RNA, 64 nt, Homo Sapiens; identical to SEQ ID NO: 333411

SEQ ID NO: 661999 - RNA, 64 nt, Homo Sapiens; identical to SEQ ID NO: 333412

SEQ ID NO: 662000 - RNA, 64 nt, Homo Sapiens; identical to SEQ ID NO: 333413

SEQ ID NO: 662001 - RNA, 64 nt, Homo Sapiens; identical to SEQ ID NO: 333414

SEQ ID NO: 662002 - RNA, 64 nt, Homo Sapiens; identical to SEQ ID NO: 333415

SEQ ID NO: 662003 - RNA, 64 nt, Homo Sapiens; identical to SEQ ID NO: 333416

SEQ ID NO: 662004 - RNA, 64 nt, Homo Sapiens; identical to SEQ ID NO: 333417

SEQ ID NO: 662005 - RNA, 64 nt, Homo Sapiens; identical to SEQ ID NO: 333418

SEQ ID NO: 662006 - RNA, 64 nt, Homo Sapiens; identical to SEQ ID NO: 333419

SEQ ID NO: 662007 - RNA, 64 nt, Homo Sapiens; identical to SEQ ID NO: 333420

SEQ ID NO: 662008 - RNA, 64 nt, Homo Sapiens; identical to SEQ ID NO: 333421

SEQ ID NO: 662009 - RNA, 64 nt, Homo Sapiens; identical to SEQ ID NO: 333422

SEQ ID NO: 662010 - RNA, 64 nt, Homo Sapiens; identical to SEQ ID NO: 333423

SEQ ID NO: 662011 - RNA, 64 nt, Homo Sapiens; identical to SEQ ID NO: 333424

SEQ ID NO: 662012 - RNA, 64 nt, Homo Sapiens; identical to SEQ ID NO: 333425

SEQ ID NO: 662013 - RNA, 64 nt, Homo Sapiens; identical to SEQ ID NO: 333426

SEQ ID NO: 662014 - RNA, 64 nt, Homo Sapiens; identical to SEQ ID NO: 333427

SEQ ID NO: 662015 - RNA, 64 nt, Homo Sapiens; identical to SEQ ID NO: 333428

SEQ ID NO: 662016 - RNA, 64 nt, Homo Sapiens; identical to SEQ ID NO: 333429

SEQ ID NO: 662017 - RNA, 64 nt, Homo Sapiens; identical to SEQ ID NO: 333430

SEQ ID NO: 662018 - RNA, 64 nt, Homo Sapiens; identical to SEQ ID NO: 333431

SEQ ID NO: 662019 - RNA, 64 nt, Homo Sapiens; identical to SEQ ID NO: 333432

SEQ ID NO: 662020 - RNA, 64 nt, Homo Sapiens; identical to SEQ ID NO: 333433

SEQ ID NO: 662021 - RNA, 64 nt, Homo Sapiens; identical to SEQ ID NO: 333434

SEQ ID NO: 662022 - RNA, 64 nt, Homo Sapiens; identical to SEQ ID NO: 333435

SEQ ID NO: 662023 - RNA, 64 nt, Homo Sapiens; identical to SEQ ID NO: 333436

SEQ ID NO: 662024 - RNA, 64 nt, Homo Sapiens; identical to SEQ ID NO: 333437

SEQ ID NO: 662025 - RNA, 64 nt, Homo Sapiens; identical to SEQ ID NO: 333438

SEQ ID NO: 662026 - RNA, 64 nt, Homo Sapiens; identical to SEQ ID NO: 333439

SEQ ID NO: 662027 - RNA, 64 nt, Homo Sapiens; identical to SEQ ID NO: 333440

SEQ ID NO: 662028 - RNA, 64 nt, Homo Sapiens; identical to SEQ ID NO: 333441

SEQ ID NO: 662029 - RNA, 64 nt, Homo Sapiens; identical to SEQ ID NO: 333442

SEQ ID NO: 662030 - RNA, 64 nt, Homo Sapiens; identical to SEQ ID NO: 333443

SEQ ID NO: 662031 - RNA, 64 nt, Homo Sapiens; identical to SEQ ID NO: 333444

SEQ ID NO: 662032 - RNA, 64 nt, Homo Sapiens; identical to SEQ ID NO: 333445

SEQ ID NO: 662033 - RNA, 64 nt, Homo Sapiens; identical to SEQ ID NO: 333446

SEQ ID NO: 662034 - RNA, 64 nt, Homo Sapiens; identical to SEQ ID NO: 333447

SEQ ID NO: 662035 - RNA, 64 nt, Homo Sapiens; identical to SEQ ID NO: 333448

SEQ ID NO: 662036 - RNA, 64 nt, Homo Sapiens; identical to SEQ ID NO: 333449

SEQ ID NO: 662037 - RNA, 64 nt, Homo Sapiens; identical to SEQ ID NO: 333450

SEQ ID NO: 662038 - RNA, 64 nt, Homo Sapiens; identical to SEQ ID NO: 333451

SEQ ID NO: 662039 - RNA, 64 nt, Homo Sapiens; identical to SEQ ID NO: 333452

SEQ ID NO: 662040 - RNA, 64 nt, Homo Sapiens; identical to SEQ ID NO: 333453

SEQ ID NO: 662041 - RNA, 64 nt, Homo Sapiens; identical to SEQ ID NO: 333454

SEQ ID NO: 662042 - RNA, 55 nt, Homo Sapiens; identical to SEQ ID NO: 333455

SEQ ID NO: 662043 - RNA, 64 nt, Homo Sapiens; identical to SEQ ID NO: 333456

SEQ ID NO: 662044 - RNA, 64 nt, Homo Sapiens; identical to SEQ ID NO: 333457

SEQ ID NO: 662045 - RNA, 64 nt, Homo Sapiens; identical to SEQ ID NO: 333458

SEQ ID NO: 662046 - RNA, 64 nt, Homo Sapiens; identical to SEQ ID NO: 237342

SEQ ID NO: 662047 - RNA, 64 nt, Homo Sapiens; identical to SEQ ID NO: 237343

SEQ ID NO: 662048 - RNA, 64 nt, Homo Sapiens; identical to SEQ ID NO: 237344

SEQ ID NO: 662049 - RNA, 64 nt, Homo Sapiens; identical to SEQ ID NO: 237345

SEQ ID NO: 662050 - RNA, 64 nt, Homo Sapiens; identical to SEQ ID NO: 237346

SEQ ID NO: 662051 - RNA, 64 nt, Homo Sapiens; identical to SEQ ID NO: 237347

SEQ ID NO: 662052 - RNA, 64 nt, Homo Sapiens; identical to SEQ ID NO: 237348

SEQ ID NO: 662053 - RNA, 64 nt, Homo Sapiens; identical to SEQ ID NO: 237349

SEQ ID NO: 662054 - RNA, 64 nt, Homo Sapiens; identical to SEQ ID NO: 237350

SEQ ID NO: 662055 - RNA, 64 nt, Homo Sapiens; identical to SEQ ID NO: 237351

SEQ ID NO: 662056 - RNA, 64 nt, Homo Sapiens; identical to SEQ ID NO: 237352

SEQ ID NO: 662057 - RNA, 64 nt, Homo Sapiens; identical to SEQ ID NO: 237353

SEQ ID NO: 662058 - RNA, 64 nt, Homo Sapiens; identical to SEQ ID NO: 333348

SEQ ID NO: 662059 - RNA, 64 nt, Homo Sapiens; identical to SEQ ID NO: 333349

SEQ ID NO: 662060 - RNA, 64 nt, Homo Sapiens; identical to SEQ ID NO: 333350

SEQ ID NO: 662061 - RNA, 64 nt, Homo Sapiens; identical to SEQ ID NO: 333351

SEQ ID NO: 662062 - RNA, 64 nt, Homo Sapiens; identical to SEQ ID NO: 333352

SEQ ID NO: 662063 - RNA, 64 nt, Homo Sapiens; identical to SEQ ID NO: 333353

SEQ ID NO: 662064 - RNA, 64 nt, Homo Sapiens; identical to SEQ ID NO: 333354

SEQ ID NO: 662065 - RNA, 64 nt, Homo Sapiens; identical to SEQ ID NO: 333355

SEQ ID NO: 662066 - RNA, 64 nt, Homo Sapiens; identical to SEQ ID NO: 333356

SEQ ID NO: 662067 - RNA, 64 nt, Homo Sapiens; identical to SEQ ID NO: 333357

SEQ ID NO: 662068 - RNA, 64 nt, Homo Sapiens; identical to SEQ ID NO: 333358

SEQ ID NO: 662069 - RNA, 64 nt, Homo Sapiens; identical to SEQ ID NO: 333359

SEQ ID NO: 662070 - RNA, 64 nt, Homo Sapiens; identical to SEQ ID NO: 333360

SEQ ID NO: 662071 - RNA, 64 nt, Homo Sapiens; identical to SEQ ID NO: 333361

SEQ ID NO: 662072 - RNA, 64 nt, Homo Sapiens; identical to SEQ ID NO: 333362

SEQ ID NO: 662073 - RNA, 64 nt, Homo Sapiens; identical to SEQ ID NO: 333363

SEQ ID NO: 662074 - RNA, 64 nt, Homo Sapiens; identical to SEQ ID NO: 333364

SEQ ID NO: 662075 - RNA, 64 nt, Homo Sapiens; identical to SEQ ID NO: 333365

SEQ ID NO: 662076 - RNA, 64 nt, Homo Sapiens; identical to SEQ ID NO: 333366

SEQ ID NO: 662077 - RNA, 64 nt, Homo Sapiens; identical to SEQ ID NO: 333367

SEQ ID NO: 662078 - RNA, 64 nt, Homo Sapiens; identical to SEQ ID NO: 333368

SEQ ID NO: 662079 - RNA, 64 nt, Homo Sapiens; identical to SEQ ID NO: 333369

SEQ ID NO: 662080 - RNA, 64 nt, Homo Sapiens; identical to SEQ ID NO: 333370

SEQ ID NO: 662081 - RNA, 64 nt, Homo Sapiens; identical to SEQ ID NO: 333371

SEQ ID NO: 662082 - RNA, 64 nt, Homo Sapiens; identical to SEQ ID NO: 333372

SEQ ID NO: 662083 - RNA, 64 nt, Homo Sapiens; identical to SEQ ID NO: 333373

SEQ ID NO: 662084 - RNA, 64 nt, Homo Sapiens; identical to SEQ ID NO: 333374

SEQ ID NO: 662085 - RNA, 64 nt, Homo Sapiens; identical to SEQ ID NO: 333375

SEQ ID NO: 662086 - RNA, 64 nt, Homo Sapiens; identical to SEQ ID NO: 333376

SEQ ID NO: 662087 - RNA, 64 nt, Homo Sapiens; identical to SEQ ID NO: 333377

SEQ ID NO: 662088 - RNA, 64 nt, Homo Sapiens; identical to SEQ ID NO: 333378

SEQ ID NO: 662089 - RNA, 64 nt, Homo Sapiens; identical to SEQ ID NO: 333379

SEQ ID NO: 662090 - RNA, 64 nt, Homo Sapiens; identical to SEQ ID NO: 333380

SEQ ID NO: 662091 - RNA, 64 nt, Homo Sapiens; identical to SEQ ID NO: 333381

SEQ ID NO: 662092 - RNA, 64 nt, Homo Sapiens; identical to SEQ ID NO: 333382

SEQ ID NO: 662093 - RNA, 64 nt, Homo Sapiens; identical to SEQ ID NO: 333383

SEQ ID NO: 662094 - RNA, 64 nt, Homo Sapiens; identical to SEQ ID NO: 333384

SEQ ID NO: 662095 - RNA, 64 nt, Homo Sapiens; identical to SEQ ID NO: 333385

SEQ ID NO: 662096 - RNA, 64 nt, Homo Sapiens; identical to SEQ ID NO: 333386

SEQ ID NO: 662097 - RNA, 64 nt, Homo Sapiens; identical to SEQ ID NO: 333387

SEQ ID NO: 662098 - RNA, 64 nt, Homo Sapiens; identical to SEQ ID NO: 333388

SEQ ID NO: 662099 - RNA, 64 nt, Homo Sapiens; identical to SEQ ID NO: 333389

SEQ ID NO: 662100 - RNA, 64 nt, Homo Sapiens; identical to SEQ ID NO: 333390

SEQ ID NO: 662101 - RNA, 64 nt, Homo Sapiens; identical to SEQ ID NO: 333391

SEQ ID NO: 662102 - RNA, 64 nt, Homo Sapiens; identical to SEQ ID NO: 333392

SEQ ID NO: 662103 - RNA, 64 nt, Homo Sapiens; identical to SEQ ID NO: 333393

SEQ ID NO: 662104 - RNA, 64 nt, Homo Sapiens; identical to SEQ ID NO: 333394

SEQ ID NO: 662105 - RNA, 64 nt, Homo Sapiens; identical to SEQ ID NO: 333395

SEQ ID NO: 662106 - RNA, 64 nt, Homo Sapiens; identical to SEQ ID NO: 333396

SEQ ID NO: 662107 - RNA, 64 nt, Homo Sapiens; identical to SEQ ID NO: 333397

SEQ ID NO: 662108 - RNA, 64 nt, Homo Sapiens; identical to SEQ ID NO: 333398

SEQ ID NO: 662109 - RNA, 64 nt, Homo Sapiens; identical to SEQ ID NO: 333399

SEQ ID NO: 662110 - RNA, 64 nt, Homo Sapiens; identical to SEQ ID NO: 333400

SEQ ID NO: 662111 - RNA, 64 nt, Homo Sapiens; identical to SEQ ID NO: 333401

SEQ ID NO: 662112 - RNA, 64 nt, Homo Sapiens; identical to SEQ ID NO: 333402

SEQ ID NO: 662113 - RNA, 64 nt, Homo Sapiens; identical to SEQ ID NO: 333403

SEQ ID NO: 662114 - RNA, 64 nt, Homo Sapiens; identical to SEQ ID NO: 333404

SEQ ID NO: 662115 - RNA, 64 nt, Homo Sapiens; identical to SEQ ID NO: 333405

SEQ ID NO: 662116 - RNA, 64 nt, Homo Sapiens; identical to SEQ ID NO: 333406

SEQ ID NO: 662117 - RNA, 64 nt, Homo Sapiens; identical to SEQ ID NO: 333407

SEQ ID NO: 662118 - RNA, 64 nt, Homo Sapiens; identical to SEQ ID NO: 333408

SEQ ID NO: 662119 - RNA, 64 nt, Homo Sapiens; identical to SEQ ID NO: 333409

SEQ ID NO: 662120 - RNA, 64 nt, Homo Sapiens; identical to SEQ ID NO: 333410

SEQ ID NO: 662121 - RNA, 64 nt, Homo Sapiens; identical to SEQ ID NO: 333411

SEQ ID NO: 662122 - RNA, 64 nt, Homo Sapiens; identical to SEQ ID NO: 333412

SEQ ID NO: 662123 - RNA, 64 nt, Homo Sapiens; identical to SEQ ID NO: 333413

SEQ ID NO: 662124 - RNA, 64 nt, Homo Sapiens; identical to SEQ ID NO: 333414

SEQ ID NO: 662125 - RNA, 64 nt, Homo Sapiens; identical to SEQ ID NO: 333415

SEQ ID NO: 662126 - RNA, 64 nt, Homo Sapiens; identical to SEQ ID NO: 333416

SEQ ID NO: 662127 - RNA, 64 nt, Homo Sapiens; identical to SEQ ID NO: 333417

SEQ ID NO: 662128 - RNA, 64 nt, Homo Sapiens; identical to SEQ ID NO: 333418

SEQ ID NO: 662129 - RNA, 64 nt, Homo Sapiens; identical to SEQ ID NO: 333419

SEQ ID NO: 662130 - RNA, 64 nt, Homo Sapiens; identical to SEQ ID NO: 333420

SEQ ID NO: 662131 - RNA, 64 nt, Homo Sapiens; identical to SEQ ID NO: 333421

SEQ ID NO: 662132 - RNA, 64 nt, Homo Sapiens; identical to SEQ ID NO: 333422

SEQ ID NO: 662133 - RNA, 64 nt, Homo Sapiens; identical to SEQ ID NO: 333423

SEQ ID NO: 662134 - RNA, 64 nt, Homo Sapiens; identical to SEQ ID NO: 333424

SEQ ID NO: 662135 - RNA, 64 nt, Homo Sapiens; identical to SEQ ID NO: 333425

SEQ ID NO: 662136 - RNA, 64 nt, Homo Sapiens; identical to SEQ ID NO: 333426

SEQ ID NO: 662137 - RNA, 64 nt, Homo Sapiens; identical to SEQ ID NO: 333427

SEQ ID NO: 662138 - RNA, 64 nt, Homo Sapiens; identical to SEQ ID NO: 333428

SEQ ID NO: 662139 - RNA, 64 nt, Homo Sapiens; identical to SEQ ID NO: 333429

SEQ ID NO: 662140 - RNA, 64 nt, Homo Sapiens; identical to SEQ ID NO: 333430

SEQ ID NO: 662141 - RNA, 64 nt, Homo Sapiens; identical to SEQ ID NO: 333431

SEQ ID NO: 662142 - RNA, 64 nt, Homo Sapiens; identical to SEQ ID NO: 333432

SEQ ID NO: 662143 - RNA, 64 nt, Homo Sapiens; identical to SEQ ID NO: 333433

SEQ ID NO: 662144 - RNA, 64 nt, Homo Sapiens; identical to SEQ ID NO: 333434

SEQ ID NO: 662145 - RNA, 64 nt, Homo Sapiens; identical to SEQ ID NO: 333435

SEQ ID NO: 662146 - RNA, 64 nt, Homo Sapiens; identical to SEQ ID NO: 333436

SEQ ID NO: 662147 - RNA, 64 nt, Homo Sapiens; identical to SEQ ID NO: 333437

SEQ ID NO: 662148 - RNA, 64 nt, Homo Sapiens; identical to SEQ ID NO: 333438

SEQ ID NO: 662149 - RNA, 64 nt, Homo Sapiens; identical to SEQ ID NO: 333439

SEQ ID NO: 662150 - RNA, 64 nt, Homo Sapiens; identical to SEQ ID NO: 333440

SEQ ID NO: 662151 - RNA, 64 nt, Homo Sapiens; identical to SEQ ID NO: 333441

SEQ ID NO: 662152 - RNA, 64 nt, Homo Sapiens; identical to SEQ ID NO: 333442

SEQ ID NO: 662153 - RNA, 64 nt, Homo Sapiens; identical to SEQ ID NO: 333443

SEQ ID NO: 662154 - RNA, 64 nt, Homo Sapiens; identical to SEQ ID NO: 333444

SEQ ID NO: 662155 - RNA, 64 nt, Homo Sapiens; identical to SEQ ID NO: 333445

SEQ ID NO: 662156 - RNA, 64 nt, Homo Sapiens; identical to SEQ ID NO: 333446

SEQ ID NO: 662157 - RNA, 64 nt, Homo Sapiens; identical to SEQ ID NO: 333447

SEQ ID NO: 662158 - RNA, 64 nt, Homo Sapiens; identical to SEQ ID NO: 333448

SEQ ID NO: 662159 - RNA, 64 nt, Homo Sapiens; identical to SEQ ID NO: 333449

SEQ ID NO: 662160 - RNA, 64 nt, Homo Sapiens; identical to SEQ ID NO: 333450

SEQ ID NO: 662161 - RNA, 64 nt, Homo Sapiens; identical to SEQ ID NO: 333451

SEQ ID NO: 662162 - RNA, 64 nt, Homo Sapiens; identical to SEQ ID NO: 333452

SEQ ID NO: 662163 - RNA, 64 nt, Homo Sapiens; identical to SEQ ID NO: 333453

SEQ ID NO: 662164 - RNA, 64 nt, Homo Sapiens; identical to SEQ ID NO: 333454

SEQ ID NO: 662165 - RNA, 55 nt, Homo Sapiens; identical to SEQ ID NO: 333455

SEQ ID NO: 662166 - RNA, 64 nt, Homo Sapiens; identical to SEQ ID NO: 333456

SEQ ID NO: 662167 - RNA, 64 nt, Homo Sapiens; identical to SEQ ID NO: 333457

SEQ ID NO: 662168 - RNA, 64 nt, Homo Sapiens; identical to SEQ ID NO: 333458

SEQ ID NO: 662169 - RNA, 63 nt, Homo Sapiens; identical to SEQ ID NO: 129380

SEQ ID NO: 662170 - RNA, 63 nt, Homo Sapiens; identical to SEQ ID NO: 129381

SEQ ID NO: 662171 - RNA, 64 nt, Homo Sapiens; identical to SEQ ID NO: 532305

SEQ ID NO: 662172 - RNA, 64 nt, Homo Sapiens; identical to SEQ ID NO: 532306

SEQ ID NO: 662173 - RNA, 64 nt, Homo Sapiens; identical to SEQ ID NO: 532307

SEQ ID NO: 662174 - RNA, 64 nt, Homo Sapiens; identical to SEQ ID NO: 532308

SEQ ID NO: 662175 - RNA, 64 nt, Homo Sapiens; identical to SEQ ID NO: 532309

SEQ ID NO: 662176 - RNA, 57 nt, Homo Sapiens; identical to SEQ ID NO: 83127

SEQ ID NO: 662177 - RNA, 64 nt, Homo Sapiens; identical to SEQ ID NO: 532311

SEQ ID NO: 662178 - RNA, 64 nt, Homo Sapiens; identical to SEQ ID NO: 532312

SEQ ID NO: 662179 - RNA, 64 nt, Homo Sapiens; identical to SEQ ID NO: 532313

SEQ ID NO: 662180 - RNA, 64 nt, Homo Sapiens; identical to SEQ ID NO: 532314

SEQ ID NO: 662181 - RNA, 64 nt, Homo Sapiens; identical to SEQ ID NO: 532315

SEQ ID NO: 662182 - RNA, 64 nt, Homo Sapiens; identical to SEQ ID NO: 532316

SEQ ID NO: 662183 - RNA, 64 nt, Homo Sapiens; identical to SEQ ID NO: 532317

SEQ ID NO: 662184 - RNA, 64 nt, Homo Sapiens; identical to SEQ ID NO: 532318

SEQ ID NO: 662185 - RNA, 59 nt, Homo Sapiens; identical to SEQ ID NO: 83136

SEQ ID NO: 662186 - RNA, 64 nt, Homo Sapiens; identical to SEQ ID NO: 532320

SEQ ID NO: 662187 - RNA, 64 nt, Homo Sapiens; identical to SEQ ID NO: 532321

SEQ ID NO: 662188 - RNA, 64 nt, Homo Sapiens; identical to SEQ ID NO: 532322

SEQ ID NO: 662189 - RNA, 64 nt, Homo Sapiens; identical to SEQ ID NO: 532323

SEQ ID NO: 662190 - RNA, 64 nt, Homo Sapiens; identical to SEQ ID NO: 532324

SEQ ID NO: 662191 - RNA, 64 nt, Homo Sapiens; identical to SEQ ID NO: 532325

SEQ ID NO: 662192 - RNA, 64 nt, Homo Sapiens; identical to SEQ ID NO: 532326

SEQ ID NO: 662193 - RNA, 64 nt, Homo Sapiens; identical to SEQ ID NO: 532327

SEQ ID NO: 662194 - RNA, 64 nt, Homo Sapiens; identical to SEQ ID NO: 532328

SEQ ID NO: 662195 - RNA, 64 nt, Homo Sapiens; identical to SEQ ID NO: 532329

SEQ ID NO: 662196 - RNA, 64 nt, Homo Sapiens; identical to SEQ ID NO: 532330

SEQ ID NO: 662197 - RNA, 64 nt, Homo Sapiens; identical to SEQ ID NO: 532331

SEQ ID NO: 662198 - RNA, 64 nt, Homo Sapiens; identical to SEQ ID NO: 532332

SEQ ID NO: 662199 - RNA, 64 nt, Homo Sapiens; identical to SEQ ID NO: 532333

SEQ ID NO: 662200 - RNA, 64 nt, Homo Sapiens; identical to SEQ ID NO: 532334

SEQ ID NO: 662201 - RNA, 64 nt, Homo Sapiens; identical to SEQ ID NO: 532335

SEQ ID NO: 662202 - RNA, 64 nt, Homo Sapiens; identical to SEQ ID NO: 532336

SEQ ID NO: 662203 - RNA, 64 nt, Homo Sapiens; identical to SEQ ID NO: 532337

SEQ ID NO: 662204 - RNA, 64 nt, Homo Sapiens; identical to SEQ ID NO: 532338

SEQ ID NO: 662205 - RNA, 64 nt, Homo Sapiens
gcaaaucaugcagaauuugauaguucuuggcuuuuaacauuaauaagcauaaaacaaaaauagg

SEQ ID NO: 662206 - RNA, 64 nt, Homo Sapiens
agagaaaagcauaaaacaaauaugagcuauacuuuaacauuaugcuuaauuuugaaaucguaua

SEQ ID NO: 662207 - RNA, 64 nt, Homo Sapiens
cggagugcugaagcagagagcagauuuaauauaguaacauuaacaguguauuuaauugacauuu

SEQ ID NO: 662208 - RNA, 64 nt, Homo Sapiens
aaggcagagaacaaaggauguggcauaauggucuuaacauuauccaaagacuugaagcuccaug

SEQ ID NO: 662209 - RNA, 64 nt, Homo Sapiens
uggaggguugcaguuucuaauaccuaaguaaacauaacauuacucuaaguaaacauaacauuaa

SEQ ID NO: 662210 - RNA, 64 nt, Homo Sapiens
accuaaguaaacauaacauuuaccuaaguaaacauaacauuaauaaauuauugccucugauaca

SEQ ID NO: 662211 - RNA, 64 nt, Homo Sapiens
guaauaacauuuagccucuuaaaauacucaucucuaacauuaugugugaugcaguguaagaagg

SEQ ID NO: 662212 - RNA, 64 nt, Homo Sapiens
auguagaauacagaugggacuaaaaaauuaaagauaacauuauacuuggucuuguuuuaagucu

SEQ ID NO: 662213 - RNA, 64 nt, Homo Sapiens
aaugugugguaaacauucauauggccauuaauuuuaacauuaaaucguagguagggcaauguag

SEQ ID NO: 662214 - RNA, 64 nt, Homo Sapiens
uuaagcauaaaauauguaaccaggaaaagacuguuaacauuacauuuaugcaaauuaaaugccc

SEQ ID NO: 662215 - RNA, 64 nt, Homo Sapiens
aaacauuucuuuggauaaauccugcaaauacuucuaacauuauucuuugauuccagcuuuuaga

SEQ ID NO: 662216 - RNA, 64 nt, Homo Sapiens
uuaauauguacauuuggaugaugauuuuucuugauaacauuaacauuaauuuuauuuuuucaga

SEQ ID NO: 662217 - RNA, 64 nt, Homo Sapiens
uguacauuuggaugaugauuuuucuugauaacauuaacauuaauuuuauuuuuucagacauacu

SEQ ID NO: 662218 - RNA, 64 nt, Homo Sapiens
gauacucuggcauuacgcuugauuaagaaaaaauuaacauuauaugauuggguauuaauuacuu

SEQ ID NO: 662219 - RNA, 64 nt, Homo Sapiens
uauuaccacaaaacagcaaaaaauuguaugaucguaacauuauuaugauuuuucugucaucuua

SEQ ID NO: 662220 - RNA, 64 nt, Homo Sapiens
agaaaaauugucuugugccacacauacaauacacuaacauuaacaauagcugaugagcuaagaa

SEQ ID NO: 662221 - RNA, 64 nt, Homo Sapiens
ucuaaaacuucauccucuuuugucccuuucgaguuaacauuacagccacagugaccuuucaaaa

SEQ ID NO: 662222 - RNA, 64 nt, Homo Sapiens
uauauugcauagcauuacacauuuaugccuauuuuaacauuaacuucuaaagaaguuuuuucua

SEQ ID NO: 662223 - RNA, 64 nt, Homo Sapiens
uuuuuuaaaagcuguuauguugaauucaguaaaauaacauuaccuuauuuuuuuucuuauucaa

SEQ ID NO: 662224 - RNA, 64 nt, Homo Sapiens
cuuguaggauguggagaagggaaaauacggacauuaacauuaaaagacaccagugaaauuguua

SEQ ID NO: 662225 - RNA, 64 nt, Homo Sapiens
cagaaauaauuuuauauuaauauauaauacagauuaacauuauauauaauauguaccuguguca

SEQ ID NO: 662226 - RNA, 64 nt, Homo Sapiens
aacaaaaucugccagagaguguuucgacuguuuaaugaguaaucgauaaauaaugucuauacau

SEQ ID NO: 662227 - RNA, 64 nt, Homo Sapiens
uagacaaaaaaaaaagccaguaaaguguuacugcaugaguaauguuggcuguuggaaggaugua

SEQ ID NO: 662228 - RNA, 64 nt, Homo Sapiens
gaaugcccaaauccgaaugaccccaguuuuccuaaugaguaaaaugaucccagaugugccccag

SEQ ID NO: 662229 - RNA, 64 nt, Homo Sapiens
cagcucaaggcuauuagguugaauauuugcuuucaugaguaaauguggaucuuuggggaauggc

SEQ ID NO: 662230 - RNA, 64 nt, Homo Sapiens
uagugggcuucucaacuuuugauccucagcucugugguuuuaagaccacagugugacaguuccc

SEQ ID NO: 662231 - RNA, 64 nt, Homo Sapiens
auugcaguccugaugauccuaaccugcagcacggugguuuuacaauguuccagagcaggaacgc

SEQ ID NO: 662232 - RNA, 64 nt, Homo Sapiens
gcaaaauucugcaauuucaccuuaaagauacuguugguuuuacagaugcucuccaaccuauuuu

SEQ ID NO: 662233 - RNA, 64 nt, Homo Sapiens
cagcaacacccaacacugucuguuuuccauuuguugguuuuaaucauaaaauugucaagugauu

SEQ ID NO: 662234 - RNA, 64 nt, Homo Sapiens
accugcuuugcauauucacaaauauuggacauacugguuuuaauccaauuacaaacugguuuua

SEQ ID NO: 662235 - RNA, 64 nt, Homo Sapiens
uauuggacauacugguuuuaccccaauuacaaacugguuuuaaaaauuaaggauuuagaaguuc

SEQ ID NO: 662236 - RNA, 64 nt, Homo Sapiens
aaaaacuuuauggaggcuguuuguccucucaauaugguuuuaagauugaaaguaagaaaacgga

SEQ ID NO: 662237 - RNA, 64 nt, Homo Sapiens
aucacuugcccucugaagcuuauuuuugcuucuuugguuuuaagaauugagaaauaucacauug

SEQ ID NO: 662238 - RNA, 64 nt, Homo Sapiens
cccuuaaaccgcccagaggagcccuauuccacucugguuuuaggcugaucugagagggucuccc

SEQ ID NO: 662239 - RNA, 64 nt, Homo Sapiens
cuguaacauuccugaagcuguucccacucccagaugguuuuaucaauagccuagagguaaagaa

SEQ ID NO: 662240 - RNA, 64 nt, Homo Sapiens
uucagauaaaucuaggcaggauacugcauuuuugugguuuuaaaaaaguccuuaggacagacug

SEQ ID NO: 662241 - RNA, 64 nt, Homo Sapiens
uuaugaugcaaaugauuauguugucugaaaggugugguuuuauugaaugucuauuugaguauca

SEQ ID NO: 662242 - RNA, 64 nt, Homo Sapiens
agcaggugaaaaauaaaacgcaguucaaauuucaugguuuuaauuuucaacucagaagcacuca

SEQ ID NO: 662243 - RNA, 64 nt, Homo Sapiens
uaccacuuucaucugcugaaaggacaaaugugcuugguuuuacuauuauguaaucacaacuuac

SEQ ID NO: 662244 - RNA, 64 nt, Homo Sapiens
uagcagcaaguugugaucaccacuguucuauuguugguuuuaauugauggacuucaauuguacu

SEQ ID NO: 662245 - RNA, 64 nt, Homo Sapiens
ggucagaguuccgacugccaucaucuaagccuucugguuuuaugguuucccuucuuuuuguucu

SEQ ID NO: 662246 - RNA, 64 nt, Homo Sapiens
cucaguguauuuaauuucaaauuguuuuuuuaauugguuuuaugcugcuuuguuaggacagaug

SEQ ID NO: 662247 - RNA, 64 nt, Homo Sapiens
ggcuagucuuauugucacuauguaaguaauccaaugguuuuagaaacuaaacuuucuagagcaa

SEQ ID NO: 662248 - RNA, 64 nt, Homo Sapiens
uuuuaauuuccauucuuaauaaaaauauuuaucuugguuuuacauuuuuuuuaguccaaaagcc

SEQ ID NO: 662249 - RNA, 64 nt, Homo Sapiens
agugucaauuuuuguaaaauaaagauaaucauguugguuuuaaugcucaguuauuggaugagug

SEQ ID NO: 662250 - RNA, 64 nt, Homo Sapiens
acuggcauugaagguacccaugaaauuauuucauugguuuuagacuguaaaaaaauacuacauu

SEQ ID NO: 662251 - RNA, 64 nt, Homo Sapiens
uguugacaauauuuacaaguguguuucauuaacuugguuuuaaauagcuuugauuuucucacug

SEQ ID NO: 662252 - RNA, 64 nt, Homo Sapiens
uucccucucaucgccagacaacugacgauuucccugguuuuagucugcgucucugcuuuaaagu

SEQ ID NO: 662253 - RNA, 64 nt, Homo Sapiens
uccuacugauguuccuuuggaagaaaaaaucugcugguuuuaacaacugugcuuuugcuaugua

SEQ ID NO: 662254 - RNA, 64 nt, Homo Sapiens
uuauuuauugcuuuuucaaugugcagccaguggaugguuuuaguucuuucagaugaacugccau

SEQ ID NO: 662255 - RNA, 64 nt, Homo Sapiens
augagcaaguaucuuaggguaguagguagccuggugguuuuagaaguguuuggugauuuuuaug

SEQ ID NO: 662256 - RNA, 64 nt, Homo Sapiens
acaagaaugaagucauuuuggcuggcuccagugcugguuuuagauuauaaaccacucuucaaca

SEQ ID NO: 662257 - RNA, 64 nt, Homo Sapiens
aacaaacccaaauccuggauguuacuuuauaaggugguuuuauugcagagcuauagucucaauu

SEQ ID NO: 662258 - RNA, 64 nt, Homo Sapiens
ccuugugcucuacuccuuccauuugaugucguacugguuuuaaauaggaauucacuguguuuuc

SEQ ID NO: 662259 - RNA, 64 nt, Homo Sapiens; identical to SEQ ID NO: 662258

SEQ ID NO: 662260 - RNA, 64 nt, Homo Sapiens
uguuuuuaauuuuguaaaagcugccacuugggccugguuuuagacagaaauggagggacucaag

SEQ ID NO: 662261 - RNA, 64 nt, Homo Sapiens
aacacggguggcaagcagaugccugggucccccaugguuuuagcuaguccucaucugagucuca

SEQ ID NO: 662262 - RNA, 64 nt, Homo Sapiens
gauuuuaauaauauauuuuaauaucuuguuuuggugguuuuaguuuuuaguuuaaaaaccuugu

SEQ ID NO: 662263 - RNA, 64 nt, Homo Sapiens
cuguauuuccccaacauguagugauauuuccccaugguuuuaauauuauuccuguggauguaaa

SEQ ID NO: 662264 - RNA, 64 nt, Homo Sapiens
aacaauaaacacucauuaaccuguaaauguacuaugguuuuauuuacaauaauguugucacuua

SEQ ID NO: 662265 - RNA, 64 nt, Homo Sapiens
ggccaaaguaaauggguggaucuuguuuugcugcugguuuuagguguguaggaauggccucagc

SEQ ID NO: 662266 - RNA, 64 nt, Homo Sapiens
cuuguuuugagccuguucucuaagaagauaggauugguuuuagcccaaacucugcuucuauggu

SEQ ID NO: 662267 - RNA, 64 nt, Homo Sapiens
uucuaugguagggcaugaggacaacuauucagcaugguuuuagcuucuuggagaugauuccaac

SEQ ID NO: 662268 - RNA, 64 nt, Homo Sapiens
uauauaaaaaguauaauuuuucuauuuuuguuuuugguuuuaauuugcagagauuugcugccag

SEQ ID NO: 662269 - RNA, 64 nt, Homo Sapiens
ccuuaauaauuagucucuuggcuuaaauguccacugguuuuacuuugacacaguugaacaacac

SEQ ID NO: 662270 - RNA, 64 nt, Homo Sapiens
gcguaacucagauauuaaugggcuguguauuaaaugguuuuauuuucaguuuugcagcacagaa

SEQ ID NO: 662271 - RNA, 64 nt, Homo Sapiens
aagaaacauaugucugcgugcuacuuuacaauguugguuuuaaagauaagcacauggguaaaaa

SEQ ID NO: 662272 - RNA, 64 nt, Homo Sapiens
uacuccaucugacuacgacuaagagagugaggggugguuuuaaugaacccucuaagcucucuca

SEQ ID NO: 662273 - RNA, 64 nt, Homo Sapiens
ccaauauuauaugcagaaauaaaaguauuuuuacugguuuuauagggaaguaaacgcuuuuuuu

SEQ ID NO: 662274 - RNA, 64 nt, Homo Sapiens
gauauguguaauuggaagaguaaggcaaaaggccugguuuuagaaucaaaaagaaaauugagcu

SEQ ID NO: 662275 - RNA, 64 nt, Homo Sapiens
gagucacaguucuuucuuggauguuguuaaaaugugguuuuauuuuuauaauaacaaaaucucc

SEQ ID NO: 662276 - RNA, 64 nt, Homo Sapiens
uuaaaccuuguagccuaacaucacauuuguaaauugguuuuauguauuggaccacuacugcuuu

SEQ ID NO: 662277 - RNA, 64 nt, Homo Sapiens
aucugugagugaaaguugccauuauucuauguagugguuuuaggauacuuaacaaauacauuca

SEQ ID NO: 662278 - RNA, 64 nt, Homo Sapiens
ggguuuuuguuuuguuuugggguuuuguuuuguuugguuuuacauuuuaguuacugaagccuua

SEQ ID NO: 662279 - RNA, 64 nt, Homo Sapiens
aaauccaacaacaacaacaacaaaacaauguucuugguuuuaauguuccaguugcugugaaaua

SEQ ID NO: 662280 - RNA, 64 nt, Homo Sapiens
uugaaaauauuucuaguuuuguagccaaagcaauugguuuuaguaaaaugagacuucuucagga

SEQ ID NO: 662281 - RNA, 64 nt, Homo Sapiens
uugggaauaaucauucauuaagaaguuucuuuucugguuuuaguuuuauaacuaauuuuaaaag

SEQ ID NO: 662282 - RNA, 64 nt, Homo Sapiens
aacccaaguuccucuaagcaguccaagacauagcugguuuuagaaucauccucauuuuggggca

SEQ ID NO: 662283 - RNA, 64 nt, Homo Sapiens
caaauuaauuuaguaaucuugguuuuaggugaauugguuuuaggauauuuauuuuagacuaauu

SEQ ID NO: 662284 - RNA, 64 nt, Homo Sapiens
ugaauugguuuuaggcaaauuauuuuagacuaauugguuuuaggcugcagauuugauaaauauu

SEQ ID NO: 662285 - RNA, 64 nt, Homo Sapiens
agcuuuguguguguccucuuggggauggggauucugguuuuauuuuuguucccaugaguuuugu

SEQ ID NO: 662286 - RNA, 64 nt, Homo Sapiens
ccuaugauggaauucuaaugaagcaguauuguccugguuuuaaaguuuuuuuuaaauaaaggaa

SEQ ID NO: 662287 - RNA, 64 nt, Homo Sapiens
uaaaaaguaaauguauuugcuugauauuauacuuugguuuuaucgcuuuugguuuaaaaguuaa

SEQ ID NO: 662288 - RNA, 64 nt, Homo Sapiens
uugcauuuccaauggcuaauaaugauaccacaugugguuuuaauccauucacauagaugugugu

SEQ ID NO: 662289 - RNA, 64 nt, Homo Sapiens
ugcuucauaaugauucuuuuuccaucuuaaaauaugguuuuacuauuaagagccaagaucaugc

SEQ ID NO: 662290 - RNA, 64 nt, Homo Sapiens
uuuugcugaaauacucagguaauugagauagcaaugguuuuauggcaugaauuauccaaaaaaa

SEQ ID NO: 662291 - RNA, 64 nt, Homo Sapiens
uguagcuaacgguugccuugaggaagaaauaauuugguuuuauuaagagucuacucucaaucca

SEQ ID NO: 662292 - RNA, 64 nt, Homo Sapiens
cugcaauuacuuuuuuaaaggcacuuuuacucuuugguuuuaucauuccauuuugcuaauauuu

SEQ ID NO: 662293 - RNA, 64 nt, Homo Sapiens
cucugugcugggcuuugguaugguaacucuuuggugguuuuaugaugcuuacaaacuugagcuu

SEQ ID NO: 662294 - RNA, 64 nt, Homo Sapiens
uuugucuuauuaacacauguauaaagguauccuuugguuuuaagucgagaacaggaauuucuuc

SEQ ID NO: 662295 - RNA, 64 nt, Homo Sapiens
aaaugacagagccuucaaaauagagaagaaaauuugguuuuagcuuaacuugaaguuguguaca

SEQ ID NO: 662296 - RNA, 64 nt, Homo Sapiens
ucuuuugcgaucccuaaauuuagaaaaguuuuuuugguuuuaucacaguguagaauaaaugugg

SEQ ID NO: 662297 - RNA, 64 nt, Homo Sapiens
gaacucagguauucuuuccugaaauuagaacuagugguuuuagauguuaccaaaacagcaauuu

SEQ ID NO: 662298 - RNA, 64 nt, Homo Sapiens
auguaggacuuaugauccaaaaaauguuuccagaugguuuuagaggauuuucagggcuaccaga

SEQ ID NO: 662299 - RNA, 64 nt, Homo Sapiens
gaaucuauagauugagauuuugaugaauuuauauugguuuuaaugagacccaaaugacucucuc

SEQ ID NO: 662300 - RNA, 64 nt, Homo Sapiens
acaaguaaaauacaaauucuugucuacuuucaugugguuuuaaauggcagggacuucgcugagu

SEQ ID NO: 662301 - RNA, 64 nt, Homo Sapiens
ugaaauucauaaauaaagaauuguucuuucuuugugguuuuaauaagaguucaagaauuguuca

SEQ ID NO: 662302 - RNA, 64 nt, Homo Sapiens
gagaguauguucucaaggaagauuuaacucucuuugguuuuaaauuacuuuuuaaccagccuaa

SEQ ID NO: 662303 - RNA, 64 nt, Homo Sapiens
auccuuagccuggucugacugagcuuguggagcuugguuuuaaauccacaggguaauucacuaa

SEQ ID NO: 662304 - RNA, 64 nt, Homo Sapiens
uaaugggcuugaauuugcauggcucuccuuucugugguuuuauucgaggacacugagccgggcu

SEQ ID NO: 662305 - RNA, 64 nt, Homo Sapiens
aacaguaaaugugcccagccgggguuuuguuaccugguuuuaauggcuggcugccuuuugcugu

SEQ ID NO: 662306 - RNA, 64 nt, Homo Sapiens
ugaaaaccugacaaaaaaaauugucacuguaguuugguuuuauuauuacauguaaaacauuauc

SEQ ID NO: 662307 - RNA, 64 nt, Homo Sapiens
uuguuaguuauuuuuaaagguuuauauagcauagugguuuuauugagguuaaaaauaauguggu

SEQ ID NO: 662308 - RNA, 64 nt, Homo Sapiens
uagcauagugguuuuauuuugguuaaaaauaaugugguuuuauauccauguaucaagauuauga

SEQ ID NO: 662309 - RNA, 64 nt, Homo Sapiens
cagggagccuccgcugggcccagacagcagcguuugguuuuauccacuuuucuuggauaaucag

SEQ ID NO: 662310 - RNA, 64 nt, Homo Sapiens
aggggguggggguccugcucagcaggguagguggugguuuuaggucuugucacccucacucagu

SEQ ID NO: 662311 - RNA, 64 nt, Homo Sapiens
uagcuaaaaauguuagccuuguaauucgaauaucugguuuuaaaugauagagguuuuuguggga

SEQ ID NO: 662312 - RNA, 64 nt, Homo Sapiens
gaauggggaacuggcaggccgcgcagaagguucuugguuuuaauggauaggcugaauuggauua

SEQ ID NO: 662313 - RNA, 64 nt, Homo Sapiens
gaacagaugaauaugcaccuucuccagaguuaugugguuuuagaauuuagaagagcauguaucu

SEQ ID NO: 662314 - RNA, 64 nt, Homo Sapiens
cuuuuuuaucuccauggugugggugggaccaccaugguuuuacaccccacccuaccuuagggaa

SEQ ID NO: 662315 - RNA, 64 nt, Homo Sapiens
aaagugaaaauauuuuuguucuaagaaaaagugaugguuuuaggaagaaagauaaaagugugau

SEQ ID NO: 662316 - RNA, 64 nt, Homo Sapiens
uaaaaugaaaugccaguccagagacaugcuuauaugguuuuauuuaacauuuauaucucacaua

SEQ ID NO: 662317 - RNA, 64 nt, Homo Sapiens
ggcuuugaaguacucagauuguuuuauucauuuaugguuuuacauguauguccaaaguccuaug

SEQ ID NO: 662318 - RNA, 64 nt, Homo Sapiens
cauuuaugguuuuacaggcuuguccaaaguccuaugguuuuauuaaaacuacuuugguugugua

SEQ ID NO: 662319 - RNA, 64 nt, Homo Sapiens
auucuguguauuuugucauaaaaagaaaaacgaaugguuuuauauugaauauaugcuuaugguu

SEQ ID NO: 662320 - RNA, 64 nt, Homo Sapiens
acuuuaagaaguuuaauuuuuuuauggcuuuuugugguuuuagcuuuuaaaaaauagguuuuca

SEQ ID NO: 662321 - RNA, 64 nt, Homo Sapiens; identical to SEQ ID NO: 300664

SEQ ID NO: 662322 - RNA, 64 nt, Homo Sapiens; identical to SEQ ID NO: 300665

SEQ ID NO: 662323 - RNA, 64 nt, Homo Sapiens; identical to SEQ ID NO: 300666

SEQ ID NO: 662324 - RNA, 64 nt, Homo Sapiens; identical to SEQ ID NO: 300667

SEQ ID NO: 662325 - RNA, 64 nt, Homo Sapiens; identical to SEQ ID NO: 300668

SEQ ID NO: 662326 - RNA, 64 nt, Homo Sapiens; identical to SEQ ID NO: 300669

SEQ ID NO: 662327 - RNA, 64 nt, Homo Sapiens; identical to SEQ ID NO: 300670

SEQ ID NO: 662328 - RNA, 64 nt, Homo Sapiens; identical to SEQ ID NO: 300671

SEQ ID NO: 662329 - RNA, 64 nt, Homo Sapiens; identical to SEQ ID NO: 300672

SEQ ID NO: 662330 - RNA, 64 nt, Homo Sapiens; identical to SEQ ID NO: 300673

SEQ ID NO: 662331 - RNA, 64 nt, Homo Sapiens; identical to SEQ ID NO: 300674

SEQ ID NO: 662332 - RNA, 64 nt, Homo Sapiens; identical to SEQ ID NO: 300675

SEQ ID NO: 662333 - RNA, 64 nt, Homo Sapiens; identical to SEQ ID NO: 300676

SEQ ID NO: 662334 - RNA, 64 nt, Homo Sapiens; identical to SEQ ID NO: 300677

SEQ ID NO: 662335 - RNA, 64 nt, Homo Sapiens; identical to SEQ ID NO: 300678

SEQ ID NO: 662336 - RNA, 64 nt, Homo Sapiens; identical to SEQ ID NO: 300679

SEQ ID NO: 662337 - RNA, 64 nt, Homo Sapiens; identical to SEQ ID NO: 300680

SEQ ID NO: 662338 - RNA, 64 nt, Homo Sapiens; identical to SEQ ID NO: 300681

SEQ ID NO: 662339 - RNA, 64 nt, Homo Sapiens; identical to SEQ ID NO: 300682

SEQ ID NO: 662340 - RNA, 64 nt, Homo Sapiens; identical to SEQ ID NO: 300683

SEQ ID NO: 662341 - RNA, 64 nt, Homo Sapiens; identical to SEQ ID NO: 300684

SEQ ID NO: 662342 - RNA, 64 nt, Homo Sapiens; identical to SEQ ID NO: 300685

SEQ ID NO: 662343 - RNA, 64 nt, Homo Sapiens; identical to SEQ ID NO: 300686

SEQ ID NO: 662344 - RNA, 64 nt, Homo Sapiens; identical to SEQ ID NO: 300687

SEQ ID NO: 662345 - RNA, 64 nt, Homo Sapiens; identical to SEQ ID NO: 300688

SEQ ID NO: 662346 - RNA, 64 nt, Homo Sapiens; identical to SEQ ID NO: 300689

SEQ ID NO: 662347 - RNA, 64 nt, Homo Sapiens; identical to SEQ ID NO: 300690

SEQ ID NO: 662348 - RNA, 64 nt, Homo Sapiens; identical to SEQ ID NO: 300691

SEQ ID NO: 662349 - RNA, 64 nt, Homo Sapiens; identical to SEQ ID NO: 300692

SEQ ID NO: 662350 - RNA, 64 nt, Homo Sapiens; identical to SEQ ID NO: 300693

SEQ ID NO: 662351 - RNA, 64 nt, Homo Sapiens
cuuugagaggggcaaaacugagaggggcuuuuccuagagaaagagaacaaggagcuugccaggc

SEQ ID NO: 662352 - RNA, 64 nt, Homo Sapiens
ugugauacacuaauguauuugcuuuuuuuggaaauagagaaaaucaauaaauugcuaguguuuc

SEQ ID NO: 662353 - RNA, 64 nt, Homo Sapiens
gaucaaaagagcacaagaguuugcauuuucccccuagagaaauauuuuucauuuuuuaccugua

SEQ ID NO: 662354 - RNA, 64 nt, Homo Sapiens
acuuaauacacauuuguugaacgaaugccuagcauagagaaaauaauaucuauuauucuccuaa

SEQ ID NO: 662355 - RNA, 64 nt, Homo Sapiens
aaguuaauaagcaaaauccugacuauuauguuguuagagaaaaaugcuuugcuuugucuggaag

SEQ ID NO: 662356 - RNA, 64 nt, Homo Sapiens
uuacuuuuuuccaauuuuagaaaaucaagcagguuagagaaaauagagaugaauuaggggacac

SEQ ID NO: 662357 - RNA, 64 nt, Homo Sapiens
ggaagguuuauucuugucuuaauaauaugacacuuagagaaaaacuuagagaaaauguggagga

SEQ ID NO: 662358 - RNA, 64 nt, Homo Sapiens
guggaggaaauaauaugacaggaaagaagcagcuuagagaaaauagagguaggugaacauucca

SEQ ID NO: 662359 - RNA, 64 nt, Homo Sapiens
uuuacauacuuaaguggguagucuccuacaaucuuagagaaagugaaaagaaaauaggcgcuuu

SEQ ID NO: 662360 - RNA, 64 nt, Homo Sapiens
aaguauuuuaguauguguaauucugaguuauuucuagagaaagacuuauaaugauuagguuuug

SEQ ID NO: 662361 - RNA, 64 nt, Homo Sapiens
gguagaaauuuaaauuguugugucggugaggauguagagaaacuaaaagauggacaagaacgag

SEQ ID NO: 662362 - RNA, 64 nt, Homo Sapiens
agagucuuuucaacaaauggccaagacaauucaauagagaaaggauugauuuuugacaagguuc

SEQ ID NO: 662363 - RNA, 64 nt, Homo Sapiens
agaaaccuuugagaucuuucugacuuuucaaaauuagagaaagcaaaugggauggauagauuuu

SEQ ID NO: 662364 - RNA, 64 nt, Homo Sapiens
aauaaagccagaaugagaaauuaccaucuucuacuagagaaaaccaagagaaaaauuuuuaugc

SEQ ID NO: 662365 - RNA, 64 nt, Homo Sapiens
uggucuaaaauugaacauccacucauuuagaagauagagaaaauauaaaagacagagccuguuu

SEQ ID NO: 662366 - RNA, 64 nt, Homo Sapiens
aauuggauguaauuuuaugcagaauauguugguuuagagaaagauguuugcuuugugaagguga

SEQ ID NO: 662367 - RNA, 64 nt, Homo Sapiens
cagugaaauggcaguuagacgucuuccuagggaguagagaaaggauccaaaacucuaugaugau

SEQ ID NO: 662368 - RNA, 64 nt, Homo Sapiens
cagugauucaauaucacaaaaugucagucuaccuuagagaaagcaauauuauggaaggguuucu

SEQ ID NO: 662369 - RNA, 64 nt, Homo Sapiens
auaugaaagucuucccuuacguuaaagagagcuauagagaaacaagaaauuuagaaaucauugu

SEQ ID NO: 662370 - RNA, 64 nt, Homo Sapiens
aucucaucacaauuggagacuuccuuacaacagcuagagaaaacggaucugauuaauguuuccu

SEQ ID NO: 662371 - RNA, 64 nt, Homo Sapiens
aagaagcauaaucgugggcagccugugcugccauuagagaaaaagccuuucucccagcuuugcc

SEQ ID NO: 662372 - RNA, 64 nt, Homo Sapiens
cuucaucuucaucucggaauaucagucauaacucuagagaaaaauccaaauuauugcuucaacc

SEQ ID NO: 662373 - RNA, 64 nt, Homo Sapiens
gcaauugauaaaguaaaugacugauacacauaaauagagaaagaagguaacauuuaacaauaau

SEQ ID NO: 662374 - RNA, 64 nt, Homo Sapiens
agaagguuucucuuuugcaagauagauagauagauagagaaauggauagauagauagauagaua

SEQ ID NO: 662375 - RNA, 64 nt, Homo Sapiens
cauugugaaacuguagagagcagguagcccaaaauagagaaagauuagauaaagagaaaauaag

SEQ ID NO: 662376 - RNA, 64 nt, Homo Sapiens
augaguaaaugaauaaaacauuugcaaagaccuuuagagaaagagaaugggagcauaugugaga

SEQ ID NO: 662377 - RNA, 64 nt, Homo Sapiens
aucuagauucauuaauuuucuaacauaaaucauuuagagaaauuuguaagaauguuguauauuu

SEQ ID NO: 662378 - RNA, 64 nt, Homo Sapiens
aaagauaccuaaccuucaacugaaagauuccacauagagaaaaguuacacauauuuuaauccug

SEQ ID NO: 662379 - RNA, 64 nt, Homo Sapiens
caaggaacauggggaccaacugccuuuauggcccuagagaaaguggaccugcaauagaagaugu

SEQ ID NO: 662380 - RNA, 64 nt, Homo Sapiens
acuuugccgcuuuuuaaaacuccaagcauguauguagagaaaggaucucuaaguuugggguauc

SEQ ID NO: 662381 - RNA, 64 nt, Homo Sapiens
cuuccuaaacccaaugacuuauguuacucaguguuagagaaaucaacacuacugcuaaauccuc

SEQ ID NO: 662382 - RNA, 64 nt, Homo Sapiens
gugacaagugaagaacacuaaauguaacuccagauagagaaauauuuuuuuuuugacuaacaag

SEQ ID NO: 662383 - RNA, 64 nt, Homo Sapiens
uaaaaguguguucuuaacucaucucuuugagaaauagagaaauagugugugauuuacuuuucug

SEQ ID NO: 662384 - RNA, 64 nt, Homo Sapiens
gcuaugccuguaauuuuuaaauaaauauagaaaauagagaaaaggaagcaugaauuauuuucau

SEQ ID NO: 662385 - RNA, 64 nt, Homo Sapiens
uugcuuuagccaaagccauaaaaaaccugcaacguagagaaaauaaugcagauacccugacuag

SEQ ID NO: 662386 - RNA, 64 nt, Homo Sapiens
cuuuauauauauuuuuuguugcaaagugucucucuagagaaacucuauauauuauucgaauuuu

SEQ ID NO: 662387 - RNA, 64 nt, Homo Sapiens
cacucuguuaccauuucauucucccuaauaaauuuagagaaagugcccaaacauuuguaacaaa

SEQ ID NO: 662388 - RNA, 64 nt, Homo Sapiens
guuuugucaaauguuuucuggaccauaacuuuuauagagaaagguauaaaacaacauaaauuua

SEQ ID NO: 662389 - RNA, 64 nt, Homo Sapiens
gaaguccaaggcuggcgacauguagugcuacaauuagagaaacaauacuaucuucuaggcugua

SEQ ID NO: 662390 - RNA, 64 nt, Homo Sapiens
uaaaauggcuuuccaucagaucuauuuuaaaauuuagagaaaaaaauguuuuccauuaaagucu

SEQ ID NO: 662391 - RNA, 64 nt, Homo Sapiens
uguacuacugacggggcuuucuguugaaggaccauagagaaaugaaaauuuuguauaugcaaaa

SEQ ID NO: 662392 - RNA, 64 nt, Homo Sapiens
cauuguuuuauucuaaaaacccaacucagugguguagagaaacuuguguaccaaaauuuuaguu

SEQ ID NO: 662393 - RNA, 64 nt, Homo Sapiens
ucauuuugguauuugaucuuaaccaagugauuauuagagaaauguaucaacuccaugccaucuc

SEQ ID NO: 662394 - RNA, 64 nt, Homo Sapiens
augaauugacuuaaguaucuugaaaaagaaacuuuagagaaagcaucagggguguguacucagu

SEQ ID NO: 662395 - RNA, 64 nt, Homo Sapiens
gucucacuauguugcccagguuuuuuuuuuuuuuuagagaaaggagugauucuuccaccuaaau

SEQ ID NO: 662396 - RNA, 64 nt, Homo Sapiens
auauguugauuuaaaagccuaauaaauuuuauauuagagaaagaucaugcucaauuccaagcau

SEQ ID NO: 662397 - RNA, 64 nt, Homo Sapiens
uacaaauguaugucauaaauuugauuuaaaggauuagagaaaucuauugguguucauuuuucuu

SEQ ID NO: 662398 - RNA, 64 nt, Homo Sapiens
auuuguaaaacucaaaugacuuuuggcauaccauuagagaaaccuggagagaacacauaaauga

SEQ ID NO: 662399 - RNA, 64 nt, Homo Sapiens
guauuguagcccacccuccaaccauucccuuuuuuagagaaaagcucuuuagauagcaagucuc

SEQ ID NO: 662400 - RNA, 64 nt, Homo Sapiens
auuaaccaacugaugacuuaaacuucucaaguucuagagaaagaauuuucaaugagcuuuuucu

SEQ ID NO: 662401 - RNA, 64 nt, Homo Sapiens
auuuucaaauucuugaauauucagaaugucuagauagagaaaguaauaauauauaggagggaua

SEQ ID NO: 662402 - RNA, 64 nt, Homo Sapiens
uaucauauguguguggcauggagagcuguuaugguagagaaaguugcucugucagacuaaccua

SEQ ID NO: 662403 - RNA, 64 nt, Homo Sapiens; identical to SEQ ID NO: 45025

SEQ ID NO: 662404 - RNA, 64 nt, Homo Sapiens; identical to SEQ ID NO: 45026

SEQ ID NO: 662405 - RNA, 64 nt, Homo Sapiens; identical to SEQ ID NO: 45027

SEQ ID NO: 662406 - RNA, 64 nt, Homo Sapiens; identical to SEQ ID NO: 45028

SEQ ID NO: 662407 - RNA, 64 nt, Homo Sapiens; identical to SEQ ID NO: 45029

SEQ ID NO: 662408 - RNA, 64 nt, Homo Sapiens; identical to SEQ ID NO: 45030

SEQ ID NO: 662409 - RNA, 64 nt, Homo Sapiens; identical to SEQ ID NO: 45031

SEQ ID NO: 662410 - RNA, 64 nt, Homo Sapiens; identical to SEQ ID NO: 45032

SEQ ID NO: 662411 - RNA, 64 nt, Homo Sapiens; identical to SEQ ID NO: 45033

SEQ ID NO: 662412 - RNA, 64 nt, Homo Sapiens; identical to SEQ ID NO: 45034

SEQ ID NO: 662413 - RNA, 64 nt, Homo Sapiens; identical to SEQ ID NO: 45035

SEQ ID NO: 662414 - RNA, 64 nt, Homo Sapiens; identical to SEQ ID NO: 45036

SEQ ID NO: 662415 - RNA, 64 nt, Homo Sapiens; identical to SEQ ID NO: 45037

SEQ ID NO: 662416 - RNA, 64 nt, Homo Sapiens; identical to SEQ ID NO: 45038

SEQ ID NO: 662417 - RNA, 64 nt, Homo Sapiens; identical to SEQ ID NO: 45039

SEQ ID NO: 662418 - RNA, 64 nt, Homo Sapiens; identical to SEQ ID NO: 45040

SEQ ID NO: 662419 - RNA, 64 nt, Homo Sapiens; identical to SEQ ID NO: 45041

SEQ ID NO: 662420 - RNA, 64 nt, Homo Sapiens; identical to SEQ ID NO: 45042

SEQ ID NO: 662421 - RNA, 64 nt, Homo Sapiens; identical to SEQ ID NO: 45043

SEQ ID NO: 662422 - RNA, 64 nt, Homo Sapiens; identical to SEQ ID NO: 45044

SEQ ID NO: 662423 - RNA, 64 nt, Homo Sapiens; identical to SEQ ID NO: 45045

SEQ ID NO: 662424 - RNA, 64 nt, Homo Sapiens; identical to SEQ ID NO: 45046

SEQ ID NO: 662425 - RNA, 64 nt, Homo Sapiens; identical to SEQ ID NO: 45047

SEQ ID NO: 662426 - RNA, 64 nt, Homo Sapiens; identical to SEQ ID NO: 45048

SEQ ID NO: 662427 - RNA, 64 nt, Homo Sapiens; identical to SEQ ID NO: 45049

SEQ ID NO: 662428 - RNA, 64 nt, Homo Sapiens; identical to SEQ ID NO: 45050

SEQ ID NO: 662429 - RNA, 64 nt, Homo Sapiens; identical to SEQ ID NO: 45051

SEQ ID NO: 662430 - RNA, 64 nt, Homo Sapiens; identical to SEQ ID NO: 45052

SEQ ID NO: 662431 - RNA, 64 nt, Homo Sapiens; identical to SEQ ID NO: 45053

SEQ ID NO: 662432 - RNA, 64 nt, Homo Sapiens; identical to SEQ ID NO: 45054

SEQ ID NO: 662433 - RNA, 64 nt, Homo Sapiens; identical to SEQ ID NO: 45055

SEQ ID NO: 662434 - RNA, 64 nt, Homo Sapiens; identical to SEQ ID NO: 45056

SEQ ID NO: 662435 - RNA, 64 nt, Homo Sapiens; identical to SEQ ID NO: 45057

SEQ ID NO: 662436 - RNA, 64 nt, Homo Sapiens; identical to SEQ ID NO: 45058

SEQ ID NO: 662437 - RNA, 64 nt, Homo Sapiens; identical to SEQ ID NO: 45059

SEQ ID NO: 662438 - RNA, 64 nt, Homo Sapiens; identical to SEQ ID NO: 45060

SEQ ID NO: 662439 - RNA, 64 nt, Homo Sapiens; identical to SEQ ID NO: 45061

SEQ ID NO: 662440 - RNA, 64 nt, Homo Sapiens; identical to SEQ ID NO: 45062

SEQ ID NO: 662441 - RNA, 64 nt, Homo Sapiens; identical to SEQ ID NO: 45063

SEQ ID NO: 662442 - RNA, 64 nt, Homo Sapiens; identical to SEQ ID NO: 45064

SEQ ID NO: 662443 - RNA, 64 nt, Homo Sapiens; identical to SEQ ID NO: 45065

SEQ ID NO: 662444 - RNA, 64 nt, Homo Sapiens; identical to SEQ ID NO: 45066

SEQ ID NO: 662445 - RNA, 64 nt, Homo Sapiens; identical to SEQ ID NO: 488487

SEQ ID NO: 662446 - RNA, 64 nt, Homo Sapiens; identical to SEQ ID NO: 488488

SEQ ID NO: 662447 - RNA, 64 nt, Homo Sapiens; identical to SEQ ID NO: 488489

SEQ ID NO: 662448 - RNA, 64 nt, Homo Sapiens; identical to SEQ ID NO: 488490

SEQ ID NO: 662449 - RNA, 64 nt, Homo Sapiens; identical to SEQ ID NO: 488491

SEQ ID NO: 662450 - RNA, 64 nt, Homo Sapiens; identical to SEQ ID NO: 488492

SEQ ID NO: 662451 - RNA, 64 nt, Homo Sapiens; identical to SEQ ID NO: 488493

SEQ ID NO: 662452 - RNA, 64 nt, Homo Sapiens; identical to SEQ ID NO: 488494

SEQ ID NO: 662453 - RNA, 64 nt, Homo Sapiens; identical to SEQ ID NO: 488495

SEQ ID NO: 662454 - RNA, 64 nt, Homo Sapiens; identical to SEQ ID NO: 488496

SEQ ID NO: 662455 - RNA, 64 nt, Homo Sapiens; identical to SEQ ID NO: 488497

SEQ ID NO: 662456 - RNA, 64 nt, Homo Sapiens; identical to SEQ ID NO: 488498

SEQ ID NO: 662457 - RNA, 64 nt, Homo Sapiens; identical to SEQ ID NO: 488499

SEQ ID NO: 662458 - RNA, 64 nt, Homo Sapiens; identical to SEQ ID NO: 488500

SEQ ID NO: 662459 - RNA, 64 nt, Homo Sapiens; identical to SEQ ID NO: 488501

SEQ ID NO: 662460 - RNA, 64 nt, Homo Sapiens; identical to SEQ ID NO: 488502

SEQ ID NO: 662461 - RNA, 64 nt, Homo Sapiens; identical to SEQ ID NO: 488503

SEQ ID NO: 662462 - RNA, 64 nt, Homo Sapiens; identical to SEQ ID NO: 488504

SEQ ID NO: 662463 - RNA, 64 nt, Homo Sapiens; identical to SEQ ID NO: 488505

SEQ ID NO: 662464 - RNA, 64 nt, Homo Sapiens; identical to SEQ ID NO: 488506

SEQ ID NO: 662465 - RNA, 64 nt, Homo Sapiens; identical to SEQ ID NO: 488507

SEQ ID NO: 662466 - RNA, 64 nt, Homo Sapiens; identical to SEQ ID NO: 488508

SEQ ID NO: 662467 - RNA, 64 nt, Homo Sapiens; identical to SEQ ID NO: 488509

SEQ ID NO: 662468 - RNA, 64 nt, Homo Sapiens; identical to SEQ ID NO: 488510

SEQ ID NO: 662469 - RNA, 64 nt, Homo Sapiens; identical to SEQ ID NO: 488511

SEQ ID NO: 662470 - RNA, 64 nt, Homo Sapiens; identical to SEQ ID NO: 488512

SEQ ID NO: 662471 - RNA, 64 nt, Homo Sapiens; identical to SEQ ID NO: 488513

SEQ ID NO: 662472 - RNA, 64 nt, Homo Sapiens; identical to SEQ ID NO: 488514

SEQ ID NO: 662473 - RNA, 64 nt, Homo Sapiens; identical to SEQ ID NO: 488515

SEQ ID NO: 662474 - RNA, 64 nt, Homo Sapiens; identical to SEQ ID NO: 488516

SEQ ID NO: 662475 - RNA, 64 nt, Homo Sapiens; identical to SEQ ID NO: 488517

SEQ ID NO: 662476 - RNA, 64 nt, Homo Sapiens; identical to SEQ ID NO: 488518

SEQ ID NO: 662477 - RNA, 64 nt, Homo Sapiens; identical to SEQ ID NO: 488519

SEQ ID NO: 662478 - RNA, 64 nt, Homo Sapiens; identical to SEQ ID NO: 488520

SEQ ID NO: 662479 - RNA, 64 nt, Homo Sapiens; identical to SEQ ID NO: 488521

SEQ ID NO: 662480 - RNA, 64 nt, Homo Sapiens; identical to SEQ ID NO: 488522

SEQ ID NO: 662481 - RNA, 64 nt, Homo Sapiens; identical to SEQ ID NO: 488523

SEQ ID NO: 662482 - RNA, 64 nt, Homo Sapiens; identical to SEQ ID NO: 488524

SEQ ID NO: 662483 - RNA, 64 nt, Homo Sapiens; identical to SEQ ID NO: 488525

SEQ ID NO: 662484 - RNA, 64 nt, Homo Sapiens; identical to SEQ ID NO: 488526

SEQ ID NO: 662485 - RNA, 64 nt, Homo Sapiens; identical to SEQ ID NO: 488527

SEQ ID NO: 662486 - RNA, 64 nt, Homo Sapiens; identical to SEQ ID NO: 488528

SEQ ID NO: 662487 - RNA, 64 nt, Homo Sapiens; identical to SEQ ID NO: 488529

SEQ ID NO: 662488 - RNA, 64 nt, Homo Sapiens; identical to SEQ ID NO: 488530

SEQ ID NO: 662489 - RNA, 64 nt, Homo Sapiens; identical to SEQ ID NO: 488531

SEQ ID NO: 662490 - RNA, 64 nt, Homo Sapiens; identical to SEQ ID NO: 488532

SEQ ID NO: 662491 - RNA, 64 nt, Homo Sapiens; identical to SEQ ID NO: 488533

SEQ ID NO: 662492 - RNA, 64 nt, Homo Sapiens; identical to SEQ ID NO: 488534

SEQ ID NO: 662493 - RNA, 64 nt, Homo Sapiens; identical to SEQ ID NO: 488535

SEQ ID NO: 662494 - RNA, 64 nt, Homo Sapiens; identical to SEQ ID NO: 488536

SEQ ID NO: 662495 - RNA, 64 nt, Homo Sapiens; identical to SEQ ID NO: 488537

SEQ ID NO: 662496 - RNA, 64 nt, Homo Sapiens; identical to SEQ ID NO: 488538

SEQ ID NO: 662497 - RNA, 64 nt, Homo Sapiens; identical to SEQ ID NO: 488539

SEQ ID NO: 662498 - RNA, 64 nt, Homo Sapiens; identical to SEQ ID NO: 488540

SEQ ID NO: 662499 - RNA, 64 nt, Homo Sapiens; identical to SEQ ID NO: 488541

SEQ ID NO: 662500 - RNA, 64 nt, Homo Sapiens; identical to SEQ ID NO: 488542

SEQ ID NO: 662501 - RNA, 64 nt, Homo Sapiens; identical to SEQ ID NO: 488543

SEQ ID NO: 662502 - RNA, 64 nt, Homo Sapiens; identical to SEQ ID NO: 488544

SEQ ID NO: 662503 - RNA, 64 nt, Homo Sapiens; identical to SEQ ID NO: 488545

SEQ ID NO: 662504 - RNA, 64 nt, Homo Sapiens; identical to SEQ ID NO: 488546

SEQ ID NO: 662505 - RNA, 64 nt, Homo Sapiens; identical to SEQ ID NO: 488547

SEQ ID NO: 662506 - RNA, 64 nt, Homo Sapiens; identical to SEQ ID NO: 488548

SEQ ID NO: 662507 - RNA, 64 nt, Homo Sapiens; identical to SEQ ID NO: 488549

SEQ ID NO: 662508 - RNA, 64 nt, Homo Sapiens
uugcuccuaacuccaccgccgauccacccccugcccacaaaaaaauugagaaugugcuuuguaa

SEQ ID NO: 662509 - RNA, 64 nt, Homo Sapiens
agugaaaauagccaguuccuaagcaacugaagauccacaaaagaguauacacccagauggccug

SEQ ID NO: 662510 - RNA, 64 nt, Homo Sapiens
gcagaugugcgaguuauugacuguggaguacuugccacaaaaucaauaaaagaugguaagaacu

SEQ ID NO: 662511 - RNA, 64 nt, Homo Sapiens
guccuguuccaauucggaaaacaauaggggaaagccacaaaagcacaaacaugggucaaaggaa

SEQ ID NO: 662512 - RNA, 64 nt, Homo Sapiens
guauacauccagauggccuaaaguaacugaagauccacaaaagaaguaaaaauagccuuaacug

SEQ ID NO: 662513 - RNA, 64 nt, Homo Sapiens
cccuugagaauguacuuugugagauccacccugcccacaaaacauugcucuuaacuucaccgcc

SEQ ID NO: 662514 - RNA, 64 nt, Homo Sapiens
uguuuaauaaguauaucuuaugguuauuucuaaaccacaaaaguagagucaaaguaguuaguuu

SEQ ID NO: 662515 - RNA, 64 nt, Homo Sapiens
aaaauuuuuaaaacugcauuucuccagaaauuuaccacaaaagcugagcuuugcauuuaugauu

SEQ ID NO: 662516 - RNA, 64 nt, Homo Sapiens
uguguuguauauaauguaaaugggguugccaguaccacaaaaacaaaaguacuuuuggaaggca

SEQ ID NO: 662517 - RNA, 64 nt, Homo Sapiens
cuacuuacuuucuuuuccuuuuaaaaaguguuagccacaaaagguuaaaaauguauuugucaug

SEQ ID NO: 662518 - RNA, 64 nt, Homo Sapiens
ccuguuacccgcugaacuccggcaaggaaaagccccacaaaauuucauuuccacaugaaggaga

SEQ ID NO: 662519 - RNA, 64 nt, Homo Sapiens
cauugguuuugagaggugaucugacaguucauccccacaaaacauacucccugcacccuucuga

SEQ ID NO: 662520 - RNA, 64 nt, Homo Sapiens
cagccuaaagaaguuaugguuacuugacauccuuccacaaaaguccauauccagaacaaaauga

SEQ ID NO: 662521 - RNA, 64 nt, Homo Sapiens
uaaaaggagcaagucggacuuuuuucuuagagaaccacaaaacauuuaauccauguggauuuuu

SEQ ID NO: 662522 - RNA, 64 nt, Homo Sapiens
accaacugccaaguuauuaguuccuaaauacuauccacaaaaaaggggaacagggaugauuccu

SEQ ID NO: 662523 - RNA, 64 nt, Homo Sapiens
aauagaaaacacaauccuaaaauuuauaugggaaccacaaaagacuuagaauagucagcuaucc

SEQ ID NO: 662524 - RNA, 64 nt, Homo Sapiens
agaaagcaggaguaaugugccgauucugaaguugccacaaaaaauaagacacuggugaaugaga

SEQ ID NO: 662525 - RNA, 64 nt, Homo Sapiens
auuaauauauaugaaauauuccuuuuugaugacaccacaaaauuguugaacaguuuaagaauuu

SEQ ID NO: 662526 - RNA, 64 nt, Homo Sapiens
aggcaaaggguaccagcuuuuuccagauaucuccccacaaaaggguagaguuuguucagcuauu

SEQ ID NO: 662527 - RNA, 64 nt, Homo Sapiens
ggucccuggugccaaaaaugggaaaaauugucuuccacaaaacucccuucacccugcagucugu

SEQ ID NO: 662528 - RNA, 64 nt, Homo Sapiens
agaauaaagaacuucaggagcuucuuaggucuugccacaaaaaucugcaaauuugauaauucuc

SEQ ID NO: 662529 - RNA, 64 nt, Homo Sapiens
ggaaaugugucccuaaauggaaacaaauauaaucccacaaaaccaacaauuuuauuugccucua

SEQ ID NO: 662530 - RNA, 64 nt, Homo Sapiens
cuacaaauucuugugaguccuaauuccuccuuauccacaaaacagucaauguucccguggagug

SEQ ID NO: 662531 - RNA, 64 nt, Homo Sapiens
agucauuuggucaaaccaaugacaaaaccgccuuccacaaaaguugaaauaagaaacaagagua

SEQ ID NO: 662532 - RNA, 64 nt, Homo Sapiens
aauuauauauaaauauauauuuugggacguccaaccacaaaagaaaaauaugaacagacucagc

SEQ ID NO: 662533 - RNA, 64 nt, Homo Sapiens
augagugccccucugugugggagcugugcaucccccacaaaaacaugacuggugacuguuuaau

SEQ ID NO: 662534 - RNA, 64 nt, Homo Sapiens; identical to SEQ ID NO: 363631

SEQ ID NO: 662535 - RNA, 64 nt, Homo Sapiens; identical to SEQ ID NO: 363632

SEQ ID NO: 662536 - RNA, 64 nt, Homo Sapiens; identical to SEQ ID NO: 363633

SEQ ID NO: 662537 - RNA, 64 nt, Homo Sapiens; identical to SEQ ID NO: 363634

SEQ ID NO: 662538 - RNA, 64 nt, Homo Sapiens; identical to SEQ ID NO: 363635

SEQ ID NO: 662539 - RNA, 64 nt, Homo Sapiens; identical to SEQ ID NO: 363636

SEQ ID NO: 662540 - RNA, 64 nt, Homo Sapiens; identical to SEQ ID NO: 363637

SEQ ID NO: 662541 - RNA, 64 nt, Homo Sapiens; identical to SEQ ID NO: 363638

SEQ ID NO: 662542 - RNA, 64 nt, Homo Sapiens; identical to SEQ ID NO: 363639

SEQ ID NO: 662543 - RNA, 64 nt, Homo Sapiens; identical to SEQ ID NO: 363640

SEQ ID NO: 662544 - RNA, 64 nt, Homo Sapiens; identical to SEQ ID NO: 363641

SEQ ID NO: 662545 - RNA, 64 nt, Homo Sapiens; identical to SEQ ID NO: 363642

SEQ ID NO: 662546 - RNA, 63 nt, Homo Sapiens; identical to SEQ ID NO: 363643

SEQ ID NO: 662547 - RNA, 64 nt, Homo Sapiens; identical to SEQ ID NO: 363644

SEQ ID NO: 662548 - RNA, 64 nt, Homo Sapiens; identical to SEQ ID NO: 363645

SEQ ID NO: 662549 - RNA, 64 nt, Homo Sapiens; identical to SEQ ID NO: 363646

SEQ ID NO: 662550 - RNA, 64 nt, Homo Sapiens; identical to SEQ ID NO: 363647

SEQ ID NO: 662551 - RNA, 64 nt, Homo Sapiens; identical to SEQ ID NO: 363648

SEQ ID NO: 662552 - RNA, 64 nt, Homo Sapiens; identical to SEQ ID NO: 363649

SEQ ID NO: 662553 - RNA, 64 nt, Homo Sapiens; identical to SEQ ID NO: 363650

SEQ ID NO: 662554 - RNA, 64 nt, Homo Sapiens; identical to SEQ ID NO: 363651

SEQ ID NO: 662555 - RNA, 64 nt, Homo Sapiens; identical to SEQ ID NO: 363652

SEQ ID NO: 662556 - RNA, 64 nt, Homo Sapiens; identical to SEQ ID NO: 363653

SEQ ID NO: 662557 - RNA, 64 nt, Homo Sapiens; identical to SEQ ID NO: 363654

SEQ ID NO: 662558 - RNA, 64 nt, Homo Sapiens; identical to SEQ ID NO: 363655

SEQ ID NO: 662559 - RNA, 64 nt, Homo Sapiens; identical to SEQ ID NO: 363656

SEQ ID NO: 662560 - RNA, 64 nt, Homo Sapiens; identical to SEQ ID NO: 363657

SEQ ID NO: 662561 - RNA, 64 nt, Homo Sapiens; identical to SEQ ID NO: 363658

SEQ ID NO: 662562 - RNA, 64 nt, Homo Sapiens; identical to SEQ ID NO: 363659

SEQ ID NO: 662563 - RNA, 64 nt, Homo Sapiens; identical to SEQ ID NO: 363660

SEQ ID NO: 662564 - RNA, 64 nt, Homo Sapiens; identical to SEQ ID NO: 363661

SEQ ID NO: 662565 - RNA, 64 nt, Homo Sapiens; identical to SEQ ID NO: 363662

SEQ ID NO: 662566 - RNA, 64 nt, Homo Sapiens; identical to SEQ ID NO: 363663

SEQ ID NO: 662567 - RNA, 64 nt, Homo Sapiens; identical to SEQ ID NO: 363664

SEQ ID NO: 662568 - RNA, 64 nt, Homo Sapiens; identical to SEQ ID NO: 363665

SEQ ID NO: 662569 - RNA, 57 nt, Homo Sapiens; identical to SEQ ID NO: 262389

SEQ ID NO: 662570 - RNA, 64 nt, Homo Sapiens; identical to SEQ ID NO: 363667

SEQ ID NO: 662571 - RNA, 64 nt, Homo Sapiens; identical to SEQ ID NO: 363668

SEQ ID NO: 662572 - RNA, 64 nt, Homo Sapiens; identical to SEQ ID NO: 363669

SEQ ID NO: 662573 - RNA, 64 nt, Homo Sapiens; identical to SEQ ID NO: 363670

SEQ ID NO: 662574 - RNA, 64 nt, Homo Sapiens; identical to SEQ ID NO: 363671

SEQ ID NO: 662575 - RNA, 64 nt, Homo Sapiens; identical to SEQ ID NO: 363672

SEQ ID NO: 662576 - RNA, 64 nt, Homo Sapiens; identical to SEQ ID NO: 363673

SEQ ID NO: 662577 - RNA, 64 nt, Homo Sapiens; identical to SEQ ID NO: 363674

SEQ ID NO: 662578 - RNA, 64 nt, Homo Sapiens; identical to SEQ ID NO: 363675

SEQ ID NO: 662579 - RNA, 64 nt, Homo Sapiens; identical to SEQ ID NO: 363676

SEQ ID NO: 662580 - RNA, 64 nt, Homo Sapiens; identical to SEQ ID NO: 363677

SEQ ID NO: 662581 - RNA, 64 nt, Homo Sapiens; identical to SEQ ID NO: 363678

SEQ ID NO: 662582 - RNA, 64 nt, Homo Sapiens; identical to SEQ ID NO: 363679

SEQ ID NO: 662583 - RNA, 64 nt, Homo Sapiens; identical to SEQ ID NO: 363680

SEQ ID NO: 662584 - RNA, 64 nt, Homo Sapiens; identical to SEQ ID NO: 523002

SEQ ID NO: 662585 - RNA, 64 nt, Homo Sapiens; identical to SEQ ID NO: 523003

SEQ ID NO: 662586 - RNA, 64 nt, Homo Sapiens; identical to SEQ ID NO: 523004

SEQ ID NO: 662587 - RNA, 64 nt, Homo Sapiens; identical to SEQ ID NO: 523005

SEQ ID NO: 662588 - RNA, 64 nt, Homo Sapiens; identical to SEQ ID NO: 523006

SEQ ID NO: 662589 - RNA, 64 nt, Homo Sapiens; identical to SEQ ID NO: 523007

SEQ ID NO: 662590 - RNA, 64 nt, Homo Sapiens; identical to SEQ ID NO: 523008

SEQ ID NO: 662591 - RNA, 64 nt, Homo Sapiens; identical to SEQ ID NO: 523009

SEQ ID NO: 662592 - RNA, 64 nt, Homo Sapiens; identical to SEQ ID NO: 523010

SEQ ID NO: 662593 - RNA, 64 nt, Homo Sapiens; identical to SEQ ID NO: 523011

SEQ ID NO: 662594 - RNA, 64 nt, Homo Sapiens; identical to SEQ ID NO: 523012

SEQ ID NO: 662595 - RNA, 64 nt, Homo Sapiens; identical to SEQ ID NO: 523013

SEQ ID NO: 662596 - RNA, 64 nt, Homo Sapiens; identical to SEQ ID NO: 523014

SEQ ID NO: 662597 - RNA, 64 nt, Homo Sapiens; identical to SEQ ID NO: 523015

SEQ ID NO: 662598 - RNA, 64 nt, Homo Sapiens; identical to SEQ ID NO: 523016

SEQ ID NO: 662599 - RNA, 64 nt, Homo Sapiens; identical to SEQ ID NO: 523017

SEQ ID NO: 662600 - RNA, 64 nt, Homo Sapiens; identical to SEQ ID NO: 523018

SEQ ID NO: 662601 - RNA, 64 nt, Homo Sapiens; identical to SEQ ID NO: 523019

SEQ ID NO: 662602 - RNA, 64 nt, Homo Sapiens; identical to SEQ ID NO: 523019

SEQ ID NO: 662603 - RNA, 64 nt, Homo Sapiens; identical to SEQ ID NO: 151188

SEQ ID NO: 662604 - RNA, 64 nt, Homo Sapiens; identical to SEQ ID NO: 151189

SEQ ID NO: 662605 - RNA, 64 nt, Homo Sapiens; identical to SEQ ID NO: 151190

SEQ ID NO: 662606 - RNA, 64 nt, Homo Sapiens; identical to SEQ ID NO: 151191

SEQ ID NO: 662607 - RNA, 64 nt, Homo Sapiens; identical to SEQ ID NO: 151192

SEQ ID NO: 662608 - RNA, 64 nt, Homo Sapiens; identical to SEQ ID NO: 151193

SEQ ID NO: 662609 - RNA, 64 nt, Homo Sapiens; identical to SEQ ID NO: 151194

SEQ ID NO: 662610 - RNA, 64 nt, Homo Sapiens; identical to SEQ ID NO: 151195

SEQ ID NO: 662611 - RNA, 64 nt, Homo Sapiens; identical to SEQ ID NO: 151196

SEQ ID NO: 662612 - RNA, 64 nt, Homo Sapiens; identical to SEQ ID NO: 151197

SEQ ID NO: 662613 - RNA, 64 nt, Homo Sapiens; identical to SEQ ID NO: 151198

SEQ ID NO: 662614 - RNA, 64 nt, Homo Sapiens; identical to SEQ ID NO: 151199

SEQ ID NO: 662615 - RNA, 64 nt, Homo Sapiens; identical to SEQ ID NO: 151200

SEQ ID NO: 662616 - RNA, 64 nt, Homo Sapiens; identical to SEQ ID NO: 151201

SEQ ID NO: 662617 - RNA, 64 nt, Homo Sapiens; identical to SEQ ID NO: 151202

SEQ ID NO: 662618 - RNA, 64 nt, Homo Sapiens; identical to SEQ ID NO: 151203

SEQ ID NO: 662619 - RNA, 64 nt, Homo Sapiens; identical to SEQ ID NO: 151204

SEQ ID NO: 662620 - RNA, 64 nt, Homo Sapiens; identical to SEQ ID NO: 151205

SEQ ID NO: 662621 - RNA, 64 nt, Homo Sapiens; identical to SEQ ID NO: 151206

SEQ ID NO: 662622 - RNA, 64 nt, Homo Sapiens; identical to SEQ ID NO: 151207

SEQ ID NO: 662623 - RNA, 64 nt, Homo Sapiens; identical to SEQ ID NO: 151208

SEQ ID NO: 662624 - RNA, 64 nt, Homo Sapiens; identical to SEQ ID NO: 151209

SEQ ID NO: 662625 - RNA, 64 nt, Homo Sapiens; identical to SEQ ID NO: 151210

SEQ ID NO: 662626 - RNA, 64 nt, Homo Sapiens; identical to SEQ ID NO: 151211

SEQ ID NO: 662627 - RNA, 64 nt, Homo Sapiens; identical to SEQ ID NO: 151212

SEQ ID NO: 662628 - RNA, 64 nt, Homo Sapiens; identical to SEQ ID NO: 151213

SEQ ID NO: 662629 - RNA, 64 nt, Homo Sapiens; identical to SEQ ID NO: 151214

SEQ ID NO: 662630 - RNA, 64 nt, Homo Sapiens; identical to SEQ ID NO: 151215

SEQ ID NO: 662631 - RNA, 64 nt, Homo Sapiens; identical to SEQ ID NO: 151216

SEQ ID NO: 662632 - RNA, 64 nt, Homo Sapiens; identical to SEQ ID NO: 151217

SEQ ID NO: 662633 - RNA, 64 nt, Homo Sapiens; identical to SEQ ID NO: 151218

SEQ ID NO: 662634 - RNA, 64 nt, Homo Sapiens; identical to SEQ ID NO: 151219

SEQ ID NO: 662635 - RNA, 64 nt, Homo Sapiens; identical to SEQ ID NO: 151220

SEQ ID NO: 662636 - RNA, 64 nt, Homo Sapiens; identical to SEQ ID NO: 151221

SEQ ID NO: 662637 - RNA, 64 nt, Homo Sapiens; identical to SEQ ID NO: 151222

SEQ ID NO: 662638 - RNA, 64 nt, Homo Sapiens; identical to SEQ ID NO: 151223

SEQ ID NO: 662639 - RNA, 64 nt, Homo Sapiens; identical to SEQ ID NO: 151224

SEQ ID NO: 662640 - RNA, 64 nt, Homo Sapiens; identical to SEQ ID NO: 151225

SEQ ID NO: 662641 - RNA, 64 nt, Homo Sapiens; identical to SEQ ID NO: 151226

SEQ ID NO: 662642 - RNA, 64 nt, Homo Sapiens; identical to SEQ ID NO: 151227

SEQ ID NO: 662643 - RNA, 64 nt, Homo Sapiens; identical to SEQ ID NO: 151228

SEQ ID NO: 662644 - RNA, 64 nt, Homo Sapiens; identical to SEQ ID NO: 151229

SEQ ID NO: 662645 - RNA, 64 nt, Homo Sapiens; identical to SEQ ID NO: 151230

SEQ ID NO: 662646 - RNA, 64 nt, Homo Sapiens; identical to SEQ ID NO: 151231

SEQ ID NO: 662647 - RNA, 64 nt, Homo Sapiens; identical to SEQ ID NO: 151232

SEQ ID NO: 662648 - RNA, 64 nt, Homo Sapiens; identical to SEQ ID NO: 151233

SEQ ID NO: 662649 - RNA, 64 nt, Homo Sapiens; identical to SEQ ID NO: 151234

SEQ ID NO: 662650 - RNA, 64 nt, Homo Sapiens; identical to SEQ ID NO: 151235

SEQ ID NO: 662651 - RNA, 64 nt, Homo Sapiens; identical to SEQ ID NO: 151236

SEQ ID NO: 662652 - RNA, 64 nt, Homo Sapiens; identical to SEQ ID NO: 151237

SEQ ID NO: 662653 - RNA, 64 nt, Homo Sapiens; identical to SEQ ID NO: 151238

SEQ ID NO: 662654 - RNA, 64 nt, Homo Sapiens; identical to SEQ ID NO: 151239

SEQ ID NO: 662655 - RNA, 64 nt, Homo Sapiens; identical to SEQ ID NO: 151240

SEQ ID NO: 662656 - RNA, 64 nt, Homo Sapiens; identical to SEQ ID NO: 151241

SEQ ID NO: 662657 - RNA, 64 nt, Homo Sapiens; identical to SEQ ID NO: 151242

SEQ ID NO: 662658 - RNA, 64 nt, Homo Sapiens; identical to SEQ ID NO: 151243

SEQ ID NO: 662659 - RNA, 64 nt, Homo Sapiens; identical to SEQ ID NO: 151244

SEQ ID NO: 662660 - RNA, 64 nt, Homo Sapiens; identical to SEQ ID NO: 151245

SEQ ID NO: 662661 - RNA, 64 nt, Homo Sapiens; identical to SEQ ID NO: 151246

SEQ ID NO: 662662 - RNA, 64 nt, Homo Sapiens; identical to SEQ ID NO: 151247

SEQ ID NO: 662663 - RNA, 64 nt, Homo Sapiens; identical to SEQ ID NO: 151248

SEQ ID NO: 662664 - RNA, 64 nt, Homo Sapiens; identical to SEQ ID NO: 151249

SEQ ID NO: 662665 - RNA, 64 nt, Homo Sapiens; identical to SEQ ID NO: 151250

SEQ ID NO: 662666 - RNA, 64 nt, Homo Sapiens; identical to SEQ ID NO: 151251

SEQ ID NO: 662667 - RNA, 64 nt, Homo Sapiens; identical to SEQ ID NO: 151252

SEQ ID NO: 662668 - RNA, 64 nt, Homo Sapiens; identical to SEQ ID NO: 151253

SEQ ID NO: 662669 - RNA, 64 nt, Homo Sapiens; identical to SEQ ID NO: 151254

SEQ ID NO: 662670 - RNA, 64 nt, Homo Sapiens; identical to SEQ ID NO: 151255

SEQ ID NO: 662671 - RNA, 64 nt, Homo Sapiens; identical to SEQ ID NO: 151256

SEQ ID NO: 662672 - RNA, 64 nt, Homo Sapiens; identical to SEQ ID NO: 151257

SEQ ID NO: 662673 - RNA, 64 nt, Homo Sapiens; identical to SEQ ID NO: 151258

SEQ ID NO: 662674 - RNA, 64 nt, Homo Sapiens; identical to SEQ ID NO: 151259

SEQ ID NO: 662675 - RNA, 64 nt, Homo Sapiens; identical to SEQ ID NO: 151260

SEQ ID NO: 662676 - RNA, 64 nt, Homo Sapiens; identical to SEQ ID NO: 151261

SEQ ID NO: 662677 - RNA, 64 nt, Homo Sapiens; identical to SEQ ID NO: 151262

SEQ ID NO: 662678 - RNA, 64 nt, Homo Sapiens; identical to SEQ ID NO: 151263

SEQ ID NO: 662679 - RNA, 64 nt, Homo Sapiens; identical to SEQ ID NO: 151264

SEQ ID NO: 662680 - RNA, 64 nt, Homo Sapiens; identical to SEQ ID NO: 151265

SEQ ID NO: 662681 - RNA, 64 nt, Homo Sapiens; identical to SEQ ID NO: 151266

SEQ ID NO: 662682 - RNA, 64 nt, Homo Sapiens; identical to SEQ ID NO: 151267

SEQ ID NO: 662683 - RNA, 64 nt, Homo Sapiens; identical to SEQ ID NO: 151268

SEQ ID NO: 662684 - RNA, 64 nt, Homo Sapiens; identical to SEQ ID NO: 151269

SEQ ID NO: 662685 - RNA, 64 nt, Homo Sapiens; identical to SEQ ID NO: 151270

SEQ ID NO: 662686 - RNA, 64 nt, Homo Sapiens; identical to SEQ ID NO: 151271

SEQ ID NO: 662687 - RNA, 64 nt, Homo Sapiens; identical to SEQ ID NO: 151272

SEQ ID NO: 662688 - RNA, 64 nt, Homo Sapiens; identical to SEQ ID NO: 151273

SEQ ID NO: 662689 - RNA, 64 nt, Homo Sapiens; identical to SEQ ID NO: 151274

SEQ ID NO: 662690 - RNA, 64 nt, Homo Sapiens; identical to SEQ ID NO: 151275

SEQ ID NO: 662691 - RNA, 64 nt, Homo Sapiens; identical to SEQ ID NO: 151276

SEQ ID NO: 662692 - RNA, 64 nt, Homo Sapiens; identical to SEQ ID NO: 151277

SEQ ID NO: 662693 - RNA, 64 nt, Homo Sapiens; identical to SEQ ID NO: 151278

SEQ ID NO: 662694 - RNA, 64 nt, Homo Sapiens; identical to SEQ ID NO: 151279

SEQ ID NO: 662695 - RNA, 64 nt, Homo Sapiens; identical to SEQ ID NO: 151280

SEQ ID NO: 662696 - RNA, 64 nt, Homo Sapiens; identical to SEQ ID NO: 151281

SEQ ID NO: 662697 - RNA, 64 nt, Homo Sapiens; identical to SEQ ID NO: 151282

SEQ ID NO: 662698 - RNA, 64 nt, Homo Sapiens; identical to SEQ ID NO: 151283

SEQ ID NO: 662699 - RNA, 64 nt, Homo Sapiens; identical to SEQ ID NO: 151284

SEQ ID NO: 662700 - RNA, 64 nt, Homo Sapiens; identical to SEQ ID NO: 151285

SEQ ID NO: 662701 - RNA, 64 nt, Homo Sapiens; identical to SEQ ID NO: 151286

SEQ ID NO: 662702 - RNA, 64 nt, Homo Sapiens; identical to SEQ ID NO: 151287

SEQ ID NO: 662703 - RNA, 64 nt, Homo Sapiens; identical to SEQ ID NO: 151288

SEQ ID NO: 662704 - RNA, 64 nt, Homo Sapiens; identical to SEQ ID NO: 151289

SEQ ID NO: 662705 - RNA, 64 nt, Homo Sapiens; identical to SEQ ID NO: 151290

SEQ ID NO: 662706 - RNA, 64 nt, Homo Sapiens; identical to SEQ ID NO: 151291

SEQ ID NO: 662707 - RNA, 64 nt, Homo Sapiens; identical to SEQ ID NO: 151292

SEQ ID NO: 662708 - RNA, 64 nt, Homo Sapiens; identical to SEQ ID NO: 151293

SEQ ID NO: 662709 - RNA, 64 nt, Homo Sapiens; identical to SEQ ID NO: 151294

SEQ ID NO: 662710 - RNA, 64 nt, Homo Sapiens; identical to SEQ ID NO: 151295

SEQ ID NO: 662711 - RNA, 64 nt, Homo Sapiens; identical to SEQ ID NO: 151296

SEQ ID NO: 662712 - RNA, 64 nt, Homo Sapiens; identical to SEQ ID NO: 151297

SEQ ID NO: 662713 - RNA, 64 nt, Homo Sapiens; identical to SEQ ID NO: 151298

SEQ ID NO: 662714 - RNA, 64 nt, Homo Sapiens; identical to SEQ ID NO: 151299

SEQ ID NO: 662715 - RNA, 64 nt, Homo Sapiens; identical to SEQ ID NO: 151300

SEQ ID NO: 662716 - RNA, 64 nt, Homo Sapiens; identical to SEQ ID NO: 151301

SEQ ID NO: 662717 - RNA, 64 nt, Homo Sapiens; identical to SEQ ID NO: 151302

SEQ ID NO: 662718 - RNA, 64 nt, Homo Sapiens; identical to SEQ ID NO: 151303

SEQ ID NO: 662719 - RNA, 64 nt, Homo Sapiens; identical to SEQ ID NO: 151304

SEQ ID NO: 662720 - RNA, 64 nt, Homo Sapiens; identical to SEQ ID NO: 151305

SEQ ID NO: 662721 - RNA, 64 nt, Homo Sapiens; identical to SEQ ID NO: 151306

SEQ ID NO: 662722 - RNA, 64 nt, Homo Sapiens; identical to SEQ ID NO: 151307

SEQ ID NO: 662723 - RNA, 64 nt, Homo Sapiens; identical to SEQ ID NO: 151308

SEQ ID NO: 662724 - RNA, 64 nt, Homo Sapiens; identical to SEQ ID NO: 151309

SEQ ID NO: 662725 - RNA, 64 nt, Homo Sapiens; identical to SEQ ID NO: 151310

SEQ ID NO: 662726 - RNA, 64 nt, Homo Sapiens; identical to SEQ ID NO: 151311

SEQ ID NO: 662727 - RNA, 64 nt, Homo Sapiens; identical to SEQ ID NO: 151312

SEQ ID NO: 662728 - RNA, 64 nt, Homo Sapiens; identical to SEQ ID NO: 151313

SEQ ID NO: 662729 - RNA, 64 nt, Homo Sapiens; identical to SEQ ID NO: 151314

SEQ ID NO: 662730 - RNA, 64 nt, Homo Sapiens; identical to SEQ ID NO: 151315

SEQ ID NO: 662731 - RNA, 64 nt, Homo Sapiens; identical to SEQ ID NO: 151316

SEQ ID NO: 662732 - RNA, 64 nt, Homo Sapiens; identical to SEQ ID NO: 333348

SEQ ID NO: 662733 - RNA, 64 nt, Homo Sapiens; identical to SEQ ID NO: 333349

SEQ ID NO: 662734 - RNA, 64 nt, Homo Sapiens; identical to SEQ ID NO: 333350

SEQ ID NO: 662735 - RNA, 64 nt, Homo Sapiens; identical to SEQ ID NO: 333351

SEQ ID NO: 662736 - RNA, 64 nt, Homo Sapiens; identical to SEQ ID NO: 333352

SEQ ID NO: 662737 - RNA, 64 nt, Homo Sapiens; identical to SEQ ID NO: 333353

SEQ ID NO: 662738 - RNA, 64 nt, Homo Sapiens; identical to SEQ ID NO: 333354

SEQ ID NO: 662739 - RNA, 64 nt, Homo Sapiens; identical to SEQ ID NO: 333355

SEQ ID NO: 662740 - RNA, 64 nt, Homo Sapiens; identical to SEQ ID NO: 333356

SEQ ID NO: 662741 - RNA, 64 nt, Homo Sapiens; identical to SEQ ID NO: 333357

SEQ ID NO: 662742 - RNA, 64 nt, Homo Sapiens; identical to SEQ ID NO: 333358

SEQ ID NO: 662743 - RNA, 64 nt, Homo Sapiens; identical to SEQ ID NO: 333359

SEQ ID NO: 662744 - RNA, 64 nt, Homo Sapiens; identical to SEQ ID NO: 333360

SEQ ID NO: 662745 - RNA, 64 nt, Homo Sapiens; identical to SEQ ID NO: 333361

SEQ ID NO: 662746 - RNA, 64 nt, Homo Sapiens; identical to SEQ ID NO: 333362

SEQ ID NO: 662747 - RNA, 64 nt, Homo Sapiens; identical to SEQ ID NO: 333363

SEQ ID NO: 662748 - RNA, 64 nt, Homo Sapiens; identical to SEQ ID NO: 333364

SEQ ID NO: 662749 - RNA, 64 nt, Homo Sapiens; identical to SEQ ID NO: 333365

SEQ ID NO: 662750 - RNA, 64 nt, Homo Sapiens; identical to SEQ ID NO: 333366

SEQ ID NO: 662751 - RNA, 64 nt, Homo Sapiens; identical to SEQ ID NO: 333367

SEQ ID NO: 662752 - RNA, 64 nt, Homo Sapiens; identical to SEQ ID NO: 333368

SEQ ID NO: 662753 - RNA, 64 nt, Homo Sapiens; identical to SEQ ID NO: 333369

SEQ ID NO: 662754 - RNA, 64 nt, Homo Sapiens; identical to SEQ ID NO: 333370

SEQ ID NO: 662755 - RNA, 64 nt, Homo Sapiens; identical to SEQ ID NO: 333371

SEQ ID NO: 662756 - RNA, 64 nt, Homo Sapiens; identical to SEQ ID NO: 333372

SEQ ID NO: 662757 - RNA, 64 nt, Homo Sapiens; identical to SEQ ID NO: 333373

SEQ ID NO: 662758 - RNA, 64 nt, Homo Sapiens; identical to SEQ ID NO: 333374

SEQ ID NO: 662759 - RNA, 64 nt, Homo Sapiens; identical to SEQ ID NO: 333375

SEQ ID NO: 662760 - RNA, 64 nt, Homo Sapiens; identical to SEQ ID NO: 333376

SEQ ID NO: 662761 - RNA, 64 nt, Homo Sapiens; identical to SEQ ID NO: 333377

SEQ ID NO: 662762 - RNA, 64 nt, Homo Sapiens; identical to SEQ ID NO: 333378

SEQ ID NO: 662763 - RNA, 64 nt, Homo Sapiens; identical to SEQ ID NO: 333379

SEQ ID NO: 662764 - RNA, 64 nt, Homo Sapiens; identical to SEQ ID NO: 333380

SEQ ID NO: 662765 - RNA, 64 nt, Homo Sapiens; identical to SEQ ID NO: 333381

SEQ ID NO: 662766 - RNA, 64 nt, Homo Sapiens; identical to SEQ ID NO: 333382

SEQ ID NO: 662767 - RNA, 64 nt, Homo Sapiens; identical to SEQ ID NO: 333383

SEQ ID NO: 662768 - RNA, 64 nt, Homo Sapiens; identical to SEQ ID NO: 333384

SEQ ID NO: 662769 - RNA, 64 nt, Homo Sapiens; identical to SEQ ID NO: 333385

SEQ ID NO: 662770 - RNA, 64 nt, Homo Sapiens; identical to SEQ ID NO: 333386

SEQ ID NO: 662771 - RNA, 64 nt, Homo Sapiens; identical to SEQ ID NO: 333387

SEQ ID NO: 662772 - RNA, 64 nt, Homo Sapiens; identical to SEQ ID NO: 333388

SEQ ID NO: 662773 - RNA, 64 nt, Homo Sapiens; identical to SEQ ID NO: 333389

SEQ ID NO: 662774 - RNA, 64 nt, Homo Sapiens; identical to SEQ ID NO: 333390

SEQ ID NO: 662775 - RNA, 64 nt, Homo Sapiens; identical to SEQ ID NO: 333391

SEQ ID NO: 662776 - RNA, 64 nt, Homo Sapiens; identical to SEQ ID NO: 333392

SEQ ID NO: 662777 - RNA, 64 nt, Homo Sapiens; identical to SEQ ID NO: 333393

SEQ ID NO: 662778 - RNA, 64 nt, Homo Sapiens; identical to SEQ ID NO: 333394

SEQ ID NO: 662779 - RNA, 64 nt, Homo Sapiens; identical to SEQ ID NO: 333395

SEQ ID NO: 662780 - RNA, 64 nt, Homo Sapiens; identical to SEQ ID NO: 333396

SEQ ID NO: 662781 - RNA, 64 nt, Homo Sapiens; identical to SEQ ID NO: 333397

SEQ ID NO: 662782 - RNA, 64 nt, Homo Sapiens; identical to SEQ ID NO: 333398

SEQ ID NO: 662783 - RNA, 64 nt, Homo Sapiens; identical to SEQ ID NO: 333399

SEQ ID NO: 662784 - RNA, 64 nt, Homo Sapiens; identical to SEQ ID NO: 333400

SEQ ID NO: 662785 - RNA, 64 nt, Homo Sapiens; identical to SEQ ID NO: 333401

SEQ ID NO: 662786 - RNA, 64 nt, Homo Sapiens; identical to SEQ ID NO: 333402

SEQ ID NO: 662787 - RNA, 64 nt, Homo Sapiens; identical to SEQ ID NO: 333403

SEQ ID NO: 662788 - RNA, 64 nt, Homo Sapiens; identical to SEQ ID NO: 333404

SEQ ID NO: 662789 - RNA, 64 nt, Homo Sapiens; identical to SEQ ID NO: 333405

SEQ ID NO: 662790 - RNA, 64 nt, Homo Sapiens; identical to SEQ ID NO: 333406

SEQ ID NO: 662791 - RNA, 64 nt, Homo Sapiens; identical to SEQ ID NO: 333407

SEQ ID NO: 662792 - RNA, 64 nt, Homo Sapiens; identical to SEQ ID NO: 333408

SEQ ID NO: 662793 - RNA, 64 nt, Homo Sapiens; identical to SEQ ID NO: 333409

SEQ ID NO: 662794 - RNA, 64 nt, Homo Sapiens; identical to SEQ ID NO: 333410

SEQ ID NO: 662795 - RNA, 64 nt, Homo Sapiens; identical to SEQ ID NO: 333411

SEQ ID NO: 662796 - RNA, 64 nt, Homo Sapiens; identical to SEQ ID NO: 333412

SEQ ID NO: 662797 - RNA, 64 nt, Homo Sapiens; identical to SEQ ID NO: 333413

SEQ ID NO: 662798 - RNA, 64 nt, Homo Sapiens; identical to SEQ ID NO: 333414

SEQ ID NO: 662799 - RNA, 64 nt, Homo Sapiens; identical to SEQ ID NO: 333415

SEQ ID NO: 662800 - RNA, 64 nt, Homo Sapiens; identical to SEQ ID NO: 333416

SEQ ID NO: 662801 - RNA, 64 nt, Homo Sapiens; identical to SEQ ID NO: 333417

SEQ ID NO: 662802 - RNA, 64 nt, Homo Sapiens; identical to SEQ ID NO: 333418

SEQ ID NO: 662803 - RNA, 64 nt, Homo Sapiens; identical to SEQ ID NO: 333419

SEQ ID NO: 662804 - RNA, 64 nt, Homo Sapiens; identical to SEQ ID NO: 333420

SEQ ID NO: 662805 - RNA, 64 nt, Homo Sapiens; identical to SEQ ID NO: 333421

SEQ ID NO: 662806 - RNA, 64 nt, Homo Sapiens; identical to SEQ ID NO: 333422

SEQ ID NO: 662807 - RNA, 64 nt, Homo Sapiens; identical to SEQ ID NO: 333423

SEQ ID NO: 662808 - RNA, 64 nt, Homo Sapiens; identical to SEQ ID NO: 333424

SEQ ID NO: 662809 - RNA, 64 nt, Homo Sapiens; identical to SEQ ID NO: 333425

SEQ ID NO: 662810 - RNA, 64 nt, Homo Sapiens; identical to SEQ ID NO: 333426

SEQ ID NO: 662811 - RNA, 64 nt, Homo Sapiens; identical to SEQ ID NO: 333427

SEQ ID NO: 662812 - RNA, 64 nt, Homo Sapiens; identical to SEQ ID NO: 333428

SEQ ID NO: 662813 - RNA, 64 nt, Homo Sapiens; identical to SEQ ID NO: 333429

SEQ ID NO: 662814 - RNA, 64 nt, Homo Sapiens; identical to SEQ ID NO: 333430

SEQ ID NO: 662815 - RNA, 64 nt, Homo Sapiens; identical to SEQ ID NO: 333431

SEQ ID NO: 662816 - RNA, 64 nt, Homo Sapiens; identical to SEQ ID NO: 333432

SEQ ID NO: 662817 - RNA, 64 nt, Homo Sapiens; identical to SEQ ID NO: 333433

SEQ ID NO: 662818 - RNA, 64 nt, Homo Sapiens; identical to SEQ ID NO: 333434

SEQ ID NO: 662819 - RNA, 64 nt, Homo Sapiens; identical to SEQ ID NO: 333435

SEQ ID NO: 662820 - RNA, 64 nt, Homo Sapiens; identical to SEQ ID NO: 333436

SEQ ID NO: 662821 - RNA, 64 nt, Homo Sapiens; identical to SEQ ID NO: 333437

SEQ ID NO: 662822 - RNA, 64 nt, Homo Sapiens; identical to SEQ ID NO: 333438

SEQ ID NO: 662823 - RNA, 64 nt, Homo Sapiens; identical to SEQ ID NO: 333439

SEQ ID NO: 662824 - RNA, 64 nt, Homo Sapiens; identical to SEQ ID NO: 333440

SEQ ID NO: 662825 - RNA, 64 nt, Homo Sapiens; identical to SEQ ID NO: 333441

SEQ ID NO: 662826 - RNA, 64 nt, Homo Sapiens; identical to SEQ ID NO: 333442

SEQ ID NO: 662827 - RNA, 64 nt, Homo Sapiens; identical to SEQ ID NO: 333443

SEQ ID NO: 662828 - RNA, 64 nt, Homo Sapiens; identical to SEQ ID NO: 333444

SEQ ID NO: 662829 - RNA, 64 nt, Homo Sapiens; identical to SEQ ID NO: 333445

SEQ ID NO: 662830 - RNA, 64 nt, Homo Sapiens; identical to SEQ ID NO: 333446

SEQ ID NO: 662831 - RNA, 64 nt, Homo Sapiens; identical to SEQ ID NO: 333447

SEQ ID NO: 662832 - RNA, 64 nt, Homo Sapiens; identical to SEQ ID NO: 333448

SEQ ID NO: 662833 - RNA, 64 nt, Homo Sapiens; identical to SEQ ID NO: 333449

SEQ ID NO: 662834 - RNA, 64 nt, Homo Sapiens; identical to SEQ ID NO: 333450

SEQ ID NO: 662835 - RNA, 64 nt, Homo Sapiens; identical to SEQ ID NO: 333451

SEQ ID NO: 662836 - RNA, 64 nt, Homo Sapiens; identical to SEQ ID NO: 333452

SEQ ID NO: 662837 - RNA, 64 nt, Homo Sapiens; identical to SEQ ID NO: 333453

SEQ ID NO: 662838 - RNA, 64 nt, Homo Sapiens; identical to SEQ ID NO: 333454

SEQ ID NO: 662839 - RNA, 55 nt, Homo Sapiens; identical to SEQ ID NO: 333455

SEQ ID NO: 662840 - RNA, 64 nt, Homo Sapiens; identical to SEQ ID NO: 333456

SEQ ID NO: 662841 - RNA, 64 nt, Homo Sapiens; identical to SEQ ID NO: 333457

SEQ ID NO: 662842 - RNA, 64 nt, Homo Sapiens; identical to SEQ ID NO: 333458

SEQ ID NO: 662843 - RNA, 64 nt, Homo Sapiens; identical to SEQ ID NO: 437584

SEQ ID NO: 662844 - RNA, 64 nt, Homo Sapiens; identical to SEQ ID NO: 437585

SEQ ID NO: 662845 - RNA, 64 nt, Homo Sapiens; identical to SEQ ID NO: 437586

SEQ ID NO: 662846 - RNA, 64 nt, Homo Sapiens; identical to SEQ ID NO: 437587

SEQ ID NO: 662847 - RNA, 64 nt, Homo Sapiens; identical to SEQ ID NO: 437588

SEQ ID NO: 662848 - RNA, 64 nt, Homo Sapiens; identical to SEQ ID NO: 437589

SEQ ID NO: 662849 - RNA, 64 nt, Homo Sapiens; identical to SEQ ID NO: 46031

SEQ ID NO: 662850 - RNA, 64 nt, Homo Sapiens; identical to SEQ ID NO: 46032

SEQ ID NO: 662851 - RNA, 64 nt, Homo Sapiens; identical to SEQ ID NO: 46033

SEQ ID NO: 662852 - RNA, 64 nt, Homo Sapiens; identical to SEQ ID NO: 46034

SEQ ID NO: 662853 - RNA, 64 nt, Homo Sapiens; identical to SEQ ID NO: 189531

SEQ ID NO: 662854 - RNA, 64 nt, Homo Sapiens; identical to SEQ ID NO: 189532

SEQ ID NO: 662855 - RNA, 64 nt, Homo Sapiens; identical to SEQ ID NO: 189533

SEQ ID NO: 662856 - RNA, 64 nt, Homo Sapiens; identical to SEQ ID NO: 189534

SEQ ID NO: 662857 - RNA, 64 nt, Homo Sapiens; identical to SEQ ID NO: 189535

SEQ ID NO: 662858 - RNA, 64 nt, Homo Sapiens; identical to SEQ ID NO: 189536

SEQ ID NO: 662859 - RNA, 64 nt, Homo Sapiens; identical to SEQ ID NO: 189537

SEQ ID NO: 662860 - RNA, 64 nt, Homo Sapiens; identical to SEQ ID NO: 189538

SEQ ID NO: 662861 - RNA, 64 nt, Homo Sapiens; identical to SEQ ID NO: 189539

SEQ ID NO: 662862 - RNA, 64 nt, Homo Sapiens; identical to SEQ ID NO: 189540

SEQ ID NO: 662863 - RNA, 64 nt, Homo Sapiens; identical to SEQ ID NO: 189541

SEQ ID NO: 662864 - RNA, 64 nt, Homo Sapiens; identical to SEQ ID NO: 189542

SEQ ID NO: 662865 - RNA, 64 nt, Homo Sapiens; identical to SEQ ID NO: 189543

SEQ ID NO: 662866 - RNA, 64 nt, Homo Sapiens; identical to SEQ ID NO: 189544

SEQ ID NO: 662867 - RNA, 64 nt, Homo Sapiens; identical to SEQ ID NO: 189545

SEQ ID NO: 662868 - RNA, 64 nt, Homo Sapiens; identical to SEQ ID NO: 189546

SEQ ID NO: 662869 - RNA, 64 nt, Homo Sapiens; identical to SEQ ID NO: 189547

SEQ ID NO: 662870 - RNA, 64 nt, Homo Sapiens; identical to SEQ ID NO: 189548

SEQ ID NO: 662871 - RNA, 64 nt, Homo Sapiens; identical to SEQ ID NO: 189549

SEQ ID NO: 662872 - RNA, 64 nt, Homo Sapiens; identical to SEQ ID NO: 189550

SEQ ID NO: 662873 - RNA, 64 nt, Homo Sapiens; identical to SEQ ID NO: 189551

SEQ ID NO: 662874 - RNA, 64 nt, Homo Sapiens; identical to SEQ ID NO: 189552

SEQ ID NO: 662875 - RNA, 64 nt, Homo Sapiens; identical to SEQ ID NO: 189553

SEQ ID NO: 662876 - RNA, 64 nt, Homo Sapiens; identical to SEQ ID NO: 189554

SEQ ID NO: 662877 - RNA, 64 nt, Homo Sapiens; identical to SEQ ID NO: 189555

SEQ ID NO: 662878 - RNA, 64 nt, Homo Sapiens; identical to SEQ ID NO: 189556

SEQ ID NO: 662879 - RNA, 64 nt, Homo Sapiens; identical to SEQ ID NO: 189557

SEQ ID NO: 662880 - RNA, 64 nt, Homo Sapiens; identical to SEQ ID NO: 189558

SEQ ID NO: 662881 - RNA, 64 nt, Homo Sapiens; identical to SEQ ID NO: 189559

SEQ ID NO: 662882 - RNA, 53 nt, Homo Sapiens; identical to SEQ ID NO: 189560

SEQ ID NO: 662883 - RNA, 64 nt, Homo Sapiens; identical to SEQ ID NO: 189561

SEQ ID NO: 662884 - RNA, 64 nt, Homo Sapiens; identical to SEQ ID NO: 189562

SEQ ID NO: 662885 - RNA, 63 nt, Homo Sapiens; identical to SEQ ID NO: 189563

SEQ ID NO: 662886 - RNA, 64 nt, Homo Sapiens; identical to SEQ ID NO: 189564

SEQ ID NO: 662887 - RNA, 64 nt, Homo Sapiens; identical to SEQ ID NO: 189565

SEQ ID NO: 662888 - RNA, 64 nt, Homo Sapiens; identical to SEQ ID NO: 189566

SEQ ID NO: 662889 - RNA, 64 nt, Homo Sapiens; identical to SEQ ID NO: 189567

SEQ ID NO: 662890 - RNA, 64 nt, Homo Sapiens; identical to SEQ ID NO: 189568

SEQ ID NO: 662891 - RNA, 64 nt, Homo Sapiens; identical to SEQ ID NO: 189569

SEQ ID NO: 662892 - RNA, 64 nt, Homo Sapiens; identical to SEQ ID NO: 189570

SEQ ID NO: 662893 - RNA, 64 nt, Homo Sapiens; identical to SEQ ID NO: 189571

SEQ ID NO: 662894 - RNA, 64 nt, Homo Sapiens; identical to SEQ ID NO: 189572

SEQ ID NO: 662895 - RNA, 64 nt, Homo Sapiens; identical to SEQ ID NO: 189573

SEQ ID NO: 662896 - RNA, 64 nt, Homo Sapiens; identical to SEQ ID NO: 189574

SEQ ID NO: 662897 - RNA, 64 nt, Homo Sapiens; identical to SEQ ID NO: 189575

SEQ ID NO: 662898 - RNA, 64 nt, Homo Sapiens; identical to SEQ ID NO: 189576

SEQ ID NO: 662899 - RNA, 64 nt, Homo Sapiens; identical to SEQ ID NO: 189577

SEQ ID NO: 662900 - RNA, 64 nt, Homo Sapiens; identical to SEQ ID NO: 189578

SEQ ID NO: 662901 - RNA, 64 nt, Homo Sapiens; identical to SEQ ID NO: 189579

SEQ ID NO: 662902 - RNA, 64 nt, Homo Sapiens; identical to SEQ ID NO: 189580

SEQ ID NO: 662903 - RNA, 64 nt, Homo Sapiens; identical to SEQ ID NO: 189581

SEQ ID NO: 662904 - RNA, 64 nt, Homo Sapiens; identical to SEQ ID NO: 189582

SEQ ID NO: 662905 - RNA, 64 nt, Homo Sapiens; identical to SEQ ID NO: 189583

SEQ ID NO: 662906 - RNA, 64 nt, Homo Sapiens; identical to SEQ ID NO: 189584

SEQ ID NO: 662907 - RNA, 64 nt, Homo Sapiens; identical to SEQ ID NO: 189585

SEQ ID NO: 662908 - RNA, 64 nt, Homo Sapiens; identical to SEQ ID NO: 189586

SEQ ID NO: 662909 - RNA, 64 nt, Homo Sapiens; identical to SEQ ID NO: 189587

SEQ ID NO: 662910 - RNA, 64 nt, Homo Sapiens; identical to SEQ ID NO: 189588

SEQ ID NO: 662911 - RNA, 64 nt, Homo Sapiens; identical to SEQ ID NO: 189589

SEQ ID NO: 662912 - RNA, 64 nt, Homo Sapiens; identical to SEQ ID NO: 189590

SEQ ID NO: 662913 - RNA, 64 nt, Homo Sapiens; identical to SEQ ID NO: 189591

SEQ ID NO: 662914 - RNA, 64 nt, Homo Sapiens; identical to SEQ ID NO: 189592

SEQ ID NO: 662915 - RNA, 64 nt, Homo Sapiens; identical to SEQ ID NO: 189593

SEQ ID NO: 662916 - RNA, 64 nt, Homo Sapiens; identical to SEQ ID NO: 189594

SEQ ID NO: 662917 - RNA, 64 nt, Homo Sapiens; identical to SEQ ID NO: 189595

SEQ ID NO: 662918 - RNA, 64 nt, Homo Sapiens; identical to SEQ ID NO: 189596

SEQ ID NO: 662919 - RNA, 64 nt, Homo Sapiens; identical to SEQ ID NO: 189597

SEQ ID NO: 662920 - RNA, 64 nt, Homo Sapiens; identical to SEQ ID NO: 189598

SEQ ID NO: 662921 - RNA, 64 nt, Homo Sapiens; identical to SEQ ID NO: 395856

SEQ ID NO: 662922 - RNA, 64 nt, Homo Sapiens; identical to SEQ ID NO: 395857

SEQ ID NO: 662923 - RNA, 64 nt, Homo Sapiens; identical to SEQ ID NO: 395858

SEQ ID NO: 662924 - RNA, 64 nt, Homo Sapiens; identical to SEQ ID NO: 395859

SEQ ID NO: 662925 - RNA, 64 nt, Homo Sapiens; identical to SEQ ID NO: 395860

SEQ ID NO: 662926 - RNA, 64 nt, Homo Sapiens; identical to SEQ ID NO: 395861

SEQ ID NO: 662927 - RNA, 64 nt, Homo Sapiens; identical to SEQ ID NO: 395862

SEQ ID NO: 662928 - RNA, 64 nt, Homo Sapiens; identical to SEQ ID NO: 395863

SEQ ID NO: 662929 - RNA, 64 nt, Homo Sapiens; identical to SEQ ID NO: 395864

SEQ ID NO: 662930 - RNA, 64 nt, Homo Sapiens; identical to SEQ ID NO: 395865

SEQ ID NO: 662931 - RNA, 64 nt, Homo Sapiens; identical to SEQ ID NO: 127462

SEQ ID NO: 662932 - RNA, 64 nt, Homo Sapiens; identical to SEQ ID NO: 127463

SEQ ID NO: 662933 - RNA, 64 nt, Homo Sapiens; identical to SEQ ID NO: 127464

SEQ ID NO: 662934 - RNA, 64 nt, Homo Sapiens; identical to SEQ ID NO: 127465

SEQ ID NO: 662935 - RNA, 64 nt, Homo Sapiens; identical to SEQ ID NO: 127466

SEQ ID NO: 662936 - RNA, 64 nt, Homo Sapiens; identical to SEQ ID NO: 127467

SEQ ID NO: 662937 - RNA, 64 nt, Homo Sapiens; identical to SEQ ID NO: 127468

SEQ ID NO: 662938 - RNA, 64 nt, Homo Sapiens; identical to SEQ ID NO: 127469

SEQ ID NO: 662939 - RNA, 64 nt, Homo Sapiens; identical to SEQ ID NO: 127470

SEQ ID NO: 662940 - RNA, 64 nt, Homo Sapiens; identical to SEQ ID NO: 127471

SEQ ID NO: 662941 - RNA, 64 nt, Homo Sapiens; identical to SEQ ID NO: 127472

SEQ ID NO: 662942 - RNA, 64 nt, Homo Sapiens; identical to SEQ ID NO: 127473

SEQ ID NO: 662943 - RNA, 64 nt, Homo Sapiens; identical to SEQ ID NO: 127474

SEQ ID NO: 662944 - RNA, 64 nt, Homo Sapiens; identical to SEQ ID NO: 127475

SEQ ID NO: 662945 - RNA, 64 nt, Homo Sapiens; identical to SEQ ID NO: 127476

SEQ ID NO: 662946 - RNA, 64 nt, Homo Sapiens; identical to SEQ ID NO: 127477

SEQ ID NO: 662947 - RNA, 64 nt, Homo Sapiens; identical to SEQ ID NO: 127476

SEQ ID NO: 662948 - RNA, 64 nt, Homo Sapiens; identical to SEQ ID NO: 127477

SEQ ID NO: 662949 - RNA, 64 nt, Homo Sapiens; identical to SEQ ID NO: 127480

SEQ ID NO: 662950 - RNA, 64 nt, Homo Sapiens; identical to SEQ ID NO: 127477

SEQ ID NO: 662951 - RNA, 64 nt, Homo Sapiens; identical to SEQ ID NO: 127482

SEQ ID NO: 662952 - RNA, 64 nt, Homo Sapiens; identical to SEQ ID NO: 127483

SEQ ID NO: 662953 - RNA, 64 nt, Homo Sapiens; identical to SEQ ID NO: 127484

SEQ ID NO: 662954 - RNA, 64 nt, Homo Sapiens; identical to SEQ ID NO: 127485

SEQ ID NO: 662955 - RNA, 64 nt, Homo Sapiens; identical to SEQ ID NO: 127486

SEQ ID NO: 662956 - RNA, 64 nt, Homo Sapiens; identical to SEQ ID NO: 127487

SEQ ID NO: 662957 - RNA, 64 nt, Homo Sapiens; identical to SEQ ID NO: 127488

SEQ ID NO: 662958 - RNA, 64 nt, Homo Sapiens; identical to SEQ ID NO: 127489

SEQ ID NO: 662959 - RNA, 64 nt, Homo Sapiens; identical to SEQ ID NO: 127490

SEQ ID NO: 662960 - RNA, 64 nt, Homo Sapiens; identical to SEQ ID NO: 127491

SEQ ID NO: 662961 - RNA, 64 nt, Homo Sapiens; identical to SEQ ID NO: 127492

SEQ ID NO: 662962 - RNA, 64 nt, Homo Sapiens; identical to SEQ ID NO: 127493

SEQ ID NO: 662963 - RNA, 64 nt, Homo Sapiens; identical to SEQ ID NO: 127494

SEQ ID NO: 662964 - RNA, 64 nt, Homo Sapiens; identical to SEQ ID NO: 127495

SEQ ID NO: 662965 - RNA, 64 nt, Homo Sapiens
guagaagauggaggucaugugcugggaaguuaauccaguacauucggugaugcgcucaccuucu

SEQ ID NO: 662966 - RNA, 64 nt, Homo Sapiens
cagugugggcuggcugggguuugcuaaaaggaucccaguacaaguguggaauuaauucuugaua

SEQ ID NO: 662967 - RNA, 64 nt, Homo Sapiens
cagcuacugacaugcaagcacauuauaccccuggcuagagaaccagaccaagaucagagggguu

SEQ ID NO: 662968 - RNA, 64 nt, Homo Sapiens
caguaccugcaucuugguuugcacccuggcugagcuagagaagcacccaaagcugugcagucag

SEQ ID NO: 662969 - RNA, 64 nt, Homo Sapiens
agcgagaugagcgcagugugagcucaccuacaaccuagagaagaguuugugaauucagacuaug

SEQ ID NO: 662970 - RNA, 64 nt, Homo Sapiens
ucaaugagaaagacccugacuugagaucaacgugcuagagaaaaguacaaggaagcagcucgac

SEQ ID NO: 662971 - RNA, 64 nt, Homo Sapiens
aguguuauauaccauauagaauaugcccagaagacuagagaauuuggauuguauuuguucguag

SEQ ID NO: 662972 - RNA, 64 nt, Homo Sapiens
ucucagaugugcuuauaaagcaaauauuuugauucuagagaacgacugcaaaaacaaauauaga

SEQ ID NO: 662973 - RNA, 64 nt, Homo Sapiens
uuuauugcacaaccagccuggguucuaagaaagccuagagaauuucuuauugcccuguuagaaa

SEQ ID NO: 662974 - RNA, 64 nt, Homo Sapiens
ucuuauugcccuguuagaaaaauuaacugagcuccuagagaagaacaauccucauguaagcuuc

SEQ ID NO: 662975 - RNA, 64 nt, Homo Sapiens
gcugaacaguacuugugcaggauuguuguggcuacuagagaacaagagggaaaguagggcagaa

SEQ ID NO: 662976 - RNA, 64 nt, Homo Sapiens
auuuacagccauuucuaaaauggcagcuucaguucuagagaagaaagaacaacaucagcaguaa

SEQ ID NO: 662977 - RNA, 64 nt, Homo Sapiens
caggaucuacaggucuuugaucuggaaacuaagacuagagaagucuuaagagaugacugcucag

SEQ ID NO: 662978 - RNA, 64 nt, Homo Sapiens
agacucaaacacgauauuacccaaguuccugagacuagagaaguguauaagucugaggacagau

SEQ ID NO: 662979 - RNA, 64 nt, Homo Sapiens
agcucaagucuuagucgacauaaaagaauacacacuagagaaaaaccuuacaaaugugaagcau

SEQ ID NO: 662980 - RNA, 64 nt, Homo Sapiens
gagcagaucuuggaaugaaugacaugaccuuucccuagagaauaaggaugaaauaaucacucau

SEQ ID NO: 662981 - RNA, 64 nt, Homo Sapiens
auucauuuuaaaguggacuuauuaaaauuggaugcuagagaaucaaguuuauuuuauguauaua

SEQ ID NO: 662982 - RNA, 64 nt, Homo Sapiens
auuauuucuuagacauaaucuaaagaaaaacagacuagagaagccaccugguuguaacagaaua

SEQ ID NO: 662983 - RNA, 64 nt, Homo Sapiens
caaauuuuuacuguuuguagacaggaaugcuguccuagagaaccuccuccucaaccagcuacgu

SEQ ID NO: 662984 - RNA, 64 nt, Homo Sapiens
aaaacuaggaaaggggaucagaaacauccucuccccgcucuagguuucuucucccaaaggggac

SEQ ID NO: 662985 - RNA, 64 nt, Homo Sapiens
guuugauauauaaauaaguuuccauguuuacacuccgcucuaauaacuaaaagggugauugaca

SEQ ID NO: 662986 - RNA, 64 nt, Homo Sapiens
guguggcuguguccaucucugcucccccaaaggcccgcucuaggccuuauccucccucuagguc

SEQ ID NO: 662987 - RNA, 64 nt, Homo Sapiens
cauuuauaauuccaacauugucuucuagucugggccgcucuaaacuaauggugguuugggcuug

SEQ ID NO: 662988 - RNA, 64 nt, Homo Sapiens
ggggcaucauuauccggugcuugaacaaggagcuccgcucuacaacugguuuuuuuaggacuug

SEQ ID NO: 662989 - RNA, 64 nt, Homo Sapiens
gagcacaagccccacagagggggaacagccagcaccgcucuagcugguuguugccaugccggaa

SEQ ID NO: 662990 - RNA, 64 nt, Homo Sapiens
ccugcaguccuggaagcgcgagggccucaaaggcccgcucuacaucuucugccuuagucucagu

SEQ ID NO: 662991 - RNA, 64 nt, Homo Sapiens
cauaauuaugcuuaagcuuuuaacagcauuuuaaccgcucuaaaaauuaccagaguaagaaaaa

SEQ ID NO: 662992 - RNA, 64 nt, Homo Sapiens
uccacuugccggcccccaccaguucuuggguuccccgcucuaguuugaccugugcagcacauuc

SEQ ID NO: 662993 - RNA, 64 nt, Homo Sapiens
aaccuggccucccuggccacagcagccuuacccaccgcucuacgugucccgggcacuucccgca

SEQ ID NO: 662994 - RNA, 64 nt, Homo Sapiens
cuaaaaauaacgaaagguugaugucagagggaggccgcucuaaauuuucaucuuugacuccaaa

SEQ ID NO: 662995 - RNA, 64 nt, Homo Sapiens
cucucaggaauuugcuuguuggcuugcacuccagccgcucuaguggccuccccgcacaggcugu

SEQ ID NO: 662996 - RNA, 64 nt, Homo Sapiens
aggggccucauuucucccagagggagcugcuggcccgcucuaaggggugcaagaggaaggagug

SEQ ID NO: 662997 - RNA, 64 nt, Homo Sapiens
ugccagucagcuccugggguugcgccaggcgcccccgcucuagcucacuguugccucgcugucu

SEQ ID NO: 662998 - RNA, 64 nt, Homo Sapiens
cgacugcagucaguguugaguggugccaugugggccgcucuauuccaaaggaaucauggauuag

SEQ ID NO: 662999 - RNA, 64 nt, Homo Sapiens
cacuucacuauacuucucuuugagaccagagcuuccgcucuaccgauucaaaccuggguggccc

SEQ ID NO: 663000 - RNA, 64 nt, Homo Sapiens
cauuccuuccaccaucugcacuucuguagccccuccgcucuacuaauauagaugauugugccau

SEQ ID NO: 663001 - RNA, 64 nt, Homo Sapiens
gguggaaugccgcugucucugaggggugggggugccgcucuaaauuggcuccauaucauuugag

SEQ ID NO: 663002 - RNA, 64 nt, Homo Sapiens
gcuccucuccaacgugcugcucuccacgccggccccgcucuacggaggccuggcacugcugacc

SEQ ID NO: 663003 - RNA, 64 nt, Homo Sapiens
acauccauagaaaaugacuuauuuccagaagauaccgcucuaaaaaugaaauuguuaggugaaa

SEQ ID NO: 663004 - RNA, 64 nt, Homo Sapiens
cuuuuagcagaucugcagccuuuuccuuguugccccgcucuagaggccucagccuuggggcugu

SEQ ID NO: 663005 - RNA, 64 nt, Homo Sapiens
gggauagugacuacuuuuuuauuggguguuaaguccgcucuauaugacauaauugacacaguuu

SEQ ID NO: 663006 - RNA, 64 nt, Homo Sapiens
aucauguugugggagcccucguccccccuccugcccgcucuacccugaccugggcuugucaucu

SEQ ID NO: 663007 - RNA, 64 nt, Homo Sapiens
uccuacuugaacaaacacauugugggagcuucuuccgcucuaagagaaguacccaugcccugaa

SEQ ID NO: 663008 - RNA, 64 nt, Homo Sapiens
cuuacccuuuaaacugucacugcauaugcaaguaccgcucuaauuuuuggaucauuaaagggag

SEQ ID NO: 663009 - RNA, 64 nt, Homo Sapiens
aauaugugguuuuuguacaaccugauuuugugaggggggggaauuuauuccuguaauucagcca

SEQ ID NO: 663010 - RNA, 64 nt, Homo Sapiens
agccacaggggacaaaccuuaaugaugggcagaagggggggaauguuaauaggaaccaaaaaau

SEQ ID NO: 663011 - RNA, 64 nt, Homo Sapiens
aaaagaaacaccaguguuaguuuuguuuuuaaaagggggggagcuagugacaugcaguuauaua

SEQ ID NO: 663012 - RNA, 64 nt, Homo Sapiens
ggggggggggcaggguagguaggaagacgauuuggggggggaggccuaaagucauugccauggg

SEQ ID NO: 663013 - RNA, 64 nt, Homo Sapiens
cccgcugucugugcugugagagucgccgcucgcugggggggaagggggggacacagcuacacgc

SEQ ID NO: 663014 - RNA, 64 nt, Homo Sapiens
ugugcugugagagucgccgcucgcugggggggaagggggggacacagcuacacgcccauuaaag

SEQ ID NO: 663015 - RNA, 64 nt, Homo Sapiens
gaaauggauuuucuuggcaacauggucgggguccgggggggacaacaaaacgggguucacaagc

SEQ ID NO: 663016 - RNA, 64 nt, Homo Sapiens
accccagaucucagggaaccggggggcuucagaagggggggaacaggggagggguagcggggga

SEQ ID NO: 663017 - RNA, 64 nt, Homo Sapiens
gggggagggcugaugaggcccucccuggguaggggggggggaauugugcugggacgacccuugu

SEQ ID NO: 663018 - RNA, 64 nt, Homo Sapiens
auggggaaaagagcugagagaaccuuuuuuauuugggggggaggucaagugacuuuuggaaauc

SEQ ID NO: 663019 - RNA, 64 nt, Homo Sapiens
uuucugugcccuuaaacccauuuagaaaauaacuacaaaguaaaaauguagaggaaauagaaau

SEQ ID NO: 663020 - RNA, 64 nt, Homo Sapiens
uccauccuuuauaaauagucaagguuugggccacacaaaguauauuuuuaucauggaaaaauuu

SEQ ID NO: 663021 - RNA, 64 nt, Homo Sapiens
caucucaauuaguggcuggaaaguacaugguaaaacaaaguaaauuuuuuuauguucuuuuuuu

SEQ ID NO: 663022 - RNA, 64 nt, Homo Sapiens
augauaaauuuuucaacauacuugccauuagaaaacaaaguauugcuaaguacuauaacauauu

SEQ ID NO: 663023 - RNA, 64 nt, Homo Sapiens
auaaauaaauaaauacacaucaugccaccgaaguacaaaguaaagacaguaaaauaauaacuga

SEQ ID NO: 663024 - RNA, 64 nt, Homo Sapiens
ccaucaugcaagcugcaaagagcgcccucuacugacaaaguauguccucuugcagugugucucc

SEQ ID NO: 663025 - RNA, 64 nt, Homo Sapiens
uugcugagcccauaucaguagguccugggacuugacaaaguaugugggaggggaaggaaggaca

SEQ ID NO: 663026 - RNA, 64 nt, Homo Sapiens
uuuccucuaaagccuuuacucugaggauaaggucacaaaguagggugugacuugaaaguaucgu

SEQ ID NO: 663027 - RNA, 64 nt, Homo Sapiens
uccagggucaaaguacagaauagaauacauugauacaaaguacagaaaaauacuuugauuuuua

SEQ ID NO: 663028 - RNA, 64 nt, Homo Sapiens
ucuccaucagauguguuccuccauuuucuuauccacaaaguacuccucacuuuucaauuuguca

SEQ ID NO: 663029 - RNA, 64 nt, Homo Sapiens
uacuuggagaaaucguguuuuaaagcaguaguccacaaaguauucugcucaugugcccccaaaa

SEQ ID NO: 663030 - RNA, 64 nt, Homo Sapiens
uaucuaaaauuuuucaugggaaguuaaauaguugacaaaguauguauuugcuggugucguguaa

SEQ ID NO: 663031 - RNA, 64 nt, Homo Sapiens
aauaacuacagcucaugggaaauguuuugacuuuacaaaguauagauguuggaacauuaagaaa

SEQ ID NO: 663032 - RNA, 64 nt, Homo Sapiens
aacaucugucaguuauagacaaagauaauaauucacaaaguacaugcuaucagaaugaacuuug

SEQ ID NO: 663033 - RNA, 64 nt, Homo Sapiens
ggcuauuucccuuauaacucaauaguaccuuaacacaaaguauaacucuguagaguuggugaau

SEQ ID NO: 663034 - RNA, 64 nt, Homo Sapiens
agaaaauaaguaguuuuugugaauugacuugcagacaaaguagaaacugugcugcaugauguua

SEQ ID NO: 663035 - RNA, 64 nt, Homo Sapiens
caaaccuggcuacggugauguagcgugucuggaaacaaaguacauguuggaacgugcuaugcug

SEQ ID NO: 663036 - RNA, 64 nt, Homo Sapiens
uuaauaagcuuuucagcccccagugugggcuaagacaaaguauaccauaauagugcuguauuug

SEQ ID NO: 663037 - RNA, 64 nt, Homo Sapiens
auuccuggaagugaggcaagacucuugcaucucuacaaaguaguuuugucaauuugaauucagg

SEQ ID NO: 663038 - RNA, 64 nt, Homo Sapiens
uuuuuuuuuuacugcauguuacauugaaauaaaaacaaaguaaaaugagcaauugccuuauugu

SEQ ID NO: 663039 - RNA, 58 nt, Homo Sapiens; identical to SEQ ID NO: 160291

SEQ ID NO: 663040 - RNA, 64 nt, Homo Sapiens; identical to SEQ ID NO: 160292

SEQ ID NO: 663041 - RNA, 64 nt, Homo Sapiens; identical to SEQ ID NO: 160293

SEQ ID NO: 663042 - RNA, 64 nt, Homo Sapiens; identical to SEQ ID NO: 160294

SEQ ID NO: 663043 - RNA, 64 nt, Homo Sapiens; identical to SEQ ID NO: 160295

SEQ ID NO: 663044 - RNA, 64 nt, Homo Sapiens; identical to SEQ ID NO: 160296

SEQ ID NO: 663045 - RNA, 64 nt, Homo Sapiens; identical to SEQ ID NO: 160297

SEQ ID NO: 663046 - RNA, 64 nt, Homo Sapiens; identical to SEQ ID NO: 160298

SEQ ID NO: 663047 - RNA, 64 nt, Homo Sapiens; identical to SEQ ID NO: 160299

SEQ ID NO: 663048 - RNA, 64 nt, Homo Sapiens; identical to SEQ ID NO: 160300

SEQ ID NO: 663049 - RNA, 64 nt, Homo Sapiens; identical to SEQ ID NO: 160301

SEQ ID NO: 663050 - RNA, 64 nt, Homo Sapiens; identical to SEQ ID NO: 160302

SEQ ID NO: 663051 - RNA, 64 nt, Homo Sapiens; identical to SEQ ID NO: 160303

SEQ ID NO: 663052 - RNA, 64 nt, Homo Sapiens; identical to SEQ ID NO: 160304

SEQ ID NO: 663053 - RNA, 64 nt, Homo Sapiens; identical to SEQ ID NO: 160305

SEQ ID NO: 663054 - RNA, 64 nt, Homo Sapiens; identical to SEQ ID NO: 160306

SEQ ID NO: 663055 - RNA, 64 nt, Homo Sapiens; identical to SEQ ID NO: 160307

SEQ ID NO: 663056 - RNA, 64 nt, Homo Sapiens; identical to SEQ ID NO: 160308

SEQ ID NO: 663057 - RNA, 64 nt, Homo Sapiens; identical to SEQ ID NO: 160309

SEQ ID NO: 663058 - RNA, 64 nt, Homo Sapiens; identical to SEQ ID NO: 160310

SEQ ID NO: 663059 - RNA, 64 nt, Homo Sapiens; identical to SEQ ID NO: 160311

SEQ ID NO: 663060 - RNA, 64 nt, Homo Sapiens; identical to SEQ ID NO: 160312

SEQ ID NO: 663061 - RNA, 64 nt, Homo Sapiens; identical to SEQ ID NO: 160313

SEQ ID NO: 663062 - RNA, 64 nt, Homo Sapiens; identical to SEQ ID NO: 160314

SEQ ID NO: 663063 - RNA, 64 nt, Homo Sapiens; identical to SEQ ID NO: 160315

SEQ ID NO: 663064 - RNA, 64 nt, Homo Sapiens; identical to SEQ ID NO: 160316

SEQ ID NO: 663065 - RNA, 64 nt, Homo Sapiens; identical to SEQ ID NO: 160317

SEQ ID NO: 663066 - RNA, 64 nt, Homo Sapiens; identical to SEQ ID NO: 160318

SEQ ID NO: 663067 - RNA, 64 nt, Homo Sapiens; identical to SEQ ID NO: 160319

SEQ ID NO: 663068 - RNA, 64 nt, Homo Sapiens; identical to SEQ ID NO: 160320

SEQ ID NO: 663069 - RNA, 64 nt, Homo Sapiens; identical to SEQ ID NO: 160321

SEQ ID NO: 663070 - RNA, 64 nt, Homo Sapiens; identical to SEQ ID NO: 160322

SEQ ID NO: 663071 - RNA, 64 nt, Homo Sapiens; identical to SEQ ID NO: 160323

SEQ ID NO: 663072 - RNA, 64 nt, Homo Sapiens; identical to SEQ ID NO: 160324

SEQ ID NO: 663073 - RNA, 64 nt, Homo Sapiens; identical to SEQ ID NO: 160325

SEQ ID NO: 663074 - RNA, 64 nt, Homo Sapiens; identical to SEQ ID NO: 160326

SEQ ID NO: 663075 - RNA, 64 nt, Homo Sapiens; identical to SEQ ID NO: 160327

SEQ ID NO: 663076 - RNA, 64 nt, Homo Sapiens; identical to SEQ ID NO: 160328

SEQ ID NO: 663077 - RNA, 64 nt, Homo Sapiens; identical to SEQ ID NO: 160329

SEQ ID NO: 663078 - RNA, 64 nt, Homo Sapiens; identical to SEQ ID NO: 160330

SEQ ID NO: 663079 - RNA, 64 nt, Homo Sapiens; identical to SEQ ID NO: 160331

SEQ ID NO: 663080 - RNA, 64 nt, Homo Sapiens; identical to SEQ ID NO: 160332

SEQ ID NO: 663081 - RNA, 64 nt, Homo Sapiens; identical to SEQ ID NO: 160333

SEQ ID NO: 663082 - RNA, 64 nt, Homo Sapiens; identical to SEQ ID NO: 160334

SEQ ID NO: 663083 - RNA, 64 nt, Homo Sapiens; identical to SEQ ID NO: 160335

SEQ ID NO: 663084 - RNA, 64 nt, Homo Sapiens; identical to SEQ ID NO: 160336

SEQ ID NO: 663085 - RNA, 64 nt, Homo Sapiens; identical to SEQ ID NO: 160337

SEQ ID NO: 663086 - RNA, 64 nt, Homo Sapiens; identical to SEQ ID NO: 160338

SEQ ID NO: 663087 - RNA, 64 nt, Homo Sapiens; identical to SEQ ID NO: 160339

SEQ ID NO: 663088 - RNA, 64 nt, Homo Sapiens; identical to SEQ ID NO: 160340

SEQ ID NO: 663089 - RNA, 64 nt, Homo Sapiens; identical to SEQ ID NO: 160341

SEQ ID NO: 663090 - RNA, 64 nt, Homo Sapiens; identical to SEQ ID NO: 160342

SEQ ID NO: 663091 - RNA, 64 nt, Homo Sapiens; identical to SEQ ID NO: 160343

SEQ ID NO: 663092 - RNA, 64 nt, Homo Sapiens; identical to SEQ ID NO: 160344

SEQ ID NO: 663093 - RNA, 64 nt, Homo Sapiens; identical to SEQ ID NO: 160345

SEQ ID NO: 663094 - RNA, 64 nt, Homo Sapiens; identical to SEQ ID NO: 160346

SEQ ID NO: 663095 - RNA, 64 nt, Homo Sapiens; identical to SEQ ID NO: 160347

SEQ ID NO: 663096 - RNA, 64 nt, Homo Sapiens; identical to SEQ ID NO: 160348

SEQ ID NO: 663097 - RNA, 64 nt, Homo Sapiens; identical to SEQ ID NO: 160349

SEQ ID NO: 663098 - RNA, 64 nt, Homo Sapiens; identical to SEQ ID NO: 160350

SEQ ID NO: 663099 - RNA, 64 nt, Homo Sapiens; identical to SEQ ID NO: 160351

SEQ ID NO: 663100 - RNA, 64 nt, Homo Sapiens; identical to SEQ ID NO: 160352

SEQ ID NO: 663101 - RNA, 64 nt, Homo Sapiens; identical to SEQ ID NO: 160353

SEQ ID NO: 663102 - RNA, 64 nt, Homo Sapiens
agggcugguguugauuuuccucccugcagagccaauggugcacauugguuuaagcccagagauc

SEQ ID NO: 663103 - RNA, 64 nt, Homo Sapiens
cccagccucccggagcucugagcacgccccacgcauggugcaggagggacuggacagaucugag

SEQ ID NO: 663104 - RNA, 64 nt, Homo Sapiens
caacaaugcugaccggugcugagaaggauggcagauggugcagcucucacagagguggcucaca

SEQ ID NO: 663105 - RNA, 64 nt, Homo Sapiens
gaauggauucaggauguuguaugaaaaaugugugauggugcaagucuagaaacacuucugaugc

SEQ ID NO: 663106 - RNA, 64 nt, Homo Sapiens
ccauuauuugcccuauccaauuuucaagauuuaauaugagcaacuacagagugauuggcaaaua

SEQ ID NO: 663107 - RNA, 64 nt, Homo Sapiens
cuauuuuauaugaacuuuuucuuuguagugugaauaugagcaauaaauuaaaaacaacguauuc

SEQ ID NO: 663108 - RNA, 64 nt, Homo Sapiens
uucaguuuugugccaacauuccauguauuuugaauaugagcaaaaacugaucuuaagagcagac

SEQ ID NO: 663109 - RNA, 64 nt, Homo Sapiens
cuuaguuacaagucuuuggaaacucuuguuuacuuaugagcauaaucauuccuuggaguuauac

SEQ ID NO: 663110 - RNA, 64 nt, Homo Sapiens
acuuaaaaauugugaauucuguuguugugauaaauaugagcaaaugaaguguaauaucuauaga

SEQ ID NO: 663111 - RNA, 64 nt, Homo Sapiens
ucauuuucucaauaguacaugaaaucaagaugcuuaugagcauggaaauguauuuaaaguuuuu

SEQ ID NO: 663112 - RNA, 64 nt, Homo Sapiens
uaaacauuuuaugcuugcauuuaaacuugaaauguaugagcagaaugagacaaucaguuaaauc

SEQ ID NO: 663113 - RNA, 64 nt, Homo Sapiens
ggaccaugagguagcuuuggccaauggauuccuuuaugagcaugaagcauguggcaauggcugu

SEQ ID NO: 663114 - RNA, 64 nt, Homo Sapiens
ugaaauugacaccgacucugccuacauucuuuucuaugagcagcaggggauagacuacgcacaa

SEQ ID NO: 663115 - RNA, 64 nt, Homo Sapiens; identical to SEQ ID NO: 91745

SEQ ID NO: 663116 - RNA, 64 nt, Homo Sapiens; identical to SEQ ID NO: 91746

SEQ ID NO: 663117 - RNA, 64 nt, Homo Sapiens; identical to SEQ ID NO: 91747

SEQ ID NO: 663118 - RNA, 64 nt, Homo Sapiens; identical to SEQ ID NO: 91748

SEQ ID NO: 663119 - RNA, 64 nt, Homo Sapiens; identical to SEQ ID NO: 91749

SEQ ID NO: 663120 - RNA, 64 nt, Homo Sapiens; identical to SEQ ID NO: 91750

SEQ ID NO: 663121 - RNA, 64 nt, Homo Sapiens; identical to SEQ ID NO: 91751

SEQ ID NO: 663122 - RNA, 64 nt, Homo Sapiens; identical to SEQ ID NO: 91752

SEQ ID NO: 663123 - RNA, 64 nt, Homo Sapiens; identical to SEQ ID NO: 91753

SEQ ID NO: 663124 - RNA, 64 nt, Homo Sapiens; identical to SEQ ID NO: 91754

SEQ ID NO: 663125 - RNA, 64 nt, Homo Sapiens; identical to SEQ ID NO: 91755

SEQ ID NO: 663126 - RNA, 64 nt, Homo Sapiens; identical to SEQ ID NO: 91756

SEQ ID NO: 663127 - RNA, 64 nt, Homo Sapiens; identical to SEQ ID NO: 91757

SEQ ID NO: 663128 - RNA, 64 nt, Homo Sapiens; identical to SEQ ID NO: 91758

SEQ ID NO: 663129 - RNA, 64 nt, Homo Sapiens; identical to SEQ ID NO: 91759

SEQ ID NO: 663130 - RNA, 64 nt, Homo Sapiens; identical to SEQ ID NO: 91760

SEQ ID NO: 663131 - RNA, 64 nt, Homo Sapiens; identical to SEQ ID NO: 91761

SEQ ID NO: 663132 - RNA, 64 nt, Homo Sapiens; identical to SEQ ID NO: 91762

SEQ ID NO: 663133 - RNA, 64 nt, Homo Sapiens; identical to SEQ ID NO: 91763

SEQ ID NO: 663134 - RNA, 64 nt, Homo Sapiens; identical to SEQ ID NO: 91764

SEQ ID NO: 663135 - RNA, 64 nt, Homo Sapiens; identical to SEQ ID NO: 91765

SEQ ID NO: 663136 - RNA, 64 nt, Homo Sapiens; identical to SEQ ID NO: 91766

SEQ ID NO: 663137 - RNA, 64 nt, Homo Sapiens; identical to SEQ ID NO: 91767

SEQ ID NO: 663138 - RNA, 64 nt, Homo Sapiens; identical to SEQ ID NO: 91768

SEQ ID NO: 663139 - RNA, 64 nt, Homo Sapiens; identical to SEQ ID NO: 91769

SEQ ID NO: 663140 - RNA, 64 nt, Homo Sapiens; identical to SEQ ID NO: 91770

SEQ ID NO: 663141 - RNA, 64 nt, Homo Sapiens; identical to SEQ ID NO: 91771

SEQ ID NO: 663142 - RNA, 64 nt, Homo Sapiens; identical to SEQ ID NO: 91772

SEQ ID NO: 663143 - RNA, 64 nt, Homo Sapiens; identical to SEQ ID NO: 91773

SEQ ID NO: 663144 - RNA, 64 nt, Homo Sapiens; identical to SEQ ID NO: 91774

SEQ ID NO: 663145 - RNA, 64 nt, Homo Sapiens; identical to SEQ ID NO: 91775

SEQ ID NO: 663146 - RNA, 64 nt, Homo Sapiens; identical to SEQ ID NO: 91776

SEQ ID NO: 663147 - RNA, 64 nt, Homo Sapiens; identical to SEQ ID NO: 91777

SEQ ID NO: 663148 - RNA, 64 nt, Homo Sapiens; identical to SEQ ID NO: 91778

SEQ ID NO: 663149 - RNA, 64 nt, Homo Sapiens; identical to SEQ ID NO: 91779

SEQ ID NO: 663150 - RNA, 64 nt, Homo Sapiens; identical to SEQ ID NO: 91780

SEQ ID NO: 663151 - RNA, 64 nt, Homo Sapiens; identical to SEQ ID NO: 91781

SEQ ID NO: 663152 - RNA, 64 nt, Homo Sapiens; identical to SEQ ID NO: 91782

SEQ ID NO: 663153 - RNA, 64 nt, Homo Sapiens; identical to SEQ ID NO: 91783

SEQ ID NO: 663154 - RNA, 64 nt, Homo Sapiens; identical to SEQ ID NO: 91784

SEQ ID NO: 663155 - RNA, 64 nt, Homo Sapiens; identical to SEQ ID NO: 91785

SEQ ID NO: 663156 - RNA, 64 nt, Homo Sapiens; identical to SEQ ID NO: 91786

SEQ ID NO: 663157 - RNA, 64 nt, Homo Sapiens; identical to SEQ ID NO: 91787

SEQ ID NO: 663158 - RNA, 64 nt, Homo Sapiens; identical to SEQ ID NO: 91788

SEQ ID NO: 663159 - RNA, 64 nt, Homo Sapiens; identical to SEQ ID NO: 91789

SEQ ID NO: 663160 - RNA, 64 nt, Homo Sapiens; identical to SEQ ID NO: 91790

SEQ ID NO: 663161 - RNA, 64 nt, Homo Sapiens; identical to SEQ ID NO: 91791

SEQ ID NO: 663162 - RNA, 64 nt, Homo Sapiens; identical to SEQ ID NO: 91792

SEQ ID NO: 663163 - RNA, 64 nt, Homo Sapiens; identical to SEQ ID NO: 91793

SEQ ID NO: 663164 - RNA, 64 nt, Homo Sapiens; identical to SEQ ID NO: 91794

SEQ ID NO: 663165 - RNA, 64 nt, Homo Sapiens; identical to SEQ ID NO: 91795

SEQ ID NO: 663166 - RNA, 64 nt, Homo Sapiens; identical to SEQ ID NO: 91796

SEQ ID NO: 663167 - RNA, 64 nt, Homo Sapiens; identical to SEQ ID NO: 91797

SEQ ID NO: 663168 - RNA, 64 nt, Homo Sapiens; identical to SEQ ID NO: 91798

SEQ ID NO: 663169 - RNA, 64 nt, Homo Sapiens; identical to SEQ ID NO: 91799

SEQ ID NO: 663170 - RNA, 64 nt, Homo Sapiens; identical to SEQ ID NO: 91800

SEQ ID NO: 663171 - RNA, 54 nt, Homo Sapiens; identical to SEQ ID NO: 91801

SEQ ID NO: 663172 - RNA, 64 nt, Homo Sapiens
ugaaugcccaggagcauuucuggggggcagcuaagacuggcagcuggguugguguguuagcggg

SEQ ID NO: 663173 - RNA, 64 nt, Homo Sapiens
gaagcacuucucagccaaggcaccccugcccugggacuggcagggcaggggcaggggcagggac

SEQ ID NO: 663174 - RNA, 64 nt, Homo Sapiens
guggagaaaacagaggaaaacuugcaguuacgaagacuggcaacuuggcuuuacuaaguuuuca

SEQ ID NO: 663175 - RNA, 64 nt, Homo Sapiens
cgaagacuggcaacuuggcuuuacuaaguuuucagacuggcaggaagucaaaccuauuaggcug

SEQ ID NO: 663176 - RNA, 64 nt, Homo Sapiens
gggaaugucauggucuugcuuuacuaaguuuugagacuggcagguagugaaacucauuaggcug

SEQ ID NO: 663177 - RNA, 64 nt, Homo Sapiens
uuauauauuugcaagcaaaggacaguaagaaguugacuggcaaaagagcagugcugaaggagga

SEQ ID NO: 663178 - RNA, 64 nt, Homo Sapiens
uuguuuaagguauuaagcacgaauuauuacaugagacuggcagauagcuauuaauccucuuaca

SEQ ID NO: 663179 - RNA, 64 nt, Homo Sapiens; identical to SEQ ID NO: 193898

SEQ ID NO: 663180 - RNA, 64 nt, Homo Sapiens; identical to SEQ ID NO: 193899

SEQ ID NO: 663181 - RNA, 64 nt, Homo Sapiens; identical to SEQ ID NO: 193900

SEQ ID NO: 663182 - RNA, 64 nt, Homo Sapiens; identical to SEQ ID NO: 193901

SEQ ID NO: 663183 - RNA, 64 nt, Homo Sapiens; identical to SEQ ID NO: 193902

SEQ ID NO: 663184 - RNA, 64 nt, Homo Sapiens; identical to SEQ ID NO: 193903

SEQ ID NO: 663185 - RNA, 64 nt, Homo Sapiens; identical to SEQ ID NO: 193904

SEQ ID NO: 663186 - RNA, 64 nt, Homo Sapiens; identical to SEQ ID NO: 193905

SEQ ID NO: 663187 - RNA, 64 nt, Homo Sapiens; identical to SEQ ID NO: 193906

SEQ ID NO: 663188 - RNA, 64 nt, Homo Sapiens; identical to SEQ ID NO: 193907

SEQ ID NO: 663189 - RNA, 64 nt, Homo Sapiens; identical to SEQ ID NO: 193908

SEQ ID NO: 663190 - RNA, 64 nt, Homo Sapiens; identical to SEQ ID NO: 193909

SEQ ID NO: 663191 - RNA, 64 nt, Homo Sapiens; identical to SEQ ID NO: 193910

SEQ ID NO: 663192 - RNA, 64 nt, Homo Sapiens; identical to SEQ ID NO: 193911

SEQ ID NO: 663193 - RNA, 64 nt, Homo Sapiens; identical to SEQ ID NO: 193912

SEQ ID NO: 663194 - RNA, 64 nt, Homo Sapiens; identical to SEQ ID NO: 193913

SEQ ID NO: 663195 - RNA, 64 nt, Homo Sapiens; identical to SEQ ID NO: 193914

SEQ ID NO: 663196 - RNA, 64 nt, Homo Sapiens; identical to SEQ ID NO: 193915

SEQ ID NO: 663197 - RNA, 64 nt, Homo Sapiens; identical to SEQ ID NO: 193916

SEQ ID NO: 663198 - RNA, 64 nt, Homo Sapiens; identical to SEQ ID NO: 193917

SEQ ID NO: 663199 - RNA, 64 nt, Homo Sapiens; identical to SEQ ID NO: 193918

SEQ ID NO: 663200 - RNA, 64 nt, Homo Sapiens; identical to SEQ ID NO: 193919

SEQ ID NO: 663201 - RNA, 66 nt, Homo Sapiens
uuuaaguauuggaauuucacaaaagacauaggacuuaacuggaaaaugaaaaaaaaaagaaaaaga

SEQ ID NO: 663202 - RNA, 66 nt, Homo Sapiens
caccccagaaagugggaauuugauuuuauccuuccgaacuggaagaacauuuuuaugaagaauuuu

SEQ ID NO: 663203 - RNA, 66 nt, Homo Sapiens
agaauacaaaggguauacucuguuggaugcaccagaaacuggaaacugggaccaguggcagagaug

SEQ ID NO: 663204 - RNA, 66 nt, Homo Sapiens
aacccagaugcccaugagcaagagaguggacaaguaaacuggaauauucacauaauagaacauuau

SEQ ID NO: 663205 - RNA, 66 nt, Homo Sapiens
uggagguucaacacuacguaccgcacuuuauaauuuaacuggaauugagaugaaggccagugacau

SEQ ID NO: 663206 - RNA, 66 nt, Homo Sapiens
gacaaaagccaggcucaacuuauagaauguuuuggaaacuggaaguaaugauacauuucacuucag

SEQ ID NO: 663207 - RNA, 66 nt, Homo Sapiens
gagcugaugugagugugugugaugggaucuguaaggaacuggaacacacauguccuauccaaagga

SEQ ID NO: 663208 - RNA, 66 nt, Homo Sapiens
ucaggaccuggcuuggcuuuaaccguuuuucaagaaaacuggaaaucuggauuuucagcgaacaug

SEQ ID NO: 663209 - RNA, 66 nt, Homo Sapiens
ggaggagaguccuucucggcagagcucacugcaaacaacuggaauugagguugcacacugugauuu

SEQ ID NO: 663210 - RNA, 66 nt, Homo Sapiens
uuagaaaacagaggaguuuguagccagcagccuguaaacuggaaacacuggucucagccaaccucc

SEQ ID NO: 663211 - RNA, 66 nt, Homo Sapiens
uguguaaaaugguauauucuuuaaaauaguguugauaacuggaauauuguauguaugcuuggagau

SEQ ID NO: 663212 - RNA, 66 nt, Homo Sapiens
ucaacuccguaaaaaagacagcuguauuuuccguccaacuggaauuguugaaucacacugcauagc

SEQ ID NO: 663213 - RNA, 66 nt, Homo Sapiens
ccuuucaguauaagcugaauaaauuuagagcuuucaaacuggaaaaaaaaaugaaacaaaacaaau

SEQ ID NO: 663214 - RNA, 66 nt, Homo Sapiens
gcagguggauacccgcuuccauggucuugcacuauaaacuggaauggauuucucaaugcgggacca

SEQ ID NO: 663215 - RNA, 66 nt, Homo Sapiens
caaagcuaauuuuuuuuacaugucaauauuggcacaaacuggaaugaaagaauaguuugauucaga

SEQ ID NO: 663216 - RNA, 66 nt, Homo Sapiens
cuacuaaauauacaggguauguccuaacauggaguuaacuggaauagcaguacacuagcaaguauc

SEQ ID NO: 663217 - RNA, 66 nt, Homo Sapiens
acccuuuggcugugcugcgagccuucuaguugugccaacuggaacccacacccuccaauucacacu

SEQ ID NO: 663218 - RNA, 66 nt, Homo Sapiens
auugaguuucuuuauuuuuauaacgugaaauccauuaacuggaauaccauugaaaguuaaacuauu

SEQ ID NO: 663219 - RNA, 66 nt, Homo Sapiens
guccccuuccccaggggagcaagccaugggaacgccaacuggaaaggcucugcuggacacccaaga

SEQ ID NO: 663220 - RNA, 66 nt, Homo Sapiens
ugguggaauguuuuggaauuauaaaguuguacugugaacuggaagauuucauaucaccuccauccc

SEQ ID NO: 663221 - RNA, 66 nt, Homo Sapiens
ggcuccagggcgggaggcaagcccccuugccuuucaaacuggaaaccccagagaaaacggugcccc

SEQ ID NO: 663222 - RNA, 66 nt, Homo Sapiens
gacgguugggggcugggagcccugggcguguaguguaacuggaaucuuuugccucucccagccacc

SEQ ID NO: 663223 - RNA, 66 nt, Homo Sapiens
uuuguauaacucuaaacgcccaugauaguagcuucaaacuggaaauagcgaaauaaaauaacucag

SEQ ID NO: 663224 - RNA, 66 nt, Homo Sapiens
uauacaaaaguaaauugggacauacauaacaacuggaacuggaaauuguugguaacuucacuagag

SEQ ID NO: 663225 - RNA, 66 nt, Homo Sapiens
ggaaauuauacaaaaguaaacuagagcauacauaacaacuggaacuauagacuguugguaacuuca

SEQ ID NO: 663226 - RNA, 66 nt, Homo Sapiens
uaguucuccuucaaguguugagaaguucaacaccaaaacuggaacauugguaguagguauuucgug

SEQ ID NO: 663227 - RNA, 54 nt, Homo Sapiens; identical to SEQ ID NO: 116395

SEQ ID NO: 663228 - RNA, 66 nt, Homo Sapiens
aaucuaauuuuaggaggaccaaauucaguggauggcaacuggaacauugauuguaaggccagugaa

SEQ ID NO: 663229 - RNA, 66 nt, Homo Sapiens
ggaacauugauuguaaggccagugaaguuuucacccaacuggaauuugauggaaagaagguuugug

SEQ ID NO: 663230 - RNA, 66 nt, Homo Sapiens
guucuguagggauuuacuggugacugcuuguugccaaacuggaaauuacaaaugugaaugaucgac

SEQ ID NO: 663231 - RNA, 66 nt, Homo Sapiens
cugccucuuggguucucaccuuucuuucucaauauuaacuggaaugaacaagaggcaacuugucac

SEQ ID NO: 663232 - RNA, 66 nt, Homo Sapiens
uauuuauuuuuuaauaaccccagcucugcuugccgaaacuggaaguucagagucccgcagguaccc

SEQ ID NO: 663233 - RNA, 66 nt, Homo Sapiens
acagaaaacuagaauuucauuucuacugcuucuaccaacuggaagcaggccaaauucccuccuccc

SEQ ID NO: 663234 - RNA, 66 nt, Homo Sapiens
uagaacgcuugagaggcacuuuguaaagauuuguuaaacuggaaacguuuuacaugaucugauaca

SEQ ID NO: 663235 - RNA, 66 nt, Homo Sapiens
uagaaugcuugagaggcacugaguaaagauuuguugaacuggaaauguuuuacaugauucuuaaac

SEQ ID NO: 663236 - RNA, 66 nt, Homo Sapiens
uuuaaaauuuauuauuuugaucuugaauuauuuauaaacuggaaagugguuugauuauugugaguc

SEQ ID NO: 663237 - RNA, 66 nt, Homo Sapiens
acaaacaaacaaacaaacaacguaucuuacugacuaaacuggaauggaaaucuuauaauuaguguu

SEQ ID NO: 663238 - RNA, 66 nt, Homo Sapiens
ggggccagccugaggacccccgccuaccaccucgagaacuggaagccaaccucuaaccuccugacc

SEQ ID NO: 663239 - RNA, 66 nt, Homo Sapiens
ggcuucaccagugcccaagucucuauggagaaugagaacuggaagccacugcuaccgucuacccag

SEQ ID NO: 663240 - RNA, 66 nt, Homo Sapiens
gaauaacuuuuucaagcaauguggggcugcuuguagaacuggaaguaccagcuuuggcucgggaga

SEQ ID NO: 663241 - RNA, 66 nt, Homo Sapiens
uuuguguuguaucuguaacacguuugaauuccuucuaacuggaacauggcuuggaccuuggcauuc

SEQ ID NO: 663242 - RNA, 66 nt, Homo Sapiens
cgagcuguaccuggcacggcccauccuggacugagaaacuggaaccucagaggaacccgugccucu

SEQ ID NO: 663243 - RNA, 66 nt, Homo Sapiens
cccugcugaauggaggagccgggggucccccaggccaacuggaaaaucucccaggcuaggccaauu

SEQ ID NO: 663244 - RNA, 64 nt, Homo Sapiens
uuagccguaguggaauuaacagauaagggugucuuccuagaacaguguucccaucugagcccag

SEQ ID NO: 663245 - RNA, 64 nt, Homo Sapiens
ugaaguuucagagcuacacagugaguagcugcauuccuagaaaucuucaagcagggaagcccca

SEQ ID NO: 663246 - RNA, 64 nt, Homo Sapiens
ugguaauugagauuacucaguuacacucuauccuuccuagaaaacuacaugaaauguuuagcuc

SEQ ID NO: 663247 - RNA, 64 nt, Homo Sapiens
uaaucuauaccauaauauuucuacacuuaacuucuccuagaagcuuaaucuucaagaaaucaug

SEQ ID NO: 663248 - RNA, 64 nt, Homo Sapiens
ggauuguaaccaugugaugacuuaucuuacaaagcucaaauacuugugcucaaauaaauguuua

SEQ ID NO: 663249 - RNA, 64 nt, Homo Sapiens
uguuuacuuaucuuacaaagagacuuuuguugugcucaaauaaaaaucccagaauacugugugu

SEQ ID NO: 663250 - RNA, 64 nt, Homo Sapiens
aagaagacuuuuaaguuuuaauagucauuaugggcucaaauagagcaaaagagccauguucaaa

SEQ ID NO: 663251 - RNA, 64 nt, Homo Sapiens
ccauuugcagacagaccguccaugucucauucuccucaaauauucaaggaaaaaagguauauca

SEQ ID NO: 663252 - RNA, 64 nt, Homo Sapiens
ccaucauaugggauggguaguacauuuucuuuuucucaaauaugacauccagaagguaaagaaa

SEQ ID NO: 663253 - RNA, 64 nt, Homo Sapiens
aaagauccuggccugugguagugguagcaguuuucucaaauaauguggugacagucacuagauc

SEQ ID NO: 663254 - RNA, 64 nt, Homo Sapiens
uauauacaaaggagacuuuuuuuuugagauaacacucaaauaguauucucuucuuuugaaaauu

SEQ ID NO: 663255 - RNA, 64 nt, Homo Sapiens
uauaguaauuugcauucccacauaaguuugaguguuacgaaaacauuccuuuaaagggaucugu

SEQ ID NO: 663256 - RNA, 64 nt, Homo Sapiens
uuugcaauuuuaucaguaauuugacuuagaguuuuuacgaaaccucuuuuguuguccuugcccc

SEQ ID NO: 663257 - RNA, 64 nt, Homo Sapiens
aaaaaguugaguuuccaaugauuuauaucacaauuuacgaaacccacuuacaguauacauauau

SEQ ID NO: 663258 - RNA, 64 nt, Homo Sapiens
gcauuucauuguuauguuuuugccauagaaguauuuacgaaauuucugaggaaaauaauccuug

SEQ ID NO: 663259 - RNA, 64 nt, Homo Sapiens
gcugcucaucagcgucaaaauaguucaaauaauuuuacgaaaaaaaacucagcuucuguuguuu

SEQ ID NO: 663260 - RNA, 64 nt, Homo Sapiens
ugucugagugacacuuuucaaauguugagauuacuuacgaaauagucuuuguauauaucuguau

SEQ ID NO: 663261 - RNA, 64 nt, Homo Sapiens
agagaccuuucccuaugacuguggcauuaggaacuuacgaaaccuguucucucuuucuugaggg

SEQ ID NO: 663262 - RNA, 64 nt, Homo Sapiens
agaagaagggcaaagauaagaacaauauuagcuguuacgaaauuuuaacuguaucuuccaaaau

SEQ ID NO: 663263 - RNA, 64 nt, Homo Sapiens
aaguucaaaacuuauuggaauguugagagugugguuacgaaauacguuaggaggacaaaaggaa

SEQ ID NO: 663264 - RNA, 64 nt, Homo Sapiens
uuucuugucuuuugaaauugacacuuggccugacuuacgaaacuuguacuauaugaaauugguc

SEQ ID NO: 663265 - RNA, 64 nt, Homo Sapiens
ucuuuucuuuucucucucucucucucuuuuuuuuuuacgaaagacuuagaauugcauuuguccu

SEQ ID NO: 663266 - RNA, 64 nt, Homo Sapiens
ucaauaauuaagcaaauugcccccuagacuuuucuuacgaaaaggcaacucuguucucccccuu

SEQ ID NO: 663267 - RNA, 64 nt, Homo Sapiens
cauguucuucuccagucccccugauucguaaggguuacgaaacucaggcauucacagaacccuu

SEQ ID NO: 663268 - RNA, 64 nt, Homo Sapiens
aauuuggaaauuagguugaaacauaucucuuaucuuacgaaaaaaugguagcauuuuaaacaaa

SEQ ID NO: 663269 - RNA, 64 nt, Homo Sapiens
gacuuugaauauacucuaaaaguggacagaaaauuuacgaaaaucuuagauuuuguuuagaaug

SEQ ID NO: 663270 - RNA, 64 nt, Homo Sapiens
uuuuaauaggcauuucacuacugccaugcuggccuuacgaaauggaugggacuacugaugcaca

SEQ ID NO: 663271 - RNA, 64 nt, Homo Sapiens
augggaugaggaaaugcuuggauccuuaaggaguuuacgaaaucugcuguuuuaucaaagugaa

SEQ ID NO: 663272 - RNA, 64 nt, Homo Sapiens
uaaauggccucuacagaguuuguaauuacagaauuuacgaaauguagggcaugauacaguaagg

SEQ ID NO: 663273 - RNA, 64 nt, Homo Sapiens
ugaacucauguuucaguucgcgaacauugacuccuuacgaaagucacuucauucuaacuagaug

SEQ ID NO: 663274 - RNA, 64 nt, Homo Sapiens
cuuugugucgauuucaccaaagcaaagguuggccuuacgaaaucggcccucugcuuuucuuccc

SEQ ID NO: 663275 - RNA, 64 nt, Homo Sapiens
gucauuccugccuaauccaucgagagaaagaggcuuacgaaaaacuuugccucugaugcucagc

SEQ ID NO: 663276 - RNA, 64 nt, Homo Sapiens
gggaggggggcauuuuuuauguuacaaaaaaaaauuacgaaagaaaagaaaucucuaugcaaaa

SEQ ID NO: 663277 - RNA, 64 nt, Homo Sapiens
aagucaaucuguauccuaagaguaaaacagucauuuacgaaagaauauguccuacuucaggaaa

SEQ ID NO: 663278 - RNA, 64 nt, Homo Sapiens
uucagggugaaauccuaugcaucucuuugucaaauuacgaaaacagcugaccgagcucugguaa

SEQ ID NO: 663279 - RNA, 64 nt, Homo Sapiens
cauuguaauauugcugugcuguacauuuuggcccuuacgaaauacgucuuuuucagaacuguua

SEQ ID NO: 663280 - RNA, 64 nt, Homo Sapiens
uaccuacaguugaagcuaauguugagacugagacuuacgaaacugugaaucccacugggaaaaa

SEQ ID NO: 663281 - RNA, 64 nt, Homo Sapiens
uauucuaaaggaggcaggagcauuucuaauacucuuacgaaaacguuuccuauuccauacuguu

SEQ ID NO: 663282 - RNA, 64 nt, Homo Sapiens
aacaagcccuucaguacuggccccuuguguaaaguuacgaaaaaagcuauauuuuccaauagua

SEQ ID NO: 663283 - RNA, 64 nt, Homo Sapiens
guucuguguuuauuuuuuaauaagauguauuuucuuacgaaauaaugugcauuggauugcacac

SEQ ID NO: 663284 - RNA, 64 nt, Homo Sapiens
uguacuaauugugggggugcaaugcaucuuuaacuuacgaaagaugggaauuaggcuuauuuug

SEQ ID NO: 663285 - RNA, 64 nt, Homo Sapiens
acacaagcaguacggaugaagacucugagucugauuacgaaaaguacucuauguuacaguaaag

SEQ ID NO: 663286 - RNA, 64 nt, Homo Sapiens
uucugggacacugaguuagaugguaaauacugacuuacgaaaguugaauugggugaggcgggca

SEQ ID NO: 663287 - RNA, 64 nt, Homo Sapiens
uguauuccuugcucacuugcuacuagcaggcgacuuacgaaauaaugauguuggcaccaguucc

SEQ ID NO: 663288 - RNA, 64 nt, Homo Sapiens
cccagguuagaccgcauaaaaaauaaaggagcucuuacgaaaaacccuuuccuuaaaauauaag

SEQ ID NO: 663289 - RNA, 64 nt, Homo Sapiens
gaucuuuacaauguaucccaagaaagguacaggcuuacgaaaauaacacgucauugauagcaaa

SEQ ID NO: 663290 - RNA, 64 nt, Homo Sapiens
agaacgacuucacguuggaggaagaaacucauucuuacgaaauuagguaaaagcagcguuuaau

SEQ ID NO: 663291 - RNA, 64 nt, Homo Sapiens
uuggcuucugucauggagaccauguaaaaggcuguuacgaaagcgauucacuuuucuccaaaga

SEQ ID NO: 663292 - RNA, 64 nt, Homo Sapiens
cuugaaguuuuguguccauuaaucaauccuuucauuacgaaagauuuuuagaauauuuauuuug

SEQ ID NO: 663293 - RNA, 64 nt, Homo Sapiens
ugcauagcauuagaagacaaaccacuauacaaacuuacgaaacauuuucuuuuuucuaauuaaa

SEQ ID NO: 663294 - RNA, 64 nt, Homo Sapiens
uagggagugcagcccugagccugcccacuccucauuacgaaaugacuguauuuaaaggaaaucu

SEQ ID NO: 663295 - RNA, 64 nt, Homo Sapiens
uauuuuuagaacuuguuuagcuaaaucugauagauuacgaaauaaauacguuuucaggaaaaug

SEQ ID NO: 663296 - RNA, 64 nt, Homo Sapiens; identical to SEQ ID NO: 72435

SEQ ID NO: 663297 - RNA, 64 nt, Homo Sapiens; identical to SEQ ID NO: 72436

SEQ ID NO: 663298 - RNA, 64 nt, Homo Sapiens; identical to SEQ ID NO: 72437

SEQ ID NO: 663299 - RNA, 64 nt, Homo Sapiens; identical to SEQ ID NO: 72438

SEQ ID NO: 663300 - RNA, 64 nt, Homo Sapiens; identical to SEQ ID NO: 72439

SEQ ID NO: 663301 - RNA, 64 nt, Homo Sapiens; identical to SEQ ID NO: 72440

SEQ ID NO: 663302 - RNA, 64 nt, Homo Sapiens; identical to SEQ ID NO: 52004

SEQ ID NO: 663303 - RNA, 64 nt, Homo Sapiens; identical to SEQ ID NO: 52005

SEQ ID NO: 663304 - RNA, 64 nt, Homo Sapiens; identical to SEQ ID NO: 52006

SEQ ID NO: 663305 - RNA, 64 nt, Homo Sapiens; identical to SEQ ID NO: 52007

SEQ ID NO: 663306 - RNA, 64 nt, Homo Sapiens; identical to SEQ ID NO: 52008

SEQ ID NO: 663307 - RNA, 64 nt, Homo Sapiens; identical to SEQ ID NO: 52009

SEQ ID NO: 663308 - RNA, 64 nt, Homo Sapiens; identical to SEQ ID NO: 52010

SEQ ID NO: 663309 - RNA, 64 nt, Homo Sapiens; identical to SEQ ID NO: 52011

SEQ ID NO: 663310 - RNA, 64 nt, Homo Sapiens; identical to SEQ ID NO: 52012

SEQ ID NO: 663311 - RNA, 64 nt, Homo Sapiens; identical to SEQ ID NO: 52013

SEQ ID NO: 663312 - RNA, 64 nt, Homo Sapiens; identical to SEQ ID NO: 52014

SEQ ID NO: 663313 - RNA, 64 nt, Homo Sapiens; identical to SEQ ID NO: 52015

SEQ ID NO: 663314 - RNA, 64 nt, Homo Sapiens; identical to SEQ ID NO: 52016

SEQ ID NO: 663315 - RNA, 64 nt, Homo Sapiens; identical to SEQ ID NO: 52017

SEQ ID NO: 663316 - RNA, 64 nt, Homo Sapiens; identical to SEQ ID NO: 52018

SEQ ID NO: 663317 - RNA, 64 nt, Homo Sapiens; identical to SEQ ID NO: 52019

SEQ ID NO: 663318 - RNA, 64 nt, Homo Sapiens; identical to SEQ ID NO: 52020

SEQ ID NO: 663319 - RNA, 64 nt, Homo Sapiens; identical to SEQ ID NO: 52021

SEQ ID NO: 663320 - RNA, 64 nt, Homo Sapiens; identical to SEQ ID NO: 52022

SEQ ID NO: 663321 - RNA, 64 nt, Homo Sapiens; identical to SEQ ID NO: 52023

SEQ ID NO: 663322 - RNA, 64 nt, Homo Sapiens; identical to SEQ ID NO: 52024

SEQ ID NO: 663323 - RNA, 64 nt, Homo Sapiens; identical to SEQ ID NO: 52025

SEQ ID NO: 663324 - RNA, 64 nt, Homo Sapiens; identical to SEQ ID NO: 52026

SEQ ID NO: 663325 - RNA, 64 nt, Homo Sapiens; identical to SEQ ID NO: 52027

SEQ ID NO: 663326 - RNA, 64 nt, Homo Sapiens; identical to SEQ ID NO: 52028

SEQ ID NO: 663327 - RNA, 64 nt, Homo Sapiens; identical to SEQ ID NO: 52029

SEQ ID NO: 663328 - RNA, 64 nt, Homo Sapiens; identical to SEQ ID NO: 52030

SEQ ID NO: 663329 - RNA, 64 nt, Homo Sapiens; identical to SEQ ID NO: 52031

SEQ ID NO: 663330 - RNA, 64 nt, Homo Sapiens; identical to SEQ ID NO: 52032

SEQ ID NO: 663331 - RNA, 64 nt, Homo Sapiens; identical to SEQ ID NO: 52033

SEQ ID NO: 663332 - RNA, 64 nt, Homo Sapiens; identical to SEQ ID NO: 52034

SEQ ID NO: 663333 - RNA, 64 nt, Homo Sapiens; identical to SEQ ID NO: 52035

SEQ ID NO: 663334 - RNA, 64 nt, Homo Sapiens; identical to SEQ ID NO: 52036

SEQ ID NO: 663335 - RNA, 64 nt, Homo Sapiens; identical to SEQ ID NO: 52037

SEQ ID NO: 663336 - RNA, 64 nt, Homo Sapiens; identical to SEQ ID NO: 52038

SEQ ID NO: 663337 - RNA, 64 nt, Homo Sapiens; identical to SEQ ID NO: 52039

SEQ ID NO: 663338 - RNA, 64 nt, Homo Sapiens; identical to SEQ ID NO: 52040

SEQ ID NO: 663339 - RNA, 64 nt, Homo Sapiens; identical to SEQ ID NO: 52041

SEQ ID NO: 663340 - RNA, 64 nt, Homo Sapiens; identical to SEQ ID NO: 52042

SEQ ID NO: 663341 - RNA, 64 nt, Homo Sapiens; identical to SEQ ID NO: 52043

SEQ ID NO: 663342 - RNA, 64 nt, Homo Sapiens; identical to SEQ ID NO: 52044

SEQ ID NO: 663343 - RNA, 64 nt, Homo Sapiens; identical to SEQ ID NO: 52045

SEQ ID NO: 663344 - RNA, 64 nt, Homo Sapiens; identical to SEQ ID NO: 52046

SEQ ID NO: 663345 - RNA, 64 nt, Homo Sapiens; identical to SEQ ID NO: 52047

SEQ ID NO: 663346 - RNA, 64 nt, Homo Sapiens; identical to SEQ ID NO: 52048

SEQ ID NO: 663347 - RNA, 64 nt, Homo Sapiens; identical to SEQ ID NO: 52049

SEQ ID NO: 663348 - RNA, 64 nt, Homo Sapiens; identical to SEQ ID NO: 52050

SEQ ID NO: 663349 - RNA, 64 nt, Homo Sapiens; identical to SEQ ID NO: 52051

SEQ ID NO: 663350 - RNA, 64 nt, Homo Sapiens; identical to SEQ ID NO: 52052

SEQ ID NO: 663351 - RNA, 64 nt, Homo Sapiens; identical to SEQ ID NO: 52053

SEQ ID NO: 663352 - RNA, 64 nt, Homo Sapiens; identical to SEQ ID NO: 52054

SEQ ID NO: 663353 - RNA, 64 nt, Homo Sapiens; identical to SEQ ID NO: 52055

SEQ ID NO: 663354 - RNA, 64 nt, Homo Sapiens; identical to SEQ ID NO: 52056

SEQ ID NO: 663355 - RNA, 64 nt, Homo Sapiens; identical to SEQ ID NO: 52057

SEQ ID NO: 663356 - RNA, 64 nt, Homo Sapiens; identical to SEQ ID NO: 52058

SEQ ID NO: 663357 - RNA, 64 nt, Homo Sapiens; identical to SEQ ID NO: 52059

SEQ ID NO: 663358 - RNA, 64 nt, Homo Sapiens; identical to SEQ ID NO: 52060

SEQ ID NO: 663359 - RNA, 64 nt, Homo Sapiens; identical to SEQ ID NO: 52061

SEQ ID NO: 663360 - RNA, 64 nt, Homo Sapiens; identical to SEQ ID NO: 52062

SEQ ID NO: 663361 - RNA, 64 nt, Homo Sapiens; identical to SEQ ID NO: 52063

SEQ ID NO: 663362 - RNA, 64 nt, Homo Sapiens; identical to SEQ ID NO: 52064

SEQ ID NO: 663363 - RNA, 64 nt, Homo Sapiens; identical to SEQ ID NO: 52065

SEQ ID NO: 663364 - RNA, 64 nt, Homo Sapiens; identical to SEQ ID NO: 52066

SEQ ID NO: 663365 - RNA, 64 nt, Homo Sapiens; identical to SEQ ID NO: 52067

SEQ ID NO: 663366 - RNA, 64 nt, Homo Sapiens; identical to SEQ ID NO: 52068

SEQ ID NO: 663367 - RNA, 64 nt, Homo Sapiens; identical to SEQ ID NO: 52069

SEQ ID NO: 663368 - RNA, 64 nt, Homo Sapiens; identical to SEQ ID NO: 52070

SEQ ID NO: 663369 - RNA, 64 nt, Homo Sapiens; identical to SEQ ID NO: 52071

SEQ ID NO: 663370 - RNA, 64 nt, Homo Sapiens; identical to SEQ ID NO: 52072

SEQ ID NO: 663371 - RNA, 64 nt, Homo Sapiens; identical to SEQ ID NO: 52073

SEQ ID NO: 663372 - RNA, 64 nt, Homo Sapiens; identical to SEQ ID NO: 52074

SEQ ID NO: 663373 - RNA, 64 nt, Homo Sapiens; identical to SEQ ID NO: 52075

SEQ ID NO: 663374 - RNA, 64 nt, Homo Sapiens; identical to SEQ ID NO: 52076

SEQ ID NO: 663375 - RNA, 64 nt, Homo Sapiens; identical to SEQ ID NO: 52077

SEQ ID NO: 663376 - RNA, 64 nt, Homo Sapiens; identical to SEQ ID NO: 52078

SEQ ID NO: 663377 - RNA, 64 nt, Homo Sapiens; identical to SEQ ID NO: 52079

SEQ ID NO: 663378 - RNA, 64 nt, Homo Sapiens; identical to SEQ ID NO: 52080

SEQ ID NO: 663379 - RNA, 64 nt, Homo Sapiens; identical to SEQ ID NO: 52081

SEQ ID NO: 663380 - RNA, 64 nt, Homo Sapiens; identical to SEQ ID NO: 52082

SEQ ID NO: 663381 - RNA, 64 nt, Homo Sapiens; identical to SEQ ID NO: 52083

SEQ ID NO: 663382 - RNA, 64 nt, Homo Sapiens; identical to SEQ ID NO: 52084

SEQ ID NO: 663383 - RNA, 64 nt, Homo Sapiens; identical to SEQ ID NO: 52085

SEQ ID NO: 663384 - RNA, 64 nt, Homo Sapiens; identical to SEQ ID NO: 52086

SEQ ID NO: 663385 - RNA, 64 nt, Homo Sapiens; identical to SEQ ID NO: 52087

SEQ ID NO: 663386 - RNA, 64 nt, Homo Sapiens; identical to SEQ ID NO: 52088

SEQ ID NO: 663387 - RNA, 64 nt, Homo Sapiens; identical to SEQ ID NO: 52089

SEQ ID NO: 663388 - RNA, 64 nt, Homo Sapiens; identical to SEQ ID NO: 52090

SEQ ID NO: 663389 - RNA, 64 nt, Homo Sapiens; identical to SEQ ID NO: 52091

SEQ ID NO: 663390 - RNA, 64 nt, Homo Sapiens; identical to SEQ ID NO: 52092

SEQ ID NO: 663391 - RNA, 64 nt, Homo Sapiens; identical to SEQ ID NO: 52093

SEQ ID NO: 663392 - RNA, 64 nt, Homo Sapiens; identical to SEQ ID NO: 52094

SEQ ID NO: 663393 - RNA, 64 nt, Homo Sapiens; identical to SEQ ID NO: 52095

SEQ ID NO: 663394 - RNA, 64 nt, Homo Sapiens; identical to SEQ ID NO: 52096

SEQ ID NO: 663395 - RNA, 64 nt, Homo Sapiens; identical to SEQ ID NO: 52097

SEQ ID NO: 663396 - RNA, 64 nt, Homo Sapiens; identical to SEQ ID NO: 52098

SEQ ID NO: 663397 - RNA, 64 nt, Homo Sapiens; identical to SEQ ID NO: 52099

SEQ ID NO: 663398 - RNA, 64 nt, Homo Sapiens; identical to SEQ ID NO: 52100

SEQ ID NO: 663399 - RNA, 64 nt, Homo Sapiens; identical to SEQ ID NO: 52101

SEQ ID NO: 663400 - RNA, 64 nt, Homo Sapiens; identical to SEQ ID NO: 52102

SEQ ID NO: 663401 - RNA, 64 nt, Homo Sapiens; identical to SEQ ID NO: 52103

SEQ ID NO: 663402 - RNA, 64 nt, Homo Sapiens; identical to SEQ ID NO: 52104

SEQ ID NO: 663403 - RNA, 64 nt, Homo Sapiens; identical to SEQ ID NO: 52105

SEQ ID NO: 663404 - RNA, 64 nt, Homo Sapiens; identical to SEQ ID NO: 52106

SEQ ID NO: 663405 - RNA, 64 nt, Homo Sapiens; identical to SEQ ID NO: 52107

SEQ ID NO: 663406 - RNA, 64 nt, Homo Sapiens; identical to SEQ ID NO: 52108

SEQ ID NO: 663407 - RNA, 64 nt, Homo Sapiens; identical to SEQ ID NO: 52109

SEQ ID NO: 663408 - RNA, 64 nt, Homo Sapiens; identical to SEQ ID NO: 52110

SEQ ID NO: 663409 - RNA, 64 nt, Homo Sapiens; identical to SEQ ID NO: 52111

SEQ ID NO: 663410 - RNA, 64 nt, Homo Sapiens; identical to SEQ ID NO: 52112

SEQ ID NO: 663411 - RNA, 64 nt, Homo Sapiens; identical to SEQ ID NO: 52113

SEQ ID NO: 663412 - RNA, 64 nt, Homo Sapiens; identical to SEQ ID NO: 52114

SEQ ID NO: 663413 - RNA, 64 nt, Homo Sapiens; identical to SEQ ID NO: 52115

SEQ ID NO: 663414 - RNA, 64 nt, Homo Sapiens; identical to SEQ ID NO: 52116

SEQ ID NO: 663415 - RNA, 64 nt, Homo Sapiens; identical to SEQ ID NO: 52117

SEQ ID NO: 663416 - RNA, 64 nt, Homo Sapiens; identical to SEQ ID NO: 52118

SEQ ID NO: 663417 - RNA, 64 nt, Homo Sapiens; identical to SEQ ID NO: 52119

SEQ ID NO: 663418 - RNA, 64 nt, Homo Sapiens; identical to SEQ ID NO: 52120

SEQ ID NO: 663419 - RNA, 64 nt, Homo Sapiens; identical to SEQ ID NO: 52121

SEQ ID NO: 663420 - RNA, 64 nt, Homo Sapiens; identical to SEQ ID NO: 52122

SEQ ID NO: 663421 - RNA, 64 nt, Homo Sapiens; identical to SEQ ID NO: 52123

SEQ ID NO: 663422 - RNA, 64 nt, Homo Sapiens; identical to SEQ ID NO: 52124

SEQ ID NO: 663423 - RNA, 64 nt, Homo Sapiens; identical to SEQ ID NO: 52125

SEQ ID NO: 663424 - RNA, 64 nt, Homo Sapiens; identical to SEQ ID NO: 52126

SEQ ID NO: 663425 - RNA, 64 nt, Homo Sapiens; identical to SEQ ID NO: 52127

SEQ ID NO: 663426 - RNA, 64 nt, Homo Sapiens; identical to SEQ ID NO: 52128

SEQ ID NO: 663427 - RNA, 64 nt, Homo Sapiens; identical to SEQ ID NO: 52129

SEQ ID NO: 663428 - RNA, 64 nt, Homo Sapiens; identical to SEQ ID NO: 52130

SEQ ID NO: 663429 - RNA, 64 nt, Homo Sapiens; identical to SEQ ID NO: 52131

SEQ ID NO: 663430 - RNA, 64 nt, Homo Sapiens; identical to SEQ ID NO: 52132

SEQ ID NO: 663431 - RNA, 64 nt, Homo Sapiens; identical to SEQ ID NO: 52133

SEQ ID NO: 663432 - RNA, 64 nt, Homo Sapiens; identical to SEQ ID NO: 52134

SEQ ID NO: 663433 - RNA, 64 nt, Homo Sapiens; identical to SEQ ID NO: 52135

SEQ ID NO: 663434 - RNA, 64 nt, Homo Sapiens; identical to SEQ ID NO: 52136

SEQ ID NO: 663435 - RNA, 64 nt, Homo Sapiens; identical to SEQ ID NO: 52137

SEQ ID NO: 663436 - RNA, 64 nt, Homo Sapiens; identical to SEQ ID NO: 52138

SEQ ID NO: 663437 - RNA, 64 nt, Homo Sapiens; identical to SEQ ID NO: 52139

SEQ ID NO: 663438 - RNA, 64 nt, Homo Sapiens; identical to SEQ ID NO: 52140

SEQ ID NO: 663439 - RNA, 64 nt, Homo Sapiens; identical to SEQ ID NO: 52141

SEQ ID NO: 663440 - RNA, 64 nt, Homo Sapiens; identical to SEQ ID NO: 52142

SEQ ID NO: 663441 - RNA, 64 nt, Homo Sapiens; identical to SEQ ID NO: 52143

SEQ ID NO: 663442 - RNA, 64 nt, Homo Sapiens; identical to SEQ ID NO: 52144

SEQ ID NO: 663443 - RNA, 64 nt, Homo Sapiens; identical to SEQ ID NO: 52145

SEQ ID NO: 663444 - RNA, 64 nt, Homo Sapiens; identical to SEQ ID NO: 52146

SEQ ID NO: 663445 - RNA, 64 nt, Homo Sapiens; identical to SEQ ID NO: 52147

SEQ ID NO: 663446 - RNA, 64 nt, Homo Sapiens; identical to SEQ ID NO: 52148

SEQ ID NO: 663447 - RNA, 64 nt, Homo Sapiens; identical to SEQ ID NO: 52149

SEQ ID NO: 663448 - RNA, 64 nt, Homo Sapiens; identical to SEQ ID NO: 52150

SEQ ID NO: 663449 - RNA, 64 nt, Homo Sapiens; identical to SEQ ID NO: 52151

SEQ ID NO: 663450 - RNA, 64 nt, Homo Sapiens; identical to SEQ ID NO: 52152

SEQ ID NO: 663451 - RNA, 64 nt, Homo Sapiens; identical to SEQ ID NO: 52153

SEQ ID NO: 663452 - RNA, 63 nt, Homo Sapiens; identical to SEQ ID NO: 52154

SEQ ID NO: 663453 - RNA, 64 nt, Homo Sapiens; identical to SEQ ID NO: 52155

SEQ ID NO: 663454 - RNA, 64 nt, Homo Sapiens; identical to SEQ ID NO: 52156

SEQ ID NO: 663455 - RNA, 64 nt, Homo Sapiens; identical to SEQ ID NO: 52157

SEQ ID NO: 663456 - RNA, 64 nt, Homo Sapiens; identical to SEQ ID NO: 52158

SEQ ID NO: 663457 - RNA, 64 nt, Homo Sapiens; identical to SEQ ID NO: 52159

SEQ ID NO: 663458 - RNA, 64 nt, Homo Sapiens; identical to SEQ ID NO: 52160

SEQ ID NO: 663459 - RNA, 64 nt, Homo Sapiens; identical to SEQ ID NO: 52161

SEQ ID NO: 663460 - RNA, 64 nt, Homo Sapiens; identical to SEQ ID NO: 52162

SEQ ID NO: 663461 - RNA, 64 nt, Homo Sapiens; identical to SEQ ID NO: 52163

SEQ ID NO: 663462 - RNA, 64 nt, Homo Sapiens; identical to SEQ ID NO: 52164

SEQ ID NO: 663463 - RNA, 64 nt, Homo Sapiens; identical to SEQ ID NO: 52165

SEQ ID NO: 663464 - RNA, 64 nt, Homo Sapiens; identical to SEQ ID NO: 52166

SEQ ID NO: 663465 - RNA, 64 nt, Homo Sapiens; identical to SEQ ID NO: 52167

SEQ ID NO: 663466 - RNA, 64 nt, Homo Sapiens; identical to SEQ ID NO: 52168

SEQ ID NO: 663467 - RNA, 64 nt, Homo Sapiens; identical to SEQ ID NO: 52169

SEQ ID NO: 663468 - RNA, 64 nt, Homo Sapiens; identical to SEQ ID NO: 52170

SEQ ID NO: 663469 - RNA, 64 nt, Homo Sapiens; identical to SEQ ID NO: 52171

SEQ ID NO: 663470 - RNA, 64 nt, Homo Sapiens; identical to SEQ ID NO: 52172

SEQ ID NO: 663471 - RNA, 64 nt, Homo Sapiens; identical to SEQ ID NO: 52173

SEQ ID NO: 663472 - RNA, 64 nt, Homo Sapiens; identical to SEQ ID NO: 52174

SEQ ID NO: 663473 - RNA, 64 nt, Homo Sapiens; identical to SEQ ID NO: 52175

SEQ ID NO: 663474 - RNA, 64 nt, Homo Sapiens; identical to SEQ ID NO: 52176

SEQ ID NO: 663475 - RNA, 64 nt, Homo Sapiens; identical to SEQ ID NO: 52177

SEQ ID NO: 663476 - RNA, 64 nt, Homo Sapiens; identical to SEQ ID NO: 52178

SEQ ID NO: 663477 - RNA, 64 nt, Homo Sapiens; identical to SEQ ID NO: 52179

SEQ ID NO: 663478 - RNA, 64 nt, Homo Sapiens; identical to SEQ ID NO: 52180

SEQ ID NO: 663479 - RNA, 64 nt, Homo Sapiens; identical to SEQ ID NO: 52181

SEQ ID NO: 663480 - RNA, 64 nt, Homo Sapiens; identical to SEQ ID NO: 52182

SEQ ID NO: 663481 - RNA, 64 nt, Homo Sapiens; identical to SEQ ID NO: 52183

SEQ ID NO: 663482 - RNA, 57 nt, Homo Sapiens; identical to SEQ ID NO: 52184

SEQ ID NO: 663483 - RNA, 52 nt, Homo Sapiens; identical to SEQ ID NO: 52185

SEQ ID NO: 663484 - RNA, 64 nt, Homo Sapiens; identical to SEQ ID NO: 52186

SEQ ID NO: 663485 - RNA, 64 nt, Homo Sapiens; identical to SEQ ID NO: 52187

SEQ ID NO: 663486 - RNA, 64 nt, Homo Sapiens; identical to SEQ ID NO: 52188

SEQ ID NO: 663487 - RNA, 64 nt, Homo Sapiens; identical to SEQ ID NO: 52189

SEQ ID NO: 663488 - RNA, 64 nt, Homo Sapiens; identical to SEQ ID NO: 52190

SEQ ID NO: 663489 - RNA, 64 nt, Homo Sapiens; identical to SEQ ID NO: 52191

SEQ ID NO: 663490 - RNA, 64 nt, Homo Sapiens; identical to SEQ ID NO: 52192

SEQ ID NO: 663491 - RNA, 64 nt, Homo Sapiens; identical to SEQ ID NO: 52193

SEQ ID NO: 663492 - RNA, 64 nt, Homo Sapiens; identical to SEQ ID NO: 52194

SEQ ID NO: 663493 - RNA, 64 nt, Homo Sapiens; identical to SEQ ID NO: 52195

SEQ ID NO: 663494 - RNA, 64 nt, Homo Sapiens; identical to SEQ ID NO: 52196

SEQ ID NO: 663495 - RNA, 64 nt, Homo Sapiens; identical to SEQ ID NO: 52197

SEQ ID NO: 663496 - RNA, 64 nt, Homo Sapiens; identical to SEQ ID NO: 52198

SEQ ID NO: 663497 - RNA, 64 nt, Homo Sapiens; identical to SEQ ID NO: 52199

SEQ ID NO: 663498 - RNA, 64 nt, Homo Sapiens; identical to SEQ ID NO: 52200

SEQ ID NO: 663499 - RNA, 64 nt, Homo Sapiens; identical to SEQ ID NO: 52201

SEQ ID NO: 663500 - RNA, 64 nt, Homo Sapiens; identical to SEQ ID NO: 52202

SEQ ID NO: 663501 - RNA, 64 nt, Homo Sapiens; identical to SEQ ID NO: 52203

SEQ ID NO: 663502 - RNA, 64 nt, Homo Sapiens; identical to SEQ ID NO: 52204

SEQ ID NO: 663503 - RNA, 64 nt, Homo Sapiens; identical to SEQ ID NO: 52205

SEQ ID NO: 663504 - RNA, 64 nt, Homo Sapiens; identical to SEQ ID NO: 52206

SEQ ID NO: 663505 - RNA, 64 nt, Homo Sapiens; identical to SEQ ID NO: 52207

SEQ ID NO: 663506 - RNA, 64 nt, Homo Sapiens; identical to SEQ ID NO: 52208

SEQ ID NO: 663507 - RNA, 64 nt, Homo Sapiens; identical to SEQ ID NO: 52209

SEQ ID NO: 663508 - RNA, 64 nt, Homo Sapiens; identical to SEQ ID NO: 52210

SEQ ID NO: 663509 - RNA, 64 nt, Homo Sapiens; identical to SEQ ID NO: 52211

SEQ ID NO: 663510 - RNA, 64 nt, Homo Sapiens; identical to SEQ ID NO: 52212

SEQ ID NO: 663511 - RNA, 64 nt, Homo Sapiens; identical to SEQ ID NO: 52213

SEQ ID NO: 663512 - RNA, 64 nt, Homo Sapiens; identical to SEQ ID NO: 52214

SEQ ID NO: 663513 - RNA, 64 nt, Homo Sapiens; identical to SEQ ID NO: 52215

SEQ ID NO: 663514 - RNA, 64 nt, Homo Sapiens; identical to SEQ ID NO: 52216

SEQ ID NO: 663515 - RNA, 64 nt, Homo Sapiens; identical to SEQ ID NO: 52217

SEQ ID NO: 663516 - RNA, 64 nt, Homo Sapiens; identical to SEQ ID NO: 52218

SEQ ID NO: 663517 - RNA, 64 nt, Homo Sapiens; identical to SEQ ID NO: 52219

SEQ ID NO: 663518 - RNA, 64 nt, Homo Sapiens; identical to SEQ ID NO: 52220

SEQ ID NO: 663519 - RNA, 64 nt, Homo Sapiens; identical to SEQ ID NO: 52221

SEQ ID NO: 663520 - RNA, 64 nt, Homo Sapiens; identical to SEQ ID NO: 52222

SEQ ID NO: 663521 - RNA, 64 nt, Homo Sapiens; identical to SEQ ID NO: 52223

SEQ ID NO: 663522 - RNA, 64 nt, Homo Sapiens; identical to SEQ ID NO: 52224

SEQ ID NO: 663523 - RNA, 64 nt, Homo Sapiens; identical to SEQ ID NO: 52225

SEQ ID NO: 663524 - RNA, 64 nt, Homo Sapiens; identical to SEQ ID NO: 52226

SEQ ID NO: 663525 - RNA, 64 nt, Homo Sapiens; identical to SEQ ID NO: 52227

SEQ ID NO: 663526 - RNA, 64 nt, Homo Sapiens; identical to SEQ ID NO: 52228

SEQ ID NO: 663527 - RNA, 64 nt, Homo Sapiens; identical to SEQ ID NO: 52229

SEQ ID NO: 663528 - RNA, 64 nt, Homo Sapiens; identical to SEQ ID NO: 52230

SEQ ID NO: 663529 - RNA, 64 nt, Homo Sapiens; identical to SEQ ID NO: 52231

SEQ ID NO: 663530 - RNA, 64 nt, Homo Sapiens; identical to SEQ ID NO: 52232

SEQ ID NO: 663531 - RNA, 64 nt, Homo Sapiens; identical to SEQ ID NO: 52233

SEQ ID NO: 663532 - RNA, 64 nt, Homo Sapiens; identical to SEQ ID NO: 52234

SEQ ID NO: 663533 - RNA, 64 nt, Homo Sapiens; identical to SEQ ID NO: 52235

SEQ ID NO: 663534 - RNA, 62 nt, Homo Sapiens
auuuuauuuuuacaacuaacauccauuccccuucauuuaaacaccuuuuguguuuuacuuca

SEQ ID NO: 663535 - RNA, 62 nt, Homo Sapiens
auuuuuucaugaacauuuugauacaaauuucaucauuuaaugauucaccaauuucuugcauu

SEQ ID NO: 663536 - RNA, 62 nt, Homo Sapiens
guuucacucaugucugucauuuuauaagcauaucauuuaaaaagcuucuaaaaagcuauuuc

SEQ ID NO: 663537 - RNA, 62 nt, Homo Sapiens
augaaaauauauuucccuguaagcugaauuacucauuuaaaaauuuuaacuucuauauggga

SEQ ID NO: 663538 - RNA, 62 nt, Homo Sapiens
aauagccagcacaucccuuccccccucuaaagucauuuaacuugagacagagacaaaugaac

SEQ ID NO: 663539 - RNA, 62 nt, Homo Sapiens
aaucuaagccaagaugauaaaggcuugggauuucauuuaaauacaaccaaaggaaaaugggg

SEQ ID NO: 663540 - RNA, 62 nt, Homo Sapiens
uuaaccuagucugggagauguacuacauccugucauuuaaucaaugcuuacuaugugccagg

SEQ ID NO: 663541 - RNA, 62 nt, Homo Sapiens
ucacauggucaguagguggcagauaaaaggacucauuuaagcuuauaaagaauuugagguua

SEQ ID NO: 663542 - RNA, 62 nt, Homo Sapiens
aagggaucgaagacauuucaauagacauuucgucauuuaaguaaauugcucuaucugggcug

SEQ ID NO: 663543 - RNA, 62 nt, Homo Sapiens
aagggaucgaaaacauuucaauauacauuucaucauuuaaguuccaauuuacagauaguaug

SEQ ID NO: 663544 - RNA, 62 nt, Homo Sapiens
ccaguauauucaguaguugaugucucacuccaucauuuaaaacacgucagcaagagccucuu

SEQ ID NO: 663545 - RNA, 62 nt, Homo Sapiens
uuugaugcuuaguuauguugaggaauuuugacucauuuaaacgauuugugaagacaucagau

SEQ ID NO: 663546 - RNA, 62 nt, Homo Sapiens
uuccuacacgcuaacuucguuuuaaauuuguuucauuuaaguuuuuuaccguaacuauuucg

SEQ ID NO: 663547 - RNA, 62 nt, Homo Sapiens
guuccuguaacaguuaugcaaauggaagagaaucauuuaagauuuucuggccuuuacaacag

SEQ ID NO: 663548 - RNA, 62 nt, Homo Sapiens
gcuggccauggaagccucuuaacaacacacugucauuuaaggcugugcuugugcuuuauaca

SEQ ID NO: 663549 - RNA, 62 nt, Homo Sapiens
ugcacuuuauguaagaauguaaaccuggagucucauuuaagaaugaucagcaauacguuuag

SEQ ID NO: 663550 - RNA, 62 nt, Homo Sapiens
aucaaugaaaaacccauauguaauaaucgaauucauuuaacaugaaucuugaguacguggac

SEQ ID NO: 663551 - RNA, 62 nt, Homo Sapiens
ugaaggugccauucuuaugagccaaaaguuugucauuuaaaaguucauuuugagggaauaac

SEQ ID NO: 663552 - RNA, 62 nt, Homo Sapiens
caauuuguaaguagcgcagcccguuucagcccucauuuaauuacaguacaugcugaagcgug

SEQ ID NO: 663553 - RNA, 62 nt, Homo Sapiens
gaaaaauauauaucuaucuaacucauuucaucucauuuaaggucccuccaccccaggacgcc

SEQ ID NO: 663554 - RNA, 62 nt, Homo Sapiens
gucugccaucuuuaaaaaaaaauacaguauuuucauuuaaauucucugauggagggacaaca

SEQ ID NO: 663555 - RNA, 62 nt, Homo Sapiens
uuauucucuuuuucaucuggggauuuaccuguucauuuaaucugccuguuuugaucuguuuu

SEQ ID NO: 663556 - RNA, 62 nt, Homo Sapiens
uuaauaaugguguacuuuaaaaaauauauguuucauuuaaucuucacaaaagaucuguagag

SEQ ID NO: 663557 - RNA, 62 nt, Homo Sapiens
ggaucacuuacauccaauauauguauauuuugucauuuaaaucagaacaaccacuugaaauu

SEQ ID NO: 663558 - RNA, 62 nt, Homo Sapiens
uuuugucacucaguuauuuaacuguguuuagcucauuuaaaucaaaauguguacuuuaaucu

SEQ ID NO: 663559 - RNA, 62 nt, Homo Sapiens
gaauauuugaucuucuugagauuuucauacuaucauuuaaccaccaggaagcugaagugugu

SEQ ID NO: 663560 - RNA, 62 nt, Homo Sapiens
cauaccaaccauuauccagagguugggcuuauucauuuaacaugcugcguucuguuugcuga

SEQ ID NO: 663561 - RNA, 62 nt, Homo Sapiens
uauaauugcgaauaucagaaauugaguaguugucauuuaaaaagaguuuaaaaguuuagcuu

SEQ ID NO: 663562 - RNA, 62 nt, Homo Sapiens
ggaaaugaaaguagcgucuuuuaaauugcuauucauuuaauauaccuguuuucccaucuuuu

SEQ ID NO: 663563 - RNA, 62 nt, Homo Sapiens
uuuacaguaucagccuuugauuauagaugugaucauuuaaaauuugauaaugacuuuaguga

SEQ ID NO: 663564 - RNA, 62 nt, Homo Sapiens
caguuuuucuuuugaucgugcacuuauagucuucauuuaauuccucauagaaucccagucac

SEQ ID NO: 663565 - RNA, 62 nt, Homo Sapiens
uacaucuacccacuccauuauuuuuuaaaacuucauuuaauaguuuaaacaagauugguuuu

SEQ ID NO: 663566 - RNA, 62 nt, Homo Sapiens
gaauuauuguuacucauauuuuaaucaguaagucauuuaagcuaugacagaguaggaauuga

SEQ ID NO: 663567 - RNA, 62 nt, Homo Sapiens
uuuuaaaaauuuaaaauuucuuaaauuuucagucauuuaaaauuguuucagucauuuaaaau

SEQ ID NO: 663568 - RNA, 62 nt, Homo Sapiens
uuuaaauuuucagucauuuaauuuuguuucagucauuuaaaauuuugaauaauaauguuuaa

SEQ ID NO: 663569 - RNA, 62 nt, Homo Sapiens
cucuguacuaugcauuuuugcuuucgaagauuucauuuaaaugacugaaaagcaaauuuauu

SEQ ID NO: 663570 - RNA, 62 nt, Homo Sapiens
ugugccucucaaaacuucaguagauagugcacucauuuaaucuagacuugcugaguuuggca

SEQ ID NO: 663571 - RNA, 62 nt, Homo Sapiens
uuaaaaucauaacuuaauuucauuaacuuuuaucauuuaacucucucauguuuguuguaacc

SEQ ID NO: 663572 - RNA, 62 nt, Homo Sapiens
aaagcaaauagcauugacacauuuaaagcuuuucauuuaaaguaguggauguuuuugaagua

SEQ ID NO: 663573 - RNA, 62 nt, Homo Sapiens
acagucauuuaugccuaaagccuggugauuauucauuuaaaugaagaucacauuucauauca

SEQ ID NO: 663574 - RNA, 62 nt, Homo Sapiens
ccaauugaauuaaaguguggccucguuuuuagucauuuaaaauuguuuucuaaguaauugcu

SEQ ID NO: 663575 - RNA, 62 nt, Homo Sapiens
uuuaaaggaauggaguuuuuagccuuuaagcaucauuuaaauacuugcacaauguugaacau

SEQ ID NO: 663576 - RNA, 62 nt, Homo Sapiens
uucuuuuuagaaaauaacauaugauggcuggaucauuuaaaguuauuuucuuuuaaugugca

SEQ ID NO: 663577 - RNA, 62 nt, Homo Sapiens
ggaaguggaacuuugguaaaugacuguuugccucauuuaauaguauacaggcucagcccaua

SEQ ID NO: 663578 - RNA, 62 nt, Homo Sapiens
cuucuuaauggagauauucaguuuucuuuuuuucauuuaaacaaagaaaaaaaauguaucua

SEQ ID NO: 663579 - RNA, 62 nt, Homo Sapiens
auuuuauaguauaaaguauugacuuauaccucucauuuaaauaaagacaggaucauacacau

SEQ ID NO: 663580 - RNA, 62 nt, Homo Sapiens
aguaauucagaagaacagugagaacaaaucacucauuuaaaaaauuuuaauaaaagugaacc

SEQ ID NO: 663581 - RNA, 62 nt, Homo Sapiens
caaauaccaaauaguuuacacaucauuaauauucauuuaauuaaaccaaaaaaaccaaggug

SEQ ID NO: 663582 - RNA, 62 nt, Homo Sapiens
gauguagggaaacuagauauacagaaaagcacucauuuaauauuuccauauucugauuuuua

SEQ ID NO: 663583 - RNA, 62 nt, Homo Sapiens
aauuauuuuuucacuacaacccaguauuauguucauuuaauauuuuauaaugcauuuuacuc

SEQ ID NO: 663584 - RNA, 62 nt, Homo Sapiens
aguaccauucuguaucuuauuaaaaagaacaaucauuuaaucuucuagacuuacaaaaggcu

SEQ ID NO: 663585 - RNA, 62 nt, Homo Sapiens
uguaucauacaguaaugccaguuauugguggcucauuuaaacauuaagauauguauuuguaa

SEQ ID NO: 663586 - RNA, 62 nt, Homo Sapiens
auggauuagaaaaauauuuucacuuuuaauuuucauuuaacacaaauuuagcauuauuuuga

SEQ ID NO: 663587 - RNA, 62 nt, Homo Sapiens
aauuucuaaaagggucuuuuuuuaaagagugaucauuuaaauuucugagauuaaaaaaaauu

SEQ ID NO: 663588 - RNA, 62 nt, Homo Sapiens
gccagaaauggucaagcaauuauucugggaggucauuuaaauuagucucagggcuuguguaa

SEQ ID NO: 663589 - RNA, 62 nt, Homo Sapiens
cauuuuuaaaaacgaauuguaguuguuuuucuucauuuaaaauggaucuguuggagguuaug

SEQ ID NO: 663590 - RNA, 62 nt, Homo Sapiens
auauauauuuucuguauuaagcucauuuggcuucauuuaagcuguauacuuagucauauauc

SEQ ID NO: 663591 - RNA, 62 nt, Homo Sapiens
aggucccacgcuggauauuuucacaccuuaccucauuuaauacaacaagcaaggagguagac

SEQ ID NO: 663592 - RNA, 62 nt, Homo Sapiens
cugugcuaggcacagacuuucuagggauuauuucauuuaauucucauggcaaccaccaugca

SEQ ID NO: 663593 - RNA, 62 nt, Homo Sapiens
aagucccugucucuuucagacacagacaagcuucauuuaaauuauuucaucugaucauuauc

SEQ ID NO: 663594 - RNA, 62 nt, Homo Sapiens
ggaaauuuaaagcugcauggucugucuuguuuucauuuaauuauugugaauaccuagaaucu

SEQ ID NO: 663595 - RNA, 62 nt, Homo Sapiens
ugggagccuuuaucugucauuagaaaucuuucucauuuaagaacuuaugaauaugcugaaga

SEQ ID NO: 663596 - RNA, 62 nt, Homo Sapiens
gucuuacuuguacuguaucacauuccauacccucauuuaauucuuaauaaaacuguucacuu

SEQ ID NO: 663597 - RNA, 62 nt, Homo Sapiens
guaugguucaaguacugcuccauaaauagaacucauuuaaaauguauuggggauauguuuua

SEQ ID NO: 663598 - RNA, 62 nt, Homo Sapiens
guuuaaauugaaaaugggccaagcaagcuaaaucauuuaaauacuaucaagagugaccuuug

SEQ ID NO: 663599 - RNA, 62 nt, Homo Sapiens
cccaggggaaaaugaagguuaggauuuaacagucauuuaaaaaaaaaauuuguuuugacgga

SEQ ID NO: 663600 - RNA, 62 nt, Homo Sapiens
aaaaaauuuguuuugacggaugauuggauuauucauuuaaaaugauuagaaggcaaguuucu

SEQ ID NO: 663601 - RNA, 62 nt, Homo Sapiens
aauaugguauaacaacaagugaauuugaagacucauuuaaaauauuguguuauuuauaaagu

SEQ ID NO: 663602 - RNA, 62 nt, Homo Sapiens
gguuaaacuuauggcuauuuuuaaagggcuauucauuuaaucugaguuuucccuuauuuuca

SEQ ID NO: 663603 - RNA, 62 nt, Homo Sapiens
uuucuuuauuguguuggugcaauauuuuauuaucauuuaaccucaggauauucagaccaaca

SEQ ID NO: 663604 - RNA, 62 nt, Homo Sapiens
acccuggugcuuccccugcagaauacuguacuucauuuaacagaaugauugauuuuucuuuc

SEQ ID NO: 663605 - RNA, 62 nt, Homo Sapiens
aauguauuauucaggaagaauacugagugccuucauuuaacuaaaguugaauguaaaaguca

SEQ ID NO: 663606 - RNA, 62 nt, Homo Sapiens
agaauuauaaauuguuaaaaccuugauaauugucauuuaauuauauuucagguguccugaac

SEQ ID NO: 663607 - RNA, 62 nt, Homo Sapiens
aauuaucuuuaguuaauugcuucauacuuuacucauuuaacaaugaaaguguucauccagau

SEQ ID NO: 663608 - RNA, 62 nt, Homo Sapiens
auauuaaaucuuagaaguuauuaugugggaaaucauuuaauauacagagaaacuauaagcaa

SEQ ID NO: 663609 - RNA, 62 nt, Homo Sapiens
aaagaucagaucccuccuucugaaaauugguuucauuuaacaaaauggccaaauauauaccg

SEQ ID NO: 663610 - RNA, 62 nt, Homo Sapiens
ugacaugggugucgguuuugcaaucuaccucaucauuuaaaaucacuuuacugcauaggaaa

SEQ ID NO: 663611 - RNA, 62 nt, Homo Sapiens
auaacuuucuggcauuuagaauuuuguuccauucauuuaauuuguucaucugagaauuuuuu

SEQ ID NO: 663612 - RNA, 62 nt, Homo Sapiens
guuguguuuauguagaaaauucacaaaucuguucauuuaauuuuuuaauuugagaauuuuua

SEQ ID NO: 663613 - RNA, 62 nt, Homo Sapiens
aauuguuuuguaguuucuggaggaaaaucaggucauuuaagacuaauguuuuuaagguuuuu

SEQ ID NO: 663614 - RNA, 62 nt, Homo Sapiens
caaauccacaucuuuuguaauuauuuuuuuuuucauuuaaaauuugguauuucauauaggaa

SEQ ID NO: 663615 - RNA, 64 nt, Homo Sapiens
aguuaucaauuguuaguuagcaucuuugugaguccuucaagagcaagcuuacaucuuccucagc

SEQ ID NO: 663616 - RNA, 64 nt, Homo Sapiens
cauuguuucuauuggucaggaauagaugccucuucuucaagaugcaccuuugugagaaagaaaa

SEQ ID NO: 663617 - RNA, 64 nt, Homo Sapiens
gcagacauuugguaugauuuccuuuucucucugccuucaagaagcaaaguagaagagcccccaa

SEQ ID NO: 663618 - RNA, 64 nt, Homo Sapiens
cuugcucugaccccucuaagaauuaaucuuuaagcuucaagaaaaaucuuuucuuucucaaauu

SEQ ID NO: 663619 - RNA, 64 nt, Homo Sapiens
aacugauuauuuggaucagaaaccauugaaacugcuucaagaauuguaucuuuaaguacugcua

SEQ ID NO: 663620 - RNA, 64 nt, Homo Sapiens
cuguuuugaagcuuacauggacaaauguuuaggacuucaagaucacacuugugggcaaucuggg

SEQ ID NO: 663621 - RNA, 64 nt, Homo Sapiens
aguuguauuuuaccauggaaacuauuugcuuucucuucaagauaagcaugucucccugaucuga

SEQ ID NO: 663622 - RNA, 64 nt, Homo Sapiens
uguuaaauauuuauaugcuucacuaaaauguuaucuucaagagaaauuauguagucuccguuau

SEQ ID NO: 663623 - RNA, 64 nt, Homo Sapiens
gagccuuggaguugguuuuugaggcugauucuggcuucaagaugguugcuuuacagacuuccaa

SEQ ID NO: 663624 - RNA, 64 nt, Homo Sapiens
cguuucuauucuaguuucuguucauuauuucccucuucaagaguaauuucacaugcacuuguac

SEQ ID NO: 663625 - RNA, 64 nt, Homo Sapiens
caugauaaugauaggauaaacaaaauaccacugucuucaagaaacauuaucuuagguuuguuug

SEQ ID NO: 663626 - RNA, 64 nt, Homo Sapiens
agauauguuguguuugcuucauuuuuaaugaugacuucaagauugaugaugugauccaauaacu

SEQ ID NO: 663627 - RNA, 64 nt, Homo Sapiens
uuauaacuuugcuacccugggguuaauuugauaacuucaagaagacagccauucuuuggacugu

SEQ ID NO: 663628 - RNA, 64 nt, Homo Sapiens
auuuaauugagcuucuauaauuugucuaauuccacuucaagaugcuccauuaaaauguagaugc

SEQ ID NO: 663629 - RNA, 64 nt, Homo Sapiens
uacaaaggugaaaagccaaaguuuguuucccaaacuaccauaguuuucauauaauuguuagaag

SEQ ID NO: 663630 - RNA, 64 nt, Homo Sapiens
uggcaucagcuuugguuaccauaugccaagaacacuaccauauauggucugaggcauauagagu

SEQ ID NO: 663631 - RNA, 64 nt, Homo Sapiens; identical to SEQ ID NO: 662508

SEQ ID NO: 663632 - RNA, 64 nt, Homo Sapiens; identical to SEQ ID NO: 662509

SEQ ID NO: 663633 - RNA, 64 nt, Homo Sapiens; identical to SEQ ID NO: 662510

SEQ ID NO: 663634 - RNA, 64 nt, Homo Sapiens; identical to SEQ ID NO: 662511

SEQ ID NO: 663635 - RNA, 64 nt, Homo Sapiens; identical to SEQ ID NO: 662512

SEQ ID NO: 663636 - RNA, 64 nt, Homo Sapiens; identical to SEQ ID NO: 662513

SEQ ID NO: 663637 - RNA, 64 nt, Homo Sapiens; identical to SEQ ID NO: 662514

SEQ ID NO: 663638 - RNA, 64 nt, Homo Sapiens; identical to SEQ ID NO: 662515

SEQ ID NO: 663639 - RNA, 64 nt, Homo Sapiens; identical to SEQ ID NO: 662516

SEQ ID NO: 663640 - RNA, 64 nt, Homo Sapiens; identical to SEQ ID NO: 662517

SEQ ID NO: 663641 - RNA, 64 nt, Homo Sapiens; identical to SEQ ID NO: 662518

SEQ ID NO: 663642 - RNA, 64 nt, Homo Sapiens; identical to SEQ ID NO: 662519

SEQ ID NO: 663643 - RNA, 64 nt, Homo Sapiens; identical to SEQ ID NO: 662520

SEQ ID NO: 663644 - RNA, 64 nt, Homo Sapiens; identical to SEQ ID NO: 662521

SEQ ID NO: 663645 - RNA, 64 nt, Homo Sapiens; identical to SEQ ID NO: 662522

SEQ ID NO: 663646 - RNA, 64 nt, Homo Sapiens; identical to SEQ ID NO: 662523

SEQ ID NO: 663647 - RNA, 64 nt, Homo Sapiens; identical to SEQ ID NO: 662524

SEQ ID NO: 663648 - RNA, 64 nt, Homo Sapiens; identical to SEQ ID NO: 662525

SEQ ID NO: 663649 - RNA, 64 nt, Homo Sapiens; identical to SEQ ID NO: 662526

SEQ ID NO: 663650 - RNA, 64 nt, Homo Sapiens; identical to SEQ ID NO: 662527

SEQ ID NO: 663651 - RNA, 64 nt, Homo Sapiens; identical to SEQ ID NO: 662528

SEQ ID NO: 663652 - RNA, 64 nt, Homo Sapiens; identical to SEQ ID NO: 662529

SEQ ID NO: 663653 - RNA, 64 nt, Homo Sapiens; identical to SEQ ID NO: 662530

SEQ ID NO: 663654 - RNA, 64 nt, Homo Sapiens; identical to SEQ ID NO: 662531

SEQ ID NO: 663655 - RNA, 64 nt, Homo Sapiens; identical to SEQ ID NO: 662532

SEQ ID NO: 663656 - RNA, 64 nt, Homo Sapiens; identical to SEQ ID NO: 662533

SEQ ID NO: 663657 - RNA, 64 nt, Homo Sapiens
ugguccaucuauauuuaaaacgugcaagaaaaaaauaaaauacucugcucuagcaaguuuugug

SEQ ID NO: 663658 - RNA, 64 nt, Homo Sapiens
aucgucauguuaauaaauuuaaaacaucauucguauaaaauauuuuaauuuucuuguauuucau

SEQ ID NO: 663659 - RNA, 64 nt, Homo Sapiens
gucaauagccuagggcugaauuuuugucagauaaauaaaauaaaucauucauccuuuuuuuuga

SEQ ID NO: 663660 - RNA, 64 nt, Homo Sapiens
uacuaaauguauuuuagacuuccuguagggggcgauaaaauaaaaugcuaaacaacuggguaua

SEQ ID NO: 663661 - RNA, 64 nt, Homo Sapiens
aaucaugucaucuucuauuuguacagaaaugaaaauaaaauaugaaaauaaugaaagaaaugaa

SEQ ID NO: 663662 - RNA, 64 nt, Homo Sapiens
ugcuauauaauauucaguggcucauuuauaccuaauaaaauaaugguauuuuaaaauaaugcua

SEQ ID NO: 663663 - RNA, 64 nt, Homo Sapiens
ccucauugauauauugcacuauuucauaaauacuauaaaauaaugacuaggaaguaacuuauua

SEQ ID NO: 663664 - RNA, 64 nt, Homo Sapiens
gugugauagcugauuucaauauugaaguauugaaauaaaauauucuuuacaccugaaguaaaua

SEQ ID NO: 663665 - RNA, 64 nt, Homo Sapiens
aguccugccugccaagaacucaaguguaacugugauaaaauaaccuuucccagguauauuggca

SEQ ID NO: 663666 - RNA, 64 nt, Homo Sapiens
ccauugagcuguguaugcauuuuuguuuauuucaauaaaauauauuuguauuauuuguccuuca

SEQ ID NO: 663667 - RNA, 64 nt, Homo Sapiens
uaaaauuaguuacuaaguauuuugaucaaagcuuauaaaauaacuuacggagauuuuuguaagu

SEQ ID NO: 663668 - RNA, 64 nt, Homo Sapiens
uuucauuuuuaagaagaaaaacaccacucauuuuauaaaauauaguacagcuacuauaaggcuu

SEQ ID NO: 663669 - RNA, 64 nt, Homo Sapiens
gagcauaaaauguaugcuguugugaccaauaaauauaaaauaugguaauuggaauuaacuccac

SEQ ID NO: 663670 - RNA, 64 nt, Homo Sapiens
uaugaauuuuggcauguuucagagagaucaguaaauaaaauauuagauaaaauauauauuguuu

SEQ ID NO: 663671 - RNA, 64 nt, Homo Sapiens
uucaauuuuucugccuuaagaaugaauguccuucauaaaauauuggaugcaguguaacacuauc

SEQ ID NO: 663672 - RNA, 64 nt, Homo Sapiens
cuauccaaggcagugacuucagcuuuauauacauauaaaauauaguuaguuuuaaaauuauuga

SEQ ID NO: 663673 - RNA, 64 nt, Homo Sapiens
auaaaauaaaauaaaauaaauaaaauaaaauaaaauaaaauaaaucucaaaaaauaaaauaaaa

SEQ ID NO: 663674 - RNA, 64 nt, Homo Sapiens
auaaaauaaaauaaaauaaauaaaauaaaauaaaauaaaauaaacucugucucaaaaaauaaaa

SEQ ID NO: 663675 - RNA, 64 nt, Homo Sapiens
auaaaauaaaauaaaauaaauaaaauaaaauaaaauaaaauaaaugacacucugucucaaaaaa

SEQ ID NO: 663676 - RNA, 64 nt, Homo Sapiens
auaaaauaaaauaaaauaaaaaaaauaaaauaaaauaaaauaaacagagugacacucugucuca

SEQ ID NO: 663677 - RNA, 64 nt, Homo Sapiens
auaaaauaaaauaaaauaaaucucaaaaaauaaaauaaaauaaaggcaacagagugacacucug

SEQ ID NO: 663678 - RNA, 64 nt, Homo Sapiens
auaaaauaaaauaaaauaaacucugucucaaaaaauaaaauaaagccugggcaacagagugaca

SEQ ID NO: 663679 - RNA, 64 nt, Homo Sapiens
auaaagcauuuuaaauauggcugaauaauaucaaauaaaauaucuugccacaaaaccuguauua

SEQ ID NO: 663680 - RNA, 64 nt, Homo Sapiens
auaauucuuuucugaggauauucaauuaguggucauaaaauagaaugucucaugucaaugacca

SEQ ID NO: 663681 - RNA, 64 nt, Homo Sapiens
gggagacuugggaguugucuaagauuugugcaaaauaaaauaugagcccugaggaguuauuggc

SEQ ID NO: 663682 - RNA, 64 nt, Homo Sapiens
cugaaauuuaaccucaguaaaaguaauauuuuuuauaaaauacaguaucucuucacuucuguga

SEQ ID NO: 663683 - RNA, 64 nt, Homo Sapiens
uaggauuacaaaggaaucuaauguuuuuaaaugcauaaaauauaaugaaugccuucuuaaaauc

SEQ ID NO: 663684 - RNA, 64 nt, Homo Sapiens
caauacuccacugcucauaucugagccaaccagaauaaaauaacggccuuuauuuggcaaauaa

SEQ ID NO: 663685 - RNA, 64 nt, Homo Sapiens
aauucauauauauagauuacaauaucucauaaucauaaaauauuaaauuauaagacucugcaau

SEQ ID NO: 663686 - RNA, 64 nt, Homo Sapiens
cagcagugggggacaccacuuacaaaaacaaauaauaaaauauuaaauucucuuccuaaauuuc

SEQ ID NO: 663687 - RNA, 64 nt, Homo Sapiens
gcaccauuuuguuucccuuuuuaaaauaaauaaaauaaaauaaaccugccacuguagcgccuuu

SEQ ID NO: 663688 - RNA, 64 nt, Homo Sapiens
auaaagcaccauuuuguuucccuuuuuaaaauaaauaaaauaaaagcguccugccacuguagcg

SEQ ID NO: 663689 - RNA, 64 nt, Homo Sapiens
aaggaaaacagacuuaaauuaauaaaauacauuuauaaaauaaagauggauuaaacaaguauaa

SEQ ID NO: 663690 - RNA, 64 nt, Homo Sapiens
uuuauaaaauaaaaaggaaauaaacaaguauaaaauaaaauacagugcuaggucuaagauggau

SEQ ID NO: 663691 - RNA, 64 nt, Homo Sapiens
auacauuuauaaaauaaaaauggauuaaacaaguauaaaauaaaaggaugugcuaggucuaaga

SEQ ID NO: 663692 - RNA, 64 nt, Homo Sapiens
ggcaaacaauacagcaacaaaugcaaaaugcaaaauaaaauauuaaggauuuuauucucaacag

SEQ ID NO: 663693 - RNA, 64 nt, Homo Sapiens
aauuaaaaugagaaauacaucuugaaauagaccuauaaaauagucuaacagaacaacugaaaua

SEQ ID NO: 663694 - RNA, 64 nt, Homo Sapiens
uuugucuauaaucguuuaaaaugccaauaugauaauaaaauacaaggaauagcaacuaauacaa

SEQ ID NO: 663695 - RNA, 60 nt, Homo Sapiens
cugaagauaauuuacagugaccccaucuaaauaaaauacugcuuuugcaaacagaacacu

SEQ ID NO: 663696 - RNA, 64 nt, Homo Sapiens
ucuuuaucucaaguauauaaaguuuugccccaugauaaaauaaguaacauauaaauuaauacau

SEQ ID NO: 663697 - RNA, 64 nt, Homo Sapiens
auagugaauuuuaaaauguagaagaaagcaaaaaauaaaauaaguccuaaagugaagaagccau

SEQ ID NO: 663698 - RNA, 64 nt, Homo Sapiens
agaccugauuuucaaaaucugcccucagaugaaaauaaaauaaacgaaacauuuagacaauggc

SEQ ID NO: 663699 - RNA, 64 nt, Homo Sapiens
acacgugccauuauaguaucuaacaaaaaguggcauaaaauauuacaaaacauccaacacuaga

SEQ ID NO: 663700 - RNA, 64 nt, Homo Sapiens
ucuucacauuaaacuauggacucuaauuuucuggauaaaauauccugccuuauggaaaugaaau

SEQ ID NO: 663701 - RNA, 64 nt, Homo Sapiens
uuuacauguaaaaauaaacuaaacaaaucuaaugauaaaauaugucagauccauguucuaaaaa

SEQ ID NO: 663702 - RNA, 64 nt, Homo Sapiens
uucagaaagucaaaagauuaccuaucguucuacaauaaaauacauggaaauagcuugcuauuuu

SEQ ID NO: 663703 - RNA, 64 nt, Homo Sapiens
ugcuacaguuugcaggugaaaaaaaauaaauauuauaaaauaugcuauuguuuuuguguucuug

SEQ ID NO: 663704 - RNA, 64 nt, Homo Sapiens
aaugggggcucuuacugacuuuaaauuagcgcuuauaaaauaaaaauguuuaguucaagaagag

SEQ ID NO: 663705 - RNA, 64 nt, Homo Sapiens
auggcuuaagcaccucagcauuccuuacuaugugauaaaauacauauagaauauaagauauacu

SEQ ID NO: 663706 - RNA, 64 nt, Homo Sapiens
ccugucaguauuacaguuaguuuucuagugacucauaaaauaagauuuccuguuucauguagaa

SEQ ID NO: 663707 - RNA, 64 nt, Homo Sapiens
uccugcccaguggcucuugggcaauauccacuuuauaaaauagcgacaggcauacuguuacuuu

SEQ ID NO: 663708 - RNA, 64 nt, Homo Sapiens
aaacucaauaauaaacagugauaaaauacacaauauaaaauaugaacuaguacuaauuauaaau

SEQ ID NO: 663709 - RNA, 64 nt, Homo Sapiens
caauauaaaauaugaaacucuacuaauuauaaauauaaaauacacaugucauauguguaacuag

SEQ ID NO: 663710 - RNA, 64 nt, Homo Sapiens
aaaacugcuuucaaaacuacccuuuuuguggaagauaaaauauuucagcacagaaacuuuccua

SEQ ID NO: 663711 - RNA, 64 nt, Homo Sapiens
ugucuaauaaaacagaggcaugauucauuuucugauaaaauauuuuuuaaauacucacaacaug

SEQ ID NO: 663712 - RNA, 64 nt, Homo Sapiens
aggaaaaguuuaaccuaaaugauuccaugugaaaauaaaauauguaucggggcgaaccuuuuag

SEQ ID NO: 663713 - RNA, 64 nt, Homo Sapiens
uuuuuauaaggaauacuguuuauuuuuuaaaaccauaaaauaaauguuuauacaauaauuuaaa

SEQ ID NO: 663714 - RNA, 64 nt, Homo Sapiens
uaauaaaaugguguaguauuuaaaauaaaauaaaauaaaauaaugcaagacucuaucucaaaaa

SEQ ID NO: 663715 - RNA, 64 nt, Homo Sapiens
auaauuaauaaaaugguguaaaaaauaaaauaaaauaaaauaaaacagagcaagacucuaucuc

SEQ ID NO: 663716 - RNA, 64 nt, Homo Sapiens
auaaaauaauuaauaaaaugaucucaaaaauaaaauaaaauaaagagcaacagagcaagacucu

SEQ ID NO: 663717 - RNA, 64 nt, Homo Sapiens
auaaaauaaaauaauuaauaacucuaucucaaaaauaaaauaaaagccugagcaacagagcaag

SEQ ID NO: 663718 - RNA, 64 nt, Homo Sapiens
aaaaauuaguugggugugguaccccgucucuacuauaaaauacaagccuggccaacauggcgaa

SEQ ID NO: 663719 - RNA, 64 nt, Homo Sapiens
auauccuuggggucaagaucugaucuuucuuggaauaaaauaaucugucaucuuuucgccuacc

SEQ ID NO: 663720 - RNA, 64 nt, Homo Sapiens
cauacacacacacacacaccacaaauauguguguauaaaauaaauuaguaauauauuagaauau

SEQ ID NO: 663721 - RNA, 64 nt, Homo Sapiens
uguucuuguauugcuuucuuucaacaguuucaaaauaaaauaucauauaaauauugagggaaau

SEQ ID NO: 663722 - RNA, 64 nt, Homo Sapiens
auucauauauuuuaugaaucagaauaaccuucaaauaaaauaaaucuaagucgguuaaaaugga

SEQ ID NO: 663723 - RNA, 64 nt, Homo Sapiens
acauaaauauauuuuuauagaaaaacaaaucuacauaaaauaaaucuacuguuuagugagcagu

SEQ ID NO: 663724 - RNA, 64 nt, Homo Sapiens
auguuucuucucauguaagaaauaaaaaauaaaaauaaaauaaaauauauugguauguaacuac

SEQ ID NO: 663725 - RNA, 64 nt, Homo Sapiens
ucuucucauguaagaaauaaaaaauaaaaauaaaauaaaauauauugguauguaacuacaggaa

SEQ ID NO: 663726 - RNA, 64 nt, Homo Sapiens
uugauugguuuuauaguucauugaaaauccucaaauaaaauauaauuauuacugaaauauguuu

SEQ ID NO: 663727 - RNA, 64 nt, Homo Sapiens
ggauccuaguccuuuucauuaccugaugguagaaauaaaauaauugauuuuaaauuccuuugcu

SEQ ID NO: 663728 - RNA, 64 nt, Homo Sapiens
aauagauggucacauugcugaacauaauucuaaaauaaaauauuggcacaaagaggugagauug

SEQ ID NO: 663729 - RNA, 64 nt, Homo Sapiens
gauuuuuuucuauuuguaaaggauuaugaguuguauaaaauacauacucccuaaacuagaucau

SEQ ID NO: 663730 - RNA, 64 nt, Homo Sapiens
uucuguuuuaugcaguugucauuuguaaagucuaauaaaauauucucuauaauugcuucuagau

SEQ ID NO: 663731 - RNA, 64 nt, Homo Sapiens
ccucucugugccucaguuuucccaugcaugaaaaauaaaauaaaauaaaacggggauucuaaug

SEQ ID NO: 663732 - RNA, 64 nt, Homo Sapiens
cugugccucaguuuucccaugcaugaaaaauaaaauaaaauaaaacggggauucuaauguuugu

SEQ ID NO: 663733 - RNA, 64 nt, Homo Sapiens
auauaacuauauauauugccaucacacacgaacaauaaaauaaaguguucuauuaaccugaucu

SEQ ID NO: 663734 - RNA, 64 nt, Homo Sapiens
ugggcaacauagugagaccuugucucuacaaaaaauaaaauaaaauaaaaaccaaauuagccag

SEQ ID NO: 663735 - RNA, 64 nt, Homo Sapiens
aacauagugagaccuugucucuacaaaaaauaaaauaaaauaaaaaccaaauuagccagacaug

SEQ ID NO: 663736 - RNA, 64 nt, Homo Sapiens
aagcuacaaauugagaaaaccguuauaaauaagaauaaaauaggccaggcacaguggcucacac

SEQ ID NO: 663737 - RNA, 64 nt, Homo Sapiens
gacccugucuccaaaggaaaaacaaaaaagaagaauaaaauaauuuggaugaaaaucauguuua

SEQ ID NO: 663738 - RNA, 64 nt, Homo Sapiens
gaucuguguugcauuucaaaaauaaguuguauucauaaaauacuuuuuuaccugauaauguagu

SEQ ID NO: 663739 - RNA, 64 nt, Homo Sapiens
aucaacuuggguuauauuugaauguauuucuacuauaaaauagacucucauuuuauucuuccau

SEQ ID NO: 663740 - RNA, 64 nt, Homo Sapiens
uuuaguaguccaaaaugucagaagaaaaacauguauaaaauaguucauagauccuuuucuuaaa

SEQ ID NO: 663741 - RNA, 64 nt, Homo Sapiens
aaauauuagucauguuaauuaaucuucuaacaaaauaaaauaugggguacaaugauuacaaauu

SEQ ID NO: 663742 - RNA, 64 nt, Homo Sapiens
uuuagaaaguuuuguuguucgaaaauuauaaaaaauaaaauaauuuuucuaacaccauguguua

SEQ ID NO: 663743 - RNA, 64 nt, Homo Sapiens
uagguacaaauaacaagacuuguguuucaaauugauaaaauauuauaaugacaauuuaugaauu

SEQ ID NO: 663744 - RNA, 64 nt, Homo Sapiens
uugccagaucucuaagauugcagaugccuuauauauaaaauaaguucauaacgucucuugguca

SEQ ID NO: 663745 - RNA, 64 nt, Homo Sapiens
cuggcuucuaucccuaaccccagacuuuguuggcauaaaauaacaacaauaaggcuuuuuagag

SEQ ID NO: 663746 - RNA, 64 nt, Homo Sapiens
ggcuuuaaaaaagcauagucaaaauaaaauaaauauaaaauauaccugucacuaacaaaauuaa

SEQ ID NO: 663747 - RNA, 64 nt, Homo Sapiens
uauaaaauauaggcuuuaaaaacaaaauuaaaaaauaaaauaaauaaagugagacccugucacu

SEQ ID NO: 663748 - RNA, 64 nt, Homo Sapiens
auuauuuaagaugguagcacuagucuuaaauuguauaaaauauccccuaacauguuuaaauguc

SEQ ID NO: 663749 - RNA, 64 nt, Homo Sapiens
auuuuguuauauuuaauaauagaauuagauugaaauaaaauauaaugggaaauaaucugcagaa

SEQ ID NO: 663750 - RNA, 64 nt, Homo Sapiens
guuuacuguacuauuucaaagcuucuaaauaaauauaaaauauauauauuauauuauauaauuu

SEQ ID NO: 663751 - RNA, 64 nt, Homo Sapiens
uuuuuaaauggaugcauacaguccacaucauacaauaaaauaaaagguaauucagggucccaaa

SEQ ID NO: 663752 - RNA, 64 nt, Homo Sapiens
gauauagaaacaucugaacugguaaagaauaacuauaaaauaugaaagcucuaaauuuaaaaua

SEQ ID NO: 663753 - RNA, 64 nt, Homo Sapiens
gccuccaacaugcugaaaaaacccuuuagaaaguauaaaauauuuuccuuauugccucuucaga

SEQ ID NO: 663754 - RNA, 64 nt, Homo Sapiens
gacuaagccucagguuuuuaucuccauuaucuauauaaaauaguauaacaugauuacagucaac

SEQ ID NO: 663755 - RNA, 64 nt, Homo Sapiens
ugcuucuagaugucauggcauuuaaguuuuuugcauaaaauaaauauguguacacauaaucaua

SEQ ID NO: 663756 - RNA, 64 nt, Homo Sapiens
caauguuuuugucucaagaaauuaguauaucaucauaaaauagauuguguuuccauauucuggc

SEQ ID NO: 663757 - RNA, 64 nt, Homo Sapiens
uuacuaaaauauuguauggcaguaguaauaaagaauaaaauacuuaaggauaaauaaaaaauaa

SEQ ID NO: 663758 - RNA, 64 nt, Homo Sapiens
uucauuaaagcucuuagauuauuauacauauguuauaaaauaugggaguauuuucaauucucag

SEQ ID NO: 663759 - RNA, 64 nt, Homo Sapiens
aauaacauauuggugaagaugagacugucucaaaauaaaauaaauccagccugggugacagagu

SEQ ID NO: 663760 - RNA, 64 nt, Homo Sapiens
aaaauuucacuaaauuuagacacugaguaaaaauauaaaauaguuucaugagcaacaguauaua

SEQ ID NO: 663761 - RNA, 64 nt, Homo Sapiens
gaaugaaugaaugaauauggaugauauauuuauuauaaaauaggccucucauuuuuucacugcu

SEQ ID NO: 663762 - RNA, 64 nt, Homo Sapiens
acccaaguuucuucaugaguuuguuuauuggaguauaaaauauugacauucauaaaaacuuaca

SEQ ID NO: 663763 - RNA, 64 nt, Homo Sapiens
auguaaacaaaaaaaauuacuugacuguaauaaaauaaaauaugcauauauaaaaguauauuua

SEQ ID NO: 663764 - RNA, 64 nt, Homo Sapiens
auaugauguaaacaaaaaaaauuuauugacuguaauaaaauaaagauuucauauauaaaaguau

SEQ ID NO: 663765 - RNA, 64 nt, Homo Sapiens
auuagaacucugguaaauguuucauaggaauaaaauaaaauauuaucaaaauuuaugauuuaca

SEQ ID NO: 663766 - RNA, 64 nt, Homo Sapiens
auauuauuagaacucugguauuacauucauaggaauaaaauaaaaaaacaucaaaauuuaugau

SEQ ID NO: 663767 - RNA, 64 nt, Homo Sapiens
ucaaaguugaaaauucauaguaagauugauaucuauaaaauagauauaaauuuuuaagagaaag

SEQ ID NO: 663768 - RNA, 64 nt, Homo Sapiens
uacaguccaaaauacuguucuuuccaggcuauguauaaaauacauagugaaaauuguuuaguga

SEQ ID NO: 663769 - RNA, 64 nt, Homo Sapiens
cgugguaguauguuuuuauuaggagaauaaugcaauaaaauauguaaugucuuuuuuauaaagc

SEQ ID NO: 663770 - RNA, 64 nt, Homo Sapiens
uagaauuuugcuguaauaaaguuucaaaauuugaauaaaauaauuaaauuuuuugaggaagugg

SEQ ID NO: 663771 - RNA, 64 nt, Homo Sapiens
uuuggaaaacaggacuuaaaaugacauucaguauauaaaauauguacauaauauuggaugacua

SEQ ID NO: 663772 - RNA, 64 nt, Homo Sapiens
augccaaauucuuauuuuuuaaaaagcuaguucuauaaaauacugguauuauggguggggagga

SEQ ID NO: 663773 - RNA, 64 nt, Homo Sapiens
gccgagauugcaccacugcacuccagcuugggugauaaaauaaaauaaaauagucgugaaucuu

SEQ ID NO: 663774 - RNA, 64 nt, Homo Sapiens
gauugcaccacugcacuccagcuugggugauaaaauaaaauaaaauagucgugaaucuuguuca

SEQ ID NO: 663775 - RNA, 64 nt, Homo Sapiens
caccacugcacuccagcuugggugauaaaauaaaauaaaauagucgugaaucuuguucaaaaug

SEQ ID NO: 663776 - RNA, 64 nt, Homo Sapiens
accuuauauuuuauuuuugccaaaauauuuuauuauaaaauaugaccaaaauauuuaaaaugca

SEQ ID NO: 663777 - RNA, 64 nt, Homo Sapiens
uaauaggaaauauauaauaauagcauuuuauguaauaaaauaugggcaacgauuaucuuggaaa

SEQ ID NO: 663778 - RNA, 64 nt, Homo Sapiens
caagauucaaacagcuuuaaacacuuccaaugagauaaaauauuuacuauuaugcuuauuagaa

SEQ ID NO: 663779 - RNA, 64 nt, Homo Sapiens
aaaaauuguuuuuuuaauuuucuauauuauaaacauaaaauaaguaaugagcacuuucuacuca

SEQ ID NO: 663780 - RNA, 64 nt, Homo Sapiens
acaauuaugaauuacaugcucagcuauauauguaauaaaauacuuuggucuguggaaauauugu

SEQ ID NO: 663781 - RNA, 64 nt, Homo Sapiens
aaguucuauuuucccuguauugguaucuccuuaaauaaaauaaaauauuccuauuguaagugau

SEQ ID NO: 663782 - RNA, 64 nt, Homo Sapiens
cuauuuucccuguauugguaucuccuuaaauaaaauaaaauauuccuauuguaagugauaugag

SEQ ID NO: 663783 - RNA, 64 nt, Homo Sapiens
ccagccugggcaauaagagcaaaacuccaucaaaauaaaauaaaauaaaauauaaaauaacuua

SEQ ID NO: 663784 - RNA, 64 nt, Homo Sapiens
cugggcaauaagagcaaaacuccaucaaaauaaaauaaaauaaaauauaaaauaacuuaaaaag

SEQ ID NO: 663785 - RNA, 64 nt, Homo Sapiens
caauaagagcaaaacuccaucaaaauaaaauaaaauaaaauauaaaauaacuuaaaaagaacuu

SEQ ID NO: 663786 - RNA, 64 nt, Homo Sapiens
agcaaaacuccaucaaaauaaaauaaaauaaaauauaaaauaacuuaaaaagaacuuugaauaa

SEQ ID NO: 663787 - RNA, 64 nt, Homo Sapiens
ggaugucuagauuauauagguuuagguugaaguuauaaaauaaaauaaaauucauuuuccacug

SEQ ID NO: 663788 - RNA, 64 nt, Homo Sapiens
ucuagauuauauagguuuagguugaaguuauaaaauaaaauaaaauucauuuuccacuggaacu

SEQ ID NO: 663789 - RNA, 64 nt, Homo Sapiens
uucaauaaguguuguaccauauguagcauuaaauauaaaauacauaaaagaauguacagaaaau

SEQ ID NO: 663790 - RNA, 64 nt, Homo Sapiens
caccaauaucauguguagauauuauguauagaaaauaaaauaaauuauggcucuaacuucugug

SEQ ID NO: 663791 - RNA, 64 nt, Homo Sapiens
uaaagauauauaaauuuaaagauucaagaaaacuauaaaauacucuuagagcuuguuuauggaa

SEQ ID NO: 663792 - RNA, 64 nt, Homo Sapiens
aagcagcaauaugucauuaaaaucuuaauaaugaauaaaauaaauucccccacagagugccuag

SEQ ID NO: 663793 - RNA, 64 nt, Homo Sapiens
aucauuuucaguaugugauauuaaauguaaauggauaaaauaaaccggacaaguuuauaucaag

SEQ ID NO: 663794 - RNA, 64 nt, Homo Sapiens
cguguaagcaaaauuuucuucuuuauaaggaagaauaaaauaaaucugacccauuuugauaagu

SEQ ID NO: 663795 - RNA, 64 nt, Homo Sapiens
gauuuuucacucucuuuaaaugcuacacaaaagcauaaaauaauauguuauuuaauucaucuaa

SEQ ID NO: 663796 - RNA, 64 nt, Homo Sapiens
cuugagguuaaauaauggguaacaugacgauuccauaaaauaaaaaaauguuuguaaaagcuca

SEQ ID NO: 663797 - RNA, 64 nt, Homo Sapiens
cagccaguggcuguggucuacagaauuguuucauauaaaauacggguagagugguagaguuuca

SEQ ID NO: 663798 - RNA, 64 nt, Homo Sapiens
gcacugauaaaaccgcaacaaaaacauguaagaaauaaaauagaaaugcuuuauauaauuuagu

SEQ ID NO: 663799 - RNA, 64 nt, Homo Sapiens
caguuaauaguaugaucuuuaaaguuuugacaauauaaaauaaacuugguaacuguuuuacaaa

SEQ ID NO: 663800 - RNA, 64 nt, Homo Sapiens
uguauuuauuguuaauucuuaaaauaguguguaaauaaaauaacaucagugugcuuuaaagaaa

SEQ ID NO: 663801 - RNA, 64 nt, Homo Sapiens
aacccuuaacuugugccuagaaacuacagcacauauaaaauauguaaacaccagccuguugcug

SEQ ID NO: 663802 - RNA, 64 nt, Homo Sapiens
uagguacaaacuuuauaaagaauguuaguaugucauaaaauauaacauuacagcuuauuuaaaa

SEQ ID NO: 663803 - RNA, 64 nt, Homo Sapiens
aaguaacugaaauacuuuuaccuuucuguccuugauaaaauaguaaagaaaaccaaacaaaccc

SEQ ID NO: 663804 - RNA, 64 nt, Homo Sapiens
ccauucagaaacaaaaauuagcacuaaauuuuuuauaaaauagaccagaugacaaaauuuauuu

SEQ ID NO: 663805 - RNA, 64 nt, Homo Sapiens
guuuauauuaauauaguuuuuuucucccuuuuuaauaaaauaauuacagucaucccucaguguc

SEQ ID NO: 663806 - RNA, 64 nt, Homo Sapiens
gugacaaagcaagacugugucucaaaauaaauaaauaaaauaaaauaaaaugacguacagagau

SEQ ID NO: 663807 - RNA, 64 nt, Homo Sapiens
aaagcaagacugugucucaaaauaaauaaauaaaauaaaauaaaaugacguacagagauucuau

SEQ ID NO: 663808 - RNA, 64 nt, Homo Sapiens
aaaauauuacauucaugauuauuuuauuuaguaaauaaaauaauagagagcccagaaaucaacc

SEQ ID NO: 663809 - RNA, 64 nt, Homo Sapiens
uuguauuauauagguugaaauuaaagaugaauaaauaaaauaaaaugacacaaggccaaaaaca

SEQ ID NO: 663810 - RNA, 64 nt, Homo Sapiens
auguacuuagagcuggauucaaucaucaggucuuauaaaauauauuuauaauuuaaucuguuua

SEQ ID NO: 663811 - RNA, 61 nt, Homo Sapiens
aucacacugacauguuuuugaugagacauagauaaaauaaaaucuacuuacagaaaaguaa

SEQ ID NO: 663812 - RNA, 64 nt, Homo Sapiens
auaauaugagaaauuaagucaguauaaaagauauauaaaauagcuuucauuucauugcaaaggc

SEQ ID NO: 663813 - RNA, 64 nt, Homo Sapiens
ucuuuguuauuuucaacuguugugugacacugagauaaaauaggauucuguaaagccacuuguc

SEQ ID NO: 663814 - RNA, 64 nt, Homo Sapiens
auuuacuucuauauaggugauugcagauguggccauaaaauauugaagaugaucauauuucauu

SEQ ID NO: 663815 - RNA, 64 nt, Homo Sapiens
accauugauauucuuguuuauaacccauauaaggauaaaauaauacaacucauaaauaauuucu

SEQ ID NO: 663816 - RNA, 64 nt, Homo Sapiens
aacugaugaggcaugcagcuuauagccauaaccaauaaaauaaauuauauggaaagaugucaac

SEQ ID NO: 663817 - RNA, 64 nt, Homo Sapiens
uugaaauuuagagaggaauuuuuccuuagaagucauaaaauauuauuauuuauuguaaaaaaag

SEQ ID NO: 663818 - RNA, 64 nt, Homo Sapiens
auucucuauuugaauuauuucugucacaguaaaaauaaaauacuuugaguuuugagcuacugga

SEQ ID NO: 663819 - RNA, 64 nt, Homo Sapiens
aguuugaaaagcaauauuguauauuuuuaucuauauaaaauaacuaaaauguaucuaagaauaa

SEQ ID NO: 663820 - RNA, 64 nt, Homo Sapiens
uaaggcugcaugauagcauuccuauauuucucucauaaaauaggauuugaaggaugaaauuaau

SEQ ID NO: 663821 - RNA, 64 nt, Homo Sapiens
uuuuauuugaauuguaaaauauuuaaaaguaugaauaaaauauauuuauagguauuuaucagag

SEQ ID NO: 663822 - RNA, 64 nt, Homo Sapiens
gguauuugggagcuggauucuugucaacugcuguauaaaauauacucacaaaaccauugcagaa

SEQ ID NO: 663823 - RNA, 64 nt, Homo Sapiens
ucuagagauaacuauuaacaguauucuuucaaacauaaaauaauaagauaauugggagcugagc

SEQ ID NO: 663824 - RNA, 64 nt, Homo Sapiens
auuguuuaaccuuagagagaccauuaaauuauuuauaaaauauuuuguaauuaccuguagcuaa

SEQ ID NO: 663825 - RNA, 64 nt, Homo Sapiens
ccuggauaacagagcgagacccugucucaaaaaaauaaaauaaaaaauaaaaacacccuugccu

SEQ ID NO: 663826 - RNA, 64 nt, Homo Sapiens
uuaugugcuggccuuggccuauuggugaaaugguauaaaauaucauaugcaguuuuaaaacuuu

SEQ ID NO: 663827 - RNA, 64 nt, Homo Sapiens
uuaaauuuuccuuacaauaaagcacacuuuuauaauaaaauacaugaauuauuguuuuucauac

SEQ ID NO: 663828 - RNA, 64 nt, Homo Sapiens
acucguuuuguaauaauugcuguauuucuguguaauaaaauauaaaaauaaaauauucaguggu

SEQ ID NO: 663829 - RNA, 64 nt, Homo Sapiens
uaauugcuguauuucuguguaauaaaauauaaaaauaaaauauucagugguauucaacaucaaa

SEQ ID NO: 663830 - RNA, 64 nt, Homo Sapiens
uucucuaguuuuggagcuucuuuauaucaauaaaauaaaauacucuuuaaacccauaaauuaau

SEQ ID NO: 663831 - RNA, 64 nt, Homo Sapiens
auacuuucucuaguuuuggauuaauuuuauaucaauaaaauaaauauaccuuuaaacccauaaa

SEQ ID NO: 663832 - RNA, 64 nt, Homo Sapiens
accaaucaaacacagaauuuaaauaaagcugaguauaaaauaaaaauuacaguuuugugauaua

SEQ ID NO: 663833 - RNA, 64 nt, Homo Sapiens
gcugaguauaaaauaaaaccuacaguuuugugauauaaaauaaaaaauaaccuuauaccugaau

SEQ ID NO: 663834 - RNA, 64 nt, Homo Sapiens
uaccagauuuuaaagauguagaugugcugucaguauaaaauacaauguagcuuguccaaauuga

SEQ ID NO: 663835 - RNA, 64 nt, Homo Sapiens
uugccaaagaaguuucugaauucuauuguuuaacauaaaauaguaucauggcuuucuacaguau

SEQ ID NO: 663836 - RNA, 64 nt, Homo Sapiens
uuaauuugcacacccuguacacacagaaaaugguauaaaauaugagaacgaaguuuaaaauugu

SEQ ID NO: 663837 - RNA, 64 nt, Homo Sapiens
cauagaacuauacuaaucuucucacaaaaggucuauaaaauacagucguugaaaaaaauuuugu

SEQ ID NO: 663838 - RNA, 64 nt, Homo Sapiens
gccaaaugcauauaaaucuugauaaacaaagucuauaaaauaaaacaugggacauuagcuuugg

SEQ ID NO: 663839 - RNA, 64 nt, Homo Sapiens
auauuaaauucugauauugcacuucuuauuuuauauaaaauaauccuuuaauauccaaaugaau

SEQ ID NO: 663840 - RNA, 64 nt, Homo Sapiens
acacacacguauacacacacacaguuuauuuuuaauaaaauaggauuauaccacacacauccug

SEQ ID NO: 663841 - RNA, 64 nt, Homo Sapiens
gcucuuacuucaaaauuaguccaaaauguuggaaauaaaauauaagacauugaucuagauauga

SEQ ID NO: 663842 - RNA, 64 nt, Homo Sapiens
aauggauagguggugacccacaaaaauaaaauaaauaaaauaaaauagguaaacaaagaaauga

SEQ ID NO: 663843 - RNA, 64 nt, Homo Sapiens
uaaaauaaaaauggauagguaagaaaugacaaaaauaaaauaaauaaaaaaggauagguaaaca

SEQ ID NO: 663844 - RNA, 64 nt, Homo Sapiens
aaaauuaugcucauuucuauaauauauuugaaauauaaaauauucuguuuuuaucaagaaggga

SEQ ID NO: 663845 - RNA, 64 nt, Homo Sapiens
agaaacaaacuuuaucuccccucauagcauuaacauaaaauacccauugauaacugacagauau

SEQ ID NO: 663846 - RNA, 64 nt, Homo Sapiens
agcuguagcuaccaaauacuuacacuauuuuugcauaaaauaagauuuuuaaacuuuuauauug

SEQ ID NO: 663847 - RNA, 64 nt, Homo Sapiens
ugagcuauguauuaacacugacauuucuccuuugauaaaauaaacaaauugcuuacuuuggaau

SEQ ID NO: 663848 - RNA, 64 nt, Homo Sapiens
uucauacagcauuacaaauucacuauaucuguauauaaaauauuauaucuguauuuaauuuuga

SEQ ID NO: 663849 - RNA, 64 nt, Homo Sapiens
aauaaauucaccuagucuaauucaaaaaaauaaaauaaaauaaaugacaugaaaaaaggacaau

SEQ ID NO: 663850 - RNA, 64 nt, Homo Sapiens
auaaaaauaaauucaccuagacaauuucaaaaaaauaaaauaaauguuuugacaugaaaaaagg

SEQ ID NO: 663851 - RNA, 64 nt, Homo Sapiens
ccaagcacaaguacgaacuuuaccuauuuauaaaauaaaauaaaauuuggaaccaugcgaguga

SEQ ID NO: 663852 - RNA, 64 nt, Homo Sapiens
auaaaccaagcacaaguacgagugauaccuauuuauaaaauaaaaccgcauuuggaaccaugcg

SEQ ID NO: 663853 - RNA, 64 nt, Homo Sapiens
ugcaaauaaagcaaugauuaacccucacuugcaaauaaaauaagcguaacuugcgaaucuguuu

SEQ ID NO: 663854 - RNA, 64 nt, Homo Sapiens
gcacaauugcuauaugaaacggauaaagcauaauauaaaauaagugugcuguagucauacaauu

SEQ ID NO: 663855 - RNA, 64 nt, Homo Sapiens
acugagagagaauugguccaucuucaaagacuugauaaaauaacauuauaaaacuguuauggug

SEQ ID NO: 663856 - RNA, 64 nt, Homo Sapiens
acuuugauuuacgacaucacaaauaacucauuuaauaaaauaguauugauguucauauugugua

SEQ ID NO: 663857 - RNA, 64 nt, Homo Sapiens
aaaaaaagaaagcaugauauauuacaaaaacaaaauaaaauaauaauacuauuuccaaacucau

SEQ ID NO: 663858 - RNA, 64 nt, Homo Sapiens
uauaaauaucauuguacauagaagucuauaaaaaauaaaauaaugucuauaaaagaaacacuuu

SEQ ID NO: 663859 - RNA, 64 nt, Homo Sapiens
cugggugacagagugagacucugucucaaaaaaaauaaaauaaaaagucaauuuagaaugugaa

SEQ ID NO: 663860 - RNA, 64 nt, Homo Sapiens
auugaugguuguauaagaacuagcucauguaaaaauaaaauaacauuauuacauugccucaaaa

SEQ ID NO: 663861 - RNA, 64 nt, Homo Sapiens
uuuccuugccugacaguauuuuugaauuauuuauauaaaauaucuaucuuuucaucaugucuau

SEQ ID NO: 663862 - RNA, 64 nt, Homo Sapiens
auuuaccaacuuuauugaaaauguuguuacaucaauaaaauagcaugcugggaaccugagaagg

SEQ ID NO: 663863 - RNA, 64 nt, Homo Sapiens
uuugaaauuuugccucuuucauggagaauuuugaauaaaauauauuauauaucuuuucuccuaa

SEQ ID NO: 663864 - RNA, 64 nt, Homo Sapiens
ugauuaauauaauucuaacaccauuuugcuggcuauaaaauaacguuuucuuaaugcguuugga

SEQ ID NO: 663865 - RNA, 64 nt, Homo Sapiens
cagcguacacaaugagauauaauugcaaaauaaaauaaaauagcaguuguaggaugcagggcua

SEQ ID NO: 663866 - RNA, 64 nt, Homo Sapiens
auagccagcguacacaaugaggcuaaauugcaaaauaaaauaaaucaagaguuguaggaugcag

SEQ ID NO: 663867 - RNA, 64 nt, Homo Sapiens
guguaguuuacagaaaaagauuuuacuguguuuuauaaaauagaaugcgucccaagauguugau

SEQ ID NO: 663868 - RNA, 64 nt, Homo Sapiens
aacaaagauucaugauuuauauucuucuguguuuauaaaauauauuccuacguaggaugaaaag

SEQ ID NO: 663869 - RNA, 64 nt, Homo Sapiens
auauaauagaaaaauauuuuauuuguauuguuguauaaaauauuuacaaucauauagaauauau

SEQ ID NO: 663870 - RNA, 64 nt, Homo Sapiens
uuuaugaaggacauuauucugauucauaaaaguuauaaaauauuagguaaauacagagaaaaca

SEQ ID NO: 663871 - RNA, 64 nt, Homo Sapiens
uuuacaaaaaugaaaauaauaaacauguuuucguauaaaauaacacaaaaugauauacacugaa

SEQ ID NO: 663872 - RNA, 64 nt, Homo Sapiens
uugguaaccagaaauguaaaauuucaaauaacggauaaaauaauguguuauuuuuauagagaaa

SEQ ID NO: 663873 - RNA, 64 nt, Homo Sapiens
ccucucacauucaaguauuagcaacuugcaguauauaaaauaguuagauaaugagaaguuguua

SEQ ID NO: 663874 - RNA, 64 nt, Homo Sapiens
cagaagagucaaaugcuucuaaugucucaaggugauaaaauacaaaaacuaaguagacagauau

SEQ ID NO: 663875 - RNA, 64 nt, Homo Sapiens
acaugucaugaacccauguuugcaaucaaagaugauaaaauagauucuuauuuuucccccaccc

SEQ ID NO: 663876 - RNA, 64 nt, Homo Sapiens
auggaggauuuuuuugccccuuguguuuggaauuauaaaauauagguaaaaguacguaauuaaa

SEQ ID NO: 663877 - RNA, 64 nt, Homo Sapiens
gggaaggauuuaaggaggugaagucgggucaaaaauaaaauauauauacauauauacauugcuu

SEQ ID NO: 663878 - RNA, 64 nt, Homo Sapiens
gagaagguuacugagugaguuauugggagucuuaauaaaauaaacuagauauuagguccauuca

SEQ ID NO: 663879 - RNA, 64 nt, Homo Sapiens
caaauaauaauaauauuaauaauaauaaagagaaauaaaauaauaaaauaaaaaacaauagcac

SEQ ID NO: 663880 - RNA, 64 nt, Homo Sapiens
aauaauauuaauaauaauaaagagaaauaaaauaauaaaauaaaaaacaauagcacagcccuug

SEQ ID NO: 663881 - RNA, 64 nt, Homo Sapiens
uacaguuucaaaaggaagacucaugagaaauuucauaaaauacaaguuuuuagauguuuaugcu

SEQ ID NO: 663882 - RNA, 64 nt, Homo Sapiens
aggaaaaagaguguuaauaccaugaugcauuaacauaaaauaucaaacacacaaagucauaaaa

SEQ ID NO: 663883 - RNA, 64 nt, Homo Sapiens
ggauaauauaugacaaauucaacuuagggcagauauaaaauaaaaguaucuuuauuccuuuauu

SEQ ID NO: 663884 - RNA, 64 nt, Homo Sapiens
agagaaauaacaauuucuacaaauauaugcaacuauaaaauaucuaaauuagaaaaauuuggua

SEQ ID NO: 663885 - RNA, 64 nt, Homo Sapiens
auuuagauuuaagucgagcuggccauaaaauaaaauaaaauaaaagauuuauuagagggagcau

SEQ ID NO: 663886 - RNA, 64 nt, Homo Sapiens
auaaaauuuagauuuaagucagcauggccauaaaauaaaauaaaaauuuagauuuauuagaggg

SEQ ID NO: 663887 - RNA, 64 nt, Homo Sapiens
auaaaauaaaauuuagauuugagggagcauggccauaaaauaaauuuaaaauuuagauuuauua

SEQ ID NO: 663888 - RNA, 64 nt, Homo Sapiens
uuucuauuauauuuauuaugauacaacaauacaaauaaaauauuuauaugauuguaaauauuuu

SEQ ID NO: 663889 - RNA, 64 nt, Homo Sapiens
guauuaaaaauuuaaaauagauguuuauauuaaaauaaaauauuucuuugucuauaacugacag

SEQ ID NO: 663890 - RNA, 64 nt, Homo Sapiens
uuucuuuguuuugcaucaguaauuuuaaguuacaauaaaauauuuaucuguugucuaggggaug

SEQ ID NO: 663891 - RNA, 64 nt, Homo Sapiens
ugacauaaaaaaaaaaaaaagucaagguuaguaaauaaaauaaguaccucauucuuuagucccu

SEQ ID NO: 663892 - RNA, 64 nt, Homo Sapiens
uuccuacuguguauguaggaaaauaaaggauuuuauaaaauaccggugacgauugccacucaua

SEQ ID NO: 663893 - RNA, 64 nt, Homo Sapiens
ggauuuuauaaaauaccuucgacgauugccacucauaaaauaaauauguguuggguagggaggu

SEQ ID NO: 663894 - RNA, 64 nt, Homo Sapiens
ugugcuuauuaaauaaugcagcuuagaaauggaaauaaaauauaucuaauguauuuuguuaguu

SEQ ID NO: 663895 - RNA, 64 nt, Homo Sapiens
ggcauauaccucauauauaccauguaucuuguauauaaaauauauacaugaauauauauauauu

SEQ ID NO: 663896 - RNA, 64 nt, Homo Sapiens
uuuugaccuugaaagaugaauuccuucaagaaaaauaaaauaaugcuuaagauaauguguacga

SEQ ID NO: 663897 - RNA, 64 nt, Homo Sapiens
agcuuggcaguacguucuuugacuuaaggauggcauaaaauaaucauuuuugaaccuguguaau

SEQ ID NO: 663898 - RNA, 64 nt, Homo Sapiens
gggcuacagagagcaagacucugucucaaaaaaaauaaaauaaaauaaauaaaaaaagauauag

SEQ ID NO: 663899 - RNA, 64 nt, Homo Sapiens
acagagagcaagacucugucucaaaaaaaauaaaauaaaauaaauaaaaaaagauauaguauua

SEQ ID NO: 663900 - RNA, 64 nt, Homo Sapiens
ugggaaaugggggaucuucaauguuuauuuuaaaauaaaauaaaauaaguucuugacuuuucuc

SEQ ID NO: 663901 - RNA, 64 nt, Homo Sapiens
aaugggggaucuucaauguuuauuuuaaaauaaaauaaaauaaguucuugacuuuucucaugug

SEQ ID NO: 663902 - RNA, 64 nt, Homo Sapiens
acaaccauauguuaccuguaucuuaggggaauggauaaaauauuugugguuuacuggguaaucc

SEQ ID NO: 663903 - RNA, 64 nt, Homo Sapiens
auagucuuugaauucauuuauuuuaaauaaaugaauaaaauaaaauaaaaaagaauauucaguc

SEQ ID NO: 663904 - RNA, 64 nt, Homo Sapiens
cuuugaauucauuuauuuuaaauaaaugaauaaaauaaaauaaaaaagaauauucagucguugg

SEQ ID NO: 663905 - RNA, 64 nt, Homo Sapiens
ucaagaaaaaauucugugaauuaagauguaauuuauaaaauaacauuucaauggggguaaacag

SEQ ID NO: 663906 - RNA, 64 nt, Homo Sapiens
cagccugggcaauguagcaagaccccaucucuauauaaaauauaaaaauguuggcugugcacgg

SEQ ID NO: 663907 - RNA, 64 nt, Homo Sapiens
acagagcaagacuccgucucacaaaaaugaauaaauaaaauaaaaauaaaaauguuacuuuuua

SEQ ID NO: 663908 - RNA, 64 nt, Homo Sapiens
agccucaaaucuaagagggcuucccauccuagauauaaaauagguguugccuauugcugugcuu

SEQ ID NO: 663909 - RNA, 64 nt, Homo Sapiens
cauccuccuuucccucucugagaaugaacuauguauaaaauaagcuucugccuauuugcauuua

SEQ ID NO: 663910 - RNA, 64 nt, Homo Sapiens
uaugaaaauuagaagauaauuuuaccguauauacauaaaauacuagaaaauagagugaggcuuu

SEQ ID NO: 663911 - RNA, 64 nt, Homo Sapiens
ccucgaauauuaaaaaguugcuuuuuacuuagauauaaaauaaagggcaggaguauucuggaau

SEQ ID NO: 663912 - RNA, 64 nt, Homo Sapiens
gaaguaacaugugaggcucuaagaguaauaguuuauaaaauaaguauucaaacauuagauuuga

SEQ ID NO: 663913 - RNA, 64 nt, Homo Sapiens
uucagauauuuuccaggguggcugucauuugagcauaaaauauuaugcauacugucauuugcag

SEQ ID NO: 663914 - RNA, 64 nt, Homo Sapiens
cuuagagaggaaaagcugccauccacugacagauauaaaauagggguaaaaugagugaucucaa

SEQ ID NO: 663915 - RNA, 64 nt, Homo Sapiens
aauuagcagaagugaccaaaaaauuucaaguuuaauaaaauagcucccuuugcuucccaaccua

SEQ ID NO: 663916 - RNA, 64 nt, Homo Sapiens
uuaggaauucuaaacaucuaacuucucauuuuaaauaaaauauuuguauuagaaaauuagcgug

SEQ ID NO: 663917 - RNA, 64 nt, Homo Sapiens
gaauuccauauuagggcaaucucuguaaucucuaauaaaauaugggaccuuaagaaacuauuua

SEQ ID NO: 663918 - RNA, 64 nt, Homo Sapiens
ucuuauaaaguggaaguauguuguauagcaugaaauaaaauauaauaggcuauuuucuaaagac

SEQ ID NO: 663919 - RNA, 64 nt, Homo Sapiens
augaaaauggaaauuugggaucuuacuaaaaaguauaaaauagugcauauaaugaauaaaucau

SEQ ID NO: 663920 - RNA, 64 nt, Homo Sapiens
gaauggaaucuucuccaguaugaaauuaccagauauaaaauaauguaaugaugcugaggauaua

SEQ ID NO: 663921 - RNA, 64 nt, Homo Sapiens
caaccccggaaaacauugcuuuugaaaacugcugauaaaauaugagccgguuauuacuucuguu

SEQ ID NO: 663922 - RNA, 64 nt, Homo Sapiens
ugcuucaaaauuagcauauuuuaaguuuaccaguauaaaauaccaaugcaacuacucuacauag

SEQ ID NO: 663923 - RNA, 64 nt, Homo Sapiens
uuuaguuguuuaaauaaguaauauuuucaaaagaauaaaauaaccaaugauaucucuuggaaua

SEQ ID NO: 663924 - RNA, 64 nt, Homo Sapiens
auaaaagugauuuauaugaaagauaaaauaccaaauaaaauaauaauaauuuuggaagcuguga

SEQ ID NO: 663925 - RNA, 64 nt, Homo Sapiens
aaauaaaauaauauaaaaguuggaagcugugaagauaaaauaccaaauaaaugauaaauaauuu

SEQ ID NO: 663926 - RNA, 64 nt, Homo Sapiens
augcggacugauucccaggauauaugaauguacuauaaaauaaaaccuuggaaaugcaggaacu

SEQ ID NO: 663927 - RNA, 64 nt, Homo Sapiens
cacuggcugugguuuuucauucagggguuguauuauaaaauaugcugcugcuggggggcuuuuu

SEQ ID NO: 663928 - RNA, 64 nt, Homo Sapiens
uuuaugacuacagauuuugcauguaaaauuaccaauaaaauauuaguauagccccacuuauacu

SEQ ID NO: 663929 - RNA, 64 nt, Homo Sapiens
aauuuguuagaauuuguuagaauuugaguuuuacauaaaauagauacauucaugcacaauccau

SEQ ID NO: 663930 - RNA, 64 nt, Homo Sapiens
aaguaacauagcucuaaaagaauuauaaauaccuauaaaauauauuguaaauaccuauaaaaua

SEQ ID NO: 663931 - RNA, 64 nt, Homo Sapiens
uuauaaauaccuauaaaauaaauuguaaauaccuauaaaauaaagcuuuaucccaaucuggaua

SEQ ID NO: 663932 - RNA, 64 nt, Homo Sapiens
ugggggccaucuagaaauagcuguuucuaugaagauaaaauaauaaccguugguccauuuuugu

SEQ ID NO: 663933 - RNA, 64 nt, Homo Sapiens
uaauuuugagguaccaaauauauuucugugggaaauaaaauaacagaauggaagauaaugcaga

SEQ ID NO: 663934 - RNA, 64 nt, Homo Sapiens
gucauugguauuuaaaaauguaucaauaaauuccauaaaauaaugaacuuuauucagaagcagu

SEQ ID NO: 663935 - RNA, 64 nt, Homo Sapiens
guuuguuauuuaucucauuauuuauaaaauaaaaauaaaauaucauuuguuguaaacugcaugu

SEQ ID NO: 663936 - RNA, 64 nt, Homo Sapiens
aauaaaauaucguuuguuauaaacugcauguuuuauaaaauaaaauuuuuuaaaaauuuguugu

SEQ ID NO: 663937 - RNA, 64 nt, Homo Sapiens
ugguuuuuauuugcuugucccucaauuuuaauuaauaaaauacuagucuuaguugguuuagggu

SEQ ID NO: 663938 - RNA, 64 nt, Homo Sapiens
ugagcugaacucaccugaagaaaaaaaaauaauaauaaaauaaggagcaagacucugucucaaa

SEQ ID NO: 663939 - RNA, 64 nt, Homo Sapiens
auauacagaauaauacacacaguugugugugcauauaaaauacauauuuacgccaggcguggug

SEQ ID NO: 663940 - RNA, 64 nt, Homo Sapiens
acaagagcaaaacuccgucucaaaaaagaugaaaauaaaauaaaauauauauuuacaggccuac

SEQ ID NO: 663941 - RNA, 64 nt, Homo Sapiens
agcaaaacuccgucucaaaaaagaugaaaauaaaauaaaauauauauuuacaggccuacaacuu

SEQ ID NO: 663942 - RNA, 64 nt, Homo Sapiens
cuccgaacaauuccuuuacuacgaaguauaauuuauaaaauaaaauauacccauuuuaagggua

SEQ ID NO: 663943 - RNA, 64 nt, Homo Sapiens
aacaauuccuuuacuacgaaguauaauuuauaaaauaaaauauacccauuuuaaggguacaguu

SEQ ID NO: 663944 - RNA, 64 nt, Homo Sapiens
guuagugggaagaauaugguaaauuuuuuguuaaauaaaauagacccuuauguuuagcauuuug

SEQ ID NO: 663945 - RNA, 64 nt, Homo Sapiens
uagagaacuauucugguacuaucagaacaaauacauaaaauaacuucccauagagaacaggaua

SEQ ID NO: 663946 - RNA, 64 nt, Homo Sapiens
agauuucaccauuugauuguauaaucuuuuaccuauaaaauauuuauuugaaguagaggguaaa

SEQ ID NO: 663947 - RNA, 64 nt, Homo Sapiens
aucagcgguaagaacagugaacacagugguugggauaaaauaaggugacaaacaucacaccaaa

SEQ ID NO: 663948 - RNA, 64 nt, Homo Sapiens
uaaugcacuauuaaaauaauacuucuuaauuuaaauaaaauauuaauguaugugauuuuguuau

SEQ ID NO: 663949 - RNA, 64 nt, Homo Sapiens
uuuagaaacuuuuaaagucauuacuuagauacuaauaaaauacacauauagaaaucuagaauuu

SEQ ID NO: 663950 - RNA, 64 nt, Homo Sapiens
aaacuacauuuuauuuuuguagcaggugguaaugauaaaauacuugaucuggcagacucauugc

SEQ ID NO: 663951 - RNA, 64 nt, Homo Sapiens
uguguaaugcaaauuucauaguaauaguaacuuuauaaaauaauauuauaaaauacaggauuua

SEQ ID NO: 663952 - RNA, 64 nt, Homo Sapiens
uuucauaguaauaguaacuuuauaaaauaauauuauaaaauacaggauuuaaaccuuucuaaau

SEQ ID NO: 663953 - RNA, 64 nt, Homo Sapiens
aauuauugccuuuguuguuguauuacaaaucugcauaaaauaccucauuucaaaucaaaucuua

SEQ ID NO: 663954 - RNA, 64 nt, Homo Sapiens
ugucagggagcccccaggccgcagguggagggugauaaaauauguucucugacaggacccagcc

SEQ ID NO: 663955 - RNA, 64 nt, Homo Sapiens
ugaaaauauguaaagcuguuugagaguuuaaaaaauaaaauauaacugcuagcuugcaaaguua

SEQ ID NO: 663956 - RNA, 64 nt, Homo Sapiens
auuguuaaagaaugguacuuuaaggccaacuaauauaaaauaccguuuaaaaaguauucuaucu

SEQ ID NO: 663957 - RNA, 64 nt, Homo Sapiens
aauaucaggaagccauuuuuuaaugcauuuuuaaauaaaauaccuggucuuuuggaugagggaa

SEQ ID NO: 663958 - RNA, 64 nt, Homo Sapiens
gcaaaaaaaacacauuuguauuuaauuuggcaggauaaaauauuaggcugccauaauauauuuu

SEQ ID NO: 663959 - RNA, 64 nt, Homo Sapiens
aauuuauaggacaguuuuuccuauaaagaacaaaauaaaauaauuggcauucacaauacuggca

SEQ ID NO: 663960 - RNA, 64 nt, Homo Sapiens
aaaaaaauucucaaaaaaacuauuaugaaagucaauaaaauagauaauuuaacaaaaguacagg

SEQ ID NO: 663961 - RNA, 64 nt, Homo Sapiens
uacagaaauuuaaauagaaauaguguauauacauauaaaauacaagcuauguuaggaccaaaug

SEQ ID NO: 663962 - RNA, 64 nt, Homo Sapiens
caggaccagccuagagagaucccaucucuaaaaaauaaaauauaagaaaauaaaacuuagggga

SEQ ID NO: 663963 - RNA, 64 nt, Homo Sapiens
ugaaugucuuuuugguuguaauuuaacaagucaaauaaaauaaucauugcugagcacaaucaca

SEQ ID NO: 663964 - RNA, 64 nt, Homo Sapiens
accauuuaaaaaguaaugcuuucauuauuuguacauaaaauaaaauuuauggguacaacguaug

SEQ ID NO: 663965 - RNA, 64 nt, Homo Sapiens
cuuugcaguaaaauauucccuagugauguauaaaauaaaauauuuaauggcaaaaauucauggc

SEQ ID NO: 663966 - RNA, 64 nt, Homo Sapiens
auauucuuugcaguaaaauaauggcuagugauguauaaaauaaaguaacuaauggcaaaaauuc

SEQ ID NO: 663967 - RNA, 64 nt, Homo Sapiens
aucaguuccugagucacacauuaaaugaaauaaaauaaaauaaaugucgcuauuuaaguuaaau

SEQ ID NO: 663968 - RNA, 64 nt, Homo Sapiens
auaaaaucaguuccugagucuaaauuuaaaugaaauaaaauaaaccaagugucgcuauuuaagu

SEQ ID NO: 663969 - RNA, 64 nt, Homo Sapiens
acaacugcuuuaugguuucucaaaauuaguugccauaaaauauggugaugaggaaaucccuaaa

SEQ ID NO: 663970 - RNA, 64 nt, Homo Sapiens
acuuuuagacucuaaauauuuguauagucaguguauaaaauaacuguaaacauucaauguauau

SEQ ID NO: 663971 - RNA, 64 nt, Homo Sapiens
acuuagagcaaaguuuaaaacaucucaaaauaaaauaaaauaaacuugggcaauagcaagacuc

SEQ ID NO: 663972 - RNA, 64 nt, Homo Sapiens
auaaaacuuagagcaaaguugacuccaucucaaaauaaaauaaauccagcuugggcaauagcaa

SEQ ID NO: 663973 - RNA, 64 nt, Homo Sapiens
aauuaaaaaaguugccgggguauuucaauaaaaaauaaaauauauucacaaguuuugggccacc

SEQ ID NO: 663974 - RNA, 64 nt, Homo Sapiens
auaaguggacauguuuauagguauauagauagcaauaaaauaacuaauacaguaaacugaaaga

SEQ ID NO: 663975 - RNA, 64 nt, Homo Sapiens
uuuuguucuauugguagguucugguauaauuaaaauaaaauauaucuuucugggccuuacugug

SEQ ID NO: 663976 - RNA, 64 nt, Homo Sapiens
aauaggaguugugagccugauuaaggaaaauaaaauaaaauauuaauguaauuuuaugucugcu

SEQ ID NO: 663977 - RNA, 64 nt, Homo Sapiens
auauuaauaggaguugugagcugcuuuaaggaaaauaaaauaaauuccaaauguaauuuuaugu

SEQ ID NO: 663978 - RNA, 64 nt, Homo Sapiens
uguauguaaccauuuggcaaaaguaugcaggaacauaaaauaaaauauccuuuagcucagaaau

SEQ ID NO: 663979 - RNA, 64 nt, Homo Sapiens
guaaccauuuggcaaaaguaugcaggaacauaaaauaaaauauccuuuagcucagaaauucuau

SEQ ID NO: 663980 - RNA, 64 nt, Homo Sapiens
uaggucaguaauuuaaaccuuggaucuucaaaaaauaaaauaaugugaagcaaaaccaacuaaa

SEQ ID NO: 663981 - RNA, 64 nt, Homo Sapiens
uucauuauuuuaggacgccaacaugagaccuguaauaaaauauguaaugggguugaaagcuggg

SEQ ID NO: 663982 - RNA, 64 nt, Homo Sapiens
ggcuagcuuguuuucaaauuuuaaaaguuuaaaaauaaaauacuuugcauucuaaguugccaau

SEQ ID NO: 663983 - RNA, 64 nt, Homo Sapiens
uuaaaaauaaaauacuuugcauucuaaguugccaauaaaauagaccuucaaguuauuuuaaugc

SEQ ID NO: 663984 - RNA, 64 nt, Homo Sapiens
accaauuuuuaaaaagagaaguuaaaaaaauaaaauaaaauaaagggcaacauagugagauucu

SEQ ID NO: 663985 - RNA, 64 nt, Homo Sapiens
auaaaaccaauuuuuaaaaaauucuguuaaaaaaauaaaauaaaaaccugggcaacauagugag

SEQ ID NO: 663986 - RNA, 64 nt, Homo Sapiens
aauugagggcccgggacggucaagcggcucaagaauaaaauauggugugcgaaucaaaccugac

SEQ ID NO: 663987 - RNA, 64 nt, Homo Sapiens
cugagaccucagaguauguaggaguaaauaguauauaaaauagcucugguggcucaugccugua

SEQ ID NO: 663988 - RNA, 64 nt, Homo Sapiens
accaaaagccaucugcuccccaaaaacuauugaaauaaaauaaaauauaaaaagaaagagaaag

SEQ ID NO: 663989 - RNA, 64 nt, Homo Sapiens
aagccaucugcuccccaaaaacuauugaaauaaaauaaaauauaaaaagaaagagaaagaaaag

SEQ ID NO: 663990 - RNA, 64 nt, Homo Sapiens
aucugaaaaccucauguucucgcccaggauuaaaauaaaauauaauguaaaaauaaaauucaaa

SEQ ID NO: 663991 - RNA, 64 nt, Homo Sapiens
cuaaucaaagaauauuauuagaaaaaauguuguaauaaaauaauacaggaaaugacugguaaug

SEQ ID NO: 663992 - RNA, 64 nt, Homo Sapiens
uccagccaaacuaagcuucauaagugaaggagaaauaaaauacuuuacagacaagcaaaugcug

SEQ ID NO: 663993 - RNA, 64 nt, Homo Sapiens
auauccuugaugaacauugaugugaaaauccucaauaaaauacuggcaaaccgaauccagcagc

SEQ ID NO: 663994 - RNA, 64 nt, Homo Sapiens
caaccuaaauauucaucagugggguaauggaugaauaaaauaugauauauucaaaugauagaau

SEQ ID NO: 663995 - RNA, 64 nt, Homo Sapiens
uguaguuuuuauaccuuaaaaagacugguagcauauaaaauaaaucuuaaaagcuaauuauaca

SEQ ID NO: 663996 - RNA, 64 nt, Homo Sapiens
ggcauguaaacagcacagacaugagaaccuuuguauaaaauauuuaacugacagcugacaccau

SEQ ID NO: 663997 - RNA, 64 nt, Homo Sapiens
aauaauguaugaagcucugugguuaaaaaauaaaauaaaauaauaagcacuuuugcauuaauuu

SEQ ID NO: 663998 - RNA, 64 nt, Homo Sapiens
auaauaauaauguaugaagcaauuugguuaaaaaauaaaauaaacuuugaagcacuuuugcauu

SEQ ID NO: 663999 - RNA, 64 nt, Homo Sapiens
uguauguguacaugaaucuagguaauauacccaaauaaaauauagacaguuguugauuuucuga

SEQ ID NO: 664000 - RNA, 64 nt, Homo Sapiens
uuucuuaugaauucuuaaagucucccaucauaauauaaaauauucuucauauggaaaaauaaua

SEQ ID NO: 664001 - RNA, 64 nt, Homo Sapiens
gaauuuagaaacaaaaucuaugaucauuucugugauaaaauacaguggaauagaugaauaagug

SEQ ID NO: 664002 - RNA, 64 nt, Homo Sapiens
uugaaaggcacaaaagaacagucuuuaucaaguuauaaaauauguaaacacaacaaugaguuag

SEQ ID NO: 664003 - RNA, 64 nt, Homo Sapiens
caaauaagacagcacuuuauaaaaauaagauaaaauaaaauaaacaagagcaaaauuucaucuc

SEQ ID NO: 664004 - RNA, 64 nt, Homo Sapiens
auaaacaaauaagacagcacaucucaaaaauaagauaaaauaaaggcaacaagagcaaaauuuc

SEQ ID NO: 664005 - RNA, 64 nt, Homo Sapiens
caaccauugauaauacaacuuaaacauguuugcuauaaaauaccaucacaaguaaaugagcuug

SEQ ID NO: 664006 - RNA, 64 nt, Homo Sapiens
uuuggcacuaacaucucaugaaaaauuaugguuaauaaaauaucaccacauuuggauugccaau

SEQ ID NO: 664007 - RNA, 64 nt, Homo Sapiens
uuuuuuuuuuuuugcugaauccaaagauauauaaauaaaauauauauauuuuauaaagaucaga

SEQ ID NO: 664008 - RNA, 64 nt, Homo Sapiens
cucucuuccuuucuaauauauggaguuucgaagaauaaaauaugagagcaauauuuaaauucuc

SEQ ID NO: 664009 - RNA, 64 nt, Homo Sapiens
caguuucugguaguucuuuaaaccucuuuuauucauaaaauaucuggaacugugaguccaauua

SEQ ID NO: 664010 - RNA, 64 nt, Homo Sapiens
auuuauuuucucuaucccggauaaacuaccuuguauaaaauauucuucauuaaaggcaccuucu

SEQ ID NO: 664011 - RNA, 64 nt, Homo Sapiens
gcccagccaacauugugagacauaaucucuacaaauaaaauaaauuaguuggacaugauggugu

SEQ ID NO: 664012 - RNA, 64 nt, Homo Sapiens
ccugagugacagagugagacuuugcaaccaaaaaauaaaauaauaauaauaaugaaauaaauaa

SEQ ID NO: 664013 - RNA, 64 nt, Homo Sapiens
aaaucaguaguacuuaaaguauauguuauguaagauaaaauauuugcucaauucuuuugguugu

SEQ ID NO: 664014 - RNA, 64 nt, Homo Sapiens
aacaaauuuccuuaggauuauaguauuacaugccauaaaauacuaugcuuuauuggucccaugu

SEQ ID NO: 664015 - RNA, 64 nt, Homo Sapiens
aauuguaauuucccaaauuuuaaaauaucuuauaauaaaauaaaaauauaugauggcuaacugu

SEQ ID NO: 664016 - RNA, 64 nt, Homo Sapiens
agacauacugugugauagggagaaaaagcagcuuauaaaauaauguauauagcaugauacuauu

SEQ ID NO: 664017 - RNA, 64 nt, Homo Sapiens
uauauagcaugauacuauuuuuguuuaaaaauauauaaaauauauaaaugcauaaaaaaauccu

SEQ ID NO: 664018 - RNA, 64 nt, Homo Sapiens
gagagaggcugagaaaugcagagaagaauaagacauaaaauagcuccgaccuccaugauccgag

SEQ ID NO: 664019 - RNA, 64 nt, Homo Sapiens
ugaaaaucauauugguauuugcaccaacauagucauaaaauaguauguuaauauguuuuuacuu

SEQ ID NO: 664020 - RNA, 64 nt, Homo Sapiens
ggccuaguuucuauuaauaaauuggauaaauuuaauaaaauaagagugauacugaaagugcuca

SEQ ID NO: 664021 - RNA, 64 nt, Homo Sapiens
auuuguauugauucucuuuaaauauaaaauguaaauaaaauauuccaauaaaaguuugugucug

SEQ ID NO: 664022 - RNA, 64 nt, Homo Sapiens
augauucuaguucuaggacuuuguaggcuuaacuauaaaauauuuccuuuccucuggguuuaag

SEQ ID NO: 664023 - RNA, 64 nt, Homo Sapiens
auaagccaccucagucaggauuaauaauucauuaauaaaauauauuuaacccaauaucagagug

SEQ ID NO: 664024 - RNA, 64 nt, Homo Sapiens
aacagauauauaaagauguucuuuaaaguuuauuauaaaauauacuaaauaucuguugcaugua

SEQ ID NO: 664025 - RNA, 64 nt, Homo Sapiens
uuuuugacuaaauuauugaucguaaaucuaaucaauaaaauauaaauucacacauaacacuaag

SEQ ID NO: 664026 - RNA, 64 nt, Homo Sapiens
auaaaacaguauuuuuaggaaaguaguaaauaacauaaaauaacuguuguuccagauuuaacau

SEQ ID NO: 664027 - RNA, 64 nt, Homo Sapiens
acacaugcauaaaaauagaacacaauacguucuuauaaaauacaaggucuguucuauuugguaa

SEQ ID NO: 664028 - RNA, 64 nt, Homo Sapiens
aacaacuuucaacaauguauacugcaauuagaaaauaaaauaugaaagaaaucagauacaaacu

SEQ ID NO: 664029 - RNA, 64 nt, Homo Sapiens
augucaugcugcagaauauggcuacagcugagaaauaaaauaaauccaguuucugaaugaaaaa

SEQ ID NO: 664030 - RNA, 64 nt, Homo Sapiens
uguugaaaagccuuuuucaagcaacuuguaaaaaauaaaauacuauauaaauuuuaauuucaua

SEQ ID NO: 664031 - RNA, 64 nt, Homo Sapiens
gugacuuuugugaaaauuuuaauuuacuacacuuauaaaauaguggcuaaaauguguagaaggu

SEQ ID NO: 664032 - RNA, 64 nt, Homo Sapiens
gagcugaugccuguauauaggggaaagaaaaaucauaaaauauugaaaaggacucccuuagaau

SEQ ID NO: 664033 - RNA, 64 nt, Homo Sapiens
caucuguauuacugagguuguuguaacuuuuuuaauaaaauagacgacccugcaguccaccugu

SEQ ID NO: 664034 - RNA, 64 nt, Homo Sapiens
guaaccuauuaucauggaucguagggcucugcaaauaaaauaaugaguuguucaaaucacugca

SEQ ID NO: 664035 - RNA, 64 nt, Homo Sapiens
acaaaaccaaaacuauacuugaacaugcuucuaaauaaaauaaagagcccagcuuuagucauuu

SEQ ID NO: 664036 - RNA, 64 nt, Homo Sapiens
cucuugaggauacuuaggguaaacuggauccuuccugcucaaggauccucauuuguauaccuag

SEQ ID NO: 664037 - RNA, 64 nt, Homo Sapiens
acuuuucugaaaaaucuccauuguugaggagaggcugcucaaucgacaccccgaguucucauga

SEQ ID NO: 664038 - RNA, 64 nt, Homo Sapiens
cacaaccucugggcuggaguuggaacaugcucuccugcucaaggccuuaaguugacaggauuga

SEQ ID NO: 664039 - RNA, 64 nt, Homo Sapiens
aaaucagauuuauuucacauaucaaagcugccuucugcucaaacggagaugcauuuaugccuga

SEQ ID NO: 664040 - RNA, 64 nt, Homo Sapiens
acaugagaggaaucacacugcaguuaccacuguacugcucaaaaaaggaaugugggaaagccuu

SEQ ID NO: 664041 - RNA, 64 nt, Homo Sapiens
acaugaaaagacucauacugcguauaucacaacucugcucaaagaaaaaaugugggaaaguguu

SEQ ID NO: 664042 - RNA, 64 nt, Homo Sapiens
acaugaaaaggcucauacugccgauaccaccaaucugcucaaaaaaagaauguggaaaagcauu

SEQ ID NO: 664043 - RNA, 64 nt, Homo Sapiens
gcuuggcuuccaggcaagacgagggacuccaccccugcucaacacuuggugagcauccucugua

SEQ ID NO: 664044 - RNA, 64 nt, Homo Sapiens
ccauuuaaauuauauccucauuuuacagcaaaaacugcucaaagagaugacuaacuaaaaucau

SEQ ID NO: 664045 - RNA, 64 nt, Homo Sapiens
cuuacagggcuaggauuucaguguugucagaguauuaccacacagcaacagcaacauacagaag

SEQ ID NO: 664046 - RNA, 64 nt, Homo Sapiens
gaaugcaccuauaaauuauggagcauuguagauuuuaccacaucaauucauagcaguaacuuua

SEQ ID NO: 664047 - RNA, 64 nt, Homo Sapiens
aaaugcaaaaaauaaaaaguauguuauguauauuuuaccacaauauaaaugguuaaaagguuuu

SEQ ID NO: 664048 - RNA, 64 nt, Homo Sapiens
aucuuuuaaacaauaaaacaguaucccaaaguuauuaccacauaguuugauuacucuauuuagu

SEQ ID NO: 664049 - RNA, 64 nt, Homo Sapiens
ggggugugcuauaacugcugaaggcugcauccuauuaccacaauaagcaggaaucagugucucu

SEQ ID NO: 664050 - RNA, 64 nt, Homo Sapiens
uuuaagaguuucaguuaccaggguucaugauucauuaccacaguccuuuguugagccuuuugag

SEQ ID NO: 664051 - RNA, 64 nt, Homo Sapiens
acuaggguacagccagauuuaaugcuuauaaagguuaccacaugggugaagauuuggaaucuug

SEQ ID NO: 664052 - RNA, 64 nt, Homo Sapiens
uuacuuacgcauuucuuuuguugucaucauaugauuaccacauuuucuguaauugcuguauaga

SEQ ID NO: 664053 - RNA, 64 nt, Homo Sapiens; identical to SEQ ID NO: 257521

SEQ ID NO: 664054 - RNA, 64 nt, Homo Sapiens; identical to SEQ ID NO: 257522

SEQ ID NO: 664055 - RNA, 64 nt, Homo Sapiens; identical to SEQ ID NO: 257523

SEQ ID NO: 664056 - RNA, 64 nt, Homo Sapiens; identical to SEQ ID NO: 257524

SEQ ID NO: 664057 - RNA, 64 nt, Homo Sapiens
gggguuggggguggggcugguggggccuccaggcaaggccaaguuccugccguccugcgccugc

SEQ ID NO: 664058 - RNA, 64 nt, Homo Sapiens
ggagacagccgugacgguaacccgagggcucagcaaggccaagauaucuaaguggaacuaauug

SEQ ID NO: 664059 - RNA, 64 nt, Homo Sapiens
aggcgcuaagggggaugggagaaaaucaggccggaaggccaagauggccagaacugcugucgaa

SEQ ID NO: 664060 - RNA, 64 nt, Homo Sapiens
cuguccuggucuugcuguggacgugauggaggaaaaggccaacuguuuaggcugaaugccuucc

SEQ ID NO: 664061 - RNA, 64 nt, Homo Sapiens
ggauguggggaagauggcagaaacucaagagcccaaggccaaggccuggacuaguccuagaugc

SEQ ID NO: 664062 - RNA, 64 nt, Homo Sapiens
cuggagcccguccaggcuuucacugaaauccugaaaggccaagccuauggcaaugugcaagucg

SEQ ID NO: 664063 - RNA, 64 nt, Homo Sapiens
ccaugccuauucugcaggugacuaauauacacaaaaggccaaaauuauaguaucuacuucuggu

SEQ ID NO: 664064 - RNA, 64 nt, Homo Sapiens
cagcuugacccuggcucacagaaaaugcaucaagaaggccaaacugcuccaccagugggccuug

SEQ ID NO: 664065 - RNA, 64 nt, Homo Sapiens
gcaggggcaugcgccuagaaucccagcuacucggaaggccaaggcaggaggaccgcuugagucc

SEQ ID NO: 664066 - RNA, 64 nt, Homo Sapiens
ccaaggcaggaggaccgcuugaguccagggauucaaggccaaccugggcaauagagcgagaccc

SEQ ID NO: 664067 - RNA, 64 nt, Homo Sapiens
cuacugaauuuagcgaauuuuaaaugaaucuuggaaggccaaaguuaaagcauucaacauugug

SEQ ID NO: 664068 - RNA, 64 nt, Homo Sapiens
uccaccacuuacuagguuugacagaucuggguucaaggccaaauagcacuucggcucuggaguu

SEQ ID NO: 664069 - RNA, 64 nt, Homo Sapiens
agggagcguggucguggaagaaacaacccaccugaaggccaaaugccagagauuugggguuggg

SEQ ID NO: 664070 - RNA, 64 nt, Homo Sapiens
ucaggcuccuccuugcccccaccuugccccaggaaaggccaaaguccaggugacugcccuccuu

SEQ ID NO: 664071 - RNA, 64 nt, Homo Sapiens
gugcaggcagggagcacaguuugagaucaugcugaaggccaagcaggcccggaacucccaguuu

SEQ ID NO: 664072 - RNA, 64 nt, Homo Sapiens
aauagcuuccuuugcuccaauaagcuuugcaaucaaggccaaagaaaaugaucugcuuccccug

SEQ ID NO: 664073 - RNA, 64 nt, Homo Sapiens
gaugaugacagugaugaugaugaagaaagcaaagaaggccaagaaaguucuaguagugcugcaa

SEQ ID NO: 664074 - RNA, 64 nt, Homo Sapiens
ucugauaagcaaaacagagacgaugguuuuugguaaggccaaacgugaguuauccuggacauuu

SEQ ID NO: 664075 - RNA, 64 nt, Homo Sapiens
aauauaaaauaccauuguuaaaguauucuaucuuaaggccaacuuuggaucuauuugguuuaaa

SEQ ID NO: 664076 - RNA, 64 nt, Homo Sapiens
aaugcacugucugucucuccacugacacucuguaaaggccaaucgcugugaaugugauccgcuc

SEQ ID NO: 664077 - RNA, 64 nt, Homo Sapiens
ugaacaccggauggugccaaggugcugcaucggcaaggccaaguggucgguuuaccacuggacg

SEQ ID NO: 664078 - RNA, 58 nt, Homo Sapiens
aggugcugcugcagacguagggcaggugaaggccaaagcggguguugguggucaggcc

SEQ ID NO: 664079 - RNA, 64 nt, Homo Sapiens
auuuguuagaacucugcccuuuugucugaaacucaaggccaaggagaaugauaggagacuuagg

SEQ ID NO: 664080 - RNA, 64 nt, Homo Sapiens; identical to SEQ ID NO: 159163

SEQ ID NO: 664081 - RNA, 64 nt, Homo Sapiens; identical to SEQ ID NO: 159164

SEQ ID NO: 664082 - RNA, 64 nt, Homo Sapiens; identical to SEQ ID NO: 159165

SEQ ID NO: 664083 - RNA, 64 nt, Homo Sapiens; identical to SEQ ID NO: 159166

SEQ ID NO: 664084 - RNA, 64 nt, Homo Sapiens; identical to SEQ ID NO: 159167

SEQ ID NO: 664085 - RNA, 64 nt, Homo Sapiens; identical to SEQ ID NO: 159168

SEQ ID NO: 664086 - RNA, 64 nt, Homo Sapiens; identical to SEQ ID NO: 159169

SEQ ID NO: 664087 - RNA, 64 nt, Homo Sapiens; identical to SEQ ID NO: 159170

SEQ ID NO: 664088 - RNA, 64 nt, Homo Sapiens; identical to SEQ ID NO: 159171

SEQ ID NO: 664089 - RNA, 64 nt, Homo Sapiens; identical to SEQ ID NO: 159172

SEQ ID NO: 664090 - RNA, 64 nt, Homo Sapiens; identical to SEQ ID NO: 159173

SEQ ID NO: 664091 - RNA, 64 nt, Homo Sapiens; identical to SEQ ID NO: 159174

SEQ ID NO: 664092 - RNA, 64 nt, Homo Sapiens; identical to SEQ ID NO: 159175

SEQ ID NO: 664093 - RNA, 64 nt, Homo Sapiens; identical to SEQ ID NO: 159176

SEQ ID NO: 664094 - RNA, 64 nt, Homo Sapiens; identical to SEQ ID NO: 159177

SEQ ID NO: 664095 - RNA, 64 nt, Homo Sapiens; identical to SEQ ID NO: 159178

SEQ ID NO: 664096 - RNA, 64 nt, Homo Sapiens; identical to SEQ ID NO: 159179

SEQ ID NO: 664097 - RNA, 64 nt, Homo Sapiens; identical to SEQ ID NO: 159180

SEQ ID NO: 664098 - RNA, 64 nt, Homo Sapiens; identical to SEQ ID NO: 159181

SEQ ID NO: 664099 - RNA, 64 nt, Homo Sapiens; identical to SEQ ID NO: 159182

SEQ ID NO: 664100 - RNA, 64 nt, Homo Sapiens; identical to SEQ ID NO: 159183

SEQ ID NO: 664101 - RNA, 64 nt, Homo Sapiens; identical to SEQ ID NO: 159184

SEQ ID NO: 664102 - RNA, 64 nt, Homo Sapiens; identical to SEQ ID NO: 159185

SEQ ID NO: 664103 - RNA, 64 nt, Homo Sapiens; identical to SEQ ID NO: 159186

SEQ ID NO: 664104 - RNA, 64 nt, Homo Sapiens; identical to SEQ ID NO: 159187

SEQ ID NO: 664105 - RNA, 64 nt, Homo Sapiens; identical to SEQ ID NO: 159188

SEQ ID NO: 664106 - RNA, 64 nt, Homo Sapiens; identical to SEQ ID NO: 159189

SEQ ID NO: 664107 - RNA, 64 nt, Homo Sapiens; identical to SEQ ID NO: 159190

SEQ ID NO: 664108 - RNA, 64 nt, Homo Sapiens; identical to SEQ ID NO: 159191

SEQ ID NO: 664109 - RNA, 64 nt, Homo Sapiens; identical to SEQ ID NO: 159192

SEQ ID NO: 664110 - RNA, 64 nt, Homo Sapiens; identical to SEQ ID NO: 159193

SEQ ID NO: 664111 - RNA, 64 nt, Homo Sapiens; identical to SEQ ID NO: 159194

SEQ ID NO: 664112 - RNA, 64 nt, Homo Sapiens; identical to SEQ ID NO: 159195

SEQ ID NO: 664113 - RNA, 64 nt, Homo Sapiens; identical to SEQ ID NO: 159196

SEQ ID NO: 664114 - RNA, 64 nt, Homo Sapiens; identical to SEQ ID NO: 159197

SEQ ID NO: 664115 - RNA, 64 nt, Homo Sapiens; identical to SEQ ID NO: 159198

SEQ ID NO: 664116 - RNA, 64 nt, Homo Sapiens; identical to SEQ ID NO: 159199

SEQ ID NO: 664117 - RNA, 64 nt, Homo Sapiens; identical to SEQ ID NO: 159200

SEQ ID NO: 664118 - RNA, 64 nt, Homo Sapiens; identical to SEQ ID NO: 159201

SEQ ID NO: 664119 - RNA, 63 nt, Homo Sapiens
ucuaucccaauugagacagcuagaaacaguugacugacuaaauggaaacuagucuauuugaca

SEQ ID NO: 664120 - RNA, 63 nt, Homo Sapiens
aauaagcaguuugccuuuauaaaaacuugcugccugacuaaagauuaacagguuauaguuuaa

SEQ ID NO: 664121 - RNA, 63 nt, Homo Sapiens
caugaaaguaauaaugugggauuacuagaaaaccugacuaauggugucacugcuggcaauggu

SEQ ID NO: 664122 - RNA, 63 nt, Homo Sapiens
cacggaaguacucaugucggauucccagaaaaccugacuaauggugccacugcuggcaauggu

SEQ ID NO: 664123 - RNA, 63 nt, Homo Sapiens
cuacaaaacuugaauauaacacauuuuggaaggcugacuaaccucgauucuguguugugaugu

SEQ ID NO: 664124 - RNA, 63 nt, Homo Sapiens
uaaguaauuuuuaaauauuuguaauauuguugacugacuaauaaacuauuaaguuauuggcau

SEQ ID NO: 664125 - RNA, 63 nt, Homo Sapiens
ccauccaggcugggaggggagccagccuguucucugacuaacggcaaccugaggaagucuuuu

SEQ ID NO: 664126 - RNA, 63 nt, Homo Sapiens
gccucagcacauccgacacccaaaucucagucccugacuaacacccuugccuuucuguuucag

SEQ ID NO: 664127 - RNA, 64 nt, Homo Sapiens
agugauuuuaaaaaccagaauuuuaguugcaauacaauuuuaauaucacccuacauauuauuua

SEQ ID NO: 664128 - RNA, 64 nt, Homo Sapiens
acaguagauaagcugucgaaaauggaaaacaauucaauuuuaauuuucugcucugaguauuuag

SEQ ID NO: 664129 - RNA, 64 nt, Homo Sapiens
ucugcaaauuguauaagaauaaaguuagaauuaacaauuuuauuuuguacaacaguggaauuuu

SEQ ID NO: 664130 - RNA, 64 nt, Homo Sapiens
aaauccacaaauuuuucagauagugcccuaaaaacaauuuuauaugccucacugguuguuauuc

SEQ ID NO: 664131 - RNA, 64 nt, Homo Sapiens
uuucugcaagaauuauucugauauuuaagagagccaauuuuaacugcugugaaaauguuuccag

SEQ ID NO: 664132 - RNA, 64 nt, Homo Sapiens
cugagucaaaggauuuuccuuuaaaugcuugucucaauuuuagucuggucuuuuguacuuuucu

SEQ ID NO: 664133 - RNA, 64 nt, Homo Sapiens
auuuuauuuuuguuuuuuucgagaugggauuuuucaauuuuauuuguuuuggaacauuaauugu

SEQ ID NO: 664134 - RNA, 64 nt, Homo Sapiens
ccucaauuuuuuuuuuuuuccuuaaguaaccacacaauuuuagguuucccauuuuuuuuuucag

SEQ ID NO: 664135 - RNA, 64 nt, Homo Sapiens
aauuguguaacuuuuauguuuaaauuuugcacugcaauuuuauuuggugauaagcacaaaucuc

SEQ ID NO: 664136 - RNA, 64 nt, Homo Sapiens
gcuuaaaaaaagaaauuaaaguuuuauuuagaaucaauuuuaccugucauuguaauugacccau

SEQ ID NO: 664137 - RNA, 64 nt, Homo Sapiens
acucuuacguguuuauuuugagucaugagauaaucaauuuuaacccaaagucauuggauuauuu

SEQ ID NO: 664138 - RNA, 64 nt, Homo Sapiens
cuauuucauauacauuguauuaaaacugccauaucaauuuuaauguauagauuuugcaaauauu

SEQ ID NO: 664139 - RNA, 64 nt, Homo Sapiens
gcauauuuaacaaaauuugaaugugacuuggauucaauuuuaagaugcuaauuuuauuauagua

SEQ ID NO: 664140 - RNA, 60 nt, Homo Sapiens
ugucaaugggaaaaaacaccagaucaccaucaauuuuaguuagaaaucaacuggucauga

SEQ ID NO: 664141 - RNA, 64 nt, Homo Sapiens
aguuuuuaacugaaggaaccaguuguaacagucucaauuuuaacuaaaacuugaagaacuaaaa

SEQ ID NO: 664142 - RNA, 64 nt, Homo Sapiens
gagcuaaauuccuaauguguauuguauuccaacccaauuuuacuggaacuauugaauaaaucuu

SEQ ID NO: 664143 - RNA, 64 nt, Homo Sapiens
auucuuauaguauucuuggguucaaccuuugaaucaauuuuaccacugauuaaauaaaugacuc

SEQ ID NO: 664144 - RNA, 64 nt, Homo Sapiens
gugucauuuaucauuuuguaauauuaaauuauggcaauuuuauuucaaacuaaaguuugaacac

SEQ ID NO: 664145 - RNA, 64 nt, Homo Sapiens
ggauggcuggguagagcaaucugggcacuuuggccaauuuuagucuugcuguuucuugaugcuc

SEQ ID NO: 664146 - RNA, 64 nt, Homo Sapiens
aauuacuacaaauggaugacacauuuaaugaacacaauuuuauuuuuuuucuguaacugugcuu

SEQ ID NO: 664147 - RNA, 64 nt, Homo Sapiens
ugagcacaggaacaggcaugaagauauugccauacaauuuuaauuuauacaaguauuggccccu

SEQ ID NO: 664148 - RNA, 64 nt, Homo Sapiens
uaagaaacagaccuaguuuaaaaggaauaaucaacaauuuuauaaaggagauggcuuauucaac

SEQ ID NO: 664149 - RNA, 64 nt, Homo Sapiens
uagacagucuuaaauaugucaaaggaaacccaugcaauuuuaccaauugauucaauuuuauggu

SEQ ID NO: 664150 - RNA, 64 nt, Homo Sapiens
guaaaggaaacccaugcaauaaaaaaaauugauucaauuuuaugagauagugauacugagggua

SEQ ID NO: 664151 - RNA, 64 nt, Homo Sapiens
uugaaaucgguguaguauccuguauugugauuuucaauuuuauggguuuuaacuuaaaaaaaau

SEQ ID NO: 664152 - RNA, 64 nt, Homo Sapiens
auguaauauauagagguauacauaguaggcaauacaauuuuagaguagacuccaggauacaaac

SEQ ID NO: 664153 - RNA, 64 nt, Homo Sapiens
uucuggcaaagggacaucauagcaaggaaauguacaauuuuaucucaaguuggaaccaagaaau

SEQ ID NO: 664154 - RNA, 64 nt, Homo Sapiens
gaaaacaaagcaaaugaauacuggacagucuuaacaauuuuauaaguuauaaaaugacuuuaga

SEQ ID NO: 664155 - RNA, 64 nt, Homo Sapiens
auacauacccagcaacuuuuauaaauguguuaaacaauuuuacugauuuuuauaauaaauauuu

SEQ ID NO: 664156 - RNA, 64 nt, Homo Sapiens
uuuuagaauaucaucuugaauauuuuugucuaagcaauuuuauauuucuccuugagaaaacuuu

SEQ ID NO: 664157 - RNA, 64 nt, Homo Sapiens
auggccaaugauguauacauaugaauuauuaaaacaauuuuaaaauuaauuguaauuaagggaa

SEQ ID NO: 664158 - RNA, 64 nt, Homo Sapiens
acuguaaauuacaucugaagaaaguuuuaaagugcaauuuuaaauuuauacugucuaaaaaagc

SEQ ID NO: 664159 - RNA, 50 nt, Homo Sapiens
ugguaagguucacaaauaggcaauuuuagaauuuagaagacacagacuaa

SEQ ID NO: 664160 - RNA, 64 nt, Homo Sapiens
aaauuaugcaguuuaaaaugaaaagaaauuguaccaauuuuacucuaauguugauuaauaugug

SEQ ID NO: 664161 - RNA, 64 nt, Homo Sapiens
auuuucaucaguaugaucaucaccacagucagagcaauuuuauuaagaaaugggaaaaaaucuu

SEQ ID NO: 664162 - RNA, 64 nt, Homo Sapiens
uguaaagugauggaauaaaaacuccugugagccucaauuuuauuucugugaccuuaagcaaaua

SEQ ID NO: 664163 - RNA, 64 nt, Homo Sapiens
ucaugucccuggacauaaaaacaacauuaauuaacaauuuuacgggagguaaaaggugaaagga

SEQ ID NO: 664164 - RNA, 64 nt, Homo Sapiens
uaggaaauuccuaggucuagugagaauuauuuuucaauuuuauuuuaguucuaaauuauguuuc

SEQ ID NO: 664165 - RNA, 64 nt, Homo Sapiens
aucaccauuugaauuucaaauguaguuuucaugacaauuuuauauugauguguguuuacaauga

SEQ ID NO: 664166 - RNA, 64 nt, Homo Sapiens
aacacucgggaaaugaguaaguguaaaaucucaucaauuuuaaguguguacagguaugggccaa

SEQ ID NO: 664167 - RNA, 64 nt, Homo Sapiens
uguaaauuuuauugucuguuuaucaugauauuuucaauuuuauguugugugcauuuguaaacac

SEQ ID NO: 664168 - RNA, 64 nt, Homo Sapiens
acucaaguuccauuguguuaaauuuuacccaauccaauuuuagccaccccugucauucacuucc

SEQ ID NO: 664169 - RNA, 64 nt, Homo Sapiens
caauccaauuuuagcacucacugucauucacuuccaauuuuaccguaacugagcuccuccaccc

SEQ ID NO: 664170 - RNA, 64 nt, Homo Sapiens
ugcgacucugucucgggaaugauucuuuccuguaaagucuuauccaaaguguacucuuggaaug

SEQ ID NO: 664171 - RNA, 64 nt, Homo Sapiens
gcugagauuucuaaagaugcccuuagccccuccuaagucuuaauggcuguucaacauccucccu

SEQ ID NO: 664172 - RNA, 64 nt, Homo Sapiens
aaacugguuauuuaaaauguaaaaaggaauaugaaagucuuauuaaaacacuucauugaaaaua

SEQ ID NO: 664173 - RNA, 64 nt, Homo Sapiens
cagucuaaauuuauuauuuaaauuuuacuagcaaaagucuuaggugaacaaucaacuaguauuu

SEQ ID NO: 664174 - RNA, 64 nt, Homo Sapiens
cuacaggucuuugaucuggaaacuaagacuagagaagucuuaagagaugacugcucaggugagu

SEQ ID NO: 664175 - RNA, 64 nt, Homo Sapiens
guaaagaaugugaaaagucuuucagucagagcucaagucuuagucgacauaaaagaauacacac

SEQ ID NO: 664176 - RNA, 64 nt, Homo Sapiens
caaucucuaagguuuguuucagugguggguuuuuaagucuuaacagauuaagugguaaugucau

SEQ ID NO: 664177 - RNA, 64 nt, Homo Sapiens
uuaccuucaguuuaaucuguaauaaccaaaacugaagucuuaauauccucacagaaaaguugga

SEQ ID NO: 664178 - RNA, 64 nt, Homo Sapiens
acugacauacuggauuuuuaggauuuggaugaagaagucuuaauuaauagcaauaaaccuaacu

SEQ ID NO: 664179 - RNA, 64 nt, Homo Sapiens
acugaaauacugaauuuuuagucuuuggaugaagaagucuuaaugccuaguuagaguuagaccu

SEQ ID NO: 664180 - RNA, 64 nt, Homo Sapiens
caaucuuuggcaucuuaaaaaaggagacacugcaaagucuuagauuaauauuuugaaagucuua

SEQ ID NO: 664181 - RNA, 64 nt, Homo Sapiens
ggagacacugcaaagucuuaucuuaauauuuugaaagucuuaaaacuuuuucguaacuuuugaa

SEQ ID NO: 664182 - RNA, 64 nt, Homo Sapiens
uuuuugucuuacuuuuuuuucguagaugucuuacaagucuuauaacuugaaacuuaucucaacc

SEQ ID NO: 664183 - RNA, 64 nt, Homo Sapiens
auuuauuuaauaauuauauuuggguuaguauuuaaagucuuaacuuguauuuuuaaauuuuucu

SEQ ID NO: 664184 - RNA, 64 nt, Homo Sapiens
gaauuuguauuuuuaaauuuuguuguuagagcaaaagucuuacuguugauucguuuugaaaaau

SEQ ID NO: 664185 - RNA, 64 nt, Homo Sapiens
aaaaaugcauaauuuugcuagauauuggugaugaaagucuuaggacaaaagcaggguauaaggc

SEQ ID NO: 664186 - RNA, 64 nt, Homo Sapiens
ccuauguuuuuaaauuuuuugcuaaucuacaaauaagucuuaaacauacaagucaggguguuug

SEQ ID NO: 664187 - RNA, 64 nt, Homo Sapiens
gacaaagugccaaagaaaguuauguagaagcaugaagucuuaagugaccuuguaaaagacagug

SEQ ID NO: 664188 - RNA, 64 nt, Homo Sapiens
acagaaaugaggaggaugcuggagggaguuacugaagucuuacuaagagauccaaagacucuug

SEQ ID NO: 664189 - RNA, 64 nt, Homo Sapiens; identical to SEQ ID NO: 93643

SEQ ID NO: 664190 - RNA, 64 nt, Homo Sapiens; identical to SEQ ID NO: 93644

SEQ ID NO: 664191 - RNA, 64 nt, Homo Sapiens; identical to SEQ ID NO: 93645

SEQ ID NO: 664192 - RNA, 64 nt, Homo Sapiens; identical to SEQ ID NO: 93646

SEQ ID NO: 664193 - RNA, 64 nt, Homo Sapiens; identical to SEQ ID NO: 93647

SEQ ID NO: 664194 - RNA, 64 nt, Homo Sapiens; identical to SEQ ID NO: 93648

SEQ ID NO: 664195 - RNA, 64 nt, Homo Sapiens; identical to SEQ ID NO: 93649

SEQ ID NO: 664196 - RNA, 64 nt, Homo Sapiens; identical to SEQ ID NO: 93650

SEQ ID NO: 664197 - RNA, 64 nt, Homo Sapiens; identical to SEQ ID NO: 93651

SEQ ID NO: 664198 - RNA, 64 nt, Homo Sapiens; identical to SEQ ID NO: 93652

SEQ ID NO: 664199 - RNA, 64 nt, Homo Sapiens; identical to SEQ ID NO: 93653

SEQ ID NO: 664200 - RNA, 64 nt, Homo Sapiens; identical to SEQ ID NO: 93654

SEQ ID NO: 664201 - RNA, 64 nt, Homo Sapiens; identical to SEQ ID NO: 93655

SEQ ID NO: 664202 - RNA, 64 nt, Homo Sapiens; identical to SEQ ID NO: 93656

SEQ ID NO: 664203 - RNA, 64 nt, Homo Sapiens; identical to SEQ ID NO: 93657

SEQ ID NO: 664204 - RNA, 64 nt, Homo Sapiens; identical to SEQ ID NO: 93658

SEQ ID NO: 664205 - RNA, 64 nt, Homo Sapiens; identical to SEQ ID NO: 93659

SEQ ID NO: 664206 - RNA, 64 nt, Homo Sapiens; identical to SEQ ID NO: 93660

SEQ ID NO: 664207 - RNA, 64 nt, Homo Sapiens; identical to SEQ ID NO: 93661

SEQ ID NO: 664208 - RNA, 64 nt, Homo Sapiens; identical to SEQ ID NO: 93662

SEQ ID NO: 664209 - RNA, 64 nt, Homo Sapiens; identical to SEQ ID NO: 93663

SEQ ID NO: 664210 - RNA, 64 nt, Homo Sapiens; identical to SEQ ID NO: 93664

SEQ ID NO: 664211 - RNA, 64 nt, Homo Sapiens; identical to SEQ ID NO: 226834

SEQ ID NO: 664212 - RNA, 64 nt, Homo Sapiens; identical to SEQ ID NO: 226835

SEQ ID NO: 664213 - RNA, 64 nt, Homo Sapiens; identical to SEQ ID NO: 226836

SEQ ID NO: 664214 - RNA, 64 nt, Homo Sapiens; identical to SEQ ID NO: 226837

SEQ ID NO: 664215 - RNA, 64 nt, Homo Sapiens; identical to SEQ ID NO: 226838

SEQ ID NO: 664216 - RNA, 64 nt, Homo Sapiens; identical to SEQ ID NO: 226839

SEQ ID NO: 664217 - RNA, 64 nt, Homo Sapiens; identical to SEQ ID NO: 226840

SEQ ID NO: 664218 - RNA, 64 nt, Homo Sapiens; identical to SEQ ID NO: 226841

SEQ ID NO: 664219 - RNA, 64 nt, Homo Sapiens; identical to SEQ ID NO: 226842

SEQ ID NO: 664220 - RNA, 64 nt, Homo Sapiens; identical to SEQ ID NO: 226843

SEQ ID NO: 664221 - RNA, 64 nt, Homo Sapiens; identical to SEQ ID NO: 226844

SEQ ID NO: 664222 - RNA, 64 nt, Homo Sapiens; identical to SEQ ID NO: 226845

SEQ ID NO: 664223 - RNA, 64 nt, Homo Sapiens; identical to SEQ ID NO: 226846

SEQ ID NO: 664224 - RNA, 64 nt, Homo Sapiens; identical to SEQ ID NO: 226847

SEQ ID NO: 664225 - RNA, 64 nt, Homo Sapiens; identical to SEQ ID NO: 226848

SEQ ID NO: 664226 - RNA, 64 nt, Homo Sapiens; identical to SEQ ID NO: 226849

SEQ ID NO: 664227 - RNA, 64 nt, Homo Sapiens; identical to SEQ ID NO: 226850

SEQ ID NO: 664228 - RNA, 64 nt, Homo Sapiens; identical to SEQ ID NO: 226851

SEQ ID NO: 664229 - RNA, 64 nt, Homo Sapiens; identical to SEQ ID NO: 226852

SEQ ID NO: 664230 - RNA, 64 nt, Homo Sapiens; identical to SEQ ID NO: 226853

SEQ ID NO: 664231 - RNA, 64 nt, Homo Sapiens; identical to SEQ ID NO: 226854

SEQ ID NO: 664232 - RNA, 64 nt, Homo Sapiens; identical to SEQ ID NO: 226855

SEQ ID NO: 664233 - RNA, 64 nt, Homo Sapiens; identical to SEQ ID NO: 226856

SEQ ID NO: 664234 - RNA, 64 nt, Homo Sapiens; identical to SEQ ID NO: 226857

SEQ ID NO: 664235 - RNA, 64 nt, Homo Sapiens; identical to SEQ ID NO: 226858

SEQ ID NO: 664236 - RNA, 64 nt, Homo Sapiens; identical to SEQ ID NO: 226859

SEQ ID NO: 664237 - RNA, 64 nt, Homo Sapiens; identical to SEQ ID NO: 226860

SEQ ID NO: 664238 - RNA, 64 nt, Homo Sapiens; identical to SEQ ID NO: 226861

SEQ ID NO: 664239 - RNA, 64 nt, Homo Sapiens; identical to SEQ ID NO: 226862

SEQ ID NO: 664240 - RNA, 64 nt, Homo Sapiens; identical to SEQ ID NO: 226863

SEQ ID NO: 664241 - RNA, 64 nt, Homo Sapiens; identical to SEQ ID NO: 226864

SEQ ID NO: 664242 - RNA, 64 nt, Homo Sapiens; identical to SEQ ID NO: 226865

SEQ ID NO: 664243 - RNA, 64 nt, Homo Sapiens; identical to SEQ ID NO: 226866

SEQ ID NO: 664244 - RNA, 64 nt, Homo Sapiens; identical to SEQ ID NO: 226867

SEQ ID NO: 664245 - RNA, 64 nt, Homo Sapiens; identical to SEQ ID NO: 226868

SEQ ID NO: 664246 - RNA, 64 nt, Homo Sapiens; identical to SEQ ID NO: 226869

SEQ ID NO: 664247 - RNA, 64 nt, Homo Sapiens; identical to SEQ ID NO: 226870

SEQ ID NO: 664248 - RNA, 64 nt, Homo Sapiens; identical to SEQ ID NO: 226871

SEQ ID NO: 664249 - RNA, 64 nt, Homo Sapiens; identical to SEQ ID NO: 226872

SEQ ID NO: 664250 - RNA, 64 nt, Homo Sapiens; identical to SEQ ID NO: 226873

SEQ ID NO: 664251 - RNA, 64 nt, Homo Sapiens; identical to SEQ ID NO: 226874

SEQ ID NO: 664252 - RNA, 64 nt, Homo Sapiens; identical to SEQ ID NO: 226875

SEQ ID NO: 664253 - RNA, 64 nt, Homo Sapiens; identical to SEQ ID NO: 226876

SEQ ID NO: 664254 - RNA, 64 nt, Homo Sapiens; identical to SEQ ID NO: 226877

SEQ ID NO: 664255 - RNA, 64 nt, Homo Sapiens; identical to SEQ ID NO: 226878

SEQ ID NO: 664256 - RNA, 64 nt, Homo Sapiens; identical to SEQ ID NO: 226879

SEQ ID NO: 664257 - RNA, 64 nt, Homo Sapiens; identical to SEQ ID NO: 226880

SEQ ID NO: 664258 - RNA, 64 nt, Homo Sapiens; identical to SEQ ID NO: 226881

SEQ ID NO: 664259 - RNA, 64 nt, Homo Sapiens; identical to SEQ ID NO: 226882

SEQ ID NO: 664260 - RNA, 64 nt, Homo Sapiens; identical to SEQ ID NO: 226883

SEQ ID NO: 664261 - RNA, 64 nt, Homo Sapiens; identical to SEQ ID NO: 226884

SEQ ID NO: 664262 - RNA, 64 nt, Homo Sapiens; identical to SEQ ID NO: 226885

SEQ ID NO: 664263 - RNA, 64 nt, Homo Sapiens; identical to SEQ ID NO: 226886

SEQ ID NO: 664264 - RNA, 64 nt, Homo Sapiens; identical to SEQ ID NO: 226887

SEQ ID NO: 664265 - RNA, 64 nt, Homo Sapiens; identical to SEQ ID NO: 226888

SEQ ID NO: 664266 - RNA, 64 nt, Homo Sapiens; identical to SEQ ID NO: 226889

SEQ ID NO: 664267 - RNA, 64 nt, Homo Sapiens; identical to SEQ ID NO: 226890

SEQ ID NO: 664268 - RNA, 64 nt, Homo Sapiens
ccccuuguuccuccccauuacgaccagguucucaagacacgaguuggacuggguucucaagaca

SEQ ID NO: 664269 - RNA, 64 nt, Homo Sapiens
agguucucaagacacgagucggacuggguucucaagacacgaccccagaggccugauucuguuu

SEQ ID NO: 664270 - RNA, 64 nt, Homo Sapiens
ucuuucaggagcagagcagcuauuucuuaguguagguagacaaugcaacaccucccuauucugu

SEQ ID NO: 664271 - RNA, 64 nt, Homo Sapiens
uucuugcaacuugggggaaaugaaagaaaauguggguagacaaugaaacaaugaaaggaacauu

SEQ ID NO: 664272 - RNA, 64 nt, Homo Sapiens; identical to SEQ ID NO: 236234

SEQ ID NO: 664273 - RNA, 64 nt, Homo Sapiens; identical to SEQ ID NO: 236235

SEQ ID NO: 664274 - RNA, 64 nt, Homo Sapiens; identical to SEQ ID NO: 236236

SEQ ID NO: 664275 - RNA, 64 nt, Homo Sapiens; identical to SEQ ID NO: 236237

SEQ ID NO: 664276 - RNA, 64 nt, Homo Sapiens; identical to SEQ ID NO: 236238

SEQ ID NO: 664277 - RNA, 64 nt, Homo Sapiens; identical to SEQ ID NO: 236239

SEQ ID NO: 664278 - RNA, 64 nt, Homo Sapiens; identical to SEQ ID NO: 164794

SEQ ID NO: 664279 - RNA, 64 nt, Homo Sapiens; identical to SEQ ID NO: 164795

SEQ ID NO: 664280 - RNA, 64 nt, Homo Sapiens; identical to SEQ ID NO: 164796

SEQ ID NO: 664281 - RNA, 64 nt, Homo Sapiens; identical to SEQ ID NO: 164797

SEQ ID NO: 664282 - RNA, 64 nt, Homo Sapiens; identical to SEQ ID NO: 164798

SEQ ID NO: 664283 - RNA, 64 nt, Homo Sapiens; identical to SEQ ID NO: 164799

SEQ ID NO: 664284 - RNA, 64 nt, Homo Sapiens; identical to SEQ ID NO: 164800

SEQ ID NO: 664285 - RNA, 64 nt, Homo Sapiens; identical to SEQ ID NO: 164801

SEQ ID NO: 664286 - RNA, 64 nt, Homo Sapiens; identical to SEQ ID NO: 164802

SEQ ID NO: 664287 - RNA, 64 nt, Homo Sapiens; identical to SEQ ID NO: 164803

SEQ ID NO: 664288 - RNA, 64 nt, Homo Sapiens; identical to SEQ ID NO: 164804

SEQ ID NO: 664289 - RNA, 64 nt, Homo Sapiens; identical to SEQ ID NO: 164805

SEQ ID NO: 664290 - RNA, 64 nt, Homo Sapiens; identical to SEQ ID NO: 164806

SEQ ID NO: 664291 - RNA, 64 nt, Homo Sapiens; identical to SEQ ID NO: 164807

SEQ ID NO: 664292 - RNA, 64 nt, Homo Sapiens; identical to SEQ ID NO: 164808

SEQ ID NO: 664293 - RNA, 64 nt, Homo Sapiens; identical to SEQ ID NO: 164809

SEQ ID NO: 664294 - RNA, 64 nt, Homo Sapiens; identical to SEQ ID NO: 164810

SEQ ID NO: 664295 - RNA, 64 nt, Homo Sapiens; identical to SEQ ID NO: 164811

SEQ ID NO: 664296 - RNA, 64 nt, Homo Sapiens; identical to SEQ ID NO: 164812

SEQ ID NO: 664297 - RNA, 64 nt, Homo Sapiens; identical to SEQ ID NO: 164813

SEQ ID NO: 664298 - RNA, 64 nt, Homo Sapiens; identical to SEQ ID NO: 164814

SEQ ID NO: 664299 - RNA, 64 nt, Homo Sapiens; identical to SEQ ID NO: 164815

SEQ ID NO: 664300 - RNA, 64 nt, Homo Sapiens; identical to SEQ ID NO: 164816

SEQ ID NO: 664301 - RNA, 64 nt, Homo Sapiens; identical to SEQ ID NO: 164817

SEQ ID NO: 664302 - RNA, 64 nt, Homo Sapiens; identical to SEQ ID NO: 164818

SEQ ID NO: 664303 - RNA, 64 nt, Homo Sapiens; identical to SEQ ID NO: 164819

SEQ ID NO: 664304 - RNA, 64 nt, Homo Sapiens; identical to SEQ ID NO: 164820

SEQ ID NO: 664305 - RNA, 64 nt, Homo Sapiens; identical to SEQ ID NO: 164821

SEQ ID NO: 664306 - RNA, 64 nt, Homo Sapiens; identical to SEQ ID NO: 164822

SEQ ID NO: 664307 - RNA, 64 nt, Homo Sapiens; identical to SEQ ID NO: 164823

SEQ ID NO: 664308 - RNA, 64 nt, Homo Sapiens; identical to SEQ ID NO: 164824

SEQ ID NO: 664309 - RNA, 64 nt, Homo Sapiens; identical to SEQ ID NO: 164825

SEQ ID NO: 664310 - RNA, 64 nt, Homo Sapiens; identical to SEQ ID NO: 164826

SEQ ID NO: 664311 - RNA, 64 nt, Homo Sapiens; identical to SEQ ID NO: 164827

SEQ ID NO: 664312 - RNA, 64 nt, Homo Sapiens; identical to SEQ ID NO: 164828

SEQ ID NO: 664313 - RNA, 64 nt, Homo Sapiens; identical to SEQ ID NO: 133550

SEQ ID NO: 664314 - RNA, 64 nt, Homo Sapiens; identical to SEQ ID NO: 133551

SEQ ID NO: 664315 - RNA, 64 nt, Homo Sapiens; identical to SEQ ID NO: 133552

SEQ ID NO: 664316 - RNA, 64 nt, Homo Sapiens; identical to SEQ ID NO: 133553

SEQ ID NO: 664317 - RNA, 64 nt, Homo Sapiens; identical to SEQ ID NO: 133554

SEQ ID NO: 664318 - RNA, 64 nt, Homo Sapiens; identical to SEQ ID NO: 133555

SEQ ID NO: 664319 - RNA, 64 nt, Homo Sapiens; identical to SEQ ID NO: 133556

SEQ ID NO: 664320 - RNA, 64 nt, Homo Sapiens; identical to SEQ ID NO: 133557

SEQ ID NO: 664321 - RNA, 64 nt, Homo Sapiens; identical to SEQ ID NO: 133558

SEQ ID NO: 664322 - RNA, 64 nt, Homo Sapiens; identical to SEQ ID NO: 133559

SEQ ID NO: 664323 - RNA, 64 nt, Homo Sapiens; identical to SEQ ID NO: 133560

SEQ ID NO: 664324 - RNA, 64 nt, Homo Sapiens; identical to SEQ ID NO: 133561

SEQ ID NO: 664325 - RNA, 64 nt, Homo Sapiens; identical to SEQ ID NO: 133562

SEQ ID NO: 664326 - RNA, 64 nt, Homo Sapiens; identical to SEQ ID NO: 133563

SEQ ID NO: 664327 - RNA, 64 nt, Homo Sapiens; identical to SEQ ID NO: 133564

SEQ ID NO: 664328 - RNA, 64 nt, Homo Sapiens; identical to SEQ ID NO: 133565

SEQ ID NO: 664329 - RNA, 64 nt, Homo Sapiens; identical to SEQ ID NO: 133566

SEQ ID NO: 664330 - RNA, 64 nt, Homo Sapiens; identical to SEQ ID NO: 133567

SEQ ID NO: 664331 - RNA, 64 nt, Homo Sapiens; identical to SEQ ID NO: 133568

SEQ ID NO: 664332 - RNA, 64 nt, Homo Sapiens; identical to SEQ ID NO: 133569

SEQ ID NO: 664333 - RNA, 64 nt, Homo Sapiens; identical to SEQ ID NO: 133570

SEQ ID NO: 664334 - RNA, 64 nt, Homo Sapiens; identical to SEQ ID NO: 133571

SEQ ID NO: 664335 - RNA, 64 nt, Homo Sapiens; identical to SEQ ID NO: 133572

SEQ ID NO: 664336 - RNA, 64 nt, Homo Sapiens; identical to SEQ ID NO: 133573

SEQ ID NO: 664337 - RNA, 64 nt, Homo Sapiens; identical to SEQ ID NO: 133574

SEQ ID NO: 664338 - RNA, 64 nt, Homo Sapiens; identical to SEQ ID NO: 133575

SEQ ID NO: 664339 - RNA, 64 nt, Homo Sapiens; identical to SEQ ID NO: 133576

SEQ ID NO: 664340 - RNA, 64 nt, Homo Sapiens; identical to SEQ ID NO: 133577

SEQ ID NO: 664341 - RNA, 64 nt, Homo Sapiens; identical to SEQ ID NO: 133578

SEQ ID NO: 664342 - RNA, 64 nt, Homo Sapiens; identical to SEQ ID NO: 133579

SEQ ID NO: 664343 - RNA, 64 nt, Homo Sapiens; identical to SEQ ID NO: 133580

SEQ ID NO: 664344 - RNA, 64 nt, Homo Sapiens; identical to SEQ ID NO: 133581

SEQ ID NO: 664345 - RNA, 64 nt, Homo Sapiens; identical to SEQ ID NO: 133582

SEQ ID NO: 664346 - RNA, 64 nt, Homo Sapiens; identical to SEQ ID NO: 133583

SEQ ID NO: 664347 - RNA, 64 nt, Homo Sapiens; identical to SEQ ID NO: 133584

SEQ ID NO: 664348 - RNA, 64 nt, Homo Sapiens; identical to SEQ ID NO: 133585

SEQ ID NO: 664349 - RNA, 64 nt, Homo Sapiens; identical to SEQ ID NO: 133586

SEQ ID NO: 664350 - RNA, 64 nt, Homo Sapiens; identical to SEQ ID NO: 133587

SEQ ID NO: 664351 - RNA, 64 nt, Homo Sapiens; identical to SEQ ID NO: 133588

SEQ ID NO: 664352 - RNA, 64 nt, Homo Sapiens; identical to SEQ ID NO: 133589

SEQ ID NO: 664353 - RNA, 64 nt, Homo Sapiens; identical to SEQ ID NO: 133590

SEQ ID NO: 664354 - RNA, 64 nt, Homo Sapiens; identical to SEQ ID NO: 133591

SEQ ID NO: 664355 - RNA, 64 nt, Homo Sapiens; identical to SEQ ID NO: 133592

SEQ ID NO: 664356 - RNA, 64 nt, Homo Sapiens; identical to SEQ ID NO: 133593

SEQ ID NO: 664357 - RNA, 64 nt, Homo Sapiens; identical to SEQ ID NO: 133594

SEQ ID NO: 664358 - RNA, 64 nt, Homo Sapiens; identical to SEQ ID NO: 133595

SEQ ID NO: 664359 - RNA, 64 nt, Homo Sapiens; identical to SEQ ID NO: 133596

SEQ ID NO: 664360 - RNA, 64 nt, Homo Sapiens; identical to SEQ ID NO: 133597

SEQ ID NO: 664361 - RNA, 64 nt, Homo Sapiens; identical to SEQ ID NO: 133598

SEQ ID NO: 664362 - RNA, 64 nt, Homo Sapiens; identical to SEQ ID NO: 133599

SEQ ID NO: 664363 - RNA, 64 nt, Homo Sapiens; identical to SEQ ID NO: 133600

SEQ ID NO: 664364 - RNA, 64 nt, Homo Sapiens; identical to SEQ ID NO: 133601

SEQ ID NO: 664365 - RNA, 64 nt, Homo Sapiens; identical to SEQ ID NO: 133602

SEQ ID NO: 664366 - RNA, 64 nt, Homo Sapiens; identical to SEQ ID NO: 133603

SEQ ID NO: 664367 - RNA, 64 nt, Homo Sapiens; identical to SEQ ID NO: 133604

SEQ ID NO: 664368 - RNA, 64 nt, Homo Sapiens; identical to SEQ ID NO: 133605

SEQ ID NO: 664369 - RNA, 64 nt, Homo Sapiens; identical to SEQ ID NO: 133606

SEQ ID NO: 664370 - RNA, 64 nt, Homo Sapiens; identical to SEQ ID NO: 133607

SEQ ID NO: 664371 - RNA, 64 nt, Homo Sapiens; identical to SEQ ID NO: 133608

SEQ ID NO: 664372 - RNA, 64 nt, Homo Sapiens; identical to SEQ ID NO: 133609

SEQ ID NO: 664373 - RNA, 64 nt, Homo Sapiens; identical to SEQ ID NO: 133610

SEQ ID NO: 664374 - RNA, 52 nt, Homo Sapiens; identical to SEQ ID NO: 133611

SEQ ID NO: 664375 - RNA, 55 nt, Homo Sapiens; identical to SEQ ID NO: 133612

SEQ ID NO: 664376 - RNA, 64 nt, Homo Sapiens; identical to SEQ ID NO: 133613

SEQ ID NO: 664377 - RNA, 64 nt, Homo Sapiens; identical to SEQ ID NO: 133614

SEQ ID NO: 664378 - RNA, 64 nt, Homo Sapiens; identical to SEQ ID NO: 133615

SEQ ID NO: 664379 - RNA, 64 nt, Homo Sapiens; identical to SEQ ID NO: 133616

SEQ ID NO: 664380 - RNA, 64 nt, Homo Sapiens; identical to SEQ ID NO: 133617

SEQ ID NO: 664381 - RNA, 64 nt, Homo Sapiens; identical to SEQ ID NO: 133618

SEQ ID NO: 664382 - RNA, 64 nt, Homo Sapiens; identical to SEQ ID NO: 133619

SEQ ID NO: 664383 - RNA, 64 nt, Homo Sapiens; identical to SEQ ID NO: 133620

SEQ ID NO: 664384 - RNA, 64 nt, Homo Sapiens; identical to SEQ ID NO: 133621

SEQ ID NO: 664385 - RNA, 64 nt, Homo Sapiens; identical to SEQ ID NO: 133622

SEQ ID NO: 664386 - RNA, 64 nt, Homo Sapiens; identical to SEQ ID NO: 133623

SEQ ID NO: 664387 - RNA, 64 nt, Homo Sapiens; identical to SEQ ID NO: 133624

SEQ ID NO: 664388 - RNA, 64 nt, Homo Sapiens; identical to SEQ ID NO: 133625

SEQ ID NO: 664389 - RNA, 64 nt, Homo Sapiens; identical to SEQ ID NO: 133626

SEQ ID NO: 664390 - RNA, 64 nt, Homo Sapiens; identical to SEQ ID NO: 133627

SEQ ID NO: 664391 - RNA, 64 nt, Homo Sapiens; identical to SEQ ID NO: 133628

SEQ ID NO: 664392 - RNA, 64 nt, Homo Sapiens; identical to SEQ ID NO: 133629

SEQ ID NO: 664393 - RNA, 64 nt, Homo Sapiens; identical to SEQ ID NO: 133630

SEQ ID NO: 664394 - RNA, 64 nt, Homo Sapiens; identical to SEQ ID NO: 133631

SEQ ID NO: 664395 - RNA, 64 nt, Homo Sapiens; identical to SEQ ID NO: 133632

SEQ ID NO: 664396 - RNA, 64 nt, Homo Sapiens; identical to SEQ ID NO: 133633

SEQ ID NO: 664397 - RNA, 64 nt, Homo Sapiens; identical to SEQ ID NO: 133634

SEQ ID NO: 664398 - RNA, 64 nt, Homo Sapiens; identical to SEQ ID NO: 133635

SEQ ID NO: 664399 - RNA, 64 nt, Homo Sapiens; identical to SEQ ID NO: 133636

SEQ ID NO: 664400 - RNA, 64 nt, Homo Sapiens; identical to SEQ ID NO: 133637

SEQ ID NO: 664401 - RNA, 64 nt, Homo Sapiens; identical to SEQ ID NO: 133638

SEQ ID NO: 664402 - RNA, 63 nt, Homo Sapiens; identical to SEQ ID NO: 133639

SEQ ID NO: 664403 - RNA, 51 nt, Homo Sapiens; identical to SEQ ID NO: 133640

SEQ ID NO: 664404 - RNA, 64 nt, Homo Sapiens; identical to SEQ ID NO: 133641

SEQ ID NO: 664405 - RNA, 64 nt, Homo Sapiens; identical to SEQ ID NO: 133642

SEQ ID NO: 664406 - RNA, 64 nt, Homo Sapiens; identical to SEQ ID NO: 133643

SEQ ID NO: 664407 - RNA, 64 nt, Homo Sapiens; identical to SEQ ID NO: 133644

SEQ ID NO: 664408 - RNA, 64 nt, Homo Sapiens; identical to SEQ ID NO: 133645

SEQ ID NO: 664409 - RNA, 64 nt, Homo Sapiens; identical to SEQ ID NO: 133646

SEQ ID NO: 664410 - RNA, 64 nt, Homo Sapiens; identical to SEQ ID NO: 133647

SEQ ID NO: 664411 - RNA, 64 nt, Homo Sapiens; identical to SEQ ID NO: 133648

SEQ ID NO: 664412 - RNA, 64 nt, Homo Sapiens; identical to SEQ ID NO: 133649

SEQ ID NO: 664413 - RNA, 64 nt, Homo Sapiens; identical to SEQ ID NO: 133650

SEQ ID NO: 664414 - RNA, 64 nt, Homo Sapiens; identical to SEQ ID NO: 133651

SEQ ID NO: 664415 - RNA, 64 nt, Homo Sapiens; identical to SEQ ID NO: 133652

SEQ ID NO: 664416 - RNA, 64 nt, Homo Sapiens; identical to SEQ ID NO: 133653

SEQ ID NO: 664417 - RNA, 64 nt, Homo Sapiens; identical to SEQ ID NO: 133654

SEQ ID NO: 664418 - RNA, 64 nt, Homo Sapiens; identical to SEQ ID NO: 133655

SEQ ID NO: 664419 - RNA, 64 nt, Homo Sapiens; identical to SEQ ID NO: 133656

SEQ ID NO: 664420 - RNA, 64 nt, Homo Sapiens; identical to SEQ ID NO: 133657

SEQ ID NO: 664421 - RNA, 64 nt, Homo Sapiens; identical to SEQ ID NO: 133658

SEQ ID NO: 664422 - RNA, 64 nt, Homo Sapiens; identical to SEQ ID NO: 133659

SEQ ID NO: 664423 - RNA, 64 nt, Homo Sapiens; identical to SEQ ID NO: 133660

SEQ ID NO: 664424 - RNA, 64 nt, Homo Sapiens; identical to SEQ ID NO: 133661

SEQ ID NO: 664425 - RNA, 64 nt, Homo Sapiens; identical to SEQ ID NO: 133662

SEQ ID NO: 664426 - RNA, 64 nt, Homo Sapiens; identical to SEQ ID NO: 133663

SEQ ID NO: 664427 - RNA, 64 nt, Homo Sapiens; identical to SEQ ID NO: 133664

SEQ ID NO: 664428 - RNA, 64 nt, Homo Sapiens; identical to SEQ ID NO: 133665

SEQ ID NO: 664429 - RNA, 64 nt, Homo Sapiens; identical to SEQ ID NO: 133666

SEQ ID NO: 664430 - RNA, 64 nt, Homo Sapiens; identical to SEQ ID NO: 133667

SEQ ID NO: 664431 - RNA, 64 nt, Homo Sapiens; identical to SEQ ID NO: 133668

SEQ ID NO: 664432 - RNA, 64 nt, Homo Sapiens; identical to SEQ ID NO: 133669

SEQ ID NO: 664433 - RNA, 64 nt, Homo Sapiens; identical to SEQ ID NO: 133670

SEQ ID NO: 664434 - RNA, 64 nt, Homo Sapiens; identical to SEQ ID NO: 133671

SEQ ID NO: 664435 - RNA, 64 nt, Homo Sapiens; identical to SEQ ID NO: 133672

SEQ ID NO: 664436 - RNA, 64 nt, Homo Sapiens; identical to SEQ ID NO: 133673

SEQ ID NO: 664437 - RNA, 64 nt, Homo Sapiens; identical to SEQ ID NO: 133674

SEQ ID NO: 664438 - RNA, 64 nt, Homo Sapiens; identical to SEQ ID NO: 133675

SEQ ID NO: 664439 - RNA, 64 nt, Homo Sapiens; identical to SEQ ID NO: 133676

SEQ ID NO: 664440 - RNA, 50 nt, Homo Sapiens; identical to SEQ ID NO: 133677

SEQ ID NO: 664441 - RNA, 64 nt, Homo Sapiens; identical to SEQ ID NO: 133678

SEQ ID NO: 664442 - RNA, 64 nt, Homo Sapiens; identical to SEQ ID NO: 133679

SEQ ID NO: 664443 - RNA, 64 nt, Homo Sapiens; identical to SEQ ID NO: 133680

SEQ ID NO: 664444 - RNA, 64 nt, Homo Sapiens; identical to SEQ ID NO: 133681

SEQ ID NO: 664445 - RNA, 64 nt, Homo Sapiens; identical to SEQ ID NO: 133682

SEQ ID NO: 664446 - RNA, 64 nt, Homo Sapiens; identical to SEQ ID NO: 133683

SEQ ID NO: 664447 - RNA, 64 nt, Homo Sapiens; identical to SEQ ID NO: 133684

SEQ ID NO: 664448 - RNA, 64 nt, Homo Sapiens; identical to SEQ ID NO: 133685

SEQ ID NO: 664449 - RNA, 64 nt, Homo Sapiens; identical to SEQ ID NO: 133686

SEQ ID NO: 664450 - RNA, 64 nt, Homo Sapiens; identical to SEQ ID NO: 133687

SEQ ID NO: 664451 - RNA, 64 nt, Homo Sapiens; identical to SEQ ID NO: 133688

SEQ ID NO: 664452 - RNA, 64 nt, Homo Sapiens; identical to SEQ ID NO: 133689

SEQ ID NO: 664453 - RNA, 64 nt, Homo Sapiens; identical to SEQ ID NO: 133690

SEQ ID NO: 664454 - RNA, 64 nt, Homo Sapiens; identical to SEQ ID NO: 133691

SEQ ID NO: 664455 - RNA, 64 nt, Homo Sapiens; identical to SEQ ID NO: 133692

SEQ ID NO: 664456 - RNA, 64 nt, Homo Sapiens; identical to SEQ ID NO: 133693

SEQ ID NO: 664457 - RNA, 64 nt, Homo Sapiens; identical to SEQ ID NO: 133694

SEQ ID NO: 664458 - RNA, 64 nt, Homo Sapiens; identical to SEQ ID NO: 133695

SEQ ID NO: 664459 - RNA, 64 nt, Homo Sapiens; identical to SEQ ID NO: 133696

SEQ ID NO: 664460 - RNA, 64 nt, Homo Sapiens; identical to SEQ ID NO: 133697

SEQ ID NO: 664461 - RNA, 64 nt, Homo Sapiens; identical to SEQ ID NO: 133698

SEQ ID NO: 664462 - RNA, 64 nt, Homo Sapiens; identical to SEQ ID NO: 133699

SEQ ID NO: 664463 - RNA, 64 nt, Homo Sapiens; identical to SEQ ID NO: 133700

SEQ ID NO: 664464 - RNA, 64 nt, Homo Sapiens; identical to SEQ ID NO: 133701

SEQ ID NO: 664465 - RNA, 64 nt, Homo Sapiens; identical to SEQ ID NO: 133702

SEQ ID NO: 664466 - RNA, 64 nt, Homo Sapiens; identical to SEQ ID NO: 133703

SEQ ID NO: 664467 - RNA, 64 nt, Homo Sapiens; identical to SEQ ID NO: 133704

SEQ ID NO: 664468 - RNA, 64 nt, Homo Sapiens; identical to SEQ ID NO: 133705

SEQ ID NO: 664469 - RNA, 64 nt, Homo Sapiens; identical to SEQ ID NO: 133706

SEQ ID NO: 664470 - RNA, 64 nt, Homo Sapiens; identical to SEQ ID NO: 133707

SEQ ID NO: 664471 - RNA, 64 nt, Homo Sapiens; identical to SEQ ID NO: 133708

SEQ ID NO: 664472 - RNA, 64 nt, Homo Sapiens; identical to SEQ ID NO: 133709

SEQ ID NO: 664473 - RNA, 64 nt, Homo Sapiens; identical to SEQ ID NO: 133710

SEQ ID NO: 664474 - RNA, 64 nt, Homo Sapiens; identical to SEQ ID NO: 133711

SEQ ID NO: 664475 - RNA, 64 nt, Homo Sapiens; identical to SEQ ID NO: 133712

SEQ ID NO: 664476 - RNA, 64 nt, Homo Sapiens; identical to SEQ ID NO: 133713

SEQ ID NO: 664477 - RNA, 64 nt, Homo Sapiens; identical to SEQ ID NO: 133714

SEQ ID NO: 664478 - RNA, 64 nt, Homo Sapiens; identical to SEQ ID NO: 133715

SEQ ID NO: 664479 - RNA, 64 nt, Homo Sapiens; identical to SEQ ID NO: 133716

SEQ ID NO: 664480 - RNA, 64 nt, Homo Sapiens; identical to SEQ ID NO: 133717

SEQ ID NO: 664481 - RNA, 64 nt, Homo Sapiens; identical to SEQ ID NO: 133718

SEQ ID NO: 664482 - RNA, 64 nt, Homo Sapiens; identical to SEQ ID NO: 133719

SEQ ID NO: 664483 - RNA, 64 nt, Homo Sapiens; identical to SEQ ID NO: 133720

SEQ ID NO: 664484 - RNA, 64 nt, Homo Sapiens; identical to SEQ ID NO: 133721

SEQ ID NO: 664485 - RNA, 64 nt, Homo Sapiens; identical to SEQ ID NO: 133722

SEQ ID NO: 664486 - RNA, 64 nt, Homo Sapiens; identical to SEQ ID NO: 133723

SEQ ID NO: 664487 - RNA, 64 nt, Homo Sapiens; identical to SEQ ID NO: 133724

SEQ ID NO: 664488 - RNA, 64 nt, Homo Sapiens; identical to SEQ ID NO: 133725

SEQ ID NO: 664489 - RNA, 64 nt, Homo Sapiens; identical to SEQ ID NO: 133726

SEQ ID NO: 664490 - RNA, 64 nt, Homo Sapiens; identical to SEQ ID NO: 133727

SEQ ID NO: 664491 - RNA, 64 nt, Homo Sapiens; identical to SEQ ID NO: 133728

SEQ ID NO: 664492 - RNA, 64 nt, Homo Sapiens; identical to SEQ ID NO: 133729

SEQ ID NO: 664493 - RNA, 64 nt, Homo Sapiens; identical to SEQ ID NO: 133730

SEQ ID NO: 664494 - RNA, 64 nt, Homo Sapiens; identical to SEQ ID NO: 133731

SEQ ID NO: 664495 - RNA, 64 nt, Homo Sapiens; identical to SEQ ID NO: 133732

SEQ ID NO: 664496 - RNA, 64 nt, Homo Sapiens; identical to SEQ ID NO: 133733

SEQ ID NO: 664497 - RNA, 64 nt, Homo Sapiens; identical to SEQ ID NO: 133734

SEQ ID NO: 664498 - RNA, 64 nt, Homo Sapiens; identical to SEQ ID NO: 133735

SEQ ID NO: 664499 - RNA, 64 nt, Homo Sapiens; identical to SEQ ID NO: 133736

SEQ ID NO: 664500 - RNA, 64 nt, Homo Sapiens; identical to SEQ ID NO: 133737

SEQ ID NO: 664501 - RNA, 64 nt, Homo Sapiens; identical to SEQ ID NO: 133738

SEQ ID NO: 664502 - RNA, 64 nt, Homo Sapiens; identical to SEQ ID NO: 133739

SEQ ID NO: 664503 - RNA, 64 nt, Homo Sapiens; identical to SEQ ID NO: 133740

SEQ ID NO: 664504 - RNA, 64 nt, Homo Sapiens; identical to SEQ ID NO: 133741

SEQ ID NO: 664505 - RNA, 64 nt, Homo Sapiens; identical to SEQ ID NO: 133742

SEQ ID NO: 664506 - RNA, 64 nt, Homo Sapiens; identical to SEQ ID NO: 133743

SEQ ID NO: 664507 - RNA, 64 nt, Homo Sapiens; identical to SEQ ID NO: 133744

SEQ ID NO: 664508 - RNA, 64 nt, Homo Sapiens; identical to SEQ ID NO: 133745

SEQ ID NO: 664509 - RNA, 64 nt, Homo Sapiens; identical to SEQ ID NO: 133746

SEQ ID NO: 664510 - RNA, 64 nt, Homo Sapiens; identical to SEQ ID NO: 133747

SEQ ID NO: 664511 - RNA, 64 nt, Homo Sapiens; identical to SEQ ID NO: 133748

SEQ ID NO: 664512 - RNA, 64 nt, Homo Sapiens; identical to SEQ ID NO: 133749

SEQ ID NO: 664513 - RNA, 64 nt, Homo Sapiens; identical to SEQ ID NO: 133750

SEQ ID NO: 664514 - RNA, 64 nt, Homo Sapiens; identical to SEQ ID NO: 133751

SEQ ID NO: 664515 - RNA, 64 nt, Homo Sapiens; identical to SEQ ID NO: 133752

SEQ ID NO: 664516 - RNA, 64 nt, Homo Sapiens; identical to SEQ ID NO: 133753

SEQ ID NO: 664517 - RNA, 64 nt, Homo Sapiens; identical to SEQ ID NO: 133754

SEQ ID NO: 664518 - RNA, 64 nt, Homo Sapiens; identical to SEQ ID NO: 133755

SEQ ID NO: 664519 - RNA, 64 nt, Homo Sapiens; identical to SEQ ID NO: 133756

SEQ ID NO: 664520 - RNA, 64 nt, Homo Sapiens; identical to SEQ ID NO: 133757

SEQ ID NO: 664521 - RNA, 64 nt, Homo Sapiens; identical to SEQ ID NO: 133758

SEQ ID NO: 664522 - RNA, 64 nt, Homo Sapiens; identical to SEQ ID NO: 133759

SEQ ID NO: 664523 - RNA, 64 nt, Homo Sapiens; identical to SEQ ID NO: 133760

SEQ ID NO: 664524 - RNA, 64 nt, Homo Sapiens; identical to SEQ ID NO: 133761

SEQ ID NO: 664525 - RNA, 64 nt, Homo Sapiens; identical to SEQ ID NO: 133762

SEQ ID NO: 664526 - RNA, 64 nt, Homo Sapiens; identical to SEQ ID NO: 133763

SEQ ID NO: 664527 - RNA, 64 nt, Homo Sapiens; identical to SEQ ID NO: 133764

SEQ ID NO: 664528 - RNA, 64 nt, Homo Sapiens; identical to SEQ ID NO: 133765

SEQ ID NO: 664529 - RNA, 60 nt, Homo Sapiens; identical to SEQ ID NO: 133766

SEQ ID NO: 664530 - RNA, 57 nt, Homo Sapiens; identical to SEQ ID NO: 133767

SEQ ID NO: 664531 - RNA, 64 nt, Homo Sapiens; identical to SEQ ID NO: 133768

SEQ ID NO: 664532 - RNA, 64 nt, Homo Sapiens; identical to SEQ ID NO: 133769

SEQ ID NO: 664533 - RNA, 64 nt, Homo Sapiens; identical to SEQ ID NO: 133770

SEQ ID NO: 664534 - RNA, 64 nt, Homo Sapiens; identical to SEQ ID NO: 133771

SEQ ID NO: 664535 - RNA, 64 nt, Homo Sapiens; identical to SEQ ID NO: 133772

SEQ ID NO: 664536 - RNA, 64 nt, Homo Sapiens; identical to SEQ ID NO: 133773

SEQ ID NO: 664537 - RNA, 64 nt, Homo Sapiens; identical to SEQ ID NO: 133774

SEQ ID NO: 664538 - RNA, 64 nt, Homo Sapiens; identical to SEQ ID NO: 133775

SEQ ID NO: 664539 - RNA, 64 nt, Homo Sapiens; identical to SEQ ID NO: 133776

SEQ ID NO: 664540 - RNA, 64 nt, Homo Sapiens; identical to SEQ ID NO: 133777

SEQ ID NO: 664541 - RNA, 64 nt, Homo Sapiens; identical to SEQ ID NO: 133778

SEQ ID NO: 664542 - RNA, 64 nt, Homo Sapiens; identical to SEQ ID NO: 133779

SEQ ID NO: 664543 - RNA, 64 nt, Homo Sapiens; identical to SEQ ID NO: 133780

SEQ ID NO: 664544 - RNA, 64 nt, Homo Sapiens; identical to SEQ ID NO: 133781

SEQ ID NO: 664545 - RNA, 64 nt, Homo Sapiens; identical to SEQ ID NO: 133782

SEQ ID NO: 664546 - RNA, 64 nt, Homo Sapiens; identical to SEQ ID NO: 133783

SEQ ID NO: 664547 - RNA, 64 nt, Homo Sapiens; identical to SEQ ID NO: 133784

SEQ ID NO: 664548 - RNA, 64 nt, Homo Sapiens; identical to SEQ ID NO: 133785

SEQ ID NO: 664549 - RNA, 64 nt, Homo Sapiens; identical to SEQ ID NO: 133786

SEQ ID NO: 664550 - RNA, 64 nt, Homo Sapiens; identical to SEQ ID NO: 133787

SEQ ID NO: 664551 - RNA, 64 nt, Homo Sapiens; identical to SEQ ID NO: 133788

SEQ ID NO: 664552 - RNA, 64 nt, Homo Sapiens; identical to SEQ ID NO: 133789

SEQ ID NO: 664553 - RNA, 64 nt, Homo Sapiens; identical to SEQ ID NO: 133790

SEQ ID NO: 664554 - RNA, 64 nt, Homo Sapiens; identical to SEQ ID NO: 133791

SEQ ID NO: 664555 - RNA, 64 nt, Homo Sapiens; identical to SEQ ID NO: 133792

SEQ ID NO: 664556 - RNA, 64 nt, Homo Sapiens; identical to SEQ ID NO: 133793

SEQ ID NO: 664557 - RNA, 64 nt, Homo Sapiens; identical to SEQ ID NO: 133794

SEQ ID NO: 664558 - RNA, 64 nt, Homo Sapiens; identical to SEQ ID NO: 133795

SEQ ID NO: 664559 - RNA, 64 nt, Homo Sapiens; identical to SEQ ID NO: 133796

SEQ ID NO: 664560 - RNA, 64 nt, Homo Sapiens; identical to SEQ ID NO: 133797

SEQ ID NO: 664561 - RNA, 64 nt, Homo Sapiens; identical to SEQ ID NO: 133798

SEQ ID NO: 664562 - RNA, 64 nt, Homo Sapiens; identical to SEQ ID NO: 133799

SEQ ID NO: 664563 - RNA, 64 nt, Homo Sapiens; identical to SEQ ID NO: 133800

SEQ ID NO: 664564 - RNA, 64 nt, Homo Sapiens; identical to SEQ ID NO: 133801

SEQ ID NO: 664565 - RNA, 64 nt, Homo Sapiens; identical to SEQ ID NO: 133802

SEQ ID NO: 664566 - RNA, 64 nt, Homo Sapiens; identical to SEQ ID NO: 133803

SEQ ID NO: 664567 - RNA, 64 nt, Homo Sapiens; identical to SEQ ID NO: 133804

SEQ ID NO: 664568 - RNA, 64 nt, Homo Sapiens; identical to SEQ ID NO: 133805

SEQ ID NO: 664569 - RNA, 64 nt, Homo Sapiens; identical to SEQ ID NO: 133806

SEQ ID NO: 664570 - RNA, 64 nt, Homo Sapiens; identical to SEQ ID NO: 133807

SEQ ID NO: 664571 - RNA, 64 nt, Homo Sapiens; identical to SEQ ID NO: 133808

SEQ ID NO: 664572 - RNA, 64 nt, Homo Sapiens; identical to SEQ ID NO: 133809

SEQ ID NO: 664573 - RNA, 64 nt, Homo Sapiens; identical to SEQ ID NO: 133810

SEQ ID NO: 664574 - RNA, 64 nt, Homo Sapiens; identical to SEQ ID NO: 133811

SEQ ID NO: 664575 - RNA, 64 nt, Homo Sapiens; identical to SEQ ID NO: 133812

SEQ ID NO: 664576 - RNA, 64 nt, Homo Sapiens; identical to SEQ ID NO: 133813

SEQ ID NO: 664577 - RNA, 64 nt, Homo Sapiens; identical to SEQ ID NO: 133814

SEQ ID NO: 664578 - RNA, 64 nt, Homo Sapiens; identical to SEQ ID NO: 133815

SEQ ID NO: 664579 - RNA, 64 nt, Homo Sapiens; identical to SEQ ID NO: 133816

SEQ ID NO: 664580 - RNA, 64 nt, Homo Sapiens; identical to SEQ ID NO: 133817

SEQ ID NO: 664581 - RNA, 64 nt, Homo Sapiens; identical to SEQ ID NO: 133818

SEQ ID NO: 664582 - RNA, 64 nt, Homo Sapiens; identical to SEQ ID NO: 133819

SEQ ID NO: 664583 - RNA, 64 nt, Homo Sapiens; identical to SEQ ID NO: 133820

SEQ ID NO: 664584 - RNA, 64 nt, Homo Sapiens; identical to SEQ ID NO: 133821

SEQ ID NO: 664585 - RNA, 64 nt, Homo Sapiens; identical to SEQ ID NO: 133822

SEQ ID NO: 664586 - RNA, 64 nt, Homo Sapiens; identical to SEQ ID NO: 133823

SEQ ID NO: 664587 - RNA, 64 nt, Homo Sapiens; identical to SEQ ID NO: 133824

SEQ ID NO: 664588 - RNA, 64 nt, Homo Sapiens; identical to SEQ ID NO: 133825

SEQ ID NO: 664589 - RNA, 64 nt, Homo Sapiens; identical to SEQ ID NO: 133826

SEQ ID NO: 664590 - RNA, 64 nt, Homo Sapiens; identical to SEQ ID NO: 133827

SEQ ID NO: 664591 - RNA, 64 nt, Homo Sapiens; identical to SEQ ID NO: 133828

SEQ ID NO: 664592 - RNA, 64 nt, Homo Sapiens; identical to SEQ ID NO: 133829

SEQ ID NO: 664593 - RNA, 64 nt, Homo Sapiens; identical to SEQ ID NO: 628410

SEQ ID NO: 664594 - RNA, 64 nt, Homo Sapiens; identical to SEQ ID NO: 628411

SEQ ID NO: 664595 - RNA, 64 nt, Homo Sapiens; identical to SEQ ID NO: 628412

SEQ ID NO: 664596 - RNA, 64 nt, Homo Sapiens; identical to SEQ ID NO: 628413

SEQ ID NO: 664597 - RNA, 56 nt, Homo Sapiens; identical to SEQ ID NO: 628414

SEQ ID NO: 664598 - RNA, 64 nt, Homo Sapiens; identical to SEQ ID NO: 628415

SEQ ID NO: 664599 - RNA, 64 nt, Homo Sapiens; identical to SEQ ID NO: 628416

SEQ ID NO: 664600 - RNA, 64 nt, Homo Sapiens; identical to SEQ ID NO: 628417

SEQ ID NO: 664601 - RNA, 64 nt, Homo Sapiens; identical to SEQ ID NO: 628418

SEQ ID NO: 664602 - RNA, 64 nt, Homo Sapiens; identical to SEQ ID NO: 628419

SEQ ID NO: 664603 - RNA, 64 nt, Homo Sapiens; identical to SEQ ID NO: 227843

SEQ ID NO: 664604 - RNA, 64 nt, Homo Sapiens; identical to SEQ ID NO: 227844

SEQ ID NO: 664605 - RNA, 64 nt, Homo Sapiens; identical to SEQ ID NO: 227845

SEQ ID NO: 664606 - RNA, 64 nt, Homo Sapiens; identical to SEQ ID NO: 227846

SEQ ID NO: 664607 - RNA, 64 nt, Homo Sapiens; identical to SEQ ID NO: 227847

SEQ ID NO: 664608 - RNA, 64 nt, Homo Sapiens; identical to SEQ ID NO: 227848

SEQ ID NO: 664609 - RNA, 64 nt, Homo Sapiens; identical to SEQ ID NO: 227849

SEQ ID NO: 664610 - RNA, 64 nt, Homo Sapiens; identical to SEQ ID NO: 227850

SEQ ID NO: 664611 - RNA, 64 nt, Homo Sapiens; identical to SEQ ID NO: 227851

SEQ ID NO: 664612 - RNA, 64 nt, Homo Sapiens; identical to SEQ ID NO: 227852

SEQ ID NO: 664613 - RNA, 64 nt, Homo Sapiens; identical to SEQ ID NO: 227853

SEQ ID NO: 664614 - RNA, 64 nt, Homo Sapiens; identical to SEQ ID NO: 227854

SEQ ID NO: 664615 - RNA, 64 nt, Homo Sapiens; identical to SEQ ID NO: 227855

SEQ ID NO: 664616 - RNA, 64 nt, Homo Sapiens; identical to SEQ ID NO: 227856

SEQ ID NO: 664617 - RNA, 64 nt, Homo Sapiens; identical to SEQ ID NO: 478274

SEQ ID NO: 664618 - RNA, 64 nt, Homo Sapiens; identical to SEQ ID NO: 478275

SEQ ID NO: 664619 - RNA, 64 nt, Homo Sapiens; identical to SEQ ID NO: 478276

SEQ ID NO: 664620 - RNA, 64 nt, Homo Sapiens; identical to SEQ ID NO: 478277

SEQ ID NO: 664621 - RNA, 64 nt, Homo Sapiens; identical to SEQ ID NO: 478278

SEQ ID NO: 664622 - RNA, 64 nt, Homo Sapiens; identical to SEQ ID NO: 478279

SEQ ID NO: 664623 - RNA, 64 nt, Homo Sapiens; identical to SEQ ID NO: 478280

SEQ ID NO: 664624 - RNA, 64 nt, Homo Sapiens; identical to SEQ ID NO: 478281

SEQ ID NO: 664625 - RNA, 64 nt, Homo Sapiens; identical to SEQ ID NO: 478282

SEQ ID NO: 664626 - RNA, 64 nt, Homo Sapiens; identical to SEQ ID NO: 478283

SEQ ID NO: 664627 - RNA, 64 nt, Homo Sapiens; identical to SEQ ID NO: 478284

SEQ ID NO: 664628 - RNA, 64 nt, Homo Sapiens; identical to SEQ ID NO: 478285

SEQ ID NO: 664629 - RNA, 64 nt, Homo Sapiens; identical to SEQ ID NO: 478286

SEQ ID NO: 664630 - RNA, 64 nt, Homo Sapiens; identical to SEQ ID NO: 478287

SEQ ID NO: 664631 - RNA, 64 nt, Homo Sapiens; identical to SEQ ID NO: 478288

SEQ ID NO: 664632 - RNA, 64 nt, Homo Sapiens; identical to SEQ ID NO: 478289

SEQ ID NO: 664633 - RNA, 64 nt, Homo Sapiens; identical to SEQ ID NO: 478290

SEQ ID NO: 664634 - RNA, 64 nt, Homo Sapiens; identical to SEQ ID NO: 478291

SEQ ID NO: 664635 - RNA, 64 nt, Homo Sapiens; identical to SEQ ID NO: 478292

SEQ ID NO: 664636 - RNA, 64 nt, Homo Sapiens; identical to SEQ ID NO: 478293

SEQ ID NO: 664637 - RNA, 64 nt, Homo Sapiens; identical to SEQ ID NO: 478294

SEQ ID NO: 664638 - RNA, 64 nt, Homo Sapiens; identical to SEQ ID NO: 478295

SEQ ID NO: 664639 - RNA, 64 nt, Homo Sapiens; identical to SEQ ID NO: 478296

SEQ ID NO: 664640 - RNA, 64 nt, Homo Sapiens; identical to SEQ ID NO: 478297

SEQ ID NO: 664641 - RNA, 64 nt, Homo Sapiens; identical to SEQ ID NO: 380102

SEQ ID NO: 664642 - RNA, 64 nt, Homo Sapiens; identical to SEQ ID NO: 380103

SEQ ID NO: 664643 - RNA, 64 nt, Homo Sapiens; identical to SEQ ID NO: 380104

SEQ ID NO: 664644 - RNA, 64 nt, Homo Sapiens; identical to SEQ ID NO: 380105

SEQ ID NO: 664645 - RNA, 64 nt, Homo Sapiens; identical to SEQ ID NO: 380106

SEQ ID NO: 664646 - RNA, 64 nt, Homo Sapiens; identical to SEQ ID NO: 380107

SEQ ID NO: 664647 - RNA, 64 nt, Homo Sapiens; identical to SEQ ID NO: 380108

SEQ ID NO: 664648 - RNA, 64 nt, Homo Sapiens; identical to SEQ ID NO: 380109

SEQ ID NO: 664649 - RNA, 64 nt, Homo Sapiens; identical to SEQ ID NO: 380110

SEQ ID NO: 664650 - RNA, 64 nt, Homo Sapiens; identical to SEQ ID NO: 380111

SEQ ID NO: 664651 - RNA, 64 nt, Homo Sapiens; identical to SEQ ID NO: 380112

SEQ ID NO: 664652 - RNA, 64 nt, Homo Sapiens; identical to SEQ ID NO: 380113

SEQ ID NO: 664653 - RNA, 64 nt, Homo Sapiens; identical to SEQ ID NO: 380114

SEQ ID NO: 664654 - RNA, 64 nt, Homo Sapiens; identical to SEQ ID NO: 380115

SEQ ID NO: 664655 - RNA, 58 nt, Homo Sapiens; identical to SEQ ID NO: 380116

SEQ ID NO: 664656 - RNA, 64 nt, Homo Sapiens; identical to SEQ ID NO: 380117

SEQ ID NO: 664657 - RNA, 64 nt, Homo Sapiens; identical to SEQ ID NO: 380118

SEQ ID NO: 664658 - RNA, 64 nt, Homo Sapiens; identical to SEQ ID NO: 380119

SEQ ID NO: 664659 - RNA, 64 nt, Homo Sapiens; identical to SEQ ID NO: 380120

SEQ ID NO: 664660 - RNA, 64 nt, Homo Sapiens; identical to SEQ ID NO: 380121

SEQ ID NO: 664661 - RNA, 64 nt, Homo Sapiens; identical to SEQ ID NO: 380122

SEQ ID NO: 664662 - RNA, 64 nt, Homo Sapiens; identical to SEQ ID NO: 380123

SEQ ID NO: 664663 - RNA, 64 nt, Homo Sapiens; identical to SEQ ID NO: 380124

SEQ ID NO: 664664 - RNA, 64 nt, Homo Sapiens; identical to SEQ ID NO: 380125

SEQ ID NO: 664665 - RNA, 64 nt, Homo Sapiens; identical to SEQ ID NO: 380126

SEQ ID NO: 664666 - RNA, 64 nt, Homo Sapiens; identical to SEQ ID NO: 380127

SEQ ID NO: 664667 - RNA, 64 nt, Homo Sapiens; identical to SEQ ID NO: 380128

SEQ ID NO: 664668 - RNA, 64 nt, Homo Sapiens; identical to SEQ ID NO: 380129

SEQ ID NO: 664669 - RNA, 64 nt, Homo Sapiens; identical to SEQ ID NO: 380130

SEQ ID NO: 664670 - RNA, 64 nt, Homo Sapiens; identical to SEQ ID NO: 380131

SEQ ID NO: 664671 - RNA, 64 nt, Homo Sapiens; identical to SEQ ID NO: 380132

SEQ ID NO: 664672 - RNA, 64 nt, Homo Sapiens; identical to SEQ ID NO: 380133

SEQ ID NO: 664673 - RNA, 64 nt, Homo Sapiens; identical to SEQ ID NO: 380134

SEQ ID NO: 664674 - RNA, 64 nt, Homo Sapiens; identical to SEQ ID NO: 380135

SEQ ID NO: 664675 - RNA, 64 nt, Homo Sapiens; identical to SEQ ID NO: 380136

SEQ ID NO: 664676 - RNA, 64 nt, Homo Sapiens; identical to SEQ ID NO: 380137

SEQ ID NO: 664677 - RNA, 64 nt, Homo Sapiens; identical to SEQ ID NO: 380138

SEQ ID NO: 664678 - RNA, 64 nt, Homo Sapiens; identical to SEQ ID NO: 380139

SEQ ID NO: 664679 - RNA, 64 nt, Homo Sapiens; identical to SEQ ID NO: 380140

SEQ ID NO: 664680 - RNA, 64 nt, Homo Sapiens; identical to SEQ ID NO: 380141

SEQ ID NO: 664681 - RNA, 64 nt, Homo Sapiens; identical to SEQ ID NO: 380142

SEQ ID NO: 664682 - RNA, 64 nt, Homo Sapiens; identical to SEQ ID NO: 380143

SEQ ID NO: 664683 - RNA, 64 nt, Homo Sapiens; identical to SEQ ID NO: 380144

SEQ ID NO: 664684 - RNA, 64 nt, Homo Sapiens; identical to SEQ ID NO: 380145

SEQ ID NO: 664685 - RNA, 64 nt, Homo Sapiens; identical to SEQ ID NO: 380146

SEQ ID NO: 664686 - RNA, 64 nt, Homo Sapiens; identical to SEQ ID NO: 380147

SEQ ID NO: 664687 - RNA, 59 nt, Homo Sapiens; identical to SEQ ID NO: 380148

SEQ ID NO: 664688 - RNA, 64 nt, Homo Sapiens; identical to SEQ ID NO: 380149

SEQ ID NO: 664689 - RNA, 64 nt, Homo Sapiens; identical to SEQ ID NO: 380150

SEQ ID NO: 664690 - RNA, 64 nt, Homo Sapiens; identical to SEQ ID NO: 380151

SEQ ID NO: 664691 - RNA, 64 nt, Homo Sapiens; identical to SEQ ID NO: 380152

SEQ ID NO: 664692 - RNA, 64 nt, Homo Sapiens; identical to SEQ ID NO: 380153

SEQ ID NO: 664693 - RNA, 64 nt, Homo Sapiens; identical to SEQ ID NO: 380154

SEQ ID NO: 664694 - RNA, 64 nt, Homo Sapiens; identical to SEQ ID NO: 380155

SEQ ID NO: 664695 - RNA, 64 nt, Homo Sapiens; identical to SEQ ID NO: 380156

SEQ ID NO: 664696 - RNA, 64 nt, Homo Sapiens; identical to SEQ ID NO: 380157

SEQ ID NO: 664697 - RNA, 64 nt, Homo Sapiens; identical to SEQ ID NO: 380158

SEQ ID NO: 664698 - RNA, 64 nt, Homo Sapiens; identical to SEQ ID NO: 380159

SEQ ID NO: 664699 - RNA, 64 nt, Homo Sapiens; identical to SEQ ID NO: 380160

SEQ ID NO: 664700 - RNA, 64 nt, Homo Sapiens; identical to SEQ ID NO: 380161

SEQ ID NO: 664701 - RNA, 54 nt, Homo Sapiens; identical to SEQ ID NO: 380162

SEQ ID NO: 664702 - RNA, 64 nt, Homo Sapiens; identical to SEQ ID NO: 380163

SEQ ID NO: 664703 - RNA, 64 nt, Homo Sapiens; identical to SEQ ID NO: 380164

SEQ ID NO: 664704 - RNA, 64 nt, Homo Sapiens; identical to SEQ ID NO: 380165

SEQ ID NO: 664705 - RNA, 64 nt, Homo Sapiens; identical to SEQ ID NO: 380166

SEQ ID NO: 664706 - RNA, 64 nt, Homo Sapiens; identical to SEQ ID NO: 380167

SEQ ID NO: 664707 - RNA, 64 nt, Homo Sapiens; identical to SEQ ID NO: 380168

SEQ ID NO: 664708 - RNA, 64 nt, Homo Sapiens; identical to SEQ ID NO: 380169

SEQ ID NO: 664709 - RNA, 64 nt, Homo Sapiens; identical to SEQ ID NO: 380170

SEQ ID NO: 664710 - RNA, 64 nt, Homo Sapiens; identical to SEQ ID NO: 380171

SEQ ID NO: 664711 - RNA, 64 nt, Homo Sapiens; identical to SEQ ID NO: 380172

SEQ ID NO: 664712 - RNA, 64 nt, Homo Sapiens; identical to SEQ ID NO: 380173

SEQ ID NO: 664713 - RNA, 64 nt, Homo Sapiens; identical to SEQ ID NO: 380174

SEQ ID NO: 664714 - RNA, 64 nt, Homo Sapiens; identical to SEQ ID NO: 380175

SEQ ID NO: 664715 - RNA, 64 nt, Homo Sapiens; identical to SEQ ID NO: 380176

SEQ ID NO: 664716 - RNA, 64 nt, Homo Sapiens; identical to SEQ ID NO: 380177

SEQ ID NO: 664717 - RNA, 64 nt, Homo Sapiens; identical to SEQ ID NO: 380178

SEQ ID NO: 664718 - RNA, 64 nt, Homo Sapiens; identical to SEQ ID NO: 380179

SEQ ID NO: 664719 - RNA, 64 nt, Homo Sapiens; identical to SEQ ID NO: 380180

SEQ ID NO: 664720 - RNA, 64 nt, Homo Sapiens; identical to SEQ ID NO: 380181

SEQ ID NO: 664721 - RNA, 64 nt, Homo Sapiens; identical to SEQ ID NO: 380182

SEQ ID NO: 664722 - RNA, 64 nt, Homo Sapiens; identical to SEQ ID NO: 380183

SEQ ID NO: 664723 - RNA, 64 nt, Homo Sapiens; identical to SEQ ID NO: 380184

SEQ ID NO: 664724 - RNA, 64 nt, Homo Sapiens; identical to SEQ ID NO: 380185

SEQ ID NO: 664725 - RNA, 64 nt, Homo Sapiens; identical to SEQ ID NO: 380186

SEQ ID NO: 664726 - RNA, 64 nt, Homo Sapiens; identical to SEQ ID NO: 380187

SEQ ID NO: 664727 - RNA, 64 nt, Homo Sapiens; identical to SEQ ID NO: 380188

SEQ ID NO: 664728 - RNA, 64 nt, Homo Sapiens; identical to SEQ ID NO: 380189

SEQ ID NO: 664729 - RNA, 64 nt, Homo Sapiens; identical to SEQ ID NO: 380190

SEQ ID NO: 664730 - RNA, 64 nt, Homo Sapiens; identical to SEQ ID NO: 380191

SEQ ID NO: 664731 - RNA, 64 nt, Homo Sapiens; identical to SEQ ID NO: 380192

SEQ ID NO: 664732 - RNA, 64 nt, Homo Sapiens; identical to SEQ ID NO: 380193

SEQ ID NO: 664733 - RNA, 64 nt, Homo Sapiens; identical to SEQ ID NO: 380194

SEQ ID NO: 664734 - RNA, 64 nt, Homo Sapiens; identical to SEQ ID NO: 380195

SEQ ID NO: 664735 - RNA, 58 nt, Homo Sapiens; identical to SEQ ID NO: 380196

SEQ ID NO: 664736 - RNA, 64 nt, Homo Sapiens; identical to SEQ ID NO: 380197

SEQ ID NO: 664737 - RNA, 64 nt, Homo Sapiens; identical to SEQ ID NO: 380198

SEQ ID NO: 664738 - RNA, 64 nt, Homo Sapiens; identical to SEQ ID NO: 380199

SEQ ID NO: 664739 - RNA, 64 nt, Homo Sapiens; identical to SEQ ID NO: 380200

SEQ ID NO: 664740 - RNA, 64 nt, Homo Sapiens; identical to SEQ ID NO: 380201

SEQ ID NO: 664741 - RNA, 64 nt, Homo Sapiens; identical to SEQ ID NO: 380202

SEQ ID NO: 664742 - RNA, 64 nt, Homo Sapiens; identical to SEQ ID NO: 380203

SEQ ID NO: 664743 - RNA, 64 nt, Homo Sapiens; identical to SEQ ID NO: 380204

SEQ ID NO: 664744 - RNA, 64 nt, Homo Sapiens; identical to SEQ ID NO: 380205

SEQ ID NO: 664745 - RNA, 64 nt, Homo Sapiens; identical to SEQ ID NO: 380206

SEQ ID NO: 664746 - RNA, 64 nt, Homo Sapiens; identical to SEQ ID NO: 380207

SEQ ID NO: 664747 - RNA, 64 nt, Homo Sapiens; identical to SEQ ID NO: 380208

SEQ ID NO: 664748 - RNA, 64 nt, Homo Sapiens; identical to SEQ ID NO: 380209

SEQ ID NO: 664749 - RNA, 63 nt, Homo Sapiens; identical to SEQ ID NO: 380210

SEQ ID NO: 664750 - RNA, 64 nt, Homo Sapiens; identical to SEQ ID NO: 380211

SEQ ID NO: 664751 - RNA, 64 nt, Homo Sapiens; identical to SEQ ID NO: 380212

SEQ ID NO: 664752 - RNA, 64 nt, Homo Sapiens; identical to SEQ ID NO: 380213

SEQ ID NO: 664753 - RNA, 64 nt, Homo Sapiens; identical to SEQ ID NO: 380214

SEQ ID NO: 664754 - RNA, 64 nt, Homo Sapiens; identical to SEQ ID NO: 380215

SEQ ID NO: 664755 - RNA, 64 nt, Homo Sapiens; identical to SEQ ID NO: 380216

SEQ ID NO: 664756 - RNA, 64 nt, Homo Sapiens; identical to SEQ ID NO: 380217

SEQ ID NO: 664757 - RNA, 64 nt, Homo Sapiens; identical to SEQ ID NO: 380218

SEQ ID NO: 664758 - RNA, 64 nt, Homo Sapiens; identical to SEQ ID NO: 380219

SEQ ID NO: 664759 - RNA, 64 nt, Homo Sapiens; identical to SEQ ID NO: 380220

SEQ ID NO: 664760 - RNA, 64 nt, Homo Sapiens; identical to SEQ ID NO: 380221

SEQ ID NO: 664761 - RNA, 64 nt, Homo Sapiens; identical to SEQ ID NO: 380222

SEQ ID NO: 664762 - RNA, 64 nt, Homo Sapiens; identical to SEQ ID NO: 380223

SEQ ID NO: 664763 - RNA, 64 nt, Homo Sapiens; identical to SEQ ID NO: 380224

SEQ ID NO: 664764 - RNA, 64 nt, Homo Sapiens; identical to SEQ ID NO: 380225

SEQ ID NO: 664765 - RNA, 64 nt, Homo Sapiens; identical to SEQ ID NO: 380226

SEQ ID NO: 664766 - RNA, 64 nt, Homo Sapiens; identical to SEQ ID NO: 380227

SEQ ID NO: 664767 - RNA, 64 nt, Homo Sapiens; identical to SEQ ID NO: 380228

SEQ ID NO: 664768 - RNA, 64 nt, Homo Sapiens; identical to SEQ ID NO: 380229

SEQ ID NO: 664769 - RNA, 64 nt, Homo Sapiens; identical to SEQ ID NO: 380230

SEQ ID NO: 664770 - RNA, 64 nt, Homo Sapiens; identical to SEQ ID NO: 380231

SEQ ID NO: 664771 - RNA, 64 nt, Homo Sapiens; identical to SEQ ID NO: 380232

SEQ ID NO: 664772 - RNA, 64 nt, Homo Sapiens; identical to SEQ ID NO: 380233

SEQ ID NO: 664773 - RNA, 64 nt, Homo Sapiens; identical to SEQ ID NO: 380234

SEQ ID NO: 664774 - RNA, 64 nt, Homo Sapiens; identical to SEQ ID NO: 380235

SEQ ID NO: 664775 - RNA, 51 nt, Homo Sapiens; identical to SEQ ID NO: 380236

SEQ ID NO: 664776 - RNA, 64 nt, Homo Sapiens; identical to SEQ ID NO: 380237

SEQ ID NO: 664777 - RNA, 64 nt, Homo Sapiens; identical to SEQ ID NO: 380238

SEQ ID NO: 664778 - RNA, 64 nt, Homo Sapiens; identical to SEQ ID NO: 380239

SEQ ID NO: 664779 - RNA, 64 nt, Homo Sapiens; identical to SEQ ID NO: 380240

SEQ ID NO: 664780 - RNA, 64 nt, Homo Sapiens; identical to SEQ ID NO: 380241

SEQ ID NO: 664781 - RNA, 64 nt, Homo Sapiens; identical to SEQ ID NO: 380242

SEQ ID NO: 664782 - RNA, 64 nt, Homo Sapiens; identical to SEQ ID NO: 380243

SEQ ID NO: 664783 - RNA, 64 nt, Homo Sapiens; identical to SEQ ID NO: 380244

SEQ ID NO: 664784 - RNA, 64 nt, Homo Sapiens; identical to SEQ ID NO: 380245

SEQ ID NO: 664785 - RNA, 64 nt, Homo Sapiens; identical to SEQ ID NO: 380246

SEQ ID NO: 664786 - RNA, 64 nt, Homo Sapiens; identical to SEQ ID NO: 380247

SEQ ID NO: 664787 - RNA, 64 nt, Homo Sapiens; identical to SEQ ID NO: 380248

SEQ ID NO: 664788 - RNA, 64 nt, Homo Sapiens; identical to SEQ ID NO: 380249

SEQ ID NO: 664789 - RNA, 64 nt, Homo Sapiens; identical to SEQ ID NO: 380250

SEQ ID NO: 664790 - RNA, 64 nt, Homo Sapiens; identical to SEQ ID NO: 380251

SEQ ID NO: 664791 - RNA, 64 nt, Homo Sapiens; identical to SEQ ID NO: 380252

SEQ ID NO: 664792 - RNA, 64 nt, Homo Sapiens; identical to SEQ ID NO: 380253

SEQ ID NO: 664793 - RNA, 64 nt, Homo Sapiens; identical to SEQ ID NO: 380254

SEQ ID NO: 664794 - RNA, 64 nt, Homo Sapiens; identical to SEQ ID NO: 380255

SEQ ID NO: 664795 - RNA, 64 nt, Homo Sapiens; identical to SEQ ID NO: 380256

SEQ ID NO: 664796 - RNA, 64 nt, Homo Sapiens; identical to SEQ ID NO: 380257

SEQ ID NO: 664797 - RNA, 64 nt, Homo Sapiens; identical to SEQ ID NO: 380258

SEQ ID NO: 664798 - RNA, 64 nt, Homo Sapiens; identical to SEQ ID NO: 380259

SEQ ID NO: 664799 - RNA, 64 nt, Homo Sapiens; identical to SEQ ID NO: 380260

SEQ ID NO: 664800 - RNA, 64 nt, Homo Sapiens; identical to SEQ ID NO: 380261

SEQ ID NO: 664801 - RNA, 64 nt, Homo Sapiens; identical to SEQ ID NO: 380262

SEQ ID NO: 664802 - RNA, 64 nt, Homo Sapiens; identical to SEQ ID NO: 380263

SEQ ID NO: 664803 - RNA, 64 nt, Homo Sapiens; identical to SEQ ID NO: 380264

SEQ ID NO: 664804 - RNA, 64 nt, Homo Sapiens; identical to SEQ ID NO: 380265

SEQ ID NO: 664805 - RNA, 64 nt, Homo Sapiens; identical to SEQ ID NO: 380266

SEQ ID NO: 664806 - RNA, 64 nt, Homo Sapiens; identical to SEQ ID NO: 380267

SEQ ID NO: 664807 - RNA, 64 nt, Homo Sapiens; identical to SEQ ID NO: 380268

SEQ ID NO: 664808 - RNA, 64 nt, Homo Sapiens; identical to SEQ ID NO: 380269

SEQ ID NO: 664809 - RNA, 64 nt, Homo Sapiens; identical to SEQ ID NO: 380270

SEQ ID NO: 664810 - RNA, 64 nt, Homo Sapiens; identical to SEQ ID NO: 380271

SEQ ID NO: 664811 - RNA, 64 nt, Homo Sapiens; identical to SEQ ID NO: 380272

SEQ ID NO: 664812 - RNA, 64 nt, Homo Sapiens; identical to SEQ ID NO: 380273

SEQ ID NO: 664813 - RNA, 64 nt, Homo Sapiens; identical to SEQ ID NO: 380274

SEQ ID NO: 664814 - RNA, 64 nt, Homo Sapiens; identical to SEQ ID NO: 380275

SEQ ID NO: 664815 - RNA, 64 nt, Homo Sapiens; identical to SEQ ID NO: 380276

SEQ ID NO: 664816 - RNA, 64 nt, Homo Sapiens; identical to SEQ ID NO: 380277

SEQ ID NO: 664817 - RNA, 64 nt, Homo Sapiens; identical to SEQ ID NO: 380278

SEQ ID NO: 664818 - RNA, 64 nt, Homo Sapiens; identical to SEQ ID NO: 380279

SEQ ID NO: 664819 - RNA, 50 nt, Homo Sapiens; identical to SEQ ID NO: 380280

SEQ ID NO: 664820 - RNA, 64 nt, Homo Sapiens; identical to SEQ ID NO: 380281

SEQ ID NO: 664821 - RNA, 63 nt, Homo Sapiens; identical to SEQ ID NO: 380282

SEQ ID NO: 664822 - RNA, 64 nt, Homo Sapiens; identical to SEQ ID NO: 380283

SEQ ID NO: 664823 - RNA, 64 nt, Homo Sapiens; identical to SEQ ID NO: 380284

SEQ ID NO: 664824 - RNA, 64 nt, Homo Sapiens; identical to SEQ ID NO: 380285

SEQ ID NO: 664825 - RNA, 64 nt, Homo Sapiens; identical to SEQ ID NO: 380286

SEQ ID NO: 664826 - RNA, 64 nt, Homo Sapiens; identical to SEQ ID NO: 380287

SEQ ID NO: 664827 - RNA, 64 nt, Homo Sapiens; identical to SEQ ID NO: 380288

SEQ ID NO: 664828 - RNA, 64 nt, Homo Sapiens; identical to SEQ ID NO: 380289

SEQ ID NO: 664829 - RNA, 64 nt, Homo Sapiens; identical to SEQ ID NO: 380290

SEQ ID NO: 664830 - RNA, 64 nt, Homo Sapiens; identical to SEQ ID NO: 380291

SEQ ID NO: 664831 - RNA, 64 nt, Homo Sapiens; identical to SEQ ID NO: 380292

SEQ ID NO: 664832 - RNA, 64 nt, Homo Sapiens; identical to SEQ ID NO: 380293

SEQ ID NO: 664833 - RNA, 64 nt, Homo Sapiens; identical to SEQ ID NO: 380294

SEQ ID NO: 664834 - RNA, 64 nt, Homo Sapiens; identical to SEQ ID NO: 380295

SEQ ID NO: 664835 - RNA, 64 nt, Homo Sapiens; identical to SEQ ID NO: 380296

SEQ ID NO: 664836 - RNA, 64 nt, Homo Sapiens; identical to SEQ ID NO: 380297

SEQ ID NO: 664837 - RNA, 64 nt, Homo Sapiens; identical to SEQ ID NO: 380298

SEQ ID NO: 664838 - RNA, 64 nt, Homo Sapiens; identical to SEQ ID NO: 380299

SEQ ID NO: 664839 - RNA, 64 nt, Homo Sapiens; identical to SEQ ID NO: 380300

SEQ ID NO: 664840 - RNA, 64 nt, Homo Sapiens; identical to SEQ ID NO: 380301

SEQ ID NO: 664841 - RNA, 64 nt, Homo Sapiens; identical to SEQ ID NO: 380302

SEQ ID NO: 664842 - RNA, 64 nt, Homo Sapiens; identical to SEQ ID NO: 380303

SEQ ID NO: 664843 - RNA, 64 nt, Homo Sapiens; identical to SEQ ID NO: 380304

SEQ ID NO: 664844 - RNA, 64 nt, Homo Sapiens; identical to SEQ ID NO: 380304

SEQ ID NO: 664845 - RNA, 64 nt, Homo Sapiens; identical to SEQ ID NO: 380306

SEQ ID NO: 664846 - RNA, 64 nt, Homo Sapiens; identical to SEQ ID NO: 380307

SEQ ID NO: 664847 - RNA, 64 nt, Homo Sapiens; identical to SEQ ID NO: 380308

SEQ ID NO: 664848 - RNA, 64 nt, Homo Sapiens; identical to SEQ ID NO: 380309

SEQ ID NO: 664849 - RNA, 64 nt, Homo Sapiens; identical to SEQ ID NO: 380310

SEQ ID NO: 664850 - RNA, 64 nt, Homo Sapiens; identical to SEQ ID NO: 380311

SEQ ID NO: 664851 - RNA, 64 nt, Homo Sapiens
auauacaacuacaaauccaaacuguuuuccaaagggauuugagcugucccucaugucauuucaa

SEQ ID NO: 664852 - RNA, 64 nt, Homo Sapiens
cucauuuuaccauagcuuauucuccguuuauuugggauuugauuuaaacauugagaagugcugc

SEQ ID NO: 664853 - RNA, 64 nt, Homo Sapiens
gaugugaacaaccugcucacaguccucauuuacuggauuugacuucagccaggugaacuggaau

SEQ ID NO: 664854 - RNA, 64 nt, Homo Sapiens
aagaacacuguucugauaucucugauugucauguggauuugaauguagcuugacagagggaaug

SEQ ID NO: 664855 - RNA, 64 nt, Homo Sapiens
auacagccuacuuuuaugucuugaauauauuguaggauuugaaucaaaagauaauuggaaaaaa

SEQ ID NO: 664856 - RNA, 64 nt, Homo Sapiens
aaaagcaggacuccaccucuuguaauagaagguaggauuugaaaccucucucuucuuuauuccc

SEQ ID NO: 664857 - RNA, 64 nt, Homo Sapiens
ggaaagagaggaaaauggggauauguauuuucuaggauuugagaauuuccuuagcuuccccacc

SEQ ID NO: 664858 - RNA, 64 nt, Homo Sapiens
gugauuccccacguguguucuggggcacaguacuggauuugacacaauaaacucagcuuuuuug

SEQ ID NO: 664859 - RNA, 64 nt, Homo Sapiens
agacagucucccagugucugacucucggauauuuggauuugacuggugugaggcaaagugaaaa

SEQ ID NO: 664860 - RNA, 64 nt, Homo Sapiens
agagggaaugugaaagaaaauaagagaauccacgggauuugaugccuggaagauucuccuucaa

SEQ ID NO: 664861 - RNA, 64 nt, Homo Sapiens
cagcuccaucaagaaugugggaugugccgaccaaggauuugagaaaguuguacagaaauguguu

SEQ ID NO: 664862 - RNA, 64 nt, Homo Sapiens
gagcuuuauaaaugacuuuacagagacuaauaagggauuugaucuuucuuuuuuuguuaucgag

SEQ ID NO: 664863 - RNA, 64 nt, Homo Sapiens
ucuauuugucgaugaaauaaacacaacucuuugaggauuugagacuacauucacccuuuauuca

SEQ ID NO: 664864 - RNA, 64 nt, Homo Sapiens
ugccuccagccaaaugccuagcacagagcucaguggauuugauucuuccauucagauacucaua

SEQ ID NO: 664865 - RNA, 64 nt, Homo Sapiens
augaguauuuuuuuuuuuggguuagagccaaaauggauuugagggguuuugugcagggucuugg

SEQ ID NO: 664866 - RNA, 64 nt, Homo Sapiens
ucuggaacacacaucaucccgggcucaaucagcuggauuugaguuauaucccacugcacugaga

SEQ ID NO: 664867 - RNA, 64 nt, Homo Sapiens
aaaagaagucuaguaagaauaccaaggugauucaggauuugaucgaccugacaugucugagaua

SEQ ID NO: 664868 - RNA, 64 nt, Homo Sapiens
uaccaccagagcauagaaaacggguucacuuaaaggauuugacuaacugauuuguuuccaaugu

SEQ ID NO: 664869 - RNA, 64 nt, Homo Sapiens
ugaaaaaauuuuaggugaaguacuaaaauggggaggauuugagggguggaugguuggugucauu

SEQ ID NO: 664870 - RNA, 64 nt, Homo Sapiens
uaaagaaguaaagagcaucggcccggaggaacguggauuugacugguuaauucuucaggaugca

SEQ ID NO: 664871 - RNA, 64 nt, Homo Sapiens
cccaaaucugucagcaucuggcugucuagaauguggauuugauucauuuuccuguucagugaga

SEQ ID NO: 664872 - RNA, 64 nt, Homo Sapiens
cugccugaguuuccagccugcuagucugcccuauggauuugaaguuugccaaccccaacaauug

SEQ ID NO: 664873 - RNA, 64 nt, Homo Sapiens
gcuuuguuacaauaaaacuaaauguguacacaaaggauuugaugcuuuucucucagcauaggua

SEQ ID NO: 664874 - RNA, 64 nt, Homo Sapiens
aggaugaccucagggcuauguggauugaguaaugggauuugaaucaauguauuaauaucuccau

SEQ ID NO: 664875 - RNA, 64 nt, Homo Sapiens
caggccuucugauuucaagggagccgugcagcugggauuugaacacauagcugggauuugaacu

SEQ ID NO: 664876 - RNA, 64 nt, Homo Sapiens
ugagccgugcagcugggauuaggucacauagcugggauuugaacuuugucuuugaacguaccca

SEQ ID NO: 664877 - RNA, 64 nt, Homo Sapiens
gcuucaccuuaaauuggaaauacagugaguuuuauuaauagaaucacugaauuguaaauguuuu

SEQ ID NO: 664878 - RNA, 64 nt, Homo Sapiens
cagagacuggggauauaccugacaagaggugggcuuaauagaggcacucuuucacccuggaaca

SEQ ID NO: 664879 - RNA, 64 nt, Homo Sapiens
auuauaaacucaaaauauaagaauuuucuucguuuuaauagaauuuguaaaaaguauguauuug

SEQ ID NO: 664880 - RNA, 64 nt, Homo Sapiens
guacugcuucuuaaaccagcccaaauaaggcauuuuaauagacuaacaagggaaauuuaaaucu

SEQ ID NO: 664881 - RNA, 64 nt, Homo Sapiens
aagcaguuuuccugcugcaguucagucauagauguuaauagaggucuauuagacacaucugugc

SEQ ID NO: 664882 - RNA, 64 nt, Homo Sapiens
cuauacucucugccaauuuuuagacuuagauuuauuaauagaaaguugccuaaaacagacaaaa

SEQ ID NO: 664883 - RNA, 64 nt, Homo Sapiens
uuuuaacaaaacuucuuagaaggauauguauauuuuaauagaauuaugaaugugauugguaacu

SEQ ID NO: 664884 - RNA, 64 nt, Homo Sapiens
ggaggggacuccaaagcuggguuuaucacccuaauuaauagaauaauucccugcuaaaugccau

SEQ ID NO: 664885 - RNA, 64 nt, Homo Sapiens
uuuucccuagcagacuuuuguuuaaaaacauauauuaauagauggcauuucuggaaauauuuga

SEQ ID NO: 664886 - RNA, 64 nt, Homo Sapiens
acaaacuaaguuacuuuuuuucuuuuccuuaaaauuaauagauauauuuuuuuccuuuuucuaa

SEQ ID NO: 664887 - RNA, 64 nt, Homo Sapiens
agccuuguaaagcaagcauaaaaaugucacaaguuuaauagaucuuguuuauucuuuuuaaaua

SEQ ID NO: 664888 - RNA, 64 nt, Homo Sapiens
gugaggcugguguguaugauugucuuaaaauuuuuuaauagauauggccgagcgugauggcuca

SEQ ID NO: 664889 - RNA, 64 nt, Homo Sapiens
uuugacagugagacugucaaaaaaaaaaaaaaaauuaauagauaaaacaggccacuagagggug

SEQ ID NO: 664890 - RNA, 64 nt, Homo Sapiens
ugcuaguaaucagcacucuuucuuuuuuuuuuuuuuaauagagacagggucucgcaguguugcc

SEQ ID NO: 664891 - RNA, 64 nt, Homo Sapiens
acaguuauauauaugguauuuugcaaaaggacuauuaauagaaccuuuugagaugaauuaaugu

SEQ ID NO: 664892 - RNA, 64 nt, Homo Sapiens
cauauuuuuuaguggcuucuaaaugggcucuugauuaauagaccuaaaugcucuuaucauuuug

SEQ ID NO: 664893 - RNA, 64 nt, Homo Sapiens
ugaacuuuugauuaguauggggaaaaaaggguuuuuaauagaaaugccagauguagcuacuuaa

SEQ ID NO: 664894 - RNA, 64 nt, Homo Sapiens
cgggguuucaccauguuggcuaauuuuuguauuuuuaauagagaugagcacuaccacgcccggc

SEQ ID NO: 664895 - RNA, 64 nt, Homo Sapiens
ugggguuucgccauguuggcuuuuuuguauuuuuuuaauagauagugccaccaugucuggcuaa

SEQ ID NO: 664896 - RNA, 64 nt, Homo Sapiens
ucagagaauucacacuaguggcuuguuuccuaccuuaauagaaaaggaaugugggaaggccuuu

SEQ ID NO: 664897 - RNA, 64 nt, Homo Sapiens
ucagagaauucacaaaggaguuguuuuuuugauuuuaauagacagaaugugggaaugccuucau

SEQ ID NO: 664898 - RNA, 64 nt, Homo Sapiens
aaugcuucauauuauucaaauauacauauuuuccuuaauagaggggauacagauuauauauaua

SEQ ID NO: 664899 - RNA, 64 nt, Homo Sapiens
aauuuauuuuauuucuaaagggaguuuuauguguuuaauagaugcuuguaaucugcauucucca

SEQ ID NO: 664900 - RNA, 64 nt, Homo Sapiens
uauucugauuauuuggacugcaguuuaggcuucauuaauagaacgguauaaaacaauauuuuga

SEQ ID NO: 664901 - RNA, 64 nt, Homo Sapiens
guacagggcuaaaagaguauuagaaguguguucuuuaauagagugaauucgugugccuuagauu

SEQ ID NO: 664902 - RNA, 64 nt, Homo Sapiens
ucuauuucuguuacauuuuauaggcccccaaaauuuaauagauaaauaaucaaaaauauuuuau

SEQ ID NO: 664903 - RNA, 64 nt, Homo Sapiens
caauggaacuuuaaaauauuauuuuuuaaauguauuaauagaguuagucuuaagcauuuuugca

SEQ ID NO: 664904 - RNA, 64 nt, Homo Sapiens
guccuucguuugaucaauaaacaguguuacagauaacuucaaguuuauaaaaauacagugaaau

SEQ ID NO: 664905 - RNA, 64 nt, Homo Sapiens
uauauaugcucagaucaauauacuuguuuagaaaaacuucaagacauucaaaaacuaggaagga

SEQ ID NO: 664906 - RNA, 64 nt, Homo Sapiens
cuuagggcgggagcacuaaaacuggauaaaaguaaacuucaaacugaucauggaggaaaaaggu

SEQ ID NO: 664907 - RNA, 50 nt, Homo Sapiens
acacaaaaugaaacaaaagaaacuucaaauaggagucugaggauaacuaa

SEQ ID NO: 664908 - RNA, 64 nt, Homo Sapiens
uucauuuaguacucuucuuuccuccuacucuaugaacuucaaaacaaaaacaaaacuuugagag

SEQ ID NO: 664909 - RNA, 64 nt, Homo Sapiens
gcuaaaaggugcugauauuuuauuuaguacugccaacuucaagugauuuagauaucuaucuauc

SEQ ID NO: 664910 - RNA, 64 nt, Homo Sapiens
agggaugcauugagcagucuucgaaacuucaagaaacuucaauauaucugaacauaccuguuuu

SEQ ID NO: 664911 - RNA, 64 nt, Homo Sapiens
aacuucaauaagggaugcauuaccuguuuuucgaaacuucaagaugcugaaaauuaucugaaca

SEQ ID NO: 664912 - RNA, 64 nt, Homo Sapiens
aaauucacaaaaaaauuaauaccucuguggagaaaacuucaaaacuuaaaaaaggacauagaaa

SEQ ID NO: 664913 - RNA, 64 nt, Homo Sapiens
aaguggcauaguuuuaucaauaucugucaaauuaaacuucaaggcaaaacuuuuuuauugagau

SEQ ID NO: 664914 - RNA, 64 nt, Homo Sapiens
uuuuagcaacagcugaauagauuuuuuauauuuaaacuucaauuacauuuauauuuaaacuuca

SEQ ID NO: 664915 - RNA, 64 nt, Homo Sapiens
uuuuauauuuaaacuucaaucacauuuauauuuaaacuucaauuggaaaaaagguccgaauuuu

SEQ ID NO: 664916 - RNA, 64 nt, Homo Sapiens
acuguagucuaagaccugauauggcuguaaugagaacuucaaucugauuauguguccuuucuug

SEQ ID NO: 664917 - RNA, 64 nt, Homo Sapiens
uguucguauucuauucaaaacgcuuaaaaccuagaacuucaaaagcagcaguuccaugaagaca

SEQ ID NO: 664918 - RNA, 64 nt, Homo Sapiens
aucaagauaccuaauauuuauauggggacaucaaaacuucaauaucaucucaggcacaaauaua

SEQ ID NO: 664919 - RNA, 64 nt, Homo Sapiens
aaaggaauuuuccuguuaaagugaucuucuuaggaacuucaagagucauaugcagugaccuuug

SEQ ID NO: 664920 - RNA, 64 nt, Homo Sapiens
cccaaaugaauagaaacacaugugggguacacugaacuucaaaguacacacacagacacacaga

SEQ ID NO: 664921 - RNA, 64 nt, Homo Sapiens
caaguuuggcugaaaacagugcaauacuacaacaaacuucaaggggcccucugcuggcugagug

SEQ ID NO: 664922 - RNA, 64 nt, Homo Sapiens
uucaucacacagcuuaaugaauuugcuuaaauuuaacuucaaagggugugauuagguguagaga

SEQ ID NO: 664923 - RNA, 64 nt, Homo Sapiens
caaaacacuguuuucuuaugugcagcaguuggucaacuucaacuguauguuagcauauuuucua

SEQ ID NO: 664924 - RNA, 64 nt, Homo Sapiens
auacccacuuuucaggaugggacaguaucagaugaacuucaacccauggagaacaagccucaac

SEQ ID NO: 664925 - RNA, 64 nt, Homo Sapiens
gacaggaaacgaauauggacguaauugcagaaggaacuucaaggagaugaaugaaugcuaaaag

SEQ ID NO: 664926 - RNA, 64 nt, Homo Sapiens
acgacgugugaccauuucgucauauuuaaaauauaacuucaagaaaagaguaaacauccauugg

SEQ ID NO: 664927 - RNA, 64 nt, Homo Sapiens
auguugauguuuucaacuccaaaucaauucuaaaaacuucaagcacuuaauggaaagguaaaug

SEQ ID NO: 664928 - RNA, 64 nt, Homo Sapiens
ugaugagagcacuuaagauccaggaauuauaaauaacuucaauauaagaguauauaauucuuaa

SEQ ID NO: 664929 - RNA, 64 nt, Homo Sapiens
uggucacguacaguuguauggaauuaccugagcuaacuucaaggaaguaauggaugagcaaaca

SEQ ID NO: 664930 - RNA, 64 nt, Homo Sapiens
auguuuaauguuguaauauuaucuaacuggucuaaacuucaaauaucauuuuaccuuugaagaa

SEQ ID NO: 664931 - RNA, 64 nt, Homo Sapiens
uuaccuuugaagaaaaccagaaaacauucaaaagaacuucaacaaaucaucacguaacaggauc

SEQ ID NO: 664932 - RNA, 64 nt, Homo Sapiens
auugucuaagcuuuaauccacuguguuaggucaaaacuucaaauacaugcauuuuucaauauag

SEQ ID NO: 664933 - RNA, 64 nt, Homo Sapiens
accuaucagcuuaguuuuuuaacaugguagucuaaacuucaaggcuugcucuaucuccuagagc

SEQ ID NO: 664934 - RNA, 64 nt, Homo Sapiens
agaaauccaguuagaagugcugaauaaagaaauaaacuucaacugaaauuguugaauuaguuag

SEQ ID NO: 664935 - RNA, 64 nt, Homo Sapiens
guguauuaugauaauuucccguagaccagaaaguaacuucaaaugcuagaaauggauugaauua

SEQ ID NO: 664936 - RNA, 64 nt, Homo Sapiens
ugagacaugcuuauuuugcuaaaggaugcacccaaacuucaaacuucaagcaaaugaaauggac

SEQ ID NO: 664937 - RNA, 64 nt, Homo Sapiens
ugcuuauuuugcuaaaggaugcacccaaacuucaaacuucaagcaaaugaaauggacaaugcag

SEQ ID NO: 664938 - RNA, 64 nt, Homo Sapiens
cuugacauuugccagaaugugaacccacaggaaaaacuucaaaauuugcauaugaaagaggcca

SEQ ID NO: 664939 - RNA, 64 nt, Homo Sapiens
uggcuauuccucuugcaaauucuuaaauuugcagaacuucaaauacccuccaccccgcuguuuu

SEQ ID NO: 664940 - RNA, 64 nt, Homo Sapiens
cccuucucaccccucaaccuccggaguccaggagaacccguacccccacagagccuuaagcaac

SEQ ID NO: 664941 - RNA, 50 nt, Homo Sapiens
guucacaauagagcucagggaacccguauaucauaccauuccuuggauga

SEQ ID NO: 664942 - RNA, 64 nt, Homo Sapiens
cacggacacacccagucucacaaucacacacagaaacccguagggugugcaaaaagcacaaccc

SEQ ID NO: 664943 - RNA, 64 nt, Homo Sapiens
uauccauuuugacauaggaauuuucuguauguauaacccguaaacaaacaugauugccuucuug

SEQ ID NO: 664944 - RNA, 64 nt, Homo Sapiens
agcauuuuugccugccucgauauucuccuaauacaacccguaaugggaaaacugagaaaaccca

SEQ ID NO: 664945 - RNA, 64 nt, Homo Sapiens
uauuccuaacuacugccucuggagauagcuuucaaacccguauccuauacuagacagauacagu

SEQ ID NO: 664946 - RNA, 61 nt, Homo Sapiens
acucaaccagugaugauuagaacaaaagaaaaacccguaagauuccuuuugugaaaaguuu

SEQ ID NO: 664947 - RNA, 64 nt, Homo Sapiens
cuagggccaaauccauucuugguuacauuuggagaacccguacuucagagaucuguagggccga

SEQ ID NO: 664948 - RNA, 64 nt, Homo Sapiens
cugcacaacuggaaguucuggaugacuacguccgaacccguacgaccagaugcgagacauguuu

SEQ ID NO: 664949 - RNA, 64 nt, Homo Sapiens
gugaugcuguaauuuuacuuuucaacauaaguugaacccguagcagucuguuuaccuuguaaag

SEQ ID NO: 664950 - RNA, 64 nt, Homo Sapiens
cccuccucccccacucucaauaccuagagagugaaacccguacaaugagauaaagacuaaaaag

SEQ ID NO: 664951 - RNA, 64 nt, Homo Sapiens
ugucuuacaagucuuauauuuugaaacuuaucucaacccguagauaaauaugagacaccaggac

SEQ ID NO: 664952 - RNA, 64 nt, Homo Sapiens
gucaaaaaaacagagguuuuaacacauaaguaaaaacccguacauauuugauguguaaugcagg

SEQ ID NO: 664953 - RNA, 64 nt, Homo Sapiens
uaaaagccuuaaaaccauguaugugcgcuguuugaacccguaagccacuucuuugacauuagaa

SEQ ID NO: 664954 - RNA, 64 nt, Homo Sapiens
cuccggcuccugacgccacacacucuuggcuuucaacccguaggugguuucagcuuugauugcc

SEQ ID NO: 664955 - RNA, 64 nt, Homo Sapiens
aaagauacucuaccuacauuuuguuggauaggaaaacccguacuggagagagagagaagccuug

SEQ ID NO: 664956 - RNA, 64 nt, Homo Sapiens
cuucuuaccucagaugccugaacagaacaaggcaaacccguagcagccucucaggagcugacag

SEQ ID NO: 664957 - RNA, 64 nt, Homo Sapiens
uauuuuugaaagaauacauuuggucauaaagugaaacccguauuagcaaguacguggcaauguu

SEQ ID NO: 664958 - RNA, 64 nt, Homo Sapiens
gcauguuacuguccugcauggcuccuaggcuacaaacccguauagcuauaugguauagucuguu

SEQ ID NO: 664959 - RNA, 64 nt, Homo Sapiens
gccuuccguguaaccugcauugaaccccugaguuaacccguaagcauggagacaguagaauuag

SEQ ID NO: 664960 - RNA, 64 nt, Homo Sapiens
cccaaaacucccacaacaaguauaguguaaagaaaacccguacccuaugauguuuaauaaguau

SEQ ID NO: 664961 - RNA, 64 nt, Homo Sapiens
gcuucuguaugucucuugugguauuggaacaauaaacccguacaaccugcaguuguggucucag

SEQ ID NO: 664962 - RNA, 64 nt, Homo Sapiens
uacagagaaguggucgauucgagaguucuuuggaaacccguagacuuguuucagaaagauggaa

SEQ ID NO: 664963 - RNA, 64 nt, Homo Sapiens; identical to SEQ ID NO: 311803

SEQ ID NO: 664964 - RNA, 64 nt, Homo Sapiens; identical to SEQ ID NO: 311804

SEQ ID NO: 664965 - RNA, 64 nt, Homo Sapiens; identical to SEQ ID NO: 311805

SEQ ID NO: 664966 - RNA, 64 nt, Homo Sapiens; identical to SEQ ID NO: 311806

SEQ ID NO: 664967 - RNA, 64 nt, Homo Sapiens; identical to SEQ ID NO: 311807

SEQ ID NO: 664968 - RNA, 64 nt, Homo Sapiens; identical to SEQ ID NO: 311808

SEQ ID NO: 664969 - RNA, 64 nt, Homo Sapiens; identical to SEQ ID NO: 311809

SEQ ID NO: 664970 - RNA, 64 nt, Homo Sapiens; identical to SEQ ID NO: 311810

SEQ ID NO: 664971 - RNA, 64 nt, Homo Sapiens; identical to SEQ ID NO: 311811

SEQ ID NO: 664972 - RNA, 64 nt, Homo Sapiens; identical to SEQ ID NO: 311812

SEQ ID NO: 664973 - RNA, 64 nt, Homo Sapiens; identical to SEQ ID NO: 311813

SEQ ID NO: 664974 - RNA, 64 nt, Homo Sapiens; identical to SEQ ID NO: 311814

SEQ ID NO: 664975 - RNA, 64 nt, Homo Sapiens; identical to SEQ ID NO: 311815

SEQ ID NO: 664976 - RNA, 64 nt, Homo Sapiens; identical to SEQ ID NO: 311816

SEQ ID NO: 664977 - RNA, 64 nt, Homo Sapiens; identical to SEQ ID NO: 311817

SEQ ID NO: 664978 - RNA, 64 nt, Homo Sapiens; identical to SEQ ID NO: 311818

SEQ ID NO: 664979 - RNA, 64 nt, Homo Sapiens; identical to SEQ ID NO: 311819

SEQ ID NO: 664980 - RNA, 64 nt, Homo Sapiens; identical to SEQ ID NO: 311820

SEQ ID NO: 664981 - RNA, 64 nt, Homo Sapiens; identical to SEQ ID NO: 311821

SEQ ID NO: 664982 - RNA, 64 nt, Homo Sapiens; identical to SEQ ID NO: 311822

SEQ ID NO: 664983 - RNA, 64 nt, Homo Sapiens; identical to SEQ ID NO: 311823

SEQ ID NO: 664984 - RNA, 64 nt, Homo Sapiens; identical to SEQ ID NO: 311824

SEQ ID NO: 664985 - RNA, 64 nt, Homo Sapiens; identical to SEQ ID NO: 311825

SEQ ID NO: 664986 - RNA, 64 nt, Homo Sapiens; identical to SEQ ID NO: 311824

SEQ ID NO: 664987 - RNA, 64 nt, Homo Sapiens; identical to SEQ ID NO: 311824

SEQ ID NO: 664988 - RNA, 64 nt, Homo Sapiens; identical to SEQ ID NO: 311828

SEQ ID NO: 664989 - RNA, 64 nt, Homo Sapiens; identical to SEQ ID NO: 311829

SEQ ID NO: 664990 - RNA, 64 nt, Homo Sapiens; identical to SEQ ID NO: 311830

SEQ ID NO: 664991 - RNA, 64 nt, Homo Sapiens; identical to SEQ ID NO: 311831

SEQ ID NO: 664992 - RNA, 64 nt, Homo Sapiens; identical to SEQ ID NO: 311832

SEQ ID NO: 664993 - RNA, 64 nt, Homo Sapiens; identical to SEQ ID NO: 311833

SEQ ID NO: 664994 - RNA, 64 nt, Homo Sapiens; identical to SEQ ID NO: 311834

SEQ ID NO: 664995 - RNA, 64 nt, Homo Sapiens; identical to SEQ ID NO: 311835

SEQ ID NO: 664996 - RNA, 64 nt, Homo Sapiens; identical to SEQ ID NO: 311836

SEQ ID NO: 664997 - RNA, 64 nt, Homo Sapiens; identical to SEQ ID NO: 311837

SEQ ID NO: 664998 - RNA, 64 nt, Homo Sapiens; identical to SEQ ID NO: 311838

SEQ ID NO: 664999 - RNA, 64 nt, Homo Sapiens; identical to SEQ ID NO: 311839

SEQ ID NO: 665000 - RNA, 64 nt, Homo Sapiens; identical to SEQ ID NO: 311840

SEQ ID NO: 665001 - RNA, 64 nt, Homo Sapiens; identical to SEQ ID NO: 311841

SEQ ID NO: 665002 - RNA, 64 nt, Homo Sapiens; identical to SEQ ID NO: 311842

SEQ ID NO: 665003 - RNA, 64 nt, Homo Sapiens; identical to SEQ ID NO: 311843

SEQ ID NO: 665004 - RNA, 64 nt, Homo Sapiens; identical to SEQ ID NO: 311844

SEQ ID NO: 665005 - RNA, 64 nt, Homo Sapiens; identical to SEQ ID NO: 311845

SEQ ID NO: 665006 - RNA, 64 nt, Homo Sapiens; identical to SEQ ID NO: 311846

SEQ ID NO: 665007 - RNA, 64 nt, Homo Sapiens
agauguaucuguaccuucucauuugauguauuaaucauaaaauuucacuacaagguaauuuuug

SEQ ID NO: 665008 - RNA, 64 nt, Homo Sapiens
caugcugaccagaauccuguuauuuuuauaugcaucauaaaauuucccauuucugcauuaaaua

SEQ ID NO: 665009 - RNA, 64 nt, Homo Sapiens
uccuuucuagaguauauguucagcaauguugaucucauaaaaggaaaaacaaaagauuuaagua

SEQ ID NO: 665010 - RNA, 64 nt, Homo Sapiens
gggauugguguaggguuaaaucaucaacauuauuucauaaaauaagaauuuguucuguguuauc

SEQ ID NO: 665011 - RNA, 64 nt, Homo Sapiens
aauuauaguuaauuauacccuuuuucuuauuuauucauaaaauaauccuuuauagccagggacu

SEQ ID NO: 665012 - RNA, 64 nt, Homo Sapiens
uaauaaauaaaaagucucagagcaauacuccgucucauaaaaauagaaucagccugggcaacau

SEQ ID NO: 665013 - RNA, 64 nt, Homo Sapiens
aaagcuuaaaaauugucuuagaaucugaaauguuucauaaaaauugaugugcugugauaugagg

SEQ ID NO: 665014 - RNA, 64 nt, Homo Sapiens
aauucagcaaauauuuccaaccaagaggaagcuuucauaaaaacuacucugauccuuacagaau

SEQ ID NO: 665015 - RNA, 63 nt, Homo Sapiens
uagauguaaacaccucuucuuuuggaaauaaauuucauaaaaauauauacacugccucuucaa

SEQ ID NO: 665016 - RNA, 64 nt, Homo Sapiens
uuuacuuaaaaucuguaacgcacauucuguuucuucauaaaaaucagguaucuuggauuucaga

SEQ ID NO: 665017 - RNA, 64 nt, Homo Sapiens
caucugcaucccaaguccuauuuuauaaggauauucauaaaaauuccauggugaauccuugucu

SEQ ID NO: 665018 - RNA, 64 nt, Homo Sapiens
acccuucuccuuggauuguuuuggaaguuauucuucauaaaaaauguuaacgugggcugggcau

SEQ ID NO: 665019 - RNA, 64 nt, Homo Sapiens
uguaauuuguggaugguugaguuuguaagaacaaucauaaaaggacuuguuagucuccagaaca

SEQ ID NO: 665020 - RNA, 64 nt, Homo Sapiens
aaauaucacugacucaucccuacccauauucuuuucauaaaacccacucaccagguacaauaga

SEQ ID NO: 665021 - RNA, 64 nt, Homo Sapiens
uugaauguuguacacaguaaaauuagugacagauucauaaaaaaguguauauauaaacacaaau

SEQ ID NO: 665022 - RNA, 64 nt, Homo Sapiens
gagaaauuaaauauuacuguuugucacuggauuaucauaaaaggagcaaagucauacuuacgug

SEQ ID NO: 665023 - RNA, 64 nt, Homo Sapiens
aaggaaauacguugcagugauguggguacugcuuucauaaaacaguuuuuucaguauuuugaga

SEQ ID NO: 665024 - RNA, 64 nt, Homo Sapiens
aauggaaaacuuaauaaauugcuacuguuuuauaucauaaaauuaaaauaccaugguaauauuu

SEQ ID NO: 665025 - RNA, 64 nt, Homo Sapiens
acaagaaaaacugaguaacaaaaaagaccaugcaucauaaaauugcccagucuucagcggagca

SEQ ID NO: 665026 - RNA, 64 nt, Homo Sapiens
gagggagguauccuguuguucuuacucacucuucucauaaaauaggaaauauuuuaguucuguu

SEQ ID NO: 665027 - RNA, 64 nt, Homo Sapiens
auuuaguacuaaaaucacagucaugaaaucauagucauaaaauggucuucacacagcagucauc

SEQ ID NO: 665028 - RNA, 64 nt, Homo Sapiens
aaguuuuguauauuuauuguauuaacacagagugucauaaaauaaaaugcuguuuacuggaugu

SEQ ID NO: 665029 - RNA, 64 nt, Homo Sapiens
aaagcuauuaugcaggaggauuuagaagucacauucauaaaacccaagugcuauggguguauua

SEQ ID NO: 665030 - RNA, 64 nt, Homo Sapiens
aaugaagcuuuuucucaguacaagauucugaguaucauaaaaugguuauuuaauugaaacguag

SEQ ID NO: 665031 - RNA, 64 nt, Homo Sapiens
uuuagaauauuuuauguugcuugcacuauaggagucauaaaaggaacuuaguuaaaauauguug

SEQ ID NO: 665032 - RNA, 64 nt, Homo Sapiens
uuuagguacaaacuuuauaaagaauguuaguaugucauaaaauauaacauuacagcuuauuuaa

SEQ ID NO: 665033 - RNA, 64 nt, Homo Sapiens
aaaccauuuucaggaaaaucgauuugcauuuacaucauaaaauuaaaaaaguuuuuacuucuaa

SEQ ID NO: 665034 - RNA, 64 nt, Homo Sapiens
acggaccuguuaggaaaaugagaggaacccugggucauaaaaugaggggagaaaacaccaggaa

SEQ ID NO: 665035 - RNA, 64 nt, Homo Sapiens
agaggcgaguagggcacaacaauaugacugaugaucauaaaagaauuaggauagacccuaauuc

SEQ ID NO: 665036 - RNA, 64 nt, Homo Sapiens
uacuuacaaggaggcugcucaaacauaagaacuaucauaaaauuaaauaaaaacuacggguaga

SEQ ID NO: 665037 - RNA, 64 nt, Homo Sapiens
gguaaggcugcaugauagcauuccuauauuucucucauaaaauaggauuugaaggaugaaauua

SEQ ID NO: 665038 - RNA, 64 nt, Homo Sapiens
aucuacucuagagacauauaaucauacagauuauucauaaaauuuuucagugcuguccuuccac

SEQ ID NO: 665039 - RNA, 64 nt, Homo Sapiens
gccagaggcagaaauggucuggguauaagcuauuucauaaaagcagcuuuaaauugucaguauu

SEQ ID NO: 665040 - RNA, 64 nt, Homo Sapiens
ucuuaauuucuaacauuaucuuugcuuuuauguuucauaaaaauuugucauuauuuaugcuggu

SEQ ID NO: 665041 - RNA, 64 nt, Homo Sapiens
gaacacauaacacuacugaauuauaaaaauucaaucauaaaagucaaaauauauuacauaauau

SEQ ID NO: 665042 - RNA, 64 nt, Homo Sapiens
uagucauuauucuugaugaagagucuguuuuuaaucauaaaaaucaugacaguuacucagaccc

SEQ ID NO: 665043 - RNA, 64 nt, Homo Sapiens
uaguaccucaaugcgauucugagauauuugaauuucauaaaauuguaacugaaauuuaaaauuu

SEQ ID NO: 665044 - RNA, 64 nt, Homo Sapiens
auaauugcuuguuuucuagccuggcaagauauuuucauaaaagagggauaacaaugcugauuac

SEQ ID NO: 665045 - RNA, 64 nt, Homo Sapiens
aauacaguuucaaaaggaagacucaugagaaauuucauaaaauacaaguuuuuagauguuuaug

SEQ ID NO: 665046 - RNA, 64 nt, Homo Sapiens
ugaugcauuaacauaaaauaucaaacacacaaagucauaaaaugaaaauuuacaguuuuaccug

SEQ ID NO: 665047 - RNA, 64 nt, Homo Sapiens
guugagaacaucucucguguaagugacuuugaccucauaaaagauuuucguuuucaguuaucaa

SEQ ID NO: 665048 - RNA, 64 nt, Homo Sapiens
augaacagauauggaggccagacauuuagauacuucauaaaauuuuuuuuuuaaacuaaugaau

SEQ ID NO: 665049 - RNA, 64 nt, Homo Sapiens
uaacugugcguuaaauaagcaaauaaacaguggcucauaaaaauaaaagucgcauuccauaucu

SEQ ID NO: 665050 - RNA, 64 nt, Homo Sapiens
uuggaugggccuuuuagaaaccucauuggccagcucauaaaauggaagcaauugcucauguugg

SEQ ID NO: 665051 - RNA, 64 nt, Homo Sapiens
aaaaaagcuuguggccaauggaacaguaagaacaucauaaaauuuuuauauauauaguuuauuu

SEQ ID NO: 665052 - RNA, 64 nt, Homo Sapiens
uaccuaagcaaguggucuuguuaguuuuguugcuucauaaaauugguuaaaauucuucaccaua

SEQ ID NO: 665053 - RNA, 64 nt, Homo Sapiens
ucaagagcauuuuuaagcccuuguaucauuucuuucauaaaaccaaaguuagagaacauuaugu

SEQ ID NO: 665054 - RNA, 64 nt, Homo Sapiens
gucauuucuguguguuacuuuguuuauaggcuugucauaaaaggaacuauaaugugauucaagg

SEQ ID NO: 665055 - RNA, 64 nt, Homo Sapiens
ggcacaaaaguuuuaucaguguaaucuauuuucuucauaaaacauaucaaucuuauaaauauau

SEQ ID NO: 665056 - RNA, 64 nt, Homo Sapiens
auggccuguuuaagauggaagacaacauauucuuucauaaaacuaauucugaauuucauguaau

SEQ ID NO: 665057 - RNA, 64 nt, Homo Sapiens
caugaaggacuuugaucgugaauccagaacuuccucauaaaaugaucugguugaccaugauuuu

SEQ ID NO: 665058 - RNA, 64 nt, Homo Sapiens
aauugagugcuuuuaaauacuuuuuagaaaguaaucauaaaaguaaauugaauuucaaaccuau

SEQ ID NO: 665059 - RNA, 64 nt, Homo Sapiens
aggcugaaugaacuucauacaaaugaaaaaaaucucauaaaaauacauaaacuauguagcaaaa

SEQ ID NO: 665060 - RNA, 64 nt, Homo Sapiens
gacaggcaggggaaucuuccuugguuuuuagaauucauaaaacuugagaguauuacagguagac

SEQ ID NO: 665061 - RNA, 64 nt, Homo Sapiens
agccaguucuuuucucugcuaguccugcuugcucucauaaaaagugaaguguagauuuguauuu

SEQ ID NO: 665062 - RNA, 64 nt, Homo Sapiens
augccacugugugcauccauuuuaaaggguucccucauaaaaaaauguuauuccccauuaucac

SEQ ID NO: 665063 - RNA, 64 nt, Homo Sapiens
accuguugaguuucuaaugaauauuuguagaaucucauaaaacaguuuaaauacaagcuuaagu

SEQ ID NO: 665064 - RNA, 64 nt, Homo Sapiens
uuaguuuaaugugcucuuuggauuaagucauaauucauaaaauuagucugcuguugaacuauua

SEQ ID NO: 665065 - RNA, 64 nt, Homo Sapiens
uuaauggaagcuuuuugaugcuagauugccaaauucauaaaaugacaauacuuaauguauugua

SEQ ID NO: 665066 - RNA, 64 nt, Homo Sapiens
uuaaauuuuacuaguguuacuuuuuaaggccuggucauaaaacuucugucaucaucauucaugu

SEQ ID NO: 665067 - RNA, 64 nt, Homo Sapiens
uuggaaguauuuacauccuccuguaauguagcauucauaaaaauaaauagcuacacucugcccu

SEQ ID NO: 665068 - RNA, 64 nt, Homo Sapiens
aaagcugcuuaaaacuguggcucuaagagaguaaucauaaaauaccuuagauaaaauugcacua

SEQ ID NO: 665069 - RNA, 64 nt, Homo Sapiens
uacuaauacacaucugcuucaaaaugaacauauuucauaaaauuggcaucaauuuuaaugacgc

SEQ ID NO: 665070 - RNA, 64 nt, Homo Sapiens
auauaccacucugauaacucauauaaaaauaucaucauaaaaagcuuaauuucaucccuuuuau

SEQ ID NO: 665071 - RNA, 64 nt, Homo Sapiens
auuuuuaaagcacuagguuuuaaaucaguggguaucauaaaagccauauauaaaagauccuuuc

SEQ ID NO: 665072 - RNA, 64 nt, Homo Sapiens
uucuaagaauuccauuugccucuaugaucuuagcucauaaaaauauaauaugacuugauaaagc

SEQ ID NO: 665073 - RNA, 64 nt, Homo Sapiens
ugaaguuauaaguuuaaaacucaauuucagaugcucauaaaaguuacuuagcuaaaauuuuagc

SEQ ID NO: 665074 - RNA, 64 nt, Homo Sapiens
uaugugaauaugaucuuucuacaauauacuguaaucauaaaagucauaauauggaacaauuaua

SEQ ID NO: 665075 - RNA, 64 nt, Homo Sapiens
gagacugagacagaauauuguguuguugaagcagucauaaaacucuagaaucaucaaaauuauu

SEQ ID NO: 665076 - RNA, 64 nt, Homo Sapiens; identical to SEQ ID NO: 605451

SEQ ID NO: 665077 - RNA, 64 nt, Homo Sapiens; identical to SEQ ID NO: 605452

SEQ ID NO: 665078 - RNA, 64 nt, Homo Sapiens; identical to SEQ ID NO: 605453

SEQ ID NO: 665079 - RNA, 64 nt, Homo Sapiens; identical to SEQ ID NO: 605454

SEQ ID NO: 665080 - RNA, 64 nt, Homo Sapiens; identical to SEQ ID NO: 605455

SEQ ID NO: 665081 - RNA, 64 nt, Homo Sapiens; identical to SEQ ID NO: 605456

SEQ ID NO: 665082 - RNA, 64 nt, Homo Sapiens; identical to SEQ ID NO: 605457

SEQ ID NO: 665083 - RNA, 64 nt, Homo Sapiens; identical to SEQ ID NO: 605458

SEQ ID NO: 665084 - RNA, 64 nt, Homo Sapiens; identical to SEQ ID NO: 605459

SEQ ID NO: 665085 - RNA, 64 nt, Homo Sapiens; identical to SEQ ID NO: 605460

SEQ ID NO: 665086 - RNA, 64 nt, Homo Sapiens; identical to SEQ ID NO: 605461

SEQ ID NO: 665087 - RNA, 64 nt, Homo Sapiens; identical to SEQ ID NO: 605462

SEQ ID NO: 665088 - RNA, 64 nt, Homo Sapiens; identical to SEQ ID NO: 605463

SEQ ID NO: 665089 - RNA, 64 nt, Homo Sapiens; identical to SEQ ID NO: 605464

SEQ ID NO: 665090 - RNA, 64 nt, Homo Sapiens; identical to SEQ ID NO: 605465

SEQ ID NO: 665091 - RNA, 64 nt, Homo Sapiens; identical to SEQ ID NO: 605466

SEQ ID NO: 665092 - RNA, 64 nt, Homo Sapiens; identical to SEQ ID NO: 605467

SEQ ID NO: 665093 - RNA, 64 nt, Homo Sapiens; identical to SEQ ID NO: 605468

SEQ ID NO: 665094 - RNA, 64 nt, Homo Sapiens; identical to SEQ ID NO: 605469

SEQ ID NO: 665095 - RNA, 64 nt, Homo Sapiens; identical to SEQ ID NO: 605470

SEQ ID NO: 665096 - RNA, 64 nt, Homo Sapiens; identical to SEQ ID NO: 605471

SEQ ID NO: 665097 - RNA, 64 nt, Homo Sapiens; identical to SEQ ID NO: 605472

SEQ ID NO: 665098 - RNA, 64 nt, Homo Sapiens; identical to SEQ ID NO: 605473

SEQ ID NO: 665099 - RNA, 64 nt, Homo Sapiens; identical to SEQ ID NO: 605474

SEQ ID NO: 665100 - RNA, 64 nt, Homo Sapiens; identical to SEQ ID NO: 605475

SEQ ID NO: 665101 - RNA, 64 nt, Homo Sapiens; identical to SEQ ID NO: 605476

SEQ ID NO: 665102 - RNA, 64 nt, Homo Sapiens; identical to SEQ ID NO: 605477

SEQ ID NO: 665103 - RNA, 64 nt, Homo Sapiens; identical to SEQ ID NO: 605478

SEQ ID NO: 665104 - RNA, 64 nt, Homo Sapiens; identical to SEQ ID NO: 605479

SEQ ID NO: 665105 - RNA, 64 nt, Homo Sapiens; identical to SEQ ID NO: 605480

SEQ ID NO: 665106 - RNA, 64 nt, Homo Sapiens; identical to SEQ ID NO: 605481

SEQ ID NO: 665107 - RNA, 64 nt, Homo Sapiens; identical to SEQ ID NO: 605482

SEQ ID NO: 665108 - RNA, 64 nt, Homo Sapiens; identical to SEQ ID NO: 605483

SEQ ID NO: 665109 - RNA, 64 nt, Homo Sapiens; identical to SEQ ID NO: 605484

SEQ ID NO: 665110 - RNA, 64 nt, Homo Sapiens; identical to SEQ ID NO: 605485

SEQ ID NO: 665111 - RNA, 64 nt, Homo Sapiens; identical to SEQ ID NO: 605486

SEQ ID NO: 665112 - RNA, 64 nt, Homo Sapiens; identical to SEQ ID NO: 605487

SEQ ID NO: 665113 - RNA, 64 nt, Homo Sapiens; identical to SEQ ID NO: 605488

SEQ ID NO: 665114 - RNA, 64 nt, Homo Sapiens; identical to SEQ ID NO: 605489

SEQ ID NO: 665115 - RNA, 64 nt, Homo Sapiens; identical to SEQ ID NO: 605490

SEQ ID NO: 665116 - RNA, 64 nt, Homo Sapiens; identical to SEQ ID NO: 605491

SEQ ID NO: 665117 - RNA, 64 nt, Homo Sapiens; identical to SEQ ID NO: 605492

SEQ ID NO: 665118 - RNA, 64 nt, Homo Sapiens; identical to SEQ ID NO: 605493

SEQ ID NO: 665119 - RNA, 64 nt, Homo Sapiens; identical to SEQ ID NO: 605494

SEQ ID NO: 665120 - RNA, 64 nt, Homo Sapiens; identical to SEQ ID NO: 605495

SEQ ID NO: 665121 - RNA, 64 nt, Homo Sapiens; identical to SEQ ID NO: 605496

SEQ ID NO: 665122 - RNA, 64 nt, Homo Sapiens; identical to SEQ ID NO: 605497

SEQ ID NO: 665123 - RNA, 64 nt, Homo Sapiens; identical to SEQ ID NO: 605498

SEQ ID NO: 665124 - RNA, 64 nt, Homo Sapiens; identical to SEQ ID NO: 605499

SEQ ID NO: 665125 - RNA, 64 nt, Homo Sapiens; identical to SEQ ID NO: 605500

SEQ ID NO: 665126 - RNA, 64 nt, Homo Sapiens; identical to SEQ ID NO: 605501

SEQ ID NO: 665127 - RNA, 64 nt, Homo Sapiens; identical to SEQ ID NO: 605502

SEQ ID NO: 665128 - RNA, 64 nt, Homo Sapiens; identical to SEQ ID NO: 605503

SEQ ID NO: 665129 - RNA, 64 nt, Homo Sapiens; identical to SEQ ID NO: 605504

SEQ ID NO: 665130 - RNA, 64 nt, Homo Sapiens; identical to SEQ ID NO: 605505

SEQ ID NO: 665131 - RNA, 64 nt, Homo Sapiens; identical to SEQ ID NO: 605506

SEQ ID NO: 665132 - RNA, 64 nt, Homo Sapiens; identical to SEQ ID NO: 605507

SEQ ID NO: 665133 - RNA, 64 nt, Homo Sapiens; identical to SEQ ID NO: 605508

SEQ ID NO: 665134 - RNA, 64 nt, Homo Sapiens; identical to SEQ ID NO: 605509

SEQ ID NO: 665135 - RNA, 64 nt, Homo Sapiens; identical to SEQ ID NO: 605510

SEQ ID NO: 665136 - RNA, 64 nt, Homo Sapiens
uauaauaaaugacuaggguucacuuucugggacugauguuuaauuguaacacagauacaacagg

SEQ ID NO: 665137 - RNA, 64 nt, Homo Sapiens
uaauugaaggcauuguuuuguuagaugcaguaaugauguuuaccagagauuauuguuuccuaug

SEQ ID NO: 665138 - RNA, 64 nt, Homo Sapiens
aauuaucuugacauaagcgucuuuuucaaauaaugauguuuaaauaaagggacauuuuccugua

SEQ ID NO: 665139 - RNA, 64 nt, Homo Sapiens
gggaugagcauuaaagcugcacuaaugcugacuggauguuuaauauuaccuuauguaaagcaga

SEQ ID NO: 665140 - RNA, 64 nt, Homo Sapiens
uguuuacaagacugcuuuuaccuuaaacuuuguagauguuuacaucuuuuuguuguguuuuaag

SEQ ID NO: 665141 - RNA, 64 nt, Homo Sapiens
ucugugaucaaccauuuuaacuuucaucucuagggauguuuaacauuuauaauugcaaaauaaa

SEQ ID NO: 665142 - RNA, 64 nt, Homo Sapiens
uugcuuuagucauuuaaaaauuguacaaugaauugauguuuagucuauuguguaugaaagaugu

SEQ ID NO: 665143 - RNA, 64 nt, Homo Sapiens
uauuuuuaaugcaguaauauauuaaaaaaauauagauguuuauuguauuuugcuauaguugcua

SEQ ID NO: 665144 - RNA, 64 nt, Homo Sapiens
ugagaccaccuuggauuuuuauuuuugccauuuagauguuuauacuuauuuagcuuuuauaaaa

SEQ ID NO: 665145 - RNA, 64 nt, Homo Sapiens
cucuuaaagucuaauuuuaggauggaugaauucagauguuuaccagaguguguauuuuacauaa

SEQ ID NO: 665146 - RNA, 64 nt, Homo Sapiens
auggggcugauguguaaagcuguucaaguuauuugauguuuacaccucagggaaagucuugugu

SEQ ID NO: 665147 - RNA, 64 nt, Homo Sapiens
uuuuguguuugaaguaucugugcaugggaucguugauguuuaucagaacuguucacuuucagaa

SEQ ID NO: 665148 - RNA, 64 nt, Homo Sapiens
uauguuuggguccuaaacagcuguauguguaagagauguuuaaaaauauuuguaaacugaaauu

SEQ ID NO: 665149 - RNA, 64 nt, Homo Sapiens
aacaguauucugcaugguucaggaaggcagaaacgauguuuagcaaaacuaccaagagaacacg

SEQ ID NO: 665150 - RNA, 64 nt, Homo Sapiens
uagguacuucacauugcaaaaucuucucgauguagauguuuaugaccuuuaacagacuuguuua

SEQ ID NO: 665151 - RNA, 64 nt, Homo Sapiens
uccacaccgagcccaguguggugcagguaccugcgauguuuacgcagcugcuuguuggauucca

SEQ ID NO: 665152 - RNA, 64 nt, Homo Sapiens; identical to SEQ ID NO: 155809

SEQ ID NO: 665153 - RNA, 64 nt, Homo Sapiens; identical to SEQ ID NO: 155810

SEQ ID NO: 665154 - RNA, 64 nt, Homo Sapiens; identical to SEQ ID NO: 155811

SEQ ID NO: 665155 - RNA, 64 nt, Homo Sapiens; identical to SEQ ID NO: 155812

SEQ ID NO: 665156 - RNA, 64 nt, Homo Sapiens; identical to SEQ ID NO: 155813

SEQ ID NO: 665157 - RNA, 64 nt, Homo Sapiens; identical to SEQ ID NO: 155814

SEQ ID NO: 665158 - RNA, 64 nt, Homo Sapiens; identical to SEQ ID NO: 155815

SEQ ID NO: 665159 - RNA, 64 nt, Homo Sapiens; identical to SEQ ID NO: 155816

SEQ ID NO: 665160 - RNA, 64 nt, Homo Sapiens; identical to SEQ ID NO: 155817

SEQ ID NO: 665161 - RNA, 64 nt, Homo Sapiens; identical to SEQ ID NO: 155817

SEQ ID NO: 665162 - RNA, 64 nt, Homo Sapiens; identical to SEQ ID NO: 155819

SEQ ID NO: 665163 - RNA, 64 nt, Homo Sapiens; identical to SEQ ID NO: 155820

SEQ ID NO: 665164 - RNA, 64 nt, Homo Sapiens; identical to SEQ ID NO: 155821

SEQ ID NO: 665165 - RNA, 64 nt, Homo Sapiens
caagcuccuugaaaguaggaccuuugugagccacgccuuucauucuucaacagugccuugcaug

SEQ ID NO: 665166 - RNA, 64 nt, Homo Sapiens
agcccuugcaguauuucugccucccuuucuuucugccuuucaccccacuaaauguauguuauug

SEQ ID NO: 665167 - RNA, 64 nt, Homo Sapiens
ucaaggcucuuauucaauaccacguuccgaguuggccuuucaucuucuuugagacuggcccugc

SEQ ID NO: 665168 - RNA, 64 nt, Homo Sapiens
gugagcugggccuacucucagcugccuaucuucugccuuucacuugcauccaacuccuggggcu

SEQ ID NO: 665169 - RNA, 64 nt, Homo Sapiens
auaauguucccucaaauagcacggggaagcaacugccuuucaaggguaauugaggcugaaugaa

SEQ ID NO: 665170 - RNA, 64 nt, Homo Sapiens
ggucauucaaucuguuuuuuuaaauguuauuuuugccuuucaauguaaucaauuggauuaacaa

SEQ ID NO: 665171 - RNA, 64 nt, Homo Sapiens
uguaggcaggugggcucugccagcaccggcuguggccuuucaggugcagaccucagagaggucc

SEQ ID NO: 665172 - RNA, 64 nt, Homo Sapiens
ucuagaucccccuccccugcguuauccauguauugccuuucagcagugggaguggggcgugcgc

SEQ ID NO: 665173 - RNA, 53 nt, Homo Sapiens; identical to SEQ ID NO: 588180

SEQ ID NO: 665174 - RNA, 64 nt, Homo Sapiens; identical to SEQ ID NO: 588181

SEQ ID NO: 665175 - RNA, 52 nt, Homo Sapiens; identical to SEQ ID NO: 588182

SEQ ID NO: 665176 - RNA, 64 nt, Homo Sapiens; identical to SEQ ID NO: 588183

SEQ ID NO: 665177 - RNA, 64 nt, Homo Sapiens; identical to SEQ ID NO: 588184

SEQ ID NO: 665178 - RNA, 64 nt, Homo Sapiens; identical to SEQ ID NO: 588185

SEQ ID NO: 665179 - RNA, 64 nt, Homo Sapiens; identical to SEQ ID NO: 588186

SEQ ID NO: 665180 - RNA, 64 nt, Homo Sapiens; identical to SEQ ID NO: 588187

SEQ ID NO: 665181 - RNA, 64 nt, Homo Sapiens; identical to SEQ ID NO: 588188

SEQ ID NO: 665182 - RNA, 64 nt, Homo Sapiens; identical to SEQ ID NO: 588189

SEQ ID NO: 665183 - RNA, 64 nt, Homo Sapiens; identical to SEQ ID NO: 588190

SEQ ID NO: 665184 - RNA, 64 nt, Homo Sapiens; identical to SEQ ID NO: 588191

SEQ ID NO: 665185 - RNA, 64 nt, Homo Sapiens; identical to SEQ ID NO: 588192

SEQ ID NO: 665186 - RNA, 64 nt, Homo Sapiens; identical to SEQ ID NO: 588193

SEQ ID NO: 665187 - RNA, 64 nt, Homo Sapiens; identical to SEQ ID NO: 588194

SEQ ID NO: 665188 - RNA, 64 nt, Homo Sapiens; identical to SEQ ID NO: 588195

SEQ ID NO: 665189 - RNA, 64 nt, Homo Sapiens; identical to SEQ ID NO: 588196

SEQ ID NO: 665190 - RNA, 64 nt, Homo Sapiens; identical to SEQ ID NO: 588197

SEQ ID NO: 665191 - RNA, 64 nt, Homo Sapiens; identical to SEQ ID NO: 588198

SEQ ID NO: 665192 - RNA, 64 nt, Homo Sapiens; identical to SEQ ID NO: 588199

SEQ ID NO: 665193 - RNA, 64 nt, Homo Sapiens; identical to SEQ ID NO: 588200

SEQ ID NO: 665194 - RNA, 64 nt, Homo Sapiens; identical to SEQ ID NO: 588201

SEQ ID NO: 665195 - RNA, 64 nt, Homo Sapiens; identical to SEQ ID NO: 588202

SEQ ID NO: 665196 - RNA, 64 nt, Homo Sapiens; identical to SEQ ID NO: 588203

SEQ ID NO: 665197 - RNA, 64 nt, Homo Sapiens; identical to SEQ ID NO: 588204

SEQ ID NO: 665198 - RNA, 64 nt, Homo Sapiens; identical to SEQ ID NO: 588205

SEQ ID NO: 665199 - RNA, 64 nt, Homo Sapiens; identical to SEQ ID NO: 588206

SEQ ID NO: 665200 - RNA, 64 nt, Homo Sapiens; identical to SEQ ID NO: 588207

SEQ ID NO: 665201 - RNA, 64 nt, Homo Sapiens; identical to SEQ ID NO: 588208

SEQ ID NO: 665202 - RNA, 64 nt, Homo Sapiens; identical to SEQ ID NO: 588209

SEQ ID NO: 665203 - RNA, 64 nt, Homo Sapiens; identical to SEQ ID NO: 588210

SEQ ID NO: 665204 - RNA, 64 nt, Homo Sapiens; identical to SEQ ID NO: 588211

SEQ ID NO: 665205 - RNA, 64 nt, Homo Sapiens; identical to SEQ ID NO: 588212

SEQ ID NO: 665206 - RNA, 64 nt, Homo Sapiens; identical to SEQ ID NO: 588213

SEQ ID NO: 665207 - RNA, 64 nt, Homo Sapiens; identical to SEQ ID NO: 588214

SEQ ID NO: 665208 - RNA, 64 nt, Homo Sapiens; identical to SEQ ID NO: 588215

SEQ ID NO: 665209 - RNA, 64 nt, Homo Sapiens; identical to SEQ ID NO: 588216

SEQ ID NO: 665210 - RNA, 64 nt, Homo Sapiens; identical to SEQ ID NO: 588217

SEQ ID NO: 665211 - RNA, 64 nt, Homo Sapiens; identical to SEQ ID NO: 588218

SEQ ID NO: 665212 - RNA, 64 nt, Homo Sapiens; identical to SEQ ID NO: 588219

SEQ ID NO: 665213 - RNA, 64 nt, Homo Sapiens; identical to SEQ ID NO: 588220

SEQ ID NO: 665214 - RNA, 64 nt, Homo Sapiens; identical to SEQ ID NO: 588221

SEQ ID NO: 665215 - RNA, 64 nt, Homo Sapiens; identical to SEQ ID NO: 588222

SEQ ID NO: 665216 - RNA, 64 nt, Homo Sapiens; identical to SEQ ID NO: 588223

SEQ ID NO: 665217 - RNA, 64 nt, Homo Sapiens; identical to SEQ ID NO: 588224

SEQ ID NO: 665218 - RNA, 64 nt, Homo Sapiens; identical to SEQ ID NO: 588225

SEQ ID NO: 665219 - RNA, 64 nt, Homo Sapiens; identical to SEQ ID NO: 588226

SEQ ID NO: 665220 - RNA, 64 nt, Homo Sapiens; identical to SEQ ID NO: 588227

SEQ ID NO: 665221 - RNA, 64 nt, Homo Sapiens; identical to SEQ ID NO: 588228

SEQ ID NO: 665222 - RNA, 64 nt, Homo Sapiens; identical to SEQ ID NO: 588229

SEQ ID NO: 665223 - RNA, 64 nt, Homo Sapiens; identical to SEQ ID NO: 588230

SEQ ID NO: 665224 - RNA, 64 nt, Homo Sapiens; identical to SEQ ID NO: 588231

SEQ ID NO: 665225 - RNA, 64 nt, Homo Sapiens; identical to SEQ ID NO: 588232

SEQ ID NO: 665226 - RNA, 64 nt, Homo Sapiens; identical to SEQ ID NO: 588233

SEQ ID NO: 665227 - RNA, 64 nt, Homo Sapiens; identical to SEQ ID NO: 588234

SEQ ID NO: 665228 - RNA, 64 nt, Homo Sapiens; identical to SEQ ID NO: 588235

SEQ ID NO: 665229 - RNA, 64 nt, Homo Sapiens; identical to SEQ ID NO: 588236

SEQ ID NO: 665230 - RNA, 64 nt, Homo Sapiens; identical to SEQ ID NO: 588237

SEQ ID NO: 665231 - RNA, 64 nt, Homo Sapiens; identical to SEQ ID NO: 588238

SEQ ID NO: 665232 - RNA, 64 nt, Homo Sapiens
aacauaagcaacucaacaauauuaguugcauuccuuuauagacauaccaugucaaagacguuuu

SEQ ID NO: 665233 - RNA, 64 nt, Homo Sapiens
uugagaguuuuuuagugcaaucugggccaguauuuuuauagauuaugauuaugugguaauuuau

SEQ ID NO: 665234 - RNA, 64 nt, Homo Sapiens
uguaaacucucauaacugaauugcuuaaguauaauuuauagaauuucagugcaguucauucuua

SEQ ID NO: 665235 - RNA, 64 nt, Homo Sapiens
uaugcuuguagcaaauugauguucuaacuguaguuuuauagaaaguauuaaugcuuuuauguau

SEQ ID NO: 665236 - RNA, 64 nt, Homo Sapiens
gcacaucauucuuuaaggcagaaaaugcuacaguuuuauagauucauuguguugcuacccaaga

SEQ ID NO: 665237 - RNA, 64 nt, Homo Sapiens
aucuuguuuuucaaaaaagaauggcuaaaacguuuuuauagagacagcuagcagaauaauuaca

SEQ ID NO: 665238 - RNA, 64 nt, Homo Sapiens
ugggguuuuacuaugcugucaauuuuuaaaauuuuuuauagagggugcaccacaacucucagcu

SEQ ID NO: 665239 - RNA, 64 nt, Homo Sapiens
aagaccaguuuuaccuagauagaagauaguagacuuuauagagaauacuuuuugaaacuagacc

SEQ ID NO: 665240 - RNA, 64 nt, Homo Sapiens
ccauguauugauguaguuaguccacauuuaaauuuuuauagaauuauauaguuuuugaaaaaua

SEQ ID NO: 665241 - RNA, 64 nt, Homo Sapiens
uagucauucuaaaaaacaccuaauuauuaaaacauuuauagagugccuacuguaugcaugaguu

SEQ ID NO: 665242 - RNA, 64 nt, Homo Sapiens
uuuugguacaguguacauuguacaaaguuauuuauuuauagaaagagggaguauuacuuuuaug

SEQ ID NO: 665243 - RNA, 64 nt, Homo Sapiens
cuacaaccacauuuguucacacgcauggcuggaauuuauagagggaaauaguucuggugccuua

SEQ ID NO: 665244 - RNA, 64 nt, Homo Sapiens
acuaugagguacuguugugaguauagcuuagcuauuuauagaagcacguucuuauagcuguaaa

SEQ ID NO: 665245 - RNA, 64 nt, Homo Sapiens
uuuauuucauauccggugugugauuucaauucucuuuauagaguuggacuuuauuuucaucaua

SEQ ID NO: 665246 - RNA, 64 nt, Homo Sapiens
aucucacacauuuguaauggcuuuaaauauguguuuuauagaauuuuuauaugaggauagggac

SEQ ID NO: 665247 - RNA, 64 nt, Homo Sapiens
uauuaaauuuugauaaaguaaacuuugggugaguuuuauagauuacucuuuguaaaacaaaagc

SEQ ID NO: 665248 - RNA, 64 nt, Homo Sapiens
auguuugcaaaauaagacuggaguagcaaaaaccuuuauagauggcuugggcuaccaaaacuug

SEQ ID NO: 665249 - RNA, 64 nt, Homo Sapiens
cccucuuuuuggcacaaguuacuauauuuucuguuuuauagauuuuucuuuccuuaagggggaa

SEQ ID NO: 665250 - RNA, 64 nt, Homo Sapiens
uaagugcuucuuguugcugggugagaaauacuacuuuauagacaguuuugguuuucuguuugca

SEQ ID NO: 665251 - RNA, 64 nt, Homo Sapiens
ugaacuauauauaaacuguacaaucuguaaaguuuuuauagaauaaauauucagcugugaaaac

SEQ ID NO: 665252 - RNA, 64 nt, Homo Sapiens
uuccuccaaauccauacagugaggaaucagaguguuuauagauauaugaguugaaugcaauuuu

SEQ ID NO: 665253 - RNA, 64 nt, Homo Sapiens
agaauacaucauuucucacagucuuaaguugauauuuauagaaaugaauaccuuugugaaccua

SEQ ID NO: 665254 - RNA, 64 nt, Homo Sapiens
ucaaaauugagaaagaaguaaacaucuauaaauauuuauagauuuuuuuauuugucaaauaaag

SEQ ID NO: 665255 - RNA, 64 nt, Homo Sapiens
uuuacucuggaggcacaagcuugcaagaaguugguuuauagacgaucuguguucagggaaugau

SEQ ID NO: 665256 - RNA, 64 nt, Homo Sapiens
ggaucaugaaaaggucugguugcuuugagcuucuuuuauagaagucuggauugaccacccacaa

SEQ ID NO: 665257 - RNA, 64 nt, Homo Sapiens
uugcaggaauguauacauauuaauuaaaugugucuuuauagauauguuagaauuucauaagcaa

SEQ ID NO: 665258 - RNA, 64 nt, Homo Sapiens
gauuuuacuagaaagaauuucuuuuaacagauuguuuauagaguuccauacauacuauaaggca

SEQ ID NO: 665259 - RNA, 64 nt, Homo Sapiens
uacaguuuugcuuuaaccacuucucuugaauuccuuuauagauguugucauccuuuuccugcac

SEQ ID NO: 665260 - RNA, 64 nt, Homo Sapiens
uguggaaagcuugcuguaaugagucuuauuuuuauuuauagaaagaaagcaauuuauaacauau

SEQ ID NO: 665261 - RNA, 64 nt, Homo Sapiens
gguaaaugugaguuaaauauuuauagacagauaauuuauagacaguuaaguaaaaauggauaau

SEQ ID NO: 665262 - RNA, 64 nt, Homo Sapiens
gauaauuuauagacagguaaguaaaaauggauaauuuauagacauuaaauuuauagacaguuaa

SEQ ID NO: 665263 - RNA, 64 nt, Homo Sapiens
guuaaguaaaaauggauaauuauagacaguuaaauuuauagacauuuaaaauuaauggauaauu

SEQ ID NO: 665264 - RNA, 64 nt, Homo Sapiens
guuaaauuuauagacaguuaaaauuaauggauaauuuauagacacuacuccagccaacauuuua

SEQ ID NO: 665265 - RNA, 64 nt, Homo Sapiens
gcacacacucccuaauugucggacccauaguuuauuuauagagaucuucaaugaccucccauuu

SEQ ID NO: 665266 - RNA, 64 nt, Homo Sapiens
gugaggcugugcauacguacucaggacacauacauuuauagaguucauuauuaagcucugaaau

SEQ ID NO: 665267 - RNA, 64 nt, Homo Sapiens
uguuuuuuaaaaauccuaaguuaaacguuguauuuuuauagacaaaaugcauuuccaaacugcc

SEQ ID NO: 665268 - RNA, 64 nt, Homo Sapiens
ugaaguuaacauucuuauuuaauguacaguguauuuuauagaauuauauuuagaacagucuuaa

SEQ ID NO: 665269 - RNA, 64 nt, Homo Sapiens
uauaaggcaguaucacccauccaaaagaaaggucuuuauagaccugcacagucacuagauuaau

SEQ ID NO: 665270 - RNA, 64 nt, Homo Sapiens
gccaucgaaaagugauuuaaauaagcagguuaucuuuauagauuuuaaagaaaacuagaaaguu

SEQ ID NO: 665271 - RNA, 64 nt, Homo Sapiens
cuuuguaaauuguaaaaugauacaaaauuuaaaguuuauagagccaguuacaaaauccuauuag

SEQ ID NO: 665272 - RNA, 64 nt, Homo Sapiens
auagagccaguuacaaaauccuauuagucauauauuuauagauuguguucacagcaaucauuua

SEQ ID NO: 665273 - RNA, 64 nt, Homo Sapiens
auuuuuguacauaagagagaaagagagagaaaaauuuauagaaguuuuguacaaaugguuuaaa

SEQ ID NO: 665274 - RNA, 64 nt, Homo Sapiens
ccaccaguuguacuucagcaccaaugugucuuacuuuauagaaauguuguuaauguauuaauga

SEQ ID NO: 665275 - RNA, 64 nt, Homo Sapiens
auuagcuuaugaacuguugcuucuacuuagcccuuuuauagaaacucugagcuguuacuuuggg

SEQ ID NO: 665276 - RNA, 64 nt, Homo Sapiens
guuaucagcuuccugucucugaaguuuggaucauuuuauagauccacgcaauagagagcuuccu

SEQ ID NO: 665277 - RNA, 64 nt, Homo Sapiens
aagucccuuuacauaaauaguauuugguaauacauuuauagaugagaguuauaugaaaaggcua

SEQ ID NO: 665278 - RNA, 64 nt, Homo Sapiens
ucauaaucaguuuucagugugaauucacugaauguuuauagacaaaagaaaauacacacuaaaa

SEQ ID NO: 665279 - RNA, 64 nt, Homo Sapiens
aaggguuuugucaaauguuuuuuagaccauaacuuuuauagagagccuuauaaaacaacauaaa

SEQ ID NO: 665280 - RNA, 64 nt, Homo Sapiens
guuuagccuucauauuuuaauggcauucuguagguuuauagaaguagaaguucuaucuaagaaa

SEQ ID NO: 665281 - RNA, 64 nt, Homo Sapiens
gguuguacagcuuucaaaauauaauuaauuuuguuuuauagauaugauaggcaacagacugaaa

SEQ ID NO: 665282 - RNA, 64 nt, Homo Sapiens
ugagauugccaaucacgguuaaacacaaaguguuuuuauagaaugaagaaacagucuuuaacag

SEQ ID NO: 665283 - RNA, 64 nt, Homo Sapiens
uacaguauuaaagucagugguuauaacuauaaacuuuauagaaggcuuauguggcauacaauau

SEQ ID NO: 665284 - RNA, 64 nt, Homo Sapiens
uaaucuucucuguuaacagcaucaaaauacuauauuuauagaaguuucuaaaugcucaaauguu

SEQ ID NO: 665285 - RNA, 64 nt, Homo Sapiens
aaguuagcuguuaacuccuugugagcugcuucucuuuauagagcucuuggguauguagaacugu

SEQ ID NO: 665286 - RNA, 64 nt, Homo Sapiens
auauucuuucacaaggcauccauacuguuuaauauuuauagaguucauagaaauacaucaauaa

SEQ ID NO: 665287 - RNA, 64 nt, Homo Sapiens
aaugcuuugaaaauguuuuuaagugcuaugcauauuuauagaguuauuauaguuauucaaaucc

SEQ ID NO: 665288 - RNA, 64 nt, Homo Sapiens
uagugaguguauguccgucugagcaaguaaaauaguaaagcacaaugaugacuguagaacauuu

SEQ ID NO: 665289 - RNA, 64 nt, Homo Sapiens
caaagaaucuagugugcucauuaacguaagguuaguaaagcauaaaugaaaccaguggaugugc

SEQ ID NO: 665290 - RNA, 64 nt, Homo Sapiens
aaaguaaacaaugugcuauuaaaaugauaguaccguaaagcauuuaagugcugauugugauuuu

SEQ ID NO: 665291 - RNA, 64 nt, Homo Sapiens
acagcaucaauauauauguguggaucuaaaugauguaaagcaaaucuuuccuuuuuuggacacu

SEQ ID NO: 665292 - RNA, 64 nt, Homo Sapiens
aguacuccaaccuuccagaaaguaacuuuguuugguaaagcaccaaaaagagaaaaggagagaa

SEQ ID NO: 665293 - RNA, 64 nt, Homo Sapiens
ugaauuuauagugaagcaaaacuuggucucaguuguaaagcaacaccuaaauaauuagaauauu

SEQ ID NO: 665294 - RNA, 64 nt, Homo Sapiens
gccaggcuuuggcauaucuguucuaaaucuggggguaaagcaagaaccugaacauuuuggagcc

SEQ ID NO: 665295 - RNA, 64 nt, Homo Sapiens
cagggaaacauugaagaggcaguucgcuuguaucguaaagcauuagaaguaugugaggguggug

SEQ ID NO: 665296 - RNA, 64 nt, Homo Sapiens; identical to SEQ ID NO: 322895

SEQ ID NO: 665297 - RNA, 64 nt, Homo Sapiens; identical to SEQ ID NO: 322896

SEQ ID NO: 665298 - RNA, 64 nt, Homo Sapiens; identical to SEQ ID NO: 322897

SEQ ID NO: 665299 - RNA, 64 nt, Homo Sapiens; identical to SEQ ID NO: 322898

SEQ ID NO: 665300 - RNA, 64 nt, Homo Sapiens; identical to SEQ ID NO: 322899

SEQ ID NO: 665301 - RNA, 64 nt, Homo Sapiens; identical to SEQ ID NO: 322900

SEQ ID NO: 665302 - RNA, 64 nt, Homo Sapiens; identical to SEQ ID NO: 322901

SEQ ID NO: 665303 - RNA, 64 nt, Homo Sapiens; identical to SEQ ID NO: 322902

SEQ ID NO: 665304 - RNA, 64 nt, Homo Sapiens; identical to SEQ ID NO: 322903

SEQ ID NO: 665305 - RNA, 64 nt, Homo Sapiens; identical to SEQ ID NO: 322904

SEQ ID NO: 665306 - RNA, 64 nt, Homo Sapiens; identical to SEQ ID NO: 322905

SEQ ID NO: 665307 - RNA, 64 nt, Homo Sapiens; identical to SEQ ID NO: 322906

SEQ ID NO: 665308 - RNA, 64 nt, Homo Sapiens; identical to SEQ ID NO: 322907

SEQ ID NO: 665309 - RNA, 64 nt, Homo Sapiens; identical to SEQ ID NO: 322908

SEQ ID NO: 665310 - RNA, 64 nt, Homo Sapiens; identical to SEQ ID NO: 322909

SEQ ID NO: 665311 - RNA, 64 nt, Homo Sapiens; identical to SEQ ID NO: 322910

SEQ ID NO: 665312 - RNA, 64 nt, Homo Sapiens; identical to SEQ ID NO: 322911

SEQ ID NO: 665313 - RNA, 64 nt, Homo Sapiens; identical to SEQ ID NO: 322912

SEQ ID NO: 665314 - RNA, 64 nt, Homo Sapiens; identical to SEQ ID NO: 322913

SEQ ID NO: 665315 - RNA, 64 nt, Homo Sapiens; identical to SEQ ID NO: 322914

SEQ ID NO: 665316 - RNA, 64 nt, Homo Sapiens; identical to SEQ ID NO: 322915

SEQ ID NO: 665317 - RNA, 64 nt, Homo Sapiens; identical to SEQ ID NO: 322916

SEQ ID NO: 665318 - RNA, 64 nt, Homo Sapiens; identical to SEQ ID NO: 322917

SEQ ID NO: 665319 - RNA, 64 nt, Homo Sapiens; identical to SEQ ID NO: 322918

SEQ ID NO: 665320 - RNA, 64 nt, Homo Sapiens; identical to SEQ ID NO: 322919

SEQ ID NO: 665321 - RNA, 64 nt, Homo Sapiens; identical to SEQ ID NO: 322920

SEQ ID NO: 665322 - RNA, 64 nt, Homo Sapiens; identical to SEQ ID NO: 322921

SEQ ID NO: 665323 - RNA, 64 nt, Homo Sapiens; identical to SEQ ID NO: 322922

SEQ ID NO: 665324 - RNA, 64 nt, Homo Sapiens; identical to SEQ ID NO: 322923

SEQ ID NO: 665325 - RNA, 64 nt, Homo Sapiens; identical to SEQ ID NO: 322924

SEQ ID NO: 665326 - RNA, 64 nt, Homo Sapiens; identical to SEQ ID NO: 322925

SEQ ID NO: 665327 - RNA, 64 nt, Homo Sapiens; identical to SEQ ID NO: 322926

SEQ ID NO: 665328 - RNA, 64 nt, Homo Sapiens; identical to SEQ ID NO: 322927

SEQ ID NO: 665329 - RNA, 64 nt, Homo Sapiens; identical to SEQ ID NO: 322928

SEQ ID NO: 665330 - RNA, 64 nt, Homo Sapiens; identical to SEQ ID NO: 322929

SEQ ID NO: 665331 - RNA, 64 nt, Homo Sapiens; identical to SEQ ID NO: 322930

SEQ ID NO: 665332 - RNA, 64 nt, Homo Sapiens; identical to SEQ ID NO: 322931

SEQ ID NO: 665333 - RNA, 64 nt, Homo Sapiens; identical to SEQ ID NO: 322932

SEQ ID NO: 665334 - RNA, 51 nt, Homo Sapiens; identical to SEQ ID NO: 201885

SEQ ID NO: 665335 - RNA, 64 nt, Homo Sapiens; identical to SEQ ID NO: 322934

SEQ ID NO: 665336 - RNA, 64 nt, Homo Sapiens; identical to SEQ ID NO: 322935

SEQ ID NO: 665337 - RNA, 64 nt, Homo Sapiens; identical to SEQ ID NO: 322936

SEQ ID NO: 665338 - RNA, 64 nt, Homo Sapiens; identical to SEQ ID NO: 322937

SEQ ID NO: 665339 - RNA, 64 nt, Homo Sapiens; identical to SEQ ID NO: 322938

SEQ ID NO: 665340 - RNA, 64 nt, Homo Sapiens; identical to SEQ ID NO: 322939

SEQ ID NO: 665341 - RNA, 64 nt, Homo Sapiens; identical to SEQ ID NO: 322940

SEQ ID NO: 665342 - RNA, 64 nt, Homo Sapiens; identical to SEQ ID NO: 322941

SEQ ID NO: 665343 - RNA, 64 nt, Homo Sapiens; identical to SEQ ID NO: 322942

SEQ ID NO: 665344 - RNA, 64 nt, Homo Sapiens; identical to SEQ ID NO: 322943

SEQ ID NO: 665345 - RNA, 64 nt, Homo Sapiens; identical to SEQ ID NO: 322944

SEQ ID NO: 665346 - RNA, 64 nt, Homo Sapiens; identical to SEQ ID NO: 322945

SEQ ID NO: 665347 - RNA, 64 nt, Homo Sapiens; identical to SEQ ID NO: 322946

SEQ ID NO: 665348 - RNA, 64 nt, Homo Sapiens; identical to SEQ ID NO: 322947

SEQ ID NO: 665349 - RNA, 64 nt, Homo Sapiens; identical to SEQ ID NO: 322948

SEQ ID NO: 665350 - RNA, 64 nt, Homo Sapiens; identical to SEQ ID NO: 322949

SEQ ID NO: 665351 - RNA, 64 nt, Homo Sapiens; identical to SEQ ID NO: 322950

SEQ ID NO: 665352 - RNA, 64 nt, Homo Sapiens; identical to SEQ ID NO: 322951

SEQ ID NO: 665353 - RNA, 64 nt, Homo Sapiens; identical to SEQ ID NO: 322952

SEQ ID NO: 665354 - RNA, 64 nt, Homo Sapiens; identical to SEQ ID NO: 322953

SEQ ID NO: 665355 - RNA, 64 nt, Homo Sapiens; identical to SEQ ID NO: 322954

SEQ ID NO: 665356 - RNA, 64 nt, Homo Sapiens; identical to SEQ ID NO: 322955

SEQ ID NO: 665357 - RNA, 64 nt, Homo Sapiens; identical to SEQ ID NO: 322956

SEQ ID NO: 665358 - RNA, 64 nt, Homo Sapiens; identical to SEQ ID NO: 322957

SEQ ID NO: 665359 - RNA, 64 nt, Homo Sapiens; identical to SEQ ID NO: 322958

SEQ ID NO: 665360 - RNA, 64 nt, Homo Sapiens; identical to SEQ ID NO: 322959

SEQ ID NO: 665361 - RNA, 64 nt, Homo Sapiens; identical to SEQ ID NO: 322960

SEQ ID NO: 665362 - RNA, 64 nt, Homo Sapiens; identical to SEQ ID NO: 322961

SEQ ID NO: 665363 - RNA, 64 nt, Homo Sapiens; identical to SEQ ID NO: 322962

SEQ ID NO: 665364 - RNA, 64 nt, Homo Sapiens; identical to SEQ ID NO: 322963

SEQ ID NO: 665365 - RNA, 64 nt, Homo Sapiens; identical to SEQ ID NO: 322964

SEQ ID NO: 665366 - RNA, 64 nt, Homo Sapiens; identical to SEQ ID NO: 322965

SEQ ID NO: 665367 - RNA, 64 nt, Homo Sapiens; identical to SEQ ID NO: 322966

SEQ ID NO: 665368 - RNA, 64 nt, Homo Sapiens; identical to SEQ ID NO: 322967

SEQ ID NO: 665369 - RNA, 64 nt, Homo Sapiens; identical to SEQ ID NO: 322968

SEQ ID NO: 665370 - RNA, 64 nt, Homo Sapiens; identical to SEQ ID NO: 322969

SEQ ID NO: 665371 - RNA, 64 nt, Homo Sapiens; identical to SEQ ID NO: 322970

SEQ ID NO: 665372 - RNA, 64 nt, Homo Sapiens; identical to SEQ ID NO: 322971

SEQ ID NO: 665373 - RNA, 54 nt, Homo Sapiens; identical to SEQ ID NO: 201924

SEQ ID NO: 665374 - RNA, 64 nt, Homo Sapiens; identical to SEQ ID NO: 322973

SEQ ID NO: 665375 - RNA, 64 nt, Homo Sapiens; identical to SEQ ID NO: 322974

SEQ ID NO: 665376 - RNA, 64 nt, Homo Sapiens; identical to SEQ ID NO: 322975

SEQ ID NO: 665377 - RNA, 64 nt, Homo Sapiens; identical to SEQ ID NO: 322976

SEQ ID NO: 665378 - RNA, 64 nt, Homo Sapiens; identical to SEQ ID NO: 322977

SEQ ID NO: 665379 - RNA, 64 nt, Homo Sapiens; identical to SEQ ID NO: 322978

SEQ ID NO: 665380 - RNA, 64 nt, Homo Sapiens; identical to SEQ ID NO: 322979

SEQ ID NO: 665381 - RNA, 64 nt, Homo Sapiens; identical to SEQ ID NO: 322980

SEQ ID NO: 665382 - RNA, 64 nt, Homo Sapiens; identical to SEQ ID NO: 322981

SEQ ID NO: 665383 - RNA, 64 nt, Homo Sapiens; identical to SEQ ID NO: 322982

SEQ ID NO: 665384 - RNA, 64 nt, Homo Sapiens; identical to SEQ ID NO: 322983

SEQ ID NO: 665385 - RNA, 64 nt, Homo Sapiens; identical to SEQ ID NO: 322984

SEQ ID NO: 665386 - RNA, 64 nt, Homo Sapiens; identical to SEQ ID NO: 322985

SEQ ID NO: 665387 - RNA, 64 nt, Homo Sapiens; identical to SEQ ID NO: 322986

SEQ ID NO: 665388 - RNA, 64 nt, Homo Sapiens; identical to SEQ ID NO: 322987

SEQ ID NO: 665389 - RNA, 64 nt, Homo Sapiens; identical to SEQ ID NO: 322988

SEQ ID NO: 665390 - RNA, 64 nt, Homo Sapiens; identical to SEQ ID NO: 322989

SEQ ID NO: 665391 - RNA, 64 nt, Homo Sapiens; identical to SEQ ID NO: 322990

SEQ ID NO: 665392 - RNA, 64 nt, Homo Sapiens; identical to SEQ ID NO: 322991

SEQ ID NO: 665393 - RNA, 64 nt, Homo Sapiens; identical to SEQ ID NO: 322992

SEQ ID NO: 665394 - RNA, 64 nt, Homo Sapiens; identical to SEQ ID NO: 322993

SEQ ID NO: 665395 - RNA, 64 nt, Homo Sapiens; identical to SEQ ID NO: 322994

SEQ ID NO: 665396 - RNA, 64 nt, Homo Sapiens
agagauagcacagauggaccuuuuagguuucucuugcagauauguuaacacucaaauauuaaca

SEQ ID NO: 665397 - RNA, 64 nt, Homo Sapiens
uuuauuauaauucuccagaaaggccugcuucacuugcagauaaguugagagauuacagaagagg

SEQ ID NO: 665398 - RNA, 64 nt, Homo Sapiens
cagucccaguccuaugguaaugacuuaggaggaaugcagauaaaaguaccuuguaagauaaaua

SEQ ID NO: 665399 - RNA, 64 nt, Homo Sapiens
cguuggaaauagaugagaaauggaugcagaauaaugcagauagugaucccauguuuguuaauug

SEQ ID NO: 665400 - RNA, 64 nt, Homo Sapiens
ucauguauauuaaaauuggcuaauauuaaguuauugcagauaccacauucauuaugcugcagua

SEQ ID NO: 665401 - RNA, 64 nt, Homo Sapiens
gguuuagucacaucauuuuuccuguucagguaucugcagauaucccuguucaggaaagaucuuu

SEQ ID NO: 665402 - RNA, 64 nt, Homo Sapiens
acacacacggauaugcugucuggacgcacacacgugcagauaugguauccggacacacacgugc

SEQ ID NO: 665403 - RNA, 64 nt, Homo Sapiens
gugcacagauaugcugucuggacacgcacacacaugcagauaugcugccuggacacacacuucc

SEQ ID NO: 665404 - RNA, 64 nt, Homo Sapiens
cacacagauaaugcugccucaacacucacacacgugcagauauugccuggacacacacaugugc

SEQ ID NO: 665405 - RNA, 64 nt, Homo Sapiens
gugcacagauaugcugucuggacaugcacacacgugcagauaugcuguccggauacacacgcac

SEQ ID NO: 665406 - RNA, 64 nt, Homo Sapiens
agauaugcuguccggauacacacgcacgcacacaugcagauaugcugccugggcacacacuucc

SEQ ID NO: 665407 - RNA, 64 nt, Homo Sapiens
ggcacacacuuccggacacacaugcacacacaggugcagauaugcugccuggacacacgcagac

SEQ ID NO: 665408 - RNA, 64 nt, Homo Sapiens
gugaucugcaugccuguuaaagucugagcucuguugcagauaaccagagacccaacaaccaaag

SEQ ID NO: 665409 - RNA, 64 nt, Homo Sapiens
aaguccaucauuagguuaagcgauuuacugaaggugcagauaucaugcuuauuucauuggguug

SEQ ID NO: 665410 - RNA, 64 nt, Homo Sapiens
auuuucuugguguauccuuuuccuuucaacacagugcagauaagaguugaauauugauaucaua

SEQ ID NO: 665411 - RNA, 64 nt, Homo Sapiens
uuuuauuucucucuaaacuugaaaacaguaaaucugcagauacugugaggcacaaauuauacug

SEQ ID NO: 665412 - RNA, 64 nt, Homo Sapiens
ggcuuggcgcucggggugguagcagagagggaucugcagauacaacaggacguggugguuccug

SEQ ID NO: 665413 - RNA, 64 nt, Homo Sapiens
cgguugagugggguccugggggaggccuccgaaaugcagauaggcccaacaacucugcuuuuag

SEQ ID NO: 665414 - RNA, 64 nt, Homo Sapiens
aaauauucauguagcaaaucugagaauugaaaacugcagauaaccggccggguauggugacuca

SEQ ID NO: 665415 - RNA, 64 nt, Homo Sapiens
aaaaaaaaaaaacagaaagaaagaaaaagaaaacugcagauaacccuauacauuaauacuggua

SEQ ID NO: 665416 - RNA, 64 nt, Homo Sapiens
ugguuuucucucuuuuugugguauuagcagcugcugcagauaaaugcauuaauucaugaugcuu

SEQ ID NO: 665417 - RNA, 64 nt, Homo Sapiens
agacaauaauuggaguaguuuaaucuuauucaugugcagauaaaagagguuuaugaaguuuagg

SEQ ID NO: 665418 - RNA, 64 nt, Homo Sapiens
aaaacugcuaccuucucaucauuauauuguagugugcagauaacuuacuuuuccccuuuacuua

SEQ ID NO: 665419 - RNA, 64 nt, Homo Sapiens
agcuuuuggugcacuuuugucuuauuuuccucaaugcagauaauuuaucuuauuuauauuuucc

SEQ ID NO: 665420 - RNA, 64 nt, Homo Sapiens
gcugcuguuuuacgauuucacaguuccuugauucugcagauacugggaaaaaacagaauuguaa

SEQ ID NO: 665421 - RNA, 64 nt, Homo Sapiens
acacugcacacagaaauguuagaaaugugcaguuugcagauagagauacagcucaucauucugu

SEQ ID NO: 665422 - RNA, 64 nt, Homo Sapiens; identical to SEQ ID NO: 165822

SEQ ID NO: 665423 - RNA, 64 nt, Homo Sapiens; identical to SEQ ID NO: 165823

SEQ ID NO: 665424 - RNA, 64 nt, Homo Sapiens; identical to SEQ ID NO: 22017

SEQ ID NO: 665425 - RNA, 64 nt, Homo Sapiens; identical to SEQ ID NO: 22018

SEQ ID NO: 665426 - RNA, 64 nt, Homo Sapiens; identical to SEQ ID NO: 22019

SEQ ID NO: 665427 - RNA, 64 nt, Homo Sapiens; identical to SEQ ID NO: 22020

SEQ ID NO: 665428 - RNA, 64 nt, Homo Sapiens; identical to SEQ ID NO: 22021

SEQ ID NO: 665429 - RNA, 64 nt, Homo Sapiens; identical to SEQ ID NO: 22022

SEQ ID NO: 665430 - RNA, 64 nt, Homo Sapiens; identical to SEQ ID NO: 22023

SEQ ID NO: 665431 - RNA, 64 nt, Homo Sapiens; identical to SEQ ID NO: 22024

SEQ ID NO: 665432 - RNA, 64 nt, Homo Sapiens; identical to SEQ ID NO: 22025

SEQ ID NO: 665433 - RNA, 64 nt, Homo Sapiens; identical to SEQ ID NO: 22026

SEQ ID NO: 665434 - RNA, 64 nt, Homo Sapiens; identical to SEQ ID NO: 22027

SEQ ID NO: 665435 - RNA, 64 nt, Homo Sapiens; identical to SEQ ID NO: 22028

SEQ ID NO: 665436 - RNA, 64 nt, Homo Sapiens; identical to SEQ ID NO: 22029

SEQ ID NO: 665437 - RNA, 64 nt, Homo Sapiens; identical to SEQ ID NO: 22030

SEQ ID NO: 665438 - RNA, 64 nt, Homo Sapiens
gggggcauuaggaacagaccguuuugcuggguucucaggcuaguggagauccuucauguugagg

SEQ ID NO: 665439 - RNA, 64 nt, Homo Sapiens
gggauugguugcauuacagacagcagcccaaucuucaggcuagugugcauaaggaagaacucua

SEQ ID NO: 665440 - RNA, 64 nt, Homo Sapiens
auaucaauuaaacacaaaaaccauaauacucuauucaggcuagguuaaaaugguauuauuaaua

SEQ ID NO: 665441 - RNA, 64 nt, Homo Sapiens
gucugugauucuuuuguuugcucaucagcggccgucaggcuacuacaguauguagacugccauu

SEQ ID NO: 665442 - RNA, 56 nt, Homo Sapiens
guccuaacgagaagagauaauuacaaucaggcuaccagaggaagccuuugguccua

SEQ ID NO: 665443 - RNA, 64 nt, Homo Sapiens
agccuuugguccuaacgagaagagauaauuacaaucaggcuaccaaaggaagcacuaacuuugg

SEQ ID NO: 665444 - RNA, 64 nt, Homo Sapiens
auagggaccagaguuuaacauagcgaucuaggccagaauugacaauguuuaaguaaugguggaa

SEQ ID NO: 665445 - RNA, 64 nt, Homo Sapiens
aagguaaacauucuauauauucuaugccugcucuagaauugaaagacuucagcaguauuaaagc

SEQ ID NO: 665446 - RNA, 64 nt, Homo Sapiens
ugucauucaucaauaaaccaaagccaauagcuggagaauugagaucugguugaaagugguuuau

SEQ ID NO: 665447 - RNA, 64 nt, Homo Sapiens
aaggcacuuugaaaucauuccaguauauuugggaagaauugagugaaugagaaugcucuuccuu

SEQ ID NO: 665448 - RNA, 64 nt, Homo Sapiens
cauuuaggauaaucuuugacauuuuggaaaaauaagaauugaggaaaaaaaguguaucuuucaa

SEQ ID NO: 665449 - RNA, 64 nt, Homo Sapiens
uauacuggucuguuagcagagacaaacuuuuuuuagaauugaagucugaaacaaacaaaagcaa

SEQ ID NO: 665450 - RNA, 64 nt, Homo Sapiens
gggcacaucauuucaagaagaaaagaauaaaccaagaauugauuuugguuauuuuacuuuuugg

SEQ ID NO: 665451 - RNA, 64 nt, Homo Sapiens
acuaaccguuguaaugcagguggauuccuguuccagaauugagaaugauucaaacauagaugac

SEQ ID NO: 665452 - RNA, 64 nt, Homo Sapiens
agagcuuguguuguuuagcaucaaaagguauuuaagaauugacguaucucuuuacuguaaugac

SEQ ID NO: 665453 - RNA, 64 nt, Homo Sapiens
cugcaaaggaagaauaaugaguuauggaguaaauagaauugagaagggauaaaacaguuuacuu

SEQ ID NO: 665454 - RNA, 64 nt, Homo Sapiens
uugaaaaauauuugauugccugaaugaauacaacagaauugaggugguguuaauaucaaagaau

SEQ ID NO: 665455 - RNA, 64 nt, Homo Sapiens
gaauacaacagaauugaggugguguuaauaucaaagaauugaaucugauguucucuaugauauu

SEQ ID NO: 665456 - RNA, 64 nt, Homo Sapiens
agcauuugagaauucuuaaauaugaaauuuauucagaauugaagauggugaccuauucagagcc

SEQ ID NO: 665457 - RNA, 64 nt, Homo Sapiens
aucuagcuuucuuuaugauguuucugauaauacgagaauugaaaacuuuaccuucucuuguaca

SEQ ID NO: 665458 - RNA, 64 nt, Homo Sapiens
uuugguuucccaagagcuacguauuuaauagcaaagaauugacuggggcaauaacguuuaagcc

SEQ ID NO: 665459 - RNA, 64 nt, Homo Sapiens
auucucucucuugcaggaaggacuaugaaaagcuagaauugaguguuuaaaguucaacauguua

SEQ ID NO: 665460 - RNA, 64 nt, Homo Sapiens
gccuucguaucuugaaccucaaagucuguuauacagaauugaaaagagcggagaaacuuaagcu

SEQ ID NO: 665461 - RNA, 64 nt, Homo Sapiens
agaacgugccaaaugagaauuuaauuuagugaacagaauugagagcaguuuaaauuuaguaauu

SEQ ID NO: 665462 - RNA, 64 nt, Homo Sapiens
auuuucuuuguauacuuuuugcacggaaagauaaagaauugaacauuaauacugauuauauaga

SEQ ID NO: 665463 - RNA, 63 nt, Homo Sapiens
ggcuaacauauuuacucuugaagaugaagaggcagaauugagaaaaaaucuaaguauagauga

SEQ ID NO: 665464 - RNA, 64 nt, Homo Sapiens
uggaagugggggugucccuaggcuuccuugcuucagaauugaaaaaaccucuccugucauuccu

SEQ ID NO: 665465 - RNA, 64 nt, Homo Sapiens
gugaggguauaaaguguaacuuuaguauaaaaauagaauugauaagcucucauaacuaaguuaa

SEQ ID NO: 665466 - RNA, 64 nt, Homo Sapiens
uauguuuggccuuuugcauguuucucuacaaaagagaauugaguuaccucacagagaacagaua

SEQ ID NO: 665467 - RNA, 64 nt, Homo Sapiens
aacuagguuucuuuguauucuucaguccuuuuacagaauugaugugcuaacugaauaucauugc

SEQ ID NO: 665468 - RNA, 64 nt, Homo Sapiens
uuuaucucaagacuaucuuauuuuuuaaaaucacagaauugauacacuacuaccaacaagagga

SEQ ID NO: 665469 - RNA, 64 nt, Homo Sapiens
uauuacaaaauuauguucuaacauccacccuuuaagaauugauugugacauuaugcauuacucc

SEQ ID NO: 665470 - RNA, 64 nt, Homo Sapiens
cuguggcugguuucucagaaauuuuucauaaagcagaauugaucgaguuguuccucaggaauag

SEQ ID NO: 665471 - RNA, 64 nt, Homo Sapiens
cuaacccauuuuuaaguacauuugcaugugggcaagaauugaaaguauacagauaauugaacag

SEQ ID NO: 665472 - RNA, 64 nt, Homo Sapiens
ugggcaagaauugaaaguauacagauaauugaacagaauugauuuguuagauaaggagauuuug

SEQ ID NO: 665473 - RNA, 64 nt, Homo Sapiens
agcaaaucucacuaaugauauaacuuucuaguaaagaauugaaacagcuauuuuaaaugagcug

SEQ ID NO: 665474 - RNA, 64 nt, Homo Sapiens
caggaaccuacugaauagcguccacauguacauaagaauugacacauucuuuuaucuuuuuugc

SEQ ID NO: 665475 - RNA, 64 nt, Homo Sapiens
gauuuggagaugagcuuugcuuuaagaagaauugagaauugauaacaugugguuagucuuuuau

SEQ ID NO: 665476 - RNA, 64 nt, Homo Sapiens
auugauagauuuggagaugacuuuuauuuuaagaagaauugagauggcugaacaugugguuagu

SEQ ID NO: 665477 - RNA, 64 nt, Homo Sapiens
agauuaccuuguuuauuuaaaaacuacacuuuguagaauugauuccuagugcuacuuguuuuac

SEQ ID NO: 665478 - RNA, 64 nt, Homo Sapiens
cacccccuagauaccaacugccaguguggccccuagaauugagucuccacuuggagggaauugu

SEQ ID NO: 665479 - RNA, 64 nt, Homo Sapiens
uguagaacacccaauuggugacacccaguuguucagaauugaauugucagaauugaauuauaga

SEQ ID NO: 665480 - RNA, 64 nt, Homo Sapiens
uauagaacacccaguuguucgagaaguuagugucagaauugaauguggagucugcacuaacuug

SEQ ID NO: 665481 - RNA, 64 nt, Homo Sapiens
agggugggggugccuagccaggugcaguccccgccccgccuaguccucggcgucacgcaaugcu

SEQ ID NO: 665482 - RNA, 64 nt, Homo Sapiens
aagucgagaacacuugaacacacagaagggagaccccgccuagcauagauuugcaguuacggcc

SEQ ID NO: 665483 - RNA, 64 nt, Homo Sapiens
gcagugcugcauggcugcccgacuuugggggauccccgccuaggcacugaugcccaaacuguca

SEQ ID NO: 665484 - RNA, 64 nt, Homo Sapiens
aguugaguacagugaggaggagcugcucuuagugcccgccuagguaagguggguccaggaaggc

SEQ ID NO: 665485 - RNA, 64 nt, Homo Sapiens
aaccuaggcagaaggcggcugucugagggcuguccccgccuaggacagggucaaucgaggaaug

SEQ ID NO: 665486 - RNA, 64 nt, Homo Sapiens
ucugggugcaggauagcaguccagaguccauggccccgccuaggccaucugggugcugggcaug

SEQ ID NO: 665487 - RNA, 64 nt, Homo Sapiens
uccacuuccuuucccuugcugggcuggugcuguccccgccuaccgccucaggucuggccagcca

SEQ ID NO: 665488 - RNA, 64 nt, Homo Sapiens
ccacuuagcacagcugaagggguuugugaauacucccgccuaaaucccuucuacuucacuccuc

SEQ ID NO: 665489 - RNA, 64 nt, Homo Sapiens
caucugacaggcuuaucauuguccucgcucucuccccgccuaguccccuaccucuguucugccu

SEQ ID NO: 665490 - RNA, 64 nt, Homo Sapiens
ccgucggcauuuucuucuucuuuucccccucgcucccgccuacccucauguuucgcaacucuuu

SEQ ID NO: 665491 - RNA, 64 nt, Homo Sapiens
cgaguagcugggacuacaggcgccugccaccaugcccgccuaauuuuuuuguauuuuuaguaga

SEQ ID NO: 665492 - RNA, 64 nt, Homo Sapiens
uguacucgugggagguaaugugaugcacgaacaccccgccuacccaaccucugguggccguacc

SEQ ID NO: 665493 - RNA, 64 nt, Homo Sapiens
guguuggagaaggugaagaacccucccauucacgcccgccuaccaacaacaaacgugcuuuuuu

SEQ ID NO: 665494 - RNA, 64 nt, Homo Sapiens
acaucccaggugcacccuccccaaguacucccaccccgccuacuguccaugcggccucacuggg

SEQ ID NO: 665495 - RNA, 64 nt, Homo Sapiens
uaccuaccggagaguuauccugaaaaucagcaugcccgccuaguaacucuugaagacuccagua

SEQ ID NO: 665496 - RNA, 51 nt, Homo Sapiens
agagugagaagccugacugaccccgccuagacgccaggcccacuucacgcc

SEQ ID NO: 665497 - RNA, 64 nt, Homo Sapiens
gccucuugugccccagcaccuucucucucugccccccgccuaaaguccugcauucagugugugg

SEQ ID NO: 665498 - RNA, 64 nt, Homo Sapiens
cuucaucagucaagucaccagccacagccuugcccccgccuaguagcaccccugcccaucuggu

SEQ ID NO: 665499 - RNA, 64 nt, Homo Sapiens
acaggagcugucuggagcucucugguuccugcuccccgccuagguuucugcuucccauagcagg

SEQ ID NO: 665500 - RNA, 64 nt, Homo Sapiens
uggaggaagcgcugcugggcgugggcccccgagacccgccuagaaccuguggagggcauuuccc

SEQ ID NO: 665501 - RNA, 64 nt, Homo Sapiens
acccagucuaaugagaacucuggagcuggagcagcccgccuagacgacaucgagugcuuccuua

SEQ ID NO: 665502 - RNA, 64 nt, Homo Sapiens
uuuuuguauuuuuuaguagacuuggcccaccacgcccgccuaaucuggagugcaguggcgcgau

SEQ ID NO: 665503 - RNA, 64 nt, Homo Sapiens
cuccuacguguccagggcuuuggccuugccccugcccgccuacaggacaacuccaccccuuccu

SEQ ID NO: 665504 - RNA, 64 nt, Homo Sapiens
cccaucccccagcgcuuguccugcuucacccuaccccgccuaagacuguaaaggccuaaaaacc

SEQ ID NO: 665505 - RNA, 64 nt, Homo Sapiens
aacgugcugggauuauaggcgugagccaccacgccccgccuaaaauccauauucaaagaagcaa

SEQ ID NO: 665506 - RNA, 64 nt, Homo Sapiens
agccaggacaggagugggggccagccugaggacccccgccuaccaccucgagaacuggaagcca

SEQ ID NO: 665507 - RNA, 64 nt, Homo Sapiens
acugaugaauuauuucugaagugagccacuguaccccgccuaaaaaagugcugggauuacaguc

SEQ ID NO: 665508 - RNA, 64 nt, Homo Sapiens
acguggguagugugugaagccccucagccugggucccgccuagccuaagagugguggccucgag

SEQ ID NO: 665509 - RNA, 64 nt, Homo Sapiens
cuuugugaggcucagaggaaggacagucugcaagcccgccuaggagguccauccccagcaaaug

SEQ ID NO: 665510 - RNA, 64 nt, Homo Sapiens
uaacaagggugagugcucucgcuaagaagugucccccgccuaaucauguguuuauaggauagua

SEQ ID NO: 665511 - RNA, 64 nt, Homo Sapiens
cucccuccagaauagccccuuucaccccuccuugcccgccuaccugacuccccucagcuccccc

SEQ ID NO: 665512 - RNA, 59 nt, Homo Sapiens
gucuugaacugcuggccuaaagcgauccccccgccuaggccucccaaagugcuggguuu

SEQ ID NO: 665513 - RNA, 64 nt, Homo Sapiens
ggagggguccgugcugguucugaauaaagcaggacccgccuaguggcugccugugugcauggcu

SEQ ID NO: 665514 - RNA, 64 nt, Homo Sapiens
ucguucuccgcuggacucagaagccaagcugcuucccgccuagacucggcgcagggccccgcac

SEQ ID NO: 665515 - RNA, 64 nt, Homo Sapiens
ugccugccggccugguggggugccuucucuuucgcccgccuaucugagcugggcccugggauac

SEQ ID NO: 665516 - RNA, 64 nt, Homo Sapiens
cgcgucuucuccacggcaucuggugcuccgcggccccgccuacagcuggaaccgcgcagccugc

SEQ ID NO: 665517 - RNA, 64 nt, Homo Sapiens
guguccugugaauguaucgcuacugugagcuguucccgccuagccagggccaugucuuaggugc

SEQ ID NO: 665518 - RNA, 64 nt, Homo Sapiens
ggcacacacuuuagagucuggggcuccaguggggcccgccuaauuuuuuuuccccccaagacag

SEQ ID NO: 665519 - RNA, 64 nt, Homo Sapiens
ccucccaaaguguugggauugaccucgugauccacccgccuaggcaggcuggucuugaacuccu

SEQ ID NO: 665520 - RNA, 64 nt, Homo Sapiens
gggcaccaugccaagcacuuaguggccaucagcacccgccuaacgccaacccaucaucuagagu

SEQ ID NO: 665521 - RNA, 64 nt, Homo Sapiens
aaauuuuggucagaccgguuaggaagaggaaauucccgccuaauauagcgcucccaggcuuauu

SEQ ID NO: 665522 - RNA, 64 nt, Homo Sapiens
ggugggcccugaugcugccagcccaggcagcagccccgccuaguaguaaacccuggaguccgag

SEQ ID NO: 665523 - RNA, 64 nt, Homo Sapiens
agacuucauugcuguaguuuggauuaacuccccucccgccuacccccaucccaaacugcauuua

SEQ ID NO: 665524 - RNA, 64 nt, Homo Sapiens
uuuggaacaaucacagggaauggccacaaaccugcccgccuaagacccugaauccguacuuggg

SEQ ID NO: 665525 - RNA, 64 nt, Homo Sapiens
ucccccuccagcccuagccgagcugguccuaggccccgccuagugccccacccccacccacagu

SEQ ID NO: 665526 - RNA, 64 nt, Homo Sapiens; identical to SEQ ID NO: 391367

SEQ ID NO: 665527 - RNA, 64 nt, Homo Sapiens; identical to SEQ ID NO: 391368

SEQ ID NO: 665528 - RNA, 64 nt, Homo Sapiens; identical to SEQ ID NO: 391369

SEQ ID NO: 665529 - RNA, 64 nt, Homo Sapiens; identical to SEQ ID NO: 391370

SEQ ID NO: 665530 - RNA, 64 nt, Homo Sapiens; identical to SEQ ID NO: 391371

SEQ ID NO: 665531 - RNA, 64 nt, Homo Sapiens; identical to SEQ ID NO: 391372

SEQ ID NO: 665532 - RNA, 64 nt, Homo Sapiens; identical to SEQ ID NO: 391373

SEQ ID NO: 665533 - RNA, 64 nt, Homo Sapiens; identical to SEQ ID NO: 391374

SEQ ID NO: 665534 - RNA, 64 nt, Homo Sapiens; identical to SEQ ID NO: 391375

SEQ ID NO: 665535 - RNA, 64 nt, Homo Sapiens; identical to SEQ ID NO: 391376

SEQ ID NO: 665536 - RNA, 64 nt, Homo Sapiens; identical to SEQ ID NO: 391377

SEQ ID NO: 665537 - RNA, 64 nt, Homo Sapiens; identical to SEQ ID NO: 391378

SEQ ID NO: 665538 - RNA, 64 nt, Homo Sapiens; identical to SEQ ID NO: 391379

SEQ ID NO: 665539 - RNA, 64 nt, Homo Sapiens; identical to SEQ ID NO: 391380

SEQ ID NO: 665540 - RNA, 64 nt, Homo Sapiens; identical to SEQ ID NO: 391381

SEQ ID NO: 665541 - RNA, 64 nt, Homo Sapiens; identical to SEQ ID NO: 391382

SEQ ID NO: 665542 - RNA, 64 nt, Homo Sapiens; identical to SEQ ID NO: 391383

SEQ ID NO: 665543 - RNA, 64 nt, Homo Sapiens; identical to SEQ ID NO: 391384

SEQ ID NO: 665544 - RNA, 64 nt, Homo Sapiens; identical to SEQ ID NO: 391385

SEQ ID NO: 665545 - RNA, 64 nt, Homo Sapiens; identical to SEQ ID NO: 391386

SEQ ID NO: 665546 - RNA, 64 nt, Homo Sapiens; identical to SEQ ID NO: 391387

SEQ ID NO: 665547 - RNA, 64 nt, Homo Sapiens; identical to SEQ ID NO: 391388

SEQ ID NO: 665548 - RNA, 64 nt, Homo Sapiens
agcccuuucugcacagcuggugucggcaucauacuaaaagcaauguuuaaaucaaacuaaagau

SEQ ID NO: 665549 - RNA, 64 nt, Homo Sapiens
uguguguguuuuuuuuuuuuuuuuuuuuguuguuuaaaagcaaggcaugcuuguggaugacucu

SEQ ID NO: 665550 - RNA, 64 nt, Homo Sapiens
auugcuuucuguacugcgucgaaagaaguuucauuaaaagcaccgcuagcauguucacagauuu

SEQ ID NO: 665551 - RNA, 64 nt, Homo Sapiens
uacuucacagcuagcauguuuccuauggaaagaauaaaagcauggaucauuauuuggaaauaug

SEQ ID NO: 665552 - RNA, 64 nt, Homo Sapiens
uaucucuccauaaauauuauaaaguuuguugcuuuaaaagcaagagggaccuauccuugucuug

SEQ ID NO: 665553 - RNA, 64 nt, Homo Sapiens
aguuuugcguuuuuuacugcaagacugaugaguauaaaagcagagauuuuaauagcaugcuuua

SEQ ID NO: 665554 - RNA, 64 nt, Homo Sapiens
cuuauucacagauugcaguacaaguagaaauauuuaaaagcaguucuauauguaagauagcaca

SEQ ID NO: 665555 - RNA, 64 nt, Homo Sapiens
aauugguuugaguuuucaagcaagaauuuaauucuaaaagcaaauacaagauugaaaaacucaa

SEQ ID NO: 665556 - RNA, 64 nt, Homo Sapiens
gggcuuagccugcaggcuucuuccuucagcccucuaaaagcauacaggauuaaacuagguuugg

SEQ ID NO: 665557 - RNA, 64 nt, Homo Sapiens
aaaccacagugucucuucacguacaccaauuuguuaaaagcaagacuaugggaggagggcaaga

SEQ ID NO: 665558 - RNA, 64 nt, Homo Sapiens
cuugaagauuuagaaguuauauaaaaaauuaauuuaaaagcaaaccaaaagagguuuccauuaa

SEQ ID NO: 665559 - RNA, 64 nt, Homo Sapiens
caguguuuugccaauuaauauuauaugcuuguaauaaaagcaaaagaaaagcuuaagugaaagu

SEQ ID NO: 665560 - RNA, 64 nt, Homo Sapiens
ugaaaaguagagcaaucguguauaagcuaauguuuaaaagcaaaacugcaaauuguagcccagu

SEQ ID NO: 665561 - RNA, 64 nt, Homo Sapiens
gccauaucaccagucuuaccaaacaauaggcuuuuaaaagcauugagucauugucagaauccac

SEQ ID NO: 665562 - RNA, 64 nt, Homo Sapiens
uuccuggucaaagcuccuuaaaguucugggcagcuaaaagcaucccugugagcaaaaaugccag

SEQ ID NO: 665563 - RNA, 64 nt, Homo Sapiens
ccacuauuuuugugcaaauaauaugaaagugaaguaaaagcaauagaagaaauuucuauaggau

SEQ ID NO: 665564 - RNA, 64 nt, Homo Sapiens
uauuuugccauaucauuuagcuggaagugacauuuaaaagcacccugcaucacuaguaauagug

SEQ ID NO: 665565 - RNA, 64 nt, Homo Sapiens
uuuuuauguuauugaaaauauacuaaauuauaacuaaaagcaacauuagugaaaguauugaaaa

SEQ ID NO: 665566 - RNA, 64 nt, Homo Sapiens
aaaaauugaaauaagacaucaaaauacacgucuuuaaaagcaacagagugucccauugcugcca

SEQ ID NO: 665567 - RNA, 64 nt, Homo Sapiens
uaaacugcccacuaucucuagaacuggaugucccuaaaagcaaauauaagggcuauuauuuccu

SEQ ID NO: 665568 - RNA, 64 nt, Homo Sapiens
agucuguaacuagaacaaauuaucuugagacucuuaaaagcaucuucaguugguguccaagacu

SEQ ID NO: 665569 - RNA, 64 nt, Homo Sapiens
aaccucccuuuuuaauugccuuuccuuucucauuuaaaagcaaacaguaguaccaaaaagguau

SEQ ID NO: 665570 - RNA, 64 nt, Homo Sapiens
cacacacacacacacacacaugcucccuccaauuuaaaagcacaucaauuuaacaauccugaca

SEQ ID NO: 665571 - RNA, 64 nt, Homo Sapiens
ggcgauaugauaaugcaaaccuauuucaucacucuaaaagcacugaccucaaaaaaccuuauaa

SEQ ID NO: 665572 - RNA, 64 nt, Homo Sapiens
uaauuuaaccaagccccucuccacuucuuuuauuuaaaagcacugauucaauugcuaggaauau

SEQ ID NO: 665573 - RNA, 64 nt, Homo Sapiens
aagaaaacacgcuaguuauuuaacugcaagcuacuaaaagcauagguguguugagauuucugug

SEQ ID NO: 665574 - RNA, 64 nt, Homo Sapiens
uucuguguucuccacucuuccacuguuauccuaguaaaagcaucaggggcuggggacaauuucu

SEQ ID NO: 665575 - RNA, 64 nt, Homo Sapiens
uauccuguauucuccuccaacaucaccacuagcguaaaagcaaaaagcuuuuacaaaacacagc

SEQ ID NO: 665576 - RNA, 64 nt, Homo Sapiens
ugaauaucaagauaccucauugaaucccuaaauuuaaaagcaguccaguaaaagguuaacugua

SEQ ID NO: 665577 - RNA, 64 nt, Homo Sapiens
auguuuuuuccaguuagucuaggaauuuuuauacuaaaagcaaauguguaccuuucagcauccu

SEQ ID NO: 665578 - RNA, 64 nt, Homo Sapiens
cucaacauaugugauguuuaguuggaaacaaaacuaaaagcaaaaggaacauugguuaagaacu

SEQ ID NO: 665579 - RNA, 64 nt, Homo Sapiens
ugggauacuguaauacuucuuuguuauuauaacauaaaagcaccacuguucuguucauuuccua

SEQ ID NO: 665580 - RNA, 64 nt, Homo Sapiens
uaguuaauauaaauguugcucuaaucagauugcuuaaaagcauuuuuauuauauuuauguuguu

SEQ ID NO: 665581 - RNA, 64 nt, Homo Sapiens
aucuguuauuuagcuguaaauguauaaaaaaaccuaaaagcaguaaccuaaaguuuagaugcau

SEQ ID NO: 665582 - RNA, 64 nt, Homo Sapiens
cacaauguguaacugaauggcauauuuuaaauucuaaaagcauauuuagacugcuaugguaaua

SEQ ID NO: 665583 - RNA, 64 nt, Homo Sapiens
gaccucauccggggcuuugguucaaggaggcucauaaaagcagugggauuaugucaaggcuucu

SEQ ID NO: 665584 - RNA, 64 nt, Homo Sapiens
agccgaauuuagaaguuccccauuuuggugcuguuaaaagcaagcuaagauuaugauucagggg

SEQ ID NO: 665585 - RNA, 64 nt, Homo Sapiens
uguacuucacuagugcugccagaggaauuguuaauaaaagcaccuucuuuaacaauaaaugucu

SEQ ID NO: 665586 - RNA, 64 nt, Homo Sapiens
aaaaugagucuuauaaaauuaagugaagugcaaauaaaagcacugcuacuauaagacauucugg

SEQ ID NO: 665587 - RNA, 64 nt, Homo Sapiens
cucugucaucgaagagaccagcucugacacagacuaaaagcaucaccugcucaacucucaauau

SEQ ID NO: 665588 - RNA, 64 nt, Homo Sapiens
auacagagcugcaguuagacgggguuacgggggcuaaaagcagaaaaaaaauuccauuucaucg

SEQ ID NO: 665589 - RNA, 64 nt, Homo Sapiens
uaaccaggucuuuagaauaucuaauugcauugguuaaaagcagcuuucccccuuuuuuggugau

SEQ ID NO: 665590 - RNA, 64 nt, Homo Sapiens
ggccccucccugcuuuuauuuguugugaaacguuuaaaagcagugcuagaaguaucaucuggau

SEQ ID NO: 665591 - RNA, 64 nt, Homo Sapiens
auugcuuuauauuuuggaucugaguagucaguuauaaaagcauagagccuugggcuaaucuggc

SEQ ID NO: 665592 - RNA, 64 nt, Homo Sapiens
agccuaagaauggcacucccgaagcaggauaguauaaaagcaucguauggcugacccuguuuca

SEQ ID NO: 665593 - RNA, 64 nt, Homo Sapiens
caguaccacuugaugauuuuguuacaggucacuuuaaaagcaaaauuaaugauuauaauaaaaa

SEQ ID NO: 665594 - RNA, 64 nt, Homo Sapiens
gcuaccuucuuugauuguaucaauaaaaaguaaauaaaagcacuccuagaaaacugcuugauga

SEQ ID NO: 665595 - RNA, 64 nt, Homo Sapiens
uguucuccaucugaacuagaaguuuacagaucaauaaaagcaccuguggaaaauuauauuggua

SEQ ID NO: 665596 - RNA, 64 nt, Homo Sapiens
guaaaauauuuaaaagguuagcaauauaguugcauaaaagcacuaaauuuaaaaugaucaaaaa

SEQ ID NO: 665597 - RNA, 64 nt, Homo Sapiens
uuuuuuauuuaucucuuuaaucuuuuuuuauuauuaaaagcaaguuucuuuguauuccucaccc

SEQ ID NO: 665598 - RNA, 64 nt, Homo Sapiens
agcacucauaauauggcauccuucaauuucuguauaaaagcagaucuuuuuaaaaagauacuuc

SEQ ID NO: 665599 - RNA, 64 nt, Homo Sapiens
ucuuuuuguucugaaauugaguuuauucaaaguguaaaagcacauacugcauuuucugcugaaa

SEQ ID NO: 665600 - RNA, 64 nt, Homo Sapiens
cccuuuguucagauaccuuaaaaguuacuuuauuuaaaagcauuuauuaaucuuagucugaaau

SEQ ID NO: 665601 - RNA, 64 nt, Homo Sapiens
uuuauuuucucuguucccuuucuuaggaauguuauaaaagcaaaucccaagcaucauaucauuu

SEQ ID NO: 665602 - RNA, 64 nt, Homo Sapiens
auggaucuuuucuuuagaccuauuuuugaaggcauaaaagcaguugaguuucuggagaauuuuu

SEQ ID NO: 665603 - RNA, 64 nt, Homo Sapiens
gcagaaguuagacacuaagguuuacuaguucuguuaaaagcagaauucuauguauuauuaaaua

SEQ ID NO: 665604 - RNA, 64 nt, Homo Sapiens
gcaaacugcacugcacuuauaauauguagaauguuaaaagcacaaaauagcguucauggcuacg

SEQ ID NO: 665605 - RNA, 64 nt, Homo Sapiens; identical to SEQ ID NO: 426691

SEQ ID NO: 665606 - RNA, 64 nt, Homo Sapiens; identical to SEQ ID NO: 426692

SEQ ID NO: 665607 - RNA, 64 nt, Homo Sapiens; identical to SEQ ID NO: 426693

SEQ ID NO: 665608 - RNA, 64 nt, Homo Sapiens; identical to SEQ ID NO: 426694

SEQ ID NO: 665609 - RNA, 64 nt, Homo Sapiens; identical to SEQ ID NO: 426695

SEQ ID NO: 665610 - RNA, 64 nt, Homo Sapiens; identical to SEQ ID NO: 426696

SEQ ID NO: 665611 - RNA, 64 nt, Homo Sapiens; identical to SEQ ID NO: 426697

SEQ ID NO: 665612 - RNA, 64 nt, Homo Sapiens; identical to SEQ ID NO: 426698

SEQ ID NO: 665613 - RNA, 64 nt, Homo Sapiens; identical to SEQ ID NO: 426699

SEQ ID NO: 665614 - RNA, 64 nt, Homo Sapiens; identical to SEQ ID NO: 426700

SEQ ID NO: 665615 - RNA, 64 nt, Homo Sapiens; identical to SEQ ID NO: 426701

SEQ ID NO: 665616 - RNA, 64 nt, Homo Sapiens; identical to SEQ ID NO: 426702

SEQ ID NO: 665617 - RNA, 64 nt, Homo Sapiens; identical to SEQ ID NO: 426703

SEQ ID NO: 665618 - RNA, 64 nt, Homo Sapiens; identical to SEQ ID NO: 426704

SEQ ID NO: 665619 - RNA, 64 nt, Homo Sapiens; identical to SEQ ID NO: 426705

SEQ ID NO: 665620 - RNA, 64 nt, Homo Sapiens; identical to SEQ ID NO: 426706

SEQ ID NO: 665621 - RNA, 54 nt, Homo Sapiens; identical to SEQ ID NO: 426707

SEQ ID NO: 665622 - RNA, 64 nt, Homo Sapiens; identical to SEQ ID NO: 426708

SEQ ID NO: 665623 - RNA, 64 nt, Homo Sapiens; identical to SEQ ID NO: 426709

SEQ ID NO: 665624 - RNA, 64 nt, Homo Sapiens; identical to SEQ ID NO: 426710

SEQ ID NO: 665625 - RNA, 64 nt, Homo Sapiens; identical to SEQ ID NO: 426711

SEQ ID NO: 665626 - RNA, 64 nt, Homo Sapiens; identical to SEQ ID NO: 426712

SEQ ID NO: 665627 - RNA, 64 nt, Homo Sapiens; identical to SEQ ID NO: 426713

SEQ ID NO: 665628 - RNA, 64 nt, Homo Sapiens; identical to SEQ ID NO: 426714

SEQ ID NO: 665629 - RNA, 64 nt, Homo Sapiens; identical to SEQ ID NO: 426715

SEQ ID NO: 665630 - RNA, 64 nt, Homo Sapiens; identical to SEQ ID NO: 426716

SEQ ID NO: 665631 - RNA, 64 nt, Homo Sapiens; identical to SEQ ID NO: 426717

SEQ ID NO: 665632 - RNA, 64 nt, Homo Sapiens; identical to SEQ ID NO: 426718

SEQ ID NO: 665633 - RNA, 64 nt, Homo Sapiens; identical to SEQ ID NO: 426719

SEQ ID NO: 665634 - RNA, 64 nt, Homo Sapiens; identical to SEQ ID NO: 426720

SEQ ID NO: 665635 - RNA, 64 nt, Homo Sapiens; identical to SEQ ID NO: 426721

SEQ ID NO: 665636 - RNA, 64 nt, Homo Sapiens; identical to SEQ ID NO: 426722

SEQ ID NO: 665637 - RNA, 64 nt, Homo Sapiens; identical to SEQ ID NO: 426723

SEQ ID NO: 665638 - RNA, 64 nt, Homo Sapiens; identical to SEQ ID NO: 426724

SEQ ID NO: 665639 - RNA, 64 nt, Homo Sapiens; identical to SEQ ID NO: 426725

SEQ ID NO: 665640 - RNA, 64 nt, Homo Sapiens; identical to SEQ ID NO: 426726

SEQ ID NO: 665641 - RNA, 61 nt, Homo Sapiens; identical to SEQ ID NO: 426727

SEQ ID NO: 665642 - RNA, 64 nt, Homo Sapiens; identical to SEQ ID NO: 426728

SEQ ID NO: 665643 - RNA, 64 nt, Homo Sapiens; identical to SEQ ID NO: 426729

SEQ ID NO: 665644 - RNA, 64 nt, Homo Sapiens; identical to SEQ ID NO: 426730

SEQ ID NO: 665645 - RNA, 64 nt, Homo Sapiens; identical to SEQ ID NO: 426731

SEQ ID NO: 665646 - RNA, 64 nt, Homo Sapiens; identical to SEQ ID NO: 426732

SEQ ID NO: 665647 - RNA, 64 nt, Homo Sapiens; identical to SEQ ID NO: 426733

SEQ ID NO: 665648 - RNA, 64 nt, Homo Sapiens; identical to SEQ ID NO: 426734

SEQ ID NO: 665649 - RNA, 64 nt, Homo Sapiens; identical to SEQ ID NO: 426735

SEQ ID NO: 665650 - RNA, 64 nt, Homo Sapiens; identical to SEQ ID NO: 426736

SEQ ID NO: 665651 - RNA, 64 nt, Homo Sapiens; identical to SEQ ID NO: 426737

SEQ ID NO: 665652 - RNA, 64 nt, Homo Sapiens; identical to SEQ ID NO: 426738

SEQ ID NO: 665653 - RNA, 64 nt, Homo Sapiens; identical to SEQ ID NO: 426739

SEQ ID NO: 665654 - RNA, 64 nt, Homo Sapiens; identical to SEQ ID NO: 426740

SEQ ID NO: 665655 - RNA, 64 nt, Homo Sapiens; identical to SEQ ID NO: 426741

SEQ ID NO: 665656 - RNA, 64 nt, Homo Sapiens; identical to SEQ ID NO: 426742

SEQ ID NO: 665657 - RNA, 64 nt, Homo Sapiens; identical to SEQ ID NO: 426743

SEQ ID NO: 665658 - RNA, 64 nt, Homo Sapiens; identical to SEQ ID NO: 426744

SEQ ID NO: 665659 - RNA, 64 nt, Homo Sapiens; identical to SEQ ID NO: 426745

SEQ ID NO: 665660 - RNA, 64 nt, Homo Sapiens; identical to SEQ ID NO: 426746

SEQ ID NO: 665661 - RNA, 64 nt, Homo Sapiens; identical to SEQ ID NO: 426747

SEQ ID NO: 665662 - RNA, 64 nt, Homo Sapiens; identical to SEQ ID NO: 426748

SEQ ID NO: 665663 - RNA, 64 nt, Homo Sapiens; identical to SEQ ID NO: 426749

SEQ ID NO: 665664 - RNA, 64 nt, Homo Sapiens; identical to SEQ ID NO: 426750

SEQ ID NO: 665665 - RNA, 64 nt, Homo Sapiens; identical to SEQ ID NO: 426751

SEQ ID NO: 665666 - RNA, 64 nt, Homo Sapiens; identical to SEQ ID NO: 426752

SEQ ID NO: 665667 - RNA, 64 nt, Homo Sapiens; identical to SEQ ID NO: 426753

SEQ ID NO: 665668 - RNA, 64 nt, Homo Sapiens; identical to SEQ ID NO: 426754

SEQ ID NO: 665669 - RNA, 64 nt, Homo Sapiens; identical to SEQ ID NO: 426755

SEQ ID NO: 665670 - RNA, 64 nt, Homo Sapiens; identical to SEQ ID NO: 426756

SEQ ID NO: 665671 - RNA, 64 nt, Homo Sapiens; identical to SEQ ID NO: 426757

SEQ ID NO: 665672 - RNA, 64 nt, Homo Sapiens; identical to SEQ ID NO: 426758

SEQ ID NO: 665673 - RNA, 64 nt, Homo Sapiens; identical to SEQ ID NO: 426759

SEQ ID NO: 665674 - RNA, 64 nt, Homo Sapiens; identical to SEQ ID NO: 426760

SEQ ID NO: 665675 - RNA, 64 nt, Homo Sapiens; identical to SEQ ID NO: 426761

SEQ ID NO: 665676 - RNA, 64 nt, Homo Sapiens; identical to SEQ ID NO: 426762

SEQ ID NO: 665677 - RNA, 64 nt, Homo Sapiens; identical to SEQ ID NO: 426763

SEQ ID NO: 665678 - RNA, 64 nt, Homo Sapiens; identical to SEQ ID NO: 426764

SEQ ID NO: 665679 - RNA, 64 nt, Homo Sapiens; identical to SEQ ID NO: 426765

SEQ ID NO: 665680 - RNA, 64 nt, Homo Sapiens; identical to SEQ ID NO: 426766

SEQ ID NO: 665681 - RNA, 64 nt, Homo Sapiens; identical to SEQ ID NO: 426767

SEQ ID NO: 665682 - RNA, 64 nt, Homo Sapiens; identical to SEQ ID NO: 426768

SEQ ID NO: 665683 - RNA, 64 nt, Homo Sapiens
gcagcuucccuacauuacacacacucagguugagucauucuaacuauaaaagugcaaugacuaa

SEQ ID NO: 665684 - RNA, 64 nt, Homo Sapiens
acgucuuuuguuuccaacaagaggauuuucuuuuucauucuagaauuaucuccuugauaacuug

SEQ ID NO: 665685 - RNA, 64 nt, Homo Sapiens
uaccuaaaucaccccagagcuuuaugucuuuuauucauucuaauucuuauuaaccggaauaugu

SEQ ID NO: 665686 - RNA, 64 nt, Homo Sapiens
gguaguuaagaugaaauuuauuuacuuuuccguuucauucuaaaaggaaaaugcacacuuuguu

SEQ ID NO: 665687 - RNA, 64 nt, Homo Sapiens
uggugacucucugcccuugggugcaaacauuuuaucauucuaaacugucagccucuuucauagu

SEQ ID NO: 665688 - RNA, 64 nt, Homo Sapiens
ucauugcuuguaugacuucacaagcaacucaggaucauucuagcaggcuuucccacugucaaac

SEQ ID NO: 665689 - RNA, 64 nt, Homo Sapiens
uucuagcaggcuuucccacugucaaacagagacuucauucuaaaaagagaagugauaaacagag

SEQ ID NO: 665690 - RNA, 64 nt, Homo Sapiens
augagccaccgugccuggcuggguauuuauauuaucauucuaguuucagaguauacagaaguuu

SEQ ID NO: 665691 - RNA, 64 nt, Homo Sapiens
guugagauuucaguggggacacagccaaaccauaucauucuaccccuggcaccuccaaaucuca

SEQ ID NO: 665692 - RNA, 64 nt, Homo Sapiens
gcauuagagaaaaaaguucuagcaaagguaugaaacagccuaauggcugagagggaauaaucug

SEQ ID NO: 665693 - RNA, 64 nt, Homo Sapiens
caggcauauggauauguaaacccuagaguuguucacagccuaguugaauaaagcauuauuucug

SEQ ID NO: 665694 - RNA, 64 nt, Homo Sapiens
ggggaaaaacaagcuggauagguuugagcccagaacagccuacaugguuuucacucauuugauu

SEQ ID NO: 665695 - RNA, 64 nt, Homo Sapiens
cugcugcccugcuggccccugcagucuuuucugaacagccuauguacuuccugccucauuucau

SEQ ID NO: 665696 - RNA, 64 nt, Homo Sapiens; identical to SEQ ID NO: 217362

SEQ ID NO: 665697 - RNA, 64 nt, Homo Sapiens; identical to SEQ ID NO: 217363

SEQ ID NO: 665698 - RNA, 64 nt, Homo Sapiens; identical to SEQ ID NO: 217364

SEQ ID NO: 665699 - RNA, 64 nt, Homo Sapiens; identical to SEQ ID NO: 217365

SEQ ID NO: 665700 - RNA, 64 nt, Homo Sapiens; identical to SEQ ID NO: 217366

SEQ ID NO: 665701 - RNA, 64 nt, Homo Sapiens; identical to SEQ ID NO: 217367

SEQ ID NO: 665702 - RNA, 64 nt, Homo Sapiens; identical to SEQ ID NO: 217368

SEQ ID NO: 665703 - RNA, 64 nt, Homo Sapiens; identical to SEQ ID NO: 217369

SEQ ID NO: 665704 - RNA, 64 nt, Homo Sapiens; identical to SEQ ID NO: 217370

SEQ ID NO: 665705 - RNA, 64 nt, Homo Sapiens; identical to SEQ ID NO: 217371

SEQ ID NO: 665706 - RNA, 64 nt, Homo Sapiens; identical to SEQ ID NO: 217372

SEQ ID NO: 665707 - RNA, 64 nt, Homo Sapiens; identical to SEQ ID NO: 217373

SEQ ID NO: 665708 - RNA, 64 nt, Homo Sapiens; identical to SEQ ID NO: 217374

SEQ ID NO: 665709 - RNA, 64 nt, Homo Sapiens; identical to SEQ ID NO: 217375

SEQ ID NO: 665710 - RNA, 64 nt, Homo Sapiens; identical to SEQ ID NO: 217376

SEQ ID NO: 665711 - RNA, 64 nt, Homo Sapiens; identical to SEQ ID NO: 217377

SEQ ID NO: 665712 - RNA, 64 nt, Homo Sapiens; identical to SEQ ID NO: 217378

SEQ ID NO: 665713 - RNA, 64 nt, Homo Sapiens; identical to SEQ ID NO: 217379

SEQ ID NO: 665714 - RNA, 64 nt, Homo Sapiens; identical to SEQ ID NO: 217380

SEQ ID NO: 665715 - RNA, 64 nt, Homo Sapiens; identical to SEQ ID NO: 217381

SEQ ID NO: 665716 - RNA, 64 nt, Homo Sapiens; identical to SEQ ID NO: 217382

SEQ ID NO: 665717 - RNA, 64 nt, Homo Sapiens; identical to SEQ ID NO: 217383

SEQ ID NO: 665718 - RNA, 64 nt, Homo Sapiens; identical to SEQ ID NO: 217384

SEQ ID NO: 665719 - RNA, 64 nt, Homo Sapiens; identical to SEQ ID NO: 217385

SEQ ID NO: 665720 - RNA, 55 nt, Homo Sapiens; identical to SEQ ID NO: 217386

SEQ ID NO: 665721 - RNA, 64 nt, Homo Sapiens; identical to SEQ ID NO: 217387

SEQ ID NO: 665722 - RNA, 64 nt, Homo Sapiens; identical to SEQ ID NO: 217388

SEQ ID NO: 665723 - RNA, 64 nt, Homo Sapiens; identical to SEQ ID NO: 217389

SEQ ID NO: 665724 - RNA, 64 nt, Homo Sapiens; identical to SEQ ID NO: 217390

SEQ ID NO: 665725 - RNA, 64 nt, Homo Sapiens; identical to SEQ ID NO: 217391

SEQ ID NO: 665726 - RNA, 64 nt, Homo Sapiens; identical to SEQ ID NO: 217392

SEQ ID NO: 665727 - RNA, 64 nt, Homo Sapiens; identical to SEQ ID NO: 217393

SEQ ID NO: 665728 - RNA, 64 nt, Homo Sapiens; identical to SEQ ID NO: 217394

SEQ ID NO: 665729 - RNA, 64 nt, Homo Sapiens; identical to SEQ ID NO: 175055

SEQ ID NO: 665730 - RNA, 64 nt, Homo Sapiens; identical to SEQ ID NO: 175056

SEQ ID NO: 665731 - RNA, 64 nt, Homo Sapiens; identical to SEQ ID NO: 175057

SEQ ID NO: 665732 - RNA, 64 nt, Homo Sapiens; identical to SEQ ID NO: 175058

SEQ ID NO: 665733 - RNA, 64 nt, Homo Sapiens; identical to SEQ ID NO: 175059

SEQ ID NO: 665734 - RNA, 64 nt, Homo Sapiens; identical to SEQ ID NO: 175060

SEQ ID NO: 665735 - RNA, 64 nt, Homo Sapiens; identical to SEQ ID NO: 175061

SEQ ID NO: 665736 - RNA, 64 nt, Homo Sapiens; identical to SEQ ID NO: 175062

SEQ ID NO: 665737 - RNA, 64 nt, Homo Sapiens; identical to SEQ ID NO: 175063

SEQ ID NO: 665738 - RNA, 64 nt, Homo Sapiens; identical to SEQ ID NO: 175064

SEQ ID NO: 665739 - RNA, 64 nt, Homo Sapiens; identical to SEQ ID NO: 175065

SEQ ID NO: 665740 - RNA, 64 nt, Homo Sapiens; identical to SEQ ID NO: 175066

SEQ ID NO: 665741 - RNA, 64 nt, Homo Sapiens; identical to SEQ ID NO: 175067

SEQ ID NO: 665742 - RNA, 64 nt, Homo Sapiens; identical to SEQ ID NO: 175068

SEQ ID NO: 665743 - RNA, 64 nt, Homo Sapiens; identical to SEQ ID NO: 175069

SEQ ID NO: 665744 - RNA, 64 nt, Homo Sapiens; identical to SEQ ID NO: 175070

SEQ ID NO: 665745 - RNA, 64 nt, Homo Sapiens; identical to SEQ ID NO: 175071

SEQ ID NO: 665746 - RNA, 64 nt, Homo Sapiens; identical to SEQ ID NO: 175072

SEQ ID NO: 665747 - RNA, 64 nt, Homo Sapiens; identical to SEQ ID NO: 175073

SEQ ID NO: 665748 - RNA, 64 nt, Homo Sapiens; identical to SEQ ID NO: 175074

SEQ ID NO: 665749 - RNA, 64 nt, Homo Sapiens; identical to SEQ ID NO: 218812

SEQ ID NO: 665750 - RNA, 64 nt, Homo Sapiens; identical to SEQ ID NO: 218813

SEQ ID NO: 665751 - RNA, 64 nt, Homo Sapiens; identical to SEQ ID NO: 218814

SEQ ID NO: 665752 - RNA, 64 nt, Homo Sapiens; identical to SEQ ID NO: 218815

SEQ ID NO: 665753 - RNA, 64 nt, Homo Sapiens; identical to SEQ ID NO: 218816

SEQ ID NO: 665754 - RNA, 64 nt, Homo Sapiens; identical to SEQ ID NO: 218817

SEQ ID NO: 665755 - RNA, 64 nt, Homo Sapiens; identical to SEQ ID NO: 218818

SEQ ID NO: 665756 - RNA, 64 nt, Homo Sapiens; identical to SEQ ID NO: 218819

SEQ ID NO: 665757 - RNA, 64 nt, Homo Sapiens; identical to SEQ ID NO: 218820

SEQ ID NO: 665758 - RNA, 64 nt, Homo Sapiens; identical to SEQ ID NO: 218821

SEQ ID NO: 665759 - RNA, 64 nt, Homo Sapiens; identical to SEQ ID NO: 218822

SEQ ID NO: 665760 - RNA, 64 nt, Homo Sapiens; identical to SEQ ID NO: 218823

SEQ ID NO: 665761 - RNA, 64 nt, Homo Sapiens; identical to SEQ ID NO: 218824

SEQ ID NO: 665762 - RNA, 64 nt, Homo Sapiens; identical to SEQ ID NO: 218825

SEQ ID NO: 665763 - RNA, 64 nt, Homo Sapiens; identical to SEQ ID NO: 218826

SEQ ID NO: 665764 - RNA, 64 nt, Homo Sapiens; identical to SEQ ID NO: 218827

SEQ ID NO: 665765 - RNA, 64 nt, Homo Sapiens; identical to SEQ ID NO: 218828

SEQ ID NO: 665766 - RNA, 64 nt, Homo Sapiens; identical to SEQ ID NO: 218829

SEQ ID NO: 665767 - RNA, 64 nt, Homo Sapiens; identical to SEQ ID NO: 218830

SEQ ID NO: 665768 - RNA, 64 nt, Homo Sapiens; identical to SEQ ID NO: 218831

SEQ ID NO: 665769 - RNA, 64 nt, Homo Sapiens; identical to SEQ ID NO: 218832

SEQ ID NO: 665770 - RNA, 64 nt, Homo Sapiens; identical to SEQ ID NO: 218833

SEQ ID NO: 665771 - RNA, 64 nt, Homo Sapiens; identical to SEQ ID NO: 218834

SEQ ID NO: 665772 - RNA, 64 nt, Homo Sapiens; identical to SEQ ID NO: 218835

SEQ ID NO: 665773 - RNA, 64 nt, Homo Sapiens; identical to SEQ ID NO: 218836

SEQ ID NO: 665774 - RNA, 64 nt, Homo Sapiens; identical to SEQ ID NO: 161149

SEQ ID NO: 665775 - RNA, 64 nt, Homo Sapiens; identical to SEQ ID NO: 161150

SEQ ID NO: 665776 - RNA, 64 nt, Homo Sapiens; identical to SEQ ID NO: 161151

SEQ ID NO: 665777 - RNA, 64 nt, Homo Sapiens; identical to SEQ ID NO: 161152

SEQ ID NO: 665778 - RNA, 64 nt, Homo Sapiens; identical to SEQ ID NO: 161153

SEQ ID NO: 665779 - RNA, 64 nt, Homo Sapiens; identical to SEQ ID NO: 161154

SEQ ID NO: 665780 - RNA, 64 nt, Homo Sapiens; identical to SEQ ID NO: 161155

SEQ ID NO: 665781 - RNA, 64 nt, Homo Sapiens; identical to SEQ ID NO: 161156

SEQ ID NO: 665782 - RNA, 64 nt, Homo Sapiens; identical to SEQ ID NO: 161157

SEQ ID NO: 665783 - RNA, 64 nt, Homo Sapiens; identical to SEQ ID NO: 161158

SEQ ID NO: 665784 - RNA, 64 nt, Homo Sapiens; identical to SEQ ID NO: 161159

SEQ ID NO: 665785 - RNA, 64 nt, Homo Sapiens; identical to SEQ ID NO: 161160

SEQ ID NO: 665786 - RNA, 64 nt, Homo Sapiens; identical to SEQ ID NO: 161161

SEQ ID NO: 665787 - RNA, 64 nt, Homo Sapiens; identical to SEQ ID NO: 161162

SEQ ID NO: 665788 - RNA, 64 nt, Homo Sapiens; identical to SEQ ID NO: 161163

SEQ ID NO: 665789 - RNA, 64 nt, Homo Sapiens; identical to SEQ ID NO: 161164

SEQ ID NO: 665790 - RNA, 64 nt, Homo Sapiens; identical to SEQ ID NO: 161165

SEQ ID NO: 665791 - RNA, 64 nt, Homo Sapiens; identical to SEQ ID NO: 161166

SEQ ID NO: 665792 - RNA, 64 nt, Homo Sapiens; identical to SEQ ID NO: 161167

SEQ ID NO: 665793 - RNA, 64 nt, Homo Sapiens; identical to SEQ ID NO: 161168

SEQ ID NO: 665794 - RNA, 64 nt, Homo Sapiens; identical to SEQ ID NO: 161169

SEQ ID NO: 665795 - RNA, 64 nt, Homo Sapiens; identical to SEQ ID NO: 161170

SEQ ID NO: 665796 - RNA, 64 nt, Homo Sapiens; identical to SEQ ID NO: 161171

SEQ ID NO: 665797 - RNA, 64 nt, Homo Sapiens; identical to SEQ ID NO: 161172

SEQ ID NO: 665798 - RNA, 64 nt, Homo Sapiens; identical to SEQ ID NO: 161173

SEQ ID NO: 665799 - RNA, 64 nt, Homo Sapiens; identical to SEQ ID NO: 161174

SEQ ID NO: 665800 - RNA, 64 nt, Homo Sapiens; identical to SEQ ID NO: 161175

SEQ ID NO: 665801 - RNA, 64 nt, Homo Sapiens; identical to SEQ ID NO: 161176

SEQ ID NO: 665802 - RNA, 64 nt, Homo Sapiens; identical to SEQ ID NO: 161177

SEQ ID NO: 665803 - RNA, 64 nt, Homo Sapiens; identical to SEQ ID NO: 161178

SEQ ID NO: 665804 - RNA, 64 nt, Homo Sapiens; identical to SEQ ID NO: 161179

SEQ ID NO: 665805 - RNA, 64 nt, Homo Sapiens; identical to SEQ ID NO: 161180

SEQ ID NO: 665806 - RNA, 64 nt, Homo Sapiens; identical to SEQ ID NO: 161181

SEQ ID NO: 665807 - RNA, 64 nt, Homo Sapiens; identical to SEQ ID NO: 161182

SEQ ID NO: 665808 - RNA, 64 nt, Homo Sapiens; identical to SEQ ID NO: 161183

SEQ ID NO: 665809 - RNA, 64 nt, Homo Sapiens; identical to SEQ ID NO: 525800

SEQ ID NO: 665810 - RNA, 64 nt, Homo Sapiens; identical to SEQ ID NO: 525801

SEQ ID NO: 665811 - RNA, 64 nt, Homo Sapiens; identical to SEQ ID NO: 525802

SEQ ID NO: 665812 - RNA, 64 nt, Homo Sapiens; identical to SEQ ID NO: 525803

SEQ ID NO: 665813 - RNA, 64 nt, Homo Sapiens; identical to SEQ ID NO: 525804

SEQ ID NO: 665814 - RNA, 64 nt, Homo Sapiens; identical to SEQ ID NO: 525805

SEQ ID NO: 665815 - RNA, 64 nt, Homo Sapiens; identical to SEQ ID NO: 525806

SEQ ID NO: 665816 - RNA, 64 nt, Homo Sapiens; identical to SEQ ID NO: 525807

SEQ ID NO: 665817 - RNA, 64 nt, Homo Sapiens; identical to SEQ ID NO: 525808

SEQ ID NO: 665818 - RNA, 64 nt, Homo Sapiens; identical to SEQ ID NO: 525809

SEQ ID NO: 665819 - RNA, 64 nt, Homo Sapiens; identical to SEQ ID NO: 525810

SEQ ID NO: 665820 - RNA, 64 nt, Homo Sapiens; identical to SEQ ID NO: 525811

SEQ ID NO: 665821 - RNA, 64 nt, Homo Sapiens; identical to SEQ ID NO: 525812

SEQ ID NO: 665822 - RNA, 64 nt, Homo Sapiens; identical to SEQ ID NO: 525813

SEQ ID NO: 665823 - RNA, 64 nt, Homo Sapiens; identical to SEQ ID NO: 525814

SEQ ID NO: 665824 - RNA, 64 nt, Homo Sapiens; identical to SEQ ID NO: 525815

SEQ ID NO: 665825 - RNA, 64 nt, Homo Sapiens; identical to SEQ ID NO: 525816

SEQ ID NO: 665826 - RNA, 64 nt, Homo Sapiens; identical to SEQ ID NO: 525817

SEQ ID NO: 665827 - RNA, 64 nt, Homo Sapiens; identical to SEQ ID NO: 525818

SEQ ID NO: 665828 - RNA, 64 nt, Homo Sapiens; identical to SEQ ID NO: 525819

SEQ ID NO: 665829 - RNA, 64 nt, Homo Sapiens; identical to SEQ ID NO: 525820

SEQ ID NO: 665830 - RNA, 64 nt, Homo Sapiens; identical to SEQ ID NO: 525821

SEQ ID NO: 665831 - RNA, 64 nt, Homo Sapiens; identical to SEQ ID NO: 525822

SEQ ID NO: 665832 - RNA, 64 nt, Homo Sapiens; identical to SEQ ID NO: 525823

SEQ ID NO: 665833 - RNA, 64 nt, Homo Sapiens; identical to SEQ ID NO: 525824

SEQ ID NO: 665834 - RNA, 64 nt, Homo Sapiens; identical to SEQ ID NO: 525825

SEQ ID NO: 665835 - RNA, 64 nt, Homo Sapiens; identical to SEQ ID NO: 525826

SEQ ID NO: 665836 - RNA, 64 nt, Homo Sapiens; identical to SEQ ID NO: 525827

SEQ ID NO: 665837 - RNA, 64 nt, Homo Sapiens; identical to SEQ ID NO: 525828

SEQ ID NO: 665838 - RNA, 64 nt, Homo Sapiens; identical to SEQ ID NO: 525829

SEQ ID NO: 665839 - RNA, 64 nt, Homo Sapiens; identical to SEQ ID NO: 525830

SEQ ID NO: 665840 - RNA, 64 nt, Homo Sapiens; identical to SEQ ID NO: 525831

SEQ ID NO: 665841 - RNA, 64 nt, Homo Sapiens; identical to SEQ ID NO: 525832

SEQ ID NO: 665842 - RNA, 64 nt, Homo Sapiens; identical to SEQ ID NO: 525833

SEQ ID NO: 665843 - RNA, 64 nt, Homo Sapiens; identical to SEQ ID NO: 525834

SEQ ID NO: 665844 - RNA, 64 nt, Homo Sapiens; identical to SEQ ID NO: 525835

SEQ ID NO: 665845 - RNA, 64 nt, Homo Sapiens; identical to SEQ ID NO: 525836

SEQ ID NO: 665846 - RNA, 64 nt, Homo Sapiens; identical to SEQ ID NO: 525837

SEQ ID NO: 665847 - RNA, 64 nt, Homo Sapiens; identical to SEQ ID NO: 525838

SEQ ID NO: 665848 - RNA, 64 nt, Homo Sapiens; identical to SEQ ID NO: 525839

SEQ ID NO: 665849 - RNA, 64 nt, Homo Sapiens; identical to SEQ ID NO: 525840

SEQ ID NO: 665850 - RNA, 64 nt, Homo Sapiens; identical to SEQ ID NO: 525841

SEQ ID NO: 665851 - RNA, 64 nt, Homo Sapiens; identical to SEQ ID NO: 525842

SEQ ID NO: 665852 - RNA, 64 nt, Homo Sapiens; identical to SEQ ID NO: 525843

SEQ ID NO: 665853 - RNA, 64 nt, Homo Sapiens; identical to SEQ ID NO: 525844

SEQ ID NO: 665854 - RNA, 64 nt, Homo Sapiens; identical to SEQ ID NO: 525845

SEQ ID NO: 665855 - RNA, 64 nt, Homo Sapiens; identical to SEQ ID NO: 525846

SEQ ID NO: 665856 - RNA, 64 nt, Homo Sapiens; identical to SEQ ID NO: 525847

SEQ ID NO: 665857 - RNA, 64 nt, Homo Sapiens; identical to SEQ ID NO: 525848

SEQ ID NO: 665858 - RNA, 64 nt, Homo Sapiens; identical to SEQ ID NO: 525849

SEQ ID NO: 665859 - RNA, 64 nt, Homo Sapiens; identical to SEQ ID NO: 525850

SEQ ID NO: 665860 - RNA, 64 nt, Homo Sapiens; identical to SEQ ID NO: 525851

SEQ ID NO: 665861 - RNA, 64 nt, Homo Sapiens; identical to SEQ ID NO: 525852

SEQ ID NO: 665862 - RNA, 64 nt, Homo Sapiens; identical to SEQ ID NO: 525853

SEQ ID NO: 665863 - RNA, 64 nt, Homo Sapiens; identical to SEQ ID NO: 525854

SEQ ID NO: 665864 - RNA, 64 nt, Homo Sapiens; identical to SEQ ID NO: 525855

SEQ ID NO: 665865 - RNA, 64 nt, Homo Sapiens; identical to SEQ ID NO: 525856

SEQ ID NO: 665866 - RNA, 64 nt, Homo Sapiens; identical to SEQ ID NO: 525857

SEQ ID NO: 665867 - RNA, 64 nt, Homo Sapiens; identical to SEQ ID NO: 525858

SEQ ID NO: 665868 - RNA, 64 nt, Homo Sapiens; identical to SEQ ID NO: 525859

SEQ ID NO: 665869 - RNA, 64 nt, Homo Sapiens; identical to SEQ ID NO: 525860

SEQ ID NO: 665870 - RNA, 64 nt, Homo Sapiens; identical to SEQ ID NO: 525861

SEQ ID NO: 665871 - RNA, 64 nt, Homo Sapiens; identical to SEQ ID NO: 525862

SEQ ID NO: 665872 - RNA, 64 nt, Homo Sapiens; identical to SEQ ID NO: 525863

SEQ ID NO: 665873 - RNA, 64 nt, Homo Sapiens; identical to SEQ ID NO: 525864

SEQ ID NO: 665874 - RNA, 64 nt, Homo Sapiens; identical to SEQ ID NO: 525865

SEQ ID NO: 665875 - RNA, 64 nt, Homo Sapiens; identical to SEQ ID NO: 525866

SEQ ID NO: 665876 - RNA, 64 nt, Homo Sapiens; identical to SEQ ID NO: 525867

SEQ ID NO: 665877 - RNA, 64 nt, Homo Sapiens; identical to SEQ ID NO: 525868

SEQ ID NO: 665878 - RNA, 64 nt, Homo Sapiens; identical to SEQ ID NO: 525869

SEQ ID NO: 665879 - RNA, 64 nt, Homo Sapiens; identical to SEQ ID NO: 525870

SEQ ID NO: 665880 - RNA, 64 nt, Homo Sapiens; identical to SEQ ID NO: 525871

SEQ ID NO: 665881 - RNA, 64 nt, Homo Sapiens; identical to SEQ ID NO: 525872

SEQ ID NO: 665882 - RNA, 64 nt, Homo Sapiens; identical to SEQ ID NO: 525873

SEQ ID NO: 665883 - RNA, 64 nt, Homo Sapiens; identical to SEQ ID NO: 525874

SEQ ID NO: 665884 - RNA, 64 nt, Homo Sapiens; identical to SEQ ID NO: 525875

SEQ ID NO: 665885 - RNA, 64 nt, Homo Sapiens; identical to SEQ ID NO: 525876

SEQ ID NO: 665886 - RNA, 64 nt, Homo Sapiens; identical to SEQ ID NO: 525877

SEQ ID NO: 665887 - RNA, 64 nt, Homo Sapiens; identical to SEQ ID NO: 525878

SEQ ID NO: 665888 - RNA, 64 nt, Homo Sapiens; identical to SEQ ID NO: 525879

SEQ ID NO: 665889 - RNA, 64 nt, Homo Sapiens; identical to SEQ ID NO: 525880

SEQ ID NO: 665890 - RNA, 64 nt, Homo Sapiens; identical to SEQ ID NO: 525881

SEQ ID NO: 665891 - RNA, 64 nt, Homo Sapiens; identical to SEQ ID NO: 525882

SEQ ID NO: 665892 - RNA, 64 nt, Homo Sapiens; identical to SEQ ID NO: 525883

SEQ ID NO: 665893 - RNA, 64 nt, Homo Sapiens; identical to SEQ ID NO: 525884

SEQ ID NO: 665894 - RNA, 64 nt, Homo Sapiens; identical to SEQ ID NO: 525885

SEQ ID NO: 665895 - RNA, 64 nt, Homo Sapiens; identical to SEQ ID NO: 525886

SEQ ID NO: 665896 - RNA, 64 nt, Homo Sapiens; identical to SEQ ID NO: 525887

SEQ ID NO: 665897 - RNA, 64 nt, Homo Sapiens; identical to SEQ ID NO: 525888

SEQ ID NO: 665898 - RNA, 64 nt, Homo Sapiens; identical to SEQ ID NO: 525889

SEQ ID NO: 665899 - RNA, 64 nt, Homo Sapiens; identical to SEQ ID NO: 525890

SEQ ID NO: 665900 - RNA, 64 nt, Homo Sapiens; identical to SEQ ID NO: 525891

SEQ ID NO: 665901 - RNA, 64 nt, Homo Sapiens; identical to SEQ ID NO: 525892

SEQ ID NO: 665902 - RNA, 64 nt, Homo Sapiens; identical to SEQ ID NO: 525893

SEQ ID NO: 665903 - RNA, 64 nt, Homo Sapiens; identical to SEQ ID NO: 525894

SEQ ID NO: 665904 - RNA, 64 nt, Homo Sapiens; identical to SEQ ID NO: 525895

SEQ ID NO: 665905 - RNA, 64 nt, Homo Sapiens; identical to SEQ ID NO: 525896

SEQ ID NO: 665906 - RNA, 64 nt, Homo Sapiens; identical to SEQ ID NO: 525897

SEQ ID NO: 665907 - RNA, 64 nt, Homo Sapiens; identical to SEQ ID NO: 525898

SEQ ID NO: 665908 - RNA, 64 nt, Homo Sapiens; identical to SEQ ID NO: 525899

SEQ ID NO: 665909 - RNA, 64 nt, Homo Sapiens; identical to SEQ ID NO: 525900

SEQ ID NO: 665910 - RNA, 64 nt, Homo Sapiens; identical to SEQ ID NO: 525901

SEQ ID NO: 665911 - RNA, 64 nt, Homo Sapiens; identical to SEQ ID NO: 525902

SEQ ID NO: 665912 - RNA, 64 nt, Homo Sapiens; identical to SEQ ID NO: 525903

SEQ ID NO: 665913 - RNA, 64 nt, Homo Sapiens; identical to SEQ ID NO: 525904

SEQ ID NO: 665914 - RNA, 64 nt, Homo Sapiens; identical to SEQ ID NO: 525905

SEQ ID NO: 665915 - RNA, 64 nt, Homo Sapiens; identical to SEQ ID NO: 525906

SEQ ID NO: 665916 - RNA, 64 nt, Homo Sapiens; identical to SEQ ID NO: 525907

SEQ ID NO: 665917 - RNA, 64 nt, Homo Sapiens; identical to SEQ ID NO: 525908

SEQ ID NO: 665918 - RNA, 64 nt, Homo Sapiens; identical to SEQ ID NO: 525909

SEQ ID NO: 665919 - RNA, 64 nt, Homo Sapiens; identical to SEQ ID NO: 525910

SEQ ID NO: 665920 - RNA, 64 nt, Homo Sapiens; identical to SEQ ID NO: 525911

SEQ ID NO: 665921 - RNA, 64 nt, Homo Sapiens; identical to SEQ ID NO: 525912

SEQ ID NO: 665922 - RNA, 64 nt, Homo Sapiens; identical to SEQ ID NO: 525913

SEQ ID NO: 665923 - RNA, 64 nt, Homo Sapiens; identical to SEQ ID NO: 525914

SEQ ID NO: 665924 - RNA, 64 nt, Homo Sapiens; identical to SEQ ID NO: 525915

SEQ ID NO: 665925 - RNA, 64 nt, Homo Sapiens; identical to SEQ ID NO: 525916

SEQ ID NO: 665926 - RNA, 64 nt, Homo Sapiens; identical to SEQ ID NO: 525917

SEQ ID NO: 665927 - RNA, 64 nt, Homo Sapiens; identical to SEQ ID NO: 525918

SEQ ID NO: 665928 - RNA, 64 nt, Homo Sapiens; identical to SEQ ID NO: 525919

SEQ ID NO: 665929 - RNA, 64 nt, Homo Sapiens; identical to SEQ ID NO: 525920

SEQ ID NO: 665930 - RNA, 64 nt, Homo Sapiens; identical to SEQ ID NO: 525921

SEQ ID NO: 665931 - RNA, 64 nt, Homo Sapiens; identical to SEQ ID NO: 525922

SEQ ID NO: 665932 - RNA, 64 nt, Homo Sapiens; identical to SEQ ID NO: 525923

SEQ ID NO: 665933 - RNA, 64 nt, Homo Sapiens; identical to SEQ ID NO: 525924

SEQ ID NO: 665934 - RNA, 64 nt, Homo Sapiens; identical to SEQ ID NO: 525925

SEQ ID NO: 665935 - RNA, 64 nt, Homo Sapiens; identical to SEQ ID NO: 525926

SEQ ID NO: 665936 - RNA, 64 nt, Homo Sapiens; identical to SEQ ID NO: 525927

SEQ ID NO: 665937 - RNA, 64 nt, Homo Sapiens; identical to SEQ ID NO: 525928

SEQ ID NO: 665938 - RNA, 64 nt, Homo Sapiens; identical to SEQ ID NO: 525929

SEQ ID NO: 665939 - RNA, 64 nt, Homo Sapiens; identical to SEQ ID NO: 525930

SEQ ID NO: 665940 - RNA, 64 nt, Homo Sapiens; identical to SEQ ID NO: 525931

SEQ ID NO: 665941 - RNA, 64 nt, Homo Sapiens; identical to SEQ ID NO: 525932

SEQ ID NO: 665942 - RNA, 64 nt, Homo Sapiens; identical to SEQ ID NO: 525933

SEQ ID NO: 665943 - RNA, 64 nt, Homo Sapiens; identical to SEQ ID NO: 525934

SEQ ID NO: 665944 - RNA, 64 nt, Homo Sapiens; identical to SEQ ID NO: 525935

SEQ ID NO: 665945 - RNA, 64 nt, Homo Sapiens; identical to SEQ ID NO: 525936

SEQ ID NO: 665946 - RNA, 64 nt, Homo Sapiens; identical to SEQ ID NO: 525937

SEQ ID NO: 665947 - RNA, 64 nt, Homo Sapiens; identical to SEQ ID NO: 525938

SEQ ID NO: 665948 - RNA, 64 nt, Homo Sapiens; identical to SEQ ID NO: 525939

SEQ ID NO: 665949 - RNA, 64 nt, Homo Sapiens; identical to SEQ ID NO: 525940

SEQ ID NO: 665950 - RNA, 64 nt, Homo Sapiens; identical to SEQ ID NO: 525941

SEQ ID NO: 665951 - RNA, 64 nt, Homo Sapiens; identical to SEQ ID NO: 525942

SEQ ID NO: 665952 - RNA, 64 nt, Homo Sapiens; identical to SEQ ID NO: 525943

SEQ ID NO: 665953 - RNA, 64 nt, Homo Sapiens; identical to SEQ ID NO: 525944

SEQ ID NO: 665954 - RNA, 64 nt, Homo Sapiens; identical to SEQ ID NO: 525945

SEQ ID NO: 665955 - RNA, 64 nt, Homo Sapiens; identical to SEQ ID NO: 525946

SEQ ID NO: 665956 - RNA, 64 nt, Homo Sapiens; identical to SEQ ID NO: 525947

SEQ ID NO: 665957 - RNA, 64 nt, Homo Sapiens; identical to SEQ ID NO: 525948

SEQ ID NO: 665958 - RNA, 64 nt, Homo Sapiens; identical to SEQ ID NO: 525949

SEQ ID NO: 665959 - RNA, 64 nt, Homo Sapiens; identical to SEQ ID NO: 525950

SEQ ID NO: 665960 - RNA, 64 nt, Homo Sapiens; identical to SEQ ID NO: 525951

SEQ ID NO: 665961 - RNA, 64 nt, Homo Sapiens; identical to SEQ ID NO: 525952

SEQ ID NO: 665962 - RNA, 64 nt, Homo Sapiens; identical to SEQ ID NO: 525953

SEQ ID NO: 665963 - RNA, 64 nt, Homo Sapiens; identical to SEQ ID NO: 525954

SEQ ID NO: 665964 - RNA, 64 nt, Homo Sapiens; identical to SEQ ID NO: 525955

SEQ ID NO: 665965 - RNA, 64 nt, Homo Sapiens; identical to SEQ ID NO: 525956

SEQ ID NO: 665966 - RNA, 64 nt, Homo Sapiens; identical to SEQ ID NO: 525957

SEQ ID NO: 665967 - RNA, 64 nt, Homo Sapiens; identical to SEQ ID NO: 525958

SEQ ID NO: 665968 - RNA, 64 nt, Homo Sapiens; identical to SEQ ID NO: 525959

SEQ ID NO: 665969 - RNA, 58 nt, Homo Sapiens; identical to SEQ ID NO: 525960

SEQ ID NO: 665970 - RNA, 64 nt, Homo Sapiens; identical to SEQ ID NO: 525961

SEQ ID NO: 665971 - RNA, 64 nt, Homo Sapiens; identical to SEQ ID NO: 525962

SEQ ID NO: 665972 - RNA, 64 nt, Homo Sapiens; identical to SEQ ID NO: 525963

SEQ ID NO: 665973 - RNA, 64 nt, Homo Sapiens; identical to SEQ ID NO: 525964

SEQ ID NO: 665974 - RNA, 64 nt, Homo Sapiens; identical to SEQ ID NO: 525965

SEQ ID NO: 665975 - RNA, 64 nt, Homo Sapiens; identical to SEQ ID NO: 525966

SEQ ID NO: 665976 - RNA, 64 nt, Homo Sapiens; identical to SEQ ID NO: 525967

SEQ ID NO: 665977 - RNA, 64 nt, Homo Sapiens; identical to SEQ ID NO: 525968

SEQ ID NO: 665978 - RNA, 64 nt, Homo Sapiens; identical to SEQ ID NO: 525969

SEQ ID NO: 665979 - RNA, 64 nt, Homo Sapiens; identical to SEQ ID NO: 525970

SEQ ID NO: 665980 - RNA, 64 nt, Homo Sapiens; identical to SEQ ID NO: 525971

SEQ ID NO: 665981 - RNA, 64 nt, Homo Sapiens; identical to SEQ ID NO: 525972

SEQ ID NO: 665982 - RNA, 64 nt, Homo Sapiens; identical to SEQ ID NO: 525973

SEQ ID NO: 665983 - RNA, 64 nt, Homo Sapiens; identical to SEQ ID NO: 525974

SEQ ID NO: 665984 - RNA, 64 nt, Homo Sapiens; identical to SEQ ID NO: 525975

SEQ ID NO: 665985 - RNA, 64 nt, Homo Sapiens; identical to SEQ ID NO: 525976

SEQ ID NO: 665986 - RNA, 64 nt, Homo Sapiens; identical to SEQ ID NO: 525977

SEQ ID NO: 665987 - RNA, 64 nt, Homo Sapiens; identical to SEQ ID NO: 525978

SEQ ID NO: 665988 - RNA, 64 nt, Homo Sapiens; identical to SEQ ID NO: 525979

SEQ ID NO: 665989 - RNA, 64 nt, Homo Sapiens; identical to SEQ ID NO: 525980

SEQ ID NO: 665990 - RNA, 64 nt, Homo Sapiens; identical to SEQ ID NO: 525981

SEQ ID NO: 665991 - RNA, 64 nt, Homo Sapiens; identical to SEQ ID NO: 525982

SEQ ID NO: 665992 - RNA, 64 nt, Homo Sapiens; identical to SEQ ID NO: 525983

SEQ ID NO: 665993 - RNA, 64 nt, Homo Sapiens; identical to SEQ ID NO: 525984

SEQ ID NO: 665994 - RNA, 64 nt, Homo Sapiens; identical to SEQ ID NO: 525985

SEQ ID NO: 665995 - RNA, 64 nt, Homo Sapiens; identical to SEQ ID NO: 525986

SEQ ID NO: 665996 - RNA, 64 nt, Homo Sapiens; identical to SEQ ID NO: 525987

SEQ ID NO: 665997 - RNA, 64 nt, Homo Sapiens; identical to SEQ ID NO: 525988

SEQ ID NO: 665998 - RNA, 64 nt, Homo Sapiens; identical to SEQ ID NO: 525989

SEQ ID NO: 665999 - RNA, 64 nt, Homo Sapiens; identical to SEQ ID NO: 525990

SEQ ID NO: 666000 - RNA, 64 nt, Homo Sapiens; identical to SEQ ID NO: 525991

SEQ ID NO: 666001 - RNA, 64 nt, Homo Sapiens; identical to SEQ ID NO: 525992

SEQ ID NO: 666002 - RNA, 64 nt, Homo Sapiens; identical to SEQ ID NO: 525993

SEQ ID NO: 666003 - RNA, 64 nt, Homo Sapiens; identical to SEQ ID NO: 525994

SEQ ID NO: 666004 - RNA, 64 nt, Homo Sapiens; identical to SEQ ID NO: 525995

SEQ ID NO: 666005 - RNA, 64 nt, Homo Sapiens; identical to SEQ ID NO: 525996

SEQ ID NO: 666006 - RNA, 64 nt, Homo Sapiens; identical to SEQ ID NO: 525997

SEQ ID NO: 666007 - RNA, 64 nt, Homo Sapiens; identical to SEQ ID NO: 525998

SEQ ID NO: 666008 - RNA, 64 nt, Homo Sapiens; identical to SEQ ID NO: 525999

SEQ ID NO: 666009 - RNA, 64 nt, Homo Sapiens; identical to SEQ ID NO: 526000

SEQ ID NO: 666010 - RNA, 64 nt, Homo Sapiens; identical to SEQ ID NO: 526001

SEQ ID NO: 666011 - RNA, 64 nt, Homo Sapiens; identical to SEQ ID NO: 526002

SEQ ID NO: 666012 - RNA, 64 nt, Homo Sapiens; identical to SEQ ID NO: 526003

SEQ ID NO: 666013 - RNA, 64 nt, Homo Sapiens; identical to SEQ ID NO: 526004

SEQ ID NO: 666014 - RNA, 64 nt, Homo Sapiens; identical to SEQ ID NO: 526005

SEQ ID NO: 666015 - RNA, 64 nt, Homo Sapiens; identical to SEQ ID NO: 526006

SEQ ID NO: 666016 - RNA, 64 nt, Homo Sapiens; identical to SEQ ID NO: 526007

SEQ ID NO: 666017 - RNA, 64 nt, Homo Sapiens; identical to SEQ ID NO: 526008

SEQ ID NO: 666018 - RNA, 64 nt, Homo Sapiens; identical to SEQ ID NO: 526009

SEQ ID NO: 666019 - RNA, 64 nt, Homo Sapiens; identical to SEQ ID NO: 526010

SEQ ID NO: 666020 - RNA, 64 nt, Homo Sapiens; identical to SEQ ID NO: 526011

SEQ ID NO: 666021 - RNA, 64 nt, Homo Sapiens; identical to SEQ ID NO: 526012

SEQ ID NO: 666022 - RNA, 64 nt, Homo Sapiens; identical to SEQ ID NO: 526013

SEQ ID NO: 666023 - RNA, 64 nt, Homo Sapiens; identical to SEQ ID NO: 526014

SEQ ID NO: 666024 - RNA, 64 nt, Homo Sapiens; identical to SEQ ID NO: 526015

SEQ ID NO: 666025 - RNA, 64 nt, Homo Sapiens; identical to SEQ ID NO: 526016

SEQ ID NO: 666026 - RNA, 64 nt, Homo Sapiens; identical to SEQ ID NO: 526017

SEQ ID NO: 666027 - RNA, 64 nt, Homo Sapiens; identical to SEQ ID NO: 526018

SEQ ID NO: 666028 - RNA, 64 nt, Homo Sapiens; identical to SEQ ID NO: 526019

SEQ ID NO: 666029 - RNA, 64 nt, Homo Sapiens; identical to SEQ ID NO: 526020

SEQ ID NO: 666030 - RNA, 64 nt, Homo Sapiens; identical to SEQ ID NO: 526021

SEQ ID NO: 666031 - RNA, 64 nt, Homo Sapiens; identical to SEQ ID NO: 526022

SEQ ID NO: 666032 - RNA, 64 nt, Homo Sapiens; identical to SEQ ID NO: 526023

SEQ ID NO: 666033 - RNA, 64 nt, Homo Sapiens; identical to SEQ ID NO: 526024

SEQ ID NO: 666034 - RNA, 64 nt, Homo Sapiens; identical to SEQ ID NO: 526025

SEQ ID NO: 666035 - RNA, 64 nt, Homo Sapiens; identical to SEQ ID NO: 526026

SEQ ID NO: 666036 - RNA, 64 nt, Homo Sapiens; identical to SEQ ID NO: 526027

SEQ ID NO: 666037 - RNA, 64 nt, Homo Sapiens; identical to SEQ ID NO: 526028

SEQ ID NO: 666038 - RNA, 64 nt, Homo Sapiens; identical to SEQ ID NO: 526029

SEQ ID NO: 666039 - RNA, 64 nt, Homo Sapiens; identical to SEQ ID NO: 526030

SEQ ID NO: 666040 - RNA, 64 nt, Homo Sapiens; identical to SEQ ID NO: 526031

SEQ ID NO: 666041 - RNA, 64 nt, Homo Sapiens; identical to SEQ ID NO: 526032

SEQ ID NO: 666042 - RNA, 64 nt, Homo Sapiens; identical to SEQ ID NO: 526033

SEQ ID NO: 666043 - RNA, 64 nt, Homo Sapiens; identical to SEQ ID NO: 526034

SEQ ID NO: 666044 - RNA, 64 nt, Homo Sapiens; identical to SEQ ID NO: 526035

SEQ ID NO: 666045 - RNA, 64 nt, Homo Sapiens; identical to SEQ ID NO: 526036

SEQ ID NO: 666046 - RNA, 64 nt, Homo Sapiens; identical to SEQ ID NO: 526037

SEQ ID NO: 666047 - RNA, 64 nt, Homo Sapiens; identical to SEQ ID NO: 526038

SEQ ID NO: 666048 - RNA, 64 nt, Homo Sapiens; identical to SEQ ID NO: 526039

SEQ ID NO: 666049 - RNA, 64 nt, Homo Sapiens; identical to SEQ ID NO: 526040

SEQ ID NO: 666050 - RNA, 64 nt, Homo Sapiens; identical to SEQ ID NO: 526041

SEQ ID NO: 666051 - RNA, 64 nt, Homo Sapiens; identical to SEQ ID NO: 526042

SEQ ID NO: 666052 - RNA, 64 nt, Homo Sapiens; identical to SEQ ID NO: 526043

SEQ ID NO: 666053 - RNA, 64 nt, Homo Sapiens; identical to SEQ ID NO: 526044

SEQ ID NO: 666054 - RNA, 64 nt, Homo Sapiens; identical to SEQ ID NO: 526045

SEQ ID NO: 666055 - RNA, 64 nt, Homo Sapiens; identical to SEQ ID NO: 526046

SEQ ID NO: 666056 - RNA, 64 nt, Homo Sapiens; identical to SEQ ID NO: 526047

SEQ ID NO: 666057 - RNA, 64 nt, Homo Sapiens; identical to SEQ ID NO: 526048

SEQ ID NO: 666058 - RNA, 64 nt, Homo Sapiens; identical to SEQ ID NO: 526049

SEQ ID NO: 666059 - RNA, 64 nt, Homo Sapiens; identical to SEQ ID NO: 526050

SEQ ID NO: 666060 - RNA, 64 nt, Homo Sapiens; identical to SEQ ID NO: 526051

SEQ ID NO: 666061 - RNA, 64 nt, Homo Sapiens; identical to SEQ ID NO: 526052

SEQ ID NO: 666062 - RNA, 64 nt, Homo Sapiens; identical to SEQ ID NO: 526053

SEQ ID NO: 666063 - RNA, 64 nt, Homo Sapiens; identical to SEQ ID NO: 526054

SEQ ID NO: 666064 - RNA, 64 nt, Homo Sapiens; identical to SEQ ID NO: 526055

SEQ ID NO: 666065 - RNA, 64 nt, Homo Sapiens; identical to SEQ ID NO: 526056

SEQ ID NO: 666066 - RNA, 64 nt, Homo Sapiens; identical to SEQ ID NO: 526057

SEQ ID NO: 666067 - RNA, 64 nt, Homo Sapiens; identical to SEQ ID NO: 526058

SEQ ID NO: 666068 - RNA, 64 nt, Homo Sapiens; identical to SEQ ID NO: 526059

SEQ ID NO: 666069 - RNA, 64 nt, Homo Sapiens; identical to SEQ ID NO: 526060

SEQ ID NO: 666070 - RNA, 64 nt, Homo Sapiens; identical to SEQ ID NO: 526061

SEQ ID NO: 666071 - RNA, 64 nt, Homo Sapiens; identical to SEQ ID NO: 526062

SEQ ID NO: 666072 - RNA, 64 nt, Homo Sapiens; identical to SEQ ID NO: 526063

SEQ ID NO: 666073 - RNA, 64 nt, Homo Sapiens; identical to SEQ ID NO: 526064

SEQ ID NO: 666074 - RNA, 64 nt, Homo Sapiens; identical to SEQ ID NO: 526065

SEQ ID NO: 666075 - RNA, 64 nt, Homo Sapiens; identical to SEQ ID NO: 526066

SEQ ID NO: 666076 - RNA, 64 nt, Homo Sapiens; identical to SEQ ID NO: 526067

SEQ ID NO: 666077 - RNA, 64 nt, Homo Sapiens; identical to SEQ ID NO: 526068

SEQ ID NO: 666078 - RNA, 64 nt, Homo Sapiens; identical to SEQ ID NO: 526069

SEQ ID NO: 666079 - RNA, 64 nt, Homo Sapiens; identical to SEQ ID NO: 526070

SEQ ID NO: 666080 - RNA, 64 nt, Homo Sapiens; identical to SEQ ID NO: 526071

SEQ ID NO: 666081 - RNA, 64 nt, Homo Sapiens; identical to SEQ ID NO: 526072

SEQ ID NO: 666082 - RNA, 64 nt, Homo Sapiens; identical to SEQ ID NO: 526073

SEQ ID NO: 666083 - RNA, 64 nt, Homo Sapiens; identical to SEQ ID NO: 526074

SEQ ID NO: 666084 - RNA, 64 nt, Homo Sapiens; identical to SEQ ID NO: 526075

SEQ ID NO: 666085 - RNA, 64 nt, Homo Sapiens; identical to SEQ ID NO: 526076

SEQ ID NO: 666086 - RNA, 64 nt, Homo Sapiens; identical to SEQ ID NO: 526077

SEQ ID NO: 666087 - RNA, 64 nt, Homo Sapiens; identical to SEQ ID NO: 526078

SEQ ID NO: 666088 - RNA, 64 nt, Homo Sapiens; identical to SEQ ID NO: 526079

SEQ ID NO: 666089 - RNA, 64 nt, Homo Sapiens; identical to SEQ ID NO: 526080

SEQ ID NO: 666090 - RNA, 64 nt, Homo Sapiens; identical to SEQ ID NO: 526081

SEQ ID NO: 666091 - RNA, 64 nt, Homo Sapiens; identical to SEQ ID NO: 526082

SEQ ID NO: 666092 - RNA, 64 nt, Homo Sapiens; identical to SEQ ID NO: 526083

SEQ ID NO: 666093 - RNA, 64 nt, Homo Sapiens; identical to SEQ ID NO: 526084

SEQ ID NO: 666094 - RNA, 64 nt, Homo Sapiens; identical to SEQ ID NO: 526085

SEQ ID NO: 666095 - RNA, 64 nt, Homo Sapiens; identical to SEQ ID NO: 526086

SEQ ID NO: 666096 - RNA, 64 nt, Homo Sapiens; identical to SEQ ID NO: 526087

SEQ ID NO: 666097 - RNA, 64 nt, Homo Sapiens; identical to SEQ ID NO: 526088

SEQ ID NO: 666098 - RNA, 64 nt, Homo Sapiens; identical to SEQ ID NO: 526089

SEQ ID NO: 666099 - RNA, 64 nt, Homo Sapiens; identical to SEQ ID NO: 526090

SEQ ID NO: 666100 - RNA, 64 nt, Homo Sapiens; identical to SEQ ID NO: 526091

SEQ ID NO: 666101 - RNA, 64 nt, Homo Sapiens; identical to SEQ ID NO: 526092

SEQ ID NO: 666102 - RNA, 64 nt, Homo Sapiens; identical to SEQ ID NO: 526093

SEQ ID NO: 666103 - RNA, 64 nt, Homo Sapiens; identical to SEQ ID NO: 526094

SEQ ID NO: 666104 - RNA, 64 nt, Homo Sapiens; identical to SEQ ID NO: 526095

SEQ ID NO: 666105 - RNA, 64 nt, Homo Sapiens; identical to SEQ ID NO: 526096

SEQ ID NO: 666106 - RNA, 64 nt, Homo Sapiens; identical to SEQ ID NO: 526097

SEQ ID NO: 666107 - RNA, 64 nt, Homo Sapiens; identical to SEQ ID NO: 526098

SEQ ID NO: 666108 - RNA, 63 nt, Homo Sapiens; identical to SEQ ID NO: 526099

SEQ ID NO: 666109 - RNA, 64 nt, Homo Sapiens; identical to SEQ ID NO: 526100

SEQ ID NO: 666110 - RNA, 64 nt, Homo Sapiens; identical to SEQ ID NO: 526101

SEQ ID NO: 666111 - RNA, 64 nt, Homo Sapiens; identical to SEQ ID NO: 526102

SEQ ID NO: 666112 - RNA, 64 nt, Homo Sapiens; identical to SEQ ID NO: 526103

SEQ ID NO: 666113 - RNA, 64 nt, Homo Sapiens; identical to SEQ ID NO: 526104

SEQ ID NO: 666114 - RNA, 64 nt, Homo Sapiens; identical to SEQ ID NO: 526105

SEQ ID NO: 666115 - RNA, 64 nt, Homo Sapiens; identical to SEQ ID NO: 526106

SEQ ID NO: 666116 - RNA, 64 nt, Homo Sapiens; identical to SEQ ID NO: 526107

SEQ ID NO: 666117 - RNA, 64 nt, Homo Sapiens; identical to SEQ ID NO: 526108

SEQ ID NO: 666118 - RNA, 64 nt, Homo Sapiens; identical to SEQ ID NO: 526109

SEQ ID NO: 666119 - RNA, 64 nt, Homo Sapiens; identical to SEQ ID NO: 526110

SEQ ID NO: 666120 - RNA, 64 nt, Homo Sapiens; identical to SEQ ID NO: 526111

SEQ ID NO: 666121 - RNA, 64 nt, Homo Sapiens; identical to SEQ ID NO: 526112

SEQ ID NO: 666122 - RNA, 64 nt, Homo Sapiens; identical to SEQ ID NO: 526113

SEQ ID NO: 666123 - RNA, 64 nt, Homo Sapiens; identical to SEQ ID NO: 526114

SEQ ID NO: 666124 - RNA, 64 nt, Homo Sapiens; identical to SEQ ID NO: 526115

SEQ ID NO: 666125 - RNA, 64 nt, Homo Sapiens; identical to SEQ ID NO: 526116

SEQ ID NO: 666126 - RNA, 64 nt, Homo Sapiens; identical to SEQ ID NO: 526117

SEQ ID NO: 666127 - RNA, 64 nt, Homo Sapiens; identical to SEQ ID NO: 526118

SEQ ID NO: 666128 - RNA, 64 nt, Homo Sapiens; identical to SEQ ID NO: 526119

SEQ ID NO: 666129 - RNA, 64 nt, Homo Sapiens; identical to SEQ ID NO: 526120

SEQ ID NO: 666130 - RNA, 64 nt, Homo Sapiens; identical to SEQ ID NO: 526121

SEQ ID NO: 666131 - RNA, 64 nt, Homo Sapiens; identical to SEQ ID NO: 526122

SEQ ID NO: 666132 - RNA, 64 nt, Homo Sapiens; identical to SEQ ID NO: 526123

SEQ ID NO: 666133 - RNA, 64 nt, Homo Sapiens; identical to SEQ ID NO: 526124

SEQ ID NO: 666134 - RNA, 64 nt, Homo Sapiens; identical to SEQ ID NO: 526125

SEQ ID NO: 666135 - RNA, 64 nt, Homo Sapiens; identical to SEQ ID NO: 526126

SEQ ID NO: 666136 - RNA, 64 nt, Homo Sapiens; identical to SEQ ID NO: 526127

SEQ ID NO: 666137 - RNA, 64 nt, Homo Sapiens; identical to SEQ ID NO: 526128

SEQ ID NO: 666138 - RNA, 64 nt, Homo Sapiens; identical to SEQ ID NO: 526129

SEQ ID NO: 666139 - RNA, 64 nt, Homo Sapiens; identical to SEQ ID NO: 526130

SEQ ID NO: 666140 - RNA, 64 nt, Homo Sapiens; identical to SEQ ID NO: 526131

SEQ ID NO: 666141 - RNA, 64 nt, Homo Sapiens; identical to SEQ ID NO: 526132

SEQ ID NO: 666142 - RNA, 64 nt, Homo Sapiens; identical to SEQ ID NO: 526133

SEQ ID NO: 666143 - RNA, 64 nt, Homo Sapiens; identical to SEQ ID NO: 526134

SEQ ID NO: 666144 - RNA, 64 nt, Homo Sapiens; identical to SEQ ID NO: 526135

SEQ ID NO: 666145 - RNA, 64 nt, Homo Sapiens; identical to SEQ ID NO: 526136

SEQ ID NO: 666146 - RNA, 64 nt, Homo Sapiens; identical to SEQ ID NO: 526137

SEQ ID NO: 666147 - RNA, 64 nt, Homo Sapiens; identical to SEQ ID NO: 526138

SEQ ID NO: 666148 - RNA, 64 nt, Homo Sapiens; identical to SEQ ID NO: 526139

SEQ ID NO: 666149 - RNA, 64 nt, Homo Sapiens; identical to SEQ ID NO: 526140

SEQ ID NO: 666150 - RNA, 64 nt, Homo Sapiens; identical to SEQ ID NO: 526141

SEQ ID NO: 666151 - RNA, 64 nt, Homo Sapiens; identical to SEQ ID NO: 526142

SEQ ID NO: 666152 - RNA, 64 nt, Homo Sapiens; identical to SEQ ID NO: 526143

SEQ ID NO: 666153 - RNA, 64 nt, Homo Sapiens; identical to SEQ ID NO: 526144

SEQ ID NO: 666154 - RNA, 64 nt, Homo Sapiens; identical to SEQ ID NO: 526145

SEQ ID NO: 666155 - RNA, 64 nt, Homo Sapiens; identical to SEQ ID NO: 526146

SEQ ID NO: 666156 - RNA, 52 nt, Homo Sapiens; identical to SEQ ID NO: 526147

SEQ ID NO: 666157 - RNA, 64 nt, Homo Sapiens; identical to SEQ ID NO: 526148

SEQ ID NO: 666158 - RNA, 64 nt, Homo Sapiens; identical to SEQ ID NO: 526149

SEQ ID NO: 666159 - RNA, 64 nt, Homo Sapiens; identical to SEQ ID NO: 526150

SEQ ID NO: 666160 - RNA, 64 nt, Homo Sapiens; identical to SEQ ID NO: 526151

SEQ ID NO: 666161 - RNA, 64 nt, Homo Sapiens; identical to SEQ ID NO: 526152

SEQ ID NO: 666162 - RNA, 64 nt, Homo Sapiens; identical to SEQ ID NO: 526153

SEQ ID NO: 666163 - RNA, 64 nt, Homo Sapiens; identical to SEQ ID NO: 526154

SEQ ID NO: 666164 - RNA, 64 nt, Homo Sapiens; identical to SEQ ID NO: 526155

SEQ ID NO: 666165 - RNA, 64 nt, Homo Sapiens; identical to SEQ ID NO: 526156

SEQ ID NO: 666166 - RNA, 64 nt, Homo Sapiens; identical to SEQ ID NO: 526157

SEQ ID NO: 666167 - RNA, 64 nt, Homo Sapiens; identical to SEQ ID NO: 526158

SEQ ID NO: 666168 - RNA, 64 nt, Homo Sapiens; identical to SEQ ID NO: 526159

SEQ ID NO: 666169 - RNA, 64 nt, Homo Sapiens; identical to SEQ ID NO: 526160

SEQ ID NO: 666170 - RNA, 64 nt, Homo Sapiens; identical to SEQ ID NO: 526161

SEQ ID NO: 666171 - RNA, 64 nt, Homo Sapiens; identical to SEQ ID NO: 526162

SEQ ID NO: 666172 - RNA, 64 nt, Homo Sapiens; identical to SEQ ID NO: 526163

SEQ ID NO: 666173 - RNA, 64 nt, Homo Sapiens; identical to SEQ ID NO: 526164

SEQ ID NO: 666174 - RNA, 64 nt, Homo Sapiens; identical to SEQ ID NO: 526165

SEQ ID NO: 666175 - RNA, 64 nt, Homo Sapiens; identical to SEQ ID NO: 526166

SEQ ID NO: 666176 - RNA, 64 nt, Homo Sapiens; identical to SEQ ID NO: 526167

SEQ ID NO: 666177 - RNA, 64 nt, Homo Sapiens; identical to SEQ ID NO: 526168

SEQ ID NO: 666178 - RNA, 64 nt, Homo Sapiens; identical to SEQ ID NO: 526169

SEQ ID NO: 666179 - RNA, 64 nt, Homo Sapiens; identical to SEQ ID NO: 526170

SEQ ID NO: 666180 - RNA, 64 nt, Homo Sapiens; identical to SEQ ID NO: 526171

SEQ ID NO: 666181 - RNA, 64 nt, Homo Sapiens; identical to SEQ ID NO: 526172

SEQ ID NO: 666182 - RNA, 64 nt, Homo Sapiens; identical to SEQ ID NO: 526173

SEQ ID NO: 666183 - RNA, 64 nt, Homo Sapiens; identical to SEQ ID NO: 526174

SEQ ID NO: 666184 - RNA, 64 nt, Homo Sapiens; identical to SEQ ID NO: 526175

SEQ ID NO: 666185 - RNA, 64 nt, Homo Sapiens; identical to SEQ ID NO: 526176

SEQ ID NO: 666186 - RNA, 64 nt, Homo Sapiens; identical to SEQ ID NO: 526177

SEQ ID NO: 666187 - RNA, 64 nt, Homo Sapiens; identical to SEQ ID NO: 526178

SEQ ID NO: 666188 - RNA, 64 nt, Homo Sapiens; identical to SEQ ID NO: 526179

SEQ ID NO: 666189 - RNA, 64 nt, Homo Sapiens; identical to SEQ ID NO: 526180

SEQ ID NO: 666190 - RNA, 64 nt, Homo Sapiens; identical to SEQ ID NO: 526181

SEQ ID NO: 666191 - RNA, 64 nt, Homo Sapiens; identical to SEQ ID NO: 526182

SEQ ID NO: 666192 - RNA, 64 nt, Homo Sapiens; identical to SEQ ID NO: 526183

SEQ ID NO: 666193 - RNA, 64 nt, Homo Sapiens; identical to SEQ ID NO: 526184

SEQ ID NO: 666194 - RNA, 64 nt, Homo Sapiens; identical to SEQ ID NO: 526185

SEQ ID NO: 666195 - RNA, 64 nt, Homo Sapiens; identical to SEQ ID NO: 526186

SEQ ID NO: 666196 - RNA, 64 nt, Homo Sapiens; identical to SEQ ID NO: 526187

SEQ ID NO: 666197 - RNA, 64 nt, Homo Sapiens; identical to SEQ ID NO: 526188

SEQ ID NO: 666198 - RNA, 64 nt, Homo Sapiens; identical to SEQ ID NO: 526189

SEQ ID NO: 666199 - RNA, 64 nt, Homo Sapiens; identical to SEQ ID NO: 526190

SEQ ID NO: 666200 - RNA, 64 nt, Homo Sapiens; identical to SEQ ID NO: 526191

SEQ ID NO: 666201 - RNA, 64 nt, Homo Sapiens; identical to SEQ ID NO: 526192

SEQ ID NO: 666202 - RNA, 64 nt, Homo Sapiens; identical to SEQ ID NO: 526193

SEQ ID NO: 666203 - RNA, 64 nt, Homo Sapiens; identical to SEQ ID NO: 526194

SEQ ID NO: 666204 - RNA, 64 nt, Homo Sapiens; identical to SEQ ID NO: 526195

SEQ ID NO: 666205 - RNA, 64 nt, Homo Sapiens; identical to SEQ ID NO: 526196

SEQ ID NO: 666206 - RNA, 64 nt, Homo Sapiens; identical to SEQ ID NO: 526197

SEQ ID NO: 666207 - RNA, 64 nt, Homo Sapiens; identical to SEQ ID NO: 526198

SEQ ID NO: 666208 - RNA, 64 nt, Homo Sapiens; identical to SEQ ID NO: 526199

SEQ ID NO: 666209 - RNA, 64 nt, Homo Sapiens; identical to SEQ ID NO: 526200

SEQ ID NO: 666210 - RNA, 64 nt, Homo Sapiens; identical to SEQ ID NO: 526201

SEQ ID NO: 666211 - RNA, 64 nt, Homo Sapiens; identical to SEQ ID NO: 526202

SEQ ID NO: 666212 - RNA, 64 nt, Homo Sapiens; identical to SEQ ID NO: 526203

SEQ ID NO: 666213 - RNA, 64 nt, Homo Sapiens; identical to SEQ ID NO: 526204

SEQ ID NO: 666214 - RNA, 64 nt, Homo Sapiens; identical to SEQ ID NO: 526205

SEQ ID NO: 666215 - RNA, 64 nt, Homo Sapiens; identical to SEQ ID NO: 526206

SEQ ID NO: 666216 - RNA, 64 nt, Homo Sapiens; identical to SEQ ID NO: 526207

SEQ ID NO: 666217 - RNA, 64 nt, Homo Sapiens; identical to SEQ ID NO: 526208

SEQ ID NO: 666218 - RNA, 64 nt, Homo Sapiens; identical to SEQ ID NO: 526209

SEQ ID NO: 666219 - RNA, 64 nt, Homo Sapiens; identical to SEQ ID NO: 526210

SEQ ID NO: 666220 - RNA, 64 nt, Homo Sapiens; identical to SEQ ID NO: 526211

SEQ ID NO: 666221 - RNA, 64 nt, Homo Sapiens; identical to SEQ ID NO: 526212

SEQ ID NO: 666222 - RNA, 64 nt, Homo Sapiens; identical to SEQ ID NO: 526213

SEQ ID NO: 666223 - RNA, 64 nt, Homo Sapiens; identical to SEQ ID NO: 526214

SEQ ID NO: 666224 - RNA, 64 nt, Homo Sapiens; identical to SEQ ID NO: 526215

SEQ ID NO: 666225 - RNA, 64 nt, Homo Sapiens; identical to SEQ ID NO: 526216

SEQ ID NO: 666226 - RNA, 64 nt, Homo Sapiens; identical to SEQ ID NO: 526217

SEQ ID NO: 666227 - RNA, 64 nt, Homo Sapiens; identical to SEQ ID NO: 526218

SEQ ID NO: 666228 - RNA, 64 nt, Homo Sapiens; identical to SEQ ID NO: 526219

SEQ ID NO: 666229 - RNA, 64 nt, Homo Sapiens; identical to SEQ ID NO: 526220

SEQ ID NO: 666230 - RNA, 64 nt, Homo Sapiens; identical to SEQ ID NO: 526221

SEQ ID NO: 666231 - RNA, 64 nt, Homo Sapiens; identical to SEQ ID NO: 526222

SEQ ID NO: 666232 - RNA, 64 nt, Homo Sapiens; identical to SEQ ID NO: 526223

SEQ ID NO: 666233 - RNA, 64 nt, Homo Sapiens; identical to SEQ ID NO: 526224

SEQ ID NO: 666234 - RNA, 64 nt, Homo Sapiens; identical to SEQ ID NO: 526225

SEQ ID NO: 666235 - RNA, 64 nt, Homo Sapiens; identical to SEQ ID NO: 526226

SEQ ID NO: 666236 - RNA, 64 nt, Homo Sapiens; identical to SEQ ID NO: 526227

SEQ ID NO: 666237 - RNA, 64 nt, Homo Sapiens; identical to SEQ ID NO: 526228

SEQ ID NO: 666238 - RNA, 64 nt, Homo Sapiens; identical to SEQ ID NO: 526229

SEQ ID NO: 666239 - RNA, 64 nt, Homo Sapiens; identical to SEQ ID NO: 526230

SEQ ID NO: 666240 - RNA, 64 nt, Homo Sapiens; identical to SEQ ID NO: 526231

SEQ ID NO: 666241 - RNA, 64 nt, Homo Sapiens; identical to SEQ ID NO: 526232

SEQ ID NO: 666242 - RNA, 64 nt, Homo Sapiens; identical to SEQ ID NO: 526233

SEQ ID NO: 666243 - RNA, 64 nt, Homo Sapiens; identical to SEQ ID NO: 526234

SEQ ID NO: 666244 - RNA, 64 nt, Homo Sapiens; identical to SEQ ID NO: 526235

SEQ ID NO: 666245 - RNA, 64 nt, Homo Sapiens; identical to SEQ ID NO: 526236

SEQ ID NO: 666246 - RNA, 64 nt, Homo Sapiens; identical to SEQ ID NO: 526237

SEQ ID NO: 666247 - RNA, 64 nt, Homo Sapiens; identical to SEQ ID NO: 526238

SEQ ID NO: 666248 - RNA, 64 nt, Homo Sapiens; identical to SEQ ID NO: 526239

SEQ ID NO: 666249 - RNA, 64 nt, Homo Sapiens; identical to SEQ ID NO: 526240

SEQ ID NO: 666250 - RNA, 64 nt, Homo Sapiens; identical to SEQ ID NO: 526241

SEQ ID NO: 666251 - RNA, 64 nt, Homo Sapiens; identical to SEQ ID NO: 526242

SEQ ID NO: 666252 - RNA, 64 nt, Homo Sapiens; identical to SEQ ID NO: 526243

SEQ ID NO: 666253 - RNA, 64 nt, Homo Sapiens; identical to SEQ ID NO: 526244

SEQ ID NO: 666254 - RNA, 64 nt, Homo Sapiens; identical to SEQ ID NO: 526245

SEQ ID NO: 666255 - RNA, 64 nt, Homo Sapiens; identical to SEQ ID NO: 526246

SEQ ID NO: 666256 - RNA, 64 nt, Homo Sapiens; identical to SEQ ID NO: 526247

SEQ ID NO: 666257 - RNA, 64 nt, Homo Sapiens; identical to SEQ ID NO: 526248

SEQ ID NO: 666258 - RNA, 64 nt, Homo Sapiens; identical to SEQ ID NO: 526249

SEQ ID NO: 666259 - RNA, 64 nt, Homo Sapiens; identical to SEQ ID NO: 526250

SEQ ID NO: 666260 - RNA, 64 nt, Homo Sapiens; identical to SEQ ID NO: 526251

SEQ ID NO: 666261 - RNA, 64 nt, Homo Sapiens; identical to SEQ ID NO: 526252

SEQ ID NO: 666262 - RNA, 64 nt, Homo Sapiens; identical to SEQ ID NO: 526253

SEQ ID NO: 666263 - RNA, 64 nt, Homo Sapiens; identical to SEQ ID NO: 526254

SEQ ID NO: 666264 - RNA, 64 nt, Homo Sapiens; identical to SEQ ID NO: 526255

SEQ ID NO: 666265 - RNA, 64 nt, Homo Sapiens; identical to SEQ ID NO: 526256

SEQ ID NO: 666266 - RNA, 64 nt, Homo Sapiens; identical to SEQ ID NO: 526257

SEQ ID NO: 666267 - RNA, 64 nt, Homo Sapiens; identical to SEQ ID NO: 526258

SEQ ID NO: 666268 - RNA, 64 nt, Homo Sapiens; identical to SEQ ID NO: 526259

SEQ ID NO: 666269 - RNA, 64 nt, Homo Sapiens; identical to SEQ ID NO: 526260

SEQ ID NO: 666270 - RNA, 64 nt, Homo Sapiens; identical to SEQ ID NO: 526261

SEQ ID NO: 666271 - RNA, 64 nt, Homo Sapiens; identical to SEQ ID NO: 526262

SEQ ID NO: 666272 - RNA, 64 nt, Homo Sapiens; identical to SEQ ID NO: 526263

SEQ ID NO: 666273 - RNA, 64 nt, Homo Sapiens; identical to SEQ ID NO: 526264

SEQ ID NO: 666274 - RNA, 64 nt, Homo Sapiens; identical to SEQ ID NO: 526265

SEQ ID NO: 666275 - RNA, 64 nt, Homo Sapiens; identical to SEQ ID NO: 526266

SEQ ID NO: 666276 - RNA, 64 nt, Homo Sapiens; identical to SEQ ID NO: 526267

SEQ ID NO: 666277 - RNA, 64 nt, Homo Sapiens; identical to SEQ ID NO: 526268

SEQ ID NO: 666278 - RNA, 64 nt, Homo Sapiens; identical to SEQ ID NO: 526269

SEQ ID NO: 666279 - RNA, 64 nt, Homo Sapiens; identical to SEQ ID NO: 526270

SEQ ID NO: 666280 - RNA, 64 nt, Homo Sapiens; identical to SEQ ID NO: 526271

SEQ ID NO: 666281 - RNA, 64 nt, Homo Sapiens; identical to SEQ ID NO: 526272

SEQ ID NO: 666282 - RNA, 64 nt, Homo Sapiens; identical to SEQ ID NO: 526273

SEQ ID NO: 666283 - RNA, 64 nt, Homo Sapiens; identical to SEQ ID NO: 526274

SEQ ID NO: 666284 - RNA, 64 nt, Homo Sapiens; identical to SEQ ID NO: 526275

SEQ ID NO: 666285 - RNA, 64 nt, Homo Sapiens; identical to SEQ ID NO: 526276

SEQ ID NO: 666286 - RNA, 64 nt, Homo Sapiens; identical to SEQ ID NO: 526277

SEQ ID NO: 666287 - RNA, 64 nt, Homo Sapiens; identical to SEQ ID NO: 526278

SEQ ID NO: 666288 - RNA, 64 nt, Homo Sapiens; identical to SEQ ID NO: 526279

SEQ ID NO: 666289 - RNA, 64 nt, Homo Sapiens; identical to SEQ ID NO: 526280

SEQ ID NO: 666290 - RNA, 64 nt, Homo Sapiens; identical to SEQ ID NO: 526281

SEQ ID NO: 666291 - RNA, 64 nt, Homo Sapiens; identical to SEQ ID NO: 526282

SEQ ID NO: 666292 - RNA, 64 nt, Homo Sapiens; identical to SEQ ID NO: 526283

SEQ ID NO: 666293 - RNA, 64 nt, Homo Sapiens; identical to SEQ ID NO: 526284

SEQ ID NO: 666294 - RNA, 64 nt, Homo Sapiens; identical to SEQ ID NO: 526285

SEQ ID NO: 666295 - RNA, 64 nt, Homo Sapiens; identical to SEQ ID NO: 526286

SEQ ID NO: 666296 - RNA, 64 nt, Homo Sapiens; identical to SEQ ID NO: 526287

SEQ ID NO: 666297 - RNA, 64 nt, Homo Sapiens; identical to SEQ ID NO: 526288

SEQ ID NO: 666298 - RNA, 64 nt, Homo Sapiens; identical to SEQ ID NO: 526289

SEQ ID NO: 666299 - RNA, 64 nt, Homo Sapiens; identical to SEQ ID NO: 526290

SEQ ID NO: 666300 - RNA, 64 nt, Homo Sapiens; identical to SEQ ID NO: 526291

SEQ ID NO: 666301 - RNA, 64 nt, Homo Sapiens; identical to SEQ ID NO: 526292

SEQ ID NO: 666302 - RNA, 64 nt, Homo Sapiens; identical to SEQ ID NO: 526293

SEQ ID NO: 666303 - RNA, 64 nt, Homo Sapiens; identical to SEQ ID NO: 526294

SEQ ID NO: 666304 - RNA, 64 nt, Homo Sapiens; identical to SEQ ID NO: 526295

SEQ ID NO: 666305 - RNA, 64 nt, Homo Sapiens; identical to SEQ ID NO: 526296

SEQ ID NO: 666306 - RNA, 64 nt, Homo Sapiens; identical to SEQ ID NO: 526297

SEQ ID NO: 666307 - RNA, 64 nt, Homo Sapiens; identical to SEQ ID NO: 526298

SEQ ID NO: 666308 - RNA, 64 nt, Homo Sapiens; identical to SEQ ID NO: 526299

SEQ ID NO: 666309 - RNA, 64 nt, Homo Sapiens; identical to SEQ ID NO: 526300

SEQ ID NO: 666310 - RNA, 64 nt, Homo Sapiens; identical to SEQ ID NO: 526301

SEQ ID NO: 666311 - RNA, 64 nt, Homo Sapiens; identical to SEQ ID NO: 526302

SEQ ID NO: 666312 - RNA, 64 nt, Homo Sapiens; identical to SEQ ID NO: 526303

SEQ ID NO: 666313 - RNA, 64 nt, Homo Sapiens; identical to SEQ ID NO: 526304

SEQ ID NO: 666314 - RNA, 64 nt, Homo Sapiens; identical to SEQ ID NO: 526305

SEQ ID NO: 666315 - RNA, 64 nt, Homo Sapiens; identical to SEQ ID NO: 526306

SEQ ID NO: 666316 - RNA, 64 nt, Homo Sapiens; identical to SEQ ID NO: 526307

SEQ ID NO: 666317 - RNA, 64 nt, Homo Sapiens; identical to SEQ ID NO: 526308

SEQ ID NO: 666318 - RNA, 64 nt, Homo Sapiens; identical to SEQ ID NO: 526309

SEQ ID NO: 666319 - RNA, 64 nt, Homo Sapiens; identical to SEQ ID NO: 526310

SEQ ID NO: 666320 - RNA, 64 nt, Homo Sapiens; identical to SEQ ID NO: 526311

SEQ ID NO: 666321 - RNA, 64 nt, Homo Sapiens; identical to SEQ ID NO: 526312

SEQ ID NO: 666322 - RNA, 64 nt, Homo Sapiens; identical to SEQ ID NO: 526313

SEQ ID NO: 666323 - RNA, 64 nt, Homo Sapiens; identical to SEQ ID NO: 526314

SEQ ID NO: 666324 - RNA, 64 nt, Homo Sapiens; identical to SEQ ID NO: 526315

SEQ ID NO: 666325 - RNA, 64 nt, Homo Sapiens; identical to SEQ ID NO: 526316

SEQ ID NO: 666326 - RNA, 64 nt, Homo Sapiens; identical to SEQ ID NO: 526317

SEQ ID NO: 666327 - RNA, 64 nt, Homo Sapiens; identical to SEQ ID NO: 526318

SEQ ID NO: 666328 - RNA, 64 nt, Homo Sapiens; identical to SEQ ID NO: 526319

SEQ ID NO: 666329 - RNA, 64 nt, Homo Sapiens; identical to SEQ ID NO: 526320

SEQ ID NO: 666330 - RNA, 64 nt, Homo Sapiens; identical to SEQ ID NO: 526321

SEQ ID NO: 666331 - RNA, 64 nt, Homo Sapiens; identical to SEQ ID NO: 526322

SEQ ID NO: 666332 - RNA, 64 nt, Homo Sapiens; identical to SEQ ID NO: 526323

SEQ ID NO: 666333 - RNA, 64 nt, Homo Sapiens; identical to SEQ ID NO: 526324

SEQ ID NO: 666334 - RNA, 64 nt, Homo Sapiens; identical to SEQ ID NO: 526325

SEQ ID NO: 666335 - RNA, 64 nt, Homo Sapiens; identical to SEQ ID NO: 526326

SEQ ID NO: 666336 - RNA, 64 nt, Homo Sapiens; identical to SEQ ID NO: 526327

SEQ ID NO: 666337 - RNA, 64 nt, Homo Sapiens; identical to SEQ ID NO: 526328

SEQ ID NO: 666338 - RNA, 64 nt, Homo Sapiens; identical to SEQ ID NO: 526329

SEQ ID NO: 666339 - RNA, 64 nt, Homo Sapiens; identical to SEQ ID NO: 526330

SEQ ID NO: 666340 - RNA, 64 nt, Homo Sapiens; identical to SEQ ID NO: 526331

SEQ ID NO: 666341 - RNA, 64 nt, Homo Sapiens; identical to SEQ ID NO: 526332

SEQ ID NO: 666342 - RNA, 64 nt, Homo Sapiens; identical to SEQ ID NO: 526333

SEQ ID NO: 666343 - RNA, 64 nt, Homo Sapiens; identical to SEQ ID NO: 526334

SEQ ID NO: 666344 - RNA, 64 nt, Homo Sapiens; identical to SEQ ID NO: 526335

SEQ ID NO: 666345 - RNA, 64 nt, Homo Sapiens; identical to SEQ ID NO: 526336

SEQ ID NO: 666346 - RNA, 64 nt, Homo Sapiens; identical to SEQ ID NO: 526337

SEQ ID NO: 666347 - RNA, 64 nt, Homo Sapiens; identical to SEQ ID NO: 526338

SEQ ID NO: 666348 - RNA, 64 nt, Homo Sapiens; identical to SEQ ID NO: 526339

SEQ ID NO: 666349 - RNA, 64 nt, Homo Sapiens; identical to SEQ ID NO: 526340

SEQ ID NO: 666350 - RNA, 64 nt, Homo Sapiens; identical to SEQ ID NO: 526341

SEQ ID NO: 666351 - RNA, 64 nt, Homo Sapiens; identical to SEQ ID NO: 526342

SEQ ID NO: 666352 - RNA, 64 nt, Homo Sapiens; identical to SEQ ID NO: 526343

SEQ ID NO: 666353 - RNA, 64 nt, Homo Sapiens; identical to SEQ ID NO: 526344

SEQ ID NO: 666354 - RNA, 64 nt, Homo Sapiens; identical to SEQ ID NO: 526345

SEQ ID NO: 666355 - RNA, 64 nt, Homo Sapiens; identical to SEQ ID NO: 526346

SEQ ID NO: 666356 - RNA, 64 nt, Homo Sapiens; identical to SEQ ID NO: 526347

SEQ ID NO: 666357 - RNA, 64 nt, Homo Sapiens; identical to SEQ ID NO: 526348

SEQ ID NO: 666358 - RNA, 64 nt, Homo Sapiens; identical to SEQ ID NO: 526349

SEQ ID NO: 666359 - RNA, 64 nt, Homo Sapiens; identical to SEQ ID NO: 526350

SEQ ID NO: 666360 - RNA, 64 nt, Homo Sapiens; identical to SEQ ID NO: 526351

SEQ ID NO: 666361 - RNA, 64 nt, Homo Sapiens; identical to SEQ ID NO: 526352

SEQ ID NO: 666362 - RNA, 64 nt, Homo Sapiens; identical to SEQ ID NO: 608305

SEQ ID NO: 666363 - RNA, 64 nt, Homo Sapiens; identical to SEQ ID NO: 608306

SEQ ID NO: 666364 - RNA, 64 nt, Homo Sapiens; identical to SEQ ID NO: 608307

SEQ ID NO: 666365 - RNA, 64 nt, Homo Sapiens; identical to SEQ ID NO: 608308

SEQ ID NO: 666366 - RNA, 64 nt, Homo Sapiens; identical to SEQ ID NO: 608309

SEQ ID NO: 666367 - RNA, 64 nt, Homo Sapiens; identical to SEQ ID NO: 608310

SEQ ID NO: 666368 - RNA, 64 nt, Homo Sapiens; identical to SEQ ID NO: 608311

SEQ ID NO: 666369 - RNA, 64 nt, Homo Sapiens; identical to SEQ ID NO: 608312

SEQ ID NO: 666370 - RNA, 64 nt, Homo Sapiens; identical to SEQ ID NO: 608313

SEQ ID NO: 666371 - RNA, 64 nt, Homo Sapiens; identical to SEQ ID NO: 608314

SEQ ID NO: 666372 - RNA, 64 nt, Homo Sapiens; identical to SEQ ID NO: 608315

SEQ ID NO: 666373 - RNA, 64 nt, Homo Sapiens; identical to SEQ ID NO: 608316

SEQ ID NO: 666374 - RNA, 64 nt, Homo Sapiens; identical to SEQ ID NO: 608317

SEQ ID NO: 666375 - RNA, 64 nt, Homo Sapiens; identical to SEQ ID NO: 608318

SEQ ID NO: 666376 - RNA, 64 nt, Homo Sapiens; identical to SEQ ID NO: 608319

SEQ ID NO: 666377 - RNA, 64 nt, Homo Sapiens; identical to SEQ ID NO: 608320

SEQ ID NO: 666378 - RNA, 64 nt, Homo Sapiens; identical to SEQ ID NO: 608321

SEQ ID NO: 666379 - RNA, 64 nt, Homo Sapiens; identical to SEQ ID NO: 608322

SEQ ID NO: 666380 - RNA, 64 nt, Homo Sapiens; identical to SEQ ID NO: 608323

SEQ ID NO: 666381 - RNA, 64 nt, Homo Sapiens; identical to SEQ ID NO: 608324

SEQ ID NO: 666382 - RNA, 64 nt, Homo Sapiens; identical to SEQ ID NO: 608325

SEQ ID NO: 666383 - RNA, 64 nt, Homo Sapiens; identical to SEQ ID NO: 608326

SEQ ID NO: 666384 - RNA, 64 nt, Homo Sapiens; identical to SEQ ID NO: 608327

SEQ ID NO: 666385 - RNA, 64 nt, Homo Sapiens; identical to SEQ ID NO: 608328

SEQ ID NO: 666386 - RNA, 64 nt, Homo Sapiens; identical to SEQ ID NO: 608329

SEQ ID NO: 666387 - RNA, 64 nt, Homo Sapiens; identical to SEQ ID NO: 608330

SEQ ID NO: 666388 - RNA, 64 nt, Homo Sapiens; identical to SEQ ID NO: 608331

SEQ ID NO: 666389 - RNA, 64 nt, Homo Sapiens; identical to SEQ ID NO: 608332

SEQ ID NO: 666390 - RNA, 56 nt, Homo Sapiens; identical to SEQ ID NO: 608333

SEQ ID NO: 666391 - RNA, 64 nt, Homo Sapiens; identical to SEQ ID NO: 608334

SEQ ID NO: 666392 - RNA, 64 nt, Homo Sapiens; identical to SEQ ID NO: 608335

SEQ ID NO: 666393 - RNA, 64 nt, Homo Sapiens; identical to SEQ ID NO: 608336

SEQ ID NO: 666394 - RNA, 64 nt, Homo Sapiens; identical to SEQ ID NO: 608337

SEQ ID NO: 666395 - RNA, 64 nt, Homo Sapiens; identical to SEQ ID NO: 608338

SEQ ID NO: 666396 - RNA, 64 nt, Homo Sapiens; identical to SEQ ID NO: 608339

SEQ ID NO: 666397 - RNA, 64 nt, Homo Sapiens; identical to SEQ ID NO: 608340

SEQ ID NO: 666398 - RNA, 64 nt, Homo Sapiens; identical to SEQ ID NO: 608341

SEQ ID NO: 666399 - RNA, 64 nt, Homo Sapiens; identical to SEQ ID NO: 608342

SEQ ID NO: 666400 - RNA, 64 nt, Homo Sapiens; identical to SEQ ID NO: 608343

SEQ ID NO: 666401 - RNA, 64 nt, Homo Sapiens; identical to SEQ ID NO: 608344

SEQ ID NO: 666402 - RNA, 64 nt, Homo Sapiens; identical to SEQ ID NO: 608345

SEQ ID NO: 666403 - RNA, 64 nt, Homo Sapiens; identical to SEQ ID NO: 608346

SEQ ID NO: 666404 - RNA, 64 nt, Homo Sapiens; identical to SEQ ID NO: 608347

SEQ ID NO: 666405 - RNA, 64 nt, Homo Sapiens; identical to SEQ ID NO: 608348

SEQ ID NO: 666406 - RNA, 64 nt, Homo Sapiens; identical to SEQ ID NO: 608349

SEQ ID NO: 666407 - RNA, 64 nt, Homo Sapiens; identical to SEQ ID NO: 608350

SEQ ID NO: 666408 - RNA, 64 nt, Homo Sapiens; identical to SEQ ID NO: 608351

SEQ ID NO: 666409 - RNA, 64 nt, Homo Sapiens; identical to SEQ ID NO: 608352

SEQ ID NO: 666410 - RNA, 64 nt, Homo Sapiens; identical to SEQ ID NO: 608353

SEQ ID NO: 666411 - RNA, 64 nt, Homo Sapiens; identical to SEQ ID NO: 608354

SEQ ID NO: 666412 - RNA, 64 nt, Homo Sapiens; identical to SEQ ID NO: 608355

SEQ ID NO: 666413 - RNA, 64 nt, Homo Sapiens; identical to SEQ ID NO: 608356

SEQ ID NO: 666414 - RNA, 64 nt, Homo Sapiens; identical to SEQ ID NO: 608357

SEQ ID NO: 666415 - RNA, 64 nt, Homo Sapiens; identical to SEQ ID NO: 608358

SEQ ID NO: 666416 - RNA, 64 nt, Homo Sapiens; identical to SEQ ID NO: 608359

SEQ ID NO: 666417 - RNA, 64 nt, Homo Sapiens; identical to SEQ ID NO: 608360

SEQ ID NO: 666418 - RNA, 64 nt, Homo Sapiens; identical to SEQ ID NO: 608361

SEQ ID NO: 666419 - RNA, 64 nt, Homo Sapiens; identical to SEQ ID NO: 608362

SEQ ID NO: 666420 - RNA, 64 nt, Homo Sapiens; identical to SEQ ID NO: 608363

SEQ ID NO: 666421 - RNA, 64 nt, Homo Sapiens; identical to SEQ ID NO: 608364

SEQ ID NO: 666422 - RNA, 64 nt, Homo Sapiens; identical to SEQ ID NO: 608365

SEQ ID NO: 666423 - RNA, 64 nt, Homo Sapiens; identical to SEQ ID NO: 608366

SEQ ID NO: 666424 - RNA, 64 nt, Homo Sapiens; identical to SEQ ID NO: 608367

SEQ ID NO: 666425 - RNA, 64 nt, Homo Sapiens; identical to SEQ ID NO: 608368

SEQ ID NO: 666426 - RNA, 64 nt, Homo Sapiens; identical to SEQ ID NO: 608369

SEQ ID NO: 666427 - RNA, 64 nt, Homo Sapiens; identical to SEQ ID NO: 608370

SEQ ID NO: 666428 - RNA, 64 nt, Homo Sapiens; identical to SEQ ID NO: 608371

SEQ ID NO: 666429 - RNA, 64 nt, Homo Sapiens; identical to SEQ ID NO: 608372

SEQ ID NO: 666430 - RNA, 64 nt, Homo Sapiens; identical to SEQ ID NO: 608373

SEQ ID NO: 666431 - RNA, 64 nt, Homo Sapiens; identical to SEQ ID NO: 608374

SEQ ID NO: 666432 - RNA, 64 nt, Homo Sapiens; identical to SEQ ID NO: 608375

SEQ ID NO: 666433 - RNA, 64 nt, Homo Sapiens; identical to SEQ ID NO: 608376

SEQ ID NO: 666434 - RNA, 64 nt, Homo Sapiens; identical to SEQ ID NO: 608377

SEQ ID NO: 666435 - RNA, 64 nt, Homo Sapiens; identical to SEQ ID NO: 608378

SEQ ID NO: 666436 - RNA, 64 nt, Homo Sapiens; identical to SEQ ID NO: 608379

SEQ ID NO: 666437 - RNA, 64 nt, Homo Sapiens; identical to SEQ ID NO: 608380

SEQ ID NO: 666438 - RNA, 64 nt, Homo Sapiens; identical to SEQ ID NO: 608381

SEQ ID NO: 666439 - RNA, 64 nt, Homo Sapiens; identical to SEQ ID NO: 608382

SEQ ID NO: 666440 - RNA, 64 nt, Homo Sapiens; identical to SEQ ID NO: 608383

SEQ ID NO: 666441 - RNA, 64 nt, Homo Sapiens; identical to SEQ ID NO: 608384

SEQ ID NO: 666442 - RNA, 64 nt, Homo Sapiens; identical to SEQ ID NO: 608385

SEQ ID NO: 666443 - RNA, 64 nt, Homo Sapiens; identical to SEQ ID NO: 608386

SEQ ID NO: 666444 - RNA, 64 nt, Homo Sapiens; identical to SEQ ID NO: 608387

SEQ ID NO: 666445 - RNA, 64 nt, Homo Sapiens; identical to SEQ ID NO: 608388

SEQ ID NO: 666446 - RNA, 64 nt, Homo Sapiens; identical to SEQ ID NO: 608389

SEQ ID NO: 666447 - RNA, 64 nt, Homo Sapiens; identical to SEQ ID NO: 608390

SEQ ID NO: 666448 - RNA, 64 nt, Homo Sapiens; identical to SEQ ID NO: 608391

SEQ ID NO: 666449 - RNA, 64 nt, Homo Sapiens; identical to SEQ ID NO: 608392

SEQ ID NO: 666450 - RNA, 64 nt, Homo Sapiens; identical to SEQ ID NO: 608393

SEQ ID NO: 666451 - RNA, 64 nt, Homo Sapiens; identical to SEQ ID NO: 608394

SEQ ID NO: 666452 - RNA, 64 nt, Homo Sapiens; identical to SEQ ID NO: 608395

SEQ ID NO: 666453 - RNA, 64 nt, Homo Sapiens; identical to SEQ ID NO: 608396

SEQ ID NO: 666454 - RNA, 64 nt, Homo Sapiens; identical to SEQ ID NO: 608397

SEQ ID NO: 666455 - RNA, 64 nt, Homo Sapiens; identical to SEQ ID NO: 608398

SEQ ID NO: 666456 - RNA, 64 nt, Homo Sapiens; identical to SEQ ID NO: 608399

SEQ ID NO: 666457 - RNA, 64 nt, Homo Sapiens; identical to SEQ ID NO: 608400

SEQ ID NO: 666458 - RNA, 64 nt, Homo Sapiens; identical to SEQ ID NO: 608401

SEQ ID NO: 666459 - RNA, 64 nt, Homo Sapiens; identical to SEQ ID NO: 608402

SEQ ID NO: 666460 - RNA, 64 nt, Homo Sapiens; identical to SEQ ID NO: 608403

SEQ ID NO: 666461 - RNA, 64 nt, Homo Sapiens; identical to SEQ ID NO: 608404

SEQ ID NO: 666462 - RNA, 64 nt, Homo Sapiens; identical to SEQ ID NO: 608405

SEQ ID NO: 666463 - RNA, 64 nt, Homo Sapiens; identical to SEQ ID NO: 608406

SEQ ID NO: 666464 - RNA, 64 nt, Homo Sapiens; identical to SEQ ID NO: 608407

SEQ ID NO: 666465 - RNA, 64 nt, Homo Sapiens; identical to SEQ ID NO: 608408

SEQ ID NO: 666466 - RNA, 64 nt, Homo Sapiens; identical to SEQ ID NO: 608409

SEQ ID NO: 666467 - RNA, 64 nt, Homo Sapiens; identical to SEQ ID NO: 608410

SEQ ID NO: 666468 - RNA, 64 nt, Homo Sapiens; identical to SEQ ID NO: 608411

SEQ ID NO: 666469 - RNA, 64 nt, Homo Sapiens; identical to SEQ ID NO: 608412

SEQ ID NO: 666470 - RNA, 64 nt, Homo Sapiens; identical to SEQ ID NO: 608413

SEQ ID NO: 666471 - RNA, 64 nt, Homo Sapiens; identical to SEQ ID NO: 608414

SEQ ID NO: 666472 - RNA, 64 nt, Homo Sapiens; identical to SEQ ID NO: 608415

SEQ ID NO: 666473 - RNA, 64 nt, Homo Sapiens; identical to SEQ ID NO: 608416

SEQ ID NO: 666474 - RNA, 64 nt, Homo Sapiens; identical to SEQ ID NO: 608417

SEQ ID NO: 666475 - RNA, 64 nt, Homo Sapiens; identical to SEQ ID NO: 608418

SEQ ID NO: 666476 - RNA, 64 nt, Homo Sapiens; identical to SEQ ID NO: 608419

SEQ ID NO: 666477 - RNA, 64 nt, Homo Sapiens; identical to SEQ ID NO: 608420

SEQ ID NO: 666478 - RNA, 64 nt, Homo Sapiens; identical to SEQ ID NO: 608421

SEQ ID NO: 666479 - RNA, 64 nt, Homo Sapiens; identical to SEQ ID NO: 608422

SEQ ID NO: 666480 - RNA, 64 nt, Homo Sapiens; identical to SEQ ID NO: 608423

SEQ ID NO: 666481 - RNA, 64 nt, Homo Sapiens; identical to SEQ ID NO: 608424

SEQ ID NO: 666482 - RNA, 64 nt, Homo Sapiens; identical to SEQ ID NO: 608425

SEQ ID NO: 666483 - RNA, 64 nt, Homo Sapiens; identical to SEQ ID NO: 608426

SEQ ID NO: 666484 - RNA, 64 nt, Homo Sapiens; identical to SEQ ID NO: 608427

SEQ ID NO: 666485 - RNA, 64 nt, Homo Sapiens; identical to SEQ ID NO: 608428

SEQ ID NO: 666486 - RNA, 64 nt, Homo Sapiens; identical to SEQ ID NO: 608429

SEQ ID NO: 666487 - RNA, 64 nt, Homo Sapiens; identical to SEQ ID NO: 608430

SEQ ID NO: 666488 - RNA, 64 nt, Homo Sapiens; identical to SEQ ID NO: 608431

SEQ ID NO: 666489 - RNA, 64 nt, Homo Sapiens; identical to SEQ ID NO: 608432

SEQ ID NO: 666490 - RNA, 64 nt, Homo Sapiens; identical to SEQ ID NO: 608433

SEQ ID NO: 666491 - RNA, 64 nt, Homo Sapiens; identical to SEQ ID NO: 608434

SEQ ID NO: 666492 - RNA, 64 nt, Homo Sapiens; identical to SEQ ID NO: 608435

SEQ ID NO: 666493 - RNA, 64 nt, Homo Sapiens; identical to SEQ ID NO: 608436

SEQ ID NO: 666494 - RNA, 64 nt, Homo Sapiens; identical to SEQ ID NO: 608437

SEQ ID NO: 666495 - RNA, 64 nt, Homo Sapiens; identical to SEQ ID NO: 608438

SEQ ID NO: 666496 - RNA, 64 nt, Homo Sapiens; identical to SEQ ID NO: 608439

SEQ ID NO: 666497 - RNA, 64 nt, Homo Sapiens; identical to SEQ ID NO: 608440

SEQ ID NO: 666498 - RNA, 64 nt, Homo Sapiens; identical to SEQ ID NO: 608441

SEQ ID NO: 666499 - RNA, 64 nt, Homo Sapiens; identical to SEQ ID NO: 608442

SEQ ID NO: 666500 - RNA, 64 nt, Homo Sapiens; identical to SEQ ID NO: 608443

SEQ ID NO: 666501 - RNA, 64 nt, Homo Sapiens; identical to SEQ ID NO: 608444

SEQ ID NO: 666502 - RNA, 64 nt, Homo Sapiens; identical to SEQ ID NO: 608445

SEQ ID NO: 666503 - RNA, 64 nt, Homo Sapiens; identical to SEQ ID NO: 608446

SEQ ID NO: 666504 - RNA, 64 nt, Homo Sapiens; identical to SEQ ID NO: 608447

SEQ ID NO: 666505 - RNA, 64 nt, Homo Sapiens; identical to SEQ ID NO: 608448

SEQ ID NO: 666506 - RNA, 64 nt, Homo Sapiens; identical to SEQ ID NO: 608449

SEQ ID NO: 666507 - RNA, 64 nt, Homo Sapiens; identical to SEQ ID NO: 608450

SEQ ID NO: 666508 - RNA, 64 nt, Homo Sapiens; identical to SEQ ID NO: 608451

SEQ ID NO: 666509 - RNA, 64 nt, Homo Sapiens; identical to SEQ ID NO: 608452

SEQ ID NO: 666510 - RNA, 64 nt, Homo Sapiens; identical to SEQ ID NO: 244748

SEQ ID NO: 666511 - RNA, 64 nt, Homo Sapiens; identical to SEQ ID NO: 244749

SEQ ID NO: 666512 - RNA, 64 nt, Homo Sapiens; identical to SEQ ID NO: 244750

SEQ ID NO: 666513 - RNA, 64 nt, Homo Sapiens; identical to SEQ ID NO: 244751

SEQ ID NO: 666514 - RNA, 64 nt, Homo Sapiens; identical to SEQ ID NO: 244752

SEQ ID NO: 666515 - RNA, 64 nt, Homo Sapiens; identical to SEQ ID NO: 244753

SEQ ID NO: 666516 - RNA, 64 nt, Homo Sapiens; identical to SEQ ID NO: 244754

SEQ ID NO: 666517 - RNA, 64 nt, Homo Sapiens; identical to SEQ ID NO: 244755

SEQ ID NO: 666518 - RNA, 64 nt, Homo Sapiens; identical to SEQ ID NO: 244756

SEQ ID NO: 666519 - RNA, 64 nt, Homo Sapiens; identical to SEQ ID NO: 244757

SEQ ID NO: 666520 - RNA, 64 nt, Homo Sapiens; identical to SEQ ID NO: 244758

SEQ ID NO: 666521 - RNA, 64 nt, Homo Sapiens; identical to SEQ ID NO: 244759

SEQ ID NO: 666522 - RNA, 64 nt, Homo Sapiens; identical to SEQ ID NO: 244760

SEQ ID NO: 666523 - RNA, 64 nt, Homo Sapiens; identical to SEQ ID NO: 244761

SEQ ID NO: 666524 - RNA, 64 nt, Homo Sapiens; identical to SEQ ID NO: 244762

SEQ ID NO: 666525 - RNA, 64 nt, Homo Sapiens; identical to SEQ ID NO: 244763

SEQ ID NO: 666526 - RNA, 64 nt, Homo Sapiens; identical to SEQ ID NO: 244764

SEQ ID NO: 666527 - RNA, 61 nt, Homo Sapiens
gaaccucaggacccgcccauuucucggcaguacugugaauuuugaaguuaaacuaaauuuu

SEQ ID NO: 666528 - RNA, 61 nt, Homo Sapiens
acaugaagaguuuaguuuuuuuacuuuauaaacugugaauaugaguaugccagcugcauac

SEQ ID NO: 666529 - RNA, 61 nt, Homo Sapiens
caacaacaacaaaccacaaaauuauuugaguacugugaaggauuauuugucuaacaguuca

SEQ ID NO: 666530 - RNA, 61 nt, Homo Sapiens
uggaaagagcguccauaggagaagugagaauacugugaaaaagggauguuagcauucauua

SEQ ID NO: 666531 - RNA, 61 nt, Homo Sapiens
ugaguaugccagcugcauuauuacuuuauaaacugugaauaacaugaagaguuuaguuuuu

SEQ ID NO: 666532 - RNA, 61 nt, Homo Sapiens
uugaaguuaaacuaaauuuuuucucggcaguacugugaauugaaccucaggacccgcccau

SEQ ID NO: 666533 - RNA, 61 nt, Homo Sapiens
ugguuuaacacuguauccuaacucaagcugaacugugaaagcucauucuccaagagccaca

SEQ ID NO: 666534 - RNA, 61 nt, Homo Sapiens
guuuuuguacaguuaucauguuaaaaaaauuacugugaauuuuuuucuggaguggaaaagc

SEQ ID NO: 666535 - RNA, 61 nt, Homo Sapiens
auggccauauauaauuuuuuuuggcugcguaacugugaacuggcuguaauuggagcagcuu

SEQ ID NO: 666536 - RNA, 61 nt, Homo Sapiens
uacuuccugaaggggagggaaggacuuuggaacugugaauaguugagagcauuucagccag

SEQ ID NO: 666537 - RNA, 61 nt, Homo Sapiens
uuaugggauugcuaccuguauaaacaauggcacugugaaaauacuguuaguuuuaauacaa

SEQ ID NO: 666538 - RNA, 61 nt, Homo Sapiens
aacacuagcuuuguauuuuuuuuucuguaaaacugugaacugauauauuuuccuuuaucac

SEQ ID NO: 666539 - RNA, 61 nt, Homo Sapiens
ucagaaucgccucagcauuuaaccuccuagcacugugaaaguccuugaaguguugcaaggg

SEQ ID NO: 666540 - RNA, 61 nt, Homo Sapiens
uagcaauauaguacuggacaaaguccguuuuacugugaauagacugaucacucagaaauua

SEQ ID NO: 666541 - RNA, 61 nt, Homo Sapiens
ugagaaauacagaagaaaauacuuauuaacaacugugaauaucuuugggacaccucagaaa

SEQ ID NO: 666542 - RNA, 61 nt, Homo Sapiens
auuuugaagaaaacacaacaaaucaaaaggcacugugaacuuucaaggccauauuuuaaaa

SEQ ID NO: 666543 - RNA, 61 nt, Homo Sapiens
agaugcccuggucuugcuuuggucacaggugacugugaaacguaaucauguuggcuggucu

SEQ ID NO: 666544 - RNA, 61 nt, Homo Sapiens; identical to SEQ ID NO: 379771

SEQ ID NO: 666545 - RNA, 61 nt, Homo Sapiens
aaaguucauucuguagugcaaucccucauuuacugugaacuuuuauuucuuaagaaaaagc

SEQ ID NO: 666546 - RNA, 61 nt, Homo Sapiens
ucacccaggcaaaauggcuacuccugagccaacugugaaccgguuaaugaucagaagaugu

SEQ ID NO: 666547 - RNA, 61 nt, Homo Sapiens
uugggauuuauguccuugccuccccacaaggacugugaauaagauacaauaucacaccccu

SEQ ID NO: 666548 - RNA, 61 nt, Homo Sapiens
aucugguuccucauucacuguaugagguacuacugugaaggcuccccccaugguguuuuca

SEQ ID NO: 666549 - RNA, 61 nt, Homo Sapiens
cagccuuuuccuccucaguuuucucuuuaaaacugugaaguacuaacuuuccaaggccugc

SEQ ID NO: 666550 - RNA, 61 nt, Homo Sapiens
gggcccacaucaucuaggcuccccagcccccacugugaaggggcuggccaggggcccgagc

SEQ ID NO: 666551 - RNA, 61 nt, Homo Sapiens
ccaucagaugugccaaaugguauugaguucaacugugaaaugcauuaggcuguaguucuaa

SEQ ID NO: 666552 - RNA, 61 nt, Homo Sapiens
aaguugaauggugguuuuuaggggauuucagacugugaagauucacuggaaaacagggagg

SEQ ID NO: 666553 - RNA, 61 nt, Homo Sapiens
aacauaauuaaugauggagagaaaccauacaacugugaagaauguggcaaagcuuuuaacc

SEQ ID NO: 666554 - RNA, 61 nt, Homo Sapiens
uuuauauuugagaaaaauuguagaaauauagacugugaaaaagacgucaauaucugcucac

SEQ ID NO: 666555 - RNA, 61 nt, Homo Sapiens
auaugagccuuugaaaguucggugagaagaaacugugaaguauuauucugaugcugggaca

SEQ ID NO: 666556 - RNA, 61 nt, Homo Sapiens
ugaugacgggcuuguagcaccuuaagcuucaacugugaaaacauucaacagagaacucugu

SEQ ID NO: 666557 - RNA, 61 nt, Homo Sapiens
agccauuaauacaugcucaccaaauauaaagacugugaaaauauacuugagaaauauugua

SEQ ID NO: 666558 - RNA, 61 nt, Homo Sapiens
auauggcaaagccuuuaauagaacuccugugacugugaagaaaaaaaauucauacuggagg

SEQ ID NO: 666559 - RNA, 61 nt, Homo Sapiens
uuuguuuuccaagcuguuuugcuguauugauacugugaauggguagcaccgugagaaaugg

SEQ ID NO: 666560 - RNA, 61 nt, Homo Sapiens
gaaaggaugggucaccucucccugugcugucacugugaaugucacaaaaaggaggugcccc

SEQ ID NO: 666561 - RNA, 61 nt, Homo Sapiens
ggcugaaagacaccuucccgauugucuugagacugugaagaaaugccuguggcuucaguca

SEQ ID NO: 666562 - RNA, 61 nt, Homo Sapiens
uaauggaaacguaggagcauuugugaaagaaacugugaaugcuucuccuuugaaugcuguu

SEQ ID NO: 666563 - RNA, 61 nt, Homo Sapiens
agucagacaaauaaagcaagcagggggcugaacugugaacauggcccguugguuuucugag

SEQ ID NO: 666564 - RNA, 61 nt, Homo Sapiens
acagacccugggucccacacuuccaccuccuacugugaagaauaaagaacuuagucauccc

SEQ ID NO: 666565 - RNA, 64 nt, Homo Sapiens; identical to SEQ ID NO: 612739

SEQ ID NO: 666566 - RNA, 64 nt, Homo Sapiens; identical to SEQ ID NO: 612740

SEQ ID NO: 666567 - RNA, 64 nt, Homo Sapiens; identical to SEQ ID NO: 612741

SEQ ID NO: 666568 - RNA, 64 nt, Homo Sapiens; identical to SEQ ID NO: 612742

SEQ ID NO: 666569 - RNA, 64 nt, Homo Sapiens; identical to SEQ ID NO: 612743

SEQ ID NO: 666570 - RNA, 64 nt, Homo Sapiens; identical to SEQ ID NO: 612744

SEQ ID NO: 666571 - RNA, 64 nt, Homo Sapiens; identical to SEQ ID NO: 564088

SEQ ID NO: 666572 - RNA, 64 nt, Homo Sapiens; identical to SEQ ID NO: 564089

SEQ ID NO: 666573 - RNA, 64 nt, Homo Sapiens; identical to SEQ ID NO: 564090

SEQ ID NO: 666574 - RNA, 64 nt, Homo Sapiens; identical to SEQ ID NO: 564091

SEQ ID NO: 666575 - RNA, 64 nt, Homo Sapiens; identical to SEQ ID NO: 564092

SEQ ID NO: 666576 - RNA, 64 nt, Homo Sapiens; identical to SEQ ID NO: 564093

SEQ ID NO: 666577 - RNA, 64 nt, Homo Sapiens; identical to SEQ ID NO: 564094

SEQ ID NO: 666578 - RNA, 64 nt, Homo Sapiens; identical to SEQ ID NO: 564095

SEQ ID NO: 666579 - RNA, 64 nt, Homo Sapiens; identical to SEQ ID NO: 564096

SEQ ID NO: 666580 - RNA, 64 nt, Homo Sapiens; identical to SEQ ID NO: 564097

SEQ ID NO: 666581 - RNA, 64 nt, Homo Sapiens; identical to SEQ ID NO: 564098

SEQ ID NO: 666582 - RNA, 64 nt, Homo Sapiens; identical to SEQ ID NO: 564099

SEQ ID NO: 666583 - RNA, 64 nt, Homo Sapiens; identical to SEQ ID NO: 510924

SEQ ID NO: 666584 - RNA, 64 nt, Homo Sapiens; identical to SEQ ID NO: 510925

SEQ ID NO: 666585 - RNA, 57 nt, Homo Sapiens; identical to SEQ ID NO: 510926

SEQ ID NO: 666586 - RNA, 64 nt, Homo Sapiens; identical to SEQ ID NO: 510927

SEQ ID NO: 666587 - RNA, 64 nt, Homo Sapiens; identical to SEQ ID NO: 510928

SEQ ID NO: 666588 - RNA, 64 nt, Homo Sapiens; identical to SEQ ID NO: 510929

SEQ ID NO: 666589 - RNA, 64 nt, Homo Sapiens; identical to SEQ ID NO: 510930

SEQ ID NO: 666590 - RNA, 64 nt, Homo Sapiens; identical to SEQ ID NO: 510931

SEQ ID NO: 666591 - RNA, 64 nt, Homo Sapiens; identical to SEQ ID NO: 510932

SEQ ID NO: 666592 - RNA, 64 nt, Homo Sapiens; identical to SEQ ID NO: 510933

SEQ ID NO: 666593 - RNA, 64 nt, Homo Sapiens; identical to SEQ ID NO: 510934

SEQ ID NO: 666594 - RNA, 64 nt, Homo Sapiens; identical to SEQ ID NO: 510935

SEQ ID NO: 666595 - RNA, 64 nt, Homo Sapiens; identical to SEQ ID NO: 510936

SEQ ID NO: 666596 - RNA, 64 nt, Homo Sapiens; identical to SEQ ID NO: 510937

SEQ ID NO: 666597 - RNA, 64 nt, Homo Sapiens; identical to SEQ ID NO: 510938

SEQ ID NO: 666598 - RNA, 64 nt, Homo Sapiens; identical to SEQ ID NO: 510939

SEQ ID NO: 666599 - RNA, 64 nt, Homo Sapiens; identical to SEQ ID NO: 510940

SEQ ID NO: 666600 - RNA, 64 nt, Homo Sapiens; identical to SEQ ID NO: 510941

SEQ ID NO: 666601 - RNA, 64 nt, Homo Sapiens; identical to SEQ ID NO: 510942

SEQ ID NO: 666602 - RNA, 64 nt, Homo Sapiens; identical to SEQ ID NO: 510943

SEQ ID NO: 666603 - RNA, 64 nt, Homo Sapiens; identical to SEQ ID NO: 510944

SEQ ID NO: 666604 - RNA, 64 nt, Homo Sapiens; identical to SEQ ID NO: 510945

SEQ ID NO: 666605 - RNA, 64 nt, Homo Sapiens; identical to SEQ ID NO: 510946

SEQ ID NO: 666606 - RNA, 64 nt, Homo Sapiens; identical to SEQ ID NO: 510947

SEQ ID NO: 666607 - RNA, 64 nt, Homo Sapiens; identical to SEQ ID NO: 510948

SEQ ID NO: 666608 - RNA, 64 nt, Homo Sapiens; identical to SEQ ID NO: 510949

SEQ ID NO: 666609 - RNA, 64 nt, Homo Sapiens; identical to SEQ ID NO: 510950

SEQ ID NO: 666610 - RNA, 64 nt, Homo Sapiens; identical to SEQ ID NO: 510951

SEQ ID NO: 666611 - RNA, 64 nt, Homo Sapiens; identical to SEQ ID NO: 510952

SEQ ID NO: 666612 - RNA, 64 nt, Homo Sapiens; identical to SEQ ID NO: 510953

SEQ ID NO: 666613 - RNA, 64 nt, Homo Sapiens; identical to SEQ ID NO: 510954

SEQ ID NO: 666614 - RNA, 64 nt, Homo Sapiens; identical to SEQ ID NO: 510955

SEQ ID NO: 666615 - RNA, 64 nt, Homo Sapiens; identical to SEQ ID NO: 510956

SEQ ID NO: 666616 - RNA, 64 nt, Homo Sapiens; identical to SEQ ID NO: 510957

SEQ ID NO: 666617 - RNA, 64 nt, Homo Sapiens; identical to SEQ ID NO: 510958

SEQ ID NO: 666618 - RNA, 64 nt, Homo Sapiens; identical to SEQ ID NO: 510959

SEQ ID NO: 666619 - RNA, 64 nt, Homo Sapiens; identical to SEQ ID NO: 510960

SEQ ID NO: 666620 - RNA, 64 nt, Homo Sapiens; identical to SEQ ID NO: 510961

SEQ ID NO: 666621 - RNA, 64 nt, Homo Sapiens; identical to SEQ ID NO: 510962

SEQ ID NO: 666622 - RNA, 64 nt, Homo Sapiens; identical to SEQ ID NO: 510963

SEQ ID NO: 666623 - RNA, 64 nt, Homo Sapiens; identical to SEQ ID NO: 510964

SEQ ID NO: 666624 - RNA, 64 nt, Homo Sapiens; identical to SEQ ID NO: 510965

SEQ ID NO: 666625 - RNA, 64 nt, Homo Sapiens; identical to SEQ ID NO: 510966

SEQ ID NO: 666626 - RNA, 64 nt, Homo Sapiens; identical to SEQ ID NO: 510967

SEQ ID NO: 666627 - RNA, 64 nt, Homo Sapiens; identical to SEQ ID NO: 510968

SEQ ID NO: 666628 - RNA, 64 nt, Homo Sapiens; identical to SEQ ID NO: 510969

SEQ ID NO: 666629 - RNA, 64 nt, Homo Sapiens; identical to SEQ ID NO: 510970

SEQ ID NO: 666630 - RNA, 64 nt, Homo Sapiens; identical to SEQ ID NO: 510971

SEQ ID NO: 666631 - RNA, 64 nt, Homo Sapiens; identical to SEQ ID NO: 510972

SEQ ID NO: 666632 - RNA, 64 nt, Homo Sapiens; identical to SEQ ID NO: 510973

SEQ ID NO: 666633 - RNA, 64 nt, Homo Sapiens; identical to SEQ ID NO: 510974

SEQ ID NO: 666634 - RNA, 64 nt, Homo Sapiens; identical to SEQ ID NO: 510975

SEQ ID NO: 666635 - RNA, 64 nt, Homo Sapiens; identical to SEQ ID NO: 510976

SEQ ID NO: 666636 - RNA, 64 nt, Homo Sapiens; identical to SEQ ID NO: 510977

SEQ ID NO: 666637 - RNA, 64 nt, Homo Sapiens; identical to SEQ ID NO: 510978

SEQ ID NO: 666638 - RNA, 64 nt, Homo Sapiens; identical to SEQ ID NO: 510979

SEQ ID NO: 666639 - RNA, 64 nt, Homo Sapiens; identical to SEQ ID NO: 510980

SEQ ID NO: 666640 - RNA, 64 nt, Homo Sapiens; identical to SEQ ID NO: 510981

SEQ ID NO: 666641 - RNA, 64 nt, Homo Sapiens; identical to SEQ ID NO: 510982

SEQ ID NO: 666642 - RNA, 64 nt, Homo Sapiens; identical to SEQ ID NO: 510983

SEQ ID NO: 666643 - RNA, 64 nt, Homo Sapiens; identical to SEQ ID NO: 657951

SEQ ID NO: 666644 - RNA, 64 nt, Homo Sapiens; identical to SEQ ID NO: 657952

SEQ ID NO: 666645 - RNA, 64 nt, Homo Sapiens; identical to SEQ ID NO: 657953

SEQ ID NO: 666646 - RNA, 64 nt, Homo Sapiens; identical to SEQ ID NO: 657954

SEQ ID NO: 666647 - RNA, 64 nt, Homo Sapiens; identical to SEQ ID NO: 657955

SEQ ID NO: 666648 - RNA, 64 nt, Homo Sapiens; identical to SEQ ID NO: 657956

SEQ ID NO: 666649 - RNA, 64 nt, Homo Sapiens; identical to SEQ ID NO: 657957

SEQ ID NO: 666650 - RNA, 64 nt, Homo Sapiens; identical to SEQ ID NO: 657958

SEQ ID NO: 666651 - RNA, 64 nt, Homo Sapiens; identical to SEQ ID NO: 657959

SEQ ID NO: 666652 - RNA, 64 nt, Homo Sapiens; identical to SEQ ID NO: 657960

SEQ ID NO: 666653 - RNA, 64 nt, Homo Sapiens; identical to SEQ ID NO: 657961

SEQ ID NO: 666654 - RNA, 64 nt, Homo Sapiens; identical to SEQ ID NO: 657962

SEQ ID NO: 666655 - RNA, 64 nt, Homo Sapiens; identical to SEQ ID NO: 657963

SEQ ID NO: 666656 - RNA, 64 nt, Homo Sapiens; identical to SEQ ID NO: 657964

SEQ ID NO: 666657 - RNA, 64 nt, Homo Sapiens; identical to SEQ ID NO: 657965

SEQ ID NO: 666658 - RNA, 64 nt, Homo Sapiens; identical to SEQ ID NO: 657966

SEQ ID NO: 666659 - RNA, 64 nt, Homo Sapiens; identical to SEQ ID NO: 657967

SEQ ID NO: 666660 - RNA, 64 nt, Homo Sapiens; identical to SEQ ID NO: 657968

SEQ ID NO: 666661 - RNA, 64 nt, Homo Sapiens; identical to SEQ ID NO: 657969

SEQ ID NO: 666662 - RNA, 64 nt, Homo Sapiens; identical to SEQ ID NO: 657970

SEQ ID NO: 666663 - RNA, 64 nt, Homo Sapiens; identical to SEQ ID NO: 657971

SEQ ID NO: 666664 - RNA, 64 nt, Homo Sapiens; identical to SEQ ID NO: 657972

SEQ ID NO: 666665 - RNA, 64 nt, Homo Sapiens; identical to SEQ ID NO: 657973

SEQ ID NO: 666666 - RNA, 64 nt, Homo Sapiens
cucaucuccccaggugagggcaccaaauagguagucaaggcagcugaucaccaagcugucucau

SEQ ID NO: 666667 - RNA, 64 nt, Homo Sapiens
caggccaacuagaccacacucagcaaauauguagucaaggcagcugaucaccgagcugucacau

SEQ ID NO: 666668 - RNA, 64 nt, Homo Sapiens
ccgggcuccagggcuccccucuaucuccuuccugucaaggcagggccguguauuuauuuuucac

SEQ ID NO: 666669 - RNA, 64 nt, Homo Sapiens
cagcccaggcccugggccuggcuucucuggaaccucaaggcaggcgagcuucagcuuccaggau

SEQ ID NO: 666670 - RNA, 64 nt, Homo Sapiens; identical to SEQ ID NO: 166184

SEQ ID NO: 666671 - RNA, 64 nt, Homo Sapiens; identical to SEQ ID NO: 166185

SEQ ID NO: 666672 - RNA, 64 nt, Homo Sapiens; identical to SEQ ID NO: 166186

SEQ ID NO: 666673 - RNA, 64 nt, Homo Sapiens; identical to SEQ ID NO: 166187

SEQ ID NO: 666674 - RNA, 64 nt, Homo Sapiens; identical to SEQ ID NO: 166188

SEQ ID NO: 666675 - RNA, 64 nt, Homo Sapiens; identical to SEQ ID NO: 166189

SEQ ID NO: 666676 - RNA, 64 nt, Homo Sapiens; identical to SEQ ID NO: 166190

SEQ ID NO: 666677 - RNA, 64 nt, Homo Sapiens; identical to SEQ ID NO: 166191

SEQ ID NO: 666678 - RNA, 64 nt, Homo Sapiens; identical to SEQ ID NO: 166192

SEQ ID NO: 666679 - RNA, 64 nt, Homo Sapiens; identical to SEQ ID NO: 166193

SEQ ID NO: 666680 - RNA, 64 nt, Homo Sapiens; identical to SEQ ID NO: 166194

SEQ ID NO: 666681 - RNA, 64 nt, Homo Sapiens; identical to SEQ ID NO: 166195

SEQ ID NO: 666682 - RNA, 64 nt, Homo Sapiens; identical to SEQ ID NO: 166196

SEQ ID NO: 666683 - RNA, 64 nt, Homo Sapiens; identical to SEQ ID NO: 166197

SEQ ID NO: 666684 - RNA, 64 nt, Homo Sapiens; identical to SEQ ID NO: 166198

SEQ ID NO: 666685 - RNA, 64 nt, Homo Sapiens; identical to SEQ ID NO: 166199

SEQ ID NO: 666686 - RNA, 64 nt, Homo Sapiens; identical to SEQ ID NO: 166200

SEQ ID NO: 666687 - RNA, 64 nt, Homo Sapiens; identical to SEQ ID NO: 166201

SEQ ID NO: 666688 - RNA, 64 nt, Homo Sapiens; identical to SEQ ID NO: 166202

SEQ ID NO: 666689 - RNA, 64 nt, Homo Sapiens; identical to SEQ ID NO: 166203

SEQ ID NO: 666690 - RNA, 64 nt, Homo Sapiens; identical to SEQ ID NO: 166204

SEQ ID NO: 666691 - RNA, 64 nt, Homo Sapiens; identical to SEQ ID NO: 166205

SEQ ID NO: 666692 - RNA, 64 nt, Homo Sapiens; identical to SEQ ID NO: 166206

SEQ ID NO: 666693 - RNA, 64 nt, Homo Sapiens; identical to SEQ ID NO: 166207

SEQ ID NO: 666694 - RNA, 64 nt, Homo Sapiens; identical to SEQ ID NO: 166208

SEQ ID NO: 666695 - RNA, 64 nt, Homo Sapiens; identical to SEQ ID NO: 166209

SEQ ID NO: 666696 - RNA, 64 nt, Homo Sapiens; identical to SEQ ID NO: 166210

SEQ ID NO: 666697 - RNA, 64 nt, Homo Sapiens; identical to SEQ ID NO: 166211

SEQ ID NO: 666698 - RNA, 64 nt, Homo Sapiens; identical to SEQ ID NO: 166212

SEQ ID NO: 666699 - RNA, 64 nt, Homo Sapiens; identical to SEQ ID NO: 166213

SEQ ID NO: 666700 - RNA, 64 nt, Homo Sapiens; identical to SEQ ID NO: 166214

SEQ ID NO: 666701 - RNA, 64 nt, Homo Sapiens; identical to SEQ ID NO: 166215

SEQ ID NO: 666702 - RNA, 64 nt, Homo Sapiens; identical to SEQ ID NO: 166216

SEQ ID NO: 666703 - RNA, 64 nt, Homo Sapiens; identical to SEQ ID NO: 166217

SEQ ID NO: 666704 - RNA, 64 nt, Homo Sapiens; identical to SEQ ID NO: 166218

SEQ ID NO: 666705 - RNA, 64 nt, Homo Sapiens; identical to SEQ ID NO: 166219

SEQ ID NO: 666706 - RNA, 64 nt, Homo Sapiens; identical to SEQ ID NO: 166220

SEQ ID NO: 666707 - RNA, 64 nt, Homo Sapiens; identical to SEQ ID NO: 166221

SEQ ID NO: 666708 - RNA, 64 nt, Homo Sapiens; identical to SEQ ID NO: 166222

SEQ ID NO: 666709 - RNA, 64 nt, Homo Sapiens; identical to SEQ ID NO: 166223

SEQ ID NO: 666710 - RNA, 64 nt, Homo Sapiens; identical to SEQ ID NO: 166224

SEQ ID NO: 666711 - RNA, 58 nt, Homo Sapiens; identical to SEQ ID NO: 96080

SEQ ID NO: 666712 - RNA, 64 nt, Homo Sapiens; identical to SEQ ID NO: 166226

SEQ ID NO: 666713 - RNA, 64 nt, Homo Sapiens; identical to SEQ ID NO: 166227

SEQ ID NO: 666714 - RNA, 64 nt, Homo Sapiens; identical to SEQ ID NO: 166228

SEQ ID NO: 666715 - RNA, 64 nt, Homo Sapiens; identical to SEQ ID NO: 166229

SEQ ID NO: 666716 - RNA, 64 nt, Homo Sapiens; identical to SEQ ID NO: 166230

SEQ ID NO: 666717 - RNA, 64 nt, Homo Sapiens; identical to SEQ ID NO: 166231

SEQ ID NO: 666718 - RNA, 64 nt, Homo Sapiens; identical to SEQ ID NO: 166232

SEQ ID NO: 666719 - RNA, 64 nt, Homo Sapiens; identical to SEQ ID NO: 166233

SEQ ID NO: 666720 - RNA, 64 nt, Homo Sapiens; identical to SEQ ID NO: 166234

SEQ ID NO: 666721 - RNA, 64 nt, Homo Sapiens; identical to SEQ ID NO: 166235

SEQ ID NO: 666722 - RNA, 64 nt, Homo Sapiens; identical to SEQ ID NO: 166236

SEQ ID NO: 666723 - RNA, 64 nt, Homo Sapiens; identical to SEQ ID NO: 166237

SEQ ID NO: 666724 - RNA, 64 nt, Homo Sapiens; identical to SEQ ID NO: 166238

SEQ ID NO: 666725 - RNA, 64 nt, Homo Sapiens; identical to SEQ ID NO: 166239

SEQ ID NO: 666726 - RNA, 64 nt, Homo Sapiens; identical to SEQ ID NO: 166240

SEQ ID NO: 666727 - RNA, 64 nt, Homo Sapiens; identical to SEQ ID NO: 166241

SEQ ID NO: 666728 - RNA, 64 nt, Homo Sapiens; identical to SEQ ID NO: 166242

SEQ ID NO: 666729 - RNA, 64 nt, Homo Sapiens; identical to SEQ ID NO: 166243

SEQ ID NO: 666730 - RNA, 64 nt, Homo Sapiens; identical to SEQ ID NO: 166244

SEQ ID NO: 666731 - RNA, 64 nt, Homo Sapiens; identical to SEQ ID NO: 166245

SEQ ID NO: 666732 - RNA, 64 nt, Homo Sapiens; identical to SEQ ID NO: 166246

SEQ ID NO: 666733 - RNA, 64 nt, Homo Sapiens; identical to SEQ ID NO: 166247

SEQ ID NO: 666734 - RNA, 64 nt, Homo Sapiens; identical to SEQ ID NO: 166248

SEQ ID NO: 666735 - RNA, 64 nt, Homo Sapiens; identical to SEQ ID NO: 166249

SEQ ID NO: 666736 - RNA, 64 nt, Homo Sapiens; identical to SEQ ID NO: 166250

SEQ ID NO: 666737 - RNA, 64 nt, Homo Sapiens; identical to SEQ ID NO: 166251

SEQ ID NO: 666738 - RNA, 64 nt, Homo Sapiens; identical to SEQ ID NO: 166252

SEQ ID NO: 666739 - RNA, 64 nt, Homo Sapiens; identical to SEQ ID NO: 166253

SEQ ID NO: 666740 - RNA, 64 nt, Homo Sapiens; identical to SEQ ID NO: 166254

SEQ ID NO: 666741 - RNA, 64 nt, Homo Sapiens; identical to SEQ ID NO: 166255

SEQ ID NO: 666742 - RNA, 64 nt, Homo Sapiens; identical to SEQ ID NO: 166256

SEQ ID NO: 666743 - RNA, 64 nt, Homo Sapiens; identical to SEQ ID NO: 166257

SEQ ID NO: 666744 - RNA, 64 nt, Homo Sapiens; identical to SEQ ID NO: 166258

SEQ ID NO: 666745 - RNA, 64 nt, Homo Sapiens; identical to SEQ ID NO: 166259

SEQ ID NO: 666746 - RNA, 64 nt, Homo Sapiens; identical to SEQ ID NO: 166260

SEQ ID NO: 666747 - RNA, 64 nt, Homo Sapiens; identical to SEQ ID NO: 166261

SEQ ID NO: 666748 - RNA, 64 nt, Homo Sapiens; identical to SEQ ID NO: 166262

SEQ ID NO: 666749 - RNA, 64 nt, Homo Sapiens; identical to SEQ ID NO: 166263

SEQ ID NO: 666750 - RNA, 64 nt, Homo Sapiens; identical to SEQ ID NO: 166264

SEQ ID NO: 666751 - RNA, 64 nt, Homo Sapiens; identical to SEQ ID NO: 166265

SEQ ID NO: 666752 - RNA, 64 nt, Homo Sapiens; identical to SEQ ID NO: 166266

SEQ ID NO: 666753 - RNA, 64 nt, Homo Sapiens; identical to SEQ ID NO: 166267

SEQ ID NO: 666754 - RNA, 64 nt, Homo Sapiens; identical to SEQ ID NO: 166268

SEQ ID NO: 666755 - RNA, 64 nt, Homo Sapiens; identical to SEQ ID NO: 166269

SEQ ID NO: 666756 - RNA, 64 nt, Homo Sapiens; identical to SEQ ID NO: 166270

SEQ ID NO: 666757 - RNA, 64 nt, Homo Sapiens; identical to SEQ ID NO: 166271

SEQ ID NO: 666758 - RNA, 64 nt, Homo Sapiens; identical to SEQ ID NO: 166272

SEQ ID NO: 666759 - RNA, 64 nt, Homo Sapiens; identical to SEQ ID NO: 166273

SEQ ID NO: 666760 - RNA, 64 nt, Homo Sapiens; identical to SEQ ID NO: 166274

SEQ ID NO: 666761 - RNA, 64 nt, Homo Sapiens; identical to SEQ ID NO: 166275

SEQ ID NO: 666762 - RNA, 64 nt, Homo Sapiens; identical to SEQ ID NO: 166276

SEQ ID NO: 666763 - RNA, 64 nt, Homo Sapiens; identical to SEQ ID NO: 166277

SEQ ID NO: 666764 - RNA, 64 nt, Homo Sapiens; identical to SEQ ID NO: 166278

SEQ ID NO: 666765 - RNA, 64 nt, Homo Sapiens; identical to SEQ ID NO: 166279

SEQ ID NO: 666766 - RNA, 64 nt, Homo Sapiens; identical to SEQ ID NO: 166280

SEQ ID NO: 666767 - RNA, 64 nt, Homo Sapiens; identical to SEQ ID NO: 166281

SEQ ID NO: 666768 - RNA, 64 nt, Homo Sapiens; identical to SEQ ID NO: 166282

SEQ ID NO: 666769 - RNA, 64 nt, Homo Sapiens; identical to SEQ ID NO: 166283

SEQ ID NO: 666770 - RNA, 64 nt, Homo Sapiens; identical to SEQ ID NO: 166284

SEQ ID NO: 666771 - RNA, 64 nt, Homo Sapiens; identical to SEQ ID NO: 166285

SEQ ID NO: 666772 - RNA, 64 nt, Homo Sapiens; identical to SEQ ID NO: 166286

SEQ ID NO: 666773 - RNA, 64 nt, Homo Sapiens; identical to SEQ ID NO: 166287

SEQ ID NO: 666774 - RNA, 64 nt, Homo Sapiens; identical to SEQ ID NO: 166288

SEQ ID NO: 666775 - RNA, 64 nt, Homo Sapiens; identical to SEQ ID NO: 166289

SEQ ID NO: 666776 - RNA, 64 nt, Homo Sapiens; identical to SEQ ID NO: 166290

SEQ ID NO: 666777 - RNA, 64 nt, Homo Sapiens; identical to SEQ ID NO: 166291

SEQ ID NO: 666778 - RNA, 64 nt, Homo Sapiens; identical to SEQ ID NO: 166292

SEQ ID NO: 666779 - RNA, 64 nt, Homo Sapiens; identical to SEQ ID NO: 166293

SEQ ID NO: 666780 - RNA, 64 nt, Homo Sapiens; identical to SEQ ID NO: 166294

SEQ ID NO: 666781 - RNA, 64 nt, Homo Sapiens; identical to SEQ ID NO: 166295

SEQ ID NO: 666782 - RNA, 64 nt, Homo Sapiens; identical to SEQ ID NO: 166296

SEQ ID NO: 666783 - RNA, 64 nt, Homo Sapiens; identical to SEQ ID NO: 166297

SEQ ID NO: 666784 - RNA, 64 nt, Homo Sapiens; identical to SEQ ID NO: 166298

SEQ ID NO: 666785 - RNA, 64 nt, Homo Sapiens; identical to SEQ ID NO: 166299

SEQ ID NO: 666786 - RNA, 64 nt, Homo Sapiens; identical to SEQ ID NO: 166300

SEQ ID NO: 666787 - RNA, 64 nt, Homo Sapiens; identical to SEQ ID NO: 166301

SEQ ID NO: 666788 - RNA, 64 nt, Homo Sapiens; identical to SEQ ID NO: 166302

SEQ ID NO: 666789 - RNA, 64 nt, Homo Sapiens; identical to SEQ ID NO: 166303

SEQ ID NO: 666790 - RNA, 64 nt, Homo Sapiens; identical to SEQ ID NO: 166304

SEQ ID NO: 666791 - RNA, 64 nt, Homo Sapiens; identical to SEQ ID NO: 166305

SEQ ID NO: 666792 - RNA, 64 nt, Homo Sapiens; identical to SEQ ID NO: 166306

SEQ ID NO: 666793 - RNA, 64 nt, Homo Sapiens; identical to SEQ ID NO: 166307

SEQ ID NO: 666794 - RNA, 64 nt, Homo Sapiens; identical to SEQ ID NO: 166308

SEQ ID NO: 666795 - RNA, 64 nt, Homo Sapiens; identical to SEQ ID NO: 166309

SEQ ID NO: 666796 - RNA, 64 nt, Homo Sapiens; identical to SEQ ID NO: 166310

SEQ ID NO: 666797 - RNA, 64 nt, Homo Sapiens; identical to SEQ ID NO: 166311

SEQ ID NO: 666798 - RNA, 64 nt, Homo Sapiens; identical to SEQ ID NO: 166312

SEQ ID NO: 666799 - RNA, 64 nt, Homo Sapiens; identical to SEQ ID NO: 166313

SEQ ID NO: 666800 - RNA, 64 nt, Homo Sapiens; identical to SEQ ID NO: 166314

SEQ ID NO: 666801 - RNA, 64 nt, Homo Sapiens; identical to SEQ ID NO: 166315

SEQ ID NO: 666802 - RNA, 64 nt, Homo Sapiens; identical to SEQ ID NO: 56858

SEQ ID NO: 666803 - RNA, 64 nt, Homo Sapiens; identical to SEQ ID NO: 56859

SEQ ID NO: 666804 - RNA, 64 nt, Homo Sapiens; identical to SEQ ID NO: 56860

SEQ ID NO: 666805 - RNA, 64 nt, Homo Sapiens; identical to SEQ ID NO: 56861

SEQ ID NO: 666806 - RNA, 64 nt, Homo Sapiens; identical to SEQ ID NO: 56862

SEQ ID NO: 666807 - RNA, 64 nt, Homo Sapiens; identical to SEQ ID NO: 56863

SEQ ID NO: 666808 - RNA, 64 nt, Homo Sapiens; identical to SEQ ID NO: 56864

SEQ ID NO: 666809 - RNA, 64 nt, Homo Sapiens; identical to SEQ ID NO: 56865

SEQ ID NO: 666810 - RNA, 64 nt, Homo Sapiens; identical to SEQ ID NO: 56866

SEQ ID NO: 666811 - RNA, 64 nt, Homo Sapiens; identical to SEQ ID NO: 56867

SEQ ID NO: 666812 - RNA, 64 nt, Homo Sapiens; identical to SEQ ID NO: 56868

SEQ ID NO: 666813 - RNA, 64 nt, Homo Sapiens; identical to SEQ ID NO: 56869

SEQ ID NO: 666814 - RNA, 64 nt, Homo Sapiens; identical to SEQ ID NO: 56870

SEQ ID NO: 666815 - RNA, 64 nt, Homo Sapiens; identical to SEQ ID NO: 56871

SEQ ID NO: 666816 - RNA, 64 nt, Homo Sapiens; identical to SEQ ID NO: 56872

SEQ ID NO: 666817 - RNA, 64 nt, Homo Sapiens; identical to SEQ ID NO: 56873

SEQ ID NO: 666818 - RNA, 64 nt, Homo Sapiens; identical to SEQ ID NO: 56874

SEQ ID NO: 666819 - RNA, 64 nt, Homo Sapiens; identical to SEQ ID NO: 56875

SEQ ID NO: 666820 - RNA, 64 nt, Homo Sapiens; identical to SEQ ID NO: 56876

SEQ ID NO: 666821 - RNA, 64 nt, Homo Sapiens; identical to SEQ ID NO: 56877

SEQ ID NO: 666822 - RNA, 64 nt, Homo Sapiens; identical to SEQ ID NO: 56878

SEQ ID NO: 666823 - RNA, 64 nt, Homo Sapiens; identical to SEQ ID NO: 56879

SEQ ID NO: 666824 - RNA, 64 nt, Homo Sapiens; identical to SEQ ID NO: 56880

SEQ ID NO: 666825 - RNA, 64 nt, Homo Sapiens; identical to SEQ ID NO: 56881

SEQ ID NO: 666826 - RNA, 64 nt, Homo Sapiens
ggggaugaaauuccucaagaugauuauuccugaaaguguggaugcgcuggaugcgcagggaaca

SEQ ID NO: 666827 - RNA, 64 nt, Homo Sapiens
ccagcagauggcuuuucuauagacaaacuagguuaguguggaagauauagguuaaaauaaacua

SEQ ID NO: 666828 - RNA, 64 nt, Homo Sapiens
aaggcagaaaaggauccuagcucucaugccccgcaguguggaacucggggaguggcuuuuccag

SEQ ID NO: 666829 - RNA, 64 nt, Homo Sapiens
ccucggggaguggcuuuuccgcccaggagaacaaaguguggaggugcugucucuuggaggcagg

SEQ ID NO: 666830 - RNA, 64 nt, Homo Sapiens
ugcgauggcauugucucgguucccgcagugcugcaguguggaagggagugccccauccucauua

SEQ ID NO: 666831 - RNA, 64 nt, Homo Sapiens
gagugccccauccucauuacagaugacacacuggaguguggaggggucgaugacuugugcaggg

SEQ ID NO: 666832 - RNA, 64 nt, Homo Sapiens
gucuacagugcagaaaggcuugcuucuuuuccagaguguggaaauucuuugggguuuguuuguu

SEQ ID NO: 666833 - RNA, 64 nt, Homo Sapiens
acuuuuauuuuaggagaaggcaaucacguggcugaguguggauggcaagcccccuuucucuucc

SEQ ID NO: 666834 - RNA, 64 nt, Homo Sapiens
gaucuuggcacuguaagcaaaacacggaagugugaguguggaagauguacaaguuaggucacca

SEQ ID NO: 666835 - RNA, 64 nt, Homo Sapiens
cacuacuuuauucuguuuaaaaucacaaauagcaaguguggaagaaaaccuauuuuuaaauaga

SEQ ID NO: 666836 - RNA, 64 nt, Homo Sapiens
uuuagaacuuggaauaauuugcccaaaauauaaaaguguggaacuugccacucuuaaaaauugu

SEQ ID NO: 666837 - RNA, 64 nt, Homo Sapiens
uggggaagccagugagcauuuggauccgucugaaaguguggaugucaaacaaaggcauuggauu

SEQ ID NO: 666838 - RNA, 64 nt, Homo Sapiens
caguguucuuuucuggugaaccugcucaggucuagaaucccaaguuuagcccgguuuguuucuc

SEQ ID NO: 666839 - RNA, 64 nt, Homo Sapiens
cggacacccuuucucaaaagcagggaagcucuuagaaucccaggaccugauuuaggccagcaac

SEQ ID NO: 666840 - RNA, 64 nt, Homo Sapiens
cagagcccuggcuggugaugugcuggcugggggugaaucccaaugagggucccucucagagcgg

SEQ ID NO: 666841 - RNA, 64 nt, Homo Sapiens
cagagcccuggauggugaugcgcuggcugggggugaaucccaaugagggucccucucagaaagg

SEQ ID NO: 666842 - RNA, 64 nt, Homo Sapiens
ggccuuguccaagggacagagccuucuauucugagaaucccaggggcccucagacccugccuga

SEQ ID NO: 666843 - RNA, 64 nt, Homo Sapiens
uucauaguacauuaaaaagagagagagagagaaagaaucccacagggcacuauuaaaauacuuc

SEQ ID NO: 666844 - RNA, 64 nt, Homo Sapiens
uuugaaaauccaaucccaagcccaaauccccagggaaucccaaaggacccccaaaucauggaau

SEQ ID NO: 666845 - RNA, 64 nt, Homo Sapiens
uccccagggaaucccaaauuacccccaaaucauggaaucccaaaccaaugccguaacuccuagg

SEQ ID NO: 666846 - RNA, 64 nt, Homo Sapiens
ugcggaacggguguggauuugaauguggacuucggaaucccaggaggcaggggccgggcucucc

SEQ ID NO: 666847 - RNA, 64 nt, Homo Sapiens
acaaccgcuguaaaaugacggagagagagagaaagaaucccagacauuaacgguauuagagagu

SEQ ID NO: 666848 - RNA, 64 nt, Homo Sapiens
aaggcaccuguaaauaaauccaaguuuauaaugguggucugaacaauacacacauauuuuaucc

SEQ ID NO: 666849 - RNA, 64 nt, Homo Sapiens
gaggugucuccgaggauccuuuucuggaagcuucuggucugaggaaacacagagcugcccaggc

SEQ ID NO: 666850 - RNA, 64 nt, Homo Sapiens
auaccuauuauaucuguguggaguagguuuucucuggucugauuuugacaaauagaagaguguc

SEQ ID NO: 666851 - RNA, 64 nt, Homo Sapiens
auaguaaauugaccagaacacaguugugggaauuuggucugaaguuagugaaauaaaacuuuaa

SEQ ID NO: 666852 - RNA, 64 nt, Homo Sapiens
uuggacaggagaucagcagcgugcacaucugcuguggucugaagugguuugcaggucagccucc

SEQ ID NO: 666853 - RNA, 64 nt, Homo Sapiens
ccgaaugucacugguggaucuaagaagggcugaguggucugacaccaaaacaugccgcagggag

SEQ ID NO: 666854 - RNA, 64 nt, Homo Sapiens
ugcagcuuaggcuuucauccgccucuucccaggcuggucugacaggcagcaguguguccagccu

SEQ ID NO: 666855 - RNA, 64 nt, Homo Sapiens
ucugaccagcacaaggaaggucaacagaaggaaauggucugaaggaauggcauggacuugcuga

SEQ ID NO: 666856 - RNA, 64 nt, Homo Sapiens
cucuccugcugauggaaaugggaaugaaguuaaguggucugaaaaacuugaaucguucacauuu

SEQ ID NO: 666857 - RNA, 64 nt, Homo Sapiens
aaugcacucuucccuugccggcuccugguaccauuggucugaacagcuguaguuggucuacucc

SEQ ID NO: 666858 - RNA, 64 nt, Homo Sapiens
ccaccuucuuagccaaaaacaaggucagcuuggcuggucugaggacagaagccagccaagugcc

SEQ ID NO: 666859 - RNA, 64 nt, Homo Sapiens
aggagggacucuggaguagccucccuccugccccuggucugaggaggccaaggccauucccuaa

SEQ ID NO: 666860 - RNA, 64 nt, Homo Sapiens
acugaguuuggccucuggcucgguuuccuuucuuuggucugauacuucauguauuugaauauag

SEQ ID NO: 666861 - RNA, 64 nt, Homo Sapiens
aaacaagucucugucucaguuaagagaaaucuauuggucugaagguuucugaaccucuuucugg

SEQ ID NO: 666862 - RNA, 64 nt, Homo Sapiens
uuaaguuguuugaaaaaagaagaaucccuuuucauggucugaucuuucagccuuugagguuuua

SEQ ID NO: 666863 - RNA, 64 nt, Homo Sapiens
guaacccccaucaugacuagaggcacacuucuuuuggucugaagaaaccagagcaggaaaaaga

SEQ ID NO: 666864 - RNA, 64 nt, Homo Sapiens
acacagggcagucauucagcaccagagcacgugauggucugagacucucuuaggagcagagcuc

SEQ ID NO: 666865 - RNA, 64 nt, Homo Sapiens
gcucugccgcaauggccauguggggauccacaccuggucugaggggcaacugagucugcgggag

SEQ ID NO: 666866 - RNA, 64 nt, Homo Sapiens
uauacaguguugaaaucucaaugcaguugaaaucuggucugaugugccuaauuuaucuguggaa

SEQ ID NO: 666867 - RNA, 64 nt, Homo Sapiens
aaaauucuauaauacauacuaaaauagugguuauuggucugauauaugcugcucuugguucuau

SEQ ID NO: 666868 - RNA, 64 nt, Homo Sapiens; identical to SEQ ID NO: 265240

SEQ ID NO: 666869 - RNA, 64 nt, Homo Sapiens; identical to SEQ ID NO: 265241

SEQ ID NO: 666870 - RNA, 64 nt, Homo Sapiens; identical to SEQ ID NO: 265242

SEQ ID NO: 666871 - RNA, 64 nt, Homo Sapiens; identical to SEQ ID NO: 265243

SEQ ID NO: 666872 - RNA, 64 nt, Homo Sapiens; identical to SEQ ID NO: 561089

SEQ ID NO: 666873 - RNA, 64 nt, Homo Sapiens; identical to SEQ ID NO: 561090

SEQ ID NO: 666874 - RNA, 64 nt, Homo Sapiens; identical to SEQ ID NO: 561091

SEQ ID NO: 666875 - RNA, 64 nt, Homo Sapiens; identical to SEQ ID NO: 561092

SEQ ID NO: 666876 - RNA, 64 nt, Homo Sapiens; identical to SEQ ID NO: 561093

SEQ ID NO: 666877 - RNA, 64 nt, Homo Sapiens; identical to SEQ ID NO: 561094

SEQ ID NO: 666878 - RNA, 64 nt, Homo Sapiens; identical to SEQ ID NO: 561095

SEQ ID NO: 666879 - RNA, 64 nt, Homo Sapiens; identical to SEQ ID NO: 561096

SEQ ID NO: 666880 - RNA, 64 nt, Homo Sapiens; identical to SEQ ID NO: 561097

SEQ ID NO: 666881 - RNA, 64 nt, Homo Sapiens; identical to SEQ ID NO: 561098

SEQ ID NO: 666882 - RNA, 64 nt, Homo Sapiens; identical to SEQ ID NO: 561099

SEQ ID NO: 666883 - RNA, 64 nt, Homo Sapiens; identical to SEQ ID NO: 561100

SEQ ID NO: 666884 - RNA, 64 nt, Homo Sapiens; identical to SEQ ID NO: 561101

SEQ ID NO: 666885 - RNA, 64 nt, Homo Sapiens; identical to SEQ ID NO: 561102

SEQ ID NO: 666886 - RNA, 64 nt, Homo Sapiens; identical to SEQ ID NO: 561103

SEQ ID NO: 666887 - RNA, 64 nt, Homo Sapiens; identical to SEQ ID NO: 561104

SEQ ID NO: 666888 - RNA, 64 nt, Homo Sapiens; identical to SEQ ID NO: 561105

SEQ ID NO: 666889 - RNA, 64 nt, Homo Sapiens; identical to SEQ ID NO: 561106

SEQ ID NO: 666890 - RNA, 64 nt, Homo Sapiens; identical to SEQ ID NO: 561107

SEQ ID NO: 666891 - RNA, 64 nt, Homo Sapiens; identical to SEQ ID NO: 561108

SEQ ID NO: 666892 - RNA, 64 nt, Homo Sapiens; identical to SEQ ID NO: 561109

SEQ ID NO: 666893 - RNA, 64 nt, Homo Sapiens; identical to SEQ ID NO: 561110

SEQ ID NO: 666894 - RNA, 64 nt, Homo Sapiens; identical to SEQ ID NO: 561111

SEQ ID NO: 666895 - RNA, 64 nt, Homo Sapiens; identical to SEQ ID NO: 561112

SEQ ID NO: 666896 - RNA, 64 nt, Homo Sapiens; identical to SEQ ID NO: 561113

SEQ ID NO: 666897 - RNA, 64 nt, Homo Sapiens; identical to SEQ ID NO: 561114

SEQ ID NO: 666898 - RNA, 64 nt, Homo Sapiens; identical to SEQ ID NO: 561115

SEQ ID NO: 666899 - RNA, 64 nt, Homo Sapiens; identical to SEQ ID NO: 561116

SEQ ID NO: 666900 - RNA, 64 nt, Homo Sapiens; identical to SEQ ID NO: 561117

SEQ ID NO: 666901 - RNA, 64 nt, Homo Sapiens; identical to SEQ ID NO: 561118

SEQ ID NO: 666902 - RNA, 64 nt, Homo Sapiens; identical to SEQ ID NO: 561119

SEQ ID NO: 666903 - RNA, 64 nt, Homo Sapiens; identical to SEQ ID NO: 561120

SEQ ID NO: 666904 - RNA, 64 nt, Homo Sapiens; identical to SEQ ID NO: 561121

SEQ ID NO: 666905 - RNA, 64 nt, Homo Sapiens; identical to SEQ ID NO: 561122

SEQ ID NO: 666906 - RNA, 64 nt, Homo Sapiens; identical to SEQ ID NO: 561123

SEQ ID NO: 666907 - RNA, 64 nt, Homo Sapiens; identical to SEQ ID NO: 561124

SEQ ID NO: 666908 - RNA, 64 nt, Homo Sapiens; identical to SEQ ID NO: 561125

SEQ ID NO: 666909 - RNA, 64 nt, Homo Sapiens; identical to SEQ ID NO: 561126

SEQ ID NO: 666910 - RNA, 64 nt, Homo Sapiens; identical to SEQ ID NO: 561127

SEQ ID NO: 666911 - RNA, 64 nt, Homo Sapiens; identical to SEQ ID NO: 561128

SEQ ID NO: 666912 - RNA, 64 nt, Homo Sapiens; identical to SEQ ID NO: 561129

SEQ ID NO: 666913 - RNA, 64 nt, Homo Sapiens; identical to SEQ ID NO: 561130

SEQ ID NO: 666914 - RNA, 64 nt, Homo Sapiens; identical to SEQ ID NO: 561131

SEQ ID NO: 666915 - RNA, 64 nt, Homo Sapiens; identical to SEQ ID NO: 561132

SEQ ID NO: 666916 - RNA, 64 nt, Homo Sapiens; identical to SEQ ID NO: 561133

SEQ ID NO: 666917 - RNA, 64 nt, Homo Sapiens; identical to SEQ ID NO: 561134

SEQ ID NO: 666918 - RNA, 64 nt, Homo Sapiens; identical to SEQ ID NO: 561135

SEQ ID NO: 666919 - RNA, 64 nt, Homo Sapiens; identical to SEQ ID NO: 561136

SEQ ID NO: 666920 - RNA, 64 nt, Homo Sapiens; identical to SEQ ID NO: 561137

SEQ ID NO: 666921 - RNA, 64 nt, Homo Sapiens; identical to SEQ ID NO: 561138

SEQ ID NO: 666922 - RNA, 64 nt, Homo Sapiens; identical to SEQ ID NO: 561139

SEQ ID NO: 666923 - RNA, 64 nt, Homo Sapiens; identical to SEQ ID NO: 561140

SEQ ID NO: 666924 - RNA, 64 nt, Homo Sapiens; identical to SEQ ID NO: 561141

SEQ ID NO: 666925 - RNA, 64 nt, Homo Sapiens; identical to SEQ ID NO: 561142

SEQ ID NO: 666926 - RNA, 64 nt, Homo Sapiens; identical to SEQ ID NO: 561143

SEQ ID NO: 666927 - RNA, 64 nt, Homo Sapiens; identical to SEQ ID NO: 561144

SEQ ID NO: 666928 - RNA, 64 nt, Homo Sapiens; identical to SEQ ID NO: 561145

SEQ ID NO: 666929 - RNA, 64 nt, Homo Sapiens; identical to SEQ ID NO: 561146

SEQ ID NO: 666930 - RNA, 64 nt, Homo Sapiens; identical to SEQ ID NO: 561147

SEQ ID NO: 666931 - RNA, 64 nt, Homo Sapiens; identical to SEQ ID NO: 561148

SEQ ID NO: 666932 - RNA, 64 nt, Homo Sapiens; identical to SEQ ID NO: 561149

SEQ ID NO: 666933 - RNA, 64 nt, Homo Sapiens; identical to SEQ ID NO: 561150

SEQ ID NO: 666934 - RNA, 64 nt, Homo Sapiens; identical to SEQ ID NO: 561151

SEQ ID NO: 666935 - RNA, 64 nt, Homo Sapiens; identical to SEQ ID NO: 561152

SEQ ID NO: 666936 - RNA, 64 nt, Homo Sapiens; identical to SEQ ID NO: 561153

SEQ ID NO: 666937 - RNA, 64 nt, Homo Sapiens; identical to SEQ ID NO: 561154

SEQ ID NO: 666938 - RNA, 64 nt, Homo Sapiens; identical to SEQ ID NO: 561155

SEQ ID NO: 666939 - RNA, 64 nt, Homo Sapiens; identical to SEQ ID NO: 561156

SEQ ID NO: 666940 - RNA, 64 nt, Homo Sapiens; identical to SEQ ID NO: 561157

SEQ ID NO: 666941 - RNA, 64 nt, Homo Sapiens; identical to SEQ ID NO: 561158

SEQ ID NO: 666942 - RNA, 64 nt, Homo Sapiens; identical to SEQ ID NO: 561159

SEQ ID NO: 666943 - RNA, 64 nt, Homo Sapiens; identical to SEQ ID NO: 561160

SEQ ID NO: 666944 - RNA, 64 nt, Homo Sapiens; identical to SEQ ID NO: 561161

SEQ ID NO: 666945 - RNA, 64 nt, Homo Sapiens; identical to SEQ ID NO: 561162

SEQ ID NO: 666946 - RNA, 64 nt, Homo Sapiens; identical to SEQ ID NO: 561163

SEQ ID NO: 666947 - RNA, 64 nt, Homo Sapiens; identical to SEQ ID NO: 561164

SEQ ID NO: 666948 - RNA, 64 nt, Homo Sapiens; identical to SEQ ID NO: 561165

SEQ ID NO: 666949 - RNA, 64 nt, Homo Sapiens; identical to SEQ ID NO: 561166

SEQ ID NO: 666950 - RNA, 64 nt, Homo Sapiens; identical to SEQ ID NO: 561167

SEQ ID NO: 666951 - RNA, 64 nt, Homo Sapiens; identical to SEQ ID NO: 561168

SEQ ID NO: 666952 - RNA, 64 nt, Homo Sapiens; identical to SEQ ID NO: 561169

SEQ ID NO: 666953 - RNA, 64 nt, Homo Sapiens; identical to SEQ ID NO: 561170

SEQ ID NO: 666954 - RNA, 64 nt, Homo Sapiens; identical to SEQ ID NO: 561171

SEQ ID NO: 666955 - RNA, 64 nt, Homo Sapiens; identical to SEQ ID NO: 561172

SEQ ID NO: 666956 - RNA, 64 nt, Homo Sapiens; identical to SEQ ID NO: 561173

SEQ ID NO: 666957 - RNA, 64 nt, Homo Sapiens; identical to SEQ ID NO: 561174

SEQ ID NO: 666958 - RNA, 64 nt, Homo Sapiens; identical to SEQ ID NO: 561175

SEQ ID NO: 666959 - RNA, 64 nt, Homo Sapiens; identical to SEQ ID NO: 561176

SEQ ID NO: 666960 - RNA, 64 nt, Homo Sapiens; identical to SEQ ID NO: 561177

SEQ ID NO: 666961 - RNA, 64 nt, Homo Sapiens; identical to SEQ ID NO: 561178

SEQ ID NO: 666962 - RNA, 64 nt, Homo Sapiens; identical to SEQ ID NO: 561179

SEQ ID NO: 666963 - RNA, 64 nt, Homo Sapiens; identical to SEQ ID NO: 561180

SEQ ID NO: 666964 - RNA, 64 nt, Homo Sapiens; identical to SEQ ID NO: 561181

SEQ ID NO: 666965 - RNA, 64 nt, Homo Sapiens; identical to SEQ ID NO: 561182

SEQ ID NO: 666966 - RNA, 64 nt, Homo Sapiens; identical to SEQ ID NO: 561183

SEQ ID NO: 666967 - RNA, 64 nt, Homo Sapiens; identical to SEQ ID NO: 561184

SEQ ID NO: 666968 - RNA, 64 nt, Homo Sapiens; identical to SEQ ID NO: 561185

SEQ ID NO: 666969 - RNA, 64 nt, Homo Sapiens; identical to SEQ ID NO: 561186

SEQ ID NO: 666970 - RNA, 64 nt, Homo Sapiens; identical to SEQ ID NO: 561187

SEQ ID NO: 666971 - RNA, 64 nt, Homo Sapiens; identical to SEQ ID NO: 561188

SEQ ID NO: 666972 - RNA, 64 nt, Homo Sapiens; identical to SEQ ID NO: 561189

SEQ ID NO: 666973 - RNA, 64 nt, Homo Sapiens; identical to SEQ ID NO: 561190

SEQ ID NO: 666974 - RNA, 64 nt, Homo Sapiens; identical to SEQ ID NO: 561191

SEQ ID NO: 666975 - RNA, 64 nt, Homo Sapiens; identical to SEQ ID NO: 561192

SEQ ID NO: 666976 - RNA, 64 nt, Homo Sapiens; identical to SEQ ID NO: 561193

SEQ ID NO: 666977 - RNA, 64 nt, Homo Sapiens; identical to SEQ ID NO: 561194

SEQ ID NO: 666978 - RNA, 64 nt, Homo Sapiens; identical to SEQ ID NO: 561195

SEQ ID NO: 666979 - RNA, 64 nt, Homo Sapiens; identical to SEQ ID NO: 561196

SEQ ID NO: 666980 - RNA, 64 nt, Homo Sapiens; identical to SEQ ID NO: 561197

SEQ ID NO: 666981 - RNA, 64 nt, Homo Sapiens; identical to SEQ ID NO: 561198

SEQ ID NO: 666982 - RNA, 64 nt, Homo Sapiens; identical to SEQ ID NO: 561199

SEQ ID NO: 666983 - RNA, 64 nt, Homo Sapiens
uugagaacacacucgugugugcacauaaagacacgcagauuacauuugauaaauguuacacaga

SEQ ID NO: 666984 - RNA, 64 nt, Homo Sapiens
ugucagaauaaauuccugguggucagaugaaagggcagauuaaauggacucaucaggguaagag

SEQ ID NO: 666985 - RNA, 64 nt, Homo Sapiens
ccccaccagccuuaguccaguuaaaaguaagacugcagauuaucaauuuauugguguuucuaac

SEQ ID NO: 666986 - RNA, 64 nt, Homo Sapiens
uagcagaaaguccaggaaagcuuguucuugggaagcagauuaagguuucauguuaguaaauuca

SEQ ID NO: 666987 - RNA, 61 nt, Homo Sapiens
cuuucuuuacccagugcaauuuuguuugugugcaaaccaaagagccuugcuggacaagugg

SEQ ID NO: 666988 - RNA, 61 nt, Homo Sapiens
cugugaccaacacaugugaggacuucccuuugcaaaccaggaucagucaucucuuuauggu

SEQ ID NO: 666989 - RNA, 61 nt, Homo Sapiens
agcuuuggcuucugguguggagcguuguuuggcaaaccaacuuucacauuaaaugguguga

SEQ ID NO: 666990 - RNA, 61 nt, Homo Sapiens
uuuaaaacaaacaaacaaacaaaacaaaaaagcaaaccacauuuguuaucucaaauuuuga

SEQ ID NO: 666991 - RNA, 61 nt, Homo Sapiens
ggcuuuguuagcacuuucaaaaaaaaaaaaagcaaaccauacuuguccacuguccugugcu

SEQ ID NO: 666992 - RNA, 64 nt, Homo Sapiens; identical to SEQ ID NO: 486861

SEQ ID NO: 666993 - RNA, 64 nt, Homo Sapiens; identical to SEQ ID NO: 486862

SEQ ID NO: 666994 - RNA, 64 nt, Homo Sapiens; identical to SEQ ID NO: 486863

SEQ ID NO: 666995 - RNA, 64 nt, Homo Sapiens; identical to SEQ ID NO: 486864

SEQ ID NO: 666996 - RNA, 64 nt, Homo Sapiens; identical to SEQ ID NO: 486865

SEQ ID NO: 666997 - RNA, 64 nt, Homo Sapiens; identical to SEQ ID NO: 486866

SEQ ID NO: 666998 - RNA, 64 nt, Homo Sapiens; identical to SEQ ID NO: 486867

SEQ ID NO: 666999 - RNA, 64 nt, Homo Sapiens; identical to SEQ ID NO: 486868

SEQ ID NO: 667000 - RNA, 64 nt, Homo Sapiens; identical to SEQ ID NO: 486869

SEQ ID NO: 667001 - RNA, 64 nt, Homo Sapiens; identical to SEQ ID NO: 486870

SEQ ID NO: 667002 - RNA, 64 nt, Homo Sapiens; identical to SEQ ID NO: 486871

SEQ ID NO: 667003 - RNA, 64 nt, Homo Sapiens; identical to SEQ ID NO: 486872

SEQ ID NO: 667004 - RNA, 64 nt, Homo Sapiens; identical to SEQ ID NO: 486873

SEQ ID NO: 667005 - RNA, 64 nt, Homo Sapiens; identical to SEQ ID NO: 486874

SEQ ID NO: 667006 - RNA, 64 nt, Homo Sapiens; identical to SEQ ID NO: 486875

SEQ ID NO: 667007 - RNA, 64 nt, Homo Sapiens; identical to SEQ ID NO: 486876

SEQ ID NO: 667008 - RNA, 64 nt, Homo Sapiens; identical to SEQ ID NO: 486877

SEQ ID NO: 667009 - RNA, 64 nt, Homo Sapiens; identical to SEQ ID NO: 486878

SEQ ID NO: 667010 - RNA, 64 nt, Homo Sapiens; identical to SEQ ID NO: 486879

SEQ ID NO: 667011 - RNA, 64 nt, Homo Sapiens; identical to SEQ ID NO: 486880

SEQ ID NO: 667012 - RNA, 64 nt, Homo Sapiens; identical to SEQ ID NO: 486881

SEQ ID NO: 667013 - RNA, 64 nt, Homo Sapiens; identical to SEQ ID NO: 486882

SEQ ID NO: 667014 - RNA, 64 nt, Homo Sapiens; identical to SEQ ID NO: 486883

SEQ ID NO: 667015 - RNA, 64 nt, Homo Sapiens; identical to SEQ ID NO: 486884

SEQ ID NO: 667016 - RNA, 64 nt, Homo Sapiens; identical to SEQ ID NO: 486885

SEQ ID NO: 667017 - RNA, 64 nt, Homo Sapiens; identical to SEQ ID NO: 486886

SEQ ID NO: 667018 - RNA, 64 nt, Homo Sapiens
aauuuagaaaaacuugagaauaagaauuaucagaaacaggaaagauaucuccuuuucugagcuc

SEQ ID NO: 667019 - RNA, 64 nt, Homo Sapiens
uuuugcagaauauagguuuaguacuuaaguguguaacaggaauaguaauccugcugauccaguu

SEQ ID NO: 667020 - RNA, 64 nt, Homo Sapiens
agguggagagcaagacugaccagaaagaauagagaacaggaacgcugaacaggagaaagacaaa

SEQ ID NO: 667021 - RNA, 64 nt, Homo Sapiens
guguuuuuuuuuuuuuuuuucagugucuuugaaaaacaggaaccgauccuccucuuugggaguc

SEQ ID NO: 667022 - RNA, 64 nt, Homo Sapiens
agccggacagccuggcugucucugcaugugaaugaacaggaauggaagaccagaucaugggugg

SEQ ID NO: 667023 - RNA, 64 nt, Homo Sapiens
ugccucaaagccuugcuuccaggcuccuuuguacaacaggaaaaaaaggucuuugaggguuccu

SEQ ID NO: 667024 - RNA, 64 nt, Homo Sapiens
gcauguuugaucuguugucacaaaccaaacaggaaacaggaaaucaccugagaggcagacagau

SEQ ID NO: 667025 - RNA, 64 nt, Homo Sapiens
aggaaaugcauguuugaucugacagaucaaaccaaacaggaaacuauaagucaccugagaggca

SEQ ID NO: 667026 - RNA, 64 nt, Homo Sapiens
uuaccugaacaaccaugagcgcuccagugaacagaacaggaaucugaugaacaagcuggugaau

SEQ ID NO: 667027 - RNA, 64 nt, Homo Sapiens
agugauuuuuuuaaaaaaaagucuucuguuuauuaacaggaaaauuuauuuauuugacaggauu

SEQ ID NO: 667028 - RNA, 64 nt, Homo Sapiens
aaauuguaaaaaagguuuucuuuuaaagauuaacaacaggaaaugcacuuagcuagaaccucau

SEQ ID NO: 667029 - RNA, 64 nt, Homo Sapiens
auccauaacuuuagucuuaaacauuucuaugccaaacaggaacaccuuucuguuaauagucauc

SEQ ID NO: 667030 - RNA, 64 nt, Homo Sapiens
uguucuccuacagaaaagugauucugugagggugaacaggaaaugccuuguggaaacaggaagu

SEQ ID NO: 667031 - RNA, 64 nt, Homo Sapiens
auucugugagggugaacaggaaaugccuuguggaaacaggaaguccaagugauucauguacuga

SEQ ID NO: 667032 - RNA, 64 nt, Homo Sapiens
gaaaccccaaacucaggccgguaagggaaaagggaacaggaaaauuaucuuuugagaacuuuug

SEQ ID NO: 667033 - RNA, 64 nt, Homo Sapiens
cacauugccagugacaugagaacaccuagaucagaacaggaaucgagcccuguaucaacccaga

SEQ ID NO: 667034 - RNA, 64 nt, Homo Sapiens
gcaaauauuuauauuuuuucgcacaaaagauauaaacaggaacaccuuagaaaagacaauaaau

SEQ ID NO: 667035 - RNA, 64 nt, Homo Sapiens
augugcuuuaaaaaaagguggauucaguguguggaacaggaaggaaguugagacaaaccaggca

SEQ ID NO: 667036 - RNA, 64 nt, Homo Sapiens
cuaacucccaauauuggaauauuaauaacacugaaacaggaaauaggaaucuauuaaggucaau

SEQ ID NO: 667037 - RNA, 64 nt, Homo Sapiens
gaacauagucguuuccaacaauuuuuauuguuugaacaggaaguguuuucuuacuguuuaauuu

SEQ ID NO: 667038 - RNA, 64 nt, Homo Sapiens
ugccuucauccaggacaggaaguagcacuucugaaacaggaaguggucuggcuggaacuccaag

SEQ ID NO: 667039 - RNA, 64 nt, Homo Sapiens
uccuuccugauuuuucuaaucgcuccuucuggggaacaggaaguugauauugccaugguggcgg

SEQ ID NO: 667040 - RNA, 64 nt, Homo Sapiens
aacaucuccacccaagacgucuuuggaauccaagaacaggaagccaagagagugagcagggagg

SEQ ID NO: 667041 - RNA, 64 nt, Homo Sapiens
uccugguuccuccgccacucuuccucuuggggacaacaggaagugucugauuccagucugccua

SEQ ID NO: 667042 - RNA, 64 nt, Homo Sapiens
gagcaaggggccacuuccuagugaacaggaagcaaacaggaaguggacaggaagcugauagaaa

SEQ ID NO: 667043 - RNA, 64 nt, Homo Sapiens
aaacaggaagugagcaaggggcugauagaaagugaacaggaagcugucuggcaagggacaggaa

SEQ ID NO: 667044 - RNA, 64 nt, Homo Sapiens
uccagggaggccuggccuggaggaggaguccacuaacaggaaacacuucucacccccucacaca

SEQ ID NO: 667045 - RNA, 64 nt, Homo Sapiens
ggggagccccuggagggaaauuccuuggcaggggaacaggaaauguggccgccucugccccacu

SEQ ID NO: 667046 - RNA, 64 nt, Homo Sapiens
aaucaaaccuuggcacacaggugugauacaacuuaacaggaaucaucgauucauccauaaauaa

SEQ ID NO: 667047 - RNA, 64 nt, Homo Sapiens
gcuaguguugauguuuuuuggucaagaggguaugaacaggaagaauuaaaugcagcaggcuuua

SEQ ID NO: 667048 - RNA, 64 nt, Homo Sapiens; identical to SEQ ID NO: 443640

SEQ ID NO: 667049 - RNA, 64 nt, Homo Sapiens; identical to SEQ ID NO: 443641

SEQ ID NO: 667050 - RNA, 64 nt, Homo Sapiens; identical to SEQ ID NO: 443642

SEQ ID NO: 667051 - RNA, 64 nt, Homo Sapiens; identical to SEQ ID NO: 443643

SEQ ID NO: 667052 - RNA, 64 nt, Homo Sapiens; identical to SEQ ID NO: 443644

SEQ ID NO: 667053 - RNA, 64 nt, Homo Sapiens; identical to SEQ ID NO: 443645

SEQ ID NO: 667054 - RNA, 64 nt, Homo Sapiens; identical to SEQ ID NO: 443646

SEQ ID NO: 667055 - RNA, 64 nt, Homo Sapiens; identical to SEQ ID NO: 443647

SEQ ID NO: 667056 - RNA, 56 nt, Homo Sapiens; identical to SEQ ID NO: 443648

SEQ ID NO: 667057 - RNA, 64 nt, Homo Sapiens; identical to SEQ ID NO: 443649

SEQ ID NO: 667058 - RNA, 64 nt, Homo Sapiens; identical to SEQ ID NO: 443650

SEQ ID NO: 667059 - RNA, 64 nt, Homo Sapiens; identical to SEQ ID NO: 443651

SEQ ID NO: 667060 - RNA, 64 nt, Homo Sapiens; identical to SEQ ID NO: 443652

SEQ ID NO: 667061 - RNA, 64 nt, Homo Sapiens; identical to SEQ ID NO: 443653

SEQ ID NO: 667062 - RNA, 64 nt, Homo Sapiens; identical to SEQ ID NO: 443654

SEQ ID NO: 667063 - RNA, 64 nt, Homo Sapiens; identical to SEQ ID NO: 443655

SEQ ID NO: 667064 - RNA, 64 nt, Homo Sapiens; identical to SEQ ID NO: 443656

SEQ ID NO: 667065 - RNA, 64 nt, Homo Sapiens; identical to SEQ ID NO: 443657

SEQ ID NO: 667066 - RNA, 64 nt, Homo Sapiens; identical to SEQ ID NO: 443658

SEQ ID NO: 667067 - RNA, 64 nt, Homo Sapiens; identical to SEQ ID NO: 443659

SEQ ID NO: 667068 - RNA, 64 nt, Homo Sapiens; identical to SEQ ID NO: 443660

SEQ ID NO: 667069 - RNA, 64 nt, Homo Sapiens; identical to SEQ ID NO: 443661

SEQ ID NO: 667070 - RNA, 64 nt, Homo Sapiens; identical to SEQ ID NO: 443662

SEQ ID NO: 667071 - RNA, 64 nt, Homo Sapiens; identical to SEQ ID NO: 443663

SEQ ID NO: 667072 - RNA, 64 nt, Homo Sapiens; identical to SEQ ID NO: 443664

SEQ ID NO: 667073 - RNA, 64 nt, Homo Sapiens; identical to SEQ ID NO: 443665

SEQ ID NO: 667074 - RNA, 64 nt, Homo Sapiens; identical to SEQ ID NO: 443666

SEQ ID NO: 667075 - RNA, 64 nt, Homo Sapiens; identical to SEQ ID NO: 443667

SEQ ID NO: 667076 - RNA, 64 nt, Homo Sapiens; identical to SEQ ID NO: 443668

SEQ ID NO: 667077 - RNA, 64 nt, Homo Sapiens; identical to SEQ ID NO: 443669

SEQ ID NO: 667078 - RNA, 64 nt, Homo Sapiens; identical to SEQ ID NO: 443670

SEQ ID NO: 667079 - RNA, 64 nt, Homo Sapiens; identical to SEQ ID NO: 443671

SEQ ID NO: 667080 - RNA, 64 nt, Homo Sapiens; identical to SEQ ID NO: 443672

SEQ ID NO: 667081 - RNA, 64 nt, Homo Sapiens; identical to SEQ ID NO: 443673

SEQ ID NO: 667082 - RNA, 64 nt, Homo Sapiens; identical to SEQ ID NO: 443674

SEQ ID NO: 667083 - RNA, 64 nt, Homo Sapiens; identical to SEQ ID NO: 443675

SEQ ID NO: 667084 - RNA, 64 nt, Homo Sapiens; identical to SEQ ID NO: 443676

SEQ ID NO: 667085 - RNA, 64 nt, Homo Sapiens; identical to SEQ ID NO: 443677

SEQ ID NO: 667086 - RNA, 64 nt, Homo Sapiens; identical to SEQ ID NO: 443678

SEQ ID NO: 667087 - RNA, 64 nt, Homo Sapiens; identical to SEQ ID NO: 443679

SEQ ID NO: 667088 - RNA, 64 nt, Homo Sapiens; identical to SEQ ID NO: 443680

SEQ ID NO: 667089 - RNA, 64 nt, Homo Sapiens; identical to SEQ ID NO: 443681

SEQ ID NO: 667090 - RNA, 64 nt, Homo Sapiens; identical to SEQ ID NO: 443682

SEQ ID NO: 667091 - RNA, 64 nt, Homo Sapiens; identical to SEQ ID NO: 443683

SEQ ID NO: 667092 - RNA, 64 nt, Homo Sapiens; identical to SEQ ID NO: 443684

SEQ ID NO: 667093 - RNA, 64 nt, Homo Sapiens; identical to SEQ ID NO: 443685

SEQ ID NO: 667094 - RNA, 64 nt, Homo Sapiens; identical to SEQ ID NO: 443686

SEQ ID NO: 667095 - RNA, 64 nt, Homo Sapiens; identical to SEQ ID NO: 443687

SEQ ID NO: 667096 - RNA, 64 nt, Homo Sapiens; identical to SEQ ID NO: 443688

SEQ ID NO: 667097 - RNA, 64 nt, Homo Sapiens; identical to SEQ ID NO: 443689

SEQ ID NO: 667098 - RNA, 64 nt, Homo Sapiens; identical to SEQ ID NO: 443690

SEQ ID NO: 667099 - RNA, 64 nt, Homo Sapiens; identical to SEQ ID NO: 443691

SEQ ID NO: 667100 - RNA, 64 nt, Homo Sapiens; identical to SEQ ID NO: 443692

SEQ ID NO: 667101 - RNA, 64 nt, Homo Sapiens; identical to SEQ ID NO: 443693

SEQ ID NO: 667102 - RNA, 64 nt, Homo Sapiens; identical to SEQ ID NO: 443694

SEQ ID NO: 667103 - RNA, 64 nt, Homo Sapiens; identical to SEQ ID NO: 443695

SEQ ID NO: 667104 - RNA, 64 nt, Homo Sapiens; identical to SEQ ID NO: 443696

SEQ ID NO: 667105 - RNA, 64 nt, Homo Sapiens; identical to SEQ ID NO: 443697

SEQ ID NO: 667106 - RNA, 64 nt, Homo Sapiens; identical to SEQ ID NO: 443698

SEQ ID NO: 667107 - RNA, 64 nt, Homo Sapiens; identical to SEQ ID NO: 443699

SEQ ID NO: 667108 - RNA, 64 nt, Homo Sapiens; identical to SEQ ID NO: 443700

SEQ ID NO: 667109 - RNA, 64 nt, Homo Sapiens; identical to SEQ ID NO: 443701

SEQ ID NO: 667110 - RNA, 64 nt, Homo Sapiens; identical to SEQ ID NO: 443702

SEQ ID NO: 667111 - RNA, 64 nt, Homo Sapiens; identical to SEQ ID NO: 443703

SEQ ID NO: 667112 - RNA, 64 nt, Homo Sapiens; identical to SEQ ID NO: 443704

SEQ ID NO: 667113 - RNA, 64 nt, Homo Sapiens; identical to SEQ ID NO: 443705

SEQ ID NO: 667114 - RNA, 64 nt, Homo Sapiens; identical to SEQ ID NO: 443706

SEQ ID NO: 667115 - RNA, 64 nt, Homo Sapiens; identical to SEQ ID NO: 443707

SEQ ID NO: 667116 - RNA, 64 nt, Homo Sapiens; identical to SEQ ID NO: 443708

SEQ ID NO: 667117 - RNA, 64 nt, Homo Sapiens; identical to SEQ ID NO: 443709

SEQ ID NO: 667118 - RNA, 64 nt, Homo Sapiens; identical to SEQ ID NO: 443710

SEQ ID NO: 667119 - RNA, 64 nt, Homo Sapiens; identical to SEQ ID NO: 443711

SEQ ID NO: 667120 - RNA, 64 nt, Homo Sapiens; identical to SEQ ID NO: 443712

SEQ ID NO: 667121 - RNA, 64 nt, Homo Sapiens; identical to SEQ ID NO: 443713

SEQ ID NO: 667122 - RNA, 64 nt, Homo Sapiens; identical to SEQ ID NO: 443714

SEQ ID NO: 667123 - RNA, 64 nt, Homo Sapiens; identical to SEQ ID NO: 443715

SEQ ID NO: 667124 - RNA, 64 nt, Homo Sapiens; identical to SEQ ID NO: 443716

SEQ ID NO: 667125 - RNA, 64 nt, Homo Sapiens; identical to SEQ ID NO: 443717

SEQ ID NO: 667126 - RNA, 64 nt, Homo Sapiens; identical to SEQ ID NO: 443718

SEQ ID NO: 667127 - RNA, 64 nt, Homo Sapiens; identical to SEQ ID NO: 443719

SEQ ID NO: 667128 - RNA, 64 nt, Homo Sapiens; identical to SEQ ID NO: 443720

SEQ ID NO: 667129 - RNA, 64 nt, Homo Sapiens; identical to SEQ ID NO: 443721

SEQ ID NO: 667130 - RNA, 64 nt, Homo Sapiens; identical to SEQ ID NO: 443722

SEQ ID NO: 667131 - RNA, 64 nt, Homo Sapiens; identical to SEQ ID NO: 443723

SEQ ID NO: 667132 - RNA, 64 nt, Homo Sapiens; identical to SEQ ID NO: 443724

SEQ ID NO: 667133 - RNA, 64 nt, Homo Sapiens; identical to SEQ ID NO: 443725

SEQ ID NO: 667134 - RNA, 64 nt, Homo Sapiens; identical to SEQ ID NO: 443726

SEQ ID NO: 667135 - RNA, 64 nt, Homo Sapiens; identical to SEQ ID NO: 443727

SEQ ID NO: 667136 - RNA, 64 nt, Homo Sapiens; identical to SEQ ID NO: 443728

SEQ ID NO: 667137 - RNA, 64 nt, Homo Sapiens; identical to SEQ ID NO: 443729

SEQ ID NO: 667138 - RNA, 64 nt, Homo Sapiens; identical to SEQ ID NO: 443730

SEQ ID NO: 667139 - RNA, 64 nt, Homo Sapiens; identical to SEQ ID NO: 443731

SEQ ID NO: 667140 - RNA, 64 nt, Homo Sapiens; identical to SEQ ID NO: 443732

SEQ ID NO: 667141 - RNA, 64 nt, Homo Sapiens; identical to SEQ ID NO: 443733

SEQ ID NO: 667142 - RNA, 64 nt, Homo Sapiens; identical to SEQ ID NO: 443734

SEQ ID NO: 667143 - RNA, 64 nt, Homo Sapiens; identical to SEQ ID NO: 443735

SEQ ID NO: 667144 - RNA, 64 nt, Homo Sapiens; identical to SEQ ID NO: 443736

SEQ ID NO: 667145 - RNA, 64 nt, Homo Sapiens; identical to SEQ ID NO: 443737

SEQ ID NO: 667146 - RNA, 64 nt, Homo Sapiens; identical to SEQ ID NO: 443738

SEQ ID NO: 667147 - RNA, 64 nt, Homo Sapiens; identical to SEQ ID NO: 443739

SEQ ID NO: 667148 - RNA, 58 nt, Homo Sapiens
gggcgcucccgacacagcgcagacccaccaggaggaaagaggcccagcucucagcuga

SEQ ID NO: 667149 - RNA, 58 nt, Homo Sapiens
cugcgggcugcccugugggcuggugcuucaggaggaauccagagaaguguucagaugc

SEQ ID NO: 667150 - RNA, 58 nt, Homo Sapiens
ccccagcugaccagaaccaggcugagcgcaggaggacaggcaccaccggaugccacac

SEQ ID NO: 667151 - RNA, 58 nt, Homo Sapiens
gacaggcaccaccggaugccacaccaggcaggaggagguguggacagugaugguacgg

SEQ ID NO: 667152 - RNA, 58 nt, Homo Sapiens
guggucccagcuacucaggaggcugaggcaggaggaucacuugagcacaggaguuuga

SEQ ID NO: 667153 - RNA, 58 nt, Homo Sapiens
aggcugaggcagguggaucaccugaggucaggaggaguucaagaccagccuggccaac

SEQ ID NO: 667154 - RNA, 58 nt, Homo Sapiens
ggaggaagggggagucauuuauauucugcaggaggaaggggccccagcugucgccuuu

SEQ ID NO: 667155 - RNA, 58 nt, Homo Sapiens
ucugacugcaguguagggaauaggucaccaggaggagcccuucauccuggcaggccgg

SEQ ID NO: 667156 - RNA, 58 nt, Homo Sapiens
guaaucccgacacuuugggaggccaaggcaggaggauggcuugaagccaguaguucaa

SEQ ID NO: 667157 - RNA, 58 nt, Homo Sapiens
guaguccuagcuacuugggaggcugaggcaggaggaucccuugaguccaggagguuga

SEQ ID NO: 667158 - RNA, 58 nt, Homo Sapiens
ucccuccccuccuuuucagguaaggagacaggaggaguaggaggaggcagggccucuc

SEQ ID NO: 667159 - RNA, 58 nt, Homo Sapiens
aauacuugaaccuucucccagguaggggcaggaggagccacaugagagagggagaagg

SEQ ID NO: 667160 - RNA, 58 nt, Homo Sapiens
gacccucuguuuggagcauuccuaaggacaggaggaaaguagacacuaaaccucaugc

SEQ ID NO: 667161 - RNA, 58 nt, Homo Sapiens
uagacuuagacgaaagaaagagugacaacaggaggaaaggguggacauaaaugaguca

SEQ ID NO: 667162 - RNA, 58 nt, Homo Sapiens
ugggccuggacgacacggccgagcaagccaggaggacaucucgggguugucugcagga

SEQ ID NO: 667163 - RNA, 58 nt, Homo Sapiens
ggcaggagccaguccgugcaagaacaggcaggaggaaacauccugugaagggacacag

SEQ ID NO: 667164 - RNA, 58 nt, Homo Sapiens
uauagucccacuacuuguggggcuaaggcaggaggaucacuugagccccggaggucga

SEQ ID NO: 667165 - RNA, 58 nt, Homo Sapiens
guaauccuugcauuuuggaaggcugaggcaggaggaucacuuuaggccugguguguuc

SEQ ID NO: 667166 - RNA, 58 nt, Homo Sapiens
ccgagggccccaggaugucuaggggaggcaggaggaggcugucaucacauccccuggg

SEQ ID NO: 667167 - RNA, 58 nt, Homo Sapiens
ggggagcccccucuggcuguccggacggcaggaggagagacagcguggugagccgugg

SEQ ID NO: 667168 - RNA, 58 nt, Homo Sapiens
aucccaacacuuuguugggaggccaaagcaggaggauagcuugaggccaggaguucca

SEQ ID NO: 667169 - RNA, 58 nt, Homo Sapiens
guguucccagcuacucaggaggcugaagcaggaggauagcuugagcccaggaguuuga

SEQ ID NO: 667170 - RNA, 58 nt, Homo Sapiens
ccauacauuccucccugcuccccacugccaggaggaccacuguccccagccagccaaa

SEQ ID NO: 667171 - RNA, 58 nt, Homo Sapiens
ccaugcgcuuccagggccccacgguccccaggaggacgcuuccuggccaaagccccaa

SEQ ID NO: 667172 - RNA, 58 nt, Homo Sapiens
cagcauuauucuagugcuguauguguaacaggaggacagaguaggagagaccaugagu

SEQ ID NO: 667173 - RNA, 58 nt, Homo Sapiens
acauuagauaaugacacaauuuagaguccaggaggaauagcauuuguucauuuggagc

SEQ ID NO: 667174 - RNA, 58 nt, Homo Sapiens
acuggccauuaugcauccccaggcugcccaggaggaagacuccuggcucuguucaggg

SEQ ID NO: 667175 - RNA, 58 nt, Homo Sapiens
accgggcuugggcuuccucuguagacagcaggaggagcagguacuauucguaggcagu

SEQ ID NO: 667176 - RNA, 58 nt, Homo Sapiens
acacagaaacaccguaagugaaaagacacaggaggaugguccucacccccaccucucu

SEQ ID NO: 667177 - RNA, 58 nt, Homo Sapiens
ucuugagcccaggaggucaaggaugaggcaggaggaucguggucccagcuguucagga

SEQ ID NO: 667178 - RNA, 58 nt, Homo Sapiens
aggcaggaggaucucuugagcagcuguucaggaggaugguggcucaugcuuguggucc

SEQ ID NO: 667179 - RNA, 58 nt, Homo Sapiens
aggggccggggcggugccaggugagcaacaggaggacguggcagccugggcaaaccgg

SEQ ID NO: 667180 - RNA, 58 nt, Homo Sapiens
agccgugacccuguggaaggcugagcagcaggaggaggaaucuagcgaguccauggag

SEQ ID NO: 667181 - RNA, 58 nt, Homo Sapiens
uaauguauggaaaacauuuauaaauccacaggaggagauuuugauaucauuuggcuua

SEQ ID NO: 667182 - RNA, 58 nt, Homo Sapiens
guugagcccaggaguuugagggcugaggcaggaggauuauagucccagcuacuugaga

SEQ ID NO: 667183 - RNA, 58 nt, Homo Sapiens
acagugaccuauaaugagccggcugaggcaggaggaucgcagucccagcuacucagga

SEQ ID NO: 667184 - RNA, 58 nt, Homo Sapiens
acuuggagccaggaguuugaggccaaggcaggaggaucguaaucccagcauuuuagga

SEQ ID NO: 667185 - RNA, 58 nt, Homo Sapiens
aaggggaaggagaagagggagaauggagcaggaggaaaagcagaguuggucuagagag

SEQ ID NO: 667186 - RNA, 58 nt, Homo Sapiens
ugguuuccugucacucagagcugauucacaggaggaggggagguuggggggcgggaga

SEQ ID NO: 667187 - RNA, 58 nt, Homo Sapiens
uuagauuuugauauugauuuagaagacacaggaggagaccaucaaaugaauuaauauc

SEQ ID NO: 667188 - RNA, 58 nt, Homo Sapiens
guaaucccagcuacucaggaggcugaggcaggaggauugcuugaacccuggaggcgga

SEQ ID NO: 667189 - RNA, 58 nt, Homo Sapiens
gcacuuggcuccuggcagagggagaggacaggaggaggagccuuccccaggaggaacg

SEQ ID NO: 667190 - RNA, 58 nt, Homo Sapiens
gggagaggacaggaggaggagccuuccccaggaggaacgaggagagguggccacgugg

SEQ ID NO: 667191 - RNA, 58 nt, Homo Sapiens
ggcccuguucugggggagcaggguaaggcaggaggaagugggugagcuccgagaugau

SEQ ID NO: 667192 - RNA, 58 nt, Homo Sapiens
uguggcucugcuggcucagugugggcugcaggaggacugcagacucagcugcaauucu

SEQ ID NO: 667193 - RNA, 58 nt, Homo Sapiens
gugcugaggcgggaggauuacuugagcccaggaggauuacuucaaccugggagguuga

SEQ ID NO: 667194 - RNA, 58 nt, Homo Sapiens
uguaauucuagcacuuuggaggccaaggcaggaggacugcuugagcccaggaguuuga

SEQ ID NO: 667195 - RNA, 58 nt, Homo Sapiens
uuagccaugccugcuccucugccuggaccaggaggagggccccuggggcagaaguuag

SEQ ID NO: 667196 - RNA, 58 nt, Homo Sapiens
ccugcagggcuggucagggugucuggggcaggaggaggccaacucacugaacuagugc

SEQ ID NO: 667197 - RNA, 58 nt, Homo Sapiens
uaggccacucgagcaucagagcuuccagcaggaggaagggcuguaggaauggaagcuu

SEQ ID NO: 667198 - RNA, 58 nt, Homo Sapiens
acuggaaccugggagguugcggcugaggcaggaggauccuguagucccggccacucgg

SEQ ID NO: 667199 - RNA, 58 nt, Homo Sapiens
acuugaguccagaaauucaaggccaaggcaggaggaucauaaucccaggacuuuggga

SEQ ID NO: 667200 - RNA, 58 nt, Homo Sapiens
gcggggauccuguuacaaaggugaaacccaggaggagaguguggaguccagagugcug

SEQ ID NO: 667201 - RNA, 58 nt, Homo Sapiens
uucugccaccaucagggacaaacgggggcaggaggaaagucacugaugcccagauguu

SEQ ID NO: 667202 - RNA, 58 nt, Homo Sapiens
uggcacugaagguggaacagaugccugccaggaggagcgcaggaagcccaggaggcug

SEQ ID NO: 667203 - RNA, 58 nt, Homo Sapiens
cccaggaggcugaugccugcaugagcuccaggaggaagccagcugcaagaccguguaa

SEQ ID NO: 667204 - RNA, 58 nt, Homo Sapiens
aaugagagugauguuggccaauucuugccaggaggaggcccuaggacccuaggaugcc

SEQ ID NO: 667205 - RNA, 58 nt, Homo Sapiens
uucuauguguauguauauguauuuagaacaggaggauacugccuguguucucaugugg

SEQ ID NO: 667206 - RNA, 58 nt, Homo Sapiens
gagaccagucaguacuucuuggagggggcaggaggagagaggaaaagggagggcgaga

SEQ ID NO: 667207 - RNA, 58 nt, Homo Sapiens
ccacccgcgcccugggacgcagccacgccaggaggaggacacggccgccgagagcaag

SEQ ID NO: 667208 - RNA, 58 nt, Homo Sapiens
agaucugaggaaggccguaaaauggggacaggaggauucagcucaggaguaagggaag

SEQ ID NO: 667209 - RNA, 58 nt, Homo Sapiens
cagggcuagaagcacaggcccgucaccccaggaggaaaagcccagggucuggggcagc

SEQ ID NO: 667210 - RNA, 58 nt, Homo Sapiens
gaaagagagcuucaaccucaagagggcucaggaggacaucucacggcugcggcgcaag

SEQ ID NO: 667211 - RNA, 58 nt, Homo Sapiens
ggucuacgcagaugccgacgaaauccuccaggaggagaucaaggaguacaaggugggg

SEQ ID NO: 667212 - RNA, 58 nt, Homo Sapiens
cagagccuuggaggacacuaagaggaggcaggaggagcaacucaaauccccaagaaca

SEQ ID NO: 667213 - RNA, 58 nt, Homo Sapiens
uggcagcaugcaaacuuggaucagauagcaggaggaacuuucaaaagucuggcccacu

SEQ ID NO: 667214 - RNA, 58 nt, Homo Sapiens
gcuugagcucaggaguucaagccugaggcaggaggauuguagucccagguacuuggga

SEQ ID NO: 667215 - RNA, 58 nt, Homo Sapiens
acuugagcccgggagguugaggcugagccaggaggaucguagucccagcuacuaggga

SEQ ID NO: 667216 - RNA, 58 nt, Homo Sapiens
uauaaucgagcacuuugggaggccaagacaggaggaucacuugaggccaggagucuga

SEQ ID NO: 667217 - RNA, 58 nt, Homo Sapiens
guagucccagccacucagaaggcugaggcaggaggaucgcuugagaccaagaguuuga

SEQ ID NO: 667218 - RNA, 58 nt, Homo Sapiens
aagaccuugccucugugccgcggagguccaggaggaaacggggcggccgcuaggccuc

SEQ ID NO: 667219 - RNA, 58 nt, Homo Sapiens
acacgcucaaugccccacgugccuucuccaggaggaacgaagcaggguuugaggguug

SEQ ID NO: 667220 - RNA, 58 nt, Homo Sapiens
ggggcagcugugucaucuuucuggggcccaggaggaucugggcugguuugucugggga

SEQ ID NO: 667221 - RNA, 58 nt, Homo Sapiens
auaaucccagcuguuugagaggccaaugcaggaggaugguugagcucaggaguucgag

SEQ ID NO: 667222 - RNA, 58 nt, Homo Sapiens
gcaaucccagugcuuugggagacugaggcaggaggaucacuuaaggccaggaguucga

SEQ ID NO: 667223 - RNA, 58 nt, Homo Sapiens
guaauccgagugcuuugggaggcugaggcaggaggaucacucgagcucaagaauucaa

SEQ ID NO: 667224 - RNA, 58 nt, Homo Sapiens
agcuuggaguucucuauacugcuuucuccaggaggauuucucauguuaggccuaagag

SEQ ID NO: 667225 - RNA, 58 nt, Homo Sapiens
acaggcaaauguacuucucaaggaaggacaggaggaagaaauguaucuuauaauaaaa

SEQ ID NO: 667226 - RNA, 58 nt, Homo Sapiens
uggccgaguaggggugggggugggauggcaggaggagccgcaggaggaaggagguugu

SEQ ID NO: 667227 - RNA, 58 nt, Homo Sapiens
ggugggggugggauggcaggaggagccgcaggaggaaggagguugugcagggucugga

SEQ ID NO: 667228 - RNA, 58 nt, Homo Sapiens
agaagaaaaaaaccccuggccuuugggccaggaggaaucuguuacucgaauccaccca

SEQ ID NO: 667229 - RNA, 58 nt, Homo Sapiens
acucugaagucacuaguccagcugggugcaggaggacuucaaguguguggacgaaaga

SEQ ID NO: 667230 - RNA, 58 nt, Homo Sapiens
uugggcuccgugugggagaccggccugccaggaggacccagggcucuguaaguagaug

SEQ ID NO: 667231 - RNA, 57 nt, Homo Sapiens
gggcucuguaaguagaugcauuuggguccaggaggaagcguggacaccucguaggga

SEQ ID NO: 667232 - RNA, 58 nt, Homo Sapiens
agaccuagacuuaccugaaggaucuucacaggaggauaaagacguagaauuaccugaa

SEQ ID NO: 667233 - RNA, 58 nt, Homo Sapiens
agacguagaauuaccugaaggaucuucacaggaggaugaagaccuagagaaaaagcga

SEQ ID NO: 667234 - RNA, 58 nt, Homo Sapiens
aagaccuaggguuaucugaagaucuucacaggaggaugagaccuacaauuaccugaag

SEQ ID NO: 667235 - RNA, 58 nt, Homo Sapiens
aagaccuagacucaucugcagauccucacaggaggaugccaagaggaggaggacgaag

SEQ ID NO: 667236 - RNA, 64 nt, Homo Sapiens
uucagugugugucauaacgacgucacugcuuuuuaaacucgauaacucuuuauuuuaguaaaau

SEQ ID NO: 667237 - RNA, 64 nt, Homo Sapiens
uucauuauuuauuuuaccuuuuacugacaaugugaaacucgaagaaaauguucucuuuuuaaau

SEQ ID NO: 667238 - RNA, 64 nt, Homo Sapiens
cccguuccugcccagauaauguauaugcauaugcaaacucgaccagugcucugucugaggaugu

SEQ ID NO: 667239 - RNA, 64 nt, Homo Sapiens
uacagcuuuuugcaguaugggaugcauguugauuaaacucgagaguguauuuccccuuaauuag

SEQ ID NO: 667240 - RNA, 64 nt, Homo Sapiens
ccgagaucaugccacugcacugggcaacagagcaaaacucgaucucaaaaaaaaaaaaaaaaaa

SEQ ID NO: 667241 - RNA, 64 nt, Homo Sapiens
caaucuggauaauuuguacugcuaaaguuuuaauaaacucgacaugagaaaaacacuuuggugu

SEQ ID NO: 667242 - RNA, 64 nt, Homo Sapiens
ugugccacaauagcaguucuggaaugaagcuaggaaacucgagugugcuuuuuguuuaaugagc

SEQ ID NO: 667243 - RNA, 64 nt, Homo Sapiens
agacagaugacggcugcucgaagaacaaugucagaaacucgaugaauguguugauuugagaaau

SEQ ID NO: 667244 - RNA, 64 nt, Homo Sapiens
cauggagucucacuggccaagaaaauugccuuuaaaacucgaaaauaaggccagguguggugac

SEQ ID NO: 667245 - RNA, 63 nt, Homo Sapiens
aaaugagguucuucucuguucacauacuaucuaaaacucgacccaacacaaccagcagaguga

SEQ ID NO: 667246 - RNA, 64 nt, Homo Sapiens
cguucuucggcaucuucuuuagcaccugagcaugaaacucgacgggccuggggcgagcacugug

SEQ ID NO: 667247 - RNA, 64 nt, Homo Sapiens
ucuuucaccccuuaccccaaagagaaagaguuugaaacucgagaccauaaagauauucuuuagu

SEQ ID NO: 667248 - RNA, 64 nt, Homo Sapiens
uggugugcccagacccacagugaggagaaucccuaaacucgagguccaaaguuugggcuagaag

SEQ ID NO: 667249 - RNA, 64 nt, Homo Sapiens
cuggcagugcgugucccguggggugugcauuuuaaaacucgauucauagacacagguaccaugu

SEQ ID NO: 667250 - RNA, 64 nt, Homo Sapiens
ggaccaagacagaacucaagaaagccacuggggaaaacucgagaagaaagggaguauacuagua

SEQ ID NO: 667251 - RNA, 64 nt, Homo Sapiens
ggaugggggaaaaauugacaucuuuauuuuugcuaaacucgaucuaaaguuuagcauuuccauc

SEQ ID NO: 667252 - RNA, 64 nt, Homo Sapiens
uacaaagaaagaaugaacuaguucuaagauaaaaaaacucgagcaacaccgacagcuguaaaau

SEQ ID NO: 667253 - RNA, 64 nt, Homo Sapiens
uuauuccaaaaguaacuucauugguauggcaugaaaacucgacucuuugcugucuugcucaagc

SEQ ID NO: 667254 - RNA, 64 nt, Homo Sapiens
aaaacaaguguauaacuaaaaguccuuuugaauuaaacucgacuuuuuacaccauacuguuaag

SEQ ID NO: 667255 - RNA, 64 nt, Homo Sapiens
aacaaugauaaauuucucaguuuggguaucuuaaaaacucgaaacauaccucucagaaaaagug

SEQ ID NO: 667256 - RNA, 64 nt, Homo Sapiens
caagcaaaaggcuucacggaaaagggagaaauuuaaacucgaacaacuauagucauacucacac

SEQ ID NO: 667257 - RNA, 64 nt, Homo Sapiens
aaaaucuuuaaugaacuggagaacacuaagauuuaaacucgaaaauucguuguucaaguaaaga

SEQ ID NO: 667258 - RNA, 64 nt, Homo Sapiens
acagcccugcccugugguuauaggagccaagggcaaacucgaaacaggagucaagaugugcuca

SEQ ID NO: 667259 - RNA, 64 nt, Homo Sapiens
gacuuaggcagaacaugccucgaaaaacaaaaaaaaacucgaauggcaccaacagaauuaaaaa

SEQ ID NO: 667260 - RNA, 64 nt, Homo Sapiens
uuuagguuuaugaguauauaagaaagaauuuaauaaacucgaagguuuauagagugauuuuacu

SEQ ID NO: 667261 - RNA, 64 nt, Homo Sapiens
ucaacaauuaauuguuucauaauggcucaucaauaaacucgauagaguauggcaucugaaggua

SEQ ID NO: 667262 - RNA, 64 nt, Homo Sapiens
uuucuuaaaucccaauauaacacgucgccucuugaaacucgagagccucucgcagcccggggag

SEQ ID NO: 667263 - RNA, 64 nt, Homo Sapiens
uaguagacaagaauuugauguaacgcaaauggaaaaacucgacaccacauuucaggcuuuaccc

SEQ ID NO: 667264 - RNA, 64 nt, Homo Sapiens
aacuuuggccuuuguguauuaaauuguccaagugaaacucgacuccaaaacccauguauuaaau

SEQ ID NO: 667265 - RNA, 64 nt, Homo Sapiens
cuugccucccugaggaccacacuggcugcaacccaaacucgacucuucuacuuacacuugcuca

SEQ ID NO: 667266 - RNA, 64 nt, Homo Sapiens
agauuugacaaggguagccacaaguauuuugaaaaaacucgaacgcugggugcguuaaaaagcc

SEQ ID NO: 667267 - RNA, 64 nt, Homo Sapiens
gucuguuggagcaagaggaacaugcuuguuuugaaaacucgagaugaugagggugguacaugca

SEQ ID NO: 667268 - RNA, 64 nt, Homo Sapiens
cguuucacugucagccugccguguugagaauccuaaacucgaacugcccacagggauagggagg

SEQ ID NO: 667269 - RNA, 64 nt, Homo Sapiens
uaguuaucuagaucuggguaauuucauguuuauuaaacucgaacuuuggcuaguuaaacucaua

SEQ ID NO: 667270 - RNA, 64 nt, Homo Sapiens
ccuccccuccucccgaccuagccaguugugggaaaaacucgaguugcucgugauaugugcucaa

SEQ ID NO: 667271 - RNA, 64 nt, Homo Sapiens
uuuguguaauauguucugugugagccucugcauuaaacucgauuucuugggcaauuauggaaau

SEQ ID NO: 667272 - RNA, 64 nt, Homo Sapiens
gugacugauuacuggcugugucuugggugggcagaaacucgaacuugcuauguaauuugugucu

SEQ ID NO: 667273 - RNA, 64 nt, Homo Sapiens
auguuuuagacaaauacucauguguaugggcaaaaaacucgaggacuguauuugugacuaauug

SEQ ID NO: 667274 - RNA, 64 nt, Homo Sapiens
aauguguuguuucugaugugucaauaguuaauaaaaacucgagauguaaaucauauuguaguau

SEQ ID NO: 667275 - RNA, 64 nt, Homo Sapiens; identical to SEQ ID NO: 667273

SEQ ID NO: 667276 - RNA, 64 nt, Homo Sapiens
augauuacagcgaagacuuuccugauaaguucucaaacucgaugugugacuguuuggcacuuga

SEQ ID NO: 667277 - RNA, 64 nt, Homo Sapiens
agauucaaucacuguauagauuccuauaaauacgaaacucgagaaaaucaugcaagcgcucuaa

SEQ ID NO: 667278 - RNA, 64 nt, Homo Sapiens
cuuuaauuguaaugacuuugauuggaaaugccaaaaacucgaguaccucagugcccugacuaca

SEQ ID NO: 667279 - RNA, 64 nt, Homo Sapiens
auaaaaagcgguugguguaagugaaagguuucugaaacucgauauuuuuuuuuuuuaccaucuu

SEQ ID NO: 667280 - RNA, 64 nt, Homo Sapiens
aaaggaugggaccaaccccaggguaggggcaaggaaacucgaaucaacgucagggucggggcua

SEQ ID NO: 667281 - RNA, 64 nt, Homo Sapiens
uauugccaaaacccuagauucguagaagugcaucaaacucgauuagacuggauagaaaaucuag

SEQ ID NO: 667282 - RNA, 64 nt, Homo Sapiens
ugauggauugauuugacaugaaccaaacacagccaaacucgauacccacaagcugucagcugaa

SEQ ID NO: 667283 - RNA, 64 nt, Homo Sapiens
ccaguucaaggacccggaugugaauggcaugcugaaacucgaagucauggccaccuccagggac

SEQ ID NO: 667284 - RNA, 64 nt, Homo Sapiens
gcugcgucuaccaaguacgagugaaggguggacaaaacucgacuccagcaacgugggcagcaca

SEQ ID NO: 667285 - RNA, 62 nt, Homo Sapiens
cgcucggucaccuccaauccuaauaaagaugugaaaacucgaaauaacaacaacaacaacaa

SEQ ID NO: 667286 - RNA, 64 nt, Homo Sapiens
guuugguuagcaaccaagccuuaaaccuuuggcaaaacucgaaugccuucuagucuuuugauaa

SEQ ID NO: 667287 - RNA, 64 nt, Homo Sapiens
augacaggaaaauuccaaacacauguauugguuuaaacucgauaagaccaugaaaccagacaac

SEQ ID NO: 667288 - RNA, 64 nt, Homo Sapiens
gggauggcagucagacucaaacccgugacacuccaaacucgauuaugcuccagggcccacuuuc

SEQ ID NO: 667289 - RNA, 64 nt, Homo Sapiens
aggucucuggaagccauuugacgcccaccccaugaaacucgagcaauuagcugggugucccugc

SEQ ID NO: 667290 - RNA, 64 nt, Homo Sapiens
ugaccacaaauguccacagugucuuccucugaggaaacucgaauccugaaauggaaauucuuug

SEQ ID NO: 667291 - RNA, 64 nt, Homo Sapiens
auaaugcaguggcaaaagguucugaaagccuuuuaaacucgaaccagugggggaaagauggauc

SEQ ID NO: 667292 - RNA, 64 nt, Homo Sapiens
ccccaauucacucaaccaaggaaaggaagauuaaaaacucgacacucauugggucagcaccugu

SEQ ID NO: 667293 - RNA, 64 nt, Homo Sapiens
acauucaccacgaugauuuuaaaggugucugcggaaacucgaggcacgugaccaugccgaccac

SEQ ID NO: 667294 - RNA, 64 nt, Homo Sapiens
aggagagaaccggcgcugggcaacacgggccugcaaacucgacaggacccugcccgaggggccc

SEQ ID NO: 667295 - RNA, 64 nt, Homo Sapiens
caucgauaccccauuuagcuccagaaagcaaagaaaacucgaguaacacuuguuugaaagagau

SEQ ID NO: 667296 - RNA, 64 nt, Homo Sapiens
gaugauuucaaagcccugugcuuuacaauguauuaaacucgaucacgccaauguaguuuuccuu

SEQ ID NO: 667297 - RNA, 64 nt, Homo Sapiens
cccaccuuugggcuuucccugugaaaggucccagacuucgaaugaggucagcccugaggccagg

SEQ ID NO: 667298 - RNA, 64 nt, Homo Sapiens
aggaaagccagauuccagccuccugaaccaggcuacuucgaaccggauccaggcuugcuagggg

SEQ ID NO: 667299 - RNA, 64 nt, Homo Sapiens
acugcugaauacucuggauuuuuagucuucugagacggaggaaaugcgcauugucuacuggagc

SEQ ID NO: 667300 - RNA, 64 nt, Homo Sapiens
ugaggcucucccuuucucugagcggauguuggccacggaggagcgacuaagcgggugaugcccc

SEQ ID NO: 667301 - RNA, 62 nt, Homo Sapiens
acuccugagaaugggcuccuguuagaugggcacgggcggauuaauuuuagcaaaauguucug

SEQ ID NO: 667302 - RNA, 62 nt, Homo Sapiens
gccuguaaucccaacacuuugggaggccgaggcgggcggaucacgaggucagaucaagaaca

SEQ ID NO: 667303 - RNA, 62 nt, Homo Sapiens
acgaggucaggaguucgagagggaggccgaggcgggcggaucaccuguaaucccagcacuuu

SEQ ID NO: 667304 - RNA, 62 nt, Homo Sapiens
acaagguccagaguucaagagggaggcugaggcgggcggaucgccuguaaucucagcacuuu

SEQ ID NO: 667305 - RNA, 62 nt, Homo Sapiens
aaagugcaucccccagagcucacagggggugucgggcggaggauaaaggaugagccuggggu

SEQ ID NO: 667306 - RNA, 62 nt, Homo Sapiens
gccuguaaucccagcacuuugggaggcugaggcgggcggaucaccugaggucgggaguucga

SEQ ID NO: 667307 - RNA, 62 nt, Homo Sapiens
gccuguaaucccagcacuuugagagaccgaggcgggcggaucacgaggucaggagaucgaga

SEQ ID NO: 667308 - RNA, 62 nt, Homo Sapiens
accugaggugaggaguucaagggaggccaagacgggcggaucgccuguaauccuagcacuuu

SEQ ID NO: 667309 - RNA, 62 nt, Homo Sapiens
gccuguaaucccagcacuuugggaggccgaggcgggcggaucacgaggucaggagauugaga

SEQ ID NO: 667310 - RNA, 62 nt, Homo Sapiens
gacuauguguaaugcucuaagaccucucagcacgggcggaagaaacucccggagagcucacc

SEQ ID NO: 667311 - RNA, 62 nt, Homo Sapiens
ggcuguaaucccaacacuuugggagucugaggcgggcggaucaugaggucaggagauuaaga

SEQ ID NO: 667312 - RNA, 62 nt, Homo Sapiens
gccugugaucccagcacuuugggaggccaagacgggcggaucaugaggucaagagaucaaga

SEQ ID NO: 667313 - RNA, 62 nt, Homo Sapiens
gccuguaaucccagcacuuugggaggccgaggcgggcggaucacgaggucaggagaucgaga

SEQ ID NO: 667314 - RNA, 62 nt, Homo Sapiens
accugcaaucccagcacuuugggaggccgaggcgggcggaucaccugaggucagcaguucaa

SEQ ID NO: 667315 - RNA, 62 nt, Homo Sapiens
gccuauaaucccagcacuuugggaggccgaggcgggcggaucacgaggucaggagauugaga

SEQ ID NO: 667316 - RNA, 62 nt, Homo Sapiens
acaaggucaggagaucgagagggaggccgaggcgggcggaucgccuguaaucccagcacuuu

SEQ ID NO: 667317 - RNA, 62 nt, Homo Sapiens
accugagucaggaguucgaggagaggcugaggcgggcggauccgccuguaauccaacacuuu

SEQ ID NO: 667318 - RNA, 62 nt, Homo Sapiens
ccgggcauccacguagggggcaggggcaggggcgggcggagggaggggaggggugaaaucca

SEQ ID NO: 667319 - RNA, 62 nt, Homo Sapiens
aguugaggucgggaguuugagggaggccgaggcgggcggauggccuguaaucccagcacuuu

SEQ ID NO: 667320 - RNA, 62 nt, Homo Sapiens
accugagguugggaguucgagggaggcugaggcgggcggaucgccuguaaucccagcacuuu

SEQ ID NO: 667321 - RNA, 62 nt, Homo Sapiens
ugagucgggcagccgcucucgcugauccuggucgggcggacccucaagaggggaggagcggg

SEQ ID NO: 667322 - RNA, 62 nt, Homo Sapiens
accugaggucaggaguucaagggaggccgaggcgggcggauggccuguaaucccagcacuuu

SEQ ID NO: 667323 - RNA, 62 nt, Homo Sapiens
gccuguaaucccagcacuuugggaggccaaggcgggcggaucaugaggucaggagaucgaga

SEQ ID NO: 667324 - RNA, 62 nt, Homo Sapiens
gccuguaaucccagcacuuugggaggccgaggcgggcggaucaugaggucaggaguucgaga

SEQ ID NO: 667325 - RNA, 62 nt, Homo Sapiens
augaggucaggagaucgagagggaggccgaggcgggcggaucgccuguaaucccagcacuuu

SEQ ID NO: 667326 - RNA, 62 nt, Homo Sapiens
cgcacacacucgugucauccccccucgagcuccgggcggacugcccugguccagcugggugc

SEQ ID NO: 667327 - RNA, 62 nt, Homo Sapiens
acgaggucaggagaucgagagggaggcccaggcgggcggaucgccuguaaucccaacacuuu

SEQ ID NO: 667328 - RNA, 62 nt, Homo Sapiens
acgaggucaggagaucgagagggaggccgaggcgggcggaucgccuguaaucccagcacuuu

SEQ ID NO: 667329 - RNA, 62 nt, Homo Sapiens
gccuguaaucccagcacguugggaggccaagucgggcggaucacaaggucaggagaucaagg

SEQ ID NO: 667330 - RNA, 62 nt, Homo Sapiens
aauacuucuggcagcacuuugggaggccaaggcgggcggaucacgaggucaggagaucgaga

SEQ ID NO: 667331 - RNA, 62 nt, Homo Sapiens
cuccggugcuguaaaacgcaggcgcugggccgcgggcggagcugaggacaggccuuggcugg

SEQ ID NO: 667332 - RNA, 62 nt, Homo Sapiens
acgaggucaggagaucgagagggaggccgaggcgggcggaucgccgguaaucccagcacuuu

SEQ ID NO: 667333 - RNA, 62 nt, Homo Sapiens
accuguaaucccagcacuuuggggagcugaggcgggcggaucacgaggucaagagaucgaga

SEQ ID NO: 667334 - RNA, 62 nt, Homo Sapiens
accaggucaggagaucaagagggaggccgaggcgggcggaucuccuguaaucccagcacuuu

SEQ ID NO: 667335 - RNA, 62 nt, Homo Sapiens
acuugagaccaggaguucgagggaggccgaggcgggcggaucgccuguaaucccagcacuuu

SEQ ID NO: 667336 - RNA, 62 nt, Homo Sapiens
gaggagagcagguuucagauggggagcagggacgggcggagguuguuucuguuuucuugggu

SEQ ID NO: 667337 - RNA, 62 nt, Homo Sapiens
acaaagucaggacgagaccagggaggccgaggcgggcggaucgccuguaaucccagcacuuu

SEQ ID NO: 667338 - RNA, 62 nt, Homo Sapiens
ccccaaagugcagauuccggagcagacacauccgggcggagagacucagcagacaagugcug

SEQ ID NO: 667339 - RNA, 62 nt, Homo Sapiens
accuguaaucccagcacuuugggagaccaaggcgggcggaucacuuaaagucaggaguccaa

SEQ ID NO: 667340 - RNA, 62 nt, Homo Sapiens
accuguggucaggaguuugagggaggccgagccgggcggaucgccuguaaucccagcacuuu

SEQ ID NO: 667341 - RNA, 62 nt, Homo Sapiens
gcuggacagacgcacccacugcacgaccacaccgggcggacccccauccccacgcgggccgg

SEQ ID NO: 667342 - RNA, 62 nt, Homo Sapiens
acuugaggucaggagcucaagggaggccaaggcgggcggaucgccuguaaucccagcauuuu

SEQ ID NO: 667343 - RNA, 62 nt, Homo Sapiens
gccuguaaucccaacacuuuaggaguccaaggcgggcggaucacuugaggucaggaguucaa

SEQ ID NO: 667344 - RNA, 62 nt, Homo Sapiens
ggauccagccacuucccccugaaggccggcagcgggcggaggcgccacggccuggcuggugg

SEQ ID NO: 667345 - RNA, 62 nt, Homo Sapiens
accuguaaucccagcacuuugggaggccgaggcgggcggaucaccugaagucaggaguuuga

SEQ ID NO: 667346 - RNA, 62 nt, Homo Sapiens
gccuguaaucccagcacuuugggaggccgaggcgggcggaucacaaggucaggagaucgaga

SEQ ID NO: 667347 - RNA, 62 nt, Homo Sapiens
acgaggucaggaguucgagagggaggccgaggcgggcggaucgcuuguaaucccagcacuuu

SEQ ID NO: 667348 - RNA, 62 nt, Homo Sapiens
gccuguaaucccagcacuuugggaggccgaggcgggcggaucaccugagguggggaguauga

SEQ ID NO: 667349 - RNA, 62 nt, Homo Sapiens
gccuauaaucccagcacguugggaggcugaggcgggcggaucgguugagcucaggcguucgg

SEQ ID NO: 667350 - RNA, 62 nt, Homo Sapiens
gccuguaaucccagcacuuugggaggccgaggcgggcggaucaccugaggccaggaguugga

SEQ ID NO: 667351 - RNA, 62 nt, Homo Sapiens
gagcgagggcccccggacugguccugggagagcgggcggagcgagcgggcauccagagagga

SEQ ID NO: 667352 - RNA, 62 nt, Homo Sapiens
augagguuaggagagcgagagggaggccgaggcgggcggaucgccuguaaucccagcacuuu

SEQ ID NO: 667353 - RNA, 62 nt, Homo Sapiens
augaagucaagaguucgagagggaggccuaggcgggcggaucacugucaaucccagcacuuu

SEQ ID NO: 667354 - RNA, 62 nt, Homo Sapiens
uucuguuucucccagccaaucugcgcugcggucgggcggagccggccgggccuggcaccaau

SEQ ID NO: 667355 - RNA, 62 nt, Homo Sapiens
accugaggucaggaguucgagggaggccgagacgggcggaucgccuguaaucccagcacuuu

SEQ ID NO: 667356 - RNA, 62 nt, Homo Sapiens
gccuguaaucccagcacuuugggaggccaaggcgggcggaucaccugaggucgggaguuuga

SEQ ID NO: 667357 - RNA, 62 nt, Homo Sapiens
gucacucagccgucgugagcgcaggcgcggggcgggcggagcgggaccccuggggcucuccc

SEQ ID NO: 667358 - RNA, 62 nt, Homo Sapiens
gccuguaaucccagcacuuugggaggcugaggcgggcggaucacgaggucaggagaucgaga

SEQ ID NO: 667359 - RNA, 62 nt, Homo Sapiens
accuguaaucccagcacuuugggaggccgaggcgggcggaucacaaggucaggaguucgaga

SEQ ID NO: 667360 - RNA, 62 nt, Homo Sapiens
accuguaaucccagcacuuugggaggccaaggcgggcggaucagcugaggucaggaguugga

SEQ ID NO: 667361 - RNA, 62 nt, Homo Sapiens
gccuguaaucccagcacuuugggaggccgaggcgggcggaucagaccauccuggcuaacacg

SEQ ID NO: 667362 - RNA, 62 nt, Homo Sapiens
ugugggacugagucagcgguggcgaggagaggcgggcggauuuggggagggcccugaggacc

SEQ ID NO: 667363 - RNA, 51 nt, Homo Sapiens; identical to SEQ ID NO: 497424

SEQ ID NO: 667364 - RNA, 62 nt, Homo Sapiens
cugcugggacccuccugggcccucccaaggaucgggcggaaggaccugcuccucacagagcc

SEQ ID NO: 667365 - RNA, 62 nt, Homo Sapiens
cuguauauauguauauacucccagcgggcaggcgggcggagcuuuauuggagccccaucucc

SEQ ID NO: 667366 - RNA, 62 nt, Homo Sapiens
gcagugcacgcggcuuguugacuucgcagccccgggcggagccuucccgggcgggcguggga

SEQ ID NO: 667367 - RNA, 62 nt, Homo Sapiens
gcccugaggucgcgcgcagcgcgugcacagcgcgggcggaggcggcuccagguccggagggg

SEQ ID NO: 667368 - RNA, 62 nt, Homo Sapiens
gccuauaaucccagcacuuugggaggccgaggcgggcggaucacuaggucaggaaauggaga

SEQ ID NO: 667369 - RNA, 62 nt, Homo Sapiens
gccuguaaucccagcacuuugggaggccaagacgggcggaucuuuugaggucgggaguugga

SEQ ID NO: 667370 - RNA, 62 nt, Homo Sapiens
gccuguaaucccaacacuuugggagcccgaggcgggcggaucacaaggucaggaguucgaga

SEQ ID NO: 667371 - RNA, 62 nt, Homo Sapiens
ugguguaauccuaacacuuugggaggccaaggcgggcggauugccugagcucaggaguucaa

SEQ ID NO: 667372 - RNA, 62 nt, Homo Sapiens
accugagguugggaguucaagggaggcugaggcgggcggaucgucuguaaucccagcacuuu

SEQ ID NO: 667373 - RNA, 62 nt, Homo Sapiens
accugaggucagguguucgagggaggcugaggcgggcggaacaccuguaaucccagcacuuu

SEQ ID NO: 667374 - RNA, 62 nt, Homo Sapiens
uccugaggccuggacccccacucugccccucccgggcggaccacaccacuggccccggaugc

SEQ ID NO: 667375 - RNA, 62 nt, Homo Sapiens
ccgcguggccgaagcuggaaccgagcucggggcgggcggagccggcgggggcgccccgugac

SEQ ID NO: 667376 - RNA, 62 nt, Homo Sapiens
acuggaggucaggaguuuaagagaggccaaggcgggcggauccccugucaucccagcacuuu

SEQ ID NO: 667377 - RNA, 62 nt, Homo Sapiens; identical to SEQ ID NO: 667328

SEQ ID NO: 667378 - RNA, 62 nt, Homo Sapiens
gggacgcgggcugugccuuaugccuuccgggccgggcggaaggcgccggccuccgucaugaa

SEQ ID NO: 667379 - RNA, 62 nt, Homo Sapiens
acuugaggucaggaguuccagggaggccgaggcgggcggaucgccuguaauccuagcaccuu

SEQ ID NO: 667380 - RNA, 62 nt, Homo Sapiens
acgaggucaggagacugagagggaggccgagacgggcggaucgccuguaaucccagcacuau

SEQ ID NO: 667381 - RNA, 62 nt, Homo Sapiens
ucccuaacagggcggcuucccagggcugcaggcgggcggagguuccaggagaugggacuuca

SEQ ID NO: 667382 - RNA, 62 nt, Homo Sapiens
gccuguaaucccagcacuuugggaggccgaagcgggcggaucaccugaggucgggaguucga

SEQ ID NO: 667383 - RNA, 62 nt, Homo Sapiens
aauaggucaggaaauccagagggaggccgaggcgggcggaucgccuguaaucccagcacuuu

SEQ ID NO: 667384 - RNA, 62 nt, Homo Sapiens
cagaccguucuccuguaaguucauuacaaacacgggcggaaggcacucaggcuuucguugga

SEQ ID NO: 667385 - RNA, 62 nt, Homo Sapiens
augaggucaggagaucgcgagggagacugaggcgggcggaucgccugcaaucccagcacuuu

SEQ ID NO: 667386 - RNA, 61 nt, Homo Sapiens
gcauguaaucccagcacuuugggaggccaaggcgggcggaucacgaggucaggaguucgag

SEQ ID NO: 667387 - RNA, 62 nt, Homo Sapiens
gccuguaauccgagcacuuugggaggccaaggcgggcggaucacgaggucaggagaucgaga

SEQ ID NO: 667388 - RNA, 62 nt, Homo Sapiens
gccuguaaucccagcacuuugggaggccgaggcgggcggaucacgaggucaggaguucgaga

SEQ ID NO: 667389 - RNA, 62 nt, Homo Sapiens
gccuguaaucccagcaauuugggaguccgaggcgggcggaucacucgaggucaggaguucca

SEQ ID NO: 667390 - RNA, 62 nt, Homo Sapiens
ccuucagugcccugccuguacucgagcggcuccgggcggagaacaagucggcugugaguuuc

SEQ ID NO: 667391 - RNA, 62 nt, Homo Sapiens
gaggcugaggcucacacccccacgcgcgcugccgggcggacaggaggccagaccaagggagg

SEQ ID NO: 667392 - RNA, 64 nt, Homo Sapiens
gugcuggcugacucaacugugcgucccagguucagggucuuacagagcuccacccccugggguc

SEQ ID NO: 667393 - RNA, 64 nt, Homo Sapiens
ccagguucagggucuuacagagcuccacccccuggggucuuaccucacugggaauguguuuuga

SEQ ID NO: 667394 - RNA, 64 nt, Homo Sapiens
gaggggcggcagguggugagagcgggcagcggaagcucgagaugccgucggccacaagauccuc

SEQ ID NO: 667395 - RNA, 64 nt, Homo Sapiens
cauucaucauuacuguggacuuggcagcgacguggcucgagaaguagaaaugccugugaagacc

SEQ ID NO: 667396 - RNA, 64 nt, Homo Sapiens
uuucccgggcacaggccugcgccgacccgacccugcucgagagcccgcgcuagagucggggagg

SEQ ID NO: 667397 - RNA, 64 nt, Homo Sapiens
cuggcuuuagacggggagaaacaucuggaaggaugcucgagagaacaaauggagguggugaaaa

SEQ ID NO: 667398 - RNA, 64 nt, Homo Sapiens
uucauggguuagacuugcugagaaugguuuuggagcucgagauccaaucaaaauggugggcucu

SEQ ID NO: 667399 - RNA, 64 nt, Homo Sapiens
accugggacgugcgagggaacaccguccugugcugcucgagagggggugaguggguuugcucca

SEQ ID NO: 667400 - RNA, 64 nt, Homo Sapiens
guggagaguucucucaggucaggucugcagcagagcucgagacagggaucugaaugcacuuggu

SEQ ID NO: 667401 - RNA, 64 nt, Homo Sapiens
cagaagggaagauuuauuacccaacuggaagacagcucgagaucaaaaaccauugucuuaccuc

SEQ ID NO: 667402 - RNA, 64 nt, Homo Sapiens
uccugccccacccagugggucaccccaagugaaggcucgagacuugaccgaucucccuccuccu

SEQ ID NO: 667403 - RNA, 64 nt, Homo Sapiens
uucacaauacgguggaauuucaaaagcuggaagagcucgagaucaugccucaggcaaaggcgug

SEQ ID NO: 667404 - RNA, 64 nt, Homo Sapiens
uuagacaugcuuuagaauuauuuuauuugaaguugcucgagaaguguugguagauuacaacucu

SEQ ID NO: 667405 - RNA, 64 nt, Homo Sapiens
ugaguucugcaaaaggugguuuuuaauuuaaacugcucgagauauuaacuuaagggaggcuaau

SEQ ID NO: 667406 - RNA, 64 nt, Homo Sapiens
gcugguccuuauuuauuuaauaacucugggaggggcucgagaggccuugagaggagaaaugcaa

SEQ ID NO: 667407 - RNA, 64 nt, Homo Sapiens
uugcuuggugacaugugccaugggaccacugcaagcucgagacccacaacacugccccagaggg

SEQ ID NO: 667408 - RNA, 64 nt, Homo Sapiens
uucccuggccauguugcaaacagcgcaauuccaagcucgagagcuucagccucaggaaagaacu

SEQ ID NO: 667409 - RNA, 64 nt, Homo Sapiens
uuuaaagauuuuauuuuuacagaagagacguggggcucgagagaccauaggccgaugcucugaa

SEQ ID NO: 667410 - RNA, 64 nt, Homo Sapiens
cugaggcacgagaaucaguucuguagucccagcugcucgagaggccuggugugguggcacacac

SEQ ID NO: 667411 - RNA, 64 nt, Homo Sapiens
agcuacaacuccacaucaacuccacaugcgcccagcucgagacugaugaguggaaucagcuucc

SEQ ID NO: 667412 - RNA, 64 nt, Homo Sapiens
uuugggcugagcuguuagaggggcuucuccagaggcucgagagcaggccauuucccaagaagau

SEQ ID NO: 667413 - RNA, 64 nt, Homo Sapiens
aucuuggccccggccaccuuuggccucuaaacuggcucgagagccagauggccaggaagggccc

SEQ ID NO: 667414 - RNA, 64 nt, Homo Sapiens
gaauuuuuuccaaggaaaugcaaccuggucgauagcucgagaaaggaaucccuuugcuuaggcc

SEQ ID NO: 667415 - RNA, 64 nt, Homo Sapiens
cuuuaugccggaugugcuuuucuccaauaucagugcucgagacacagugaagcaaauuaaaaaa

SEQ ID NO: 667416 - RNA, 64 nt, Homo Sapiens
acacuuuuaaaccuaaagagccuuauuauuauuagcucgagaaauaccacaugccagucuuccc

SEQ ID NO: 667417 - RNA, 64 nt, Homo Sapiens
gcaccccagcgcagccuggcgccgcgggacugaagcucgagaagggccugaccuaaaggucagg

SEQ ID NO: 667418 - RNA, 64 nt, Homo Sapiens
gacuuaguucagugcagagagauaggugaggccagcucgagaucuuauaccacucuguauugga

SEQ ID NO: 667419 - RNA, 64 nt, Homo Sapiens
caauacccugugcccuccacccuacuggcucucugcucgagagcggaaucgaacaccagucaug

SEQ ID NO: 667420 - RNA, 64 nt, Homo Sapiens
cagacggccagacaggcagaaagaaguugggggagcucgagagcuuccugacuuacuaauacua

SEQ ID NO: 667421 - RNA, 64 nt, Homo Sapiens
ggccaagaggccgcagaacaaucugggggacgcugcucgagagacaaagcaaggucuugcuucu

SEQ ID NO: 667422 - RNA, 64 nt, Homo Sapiens
agccuggccaacacggugaaacuugaggucaggagcucgagaccgaggcugaggcaggcggauc

SEQ ID NO: 667423 - RNA, 64 nt, Homo Sapiens
gugcaggggucuccugccugugccauccacuggggcucgagacaauuucccacucaccugugag

SEQ ID NO: 667424 - RNA, 64 nt, Homo Sapiens
guguaagccacuagucuguggcauuguuauagcagcucgagaagacuaaggcagaugggcuucc

SEQ ID NO: 667425 - RNA, 64 nt, Homo Sapiens
uaggugaaacccccuacccuccccaacguuaaaugcucgagaggaaucuuccacaaggcagggc

SEQ ID NO: 667426 - RNA, 64 nt, Homo Sapiens
gagaggaacucagaaggcaaaagcugaacggauugcucgagaaaucugaaggaacgucguaagg

SEQ ID NO: 667427 - RNA, 64 nt, Homo Sapiens
gaggccaagguggguggaucaccugaggucaggagcucgagaccagccuggccaacauggugaa

SEQ ID NO: 667428 - RNA, 64 nt, Homo Sapiens
gaggcugagguggguggaucacuugaggucaggagcucgagaccagcuuggccaacauggugag

SEQ ID NO: 667429 - RNA, 64 nt, Homo Sapiens
uguggacaccccagcgugcgugccgccggcacaugcucgagacgcacaugcacaccaacaugca

SEQ ID NO: 667430 - RNA, 64 nt, Homo Sapiens
acagaugccaugguaugggccacaggacacacuugcucgagaaccaaagugcauuugggugaca

SEQ ID NO: 667431 - RNA, 64 nt, Homo Sapiens
gucugaugugaaaauucaaucacgacguuaaccggcucgagagagcgccggccuagaggcucau

SEQ ID NO: 667432 - RNA, 64 nt, Homo Sapiens
gauucagagauggaacacacuaagaaagagugcagcucgagagauuaaacuuaugaaaauguau

SEQ ID NO: 667433 - RNA, 64 nt, Homo Sapiens; identical to SEQ ID NO: 667432

SEQ ID NO: 667434 - RNA, 64 nt, Homo Sapiens; identical to SEQ ID NO: 667432

SEQ ID NO: 667435 - RNA, 64 nt, Homo Sapiens
uccgugggggaggccgugggcccccaccaccucugcucgagagggaaguugaaacccuagggca

SEQ ID NO: 667436 - RNA, 64 nt, Homo Sapiens
acccuggccaacauggugaaucgcgagaucaggagcucgagaccgggaggccaaggcgggugga

SEQ ID NO: 667437 - RNA, 64 nt, Homo Sapiens
aaagcacugauuacccaaugcaccucccuccccagcucgagaucauucuucacucaggacacaa

SEQ ID NO: 667438 - RNA, 50 nt, Homo Sapiens
agcacgugcgccuccacuaagcucgagacccggccugugcugcccugccc

SEQ ID NO: 667439 - RNA, 64 nt, Homo Sapiens
uuugaggccaugaucucugcggcuucagccaggugcucgagagcucacauggcgcccagcacug

SEQ ID NO: 667440 - RNA, 64 nt, Homo Sapiens
caagugcugcuguaguuagccaaccucgugcacugcucgagacauuguuuuauaauuccuauug

SEQ ID NO: 667441 - RNA, 64 nt, Homo Sapiens
ucuucaccccucgcagauggagcggcagcgccucgcucgagagaagcagaugagggaggaggcu

SEQ ID NO: 667442 - RNA, 64 nt, Homo Sapiens
gcuuuggggagaugggcgauaaguguugagguaggcucgagaacugcuccccaaaucagugaga

SEQ ID NO: 667443 - RNA, 64 nt, Homo Sapiens; identical to SEQ ID NO: 461032

SEQ ID NO: 667444 - RNA, 64 nt, Homo Sapiens; identical to SEQ ID NO: 461033

SEQ ID NO: 667445 - RNA, 64 nt, Homo Sapiens; identical to SEQ ID NO: 461034

SEQ ID NO: 667446 - RNA, 64 nt, Homo Sapiens; identical to SEQ ID NO: 461035

SEQ ID NO: 667447 - RNA, 64 nt, Homo Sapiens; identical to SEQ ID NO: 461036

SEQ ID NO: 667448 - RNA, 64 nt, Homo Sapiens; identical to SEQ ID NO: 461037

SEQ ID NO: 667449 - RNA, 64 nt, Homo Sapiens; identical to SEQ ID NO: 461038

SEQ ID NO: 667450 - RNA, 64 nt, Homo Sapiens; identical to SEQ ID NO: 461039

SEQ ID NO: 667451 - RNA, 64 nt, Homo Sapiens; identical to SEQ ID NO: 461040

SEQ ID NO: 667452 - RNA, 64 nt, Homo Sapiens; identical to SEQ ID NO: 461041

SEQ ID NO: 667453 - RNA, 64 nt, Homo Sapiens; identical to SEQ ID NO: 461042

SEQ ID NO: 667454 - RNA, 64 nt, Homo Sapiens; identical to SEQ ID NO: 461043

SEQ ID NO: 667455 - RNA, 64 nt, Homo Sapiens; identical to SEQ ID NO: 461044

SEQ ID NO: 667456 - RNA, 64 nt, Homo Sapiens; identical to SEQ ID NO: 461045

SEQ ID NO: 667457 - RNA, 64 nt, Homo Sapiens; identical to SEQ ID NO: 461046

SEQ ID NO: 667458 - RNA, 64 nt, Homo Sapiens; identical to SEQ ID NO: 461047

SEQ ID NO: 667459 - RNA, 64 nt, Homo Sapiens; identical to SEQ ID NO: 461048

SEQ ID NO: 667460 - RNA, 64 nt, Homo Sapiens; identical to SEQ ID NO: 461049

SEQ ID NO: 667461 - RNA, 64 nt, Homo Sapiens; identical to SEQ ID NO: 461050

SEQ ID NO: 667462 - RNA, 64 nt, Homo Sapiens; identical to SEQ ID NO: 461051

SEQ ID NO: 667463 - RNA, 64 nt, Homo Sapiens; identical to SEQ ID NO: 461052

SEQ ID NO: 667464 - RNA, 64 nt, Homo Sapiens; identical to SEQ ID NO: 461053

SEQ ID NO: 667465 - RNA, 64 nt, Homo Sapiens; identical to SEQ ID NO: 461054

SEQ ID NO: 667466 - RNA, 64 nt, Homo Sapiens; identical to SEQ ID NO: 461055

SEQ ID NO: 667467 - RNA, 64 nt, Homo Sapiens; identical to SEQ ID NO: 461056

SEQ ID NO: 667468 - RNA, 64 nt, Homo Sapiens; identical to SEQ ID NO: 461057

SEQ ID NO: 667469 - RNA, 64 nt, Homo Sapiens; identical to SEQ ID NO: 461058

SEQ ID NO: 667470 - RNA, 64 nt, Homo Sapiens; identical to SEQ ID NO: 461059

SEQ ID NO: 667471 - RNA, 64 nt, Homo Sapiens; identical to SEQ ID NO: 461060

SEQ ID NO: 667472 - RNA, 64 nt, Homo Sapiens; identical to SEQ ID NO: 461061

SEQ ID NO: 667473 - RNA, 64 nt, Homo Sapiens; identical to SEQ ID NO: 461062

SEQ ID NO: 667474 - RNA, 64 nt, Homo Sapiens; identical to SEQ ID NO: 461063

SEQ ID NO: 667475 - RNA, 64 nt, Homo Sapiens; identical to SEQ ID NO: 461064

SEQ ID NO: 667476 - RNA, 64 nt, Homo Sapiens; identical to SEQ ID NO: 461065

SEQ ID NO: 667477 - RNA, 64 nt, Homo Sapiens; identical to SEQ ID NO: 461066

SEQ ID NO: 667478 - RNA, 64 nt, Homo Sapiens; identical to SEQ ID NO: 461067

SEQ ID NO: 667479 - RNA, 64 nt, Homo Sapiens; identical to SEQ ID NO: 461068

SEQ ID NO: 667480 - RNA, 64 nt, Homo Sapiens; identical to SEQ ID NO: 461069

SEQ ID NO: 667481 - RNA, 64 nt, Homo Sapiens; identical to SEQ ID NO: 461070

SEQ ID NO: 667482 - RNA, 64 nt, Homo Sapiens; identical to SEQ ID NO: 461071

SEQ ID NO: 667483 - RNA, 64 nt, Homo Sapiens; identical to SEQ ID NO: 461072

SEQ ID NO: 667484 - RNA, 64 nt, Homo Sapiens; identical to SEQ ID NO: 461073

SEQ ID NO: 667485 - RNA, 64 nt, Homo Sapiens; identical to SEQ ID NO: 461074

SEQ ID NO: 667486 - RNA, 64 nt, Homo Sapiens; identical to SEQ ID NO: 461075

SEQ ID NO: 667487 - RNA, 64 nt, Homo Sapiens; identical to SEQ ID NO: 461076

SEQ ID NO: 667488 - RNA, 64 nt, Homo Sapiens; identical to SEQ ID NO: 461077

SEQ ID NO: 667489 - RNA, 64 nt, Homo Sapiens; identical to SEQ ID NO: 461078

SEQ ID NO: 667490 - RNA, 64 nt, Homo Sapiens; identical to SEQ ID NO: 461079

SEQ ID NO: 667491 - RNA, 64 nt, Homo Sapiens; identical to SEQ ID NO: 461080

SEQ ID NO: 667492 - RNA, 64 nt, Homo Sapiens; identical to SEQ ID NO: 461081

SEQ ID NO: 667493 - RNA, 64 nt, Homo Sapiens; identical to SEQ ID NO: 461082

SEQ ID NO: 667494 - RNA, 64 nt, Homo Sapiens; identical to SEQ ID NO: 461083

SEQ ID NO: 667495 - RNA, 64 nt, Homo Sapiens; identical to SEQ ID NO: 461084

SEQ ID NO: 667496 - RNA, 64 nt, Homo Sapiens; identical to SEQ ID NO: 461085

SEQ ID NO: 667497 - RNA, 64 nt, Homo Sapiens; identical to SEQ ID NO: 461086

SEQ ID NO: 667498 - RNA, 64 nt, Homo Sapiens; identical to SEQ ID NO: 461087

SEQ ID NO: 667499 - RNA, 64 nt, Homo Sapiens; identical to SEQ ID NO: 461088

SEQ ID NO: 667500 - RNA, 64 nt, Homo Sapiens; identical to SEQ ID NO: 461089

SEQ ID NO: 667501 - RNA, 64 nt, Homo Sapiens; identical to SEQ ID NO: 461090

SEQ ID NO: 667502 - RNA, 64 nt, Homo Sapiens; identical to SEQ ID NO: 461091

SEQ ID NO: 667503 - RNA, 64 nt, Homo Sapiens; identical to SEQ ID NO: 461092

SEQ ID NO: 667504 - RNA, 64 nt, Homo Sapiens; identical to SEQ ID NO: 461093

SEQ ID NO: 667505 - RNA, 64 nt, Homo Sapiens; identical to SEQ ID NO: 461094

SEQ ID NO: 667506 - RNA, 64 nt, Homo Sapiens; identical to SEQ ID NO: 461095

SEQ ID NO: 667507 - RNA, 64 nt, Homo Sapiens; identical to SEQ ID NO: 461096

SEQ ID NO: 667508 - RNA, 64 nt, Homo Sapiens; identical to SEQ ID NO: 461097

SEQ ID NO: 667509 - RNA, 61 nt, Homo Sapiens; identical to SEQ ID NO: 461098

SEQ ID NO: 667510 - RNA, 64 nt, Homo Sapiens; identical to SEQ ID NO: 461099

SEQ ID NO: 667511 - RNA, 64 nt, Homo Sapiens; identical to SEQ ID NO: 461100

SEQ ID NO: 667512 - RNA, 64 nt, Homo Sapiens; identical to SEQ ID NO: 461101

SEQ ID NO: 667513 - RNA, 64 nt, Homo Sapiens; identical to SEQ ID NO: 461102

SEQ ID NO: 667514 - RNA, 64 nt, Homo Sapiens; identical to SEQ ID NO: 461103

SEQ ID NO: 667515 - RNA, 64 nt, Homo Sapiens; identical to SEQ ID NO: 461104

SEQ ID NO: 667516 - RNA, 64 nt, Homo Sapiens; identical to SEQ ID NO: 461105

SEQ ID NO: 667517 - RNA, 64 nt, Homo Sapiens; identical to SEQ ID NO: 461106

SEQ ID NO: 667518 - RNA, 64 nt, Homo Sapiens; identical to SEQ ID NO: 461107

SEQ ID NO: 667519 - RNA, 64 nt, Homo Sapiens; identical to SEQ ID NO: 461108

SEQ ID NO: 667520 - RNA, 64 nt, Homo Sapiens; identical to SEQ ID NO: 461109

SEQ ID NO: 667521 - RNA, 64 nt, Homo Sapiens; identical to SEQ ID NO: 461110

SEQ ID NO: 667522 - RNA, 64 nt, Homo Sapiens; identical to SEQ ID NO: 461111

SEQ ID NO: 667523 - RNA, 64 nt, Homo Sapiens; identical to SEQ ID NO: 461112

SEQ ID NO: 667524 - RNA, 64 nt, Homo Sapiens; identical to SEQ ID NO: 461113

SEQ ID NO: 667525 - RNA, 64 nt, Homo Sapiens; identical to SEQ ID NO: 461114

SEQ ID NO: 667526 - RNA, 64 nt, Homo Sapiens; identical to SEQ ID NO: 461115

SEQ ID NO: 667527 - RNA, 64 nt, Homo Sapiens; identical to SEQ ID NO: 461116

SEQ ID NO: 667528 - RNA, 64 nt, Homo Sapiens; identical to SEQ ID NO: 461117

SEQ ID NO: 667529 - RNA, 64 nt, Homo Sapiens; identical to SEQ ID NO: 461118

SEQ ID NO: 667530 - RNA, 64 nt, Homo Sapiens; identical to SEQ ID NO: 461119

SEQ ID NO: 667531 - RNA, 64 nt, Homo Sapiens; identical to SEQ ID NO: 461120

SEQ ID NO: 667532 - RNA, 64 nt, Homo Sapiens; identical to SEQ ID NO: 461121

SEQ ID NO: 667533 - RNA, 64 nt, Homo Sapiens; identical to SEQ ID NO: 461122

SEQ ID NO: 667534 - RNA, 64 nt, Homo Sapiens; identical to SEQ ID NO: 461123

SEQ ID NO: 667535 - RNA, 64 nt, Homo Sapiens; identical to SEQ ID NO: 461124

SEQ ID NO: 667536 - RNA, 64 nt, Homo Sapiens; identical to SEQ ID NO: 461125

SEQ ID NO: 667537 - RNA, 64 nt, Homo Sapiens; identical to SEQ ID NO: 461126

SEQ ID NO: 667538 - RNA, 64 nt, Homo Sapiens; identical to SEQ ID NO: 461127

SEQ ID NO: 667539 - RNA, 64 nt, Homo Sapiens; identical to SEQ ID NO: 461128

SEQ ID NO: 667540 - RNA, 64 nt, Homo Sapiens; identical to SEQ ID NO: 461129

SEQ ID NO: 667541 - RNA, 64 nt, Homo Sapiens; identical to SEQ ID NO: 461130

SEQ ID NO: 667542 - RNA, 64 nt, Homo Sapiens; identical to SEQ ID NO: 461131

SEQ ID NO: 667543 - RNA, 64 nt, Homo Sapiens; identical to SEQ ID NO: 461132

SEQ ID NO: 667544 - RNA, 64 nt, Homo Sapiens; identical to SEQ ID NO: 461133

SEQ ID NO: 667545 - RNA, 64 nt, Homo Sapiens; identical to SEQ ID NO: 461134

SEQ ID NO: 667546 - RNA, 64 nt, Homo Sapiens; identical to SEQ ID NO: 461135

SEQ ID NO: 667547 - RNA, 64 nt, Homo Sapiens; identical to SEQ ID NO: 461136

SEQ ID NO: 667548 - RNA, 64 nt, Homo Sapiens; identical to SEQ ID NO: 461137

SEQ ID NO: 667549 - RNA, 64 nt, Homo Sapiens; identical to SEQ ID NO: 461138

SEQ ID NO: 667550 - RNA, 64 nt, Homo Sapiens; identical to SEQ ID NO: 461139

SEQ ID NO: 667551 - RNA, 64 nt, Homo Sapiens; identical to SEQ ID NO: 461140

SEQ ID NO: 667552 - RNA, 64 nt, Homo Sapiens; identical to SEQ ID NO: 461141

SEQ ID NO: 667553 - RNA, 64 nt, Homo Sapiens; identical to SEQ ID NO: 461142

SEQ ID NO: 667554 - RNA, 64 nt, Homo Sapiens; identical to SEQ ID NO: 461143

SEQ ID NO: 667555 - RNA, 64 nt, Homo Sapiens; identical to SEQ ID NO: 461144

SEQ ID NO: 667556 - RNA, 64 nt, Homo Sapiens; identical to SEQ ID NO: 461145

SEQ ID NO: 667557 - RNA, 64 nt, Homo Sapiens; identical to SEQ ID NO: 461146

SEQ ID NO: 667558 - RNA, 64 nt, Homo Sapiens; identical to SEQ ID NO: 461147

SEQ ID NO: 667559 - RNA, 64 nt, Homo Sapiens; identical to SEQ ID NO: 461148

SEQ ID NO: 667560 - RNA, 64 nt, Homo Sapiens; identical to SEQ ID NO: 461149

SEQ ID NO: 667561 - RNA, 64 nt, Homo Sapiens; identical to SEQ ID NO: 461150

SEQ ID NO: 667562 - RNA, 64 nt, Homo Sapiens; identical to SEQ ID NO: 461151

SEQ ID NO: 667563 - RNA, 64 nt, Homo Sapiens; identical to SEQ ID NO: 461152

SEQ ID NO: 667564 - RNA, 64 nt, Homo Sapiens; identical to SEQ ID NO: 461153

SEQ ID NO: 667565 - RNA, 64 nt, Homo Sapiens; identical to SEQ ID NO: 461154

SEQ ID NO: 667566 - RNA, 64 nt, Homo Sapiens; identical to SEQ ID NO: 461155

SEQ ID NO: 667567 - RNA, 64 nt, Homo Sapiens; identical to SEQ ID NO: 461156

SEQ ID NO: 667568 - RNA, 64 nt, Homo Sapiens; identical to SEQ ID NO: 461157

SEQ ID NO: 667569 - RNA, 64 nt, Homo Sapiens; identical to SEQ ID NO: 461158

SEQ ID NO: 667570 - RNA, 64 nt, Homo Sapiens; identical to SEQ ID NO: 461159

SEQ ID NO: 667571 - RNA, 64 nt, Homo Sapiens; identical to SEQ ID NO: 461160

SEQ ID NO: 667572 - RNA, 64 nt, Homo Sapiens; identical to SEQ ID NO: 461161

SEQ ID NO: 667573 - RNA, 64 nt, Homo Sapiens; identical to SEQ ID NO: 461162

SEQ ID NO: 667574 - RNA, 64 nt, Homo Sapiens; identical to SEQ ID NO: 461163

SEQ ID NO: 667575 - RNA, 64 nt, Homo Sapiens; identical to SEQ ID NO: 461164

SEQ ID NO: 667576 - RNA, 64 nt, Homo Sapiens; identical to SEQ ID NO: 461165

SEQ ID NO: 667577 - RNA, 64 nt, Homo Sapiens; identical to SEQ ID NO: 461166

SEQ ID NO: 667578 - RNA, 64 nt, Homo Sapiens; identical to SEQ ID NO: 461167

SEQ ID NO: 667579 - RNA, 64 nt, Homo Sapiens; identical to SEQ ID NO: 461168

SEQ ID NO: 667580 - RNA, 64 nt, Homo Sapiens; identical to SEQ ID NO: 461169

SEQ ID NO: 667581 - RNA, 64 nt, Homo Sapiens; identical to SEQ ID NO: 461170

SEQ ID NO: 667582 - RNA, 64 nt, Homo Sapiens; identical to SEQ ID NO: 461171

SEQ ID NO: 667583 - RNA, 64 nt, Homo Sapiens; identical to SEQ ID NO: 461172

SEQ ID NO: 667584 - RNA, 64 nt, Homo Sapiens; identical to SEQ ID NO: 461173

SEQ ID NO: 667585 - RNA, 64 nt, Homo Sapiens; identical to SEQ ID NO: 461174

SEQ ID NO: 667586 - RNA, 64 nt, Homo Sapiens
agugacuucaguugagggcaagucucuggaaaagaggcuguaggcaucuggcagcuaccaugca

SEQ ID NO: 667587 - RNA, 64 nt, Homo Sapiens
acagucaauauugucaguacuuugcuuugauugaaggcuguagagcugaguuaccaaaauuucu

SEQ ID NO: 667588 - RNA, 64 nt, Homo Sapiens; identical to SEQ ID NO: 627088

SEQ ID NO: 667589 - RNA, 64 nt, Homo Sapiens; identical to SEQ ID NO: 627089

SEQ ID NO: 667590 - RNA, 64 nt, Homo Sapiens; identical to SEQ ID NO: 627090

SEQ ID NO: 667591 - RNA, 64 nt, Homo Sapiens; identical to SEQ ID NO: 627091

SEQ ID NO: 667592 - RNA, 64 nt, Homo Sapiens; identical to SEQ ID NO: 627092

SEQ ID NO: 667593 - RNA, 64 nt, Homo Sapiens; identical to SEQ ID NO: 627093

SEQ ID NO: 667594 - RNA, 64 nt, Homo Sapiens; identical to SEQ ID NO: 627094

SEQ ID NO: 667595 - RNA, 64 nt, Homo Sapiens; identical to SEQ ID NO: 627095

SEQ ID NO: 667596 - RNA, 64 nt, Homo Sapiens; identical to SEQ ID NO: 627096

SEQ ID NO: 667597 - RNA, 64 nt, Homo Sapiens; identical to SEQ ID NO: 627097

SEQ ID NO: 667598 - RNA, 64 nt, Homo Sapiens; identical to SEQ ID NO: 627098

SEQ ID NO: 667599 - RNA, 64 nt, Homo Sapiens; identical to SEQ ID NO: 627099

SEQ ID NO: 667600 - RNA, 64 nt, Homo Sapiens; identical to SEQ ID NO: 627100

SEQ ID NO: 667601 - RNA, 64 nt, Homo Sapiens; identical to SEQ ID NO: 627101

SEQ ID NO: 667602 - RNA, 64 nt, Homo Sapiens; identical to SEQ ID NO: 627102

SEQ ID NO: 667603 - RNA, 64 nt, Homo Sapiens; identical to SEQ ID NO: 627103

SEQ ID NO: 667604 - RNA, 64 nt, Homo Sapiens; identical to SEQ ID NO: 104783

SEQ ID NO: 667605 - RNA, 64 nt, Homo Sapiens; identical to SEQ ID NO: 104784

SEQ ID NO: 667606 - RNA, 64 nt, Homo Sapiens; identical to SEQ ID NO: 104785

SEQ ID NO: 667607 - RNA, 64 nt, Homo Sapiens; identical to SEQ ID NO: 104786

SEQ ID NO: 667608 - RNA, 64 nt, Homo Sapiens; identical to SEQ ID NO: 104787

SEQ ID NO: 667609 - RNA, 64 nt, Homo Sapiens; identical to SEQ ID NO: 104788

SEQ ID NO: 667610 - RNA, 64 nt, Homo Sapiens; identical to SEQ ID NO: 104789

SEQ ID NO: 667611 - RNA, 64 nt, Homo Sapiens; identical to SEQ ID NO: 104790

SEQ ID NO: 667612 - RNA, 64 nt, Homo Sapiens; identical to SEQ ID NO: 104791

SEQ ID NO: 667613 - RNA, 64 nt, Homo Sapiens; identical to SEQ ID NO: 104792

SEQ ID NO: 667614 - RNA, 64 nt, Homo Sapiens; identical to SEQ ID NO: 104793

SEQ ID NO: 667615 - RNA, 64 nt, Homo Sapiens; identical to SEQ ID NO: 104794

SEQ ID NO: 667616 - RNA, 64 nt, Homo Sapiens; identical to SEQ ID NO: 104795

SEQ ID NO: 667617 - RNA, 64 nt, Homo Sapiens; identical to SEQ ID NO: 104796

SEQ ID NO: 667618 - RNA, 64 nt, Homo Sapiens; identical to SEQ ID NO: 104797

SEQ ID NO: 667619 - RNA, 64 nt, Homo Sapiens; identical to SEQ ID NO: 104798

SEQ ID NO: 667620 - RNA, 64 nt, Homo Sapiens; identical to SEQ ID NO: 104799

SEQ ID NO: 667621 - RNA, 64 nt, Homo Sapiens; identical to SEQ ID NO: 104800

SEQ ID NO: 667622 - RNA, 64 nt, Homo Sapiens; identical to SEQ ID NO: 104801

SEQ ID NO: 667623 - RNA, 64 nt, Homo Sapiens; identical to SEQ ID NO: 104802

SEQ ID NO: 667624 - RNA, 64 nt, Homo Sapiens; identical to SEQ ID NO: 104803

SEQ ID NO: 667625 - RNA, 64 nt, Homo Sapiens; identical to SEQ ID NO: 104804

SEQ ID NO: 667626 - RNA, 64 nt, Homo Sapiens; identical to SEQ ID NO: 104805

SEQ ID NO: 667627 - RNA, 64 nt, Homo Sapiens; identical to SEQ ID NO: 104806

SEQ ID NO: 667628 - RNA, 64 nt, Homo Sapiens; identical to SEQ ID NO: 104807

SEQ ID NO: 667629 - RNA, 64 nt, Homo Sapiens; identical to SEQ ID NO: 104808

SEQ ID NO: 667630 - RNA, 64 nt, Homo Sapiens; identical to SEQ ID NO: 104809

SEQ ID NO: 667631 - RNA, 64 nt, Homo Sapiens; identical to SEQ ID NO: 104810

SEQ ID NO: 667632 - RNA, 64 nt, Homo Sapiens; identical to SEQ ID NO: 104811

SEQ ID NO: 667633 - RNA, 64 nt, Homo Sapiens; identical to SEQ ID NO: 104812

SEQ ID NO: 667634 - RNA, 64 nt, Homo Sapiens; identical to SEQ ID NO: 104813

SEQ ID NO: 667635 - RNA, 64 nt, Homo Sapiens; identical to SEQ ID NO: 104814

SEQ ID NO: 667636 - RNA, 64 nt, Homo Sapiens; identical to SEQ ID NO: 104815

SEQ ID NO: 667637 - RNA, 64 nt, Homo Sapiens; identical to SEQ ID NO: 104816

SEQ ID NO: 667638 - RNA, 64 nt, Homo Sapiens; identical to SEQ ID NO: 104817

SEQ ID NO: 667639 - RNA, 64 nt, Homo Sapiens; identical to SEQ ID NO: 104818

SEQ ID NO: 667640 - RNA, 64 nt, Homo Sapiens; identical to SEQ ID NO: 104819

SEQ ID NO: 667641 - RNA, 64 nt, Homo Sapiens; identical to SEQ ID NO: 104820

SEQ ID NO: 667642 - RNA, 64 nt, Homo Sapiens; identical to SEQ ID NO: 104821

SEQ ID NO: 667643 - RNA, 64 nt, Homo Sapiens; identical to SEQ ID NO: 104822

SEQ ID NO: 667644 - RNA, 64 nt, Homo Sapiens; identical to SEQ ID NO: 104823

SEQ ID NO: 667645 - RNA, 64 nt, Homo Sapiens; identical to SEQ ID NO: 104824

SEQ ID NO: 667646 - RNA, 64 nt, Homo Sapiens; identical to SEQ ID NO: 104825

SEQ ID NO: 667647 - RNA, 64 nt, Homo Sapiens; identical to SEQ ID NO: 104826

SEQ ID NO: 667648 - RNA, 64 nt, Homo Sapiens; identical to SEQ ID NO: 104827

SEQ ID NO: 667649 - RNA, 64 nt, Homo Sapiens; identical to SEQ ID NO: 104828

SEQ ID NO: 667650 - RNA, 64 nt, Homo Sapiens; identical to SEQ ID NO: 104829

SEQ ID NO: 667651 - RNA, 64 nt, Homo Sapiens; identical to SEQ ID NO: 104830

SEQ ID NO: 667652 - RNA, 64 nt, Homo Sapiens; identical to SEQ ID NO: 104831

SEQ ID NO: 667653 - RNA, 64 nt, Homo Sapiens; identical to SEQ ID NO: 104832

SEQ ID NO: 667654 - RNA, 64 nt, Homo Sapiens; identical to SEQ ID NO: 104833

SEQ ID NO: 667655 - RNA, 64 nt, Homo Sapiens; identical to SEQ ID NO: 104834

SEQ ID NO: 667656 - RNA, 64 nt, Homo Sapiens; identical to SEQ ID NO: 104835

SEQ ID NO: 667657 - RNA, 64 nt, Homo Sapiens; identical to SEQ ID NO: 104836

SEQ ID NO: 667658 - RNA, 64 nt, Homo Sapiens; identical to SEQ ID NO: 104837

SEQ ID NO: 667659 - RNA, 64 nt, Homo Sapiens; identical to SEQ ID NO: 104838

SEQ ID NO: 667660 - RNA, 64 nt, Homo Sapiens; identical to SEQ ID NO: 104839

SEQ ID NO: 667661 - RNA, 64 nt, Homo Sapiens; identical to SEQ ID NO: 104840

SEQ ID NO: 667662 - RNA, 64 nt, Homo Sapiens; identical to SEQ ID NO: 104841

SEQ ID NO: 667663 - RNA, 64 nt, Homo Sapiens; identical to SEQ ID NO: 104842

SEQ ID NO: 667664 - RNA, 64 nt, Homo Sapiens; identical to SEQ ID NO: 104843

SEQ ID NO: 667665 - RNA, 64 nt, Homo Sapiens; identical to SEQ ID NO: 104844

SEQ ID NO: 667666 - RNA, 64 nt, Homo Sapiens; identical to SEQ ID NO: 104845

SEQ ID NO: 667667 - RNA, 64 nt, Homo Sapiens; identical to SEQ ID NO: 104846

SEQ ID NO: 667668 - RNA, 64 nt, Homo Sapiens; identical to SEQ ID NO: 104847

SEQ ID NO: 667669 - RNA, 64 nt, Homo Sapiens; identical to SEQ ID NO: 104848

SEQ ID NO: 667670 - RNA, 64 nt, Homo Sapiens; identical to SEQ ID NO: 104849

SEQ ID NO: 667671 - RNA, 64 nt, Homo Sapiens; identical to SEQ ID NO: 104850

SEQ ID NO: 667672 - RNA, 64 nt, Homo Sapiens; identical to SEQ ID NO: 104851

SEQ ID NO: 667673 - RNA, 64 nt, Homo Sapiens; identical to SEQ ID NO: 104852

SEQ ID NO: 667674 - RNA, 64 nt, Homo Sapiens; identical to SEQ ID NO: 104853

SEQ ID NO: 667675 - RNA, 64 nt, Homo Sapiens; identical to SEQ ID NO: 104854

SEQ ID NO: 667676 - RNA, 64 nt, Homo Sapiens; identical to SEQ ID NO: 104855

SEQ ID NO: 667677 - RNA, 64 nt, Homo Sapiens; identical to SEQ ID NO: 104856

SEQ ID NO: 667678 - RNA, 64 nt, Homo Sapiens; identical to SEQ ID NO: 104857

SEQ ID NO: 667679 - RNA, 64 nt, Homo Sapiens; identical to SEQ ID NO: 104858

SEQ ID NO: 667680 - RNA, 64 nt, Homo Sapiens; identical to SEQ ID NO: 104859

SEQ ID NO: 667681 - RNA, 64 nt, Homo Sapiens; identical to SEQ ID NO: 104860

SEQ ID NO: 667682 - RNA, 64 nt, Homo Sapiens; identical to SEQ ID NO: 104861

SEQ ID NO: 667683 - RNA, 64 nt, Homo Sapiens; identical to SEQ ID NO: 104862

SEQ ID NO: 667684 - RNA, 64 nt, Homo Sapiens; identical to SEQ ID NO: 104863

SEQ ID NO: 667685 - RNA, 64 nt, Homo Sapiens; identical to SEQ ID NO: 104864

SEQ ID NO: 667686 - RNA, 64 nt, Homo Sapiens; identical to SEQ ID NO: 104865

SEQ ID NO: 667687 - RNA, 64 nt, Homo Sapiens; identical to SEQ ID NO: 104866

SEQ ID NO: 667688 - RNA, 64 nt, Homo Sapiens; identical to SEQ ID NO: 104867

SEQ ID NO: 667689 - RNA, 64 nt, Homo Sapiens; identical to SEQ ID NO: 104868

SEQ ID NO: 667690 - RNA, 64 nt, Homo Sapiens; identical to SEQ ID NO: 104869

SEQ ID NO: 667691 - RNA, 64 nt, Homo Sapiens; identical to SEQ ID NO: 104870

SEQ ID NO: 667692 - RNA, 64 nt, Homo Sapiens; identical to SEQ ID NO: 104871

SEQ ID NO: 667693 - RNA, 64 nt, Homo Sapiens; identical to SEQ ID NO: 104872

SEQ ID NO: 667694 - RNA, 64 nt, Homo Sapiens; identical to SEQ ID NO: 104873

SEQ ID NO: 667695 - RNA, 64 nt, Homo Sapiens; identical to SEQ ID NO: 104874

SEQ ID NO: 667696 - RNA, 64 nt, Homo Sapiens; identical to SEQ ID NO: 104875

SEQ ID NO: 667697 - RNA, 64 nt, Homo Sapiens; identical to SEQ ID NO: 104876

SEQ ID NO: 667698 - RNA, 64 nt, Homo Sapiens; identical to SEQ ID NO: 104877

SEQ ID NO: 667699 - RNA, 61 nt, Homo Sapiens; identical to SEQ ID NO: 104878

SEQ ID NO: 667700 - RNA, 64 nt, Homo Sapiens; identical to SEQ ID NO: 104879

SEQ ID NO: 667701 - RNA, 64 nt, Homo Sapiens
ccucccacagaugccuccugcgcagccaaucugugaccacgauucuggcccauucuuuuuuuga

SEQ ID NO: 667702 - RNA, 64 nt, Homo Sapiens
cuggucuuuccuguuguugggcaugugcacuacugaccacgacuaagcaccaaagaccuguuaa

SEQ ID NO: 667703 - RNA, 64 nt, Homo Sapiens
ggaaagggccuauuuaacucgcgugcaccaaugagaccacgaugggcccucgaggcucagcaga

SEQ ID NO: 667704 - RNA, 64 nt, Homo Sapiens
uggauuuaaacauauuucccuguggaggggcuuugaccacgaccuuugaagagcuucauuuuga

SEQ ID NO: 667705 - RNA, 64 nt, Homo Sapiens
ucaagacuuguuaaaaaagaagaagaaaucagcggaccacgauugguuauucagugugaccuag

SEQ ID NO: 667706 - RNA, 64 nt, Homo Sapiens
cagcugacugugcaucacgcucuaaguucacugugaccacgaagcugccaaaugcagucuuggu

SEQ ID NO: 667707 - RNA, 64 nt, Homo Sapiens
ggcuguugcuggacuacaugcuggccacugcugugaccacgacacugcuggggcagcuucuucc

SEQ ID NO: 667708 - RNA, 64 nt, Homo Sapiens
acgggcagaaguacagaacagaaauggagaagcugaccacgacuccaucucuucucauuccaga

SEQ ID NO: 667709 - RNA, 64 nt, Homo Sapiens
aaauacccucaaaacuaacuagugacggcaggaggaccacgaggaucauuggaacauggggacg

SEQ ID NO: 667710 - RNA, 64 nt, Homo Sapiens
uuggccccagcucugcacuccuccuuuccuuuuugaccacgaccgacccuggaguccaugaggg

SEQ ID NO: 667711 - RNA, 64 nt, Homo Sapiens
uagaagauauguggaagaaaccuuuucccucccagaccacgaauccaccugagaacuccacuac

SEQ ID NO: 667712 - RNA, 64 nt, Homo Sapiens
uaguaaccaaggcccugucucuggcuacucccuggaccacgaggcugauuccucucauuuccag

SEQ ID NO: 667713 - RNA, 64 nt, Homo Sapiens
cuuucugcacuuucugcaccgugcacagcccaaggaccacgaggcgaucuggugauaauuuugu

SEQ ID NO: 667714 - RNA, 64 nt, Homo Sapiens
guucccuggugcugccucacacuccugagauccagaccacgagaagugaccuucagggucauca

SEQ ID NO: 667715 - RNA, 64 nt, Homo Sapiens
gagcaaaggaagcauuuaccccgaugguuaccuagaccacgauuauuuggauuggggggagggg

SEQ ID NO: 667716 - RNA, 64 nt, Homo Sapiens
gugggugcccuguugaccuacccuggaccgaguggaccacgaccucguccauuuaaacccggcu

SEQ ID NO: 667717 - RNA, 64 nt, Homo Sapiens
uggccuucucucgucugauccuccgccagggcuggaccacgagcugacuccgccgccccucugc

SEQ ID NO: 667718 - RNA, 64 nt, Homo Sapiens
ggaagcccaccuuccuggagugucuuucuuuauggaccacgaagggugguugcauccaaguauc

SEQ ID NO: 667719 - RNA, 64 nt, Homo Sapiens
aggagagcgugcauagcgacacucgggaccuguggaccacgaccacgcugucccaggcacagcu

SEQ ID NO: 667720 - RNA, 64 nt, Homo Sapiens
aaaggcuguuuuuuguuuuuaaauaaucaucuaagaccacgaaaacauuuuuuccuaaggaagg

SEQ ID NO: 667721 - RNA, 64 nt, Homo Sapiens
cucacuucaguuucccaguuuuuuaacuccuauugaccacgaguguaugaauguacauaaauau

SEQ ID NO: 667722 - RNA, 64 nt, Homo Sapiens
gaauaccacgaaggaauuuaagcaguaucuaggagaccacgaagaggguauuuauugaacuacc

SEQ ID NO: 667723 - RNA, 64 nt, Homo Sapiens
ggaauucuugcacaugcucguguagugccauugggaccacgaagcugugauugaacgugaaaug

SEQ ID NO: 667724 - RNA, 64 nt, Homo Sapiens
ccugguucagucacccaggguccucgucacuugggaccacgagcuuggucucuguccugcccca

SEQ ID NO: 667725 - RNA, 64 nt, Homo Sapiens
gagccagcgagggggcgggaugcagcugacugaggaccacgaguguguucccagcgccccagcc

SEQ ID NO: 667726 - RNA, 61 nt, Homo Sapiens
ccgguguuccaacuguuuaaaauugaucagagaccacgaaaagaaauuugugcuucaccga

SEQ ID NO: 667727 - RNA, 64 nt, Homo Sapiens
cacugcugaugacgaacuaucucuaacuggucuugaccacgagcuaguucugaauugcaggggc

SEQ ID NO: 667728 - RNA, 64 nt, Homo Sapiens
gggcagaaggaguuucuccgaagucaacccuguggaccacgacacuggcguuucgaauaccgaa

SEQ ID NO: 667729 - RNA, 64 nt, Homo Sapiens
gaacugcuccugugguuuggaccauguuauuccugaccacgauaauuaaucugaaagaucagag

SEQ ID NO: 667730 - RNA, 64 nt, Homo Sapiens
uucuaaagugcauauuagaaaugcagguauauaagaccacgauuaccugucuuauggaagaaau

SEQ ID NO: 667731 - RNA, 64 nt, Homo Sapiens
auucuuucuguccagaagggacucaaaccacauggaccacgaaucuuaguguccuucuuaacag

SEQ ID NO: 667732 - RNA, 64 nt, Homo Sapiens
gugccccuucaccaucaagcucagcgcccggaaggaccacgagggcagcugugacuacaggccu

SEQ ID NO: 667733 - RNA, 64 nt, Homo Sapiens
caccggcacagggcagagaugcggguggcccaaggaccacgaucaagggguccgggggaccgag

SEQ ID NO: 667734 - RNA, 64 nt, Homo Sapiens
uacaugcuggcagggaagccagcucgggcccugugaccacgaucuugagggcagcguccaggag

SEQ ID NO: 667735 - RNA, 64 nt, Homo Sapiens
ugugucgggcguggggccugcaggugggcgccccgaccacgacuuggcuuccuugugccuuaaa

SEQ ID NO: 667736 - RNA, 64 nt, Homo Sapiens
uuuucaaaacauuuugaaaagcauuuacuuuuuugaccacgagccaugaguuuucaaaaaaauc

SEQ ID NO: 667737 - RNA, 64 nt, Homo Sapiens
aggggccaucuggaaacuuguggacagagaagaagaccacgacuggagaagcccccuuucugag

SEQ ID NO: 667738 - RNA, 64 nt, Homo Sapiens
gcccccgucugugacugaaggcccggugggaaaagaccacgauccuccuugacgaguuuuguuu

SEQ ID NO: 667739 - RNA, 64 nt, Homo Sapiens
acaccacccagagcacccucugguugugggcuuggaccacgagcccuuagcagggaaggcuggu

SEQ ID NO: 667740 - RNA, 64 nt, Homo Sapiens
ucaguaguucgagaccagccggccgaggcaggcggaccacgaggauaaucccagcacuuuggga

SEQ ID NO: 667741 - RNA, 64 nt, Homo Sapiens
ccccuuucccccgccaaauaagaaacgcaagccagaccacgaugauuguagaagucccucccgc

SEQ ID NO: 667742 - RNA, 64 nt, Homo Sapiens
aaugcuguucugauuuacuaacuuaaauaaacaugaccacgaagaaggaaugagaauauguaau

SEQ ID NO: 667743 - RNA, 64 nt, Homo Sapiens
gcugaccccuuccagccugagccgcacgcugacggaccacgagguacuuaggcacagggacucc

SEQ ID NO: 667744 - RNA, 64 nt, Homo Sapiens
ggaagcaccagggcaaggcggacgcucacccugugaccacgauggugaccgugacugugggagg

SEQ ID NO: 667745 - RNA, 64 nt, Homo Sapiens; identical to SEQ ID NO: 360502

SEQ ID NO: 667746 - RNA, 64 nt, Homo Sapiens; identical to SEQ ID NO: 360503

SEQ ID NO: 667747 - RNA, 64 nt, Homo Sapiens; identical to SEQ ID NO: 360504

SEQ ID NO: 667748 - RNA, 64 nt, Homo Sapiens; identical to SEQ ID NO: 360505

SEQ ID NO: 667749 - RNA, 64 nt, Homo Sapiens; identical to SEQ ID NO: 360506

SEQ ID NO: 667750 - RNA, 64 nt, Homo Sapiens; identical to SEQ ID NO: 360507

SEQ ID NO: 667751 - RNA, 64 nt, Homo Sapiens; identical to SEQ ID NO: 360508

SEQ ID NO: 667752 - RNA, 64 nt, Homo Sapiens; identical to SEQ ID NO: 360509

SEQ ID NO: 667753 - RNA, 64 nt, Homo Sapiens; identical to SEQ ID NO: 360510

SEQ ID NO: 667754 - RNA, 64 nt, Homo Sapiens; identical to SEQ ID NO: 360511

SEQ ID NO: 667755 - RNA, 64 nt, Homo Sapiens; identical to SEQ ID NO: 360512

SEQ ID NO: 667756 - RNA, 64 nt, Homo Sapiens; identical to SEQ ID NO: 360513

SEQ ID NO: 667757 - RNA, 64 nt, Homo Sapiens; identical to SEQ ID NO: 360514

SEQ ID NO: 667758 - RNA, 64 nt, Homo Sapiens; identical to SEQ ID NO: 360515

SEQ ID NO: 667759 - RNA, 64 nt, Homo Sapiens; identical to SEQ ID NO: 360516

SEQ ID NO: 667760 - RNA, 64 nt, Homo Sapiens; identical to SEQ ID NO: 360517

SEQ ID NO: 667761 - RNA, 64 nt, Homo Sapiens; identical to SEQ ID NO: 360518

SEQ ID NO: 667762 - RNA, 64 nt, Homo Sapiens; identical to SEQ ID NO: 360519

SEQ ID NO: 667763 - RNA, 64 nt, Homo Sapiens; identical to SEQ ID NO: 360520

SEQ ID NO: 667764 - RNA, 64 nt, Homo Sapiens; identical to SEQ ID NO: 360521

SEQ ID NO: 667765 - RNA, 64 nt, Homo Sapiens; identical to SEQ ID NO: 360522

SEQ ID NO: 667766 - RNA, 64 nt, Homo Sapiens; identical to SEQ ID NO: 360523

SEQ ID NO: 667767 - RNA, 64 nt, Homo Sapiens; identical to SEQ ID NO: 360524

SEQ ID NO: 667768 - RNA, 64 nt, Homo Sapiens; identical to SEQ ID NO: 360525

SEQ ID NO: 667769 - RNA, 64 nt, Homo Sapiens; identical to SEQ ID NO: 360526

SEQ ID NO: 667770 - RNA, 64 nt, Homo Sapiens; identical to SEQ ID NO: 360527

SEQ ID NO: 667771 - RNA, 64 nt, Homo Sapiens; identical to SEQ ID NO: 360528

SEQ ID NO: 667772 - RNA, 64 nt, Homo Sapiens; identical to SEQ ID NO: 360529

SEQ ID NO: 667773 - RNA, 64 nt, Homo Sapiens; identical to SEQ ID NO: 360530

SEQ ID NO: 667774 - RNA, 64 nt, Homo Sapiens; identical to SEQ ID NO: 360531

SEQ ID NO: 667775 - RNA, 64 nt, Homo Sapiens; identical to SEQ ID NO: 360532

SEQ ID NO: 667776 - RNA, 64 nt, Homo Sapiens; identical to SEQ ID NO: 360533

SEQ ID NO: 667777 - RNA, 64 nt, Homo Sapiens; identical to SEQ ID NO: 360534

SEQ ID NO: 667778 - RNA, 64 nt, Homo Sapiens; identical to SEQ ID NO: 360535

SEQ ID NO: 667779 - RNA, 64 nt, Homo Sapiens; identical to SEQ ID NO: 360536

SEQ ID NO: 667780 - RNA, 64 nt, Homo Sapiens; identical to SEQ ID NO: 360537

SEQ ID NO: 667781 - RNA, 64 nt, Homo Sapiens; identical to SEQ ID NO: 360538

SEQ ID NO: 667782 - RNA, 64 nt, Homo Sapiens; identical to SEQ ID NO: 360539

SEQ ID NO: 667783 - RNA, 64 nt, Homo Sapiens; identical to SEQ ID NO: 360540

SEQ ID NO: 667784 - RNA, 64 nt, Homo Sapiens; identical to SEQ ID NO: 360541

SEQ ID NO: 667785 - RNA, 64 nt, Homo Sapiens; identical to SEQ ID NO: 360542

SEQ ID NO: 667786 - RNA, 64 nt, Homo Sapiens; identical to SEQ ID NO: 360543

SEQ ID NO: 667787 - RNA, 64 nt, Homo Sapiens; identical to SEQ ID NO: 360544

SEQ ID NO: 667788 - RNA, 64 nt, Homo Sapiens; identical to SEQ ID NO: 360545

SEQ ID NO: 667789 - RNA, 64 nt, Homo Sapiens; identical to SEQ ID NO: 360546

SEQ ID NO: 667790 - RNA, 56 nt, Homo Sapiens; identical to SEQ ID NO: 360547

SEQ ID NO: 667791 - RNA, 64 nt, Homo Sapiens; identical to SEQ ID NO: 360548

SEQ ID NO: 667792 - RNA, 64 nt, Homo Sapiens; identical to SEQ ID NO: 360549

SEQ ID NO: 667793 - RNA, 64 nt, Homo Sapiens; identical to SEQ ID NO: 360550

SEQ ID NO: 667794 - RNA, 64 nt, Homo Sapiens; identical to SEQ ID NO: 360551

SEQ ID NO: 667795 - RNA, 64 nt, Homo Sapiens; identical to SEQ ID NO: 360552

SEQ ID NO: 667796 - RNA, 64 nt, Homo Sapiens; identical to SEQ ID NO: 360553

SEQ ID NO: 667797 - RNA, 64 nt, Homo Sapiens; identical to SEQ ID NO: 360554

SEQ ID NO: 667798 - RNA, 64 nt, Homo Sapiens; identical to SEQ ID NO: 360555

SEQ ID NO: 667799 - RNA, 64 nt, Homo Sapiens; identical to SEQ ID NO: 360556

SEQ ID NO: 667800 - RNA, 64 nt, Homo Sapiens; identical to SEQ ID NO: 360557

SEQ ID NO: 667801 - RNA, 64 nt, Homo Sapiens; identical to SEQ ID NO: 360558

SEQ ID NO: 667802 - RNA, 64 nt, Homo Sapiens; identical to SEQ ID NO: 360559

SEQ ID NO: 667803 - RNA, 64 nt, Homo Sapiens; identical to SEQ ID NO: 360560

SEQ ID NO: 667804 - RNA, 64 nt, Homo Sapiens; identical to SEQ ID NO: 360561

SEQ ID NO: 667805 - RNA, 64 nt, Homo Sapiens; identical to SEQ ID NO: 360562

SEQ ID NO: 667806 - RNA, 64 nt, Homo Sapiens; identical to SEQ ID NO: 360563

SEQ ID NO: 667807 - RNA, 64 nt, Homo Sapiens; identical to SEQ ID NO: 360564

SEQ ID NO: 667808 - RNA, 64 nt, Homo Sapiens; identical to SEQ ID NO: 360565

SEQ ID NO: 667809 - RNA, 64 nt, Homo Sapiens; identical to SEQ ID NO: 360566

SEQ ID NO: 667810 - RNA, 64 nt, Homo Sapiens; identical to SEQ ID NO: 360567

SEQ ID NO: 667811 - RNA, 64 nt, Homo Sapiens; identical to SEQ ID NO: 360568

SEQ ID NO: 667812 - RNA, 64 nt, Homo Sapiens; identical to SEQ ID NO: 360569

SEQ ID NO: 667813 - RNA, 64 nt, Homo Sapiens; identical to SEQ ID NO: 360570

SEQ ID NO: 667814 - RNA, 64 nt, Homo Sapiens; identical to SEQ ID NO: 360571

SEQ ID NO: 667815 - RNA, 64 nt, Homo Sapiens; identical to SEQ ID NO: 360572

SEQ ID NO: 667816 - RNA, 64 nt, Homo Sapiens; identical to SEQ ID NO: 360573

SEQ ID NO: 667817 - RNA, 64 nt, Homo Sapiens; identical to SEQ ID NO: 360574

SEQ ID NO: 667818 - RNA, 64 nt, Homo Sapiens; identical to SEQ ID NO: 360575

SEQ ID NO: 667819 - RNA, 64 nt, Homo Sapiens; identical to SEQ ID NO: 360576

SEQ ID NO: 667820 - RNA, 64 nt, Homo Sapiens; identical to SEQ ID NO: 360577

SEQ ID NO: 667821 - RNA, 62 nt, Homo Sapiens; identical to SEQ ID NO: 360578

SEQ ID NO: 667822 - RNA, 64 nt, Homo Sapiens; identical to SEQ ID NO: 360579

SEQ ID NO: 667823 - RNA, 64 nt, Homo Sapiens; identical to SEQ ID NO: 360580

SEQ ID NO: 667824 - RNA, 64 nt, Homo Sapiens; identical to SEQ ID NO: 360581

SEQ ID NO: 667825 - RNA, 64 nt, Homo Sapiens; identical to SEQ ID NO: 360582

SEQ ID NO: 667826 - RNA, 64 nt, Homo Sapiens; identical to SEQ ID NO: 360583

SEQ ID NO: 667827 - RNA, 64 nt, Homo Sapiens; identical to SEQ ID NO: 360584

SEQ ID NO: 667828 - RNA, 64 nt, Homo Sapiens; identical to SEQ ID NO: 360585

SEQ ID NO: 667829 - RNA, 64 nt, Homo Sapiens; identical to SEQ ID NO: 360586

SEQ ID NO: 667830 - RNA, 64 nt, Homo Sapiens; identical to SEQ ID NO: 360587

SEQ ID NO: 667831 - RNA, 64 nt, Homo Sapiens; identical to SEQ ID NO: 360588

SEQ ID NO: 667832 - RNA, 64 nt, Homo Sapiens; identical to SEQ ID NO: 360589

SEQ ID NO: 667833 - RNA, 64 nt, Homo Sapiens; identical to SEQ ID NO: 360590

SEQ ID NO: 667834 - RNA, 64 nt, Homo Sapiens; identical to SEQ ID NO: 360591

SEQ ID NO: 667835 - RNA, 64 nt, Homo Sapiens; identical to SEQ ID NO: 360592

SEQ ID NO: 667836 - RNA, 64 nt, Homo Sapiens; identical to SEQ ID NO: 360593

SEQ ID NO: 667837 - RNA, 64 nt, Homo Sapiens; identical to SEQ ID NO: 360594

SEQ ID NO: 667838 - RNA, 64 nt, Homo Sapiens; identical to SEQ ID NO: 360595

SEQ ID NO: 667839 - RNA, 64 nt, Homo Sapiens; identical to SEQ ID NO: 360596

SEQ ID NO: 667840 - RNA, 64 nt, Homo Sapiens; identical to SEQ ID NO: 360597

SEQ ID NO: 667841 - RNA, 64 nt, Homo Sapiens; identical to SEQ ID NO: 360598

SEQ ID NO: 667842 - RNA, 64 nt, Homo Sapiens; identical to SEQ ID NO: 360599

SEQ ID NO: 667843 - RNA, 64 nt, Homo Sapiens; identical to SEQ ID NO: 360600

SEQ ID NO: 667844 - RNA, 64 nt, Homo Sapiens; identical to SEQ ID NO: 360601

SEQ ID NO: 667845 - RNA, 64 nt, Homo Sapiens; identical to SEQ ID NO: 360602

SEQ ID NO: 667846 - RNA, 64 nt, Homo Sapiens; identical to SEQ ID NO: 360603

SEQ ID NO: 667847 - RNA, 64 nt, Homo Sapiens; identical to SEQ ID NO: 360604

SEQ ID NO: 667848 - RNA, 64 nt, Homo Sapiens; identical to SEQ ID NO: 360605

SEQ ID NO: 667849 - RNA, 64 nt, Homo Sapiens; identical to SEQ ID NO: 360606

SEQ ID NO: 667850 - RNA, 64 nt, Homo Sapiens; identical to SEQ ID NO: 360607

SEQ ID NO: 667851 - RNA, 64 nt, Homo Sapiens; identical to SEQ ID NO: 360608

SEQ ID NO: 667852 - RNA, 64 nt, Homo Sapiens; identical to SEQ ID NO: 360609

SEQ ID NO: 667853 - RNA, 64 nt, Homo Sapiens; identical to SEQ ID NO: 360610

SEQ ID NO: 667854 - RNA, 64 nt, Homo Sapiens; identical to SEQ ID NO: 366291

SEQ ID NO: 667855 - RNA, 64 nt, Homo Sapiens; identical to SEQ ID NO: 366292

SEQ ID NO: 667856 - RNA, 64 nt, Homo Sapiens; identical to SEQ ID NO: 366293

SEQ ID NO: 667857 - RNA, 64 nt, Homo Sapiens; identical to SEQ ID NO: 366294

SEQ ID NO: 667858 - RNA, 64 nt, Homo Sapiens; identical to SEQ ID NO: 366295

SEQ ID NO: 667859 - RNA, 64 nt, Homo Sapiens; identical to SEQ ID NO: 366296

SEQ ID NO: 667860 - RNA, 64 nt, Homo Sapiens; identical to SEQ ID NO: 366297

SEQ ID NO: 667861 - RNA, 64 nt, Homo Sapiens; identical to SEQ ID NO: 366298

SEQ ID NO: 667862 - RNA, 64 nt, Homo Sapiens; identical to SEQ ID NO: 366299

SEQ ID NO: 667863 - RNA, 64 nt, Homo Sapiens; identical to SEQ ID NO: 366300

SEQ ID NO: 667864 - RNA, 64 nt, Homo Sapiens; identical to SEQ ID NO: 366301

SEQ ID NO: 667865 - RNA, 64 nt, Homo Sapiens; identical to SEQ ID NO: 366302

SEQ ID NO: 667866 - RNA, 64 nt, Homo Sapiens; identical to SEQ ID NO: 366303

SEQ ID NO: 667867 - RNA, 64 nt, Homo Sapiens; identical to SEQ ID NO: 366304

SEQ ID NO: 667868 - RNA, 64 nt, Homo Sapiens; identical to SEQ ID NO: 366305

SEQ ID NO: 667869 - RNA, 64 nt, Homo Sapiens; identical to SEQ ID NO: 366306

SEQ ID NO: 667870 - RNA, 64 nt, Homo Sapiens; identical to SEQ ID NO: 366307

SEQ ID NO: 667871 - RNA, 64 nt, Homo Sapiens; identical to SEQ ID NO: 366308

SEQ ID NO: 667872 - RNA, 64 nt, Homo Sapiens; identical to SEQ ID NO: 366309

SEQ ID NO: 667873 - RNA, 64 nt, Homo Sapiens; identical to SEQ ID NO: 366310

SEQ ID NO: 667874 - RNA, 64 nt, Homo Sapiens; identical to SEQ ID NO: 366311

SEQ ID NO: 667875 - RNA, 64 nt, Homo Sapiens; identical to SEQ ID NO: 366312

SEQ ID NO: 667876 - RNA, 64 nt, Homo Sapiens; identical to SEQ ID NO: 366313

SEQ ID NO: 667877 - RNA, 64 nt, Homo Sapiens; identical to SEQ ID NO: 366314

SEQ ID NO: 667878 - RNA, 64 nt, Homo Sapiens; identical to SEQ ID NO: 366315

SEQ ID NO: 667879 - RNA, 64 nt, Homo Sapiens; identical to SEQ ID NO: 366316

SEQ ID NO: 667880 - RNA, 64 nt, Homo Sapiens; identical to SEQ ID NO: 366317

SEQ ID NO: 667881 - RNA, 64 nt, Homo Sapiens; identical to SEQ ID NO: 366318

SEQ ID NO: 667882 - RNA, 64 nt, Homo Sapiens; identical to SEQ ID NO: 366319

SEQ ID NO: 667883 - RNA, 64 nt, Homo Sapiens; identical to SEQ ID NO: 366320

SEQ ID NO: 667884 - RNA, 64 nt, Homo Sapiens; identical to SEQ ID NO: 366321

SEQ ID NO: 667885 - RNA, 64 nt, Homo Sapiens; identical to SEQ ID NO: 366322

SEQ ID NO: 667886 - RNA, 64 nt, Homo Sapiens; identical to SEQ ID NO: 366323

SEQ ID NO: 667887 - RNA, 64 nt, Homo Sapiens; identical to SEQ ID NO: 366324

SEQ ID NO: 667888 - RNA, 64 nt, Homo Sapiens; identical to SEQ ID NO: 366325

SEQ ID NO: 667889 - RNA, 64 nt, Homo Sapiens
gccugggaaucuaagugggagacaauauuaauuuggauccgauuaauuggagauuacuaacugu

SEQ ID NO: 667890 - RNA, 64 nt, Homo Sapiens
augaagcgagucggguccccaacccgugccccugggauccgagggccccucuccaagcgccugg

SEQ ID NO: 667891 - RNA, 64 nt, Homo Sapiens
ggacaucguuuaacaccuaaacucauuuaacaaaggauccgagaagaacagggacaguguggga

SEQ ID NO: 667892 - RNA, 64 nt, Homo Sapiens
aagaggaagaagaaguaggaggagcugugugcccggauccgaggagcaaguuaaucugucccuu

SEQ ID NO: 667893 - RNA, 64 nt, Homo Sapiens
gcuuuggaccuaaauggccuucuggaggggagggggauccgacuagccucuccccagguccagc

SEQ ID NO: 667894 - RNA, 64 nt, Homo Sapiens
ccaugaguuugaggacuacagucuuggugaaccuggauccgaguaguuggaagcauacugaagu

SEQ ID NO: 667895 - RNA, 64 nt, Homo Sapiens
cccacuggugccggagacggaguggagugggccuggauccgagggaugcuaccucucccuuucc

SEQ ID NO: 667896 - RNA, 64 nt, Homo Sapiens
gaacuguacucccccugcccgucuaccuuugcugggauccgaagugaacccuuggccauugaua

SEQ ID NO: 667897 - RNA, 64 nt, Homo Sapiens
gagaagaccauuuccacucaacugcaguuaggagggauccgacaugagccugcuagacugagug

SEQ ID NO: 667898 - RNA, 64 nt, Homo Sapiens
gacuguggcgaccgugccucuugccgccuuucggggauccgaggcacugggaaggacaaagagu

SEQ ID NO: 667899 - RNA, 64 nt, Homo Sapiens
ucugcucugugcuccucaaaauauaauuucaaauggauccgaucuaaaucuauaccuagugcag

SEQ ID NO: 667900 - RNA, 64 nt, Homo Sapiens
uaaaaggauucuuuacugugccagcacggggauuggauccgaagaaacuggcuacugggguuug

SEQ ID NO: 667901 - RNA, 64 nt, Homo Sapiens
ccauccccccucaccaggggcaggcacagcacagggauccgacuugaauuuucccacugcaccc

SEQ ID NO: 667902 - RNA, 64 nt, Homo Sapiens
gcccggcccccuguccuggccaagcugccggccuggauccgagcccguguggaggucaaagcua

SEQ ID NO: 667903 - RNA, 64 nt, Homo Sapiens
auuagcggauuccguuccauuaucaaacccgaguggauccgaauguucucaacuccugaacugc

SEQ ID NO: 667904 - RNA, 64 nt, Homo Sapiens
cgcuagccuggucaguggucagcaaauuggaagaggauccgaugggaguguaaaugugagacac

SEQ ID NO: 667905 - RNA, 64 nt, Homo Sapiens
aaguauagcucccccuucccaugauguuguagcuggauccgacuuuggcgagaaaugacuucca

SEQ ID NO: 667906 - RNA, 64 nt, Homo Sapiens
uugagaggaaggagggucccguucugggcaaagaggauccgagggucagccaccugggaacaca

SEQ ID NO: 667907 - RNA, 64 nt, Homo Sapiens
acucucgccaacagaacagacacgauuuggccauggauccgacuguugucucuagauacagaug

SEQ ID NO: 667908 - RNA, 64 nt, Homo Sapiens
agagaguauccacuuuuuuuggagccauaaacggggauccgagagagccucccaucugggcagu

SEQ ID NO: 667909 - RNA, 64 nt, Homo Sapiens
ccaccucuguuccuaacaaagcgguugugagccuggauccgacucccggcagugcugacccugc

SEQ ID NO: 667910 - RNA, 64 nt, Homo Sapiens
ggcaucuuuucuagagacacauuggaccagaugaggauccgaaacggcagccuuuacguucauc

SEQ ID NO: 667911 - RNA, 64 nt, Homo Sapiens
uccauggugcccccuggucaacauaaggagcgugggauccgauggaaagguggagcucagggaa

SEQ ID NO: 667912 - RNA, 64 nt, Homo Sapiens
gcccuguccgcucugucuuccagggaagccccgcggauccgaaggaccacgaucuacaugcugg

SEQ ID NO: 667913 - RNA, 64 nt, Homo Sapiens
ucucugcugccuugggguuggcagaacacgugaaggauccgaggagcgagaggaauguccauuu

SEQ ID NO: 667914 - RNA, 64 nt, Homo Sapiens
ccgggccgaccgcaccguacuggggaacgucuugggauccgaccggcaggcccucuaggggcac

SEQ ID NO: 667915 - RNA, 64 nt, Homo Sapiens
guguggccaggaaaagacaagcucuucagcuuggggauccgaucuggaagagagauucugaucu

SEQ ID NO: 667916 - RNA, 64 nt, Homo Sapiens
aagcuguuggaugguuugaugaaggggagugacaggauccgauguaccuauuuaagaauuuaag

SEQ ID NO: 667917 - RNA, 64 nt, Homo Sapiens
gcgccccggacagaggucugagccagcaccagcaggauccgaggguggggggacagccgauggg

SEQ ID NO: 667918 - RNA, 64 nt, Homo Sapiens
uuuuggagagauuccuucacaaggagggucgcccggauccgacaggguggcugggcagucaggg

SEQ ID NO: 667919 - RNA, 64 nt, Homo Sapiens
caagcagucucuggugcuuuucuucucucaaaauggauccgauaaauauuugaauagagcagau

SEQ ID NO: 667920 - RNA, 64 nt, Homo Sapiens
uucaaaaaugauuucacugcagcuugagcagggaggauccgaagaacuuuugauucucuuuugu

SEQ ID NO: 667921 - RNA, 64 nt, Homo Sapiens
aggagcagcugggacccagaacugagccugggagggauccgacagaaaagcucagggcgggucu

SEQ ID NO: 667922 - RNA, 64 nt, Homo Sapiens
uggcgucaaguucagcuccacgugugccaucaguggauccgauccguccagccauggcuuccua

SEQ ID NO: 667923 - RNA, 64 nt, Homo Sapiens
ugcaaugauagucacuucuaagaucaaugacauaggauccgaaggggaaccagagagaaucaac

SEQ ID NO: 667924 - RNA, 64 nt, Homo Sapiens
agauucccuagggcuuguuguccaagagcaagcuggauccgaguaggcugggcaccacaguguu

SEQ ID NO: 667925 - RNA, 64 nt, Homo Sapiens; identical to SEQ ID NO: 360473

SEQ ID NO: 667926 - RNA, 64 nt, Homo Sapiens; identical to SEQ ID NO: 360474

SEQ ID NO: 667927 - RNA, 64 nt, Homo Sapiens; identical to SEQ ID NO: 360475

SEQ ID NO: 667928 - RNA, 64 nt, Homo Sapiens; identical to SEQ ID NO: 360476

SEQ ID NO: 667929 - RNA, 64 nt, Homo Sapiens; identical to SEQ ID NO: 360477

SEQ ID NO: 667930 - RNA, 64 nt, Homo Sapiens; identical to SEQ ID NO: 360478

SEQ ID NO: 667931 - RNA, 64 nt, Homo Sapiens; identical to SEQ ID NO: 360479

SEQ ID NO: 667932 - RNA, 64 nt, Homo Sapiens; identical to SEQ ID NO: 360480

SEQ ID NO: 667933 - RNA, 64 nt, Homo Sapiens; identical to SEQ ID NO: 360481

SEQ ID NO: 667934 - RNA, 64 nt, Homo Sapiens; identical to SEQ ID NO: 360482

SEQ ID NO: 667935 - RNA, 64 nt, Homo Sapiens; identical to SEQ ID NO: 360483

SEQ ID NO: 667936 - RNA, 64 nt, Homo Sapiens; identical to SEQ ID NO: 360484

SEQ ID NO: 667937 - RNA, 64 nt, Homo Sapiens
gguggacugaguggugcgagguggagggcuaacaagaggaaagaacuacauucuucagaauaca

SEQ ID NO: 667938 - RNA, 64 nt, Homo Sapiens
acccauuuagaaaauaacuacaaaguaaaaauguagaggaaauagaaauguauuuuuucaugaa

SEQ ID NO: 667939 - RNA, 64 nt, Homo Sapiens
ugucauaauuuuuuucccuguuucaaauguguucagaggaaauagaauguaaaacaucacaaaa

SEQ ID NO: 667940 - RNA, 64 nt, Homo Sapiens
guuagugauauuuggaaauaccuggauauuugcuagaggaaaaaugaaagcaaaacuucguaca

SEQ ID NO: 667941 - RNA, 64 nt, Homo Sapiens
accucuuucauuuuuuagugucaaggagagauaaagaggaaagccuuuugaaaagacagacucc

SEQ ID NO: 667942 - RNA, 64 nt, Homo Sapiens
aaugguccagcagucguuccccacuuuuucuaacagaggaaacauuccccggcuccacccuagg

SEQ ID NO: 667943 - RNA, 64 nt, Homo Sapiens
cagaagccugaauaaucuaugacagcuaucaggaagaggaaauaguagugaaaugaugcggaaa

SEQ ID NO: 667944 - RNA, 64 nt, Homo Sapiens
agauaaaacuaugccaguuuuauauauuuugucaagaggaaagaaugaaaggacguuuaaagua

SEQ ID NO: 667945 - RNA, 64 nt, Homo Sapiens
auaaaaucauccuagaagacaucacauuuggagaagaggaaaucuaucacauauuuaagcaaac

SEQ ID NO: 667946 - RNA, 64 nt, Homo Sapiens
aaaaaagauaauuuuuaggaacacaugcuccaaaagaggaaagaaaauacuccucccaccacac

SEQ ID NO: 667947 - RNA, 64 nt, Homo Sapiens
ucuguucuauuuuagugauagucacaugauccuaagaggaaaguucugcacaaaauucugaaga

SEQ ID NO: 667948 - RNA, 64 nt, Homo Sapiens
uaccuuuguaaaccugcagaacauuuuacuuaaaagaggaaacacaagaucuucaaugaacguc

SEQ ID NO: 667949 - RNA, 64 nt, Homo Sapiens
ugacuugcaaauauguuuguacuccagaagaauuagaggaaaagcagauacuagaauucuaauu

SEQ ID NO: 667950 - RNA, 64 nt, Homo Sapiens
aggaaauucuauagaaaucuaggaaaggugggagagaggaaaaaauaguaacaauaccuugcag

SEQ ID NO: 667951 - RNA, 64 nt, Homo Sapiens
ugggagagaggaaaaaaggauaacaauaccuugcagaggaaaggaaaucaguaacaaaaaauag

SEQ ID NO: 667952 - RNA, 64 nt, Homo Sapiens
cugacuuucuagcuuugcauaggaucaaaacaacagaggaaauguggcuuuggguuguauaagg

SEQ ID NO: 667953 - RNA, 64 nt, Homo Sapiens
cucagcaaaggccugagccagaggagcagacggcagaggaaaucugguggucaacgggagggag

SEQ ID NO: 667954 - RNA, 64 nt, Homo Sapiens
gggggaauggguugcaaaauauuugagaggaaagagaggaaaaucaccauauguauuuucuagg

SEQ ID NO: 667955 - RNA, 64 nt, Homo Sapiens
gaggaaaaugggggaauggguuuucuaggauuugagaggaaagauagcuuccccaccauaugua

SEQ ID NO: 667956 - RNA, 64 nt, Homo Sapiens
cauacauuuccaaaauaaaaugugauuccuuugaagaggaaaaugaauaauacauugaauuaga

SEQ ID NO: 667957 - RNA, 64 nt, Homo Sapiens
gagauggccugagaagagagaucaaauggaaaggagaggaaagaacucagugcugccuauuagu

SEQ ID NO: 667958 - RNA, 64 nt, Homo Sapiens
aggaacccaccaaaccaaccccuagcguuuuggaagaggaaaaccaagagucaaugguacuugu

SEQ ID NO: 667959 - RNA, 64 nt, Homo Sapiens
cugucacuccucaugccuguuaccgucuccuugaagaggaaacuguguaugucaacagaaggga

SEQ ID NO: 667960 - RNA, 64 nt, Homo Sapiens
aaaaaaguaguuuuuaauacauugguuaggacucagaggaaauacggaaaaaacauuguagaug

SEQ ID NO: 667961 - RNA, 64 nt, Homo Sapiens
aauuuucagaaaugaauuaucuguacauaugaauagaggaaaauacugagugcuaauguuacag

SEQ ID NO: 667962 - RNA, 64 nt, Homo Sapiens
gaagcaggccuguuacuuguaugucgcuuuggacagaggaaagugggguaaaaugcuaccugua

SEQ ID NO: 667963 - RNA, 64 nt, Homo Sapiens
uuuuuucuccuuuucuuuguccucaaccauacuuagaggaaagaaggaauggucuuccaugaac

SEQ ID NO: 667964 - RNA, 64 nt, Homo Sapiens
uuauaaaauauaaaauuucucuuucucauauuucagaggaaagauaacucaggagauuccaugu

SEQ ID NO: 667965 - RNA, 64 nt, Homo Sapiens
cauaaaaugaaagaugaaaaaaauuacaugguugagaggaaauguaucaacauuccuuaacagg

SEQ ID NO: 667966 - RNA, 64 nt, Homo Sapiens
gaccaccuuucuucaauuuagguuaugauucaguagaggaaaaauuugaggggcacucuaccuu

SEQ ID NO: 667967 - RNA, 64 nt, Homo Sapiens
gcaacaacagcaacaacacguuugaauguguagaagaggaaaaagguuuguacaagaaaguuug

SEQ ID NO: 667968 - RNA, 64 nt, Homo Sapiens
gaacacugccuuacagucaccucauaggaaugcuagaggaaagacuuguccauucgggguucuu

SEQ ID NO: 667969 - RNA, 64 nt, Homo Sapiens
gcacaguuccacaaucucuugaagaagaaagcucagaggaaaugccacuaucaagguuuagugu

SEQ ID NO: 667970 - RNA, 64 nt, Homo Sapiens
uuuauaggaauuugcuuccuaagucuacuuuugaagaggaaaacaggaacguaccauauauuuu

SEQ ID NO: 667971 - RNA, 64 nt, Homo Sapiens
ucuuuauacuaaaaauauaggcucuugggauuggagaggaaaaauuagaggugauuuucagauu

SEQ ID NO: 667972 - RNA, 64 nt, Homo Sapiens
cuucuaacaucgcuuccaguaagggagaaacugaagaggaaagacugucuugccagaaauggcc

SEQ ID NO: 667973 - RNA, 64 nt, Homo Sapiens
ccccuuuccccacuccccucuaguggugaacuuuagaggaaaaggaaguaauugcacaaggagu

SEQ ID NO: 667974 - RNA, 64 nt, Homo Sapiens
gcagagaacuggcuggaugagaagcaucuuaagaagaggaaacacaauagggaaaagaggggaa

SEQ ID NO: 667975 - RNA, 64 nt, Homo Sapiens
acagcacaguguggugggugacagagaaacauaaagaggaaauucugaaagagcucuugggaag

SEQ ID NO: 667976 - RNA, 64 nt, Homo Sapiens
ccugccaaaggaaguauguauugucuauuaaagcagaggaaauaguuaacaugucuuucuaaaa

SEQ ID NO: 667977 - RNA, 64 nt, Homo Sapiens
gguuuguaacaauacugcaaauuagcuauuugugagaggaaacuuuugagucauggucuuagau

SEQ ID NO: 667978 - RNA, 64 nt, Homo Sapiens
aguuuaaaaugccugcuaauuccugcguauguuaagaggaaauccaggaagaaaauguuuucuc

SEQ ID NO: 667979 - RNA, 64 nt, Homo Sapiens
cuuggggaggaagaggccugcuuuuuugaaauggagaggaaaaagaugugaagauaaaauagug

SEQ ID NO: 667980 - RNA, 64 nt, Homo Sapiens
caaggguggauaaacaaaaucaaacucagagcccagaggaaaugacuggagggucuugcuuuuu

SEQ ID NO: 667981 - RNA, 64 nt, Homo Sapiens
gaggauggaaaaccuuuuaugaaagaagacuccaagaggaaaacaauucaugcagauauggaug

SEQ ID NO: 667982 - RNA, 64 nt, Homo Sapiens
gaaauaauuucgguacaucuacacagaggaaaguagaggaaaauccauaaaguaaacuaaaaug

SEQ ID NO: 667983 - RNA, 64 nt, Homo Sapiens
agaggaaaaugaaauaauuuaacuaaaaugacacagaggaaagucauauaaauaccauaaagua

SEQ ID NO: 667984 - RNA, 64 nt, Homo Sapiens
uuuucaaugagaaaaaugugacaccaagauucugagaggaaacaauccuccuuuauguaaaacc

SEQ ID NO: 667985 - RNA, 64 nt, Homo Sapiens
uuagaagcaggggaaauacaauagagaggaguuuagaggaaagucuaaggagagagaaggcuaa

SEQ ID NO: 667986 - RNA, 64 nt, Homo Sapiens
ccaaaccuuuaguguuggugguaggaggauggggagaggaaaaaagagcuggcaaagaaaugga

SEQ ID NO: 667987 - RNA, 64 nt, Homo Sapiens
augugugcaaaacugcagaagcucacugccuauaagaggaaauaagagagaaaguggaggagag

SEQ ID NO: 667988 - RNA, 64 nt, Homo Sapiens
augugugccuuuguuucccaucagacugucaagaagaggaaagggaggaaaccuagcagaggaa

SEQ ID NO: 667989 - RNA, 64 nt, Homo Sapiens
gacugucaagaagaggaaagggaggaaaccuagcagaggaaaguguaauuuugguuuaugacuc

SEQ ID NO: 667990 - RNA, 64 nt, Homo Sapiens
uccagugugacagagugcaagcugcagcuggaucagaggaaaaagagugaacuucuuaugggag

SEQ ID NO: 667991 - RNA, 64 nt, Homo Sapiens
ucuugccaggauaccuacccacguuuacuauuucagaggaaauaagacaguaacuucuaagguc

SEQ ID NO: 667992 - RNA, 64 nt, Homo Sapiens
cccuuacuaaaaaaaguguguauuaggaggagagagaggaaaaaaagaggaaagaaggaaaaaa

SEQ ID NO: 667993 - RNA, 64 nt, Homo Sapiens
aaaaguguguauuaggaggagagagaggaaaaaaagaggaaagaaggaaaaaaaaaagaauuaa

SEQ ID NO: 667994 - RNA, 64 nt, Homo Sapiens
uuguuuauuuuuuugauaaugacuggacaucagaagaggaaaaaaacucaaaacaaaagcgaga

SEQ ID NO: 667995 - RNA, 64 nt, Homo Sapiens
guuccuguccauucacccagccaaauuguguuaaagaggaaagccccacaaacuaaaacagccu

SEQ ID NO: 667996 - RNA, 64 nt, Homo Sapiens
gguuuauauucugguugucuuuuucuuuuuguaaagaggaaacaauguacagaaaaacaauaaa

SEQ ID NO: 667997 - RNA, 64 nt, Homo Sapiens
cuaugauaggauuuccuaaaucccaguuuuauauagaggaaacaggacuuaauucuuguuuuuu

SEQ ID NO: 667998 - RNA, 64 nt, Homo Sapiens
cugucuaugauaggauuuccucccaguuuuauauagaggaaacaaggacuuacuucuuguuuuu

SEQ ID NO: 667999 - RNA, 64 nt, Homo Sapiens
aguauaaguaucucauucagugacuaauuacuuaagaggaaaacagcaaacucuauaauuauuu

SEQ ID NO: 668000 - RNA, 64 nt, Homo Sapiens
auaaaguaauuacacauguauuauacuaugccagagaggaaacugcccaugauauguauuuuac

SEQ ID NO: 668001 - RNA, 64 nt, Homo Sapiens
augguuccuuucuuaaagaaauuggcugcgcuggagaggaaagcuggaaacaggccuucagccc

SEQ ID NO: 668002 - RNA, 64 nt, Homo Sapiens
aaaaacaaguauuaaaggcauguuuagugaauacagaggaaaggccuuacaaaaaaaaaaaaau

SEQ ID NO: 668003 - RNA, 64 nt, Homo Sapiens
auguccggguccuuuaucauccuauucauccuggagaggaaaagugucgggcaaagggggaucu

SEQ ID NO: 668004 - RNA, 64 nt, Homo Sapiens
uucacccacccucagcuucccuuuuccuaaauuaagaggaaaaguggucaaagaaaaacucuuc

SEQ ID NO: 668005 - RNA, 64 nt, Homo Sapiens
auuuuggcaguagcuguaugggagaaaaagaguaagaggaaauauucccacagccaugaagggu

SEQ ID NO: 668006 - RNA, 64 nt, Homo Sapiens
ccucagguuugauaucuggcagguuugacuauccagaggaaauuaaauauuuuuauauaaaauu

SEQ ID NO: 668007 - RNA, 64 nt, Homo Sapiens
cuuucugccuuuuuauaauuaaauuuucaagagcagaggaaaguacuaauacuguggggaaaaa

SEQ ID NO: 668008 - RNA, 64 nt, Homo Sapiens
augauaagaggaggaagacaaaguggucuucuguagaggaaagccaggaccccaaaugaaaucc

SEQ ID NO: 668009 - RNA, 64 nt, Homo Sapiens
uugaauccuaaaggggauccccaaaacugcccaaagaggaaagagaucccugggggacucaaag

SEQ ID NO: 668010 - RNA, 64 nt, Homo Sapiens
gcagugauuccacgguuaggcaagucgggaucucagaggaaauucaaucccuguccugguuguc

SEQ ID NO: 668011 - RNA, 64 nt, Homo Sapiens
uguaggaauuuauuuuuucuuaggcagucccccuagaggaaaaaugcuuggcugccugucuuuc

SEQ ID NO: 668012 - RNA, 64 nt, Homo Sapiens
agggaggggagaagcccagcauggggugggggagagaggaaaggaacacauuuugauucugauc

SEQ ID NO: 668013 - RNA, 64 nt, Homo Sapiens
guuguucucccacuggaaggucacaggggaagggagaggaaagaauuccuuccucccccucauc

SEQ ID NO: 668014 - RNA, 64 nt, Homo Sapiens
augacauacgcuuuuaaugaaaaggaaucacguuagaggaaaaauauuuauucauuauuuguca

SEQ ID NO: 668015 - RNA, 64 nt, Homo Sapiens
uugucucuucaucuaauaugauagcgggaaaaggagaggaaacuacugccuuuagaaaauauaa

SEQ ID NO: 668016 - RNA, 64 nt, Homo Sapiens
cacccaaggaacauuugaucuagcagcagggaugagaggaaagcagaaaugaaugaacugugaa

SEQ ID NO: 668017 - RNA, 64 nt, Homo Sapiens
cacccccgugucacccuaggccugauaagcgaucagaggaaaggacucauucaugucacgcuuc

SEQ ID NO: 668018 - RNA, 64 nt, Homo Sapiens
aacacccugccuacaaggagauguuuugaaauggagaggaaaauuggcaccucaucuuuuaaag

SEQ ID NO: 668019 - RNA, 64 nt, Homo Sapiens
ugucucccuccaaggccccagcaggagaacagacagaggaaauggggcuuuuuaccaccacugu

SEQ ID NO: 668020 - RNA, 64 nt, Homo Sapiens
gugaguugcucaugcugauuacuuccaccaucuaagaggaaaagccugaauaucuucucugcuc

SEQ ID NO: 668021 - RNA, 64 nt, Homo Sapiens
ggguuuauaagaaaauggagagagcugcaccuaaagaggaaauuaaagguuccuuucaaauagu

SEQ ID NO: 668022 - RNA, 64 nt, Homo Sapiens
gacuggcauuuauggugaaaagccaguucauuuaagaggaaaugaccuuaugaccuugagggaa

SEQ ID NO: 668023 - RNA, 64 nt, Homo Sapiens
uuaauaauuuuaugaaauggcaaagguuuagccaagaggaaauuuuggcaugaauacaggcuug

SEQ ID NO: 668024 - RNA, 64 nt, Homo Sapiens
uaauaaucuguaccuugugguauuugguacuauuagaggaaaaacuuuggauucagaccuucuu

SEQ ID NO: 668025 - RNA, 64 nt, Homo Sapiens
acugcagaaggaacugguuucccaagacacucccagaggaaaacgugacaccgcuguggcuuag

SEQ ID NO: 668026 - RNA, 64 nt, Homo Sapiens
aaaaauguacaaaaagauuuaaaggccaaaaaaaagaggaaaaggaccacagaaaagagaaagg

SEQ ID NO: 668027 - RNA, 64 nt, Homo Sapiens
uaugcucucugcucacugguuuucaauaccaccaagaggaaaauauugacaaguuuaaaggcug

SEQ ID NO: 668028 - RNA, 64 nt, Homo Sapiens
uugcugugacuuaugugcagcuuuccaguugagcagaggaaaauaguggcaggacuguccccca

SEQ ID NO: 668029 - RNA, 64 nt, Homo Sapiens
ucccaaagagcuaaacaauuccuuacauuuaccaagaggaaagcuuuuacuguguugaagcuaa

SEQ ID NO: 668030 - RNA, 64 nt, Homo Sapiens
auaggcagacugugucuagagucaugcauggacaagaggaaagugaaaguugaauacucucuuc

SEQ ID NO: 668031 - RNA, 64 nt, Homo Sapiens; identical to SEQ ID NO: 438956

SEQ ID NO: 668032 - RNA, 64 nt, Homo Sapiens; identical to SEQ ID NO: 438957

SEQ ID NO: 668033 - RNA, 64 nt, Homo Sapiens; identical to SEQ ID NO: 438958

SEQ ID NO: 668034 - RNA, 64 nt, Homo Sapiens; identical to SEQ ID NO: 438959

SEQ ID NO: 668035 - RNA, 64 nt, Homo Sapiens; identical to SEQ ID NO: 438960

SEQ ID NO: 668036 - RNA, 64 nt, Homo Sapiens; identical to SEQ ID NO: 438961

SEQ ID NO: 668037 - RNA, 64 nt, Homo Sapiens; identical to SEQ ID NO: 438962

SEQ ID NO: 668038 - RNA, 64 nt, Homo Sapiens; identical to SEQ ID NO: 438963

SEQ ID NO: 668039 - RNA, 64 nt, Homo Sapiens; identical to SEQ ID NO: 438964

SEQ ID NO: 668040 - RNA, 64 nt, Homo Sapiens; identical to SEQ ID NO: 438965

SEQ ID NO: 668041 - RNA, 64 nt, Homo Sapiens; identical to SEQ ID NO: 438966

SEQ ID NO: 668042 - RNA, 64 nt, Homo Sapiens; identical to SEQ ID NO: 438967

SEQ ID NO: 668043 - RNA, 64 nt, Homo Sapiens; identical to SEQ ID NO: 438968

SEQ ID NO: 668044 - RNA, 64 nt, Homo Sapiens; identical to SEQ ID NO: 438969

SEQ ID NO: 668045 - RNA, 64 nt, Homo Sapiens; identical to SEQ ID NO: 438970

SEQ ID NO: 668046 - RNA, 64 nt, Homo Sapiens; identical to SEQ ID NO: 438971

SEQ ID NO: 668047 - RNA, 64 nt, Homo Sapiens; identical to SEQ ID NO: 248368

SEQ ID NO: 668048 - RNA, 64 nt, Homo Sapiens; identical to SEQ ID NO: 248369

SEQ ID NO: 668049 - RNA, 64 nt, Homo Sapiens; identical to SEQ ID NO: 248370

SEQ ID NO: 668050 - RNA, 64 nt, Homo Sapiens; identical to SEQ ID NO: 248371

SEQ ID NO: 668051 - RNA, 64 nt, Homo Sapiens; identical to SEQ ID NO: 248372

SEQ ID NO: 668052 - RNA, 64 nt, Homo Sapiens; identical to SEQ ID NO: 248373

SEQ ID NO: 668053 - RNA, 64 nt, Homo Sapiens; identical to SEQ ID NO: 248374

SEQ ID NO: 668054 - RNA, 64 nt, Homo Sapiens; identical to SEQ ID NO: 248375

SEQ ID NO: 668055 - RNA, 64 nt, Homo Sapiens; identical to SEQ ID NO: 248376

SEQ ID NO: 668056 - RNA, 64 nt, Homo Sapiens; identical to SEQ ID NO: 248377

SEQ ID NO: 668057 - RNA, 64 nt, Homo Sapiens
uuguacuaauuguacaaaggaauuguacucuaaaagacacuaaagaagcuuuuaaaagacacua

SEQ ID NO: 668058 - RNA, 64 nt, Homo Sapiens
uuguacucuaaaagacacuaaggaagcuuuuaaaagacacuaaaugaaaauguuuuaaauauuu

SEQ ID NO: 668059 - RNA, 64 nt, Homo Sapiens
ucgggggcggggcgguagguccgaaagaaaccgcagacacuacgaugcacuccucaagcugucu

SEQ ID NO: 668060 - RNA, 64 nt, Homo Sapiens
agcucucugcgucccuccugggcccuccagcgucagacacuaaugggaguucccgagaugcucg

SEQ ID NO: 668061 - RNA, 64 nt, Homo Sapiens
aguauauguuuguaauguuacuccuuguacugggagacacuaguuuuuuugagucaagagacug

SEQ ID NO: 668062 - RNA, 64 nt, Homo Sapiens
uugaaaaucagauuuauauguuaucaguguauuuagacacuaucugauaaccaaucacauaguu

SEQ ID NO: 668063 - RNA, 64 nt, Homo Sapiens
ugaucugauugagauguacaaauagccuauuuaaagacacuacguguaauacagacggcaaugc

SEQ ID NO: 668064 - RNA, 64 nt, Homo Sapiens
uauuuguuacauuuuguacucaugggagacagguagacacuacuaaauccuguauauguaucua

SEQ ID NO: 668065 - RNA, 64 nt, Homo Sapiens; identical to SEQ ID NO: 44393

SEQ ID NO: 668066 - RNA, 64 nt, Homo Sapiens; identical to SEQ ID NO: 44394

SEQ ID NO: 668067 - RNA, 64 nt, Homo Sapiens; identical to SEQ ID NO: 44395

SEQ ID NO: 668068 - RNA, 64 nt, Homo Sapiens; identical to SEQ ID NO: 44396

SEQ ID NO: 668069 - RNA, 64 nt, Homo Sapiens; identical to SEQ ID NO: 44397

SEQ ID NO: 668070 - RNA, 64 nt, Homo Sapiens; identical to SEQ ID NO: 44398

SEQ ID NO: 668071 - RNA, 64 nt, Homo Sapiens; identical to SEQ ID NO: 265889

SEQ ID NO: 668072 - RNA, 64 nt, Homo Sapiens; identical to SEQ ID NO: 265890

SEQ ID NO: 668073 - RNA, 64 nt, Homo Sapiens; identical to SEQ ID NO: 265891

SEQ ID NO: 668074 - RNA, 64 nt, Homo Sapiens; identical to SEQ ID NO: 265892

SEQ ID NO: 668075 - RNA, 64 nt, Homo Sapiens; identical to SEQ ID NO: 265893

SEQ ID NO: 668076 - RNA, 64 nt, Homo Sapiens; identical to SEQ ID NO: 265894

SEQ ID NO: 668077 - RNA, 64 nt, Homo Sapiens; identical to SEQ ID NO: 265895

SEQ ID NO: 668078 - RNA, 64 nt, Homo Sapiens; identical to SEQ ID NO: 265896

SEQ ID NO: 668079 - RNA, 64 nt, Homo Sapiens; identical to SEQ ID NO: 265897

SEQ ID NO: 668080 - RNA, 64 nt, Homo Sapiens; identical to SEQ ID NO: 265898

SEQ ID NO: 668081 - RNA, 64 nt, Homo Sapiens; identical to SEQ ID NO: 265899

SEQ ID NO: 668082 - RNA, 64 nt, Homo Sapiens; identical to SEQ ID NO: 265900

SEQ ID NO: 668083 - RNA, 64 nt, Homo Sapiens; identical to SEQ ID NO: 265901

SEQ ID NO: 668084 - RNA, 64 nt, Homo Sapiens; identical to SEQ ID NO: 265902

SEQ ID NO: 668085 - RNA, 64 nt, Homo Sapiens; identical to SEQ ID NO: 265903

SEQ ID NO: 668086 - RNA, 64 nt, Homo Sapiens; identical to SEQ ID NO: 265904

SEQ ID NO: 668087 - RNA, 64 nt, Homo Sapiens; identical to SEQ ID NO: 265905

SEQ ID NO: 668088 - RNA, 64 nt, Homo Sapiens; identical to SEQ ID NO: 265906

SEQ ID NO: 668089 - RNA, 64 nt, Homo Sapiens; identical to SEQ ID NO: 76596

SEQ ID NO: 668090 - RNA, 64 nt, Homo Sapiens; identical to SEQ ID NO: 76597

SEQ ID NO: 668091 - RNA, 64 nt, Homo Sapiens; identical to SEQ ID NO: 76598

SEQ ID NO: 668092 - RNA, 64 nt, Homo Sapiens; identical to SEQ ID NO: 76599

SEQ ID NO: 668093 - RNA, 64 nt, Homo Sapiens; identical to SEQ ID NO: 76600

SEQ ID NO: 668094 - RNA, 64 nt, Homo Sapiens; identical to SEQ ID NO: 76601

SEQ ID NO: 668095 - RNA, 64 nt, Homo Sapiens; identical to SEQ ID NO: 76602

SEQ ID NO: 668096 - RNA, 64 nt, Homo Sapiens; identical to SEQ ID NO: 76603

SEQ ID NO: 668097 - RNA, 64 nt, Homo Sapiens; identical to SEQ ID NO: 76604

SEQ ID NO: 668098 - RNA, 64 nt, Homo Sapiens; identical to SEQ ID NO: 76605

SEQ ID NO: 668099 - RNA, 64 nt, Homo Sapiens; identical to SEQ ID NO: 76606

SEQ ID NO: 668100 - RNA, 64 nt, Homo Sapiens; identical to SEQ ID NO: 76607

SEQ ID NO: 668101 - RNA, 64 nt, Homo Sapiens; identical to SEQ ID NO: 76608

SEQ ID NO: 668102 - RNA, 64 nt, Homo Sapiens; identical to SEQ ID NO: 76609

SEQ ID NO: 668103 - RNA, 64 nt, Homo Sapiens; identical to SEQ ID NO: 76610

SEQ ID NO: 668104 - RNA, 64 nt, Homo Sapiens; identical to SEQ ID NO: 76611

SEQ ID NO: 668105 - RNA, 64 nt, Homo Sapiens; identical to SEQ ID NO: 76612

SEQ ID NO: 668106 - RNA, 64 nt, Homo Sapiens; identical to SEQ ID NO: 76613

SEQ ID NO: 668107 - RNA, 64 nt, Homo Sapiens; identical to SEQ ID NO: 76614

SEQ ID NO: 668108 - RNA, 64 nt, Homo Sapiens; identical to SEQ ID NO: 76615

SEQ ID NO: 668109 - RNA, 64 nt, Homo Sapiens; identical to SEQ ID NO: 76616

SEQ ID NO: 668110 - RNA, 64 nt, Homo Sapiens; identical to SEQ ID NO: 76617

SEQ ID NO: 668111 - RNA, 64 nt, Homo Sapiens; identical to SEQ ID NO: 76618

SEQ ID NO: 668112 - RNA, 64 nt, Homo Sapiens; identical to SEQ ID NO: 76619

SEQ ID NO: 668113 - RNA, 64 nt, Homo Sapiens; identical to SEQ ID NO: 76620

SEQ ID NO: 668114 - RNA, 50 nt, Homo Sapiens; identical to SEQ ID NO: 76621

SEQ ID NO: 668115 - RNA, 64 nt, Homo Sapiens; identical to SEQ ID NO: 76622

SEQ ID NO: 668116 - RNA, 64 nt, Homo Sapiens; identical to SEQ ID NO: 76623

SEQ ID NO: 668117 - RNA, 64 nt, Homo Sapiens; identical to SEQ ID NO: 76624

SEQ ID NO: 668118 - RNA, 64 nt, Homo Sapiens; identical to SEQ ID NO: 76625

SEQ ID NO: 668119 - RNA, 64 nt, Homo Sapiens; identical to SEQ ID NO: 76626

SEQ ID NO: 668120 - RNA, 64 nt, Homo Sapiens; identical to SEQ ID NO: 76627

SEQ ID NO: 668121 - RNA, 64 nt, Homo Sapiens; identical to SEQ ID NO: 76628

SEQ ID NO: 668122 - RNA, 64 nt, Homo Sapiens; identical to SEQ ID NO: 76629

SEQ ID NO: 668123 - RNA, 64 nt, Homo Sapiens; identical to SEQ ID NO: 76630

SEQ ID NO: 668124 - RNA, 64 nt, Homo Sapiens; identical to SEQ ID NO: 76631

SEQ ID NO: 668125 - RNA, 64 nt, Homo Sapiens; identical to SEQ ID NO: 76632

SEQ ID NO: 668126 - RNA, 64 nt, Homo Sapiens; identical to SEQ ID NO: 76633

SEQ ID NO: 668127 - RNA, 64 nt, Homo Sapiens; identical to SEQ ID NO: 76634

SEQ ID NO: 668128 - RNA, 64 nt, Homo Sapiens; identical to SEQ ID NO: 76635

SEQ ID NO: 668129 - RNA, 64 nt, Homo Sapiens; identical to SEQ ID NO: 76636

SEQ ID NO: 668130 - RNA, 64 nt, Homo Sapiens; identical to SEQ ID NO: 76637

SEQ ID NO: 668131 - RNA, 64 nt, Homo Sapiens; identical to SEQ ID NO: 76638

SEQ ID NO: 668132 - RNA, 64 nt, Homo Sapiens; identical to SEQ ID NO: 76639

SEQ ID NO: 668133 - RNA, 64 nt, Homo Sapiens; identical to SEQ ID NO: 76640

SEQ ID NO: 668134 - RNA, 64 nt, Homo Sapiens; identical to SEQ ID NO: 76641

SEQ ID NO: 668135 - RNA, 64 nt, Homo Sapiens; identical to SEQ ID NO: 76642

SEQ ID NO: 668136 - RNA, 64 nt, Homo Sapiens; identical to SEQ ID NO: 76643

SEQ ID NO: 668137 - RNA, 64 nt, Homo Sapiens; identical to SEQ ID NO: 76644

SEQ ID NO: 668138 - RNA, 64 nt, Homo Sapiens; identical to SEQ ID NO: 76645

SEQ ID NO: 668139 - RNA, 64 nt, Homo Sapiens; identical to SEQ ID NO: 76646

SEQ ID NO: 668140 - RNA, 64 nt, Homo Sapiens; identical to SEQ ID NO: 76647

SEQ ID NO: 668141 - RNA, 64 nt, Homo Sapiens; identical to SEQ ID NO: 76648

SEQ ID NO: 668142 - RNA, 64 nt, Homo Sapiens; identical to SEQ ID NO: 76649

SEQ ID NO: 668143 - RNA, 64 nt, Homo Sapiens; identical to SEQ ID NO: 76650

SEQ ID NO: 668144 - RNA, 64 nt, Homo Sapiens; identical to SEQ ID NO: 76651

SEQ ID NO: 668145 - RNA, 64 nt, Homo Sapiens; identical to SEQ ID NO: 76652

SEQ ID NO: 668146 - RNA, 64 nt, Homo Sapiens; identical to SEQ ID NO: 76653

SEQ ID NO: 668147 - RNA, 64 nt, Homo Sapiens; identical to SEQ ID NO: 76654

SEQ ID NO: 668148 - RNA, 64 nt, Homo Sapiens; identical to SEQ ID NO: 76655

SEQ ID NO: 668149 - RNA, 64 nt, Homo Sapiens; identical to SEQ ID NO: 76656

SEQ ID NO: 668150 - RNA, 64 nt, Homo Sapiens; identical to SEQ ID NO: 76657

SEQ ID NO: 668151 - RNA, 64 nt, Homo Sapiens; identical to SEQ ID NO: 76658

SEQ ID NO: 668152 - RNA, 64 nt, Homo Sapiens; identical to SEQ ID NO: 76659

SEQ ID NO: 668153 - RNA, 64 nt, Homo Sapiens; identical to SEQ ID NO: 76660

SEQ ID NO: 668154 - RNA, 64 nt, Homo Sapiens; identical to SEQ ID NO: 76661

SEQ ID NO: 668155 - RNA, 64 nt, Homo Sapiens; identical to SEQ ID NO: 76662

SEQ ID NO: 668156 - RNA, 64 nt, Homo Sapiens; identical to SEQ ID NO: 76663

SEQ ID NO: 668157 - RNA, 64 nt, Homo Sapiens; identical to SEQ ID NO: 76664

SEQ ID NO: 668158 - RNA, 64 nt, Homo Sapiens; identical to SEQ ID NO: 76665

SEQ ID NO: 668159 - RNA, 64 nt, Homo Sapiens; identical to SEQ ID NO: 76666

SEQ ID NO: 668160 - RNA, 64 nt, Homo Sapiens; identical to SEQ ID NO: 76667

SEQ ID NO: 668161 - RNA, 64 nt, Homo Sapiens; identical to SEQ ID NO: 76668

SEQ ID NO: 668162 - RNA, 64 nt, Homo Sapiens; identical to SEQ ID NO: 76669

SEQ ID NO: 668163 - RNA, 64 nt, Homo Sapiens; identical to SEQ ID NO: 76670

SEQ ID NO: 668164 - RNA, 64 nt, Homo Sapiens; identical to SEQ ID NO: 76671

SEQ ID NO: 668165 - RNA, 64 nt, Homo Sapiens; identical to SEQ ID NO: 76672

SEQ ID NO: 668166 - RNA, 64 nt, Homo Sapiens; identical to SEQ ID NO: 76673

SEQ ID NO: 668167 - RNA, 64 nt, Homo Sapiens; identical to SEQ ID NO: 76674

SEQ ID NO: 668168 - RNA, 64 nt, Homo Sapiens; identical to SEQ ID NO: 76675

SEQ ID NO: 668169 - RNA, 64 nt, Homo Sapiens; identical to SEQ ID NO: 76676

SEQ ID NO: 668170 - RNA, 64 nt, Homo Sapiens; identical to SEQ ID NO: 76677

SEQ ID NO: 668171 - RNA, 64 nt, Homo Sapiens; identical to SEQ ID NO: 76678

SEQ ID NO: 668172 - RNA, 64 nt, Homo Sapiens; identical to SEQ ID NO: 76679

SEQ ID NO: 668173 - RNA, 64 nt, Homo Sapiens; identical to SEQ ID NO: 76680

SEQ ID NO: 668174 - RNA, 64 nt, Homo Sapiens; identical to SEQ ID NO: 76681

SEQ ID NO: 668175 - RNA, 64 nt, Homo Sapiens; identical to SEQ ID NO: 76682

SEQ ID NO: 668176 - RNA, 64 nt, Homo Sapiens; identical to SEQ ID NO: 76683

SEQ ID NO: 668177 - RNA, 64 nt, Homo Sapiens; identical to SEQ ID NO: 76684

SEQ ID NO: 668178 - RNA, 64 nt, Homo Sapiens; identical to SEQ ID NO: 76685

SEQ ID NO: 668179 - RNA, 64 nt, Homo Sapiens; identical to SEQ ID NO: 76686

SEQ ID NO: 668180 - RNA, 64 nt, Homo Sapiens; identical to SEQ ID NO: 76687

SEQ ID NO: 668181 - RNA, 64 nt, Homo Sapiens; identical to SEQ ID NO: 76688

SEQ ID NO: 668182 - RNA, 64 nt, Homo Sapiens; identical to SEQ ID NO: 76689

SEQ ID NO: 668183 - RNA, 64 nt, Homo Sapiens; identical to SEQ ID NO: 76690

SEQ ID NO: 668184 - RNA, 64 nt, Homo Sapiens; identical to SEQ ID NO: 76691

SEQ ID NO: 668185 - RNA, 64 nt, Homo Sapiens; identical to SEQ ID NO: 76692

SEQ ID NO: 668186 - RNA, 64 nt, Homo Sapiens; identical to SEQ ID NO: 76693

SEQ ID NO: 668187 - RNA, 64 nt, Homo Sapiens; identical to SEQ ID NO: 76694

SEQ ID NO: 668188 - RNA, 64 nt, Homo Sapiens; identical to SEQ ID NO: 76695

SEQ ID NO: 668189 - RNA, 64 nt, Homo Sapiens; identical to SEQ ID NO: 76696

SEQ ID NO: 668190 - RNA, 64 nt, Homo Sapiens; identical to SEQ ID NO: 76697

SEQ ID NO: 668191 - RNA, 64 nt, Homo Sapiens; identical to SEQ ID NO: 76698

SEQ ID NO: 668192 - RNA, 64 nt, Homo Sapiens; identical to SEQ ID NO: 76699

SEQ ID NO: 668193 - RNA, 64 nt, Homo Sapiens; identical to SEQ ID NO: 76700

SEQ ID NO: 668194 - RNA, 64 nt, Homo Sapiens; identical to SEQ ID NO: 76701

SEQ ID NO: 668195 - RNA, 64 nt, Homo Sapiens; identical to SEQ ID NO: 76702

SEQ ID NO: 668196 - RNA, 64 nt, Homo Sapiens; identical to SEQ ID NO: 76703

SEQ ID NO: 668197 - RNA, 64 nt, Homo Sapiens; identical to SEQ ID NO: 76704

SEQ ID NO: 668198 - RNA, 64 nt, Homo Sapiens; identical to SEQ ID NO: 76705

SEQ ID NO: 668199 - RNA, 64 nt, Homo Sapiens; identical to SEQ ID NO: 76706

SEQ ID NO: 668200 - RNA, 64 nt, Homo Sapiens; identical to SEQ ID NO: 76707

SEQ ID NO: 668201 - RNA, 64 nt, Homo Sapiens; identical to SEQ ID NO: 76708

SEQ ID NO: 668202 - RNA, 64 nt, Homo Sapiens; identical to SEQ ID NO: 76709

SEQ ID NO: 668203 - RNA, 64 nt, Homo Sapiens; identical to SEQ ID NO: 76710

SEQ ID NO: 668204 - RNA, 64 nt, Homo Sapiens; identical to SEQ ID NO: 76711

SEQ ID NO: 668205 - RNA, 64 nt, Homo Sapiens; identical to SEQ ID NO: 76712

SEQ ID NO: 668206 - RNA, 64 nt, Homo Sapiens; identical to SEQ ID NO: 102117

SEQ ID NO: 668207 - RNA, 64 nt, Homo Sapiens; identical to SEQ ID NO: 102118

SEQ ID NO: 668208 - RNA, 64 nt, Homo Sapiens; identical to SEQ ID NO: 102119

SEQ ID NO: 668209 - RNA, 64 nt, Homo Sapiens; identical to SEQ ID NO: 102120

SEQ ID NO: 668210 - RNA, 64 nt, Homo Sapiens; identical to SEQ ID NO: 102121

SEQ ID NO: 668211 - RNA, 64 nt, Homo Sapiens; identical to SEQ ID NO: 102122

SEQ ID NO: 668212 - RNA, 64 nt, Homo Sapiens; identical to SEQ ID NO: 102123

SEQ ID NO: 668213 - RNA, 64 nt, Homo Sapiens; identical to SEQ ID NO: 102124

SEQ ID NO: 668214 - RNA, 64 nt, Homo Sapiens; identical to SEQ ID NO: 102125

SEQ ID NO: 668215 - RNA, 64 nt, Homo Sapiens; identical to SEQ ID NO: 102126

SEQ ID NO: 668216 - RNA, 64 nt, Homo Sapiens; identical to SEQ ID NO: 102127

SEQ ID NO: 668217 - RNA, 64 nt, Homo Sapiens; identical to SEQ ID NO: 102128

SEQ ID NO: 668218 - RNA, 64 nt, Homo Sapiens; identical to SEQ ID NO: 102129

SEQ ID NO: 668219 - RNA, 64 nt, Homo Sapiens; identical to SEQ ID NO: 102130

SEQ ID NO: 668220 - RNA, 64 nt, Homo Sapiens; identical to SEQ ID NO: 102131

SEQ ID NO: 668221 - RNA, 64 nt, Homo Sapiens; identical to SEQ ID NO: 102132

SEQ ID NO: 668222 - RNA, 64 nt, Homo Sapiens; identical to SEQ ID NO: 102133

SEQ ID NO: 668223 - RNA, 64 nt, Homo Sapiens; identical to SEQ ID NO: 102134

SEQ ID NO: 668224 - RNA, 64 nt, Homo Sapiens; identical to SEQ ID NO: 102135

SEQ ID NO: 668225 - RNA, 64 nt, Homo Sapiens; identical to SEQ ID NO: 102136

SEQ ID NO: 668226 - RNA, 64 nt, Homo Sapiens; identical to SEQ ID NO: 102137

SEQ ID NO: 668227 - RNA, 64 nt, Homo Sapiens; identical to SEQ ID NO: 102138

SEQ ID NO: 668228 - RNA, 64 nt, Homo Sapiens; identical to SEQ ID NO: 102139

SEQ ID NO: 668229 - RNA, 64 nt, Homo Sapiens; identical to SEQ ID NO: 102140

SEQ ID NO: 668230 - RNA, 64 nt, Homo Sapiens; identical to SEQ ID NO: 102141

SEQ ID NO: 668231 - RNA, 64 nt, Homo Sapiens; identical to SEQ ID NO: 102142

SEQ ID NO: 668232 - RNA, 64 nt, Homo Sapiens; identical to SEQ ID NO: 102143

SEQ ID NO: 668233 - RNA, 64 nt, Homo Sapiens; identical to SEQ ID NO: 102144

SEQ ID NO: 668234 - RNA, 64 nt, Homo Sapiens; identical to SEQ ID NO: 102145

SEQ ID NO: 668235 - RNA, 64 nt, Homo Sapiens; identical to SEQ ID NO: 102146

SEQ ID NO: 668236 - RNA, 64 nt, Homo Sapiens; identical to SEQ ID NO: 102147

SEQ ID NO: 668237 - RNA, 64 nt, Homo Sapiens; identical to SEQ ID NO: 102148

SEQ ID NO: 668238 - RNA, 64 nt, Homo Sapiens; identical to SEQ ID NO: 102149

SEQ ID NO: 668239 - RNA, 64 nt, Homo Sapiens; identical to SEQ ID NO: 102150

SEQ ID NO: 668240 - RNA, 64 nt, Homo Sapiens; identical to SEQ ID NO: 102151

SEQ ID NO: 668241 - RNA, 64 nt, Homo Sapiens; identical to SEQ ID NO: 102152

SEQ ID NO: 668242 - RNA, 64 nt, Homo Sapiens; identical to SEQ ID NO: 102153

SEQ ID NO: 668243 - RNA, 64 nt, Homo Sapiens; identical to SEQ ID NO: 102154

SEQ ID NO: 668244 - RNA, 64 nt, Homo Sapiens; identical to SEQ ID NO: 102155

SEQ ID NO: 668245 - RNA, 64 nt, Homo Sapiens; identical to SEQ ID NO: 102156

SEQ ID NO: 668246 - RNA, 64 nt, Homo Sapiens; identical to SEQ ID NO: 102157

SEQ ID NO: 668247 - RNA, 64 nt, Homo Sapiens; identical to SEQ ID NO: 102158

SEQ ID NO: 668248 - RNA, 64 nt, Homo Sapiens; identical to SEQ ID NO: 102159

SEQ ID NO: 668249 - RNA, 64 nt, Homo Sapiens; identical to SEQ ID NO: 102160

SEQ ID NO: 668250 - RNA, 64 nt, Homo Sapiens; identical to SEQ ID NO: 102161

SEQ ID NO: 668251 - RNA, 64 nt, Homo Sapiens; identical to SEQ ID NO: 102162

SEQ ID NO: 668252 - RNA, 64 nt, Homo Sapiens; identical to SEQ ID NO: 102163

SEQ ID NO: 668253 - RNA, 64 nt, Homo Sapiens; identical to SEQ ID NO: 102164

SEQ ID NO: 668254 - RNA, 64 nt, Homo Sapiens; identical to SEQ ID NO: 102165

SEQ ID NO: 668255 - RNA, 64 nt, Homo Sapiens; identical to SEQ ID NO: 102166

SEQ ID NO: 668256 - RNA, 64 nt, Homo Sapiens; identical to SEQ ID NO: 102167

SEQ ID NO: 668257 - RNA, 64 nt, Homo Sapiens; identical to SEQ ID NO: 102168

SEQ ID NO: 668258 - RNA, 64 nt, Homo Sapiens; identical to SEQ ID NO: 102169

SEQ ID NO: 668259 - RNA, 64 nt, Homo Sapiens; identical to SEQ ID NO: 102170

SEQ ID NO: 668260 - RNA, 64 nt, Homo Sapiens; identical to SEQ ID NO: 102171

SEQ ID NO: 668261 - RNA, 64 nt, Homo Sapiens; identical to SEQ ID NO: 102172

SEQ ID NO: 668262 - RNA, 64 nt, Homo Sapiens; identical to SEQ ID NO: 102173

SEQ ID NO: 668263 - RNA, 64 nt, Homo Sapiens; identical to SEQ ID NO: 102174

SEQ ID NO: 668264 - RNA, 64 nt, Homo Sapiens; identical to SEQ ID NO: 102175

SEQ ID NO: 668265 - RNA, 64 nt, Homo Sapiens; identical to SEQ ID NO: 102176

SEQ ID NO: 668266 - RNA, 64 nt, Homo Sapiens; identical to SEQ ID NO: 102177

SEQ ID NO: 668267 - RNA, 64 nt, Homo Sapiens; identical to SEQ ID NO: 102178

SEQ ID NO: 668268 - RNA, 64 nt, Homo Sapiens; identical to SEQ ID NO: 102179

SEQ ID NO: 668269 - RNA, 64 nt, Homo Sapiens; identical to SEQ ID NO: 102180

SEQ ID NO: 668270 - RNA, 64 nt, Homo Sapiens; identical to SEQ ID NO: 102181

SEQ ID NO: 668271 - RNA, 64 nt, Homo Sapiens; identical to SEQ ID NO: 102182

SEQ ID NO: 668272 - RNA, 64 nt, Homo Sapiens; identical to SEQ ID NO: 102183

SEQ ID NO: 668273 - RNA, 64 nt, Homo Sapiens; identical to SEQ ID NO: 102184

SEQ ID NO: 668274 - RNA, 64 nt, Homo Sapiens; identical to SEQ ID NO: 102185

SEQ ID NO: 668275 - RNA, 64 nt, Homo Sapiens; identical to SEQ ID NO: 102186

SEQ ID NO: 668276 - RNA, 64 nt, Homo Sapiens; identical to SEQ ID NO: 102187

SEQ ID NO: 668277 - RNA, 64 nt, Homo Sapiens; identical to SEQ ID NO: 102188

SEQ ID NO: 668278 - RNA, 64 nt, Homo Sapiens; identical to SEQ ID NO: 102189

SEQ ID NO: 668279 - RNA, 64 nt, Homo Sapiens; identical to SEQ ID NO: 102190

SEQ ID NO: 668280 - RNA, 64 nt, Homo Sapiens; identical to SEQ ID NO: 102191

SEQ ID NO: 668281 - RNA, 64 nt, Homo Sapiens; identical to SEQ ID NO: 102192

SEQ ID NO: 668282 - RNA, 64 nt, Homo Sapiens; identical to SEQ ID NO: 102193

SEQ ID NO: 668283 - RNA, 64 nt, Homo Sapiens; identical to SEQ ID NO: 102194

SEQ ID NO: 668284 - RNA, 64 nt, Homo Sapiens; identical to SEQ ID NO: 102195

SEQ ID NO: 668285 - RNA, 64 nt, Homo Sapiens; identical to SEQ ID NO: 102196

SEQ ID NO: 668286 - RNA, 64 nt, Homo Sapiens; identical to SEQ ID NO: 102197

SEQ ID NO: 668287 - RNA, 64 nt, Homo Sapiens; identical to SEQ ID NO: 102198

SEQ ID NO: 668288 - RNA, 64 nt, Homo Sapiens; identical to SEQ ID NO: 102199

SEQ ID NO: 668289 - RNA, 64 nt, Homo Sapiens; identical to SEQ ID NO: 102200

SEQ ID NO: 668290 - RNA, 64 nt, Homo Sapiens; identical to SEQ ID NO: 102201

SEQ ID NO: 668291 - RNA, 64 nt, Homo Sapiens; identical to SEQ ID NO: 102202

SEQ ID NO: 668292 - RNA, 64 nt, Homo Sapiens; identical to SEQ ID NO: 102203

SEQ ID NO: 668293 - RNA, 64 nt, Homo Sapiens; identical to SEQ ID NO: 102204

SEQ ID NO: 668294 - RNA, 64 nt, Homo Sapiens; identical to SEQ ID NO: 102205

SEQ ID NO: 668295 - RNA, 64 nt, Homo Sapiens; identical to SEQ ID NO: 102206

SEQ ID NO: 668296 - RNA, 64 nt, Homo Sapiens; identical to SEQ ID NO: 102207

SEQ ID NO: 668297 - RNA, 64 nt, Homo Sapiens; identical to SEQ ID NO: 102208

SEQ ID NO: 668298 - RNA, 64 nt, Homo Sapiens; identical to SEQ ID NO: 102209

SEQ ID NO: 668299 - RNA, 64 nt, Homo Sapiens; identical to SEQ ID NO: 573683

SEQ ID NO: 668300 - RNA, 64 nt, Homo Sapiens; identical to SEQ ID NO: 573684

SEQ ID NO: 668301 - RNA, 64 nt, Homo Sapiens; identical to SEQ ID NO: 573685

SEQ ID NO: 668302 - RNA, 64 nt, Homo Sapiens; identical to SEQ ID NO: 573686

SEQ ID NO: 668303 - RNA, 64 nt, Homo Sapiens; identical to SEQ ID NO: 573687

SEQ ID NO: 668304 - RNA, 64 nt, Homo Sapiens; identical to SEQ ID NO: 573688

SEQ ID NO: 668305 - RNA, 64 nt, Homo Sapiens; identical to SEQ ID NO: 573689

SEQ ID NO: 668306 - RNA, 64 nt, Homo Sapiens; identical to SEQ ID NO: 573690

SEQ ID NO: 668307 - RNA, 64 nt, Homo Sapiens; identical to SEQ ID NO: 573691

SEQ ID NO: 668308 - RNA, 64 nt, Homo Sapiens; identical to SEQ ID NO: 573692

SEQ ID NO: 668309 - RNA, 64 nt, Homo Sapiens; identical to SEQ ID NO: 573693

SEQ ID NO: 668310 - RNA, 64 nt, Homo Sapiens; identical to SEQ ID NO: 573694

SEQ ID NO: 668311 - RNA, 64 nt, Homo Sapiens; identical to SEQ ID NO: 573695

SEQ ID NO: 668312 - RNA, 64 nt, Homo Sapiens; identical to SEQ ID NO: 573696

SEQ ID NO: 668313 - RNA, 64 nt, Homo Sapiens; identical to SEQ ID NO: 573697

SEQ ID NO: 668314 - RNA, 64 nt, Homo Sapiens; identical to SEQ ID NO: 573698

SEQ ID NO: 668315 - RNA, 64 nt, Homo Sapiens; identical to SEQ ID NO: 573699

SEQ ID NO: 668316 - RNA, 64 nt, Homo Sapiens; identical to SEQ ID NO: 573700

SEQ ID NO: 668317 - RNA, 64 nt, Homo Sapiens; identical to SEQ ID NO: 573701

SEQ ID NO: 668318 - RNA, 64 nt, Homo Sapiens; identical to SEQ ID NO: 573702

SEQ ID NO: 668319 - RNA, 64 nt, Homo Sapiens; identical to SEQ ID NO: 573703

SEQ ID NO: 668320 - RNA, 64 nt, Homo Sapiens; identical to SEQ ID NO: 573704

SEQ ID NO: 668321 - RNA, 64 nt, Homo Sapiens; identical to SEQ ID NO: 573705

SEQ ID NO: 668322 - RNA, 64 nt, Homo Sapiens; identical to SEQ ID NO: 573706

SEQ ID NO: 668323 - RNA, 64 nt, Homo Sapiens; identical to SEQ ID NO: 573707

SEQ ID NO: 668324 - RNA, 64 nt, Homo Sapiens; identical to SEQ ID NO: 573708

SEQ ID NO: 668325 - RNA, 64 nt, Homo Sapiens; identical to SEQ ID NO: 573709

SEQ ID NO: 668326 - RNA, 64 nt, Homo Sapiens; identical to SEQ ID NO: 573710

SEQ ID NO: 668327 - RNA, 64 nt, Homo Sapiens; identical to SEQ ID NO: 573711

SEQ ID NO: 668328 - RNA, 64 nt, Homo Sapiens; identical to SEQ ID NO: 573712

SEQ ID NO: 668329 - RNA, 64 nt, Homo Sapiens; identical to SEQ ID NO: 573713

SEQ ID NO: 668330 - RNA, 64 nt, Homo Sapiens; identical to SEQ ID NO: 573714

SEQ ID NO: 668331 - RNA, 64 nt, Homo Sapiens; identical to SEQ ID NO: 573715

SEQ ID NO: 668332 - RNA, 64 nt, Homo Sapiens; identical to SEQ ID NO: 573716

SEQ ID NO: 668333 - RNA, 64 nt, Homo Sapiens; identical to SEQ ID NO: 573717

SEQ ID NO: 668334 - RNA, 64 nt, Homo Sapiens; identical to SEQ ID NO: 573718

SEQ ID NO: 668335 - RNA, 64 nt, Homo Sapiens; identical to SEQ ID NO: 573719

SEQ ID NO: 668336 - RNA, 64 nt, Homo Sapiens; identical to SEQ ID NO: 573720

SEQ ID NO: 668337 - RNA, 64 nt, Homo Sapiens; identical to SEQ ID NO: 573721

SEQ ID NO: 668338 - RNA, 64 nt, Homo Sapiens; identical to SEQ ID NO: 573722

SEQ ID NO: 668339 - RNA, 63 nt, Homo Sapiens; identical to SEQ ID NO: 573723

SEQ ID NO: 668340 - RNA, 64 nt, Homo Sapiens; identical to SEQ ID NO: 573724

SEQ ID NO: 668341 - RNA, 64 nt, Homo Sapiens; identical to SEQ ID NO: 573725

SEQ ID NO: 668342 - RNA, 64 nt, Homo Sapiens; identical to SEQ ID NO: 573726

SEQ ID NO: 668343 - RNA, 64 nt, Homo Sapiens; identical to SEQ ID NO: 573727

SEQ ID NO: 668344 - RNA, 64 nt, Homo Sapiens; identical to SEQ ID NO: 573728

SEQ ID NO: 668345 - RNA, 64 nt, Homo Sapiens; identical to SEQ ID NO: 573729

SEQ ID NO: 668346 - RNA, 64 nt, Homo Sapiens; identical to SEQ ID NO: 573730

SEQ ID NO: 668347 - RNA, 64 nt, Homo Sapiens; identical to SEQ ID NO: 573731

SEQ ID NO: 668348 - RNA, 64 nt, Homo Sapiens; identical to SEQ ID NO: 573732

SEQ ID NO: 668349 - RNA, 64 nt, Homo Sapiens; identical to SEQ ID NO: 573733

SEQ ID NO: 668350 - RNA, 64 nt, Homo Sapiens; identical to SEQ ID NO: 573734

SEQ ID NO: 668351 - RNA, 64 nt, Homo Sapiens; identical to SEQ ID NO: 573735

SEQ ID NO: 668352 - RNA, 64 nt, Homo Sapiens; identical to SEQ ID NO: 573736

SEQ ID NO: 668353 - RNA, 64 nt, Homo Sapiens; identical to SEQ ID NO: 573737

SEQ ID NO: 668354 - RNA, 64 nt, Homo Sapiens; identical to SEQ ID NO: 573738

SEQ ID NO: 668355 - RNA, 64 nt, Homo Sapiens; identical to SEQ ID NO: 573739

SEQ ID NO: 668356 - RNA, 64 nt, Homo Sapiens; identical to SEQ ID NO: 573740

SEQ ID NO: 668357 - RNA, 64 nt, Homo Sapiens; identical to SEQ ID NO: 573741

SEQ ID NO: 668358 - RNA, 64 nt, Homo Sapiens; identical to SEQ ID NO: 573742

SEQ ID NO: 668359 - RNA, 64 nt, Homo Sapiens; identical to SEQ ID NO: 573743

SEQ ID NO: 668360 - RNA, 64 nt, Homo Sapiens; identical to SEQ ID NO: 573744

SEQ ID NO: 668361 - RNA, 64 nt, Homo Sapiens; identical to SEQ ID NO: 573745

SEQ ID NO: 668362 - RNA, 64 nt, Homo Sapiens; identical to SEQ ID NO: 573746

SEQ ID NO: 668363 - RNA, 64 nt, Homo Sapiens; identical to SEQ ID NO: 573747

SEQ ID NO: 668364 - RNA, 64 nt, Homo Sapiens; identical to SEQ ID NO: 573748

SEQ ID NO: 668365 - RNA, 64 nt, Homo Sapiens; identical to SEQ ID NO: 573749

SEQ ID NO: 668366 - RNA, 64 nt, Homo Sapiens; identical to SEQ ID NO: 573750

SEQ ID NO: 668367 - RNA, 64 nt, Homo Sapiens; identical to SEQ ID NO: 573751

SEQ ID NO: 668368 - RNA, 64 nt, Homo Sapiens; identical to SEQ ID NO: 573752

SEQ ID NO: 668369 - RNA, 64 nt, Homo Sapiens; identical to SEQ ID NO: 573753

SEQ ID NO: 668370 - RNA, 64 nt, Homo Sapiens; identical to SEQ ID NO: 573754

SEQ ID NO: 668371 - RNA, 64 nt, Homo Sapiens; identical to SEQ ID NO: 573755

SEQ ID NO: 668372 - RNA, 64 nt, Homo Sapiens; identical to SEQ ID NO: 573756

SEQ ID NO: 668373 - RNA, 64 nt, Homo Sapiens; identical to SEQ ID NO: 573757

SEQ ID NO: 668374 - RNA, 64 nt, Homo Sapiens; identical to SEQ ID NO: 573758

SEQ ID NO: 668375 - RNA, 64 nt, Homo Sapiens; identical to SEQ ID NO: 573759

SEQ ID NO: 668376 - RNA, 64 nt, Homo Sapiens; identical to SEQ ID NO: 573760

SEQ ID NO: 668377 - RNA, 64 nt, Homo Sapiens; identical to SEQ ID NO: 573761

SEQ ID NO: 668378 - RNA, 64 nt, Homo Sapiens; identical to SEQ ID NO: 573762

SEQ ID NO: 668379 - RNA, 64 nt, Homo Sapiens; identical to SEQ ID NO: 573763

SEQ ID NO: 668380 - RNA, 64 nt, Homo Sapiens; identical to SEQ ID NO: 573764

SEQ ID NO: 668381 - RNA, 64 nt, Homo Sapiens; identical to SEQ ID NO: 573765

SEQ ID NO: 668382 - RNA, 64 nt, Homo Sapiens; identical to SEQ ID NO: 573766

SEQ ID NO: 668383 - RNA, 64 nt, Homo Sapiens; identical to SEQ ID NO: 573767

SEQ ID NO: 668384 - RNA, 64 nt, Homo Sapiens
aauuaaugauuugaucacacauaugcuggcugcuaccuugcauauccacaaauggugugaacua

SEQ ID NO: 668385 - RNA, 64 nt, Homo Sapiens
ugagacagcaaacaaaauccugccaucccauuucaccuugcauggaaggcaccagcuugcaaua

SEQ ID NO: 668386 - RNA, 64 nt, Homo Sapiens
aacuuccuaggacuucucggcucugcccucugugaccuugcagccugcucaggucuuugugcuc

SEQ ID NO: 668387 - RNA, 64 nt, Homo Sapiens
cacaagacuaacuuuggucucuugaccuuuucuuaccuugcaacugucagugccuccagccaaa

SEQ ID NO: 668388 - RNA, 64 nt, Homo Sapiens
gguaaauaaaaaauuuccaaacuuuggagcaaaaaccuugcaguagucauaugucuggugugac

SEQ ID NO: 668389 - RNA, 64 nt, Homo Sapiens
ugucuguccauuuugauuugacuuauugauuaagaccuugcauaucaauaucuauuuguugagc

SEQ ID NO: 668390 - RNA, 64 nt, Homo Sapiens; identical to SEQ ID NO: 564507

SEQ ID NO: 668391 - RNA, 64 nt, Homo Sapiens; identical to SEQ ID NO: 564508

SEQ ID NO: 668392 - RNA, 64 nt, Homo Sapiens; identical to SEQ ID NO: 133894

SEQ ID NO: 668393 - RNA, 64 nt, Homo Sapiens; identical to SEQ ID NO: 133895

SEQ ID NO: 668394 - RNA, 64 nt, Homo Sapiens; identical to SEQ ID NO: 133896

SEQ ID NO: 668395 - RNA, 64 nt, Homo Sapiens; identical to SEQ ID NO: 133897

SEQ ID NO: 668396 - RNA, 64 nt, Homo Sapiens; identical to SEQ ID NO: 133898

SEQ ID NO: 668397 - RNA, 64 nt, Homo Sapiens; identical to SEQ ID NO: 133899

SEQ ID NO: 668398 - RNA, 64 nt, Homo Sapiens; identical to SEQ ID NO: 133900

SEQ ID NO: 668399 - RNA, 64 nt, Homo Sapiens; identical to SEQ ID NO: 133901

SEQ ID NO: 668400 - RNA, 64 nt, Homo Sapiens; identical to SEQ ID NO: 133902

SEQ ID NO: 668401 - RNA, 64 nt, Homo Sapiens; identical to SEQ ID NO: 133903

SEQ ID NO: 668402 - RNA, 64 nt, Homo Sapiens; identical to SEQ ID NO: 133904

SEQ ID NO: 668403 - RNA, 64 nt, Homo Sapiens; identical to SEQ ID NO: 133905

SEQ ID NO: 668404 - RNA, 64 nt, Homo Sapiens; identical to SEQ ID NO: 133906

SEQ ID NO: 668405 - RNA, 64 nt, Homo Sapiens; identical to SEQ ID NO: 133907

SEQ ID NO: 668406 - RNA, 64 nt, Homo Sapiens; identical to SEQ ID NO: 133908

SEQ ID NO: 668407 - RNA, 64 nt, Homo Sapiens; identical to SEQ ID NO: 133909

SEQ ID NO: 668408 - RNA, 64 nt, Homo Sapiens; identical to SEQ ID NO: 133910

SEQ ID NO: 668409 - RNA, 64 nt, Homo Sapiens; identical to SEQ ID NO: 133911

SEQ ID NO: 668410 - RNA, 64 nt, Homo Sapiens; identical to SEQ ID NO: 133912

SEQ ID NO: 668411 - RNA, 64 nt, Homo Sapiens; identical to SEQ ID NO: 133913

SEQ ID NO: 668412 - RNA, 64 nt, Homo Sapiens; identical to SEQ ID NO: 133914

SEQ ID NO: 668413 - RNA, 64 nt, Homo Sapiens; identical to SEQ ID NO: 133915

SEQ ID NO: 668414 - RNA, 64 nt, Homo Sapiens
uagucuaagauuauuaccuucauuaauaccaacaggcugcaaagcaagaguauagauuauugua

SEQ ID NO: 668415 - RNA, 64 nt, Homo Sapiens
gguuugagaaaaggagggaaguuugcuacaaaggggcugcaaagggaauaggcugauggagcug

SEQ ID NO: 668416 - RNA, 64 nt, Homo Sapiens
cugagccuaaaugucuccccgaacuggaggagugggcugcaagacuaucccugcccagaggugg

SEQ ID NO: 668417 - RNA, 64 nt, Homo Sapiens
gagucugggaaaugucauuuagauccagaaccuuggcugcaagguguuugggggaacuuaaguc

SEQ ID NO: 668418 - RNA, 64 nt, Homo Sapiens
aacuucuuccuuccccaugcuuugggucaccucgggcugcaacccugucugugccagauugccc

SEQ ID NO: 668419 - RNA, 64 nt, Homo Sapiens
caggcagcugucuccaccuccaggauguccagcaggcugcaaggagaaggaugccagccaccca

SEQ ID NO: 668420 - RNA, 64 nt, Homo Sapiens
cggucaguugcugcuuguccccauaggccucuguggcugcaagggacucuccuacauguggccc

SEQ ID NO: 668421 - RNA, 64 nt, Homo Sapiens
uuccaacccaguuguuccagagaucacuuuccugggcugcaaugagagaccaccuugucuuuaa

SEQ ID NO: 668422 - RNA, 64 nt, Homo Sapiens
aacagggcaguguuguggggacugcaaaagagaaaacguccaggcgagcccaguuguccucgcc

SEQ ID NO: 668423 - RNA, 64 nt, Homo Sapiens
caaacaaaacacaauaugccuaggggcacggaugaacguccagggagcccgggccccaggcuuu

SEQ ID NO: 668424 - RNA, 64 nt, Homo Sapiens
ccaguuaagugucccuucgccaggaagcugccgcaacguccagaccugggucaaguucccacuc

SEQ ID NO: 668425 - RNA, 64 nt, Homo Sapiens
cccgcuccccaucgccugcccgcagcagcgacgaaacguccaucugaggagccugggccuugcc

SEQ ID NO: 668426 - RNA, 64 nt, Homo Sapiens
agagacgcauggcccgaagucgauccguacucagaacguccagggagacggcaggaggccugag

SEQ ID NO: 668427 - RNA, 64 nt, Homo Sapiens
caauugguucguggcaggaagcuauuagaagucaaacguccagaugcauuacugcuaucuuagu

SEQ ID NO: 668428 - RNA, 64 nt, Homo Sapiens
ugucuccaccacacauaguguacuuuggaagcacaacguccaggcugguaccgcagcgccaugc

SEQ ID NO: 668429 - RNA, 64 nt, Homo Sapiens
ggauuaacagaacguccuugggaagauccacuaaaacguccacguugccaucuggaugacaaac

SEQ ID NO: 668430 - RNA, 64 nt, Homo Sapiens
cuguauguaauucagucauaaguaagcauuuucuaacguccauuauaucccuuuagguauuacu

SEQ ID NO: 668431 - RNA, 64 nt, Homo Sapiens
ggggggccuuccuggagugucagggucucugggcaacguccauucagggugcggcauggcuguc

SEQ ID NO: 668432 - RNA, 64 nt, Homo Sapiens
uguauuuacuucuggcugugcagcuuuuaaggcuaacguccagcgacuuuucauucacaacaga

SEQ ID NO: 668433 - RNA, 64 nt, Homo Sapiens
gcuuccuugagaucauggaaucccuuccugcucuaacguccaguuuaccccuaaagugagcgag

SEQ ID NO: 668434 - RNA, 64 nt, Homo Sapiens
ugguccugcugccaagagcccccacuugcuccacaacguccagucacggccugcacugugccca

SEQ ID NO: 668435 - RNA, 54 nt, Homo Sapiens
ugagccucgcgaucuuuugaguccaacguccagcucguucucugggccuucuca

SEQ ID NO: 668436 - RNA, 64 nt, Homo Sapiens
ggagcuguucucugucgugagugucucuugucuaaacguccauuaagcugagagugcuaugaag

SEQ ID NO: 668437 - RNA, 64 nt, Homo Sapiens
auaaauacuucucuuugaagaaaauauaaagguuaacguccauaguuaagaaauuuuauuuuaa

SEQ ID NO: 668438 - RNA, 64 nt, Homo Sapiens
aauggaguaagauuagucaucacugcagaggcagaacguccaaguccaggagggucuccuuccc

SEQ ID NO: 668439 - RNA, 64 nt, Homo Sapiens
uguaaccaccucucugucuuuuuccuuccugagaaacguccaucucucucccuuacuauuccca

SEQ ID NO: 668440 - RNA, 64 nt, Homo Sapiens
ccucucgcacucuccuucucaaaagaagggaggaaacguccauuccaugauuuaagcccaucca

SEQ ID NO: 668441 - RNA, 64 nt, Homo Sapiens
uggguguguucauuccuuccugcaaaugaaaccaaacguccaccugcaacccucccugaacccc

SEQ ID NO: 668442 - RNA, 64 nt, Homo Sapiens
uaguauugugcuguaacuuaaaaauuuucaaugaaacguccacaggaauuuuauuuuuucaagu

SEQ ID NO: 668443 - RNA, 64 nt, Homo Sapiens
uuuuuccguuugcuuuuguuccaaugucaaugugaacguccacaugaaaccuacacacugucau

SEQ ID NO: 668444 - RNA, 64 nt, Homo Sapiens
gaggggauuuuacagccgagggaccuccaaagggaacguccauuugcaugugugcccugguauu

SEQ ID NO: 668445 - RNA, 64 nt, Homo Sapiens
ccuucagcagcucucguucuuuaagaagucucagaacguccagcgaugccaaaugacuuacauc

SEQ ID NO: 668446 - RNA, 64 nt, Homo Sapiens
guggcguugaauagauguguugcaugcauuuuguaacguccagugauagcacuggggcagaaua

SEQ ID NO: 668447 - RNA, 64 nt, Homo Sapiens
cuggcucucugcggcuggugccguccguccgaggaacguccaucaacauucccaagcaggaaaa

SEQ ID NO: 668448 - RNA, 64 nt, Homo Sapiens
gcaguuuucaggcuaauacagaaaaagaugaacaaacguccagcaagauacuuuaauccucuau

SEQ ID NO: 668449 - RNA, 64 nt, Homo Sapiens
ccagccucacauugccagauggcaacaucaggccaacguccaccagcaucagcauccuacuccu

SEQ ID NO: 668450 - RNA, 64 nt, Homo Sapiens
uccuggguucaagcgauucuucucagcucacugcaacguccaccgcuggagggcaauggcgcca

SEQ ID NO: 668451 - RNA, 64 nt, Homo Sapiens
ugaccugccccuggcccuagaacagauccagggcaacguccaggccaaugugccagcuggaggc

SEQ ID NO: 668452 - RNA, 64 nt, Homo Sapiens
auuguccugccuguguuccagcaugcuuauuucaaacguccaguguugugugugaauauguguu

SEQ ID NO: 668453 - RNA, 64 nt, Homo Sapiens
ggaauuagauggaagaugauguugaacagcuguuaacguccaaaaaacuuucagaaaaagcugu

SEQ ID NO: 668454 - RNA, 64 nt, Homo Sapiens
gaguauaaauaaccaauuccccagagccuuaauaaacguccacaaggccagcuccacaguguug

SEQ ID NO: 668455 - RNA, 64 nt, Homo Sapiens
ugcuggaaaagugacuaaugagucaggagcaaggaacguccagggagugggagcagcacaugcg

SEQ ID NO: 668456 - RNA, 64 nt, Homo Sapiens
gcccagaacccugaggaguguccguggccauggcaacguccagggcauacagcacccucuaccc

SEQ ID NO: 668457 - RNA, 64 nt, Homo Sapiens
agcuuacugaguuaucagguguuuggcacucucuaacguccacuuuuauuguuuuuuaaagaau

SEQ ID NO: 668458 - RNA, 64 nt, Homo Sapiens
cuucccucagcugaguggggcuccgcuagauuuuaacguccagccccaacuccuuaauuuuauu

SEQ ID NO: 668459 - RNA, 64 nt, Homo Sapiens
ugaacucaauggacauccguagacauucaacuugaacguccaaacaauugcucugaagaaagaa

SEQ ID NO: 668460 - RNA, 64 nt, Homo Sapiens
ugacaaauguguaagguacaauuaaaacuaugacaacguccacaccuuucauuugucaaccuuc

SEQ ID NO: 668461 - RNA, 64 nt, Homo Sapiens
uuccaggugaccacacguguccccgguuuccuucaacguccacacuccgccugcacuuuugaaa

SEQ ID NO: 668462 - RNA, 64 nt, Homo Sapiens
cgcauagauacaggcaucccuuucugucuacuccaacguccacgcgacauuaagaagccucugg

SEQ ID NO: 668463 - RNA, 64 nt, Homo Sapiens
acacaccuguaucccagagaucucugggaaaaugaacguccaggccggcaaguucucuuucuuc

SEQ ID NO: 668464 - RNA, 64 nt, Homo Sapiens
uugcuccauucacucccaggugagaauucaggcaaacguccacaaaggucacaggcagcguaca

SEQ ID NO: 668465 - RNA, 64 nt, Homo Sapiens
ggguauaaacuagaaguuuaaaaaugcuucauagaacguccaggguuuacauuacaagauucuc

SEQ ID NO: 668466 - RNA, 64 nt, Homo Sapiens
gaugaguuuguagcagggccacaaaacaaagugaaacguccaggggaacccaacaguccuaugu

SEQ ID NO: 668467 - RNA, 64 nt, Homo Sapiens
uuaaggcuuuaaaagacagugauggauugaagagaacguccaccaauggcuuugugcuuuugaa

SEQ ID NO: 668468 - RNA, 64 nt, Homo Sapiens
acgcuuaacgucuuuuuuuaugugcaaaaugguuaacguccaaauuugguauccaguuucugaa

SEQ ID NO: 668469 - RNA, 64 nt, Homo Sapiens
aauggcuuuuugcuuuugaaggugguaugaagagaacguccacuuuaaggcuuuaaaagacagu

SEQ ID NO: 668470 - RNA, 64 nt, Homo Sapiens; identical to SEQ ID NO: 113667

SEQ ID NO: 668471 - RNA, 64 nt, Homo Sapiens; identical to SEQ ID NO: 113668

SEQ ID NO: 668472 - RNA, 64 nt, Homo Sapiens; identical to SEQ ID NO: 113669

SEQ ID NO: 668473 - RNA, 64 nt, Homo Sapiens; identical to SEQ ID NO: 113670

SEQ ID NO: 668474 - RNA, 64 nt, Homo Sapiens; identical to SEQ ID NO: 113671

SEQ ID NO: 668475 - RNA, 64 nt, Homo Sapiens; identical to SEQ ID NO: 113672

SEQ ID NO: 668476 - RNA, 64 nt, Homo Sapiens; identical to SEQ ID NO: 113673

SEQ ID NO: 668477 - RNA, 64 nt, Homo Sapiens; identical to SEQ ID NO: 113674

SEQ ID NO: 668478 - RNA, 64 nt, Homo Sapiens; identical to SEQ ID NO: 113675

SEQ ID NO: 668479 - RNA, 64 nt, Homo Sapiens; identical to SEQ ID NO: 113676

SEQ ID NO: 668480 - RNA, 64 nt, Homo Sapiens; identical to SEQ ID NO: 113677

SEQ ID NO: 668481 - RNA, 64 nt, Homo Sapiens; identical to SEQ ID NO: 113678

SEQ ID NO: 668482 - RNA, 64 nt, Homo Sapiens; identical to SEQ ID NO: 113679

SEQ ID NO: 668483 - RNA, 64 nt, Homo Sapiens; identical to SEQ ID NO: 113680

SEQ ID NO: 668484 - RNA, 64 nt, Homo Sapiens; identical to SEQ ID NO: 113681

SEQ ID NO: 668485 - RNA, 64 nt, Homo Sapiens; identical to SEQ ID NO: 113682

SEQ ID NO: 668486 - RNA, 64 nt, Homo Sapiens; identical to SEQ ID NO: 113683

SEQ ID NO: 668487 - RNA, 64 nt, Homo Sapiens; identical to SEQ ID NO: 113684

SEQ ID NO: 668488 - RNA, 64 nt, Homo Sapiens; identical to SEQ ID NO: 113685

SEQ ID NO: 668489 - RNA, 64 nt, Homo Sapiens; identical to SEQ ID NO: 113686

SEQ ID NO: 668490 - RNA, 64 nt, Homo Sapiens; identical to SEQ ID NO: 113687

SEQ ID NO: 668491 - RNA, 64 nt, Homo Sapiens; identical to SEQ ID NO: 113688

SEQ ID NO: 668492 - RNA, 64 nt, Homo Sapiens; identical to SEQ ID NO: 113689

SEQ ID NO: 668493 - RNA, 62 nt, Homo Sapiens; identical to SEQ ID NO: 113690

SEQ ID NO: 668494 - RNA, 64 nt, Homo Sapiens; identical to SEQ ID NO: 113691

SEQ ID NO: 668495 - RNA, 59 nt, Homo Sapiens; identical to SEQ ID NO: 113692

SEQ ID NO: 668496 - RNA, 64 nt, Homo Sapiens; identical to SEQ ID NO: 113693

SEQ ID NO: 668497 - RNA, 64 nt, Homo Sapiens; identical to SEQ ID NO: 113694

SEQ ID NO: 668498 - RNA, 64 nt, Homo Sapiens; identical to SEQ ID NO: 113695

SEQ ID NO: 668499 - RNA, 64 nt, Homo Sapiens; identical to SEQ ID NO: 113696

SEQ ID NO: 668500 - RNA, 64 nt, Homo Sapiens; identical to SEQ ID NO: 113697

SEQ ID NO: 668501 - RNA, 64 nt, Homo Sapiens; identical to SEQ ID NO: 113698

SEQ ID NO: 668502 - RNA, 64 nt, Homo Sapiens; identical to SEQ ID NO: 113699

SEQ ID NO: 668503 - RNA, 64 nt, Homo Sapiens; identical to SEQ ID NO: 113700

SEQ ID NO: 668504 - RNA, 64 nt, Homo Sapiens; identical to SEQ ID NO: 113701

SEQ ID NO: 668505 - RNA, 64 nt, Homo Sapiens; identical to SEQ ID NO: 113702

SEQ ID NO: 668506 - RNA, 64 nt, Homo Sapiens; identical to SEQ ID NO: 113703

SEQ ID NO: 668507 - RNA, 64 nt, Homo Sapiens; identical to SEQ ID NO: 113704

SEQ ID NO: 668508 - RNA, 64 nt, Homo Sapiens; identical to SEQ ID NO: 113705

SEQ ID NO: 668509 - RNA, 64 nt, Homo Sapiens; identical to SEQ ID NO: 113706

SEQ ID NO: 668510 - RNA, 64 nt, Homo Sapiens; identical to SEQ ID NO: 113707

SEQ ID NO: 668511 - RNA, 64 nt, Homo Sapiens; identical to SEQ ID NO: 113708

SEQ ID NO: 668512 - RNA, 64 nt, Homo Sapiens; identical to SEQ ID NO: 113709

SEQ ID NO: 668513 - RNA, 64 nt, Homo Sapiens; identical to SEQ ID NO: 113710

SEQ ID NO: 668514 - RNA, 64 nt, Homo Sapiens; identical to SEQ ID NO: 113711

SEQ ID NO: 668515 - RNA, 64 nt, Homo Sapiens; identical to SEQ ID NO: 113712

SEQ ID NO: 668516 - RNA, 64 nt, Homo Sapiens; identical to SEQ ID NO: 113713

SEQ ID NO: 668517 - RNA, 64 nt, Homo Sapiens; identical to SEQ ID NO: 113714

SEQ ID NO: 668518 - RNA, 64 nt, Homo Sapiens; identical to SEQ ID NO: 113715

SEQ ID NO: 668519 - RNA, 64 nt, Homo Sapiens; identical to SEQ ID NO: 113716

SEQ ID NO: 668520 - RNA, 64 nt, Homo Sapiens; identical to SEQ ID NO: 113717

SEQ ID NO: 668521 - RNA, 64 nt, Homo Sapiens; identical to SEQ ID NO: 113718

SEQ ID NO: 668522 - RNA, 64 nt, Homo Sapiens; identical to SEQ ID NO: 113719

SEQ ID NO: 668523 - RNA, 64 nt, Homo Sapiens; identical to SEQ ID NO: 113720

SEQ ID NO: 668524 - RNA, 64 nt, Homo Sapiens; identical to SEQ ID NO: 113721

SEQ ID NO: 668525 - RNA, 64 nt, Homo Sapiens; identical to SEQ ID NO: 113722

SEQ ID NO: 668526 - RNA, 64 nt, Homo Sapiens; identical to SEQ ID NO: 113723

SEQ ID NO: 668527 - RNA, 64 nt, Homo Sapiens; identical to SEQ ID NO: 113724

SEQ ID NO: 668528 - RNA, 64 nt, Homo Sapiens; identical to SEQ ID NO: 113725

SEQ ID NO: 668529 - RNA, 64 nt, Homo Sapiens; identical to SEQ ID NO: 113726

SEQ ID NO: 668530 - RNA, 64 nt, Homo Sapiens; identical to SEQ ID NO: 113727

SEQ ID NO: 668531 - RNA, 64 nt, Homo Sapiens; identical to SEQ ID NO: 113728

SEQ ID NO: 668532 - RNA, 64 nt, Homo Sapiens; identical to SEQ ID NO: 113729

SEQ ID NO: 668533 - RNA, 64 nt, Homo Sapiens; identical to SEQ ID NO: 113730

SEQ ID NO: 668534 - RNA, 64 nt, Homo Sapiens; identical to SEQ ID NO: 113731

SEQ ID NO: 668535 - RNA, 64 nt, Homo Sapiens; identical to SEQ ID NO: 113732

SEQ ID NO: 668536 - RNA, 64 nt, Homo Sapiens; identical to SEQ ID NO: 113733

SEQ ID NO: 668537 - RNA, 64 nt, Homo Sapiens; identical to SEQ ID NO: 113734

SEQ ID NO: 668538 - RNA, 64 nt, Homo Sapiens; identical to SEQ ID NO: 113735

SEQ ID NO: 668539 - RNA, 64 nt, Homo Sapiens; identical to SEQ ID NO: 113736

SEQ ID NO: 668540 - RNA, 64 nt, Homo Sapiens; identical to SEQ ID NO: 113737

SEQ ID NO: 668541 - RNA, 64 nt, Homo Sapiens; identical to SEQ ID NO: 113738

SEQ ID NO: 668542 - RNA, 64 nt, Homo Sapiens; identical to SEQ ID NO: 113739

SEQ ID NO: 668543 - RNA, 64 nt, Homo Sapiens; identical to SEQ ID NO: 113740

SEQ ID NO: 668544 - RNA, 64 nt, Homo Sapiens; identical to SEQ ID NO: 113741

SEQ ID NO: 668545 - RNA, 64 nt, Homo Sapiens; identical to SEQ ID NO: 113742

SEQ ID NO: 668546 - RNA, 64 nt, Homo Sapiens; identical to SEQ ID NO: 113743

SEQ ID NO: 668547 - RNA, 64 nt, Homo Sapiens; identical to SEQ ID NO: 113744

SEQ ID NO: 668548 - RNA, 64 nt, Homo Sapiens; identical to SEQ ID NO: 113745

SEQ ID NO: 668549 - RNA, 64 nt, Homo Sapiens; identical to SEQ ID NO: 113746

SEQ ID NO: 668550 - RNA, 64 nt, Homo Sapiens; identical to SEQ ID NO: 113747

SEQ ID NO: 668551 - RNA, 64 nt, Homo Sapiens; identical to SEQ ID NO: 113748

SEQ ID NO: 668552 - RNA, 64 nt, Homo Sapiens; identical to SEQ ID NO: 113749

SEQ ID NO: 668553 - RNA, 64 nt, Homo Sapiens; identical to SEQ ID NO: 113750

SEQ ID NO: 668554 - RNA, 64 nt, Homo Sapiens; identical to SEQ ID NO: 113751

SEQ ID NO: 668555 - RNA, 64 nt, Homo Sapiens; identical to SEQ ID NO: 113752

SEQ ID NO: 668556 - RNA, 64 nt, Homo Sapiens; identical to SEQ ID NO: 113753

SEQ ID NO: 668557 - RNA, 64 nt, Homo Sapiens; identical to SEQ ID NO: 113754

SEQ ID NO: 668558 - RNA, 64 nt, Homo Sapiens; identical to SEQ ID NO: 113755

SEQ ID NO: 668559 - RNA, 64 nt, Homo Sapiens; identical to SEQ ID NO: 113756

SEQ ID NO: 668560 - RNA, 64 nt, Homo Sapiens; identical to SEQ ID NO: 113757

SEQ ID NO: 668561 - RNA, 64 nt, Homo Sapiens; identical to SEQ ID NO: 113758

SEQ ID NO: 668562 - RNA, 64 nt, Homo Sapiens; identical to SEQ ID NO: 113759

SEQ ID NO: 668563 - RNA, 64 nt, Homo Sapiens; identical to SEQ ID NO: 113760

SEQ ID NO: 668564 - RNA, 64 nt, Homo Sapiens; identical to SEQ ID NO: 113761

SEQ ID NO: 668565 - RNA, 64 nt, Homo Sapiens; identical to SEQ ID NO: 113762

SEQ ID NO: 668566 - RNA, 64 nt, Homo Sapiens; identical to SEQ ID NO: 113763

SEQ ID NO: 668567 - RNA, 64 nt, Homo Sapiens; identical to SEQ ID NO: 113764

SEQ ID NO: 668568 - RNA, 61 nt, Homo Sapiens; identical to SEQ ID NO: 113765

SEQ ID NO: 668569 - RNA, 64 nt, Homo Sapiens; identical to SEQ ID NO: 113766

SEQ ID NO: 668570 - RNA, 64 nt, Homo Sapiens; identical to SEQ ID NO: 113767

SEQ ID NO: 668571 - RNA, 64 nt, Homo Sapiens; identical to SEQ ID NO: 113768

SEQ ID NO: 668572 - RNA, 64 nt, Homo Sapiens; identical to SEQ ID NO: 113769

SEQ ID NO: 668573 - RNA, 64 nt, Homo Sapiens; identical to SEQ ID NO: 113770

SEQ ID NO: 668574 - RNA, 64 nt, Homo Sapiens; identical to SEQ ID NO: 113771

SEQ ID NO: 668575 - RNA, 64 nt, Homo Sapiens; identical to SEQ ID NO: 113772

SEQ ID NO: 668576 - RNA, 64 nt, Homo Sapiens; identical to SEQ ID NO: 113773

SEQ ID NO: 668577 - RNA, 64 nt, Homo Sapiens; identical to SEQ ID NO: 113774

SEQ ID NO: 668578 - RNA, 64 nt, Homo Sapiens; identical to SEQ ID NO: 113775

SEQ ID NO: 668579 - RNA, 64 nt, Homo Sapiens; identical to SEQ ID NO: 113776

SEQ ID NO: 668580 - RNA, 64 nt, Homo Sapiens; identical to SEQ ID NO: 113777

SEQ ID NO: 668581 - RNA, 64 nt, Homo Sapiens; identical to SEQ ID NO: 113778

SEQ ID NO: 668582 - RNA, 64 nt, Homo Sapiens; identical to SEQ ID NO: 113779

SEQ ID NO: 668583 - RNA, 64 nt, Homo Sapiens; identical to SEQ ID NO: 113780

SEQ ID NO: 668584 - RNA, 64 nt, Homo Sapiens; identical to SEQ ID NO: 113781

SEQ ID NO: 668585 - RNA, 64 nt, Homo Sapiens; identical to SEQ ID NO: 113782

SEQ ID NO: 668586 - RNA, 64 nt, Homo Sapiens; identical to SEQ ID NO: 113783

SEQ ID NO: 668587 - RNA, 64 nt, Homo Sapiens; identical to SEQ ID NO: 113784

SEQ ID NO: 668588 - RNA, 64 nt, Homo Sapiens; identical to SEQ ID NO: 113785

SEQ ID NO: 668589 - RNA, 64 nt, Homo Sapiens; identical to SEQ ID NO: 113786

SEQ ID NO: 668590 - RNA, 64 nt, Homo Sapiens; identical to SEQ ID NO: 113787

SEQ ID NO: 668591 - RNA, 64 nt, Homo Sapiens; identical to SEQ ID NO: 113788

SEQ ID NO: 668592 - RNA, 64 nt, Homo Sapiens; identical to SEQ ID NO: 113789

SEQ ID NO: 668593 - RNA, 64 nt, Homo Sapiens; identical to SEQ ID NO: 113790

SEQ ID NO: 668594 - RNA, 64 nt, Homo Sapiens; identical to SEQ ID NO: 113791

SEQ ID NO: 668595 - RNA, 64 nt, Homo Sapiens; identical to SEQ ID NO: 113792

SEQ ID NO: 668596 - RNA, 64 nt, Homo Sapiens; identical to SEQ ID NO: 113793

SEQ ID NO: 668597 - RNA, 64 nt, Homo Sapiens; identical to SEQ ID NO: 113794

SEQ ID NO: 668598 - RNA, 64 nt, Homo Sapiens; identical to SEQ ID NO: 113795

SEQ ID NO: 668599 - RNA, 64 nt, Homo Sapiens; identical to SEQ ID NO: 113796

SEQ ID NO: 668600 - RNA, 64 nt, Homo Sapiens; identical to SEQ ID NO: 113797

SEQ ID NO: 668601 - RNA, 64 nt, Homo Sapiens; identical to SEQ ID NO: 113798

SEQ ID NO: 668602 - RNA, 64 nt, Homo Sapiens; identical to SEQ ID NO: 113799

SEQ ID NO: 668603 - RNA, 64 nt, Homo Sapiens; identical to SEQ ID NO: 113800

SEQ ID NO: 668604 - RNA, 64 nt, Homo Sapiens; identical to SEQ ID NO: 113801

SEQ ID NO: 668605 - RNA, 64 nt, Homo Sapiens; identical to SEQ ID NO: 113802

SEQ ID NO: 668606 - RNA, 64 nt, Homo Sapiens; identical to SEQ ID NO: 113803

SEQ ID NO: 668607 - RNA, 64 nt, Homo Sapiens; identical to SEQ ID NO: 113804

SEQ ID NO: 668608 - RNA, 64 nt, Homo Sapiens; identical to SEQ ID NO: 113805

SEQ ID NO: 668609 - RNA, 64 nt, Homo Sapiens; identical to SEQ ID NO: 113806

SEQ ID NO: 668610 - RNA, 64 nt, Homo Sapiens; identical to SEQ ID NO: 113807

SEQ ID NO: 668611 - RNA, 64 nt, Homo Sapiens; identical to SEQ ID NO: 113808

SEQ ID NO: 668612 - RNA, 64 nt, Homo Sapiens; identical to SEQ ID NO: 113809

SEQ ID NO: 668613 - RNA, 64 nt, Homo Sapiens; identical to SEQ ID NO: 113810

SEQ ID NO: 668614 - RNA, 64 nt, Homo Sapiens; identical to SEQ ID NO: 113811

SEQ ID NO: 668615 - RNA, 64 nt, Homo Sapiens; identical to SEQ ID NO: 125388

SEQ ID NO: 668616 - RNA, 64 nt, Homo Sapiens; identical to SEQ ID NO: 125389

SEQ ID NO: 668617 - RNA, 64 nt, Homo Sapiens; identical to SEQ ID NO: 125390

SEQ ID NO: 668618 - RNA, 64 nt, Homo Sapiens; identical to SEQ ID NO: 125391

SEQ ID NO: 668619 - RNA, 64 nt, Homo Sapiens; identical to SEQ ID NO: 125392

SEQ ID NO: 668620 - RNA, 64 nt, Homo Sapiens; identical to SEQ ID NO: 125393

SEQ ID NO: 668621 - RNA, 64 nt, Homo Sapiens; identical to SEQ ID NO: 125394

SEQ ID NO: 668622 - RNA, 64 nt, Homo Sapiens; identical to SEQ ID NO: 125395

SEQ ID NO: 668623 - RNA, 64 nt, Homo Sapiens; identical to SEQ ID NO: 125396

SEQ ID NO: 668624 - RNA, 64 nt, Homo Sapiens; identical to SEQ ID NO: 125397

SEQ ID NO: 668625 - RNA, 64 nt, Homo Sapiens; identical to SEQ ID NO: 125398

SEQ ID NO: 668626 - RNA, 64 nt, Homo Sapiens; identical to SEQ ID NO: 125399

SEQ ID NO: 668627 - RNA, 64 nt, Homo Sapiens; identical to SEQ ID NO: 125400

SEQ ID NO: 668628 - RNA, 64 nt, Homo Sapiens; identical to SEQ ID NO: 125401

SEQ ID NO: 668629 - RNA, 64 nt, Homo Sapiens
aguugauggacacuuagguuccacauuuucuuuauccacuuaucuaguccaugguacauauaua

SEQ ID NO: 668630 - RNA, 64 nt, Homo Sapiens
agugagaacaugcaguauuuccuacagcuaagcuuccacuuauaacuguguauguucuugugua

SEQ ID NO: 668631 - RNA, 64 nt, Homo Sapiens
uuaaagaacaaaccaugugacaaaauuguuaccuuccacuuacuguagcaaauaauaccuacaa

SEQ ID NO: 668632 - RNA, 64 nt, Homo Sapiens
uauuugcuguuguguaauauccauggacauguaauccacuuacuccaucuuuacaaucccuuuu

SEQ ID NO: 668633 - RNA, 64 nt, Homo Sapiens
gccauuaccaacuccaaauaaucucaaauaauuuuccacuuaauaacuguaaaguuuuuuucug

SEQ ID NO: 668634 - RNA, 64 nt, Homo Sapiens
cuauuugcccuuaguuuagaucuccaucaucaauuccacuuacuauuguaauaccuucagcugg

SEQ ID NO: 668635 - RNA, 64 nt, Homo Sapiens
uaggaagcaagaucgcuguggaggugaggguggggugccccagcacagcaguuucaccaucuuu

SEQ ID NO: 668636 - RNA, 64 nt, Homo Sapiens
uguuguccugaacugugaguagcugugaauggcugugccccaccgauaauauauacaaaccuuu

SEQ ID NO: 668637 - RNA, 50 nt, Homo Sapiens
gggcguccgcugcucccugagugccccacuccggaguuauccugcucccc

SEQ ID NO: 668638 - RNA, 64 nt, Homo Sapiens
ucccccaucgugggacacgacacacccagaccgcgugccccaccgucuuagcuucaauccuggc

SEQ ID NO: 668639 - RNA, 64 nt, Homo Sapiens
aggcagcaccugccccagaucacuugcuugcucugugccccauggagaaaugcuggcugagggu

SEQ ID NO: 668640 - RNA, 64 nt, Homo Sapiens
gucacagaacaccuggacaccuugcuaugucugggugccccauaaggucacugcuguggcgagu

SEQ ID NO: 668641 - RNA, 64 nt, Homo Sapiens
gaccuaauauauguccggaccuugccaugccugugugccccacagggucacugccacauggagu

SEQ ID NO: 668642 - RNA, 64 nt, Homo Sapiens
gagucacagugugucuggaccauaucagaucugagugccccacaggagccacugucaugcaggu

SEQ ID NO: 668643 - RNA, 64 nt, Homo Sapiens
agacauccagggaaagaggaagaaaggccuuagugugccccagcagucuggcugcguccagcca

SEQ ID NO: 668644 - RNA, 64 nt, Homo Sapiens
gugcacgaagggggcacaggagaggagaggggcugugccccaggcuccccauuucccagcuccu

SEQ ID NO: 668645 - RNA, 64 nt, Homo Sapiens
uggcgauggcuucugcuagcugucacccugccuugugccccaggcauccucagccucuggugag

SEQ ID NO: 668646 - RNA, 64 nt, Homo Sapiens
cugccagagaccauccaggacguggagagaaagagugccccaaccagucuucaggaggaagaga

SEQ ID NO: 668647 - RNA, 64 nt, Homo Sapiens
aagcuuguagguggguggugugcauaggccacgugugccccacauaugcagggggugccccaca

SEQ ID NO: 668648 - RNA, 64 nt, Homo Sapiens
ugcauaggccacgugugccccacauaugcagggggugccccacacagcuagagcggccaggaga

SEQ ID NO: 668649 - RNA, 64 nt, Homo Sapiens
cccuguggguuuccccuaugccugagcagcaggugugccccauggagagcuggaaaggggcaac

SEQ ID NO: 668650 - RNA, 64 nt, Homo Sapiens
gaagacagaagcgagagaaucuucccgagggucagugccccagugugccaggagccaaccuggu

SEQ ID NO: 668651 - RNA, 64 nt, Homo Sapiens
auucugggguuauuuaacaacuccuccccuguacgugccccagccuuccuccucccugcuuccu

SEQ ID NO: 668652 - RNA, 64 nt, Homo Sapiens
uccucuuauuccuacaucccccuugcccuuggcagugccccacagauacaacccugauuuuuga

SEQ ID NO: 668653 - RNA, 64 nt, Homo Sapiens
gagaccaucaccuggcucaucguuuccaccaagagugccccacaggagugccccacagacccgc

SEQ ID NO: 668654 - RNA, 64 nt, Homo Sapiens
ggcucaucguuuccaccaagagugccccacaggagugccccacagacccgcuggaccagccugc

SEQ ID NO: 668655 - RNA, 64 nt, Homo Sapiens
ccagcggcacuaaugacccgcuccuuugacauuggugccccacuccaucagcacuaacgcccug

SEQ ID NO: 668656 - RNA, 64 nt, Homo Sapiens
uccaucaucacuacguccagcuccaacggcacuggugccccauuccaucggcacuaacgccccg

SEQ ID NO: 668657 - RNA, 64 nt, Homo Sapiens
ccagccuggggaccccacuuauccuuggugcugugugccccacuggugggggguccagucugug

SEQ ID NO: 668658 - RNA, 64 nt, Homo Sapiens
ugccuggugcauugcuguguaaggacagcagcuggugccccacccuguucucuuggcugcaaau

SEQ ID NO: 668659 - RNA, 64 nt, Homo Sapiens
cagcagguccuaauccugugugccagggcaggcagugccccaggggcaccacgccugacucucc

SEQ ID NO: 668660 - RNA, 64 nt, Homo Sapiens
uugguuuuauccacuuuucuuggauaaucaggaggugccccaguggucacaguguggcauuccg

SEQ ID NO: 668661 - RNA, 64 nt, Homo Sapiens
uugagcuggacguggggcuaugcccaccgugacagugccccagcgggugagggugucuuuaaga

SEQ ID NO: 668662 - RNA, 64 nt, Homo Sapiens
ugacccugucucugccuggagcuacaggguucaggugccccagguucagcagagggcacagcag

SEQ ID NO: 668663 - RNA, 64 nt, Homo Sapiens
acugggaggccaaggagaagcaagacuggcauaugugccccaacaucuucugagcgccacccuu

SEQ ID NO: 668664 - RNA, 64 nt, Homo Sapiens
uugcaucccuccucauccuaggaggccccuaggggugccccaucucaguguccccugaacucuu

SEQ ID NO: 668665 - RNA, 64 nt, Homo Sapiens
uccccagagcccugcagucagggucaggcuacaggugccccacccuuuggaagcagcaaggugg

SEQ ID NO: 668666 - RNA, 64 nt, Homo Sapiens
aggcccagcccugggcaaggccacgguguggggggugccccacagcacccugcaggcaggcaga

SEQ ID NO: 668667 - RNA, 64 nt, Homo Sapiens
ggugcgggccaggucuggcgccccugggaacacagugccccagugcuggugggauaggagggug

SEQ ID NO: 668668 - RNA, 64 nt, Homo Sapiens
uccaaaugcuucuuccaguucauuuuucagccaucaguucaagagccaaugccuuuuuaaaaua

SEQ ID NO: 668669 - RNA, 64 nt, Homo Sapiens
auguauuuucaaauagaguucaggaucugcaauucaguucaacacaaguuuguugagcuuuaaa

SEQ ID NO: 668670 - RNA, 64 nt, Homo Sapiens
uccaaguucucacugcuggaaagagcuagaagcacaguucaaaguucuggcuucuggacucugc

SEQ ID NO: 668671 - RNA, 64 nt, Homo Sapiens
aaguggcccauaacuugaaggaaaaguuuaaagacaguucaauuuaaucaucagaaugcauucu

SEQ ID NO: 668672 - RNA, 64 nt, Homo Sapiens
aagcacggagaaguguugcccauauguugggcaacaguucaaauucauguguuuaaacaaaucc

SEQ ID NO: 668673 - RNA, 64 nt, Homo Sapiens
gaagcacaaggauuaaguugaugacaaaaauaaacaguucaaguagacaauguugcaauguuga

SEQ ID NO: 668674 - RNA, 64 nt, Homo Sapiens
gccccuauuuauuucaauaaguuuccuuagaccucaguucaaguaaagcacaacacuaauguuc

SEQ ID NO: 668675 - RNA, 64 nt, Homo Sapiens
gagucugcaauuggaacugcucccccgccucuuccaguucaaagguugauuuccuguuuccucc

SEQ ID NO: 668676 - RNA, 64 nt, Homo Sapiens
uuugaagggcaugcuguaauuucacacaauuuuccaguucaaaaauggagaauacuucgccuaa

SEQ ID NO: 668677 - RNA, 64 nt, Homo Sapiens
acgugaucuuggcucacugcgaccuccaccuccccaguucaagcgauucuccugccucagccuc

SEQ ID NO: 668678 - RNA, 64 nt, Homo Sapiens
aauucuccugccucagccucccgccaccucaaggcaguucaagcaucucggcucacuucagccu

SEQ ID NO: 668679 - RNA, 64 nt, Homo Sapiens
ugcagcuacuuaaugauuaaguaucaaaauagaacaguucaauuacacuggacacucuuaggaa

SEQ ID NO: 668680 - RNA, 64 nt, Homo Sapiens; identical to SEQ ID NO: 87407

SEQ ID NO: 668681 - RNA, 64 nt, Homo Sapiens; identical to SEQ ID NO: 87408

SEQ ID NO: 668682 - RNA, 64 nt, Homo Sapiens; identical to SEQ ID NO: 87409

SEQ ID NO: 668683 - RNA, 64 nt, Homo Sapiens; identical to SEQ ID NO: 87410

SEQ ID NO: 668684 - RNA, 64 nt, Homo Sapiens; identical to SEQ ID NO: 87411

SEQ ID NO: 668685 - RNA, 64 nt, Homo Sapiens; identical to SEQ ID NO: 87412

SEQ ID NO: 668686 - RNA, 64 nt, Homo Sapiens; identical to SEQ ID NO: 87413

SEQ ID NO: 668687 - RNA, 64 nt, Homo Sapiens; identical to SEQ ID NO: 87414

SEQ ID NO: 668688 - RNA, 64 nt, Homo Sapiens; identical to SEQ ID NO: 87415

SEQ ID NO: 668689 - RNA, 64 nt, Homo Sapiens; identical to SEQ ID NO: 87416

SEQ ID NO: 668690 - RNA, 64 nt, Homo Sapiens; identical to SEQ ID NO: 87417

SEQ ID NO: 668691 - RNA, 64 nt, Homo Sapiens; identical to SEQ ID NO: 87418

SEQ ID NO: 668692 - RNA, 64 nt, Homo Sapiens; identical to SEQ ID NO: 87419

SEQ ID NO: 668693 - RNA, 64 nt, Homo Sapiens; identical to SEQ ID NO: 87420

SEQ ID NO: 668694 - RNA, 64 nt, Homo Sapiens; identical to SEQ ID NO: 87421

SEQ ID NO: 668695 - RNA, 64 nt, Homo Sapiens; identical to SEQ ID NO: 87422

SEQ ID NO: 668696 - RNA, 64 nt, Homo Sapiens; identical to SEQ ID NO: 87423

SEQ ID NO: 668697 - RNA, 64 nt, Homo Sapiens; identical to SEQ ID NO: 87424

SEQ ID NO: 668698 - RNA, 64 nt, Homo Sapiens; identical to SEQ ID NO: 238476

SEQ ID NO: 668699 - RNA, 64 nt, Homo Sapiens; identical to SEQ ID NO: 238477

SEQ ID NO: 668700 - RNA, 53 nt, Homo Sapiens; identical to SEQ ID NO: 238478

SEQ ID NO: 668701 - RNA, 64 nt, Homo Sapiens; identical to SEQ ID NO: 238479

SEQ ID NO: 668702 - RNA, 64 nt, Homo Sapiens; identical to SEQ ID NO: 238480

SEQ ID NO: 668703 - RNA, 64 nt, Homo Sapiens; identical to SEQ ID NO: 238481

SEQ ID NO: 668704 - RNA, 64 nt, Homo Sapiens; identical to SEQ ID NO: 238482

SEQ ID NO: 668705 - RNA, 64 nt, Homo Sapiens; identical to SEQ ID NO: 238483

SEQ ID NO: 668706 - RNA, 64 nt, Homo Sapiens; identical to SEQ ID NO: 238484

SEQ ID NO: 668707 - RNA, 64 nt, Homo Sapiens; identical to SEQ ID NO: 238485

SEQ ID NO: 668708 - RNA, 64 nt, Homo Sapiens; identical to SEQ ID NO: 238486

SEQ ID NO: 668709 - RNA, 64 nt, Homo Sapiens; identical to SEQ ID NO: 238487

SEQ ID NO: 668710 - RNA, 64 nt, Homo Sapiens; identical to SEQ ID NO: 238488

SEQ ID NO: 668711 - RNA, 64 nt, Homo Sapiens; identical to SEQ ID NO: 238489

SEQ ID NO: 668712 - RNA, 64 nt, Homo Sapiens; identical to SEQ ID NO: 294474

SEQ ID NO: 668713 - RNA, 64 nt, Homo Sapiens; identical to SEQ ID NO: 294475

SEQ ID NO: 668714 - RNA, 64 nt, Homo Sapiens; identical to SEQ ID NO: 294476

SEQ ID NO: 668715 - RNA, 64 nt, Homo Sapiens; identical to SEQ ID NO: 294477

SEQ ID NO: 668716 - RNA, 64 nt, Homo Sapiens; identical to SEQ ID NO: 294478

SEQ ID NO: 668717 - RNA, 64 nt, Homo Sapiens; identical to SEQ ID NO: 294479

SEQ ID NO: 668718 - RNA, 64 nt, Homo Sapiens; identical to SEQ ID NO: 667937

SEQ ID NO: 668719 - RNA, 64 nt, Homo Sapiens; identical to SEQ ID NO: 667938

SEQ ID NO: 668720 - RNA, 64 nt, Homo Sapiens; identical to SEQ ID NO: 667939

SEQ ID NO: 668721 - RNA, 64 nt, Homo Sapiens; identical to SEQ ID NO: 667940

SEQ ID NO: 668722 - RNA, 64 nt, Homo Sapiens; identical to SEQ ID NO: 667941

SEQ ID NO: 668723 - RNA, 64 nt, Homo Sapiens; identical to SEQ ID NO: 667942

SEQ ID NO: 668724 - RNA, 64 nt, Homo Sapiens; identical to SEQ ID NO: 667943

SEQ ID NO: 668725 - RNA, 64 nt, Homo Sapiens; identical to SEQ ID NO: 667944

SEQ ID NO: 668726 - RNA, 64 nt, Homo Sapiens; identical to SEQ ID NO: 667945

SEQ ID NO: 668727 - RNA, 64 nt, Homo Sapiens; identical to SEQ ID NO: 667946

SEQ ID NO: 668728 - RNA, 64 nt, Homo Sapiens; identical to SEQ ID NO: 667947

SEQ ID NO: 668729 - RNA, 64 nt, Homo Sapiens; identical to SEQ ID NO: 667948

SEQ ID NO: 668730 - RNA, 64 nt, Homo Sapiens; identical to SEQ ID NO: 667949

SEQ ID NO: 668731 - RNA, 64 nt, Homo Sapiens; identical to SEQ ID NO: 667950

SEQ ID NO: 668732 - RNA, 64 nt, Homo Sapiens; identical to SEQ ID NO: 667951

SEQ ID NO: 668733 - RNA, 64 nt, Homo Sapiens; identical to SEQ ID NO: 667952

SEQ ID NO: 668734 - RNA, 64 nt, Homo Sapiens; identical to SEQ ID NO: 667953

SEQ ID NO: 668735 - RNA, 64 nt, Homo Sapiens; identical to SEQ ID NO: 667954

SEQ ID NO: 668736 - RNA, 64 nt, Homo Sapiens; identical to SEQ ID NO: 667955

SEQ ID NO: 668737 - RNA, 64 nt, Homo Sapiens; identical to SEQ ID NO: 667956

SEQ ID NO: 668738 - RNA, 64 nt, Homo Sapiens; identical to SEQ ID NO: 667957

SEQ ID NO: 668739 - RNA, 64 nt, Homo Sapiens; identical to SEQ ID NO: 667958

SEQ ID NO: 668740 - RNA, 64 nt, Homo Sapiens; identical to SEQ ID NO: 667959

SEQ ID NO: 668741 - RNA, 64 nt, Homo Sapiens; identical to SEQ ID NO: 667960

SEQ ID NO: 668742 - RNA, 64 nt, Homo Sapiens; identical to SEQ ID NO: 667961

SEQ ID NO: 668743 - RNA, 64 nt, Homo Sapiens; identical to SEQ ID NO: 667962

SEQ ID NO: 668744 - RNA, 64 nt, Homo Sapiens; identical to SEQ ID NO: 667963

SEQ ID NO: 668745 - RNA, 64 nt, Homo Sapiens; identical to SEQ ID NO: 667964

SEQ ID NO: 668746 - RNA, 64 nt, Homo Sapiens; identical to SEQ ID NO: 667965

SEQ ID NO: 668747 - RNA, 64 nt, Homo Sapiens; identical to SEQ ID NO: 667966

SEQ ID NO: 668748 - RNA, 64 nt, Homo Sapiens; identical to SEQ ID NO: 667967

SEQ ID NO: 668749 - RNA, 64 nt, Homo Sapiens; identical to SEQ ID NO: 667968

SEQ ID NO: 668750 - RNA, 64 nt, Homo Sapiens; identical to SEQ ID NO: 667969

SEQ ID NO: 668751 - RNA, 64 nt, Homo Sapiens; identical to SEQ ID NO: 667970

SEQ ID NO: 668752 - RNA, 64 nt, Homo Sapiens; identical to SEQ ID NO: 667971

SEQ ID NO: 668753 - RNA, 64 nt, Homo Sapiens; identical to SEQ ID NO: 667972

SEQ ID NO: 668754 - RNA, 64 nt, Homo Sapiens; identical to SEQ ID NO: 667973

SEQ ID NO: 668755 - RNA, 64 nt, Homo Sapiens; identical to SEQ ID NO: 667974

SEQ ID NO: 668756 - RNA, 64 nt, Homo Sapiens; identical to SEQ ID NO: 667975

SEQ ID NO: 668757 - RNA, 64 nt, Homo Sapiens; identical to SEQ ID NO: 667976

SEQ ID NO: 668758 - RNA, 64 nt, Homo Sapiens; identical to SEQ ID NO: 667977

SEQ ID NO: 668759 - RNA, 64 nt, Homo Sapiens; identical to SEQ ID NO: 667978

SEQ ID NO: 668760 - RNA, 64 nt, Homo Sapiens; identical to SEQ ID NO: 667979

SEQ ID NO: 668761 - RNA, 64 nt, Homo Sapiens; identical to SEQ ID NO: 667980

SEQ ID NO: 668762 - RNA, 64 nt, Homo Sapiens; identical to SEQ ID NO: 667981

SEQ ID NO: 668763 - RNA, 64 nt, Homo Sapiens; identical to SEQ ID NO: 667982

SEQ ID NO: 668764 - RNA, 64 nt, Homo Sapiens; identical to SEQ ID NO: 667983

SEQ ID NO: 668765 - RNA, 64 nt, Homo Sapiens; identical to SEQ ID NO: 667984

SEQ ID NO: 668766 - RNA, 64 nt, Homo Sapiens; identical to SEQ ID NO: 667985

SEQ ID NO: 668767 - RNA, 64 nt, Homo Sapiens; identical to SEQ ID NO: 667986

SEQ ID NO: 668768 - RNA, 64 nt, Homo Sapiens; identical to SEQ ID NO: 667987

SEQ ID NO: 668769 - RNA, 64 nt, Homo Sapiens; identical to SEQ ID NO: 667988

SEQ ID NO: 668770 - RNA, 64 nt, Homo Sapiens; identical to SEQ ID NO: 667989

SEQ ID NO: 668771 - RNA, 64 nt, Homo Sapiens; identical to SEQ ID NO: 667990

SEQ ID NO: 668772 - RNA, 64 nt, Homo Sapiens; identical to SEQ ID NO: 667991

SEQ ID NO: 668773 - RNA, 64 nt, Homo Sapiens; identical to SEQ ID NO: 667992

SEQ ID NO: 668774 - RNA, 64 nt, Homo Sapiens; identical to SEQ ID NO: 667993

SEQ ID NO: 668775 - RNA, 64 nt, Homo Sapiens; identical to SEQ ID NO: 667994

SEQ ID NO: 668776 - RNA, 64 nt, Homo Sapiens; identical to SEQ ID NO: 667995

SEQ ID NO: 668777 - RNA, 64 nt, Homo Sapiens; identical to SEQ ID NO: 667996

SEQ ID NO: 668778 - RNA, 64 nt, Homo Sapiens; identical to SEQ ID NO: 667997

SEQ ID NO: 668779 - RNA, 64 nt, Homo Sapiens; identical to SEQ ID NO: 667998

SEQ ID NO: 668780 - RNA, 64 nt, Homo Sapiens; identical to SEQ ID NO: 667999

SEQ ID NO: 668781 - RNA, 64 nt, Homo Sapiens; identical to SEQ ID NO: 668000

SEQ ID NO: 668782 - RNA, 64 nt, Homo Sapiens; identical to SEQ ID NO: 668001

SEQ ID NO: 668783 - RNA, 64 nt, Homo Sapiens; identical to SEQ ID NO: 668002

SEQ ID NO: 668784 - RNA, 64 nt, Homo Sapiens; identical to SEQ ID NO: 668003

SEQ ID NO: 668785 - RNA, 64 nt, Homo Sapiens; identical to SEQ ID NO: 668004

SEQ ID NO: 668786 - RNA, 64 nt, Homo Sapiens; identical to SEQ ID NO: 668005

SEQ ID NO: 668787 - RNA, 64 nt, Homo Sapiens; identical to SEQ ID NO: 668006

SEQ ID NO: 668788 - RNA, 64 nt, Homo Sapiens; identical to SEQ ID NO: 668007

SEQ ID NO: 668789 - RNA, 64 nt, Homo Sapiens; identical to SEQ ID NO: 668008

SEQ ID NO: 668790 - RNA, 64 nt, Homo Sapiens; identical to SEQ ID NO: 668009

SEQ ID NO: 668791 - RNA, 64 nt, Homo Sapiens; identical to SEQ ID NO: 668010

SEQ ID NO: 668792 - RNA, 64 nt, Homo Sapiens; identical to SEQ ID NO: 668011

SEQ ID NO: 668793 - RNA, 64 nt, Homo Sapiens; identical to SEQ ID NO: 668012

SEQ ID NO: 668794 - RNA, 64 nt, Homo Sapiens; identical to SEQ ID NO: 668013

SEQ ID NO: 668795 - RNA, 64 nt, Homo Sapiens; identical to SEQ ID NO: 668014

SEQ ID NO: 668796 - RNA, 64 nt, Homo Sapiens; identical to SEQ ID NO: 668015

SEQ ID NO: 668797 - RNA, 64 nt, Homo Sapiens; identical to SEQ ID NO: 668016

SEQ ID NO: 668798 - RNA, 64 nt, Homo Sapiens; identical to SEQ ID NO: 668017

SEQ ID NO: 668799 - RNA, 64 nt, Homo Sapiens; identical to SEQ ID NO: 668018

SEQ ID NO: 668800 - RNA, 64 nt, Homo Sapiens; identical to SEQ ID NO: 668019

SEQ ID NO: 668801 - RNA, 64 nt, Homo Sapiens; identical to SEQ ID NO: 668020

SEQ ID NO: 668802 - RNA, 64 nt, Homo Sapiens; identical to SEQ ID NO: 668021

SEQ ID NO: 668803 - RNA, 64 nt, Homo Sapiens; identical to SEQ ID NO: 668022

SEQ ID NO: 668804 - RNA, 64 nt, Homo Sapiens; identical to SEQ ID NO: 668023

SEQ ID NO: 668805 - RNA, 64 nt, Homo Sapiens; identical to SEQ ID NO: 668024

SEQ ID NO: 668806 - RNA, 64 nt, Homo Sapiens; identical to SEQ ID NO: 668025

SEQ ID NO: 668807 - RNA, 64 nt, Homo Sapiens; identical to SEQ ID NO: 668026

SEQ ID NO: 668808 - RNA, 64 nt, Homo Sapiens; identical to SEQ ID NO: 668027

SEQ ID NO: 668809 - RNA, 64 nt, Homo Sapiens; identical to SEQ ID NO: 668028

SEQ ID NO: 668810 - RNA, 64 nt, Homo Sapiens; identical to SEQ ID NO: 668029

SEQ ID NO: 668811 - RNA, 64 nt, Homo Sapiens; identical to SEQ ID NO: 668030

SEQ ID NO: 668812 - RNA, 64 nt, Homo Sapiens; identical to SEQ ID NO: 420116

SEQ ID NO: 668813 - RNA, 64 nt, Homo Sapiens; identical to SEQ ID NO: 420117

SEQ ID NO: 668814 - RNA, 64 nt, Homo Sapiens; identical to SEQ ID NO: 420118

SEQ ID NO: 668815 - RNA, 64 nt, Homo Sapiens; identical to SEQ ID NO: 420119

SEQ ID NO: 668816 - RNA, 64 nt, Homo Sapiens; identical to SEQ ID NO: 420120

SEQ ID NO: 668817 - RNA, 64 nt, Homo Sapiens; identical to SEQ ID NO: 420121

SEQ ID NO: 668818 - RNA, 64 nt, Homo Sapiens; identical to SEQ ID NO: 420122

SEQ ID NO: 668819 - RNA, 64 nt, Homo Sapiens; identical to SEQ ID NO: 420123

SEQ ID NO: 668820 - RNA, 64 nt, Homo Sapiens; identical to SEQ ID NO: 420124

SEQ ID NO: 668821 - RNA, 64 nt, Homo Sapiens; identical to SEQ ID NO: 420125

SEQ ID NO: 668822 - RNA, 64 nt, Homo Sapiens; identical to SEQ ID NO: 420126

SEQ ID NO: 668823 - RNA, 64 nt, Homo Sapiens; identical to SEQ ID NO: 420127

SEQ ID NO: 668824 - RNA, 64 nt, Homo Sapiens; identical to SEQ ID NO: 420128

SEQ ID NO: 668825 - RNA, 64 nt, Homo Sapiens; identical to SEQ ID NO: 420129

SEQ ID NO: 668826 - RNA, 64 nt, Homo Sapiens; identical to SEQ ID NO: 420130

SEQ ID NO: 668827 - RNA, 64 nt, Homo Sapiens; identical to SEQ ID NO: 420131

SEQ ID NO: 668828 - RNA, 64 nt, Homo Sapiens; identical to SEQ ID NO: 420132

SEQ ID NO: 668829 - RNA, 64 nt, Homo Sapiens; identical to SEQ ID NO: 420133

SEQ ID NO: 668830 - RNA, 64 nt, Homo Sapiens; identical to SEQ ID NO: 420134

SEQ ID NO: 668831 - RNA, 64 nt, Homo Sapiens; identical to SEQ ID NO: 420135

SEQ ID NO: 668832 - RNA, 64 nt, Homo Sapiens; identical to SEQ ID NO: 420136

SEQ ID NO: 668833 - RNA, 64 nt, Homo Sapiens; identical to SEQ ID NO: 420137

SEQ ID NO: 668834 - RNA, 64 nt, Homo Sapiens; identical to SEQ ID NO: 420138

SEQ ID NO: 668835 - RNA, 64 nt, Homo Sapiens; identical to SEQ ID NO: 420139

SEQ ID NO: 668836 - RNA, 64 nt, Homo Sapiens; identical to SEQ ID NO: 420140

SEQ ID NO: 668837 - RNA, 64 nt, Homo Sapiens; identical to SEQ ID NO: 117329

SEQ ID NO: 668838 - RNA, 64 nt, Homo Sapiens; identical to SEQ ID NO: 117330

SEQ ID NO: 668839 - RNA, 64 nt, Homo Sapiens; identical to SEQ ID NO: 117331

SEQ ID NO: 668840 - RNA, 64 nt, Homo Sapiens; identical to SEQ ID NO: 117332

SEQ ID NO: 668841 - RNA, 64 nt, Homo Sapiens; identical to SEQ ID NO: 117333

SEQ ID NO: 668842 - RNA, 64 nt, Homo Sapiens; identical to SEQ ID NO: 117334

SEQ ID NO: 668843 - RNA, 64 nt, Homo Sapiens; identical to SEQ ID NO: 117335

SEQ ID NO: 668844 - RNA, 64 nt, Homo Sapiens; identical to SEQ ID NO: 117336

SEQ ID NO: 668845 - RNA, 64 nt, Homo Sapiens; identical to SEQ ID NO: 117337

SEQ ID NO: 668846 - RNA, 64 nt, Homo Sapiens; identical to SEQ ID NO: 117338

SEQ ID NO: 668847 - RNA, 64 nt, Homo Sapiens; identical to SEQ ID NO: 117339

SEQ ID NO: 668848 - RNA, 64 nt, Homo Sapiens; identical to SEQ ID NO: 117340

SEQ ID NO: 668849 - RNA, 64 nt, Homo Sapiens; identical to SEQ ID NO: 117341

SEQ ID NO: 668850 - RNA, 64 nt, Homo Sapiens; identical to SEQ ID NO: 117342

SEQ ID NO: 668851 - RNA, 64 nt, Homo Sapiens; identical to SEQ ID NO: 117343

SEQ ID NO: 668852 - RNA, 64 nt, Homo Sapiens; identical to SEQ ID NO: 117344

SEQ ID NO: 668853 - RNA, 64 nt, Homo Sapiens; identical to SEQ ID NO: 117345

SEQ ID NO: 668854 - RNA, 64 nt, Homo Sapiens; identical to SEQ ID NO: 117346

SEQ ID NO: 668855 - RNA, 64 nt, Homo Sapiens; identical to SEQ ID NO: 117347

SEQ ID NO: 668856 - RNA, 64 nt, Homo Sapiens; identical to SEQ ID NO: 117348

SEQ ID NO: 668857 - RNA, 64 nt, Homo Sapiens; identical to SEQ ID NO: 117349

SEQ ID NO: 668858 - RNA, 64 nt, Homo Sapiens; identical to SEQ ID NO: 117350

SEQ ID NO: 668859 - RNA, 64 nt, Homo Sapiens; identical to SEQ ID NO: 117351

SEQ ID NO: 668860 - RNA, 64 nt, Homo Sapiens; identical to SEQ ID NO: 117352

SEQ ID NO: 668861 - RNA, 64 nt, Homo Sapiens; identical to SEQ ID NO: 117353

SEQ ID NO: 668862 - RNA, 64 nt, Homo Sapiens; identical to SEQ ID NO: 117354

SEQ ID NO: 668863 - RNA, 64 nt, Homo Sapiens; identical to SEQ ID NO: 117355

SEQ ID NO: 668864 - RNA, 64 nt, Homo Sapiens; identical to SEQ ID NO: 117356

SEQ ID NO: 668865 - RNA, 64 nt, Homo Sapiens; identical to SEQ ID NO: 117357

SEQ ID NO: 668866 - RNA, 64 nt, Homo Sapiens; identical to SEQ ID NO: 117358

SEQ ID NO: 668867 - RNA, 64 nt, Homo Sapiens; identical to SEQ ID NO: 117359

SEQ ID NO: 668868 - RNA, 64 nt, Homo Sapiens; identical to SEQ ID NO: 117360

SEQ ID NO: 668869 - RNA, 64 nt, Homo Sapiens; identical to SEQ ID NO: 117361

SEQ ID NO: 668870 - RNA, 64 nt, Homo Sapiens; identical to SEQ ID NO: 117362

SEQ ID NO: 668871 - RNA, 64 nt, Homo Sapiens
acaaacuccacccuaauguggaaugauaacugcacaguggcagaaguaagguacccccauccca

SEQ ID NO: 668872 - RNA, 64 nt, Homo Sapiens
gugcucccacuccagggccccagguuuuuuaauccaguggcaagccaguuaaagcccugacugg

SEQ ID NO: 668873 - RNA, 64 nt, Homo Sapiens
aucuuggcucacugcaaccuccuaggcuggagcacaguggcaugaacagggucuugcucuauug

SEQ ID NO: 668874 - RNA, 64 nt, Homo Sapiens
agagugguggcucuuccuagugaucagcuccaaccaguggcagcagaagcagggaugccugggg

SEQ ID NO: 668875 - RNA, 64 nt, Homo Sapiens
agacggagucugcucugucgcucgcgcuggagugcaguggcaugaucucggcucacugcaagcu

SEQ ID NO: 668876 - RNA, 64 nt, Homo Sapiens
gacagggucucacugugucccccaggcuggagugcaguggcacaaugacgacucacugcagccu

SEQ ID NO: 668877 - RNA, 64 nt, Homo Sapiens
aucucagcucacugcaaccucccaggcuggagugcaguggcauggauacaguuucacucuguca

SEQ ID NO: 668878 - RNA, 64 nt, Homo Sapiens
aucucaguuuaugcaacuuccccaggcuggagugcaguggcauggagacagagucucacuguca

SEQ ID NO: 668879 - RNA, 64 nt, Homo Sapiens
ggaagaaucucaaacagcgcuacuuacucaggaucaguggcaccagccaacucagcuuugggac

SEQ ID NO: 668880 - RNA, 64 nt, Homo Sapiens
caucucuacuaaaaauacaaaaauuagccggacgcaguggcacgcgccuguaaucccagcuacu

SEQ ID NO: 668881 - RNA, 64 nt, Homo Sapiens
gcaggagaaucaccugaacccccaggcuggaguacaguggcaggaucucagcuuacugcagcuu

SEQ ID NO: 668882 - RNA, 64 nt, Homo Sapiens
ucuaauuuaaaaaagaaaaagaaaaaaacauucccaguggcagccugccuaagacugucuuacc

SEQ ID NO: 668883 - RNA, 64 nt, Homo Sapiens
aucauagcucacugaaguuucuuaggcuggagugcaguggcacggauagggucuugcucaauuu

SEQ ID NO: 668884 - RNA, 64 nt, Homo Sapiens
gaguuugccaagaccaugcuccacggugaacagucaguggcaggaagcuguauagagcccgggu

SEQ ID NO: 668885 - RNA, 64 nt, Homo Sapiens
augggccgucacaaaggcuugaucacugccugggcaguggcacaaccaucccccaugucgcuac

SEQ ID NO: 668886 - RNA, 64 nt, Homo Sapiens
auagcagaagcagcuugguaggauggaaggcacgcaguggcauggccuggcuccuucccugagu

SEQ ID NO: 668887 - RNA, 64 nt, Homo Sapiens
aucucggcucacggcacgcucccaggcuggagugcaguggcacggacagagucucgcucuguug

SEQ ID NO: 668888 - RNA, 64 nt, Homo Sapiens
aucuuggcuuacugcaaccucccaggcugcagugcaguggcauggacggagucucacucuuccg

SEQ ID NO: 668889 - RNA, 64 nt, Homo Sapiens
gagacaggcucacucugucacccaggccagagugcaguggcacgaucauaguuaccgcagcauc

SEQ ID NO: 668890 - RNA, 64 nt, Homo Sapiens
ggugcggcuacuaagaugggaaaaacuaucacgacaguggcaccaccugauuucaugauguacc

SEQ ID NO: 668891 - RNA, 64 nt, Homo Sapiens
aucucggcccgcugcagccuaggcugcuggagugcaguggcacaacagucuuacucugucuccc

SEQ ID NO: 668892 - RNA, 64 nt, Homo Sapiens
aucauggcucacugcagccucccaggcuggagugcaguggcacagacagagucuugcucugucu

SEQ ID NO: 668893 - RNA, 64 nt, Homo Sapiens
cagaggaggcagcagcauugcacagccccaggcacaguggcaguuaggauggcuggagaguagg

SEQ ID NO: 668894 - RNA, 64 nt, Homo Sapiens
uuucucauccagaaauuauggaaacagggucugucaguggcaggaggccgugcuguguuuuacu

SEQ ID NO: 668895 - RNA, 64 nt, Homo Sapiens
gagagguaacuacggagcccaugggaaugcagcacaguggcacacugcaauacacaguuaccag

SEQ ID NO: 668896 - RNA, 64 nt, Homo Sapiens
cucuguugaccuaaccaagcugucucuguggguacaguggcauuuguccaagcuaagaaagggc

SEQ ID NO: 668897 - RNA, 64 nt, Homo Sapiens
gguucucaugaaucuccaacuuuaaauccugaaacaguggcaauaaauuuaucugguaaggcuu

SEQ ID NO: 668898 - RNA, 64 nt, Homo Sapiens
uaguugggaaaacaaacuucaucaagaguaaaugcaguggcaugcuaaguacccaaauaggagu

SEQ ID NO: 668899 - RNA, 64 nt, Homo Sapiens
cuacuggccuuguccagagggcuuucuggcuggccaguggcaauuggguugggggagccccaca

SEQ ID NO: 668900 - RNA, 64 nt, Homo Sapiens
gaaaagcacaagugcaugagcuuuacugaaaagacaguggcaaggggggcuggcuggauguucu

SEQ ID NO: 668901 - RNA, 64 nt, Homo Sapiens
aaaggaagacuuggcccaggauuagaagccaagacaguggcagcuguuggccugucagagcuug

SEQ ID NO: 668902 - RNA, 64 nt, Homo Sapiens
agcauuauaccaagaguaugacuaaagcaucacacaguggcacuauggccccuccauuuauuug

SEQ ID NO: 668903 - RNA, 64 nt, Homo Sapiens
ggugucaccccccuccagcugaggagaccaggcccaguggcagggguuucucugucuguccgug

SEQ ID NO: 668904 - RNA, 64 nt, Homo Sapiens
gacagaaucuugaucuguuacccaggcuggagugcaguggcaugaucucggcucacugcaaccu

SEQ ID NO: 668905 - RNA, 64 nt, Homo Sapiens
gugguggagucuugcugucuccccggcuggagcgcaguggcacgaucgcggcucacugcagccu

SEQ ID NO: 668906 - RNA, 64 nt, Homo Sapiens
gacagagacucgcucugucacccaggcuggagugcaguggcaugauuucggcucacugcaaccu

SEQ ID NO: 668907 - RNA, 64 nt, Homo Sapiens
uaaccaaaagauacagugauaucuuaauauguaccaguggcacuuuuuguuuuuguuuuuuuuc

SEQ ID NO: 668908 - RNA, 64 nt, Homo Sapiens
ucuugaguuaugcacugugaucgucucuguuacacaguggcagcauuuugagcugugaaggcag

SEQ ID NO: 668909 - RNA, 64 nt, Homo Sapiens
agccagggccgugguccagugcaggcgccaacaucaguggcagccgggcauagggacguggggu

SEQ ID NO: 668910 - RNA, 64 nt, Homo Sapiens
agcugccgguggugaccuggggccgcggcagccucaguggcagcgcggcgcccagcucccuggu

SEQ ID NO: 668911 - RNA, 64 nt, Homo Sapiens
gucuugcauuugcaagcuagagacucaggaaagacaguggcauaaugcagucugaguccaaagg

SEQ ID NO: 668912 - RNA, 64 nt, Homo Sapiens
agcucagauuuuggcuggaauggcuauggcuaugcaguggcacuucuuguuguagucuuuuugc

SEQ ID NO: 668913 - RNA, 64 nt, Homo Sapiens
cucugggauaauuggggacuucugcucaacauggcaguggcauguuaggcauguuagggcuuga

SEQ ID NO: 668914 - RNA, 64 nt, Homo Sapiens
guccuguguguggugggcuccacccacuagaugccaguggcacccccucccagagaugacaaac

SEQ ID NO: 668915 - RNA, 64 nt, Homo Sapiens
cugugggaacuucagggguucccaguggggagagcaguggcagugggaggcaucugggggccaa

SEQ ID NO: 668916 - RNA, 64 nt, Homo Sapiens
caguggcagugggaggcaucugggggccaaaggucaguggcaggggguauuucaguauuauaca

SEQ ID NO: 668917 - RNA, 64 nt, Homo Sapiens
gucagagucuuguucuguugccugggcuggagugcaguggcaugaucucagcucacugcaaccu

SEQ ID NO: 668918 - RNA, 64 nt, Homo Sapiens
aauggugguuuuuauuauuauuacucagauuccacaguggcaagaaacaucauucuacauaaug

SEQ ID NO: 668919 - RNA, 64 nt, Homo Sapiens
gucuuggcucacugcaaccuugcaggcuggagugcaguggcacaauggagucuugcuccuguug

SEQ ID NO: 668920 - RNA, 64 nt, Homo Sapiens
aucuuggcucacugcaaccuugcaggcuguagugcaguggcacgauggagucuugcuccuguug

SEQ ID NO: 668921 - RNA, 64 nt, Homo Sapiens; identical to SEQ ID NO: 615388

SEQ ID NO: 668922 - RNA, 64 nt, Homo Sapiens; identical to SEQ ID NO: 615389

SEQ ID NO: 668923 - RNA, 64 nt, Homo Sapiens; identical to SEQ ID NO: 615390

SEQ ID NO: 668924 - RNA, 64 nt, Homo Sapiens; identical to SEQ ID NO: 615391

SEQ ID NO: 668925 - RNA, 64 nt, Homo Sapiens; identical to SEQ ID NO: 615392

SEQ ID NO: 668926 - RNA, 64 nt, Homo Sapiens; identical to SEQ ID NO: 615393

SEQ ID NO: 668927 - RNA, 64 nt, Homo Sapiens; identical to SEQ ID NO: 615394

SEQ ID NO: 668928 - RNA, 64 nt, Homo Sapiens; identical to SEQ ID NO: 615395

SEQ ID NO: 668929 - RNA, 64 nt, Homo Sapiens; identical to SEQ ID NO: 152091

SEQ ID NO: 668930 - RNA, 64 nt, Homo Sapiens; identical to SEQ ID NO: 152092

SEQ ID NO: 668931 - RNA, 64 nt, Homo Sapiens; identical to SEQ ID NO: 152093

SEQ ID NO: 668932 - RNA, 64 nt, Homo Sapiens; identical to SEQ ID NO: 152094

SEQ ID NO: 668933 - RNA, 64 nt, Homo Sapiens; identical to SEQ ID NO: 152095

SEQ ID NO: 668934 - RNA, 64 nt, Homo Sapiens; identical to SEQ ID NO: 152096

SEQ ID NO: 668935 - RNA, 64 nt, Homo Sapiens; identical to SEQ ID NO: 328239

SEQ ID NO: 668936 - RNA, 64 nt, Homo Sapiens; identical to SEQ ID NO: 328240

SEQ ID NO: 668937 - RNA, 64 nt, Homo Sapiens; identical to SEQ ID NO: 328241

SEQ ID NO: 668938 - RNA, 64 nt, Homo Sapiens; identical to SEQ ID NO: 328242

SEQ ID NO: 668939 - RNA, 64 nt, Homo Sapiens; identical to SEQ ID NO: 328243

SEQ ID NO: 668940 - RNA, 64 nt, Homo Sapiens; identical to SEQ ID NO: 328244

SEQ ID NO: 668941 - RNA, 64 nt, Homo Sapiens; identical to SEQ ID NO: 328245

SEQ ID NO: 668942 - RNA, 64 nt, Homo Sapiens; identical to SEQ ID NO: 328246

SEQ ID NO: 668943 - RNA, 64 nt, Homo Sapiens; identical to SEQ ID NO: 328247

SEQ ID NO: 668944 - RNA, 64 nt, Homo Sapiens; identical to SEQ ID NO: 328248

SEQ ID NO: 668945 - RNA, 64 nt, Homo Sapiens; identical to SEQ ID NO: 328249

SEQ ID NO: 668946 - RNA, 64 nt, Homo Sapiens; identical to SEQ ID NO: 328250

SEQ ID NO: 668947 - RNA, 64 nt, Homo Sapiens; identical to SEQ ID NO: 328251

SEQ ID NO: 668948 - RNA, 64 nt, Homo Sapiens; identical to SEQ ID NO: 328252

SEQ ID NO: 668949 - RNA, 64 nt, Homo Sapiens; identical to SEQ ID NO: 328253

SEQ ID NO: 668950 - RNA, 64 nt, Homo Sapiens; identical to SEQ ID NO: 328254

SEQ ID NO: 668951 - RNA, 64 nt, Homo Sapiens; identical to SEQ ID NO: 328255

SEQ ID NO: 668952 - RNA, 64 nt, Homo Sapiens; identical to SEQ ID NO: 328256

SEQ ID NO: 668953 - RNA, 64 nt, Homo Sapiens; identical to SEQ ID NO: 328257

SEQ ID NO: 668954 - RNA, 64 nt, Homo Sapiens; identical to SEQ ID NO: 328258

SEQ ID NO: 668955 - RNA, 64 nt, Homo Sapiens; identical to SEQ ID NO: 328259

SEQ ID NO: 668956 - RNA, 64 nt, Homo Sapiens; identical to SEQ ID NO: 328260

SEQ ID NO: 668957 - RNA, 64 nt, Homo Sapiens; identical to SEQ ID NO: 328261

SEQ ID NO: 668958 - RNA, 64 nt, Homo Sapiens; identical to SEQ ID NO: 328262

SEQ ID NO: 668959 - RNA, 64 nt, Homo Sapiens; identical to SEQ ID NO: 328263

SEQ ID NO: 668960 - RNA, 64 nt, Homo Sapiens; identical to SEQ ID NO: 328264

SEQ ID NO: 668961 - RNA, 64 nt, Homo Sapiens; identical to SEQ ID NO: 328265

SEQ ID NO: 668962 - RNA, 64 nt, Homo Sapiens; identical to SEQ ID NO: 328266

SEQ ID NO: 668963 - RNA, 64 nt, Homo Sapiens; identical to SEQ ID NO: 328267

SEQ ID NO: 668964 - RNA, 64 nt, Homo Sapiens; identical to SEQ ID NO: 328268

SEQ ID NO: 668965 - RNA, 64 nt, Homo Sapiens; identical to SEQ ID NO: 328269

SEQ ID NO: 668966 - RNA, 64 nt, Homo Sapiens; identical to SEQ ID NO: 328270

SEQ ID NO: 668967 - RNA, 64 nt, Homo Sapiens; identical to SEQ ID NO: 328271

SEQ ID NO: 668968 - RNA, 64 nt, Homo Sapiens; identical to SEQ ID NO: 328272

SEQ ID NO: 668969 - RNA, 64 nt, Homo Sapiens; identical to SEQ ID NO: 328273

SEQ ID NO: 668970 - RNA, 64 nt, Homo Sapiens; identical to SEQ ID NO: 328274

SEQ ID NO: 668971 - RNA, 64 nt, Homo Sapiens; identical to SEQ ID NO: 328275

SEQ ID NO: 668972 - RNA, 64 nt, Homo Sapiens; identical to SEQ ID NO: 328276

SEQ ID NO: 668973 - RNA, 64 nt, Homo Sapiens; identical to SEQ ID NO: 328277

SEQ ID NO: 668974 - RNA, 64 nt, Homo Sapiens; identical to SEQ ID NO: 328278

SEQ ID NO: 668975 - RNA, 64 nt, Homo Sapiens; identical to SEQ ID NO: 328279

SEQ ID NO: 668976 - RNA, 64 nt, Homo Sapiens; identical to SEQ ID NO: 328280

SEQ ID NO: 668977 - RNA, 64 nt, Homo Sapiens; identical to SEQ ID NO: 328281

SEQ ID NO: 668978 - RNA, 64 nt, Homo Sapiens; identical to SEQ ID NO: 328282

SEQ ID NO: 668979 - RNA, 64 nt, Homo Sapiens; identical to SEQ ID NO: 328283

SEQ ID NO: 668980 - RNA, 64 nt, Homo Sapiens; identical to SEQ ID NO: 328284

SEQ ID NO: 668981 - RNA, 64 nt, Homo Sapiens; identical to SEQ ID NO: 328285

SEQ ID NO: 668982 - RNA, 64 nt, Homo Sapiens; identical to SEQ ID NO: 328286

SEQ ID NO: 668983 - RNA, 64 nt, Homo Sapiens; identical to SEQ ID NO: 328287

SEQ ID NO: 668984 - RNA, 64 nt, Homo Sapiens; identical to SEQ ID NO: 328288

SEQ ID NO: 668985 - RNA, 64 nt, Homo Sapiens; identical to SEQ ID NO: 328289

SEQ ID NO: 668986 - RNA, 64 nt, Homo Sapiens; identical to SEQ ID NO: 328290

SEQ ID NO: 668987 - RNA, 64 nt, Homo Sapiens
ucucauacaucugugaaaaagauaaugugaaauaaacaguaaaaaaaaaaaguauguugauggc

SEQ ID NO: 668988 - RNA, 64 nt, Homo Sapiens
gaacuugaauuaugcauuuauuggcauuaauguaaacaguaaguccuaagcuuugauggaaggg

SEQ ID NO: 668989 - RNA, 64 nt, Homo Sapiens
ugaaugagaagaaaugauucauaaauuuugaacuaacaguaauaacuucuugaaaauccaauaa

SEQ ID NO: 668990 - RNA, 64 nt, Homo Sapiens
uucuugaaaaaaaauuuuuugauaugacuacucuaacaguaauaacuauaaaucucacuuuaaa

SEQ ID NO: 668991 - RNA, 64 nt, Homo Sapiens
uugauuuaaauccuuucugaauaaagaucagauaaacaguaacugaaggagcauguauagcucu

SEQ ID NO: 668992 - RNA, 64 nt, Homo Sapiens
acugccaaauacauaggaauuuucuuucuuaaaaaacaguaaugaagacuauaucuccuuuccc

SEQ ID NO: 668993 - RNA, 64 nt, Homo Sapiens
ucagggugcccacaacucacucaccaagauguuuaacaguaaguaacaguaaauguaaaagauu

SEQ ID NO: 668994 - RNA, 64 nt, Homo Sapiens
cacaacucacucaccaagauguuuaacaguaaguaacaguaaauguaaaagauucauuuugggc

SEQ ID NO: 668995 - RNA, 64 nt, Homo Sapiens
auggauuuuguaggugucaggauuggugugaaauacuaaacacugcacagcacuuuugcaguaa

SEQ ID NO: 668996 - RNA, 64 nt, Homo Sapiens
gcucuagauaaacugcucaaguacacaucacuacacuaaacacuagauuaauauggccaacccu

SEQ ID NO: 668997 - RNA, 64 nt, Homo Sapiens
auguggcaaauccuuuaacugauccucaacuuuuacuaaacauaagguaauucauacuggagaa

SEQ ID NO: 668998 - RNA, 64 nt, Homo Sapiens
auguggcaauacuuuaaaccaauccucaaaccucacuaaacauaagauaauacugaaaacuuua

SEQ ID NO: 668999 - RNA, 64 nt, Homo Sapiens
auguggcaaagguuuuagccaacucucaaaccuuacuaaacacaagaagauucauacuagagag

SEQ ID NO: 669000 - RNA, 64 nt, Homo Sapiens
augugguaaugcuuuuaaccaauucucaaaucuuacuaaacaaaauuaauacugaaaauguuac

SEQ ID NO: 669001 - RNA, 64 nt, Homo Sapiens
uacuuaauuuucuuaaaacuauuuuuaaugauccacuaaacaaagcaggggauccugaagcuga

SEQ ID NO: 669002 - RNA, 64 nt, Homo Sapiens
auucugucuggguuuuuaaugucuguggaaaaaaacuaaacaagucucugucucaguuaagaga

SEQ ID NO: 669003 - RNA, 64 nt, Homo Sapiens
gccuugcuauauucaccaaauacaggccaaaugaacuaaacauuauaacaucuaauauauauau

SEQ ID NO: 669004 - RNA, 64 nt, Homo Sapiens
gccuugcuauauucaccaaacauuauaaaaaugaacuaaacauuaccauguaucaggauuuccg

SEQ ID NO: 669005 - RNA, 64 nt, Homo Sapiens
auguggcaaaggcuuuaauuaguucucaucccuuacuaaacauaagagaauucauaccauagag

SEQ ID NO: 669006 - RNA, 64 nt, Homo Sapiens
augucucaaagcuuuuuacugauucuuauaccuuacuaaacauaaaauaauucauaaaggagau

SEQ ID NO: 669007 - RNA, 64 nt, Homo Sapiens
auguggcaaagcuuuuaaccaauuuucaaaccuuacuaaacauaagauaacucauacuggagaa

SEQ ID NO: 669008 - RNA, 64 nt, Homo Sapiens
augugacaaagccuuuaaccaguccucaauuuuuacuaaacauaagaaaauucauacuggagag

SEQ ID NO: 669009 - RNA, 64 nt, Homo Sapiens
cugugaaaaagacgucaauaucugcucacaucuuacuaaacaccagagaguucaugcuuaauaa

SEQ ID NO: 669010 - RNA, 64 nt, Homo Sapiens
augugucaaagcuuuuaacuguuccucaauccuuacuaaacauaagggaauucauaauagagaa

SEQ ID NO: 669011 - RNA, 64 nt, Homo Sapiens
auguggcauagccucuucccaguucucaacucuuacuaaacaugagaacacauguggaagauaa

SEQ ID NO: 669012 - RNA, 64 nt, Homo Sapiens
guugacuuucuucuguccaaacaaacaaacaaaaacuaaacacacacacaaacccccagaaacc

SEQ ID NO: 669013 - RNA, 64 nt, Homo Sapiens
ccuguaauuguugcuagacuuuauguguuguacaacuaaacauugcuguuugaacaguaacugc

SEQ ID NO: 669014 - RNA, 64 nt, Homo Sapiens
aaacauuuauuuucugagucugcaggagaaacaaacuaaacauuauaguuuuauagcugcuauc

SEQ ID NO: 669015 - RNA, 64 nt, Homo Sapiens
ggcuuuacuugucuuuauaaaaauaaauauaucuacuaaacaugaaaaaugguuuacuuaaaaa

SEQ ID NO: 669016 - RNA, 64 nt, Homo Sapiens
ccccccauccugcucagcugcgucaugggccccccaugcauacguacauuccuggacacccuca

SEQ ID NO: 669017 - RNA, 64 nt, Homo Sapiens
uuuuuuguaaaaguagcaguuugguaugaguuggcaugcauacaagauuuacuaagugggauaa

SEQ ID NO: 669018 - RNA, 64 nt, Homo Sapiens
uuuacuaauccuaucugccacguguguguauacacaugcauauaaauacacaugcauuuaugug

SEQ ID NO: 669019 - RNA, 64 nt, Homo Sapiens
ugugugugauaauacacaugcauacacaugccuccaugcauauaguuuauauguauuauaauug

SEQ ID NO: 669020 - RNA, 64 nt, Homo Sapiens
auagaaaaaaaacauggaauauacaaguguaauacaugcauauacacuggaaacucuguauuau

SEQ ID NO: 669021 - RNA, 64 nt, Homo Sapiens
augaauuagauggcuuugaggccuccauuuuaaucaugcauaaaauggaaugaaauggcuuucu

SEQ ID NO: 669022 - RNA, 64 nt, Homo Sapiens
uugagcuacacuaaaccacauauguuauaugauacaugcauaaccugacaaaagaacuugaacc

SEQ ID NO: 669023 - RNA, 64 nt, Homo Sapiens
aauagaagacaaucugcuuguauaaaauacaacacaugcauaaauugguaacacaauacguucu

SEQ ID NO: 669024 - RNA, 64 nt, Homo Sapiens; identical to SEQ ID NO: 614595

SEQ ID NO: 669025 - RNA, 64 nt, Homo Sapiens; identical to SEQ ID NO: 614596

SEQ ID NO: 669026 - RNA, 64 nt, Homo Sapiens; identical to SEQ ID NO: 614597

SEQ ID NO: 669027 - RNA, 64 nt, Homo Sapiens; identical to SEQ ID NO: 614598

SEQ ID NO: 669028 - RNA, 64 nt, Homo Sapiens; identical to SEQ ID NO: 614599

SEQ ID NO: 669029 - RNA, 64 nt, Homo Sapiens; identical to SEQ ID NO: 614600

SEQ ID NO: 669030 - RNA, 64 nt, Homo Sapiens; identical to SEQ ID NO: 614601

SEQ ID NO: 669031 - RNA, 64 nt, Homo Sapiens; identical to SEQ ID NO: 614602

SEQ ID NO: 669032 - RNA, 64 nt, Homo Sapiens; identical to SEQ ID NO: 614603

SEQ ID NO: 669033 - RNA, 64 nt, Homo Sapiens; identical to SEQ ID NO: 614604

SEQ ID NO: 669034 - RNA, 64 nt, Homo Sapiens; identical to SEQ ID NO: 614605

SEQ ID NO: 669035 - RNA, 64 nt, Homo Sapiens; identical to SEQ ID NO: 614606

SEQ ID NO: 669036 - RNA, 64 nt, Homo Sapiens; identical to SEQ ID NO: 614607

SEQ ID NO: 669037 - RNA, 64 nt, Homo Sapiens; identical to SEQ ID NO: 614608

SEQ ID NO: 669038 - RNA, 64 nt, Homo Sapiens; identical to SEQ ID NO: 614609

SEQ ID NO: 669039 - RNA, 64 nt, Homo Sapiens; identical to SEQ ID NO: 614610

SEQ ID NO: 669040 - RNA, 64 nt, Homo Sapiens; identical to SEQ ID NO: 614611

SEQ ID NO: 669041 - RNA, 64 nt, Homo Sapiens; identical to SEQ ID NO: 614612

SEQ ID NO: 669042 - RNA, 64 nt, Homo Sapiens; identical to SEQ ID NO: 614613

SEQ ID NO: 669043 - RNA, 64 nt, Homo Sapiens; identical to SEQ ID NO: 614614

SEQ ID NO: 669044 - RNA, 64 nt, Homo Sapiens; identical to SEQ ID NO: 614615

SEQ ID NO: 669045 - RNA, 64 nt, Homo Sapiens; identical to SEQ ID NO: 614616

SEQ ID NO: 669046 - RNA, 64 nt, Homo Sapiens; identical to SEQ ID NO: 614617

SEQ ID NO: 669047 - RNA, 64 nt, Homo Sapiens; identical to SEQ ID NO: 614618

SEQ ID NO: 669048 - RNA, 64 nt, Homo Sapiens; identical to SEQ ID NO: 614619

SEQ ID NO: 669049 - RNA, 64 nt, Homo Sapiens; identical to SEQ ID NO: 614620

SEQ ID NO: 669050 - RNA, 64 nt, Homo Sapiens; identical to SEQ ID NO: 614621

SEQ ID NO: 669051 - RNA, 64 nt, Homo Sapiens; identical to SEQ ID NO: 614622

SEQ ID NO: 669052 - RNA, 64 nt, Homo Sapiens; identical to SEQ ID NO: 614623

SEQ ID NO: 669053 - RNA, 64 nt, Homo Sapiens; identical to SEQ ID NO: 614624

SEQ ID NO: 669054 - RNA, 64 nt, Homo Sapiens; identical to SEQ ID NO: 614625

SEQ ID NO: 669055 - RNA, 64 nt, Homo Sapiens; identical to SEQ ID NO: 614626

SEQ ID NO: 669056 - RNA, 64 nt, Homo Sapiens; identical to SEQ ID NO: 614627

SEQ ID NO: 669057 - RNA, 64 nt, Homo Sapiens; identical to SEQ ID NO: 614628

SEQ ID NO: 669058 - RNA, 64 nt, Homo Sapiens; identical to SEQ ID NO: 614629

SEQ ID NO: 669059 - RNA, 64 nt, Homo Sapiens; identical to SEQ ID NO: 614630

SEQ ID NO: 669060 - RNA, 64 nt, Homo Sapiens; identical to SEQ ID NO: 614631

SEQ ID NO: 669061 - RNA, 64 nt, Homo Sapiens; identical to SEQ ID NO: 614632

SEQ ID NO: 669062 - RNA, 64 nt, Homo Sapiens; identical to SEQ ID NO: 614633

SEQ ID NO: 669063 - RNA, 64 nt, Homo Sapiens; identical to SEQ ID NO: 614634

SEQ ID NO: 669064 - RNA, 64 nt, Homo Sapiens; identical to SEQ ID NO: 614635

SEQ ID NO: 669065 - RNA, 64 nt, Homo Sapiens; identical to SEQ ID NO: 614636

SEQ ID NO: 669066 - RNA, 64 nt, Homo Sapiens; identical to SEQ ID NO: 614637

SEQ ID NO: 669067 - RNA, 64 nt, Homo Sapiens; identical to SEQ ID NO: 614638

SEQ ID NO: 669068 - RNA, 64 nt, Homo Sapiens; identical to SEQ ID NO: 614639

SEQ ID NO: 669069 - RNA, 64 nt, Homo Sapiens; identical to SEQ ID NO: 614640

SEQ ID NO: 669070 - RNA, 64 nt, Homo Sapiens; identical to SEQ ID NO: 614641

SEQ ID NO: 669071 - RNA, 64 nt, Homo Sapiens; identical to SEQ ID NO: 614642

SEQ ID NO: 669072 - RNA, 64 nt, Homo Sapiens; identical to SEQ ID NO: 614643

SEQ ID NO: 669073 - RNA, 64 nt, Homo Sapiens; identical to SEQ ID NO: 614644

SEQ ID NO: 669074 - RNA, 56 nt, Homo Sapiens; identical to SEQ ID NO: 614645

SEQ ID NO: 669075 - RNA, 64 nt, Homo Sapiens; identical to SEQ ID NO: 614646

SEQ ID NO: 669076 - RNA, 64 nt, Homo Sapiens; identical to SEQ ID NO: 614647

SEQ ID NO: 669077 - RNA, 64 nt, Homo Sapiens; identical to SEQ ID NO: 614648

SEQ ID NO: 669078 - RNA, 64 nt, Homo Sapiens; identical to SEQ ID NO: 614649

SEQ ID NO: 669079 - RNA, 64 nt, Homo Sapiens; identical to SEQ ID NO: 614650

SEQ ID NO: 669080 - RNA, 64 nt, Homo Sapiens; identical to SEQ ID NO: 614651

SEQ ID NO: 669081 - RNA, 64 nt, Homo Sapiens; identical to SEQ ID NO: 614652

SEQ ID NO: 669082 - RNA, 64 nt, Homo Sapiens; identical to SEQ ID NO: 614653

SEQ ID NO: 669083 - RNA, 64 nt, Homo Sapiens; identical to SEQ ID NO: 614654

SEQ ID NO: 669084 - RNA, 64 nt, Homo Sapiens; identical to SEQ ID NO: 614655

SEQ ID NO: 669085 - RNA, 64 nt, Homo Sapiens; identical to SEQ ID NO: 614656

SEQ ID NO: 669086 - RNA, 64 nt, Homo Sapiens; identical to SEQ ID NO: 614657

SEQ ID NO: 669087 - RNA, 64 nt, Homo Sapiens; identical to SEQ ID NO: 614658

SEQ ID NO: 669088 - RNA, 64 nt, Homo Sapiens; identical to SEQ ID NO: 614659

SEQ ID NO: 669089 - RNA, 64 nt, Homo Sapiens; identical to SEQ ID NO: 614660

SEQ ID NO: 669090 - RNA, 64 nt, Homo Sapiens; identical to SEQ ID NO: 614661

SEQ ID NO: 669091 - RNA, 64 nt, Homo Sapiens; identical to SEQ ID NO: 614662

SEQ ID NO: 669092 - RNA, 64 nt, Homo Sapiens; identical to SEQ ID NO: 614663

SEQ ID NO: 669093 - RNA, 64 nt, Homo Sapiens; identical to SEQ ID NO: 614664

SEQ ID NO: 669094 - RNA, 64 nt, Homo Sapiens; identical to SEQ ID NO: 614665

SEQ ID NO: 669095 - RNA, 64 nt, Homo Sapiens; identical to SEQ ID NO: 614666

SEQ ID NO: 669096 - RNA, 64 nt, Homo Sapiens; identical to SEQ ID NO: 614667

SEQ ID NO: 669097 - RNA, 64 nt, Homo Sapiens; identical to SEQ ID NO: 614668

SEQ ID NO: 669098 - RNA, 64 nt, Homo Sapiens; identical to SEQ ID NO: 614669

SEQ ID NO: 669099 - RNA, 64 nt, Homo Sapiens; identical to SEQ ID NO: 614670

SEQ ID NO: 669100 - RNA, 64 nt, Homo Sapiens; identical to SEQ ID NO: 614671

SEQ ID NO: 669101 - RNA, 64 nt, Homo Sapiens; identical to SEQ ID NO: 614672

SEQ ID NO: 669102 - RNA, 64 nt, Homo Sapiens; identical to SEQ ID NO: 614673

SEQ ID NO: 669103 - RNA, 64 nt, Homo Sapiens; identical to SEQ ID NO: 614674

SEQ ID NO: 669104 - RNA, 64 nt, Homo Sapiens; identical to SEQ ID NO: 614675

SEQ ID NO: 669105 - RNA, 64 nt, Homo Sapiens; identical to SEQ ID NO: 614676

SEQ ID NO: 669106 - RNA, 64 nt, Homo Sapiens; identical to SEQ ID NO: 614677

SEQ ID NO: 669107 - RNA, 64 nt, Homo Sapiens; identical to SEQ ID NO: 614678

SEQ ID NO: 669108 - RNA, 64 nt, Homo Sapiens; identical to SEQ ID NO: 614679

SEQ ID NO: 669109 - RNA, 64 nt, Homo Sapiens; identical to SEQ ID NO: 614680

SEQ ID NO: 669110 - RNA, 64 nt, Homo Sapiens; identical to SEQ ID NO: 614681

SEQ ID NO: 669111 - RNA, 64 nt, Homo Sapiens; identical to SEQ ID NO: 614682

SEQ ID NO: 669112 - RNA, 64 nt, Homo Sapiens; identical to SEQ ID NO: 614683

SEQ ID NO: 669113 - RNA, 64 nt, Homo Sapiens; identical to SEQ ID NO: 614684

SEQ ID NO: 669114 - RNA, 64 nt, Homo Sapiens; identical to SEQ ID NO: 614685

SEQ ID NO: 669115 - RNA, 64 nt, Homo Sapiens; identical to SEQ ID NO: 614686

SEQ ID NO: 669116 - RNA, 64 nt, Homo Sapiens; identical to SEQ ID NO: 614687

SEQ ID NO: 669117 - RNA, 64 nt, Homo Sapiens; identical to SEQ ID NO: 614688

SEQ ID NO: 669118 - RNA, 64 nt, Homo Sapiens; identical to SEQ ID NO: 614689

SEQ ID NO: 669119 - RNA, 64 nt, Homo Sapiens; identical to SEQ ID NO: 614690

SEQ ID NO: 669120 - RNA, 64 nt, Homo Sapiens; identical to SEQ ID NO: 614691

SEQ ID NO: 669121 - RNA, 64 nt, Homo Sapiens; identical to SEQ ID NO: 614692

SEQ ID NO: 669122 - RNA, 64 nt, Homo Sapiens; identical to SEQ ID NO: 614693

SEQ ID NO: 669123 - RNA, 64 nt, Homo Sapiens; identical to SEQ ID NO: 614694

SEQ ID NO: 669124 - RNA, 64 nt, Homo Sapiens; identical to SEQ ID NO: 614695

SEQ ID NO: 669125 - RNA, 64 nt, Homo Sapiens; identical to SEQ ID NO: 614696

SEQ ID NO: 669126 - RNA, 64 nt, Homo Sapiens; identical to SEQ ID NO: 614697

SEQ ID NO: 669127 - RNA, 64 nt, Homo Sapiens; identical to SEQ ID NO: 614698

SEQ ID NO: 669128 - RNA, 64 nt, Homo Sapiens; identical to SEQ ID NO: 614699

SEQ ID NO: 669129 - RNA, 64 nt, Homo Sapiens; identical to SEQ ID NO: 614700

SEQ ID NO: 669130 - RNA, 64 nt, Homo Sapiens; identical to SEQ ID NO: 614701

SEQ ID NO: 669131 - RNA, 64 nt, Homo Sapiens; identical to SEQ ID NO: 614702

SEQ ID NO: 669132 - RNA, 64 nt, Homo Sapiens; identical to SEQ ID NO: 614703

SEQ ID NO: 669133 - RNA, 64 nt, Homo Sapiens; identical to SEQ ID NO: 614704

SEQ ID NO: 669134 - RNA, 64 nt, Homo Sapiens; identical to SEQ ID NO: 614705

SEQ ID NO: 669135 - RNA, 64 nt, Homo Sapiens; identical to SEQ ID NO: 614706

SEQ ID NO: 669136 - RNA, 64 nt, Homo Sapiens; identical to SEQ ID NO: 614707

SEQ ID NO: 669137 - RNA, 64 nt, Homo Sapiens; identical to SEQ ID NO: 614708

SEQ ID NO: 669138 - RNA, 64 nt, Homo Sapiens; identical to SEQ ID NO: 614709

SEQ ID NO: 669139 - RNA, 64 nt, Homo Sapiens; identical to SEQ ID NO: 614710

SEQ ID NO: 669140 - RNA, 64 nt, Homo Sapiens; identical to SEQ ID NO: 614711

SEQ ID NO: 669141 - RNA, 64 nt, Homo Sapiens; identical to SEQ ID NO: 614712

SEQ ID NO: 669142 - RNA, 64 nt, Homo Sapiens; identical to SEQ ID NO: 614713

SEQ ID NO: 669143 - RNA, 64 nt, Homo Sapiens; identical to SEQ ID NO: 614714

SEQ ID NO: 669144 - RNA, 64 nt, Homo Sapiens; identical to SEQ ID NO: 614715

SEQ ID NO: 669145 - RNA, 64 nt, Homo Sapiens; identical to SEQ ID NO: 614716

SEQ ID NO: 669146 - RNA, 64 nt, Homo Sapiens; identical to SEQ ID NO: 614717

SEQ ID NO: 669147 - RNA, 64 nt, Homo Sapiens; identical to SEQ ID NO: 614718

SEQ ID NO: 669148 - RNA, 64 nt, Homo Sapiens; identical to SEQ ID NO: 614719

SEQ ID NO: 669149 - RNA, 64 nt, Homo Sapiens; identical to SEQ ID NO: 614720

SEQ ID NO: 669150 - RNA, 64 nt, Homo Sapiens; identical to SEQ ID NO: 614721

SEQ ID NO: 669151 - RNA, 64 nt, Homo Sapiens; identical to SEQ ID NO: 614722

SEQ ID NO: 669152 - RNA, 64 nt, Homo Sapiens; identical to SEQ ID NO: 614723

SEQ ID NO: 669153 - RNA, 64 nt, Homo Sapiens; identical to SEQ ID NO: 614724

SEQ ID NO: 669154 - RNA, 64 nt, Homo Sapiens; identical to SEQ ID NO: 614725

SEQ ID NO: 669155 - RNA, 64 nt, Homo Sapiens; identical to SEQ ID NO: 614726

SEQ ID NO: 669156 - RNA, 64 nt, Homo Sapiens; identical to SEQ ID NO: 614727

SEQ ID NO: 669157 - RNA, 64 nt, Homo Sapiens; identical to SEQ ID NO: 614728

SEQ ID NO: 669158 - RNA, 64 nt, Homo Sapiens; identical to SEQ ID NO: 614729

SEQ ID NO: 669159 - RNA, 64 nt, Homo Sapiens; identical to SEQ ID NO: 614730

SEQ ID NO: 669160 - RNA, 64 nt, Homo Sapiens; identical to SEQ ID NO: 614731

SEQ ID NO: 669161 - RNA, 64 nt, Homo Sapiens; identical to SEQ ID NO: 614732

SEQ ID NO: 669162 - RNA, 64 nt, Homo Sapiens; identical to SEQ ID NO: 614733

SEQ ID NO: 669163 - RNA, 64 nt, Homo Sapiens; identical to SEQ ID NO: 614734

SEQ ID NO: 669164 - RNA, 64 nt, Homo Sapiens; identical to SEQ ID NO: 614735

SEQ ID NO: 669165 - RNA, 64 nt, Homo Sapiens; identical to SEQ ID NO: 614736

SEQ ID NO: 669166 - RNA, 64 nt, Homo Sapiens; identical to SEQ ID NO: 614737

SEQ ID NO: 669167 - RNA, 64 nt, Homo Sapiens; identical to SEQ ID NO: 614738

SEQ ID NO: 669168 - RNA, 64 nt, Homo Sapiens; identical to SEQ ID NO: 614739

SEQ ID NO: 669169 - RNA, 64 nt, Homo Sapiens; identical to SEQ ID NO: 614740

SEQ ID NO: 669170 - RNA, 64 nt, Homo Sapiens; identical to SEQ ID NO: 614741

SEQ ID NO: 669171 - RNA, 64 nt, Homo Sapiens; identical to SEQ ID NO: 614742

SEQ ID NO: 669172 - RNA, 64 nt, Homo Sapiens; identical to SEQ ID NO: 614743

SEQ ID NO: 669173 - RNA, 64 nt, Homo Sapiens; identical to SEQ ID NO: 614744

SEQ ID NO: 669174 - RNA, 64 nt, Homo Sapiens; identical to SEQ ID NO: 614745

SEQ ID NO: 669175 - RNA, 64 nt, Homo Sapiens; identical to SEQ ID NO: 614746

SEQ ID NO: 669176 - RNA, 64 nt, Homo Sapiens; identical to SEQ ID NO: 614747

SEQ ID NO: 669177 - RNA, 64 nt, Homo Sapiens; identical to SEQ ID NO: 614748

SEQ ID NO: 669178 - RNA, 64 nt, Homo Sapiens; identical to SEQ ID NO: 614749

SEQ ID NO: 669179 - RNA, 64 nt, Homo Sapiens; identical to SEQ ID NO: 614750

SEQ ID NO: 669180 - RNA, 64 nt, Homo Sapiens; identical to SEQ ID NO: 614751

SEQ ID NO: 669181 - RNA, 64 nt, Homo Sapiens; identical to SEQ ID NO: 614752

SEQ ID NO: 669182 - RNA, 64 nt, Homo Sapiens; identical to SEQ ID NO: 614753

SEQ ID NO: 669183 - RNA, 64 nt, Homo Sapiens; identical to SEQ ID NO: 614754

SEQ ID NO: 669184 - RNA, 64 nt, Homo Sapiens; identical to SEQ ID NO: 614755

SEQ ID NO: 669185 - RNA, 64 nt, Homo Sapiens; identical to SEQ ID NO: 614756

SEQ ID NO: 669186 - RNA, 64 nt, Homo Sapiens; identical to SEQ ID NO: 614757

SEQ ID NO: 669187 - RNA, 64 nt, Homo Sapiens; identical to SEQ ID NO: 614758

SEQ ID NO: 669188 - RNA, 64 nt, Homo Sapiens; identical to SEQ ID NO: 614759

SEQ ID NO: 669189 - RNA, 64 nt, Homo Sapiens; identical to SEQ ID NO: 614760

SEQ ID NO: 669190 - RNA, 64 nt, Homo Sapiens; identical to SEQ ID NO: 614761

SEQ ID NO: 669191 - RNA, 64 nt, Homo Sapiens; identical to SEQ ID NO: 614762

SEQ ID NO: 669192 - RNA, 64 nt, Homo Sapiens; identical to SEQ ID NO: 614763

SEQ ID NO: 669193 - RNA, 64 nt, Homo Sapiens; identical to SEQ ID NO: 614764

SEQ ID NO: 669194 - RNA, 64 nt, Homo Sapiens; identical to SEQ ID NO: 614765

SEQ ID NO: 669195 - RNA, 64 nt, Homo Sapiens; identical to SEQ ID NO: 458751

SEQ ID NO: 669196 - RNA, 64 nt, Homo Sapiens; identical to SEQ ID NO: 458752

SEQ ID NO: 669197 - RNA, 64 nt, Homo Sapiens; identical to SEQ ID NO: 458753

SEQ ID NO: 669198 - RNA, 64 nt, Homo Sapiens; identical to SEQ ID NO: 458754

SEQ ID NO: 669199 - RNA, 64 nt, Homo Sapiens; identical to SEQ ID NO: 458755

SEQ ID NO: 669200 - RNA, 64 nt, Homo Sapiens; identical to SEQ ID NO: 458756

SEQ ID NO: 669201 - RNA, 64 nt, Homo Sapiens; identical to SEQ ID NO: 458757

SEQ ID NO: 669202 - RNA, 64 nt, Homo Sapiens; identical to SEQ ID NO: 458758

SEQ ID NO: 669203 - RNA, 64 nt, Homo Sapiens; identical to SEQ ID NO: 358630

SEQ ID NO: 669204 - RNA, 64 nt, Homo Sapiens; identical to SEQ ID NO: 358631

SEQ ID NO: 669205 - RNA, 64 nt, Homo Sapiens; identical to SEQ ID NO: 358632

SEQ ID NO: 669206 - RNA, 64 nt, Homo Sapiens; identical to SEQ ID NO: 358633

SEQ ID NO: 669207 - RNA, 64 nt, Homo Sapiens; identical to SEQ ID NO: 358634

SEQ ID NO: 669208 - RNA, 64 nt, Homo Sapiens; identical to SEQ ID NO: 358635

SEQ ID NO: 669209 - RNA, 64 nt, Homo Sapiens; identical to SEQ ID NO: 358636

SEQ ID NO: 669210 - RNA, 64 nt, Homo Sapiens; identical to SEQ ID NO: 358637

SEQ ID NO: 669211 - RNA, 64 nt, Homo Sapiens; identical to SEQ ID NO: 358638

SEQ ID NO: 669212 - RNA, 64 nt, Homo Sapiens; identical to SEQ ID NO: 358639

SEQ ID NO: 669213 - RNA, 64 nt, Homo Sapiens; identical to SEQ ID NO: 358640

SEQ ID NO: 669214 - RNA, 64 nt, Homo Sapiens; identical to SEQ ID NO: 358641

SEQ ID NO: 669215 - RNA, 64 nt, Homo Sapiens; identical to SEQ ID NO: 358642

SEQ ID NO: 669216 - RNA, 64 nt, Homo Sapiens; identical to SEQ ID NO: 358643

SEQ ID NO: 669217 - RNA, 64 nt, Homo Sapiens; identical to SEQ ID NO: 358644

SEQ ID NO: 669218 - RNA, 64 nt, Homo Sapiens; identical to SEQ ID NO: 358645

SEQ ID NO: 669219 - RNA, 64 nt, Homo Sapiens; identical to SEQ ID NO: 358646

SEQ ID NO: 669220 - RNA, 64 nt, Homo Sapiens; identical to SEQ ID NO: 358647

SEQ ID NO: 669221 - RNA, 55 nt, Homo Sapiens; identical to SEQ ID NO: 316954

SEQ ID NO: 669222 - RNA, 64 nt, Homo Sapiens; identical to SEQ ID NO: 316955

SEQ ID NO: 669223 - RNA, 64 nt, Homo Sapiens; identical to SEQ ID NO: 316956

SEQ ID NO: 669224 - RNA, 64 nt, Homo Sapiens; identical to SEQ ID NO: 316957

SEQ ID NO: 669225 - RNA, 64 nt, Homo Sapiens; identical to SEQ ID NO: 316958

SEQ ID NO: 669226 - RNA, 64 nt, Homo Sapiens; identical to SEQ ID NO: 316959

SEQ ID NO: 669227 - RNA, 64 nt, Homo Sapiens; identical to SEQ ID NO: 316960

SEQ ID NO: 669228 - RNA, 64 nt, Homo Sapiens; identical to SEQ ID NO: 316961

SEQ ID NO: 669229 - RNA, 64 nt, Homo Sapiens; identical to SEQ ID NO: 316962

SEQ ID NO: 669230 - RNA, 64 nt, Homo Sapiens; identical to SEQ ID NO: 316963

SEQ ID NO: 669231 - RNA, 64 nt, Homo Sapiens; identical to SEQ ID NO: 316964

SEQ ID NO: 669232 - RNA, 64 nt, Homo Sapiens; identical to SEQ ID NO: 316965

SEQ ID NO: 669233 - RNA, 64 nt, Homo Sapiens; identical to SEQ ID NO: 316966

SEQ ID NO: 669234 - RNA, 64 nt, Homo Sapiens; identical to SEQ ID NO: 316967

SEQ ID NO: 669235 - RNA, 64 nt, Homo Sapiens; identical to SEQ ID NO: 316968

SEQ ID NO: 669236 - RNA, 64 nt, Homo Sapiens; identical to SEQ ID NO: 316969

SEQ ID NO: 669237 - RNA, 64 nt, Homo Sapiens; identical to SEQ ID NO: 316970

SEQ ID NO: 669238 - RNA, 64 nt, Homo Sapiens; identical to SEQ ID NO: 316971

SEQ ID NO: 669239 - RNA, 64 nt, Homo Sapiens; identical to SEQ ID NO: 316972

SEQ ID NO: 669240 - RNA, 64 nt, Homo Sapiens; identical to SEQ ID NO: 316973

SEQ ID NO: 669241 - RNA, 64 nt, Homo Sapiens; identical to SEQ ID NO: 316974

SEQ ID NO: 669242 - RNA, 64 nt, Homo Sapiens; identical to SEQ ID NO: 316975

SEQ ID NO: 669243 - RNA, 64 nt, Homo Sapiens; identical to SEQ ID NO: 316976

SEQ ID NO: 669244 - RNA, 64 nt, Homo Sapiens; identical to SEQ ID NO: 316977

SEQ ID NO: 669245 - RNA, 64 nt, Homo Sapiens; identical to SEQ ID NO: 316978

SEQ ID NO: 669246 - RNA, 64 nt, Homo Sapiens; identical to SEQ ID NO: 316979

SEQ ID NO: 669247 - RNA, 64 nt, Homo Sapiens; identical to SEQ ID NO: 316980

SEQ ID NO: 669248 - RNA, 64 nt, Homo Sapiens; identical to SEQ ID NO: 316981

SEQ ID NO: 669249 - RNA, 64 nt, Homo Sapiens; identical to SEQ ID NO: 316982

SEQ ID NO: 669250 - RNA, 64 nt, Homo Sapiens; identical to SEQ ID NO: 316983

SEQ ID NO: 669251 - RNA, 64 nt, Homo Sapiens; identical to SEQ ID NO: 316984

SEQ ID NO: 669252 - RNA, 64 nt, Homo Sapiens; identical to SEQ ID NO: 316985

SEQ ID NO: 669253 - RNA, 64 nt, Homo Sapiens; identical to SEQ ID NO: 316986

SEQ ID NO: 669254 - RNA, 64 nt, Homo Sapiens; identical to SEQ ID NO: 316987

SEQ ID NO: 669255 - RNA, 64 nt, Homo Sapiens; identical to SEQ ID NO: 316988

SEQ ID NO: 669256 - RNA, 64 nt, Homo Sapiens; identical to SEQ ID NO: 316989

SEQ ID NO: 669257 - RNA, 64 nt, Homo Sapiens; identical to SEQ ID NO: 316990

SEQ ID NO: 669258 - RNA, 64 nt, Homo Sapiens; identical to SEQ ID NO: 316991

SEQ ID NO: 669259 - RNA, 64 nt, Homo Sapiens; identical to SEQ ID NO: 316992

SEQ ID NO: 669260 - RNA, 64 nt, Homo Sapiens; identical to SEQ ID NO: 316993

SEQ ID NO: 669261 - RNA, 64 nt, Homo Sapiens; identical to SEQ ID NO: 316994

SEQ ID NO: 669262 - RNA, 64 nt, Homo Sapiens
auucagaagcaacgcuaugaacuucagcugacuuguuacuuaaaaauugugaauucuguuguug

SEQ ID NO: 669263 - RNA, 64 nt, Homo Sapiens
uucacagaauggaugaauuaguuguuucuucagaguuacuuaugaacaguugaaugcuuuaaaa

SEQ ID NO: 669264 - RNA, 64 nt, Homo Sapiens
ucuagucuuguacuucuggcuauuuuagguugaaguuacuuauucuuuugugguauuuaaagca

SEQ ID NO: 669265 - RNA, 64 nt, Homo Sapiens
auguguacaugcaugaaagcggguuugcuuauuuguuacuuaacugauguacuguauugacuug

SEQ ID NO: 669266 - RNA, 64 nt, Homo Sapiens
aaacagacuucgcauuucaaacaacaaguucugaguuacuuaggaagucaaaaaucaaaaucaa

SEQ ID NO: 669267 - RNA, 64 nt, Homo Sapiens
gacucagaauaaaagaacagaguuuguaucacauguuacuuauuaugauuuuaauaaaaucuug

SEQ ID NO: 669268 - RNA, 64 nt, Homo Sapiens; identical to SEQ ID NO: 293538

SEQ ID NO: 669269 - RNA, 64 nt, Homo Sapiens; identical to SEQ ID NO: 293539

SEQ ID NO: 669270 - RNA, 64 nt, Homo Sapiens; identical to SEQ ID NO: 293540

SEQ ID NO: 669271 - RNA, 64 nt, Homo Sapiens; identical to SEQ ID NO: 293541

SEQ ID NO: 669272 - RNA, 64 nt, Homo Sapiens; identical to SEQ ID NO: 293542

SEQ ID NO: 669273 - RNA, 64 nt, Homo Sapiens; identical to SEQ ID NO: 293543

SEQ ID NO: 669274 - RNA, 64 nt, Homo Sapiens; identical to SEQ ID NO: 293544

SEQ ID NO: 669275 - RNA, 64 nt, Homo Sapiens; identical to SEQ ID NO: 293545

SEQ ID NO: 669276 - RNA, 64 nt, Homo Sapiens; identical to SEQ ID NO: 293546

SEQ ID NO: 669277 - RNA, 64 nt, Homo Sapiens; identical to SEQ ID NO: 293547

SEQ ID NO: 669278 - RNA, 64 nt, Homo Sapiens; identical to SEQ ID NO: 293548

SEQ ID NO: 669279 - RNA, 64 nt, Homo Sapiens; identical to SEQ ID NO: 293549

SEQ ID NO: 669280 - RNA, 64 nt, Homo Sapiens; identical to SEQ ID NO: 293550

SEQ ID NO: 669281 - RNA, 64 nt, Homo Sapiens; identical to SEQ ID NO: 293551

SEQ ID NO: 669282 - RNA, 64 nt, Homo Sapiens; identical to SEQ ID NO: 293552

SEQ ID NO: 669283 - RNA, 64 nt, Homo Sapiens; identical to SEQ ID NO: 293553

SEQ ID NO: 669284 - RNA, 64 nt, Homo Sapiens; identical to SEQ ID NO: 293554

SEQ ID NO: 669285 - RNA, 64 nt, Homo Sapiens; identical to SEQ ID NO: 293555

SEQ ID NO: 669286 - RNA, 64 nt, Homo Sapiens; identical to SEQ ID NO: 293556

SEQ ID NO: 669287 - RNA, 64 nt, Homo Sapiens; identical to SEQ ID NO: 293557

SEQ ID NO: 669288 - RNA, 64 nt, Homo Sapiens; identical to SEQ ID NO: 293558

SEQ ID NO: 669289 - RNA, 64 nt, Homo Sapiens; identical to SEQ ID NO: 293559

SEQ ID NO: 669290 - RNA, 64 nt, Homo Sapiens; identical to SEQ ID NO: 293560

SEQ ID NO: 669291 - RNA, 64 nt, Homo Sapiens; identical to SEQ ID NO: 293561

SEQ ID NO: 669292 - RNA, 64 nt, Homo Sapiens; identical to SEQ ID NO: 293562

SEQ ID NO: 669293 - RNA, 64 nt, Homo Sapiens; identical to SEQ ID NO: 293563

SEQ ID NO: 669294 - RNA, 64 nt, Homo Sapiens; identical to SEQ ID NO: 293564

SEQ ID NO: 669295 - RNA, 64 nt, Homo Sapiens; identical to SEQ ID NO: 293565

SEQ ID NO: 669296 - RNA, 64 nt, Homo Sapiens; identical to SEQ ID NO: 293566

SEQ ID NO: 669297 - RNA, 64 nt, Homo Sapiens; identical to SEQ ID NO: 293567

SEQ ID NO: 669298 - RNA, 64 nt, Homo Sapiens; identical to SEQ ID NO: 293568

SEQ ID NO: 669299 - RNA, 64 nt, Homo Sapiens; identical to SEQ ID NO: 293569

SEQ ID NO: 669300 - RNA, 64 nt, Homo Sapiens; identical to SEQ ID NO: 293570

SEQ ID NO: 669301 - RNA, 64 nt, Homo Sapiens; identical to SEQ ID NO: 293571

SEQ ID NO: 669302 - RNA, 64 nt, Homo Sapiens
cccugcacauucccucaugcuuuuuggagugaagaagccuuacucacugaagugggcucagugg

SEQ ID NO: 669303 - RNA, 64 nt, Homo Sapiens
ucagccuuuccucaauauggaacuugaggggcccaagccuuaucgguuaccuugaacgaaacag

SEQ ID NO: 669304 - RNA, 64 nt, Homo Sapiens
uauaaugaacuuuguacuauaauguaauauauuaaagccuuauaagucuguuuauguagaaaca

SEQ ID NO: 669305 - RNA, 64 nt, Homo Sapiens
uguggaauucggauugauaggugggucccaagccaagccuuaagcaagaggcuuuguuuaggac

SEQ ID NO: 669306 - RNA, 64 nt, Homo Sapiens
aauuacuagaaacccaauuacuuaguauuagcucaagccuuaauugaacuggccacagaaaagc

SEQ ID NO: 669307 - RNA, 64 nt, Homo Sapiens
auuagcucaagccuuaauaaaacuggccacagaaaagccuuaguacagugguaaaaucauaaug

SEQ ID NO: 669308 - RNA, 64 nt, Homo Sapiens
gaauauugaagggccugacacguaaaaugcacugaagccuuagggcacaguuaaggccaacuaa

SEQ ID NO: 669309 - RNA, 64 nt, Homo Sapiens
guggaaugaggaacaucuucuuggagauucaggaaagccuuaggugagcauaaauagcuucugu

SEQ ID NO: 669310 - RNA, 64 nt, Homo Sapiens
uccuucucacccaguaacgggccuuccucugcugaagccuuaccucuuguuugucugucaaggu

SEQ ID NO: 669311 - RNA, 64 nt, Homo Sapiens
cucauuuggguacucaaaagucuuuucauguuaaaagccuuaauuucccaaaugcagaacuugg

SEQ ID NO: 669312 - RNA, 64 nt, Homo Sapiens
ggccugguuguucaaaggaugggaaagaaaaaaaaagccuuagucuaaaaucuggggggucggg

SEQ ID NO: 669313 - RNA, 64 nt, Homo Sapiens
auuuagcucccuagcucuugcuuguuugagguaaaagccuuaaauucagccuaagccaguacuc

SEQ ID NO: 669314 - RNA, 64 nt, Homo Sapiens
ucccagcaacaccugcaguccagccccccucuucuaggaugagccacuguagaucauuaaaguu

SEQ ID NO: 669315 - RNA, 64 nt, Homo Sapiens
gagucucugcugaaaugaaucaggauucgagcucuaggaugagacagaaaaugaaagcauguug

SEQ ID NO: 669316 - RNA, 64 nt, Homo Sapiens
cagaaaauugcaaucaugcaggggcugggaggguuaggaugaaaaaacuggggccauuggaggc

SEQ ID NO: 669317 - RNA, 64 nt, Homo Sapiens
gggucagcaaaccagauggcuuguuguuggaauguaggaugagaggccugcuuggugaccuagc

SEQ ID NO: 669318 - RNA, 64 nt, Homo Sapiens
accaaugauuaccucauagggcuguugugaggauuaggaugaaauaccugugaaagugccuagg

SEQ ID NO: 669319 - RNA, 64 nt, Homo Sapiens
acaccugaaacaaucaacgcccaauaaaacaaaguaggaugaaaauucucuuaguucuuugaua

SEQ ID NO: 669320 - RNA, 64 nt, Homo Sapiens
aucuaagaccaaagggauguguuuuauuaaugucuaggaugaagaaaugcauagaacauuguag

SEQ ID NO: 669321 - RNA, 64 nt, Homo Sapiens
auuuaauuaaaugacagucuuuugguuacagacuuaggaugaguaaaaacaagaaaauuugggg

SEQ ID NO: 669322 - RNA, 64 nt, Homo Sapiens
gggaaaugacaaaggggcagcuggccagauaagcuaggaugagagcagagacucaguguguggg

SEQ ID NO: 669323 - RNA, 64 nt, Homo Sapiens
caugcuggcugggcggcccaagcacagcccugacuaggaugacagcagcacaaaagaccaccuu

SEQ ID NO: 669324 - RNA, 64 nt, Homo Sapiens
agagauuauaaguuugacacaacaucugagacacuaggaugaauuaucuuggaugagaaagaug

SEQ ID NO: 669325 - RNA, 64 nt, Homo Sapiens
uaagccauacauauuucuuuucccacauucuguuuaggaugacaguaauucuguugucuaccau

SEQ ID NO: 669326 - RNA, 64 nt, Homo Sapiens
agaaaugaguaagacacagugcccacccccaaguuaggaugaaaaaaguuccagagguuuuuaa

SEQ ID NO: 669327 - RNA, 64 nt, Homo Sapiens
uugaauaccagauaccacuauguaguaagucuuuuaggaugauuuuaauuuagucgugcgucau

SEQ ID NO: 669328 - RNA, 64 nt, Homo Sapiens
gucuuagagucguuugugguugugcucgcuuguguaggaugaauuauauaaauauauauguaua

SEQ ID NO: 669329 - RNA, 64 nt, Homo Sapiens
auucaaagugguaacccaaaagauaugcuaggaguaggaugaugagaaguaauucucuauacca

SEQ ID NO: 669330 - RNA, 64 nt, Homo Sapiens
accuccaguccuucggacuuuugaauaucuaggauaggaugaucguuguuccuggcaacagaau

SEQ ID NO: 669331 - RNA, 64 nt, Homo Sapiens
guuuugaguauacucugcacgacugagaaaacaguaggaugacagggaauaguauugcagggaa

SEQ ID NO: 669332 - RNA, 64 nt, Homo Sapiens
aauguauacaaugcacuuuugacaaacacaauucuaggaugaacggggaaaacuacaaacguuu

SEQ ID NO: 669333 - RNA, 64 nt, Homo Sapiens
cacuccuccaugggauuugaugcaugggaguuucuaggaugaaagcuucguuuaauguagcucu

SEQ ID NO: 669334 - RNA, 64 nt, Homo Sapiens
cauauucauaugcagaugucagugacuuucuaaguaggaugaauuugcauuguaugaaagagca

SEQ ID NO: 669335 - RNA, 64 nt, Homo Sapiens
aucgcaugagcccacacaguagcacccccguccuuaggaugagagucagagccuuuggaaaggc

SEQ ID NO: 669336 - RNA, 64 nt, Homo Sapiens
uaugguuuuaagauugaaaguaagaaaacggauuuaggaugaaaacucuagaacuacccuaugc

SEQ ID NO: 669337 - RNA, 64 nt, Homo Sapiens
gaauugcaaguccucugaagacaaugagaggauuuaggaugagcccgauagguguggcagacca

SEQ ID NO: 669338 - RNA, 61 nt, Homo Sapiens
auuucuaccaaacagugugaagaaaggcaacuaggaugagguuucaaaagacggaagacga

SEQ ID NO: 669339 - RNA, 64 nt, Homo Sapiens
uggcauccugcccacaaagaacucacagucugauuaggaugaacuuaaugacuauuuacaccuc

SEQ ID NO: 669340 - RNA, 64 nt, Homo Sapiens
gguggugugauggcuccugcacaggcccugcacauaggaugagggcaucugcucccacucagcc

SEQ ID NO: 669341 - RNA, 64 nt, Homo Sapiens
cugagauggugccacuguacuccagccugggugauaggaugagacuccaucucaggggaaaaaa

SEQ ID NO: 669342 - RNA, 64 nt, Homo Sapiens
aacucaguauuucuacaauugcagcuaagaacauuaggaugaauggcuggcugcuucuaggaau

SEQ ID NO: 669343 - RNA, 64 nt, Homo Sapiens
gugguaguaaugauguauauaaugagauucuaacuaggaugaauaacagaguggaauaaauaua

SEQ ID NO: 669344 - RNA, 64 nt, Homo Sapiens
acugauuacuauuuacuaaggccuggcagcugucuaggaugaucuaugugucucuccuuuuguu

SEQ ID NO: 669345 - RNA, 64 nt, Homo Sapiens
caccagaauaugccugcucagagccuuaaagaguuaggaugagcacacacacacgggaugaaug

SEQ ID NO: 669346 - RNA, 64 nt, Homo Sapiens
agauugaaacacauguuguaauuuaccauagaauuaggaugauuccucuaucucucucugugua

SEQ ID NO: 669347 - RNA, 64 nt, Homo Sapiens
cacucaaguagacccuucacucccugcgagaaauuaggaugaauaacuaccuguggcauuguug

SEQ ID NO: 669348 - RNA, 64 nt, Homo Sapiens
aaugucagaugaagucuuguucaggguauggggcuaggaugagagagaaugccacagaguauga

SEQ ID NO: 669349 - RNA, 64 nt, Homo Sapiens
cugacuggcagcaccagcuuugggggcagaguccuaggaugaggcuugggcagugcugguaggg

SEQ ID NO: 669350 - RNA, 64 nt, Homo Sapiens
uugccaaaaagcauacaagcaaccuggucauacauaggaugacaaaauucuuucugguuguuuu

SEQ ID NO: 669351 - RNA, 64 nt, Homo Sapiens
uuauuguauugcuuaaugucuuuugguuuggauuuaggaugauagaaaacagaaguauaauugg

SEQ ID NO: 669352 - RNA, 64 nt, Homo Sapiens
cucaauaaaacagaaaggggcaaguauagaagauuaggaugacuaaauuaauggggaaaugaug

SEQ ID NO: 669353 - RNA, 64 nt, Homo Sapiens
auaauacauaaccacagcaagacugacauccacuuaggaugauacaaagcaguguaacugaaaa

SEQ ID NO: 669354 - RNA, 64 nt, Homo Sapiens
gugcuucccagccucacaaugugggaauuugacauaggaugagagucagaguauagguuuaaaa

SEQ ID NO: 669355 - RNA, 64 nt, Homo Sapiens
auuuuaugaaauuccaaugcggugacaucacuauuaggaugaaagccacagaaauaucaaaaau

SEQ ID NO: 669356 - RNA, 64 nt, Homo Sapiens
aguuauaaagaaagaagauccacccuuuaaaucuuaggaugacacaauuucuguguuccccuuc

SEQ ID NO: 669357 - RNA, 64 nt, Homo Sapiens
acaugucaaaguaauaaaagcaugacggauaguuuaggaugacuguggagauuuuuggagaaac

SEQ ID NO: 669358 - RNA, 64 nt, Homo Sapiens
acagcaaaacaauaauuuuuguuaaagagguuaguaggaugaaagcucugauaaauuguguucu

SEQ ID NO: 669359 - RNA, 64 nt, Homo Sapiens
gacuuuuuaaaauggcagaugguuuuaucugcuauaggaugagauugauagacgaaauauacuu

SEQ ID NO: 669360 - RNA, 64 nt, Homo Sapiens
uuaaacuuugauuuuguaugcuauuuuuucacuauaggaugacuauaauucuggucacuaaaua

SEQ ID NO: 669361 - RNA, 64 nt, Homo Sapiens
ugguuuucaggugagauugaaaaugaagcaaagauaggaugaaucugaacaucucuccaucuag

SEQ ID NO: 669362 - RNA, 64 nt, Homo Sapiens
ggaaauaaaugauguacuaccauaccacuuugaauaggaugauaggggcagauauuucccaaua

SEQ ID NO: 669363 - RNA, 64 nt, Homo Sapiens
gggaaaguauuuuugaaagaucuuuaaugguuaauaggaugaauugagacacauacaaaaaaaa

SEQ ID NO: 669364 - RNA, 64 nt, Homo Sapiens
agaaguaccuggagcaucauaucaacucugccccuaggaugagcacugauggugacagcuguac

SEQ ID NO: 669365 - RNA, 64 nt, Homo Sapiens
ggucaauacugcccucucacuuacagaaaagugauaggaugaaacuccauaguacauggacuug

SEQ ID NO: 669366 - RNA, 64 nt, Homo Sapiens
gagagaucagauacaugaacuuucuagcuguacauaggaugaagcauuucaguguagucauuca

SEQ ID NO: 669367 - RNA, 64 nt, Homo Sapiens
acuuuugcuguuggauuuagguuccauucuaaccuaggaugaucucauuuggaaauccuuaauu

SEQ ID NO: 669368 - RNA, 64 nt, Homo Sapiens
cuuccaaggucaguacauagguaaaaugggcuauuaggaugauccuugaaagcccuuuagaagg

SEQ ID NO: 669369 - RNA, 64 nt, Homo Sapiens
ucuuucugaauuuuuguaauucucgccuucacacuaggaugacagacucagcuaauguuuccuu

SEQ ID NO: 669370 - RNA, 64 nt, Homo Sapiens
uuguaugugcuugccgcuauuuuuuucuuccuuuuaggaugauagaucauaacagaacuuauuc

SEQ ID NO: 669371 - RNA, 64 nt, Homo Sapiens
agaugccuuucccagccaugggagugugaagugcuaggaugaaccuggccauccuagcaaggag

SEQ ID NO: 669372 - RNA, 64 nt, Homo Sapiens
aaagguugaggggagggcagccagguuggucuguuaggaugaacacuccauauuaaugcaggag

SEQ ID NO: 669373 - RNA, 64 nt, Homo Sapiens
gguuauuuaaaauggaacuagauaaauggguauguaggaugaagaagggagaaaaaggaagcaa

SEQ ID NO: 669374 - RNA, 64 nt, Homo Sapiens
uuaaaucuuaaaucuuauuaauguucugauacauuaggaugaaguugagacuuuuuuuuuuuua

SEQ ID NO: 669375 - RNA, 64 nt, Homo Sapiens
ugaucauuauaaagauuuaacauguaaaaggagguaggaugaauagccugucauuuuucagcug

SEQ ID NO: 669376 - RNA, 64 nt, Homo Sapiens
uauguuuguauauuguguguggcugcuuuugcauuaggaugacagaggugaauaguugcaacag

SEQ ID NO: 669377 - RNA, 64 nt, Homo Sapiens
acugaggaaaaaaaauucagcacuuggacuaucauaggaugaguaaaacuuuucuuguacaaag

SEQ ID NO: 669378 - RNA, 64 nt, Homo Sapiens
cuuaacuacgguguuucccuuaccauggcauucauaggaugaaaugaaugacugcccagaauga

SEQ ID NO: 669379 - RNA, 64 nt, Homo Sapiens
acaggauggagcucuucaugacugucuccagcaauaggaugauuuacuauaaauuucauccaac

SEQ ID NO: 669380 - RNA, 64 nt, Homo Sapiens
uuuuuagauggcuuucuacccccugaacaauaaauaggaugagguuuuacuguaauuggguaaa

SEQ ID NO: 669381 - RNA, 64 nt, Homo Sapiens
uauauugcccaacucuauguuugggugggauggguaggaugaagugagaugaguagaguaagau

SEQ ID NO: 669382 - RNA, 64 nt, Homo Sapiens
caggcccaguccuccuccagaggguuuaagaugcuaggaugagggaagcugcagcucuggaaag

SEQ ID NO: 669383 - RNA, 64 nt, Homo Sapiens
cucuccuagacuugaccuagugcaauuuuuuuuuuaggaugagcuuuuaauugagaaaagacuu

SEQ ID NO: 669384 - RNA, 64 nt, Homo Sapiens
uucucuugguuguuuuucauuauaaaccuuucaguaggaugauaagacauuagcaagcauaguc

SEQ ID NO: 669385 - RNA, 64 nt, Homo Sapiens
guguuaacccauuaccuuuuucaggaggugguauuaggaugacucugagagaaaauucagcauc

SEQ ID NO: 669386 - RNA, 64 nt, Homo Sapiens
ugaaguuuuuuguagguccuuguuguaacuaauuuaggaugaguuucuauguuguauauuaaag

SEQ ID NO: 669387 - RNA, 64 nt, Homo Sapiens
uauucauucacauuaggucacugucauacugucauaggaugagagaguucuucaaaaauuaugu

SEQ ID NO: 669388 - RNA, 64 nt, Homo Sapiens
acuugugcuuagcuuagcauuuuaaaagauacucuaggaugauccacaaaccuguguuuauaua

SEQ ID NO: 669389 - RNA, 64 nt, Homo Sapiens
ggaauuauuaauuuuuaaagacacugaucaacuauaggaugauuugaggcaauuggaaauuuga

SEQ ID NO: 669390 - RNA, 64 nt, Homo Sapiens
ucagagcgagagaugacacauaugugucugccucuaggaugagcaagaaguuccuuugagcaug

SEQ ID NO: 669391 - RNA, 64 nt, Homo Sapiens
cuggaaaccugaugcuuuuauaagccauugugauuaggaugacuguuacaggcuuagcuuugug

SEQ ID NO: 669392 - RNA, 64 nt, Homo Sapiens
gaaacauuagcuucuuuuaccaaccugagaaaauuaggaugaccuggcaaauaagaucuugaau

SEQ ID NO: 669393 - RNA, 64 nt, Homo Sapiens
ugauguuauaauuuuagggggguggguaacacucuaggaugacauguuuuuuguaccucuccca

SEQ ID NO: 669394 - RNA, 64 nt, Homo Sapiens
aagaauaaaggacacuuuggcaauaaaacucaaauaggaugauaauuucccagcuguguaaaaa

SEQ ID NO: 669395 - RNA, 64 nt, Homo Sapiens
ugcagccugucacaguggcagauuugucuguucguaggaugaugacuccaauugugcugaagcu

SEQ ID NO: 669396 - RNA, 64 nt, Homo Sapiens
cuucuuuaaucaaucauauacaugaaauuacccuuaggaugaguuaacaaacacaauccauugu

SEQ ID NO: 669397 - RNA, 64 nt, Homo Sapiens
uagaaauaaauugugaugaaaucuauaaucuccguaggaugaaugcuaaguaauuuuuaguucu

SEQ ID NO: 669398 - RNA, 64 nt, Homo Sapiens
uuauuuauuuucuauuuucauuguuucauuuuuauaggaugaagguacagucauuaaaagugcc

SEQ ID NO: 669399 - RNA, 64 nt, Homo Sapiens
cuccuugaacagcuuccccuccagcccacugcuuuaggaugacacaaugaauaacaccuaguca

SEQ ID NO: 669400 - RNA, 64 nt, Homo Sapiens
ccugggugguuugcagcccuaaugaaauuaugucuaggaugauucagucuauuucccauuuacu

SEQ ID NO: 669401 - RNA, 64 nt, Homo Sapiens
aaccuccuuuugucuuucauaaaauaaaagcuacuaggaugaguuguuuuaaggauuucagauu

SEQ ID NO: 669402 - RNA, 64 nt, Homo Sapiens
cuacuuauauaaaagcuagaaauaaugugauuccuaggaugagaaauugguuaacagagcucug

SEQ ID NO: 669403 - RNA, 64 nt, Homo Sapiens
aauuggugcacagcaggagaaauuucuggacuguuaggaugaauggacgccuucuccccguuau

SEQ ID NO: 669404 - RNA, 64 nt, Homo Sapiens
ucccaucuuuuggcagcaaaaccaccugcguggcuaggaugauuaauuaugaggaugaugauuu

SEQ ID NO: 669405 - RNA, 64 nt, Homo Sapiens
aaugaaaauauaaaauaaaguggcuucaguaaauuaggaugaaacuaaagcuaaccaaagaaaa

SEQ ID NO: 669406 - RNA, 64 nt, Homo Sapiens
uaauuguacauaauuuauuucaaaaggcagugauuaggaugaaaaaugcuuuuguuauuaaacu

SEQ ID NO: 669407 - RNA, 64 nt, Homo Sapiens
cauauaacagaaaaaaaaaaagaaguagacauaauaggaugaauccaguauuaucucugcuuuc

SEQ ID NO: 669408 - RNA, 64 nt, Homo Sapiens
uuuagaaagaaaauugaucaagugagcuugaacauaggaugagcuuucaauuccacagaaagaa

SEQ ID NO: 669409 - RNA, 64 nt, Homo Sapiens
uccacccuccuuggacaugagagcaagaugucaguaggaugaccagcaggacauuggaccucua

SEQ ID NO: 669410 - RNA, 64 nt, Homo Sapiens
guuucuuaacaaucaaaucucaaguucuugucuuuaggaugaccccagagcuccugaguggaau

SEQ ID NO: 669411 - RNA, 64 nt, Homo Sapiens
aacuuuuaaaauugcugaagugauacucagaaauuaggaugaagaaaguacuuuuuacuuuuua

SEQ ID NO: 669412 - RNA, 64 nt, Homo Sapiens
agauucuucuguguuuauaaaggguuuuccuacguaggaugaaaacaagcaaguucugagagcc

SEQ ID NO: 669413 - RNA, 64 nt, Homo Sapiens
uuccucggaguuuaauuugaaagucugggugucuuaggaugaugguuaggaacauugaaaaaug

SEQ ID NO: 669414 - RNA, 64 nt, Homo Sapiens
cuugagugaaauaauuuugcauugcaaaguguuuuaggaugaacuuuguuauaguuuuaacucc

SEQ ID NO: 669415 - RNA, 64 nt, Homo Sapiens
cagaccuuuuucuaugcuuuuuugaauaucagaguaggaugaacacccagauucaaauauguca

SEQ ID NO: 669416 - RNA, 64 nt, Homo Sapiens
caagaaacuugucuauguaccuuaauacuuuguuuaggaugaggagucuuugugucccuguaca

SEQ ID NO: 669417 - RNA, 64 nt, Homo Sapiens
ccauuguugauauccacauccuaaaacucaguuuuaggaugaaaguaaauauacuaaacaaaug

SEQ ID NO: 669418 - RNA, 64 nt, Homo Sapiens
ccagugauuucaugugugcuagaguuugauuauuuaggaugaucucuugucuuacauuagggug

SEQ ID NO: 669419 - RNA, 64 nt, Homo Sapiens
ucccuuuucuaagguguuuuuauguaagaaaccuuaggaugagcuuuuuauguacucuuaguuu

SEQ ID NO: 669420 - RNA, 64 nt, Homo Sapiens
gaacugaaagcacuagagcagccuuggggacugcuaggaugaagcccuaaagaaugcaaccuag

SEQ ID NO: 669421 - RNA, 64 nt, Homo Sapiens
cacaccagugucuguucuugaugcaguugcuauuuaggaugaguuaagugccuggggagucccu

SEQ ID NO: 669422 - RNA, 64 nt, Homo Sapiens
uuuauauuccauaugugguucuuacccauuuaucuaggaugaaagugugaauuagagggacucc

SEQ ID NO: 669423 - RNA, 64 nt, Homo Sapiens
ccuccaaugucugggacuugccagcucagcccguuaggaugagggugcugagaggaaacaggaa

SEQ ID NO: 669424 - RNA, 64 nt, Homo Sapiens
cuuaaaugauguuuuguauauuuuaauagacugauaggaugagaaagauuuauauuauuagauu

SEQ ID NO: 669425 - RNA, 64 nt, Homo Sapiens
aagaagaucgguuuuuaauaauuuuuuauuuucauaggaugaaguuagagaaaauauucagcug

SEQ ID NO: 669426 - RNA, 64 nt, Homo Sapiens
acacugcaggcaagguguugguaacugccugcucuaggaugaauaguagcguuagcagcacccu

SEQ ID NO: 669427 - RNA, 64 nt, Homo Sapiens
uuggcuuacugcuaucuugucaggauugagauucuaggaugagaacaguuuuggaagccucucu

SEQ ID NO: 669428 - RNA, 64 nt, Homo Sapiens
cuaggcuguuaaauagauuugcugauggaagcacuaggaugauuccuuuuuuagcaagccuucu

SEQ ID NO: 669429 - RNA, 64 nt, Homo Sapiens
ccuucugagagcuuggugaauagguccauccuccuaggaugaaggaguauagggaggccccaua

SEQ ID NO: 669430 - RNA, 64 nt, Homo Sapiens
uuagaacuguagcagugcagauuuuaaaucucucuaggaugaguaaaguucagucacuuuauuu

SEQ ID NO: 669431 - RNA, 64 nt, Homo Sapiens
gccuucaaagucuaccagcauagggguacgaaaguaggaugagauuaugaagcagucaacaauu

SEQ ID NO: 669432 - RNA, 64 nt, Homo Sapiens
uuuaaagcaauaucccaggagaauauguuagacuuaggaugauaccuucagccacuugaagaag

SEQ ID NO: 669433 - RNA, 64 nt, Homo Sapiens
aagcaguccuccagccucagccuucucaaagugcuaggaugauuggcaugagccaccucgucug

SEQ ID NO: 669434 - RNA, 64 nt, Homo Sapiens
ugggguuucaauugacuucuugccagaagguggguaggaugaccuuagaucauuauccagagac

SEQ ID NO: 669435 - RNA, 64 nt, Homo Sapiens
ccguguguguacugauucaaggcuuggagaugaauaggaugauugggcugauacauccuucugu

SEQ ID NO: 669436 - RNA, 64 nt, Homo Sapiens
gcagaagguagauccuaaaacuaugacuuuuagguaggaugagaccuaaagugucaacguuuuu

SEQ ID NO: 669437 - RNA, 64 nt, Homo Sapiens
ggaggauaacauuuuugcuuuucuuauuuauuucuaggaugaggaaaaaaaaaaauuuaugucc

SEQ ID NO: 669438 - RNA, 64 nt, Homo Sapiens
guaagagaaugagaaagaugguguacuaggggauuaggaugauucuuauugauauaugguaagg

SEQ ID NO: 669439 - RNA, 64 nt, Homo Sapiens
uacaagaaaauaaguuucuuaauauuuacaauaauaggaugaucguuuggcaaugcucuucuuc

SEQ ID NO: 669440 - RNA, 64 nt, Homo Sapiens
accacuuagugucccauucuuggcccugcaagcuuaggaugagacuccaacacccggcagcacu

SEQ ID NO: 669441 - RNA, 64 nt, Homo Sapiens
guaucuugaauaugugguagaaccuaacugaugguaggaugauuuuucaaaauauuuaaagcau

SEQ ID NO: 669442 - RNA, 64 nt, Homo Sapiens
acagcuuauuuuuaaguuguaaaucaaacuuuucuaggaugaagcauauucauuauaagauggc

SEQ ID NO: 669443 - RNA, 64 nt, Homo Sapiens
uggcaauggaagcuccaguacccagauuggagauuaggaugagacaacuuuguguauaugugca

SEQ ID NO: 669444 - RNA, 64 nt, Homo Sapiens
uuaauuuuauguuuuuaacauguaugucucugguuaggaugaagguuuguuagauaagagucua

SEQ ID NO: 669445 - RNA, 64 nt, Homo Sapiens
gcugugaaauggagaacagucugcuuggaguauuuaggaugacugucacccuccucacagaccu

SEQ ID NO: 669446 - RNA, 64 nt, Homo Sapiens
aauauagcuuuauuuuucaguggagaucauuguuuaggaugagacauuuuugguuuugguuuug

SEQ ID NO: 669447 - RNA, 64 nt, Homo Sapiens
gagaucagaucagauagguaaacugcaagauagauaggaugaaacuuuuggccuacuguauuac

SEQ ID NO: 669448 - RNA, 64 nt, Homo Sapiens
cugugacuaggcuggaguuggagacagcuaacucuaggaugaagucacuggcuaaugagaaaag

SEQ ID NO: 669449 - RNA, 64 nt, Homo Sapiens
aaauaaauuauaaagucuguaaucaaaguauuauuaggaugacuacaagagacacagacaguaa

SEQ ID NO: 669450 - RNA, 64 nt, Homo Sapiens
uagauucuucuccaucucucccuccagcagucccuaggaugaugagaaggccauggagcuuaaa

SEQ ID NO: 669451 - RNA, 64 nt, Homo Sapiens
cuuaagaagccuuaccacgcaguaacuaaagcuuuaggaugacuguauucgaggagugccgugu

SEQ ID NO: 669452 - RNA, 64 nt, Homo Sapiens
uucccccuugcaguuauguuaagguaaaaccaucuaggaugauucucagguuauucguuacucu

SEQ ID NO: 669453 - RNA, 64 nt, Homo Sapiens
cucuagcuauagauacugccaaguuuuccacaaauaggaugaccacccacuaaaguagacaaua

SEQ ID NO: 669454 - RNA, 64 nt, Homo Sapiens
uuuugaauuuacuugguagguaaacguauaagauuaggaugaacccucagucuucaccguuuua

SEQ ID NO: 669455 - RNA, 64 nt, Homo Sapiens
uguucccccucugaugaacaacuccucugugaucuaggaugaucugacacauucuuagcacuga

SEQ ID NO: 669456 - RNA, 64 nt, Homo Sapiens
cccacgagcagcaggcaacggcguccaaggagacuaggaugaguucuuggcaagggccagcguu

SEQ ID NO: 669457 - RNA, 64 nt, Homo Sapiens
cuggauuagagaagacuuuucaguggguuaucucuaggaugaucaguaguucagcacuuaaaaa

SEQ ID NO: 669458 - RNA, 64 nt, Homo Sapiens
ucauguaguuuuggcggaaauuuccccaucauucuaggaugauacagaaagaaaaacugugccu

SEQ ID NO: 669459 - RNA, 64 nt, Homo Sapiens
cuuuugucagaauagaugaugugucagaucucuuuaggaugacuguauuuuucaguugccgaua

SEQ ID NO: 669460 - RNA, 64 nt, Homo Sapiens
uaaauggguuuuugcugauuuccugggugcaugcuaggaugauggggcuugaugcaguagggaa

SEQ ID NO: 669461 - RNA, 64 nt, Homo Sapiens
gaaaauggacauaaagucaaagaaugauggcagguaggaugaaggagagauacuuaggaaaucc

SEQ ID NO: 669462 - RNA, 64 nt, Homo Sapiens
uuguuuuucuucagcauuuacuugaagauuaauguaggaugacaggcucuccuggcuguccuac

SEQ ID NO: 669463 - RNA, 64 nt, Homo Sapiens
gagacuaaagaaaucuaucuguucaaguucuaauuaggaugauuguuaauacugcacuguggau

SEQ ID NO: 669464 - RNA, 64 nt, Homo Sapiens
ucaaucuucuugcaggaacaaaaggagaaaaugcuaggaugaaguguuccugcguguuucaccc

SEQ ID NO: 669465 - RNA, 64 nt, Homo Sapiens
uuugugagcaccagacucaacaaaguagcagaaauaggaugaugcuucccucaaggcugccaca

SEQ ID NO: 669466 - RNA, 64 nt, Homo Sapiens
gcuuuugaaguauuagggcuagguuuuuauggaauaggaugaauuacuguugcugaauaauacu

SEQ ID NO: 669467 - RNA, 64 nt, Homo Sapiens
gugcugacacccaguaggaacgucugaguugccuuaggaugacaaucauagucuaaaacuauca

SEQ ID NO: 669468 - RNA, 64 nt, Homo Sapiens
aaggacaacaguuuuaggcuuaaauuuguagagauaggaugaccagcauuuuuaaaaaauacaa

SEQ ID NO: 669469 - RNA, 64 nt, Homo Sapiens
uggugccaacacucauucaucauucccgaucaacuaggaugaauuuaagacugugcuaccaugu

SEQ ID NO: 669470 - RNA, 64 nt, Homo Sapiens
gagccaggaagcagcgucucaucaggacagaagguaggaugaagacaugggguaaugugagaga

SEQ ID NO: 669471 - RNA, 64 nt, Homo Sapiens
ucucuggcuaccgggcugggggcgaccuuuaccauaggaugaaguaaccuugcauucggcugca

SEQ ID NO: 669472 - RNA, 64 nt, Homo Sapiens
ggucccuacacaaagaggccuugaaugauuuccuuaggaugaauuucccacagcaaggcugcau

SEQ ID NO: 669473 - RNA, 64 nt, Homo Sapiens
aggaguaugugggcuuugcagccuuccugucuacuaggaugacauccucaccgugaugcauucu

SEQ ID NO: 669474 - RNA, 64 nt, Homo Sapiens
acugaucauacaaaacguauucuauugaacucuuuaggaugaugcccugcuauuuuucauugac

SEQ ID NO: 669475 - RNA, 64 nt, Homo Sapiens
aaaguaaucaaaagaaauaauuauuaaguuauucuaggaugauuuuaauuuaaaccgcuauuua

SEQ ID NO: 669476 - RNA, 64 nt, Homo Sapiens
gaaacaaggaaauauagggacauuuuuaaaaauuuaggaugaagucaauaaugauuacaguuuu

SEQ ID NO: 669477 - RNA, 64 nt, Homo Sapiens
gagaagaaaaaaucaaagaaaucugucuaauucuuaggaugaccacugggaggucuuaauguuu

SEQ ID NO: 669478 - RNA, 64 nt, Homo Sapiens
uuccuaggaggaaaauuccauuagagaguggcaauaggaugagguuucuucaggguaaacuagc

SEQ ID NO: 669479 - RNA, 64 nt, Homo Sapiens
uagauucccuaauuacagugaaagacuauuaaguuaggaugaacuugcauugucuauacaugca

SEQ ID NO: 669480 - RNA, 64 nt, Homo Sapiens
uaaaaagcaaguguuuucccguuuuggauguuuuuaggaugacaggguugaucuggccccgagg

SEQ ID NO: 669481 - RNA, 64 nt, Homo Sapiens
gaucccagggaggaaguguuggggcuucaugaacuaggaugaaaggaggccccugagccaugac

SEQ ID NO: 669482 - RNA, 64 nt, Homo Sapiens
gaaaaaccccugaggacccccccccauccucuucuaggaugaggggaagcuggagccccaacuu

SEQ ID NO: 669483 - RNA, 64 nt, Homo Sapiens
cuacaguuaauucugacacuguaucuuauuaaaauaggaugauuugcauuuuguaaaauuaucc

SEQ ID NO: 669484 - RNA, 64 nt, Homo Sapiens
gugccuguagucccagcuacucaggaggcugagguaggaugauggcuugagcccaggaguucga

SEQ ID NO: 669485 - RNA, 64 nt, Homo Sapiens
aggccauucacuguggucccugggaaagaaucaguaggaugacagggcugacuucauuagcuga

SEQ ID NO: 669486 - RNA, 64 nt, Homo Sapiens
gaacaugugacucucagcauuggaaggacagagcuaggaugauggcuuuccgguggcacucguu

SEQ ID NO: 669487 - RNA, 64 nt, Homo Sapiens
caacuacccccauaacuuucacuccuugggccccuaggaugaccacauuugggcagugccaccc

SEQ ID NO: 669488 - RNA, 64 nt, Homo Sapiens
gcuaucaaugucagaaaggcccaguguuauucacuaggaugaaugaaaaaucauauuucaaaau

SEQ ID NO: 669489 - RNA, 64 nt, Homo Sapiens
gcagaaaagucuuuggggaucuccagagacaacuuaggaugagguaagucugcucauuggggaa

SEQ ID NO: 669490 - RNA, 64 nt, Homo Sapiens
aggugcugggcuggacuggccauuuuucuggggguaggaugaagagaaggcacacagagauucu

SEQ ID NO: 669491 - RNA, 64 nt, Homo Sapiens
uucccuccuuaaaagaaaaauuaccuucuaguccuaggaugaggacacacuauuaguuugaauu

SEQ ID NO: 669492 - RNA, 64 nt, Homo Sapiens
acuaaaucaauuaauuauucuuuguuucucuuccuaggaugaaagcugauuaggauugaaauga

SEQ ID NO: 669493 - RNA, 64 nt, Homo Sapiens
aauguaucugcagcaacucugcagguuugugaaauaggaugaaacucaaucuuuuucuauugug

SEQ ID NO: 669494 - RNA, 64 nt, Homo Sapiens
uucccuaggggaucaccacggcucuagggcauucuaggaugaggucagaccccuuggccauugg

SEQ ID NO: 669495 - RNA, 64 nt, Homo Sapiens
gccgucagugaaggggugggcuuuuguuguuaauuaggaugagucggguucucaauuuggucuu

SEQ ID NO: 669496 - RNA, 64 nt, Homo Sapiens
acaggcaaugacugcgcagaagaagucggccagguaggaugaaccaccaaggaaauauugagag

SEQ ID NO: 669497 - RNA, 64 nt, Homo Sapiens
ugcuuuaucagggagcuccuuccaaaaggcugucuaggaugagcggaaggacaguuacgcuaac

SEQ ID NO: 669498 - RNA, 64 nt, Homo Sapiens
aucaaguaaaaugcaaagaugagaaaccauaaaauaggaugaaagcacagcugcuuccaaauag

SEQ ID NO: 669499 - RNA, 64 nt, Homo Sapiens
aaauuugaaauggcauuuuguauugccacagagguaggaugagccauauauuagugaaauguuu

SEQ ID NO: 669500 - RNA, 64 nt, Homo Sapiens
aaauuuugaugcugagggggauuauucaagggacuaggaugaacuaaauaagaacucaguuguu

SEQ ID NO: 669501 - RNA, 64 nt, Homo Sapiens
aacagugacugauguugguuguaaugguuggguuuaggaugaaccauuuuaaggaugccaaaug

SEQ ID NO: 669502 - RNA, 64 nt, Homo Sapiens
uuguaucuuaaaguuucaugugaguuuuuaccguuaggaugauuaagauguauauaggacaaaa

SEQ ID NO: 669503 - RNA, 64 nt, Homo Sapiens
guguuaaugggggacuuugaaaauguuugggagauaggaugaagucaugauuuugcuuuugcaa

SEQ ID NO: 669504 - RNA, 64 nt, Homo Sapiens
agcaagaguccaggucacuggcggaucaggauguuaggaugacgguguguucauguuuugucca

SEQ ID NO: 669505 - RNA, 64 nt, Homo Sapiens
auuucacaauaaauguuuguuaccuaauaaaggguaggaugaauaaagugcuuugaugauguaa

SEQ ID NO: 669506 - RNA, 64 nt, Homo Sapiens
agaaaagcagaaagagagagauguauucagccuuuaggaugaucguccuccacacaggaggagg

SEQ ID NO: 669507 - RNA, 64 nt, Homo Sapiens
auuuuguguaaaauucauuaaagagaguagcaauuaggaugauccuguaagcacuguaguugaa

SEQ ID NO: 669508 - RNA, 64 nt, Homo Sapiens
gcaccccugagcugggcaaaauuccaagagagcuuaggaugacaaggagccuaggcugaauuug

SEQ ID NO: 669509 - RNA, 64 nt, Homo Sapiens
ccuuguuuugggugagacagcgucaucacagcaguaggaugaagccuuuuuaaaugugauuucc

SEQ ID NO: 669510 - RNA, 64 nt, Homo Sapiens
uugaagaaaaguauauuggaagauuuaaaauaaauaggaugaggaguucguuucaagauaggug

SEQ ID NO: 669511 - RNA, 64 nt, Homo Sapiens
gacaaacacaucugcccaaugacuauggcuugaguaggaugaaauaccgaaggcaaaucuucca

SEQ ID NO: 669512 - RNA, 64 nt, Homo Sapiens; identical to SEQ ID NO: 276789

SEQ ID NO: 669513 - RNA, 64 nt, Homo Sapiens; identical to SEQ ID NO: 276790

SEQ ID NO: 669514 - RNA, 64 nt, Homo Sapiens; identical to SEQ ID NO: 276791

SEQ ID NO: 669515 - RNA, 64 nt, Homo Sapiens; identical to SEQ ID NO: 276792

SEQ ID NO: 669516 - RNA, 64 nt, Homo Sapiens; identical to SEQ ID NO: 276793

SEQ ID NO: 669517 - RNA, 64 nt, Homo Sapiens; identical to SEQ ID NO: 276794

SEQ ID NO: 669518 - RNA, 64 nt, Homo Sapiens; identical to SEQ ID NO: 276795

SEQ ID NO: 669519 - RNA, 64 nt, Homo Sapiens; identical to SEQ ID NO: 276796

SEQ ID NO: 669520 - RNA, 64 nt, Homo Sapiens; identical to SEQ ID NO: 276797

SEQ ID NO: 669521 - RNA, 64 nt, Homo Sapiens; identical to SEQ ID NO: 276798

SEQ ID NO: 669522 - RNA, 64 nt, Homo Sapiens; identical to SEQ ID NO: 276799

SEQ ID NO: 669523 - RNA, 64 nt, Homo Sapiens; identical to SEQ ID NO: 276800

SEQ ID NO: 669524 - RNA, 64 nt, Homo Sapiens; identical to SEQ ID NO: 276801

SEQ ID NO: 669525 - RNA, 64 nt, Homo Sapiens; identical to SEQ ID NO: 276802

SEQ ID NO: 669526 - RNA, 64 nt, Homo Sapiens; identical to SEQ ID NO: 276803

SEQ ID NO: 669527 - RNA, 64 nt, Homo Sapiens; identical to SEQ ID NO: 276804

SEQ ID NO: 669528 - RNA, 64 nt, Homo Sapiens; identical to SEQ ID NO: 276805

SEQ ID NO: 669529 - RNA, 64 nt, Homo Sapiens; identical to SEQ ID NO: 276806

SEQ ID NO: 669530 - RNA, 64 nt, Homo Sapiens; identical to SEQ ID NO: 276807

SEQ ID NO: 669531 - RNA, 64 nt, Homo Sapiens; identical to SEQ ID NO: 276808

SEQ ID NO: 669532 - RNA, 64 nt, Homo Sapiens; identical to SEQ ID NO: 276809

SEQ ID NO: 669533 - RNA, 64 nt, Homo Sapiens; identical to SEQ ID NO: 276810

SEQ ID NO: 669534 - RNA, 64 nt, Homo Sapiens; identical to SEQ ID NO: 276811

SEQ ID NO: 669535 - RNA, 64 nt, Homo Sapiens; identical to SEQ ID NO: 276812

SEQ ID NO: 669536 - RNA, 64 nt, Homo Sapiens; identical to SEQ ID NO: 276813

SEQ ID NO: 669537 - RNA, 64 nt, Homo Sapiens; identical to SEQ ID NO: 276814

SEQ ID NO: 669538 - RNA, 64 nt, Homo Sapiens; identical to SEQ ID NO: 276815

SEQ ID NO: 669539 - RNA, 64 nt, Homo Sapiens; identical to SEQ ID NO: 276816

SEQ ID NO: 669540 - RNA, 64 nt, Homo Sapiens; identical to SEQ ID NO: 276817

SEQ ID NO: 669541 - RNA, 64 nt, Homo Sapiens; identical to SEQ ID NO: 276818

SEQ ID NO: 669542 - RNA, 64 nt, Homo Sapiens; identical to SEQ ID NO: 276819

SEQ ID NO: 669543 - RNA, 64 nt, Homo Sapiens; identical to SEQ ID NO: 276820

SEQ ID NO: 669544 - RNA, 64 nt, Homo Sapiens; identical to SEQ ID NO: 276821

SEQ ID NO: 669545 - RNA, 64 nt, Homo Sapiens; identical to SEQ ID NO: 276822

SEQ ID NO: 669546 - RNA, 64 nt, Homo Sapiens; identical to SEQ ID NO: 276823

SEQ ID NO: 669547 - RNA, 64 nt, Homo Sapiens; identical to SEQ ID NO: 276824

SEQ ID NO: 669548 - RNA, 64 nt, Homo Sapiens; identical to SEQ ID NO: 276825

SEQ ID NO: 669549 - RNA, 64 nt, Homo Sapiens; identical to SEQ ID NO: 276826

SEQ ID NO: 669550 - RNA, 64 nt, Homo Sapiens; identical to SEQ ID NO: 276827

SEQ ID NO: 669551 - RNA, 64 nt, Homo Sapiens; identical to SEQ ID NO: 276828

SEQ ID NO: 669552 - RNA, 64 nt, Homo Sapiens; identical to SEQ ID NO: 276829

SEQ ID NO: 669553 - RNA, 64 nt, Homo Sapiens; identical to SEQ ID NO: 276830

SEQ ID NO: 669554 - RNA, 64 nt, Homo Sapiens; identical to SEQ ID NO: 276831

SEQ ID NO: 669555 - RNA, 64 nt, Homo Sapiens; identical to SEQ ID NO: 276832

SEQ ID NO: 669556 - RNA, 64 nt, Homo Sapiens; identical to SEQ ID NO: 276833

SEQ ID NO: 669557 - RNA, 64 nt, Homo Sapiens; identical to SEQ ID NO: 276834

SEQ ID NO: 669558 - RNA, 64 nt, Homo Sapiens; identical to SEQ ID NO: 276835

SEQ ID NO: 669559 - RNA, 64 nt, Homo Sapiens; identical to SEQ ID NO: 276836

SEQ ID NO: 669560 - RNA, 64 nt, Homo Sapiens; identical to SEQ ID NO: 276837

SEQ ID NO: 669561 - RNA, 64 nt, Homo Sapiens; identical to SEQ ID NO: 276838

SEQ ID NO: 669562 - RNA, 64 nt, Homo Sapiens; identical to SEQ ID NO: 276839

SEQ ID NO: 669563 - RNA, 64 nt, Homo Sapiens; identical to SEQ ID NO: 276840

SEQ ID NO: 669564 - RNA, 64 nt, Homo Sapiens; identical to SEQ ID NO: 276841

SEQ ID NO: 669565 - RNA, 64 nt, Homo Sapiens; identical to SEQ ID NO: 276842

SEQ ID NO: 669566 - RNA, 64 nt, Homo Sapiens; identical to SEQ ID NO: 276843

SEQ ID NO: 669567 - RNA, 64 nt, Homo Sapiens; identical to SEQ ID NO: 276844

SEQ ID NO: 669568 - RNA, 64 nt, Homo Sapiens; identical to SEQ ID NO: 276845

SEQ ID NO: 669569 - RNA, 64 nt, Homo Sapiens; identical to SEQ ID NO: 276846

SEQ ID NO: 669570 - RNA, 64 nt, Homo Sapiens; identical to SEQ ID NO: 276847

SEQ ID NO: 669571 - RNA, 64 nt, Homo Sapiens; identical to SEQ ID NO: 276848

SEQ ID NO: 669572 - RNA, 64 nt, Homo Sapiens; identical to SEQ ID NO: 276849

SEQ ID NO: 669573 - RNA, 64 nt, Homo Sapiens; identical to SEQ ID NO: 276850

SEQ ID NO: 669574 - RNA, 64 nt, Homo Sapiens; identical to SEQ ID NO: 276851

SEQ ID NO: 669575 - RNA, 64 nt, Homo Sapiens; identical to SEQ ID NO: 276852

SEQ ID NO: 669576 - RNA, 64 nt, Homo Sapiens; identical to SEQ ID NO: 276853

SEQ ID NO: 669577 - RNA, 64 nt, Homo Sapiens; identical to SEQ ID NO: 276854

SEQ ID NO: 669578 - RNA, 64 nt, Homo Sapiens; identical to SEQ ID NO: 276855

SEQ ID NO: 669579 - RNA, 64 nt, Homo Sapiens; identical to SEQ ID NO: 276856

SEQ ID NO: 669580 - RNA, 64 nt, Homo Sapiens; identical to SEQ ID NO: 276857

SEQ ID NO: 669581 - RNA, 64 nt, Homo Sapiens; identical to SEQ ID NO: 218520

SEQ ID NO: 669582 - RNA, 64 nt, Homo Sapiens; identical to SEQ ID NO: 218521

SEQ ID NO: 669583 - RNA, 64 nt, Homo Sapiens; identical to SEQ ID NO: 218522

SEQ ID NO: 669584 - RNA, 64 nt, Homo Sapiens; identical to SEQ ID NO: 218523

SEQ ID NO: 669585 - RNA, 64 nt, Homo Sapiens; identical to SEQ ID NO: 218524

SEQ ID NO: 669586 - RNA, 64 nt, Homo Sapiens; identical to SEQ ID NO: 218525

SEQ ID NO: 669587 - RNA, 64 nt, Homo Sapiens; identical to SEQ ID NO: 218526

SEQ ID NO: 669588 - RNA, 64 nt, Homo Sapiens; identical to SEQ ID NO: 218527

SEQ ID NO: 669589 - RNA, 64 nt, Homo Sapiens; identical to SEQ ID NO: 218528

SEQ ID NO: 669590 - RNA, 64 nt, Homo Sapiens; identical to SEQ ID NO: 218529

SEQ ID NO: 669591 - RNA, 64 nt, Homo Sapiens; identical to SEQ ID NO: 218530

SEQ ID NO: 669592 - RNA, 64 nt, Homo Sapiens; identical to SEQ ID NO: 218531

SEQ ID NO: 669593 - RNA, 64 nt, Homo Sapiens; identical to SEQ ID NO: 218532

SEQ ID NO: 669594 - RNA, 64 nt, Homo Sapiens; identical to SEQ ID NO: 218533

SEQ ID NO: 669595 - RNA, 64 nt, Homo Sapiens; identical to SEQ ID NO: 218534

SEQ ID NO: 669596 - RNA, 64 nt, Homo Sapiens; identical to SEQ ID NO: 218535

SEQ ID NO: 669597 - RNA, 64 nt, Homo Sapiens; identical to SEQ ID NO: 218536

SEQ ID NO: 669598 - RNA, 64 nt, Homo Sapiens; identical to SEQ ID NO: 218537

SEQ ID NO: 669599 - RNA, 64 nt, Homo Sapiens; identical to SEQ ID NO: 218538

SEQ ID NO: 669600 - RNA, 61 nt, Homo Sapiens; identical to SEQ ID NO: 218539

SEQ ID NO: 669601 - RNA, 64 nt, Homo Sapiens; identical to SEQ ID NO: 218540

SEQ ID NO: 669602 - RNA, 64 nt, Homo Sapiens; identical to SEQ ID NO: 218541

SEQ ID NO: 669603 - RNA, 64 nt, Homo Sapiens; identical to SEQ ID NO: 218542

SEQ ID NO: 669604 - RNA, 64 nt, Homo Sapiens; identical to SEQ ID NO: 218543

SEQ ID NO: 669605 - RNA, 64 nt, Homo Sapiens; identical to SEQ ID NO: 218544

SEQ ID NO: 669606 - RNA, 64 nt, Homo Sapiens; identical to SEQ ID NO: 218545

SEQ ID NO: 669607 - RNA, 64 nt, Homo Sapiens; identical to SEQ ID NO: 218546

SEQ ID NO: 669608 - RNA, 64 nt, Homo Sapiens; identical to SEQ ID NO: 218547

SEQ ID NO: 669609 - RNA, 64 nt, Homo Sapiens; identical to SEQ ID NO: 218548

SEQ ID NO: 669610 - RNA, 64 nt, Homo Sapiens; identical to SEQ ID NO: 218549

SEQ ID NO: 669611 - RNA, 64 nt, Homo Sapiens; identical to SEQ ID NO: 218550

SEQ ID NO: 669612 - RNA, 64 nt, Homo Sapiens; identical to SEQ ID NO: 218551

SEQ ID NO: 669613 - RNA, 64 nt, Homo Sapiens; identical to SEQ ID NO: 218552

SEQ ID NO: 669614 - RNA, 64 nt, Homo Sapiens; identical to SEQ ID NO: 218553

SEQ ID NO: 669615 - RNA, 63 nt, Homo Sapiens; identical to SEQ ID NO: 218554

SEQ ID NO: 669616 - RNA, 64 nt, Homo Sapiens; identical to SEQ ID NO: 218555

SEQ ID NO: 669617 - RNA, 64 nt, Homo Sapiens; identical to SEQ ID NO: 218556

SEQ ID NO: 669618 - RNA, 64 nt, Homo Sapiens; identical to SEQ ID NO: 218557

SEQ ID NO: 669619 - RNA, 64 nt, Homo Sapiens; identical to SEQ ID NO: 218558

SEQ ID NO: 669620 - RNA, 64 nt, Homo Sapiens; identical to SEQ ID NO: 218559

SEQ ID NO: 669621 - RNA, 64 nt, Homo Sapiens; identical to SEQ ID NO: 218560

SEQ ID NO: 669622 - RNA, 64 nt, Homo Sapiens; identical to SEQ ID NO: 218561

SEQ ID NO: 669623 - RNA, 64 nt, Homo Sapiens; identical to SEQ ID NO: 218562

SEQ ID NO: 669624 - RNA, 64 nt, Homo Sapiens; identical to SEQ ID NO: 218563

SEQ ID NO: 669625 - RNA, 64 nt, Homo Sapiens; identical to SEQ ID NO: 218564

SEQ ID NO: 669626 - RNA, 64 nt, Homo Sapiens; identical to SEQ ID NO: 218565

SEQ ID NO: 669627 - RNA, 64 nt, Homo Sapiens; identical to SEQ ID NO: 218566

SEQ ID NO: 669628 - RNA, 64 nt, Homo Sapiens; identical to SEQ ID NO: 218567

SEQ ID NO: 669629 - RNA, 64 nt, Homo Sapiens; identical to SEQ ID NO: 218568

SEQ ID NO: 669630 - RNA, 64 nt, Homo Sapiens; identical to SEQ ID NO: 218569

SEQ ID NO: 669631 - RNA, 64 nt, Homo Sapiens; identical to SEQ ID NO: 218570

SEQ ID NO: 669632 - RNA, 64 nt, Homo Sapiens; identical to SEQ ID NO: 218571

SEQ ID NO: 669633 - RNA, 64 nt, Homo Sapiens; identical to SEQ ID NO: 218572

SEQ ID NO: 669634 - RNA, 64 nt, Homo Sapiens; identical to SEQ ID NO: 218573

SEQ ID NO: 669635 - RNA, 64 nt, Homo Sapiens; identical to SEQ ID NO: 218574

SEQ ID NO: 669636 - RNA, 64 nt, Homo Sapiens; identical to SEQ ID NO: 218575

SEQ ID NO: 669637 - RNA, 64 nt, Homo Sapiens; identical to SEQ ID NO: 218576

SEQ ID NO: 669638 - RNA, 64 nt, Homo Sapiens; identical to SEQ ID NO: 218577

SEQ ID NO: 669639 - RNA, 64 nt, Homo Sapiens; identical to SEQ ID NO: 218578

SEQ ID NO: 669640 - RNA, 64 nt, Homo Sapiens; identical to SEQ ID NO: 218579

SEQ ID NO: 669641 - RNA, 64 nt, Homo Sapiens; identical to SEQ ID NO: 218580

SEQ ID NO: 669642 - RNA, 64 nt, Homo Sapiens; identical to SEQ ID NO: 218581

SEQ ID NO: 669643 - RNA, 64 nt, Homo Sapiens; identical to SEQ ID NO: 218582

SEQ ID NO: 669644 - RNA, 64 nt, Homo Sapiens; identical to SEQ ID NO: 218583

SEQ ID NO: 669645 - RNA, 64 nt, Homo Sapiens; identical to SEQ ID NO: 218584

SEQ ID NO: 669646 - RNA, 64 nt, Homo Sapiens; identical to SEQ ID NO: 218585

SEQ ID NO: 669647 - RNA, 64 nt, Homo Sapiens; identical to SEQ ID NO: 218586

SEQ ID NO: 669648 - RNA, 64 nt, Homo Sapiens; identical to SEQ ID NO: 218587

SEQ ID NO: 669649 - RNA, 64 nt, Homo Sapiens; identical to SEQ ID NO: 218588

SEQ ID NO: 669650 - RNA, 64 nt, Homo Sapiens; identical to SEQ ID NO: 218589

SEQ ID NO: 669651 - RNA, 64 nt, Homo Sapiens; identical to SEQ ID NO: 218590

SEQ ID NO: 669652 - RNA, 64 nt, Homo Sapiens; identical to SEQ ID NO: 218591

SEQ ID NO: 669653 - RNA, 64 nt, Homo Sapiens; identical to SEQ ID NO: 218592

SEQ ID NO: 669654 - RNA, 64 nt, Homo Sapiens; identical to SEQ ID NO: 218593

SEQ ID NO: 669655 - RNA, 64 nt, Homo Sapiens; identical to SEQ ID NO: 218594

SEQ ID NO: 669656 - RNA, 64 nt, Homo Sapiens; identical to SEQ ID NO: 218595

SEQ ID NO: 669657 - RNA, 64 nt, Homo Sapiens; identical to SEQ ID NO: 218596

SEQ ID NO: 669658 - RNA, 64 nt, Homo Sapiens; identical to SEQ ID NO: 218597

SEQ ID NO: 669659 - RNA, 64 nt, Homo Sapiens; identical to SEQ ID NO: 218598

SEQ ID NO: 669660 - RNA, 64 nt, Homo Sapiens; identical to SEQ ID NO: 218599

SEQ ID NO: 669661 - RNA, 64 nt, Homo Sapiens; identical to SEQ ID NO: 218600

SEQ ID NO: 669662 - RNA, 64 nt, Homo Sapiens; identical to SEQ ID NO: 218601

SEQ ID NO: 669663 - RNA, 64 nt, Homo Sapiens; identical to SEQ ID NO: 218602

SEQ ID NO: 669664 - RNA, 64 nt, Homo Sapiens; identical to SEQ ID NO: 218603

SEQ ID NO: 669665 - RNA, 64 nt, Homo Sapiens; identical to SEQ ID NO: 218604

SEQ ID NO: 669666 - RNA, 64 nt, Homo Sapiens; identical to SEQ ID NO: 218605

SEQ ID NO: 669667 - RNA, 64 nt, Homo Sapiens; identical to SEQ ID NO: 218606

SEQ ID NO: 669668 - RNA, 64 nt, Homo Sapiens; identical to SEQ ID NO: 218607

SEQ ID NO: 669669 - RNA, 64 nt, Homo Sapiens; identical to SEQ ID NO: 218608

SEQ ID NO: 669670 - RNA, 64 nt, Homo Sapiens; identical to SEQ ID NO: 218609

SEQ ID NO: 669671 - RNA, 64 nt, Homo Sapiens; identical to SEQ ID NO: 218610

SEQ ID NO: 669672 - RNA, 64 nt, Homo Sapiens; identical to SEQ ID NO: 218611

SEQ ID NO: 669673 - RNA, 64 nt, Homo Sapiens; identical to SEQ ID NO: 218612

SEQ ID NO: 669674 - RNA, 62 nt, Homo Sapiens; identical to SEQ ID NO: 218613

SEQ ID NO: 669675 - RNA, 64 nt, Homo Sapiens; identical to SEQ ID NO: 218614

SEQ ID NO: 669676 - RNA, 64 nt, Homo Sapiens; identical to SEQ ID NO: 218615

SEQ ID NO: 669677 - RNA, 64 nt, Homo Sapiens; identical to SEQ ID NO: 218616

SEQ ID NO: 669678 - RNA, 64 nt, Homo Sapiens; identical to SEQ ID NO: 218617

SEQ ID NO: 669679 - RNA, 64 nt, Homo Sapiens; identical to SEQ ID NO: 218618

SEQ ID NO: 669680 - RNA, 64 nt, Homo Sapiens; identical to SEQ ID NO: 218619

SEQ ID NO: 669681 - RNA, 64 nt, Homo Sapiens; identical to SEQ ID NO: 218620

SEQ ID NO: 669682 - RNA, 64 nt, Homo Sapiens; identical to SEQ ID NO: 218621

SEQ ID NO: 669683 - RNA, 64 nt, Homo Sapiens; identical to SEQ ID NO: 218622

SEQ ID NO: 669684 - RNA, 64 nt, Homo Sapiens; identical to SEQ ID NO: 218623

SEQ ID NO: 669685 - RNA, 64 nt, Homo Sapiens; identical to SEQ ID NO: 218624

SEQ ID NO: 669686 - RNA, 64 nt, Homo Sapiens; identical to SEQ ID NO: 218625

SEQ ID NO: 669687 - RNA, 64 nt, Homo Sapiens; identical to SEQ ID NO: 218626

SEQ ID NO: 669688 - RNA, 64 nt, Homo Sapiens; identical to SEQ ID NO: 218627

SEQ ID NO: 669689 - RNA, 64 nt, Homo Sapiens; identical to SEQ ID NO: 218628

SEQ ID NO: 669690 - RNA, 64 nt, Homo Sapiens; identical to SEQ ID NO: 218629

SEQ ID NO: 669691 - RNA, 64 nt, Homo Sapiens; identical to SEQ ID NO: 218630

SEQ ID NO: 669692 - RNA, 64 nt, Homo Sapiens; identical to SEQ ID NO: 218631

SEQ ID NO: 669693 - RNA, 64 nt, Homo Sapiens; identical to SEQ ID NO: 218632

SEQ ID NO: 669694 - RNA, 64 nt, Homo Sapiens; identical to SEQ ID NO: 218633

SEQ ID NO: 669695 - RNA, 64 nt, Homo Sapiens; identical to SEQ ID NO: 218634

SEQ ID NO: 669696 - RNA, 64 nt, Homo Sapiens; identical to SEQ ID NO: 218635

SEQ ID NO: 669697 - RNA, 64 nt, Homo Sapiens; identical to SEQ ID NO: 218636

SEQ ID NO: 669698 - RNA, 64 nt, Homo Sapiens; identical to SEQ ID NO: 218637

SEQ ID NO: 669699 - RNA, 64 nt, Homo Sapiens; identical to SEQ ID NO: 218638

SEQ ID NO: 669700 - RNA, 64 nt, Homo Sapiens; identical to SEQ ID NO: 218639

SEQ ID NO: 669701 - RNA, 64 nt, Homo Sapiens; identical to SEQ ID NO: 218640

SEQ ID NO: 669702 - RNA, 64 nt, Homo Sapiens; identical to SEQ ID NO: 218641

SEQ ID NO: 669703 - RNA, 64 nt, Homo Sapiens; identical to SEQ ID NO: 218642

SEQ ID NO: 669704 - RNA, 64 nt, Homo Sapiens; identical to SEQ ID NO: 218643

SEQ ID NO: 669705 - RNA, 64 nt, Homo Sapiens; identical to SEQ ID NO: 218644

SEQ ID NO: 669706 - RNA, 64 nt, Homo Sapiens; identical to SEQ ID NO: 218645

SEQ ID NO: 669707 - RNA, 64 nt, Homo Sapiens; identical to SEQ ID NO: 218646

SEQ ID NO: 669708 - RNA, 64 nt, Homo Sapiens; identical to SEQ ID NO: 218647

SEQ ID NO: 669709 - RNA, 64 nt, Homo Sapiens; identical to SEQ ID NO: 218648

SEQ ID NO: 669710 - RNA, 64 nt, Homo Sapiens; identical to SEQ ID NO: 218649

SEQ ID NO: 669711 - RNA, 64 nt, Homo Sapiens; identical to SEQ ID NO: 218650

SEQ ID NO: 669712 - RNA, 64 nt, Homo Sapiens; identical to SEQ ID NO: 218651

SEQ ID NO: 669713 - RNA, 64 nt, Homo Sapiens; identical to SEQ ID NO: 218652

SEQ ID NO: 669714 - RNA, 64 nt, Homo Sapiens; identical to SEQ ID NO: 218653

SEQ ID NO: 669715 - RNA, 64 nt, Homo Sapiens; identical to SEQ ID NO: 218654

SEQ ID NO: 669716 - RNA, 64 nt, Homo Sapiens; identical to SEQ ID NO: 218655

SEQ ID NO: 669717 - RNA, 64 nt, Homo Sapiens; identical to SEQ ID NO: 218656

SEQ ID NO: 669718 - RNA, 64 nt, Homo Sapiens; identical to SEQ ID NO: 218657

SEQ ID NO: 669719 - RNA, 64 nt, Homo Sapiens; identical to SEQ ID NO: 218658

SEQ ID NO: 669720 - RNA, 64 nt, Homo Sapiens; identical to SEQ ID NO: 218659

SEQ ID NO: 669721 - RNA, 64 nt, Homo Sapiens; identical to SEQ ID NO: 218660

SEQ ID NO: 669722 - RNA, 64 nt, Homo Sapiens; identical to SEQ ID NO: 218661

SEQ ID NO: 669723 - RNA, 61 nt, Homo Sapiens; identical to SEQ ID NO: 218662

SEQ ID NO: 669724 - RNA, 64 nt, Homo Sapiens; identical to SEQ ID NO: 218663

SEQ ID NO: 669725 - RNA, 64 nt, Homo Sapiens; identical to SEQ ID NO: 218664

SEQ ID NO: 669726 - RNA, 64 nt, Homo Sapiens; identical to SEQ ID NO: 218665

SEQ ID NO: 669727 - RNA, 64 nt, Homo Sapiens; identical to SEQ ID NO: 218666

SEQ ID NO: 669728 - RNA, 64 nt, Homo Sapiens; identical to SEQ ID NO: 218667

SEQ ID NO: 669729 - RNA, 64 nt, Homo Sapiens; identical to SEQ ID NO: 218668

SEQ ID NO: 669730 - RNA, 64 nt, Homo Sapiens; identical to SEQ ID NO: 218669

SEQ ID NO: 669731 - RNA, 64 nt, Homo Sapiens; identical to SEQ ID NO: 218670

SEQ ID NO: 669732 - RNA, 64 nt, Homo Sapiens; identical to SEQ ID NO: 218671

SEQ ID NO: 669733 - RNA, 64 nt, Homo Sapiens; identical to SEQ ID NO: 218672

SEQ ID NO: 669734 - RNA, 64 nt, Homo Sapiens; identical to SEQ ID NO: 218673

SEQ ID NO: 669735 - RNA, 64 nt, Homo Sapiens; identical to SEQ ID NO: 218674

SEQ ID NO: 669736 - RNA, 64 nt, Homo Sapiens; identical to SEQ ID NO: 218675

SEQ ID NO: 669737 - RNA, 64 nt, Homo Sapiens; identical to SEQ ID NO: 218676

SEQ ID NO: 669738 - RNA, 64 nt, Homo Sapiens; identical to SEQ ID NO: 218677

SEQ ID NO: 669739 - RNA, 64 nt, Homo Sapiens; identical to SEQ ID NO: 218678

SEQ ID NO: 669740 - RNA, 64 nt, Homo Sapiens; identical to SEQ ID NO: 218679

SEQ ID NO: 669741 - RNA, 64 nt, Homo Sapiens; identical to SEQ ID NO: 218680

SEQ ID NO: 669742 - RNA, 64 nt, Homo Sapiens; identical to SEQ ID NO: 218681

SEQ ID NO: 669743 - RNA, 64 nt, Homo Sapiens; identical to SEQ ID NO: 218682

SEQ ID NO: 669744 - RNA, 64 nt, Homo Sapiens; identical to SEQ ID NO: 218683

SEQ ID NO: 669745 - RNA, 64 nt, Homo Sapiens; identical to SEQ ID NO: 218684

SEQ ID NO: 669746 - RNA, 64 nt, Homo Sapiens; identical to SEQ ID NO: 218685

SEQ ID NO: 669747 - RNA, 59 nt, Homo Sapiens; identical to SEQ ID NO: 218686

SEQ ID NO: 669748 - RNA, 64 nt, Homo Sapiens; identical to SEQ ID NO: 218687

SEQ ID NO: 669749 - RNA, 64 nt, Homo Sapiens; identical to SEQ ID NO: 218688

SEQ ID NO: 669750 - RNA, 64 nt, Homo Sapiens; identical to SEQ ID NO: 218689

SEQ ID NO: 669751 - RNA, 64 nt, Homo Sapiens; identical to SEQ ID NO: 218690

SEQ ID NO: 669752 - RNA, 64 nt, Homo Sapiens; identical to SEQ ID NO: 218691

SEQ ID NO: 669753 - RNA, 64 nt, Homo Sapiens; identical to SEQ ID NO: 218692

SEQ ID NO: 669754 - RNA, 64 nt, Homo Sapiens; identical to SEQ ID NO: 218693

SEQ ID NO: 669755 - RNA, 64 nt, Homo Sapiens; identical to SEQ ID NO: 218694

SEQ ID NO: 669756 - RNA, 64 nt, Homo Sapiens; identical to SEQ ID NO: 218695

SEQ ID NO: 669757 - RNA, 64 nt, Homo Sapiens; identical to SEQ ID NO: 218696

SEQ ID NO: 669758 - RNA, 64 nt, Homo Sapiens; identical to SEQ ID NO: 218697

SEQ ID NO: 669759 - RNA, 64 nt, Homo Sapiens; identical to SEQ ID NO: 218698

SEQ ID NO: 669760 - RNA, 64 nt, Homo Sapiens; identical to SEQ ID NO: 218699

SEQ ID NO: 669761 - RNA, 64 nt, Homo Sapiens; identical to SEQ ID NO: 218700

SEQ ID NO: 669762 - RNA, 64 nt, Homo Sapiens; identical to SEQ ID NO: 218701

SEQ ID NO: 669763 - RNA, 64 nt, Homo Sapiens; identical to SEQ ID NO: 218702

SEQ ID NO: 669764 - RNA, 64 nt, Homo Sapiens; identical to SEQ ID NO: 218703

SEQ ID NO: 669765 - RNA, 64 nt, Homo Sapiens; identical to SEQ ID NO: 218704

SEQ ID NO: 669766 - RNA, 64 nt, Homo Sapiens; identical to SEQ ID NO: 218705

SEQ ID NO: 669767 - RNA, 64 nt, Homo Sapiens; identical to SEQ ID NO: 218706

SEQ ID NO: 669768 - RNA, 64 nt, Homo Sapiens; identical to SEQ ID NO: 218707

SEQ ID NO: 669769 - RNA, 64 nt, Homo Sapiens; identical to SEQ ID NO: 218708

SEQ ID NO: 669770 - RNA, 64 nt, Homo Sapiens; identical to SEQ ID NO: 218709

SEQ ID NO: 669771 - RNA, 64 nt, Homo Sapiens; identical to SEQ ID NO: 218710

SEQ ID NO: 669772 - RNA, 64 nt, Homo Sapiens; identical to SEQ ID NO: 218711

SEQ ID NO: 669773 - RNA, 64 nt, Homo Sapiens; identical to SEQ ID NO: 218712

SEQ ID NO: 669774 - RNA, 64 nt, Homo Sapiens; identical to SEQ ID NO: 218713

SEQ ID NO: 669775 - RNA, 64 nt, Homo Sapiens; identical to SEQ ID NO: 218714

SEQ ID NO: 669776 - RNA, 64 nt, Homo Sapiens; identical to SEQ ID NO: 218715

SEQ ID NO: 669777 - RNA, 64 nt, Homo Sapiens; identical to SEQ ID NO: 218716

SEQ ID NO: 669778 - RNA, 64 nt, Homo Sapiens; identical to SEQ ID NO: 218717

SEQ ID NO: 669779 - RNA, 64 nt, Homo Sapiens; identical to SEQ ID NO: 218718

SEQ ID NO: 669780 - RNA, 64 nt, Homo Sapiens; identical to SEQ ID NO: 218719

SEQ ID NO: 669781 - RNA, 64 nt, Homo Sapiens; identical to SEQ ID NO: 218720

SEQ ID NO: 669782 - RNA, 64 nt, Homo Sapiens; identical to SEQ ID NO: 218721

SEQ ID NO: 669783 - RNA, 64 nt, Homo Sapiens; identical to SEQ ID NO: 218722

SEQ ID NO: 669784 - RNA, 64 nt, Homo Sapiens; identical to SEQ ID NO: 218723

SEQ ID NO: 669785 - RNA, 64 nt, Homo Sapiens; identical to SEQ ID NO: 218724

SEQ ID NO: 669786 - RNA, 64 nt, Homo Sapiens; identical to SEQ ID NO: 218725

SEQ ID NO: 669787 - RNA, 64 nt, Homo Sapiens; identical to SEQ ID NO: 218726

SEQ ID NO: 669788 - RNA, 64 nt, Homo Sapiens; identical to SEQ ID NO: 218727

SEQ ID NO: 669789 - RNA, 64 nt, Homo Sapiens; identical to SEQ ID NO: 218728

SEQ ID NO: 669790 - RNA, 64 nt, Homo Sapiens; identical to SEQ ID NO: 218729

SEQ ID NO: 669791 - RNA, 64 nt, Homo Sapiens; identical to SEQ ID NO: 218730

SEQ ID NO: 669792 - RNA, 64 nt, Homo Sapiens; identical to SEQ ID NO: 218731

SEQ ID NO: 669793 - RNA, 64 nt, Homo Sapiens; identical to SEQ ID NO: 218732

SEQ ID NO: 669794 - RNA, 64 nt, Homo Sapiens; identical to SEQ ID NO: 218733

SEQ ID NO: 669795 - RNA, 64 nt, Homo Sapiens; identical to SEQ ID NO: 218734

SEQ ID NO: 669796 - RNA, 64 nt, Homo Sapiens; identical to SEQ ID NO: 218735

SEQ ID NO: 669797 - RNA, 64 nt, Homo Sapiens; identical to SEQ ID NO: 218736

SEQ ID NO: 669798 - RNA, 64 nt, Homo Sapiens; identical to SEQ ID NO: 218737

SEQ ID NO: 669799 - RNA, 64 nt, Homo Sapiens; identical to SEQ ID NO: 218738

SEQ ID NO: 669800 - RNA, 64 nt, Homo Sapiens; identical to SEQ ID NO: 218739

SEQ ID NO: 669801 - RNA, 64 nt, Homo Sapiens; identical to SEQ ID NO: 218740

SEQ ID NO: 669802 - RNA, 64 nt, Homo Sapiens; identical to SEQ ID NO: 218741

SEQ ID NO: 669803 - RNA, 64 nt, Homo Sapiens; identical to SEQ ID NO: 218742

SEQ ID NO: 669804 - RNA, 64 nt, Homo Sapiens; identical to SEQ ID NO: 218743

SEQ ID NO: 669805 - RNA, 64 nt, Homo Sapiens; identical to SEQ ID NO: 218744

SEQ ID NO: 669806 - RNA, 64 nt, Homo Sapiens; identical to SEQ ID NO: 218745

SEQ ID NO: 669807 - RNA, 64 nt, Homo Sapiens; identical to SEQ ID NO: 218746

SEQ ID NO: 669808 - RNA, 64 nt, Homo Sapiens; identical to SEQ ID NO: 218747

SEQ ID NO: 669809 - RNA, 64 nt, Homo Sapiens; identical to SEQ ID NO: 218748

SEQ ID NO: 669810 - RNA, 64 nt, Homo Sapiens; identical to SEQ ID NO: 218749

SEQ ID NO: 669811 - RNA, 64 nt, Homo Sapiens; identical to SEQ ID NO: 218750

SEQ ID NO: 669812 - RNA, 64 nt, Homo Sapiens; identical to SEQ ID NO: 218751

SEQ ID NO: 669813 - RNA, 64 nt, Homo Sapiens; identical to SEQ ID NO: 218752

SEQ ID NO: 669814 - RNA, 64 nt, Homo Sapiens; identical to SEQ ID NO: 218753

SEQ ID NO: 669815 - RNA, 64 nt, Homo Sapiens; identical to SEQ ID NO: 218754

SEQ ID NO: 669816 - RNA, 64 nt, Homo Sapiens; identical to SEQ ID NO: 218755

SEQ ID NO: 669817 - RNA, 64 nt, Homo Sapiens; identical to SEQ ID NO: 218756

SEQ ID NO: 669818 - RNA, 64 nt, Homo Sapiens; identical to SEQ ID NO: 218757

SEQ ID NO: 669819 - RNA, 64 nt, Homo Sapiens; identical to SEQ ID NO: 218758

SEQ ID NO: 669820 - RNA, 64 nt, Homo Sapiens; identical to SEQ ID NO: 218759

SEQ ID NO: 669821 - RNA, 64 nt, Homo Sapiens; identical to SEQ ID NO: 218760

SEQ ID NO: 669822 - RNA, 64 nt, Homo Sapiens; identical to SEQ ID NO: 218761

SEQ ID NO: 669823 - RNA, 64 nt, Homo Sapiens; identical to SEQ ID NO: 218762

SEQ ID NO: 669824 - RNA, 64 nt, Homo Sapiens; identical to SEQ ID NO: 218763

SEQ ID NO: 669825 - RNA, 64 nt, Homo Sapiens; identical to SEQ ID NO: 218764

SEQ ID NO: 669826 - RNA, 64 nt, Homo Sapiens; identical to SEQ ID NO: 218765

SEQ ID NO: 669827 - RNA, 64 nt, Homo Sapiens; identical to SEQ ID NO: 218766

SEQ ID NO: 669828 - RNA, 64 nt, Homo Sapiens; identical to SEQ ID NO: 218767

SEQ ID NO: 669829 - RNA, 64 nt, Homo Sapiens; identical to SEQ ID NO: 218768

SEQ ID NO: 669830 - RNA, 64 nt, Homo Sapiens; identical to SEQ ID NO: 218769

SEQ ID NO: 669831 - RNA, 64 nt, Homo Sapiens; identical to SEQ ID NO: 218770

SEQ ID NO: 669832 - RNA, 64 nt, Homo Sapiens; identical to SEQ ID NO: 218771

SEQ ID NO: 669833 - RNA, 64 nt, Homo Sapiens; identical to SEQ ID NO: 218772

SEQ ID NO: 669834 - RNA, 64 nt, Homo Sapiens; identical to SEQ ID NO: 218773

SEQ ID NO: 669835 - RNA, 64 nt, Homo Sapiens; identical to SEQ ID NO: 218774

SEQ ID NO: 669836 - RNA, 64 nt, Homo Sapiens; identical to SEQ ID NO: 218775

SEQ ID NO: 669837 - RNA, 64 nt, Homo Sapiens; identical to SEQ ID NO: 218776

SEQ ID NO: 669838 - RNA, 64 nt, Homo Sapiens; identical to SEQ ID NO: 218777

SEQ ID NO: 669839 - RNA, 64 nt, Homo Sapiens; identical to SEQ ID NO: 218778

SEQ ID NO: 669840 - RNA, 64 nt, Homo Sapiens; identical to SEQ ID NO: 218779

SEQ ID NO: 669841 - RNA, 64 nt, Homo Sapiens; identical to SEQ ID NO: 218780

SEQ ID NO: 669842 - RNA, 64 nt, Homo Sapiens; identical to SEQ ID NO: 218781

SEQ ID NO: 669843 - RNA, 64 nt, Homo Sapiens; identical to SEQ ID NO: 218782

SEQ ID NO: 669844 - RNA, 64 nt, Homo Sapiens; identical to SEQ ID NO: 218783

SEQ ID NO: 669845 - RNA, 64 nt, Homo Sapiens; identical to SEQ ID NO: 218784

SEQ ID NO: 669846 - RNA, 64 nt, Homo Sapiens; identical to SEQ ID NO: 218785

SEQ ID NO: 669847 - RNA, 64 nt, Homo Sapiens; identical to SEQ ID NO: 218786

SEQ ID NO: 669848 - RNA, 64 nt, Homo Sapiens; identical to SEQ ID NO: 218787

SEQ ID NO: 669849 - RNA, 64 nt, Homo Sapiens; identical to SEQ ID NO: 218788

SEQ ID NO: 669850 - RNA, 64 nt, Homo Sapiens; identical to SEQ ID NO: 218789

SEQ ID NO: 669851 - RNA, 64 nt, Homo Sapiens; identical to SEQ ID NO: 218790

SEQ ID NO: 669852 - RNA, 64 nt, Homo Sapiens; identical to SEQ ID NO: 218791

SEQ ID NO: 669853 - RNA, 64 nt, Homo Sapiens; identical to SEQ ID NO: 218792

SEQ ID NO: 669854 - RNA, 64 nt, Homo Sapiens; identical to SEQ ID NO: 218793

SEQ ID NO: 669855 - RNA, 64 nt, Homo Sapiens; identical to SEQ ID NO: 218794

SEQ ID NO: 669856 - RNA, 64 nt, Homo Sapiens; identical to SEQ ID NO: 218795

SEQ ID NO: 669857 - RNA, 64 nt, Homo Sapiens; identical to SEQ ID NO: 218796

SEQ ID NO: 669858 - RNA, 64 nt, Homo Sapiens; identical to SEQ ID NO: 218797

SEQ ID NO: 669859 - RNA, 64 nt, Homo Sapiens; identical to SEQ ID NO: 218798

SEQ ID NO: 669860 - RNA, 64 nt, Homo Sapiens; identical to SEQ ID NO: 218799

SEQ ID NO: 669861 - RNA, 64 nt, Homo Sapiens; identical to SEQ ID NO: 218800

SEQ ID NO: 669862 - RNA, 64 nt, Homo Sapiens; identical to SEQ ID NO: 218801

SEQ ID NO: 669863 - RNA, 64 nt, Homo Sapiens; identical to SEQ ID NO: 218802

SEQ ID NO: 669864 - RNA, 64 nt, Homo Sapiens; identical to SEQ ID NO: 218803

SEQ ID NO: 669865 - RNA, 64 nt, Homo Sapiens; identical to SEQ ID NO: 218804

SEQ ID NO: 669866 - RNA, 64 nt, Homo Sapiens; identical to SEQ ID NO: 218805

SEQ ID NO: 669867 - RNA, 64 nt, Homo Sapiens; identical to SEQ ID NO: 218806

SEQ ID NO: 669868 - RNA, 64 nt, Homo Sapiens; identical to SEQ ID NO: 218807

SEQ ID NO: 669869 - RNA, 64 nt, Homo Sapiens; identical to SEQ ID NO: 218808

SEQ ID NO: 669870 - RNA, 59 nt, Homo Sapiens; identical to SEQ ID NO: 218809

SEQ ID NO: 669871 - RNA, 64 nt, Homo Sapiens; identical to SEQ ID NO: 218810

SEQ ID NO: 669872 - RNA, 64 nt, Homo Sapiens; identical to SEQ ID NO: 218811

SEQ ID NO: 669873 - RNA, 64 nt, Homo Sapiens; identical to SEQ ID NO: 168129

SEQ ID NO: 669874 - RNA, 64 nt, Homo Sapiens; identical to SEQ ID NO: 168130

SEQ ID NO: 669875 - RNA, 64 nt, Homo Sapiens; identical to SEQ ID NO: 168131

SEQ ID NO: 669876 - RNA, 64 nt, Homo Sapiens; identical to SEQ ID NO: 168132

SEQ ID NO: 669877 - RNA, 64 nt, Homo Sapiens; identical to SEQ ID NO: 168133

SEQ ID NO: 669878 - RNA, 64 nt, Homo Sapiens; identical to SEQ ID NO: 168134

SEQ ID NO: 669879 - RNA, 64 nt, Homo Sapiens; identical to SEQ ID NO: 168135

SEQ ID NO: 669880 - RNA, 64 nt, Homo Sapiens; identical to SEQ ID NO: 168136

SEQ ID NO: 669881 - RNA, 64 nt, Homo Sapiens; identical to SEQ ID NO: 168137

SEQ ID NO: 669882 - RNA, 64 nt, Homo Sapiens; identical to SEQ ID NO: 168138

SEQ ID NO: 669883 - RNA, 64 nt, Homo Sapiens; identical to SEQ ID NO: 168139

SEQ ID NO: 669884 - RNA, 64 nt, Homo Sapiens; identical to SEQ ID NO: 168140

SEQ ID NO: 669885 - RNA, 64 nt, Homo Sapiens; identical to SEQ ID NO: 168141

SEQ ID NO: 669886 - RNA, 64 nt, Homo Sapiens; identical to SEQ ID NO: 168142

SEQ ID NO: 669887 - RNA, 64 nt, Homo Sapiens; identical to SEQ ID NO: 168143

SEQ ID NO: 669888 - RNA, 64 nt, Homo Sapiens; identical to SEQ ID NO: 168144

SEQ ID NO: 669889 - RNA, 64 nt, Homo Sapiens; identical to SEQ ID NO: 168145

SEQ ID NO: 669890 - RNA, 64 nt, Homo Sapiens; identical to SEQ ID NO: 168146

SEQ ID NO: 669891 - RNA, 64 nt, Homo Sapiens; identical to SEQ ID NO: 168147

SEQ ID NO: 669892 - RNA, 64 nt, Homo Sapiens; identical to SEQ ID NO: 168148

SEQ ID NO: 669893 - RNA, 64 nt, Homo Sapiens; identical to SEQ ID NO: 168149

SEQ ID NO: 669894 - RNA, 64 nt, Homo Sapiens; identical to SEQ ID NO: 168150

SEQ ID NO: 669895 - RNA, 64 nt, Homo Sapiens; identical to SEQ ID NO: 168151

SEQ ID NO: 669896 - RNA, 64 nt, Homo Sapiens; identical to SEQ ID NO: 168152

SEQ ID NO: 669897 - RNA, 64 nt, Homo Sapiens; identical to SEQ ID NO: 168153

SEQ ID NO: 669898 - RNA, 64 nt, Homo Sapiens; identical to SEQ ID NO: 168154

SEQ ID NO: 669899 - RNA, 64 nt, Homo Sapiens; identical to SEQ ID NO: 168155

SEQ ID NO: 669900 - RNA, 64 nt, Homo Sapiens; identical to SEQ ID NO: 168156

SEQ ID NO: 669901 - RNA, 64 nt, Homo Sapiens; identical to SEQ ID NO: 168157

SEQ ID NO: 669902 - RNA, 64 nt, Homo Sapiens; identical to SEQ ID NO: 168158

SEQ ID NO: 669903 - RNA, 64 nt, Homo Sapiens; identical to SEQ ID NO: 168159

SEQ ID NO: 669904 - RNA, 64 nt, Homo Sapiens; identical to SEQ ID NO: 168160

SEQ ID NO: 669905 - RNA, 64 nt, Homo Sapiens; identical to SEQ ID NO: 168161

SEQ ID NO: 669906 - RNA, 64 nt, Homo Sapiens; identical to SEQ ID NO: 168162

SEQ ID NO: 669907 - RNA, 64 nt, Homo Sapiens; identical to SEQ ID NO: 168163

SEQ ID NO: 669908 - RNA, 64 nt, Homo Sapiens; identical to SEQ ID NO: 168164

SEQ ID NO: 669909 - RNA, 64 nt, Homo Sapiens; identical to SEQ ID NO: 168165

SEQ ID NO: 669910 - RNA, 64 nt, Homo Sapiens; identical to SEQ ID NO: 168166

SEQ ID NO: 669911 - RNA, 64 nt, Homo Sapiens; identical to SEQ ID NO: 168167

SEQ ID NO: 669912 - RNA, 64 nt, Homo Sapiens; identical to SEQ ID NO: 168168

SEQ ID NO: 669913 - RNA, 64 nt, Homo Sapiens; identical to SEQ ID NO: 168169

SEQ ID NO: 669914 - RNA, 64 nt, Homo Sapiens; identical to SEQ ID NO: 168170

SEQ ID NO: 669915 - RNA, 64 nt, Homo Sapiens; identical to SEQ ID NO: 168171

SEQ ID NO: 669916 - RNA, 64 nt, Homo Sapiens; identical to SEQ ID NO: 168172

SEQ ID NO: 669917 - RNA, 64 nt, Homo Sapiens; identical to SEQ ID NO: 168173

SEQ ID NO: 669918 - RNA, 64 nt, Homo Sapiens; identical to SEQ ID NO: 168174

SEQ ID NO: 669919 - RNA, 64 nt, Homo Sapiens; identical to SEQ ID NO: 168175

SEQ ID NO: 669920 - RNA, 64 nt, Homo Sapiens; identical to SEQ ID NO: 168176

SEQ ID NO: 669921 - RNA, 64 nt, Homo Sapiens; identical to SEQ ID NO: 168177

SEQ ID NO: 669922 - RNA, 64 nt, Homo Sapiens; identical to SEQ ID NO: 168178

SEQ ID NO: 669923 - RNA, 64 nt, Homo Sapiens; identical to SEQ ID NO: 168179

SEQ ID NO: 669924 - RNA, 64 nt, Homo Sapiens; identical to SEQ ID NO: 168180

SEQ ID NO: 669925 - RNA, 64 nt, Homo Sapiens; identical to SEQ ID NO: 168181

SEQ ID NO: 669926 - RNA, 64 nt, Homo Sapiens; identical to SEQ ID NO: 168182

SEQ ID NO: 669927 - RNA, 64 nt, Homo Sapiens; identical to SEQ ID NO: 168183

SEQ ID NO: 669928 - RNA, 64 nt, Homo Sapiens; identical to SEQ ID NO: 168184

SEQ ID NO: 669929 - RNA, 64 nt, Homo Sapiens; identical to SEQ ID NO: 168185

SEQ ID NO: 669930 - RNA, 64 nt, Homo Sapiens; identical to SEQ ID NO: 168186

SEQ ID NO: 669931 - RNA, 64 nt, Homo Sapiens; identical to SEQ ID NO: 168187

SEQ ID NO: 669932 - RNA, 64 nt, Homo Sapiens; identical to SEQ ID NO: 168188

SEQ ID NO: 669933 - RNA, 64 nt, Homo Sapiens; identical to SEQ ID NO: 168189

SEQ ID NO: 669934 - RNA, 64 nt, Homo Sapiens; identical to SEQ ID NO: 168190

SEQ ID NO: 669935 - RNA, 64 nt, Homo Sapiens; identical to SEQ ID NO: 168191

SEQ ID NO: 669936 - RNA, 64 nt, Homo Sapiens; identical to SEQ ID NO: 168192

SEQ ID NO: 669937 - RNA, 64 nt, Homo Sapiens; identical to SEQ ID NO: 168193

SEQ ID NO: 669938 - RNA, 64 nt, Homo Sapiens; identical to SEQ ID NO: 168194

SEQ ID NO: 669939 - RNA, 64 nt, Homo Sapiens; identical to SEQ ID NO: 168195

SEQ ID NO: 669940 - RNA, 64 nt, Homo Sapiens; identical to SEQ ID NO: 168196

SEQ ID NO: 669941 - RNA, 64 nt, Homo Sapiens; identical to SEQ ID NO: 168197

SEQ ID NO: 669942 - RNA, 64 nt, Homo Sapiens; identical to SEQ ID NO: 168198

SEQ ID NO: 669943 - RNA, 64 nt, Homo Sapiens; identical to SEQ ID NO: 168199

SEQ ID NO: 669944 - RNA, 64 nt, Homo Sapiens; identical to SEQ ID NO: 168200

SEQ ID NO: 669945 - RNA, 64 nt, Homo Sapiens; identical to SEQ ID NO: 168201

SEQ ID NO: 669946 - RNA, 64 nt, Homo Sapiens; identical to SEQ ID NO: 168202

SEQ ID NO: 669947 - RNA, 64 nt, Homo Sapiens; identical to SEQ ID NO: 168203

SEQ ID NO: 669948 - RNA, 64 nt, Homo Sapiens; identical to SEQ ID NO: 168204

SEQ ID NO: 669949 - RNA, 64 nt, Homo Sapiens; identical to SEQ ID NO: 168205

SEQ ID NO: 669950 - RNA, 64 nt, Homo Sapiens; identical to SEQ ID NO: 168206

SEQ ID NO: 669951 - RNA, 64 nt, Homo Sapiens; identical to SEQ ID NO: 168207

SEQ ID NO: 669952 - RNA, 64 nt, Homo Sapiens; identical to SEQ ID NO: 168208

SEQ ID NO: 669953 - RNA, 64 nt, Homo Sapiens; identical to SEQ ID NO: 168209

SEQ ID NO: 669954 - RNA, 64 nt, Homo Sapiens; identical to SEQ ID NO: 168210

SEQ ID NO: 669955 - RNA, 64 nt, Homo Sapiens; identical to SEQ ID NO: 168211

SEQ ID NO: 669956 - RNA, 64 nt, Homo Sapiens; identical to SEQ ID NO: 168212

SEQ ID NO: 669957 - RNA, 64 nt, Homo Sapiens; identical to SEQ ID NO: 168213

SEQ ID NO: 669958 - RNA, 51 nt, Homo Sapiens; identical to SEQ ID NO: 168214

SEQ ID NO: 669959 - RNA, 64 nt, Homo Sapiens; identical to SEQ ID NO: 168215

SEQ ID NO: 669960 - RNA, 64 nt, Homo Sapiens; identical to SEQ ID NO: 168216

SEQ ID NO: 669961 - RNA, 64 nt, Homo Sapiens; identical to SEQ ID NO: 168217

SEQ ID NO: 669962 - RNA, 64 nt, Homo Sapiens; identical to SEQ ID NO: 168218

SEQ ID NO: 669963 - RNA, 64 nt, Homo Sapiens; identical to SEQ ID NO: 168219

SEQ ID NO: 669964 - RNA, 64 nt, Homo Sapiens; identical to SEQ ID NO: 168220

SEQ ID NO: 669965 - RNA, 64 nt, Homo Sapiens; identical to SEQ ID NO: 168221

SEQ ID NO: 669966 - RNA, 64 nt, Homo Sapiens; identical to SEQ ID NO: 168222

SEQ ID NO: 669967 - RNA, 64 nt, Homo Sapiens; identical to SEQ ID NO: 168223

SEQ ID NO: 669968 - RNA, 64 nt, Homo Sapiens; identical to SEQ ID NO: 168224

SEQ ID NO: 669969 - RNA, 64 nt, Homo Sapiens; identical to SEQ ID NO: 168225

SEQ ID NO: 669970 - RNA, 64 nt, Homo Sapiens; identical to SEQ ID NO: 168226

SEQ ID NO: 669971 - RNA, 64 nt, Homo Sapiens; identical to SEQ ID NO: 168227

SEQ ID NO: 669972 - RNA, 64 nt, Homo Sapiens; identical to SEQ ID NO: 168228

SEQ ID NO: 669973 - RNA, 64 nt, Homo Sapiens; identical to SEQ ID NO: 168229

SEQ ID NO: 669974 - RNA, 64 nt, Homo Sapiens; identical to SEQ ID NO: 168230

SEQ ID NO: 669975 - RNA, 64 nt, Homo Sapiens; identical to SEQ ID NO: 168231

SEQ ID NO: 669976 - RNA, 64 nt, Homo Sapiens; identical to SEQ ID NO: 168232

SEQ ID NO: 669977 - RNA, 64 nt, Homo Sapiens; identical to SEQ ID NO: 168233

SEQ ID NO: 669978 - RNA, 64 nt, Homo Sapiens; identical to SEQ ID NO: 168234

SEQ ID NO: 669979 - RNA, 64 nt, Homo Sapiens; identical to SEQ ID NO: 168235

SEQ ID NO: 669980 - RNA, 64 nt, Homo Sapiens; identical to SEQ ID NO: 168236

SEQ ID NO: 669981 - RNA, 64 nt, Homo Sapiens; identical to SEQ ID NO: 168237

SEQ ID NO: 669982 - RNA, 64 nt, Homo Sapiens; identical to SEQ ID NO: 168238

SEQ ID NO: 669983 - RNA, 64 nt, Homo Sapiens; identical to SEQ ID NO: 168239

SEQ ID NO: 669984 - RNA, 64 nt, Homo Sapiens; identical to SEQ ID NO: 168240

SEQ ID NO: 669985 - RNA, 64 nt, Homo Sapiens; identical to SEQ ID NO: 168241

SEQ ID NO: 669986 - RNA, 64 nt, Homo Sapiens; identical to SEQ ID NO: 168242

SEQ ID NO: 669987 - RNA, 64 nt, Homo Sapiens; identical to SEQ ID NO: 168243

SEQ ID NO: 669988 - RNA, 64 nt, Homo Sapiens; identical to SEQ ID NO: 168244

SEQ ID NO: 669989 - RNA, 64 nt, Homo Sapiens; identical to SEQ ID NO: 168245

SEQ ID NO: 669990 - RNA, 64 nt, Homo Sapiens; identical to SEQ ID NO: 168246

SEQ ID NO: 669991 - RNA, 64 nt, Homo Sapiens; identical to SEQ ID NO: 168247

SEQ ID NO: 669992 - RNA, 64 nt, Homo Sapiens; identical to SEQ ID NO: 168248

SEQ ID NO: 669993 - RNA, 64 nt, Homo Sapiens; identical to SEQ ID NO: 168249

SEQ ID NO: 669994 - RNA, 64 nt, Homo Sapiens; identical to SEQ ID NO: 168250

SEQ ID NO: 669995 - RNA, 64 nt, Homo Sapiens; identical to SEQ ID NO: 168251

SEQ ID NO: 669996 - RNA, 64 nt, Homo Sapiens; identical to SEQ ID NO: 168252

SEQ ID NO: 669997 - RNA, 64 nt, Homo Sapiens; identical to SEQ ID NO: 168253

SEQ ID NO: 669998 - RNA, 64 nt, Homo Sapiens; identical to SEQ ID NO: 168254

SEQ ID NO: 669999 - RNA, 64 nt, Homo Sapiens; identical to SEQ ID NO: 168255

SEQ ID NO: 670000 - RNA, 64 nt, Homo Sapiens; identical to SEQ ID NO: 168256

SEQ ID NO: 670001 - RNA, 64 nt, Homo Sapiens; identical to SEQ ID NO: 168257

SEQ ID NO: 670002 - RNA, 64 nt, Homo Sapiens; identical to SEQ ID NO: 168258

SEQ ID NO: 670003 - RNA, 64 nt, Homo Sapiens; identical to SEQ ID NO: 168259

SEQ ID NO: 670004 - RNA, 64 nt, Homo Sapiens; identical to SEQ ID NO: 168260

SEQ ID NO: 670005 - RNA, 64 nt, Homo Sapiens; identical to SEQ ID NO: 168261

SEQ ID NO: 670006 - RNA, 64 nt, Homo Sapiens; identical to SEQ ID NO: 168262

SEQ ID NO: 670007 - RNA, 64 nt, Homo Sapiens; identical to SEQ ID NO: 168263

SEQ ID NO: 670008 - RNA, 64 nt, Homo Sapiens; identical to SEQ ID NO: 168264

SEQ ID NO: 670009 - RNA, 64 nt, Homo Sapiens; identical to SEQ ID NO: 168265

SEQ ID NO: 670010 - RNA, 64 nt, Homo Sapiens; identical to SEQ ID NO: 168266

SEQ ID NO: 670011 - RNA, 64 nt, Homo Sapiens; identical to SEQ ID NO: 168267

SEQ ID NO: 670012 - RNA, 64 nt, Homo Sapiens; identical to SEQ ID NO: 168268

SEQ ID NO: 670013 - RNA, 64 nt, Homo Sapiens; identical to SEQ ID NO: 168269

SEQ ID NO: 670014 - RNA, 64 nt, Homo Sapiens; identical to SEQ ID NO: 168270

SEQ ID NO: 670015 - RNA, 64 nt, Homo Sapiens; identical to SEQ ID NO: 168271

SEQ ID NO: 670016 - RNA, 64 nt, Homo Sapiens; identical to SEQ ID NO: 168272

SEQ ID NO: 670017 - RNA, 64 nt, Homo Sapiens; identical to SEQ ID NO: 168273

SEQ ID NO: 670018 - RNA, 64 nt, Homo Sapiens; identical to SEQ ID NO: 168274

SEQ ID NO: 670019 - RNA, 64 nt, Homo Sapiens; identical to SEQ ID NO: 168275

SEQ ID NO: 670020 - RNA, 64 nt, Homo Sapiens; identical to SEQ ID NO: 168276

SEQ ID NO: 670021 - RNA, 64 nt, Homo Sapiens; identical to SEQ ID NO: 168277

SEQ ID NO: 670022 - RNA, 64 nt, Homo Sapiens; identical to SEQ ID NO: 168278

SEQ ID NO: 670023 - RNA, 64 nt, Homo Sapiens; identical to SEQ ID NO: 168279

SEQ ID NO: 670024 - RNA, 64 nt, Homo Sapiens; identical to SEQ ID NO: 168280

SEQ ID NO: 670025 - RNA, 64 nt, Homo Sapiens; identical to SEQ ID NO: 168281

SEQ ID NO: 670026 - RNA, 64 nt, Homo Sapiens; identical to SEQ ID NO: 168282

SEQ ID NO: 670027 - RNA, 64 nt, Homo Sapiens; identical to SEQ ID NO: 168283

SEQ ID NO: 670028 - RNA, 64 nt, Homo Sapiens; identical to SEQ ID NO: 168284

SEQ ID NO: 670029 - RNA, 64 nt, Homo Sapiens; identical to SEQ ID NO: 168285

SEQ ID NO: 670030 - RNA, 64 nt, Homo Sapiens; identical to SEQ ID NO: 168286

SEQ ID NO: 670031 - RNA, 64 nt, Homo Sapiens; identical to SEQ ID NO: 168287

SEQ ID NO: 670032 - RNA, 64 nt, Homo Sapiens; identical to SEQ ID NO: 168288

SEQ ID NO: 670033 - RNA, 64 nt, Homo Sapiens; identical to SEQ ID NO: 168289

SEQ ID NO: 670034 - RNA, 64 nt, Homo Sapiens; identical to SEQ ID NO: 168290

SEQ ID NO: 670035 - RNA, 64 nt, Homo Sapiens; identical to SEQ ID NO: 168291

SEQ ID NO: 670036 - RNA, 64 nt, Homo Sapiens; identical to SEQ ID NO: 168292

SEQ ID NO: 670037 - RNA, 64 nt, Homo Sapiens; identical to SEQ ID NO: 168293

SEQ ID NO: 670038 - RNA, 64 nt, Homo Sapiens; identical to SEQ ID NO: 168294

SEQ ID NO: 670039 - RNA, 64 nt, Homo Sapiens; identical to SEQ ID NO: 168295

SEQ ID NO: 670040 - RNA, 64 nt, Homo Sapiens; identical to SEQ ID NO: 168296

SEQ ID NO: 670041 - RNA, 64 nt, Homo Sapiens; identical to SEQ ID NO: 168297

SEQ ID NO: 670042 - RNA, 64 nt, Homo Sapiens; identical to SEQ ID NO: 168298

SEQ ID NO: 670043 - RNA, 64 nt, Homo Sapiens; identical to SEQ ID NO: 168299

SEQ ID NO: 670044 - RNA, 64 nt, Homo Sapiens; identical to SEQ ID NO: 168300

SEQ ID NO: 670045 - RNA, 64 nt, Homo Sapiens; identical to SEQ ID NO: 168301

SEQ ID NO: 670046 - RNA, 64 nt, Homo Sapiens; identical to SEQ ID NO: 168302

SEQ ID NO: 670047 - RNA, 64 nt, Homo Sapiens; identical to SEQ ID NO: 168303

SEQ ID NO: 670048 - RNA, 64 nt, Homo Sapiens; identical to SEQ ID NO: 168304

SEQ ID NO: 670049 - RNA, 64 nt, Homo Sapiens; identical to SEQ ID NO: 168305

SEQ ID NO: 670050 - RNA, 64 nt, Homo Sapiens; identical to SEQ ID NO: 168306

SEQ ID NO: 670051 - RNA, 64 nt, Homo Sapiens; identical to SEQ ID NO: 168307

SEQ ID NO: 670052 - RNA, 64 nt, Homo Sapiens; identical to SEQ ID NO: 168308

SEQ ID NO: 670053 - RNA, 64 nt, Homo Sapiens; identical to SEQ ID NO: 168309

SEQ ID NO: 670054 - RNA, 64 nt, Homo Sapiens; identical to SEQ ID NO: 168310

SEQ ID NO: 670055 - RNA, 64 nt, Homo Sapiens; identical to SEQ ID NO: 168311

SEQ ID NO: 670056 - RNA, 64 nt, Homo Sapiens; identical to SEQ ID NO: 168312

SEQ ID NO: 670057 - RNA, 64 nt, Homo Sapiens; identical to SEQ ID NO: 168313

SEQ ID NO: 670058 - RNA, 64 nt, Homo Sapiens; identical to SEQ ID NO: 168314

SEQ ID NO: 670059 - RNA, 64 nt, Homo Sapiens; identical to SEQ ID NO: 168315

SEQ ID NO: 670060 - RNA, 64 nt, Homo Sapiens; identical to SEQ ID NO: 168316

SEQ ID NO: 670061 - RNA, 64 nt, Homo Sapiens; identical to SEQ ID NO: 168317

SEQ ID NO: 670062 - RNA, 64 nt, Homo Sapiens; identical to SEQ ID NO: 168318

SEQ ID NO: 670063 - RNA, 64 nt, Homo Sapiens; identical to SEQ ID NO: 168319

SEQ ID NO: 670064 - RNA, 64 nt, Homo Sapiens; identical to SEQ ID NO: 168320

SEQ ID NO: 670065 - RNA, 64 nt, Homo Sapiens; identical to SEQ ID NO: 168321

SEQ ID NO: 670066 - RNA, 64 nt, Homo Sapiens; identical to SEQ ID NO: 168322

SEQ ID NO: 670067 - RNA, 64 nt, Homo Sapiens; identical to SEQ ID NO: 168323

SEQ ID NO: 670068 - RNA, 64 nt, Homo Sapiens; identical to SEQ ID NO: 168324

SEQ ID NO: 670069 - RNA, 64 nt, Homo Sapiens; identical to SEQ ID NO: 168325

SEQ ID NO: 670070 - RNA, 64 nt, Homo Sapiens; identical to SEQ ID NO: 168326

SEQ ID NO: 670071 - RNA, 64 nt, Homo Sapiens; identical to SEQ ID NO: 168327

SEQ ID NO: 670072 - RNA, 64 nt, Homo Sapiens; identical to SEQ ID NO: 168328

SEQ ID NO: 670073 - RNA, 64 nt, Homo Sapiens; identical to SEQ ID NO: 168329

SEQ ID NO: 670074 - RNA, 64 nt, Homo Sapiens; identical to SEQ ID NO: 168330

SEQ ID NO: 670075 - RNA, 64 nt, Homo Sapiens; identical to SEQ ID NO: 168331

SEQ ID NO: 670076 - RNA, 64 nt, Homo Sapiens; identical to SEQ ID NO: 168332

SEQ ID NO: 670077 - RNA, 64 nt, Homo Sapiens; identical to SEQ ID NO: 168333

SEQ ID NO: 670078 - RNA, 64 nt, Homo Sapiens; identical to SEQ ID NO: 168334

SEQ ID NO: 670079 - RNA, 64 nt, Homo Sapiens; identical to SEQ ID NO: 168335

SEQ ID NO: 670080 - RNA, 64 nt, Homo Sapiens; identical to SEQ ID NO: 168336

SEQ ID NO: 670081 - RNA, 64 nt, Homo Sapiens; identical to SEQ ID NO: 168337

SEQ ID NO: 670082 - RNA, 64 nt, Homo Sapiens; identical to SEQ ID NO: 168338

SEQ ID NO: 670083 - RNA, 64 nt, Homo Sapiens; identical to SEQ ID NO: 168339

SEQ ID NO: 670084 - RNA, 64 nt, Homo Sapiens; identical to SEQ ID NO: 168340

SEQ ID NO: 670085 - RNA, 64 nt, Homo Sapiens; identical to SEQ ID NO: 168341

SEQ ID NO: 670086 - RNA, 64 nt, Homo Sapiens; identical to SEQ ID NO: 168342

SEQ ID NO: 670087 - RNA, 64 nt, Homo Sapiens; identical to SEQ ID NO: 168343

SEQ ID NO: 670088 - RNA, 64 nt, Homo Sapiens; identical to SEQ ID NO: 168344

SEQ ID NO: 670089 - RNA, 64 nt, Homo Sapiens; identical to SEQ ID NO: 168345

SEQ ID NO: 670090 - RNA, 64 nt, Homo Sapiens; identical to SEQ ID NO: 168346

SEQ ID NO: 670091 - RNA, 64 nt, Homo Sapiens; identical to SEQ ID NO: 168347

SEQ ID NO: 670092 - RNA, 64 nt, Homo Sapiens; identical to SEQ ID NO: 168348

SEQ ID NO: 670093 - RNA, 64 nt, Homo Sapiens; identical to SEQ ID NO: 168349

SEQ ID NO: 670094 - RNA, 64 nt, Homo Sapiens; identical to SEQ ID NO: 168350

SEQ ID NO: 670095 - RNA, 64 nt, Homo Sapiens; identical to SEQ ID NO: 168351

SEQ ID NO: 670096 - RNA, 64 nt, Homo Sapiens; identical to SEQ ID NO: 168352

SEQ ID NO: 670097 - RNA, 64 nt, Homo Sapiens; identical to SEQ ID NO: 168353

SEQ ID NO: 670098 - RNA, 64 nt, Homo Sapiens; identical to SEQ ID NO: 168354

SEQ ID NO: 670099 - RNA, 64 nt, Homo Sapiens; identical to SEQ ID NO: 168355

SEQ ID NO: 670100 - RNA, 64 nt, Homo Sapiens; identical to SEQ ID NO: 168356

SEQ ID NO: 670101 - RNA, 64 nt, Homo Sapiens; identical to SEQ ID NO: 168357

SEQ ID NO: 670102 - RNA, 64 nt, Homo Sapiens; identical to SEQ ID NO: 168358

SEQ ID NO: 670103 - RNA, 64 nt, Homo Sapiens; identical to SEQ ID NO: 168359

SEQ ID NO: 670104 - RNA, 64 nt, Homo Sapiens; identical to SEQ ID NO: 168360

SEQ ID NO: 670105 - RNA, 64 nt, Homo Sapiens; identical to SEQ ID NO: 168361

SEQ ID NO: 670106 - RNA, 64 nt, Homo Sapiens; identical to SEQ ID NO: 168362

SEQ ID NO: 670107 - RNA, 64 nt, Homo Sapiens; identical to SEQ ID NO: 168363

SEQ ID NO: 670108 - RNA, 64 nt, Homo Sapiens; identical to SEQ ID NO: 168364

SEQ ID NO: 670109 - RNA, 64 nt, Homo Sapiens; identical to SEQ ID NO: 168365

SEQ ID NO: 670110 - RNA, 64 nt, Homo Sapiens; identical to SEQ ID NO: 168366

SEQ ID NO: 670111 - RNA, 64 nt, Homo Sapiens; identical to SEQ ID NO: 168367

SEQ ID NO: 670112 - RNA, 64 nt, Homo Sapiens; identical to SEQ ID NO: 168368

SEQ ID NO: 670113 - RNA, 64 nt, Homo Sapiens; identical to SEQ ID NO: 168369

SEQ ID NO: 670114 - RNA, 64 nt, Homo Sapiens; identical to SEQ ID NO: 168370

SEQ ID NO: 670115 - RNA, 64 nt, Homo Sapiens; identical to SEQ ID NO: 168371

SEQ ID NO: 670116 - RNA, 64 nt, Homo Sapiens; identical to SEQ ID NO: 168372

SEQ ID NO: 670117 - RNA, 64 nt, Homo Sapiens; identical to SEQ ID NO: 168373

SEQ ID NO: 670118 - RNA, 64 nt, Homo Sapiens; identical to SEQ ID NO: 168374

SEQ ID NO: 670119 - RNA, 64 nt, Homo Sapiens; identical to SEQ ID NO: 168375

SEQ ID NO: 670120 - RNA, 64 nt, Homo Sapiens; identical to SEQ ID NO: 168376

SEQ ID NO: 670121 - RNA, 64 nt, Homo Sapiens; identical to SEQ ID NO: 168377

SEQ ID NO: 670122 - RNA, 64 nt, Homo Sapiens; identical to SEQ ID NO: 168378

SEQ ID NO: 670123 - RNA, 64 nt, Homo Sapiens; identical to SEQ ID NO: 168379

SEQ ID NO: 670124 - RNA, 64 nt, Homo Sapiens; identical to SEQ ID NO: 168380

SEQ ID NO: 670125 - RNA, 64 nt, Homo Sapiens; identical to SEQ ID NO: 168381

SEQ ID NO: 670126 - RNA, 64 nt, Homo Sapiens; identical to SEQ ID NO: 168382

SEQ ID NO: 670127 - RNA, 64 nt, Homo Sapiens; identical to SEQ ID NO: 168383

SEQ ID NO: 670128 - RNA, 64 nt, Homo Sapiens; identical to SEQ ID NO: 168384

SEQ ID NO: 670129 - RNA, 64 nt, Homo Sapiens; identical to SEQ ID NO: 168385

SEQ ID NO: 670130 - RNA, 64 nt, Homo Sapiens; identical to SEQ ID NO: 168386

SEQ ID NO: 670131 - RNA, 64 nt, Homo Sapiens; identical to SEQ ID NO: 168387

SEQ ID NO: 670132 - RNA, 64 nt, Homo Sapiens; identical to SEQ ID NO: 168388

SEQ ID NO: 670133 - RNA, 64 nt, Homo Sapiens; identical to SEQ ID NO: 168389

SEQ ID NO: 670134 - RNA, 64 nt, Homo Sapiens; identical to SEQ ID NO: 168390

SEQ ID NO: 670135 - RNA, 64 nt, Homo Sapiens; identical to SEQ ID NO: 168391

SEQ ID NO: 670136 - RNA, 64 nt, Homo Sapiens; identical to SEQ ID NO: 168392

SEQ ID NO: 670137 - RNA, 64 nt, Homo Sapiens; identical to SEQ ID NO: 168393

SEQ ID NO: 670138 - RNA, 64 nt, Homo Sapiens; identical to SEQ ID NO: 168394

SEQ ID NO: 670139 - RNA, 64 nt, Homo Sapiens; identical to SEQ ID NO: 168395

SEQ ID NO: 670140 - RNA, 64 nt, Homo Sapiens; identical to SEQ ID NO: 168396

SEQ ID NO: 670141 - RNA, 64 nt, Homo Sapiens; identical to SEQ ID NO: 168397

SEQ ID NO: 670142 - RNA, 64 nt, Homo Sapiens; identical to SEQ ID NO: 168398

SEQ ID NO: 670143 - RNA, 64 nt, Homo Sapiens; identical to SEQ ID NO: 168399

SEQ ID NO: 670144 - RNA, 64 nt, Homo Sapiens; identical to SEQ ID NO: 168400

SEQ ID NO: 670145 - RNA, 64 nt, Homo Sapiens; identical to SEQ ID NO: 168401

SEQ ID NO: 670146 - RNA, 64 nt, Homo Sapiens; identical to SEQ ID NO: 168402

SEQ ID NO: 670147 - RNA, 64 nt, Homo Sapiens; identical to SEQ ID NO: 168403

SEQ ID NO: 670148 - RNA, 64 nt, Homo Sapiens; identical to SEQ ID NO: 168404

SEQ ID NO: 670149 - RNA, 64 nt, Homo Sapiens; identical to SEQ ID NO: 168405

SEQ ID NO: 670150 - RNA, 64 nt, Homo Sapiens; identical to SEQ ID NO: 168406

SEQ ID NO: 670151 - RNA, 64 nt, Homo Sapiens; identical to SEQ ID NO: 168407

SEQ ID NO: 670152 - RNA, 64 nt, Homo Sapiens; identical to SEQ ID NO: 168408

SEQ ID NO: 670153 - RNA, 64 nt, Homo Sapiens; identical to SEQ ID NO: 168409

SEQ ID NO: 670154 - RNA, 64 nt, Homo Sapiens; identical to SEQ ID NO: 168410

SEQ ID NO: 670155 - RNA, 64 nt, Homo Sapiens; identical to SEQ ID NO: 168411

SEQ ID NO: 670156 - RNA, 64 nt, Homo Sapiens; identical to SEQ ID NO: 168412

SEQ ID NO: 670157 - RNA, 64 nt, Homo Sapiens; identical to SEQ ID NO: 168413

SEQ ID NO: 670158 - RNA, 64 nt, Homo Sapiens; identical to SEQ ID NO: 168414

SEQ ID NO: 670159 - RNA, 64 nt, Homo Sapiens; identical to SEQ ID NO: 168415

SEQ ID NO: 670160 - RNA, 64 nt, Homo Sapiens; identical to SEQ ID NO: 168416

SEQ ID NO: 670161 - RNA, 64 nt, Homo Sapiens; identical to SEQ ID NO: 168417

SEQ ID NO: 670162 - RNA, 64 nt, Homo Sapiens; identical to SEQ ID NO: 168418

SEQ ID NO: 670163 - RNA, 64 nt, Homo Sapiens; identical to SEQ ID NO: 168419

SEQ ID NO: 670164 - RNA, 64 nt, Homo Sapiens; identical to SEQ ID NO: 168420

SEQ ID NO: 670165 - RNA, 64 nt, Homo Sapiens; identical to SEQ ID NO: 168421

SEQ ID NO: 670166 - RNA, 64 nt, Homo Sapiens; identical to SEQ ID NO: 168422

SEQ ID NO: 670167 - RNA, 64 nt, Homo Sapiens; identical to SEQ ID NO: 168423

SEQ ID NO: 670168 - RNA, 64 nt, Homo Sapiens; identical to SEQ ID NO: 168424

SEQ ID NO: 670169 - RNA, 64 nt, Homo Sapiens
ugucccccuccagguucggcacccaggucuccggaggagacacaguuacccgaacccuucgccu

SEQ ID NO: 670170 - RNA, 64 nt, Homo Sapiens
gcuccuggcccuggccagaagcaggagugugaggaggagacagccucagcggacaagcagcugg

SEQ ID NO: 670171 - RNA, 64 nt, Homo Sapiens
gaggggcccagcuggagaaugauucugcuacaaaaggagacaguugagacuuuugcuuguugga

SEQ ID NO: 670172 - RNA, 64 nt, Homo Sapiens
cuggcuggccucguggggccugucucacuuuuccaggagacaugacccacuaacguggcaacuu

SEQ ID NO: 670173 - RNA, 64 nt, Homo Sapiens
cccuggucccagcuugucaggccauuugacauaaaggagacagcgggcagucugugucacgcug

SEQ ID NO: 670174 - RNA, 64 nt, Homo Sapiens
uccucccugccccagcacucagggaauaagcaagaggagacauugucuucccuugaguuggcca

SEQ ID NO: 670175 - RNA, 64 nt, Homo Sapiens
uuaggcaagcuguaugcaguggaauuuuccuuuuaggagacacacaauuaagacucucugguuc

SEQ ID NO: 670176 - RNA, 64 nt, Homo Sapiens
guucugggaggcaacagcauuaagugauaagaaaaggagacauucuggcaaagccaaucugcuu

SEQ ID NO: 670177 - RNA, 64 nt, Homo Sapiens
ucugugcagguucuaaaagguuucccccaagauuaggagacacuuucuuuaguagacaguuuaa

SEQ ID NO: 670178 - RNA, 64 nt, Homo Sapiens
aucaguuuuacggaaacaacugcuagccaucuccaggagacagguucugcacugggggacugga

SEQ ID NO: 670179 - RNA, 64 nt, Homo Sapiens
caugucggugagauggugugccacaguaucuuagaggagacaauucucugcccucaagggaacc

SEQ ID NO: 670180 - RNA, 64 nt, Homo Sapiens
cucauucauccccuacuaugucccagccuuuuuaaggagacacacuuuacaaagguuacuaaug

SEQ ID NO: 670181 - RNA, 64 nt, Homo Sapiens
aguaccugcauccagcuucccugccaaacucacaaggagacaucaaccucuagacagggaacag

SEQ ID NO: 670182 - RNA, 64 nt, Homo Sapiens
accucuagacagggaacagcuucaggauacuuccaggagacagagccaccagcagcaaaacaaa

SEQ ID NO: 670183 - RNA, 64 nt, Homo Sapiens
ccgggaugugucaucgugccaguauuguuugggaaggagacaugcacguauuuucuuuuuuguc

SEQ ID NO: 670184 - RNA, 64 nt, Homo Sapiens
auguacacucacuguaaaaagauugugcaggaguaggagacaaauuucccaaagggacuuaagc

SEQ ID NO: 670185 - RNA, 64 nt, Homo Sapiens
caaaaacaaagagaaaaaaacacacaucaauuaaaggagacaaaaagaggcagagcgaguagag

SEQ ID NO: 670186 - RNA, 64 nt, Homo Sapiens
ucaaccaucccacuaaguuauagccaagaagggaaggagacacggggauuugggguucucugcu

SEQ ID NO: 670187 - RNA, 64 nt, Homo Sapiens
cccaaaucccacucuaaauucugcaaauaucaaaaggagacacccaccgccugaaacaugcaca

SEQ ID NO: 670188 - RNA, 64 nt, Homo Sapiens
gccccugccccauggcccuggauccgagacauccaggagacagaccagccacaagcauuagcau

SEQ ID NO: 670189 - RNA, 64 nt, Homo Sapiens
uugggcucuccccuugccacuugcccuuuccuuaaggagacagugaaagugcauuagaauggaa

SEQ ID NO: 670190 - RNA, 64 nt, Homo Sapiens
ugggcuguuugccuugggugucuggaggaggggcaggagacacuuuagaagucauccagaugcu

SEQ ID NO: 670191 - RNA, 64 nt, Homo Sapiens
cauuuuagaaggccaaggagagccacaccgaaaaaggagacaguuccugugaucuccuuugcag

SEQ ID NO: 670192 - RNA, 64 nt, Homo Sapiens
gguuacuaaaugaauaaaaacucggaauuaggccaggagacauggaauaccauucaugggaugg

SEQ ID NO: 670193 - RNA, 64 nt, Homo Sapiens
ucuguucacaagcccaaggugcuagaacuagcuuaggagacaugcaggccacagggcuucuagg

SEQ ID NO: 670194 - RNA, 64 nt, Homo Sapiens
gagacuuugaccaugugacgugucaacagacucaaggagacaaccaccucaacugggucaugug

SEQ ID NO: 670195 - RNA, 64 nt, Homo Sapiens
agaucaccauaagcgucccugugaagaaugagauaggagacagguacagcggccaaaccaugac

SEQ ID NO: 670196 - RNA, 64 nt, Homo Sapiens
gaagauccuguguguuucucccauggcuaccuuuaggagacagauucugccuccaucucugccu

SEQ ID NO: 670197 - RNA, 64 nt, Homo Sapiens
ggucucagaggagggauagaccauggaagcuggcaggagacacuagagugaggucaucccgggg

SEQ ID NO: 670198 - RNA, 64 nt, Homo Sapiens
caggaagccuccugcugagugacaucgguucaggaggagacagucguguccccugccugugagu

SEQ ID NO: 670199 - RNA, 64 nt, Homo Sapiens
gacacagagcaggaggacacccaagagacagaagaggagacacaaugccaugacagguguccuu

SEQ ID NO: 670200 - RNA, 64 nt, Homo Sapiens
gacacaaagcaggaggccacaugagagacggaagaggagacacagggcccaauccagugucccu

SEQ ID NO: 670201 - RNA, 64 nt, Homo Sapiens
guuucgccauguugacgagauuuuuuuuuuuuuguagagacaggucuggcuaauuuuuuuuuuu

SEQ ID NO: 670202 - RNA, 64 nt, Homo Sapiens
guuucaccguguuagccagguuuuguauuuuuaguagagacagggccagcacgccuggcuaauu

SEQ ID NO: 670203 - RNA, 64 nt, Homo Sapiens
ccaccacaucuggcuaauuuuauuuuuauuuuuguagagacaggagucuugccauguugcccag

SEQ ID NO: 670204 - RNA, 64 nt, Homo Sapiens
caccaugcccagcaaauuuuguauuuuuuuuugguagagacaggguucaaccauguuggucagg

SEQ ID NO: 670205 - RNA, 64 nt, Homo Sapiens
uggaaugaguugggagagaaaggcccucagcuuuuagagacacaaaaauccaugaagucucuuc

SEQ ID NO: 670206 - RNA, 64 nt, Homo Sapiens
ugccacuaugccuggcuaauuuuuguguuuuuaguagagacaggguuucaccauauuggccagg

SEQ ID NO: 670207 - RNA, 64 nt, Homo Sapiens
gcaccaccaugcccagcuaauuuuguauuuuuauuagagacaggguuucuccguguuggucagg

SEQ ID NO: 670208 - RNA, 64 nt, Homo Sapiens
guaccgucaugccuggcuaauuuuuguauuuuuguagagacaggguuucaccauguugcccagu

SEQ ID NO: 670209 - RNA, 64 nt, Homo Sapiens
gucucacuuuguugcccacgauuuuacuuuuauguagagacaggauucucuccagagacuuuug

SEQ ID NO: 670210 - RNA, 64 nt, Homo Sapiens
guuucaccauguuggucagguuuuguauuuuuaguagagacagggccaccacgcccagcuaauu

SEQ ID NO: 670211 - RNA, 64 nt, Homo Sapiens
gucucacuguguugcccagguaaauacuuuuuuguagagacagguuggguaauuaaaaaauaaa

SEQ ID NO: 670212 - RNA, 64 nt, Homo Sapiens
gucugacucuguugcccaaguuguuuuguuuguuuagagacagguuauacaauucauuuuuguu

SEQ ID NO: 670213 - RNA, 64 nt, Homo Sapiens
cacaucaaugaauuugggguccuauacacuugacuagagacaugcuuguguuuuggaauuucac

SEQ ID NO: 670214 - RNA, 64 nt, Homo Sapiens
gaacagcagguugauaguagauuaugucucuagguagagacagauacaugagaagagccuccaa

SEQ ID NO: 670215 - RNA, 64 nt, Homo Sapiens
caccaccacacccagcuaauuuuuguauuuuuaguagagacagggguuucaccacguuggccag

SEQ ID NO: 670216 - RNA, 64 nt, Homo Sapiens
cccugccaccaagcccagcuaauuguauuuuuaguagagacaggauuucaccauguuggccagg

SEQ ID NO: 670217 - RNA, 64 nt, Homo Sapiens
ugccaccaugcccggcuacuuuuuguauuuuuaguagagacaggguuucaucauguuggccagg

SEQ ID NO: 670218 - RNA, 64 nt, Homo Sapiens
ccacuguggccaaccuaauuuuuguauuauuuaguagagacaggguuucaccacauuggccagg

SEQ ID NO: 670219 - RNA, 64 nt, Homo Sapiens
cgccaccacgcccagcuaauuuuuauauuuuuaguagagacaggauugcaccauauuggucagc

SEQ ID NO: 670220 - RNA, 64 nt, Homo Sapiens
cgccaccacgccuggcuacuuuuuguauuuuuaguagagacaggguuucaccacguuagccaug

SEQ ID NO: 670221 - RNA, 64 nt, Homo Sapiens
guuucaccauguuggccagguccuguauuuuuaguagagacaggcgccaccacgcccagcuaau

SEQ ID NO: 670222 - RNA, 64 nt, Homo Sapiens
guuucaccguguuagccagguuuuugauuuuuaguagagacaggucaccaugccuggcuaauuu

SEQ ID NO: 670223 - RNA, 64 nt, Homo Sapiens
agaugagaagguuugacaaaaagacagagagauguagagacagugauagagacagaggaacaaa

SEQ ID NO: 670224 - RNA, 64 nt, Homo Sapiens
uugacaaaaagacagagagauguagagacagugauagagacagaggaacaaaaagagcagcagu

SEQ ID NO: 670225 - RNA, 64 nt, Homo Sapiens
guuacaccucaauguaaccucccaggcuggaguguagagacacagacagggucuugcucuguug

SEQ ID NO: 670226 - RNA, 64 nt, Homo Sapiens
gucuugcucuguugcccagguuuuuauuuuuacuuagagacagguggaugguucuuugacucua

SEQ ID NO: 670227 - RNA, 64 nt, Homo Sapiens
ccauguugcguucaaagaggugaacauuaaaauauagagacaggacagaauguguucuuuucuc

SEQ ID NO: 670228 - RNA, 64 nt, Homo Sapiens
gccgaugugguaggugauaaagaggcaucuuuucuagagacacauuggaccagaugaggauccg

SEQ ID NO: 670229 - RNA, 64 nt, Homo Sapiens
agccaacaagcccggcuaauuuuuguauuuuuaguagagacaagguuucaccauguuggucagg

SEQ ID NO: 670230 - RNA, 64 nt, Homo Sapiens
gaggguauucccaacuugugaucuucuaccacuuuagagacauucaaguaauaguuuucuuaga

SEQ ID NO: 670231 - RNA, 62 nt, Homo Sapiens
uguggaaaaggcuccagugagcgcgccugcuuuagagacacaggaugauucagaccggaaac

SEQ ID NO: 670232 - RNA, 64 nt, Homo Sapiens
cgauuuggcugucuaggcgucauuuggcaaugucuagagacauuuuugguaguuagaauggggg

SEQ ID NO: 670233 - RNA, 64 nt, Homo Sapiens
guuucaccguguuagccagguuuuuguauuuuaguagagacaggaccgucacacccggcuaauu

SEQ ID NO: 670234 - RNA, 64 nt, Homo Sapiens
auuucaccauguuggccagguauuguaguuuuaguagagacaagcgccaccacgcccaggaaau

SEQ ID NO: 670235 - RNA, 64 nt, Homo Sapiens
ggucucgcugaacuccuggcuuuuuuggucauacuagagacaggauuuuucuacagauuuuuuu

SEQ ID NO: 670236 - RNA, 64 nt, Homo Sapiens
gucucacucuguugcccagguuuuuuaaauuuuuuagagacagguuuuguucaugcuuugauuu

SEQ ID NO: 670237 - RNA, 59 nt, Homo Sapiens
ccacgggcccucccuccaagggugagggcuagagacagcagcaagaagaccagcuguga

SEQ ID NO: 670238 - RNA, 64 nt, Homo Sapiens
guuucaccauuuuggccaggaaaaauauuuuuaguagagacaggcgcccggcuaauuuuuuuuu

SEQ ID NO: 670239 - RNA, 64 nt, Homo Sapiens
guuuugcuauguuggccagguuuuguauuuuuaguagagacagaccaccacagcccagcuaauu

SEQ ID NO: 670240 - RNA, 64 nt, Homo Sapiens
guuucaccauguuggccagguuuuguauuuuuaguagagacaggcccagcuaauuauuuauuuc

SEQ ID NO: 670241 - RNA, 64 nt, Homo Sapiens
ccuuccgugaggccuggggguaucucccccuaguuagagacaguccaggugauccccccgccau

SEQ ID NO: 670242 - RNA, 64 nt, Homo Sapiens
gugccaucaugccugacuaauuuuguauuuuuaguagagacaggguuucaccauguuggccagg

SEQ ID NO: 670243 - RNA, 64 nt, Homo Sapiens
ccaccaagcccugcaaauuuuuuuguauuuuuaguagagacaguguuuugccauguuggccagg

SEQ ID NO: 670244 - RNA, 64 nt, Homo Sapiens
guuucaccauauuggucagguuuuguauuuuuaguagagacaggcaccaccacaccuggcuaau

SEQ ID NO: 670245 - RNA, 64 nt, Homo Sapiens
guuucaccauauuggucagguuuuguauuuuuaguagagacaggugccaccacgcccggcuaau

SEQ ID NO: 670246 - RNA, 64 nt, Homo Sapiens; identical to SEQ ID NO: 144852

SEQ ID NO: 670247 - RNA, 64 nt, Homo Sapiens; identical to SEQ ID NO: 144853

SEQ ID NO: 670248 - RNA, 64 nt, Homo Sapiens; identical to SEQ ID NO: 144854

SEQ ID NO: 670249 - RNA, 64 nt, Homo Sapiens; identical to SEQ ID NO: 144855

SEQ ID NO: 670250 - RNA, 64 nt, Homo Sapiens; identical to SEQ ID NO: 144856

SEQ ID NO: 670251 - RNA, 64 nt, Homo Sapiens; identical to SEQ ID NO: 144857

SEQ ID NO: 670252 - RNA, 64 nt, Homo Sapiens; identical to SEQ ID NO: 144858

SEQ ID NO: 670253 - RNA, 64 nt, Homo Sapiens; identical to SEQ ID NO: 144859

SEQ ID NO: 670254 - RNA, 64 nt, Homo Sapiens; identical to SEQ ID NO: 144860

SEQ ID NO: 670255 - RNA, 64 nt, Homo Sapiens; identical to SEQ ID NO: 144861

SEQ ID NO: 670256 - RNA, 64 nt, Homo Sapiens; identical to SEQ ID NO: 276116

SEQ ID NO: 670257 - RNA, 64 nt, Homo Sapiens; identical to SEQ ID NO: 276117

SEQ ID NO: 670258 - RNA, 64 nt, Homo Sapiens; identical to SEQ ID NO: 276118

SEQ ID NO: 670259 - RNA, 64 nt, Homo Sapiens; identical to SEQ ID NO: 276119

SEQ ID NO: 670260 - RNA, 64 nt, Homo Sapiens; identical to SEQ ID NO: 276120

SEQ ID NO: 670261 - RNA, 64 nt, Homo Sapiens; identical to SEQ ID NO: 276121

SEQ ID NO: 670262 - RNA, 64 nt, Homo Sapiens; identical to SEQ ID NO: 276122

SEQ ID NO: 670263 - RNA, 64 nt, Homo Sapiens; identical to SEQ ID NO: 276123

SEQ ID NO: 670264 - RNA, 64 nt, Homo Sapiens; identical to SEQ ID NO: 276124

SEQ ID NO: 670265 - RNA, 64 nt, Homo Sapiens; identical to SEQ ID NO: 276125

SEQ ID NO: 670266 - RNA, 64 nt, Homo Sapiens; identical to SEQ ID NO: 276126

SEQ ID NO: 670267 - RNA, 64 nt, Homo Sapiens; identical to SEQ ID NO: 276127

SEQ ID NO: 670268 - RNA, 64 nt, Homo Sapiens; identical to SEQ ID NO: 276128

SEQ ID NO: 670269 - RNA, 64 nt, Homo Sapiens; identical to SEQ ID NO: 276129

SEQ ID NO: 670270 - RNA, 64 nt, Homo Sapiens; identical to SEQ ID NO: 276130

SEQ ID NO: 670271 - RNA, 64 nt, Homo Sapiens; identical to SEQ ID NO: 276131

SEQ ID NO: 670272 - RNA, 64 nt, Homo Sapiens; identical to SEQ ID NO: 276132

SEQ ID NO: 670273 - RNA, 64 nt, Homo Sapiens; identical to SEQ ID NO: 276133

SEQ ID NO: 670274 - RNA, 64 nt, Homo Sapiens; identical to SEQ ID NO: 276134

SEQ ID NO: 670275 - RNA, 64 nt, Homo Sapiens; identical to SEQ ID NO: 276135

SEQ ID NO: 670276 - RNA, 64 nt, Homo Sapiens; identical to SEQ ID NO: 276136

SEQ ID NO: 670277 - RNA, 64 nt, Homo Sapiens; identical to SEQ ID NO: 276137

SEQ ID NO: 670278 - RNA, 64 nt, Homo Sapiens; identical to SEQ ID NO: 276138

SEQ ID NO: 670279 - RNA, 64 nt, Homo Sapiens; identical to SEQ ID NO: 276139

SEQ ID NO: 670280 - RNA, 64 nt, Homo Sapiens; identical to SEQ ID NO: 276140

SEQ ID NO: 670281 - RNA, 64 nt, Homo Sapiens; identical to SEQ ID NO: 276141

SEQ ID NO: 670282 - RNA, 64 nt, Homo Sapiens; identical to SEQ ID NO: 276142

SEQ ID NO: 670283 - RNA, 64 nt, Homo Sapiens; identical to SEQ ID NO: 276143

SEQ ID NO: 670284 - RNA, 64 nt, Homo Sapiens; identical to SEQ ID NO: 276144

SEQ ID NO: 670285 - RNA, 64 nt, Homo Sapiens; identical to SEQ ID NO: 276145

SEQ ID NO: 670286 - RNA, 64 nt, Homo Sapiens; identical to SEQ ID NO: 276146

SEQ ID NO: 670287 - RNA, 64 nt, Homo Sapiens; identical to SEQ ID NO: 276147

SEQ ID NO: 670288 - RNA, 64 nt, Homo Sapiens; identical to SEQ ID NO: 276148

SEQ ID NO: 670289 - RNA, 64 nt, Homo Sapiens; identical to SEQ ID NO: 88200

SEQ ID NO: 670290 - RNA, 64 nt, Homo Sapiens; identical to SEQ ID NO: 88201

SEQ ID NO: 670291 - RNA, 64 nt, Homo Sapiens; identical to SEQ ID NO: 88202

SEQ ID NO: 670292 - RNA, 64 nt, Homo Sapiens; identical to SEQ ID NO: 88203

SEQ ID NO: 670293 - RNA, 64 nt, Homo Sapiens; identical to SEQ ID NO: 88204

SEQ ID NO: 670294 - RNA, 64 nt, Homo Sapiens; identical to SEQ ID NO: 88205

SEQ ID NO: 670295 - RNA, 64 nt, Homo Sapiens; identical to SEQ ID NO: 88206

SEQ ID NO: 670296 - RNA, 64 nt, Homo Sapiens; identical to SEQ ID NO: 88207

SEQ ID NO: 670297 - RNA, 64 nt, Homo Sapiens; identical to SEQ ID NO: 88208

SEQ ID NO: 670298 - RNA, 64 nt, Homo Sapiens; identical to SEQ ID NO: 88209

SEQ ID NO: 670299 - RNA, 64 nt, Homo Sapiens; identical to SEQ ID NO: 88210

SEQ ID NO: 670300 - RNA, 64 nt, Homo Sapiens; identical to SEQ ID NO: 88211

SEQ ID NO: 670301 - RNA, 64 nt, Homo Sapiens; identical to SEQ ID NO: 88212

SEQ ID NO: 670302 - RNA, 64 nt, Homo Sapiens; identical to SEQ ID NO: 88213

SEQ ID NO: 670303 - RNA, 64 nt, Homo Sapiens; identical to SEQ ID NO: 88214

SEQ ID NO: 670304 - RNA, 64 nt, Homo Sapiens; identical to SEQ ID NO: 88215

SEQ ID NO: 670305 - RNA, 64 nt, Homo Sapiens; identical to SEQ ID NO: 88216

SEQ ID NO: 670306 - RNA, 64 nt, Homo Sapiens; identical to SEQ ID NO: 88217

SEQ ID NO: 670307 - RNA, 64 nt, Homo Sapiens; identical to SEQ ID NO: 88218

SEQ ID NO: 670308 - RNA, 64 nt, Homo Sapiens; identical to SEQ ID NO: 88219

SEQ ID NO: 670309 - RNA, 64 nt, Homo Sapiens; identical to SEQ ID NO: 88220

SEQ ID NO: 670310 - RNA, 64 nt, Homo Sapiens; identical to SEQ ID NO: 88221

SEQ ID NO: 670311 - RNA, 64 nt, Homo Sapiens; identical to SEQ ID NO: 88222

SEQ ID NO: 670312 - RNA, 64 nt, Homo Sapiens; identical to SEQ ID NO: 88223

SEQ ID NO: 670313 - RNA, 64 nt, Homo Sapiens; identical to SEQ ID NO: 88224

SEQ ID NO: 670314 - RNA, 64 nt, Homo Sapiens; identical to SEQ ID NO: 88225

SEQ ID NO: 670315 - RNA, 64 nt, Homo Sapiens; identical to SEQ ID NO: 88226

SEQ ID NO: 670316 - RNA, 64 nt, Homo Sapiens; identical to SEQ ID NO: 88227

SEQ ID NO: 670317 - RNA, 64 nt, Homo Sapiens; identical to SEQ ID NO: 88228

SEQ ID NO: 670318 - RNA, 64 nt, Homo Sapiens; identical to SEQ ID NO: 88229

SEQ ID NO: 670319 - RNA, 64 nt, Homo Sapiens; identical to SEQ ID NO: 88230

SEQ ID NO: 670320 - RNA, 64 nt, Homo Sapiens; identical to SEQ ID NO: 88231

SEQ ID NO: 670321 - RNA, 64 nt, Homo Sapiens; identical to SEQ ID NO: 88232

SEQ ID NO: 670322 - RNA, 64 nt, Homo Sapiens; identical to SEQ ID NO: 88233

SEQ ID NO: 670323 - RNA, 64 nt, Homo Sapiens; identical to SEQ ID NO: 88234

SEQ ID NO: 670324 - RNA, 64 nt, Homo Sapiens; identical to SEQ ID NO: 88235

SEQ ID NO: 670325 - RNA, 64 nt, Homo Sapiens; identical to SEQ ID NO: 88236

SEQ ID NO: 670326 - RNA, 64 nt, Homo Sapiens; identical to SEQ ID NO: 88237

SEQ ID NO: 670327 - RNA, 64 nt, Homo Sapiens; identical to SEQ ID NO: 88238

SEQ ID NO: 670328 - RNA, 64 nt, Homo Sapiens; identical to SEQ ID NO: 88239

SEQ ID NO: 670329 - RNA, 64 nt, Homo Sapiens; identical to SEQ ID NO: 88240

SEQ ID NO: 670330 - RNA, 64 nt, Homo Sapiens; identical to SEQ ID NO: 88241

SEQ ID NO: 670331 - RNA, 64 nt, Homo Sapiens; identical to SEQ ID NO: 88242

SEQ ID NO: 670332 - RNA, 64 nt, Homo Sapiens; identical to SEQ ID NO: 88243

SEQ ID NO: 670333 - RNA, 64 nt, Homo Sapiens; identical to SEQ ID NO: 88244

SEQ ID NO: 670334 - RNA, 64 nt, Homo Sapiens; identical to SEQ ID NO: 88245

SEQ ID NO: 670335 - RNA, 64 nt, Homo Sapiens; identical to SEQ ID NO: 88246

SEQ ID NO: 670336 - RNA, 64 nt, Homo Sapiens; identical to SEQ ID NO: 88247

SEQ ID NO: 670337 - RNA, 64 nt, Homo Sapiens; identical to SEQ ID NO: 88248

SEQ ID NO: 670338 - RNA, 61 nt, Homo Sapiens; identical to SEQ ID NO: 88249

SEQ ID NO: 670339 - RNA, 64 nt, Homo Sapiens; identical to SEQ ID NO: 88250

SEQ ID NO: 670340 - RNA, 64 nt, Homo Sapiens; identical to SEQ ID NO: 88251

SEQ ID NO: 670341 - RNA, 64 nt, Homo Sapiens; identical to SEQ ID NO: 88252

SEQ ID NO: 670342 - RNA, 64 nt, Homo Sapiens; identical to SEQ ID NO: 88253

SEQ ID NO: 670343 - RNA, 64 nt, Homo Sapiens; identical to SEQ ID NO: 88254

SEQ ID NO: 670344 - RNA, 64 nt, Homo Sapiens; identical to SEQ ID NO: 88255

SEQ ID NO: 670345 - RNA, 64 nt, Homo Sapiens; identical to SEQ ID NO: 88256

SEQ ID NO: 670346 - RNA, 64 nt, Homo Sapiens; identical to SEQ ID NO: 542858

SEQ ID NO: 670347 - RNA, 64 nt, Homo Sapiens; identical to SEQ ID NO: 542859

SEQ ID NO: 670348 - RNA, 64 nt, Homo Sapiens; identical to SEQ ID NO: 542860

SEQ ID NO: 670349 - RNA, 64 nt, Homo Sapiens; identical to SEQ ID NO: 542861

SEQ ID NO: 670350 - RNA, 64 nt, Homo Sapiens; identical to SEQ ID NO: 542862

SEQ ID NO: 670351 - RNA, 64 nt, Homo Sapiens; identical to SEQ ID NO: 542863

SEQ ID NO: 670352 - RNA, 64 nt, Homo Sapiens; identical to SEQ ID NO: 542864

SEQ ID NO: 670353 - RNA, 64 nt, Homo Sapiens; identical to SEQ ID NO: 542865

SEQ ID NO: 670354 - RNA, 64 nt, Homo Sapiens; identical to SEQ ID NO: 542866

SEQ ID NO: 670355 - RNA, 64 nt, Homo Sapiens; identical to SEQ ID NO: 542867

SEQ ID NO: 670356 - RNA, 64 nt, Homo Sapiens; identical to SEQ ID NO: 542868

SEQ ID NO: 670357 - RNA, 62 nt, Homo Sapiens; identical to SEQ ID NO: 542869

SEQ ID NO: 670358 - RNA, 64 nt, Homo Sapiens; identical to SEQ ID NO: 542870

SEQ ID NO: 670359 - RNA, 64 nt, Homo Sapiens; identical to SEQ ID NO: 542871

SEQ ID NO: 670360 - RNA, 64 nt, Homo Sapiens; identical to SEQ ID NO: 542872

SEQ ID NO: 670361 - RNA, 64 nt, Homo Sapiens; identical to SEQ ID NO: 542873

SEQ ID NO: 670362 - RNA, 64 nt, Homo Sapiens; identical to SEQ ID NO: 542874

SEQ ID NO: 670363 - RNA, 64 nt, Homo Sapiens; identical to SEQ ID NO: 542875

SEQ ID NO: 670364 - RNA, 64 nt, Homo Sapiens; identical to SEQ ID NO: 542876

SEQ ID NO: 670365 - RNA, 64 nt, Homo Sapiens; identical to SEQ ID NO: 542877

SEQ ID NO: 670366 - RNA, 64 nt, Homo Sapiens; identical to SEQ ID NO: 542878

SEQ ID NO: 670367 - RNA, 64 nt, Homo Sapiens; identical to SEQ ID NO: 542879

SEQ ID NO: 670368 - RNA, 64 nt, Homo Sapiens; identical to SEQ ID NO: 542880

SEQ ID NO: 670369 - RNA, 64 nt, Homo Sapiens; identical to SEQ ID NO: 542881

SEQ ID NO: 670370 - RNA, 64 nt, Homo Sapiens; identical to SEQ ID NO: 542882

SEQ ID NO: 670371 - RNA, 64 nt, Homo Sapiens; identical to SEQ ID NO: 542883

SEQ ID NO: 670372 - RNA, 64 nt, Homo Sapiens; identical to SEQ ID NO: 542884

SEQ ID NO: 670373 - RNA, 64 nt, Homo Sapiens; identical to SEQ ID NO: 542885

SEQ ID NO: 670374 - RNA, 51 nt, Homo Sapiens; identical to SEQ ID NO: 542886

SEQ ID NO: 670375 - RNA, 64 nt, Homo Sapiens; identical to SEQ ID NO: 542887

SEQ ID NO: 670376 - RNA, 64 nt, Homo Sapiens; identical to SEQ ID NO: 542888

SEQ ID NO: 670377 - RNA, 53 nt, Homo Sapiens; identical to SEQ ID NO: 542889

SEQ ID NO: 670378 - RNA, 64 nt, Homo Sapiens; identical to SEQ ID NO: 542890

SEQ ID NO: 670379 - RNA, 64 nt, Homo Sapiens; identical to SEQ ID NO: 542891

SEQ ID NO: 670380 - RNA, 64 nt, Homo Sapiens; identical to SEQ ID NO: 542892

SEQ ID NO: 670381 - RNA, 64 nt, Homo Sapiens; identical to SEQ ID NO: 542893

SEQ ID NO: 670382 - RNA, 64 nt, Homo Sapiens; identical to SEQ ID NO: 542894

SEQ ID NO: 670383 - RNA, 64 nt, Homo Sapiens; identical to SEQ ID NO: 542895

SEQ ID NO: 670384 - RNA, 64 nt, Homo Sapiens; identical to SEQ ID NO: 542896

SEQ ID NO: 670385 - RNA, 64 nt, Homo Sapiens; identical to SEQ ID NO: 542897

SEQ ID NO: 670386 - RNA, 64 nt, Homo Sapiens; identical to SEQ ID NO: 542898

SEQ ID NO: 670387 - RNA, 64 nt, Homo Sapiens; identical to SEQ ID NO: 542899

SEQ ID NO: 670388 - RNA, 64 nt, Homo Sapiens; identical to SEQ ID NO: 542900

SEQ ID NO: 670389 - RNA, 64 nt, Homo Sapiens; identical to SEQ ID NO: 542901

SEQ ID NO: 670390 - RNA, 64 nt, Homo Sapiens; identical to SEQ ID NO: 542902

SEQ ID NO: 670391 - RNA, 64 nt, Homo Sapiens; identical to SEQ ID NO: 542903

SEQ ID NO: 670392 - RNA, 64 nt, Homo Sapiens; identical to SEQ ID NO: 542904

SEQ ID NO: 670393 - RNA, 64 nt, Homo Sapiens; identical to SEQ ID NO: 542905

SEQ ID NO: 670394 - RNA, 64 nt, Homo Sapiens; identical to SEQ ID NO: 542906

SEQ ID NO: 670395 - RNA, 64 nt, Homo Sapiens; identical to SEQ ID NO: 542907

SEQ ID NO: 670396 - RNA, 64 nt, Homo Sapiens; identical to SEQ ID NO: 542908

SEQ ID NO: 670397 - RNA, 62 nt, Homo Sapiens; identical to SEQ ID NO: 542909

SEQ ID NO: 670398 - RNA, 64 nt, Homo Sapiens; identical to SEQ ID NO: 542910

SEQ ID NO: 670399 - RNA, 64 nt, Homo Sapiens; identical to SEQ ID NO: 542911

SEQ ID NO: 670400 - RNA, 64 nt, Homo Sapiens; identical to SEQ ID NO: 542912

SEQ ID NO: 670401 - RNA, 64 nt, Homo Sapiens; identical to SEQ ID NO: 542913

SEQ ID NO: 670402 - RNA, 64 nt, Homo Sapiens; identical to SEQ ID NO: 542914

SEQ ID NO: 670403 - RNA, 64 nt, Homo Sapiens; identical to SEQ ID NO: 542915

SEQ ID NO: 670404 - RNA, 64 nt, Homo Sapiens; identical to SEQ ID NO: 542916

SEQ ID NO: 670405 - RNA, 64 nt, Homo Sapiens; identical to SEQ ID NO: 542917

SEQ ID NO: 670406 - RNA, 64 nt, Homo Sapiens; identical to SEQ ID NO: 542918

SEQ ID NO: 670407 - RNA, 64 nt, Homo Sapiens; identical to SEQ ID NO: 542919

SEQ ID NO: 670408 - RNA, 64 nt, Homo Sapiens; identical to SEQ ID NO: 542920

SEQ ID NO: 670409 - RNA, 64 nt, Homo Sapiens; identical to SEQ ID NO: 542921

SEQ ID NO: 670410 - RNA, 64 nt, Homo Sapiens; identical to SEQ ID NO: 542922

SEQ ID NO: 670411 - RNA, 64 nt, Homo Sapiens; identical to SEQ ID NO: 542923

SEQ ID NO: 670412 - RNA, 64 nt, Homo Sapiens; identical to SEQ ID NO: 542924

SEQ ID NO: 670413 - RNA, 64 nt, Homo Sapiens; identical to SEQ ID NO: 542925

SEQ ID NO: 670414 - RNA, 64 nt, Homo Sapiens; identical to SEQ ID NO: 542926

SEQ ID NO: 670415 - RNA, 64 nt, Homo Sapiens; identical to SEQ ID NO: 542927

SEQ ID NO: 670416 - RNA, 64 nt, Homo Sapiens; identical to SEQ ID NO: 542928

SEQ ID NO: 670417 - RNA, 64 nt, Homo Sapiens; identical to SEQ ID NO: 542929

SEQ ID NO: 670418 - RNA, 64 nt, Homo Sapiens; identical to SEQ ID NO: 542930

SEQ ID NO: 670419 - RNA, 64 nt, Homo Sapiens; identical to SEQ ID NO: 542931

SEQ ID NO: 670420 - RNA, 64 nt, Homo Sapiens; identical to SEQ ID NO: 542932

SEQ ID NO: 670421 - RNA, 64 nt, Homo Sapiens; identical to SEQ ID NO: 542933

SEQ ID NO: 670422 - RNA, 64 nt, Homo Sapiens; identical to SEQ ID NO: 542934

SEQ ID NO: 670423 - RNA, 64 nt, Homo Sapiens; identical to SEQ ID NO: 542935

SEQ ID NO: 670424 - RNA, 64 nt, Homo Sapiens; identical to SEQ ID NO: 542936

SEQ ID NO: 670425 - RNA, 64 nt, Homo Sapiens; identical to SEQ ID NO: 542937

SEQ ID NO: 670426 - RNA, 64 nt, Homo Sapiens; identical to SEQ ID NO: 542938

SEQ ID NO: 670427 - RNA, 64 nt, Homo Sapiens; identical to SEQ ID NO: 542939

SEQ ID NO: 670428 - RNA, 64 nt, Homo Sapiens; identical to SEQ ID NO: 542940

SEQ ID NO: 670429 - RNA, 64 nt, Homo Sapiens; identical to SEQ ID NO: 542941

SEQ ID NO: 670430 - RNA, 64 nt, Homo Sapiens; identical to SEQ ID NO: 542942

SEQ ID NO: 670431 - RNA, 64 nt, Homo Sapiens; identical to SEQ ID NO: 542943

SEQ ID NO: 670432 - RNA, 64 nt, Homo Sapiens; identical to SEQ ID NO: 542944

SEQ ID NO: 670433 - RNA, 64 nt, Homo Sapiens; identical to SEQ ID NO: 542945

SEQ ID NO: 670434 - RNA, 64 nt, Homo Sapiens; identical to SEQ ID NO: 542946

SEQ ID NO: 670435 - RNA, 64 nt, Homo Sapiens; identical to SEQ ID NO: 189695

SEQ ID NO: 670436 - RNA, 64 nt, Homo Sapiens; identical to SEQ ID NO: 189696

SEQ ID NO: 670437 - RNA, 64 nt, Homo Sapiens; identical to SEQ ID NO: 189697

SEQ ID NO: 670438 - RNA, 64 nt, Homo Sapiens; identical to SEQ ID NO: 189698

SEQ ID NO: 670439 - RNA, 64 nt, Homo Sapiens; identical to SEQ ID NO: 189699

SEQ ID NO: 670440 - RNA, 64 nt, Homo Sapiens; identical to SEQ ID NO: 189700

SEQ ID NO: 670441 - RNA, 64 nt, Homo Sapiens; identical to SEQ ID NO: 189701

SEQ ID NO: 670442 - RNA, 64 nt, Homo Sapiens; identical to SEQ ID NO: 189702

SEQ ID NO: 670443 - RNA, 64 nt, Homo Sapiens; identical to SEQ ID NO: 189703

SEQ ID NO: 670444 - RNA, 64 nt, Homo Sapiens; identical to SEQ ID NO: 189704

SEQ ID NO: 670445 - RNA, 64 nt, Homo Sapiens; identical to SEQ ID NO: 189705

SEQ ID NO: 670446 - RNA, 64 nt, Homo Sapiens; identical to SEQ ID NO: 189706

SEQ ID NO: 670447 - RNA, 64 nt, Homo Sapiens; identical to SEQ ID NO: 189707

SEQ ID NO: 670448 - RNA, 64 nt, Homo Sapiens; identical to SEQ ID NO: 189708

SEQ ID NO: 670449 - RNA, 64 nt, Homo Sapiens; identical to SEQ ID NO: 189709

SEQ ID NO: 670450 - RNA, 64 nt, Homo Sapiens; identical to SEQ ID NO: 189710

SEQ ID NO: 670451 - RNA, 64 nt, Homo Sapiens; identical to SEQ ID NO: 189711

SEQ ID NO: 670452 - RNA, 64 nt, Homo Sapiens; identical to SEQ ID NO: 189712

SEQ ID NO: 670453 - RNA, 64 nt, Homo Sapiens; identical to SEQ ID NO: 189713

SEQ ID NO: 670454 - RNA, 64 nt, Homo Sapiens; identical to SEQ ID NO: 189714

SEQ ID NO: 670455 - RNA, 64 nt, Homo Sapiens; identical to SEQ ID NO: 189715

SEQ ID NO: 670456 - RNA, 64 nt, Homo Sapiens; identical to SEQ ID NO: 189716

SEQ ID NO: 670457 - RNA, 64 nt, Homo Sapiens; identical to SEQ ID NO: 189717

SEQ ID NO: 670458 - RNA, 64 nt, Homo Sapiens; identical to SEQ ID NO: 189718

SEQ ID NO: 670459 - RNA, 64 nt, Homo Sapiens; identical to SEQ ID NO: 189719

SEQ ID NO: 670460 - RNA, 64 nt, Homo Sapiens; identical to SEQ ID NO: 189720

SEQ ID NO: 670461 - RNA, 64 nt, Homo Sapiens; identical to SEQ ID NO: 189721

SEQ ID NO: 670462 - RNA, 64 nt, Homo Sapiens; identical to SEQ ID NO: 189722

SEQ ID NO: 670463 - RNA, 64 nt, Homo Sapiens; identical to SEQ ID NO: 189723

SEQ ID NO: 670464 - RNA, 64 nt, Homo Sapiens; identical to SEQ ID NO: 189724

SEQ ID NO: 670465 - RNA, 64 nt, Homo Sapiens; identical to SEQ ID NO: 189725

SEQ ID NO: 670466 - RNA, 64 nt, Homo Sapiens; identical to SEQ ID NO: 189726

SEQ ID NO: 670467 - RNA, 64 nt, Homo Sapiens; identical to SEQ ID NO: 189727

SEQ ID NO: 670468 - RNA, 64 nt, Homo Sapiens; identical to SEQ ID NO: 189728

SEQ ID NO: 670469 - RNA, 64 nt, Homo Sapiens; identical to SEQ ID NO: 189729

SEQ ID NO: 670470 - RNA, 64 nt, Homo Sapiens; identical to SEQ ID NO: 189730

SEQ ID NO: 670471 - RNA, 64 nt, Homo Sapiens; identical to SEQ ID NO: 189731

SEQ ID NO: 670472 - RNA, 64 nt, Homo Sapiens; identical to SEQ ID NO: 189732

SEQ ID NO: 670473 - RNA, 64 nt, Homo Sapiens; identical to SEQ ID NO: 189733

SEQ ID NO: 670474 - RNA, 64 nt, Homo Sapiens; identical to SEQ ID NO: 189734

SEQ ID NO: 670475 - RNA, 64 nt, Homo Sapiens; identical to SEQ ID NO: 189735

SEQ ID NO: 670476 - RNA, 64 nt, Homo Sapiens; identical to SEQ ID NO: 189736

SEQ ID NO: 670477 - RNA, 64 nt, Homo Sapiens; identical to SEQ ID NO: 189737

SEQ ID NO: 670478 - RNA, 64 nt, Homo Sapiens; identical to SEQ ID NO: 189738

SEQ ID NO: 670479 - RNA, 60 nt, Homo Sapiens
uugguaaauggacaaaagcuagcuaguaaaaaggacgacccagcaacaugcuuuaacccc

SEQ ID NO: 670480 - RNA, 60 nt, Homo Sapiens
acccacccucauugcauuccgcuguagugaaaggacgagccauuucugggcacguggcag

SEQ ID NO: 670481 - RNA, 60 nt, Homo Sapiens
caucuuucguugccauucuucauuccuacaaaggacgaacuuggauuacaucaacuuugg

SEQ ID NO: 670482 - RNA, 60 nt, Homo Sapiens
ugaaaagcauuuggaaguuuaaagcugcagaaggacgaaacuuccagcucagcuccacac

SEQ ID NO: 670483 - RNA, 60 nt, Homo Sapiens
uugcacagugauauauuucuuuauaaagucaaggacgaauuaauuugaggugaaauucag

SEQ ID NO: 670484 - RNA, 60 nt, Homo Sapiens
agcacccuaccugugggugugguaucaaagaaggacgaaugaggagggcgcagggugggg

SEQ ID NO: 670485 - RNA, 60 nt, Homo Sapiens
ucuacugaguacuuucugcaggggccuguuaaggacgaggccuccccagcccugcccggu

SEQ ID NO: 670486 - RNA, 60 nt, Homo Sapiens
gagccucucuccccaccccaaguuaggaagaaggacgagaccuagcucaaggauuugcaa

SEQ ID NO: 670487 - RNA, 60 nt, Homo Sapiens
ucuccuuuaucgugaccagugugcuugacaaaggacgauucugcuggaaggaguaauucu

SEQ ID NO: 670488 - RNA, 60 nt, Homo Sapiens
auuuaucuuguugauuucuuacaaaagaaaaaggacgaugucagucaagcagcacuuuuu

SEQ ID NO: 670489 - RNA, 60 nt, Homo Sapiens
ucgcccacccuggcaaggacagcugcggccaaggacgaaagcccucccuuggcuggccuc

SEQ ID NO: 670490 - RNA, 60 nt, Homo Sapiens
gaggaaaggacagugugcuugguuagaguaaaggacgaggucauuagccauauuguauau

SEQ ID NO: 670491 - RNA, 60 nt, Homo Sapiens
aaguguaagucccgcugauuagguagagaaaaggacgaaguuucuuuuaagggggaaaca

SEQ ID NO: 670492 - RNA, 60 nt, Homo Sapiens
aaacccuccaauuuucccaaaaaaaaaacuaaggacgaaaaccauauccuguaauuuaau

SEQ ID NO: 670493 - RNA, 60 nt, Homo Sapiens
ugcuguuggcaauugcagcuaggccaucagaaggacgaggucagggacuggcagagcaag

SEQ ID NO: 670494 - RNA, 60 nt, Homo Sapiens
aagccguggggcagccucuuaugaagaaagaaggacgaggcugcugggacuagauagugg

SEQ ID NO: 670495 - RNA, 60 nt, Homo Sapiens
accauauguugugucuaaucuccuucugagaaggacgaaaaacuuucuuccaagugaaga

SEQ ID NO: 670496 - RNA, 60 nt, Homo Sapiens
gcauggagaguggcaucuucuuugcauccuaaggacgaaaaacacagugcacucagagcu

SEQ ID NO: 670497 - RNA, 60 nt, Homo Sapiens
agauuaagaaaaagcaagauaauuuugaagaaggacgagaggaagaggcaugaacuuguc

SEQ ID NO: 670498 - RNA, 60 nt, Homo Sapiens
uaucauuguugacuuguucuuccuuaggagaaggacgauuuucacccacccuuucuguuc

SEQ ID NO: 670499 - RNA, 60 nt, Homo Sapiens
gcucgugauugcuuccugugaacgccucccaaggacgagcccaguguaguuguguggcgu

SEQ ID NO: 670500 - RNA, 60 nt, Homo Sapiens
ugugacucucucucuaaugcugcucucgggaaggacgaaagugaccugcaaggagagaaa

SEQ ID NO: 670501 - RNA, 60 nt, Homo Sapiens
cacaaagauggucugagaaagugaauuuauaaggacgaauuuaccccgauuuaggacaaa

SEQ ID NO: 670502 - RNA, 60 nt, Homo Sapiens
aaagguucuugaacaccacugugauucuccaaggacgaauuacguaaauuauacuuucau

SEQ ID NO: 670503 - RNA, 60 nt, Homo Sapiens
aggauugcuccagggcugcuccuccugcccaaggacgacgguggccucugcuuccuccgu

SEQ ID NO: 670504 - RNA, 60 nt, Homo Sapiens
ucucacagacccuucagcaauggcuacuagaaggacgaacaauugcccuccuuuggaagu

SEQ ID NO: 670505 - RNA, 60 nt, Homo Sapiens
ugucauugugacaaagucaaauaaacccccaaggacgacacacaguauggaucacauauu

SEQ ID NO: 670506 - RNA, 60 nt, Homo Sapiens
aaagaauuggacugaugggugacuuccauaaaggacgacaaguggcugcaacagagaaaa

SEQ ID NO: 670507 - RNA, 60 nt, Homo Sapiens
uacuugaccuuuucuucccuggcuacagcaaaggacgaugaucugccugcuuucacugug

SEQ ID NO: 670508 - RNA, 60 nt, Homo Sapiens
agcuuaagauaaguaagcagagacaguguuaaggacgaguuggugucugugguagcuuuu

SEQ ID NO: 670509 - RNA, 60 nt, Homo Sapiens
auccaagggcaagacuuggugcccagcuggaaggacgaaagcacacuuugugaccgccau

SEQ ID NO: 670510 - RNA, 60 nt, Homo Sapiens
agcuucuuacauauucuagaugacugauucaaggacgaaugauuggccggcagggugaua

SEQ ID NO: 670511 - RNA, 60 nt, Homo Sapiens
aacuaccugcaguggugaugugggcccagaaaggacgauggccguguggcccugggaccc

SEQ ID NO: 670512 - RNA, 60 nt, Homo Sapiens
aaggccuguguugagaaagaugucaugcaaaaggacgacgguggccaacuaaagcaaguc

SEQ ID NO: 670513 - RNA, 60 nt, Homo Sapiens
uucuguucuacacccuccagggaccgcgacaaggacgacagagacgcaacugcaggcuga

SEQ ID NO: 670514 - RNA, 60 nt, Homo Sapiens
auagaaaauagaacuuuuauuuugugaccuaaggacgauggugaaaagaucacguuuuca

SEQ ID NO: 670515 - RNA, 60 nt, Homo Sapiens
auuuucuauuguuuccaggcggauaugcuaaaggacgaagaacucuuguuuucuagucca

SEQ ID NO: 670516 - RNA, 60 nt, Homo Sapiens
cagggucaaccugccuaccacaggcacuagaaggacgaaucugccuacugcccaugaacg

SEQ ID NO: 670517 - RNA, 60 nt, Homo Sapiens
uccuccagcaagcucgcaagggugcagcguaaggacgaacgaugagagacagcgcaugcu

SEQ ID NO: 670518 - RNA, 60 nt, Homo Sapiens
ucagcugagugcaggugggguucgaggggaaaggacgauggggcaugaccucagucaggc

SEQ ID NO: 670519 - RNA, 60 nt, Homo Sapiens
ccuacaggggcaagggccgcacgggaaccuaaggacgaagcccuucugauuaccuucaug

SEQ ID NO: 670520 - RNA, 60 nt, Homo Sapiens
gaaugagggacuucuccuccaguggaccugaaggacgagggaugggauuucauguaacca

SEQ ID NO: 670521 - RNA, 60 nt, Homo Sapiens
ucccuaaauguaaagccaucuguccggcguaaggacgacaccgucagcuguccgacucgc

SEQ ID NO: 670522 - RNA, 60 nt, Homo Sapiens
aaaaucaaccaacacaagaucaaaaaggaaaaggacgagagaaaaauuauuuuuaagaua

SEQ ID NO: 670523 - RNA, 60 nt, Homo Sapiens
cuuccucuugaacagugugcgugugcugcgaaggacgagagugcgggggcgauucaaccu

SEQ ID NO: 670524 - RNA, 60 nt, Homo Sapiens
gugaggggagguggggccagucagcagcccaaggacgauggccuccagccugagccuagc

SEQ ID NO: 670525 - RNA, 60 nt, Homo Sapiens
ucauggggacaauuuggauucauaaugucaaaggacgaaaacuaagauaaccaagaugaa

SEQ ID NO: 670526 - RNA, 59 nt, Homo Sapiens
ugcacggggcacugcccugagcucuggguaaggacgagaagagccaagguccgccuacu

SEQ ID NO: 670527 - RNA, 64 nt, Homo Sapiens
uucucuuguguuuuguuugaaugugcaauaguuuauaggccacaaauaagcuuucuuguaagcu

SEQ ID NO: 670528 - RNA, 64 nt, Homo Sapiens
aagacaaaauaguguuauagccuucauucucugaauaggccaucuuugacucauaaaauuaccc

SEQ ID NO: 670529 - RNA, 64 nt, Homo Sapiens
cuggagaaauaaacgcauucauguaggaguuaaaauaggccaaaauuguauuggcuguucaugu

SEQ ID NO: 670530 - RNA, 64 nt, Homo Sapiens
aaaaugcugcgcauacccaggaugggcuuucccaauaggccaaacagucuucaggacaccauua

SEQ ID NO: 670531 - RNA, 64 nt, Homo Sapiens
guuuuguaauguaguacauuauguacagauaguuauaggccacuuuccuuaaggugcacaguaa

SEQ ID NO: 670532 - RNA, 64 nt, Homo Sapiens
uucuagagauguuuauagagagcugguucauaacauaggccaaaauuuuuguuuuucuuaaguc

SEQ ID NO: 670533 - RNA, 64 nt, Homo Sapiens; identical to SEQ ID NO: 238457

SEQ ID NO: 670534 - RNA, 64 nt, Homo Sapiens; identical to SEQ ID NO: 238458

SEQ ID NO: 670535 - RNA, 64 nt, Homo Sapiens; identical to SEQ ID NO: 238459

SEQ ID NO: 670536 - RNA, 64 nt, Homo Sapiens; identical to SEQ ID NO: 238460

SEQ ID NO: 670537 - RNA, 64 nt, Homo Sapiens; identical to SEQ ID NO: 392567

SEQ ID NO: 670538 - RNA, 64 nt, Homo Sapiens; identical to SEQ ID NO: 392568

SEQ ID NO: 670539 - RNA, 64 nt, Homo Sapiens; identical to SEQ ID NO: 392569

SEQ ID NO: 670540 - RNA, 64 nt, Homo Sapiens; identical to SEQ ID NO: 392570

SEQ ID NO: 670541 - RNA, 64 nt, Homo Sapiens; identical to SEQ ID NO: 392571

SEQ ID NO: 670542 - RNA, 64 nt, Homo Sapiens; identical to SEQ ID NO: 392572

SEQ ID NO: 670543 - RNA, 64 nt, Homo Sapiens; identical to SEQ ID NO: 392573

SEQ ID NO: 670544 - RNA, 64 nt, Homo Sapiens; identical to SEQ ID NO: 392574

SEQ ID NO: 670545 - RNA, 64 nt, Homo Sapiens; identical to SEQ ID NO: 392575

SEQ ID NO: 670546 - RNA, 64 nt, Homo Sapiens; identical to SEQ ID NO: 392576

SEQ ID NO: 670547 - RNA, 64 nt, Homo Sapiens; identical to SEQ ID NO: 392577

SEQ ID NO: 670548 - RNA, 64 nt, Homo Sapiens; identical to SEQ ID NO: 392578

SEQ ID NO: 670549 - RNA, 64 nt, Homo Sapiens; identical to SEQ ID NO: 392579

SEQ ID NO: 670550 - RNA, 64 nt, Homo Sapiens; identical to SEQ ID NO: 392580

SEQ ID NO: 670551 - RNA, 64 nt, Homo Sapiens; identical to SEQ ID NO: 392581

SEQ ID NO: 670552 - RNA, 64 nt, Homo Sapiens; identical to SEQ ID NO: 392582

SEQ ID NO: 670553 - RNA, 64 nt, Homo Sapiens; identical to SEQ ID NO: 392583

SEQ ID NO: 670554 - RNA, 64 nt, Homo Sapiens; identical to SEQ ID NO: 392584

SEQ ID NO: 670555 - RNA, 64 nt, Homo Sapiens; identical to SEQ ID NO: 392585

SEQ ID NO: 670556 - RNA, 64 nt, Homo Sapiens; identical to SEQ ID NO: 392586

SEQ ID NO: 670557 - RNA, 64 nt, Homo Sapiens; identical to SEQ ID NO: 392587

SEQ ID NO: 670558 - RNA, 64 nt, Homo Sapiens; identical to SEQ ID NO: 392588

SEQ ID NO: 670559 - RNA, 61 nt, Homo Sapiens
cauaauaacgagaagaauucuuuauuuauaaagcacauauuauggaguaaccgacaauaua

SEQ ID NO: 670560 - RNA, 61 nt, Homo Sapiens
ggauguggaugugauaggugggcaugagaaaagcacauaaucaagcaccaugaucccuagg

SEQ ID NO: 670561 - RNA, 61 nt, Homo Sapiens
auuuugugucuaauaacaaucaccaaaguacagcacauaccaaacugauggaaauaauagu

SEQ ID NO: 670562 - RNA, 61 nt, Homo Sapiens
aaaaagggaacaucagggucggcacggaauaagcacauaguucagggaaacauuggcuggg

SEQ ID NO: 670563 - RNA, 61 nt, Homo Sapiens
acagguucuggaauucucauacuuguuacacagcacauaccgagacagcaaguccacccua

SEQ ID NO: 670564 - RNA, 61 nt, Homo Sapiens
cugcuuuucugucaacaucccaguuccucuaagcacauacuuaacagcuguucccacccac

SEQ ID NO: 670565 - RNA, 61 nt, Homo Sapiens
cuaaauaugagacaggguaauugccagaugcagcacauauauaggcuucugaugaucauug

SEQ ID NO: 670566 - RNA, 61 nt, Homo Sapiens
cagaggcugcaggaacuuguaggucccugugagcacauaagugucacagcuggccugcagc

SEQ ID NO: 670567 - RNA, 61 nt, Homo Sapiens
uucuucccaauuuaguaacuuagaugcuuccagcacauacguagguagcuaccccagccgg

SEQ ID NO: 670568 - RNA, 61 nt, Homo Sapiens
aaaccaucguuaauauacugaagugagcuauagcacauaucaugugcuuaguuuguuuauu

SEQ ID NO: 670569 - RNA, 61 nt, Homo Sapiens
ugagcucacuuugauuuuuaaucccaccacaagcacauacuaauuuuauuuaugauucaaa

SEQ ID NO: 670570 - RNA, 61 nt, Homo Sapiens
caggcuuucuaccucgacucucaccacagccagcacauacaccuaggcuguuuuuccuucc

SEQ ID NO: 670571 - RNA, 64 nt, Homo Sapiens
ggagaugugccuucccaauaacucuuuuuuuuuuuccuuucagaacauuuuccagauggcgagg

SEQ ID NO: 670572 - RNA, 64 nt, Homo Sapiens
uccccuucccuucccuucacccccauccucuuacuccuuucaugucccauuucagacagaguaa

SEQ ID NO: 670573 - RNA, 64 nt, Homo Sapiens
aauaagcccaaccaacuugccaaagguaucuuuguccuuucaccugggccucauaccaacagcc

SEQ ID NO: 670574 - RNA, 64 nt, Homo Sapiens
cuacauauuuuaguauaaaucacuaagacauauuuccuuucacuuggcaggauuccuuucaaaa

SEQ ID NO: 670575 - RNA, 64 nt, Homo Sapiens
ucacuaagacauauuuccuuucacuuggcaggauuccuuucaaaauggaaucugaguauuagac

SEQ ID NO: 670576 - RNA, 64 nt, Homo Sapiens
aauagcauuagcaguuauaauucuguuuauaauuuccuuucagcauuuacagugaaaagugaga

SEQ ID NO: 670577 - RNA, 64 nt, Homo Sapiens
guagacauuucauauccagcuuccuugcuuagucuccuuucaguauuuggcaauaaaagaaaga

SEQ ID NO: 670578 - RNA, 64 nt, Homo Sapiens
aucucuuuucuauacugcuccuuucugaugcuuauccuuucaucugugugauuguuuuuucccc

SEQ ID NO: 670579 - RNA, 64 nt, Homo Sapiens
ccugccugacugccaagccaucaacacacacagcuccuuucacucccuagacucugugucacuc

SEQ ID NO: 670580 - RNA, 64 nt, Homo Sapiens
acagaagggagacaucucauaaguucugugugccuccuuucagcggaccccaaaaaaccagaac

SEQ ID NO: 670581 - RNA, 64 nt, Homo Sapiens
accuuuuuuaugcuuauuuuugucaaacauguacuccuuucauacggguggcuuuuacaaggca

SEQ ID NO: 670582 - RNA, 64 nt, Homo Sapiens
uagggcuuaauaagcagccguuugcuaaugugcuuccuuucaaaggguuggaccuuuaaauugc

SEQ ID NO: 670583 - RNA, 64 nt, Homo Sapiens
ucucaucucucuuucuucucuugcccauuuuaaauccuuucaucgugggaaaccucaaagaugg

SEQ ID NO: 670584 - RNA, 64 nt, Homo Sapiens
cugugcucugcccuccccggugcagggacucagcuccuuucauccagguugguucacacaguga

SEQ ID NO: 670585 - RNA, 64 nt, Homo Sapiens
cccaaaguuaggccuccuauaauguccaaaacauuccuuucagccuuuuuauuucuuacuguac

SEQ ID NO: 670586 - RNA, 64 nt, Homo Sapiens
uggauauuguauuacccuggguauuaaaaagaacuccuuucacauuuuaaaauaacaaucugag

SEQ ID NO: 670587 - RNA, 64 nt, Homo Sapiens
gccguucucaugcaaaauaccugugucagaauacuccuuucauccaucacucagccagagucuu

SEQ ID NO: 670588 - RNA, 64 nt, Homo Sapiens
uuuguucuguucugcugccuuuuacguuuucuuguccuuucaaaaguguucuugaaagaaacaa

SEQ ID NO: 670589 - RNA, 64 nt, Homo Sapiens
gaaaaacuugcaauagagggugugguguugacuguccuuucaagcaacauccucugauucuagg

SEQ ID NO: 670590 - RNA, 64 nt, Homo Sapiens
caauuccaccuccuuccugagaagcugcucaauuuccuuucauuagcugagcaguguguuaugg

SEQ ID NO: 670591 - RNA, 64 nt, Homo Sapiens
uuucuauaaacacuauaagugauaguuucccccauccuuucauugacauuauuugccaaugcug

SEQ ID NO: 670592 - RNA, 64 nt, Homo Sapiens
auuuauugguuuuuuuuuaaccaucuguguacauuccuuucauaggguagaguucuaguucuag

SEQ ID NO: 670593 - RNA, 64 nt, Homo Sapiens
uguucuucuucccuagcauccuccuccccacaucuccuuucacccucuuggcuucuuauccugu

SEQ ID NO: 670594 - RNA, 64 nt, Homo Sapiens
ucuuauucuguggagaagaagggcgggaagaacuuccuuucaggaggaagcuggaacuuacuga

SEQ ID NO: 670595 - RNA, 64 nt, Homo Sapiens
ggcugucuuguucauuccauccuacauuucugacuccuuucagacucaacacaguucccuucuu

SEQ ID NO: 670596 - RNA, 64 nt, Homo Sapiens
aaaauucaagguccuccucuacucagcucccaucuccuuucagaucaggcuaaccuuugagauc

SEQ ID NO: 670597 - RNA, 64 nt, Homo Sapiens
gcuuuauuugaauggacaguugguuucaaaucucuccuuucaggcuccacccguucugccucag

SEQ ID NO: 670598 - RNA, 64 nt, Homo Sapiens
accuuggccucuaaggcuucagcccuccaguagauccuuucacgcucugcucccgcccggcacc

SEQ ID NO: 670599 - RNA, 64 nt, Homo Sapiens
gacaggacugcugcuccugguugaccaggacaaauccuuucagucaaacccauuuauuacuggc

SEQ ID NO: 670600 - RNA, 64 nt, Homo Sapiens
agcagcgcggauuucucuuucucucucacucucuuccuuucauucuaguauucuuuauuauuuu

SEQ ID NO: 670601 - RNA, 64 nt, Homo Sapiens
ccccuuuuucuuucccuucuuuuucccuuuccuuuccuuucauuuucuuuccuuuccccuuccc

SEQ ID NO: 670602 - RNA, 64 nt, Homo Sapiens
guuauaacacauuggcagaccacuuuucaccuacuccuuucauguauccaaauaauuuaaaaaa

SEQ ID NO: 670603 - RNA, 64 nt, Homo Sapiens
uuuucaauaaugagguaaucugauuuucagcuaguccuuucacaagacauaaaggagggugaug

SEQ ID NO: 670604 - RNA, 64 nt, Homo Sapiens
uucagaagagcuuuuuacuaauuuauuugucaguguucccuauuuguuacuuaaccaugauccu

SEQ ID NO: 670605 - RNA, 64 nt, Homo Sapiens
uguauuuuuguauuuuaaaagcuucuucacuuguguucccuaaauauucauauugcugcccaaa

SEQ ID NO: 670606 - RNA, 64 nt, Homo Sapiens
uucuguaauucauucaguggugccaaagcuggggguucccuacaauggcuauuuagacuuuccc

SEQ ID NO: 670607 - RNA, 64 nt, Homo Sapiens
uccuaaacauuaccauuuauguggcagaaguucuguucccuauaaucugcaaugcugaaguauc

SEQ ID NO: 670608 - RNA, 64 nt, Homo Sapiens
aggcugauucaaucaagaucauguagaccuaaaacuacaccaaugguugauucaaucaagaugu

SEQ ID NO: 670609 - RNA, 64 nt, Homo Sapiens
agguugauucaaucaagauggauagaccaaaaaacuacaccaguaacugacaacacuacuuacu

SEQ ID NO: 670610 - RNA, 64 nt, Homo Sapiens; identical to SEQ ID NO: 88331

SEQ ID NO: 670611 - RNA, 64 nt, Homo Sapiens; identical to SEQ ID NO: 88332

SEQ ID NO: 670612 - RNA, 64 nt, Homo Sapiens; identical to SEQ ID NO: 88333

SEQ ID NO: 670613 - RNA, 64 nt, Homo Sapiens; identical to SEQ ID NO: 88334

SEQ ID NO: 670614 - RNA, 64 nt, Homo Sapiens; identical to SEQ ID NO: 88335

SEQ ID NO: 670615 - RNA, 64 nt, Homo Sapiens; identical to SEQ ID NO: 88336

SEQ ID NO: 670616 - RNA, 64 nt, Homo Sapiens; identical to SEQ ID NO: 88337

SEQ ID NO: 670617 - RNA, 64 nt, Homo Sapiens; identical to SEQ ID NO: 88338

SEQ ID NO: 670618 - RNA, 64 nt, Homo Sapiens; identical to SEQ ID NO: 573683

SEQ ID NO: 670619 - RNA, 64 nt, Homo Sapiens; identical to SEQ ID NO: 573684

SEQ ID NO: 670620 - RNA, 64 nt, Homo Sapiens; identical to SEQ ID NO: 573685

SEQ ID NO: 670621 - RNA, 64 nt, Homo Sapiens; identical to SEQ ID NO: 573686

SEQ ID NO: 670622 - RNA, 64 nt, Homo Sapiens; identical to SEQ ID NO: 573687

SEQ ID NO: 670623 - RNA, 64 nt, Homo Sapiens; identical to SEQ ID NO: 573688

SEQ ID NO: 670624 - RNA, 64 nt, Homo Sapiens; identical to SEQ ID NO: 573689

SEQ ID NO: 670625 - RNA, 64 nt, Homo Sapiens; identical to SEQ ID NO: 573690

SEQ ID NO: 670626 - RNA, 64 nt, Homo Sapiens; identical to SEQ ID NO: 573691

SEQ ID NO: 670627 - RNA, 64 nt, Homo Sapiens; identical to SEQ ID NO: 573692

SEQ ID NO: 670628 - RNA, 64 nt, Homo Sapiens; identical to SEQ ID NO: 573693

SEQ ID NO: 670629 - RNA, 64 nt, Homo Sapiens; identical to SEQ ID NO: 573694

SEQ ID NO: 670630 - RNA, 64 nt, Homo Sapiens; identical to SEQ ID NO: 573695

SEQ ID NO: 670631 - RNA, 64 nt, Homo Sapiens; identical to SEQ ID NO: 573696

SEQ ID NO: 670632 - RNA, 64 nt, Homo Sapiens; identical to SEQ ID NO: 573697

SEQ ID NO: 670633 - RNA, 64 nt, Homo Sapiens; identical to SEQ ID NO: 573698

SEQ ID NO: 670634 - RNA, 64 nt, Homo Sapiens; identical to SEQ ID NO: 573699

SEQ ID NO: 670635 - RNA, 64 nt, Homo Sapiens; identical to SEQ ID NO: 573700

SEQ ID NO: 670636 - RNA, 64 nt, Homo Sapiens; identical to SEQ ID NO: 573701

SEQ ID NO: 670637 - RNA, 64 nt, Homo Sapiens; identical to SEQ ID NO: 573702

SEQ ID NO: 670638 - RNA, 64 nt, Homo Sapiens; identical to SEQ ID NO: 573703

SEQ ID NO: 670639 - RNA, 64 nt, Homo Sapiens; identical to SEQ ID NO: 573704

SEQ ID NO: 670640 - RNA, 64 nt, Homo Sapiens; identical to SEQ ID NO: 573705

SEQ ID NO: 670641 - RNA, 64 nt, Homo Sapiens; identical to SEQ ID NO: 573706

SEQ ID NO: 670642 - RNA, 64 nt, Homo Sapiens; identical to SEQ ID NO: 573707

SEQ ID NO: 670643 - RNA, 64 nt, Homo Sapiens; identical to SEQ ID NO: 573708

SEQ ID NO: 670644 - RNA, 64 nt, Homo Sapiens; identical to SEQ ID NO: 573709

SEQ ID NO: 670645 - RNA, 64 nt, Homo Sapiens; identical to SEQ ID NO: 573710

SEQ ID NO: 670646 - RNA, 64 nt, Homo Sapiens; identical to SEQ ID NO: 573711

SEQ ID NO: 670647 - RNA, 64 nt, Homo Sapiens; identical to SEQ ID NO: 573712

SEQ ID NO: 670648 - RNA, 64 nt, Homo Sapiens; identical to SEQ ID NO: 573713

SEQ ID NO: 670649 - RNA, 64 nt, Homo Sapiens; identical to SEQ ID NO: 573714

SEQ ID NO: 670650 - RNA, 64 nt, Homo Sapiens; identical to SEQ ID NO: 573715

SEQ ID NO: 670651 - RNA, 64 nt, Homo Sapiens; identical to SEQ ID NO: 573716

SEQ ID NO: 670652 - RNA, 64 nt, Homo Sapiens; identical to SEQ ID NO: 573717

SEQ ID NO: 670653 - RNA, 64 nt, Homo Sapiens; identical to SEQ ID NO: 573718

SEQ ID NO: 670654 - RNA, 64 nt, Homo Sapiens; identical to SEQ ID NO: 573719

SEQ ID NO: 670655 - RNA, 64 nt, Homo Sapiens; identical to SEQ ID NO: 573720

SEQ ID NO: 670656 - RNA, 64 nt, Homo Sapiens; identical to SEQ ID NO: 573721

SEQ ID NO: 670657 - RNA, 64 nt, Homo Sapiens; identical to SEQ ID NO: 573722

SEQ ID NO: 670658 - RNA, 63 nt, Homo Sapiens; identical to SEQ ID NO: 573723

SEQ ID NO: 670659 - RNA, 64 nt, Homo Sapiens; identical to SEQ ID NO: 573724

SEQ ID NO: 670660 - RNA, 64 nt, Homo Sapiens; identical to SEQ ID NO: 573725

SEQ ID NO: 670661 - RNA, 64 nt, Homo Sapiens; identical to SEQ ID NO: 573726

SEQ ID NO: 670662 - RNA, 64 nt, Homo Sapiens; identical to SEQ ID NO: 573727

SEQ ID NO: 670663 - RNA, 64 nt, Homo Sapiens; identical to SEQ ID NO: 573728

SEQ ID NO: 670664 - RNA, 64 nt, Homo Sapiens; identical to SEQ ID NO: 573729

SEQ ID NO: 670665 - RNA, 64 nt, Homo Sapiens; identical to SEQ ID NO: 573730

SEQ ID NO: 670666 - RNA, 64 nt, Homo Sapiens; identical to SEQ ID NO: 573731

SEQ ID NO: 670667 - RNA, 64 nt, Homo Sapiens; identical to SEQ ID NO: 573732

SEQ ID NO: 670668 - RNA, 64 nt, Homo Sapiens; identical to SEQ ID NO: 573733

SEQ ID NO: 670669 - RNA, 64 nt, Homo Sapiens; identical to SEQ ID NO: 573734

SEQ ID NO: 670670 - RNA, 64 nt, Homo Sapiens; identical to SEQ ID NO: 573735

SEQ ID NO: 670671 - RNA, 64 nt, Homo Sapiens; identical to SEQ ID NO: 573736

SEQ ID NO: 670672 - RNA, 64 nt, Homo Sapiens; identical to SEQ ID NO: 573737

SEQ ID NO: 670673 - RNA, 64 nt, Homo Sapiens; identical to SEQ ID NO: 573738

SEQ ID NO: 670674 - RNA, 64 nt, Homo Sapiens; identical to SEQ ID NO: 573739

SEQ ID NO: 670675 - RNA, 64 nt, Homo Sapiens; identical to SEQ ID NO: 573740

SEQ ID NO: 670676 - RNA, 64 nt, Homo Sapiens; identical to SEQ ID NO: 573741

SEQ ID NO: 670677 - RNA, 64 nt, Homo Sapiens; identical to SEQ ID NO: 573742

SEQ ID NO: 670678 - RNA, 64 nt, Homo Sapiens; identical to SEQ ID NO: 573743

SEQ ID NO: 670679 - RNA, 64 nt, Homo Sapiens; identical to SEQ ID NO: 573744

SEQ ID NO: 670680 - RNA, 64 nt, Homo Sapiens; identical to SEQ ID NO: 573745

SEQ ID NO: 670681 - RNA, 64 nt, Homo Sapiens; identical to SEQ ID NO: 573746

SEQ ID NO: 670682 - RNA, 64 nt, Homo Sapiens; identical to SEQ ID NO: 573747

SEQ ID NO: 670683 - RNA, 64 nt, Homo Sapiens; identical to SEQ ID NO: 573748

SEQ ID NO: 670684 - RNA, 64 nt, Homo Sapiens; identical to SEQ ID NO: 573749

SEQ ID NO: 670685 - RNA, 64 nt, Homo Sapiens; identical to SEQ ID NO: 573750

SEQ ID NO: 670686 - RNA, 64 nt, Homo Sapiens; identical to SEQ ID NO: 573751

SEQ ID NO: 670687 - RNA, 64 nt, Homo Sapiens; identical to SEQ ID NO: 573752

SEQ ID NO: 670688 - RNA, 64 nt, Homo Sapiens; identical to SEQ ID NO: 573753

SEQ ID NO: 670689 - RNA, 64 nt, Homo Sapiens; identical to SEQ ID NO: 573754

SEQ ID NO: 670690 - RNA, 64 nt, Homo Sapiens; identical to SEQ ID NO: 573755

SEQ ID NO: 670691 - RNA, 64 nt, Homo Sapiens; identical to SEQ ID NO: 573756

SEQ ID NO: 670692 - RNA, 64 nt, Homo Sapiens; identical to SEQ ID NO: 573757

SEQ ID NO: 670693 - RNA, 64 nt, Homo Sapiens; identical to SEQ ID NO: 573758

SEQ ID NO: 670694 - RNA, 64 nt, Homo Sapiens; identical to SEQ ID NO: 573759

SEQ ID NO: 670695 - RNA, 64 nt, Homo Sapiens; identical to SEQ ID NO: 573760

SEQ ID NO: 670696 - RNA, 64 nt, Homo Sapiens; identical to SEQ ID NO: 573761

SEQ ID NO: 670697 - RNA, 64 nt, Homo Sapiens; identical to SEQ ID NO: 573762

SEQ ID NO: 670698 - RNA, 64 nt, Homo Sapiens; identical to SEQ ID NO: 573763

SEQ ID NO: 670699 - RNA, 64 nt, Homo Sapiens; identical to SEQ ID NO: 573764

SEQ ID NO: 670700 - RNA, 64 nt, Homo Sapiens; identical to SEQ ID NO: 573765

SEQ ID NO: 670701 - RNA, 64 nt, Homo Sapiens; identical to SEQ ID NO: 573766

SEQ ID NO: 670702 - RNA, 64 nt, Homo Sapiens; identical to SEQ ID NO: 573767

SEQ ID NO: 670703 - RNA, 62 nt, Homo Sapiens
ccagccucagaacugaaggacaaguaaucauuaacccccagaaugaagugauccuuaacccc

SEQ ID NO: 670704 - RNA, 62 nt, Homo Sapiens
uaaucauuaacccccagaccgaagugauccuuaacccccaagagauccccugaggacuugau

SEQ ID NO: 670705 - RNA, 62 nt, Homo Sapiens
acaguuuuguuuguuauacucuuugcaccuuaaacccccaccacuccccgacacuauugccu

SEQ ID NO: 670706 - RNA, 62 nt, Homo Sapiens
ugggcuguaggcaggguccuccauggguuuccaacccccaucacuggcaccaggaucuccca

SEQ ID NO: 670707 - RNA, 62 nt, Homo Sapiens
acuuguuggugcuaccccuuacuccccucugcaacccccauuuugggaguugaccccagcaa

SEQ ID NO: 670708 - RNA, 62 nt, Homo Sapiens
gauaugcuggugauucccaaauacauagcuccaacccccaacuucccccagacuuuagaucu

SEQ ID NO: 670709 - RNA, 62 nt, Homo Sapiens
ccuucaggaucagucaagggcucccuuacaguaacccccaccuaugaguagccuaccacccc

SEQ ID NO: 670710 - RNA, 62 nt, Homo Sapiens
ugaggaguugagagagugcacccccaaccccgaacccccagucuacugcaacuaacuguugc

SEQ ID NO: 670711 - RNA, 62 nt, Homo Sapiens
ugggucuaauccuucucauuagguagcugucuaacccccagccagacaaaacaauccccauc

SEQ ID NO: 670712 - RNA, 62 nt, Homo Sapiens
agacaucacccuuugccuuauuucggcagaggaacccccacccacaugccacugccugcacc

SEQ ID NO: 670713 - RNA, 62 nt, Homo Sapiens
uaccugcacccaggccucagaguuucagggcuaacccccagaauacugguaggggccaaggc

SEQ ID NO: 670714 - RNA, 62 nt, Homo Sapiens
gggguugaauaugcaaaagcaguuccgcugggaacccccauccaaucaacugcuguacccau

SEQ ID NO: 670715 - RNA, 62 nt, Homo Sapiens
ccugaagaaauucagauacaaaacaccaaaaaaacccccaaacucaaaaaaacaaaacaaaa

SEQ ID NO: 670716 - RNA, 62 nt, Homo Sapiens
accuggggauugggcagugucuccccucagucaacccccauaccugguuugcgggagauuuc

SEQ ID NO: 670717 - RNA, 62 nt, Homo Sapiens
ucuacuaaaaauaccaaaaaccaacauggugaaacccccaucggaguucaagaccagccugu

SEQ ID NO: 670718 - RNA, 62 nt, Homo Sapiens
ucccuagcccaccccccuccucacugugaaccaacccccaucguugugagacuucuguuuga

SEQ ID NO: 670719 - RNA, 62 nt, Homo Sapiens
accaauuucccagggacuccugaggcuuguacaacccccaccgggccuaggcagggcuggga

SEQ ID NO: 670720 - RNA, 62 nt, Homo Sapiens
ccguuucccuggugcccagaccucccaaugccaacccccaccugaggccaguauccuccagc

SEQ ID NO: 670721 - RNA, 62 nt, Homo Sapiens
gccuuguaugaagcccacccgcacccucaagaaacccccagucccaagucuuccuacccucu

SEQ ID NO: 670722 - RNA, 62 nt, Homo Sapiens
uacagaccccaugucacccauacucccauaauaacccccaaagaggccccauuauuaacaga

SEQ ID NO: 670723 - RNA, 62 nt, Homo Sapiens
ccuuccccaccuccagcaguaacucacccccaaacccccauccuccuccuccguccuauccc

SEQ ID NO: 670724 - RNA, 62 nt, Homo Sapiens
cccacgacucacuuccacacacuuuucuccccaacccccaaagacccccggcccggcccgga

SEQ ID NO: 670725 - RNA, 62 nt, Homo Sapiens
ccugggcuucggaggggggugcuugugccccuaacccccaugcucuugugccuucccccucu

SEQ ID NO: 670726 - RNA, 62 nt, Homo Sapiens
ugcuccuuuucugggcccuagcacagguggguaacccccacccaacccagcuccugcugcug

SEQ ID NO: 670727 - RNA, 62 nt, Homo Sapiens
gaagaaagccccagacgcuugguuuuucucagaacccccaaaagaugugcaauagcuguugu

SEQ ID NO: 670728 - RNA, 62 nt, Homo Sapiens
gacaguaagacaguaaacuauuuuaggaagucaacccccauugcacucuguggcaguuauuc

SEQ ID NO: 670729 - RNA, 64 nt, Homo Sapiens; identical to SEQ ID NO: 173443

SEQ ID NO: 670730 - RNA, 64 nt, Homo Sapiens; identical to SEQ ID NO: 173444

SEQ ID NO: 670731 - RNA, 64 nt, Homo Sapiens; identical to SEQ ID NO: 173445

SEQ ID NO: 670732 - RNA, 64 nt, Homo Sapiens; identical to SEQ ID NO: 173446

SEQ ID NO: 670733 - RNA, 62 nt, Homo Sapiens
aagagccuuaggucaguuuguaaaaacaaaaaauccaggaguagacuggcugggagaagguu

SEQ ID NO: 670734 - RNA, 62 nt, Homo Sapiens
uuuuugaugcuaauuagaaggcgugccugggaauccaggaacucucucagcuuuuucaggag

SEQ ID NO: 670735 - RNA, 62 nt, Homo Sapiens
acaagaugcuaguucccaugccuguugagaagauccaggagauggaaaccugacaaugcaaa

SEQ ID NO: 670736 - RNA, 56 nt, Homo Sapiens
aaaauuuggaggaaaaguggguucugauccaggaugcuuuuggcauucucuuccag

SEQ ID NO: 670737 - RNA, 62 nt, Homo Sapiens
gucuccuuccccacugcagaauauucaccauaauccaggagguucauuugauucagagcuaa

SEQ ID NO: 670738 - RNA, 62 nt, Homo Sapiens
ccauucuucaauguugcaugucucuaguacucauccaggaaaaaaauggauagaaacaaaau

SEQ ID NO: 670739 - RNA, 62 nt, Homo Sapiens
gcuaauuagaaaucaacuuguuuuccaggaagauccaggaggagcuuaaaaagagcucaggc

SEQ ID NO: 670740 - RNA, 62 nt, Homo Sapiens
gagaugcaaaugucacaguaacuccaucauucauccaggacuucucccacugcaacuuguga

SEQ ID NO: 670741 - RNA, 62 nt, Homo Sapiens
ucagugcccagggcgaggaauguggccaggggauccaggaccugggauccagggcccugggc

SEQ ID NO: 670742 - RNA, 62 nt, Homo Sapiens
cugccgcuacuucucuggggaauguggguuccauccaggauugggggccucucugcucaccc

SEQ ID NO: 670743 - RNA, 62 nt, Homo Sapiens
gggauugccuuuccccaggaucugugucggccauccaggaagaacuguacuggccaagccug

SEQ ID NO: 670744 - RNA, 62 nt, Homo Sapiens
aaaggaggccccugagccaugacaaggggcacauccaggauuuccgccacccugaauuuagu

SEQ ID NO: 670745 - RNA, 62 nt, Homo Sapiens
gaaccaacuuggaaaacacucugcaggauauuauccaggagaacuuccccaaucuagcaagg

SEQ ID NO: 670746 - RNA, 62 nt, Homo Sapiens
uuagaucaaugagacagaaaguuaacaaggauauccaggaauugaacacagcucugcaccaa

SEQ ID NO: 670747 - RNA, 62 nt, Homo Sapiens
gagacacaaaaaaaccuucaaaaaauuaauguauccaggagcugguuuuuugaaaggaucaa

SEQ ID NO: 670748 - RNA, 62 nt, Homo Sapiens
cugauagccaaguaaguuuuaaaaaccaaagcauccaggaugcacaccccugcaccauuugc

SEQ ID NO: 670749 - RNA, 62 nt, Homo Sapiens
guagccuugacuccuugagacuguagauuucgauccaggaaacauuuauuuagcaccugcca

SEQ ID NO: 670750 - RNA, 62 nt, Homo Sapiens
cauauuuccagcagcuggcauguugcaaccccauccaggagaccuccacggcuguguacgcc

SEQ ID NO: 670751 - RNA, 62 nt, Homo Sapiens
gagaggaaacaagcuucccaugccucgcuuagauccaggacagacccgcaggcccuuguuau

SEQ ID NO: 670752 - RNA, 62 nt, Homo Sapiens
guaggagaaggcaucugaguugccacaaugacauccaggaagccccaucgccagucgucuuc

SEQ ID NO: 670753 - RNA, 62 nt, Homo Sapiens
ugcccccaacuggccucccuuaccuaaaacagauccaggaccccuauucuuugggcuucagg

SEQ ID NO: 670754 - RNA, 64 nt, Homo Sapiens; identical to SEQ ID NO: 358062

SEQ ID NO: 670755 - RNA, 64 nt, Homo Sapiens; identical to SEQ ID NO: 358063

SEQ ID NO: 670756 - RNA, 64 nt, Homo Sapiens; identical to SEQ ID NO: 358064

SEQ ID NO: 670757 - RNA, 64 nt, Homo Sapiens; identical to SEQ ID NO: 358065

SEQ ID NO: 670758 - RNA, 64 nt, Homo Sapiens; identical to SEQ ID NO: 358066

SEQ ID NO: 670759 - RNA, 64 nt, Homo Sapiens; identical to SEQ ID NO: 358067

SEQ ID NO: 670760 - RNA, 64 nt, Homo Sapiens
agccaaagccgaaaauaguaauaagaagacuaucuaggacaaaaugaaauuuggggaaaaguga

SEQ ID NO: 670761 - RNA, 64 nt, Homo Sapiens
aaccuggaguuuugccucucuuggggauuauuuguaggacaaccauuguguucauaucauuuuc

SEQ ID NO: 670762 - RNA, 64 nt, Homo Sapiens
ucuaaaaauucauauucuucggacaagcaugaguuaggacaaacuuguuacuuucuuuuuaaua

SEQ ID NO: 670763 - RNA, 64 nt, Homo Sapiens
augaguuaggacaaacucuauacuuucuuuuuaauaggacaagcaacuuauaguaacacuuugu

SEQ ID NO: 670764 - RNA, 64 nt, Homo Sapiens; identical to SEQ ID NO: 126459

SEQ ID NO: 670765 - RNA, 64 nt, Homo Sapiens; identical to SEQ ID NO: 126460

SEQ ID NO: 670766 - RNA, 64 nt, Homo Sapiens; identical to SEQ ID NO: 126461

SEQ ID NO: 670767 - RNA, 64 nt, Homo Sapiens; identical to SEQ ID NO: 126462

SEQ ID NO: 670768 - RNA, 64 nt, Homo Sapiens; identical to SEQ ID NO: 126463

SEQ ID NO: 670769 - RNA, 64 nt, Homo Sapiens; identical to SEQ ID NO: 126464

SEQ ID NO: 670770 - RNA, 64 nt, Homo Sapiens; identical to SEQ ID NO: 126465

SEQ ID NO: 670771 - RNA, 60 nt, Homo Sapiens; identical to SEQ ID NO: 126466

SEQ ID NO: 670772 - RNA, 64 nt, Homo Sapiens; identical to SEQ ID NO: 126467

SEQ ID NO: 670773 - RNA, 64 nt, Homo Sapiens; identical to SEQ ID NO: 126468

SEQ ID NO: 670774 - RNA, 64 nt, Homo Sapiens; identical to SEQ ID NO: 126469

SEQ ID NO: 670775 - RNA, 64 nt, Homo Sapiens; identical to SEQ ID NO: 126470

SEQ ID NO: 670776 - RNA, 64 nt, Homo Sapiens; identical to SEQ ID NO: 126471

SEQ ID NO: 670777 - RNA, 64 nt, Homo Sapiens; identical to SEQ ID NO: 126472

SEQ ID NO: 670778 - RNA, 64 nt, Homo Sapiens; identical to SEQ ID NO: 126473

SEQ ID NO: 670779 - RNA, 64 nt, Homo Sapiens; identical to SEQ ID NO: 126474

SEQ ID NO: 670780 - RNA, 64 nt, Homo Sapiens; identical to SEQ ID NO: 126475

SEQ ID NO: 670781 - RNA, 64 nt, Homo Sapiens; identical to SEQ ID NO: 126476

SEQ ID NO: 670782 - RNA, 64 nt, Homo Sapiens; identical to SEQ ID NO: 126477

SEQ ID NO: 670783 - RNA, 64 nt, Homo Sapiens; identical to SEQ ID NO: 126478

SEQ ID NO: 670784 - RNA, 64 nt, Homo Sapiens; identical to SEQ ID NO: 126479

SEQ ID NO: 670785 - RNA, 64 nt, Homo Sapiens; identical to SEQ ID NO: 126480

SEQ ID NO: 670786 - RNA, 64 nt, Homo Sapiens; identical to SEQ ID NO: 126481

SEQ ID NO: 670787 - RNA, 64 nt, Homo Sapiens; identical to SEQ ID NO: 126482

SEQ ID NO: 670788 - RNA, 64 nt, Homo Sapiens; identical to SEQ ID NO: 126483

SEQ ID NO: 670789 - RNA, 64 nt, Homo Sapiens; identical to SEQ ID NO: 126484

SEQ ID NO: 670790 - RNA, 64 nt, Homo Sapiens; identical to SEQ ID NO: 126485

SEQ ID NO: 670791 - RNA, 64 nt, Homo Sapiens; identical to SEQ ID NO: 126486

SEQ ID NO: 670792 - RNA, 64 nt, Homo Sapiens; identical to SEQ ID NO: 126487

SEQ ID NO: 670793 - RNA, 64 nt, Homo Sapiens; identical to SEQ ID NO: 126488

SEQ ID NO: 670794 - RNA, 64 nt, Homo Sapiens; identical to SEQ ID NO: 126489

SEQ ID NO: 670795 - RNA, 64 nt, Homo Sapiens; identical to SEQ ID NO: 126490

SEQ ID NO: 670796 - RNA, 64 nt, Homo Sapiens; identical to SEQ ID NO: 126491

SEQ ID NO: 670797 - RNA, 64 nt, Homo Sapiens; identical to SEQ ID NO: 126492

SEQ ID NO: 670798 - RNA, 64 nt, Homo Sapiens; identical to SEQ ID NO: 126493

SEQ ID NO: 670799 - RNA, 64 nt, Homo Sapiens; identical to SEQ ID NO: 126494

SEQ ID NO: 670800 - RNA, 64 nt, Homo Sapiens; identical to SEQ ID NO: 126495

SEQ ID NO: 670801 - RNA, 64 nt, Homo Sapiens; identical to SEQ ID NO: 126496

SEQ ID NO: 670802 - RNA, 64 nt, Homo Sapiens; identical to SEQ ID NO: 126497

SEQ ID NO: 670803 - RNA, 64 nt, Homo Sapiens; identical to SEQ ID NO: 126498

SEQ ID NO: 670804 - RNA, 64 nt, Homo Sapiens; identical to SEQ ID NO: 126499

SEQ ID NO: 670805 - RNA, 64 nt, Homo Sapiens; identical to SEQ ID NO: 126500

SEQ ID NO: 670806 - RNA, 64 nt, Homo Sapiens; identical to SEQ ID NO: 126501

SEQ ID NO: 670807 - RNA, 56 nt, Homo Sapiens; identical to SEQ ID NO: 126502

SEQ ID NO: 670808 - RNA, 64 nt, Homo Sapiens; identical to SEQ ID NO: 126460

SEQ ID NO: 670809 - RNA, 64 nt, Homo Sapiens; identical to SEQ ID NO: 126504

SEQ ID NO: 670810 - RNA, 64 nt, Homo Sapiens; identical to SEQ ID NO: 126505

SEQ ID NO: 670811 - RNA, 64 nt, Homo Sapiens; identical to SEQ ID NO: 126506

SEQ ID NO: 670812 - RNA, 64 nt, Homo Sapiens; identical to SEQ ID NO: 126507

SEQ ID NO: 670813 - RNA, 64 nt, Homo Sapiens; identical to SEQ ID NO: 126508

SEQ ID NO: 670814 - RNA, 64 nt, Homo Sapiens; identical to SEQ ID NO: 126509

SEQ ID NO: 670815 - RNA, 64 nt, Homo Sapiens; identical to SEQ ID NO: 126510

SEQ ID NO: 670816 - RNA, 64 nt, Homo Sapiens; identical to SEQ ID NO: 126511

SEQ ID NO: 670817 - RNA, 64 nt, Homo Sapiens; identical to SEQ ID NO: 126512

SEQ ID NO: 670818 - RNA, 64 nt, Homo Sapiens; identical to SEQ ID NO: 126513

SEQ ID NO: 670819 - RNA, 64 nt, Homo Sapiens; identical to SEQ ID NO: 126514

SEQ ID NO: 670820 - RNA, 64 nt, Homo Sapiens; identical to SEQ ID NO: 126515

SEQ ID NO: 670821 - RNA, 64 nt, Homo Sapiens; identical to SEQ ID NO: 126516

SEQ ID NO: 670822 - RNA, 64 nt, Homo Sapiens; identical to SEQ ID NO: 126517

SEQ ID NO: 670823 - RNA, 64 nt, Homo Sapiens; identical to SEQ ID NO: 84890

SEQ ID NO: 670824 - RNA, 64 nt, Homo Sapiens; identical to SEQ ID NO: 84891

SEQ ID NO: 670825 - RNA, 64 nt, Homo Sapiens; identical to SEQ ID NO: 84892

SEQ ID NO: 670826 - RNA, 64 nt, Homo Sapiens; identical to SEQ ID NO: 84893

SEQ ID NO: 670827 - RNA, 64 nt, Homo Sapiens; identical to SEQ ID NO: 84894

SEQ ID NO: 670828 - RNA, 64 nt, Homo Sapiens; identical to SEQ ID NO: 84895

SEQ ID NO: 670829 - RNA, 64 nt, Homo Sapiens; identical to SEQ ID NO: 84896

SEQ ID NO: 670830 - RNA, 64 nt, Homo Sapiens; identical to SEQ ID NO: 84897

SEQ ID NO: 670831 - RNA, 64 nt, Homo Sapiens; identical to SEQ ID NO: 84898

SEQ ID NO: 670832 - RNA, 64 nt, Homo Sapiens; identical to SEQ ID NO: 84899

SEQ ID NO: 670833 - RNA, 64 nt, Homo Sapiens; identical to SEQ ID NO: 84900

SEQ ID NO: 670834 - RNA, 64 nt, Homo Sapiens; identical to SEQ ID NO: 84901

SEQ ID NO: 670835 - RNA, 64 nt, Homo Sapiens; identical to SEQ ID NO: 84902

SEQ ID NO: 670836 - RNA, 64 nt, Homo Sapiens; identical to SEQ ID NO: 84903

SEQ ID NO: 670837 - RNA, 64 nt, Homo Sapiens; identical to SEQ ID NO: 84904

SEQ ID NO: 670838 - RNA, 64 nt, Homo Sapiens; identical to SEQ ID NO: 84905

SEQ ID NO: 670839 - RNA, 52 nt, Homo Sapiens; identical to SEQ ID NO: 84906

SEQ ID NO: 670840 - RNA, 64 nt, Homo Sapiens; identical to SEQ ID NO: 84907

SEQ ID NO: 670841 - RNA, 64 nt, Homo Sapiens; identical to SEQ ID NO: 84908

SEQ ID NO: 670842 - RNA, 64 nt, Homo Sapiens; identical to SEQ ID NO: 84909

SEQ ID NO: 670843 - RNA, 64 nt, Homo Sapiens; identical to SEQ ID NO: 84910

SEQ ID NO: 670844 - RNA, 64 nt, Homo Sapiens; identical to SEQ ID NO: 84911

SEQ ID NO: 670845 - RNA, 64 nt, Homo Sapiens; identical to SEQ ID NO: 84912

SEQ ID NO: 670846 - RNA, 64 nt, Homo Sapiens; identical to SEQ ID NO: 84913

SEQ ID NO: 670847 - RNA, 64 nt, Homo Sapiens; identical to SEQ ID NO: 84914

SEQ ID NO: 670848 - RNA, 64 nt, Homo Sapiens; identical to SEQ ID NO: 84915

SEQ ID NO: 670849 - RNA, 64 nt, Homo Sapiens; identical to SEQ ID NO: 84916

SEQ ID NO: 670850 - RNA, 64 nt, Homo Sapiens; identical to SEQ ID NO: 84917

SEQ ID NO: 670851 - RNA, 64 nt, Homo Sapiens; identical to SEQ ID NO: 84918

SEQ ID NO: 670852 - RNA, 64 nt, Homo Sapiens; identical to SEQ ID NO: 84919

SEQ ID NO: 670853 - RNA, 64 nt, Homo Sapiens; identical to SEQ ID NO: 84920

SEQ ID NO: 670854 - RNA, 64 nt, Homo Sapiens; identical to SEQ ID NO: 84921

SEQ ID NO: 670855 - RNA, 64 nt, Homo Sapiens; identical to SEQ ID NO: 84922

SEQ ID NO: 670856 - RNA, 64 nt, Homo Sapiens; identical to SEQ ID NO: 84923

SEQ ID NO: 670857 - RNA, 64 nt, Homo Sapiens; identical to SEQ ID NO: 84924

SEQ ID NO: 670858 - RNA, 64 nt, Homo Sapiens; identical to SEQ ID NO: 84925

SEQ ID NO: 670859 - RNA, 64 nt, Homo Sapiens; identical to SEQ ID NO: 84926

SEQ ID NO: 670860 - RNA, 64 nt, Homo Sapiens; identical to SEQ ID NO: 84927

SEQ ID NO: 670861 - RNA, 64 nt, Homo Sapiens; identical to SEQ ID NO: 84928

SEQ ID NO: 670862 - RNA, 64 nt, Homo Sapiens; identical to SEQ ID NO: 84929

SEQ ID NO: 670863 - RNA, 64 nt, Homo Sapiens; identical to SEQ ID NO: 84930

SEQ ID NO: 670864 - RNA, 64 nt, Homo Sapiens; identical to SEQ ID NO: 84931

SEQ ID NO: 670865 - RNA, 64 nt, Homo Sapiens; identical to SEQ ID NO: 84932

SEQ ID NO: 670866 - RNA, 64 nt, Homo Sapiens; identical to SEQ ID NO: 84933

SEQ ID NO: 670867 - RNA, 64 nt, Homo Sapiens; identical to SEQ ID NO: 84934

SEQ ID NO: 670868 - RNA, 64 nt, Homo Sapiens; identical to SEQ ID NO: 84935

SEQ ID NO: 670869 - RNA, 64 nt, Homo Sapiens; identical to SEQ ID NO: 84936

SEQ ID NO: 670870 - RNA, 64 nt, Homo Sapiens; identical to SEQ ID NO: 84937

SEQ ID NO: 670871 - RNA, 64 nt, Homo Sapiens; identical to SEQ ID NO: 84938

SEQ ID NO: 670872 - RNA, 64 nt, Homo Sapiens; identical to SEQ ID NO: 84939

SEQ ID NO: 670873 - RNA, 64 nt, Homo Sapiens; identical to SEQ ID NO: 84940

SEQ ID NO: 670874 - RNA, 64 nt, Homo Sapiens; identical to SEQ ID NO: 84941

SEQ ID NO: 670875 - RNA, 64 nt, Homo Sapiens; identical to SEQ ID NO: 84942

SEQ ID NO: 670876 - RNA, 64 nt, Homo Sapiens; identical to SEQ ID NO: 84943

SEQ ID NO: 670877 - RNA, 64 nt, Homo Sapiens; identical to SEQ ID NO: 84944

SEQ ID NO: 670878 - RNA, 64 nt, Homo Sapiens; identical to SEQ ID NO: 84945

SEQ ID NO: 670879 - RNA, 64 nt, Homo Sapiens; identical to SEQ ID NO: 84946

SEQ ID NO: 670880 - RNA, 64 nt, Homo Sapiens; identical to SEQ ID NO: 84947

SEQ ID NO: 670881 - RNA, 64 nt, Homo Sapiens; identical to SEQ ID NO: 84948

SEQ ID NO: 670882 - RNA, 64 nt, Homo Sapiens; identical to SEQ ID NO: 84949

SEQ ID NO: 670883 - RNA, 64 nt, Homo Sapiens; identical to SEQ ID NO: 84950

SEQ ID NO: 670884 - RNA, 64 nt, Homo Sapiens; identical to SEQ ID NO: 84951

SEQ ID NO: 670885 - RNA, 64 nt, Homo Sapiens; identical to SEQ ID NO: 84952

SEQ ID NO: 670886 - RNA, 64 nt, Homo Sapiens; identical to SEQ ID NO: 84953

SEQ ID NO: 670887 - RNA, 64 nt, Homo Sapiens; identical to SEQ ID NO: 84954

SEQ ID NO: 670888 - RNA, 64 nt, Homo Sapiens; identical to SEQ ID NO: 84955

SEQ ID NO: 670889 - RNA, 64 nt, Homo Sapiens; identical to SEQ ID NO: 84956

SEQ ID NO: 670890 - RNA, 64 nt, Homo Sapiens; identical to SEQ ID NO: 84957

SEQ ID NO: 670891 - RNA, 64 nt, Homo Sapiens; identical to SEQ ID NO: 84958

SEQ ID NO: 670892 - RNA, 64 nt, Homo Sapiens; identical to SEQ ID NO: 84959

SEQ ID NO: 670893 - RNA, 64 nt, Homo Sapiens; identical to SEQ ID NO: 84960

SEQ ID NO: 670894 - RNA, 64 nt, Homo Sapiens; identical to SEQ ID NO: 84961

SEQ ID NO: 670895 - RNA, 64 nt, Homo Sapiens; identical to SEQ ID NO: 84962

SEQ ID NO: 670896 - RNA, 64 nt, Homo Sapiens; identical to SEQ ID NO: 84963

SEQ ID NO: 670897 - RNA, 64 nt, Homo Sapiens; identical to SEQ ID NO: 84964

SEQ ID NO: 670898 - RNA, 64 nt, Homo Sapiens; identical to SEQ ID NO: 84965

SEQ ID NO: 670899 - RNA, 64 nt, Homo Sapiens; identical to SEQ ID NO: 84966

SEQ ID NO: 670900 - RNA, 64 nt, Homo Sapiens; identical to SEQ ID NO: 84967

SEQ ID NO: 670901 - RNA, 64 nt, Homo Sapiens; identical to SEQ ID NO: 84968

SEQ ID NO: 670902 - RNA, 64 nt, Homo Sapiens; identical to SEQ ID NO: 84969

SEQ ID NO: 670903 - RNA, 64 nt, Homo Sapiens; identical to SEQ ID NO: 84970

SEQ ID NO: 670904 - RNA, 64 nt, Homo Sapiens; identical to SEQ ID NO: 84971

SEQ ID NO: 670905 - RNA, 64 nt, Homo Sapiens; identical to SEQ ID NO: 84972

SEQ ID NO: 670906 - RNA, 58 nt, Homo Sapiens; identical to SEQ ID NO: 84973

SEQ ID NO: 670907 - RNA, 64 nt, Homo Sapiens; identical to SEQ ID NO: 84974

SEQ ID NO: 670908 - RNA, 64 nt, Homo Sapiens; identical to SEQ ID NO: 84975

SEQ ID NO: 670909 - RNA, 64 nt, Homo Sapiens; identical to SEQ ID NO: 84976

SEQ ID NO: 670910 - RNA, 64 nt, Homo Sapiens; identical to SEQ ID NO: 84977

SEQ ID NO: 670911 - RNA, 64 nt, Homo Sapiens; identical to SEQ ID NO: 84978

SEQ ID NO: 670912 - RNA, 64 nt, Homo Sapiens; identical to SEQ ID NO: 84979

SEQ ID NO: 670913 - RNA, 64 nt, Homo Sapiens; identical to SEQ ID NO: 84980

SEQ ID NO: 670914 - RNA, 64 nt, Homo Sapiens; identical to SEQ ID NO: 84981

SEQ ID NO: 670915 - RNA, 64 nt, Homo Sapiens; identical to SEQ ID NO: 84982

SEQ ID NO: 670916 - RNA, 64 nt, Homo Sapiens; identical to SEQ ID NO: 84983

SEQ ID NO: 670917 - RNA, 64 nt, Homo Sapiens; identical to SEQ ID NO: 84984

SEQ ID NO: 670918 - RNA, 64 nt, Homo Sapiens; identical to SEQ ID NO: 84985

SEQ ID NO: 670919 - RNA, 64 nt, Homo Sapiens; identical to SEQ ID NO: 84986

SEQ ID NO: 670920 - RNA, 64 nt, Homo Sapiens; identical to SEQ ID NO: 84987

SEQ ID NO: 670921 - RNA, 64 nt, Homo Sapiens; identical to SEQ ID NO: 84988

SEQ ID NO: 670922 - RNA, 64 nt, Homo Sapiens; identical to SEQ ID NO: 84989

SEQ ID NO: 670923 - RNA, 64 nt, Homo Sapiens; identical to SEQ ID NO: 84990

SEQ ID NO: 670924 - RNA, 64 nt, Homo Sapiens; identical to SEQ ID NO: 84991

SEQ ID NO: 670925 - RNA, 64 nt, Homo Sapiens; identical to SEQ ID NO: 84992

SEQ ID NO: 670926 - RNA, 64 nt, Homo Sapiens; identical to SEQ ID NO: 84993

SEQ ID NO: 670927 - RNA, 64 nt, Homo Sapiens; identical to SEQ ID NO: 84994

SEQ ID NO: 670928 - RNA, 64 nt, Homo Sapiens; identical to SEQ ID NO: 84995

SEQ ID NO: 670929 - RNA, 64 nt, Homo Sapiens; identical to SEQ ID NO: 84996

SEQ ID NO: 670930 - RNA, 64 nt, Homo Sapiens; identical to SEQ ID NO: 84997

SEQ ID NO: 670931 - RNA, 64 nt, Homo Sapiens; identical to SEQ ID NO: 84998

SEQ ID NO: 670932 - RNA, 64 nt, Homo Sapiens; identical to SEQ ID NO: 84999

SEQ ID NO: 670933 - RNA, 64 nt, Homo Sapiens; identical to SEQ ID NO: 85000

SEQ ID NO: 670934 - RNA, 64 nt, Homo Sapiens; identical to SEQ ID NO: 85001

SEQ ID NO: 670935 - RNA, 64 nt, Homo Sapiens; identical to SEQ ID NO: 85002

SEQ ID NO: 670936 - RNA, 64 nt, Homo Sapiens; identical to SEQ ID NO: 85003

SEQ ID NO: 670937 - RNA, 64 nt, Homo Sapiens; identical to SEQ ID NO: 415481

SEQ ID NO: 670938 - RNA, 64 nt, Homo Sapiens; identical to SEQ ID NO: 415482

SEQ ID NO: 670939 - RNA, 64 nt, Homo Sapiens; identical to SEQ ID NO: 415483

SEQ ID NO: 670940 - RNA, 64 nt, Homo Sapiens; identical to SEQ ID NO: 415484

SEQ ID NO: 670941 - RNA, 64 nt, Homo Sapiens; identical to SEQ ID NO: 415485

SEQ ID NO: 670942 - RNA, 64 nt, Homo Sapiens; identical to SEQ ID NO: 415486

SEQ ID NO: 670943 - RNA, 64 nt, Homo Sapiens; identical to SEQ ID NO: 415487

SEQ ID NO: 670944 - RNA, 64 nt, Homo Sapiens; identical to SEQ ID NO: 415488

SEQ ID NO: 670945 - RNA, 64 nt, Homo Sapiens; identical to SEQ ID NO: 415489

SEQ ID NO: 670946 - RNA, 64 nt, Homo Sapiens; identical to SEQ ID NO: 415490

SEQ ID NO: 670947 - RNA, 64 nt, Homo Sapiens; identical to SEQ ID NO: 415491

SEQ ID NO: 670948 - RNA, 64 nt, Homo Sapiens; identical to SEQ ID NO: 415492

SEQ ID NO: 670949 - RNA, 64 nt, Homo Sapiens; identical to SEQ ID NO: 415493

SEQ ID NO: 670950 - RNA, 64 nt, Homo Sapiens; identical to SEQ ID NO: 415494

SEQ ID NO: 670951 - RNA, 64 nt, Homo Sapiens; identical to SEQ ID NO: 415495

SEQ ID NO: 670952 - RNA, 64 nt, Homo Sapiens; identical to SEQ ID NO: 415496

SEQ ID NO: 670953 - RNA, 64 nt, Homo Sapiens; identical to SEQ ID NO: 415497

SEQ ID NO: 670954 - RNA, 64 nt, Homo Sapiens; identical to SEQ ID NO: 415498

SEQ ID NO: 670955 - RNA, 64 nt, Homo Sapiens; identical to SEQ ID NO: 415499

SEQ ID NO: 670956 - RNA, 64 nt, Homo Sapiens; identical to SEQ ID NO: 415500

SEQ ID NO: 670957 - RNA, 64 nt, Homo Sapiens; identical to SEQ ID NO: 415501

SEQ ID NO: 670958 - RNA, 64 nt, Homo Sapiens; identical to SEQ ID NO: 415502

SEQ ID NO: 670959 - RNA, 58 nt, Homo Sapiens; identical to SEQ ID NO: 415503

SEQ ID NO: 670960 - RNA, 64 nt, Homo Sapiens; identical to SEQ ID NO: 415504

SEQ ID NO: 670961 - RNA, 64 nt, Homo Sapiens; identical to SEQ ID NO: 415505

SEQ ID NO: 670962 - RNA, 64 nt, Homo Sapiens; identical to SEQ ID NO: 415506

SEQ ID NO: 670963 - RNA, 64 nt, Homo Sapiens; identical to SEQ ID NO: 415507

SEQ ID NO: 670964 - RNA, 64 nt, Homo Sapiens; identical to SEQ ID NO: 415508

SEQ ID NO: 670965 - RNA, 64 nt, Homo Sapiens; identical to SEQ ID NO: 415509

SEQ ID NO: 670966 - RNA, 64 nt, Homo Sapiens; identical to SEQ ID NO: 415510

SEQ ID NO: 670967 - RNA, 64 nt, Homo Sapiens; identical to SEQ ID NO: 415511

SEQ ID NO: 670968 - RNA, 64 nt, Homo Sapiens; identical to SEQ ID NO: 415512

SEQ ID NO: 670969 - RNA, 63 nt, Homo Sapiens; identical to SEQ ID NO: 415513

SEQ ID NO: 670970 - RNA, 64 nt, Homo Sapiens; identical to SEQ ID NO: 415514

SEQ ID NO: 670971 - RNA, 64 nt, Homo Sapiens; identical to SEQ ID NO: 415515

SEQ ID NO: 670972 - RNA, 64 nt, Homo Sapiens; identical to SEQ ID NO: 415516

SEQ ID NO: 670973 - RNA, 64 nt, Homo Sapiens; identical to SEQ ID NO: 415517

SEQ ID NO: 670974 - RNA, 64 nt, Homo Sapiens; identical to SEQ ID NO: 415518

SEQ ID NO: 670975 - RNA, 64 nt, Homo Sapiens; identical to SEQ ID NO: 415519

SEQ ID NO: 670976 - RNA, 64 nt, Homo Sapiens; identical to SEQ ID NO: 415520

SEQ ID NO: 670977 - RNA, 64 nt, Homo Sapiens; identical to SEQ ID NO: 415521

SEQ ID NO: 670978 - RNA, 57 nt, Homo Sapiens; identical to SEQ ID NO: 415522

SEQ ID NO: 670979 - RNA, 64 nt, Homo Sapiens; identical to SEQ ID NO: 415523

SEQ ID NO: 670980 - RNA, 64 nt, Homo Sapiens; identical to SEQ ID NO: 415524

SEQ ID NO: 670981 - RNA, 64 nt, Homo Sapiens; identical to SEQ ID NO: 415525

SEQ ID NO: 670982 - RNA, 63 nt, Homo Sapiens
aucuuuuuauggguggagcagagagucaaucccugcagccacccugcagccagccaucucugc

SEQ ID NO: 670983 - RNA, 63 nt, Homo Sapiens
gguggagcagagagucaaucccugcagccacccugcagccagccaucucugcaguucucucag

SEQ ID NO: 670984 - RNA, 63 nt, Homo Sapiens
cugccucaucccaaagaucagguaugggcugaaugcagccaucugagcaagggcugagggaag

SEQ ID NO: 670985 - RNA, 63 nt, Homo Sapiens
cuugcauggaugcaguugugacucuggggacaaugcagccagaagcugagggaccagcacuug

SEQ ID NO: 670986 - RNA, 63 nt, Homo Sapiens
gcgguuaaaaaauauaaguaaguuucgguuuucugcagccauuugcuuuauugccaaagggcu

SEQ ID NO: 670987 - RNA, 63 nt, Homo Sapiens
guuuccauuaugcaacuugugugacaaaugcagugcagccaguaacugaauagauuagaaugg

SEQ ID NO: 670988 - RNA, 63 nt, Homo Sapiens
agccagacaccuuguacugggcacgcgucagacugcagccaguccguuuccuuucuuuagcca

SEQ ID NO: 670989 - RNA, 63 nt, Homo Sapiens
acagcgcgguggcugggucugcacacuggccucugcagccagauuucuauauugggaguuuuu

SEQ ID NO: 670990 - RNA, 63 nt, Homo Sapiens
gauucucucuuguccuucacuauauagaaggacugcagccacuuggcggaucuagugaccaga

SEQ ID NO: 670991 - RNA, 63 nt, Homo Sapiens
caaaugccugccaaauuuuauucauuuugcaccugcagccaaggcaaagccagaaaaagaucu

SEQ ID NO: 670992 - RNA, 63 nt, Homo Sapiens
ugugugccacacggcagccucccacccgccaucugcagccagguucugcagagaaaauguccc

SEQ ID NO: 670993 - RNA, 63 nt, Homo Sapiens
uuuagccuuuggcuuuggucccauccaauaaaaugcagccaggcucccacccacuuccaucac

SEQ ID NO: 670994 - RNA, 63 nt, Homo Sapiens
agguguguuuaucccacagugccauuguggaacugcagccaugcgguuaguccauaaucuaga

SEQ ID NO: 670995 - RNA, 63 nt, Homo Sapiens
aauuuauuuucauuguuggcggggugggucaagugcagccagcuuuccaccuuucacauccaa

SEQ ID NO: 670996 - RNA, 63 nt, Homo Sapiens
ggacucgcugauccugggccgcagccuggggugugcagccaucucauucugugaaugugccaa

SEQ ID NO: 670997 - RNA, 63 nt, Homo Sapiens
cuggaggccggcuuaguucuuccauuucacccuugcagccagcuguuggccacggccccugcc

SEQ ID NO: 670998 - RNA, 63 nt, Homo Sapiens
uggccuugcuggaggcacagggcucugcggaccugcagccaucugugaggcccgcggggaugg

SEQ ID NO: 670999 - RNA, 63 nt, Homo Sapiens
gcaaaagacccaacgccaacaccuggugccuucugcagccagcgcccacccauccgugcccgg

SEQ ID NO: 671000 - RNA, 63 nt, Homo Sapiens
cuuucagcaaagcuucauugaaagagcaugagaugcagccauuaagagauacauacucucuuc

SEQ ID NO: 671001 - RNA, 63 nt, Homo Sapiens
ggcaccucaagaagaagagggugagcucccaggugcagccagagcaggugaaacccagucacu

SEQ ID NO: 671002 - RNA, 63 nt, Homo Sapiens
gucucuuauuuaucugcagaaggaacuuuggggugcagccaggacccgguaggccugagccuc

SEQ ID NO: 671003 - RNA, 63 nt, Homo Sapiens
uccuggagugaguuuccauuuccagcuggaaucugcagccacccccauuuccuguuuuccauu

SEQ ID NO: 671004 - RNA, 63 nt, Homo Sapiens
ccagcucuaugucugugucugaauuguggaucgugcagccaugguuauuguggaacuguggaa

SEQ ID NO: 671005 - RNA, 63 nt, Homo Sapiens
gugcagccaugguuauuguggaacuguggaaccugcagccauaguuauuugacuauaucuuga

SEQ ID NO: 671006 - RNA, 63 nt, Homo Sapiens
cagacuccugccagauggggucaugggaagggaugcagccaggccugcacauuccagaagccc

SEQ ID NO: 671007 - RNA, 63 nt, Homo Sapiens
agccgucagccagaucccaacauacucuaauaaugcagccaggccaagaacuuaccuucagaa

SEQ ID NO: 671008 - RNA, 63 nt, Homo Sapiens
ucucacaaaguacaaaacgauuuucucuccaggugcagccagaguuccugggaaagggguaug

SEQ ID NO: 671009 - RNA, 63 nt, Homo Sapiens
uuuuacugaguuuguggcaauguuuuguucauuugcagccagucacuuguuccuucaucuaca

SEQ ID NO: 671010 - RNA, 63 nt, Homo Sapiens
gccacaugccuagacuuauauacuaguuaguggugcagccagggagaggacucagauuuccug

SEQ ID NO: 671011 - RNA, 63 nt, Homo Sapiens
caaagucuaucucugaaacuccaugaagacuuuugcagccaguucccaccaauaugccccaga

SEQ ID NO: 671012 - RNA, 63 nt, Homo Sapiens
cuacuagaugugaacuugaagaagguugucagcugcagccacuuucugccagcaucugcagcc

SEQ ID NO: 671013 - RNA, 63 nt, Homo Sapiens
gguugucagcugcagccacuuucugccagcaucugcagccacuuucugccagcaucugcagcc

SEQ ID NO: 671014 - RNA, 63 nt, Homo Sapiens
ugccagcaucugcagccacuuucugccagcaucugcagccagcaagcugggacuggcaggaaa

SEQ ID NO: 671015 - RNA, 63 nt, Homo Sapiens
ucaucguugcgcagccccugugcaccucugaccugcagccacggcagugugccgggccuccgu

SEQ ID NO: 671016 - RNA, 63 nt, Homo Sapiens
cguguccgaacucuccaaugcccuggcugggggugcagccagugcccuuugugcagugaacag

SEQ ID NO: 671017 - RNA, 63 nt, Homo Sapiens
agccagaggauacccagggaaaaagaccagcuuugcagccagaaucaaugaaaaaaaaaaaaa

SEQ ID NO: 671018 - RNA, 63 nt, Homo Sapiens
ugcaguggcucacaccugugucaagaccagccuugcagccaggcuacugccugacguugucag

SEQ ID NO: 671019 - RNA, 63 nt, Homo Sapiens
cuuacacugggcacauggaggagacguccacccugcagccaggacugggguucacgucacugc

SEQ ID NO: 671020 - RNA, 63 nt, Homo Sapiens
ccucgcucuccuaaguuuaauuacaacagcacgugcagccacgucagccaaaugacuucauuu

SEQ ID NO: 671021 - RNA, 63 nt, Homo Sapiens
gacugggggcagagcucuggaaagggcccaugcugcagccacuacaagcccugggauuggaca

SEQ ID NO: 671022 - RNA, 63 nt, Homo Sapiens
cacgcaccaucugugggucuuucacugcagcccugcagccaccuauucaggugccauguggcc

SEQ ID NO: 671023 - RNA, 63 nt, Homo Sapiens
cagguagcauacgcucuuugacuugguagcgucugcagccaccaucuuuaagaauccgccagc

SEQ ID NO: 671024 - RNA, 64 nt, Homo Sapiens; identical to SEQ ID NO: 155629

SEQ ID NO: 671025 - RNA, 64 nt, Homo Sapiens; identical to SEQ ID NO: 155630

SEQ ID NO: 671026 - RNA, 64 nt, Homo Sapiens; identical to SEQ ID NO: 155631

SEQ ID NO: 671027 - RNA, 64 nt, Homo Sapiens; identical to SEQ ID NO: 155632

SEQ ID NO: 671028 - RNA, 64 nt, Homo Sapiens; identical to SEQ ID NO: 155633

SEQ ID NO: 671029 - RNA, 64 nt, Homo Sapiens; identical to SEQ ID NO: 155634

SEQ ID NO: 671030 - RNA, 64 nt, Homo Sapiens; identical to SEQ ID NO: 155635

SEQ ID NO: 671031 - RNA, 64 nt, Homo Sapiens; identical to SEQ ID NO: 155636

SEQ ID NO: 671032 - RNA, 64 nt, Homo Sapiens; identical to SEQ ID NO: 155637

SEQ ID NO: 671033 - RNA, 64 nt, Homo Sapiens; identical to SEQ ID NO: 155638

SEQ ID NO: 671034 - RNA, 64 nt, Homo Sapiens; identical to SEQ ID NO: 155639

SEQ ID NO: 671035 - RNA, 64 nt, Homo Sapiens; identical to SEQ ID NO: 155640

SEQ ID NO: 671036 - RNA, 64 nt, Homo Sapiens; identical to SEQ ID NO: 155641

SEQ ID NO: 671037 - RNA, 64 nt, Homo Sapiens; identical to SEQ ID NO: 155642

SEQ ID NO: 671038 - RNA, 64 nt, Homo Sapiens; identical to SEQ ID NO: 155643

SEQ ID NO: 671039 - RNA, 64 nt, Homo Sapiens; identical to SEQ ID NO: 155644

SEQ ID NO: 671040 - RNA, 64 nt, Homo Sapiens; identical to SEQ ID NO: 155645

SEQ ID NO: 671041 - RNA, 64 nt, Homo Sapiens; identical to SEQ ID NO: 155646

SEQ ID NO: 671042 - RNA, 64 nt, Homo Sapiens; identical to SEQ ID NO: 155647

SEQ ID NO: 671043 - RNA, 64 nt, Homo Sapiens; identical to SEQ ID NO: 155648

SEQ ID NO: 671044 - RNA, 64 nt, Homo Sapiens; identical to SEQ ID NO: 155649

SEQ ID NO: 671045 - RNA, 64 nt, Homo Sapiens; identical to SEQ ID NO: 155650

SEQ ID NO: 671046 - RNA, 64 nt, Homo Sapiens; identical to SEQ ID NO: 155651

SEQ ID NO: 671047 - RNA, 64 nt, Homo Sapiens; identical to SEQ ID NO: 155652

SEQ ID NO: 671048 - RNA, 64 nt, Homo Sapiens; identical to SEQ ID NO: 155653

SEQ ID NO: 671049 - RNA, 64 nt, Homo Sapiens; identical to SEQ ID NO: 155654

SEQ ID NO: 671050 - RNA, 64 nt, Homo Sapiens; identical to SEQ ID NO: 155655

SEQ ID NO: 671051 - RNA, 64 nt, Homo Sapiens; identical to SEQ ID NO: 155656

SEQ ID NO: 671052 - RNA, 64 nt, Homo Sapiens; identical to SEQ ID NO: 155657

SEQ ID NO: 671053 - RNA, 64 nt, Homo Sapiens; identical to SEQ ID NO: 155658

SEQ ID NO: 671054 - RNA, 64 nt, Homo Sapiens; identical to SEQ ID NO: 155659

SEQ ID NO: 671055 - RNA, 64 nt, Homo Sapiens; identical to SEQ ID NO: 155660

SEQ ID NO: 671056 - RNA, 64 nt, Homo Sapiens; identical to SEQ ID NO: 155661

SEQ ID NO: 671057 - RNA, 64 nt, Homo Sapiens; identical to SEQ ID NO: 155662

SEQ ID NO: 671058 - RNA, 64 nt, Homo Sapiens; identical to SEQ ID NO: 155663

SEQ ID NO: 671059 - RNA, 64 nt, Homo Sapiens; identical to SEQ ID NO: 155664

SEQ ID NO: 671060 - RNA, 64 nt, Homo Sapiens; identical to SEQ ID NO: 155665

SEQ ID NO: 671061 - RNA, 64 nt, Homo Sapiens; identical to SEQ ID NO: 155666

SEQ ID NO: 671062 - RNA, 64 nt, Homo Sapiens; identical to SEQ ID NO: 155667

SEQ ID NO: 671063 - RNA, 64 nt, Homo Sapiens; identical to SEQ ID NO: 155668

SEQ ID NO: 671064 - RNA, 64 nt, Homo Sapiens; identical to SEQ ID NO: 155669

SEQ ID NO: 671065 - RNA, 64 nt, Homo Sapiens; identical to SEQ ID NO: 155670

SEQ ID NO: 671066 - RNA, 64 nt, Homo Sapiens; identical to SEQ ID NO: 155671

SEQ ID NO: 671067 - RNA, 64 nt, Homo Sapiens; identical to SEQ ID NO: 155672

SEQ ID NO: 671068 - RNA, 64 nt, Homo Sapiens; identical to SEQ ID NO: 155673

SEQ ID NO: 671069 - RNA, 64 nt, Homo Sapiens; identical to SEQ ID NO: 155674

SEQ ID NO: 671070 - RNA, 64 nt, Homo Sapiens; identical to SEQ ID NO: 155675

SEQ ID NO: 671071 - RNA, 64 nt, Homo Sapiens; identical to SEQ ID NO: 155676

SEQ ID NO: 671072 - RNA, 64 nt, Homo Sapiens; identical to SEQ ID NO: 155677

SEQ ID NO: 671073 - RNA, 64 nt, Homo Sapiens; identical to SEQ ID NO: 155678

SEQ ID NO: 671074 - RNA, 64 nt, Homo Sapiens; identical to SEQ ID NO: 155679

SEQ ID NO: 671075 - RNA, 64 nt, Homo Sapiens; identical to SEQ ID NO: 155680

SEQ ID NO: 671076 - RNA, 64 nt, Homo Sapiens; identical to SEQ ID NO: 155681

SEQ ID NO: 671077 - RNA, 64 nt, Homo Sapiens; identical to SEQ ID NO: 155682

SEQ ID NO: 671078 - RNA, 64 nt, Homo Sapiens; identical to SEQ ID NO: 155683

SEQ ID NO: 671079 - RNA, 64 nt, Homo Sapiens; identical to SEQ ID NO: 155684

SEQ ID NO: 671080 - RNA, 64 nt, Homo Sapiens; identical to SEQ ID NO: 155685

SEQ ID NO: 671081 - RNA, 64 nt, Homo Sapiens; identical to SEQ ID NO: 155686

SEQ ID NO: 671082 - RNA, 64 nt, Homo Sapiens; identical to SEQ ID NO: 155687

SEQ ID NO: 671083 - RNA, 64 nt, Homo Sapiens; identical to SEQ ID NO: 155688

SEQ ID NO: 671084 - RNA, 64 nt, Homo Sapiens; identical to SEQ ID NO: 155689

SEQ ID NO: 671085 - RNA, 64 nt, Homo Sapiens; identical to SEQ ID NO: 155690

SEQ ID NO: 671086 - RNA, 64 nt, Homo Sapiens; identical to SEQ ID NO: 155691

SEQ ID NO: 671087 - RNA, 64 nt, Homo Sapiens; identical to SEQ ID NO: 155692

SEQ ID NO: 671088 - RNA, 64 nt, Homo Sapiens; identical to SEQ ID NO: 155693

SEQ ID NO: 671089 - RNA, 64 nt, Homo Sapiens; identical to SEQ ID NO: 155694

SEQ ID NO: 671090 - RNA, 64 nt, Homo Sapiens; identical to SEQ ID NO: 155695

SEQ ID NO: 671091 - RNA, 64 nt, Homo Sapiens; identical to SEQ ID NO: 155696

SEQ ID NO: 671092 - RNA, 64 nt, Homo Sapiens; identical to SEQ ID NO: 155697

SEQ ID NO: 671093 - RNA, 64 nt, Homo Sapiens; identical to SEQ ID NO: 155698

SEQ ID NO: 671094 - RNA, 64 nt, Homo Sapiens; identical to SEQ ID NO: 155699

SEQ ID NO: 671095 - RNA, 64 nt, Homo Sapiens; identical to SEQ ID NO: 155700

SEQ ID NO: 671096 - RNA, 64 nt, Homo Sapiens; identical to SEQ ID NO: 155701

SEQ ID NO: 671097 - RNA, 64 nt, Homo Sapiens; identical to SEQ ID NO: 155702

SEQ ID NO: 671098 - RNA, 64 nt, Homo Sapiens; identical to SEQ ID NO: 155703

SEQ ID NO: 671099 - RNA, 64 nt, Homo Sapiens; identical to SEQ ID NO: 155704

SEQ ID NO: 671100 - RNA, 64 nt, Homo Sapiens; identical to SEQ ID NO: 155705

SEQ ID NO: 671101 - RNA, 64 nt, Homo Sapiens; identical to SEQ ID NO: 155706

SEQ ID NO: 671102 - RNA, 64 nt, Homo Sapiens; identical to SEQ ID NO: 155707

SEQ ID NO: 671103 - RNA, 64 nt, Homo Sapiens; identical to SEQ ID NO: 155708

SEQ ID NO: 671104 - RNA, 64 nt, Homo Sapiens; identical to SEQ ID NO: 155709

SEQ ID NO: 671105 - RNA, 64 nt, Homo Sapiens; identical to SEQ ID NO: 155710

SEQ ID NO: 671106 - RNA, 64 nt, Homo Sapiens; identical to SEQ ID NO: 155711

SEQ ID NO: 671107 - RNA, 64 nt, Homo Sapiens; identical to SEQ ID NO: 155712

SEQ ID NO: 671108 - RNA, 64 nt, Homo Sapiens; identical to SEQ ID NO: 155713

SEQ ID NO: 671109 - RNA, 64 nt, Homo Sapiens; identical to SEQ ID NO: 155714

SEQ ID NO: 671110 - RNA, 64 nt, Homo Sapiens; identical to SEQ ID NO: 155715

SEQ ID NO: 671111 - RNA, 64 nt, Homo Sapiens; identical to SEQ ID NO: 155716

SEQ ID NO: 671112 - RNA, 64 nt, Homo Sapiens; identical to SEQ ID NO: 155717

SEQ ID NO: 671113 - RNA, 64 nt, Homo Sapiens; identical to SEQ ID NO: 155718

SEQ ID NO: 671114 - RNA, 64 nt, Homo Sapiens; identical to SEQ ID NO: 155719

SEQ ID NO: 671115 - RNA, 64 nt, Homo Sapiens; identical to SEQ ID NO: 155720

SEQ ID NO: 671116 - RNA, 64 nt, Homo Sapiens; identical to SEQ ID NO: 155721

SEQ ID NO: 671117 - RNA, 64 nt, Homo Sapiens; identical to SEQ ID NO: 155722

SEQ ID NO: 671118 - RNA, 64 nt, Homo Sapiens; identical to SEQ ID NO: 155723

SEQ ID NO: 671119 - RNA, 64 nt, Homo Sapiens; identical to SEQ ID NO: 155724

SEQ ID NO: 671120 - RNA, 64 nt, Homo Sapiens; identical to SEQ ID NO: 155725

SEQ ID NO: 671121 - RNA, 64 nt, Homo Sapiens; identical to SEQ ID NO: 155726

SEQ ID NO: 671122 - RNA, 64 nt, Homo Sapiens; identical to SEQ ID NO: 155727

SEQ ID NO: 671123 - RNA, 64 nt, Homo Sapiens; identical to SEQ ID NO: 155728

SEQ ID NO: 671124 - RNA, 64 nt, Homo Sapiens; identical to SEQ ID NO: 155729

SEQ ID NO: 671125 - RNA, 58 nt, Homo Sapiens; identical to SEQ ID NO: 155730

SEQ ID NO: 671126 - RNA, 64 nt, Homo Sapiens; identical to SEQ ID NO: 155731

SEQ ID NO: 671127 - RNA, 64 nt, Homo Sapiens; identical to SEQ ID NO: 155732

SEQ ID NO: 671128 - RNA, 64 nt, Homo Sapiens; identical to SEQ ID NO: 155733

SEQ ID NO: 671129 - RNA, 64 nt, Homo Sapiens; identical to SEQ ID NO: 155734

SEQ ID NO: 671130 - RNA, 64 nt, Homo Sapiens; identical to SEQ ID NO: 155735

SEQ ID NO: 671131 - RNA, 64 nt, Homo Sapiens; identical to SEQ ID NO: 155736

SEQ ID NO: 671132 - RNA, 64 nt, Homo Sapiens; identical to SEQ ID NO: 155737

SEQ ID NO: 671133 - RNA, 64 nt, Homo Sapiens; identical to SEQ ID NO: 155738

SEQ ID NO: 671134 - RNA, 64 nt, Homo Sapiens; identical to SEQ ID NO: 155739

SEQ ID NO: 671135 - RNA, 64 nt, Homo Sapiens; identical to SEQ ID NO: 155740

SEQ ID NO: 671136 - RNA, 64 nt, Homo Sapiens; identical to SEQ ID NO: 155741

SEQ ID NO: 671137 - RNA, 64 nt, Homo Sapiens; identical to SEQ ID NO: 155742

SEQ ID NO: 671138 - RNA, 64 nt, Homo Sapiens; identical to SEQ ID NO: 155743

SEQ ID NO: 671139 - RNA, 64 nt, Homo Sapiens; identical to SEQ ID NO: 155744

SEQ ID NO: 671140 - RNA, 64 nt, Homo Sapiens; identical to SEQ ID NO: 155745

SEQ ID NO: 671141 - RNA, 64 nt, Homo Sapiens; identical to SEQ ID NO: 155746

SEQ ID NO: 671142 - RNA, 64 nt, Homo Sapiens; identical to SEQ ID NO: 155747

SEQ ID NO: 671143 - RNA, 64 nt, Homo Sapiens; identical to SEQ ID NO: 155748

SEQ ID NO: 671144 - RNA, 64 nt, Homo Sapiens; identical to SEQ ID NO: 155749

SEQ ID NO: 671145 - RNA, 64 nt, Homo Sapiens; identical to SEQ ID NO: 155750

SEQ ID NO: 671146 - RNA, 64 nt, Homo Sapiens; identical to SEQ ID NO: 155751

SEQ ID NO: 671147 - RNA, 64 nt, Homo Sapiens; identical to SEQ ID NO: 155752

SEQ ID NO: 671148 - RNA, 64 nt, Homo Sapiens; identical to SEQ ID NO: 155753

SEQ ID NO: 671149 - RNA, 63 nt, Homo Sapiens; identical to SEQ ID NO: 155754

SEQ ID NO: 671150 - RNA, 64 nt, Homo Sapiens; identical to SEQ ID NO: 155755

SEQ ID NO: 671151 - RNA, 64 nt, Homo Sapiens; identical to SEQ ID NO: 155756

SEQ ID NO: 671152 - RNA, 64 nt, Homo Sapiens; identical to SEQ ID NO: 155757

SEQ ID NO: 671153 - RNA, 64 nt, Homo Sapiens; identical to SEQ ID NO: 155758

SEQ ID NO: 671154 - RNA, 64 nt, Homo Sapiens; identical to SEQ ID NO: 155759

SEQ ID NO: 671155 - RNA, 64 nt, Homo Sapiens; identical to SEQ ID NO: 155760

SEQ ID NO: 671156 - RNA, 64 nt, Homo Sapiens; identical to SEQ ID NO: 155761

SEQ ID NO: 671157 - RNA, 64 nt, Homo Sapiens; identical to SEQ ID NO: 155762

SEQ ID NO: 671158 - RNA, 64 nt, Homo Sapiens; identical to SEQ ID NO: 155763

SEQ ID NO: 671159 - RNA, 64 nt, Homo Sapiens; identical to SEQ ID NO: 155764

SEQ ID NO: 671160 - RNA, 64 nt, Homo Sapiens; identical to SEQ ID NO: 155765

SEQ ID NO: 671161 - RNA, 64 nt, Homo Sapiens; identical to SEQ ID NO: 155766

SEQ ID NO: 671162 - RNA, 64 nt, Homo Sapiens; identical to SEQ ID NO: 155767

SEQ ID NO: 671163 - RNA, 64 nt, Homo Sapiens; identical to SEQ ID NO: 155768

SEQ ID NO: 671164 - RNA, 64 nt, Homo Sapiens; identical to SEQ ID NO: 155769

SEQ ID NO: 671165 - RNA, 64 nt, Homo Sapiens; identical to SEQ ID NO: 155770

SEQ ID NO: 671166 - RNA, 64 nt, Homo Sapiens; identical to SEQ ID NO: 155771

SEQ ID NO: 671167 - RNA, 64 nt, Homo Sapiens; identical to SEQ ID NO: 155772

SEQ ID NO: 671168 - RNA, 64 nt, Homo Sapiens; identical to SEQ ID NO: 155773

SEQ ID NO: 671169 - RNA, 64 nt, Homo Sapiens; identical to SEQ ID NO: 155774

SEQ ID NO: 671170 - RNA, 64 nt, Homo Sapiens; identical to SEQ ID NO: 155775

SEQ ID NO: 671171 - RNA, 64 nt, Homo Sapiens; identical to SEQ ID NO: 155776

SEQ ID NO: 671172 - RNA, 64 nt, Homo Sapiens; identical to SEQ ID NO: 155777

SEQ ID NO: 671173 - RNA, 64 nt, Homo Sapiens; identical to SEQ ID NO: 155778

SEQ ID NO: 671174 - RNA, 64 nt, Homo Sapiens; identical to SEQ ID NO: 155779

SEQ ID NO: 671175 - RNA, 64 nt, Homo Sapiens; identical to SEQ ID NO: 155780

SEQ ID NO: 671176 - RNA, 64 nt, Homo Sapiens; identical to SEQ ID NO: 155781

SEQ ID NO: 671177 - RNA, 64 nt, Homo Sapiens; identical to SEQ ID NO: 155782

SEQ ID NO: 671178 - RNA, 64 nt, Homo Sapiens; identical to SEQ ID NO: 155783

SEQ ID NO: 671179 - RNA, 64 nt, Homo Sapiens; identical to SEQ ID NO: 155784

SEQ ID NO: 671180 - RNA, 64 nt, Homo Sapiens; identical to SEQ ID NO: 155785

SEQ ID NO: 671181 - RNA, 64 nt, Homo Sapiens; identical to SEQ ID NO: 155786

SEQ ID NO: 671182 - RNA, 53 nt, Homo Sapiens; identical to SEQ ID NO: 155787

SEQ ID NO: 671183 - RNA, 64 nt, Homo Sapiens; identical to SEQ ID NO: 155788

SEQ ID NO: 671184 - RNA, 64 nt, Homo Sapiens; identical to SEQ ID NO: 155789

SEQ ID NO: 671185 - RNA, 64 nt, Homo Sapiens; identical to SEQ ID NO: 155790

SEQ ID NO: 671186 - RNA, 64 nt, Homo Sapiens; identical to SEQ ID NO: 155791

SEQ ID NO: 671187 - RNA, 64 nt, Homo Sapiens; identical to SEQ ID NO: 155792

SEQ ID NO: 671188 - RNA, 64 nt, Homo Sapiens; identical to SEQ ID NO: 155793

SEQ ID NO: 671189 - RNA, 64 nt, Homo Sapiens; identical to SEQ ID NO: 155794

SEQ ID NO: 671190 - RNA, 64 nt, Homo Sapiens; identical to SEQ ID NO: 155795

SEQ ID NO: 671191 - RNA, 64 nt, Homo Sapiens; identical to SEQ ID NO: 155796

SEQ ID NO: 671192 - RNA, 64 nt, Homo Sapiens; identical to SEQ ID NO: 155797

SEQ ID NO: 671193 - RNA, 64 nt, Homo Sapiens; identical to SEQ ID NO: 155798

SEQ ID NO: 671194 - RNA, 64 nt, Homo Sapiens; identical to SEQ ID NO: 155799

SEQ ID NO: 671195 - RNA, 64 nt, Homo Sapiens; identical to SEQ ID NO: 155800

SEQ ID NO: 671196 - RNA, 64 nt, Homo Sapiens; identical to SEQ ID NO: 155801

SEQ ID NO: 671197 - RNA, 64 nt, Homo Sapiens; identical to SEQ ID NO: 155802

SEQ ID NO: 671198 - RNA, 64 nt, Homo Sapiens; identical to SEQ ID NO: 155803

SEQ ID NO: 671199 - RNA, 64 nt, Homo Sapiens; identical to SEQ ID NO: 155804

SEQ ID NO: 671200 - RNA, 64 nt, Homo Sapiens; identical to SEQ ID NO: 155805

SEQ ID NO: 671201 - RNA, 64 nt, Homo Sapiens; identical to SEQ ID NO: 155806

SEQ ID NO: 671202 - RNA, 64 nt, Homo Sapiens; identical to SEQ ID NO: 155807

SEQ ID NO: 671203 - RNA, 64 nt, Homo Sapiens; identical to SEQ ID NO: 155808

SEQ ID NO: 671204 - RNA, 64 nt, Homo Sapiens
augauuaccucuugagauauaacaccugaaaaucaugagggaaauugguaaaacuuuuaaauuc

SEQ ID NO: 671205 - RNA, 64 nt, Homo Sapiens
uucugaucauauuaaaaaucaagaguugauccuuaugagggagauagaaauucaguucuaagga

SEQ ID NO: 671206 - RNA, 64 nt, Homo Sapiens
augaauucugaucauauuuagucauuuugaccaaaugagggauuuggucaaaugagggauuccc

SEQ ID NO: 671207 - RNA, 64 nt, Homo Sapiens
uuagucauuuugaccaaaugagggauuuggucaaaugagggauucccucaaagcaauaucaggu

SEQ ID NO: 671208 - RNA, 64 nt, Homo Sapiens
cucaccucuaggccucaguguccucaucuauaaaaugagggacuucccuagaagucuucauggu

SEQ ID NO: 671209 - RNA, 64 nt, Homo Sapiens
ugaaaguguuuuucuuuaaucaaaaguccuuagaaugagggaaacaaaauauuuauuuguuuug

SEQ ID NO: 671210 - RNA, 64 nt, Homo Sapiens
aauguauaaagugggguuucuuccauauugacaaaugagggaacagguggugucuaucuuguau

SEQ ID NO: 671211 - RNA, 64 nt, Homo Sapiens
ugucagccuuuucuguggcaccuuccagaugagaaugagggagcgaccacuccaaggacggaca

SEQ ID NO: 671212 - RNA, 64 nt, Homo Sapiens
caacacagggcucccuguggugacaccaguggagaugagggaacggguagauggugugagugag

SEQ ID NO: 671213 - RNA, 64 nt, Homo Sapiens
ccgagccuguauuuauuuuuguauaauucucuggaugagggagaguggucgugagcuggucuug

SEQ ID NO: 671214 - RNA, 64 nt, Homo Sapiens
gaccugagcuggcuuggacccauuugaggacugaacuaggcaggcaauggcuccagugcccucc

SEQ ID NO: 671215 - RNA, 64 nt, Homo Sapiens
gcugccccagaacacaguccauuacgauagaaacacuaggcaccccccaggcgagagcuagugg

SEQ ID NO: 671216 - RNA, 63 nt, Homo Sapiens
ugauccuuauguuaauacaaggaagauuguuuacuucaucaaggaacacagcaucauuaugca

SEQ ID NO: 671217 - RNA, 63 nt, Homo Sapiens
ccacuaccgccuuuauuucucuauuucccuugccuucaucaccuacauuuuuuucccaguccu

SEQ ID NO: 671218 - RNA, 63 nt, Homo Sapiens
cucaccugacugucuggcugaccuguacaaguccuucaucaaaaacuacccaguggugucuac

SEQ ID NO: 671219 - RNA, 63 nt, Homo Sapiens
ggugccucaucauucuggggagacugaaaauaccuucaucacugaccuggugguggggcugug

SEQ ID NO: 671220 - RNA, 63 nt, Homo Sapiens
acuuuaaaggaaaaaucaaucacaaaauuaugccuucaucaaauuuaaagguuacuugaaugu

SEQ ID NO: 671221 - RNA, 63 nt, Homo Sapiens
uggaagccaacuguccugcccagucaagcaugucuucaucaaggcaucuugcccaggaucacu

SEQ ID NO: 671222 - RNA, 63 nt, Homo Sapiens
agaauaauuuauaacuugaccaucugcaacuugcuucaucauauugagauuuugcucaugaac

SEQ ID NO: 671223 - RNA, 63 nt, Homo Sapiens
aagcccauguuuugagauuuagcaucuaugugccuucaucaaguuauugcagugcaacuaaag

SEQ ID NO: 671224 - RNA, 63 nt, Homo Sapiens
gcuguaguccauaugugaauacuaaauguuaaacuucaucagcgucagaccuauuguaucaua

SEQ ID NO: 671225 - RNA, 63 nt, Homo Sapiens
cccaagcuucucaaacuguuagcugcugucugacuucaucaauaaaguauuuuuauuuuaaaa

SEQ ID NO: 671226 - RNA, 63 nt, Homo Sapiens
acucagacaguuaaucauagaaaagauuauuugcuucaucaguucauagaaaagauuauuugc

SEQ ID NO: 671227 - RNA, 63 nt, Homo Sapiens
uuugcuucaucaguucauagaaaagauuauuugcuucaucaguuaacuuguuuuuauaaauca

SEQ ID NO: 671228 - RNA, 63 nt, Homo Sapiens
uagugacccauggaagcuuccaagcaguuuucucuucaucacuacuaacaaacaaaacacuaa

SEQ ID NO: 671229 - RNA, 63 nt, Homo Sapiens
uuagcaguguguacacuacuguaucaucaucagcuucaucacccuguaaaccaggcuccucug

SEQ ID NO: 671230 - RNA, 63 nt, Homo Sapiens
gaacuccaggacggcuacagccaaugcccacggcuucaucauggguggaggccgcacagaagg

SEQ ID NO: 671231 - RNA, 63 nt, Homo Sapiens
uacgaguuuguccugggagagcaaccucaucgccuucaucauccucaggccagaugaccagcg

SEQ ID NO: 671232 - RNA, 64 nt, Homo Sapiens; identical to SEQ ID NO: 193920

SEQ ID NO: 671233 - RNA, 64 nt, Homo Sapiens; identical to SEQ ID NO: 193921

SEQ ID NO: 671234 - RNA, 64 nt, Homo Sapiens; identical to SEQ ID NO: 193922

SEQ ID NO: 671235 - RNA, 64 nt, Homo Sapiens; identical to SEQ ID NO: 193923

SEQ ID NO: 671236 - RNA, 64 nt, Homo Sapiens; identical to SEQ ID NO: 193924

SEQ ID NO: 671237 - RNA, 64 nt, Homo Sapiens; identical to SEQ ID NO: 193925

SEQ ID NO: 671238 - RNA, 64 nt, Homo Sapiens; identical to SEQ ID NO: 193926

SEQ ID NO: 671239 - RNA, 64 nt, Homo Sapiens; identical to SEQ ID NO: 193927

SEQ ID NO: 671240 - RNA, 64 nt, Homo Sapiens; identical to SEQ ID NO: 193928

SEQ ID NO: 671241 - RNA, 64 nt, Homo Sapiens; identical to SEQ ID NO: 193929

SEQ ID NO: 671242 - RNA, 64 nt, Homo Sapiens; identical to SEQ ID NO: 193930

SEQ ID NO: 671243 - RNA, 64 nt, Homo Sapiens; identical to SEQ ID NO: 193931

SEQ ID NO: 671244 - RNA, 64 nt, Homo Sapiens; identical to SEQ ID NO: 193932

SEQ ID NO: 671245 - RNA, 64 nt, Homo Sapiens; identical to SEQ ID NO: 193933

SEQ ID NO: 671246 - RNA, 64 nt, Homo Sapiens; identical to SEQ ID NO: 193934

SEQ ID NO: 671247 - RNA, 64 nt, Homo Sapiens; identical to SEQ ID NO: 193935

SEQ ID NO: 671248 - RNA, 64 nt, Homo Sapiens; identical to SEQ ID NO: 193936

SEQ ID NO: 671249 - RNA, 64 nt, Homo Sapiens; identical to SEQ ID NO: 193937

SEQ ID NO: 671250 - RNA, 64 nt, Homo Sapiens; identical to SEQ ID NO: 193938

SEQ ID NO: 671251 - RNA, 64 nt, Homo Sapiens; identical to SEQ ID NO: 193939

SEQ ID NO: 671252 - RNA, 64 nt, Homo Sapiens; identical to SEQ ID NO: 193940

SEQ ID NO: 671253 - RNA, 64 nt, Homo Sapiens; identical to SEQ ID NO: 193941

SEQ ID NO: 671254 - RNA, 64 nt, Homo Sapiens; identical to SEQ ID NO: 193942

SEQ ID NO: 671255 - RNA, 64 nt, Homo Sapiens; identical to SEQ ID NO: 193943

SEQ ID NO: 671256 - RNA, 64 nt, Homo Sapiens; identical to SEQ ID NO: 193944

SEQ ID NO: 671257 - RNA, 64 nt, Homo Sapiens; identical to SEQ ID NO: 193945

SEQ ID NO: 671258 - RNA, 64 nt, Homo Sapiens; identical to SEQ ID NO: 193946

SEQ ID NO: 671259 - RNA, 64 nt, Homo Sapiens; identical to SEQ ID NO: 193947

SEQ ID NO: 671260 - RNA, 64 nt, Homo Sapiens; identical to SEQ ID NO: 193948

SEQ ID NO: 671261 - RNA, 64 nt, Homo Sapiens; identical to SEQ ID NO: 193949

SEQ ID NO: 671262 - RNA, 64 nt, Homo Sapiens; identical to SEQ ID NO: 193950

SEQ ID NO: 671263 - RNA, 64 nt, Homo Sapiens; identical to SEQ ID NO: 193951

SEQ ID NO: 671264 - RNA, 64 nt, Homo Sapiens; identical to SEQ ID NO: 193952

SEQ ID NO: 671265 - RNA, 64 nt, Homo Sapiens; identical to SEQ ID NO: 193953

SEQ ID NO: 671266 - RNA, 64 nt, Homo Sapiens; identical to SEQ ID NO: 193954

SEQ ID NO: 671267 - RNA, 64 nt, Homo Sapiens; identical to SEQ ID NO: 193955

SEQ ID NO: 671268 - RNA, 64 nt, Homo Sapiens; identical to SEQ ID NO: 193956

SEQ ID NO: 671269 - RNA, 64 nt, Homo Sapiens; identical to SEQ ID NO: 193957

SEQ ID NO: 671270 - RNA, 64 nt, Homo Sapiens; identical to SEQ ID NO: 193958

SEQ ID NO: 671271 - RNA, 64 nt, Homo Sapiens; identical to SEQ ID NO: 193959

SEQ ID NO: 671272 - RNA, 64 nt, Homo Sapiens; identical to SEQ ID NO: 193960

SEQ ID NO: 671273 - RNA, 54 nt, Homo Sapiens; identical to SEQ ID NO: 193961

SEQ ID NO: 671274 - RNA, 64 nt, Homo Sapiens; identical to SEQ ID NO: 193962

SEQ ID NO: 671275 - RNA, 64 nt, Homo Sapiens; identical to SEQ ID NO: 193963

SEQ ID NO: 671276 - RNA, 64 nt, Homo Sapiens; identical to SEQ ID NO: 193964

SEQ ID NO: 671277 - RNA, 64 nt, Homo Sapiens; identical to SEQ ID NO: 193965

SEQ ID NO: 671278 - RNA, 64 nt, Homo Sapiens; identical to SEQ ID NO: 245086

SEQ ID NO: 671279 - RNA, 64 nt, Homo Sapiens; identical to SEQ ID NO: 245087

SEQ ID NO: 671280 - RNA, 64 nt, Homo Sapiens; identical to SEQ ID NO: 245088

SEQ ID NO: 671281 - RNA, 64 nt, Homo Sapiens
uguuacuaggguggccucucucccauuucccgcuguggcugagccaaacuucauuacuuuccuu

SEQ ID NO: 671282 - RNA, 64 nt, Homo Sapiens
uauuggauuccaaacugcuaugcccucuauaccaguggcugacaaggcauauagggauauaugc

SEQ ID NO: 671283 - RNA, 64 nt, Homo Sapiens
ugcauggccacucuugcccccaagggcccaggcuguggcugacacauagaagguggccacauag

SEQ ID NO: 671284 - RNA, 64 nt, Homo Sapiens
cugacaccacagucaauuaauuccucaggggccuguggcugaagaaaaggugcccagcccccac

SEQ ID NO: 671285 - RNA, 64 nt, Homo Sapiens
ccgaccacgguucuugacuuguggcgcugagugaguggcugagacacggacuucggagcauaga

SEQ ID NO: 671286 - RNA, 64 nt, Homo Sapiens
gcgauccgggcuugguuuuggcggcacugagugaguggcugacacgcuguccgaggagcuccau

SEQ ID NO: 671287 - RNA, 64 nt, Homo Sapiens
cccggcuucaccuucccagaacaagaauguggugguggcugacuucgggcuggcgcgucucaug

SEQ ID NO: 671288 - RNA, 64 nt, Homo Sapiens
agagagggcugaucccauggggcggagguccccaguggcugagcaaacagccccuucucucgcu

SEQ ID NO: 671289 - RNA, 64 nt, Homo Sapiens
ccccuuguaagaaagcauucucugguuuacagugguggcugacagaguaaguuugugguuuguu

SEQ ID NO: 671290 - RNA, 64 nt, Homo Sapiens
cugagugaagguguuugaaaaugugguggccgcuguggcugacaaaggugcggggccagcugcu

SEQ ID NO: 671291 - RNA, 64 nt, Homo Sapiens
caugggguaugccgggcacuuguugcuagcucagguggcugacacccacagcccugagagaugg

SEQ ID NO: 671292 - RNA, 64 nt, Homo Sapiens
ggucacugagugauaagcauggcagcccuucucuguggcugacauuggggcaggguuagcagau

SEQ ID NO: 671293 - RNA, 64 nt, Homo Sapiens
gaccagggugucacccacugugaggggccgggguguggcugagugcggccaggacagcagaggc

SEQ ID NO: 671294 - RNA, 64 nt, Homo Sapiens
gaccggggugugcccggcagugggccgagccaguguggcugagucacagaccucgggaaggcgc

SEQ ID NO: 671295 - RNA, 64 nt, Homo Sapiens
gugauuuuuuuucugaaacucacacaacuaggaaguggcugagucaggacuugaacccaggucu

SEQ ID NO: 671296 - RNA, 64 nt, Homo Sapiens
ucucccuggaucagaacaggagcucuuaacuacaguggcugaauagcuucuccaaaggcucccu

SEQ ID NO: 671297 - RNA, 64 nt, Homo Sapiens; identical to SEQ ID NO: 300148

SEQ ID NO: 671298 - RNA, 64 nt, Homo Sapiens; identical to SEQ ID NO: 300149

SEQ ID NO: 671299 - RNA, 64 nt, Homo Sapiens; identical to SEQ ID NO: 300150

SEQ ID NO: 671300 - RNA, 64 nt, Homo Sapiens; identical to SEQ ID NO: 300151

SEQ ID NO: 671301 - RNA, 64 nt, Homo Sapiens; identical to SEQ ID NO: 300152

SEQ ID NO: 671302 - RNA, 64 nt, Homo Sapiens; identical to SEQ ID NO: 300153

SEQ ID NO: 671303 - RNA, 64 nt, Homo Sapiens; identical to SEQ ID NO: 300154

SEQ ID NO: 671304 - RNA, 64 nt, Homo Sapiens; identical to SEQ ID NO: 300155

SEQ ID NO: 671305 - RNA, 64 nt, Homo Sapiens; identical to SEQ ID NO: 300156

SEQ ID NO: 671306 - RNA, 64 nt, Homo Sapiens; identical to SEQ ID NO: 300157

SEQ ID NO: 671307 - RNA, 64 nt, Homo Sapiens; identical to SEQ ID NO: 300158

SEQ ID NO: 671308 - RNA, 64 nt, Homo Sapiens; identical to SEQ ID NO: 300159

SEQ ID NO: 671309 - RNA, 64 nt, Homo Sapiens; identical to SEQ ID NO: 300160

SEQ ID NO: 671310 - RNA, 64 nt, Homo Sapiens; identical to SEQ ID NO: 300161

SEQ ID NO: 671311 - RNA, 64 nt, Homo Sapiens; identical to SEQ ID NO: 300162

SEQ ID NO: 671312 - RNA, 64 nt, Homo Sapiens; identical to SEQ ID NO: 300163

SEQ ID NO: 671313 - RNA, 64 nt, Homo Sapiens; identical to SEQ ID NO: 300164

SEQ ID NO: 671314 - RNA, 64 nt, Homo Sapiens; identical to SEQ ID NO: 300165

SEQ ID NO: 671315 - RNA, 64 nt, Homo Sapiens; identical to SEQ ID NO: 300166

SEQ ID NO: 671316 - RNA, 64 nt, Homo Sapiens; identical to SEQ ID NO: 300167

SEQ ID NO: 671317 - RNA, 64 nt, Homo Sapiens; identical to SEQ ID NO: 300168

SEQ ID NO: 671318 - RNA, 64 nt, Homo Sapiens; identical to SEQ ID NO: 300169

SEQ ID NO: 671319 - RNA, 64 nt, Homo Sapiens; identical to SEQ ID NO: 300170

SEQ ID NO: 671320 - RNA, 64 nt, Homo Sapiens; identical to SEQ ID NO: 300171

SEQ ID NO: 671321 - RNA, 64 nt, Homo Sapiens; identical to SEQ ID NO: 300172

SEQ ID NO: 671322 - RNA, 64 nt, Homo Sapiens; identical to SEQ ID NO: 300173

SEQ ID NO: 671323 - RNA, 64 nt, Homo Sapiens; identical to SEQ ID NO: 300174

SEQ ID NO: 671324 - RNA, 64 nt, Homo Sapiens; identical to SEQ ID NO: 300175

SEQ ID NO: 671325 - RNA, 64 nt, Homo Sapiens; identical to SEQ ID NO: 300176

SEQ ID NO: 671326 - RNA, 64 nt, Homo Sapiens; identical to SEQ ID NO: 300177

SEQ ID NO: 671327 - RNA, 64 nt, Homo Sapiens; identical to SEQ ID NO: 300178

SEQ ID NO: 671328 - RNA, 64 nt, Homo Sapiens; identical to SEQ ID NO: 300179

SEQ ID NO: 671329 - RNA, 64 nt, Homo Sapiens; identical to SEQ ID NO: 300180

SEQ ID NO: 671330 - RNA, 64 nt, Homo Sapiens; identical to SEQ ID NO: 300181

SEQ ID NO: 671331 - RNA, 64 nt, Homo Sapiens; identical to SEQ ID NO: 300182

SEQ ID NO: 671332 - RNA, 64 nt, Homo Sapiens; identical to SEQ ID NO: 300183

SEQ ID NO: 671333 - RNA, 64 nt, Homo Sapiens; identical to SEQ ID NO: 300184

SEQ ID NO: 671334 - RNA, 64 nt, Homo Sapiens; identical to SEQ ID NO: 300185

SEQ ID NO: 671335 - RNA, 64 nt, Homo Sapiens; identical to SEQ ID NO: 300186

SEQ ID NO: 671336 - RNA, 64 nt, Homo Sapiens; identical to SEQ ID NO: 300187

SEQ ID NO: 671337 - RNA, 64 nt, Homo Sapiens; identical to SEQ ID NO: 300188

SEQ ID NO: 671338 - RNA, 64 nt, Homo Sapiens; identical to SEQ ID NO: 300189

SEQ ID NO: 671339 - RNA, 64 nt, Homo Sapiens; identical to SEQ ID NO: 300190

SEQ ID NO: 671340 - RNA, 64 nt, Homo Sapiens; identical to SEQ ID NO: 300191

SEQ ID NO: 671341 - RNA, 64 nt, Homo Sapiens; identical to SEQ ID NO: 309737

SEQ ID NO: 671342 - RNA, 64 nt, Homo Sapiens; identical to SEQ ID NO: 309738

SEQ ID NO: 671343 - RNA, 64 nt, Homo Sapiens; identical to SEQ ID NO: 309739

SEQ ID NO: 671344 - RNA, 64 nt, Homo Sapiens; identical to SEQ ID NO: 309740

SEQ ID NO: 671345 - RNA, 64 nt, Homo Sapiens; identical to SEQ ID NO: 309741

SEQ ID NO: 671346 - RNA, 64 nt, Homo Sapiens; identical to SEQ ID NO: 309742

SEQ ID NO: 671347 - RNA, 64 nt, Homo Sapiens
aaacucaaggcuuauauuaagcaaacacuugaagugagaagaugauccacaacuugagaagaca

SEQ ID NO: 671348 - RNA, 64 nt, Homo Sapiens
gcaaacacuugaagugagaagaugauccacaacuugagaagacauuuauaauacaaauaacuga

SEQ ID NO: 671349 - RNA, 64 nt, Homo Sapiens
cacaggucucccgucccugccacuggcccugccuugagaagagaucaggagcacugugguagag

SEQ ID NO: 671350 - RNA, 64 nt, Homo Sapiens
gggagaaaagaccaugaaauaaggggaaaaaaccugagaagaaauagagaaaauauuaauuuuc

SEQ ID NO: 671351 - RNA, 64 nt, Homo Sapiens
agaaagaaaugaugcugagggaagauaccuggggugagaagauggggcgaaacaacugaugggg

SEQ ID NO: 671352 - RNA, 64 nt, Homo Sapiens
acauuuucugacuuacccuucuuggaugaaacagugagaagaaacagacucaagccucuagacu

SEQ ID NO: 671353 - RNA, 64 nt, Homo Sapiens
ucuuaauauuucaaguuuacaucaagauaaacccugagaagaacuacggagaaaucaaauaaaa

SEQ ID NO: 671354 - RNA, 64 nt, Homo Sapiens
uguggcagguagggaaggggagaugucugucucuugagaagagagaggcaugugugccggcauc

SEQ ID NO: 671355 - RNA, 64 nt, Homo Sapiens
cagcagauuguaauuugguuauaguauuugaaaaugagaagaagcuuuaacagugugaaucuuu

SEQ ID NO: 671356 - RNA, 64 nt, Homo Sapiens
uaagagaaaugaaagagaagucguuacacuggggugagaagagaugguaaaaaccuguagcgau

SEQ ID NO: 671357 - RNA, 64 nt, Homo Sapiens
gagauuccuccagugccugagaaccgauuuuuacugagaagagauaugccuguuguuacugcag

SEQ ID NO: 671358 - RNA, 64 nt, Homo Sapiens
gugcuggagaaaguaccgggaagaaggagguggcugagaagagccagaucaaccucauugauaa

SEQ ID NO: 671359 - RNA, 64 nt, Homo Sapiens
uaagagaugugaaccuuggugagcucugauacagugagaagagauuauacucaugaaagagaau

SEQ ID NO: 671360 - RNA, 64 nt, Homo Sapiens
aagaugcuaccaaugaaauagaaaaccaacgagaugagaagacugugauccucauguacucaga

SEQ ID NO: 671361 - RNA, 64 nt, Homo Sapiens
uagauucuggguucagggguccccaucugucaaaugagaagauuggauuaucuaaucuuuuaga

SEQ ID NO: 671362 - RNA, 64 nt, Homo Sapiens
gacaccugccagagugaaguuugauuccuaugggugagaagauguagaugacuauuguucucac

SEQ ID NO: 671363 - RNA, 64 nt, Homo Sapiens
gaggguccuccacuuucagcgcucaguuaaggaaugagaagauauuuuuuucuuaacaucggug

SEQ ID NO: 671364 - RNA, 64 nt, Homo Sapiens
uguuaaaaauuuuuagcuuguucuaaauauuuugugagaagaaaaacacuaaugcacugacaga

SEQ ID NO: 671365 - RNA, 64 nt, Homo Sapiens
guucacgccagagugcuuaucagagggagagcgcugagaagacugcaucaggaaaggagaaagg

SEQ ID NO: 671366 - RNA, 64 nt, Homo Sapiens
cgguggcugccuauguucucucgcuuugcuuuccugagaagaugacugugaggguagaguaggc

SEQ ID NO: 671367 - RNA, 64 nt, Homo Sapiens
ugaauccauggucucaaagggacagugagaagacugagaagaugugagaacuguaucuuugugg

SEQ ID NO: 671368 - RNA, 64 nt, Homo Sapiens
gagaagaugugaauccauggucuuugugggacagugagaagacuuggugcagcugagaacugua

SEQ ID NO: 671369 - RNA, 64 nt, Homo Sapiens
uuuaguaguacugugaaguucgugcuuaccuggaugagaagaauaaaugacacggauacacucc

SEQ ID NO: 671370 - RNA, 64 nt, Homo Sapiens
uggaugagaagaauaaaugacacggauacacuccugagaagacacucguuaaacauugcaucgg

SEQ ID NO: 671371 - RNA, 64 nt, Homo Sapiens
uuagggucucaaagcaagauuuuaaagugauuuuugagaagacuugggggggacaauaauagac

SEQ ID NO: 671372 - RNA, 64 nt, Homo Sapiens
uuuuucugcuacuacuacaguuucacagaauaccugagaagacacacuuggagaaaccuuuugg

SEQ ID NO: 671373 - RNA, 64 nt, Homo Sapiens
augcugcauagggcaggagccugaaaagcuaauuugagaagauaauaaguaggauuuuuguuuu

SEQ ID NO: 671374 - RNA, 64 nt, Homo Sapiens
agggcugugccuucuaaagauuccaacagagaugugagaagauaauacagaugaaccaaagaug

SEQ ID NO: 671375 - RNA, 64 nt, Homo Sapiens
auacuaggagcaauuaggagccauaugccugggcugagaagagcuaggcaguagugaccuuagg

SEQ ID NO: 671376 - RNA, 64 nt, Homo Sapiens
cgcuccugcugaagaguuuagaaugaggcagcggugagaagaagggugggagggcgugggggcc

SEQ ID NO: 671377 - RNA, 64 nt, Homo Sapiens
uauuuggacacaugaauuaaaucccaagggaaagugagaagaaaauuaauguauuagcaaccag

SEQ ID NO: 671378 - RNA, 64 nt, Homo Sapiens
ccaccugugcuuggaauuccucauucauugacuuugagaagacuggcucguccugauauuuuuu

SEQ ID NO: 671379 - RNA, 64 nt, Homo Sapiens
auauuguggcucguccugauagaguccugucugcugagaagacacagcagaacauuugcuggcg

SEQ ID NO: 671380 - RNA, 64 nt, Homo Sapiens
ugugacggcccaguggcucugcgugguacaugacugagaagagaaaaacaaaaauaaaucauac

SEQ ID NO: 671381 - RNA, 64 nt, Homo Sapiens
ugggaucuaggaagaaagaauccaguguagaaguugagaagaacuugaacguuuugguucugga

SEQ ID NO: 671382 - RNA, 64 nt, Homo Sapiens
uuuuuuugcaauaacaaggugaaaucaauauuguugagaagauucuuccaucugguaauguuga

SEQ ID NO: 671383 - RNA, 64 nt, Homo Sapiens
auauuguugagaagauucuuccaucugguaauguugagaagacuucauuugguaggagucccuu

SEQ ID NO: 671384 - RNA, 64 nt, Homo Sapiens
uuuucaauguaagaggaaggucauauaguauuugugagaagaagaccaacuguguagugugccc

SEQ ID NO: 671385 - RNA, 64 nt, Homo Sapiens
uguuaucuauucagcaugucaauuggauuauauaugagaagagcuuuccagcccuuguccuccu

SEQ ID NO: 671386 - RNA, 64 nt, Homo Sapiens
ucaguccacccagaguuagacugcccugggcuguugagaagagaaggugaaugagggaccagcc

SEQ ID NO: 671387 - RNA, 64 nt, Homo Sapiens
gagaaauuguccaaagagucggagauugaaggguugagaagaaaggggguagggggguggauua

SEQ ID NO: 671388 - RNA, 64 nt, Homo Sapiens
cuaaaccauacaaaguguuggauggagcauuuuuugagaagaaacccaauucucugaagucuac

SEQ ID NO: 671389 - RNA, 64 nt, Homo Sapiens
agaagucaacccaucccaaaccacuuccccuccuugagaagacccugaaucaaagacagcuugg

SEQ ID NO: 671390 - RNA, 61 nt, Homo Sapiens
cuagauuccacaggccauagagauuuucuucugagaagaauuuguguuuaauuuuuugaua

SEQ ID NO: 671391 - RNA, 64 nt, Homo Sapiens
guucagcucaagacuacccuaccugcuguguuugugagaagaguaggaucacacacacaggugc

SEQ ID NO: 671392 - RNA, 64 nt, Homo Sapiens; identical to SEQ ID NO: 585938

SEQ ID NO: 671393 - RNA, 64 nt, Homo Sapiens; identical to SEQ ID NO: 585939

SEQ ID NO: 671394 - RNA, 64 nt, Homo Sapiens; identical to SEQ ID NO: 585975

SEQ ID NO: 671395 - RNA, 64 nt, Homo Sapiens; identical to SEQ ID NO: 585976

SEQ ID NO: 671396 - RNA, 64 nt, Homo Sapiens; identical to SEQ ID NO: 585989

SEQ ID NO: 671397 - RNA, 64 nt, Homo Sapiens; identical to SEQ ID NO: 585990

SEQ ID NO: 671398 - RNA, 64 nt, Homo Sapiens; identical to SEQ ID NO: 586015

SEQ ID NO: 671399 - RNA, 64 nt, Homo Sapiens; identical to SEQ ID NO: 586016

SEQ ID NO: 671400 - RNA, 64 nt, Homo Sapiens; identical to SEQ ID NO: 586033

SEQ ID NO: 671401 - RNA, 64 nt, Homo Sapiens; identical to SEQ ID NO: 586034

SEQ ID NO: 671402 - RNA, 64 nt, Homo Sapiens; identical to SEQ ID NO: 586055

SEQ ID NO: 671403 - RNA, 64 nt, Homo Sapiens; identical to SEQ ID NO: 586056

SEQ ID NO: 671404 - RNA, 64 nt, Homo Sapiens; identical to SEQ ID NO: 586149

SEQ ID NO: 671405 - RNA, 64 nt, Homo Sapiens; identical to SEQ ID NO: 586150

SEQ ID NO: 671406 - RNA, 64 nt, Homo Sapiens; identical to SEQ ID NO: 586153

SEQ ID NO: 671407 - RNA, 64 nt, Homo Sapiens; identical to SEQ ID NO: 586154

SEQ ID NO: 671408 - RNA, 64 nt, Homo Sapiens; identical to SEQ ID NO: 586176

SEQ ID NO: 671409 - RNA, 64 nt, Homo Sapiens; identical to SEQ ID NO: 586177

SEQ ID NO: 671410 - RNA, 64 nt, Homo Sapiens; identical to SEQ ID NO: 586192

SEQ ID NO: 671411 - RNA, 64 nt, Homo Sapiens; identical to SEQ ID NO: 586193

SEQ ID NO: 671412 - RNA, 64 nt, Homo Sapiens; identical to SEQ ID NO: 586220

SEQ ID NO: 671413 - RNA, 64 nt, Homo Sapiens; identical to SEQ ID NO: 586221

SEQ ID NO: 671414 - RNA, 64 nt, Homo Sapiens; identical to SEQ ID NO: 586224

SEQ ID NO: 671415 - RNA, 64 nt, Homo Sapiens; identical to SEQ ID NO: 586225

SEQ ID NO: 671416 - RNA, 64 nt, Homo Sapiens
guccucacguucccaggagggcggcuucacccuucguaaccaggagacaaggcggccauggauu

SEQ ID NO: 671417 - RNA, 64 nt, Homo Sapiens
accgccuaagaaacagaacuucgagaaguccuaacguaaccacaguaaagcagacuccccuuuc

SEQ ID NO: 671418 - RNA, 64 nt, Homo Sapiens
gaagcauaauuagaagcagaagaacaaaaugccacguaaccaaagcaucagagccaucauugca

SEQ ID NO: 671419 - RNA, 64 nt, Homo Sapiens
ggaaugcaccccacauucccaugauggaagucugcguaaccaauaaauugugccuuucucacuc

SEQ ID NO: 671420 - RNA, 64 nt, Homo Sapiens
uugguuaagcagcuuaugaaagucacuuagcugacguaaccagcgcaacauuaagugcuaugcu

SEQ ID NO: 671421 - RNA, 64 nt, Homo Sapiens
aaagcacggacucuuacugcuaacuuuuguguaucguaaccagccagauccucuugguuauuug

SEQ ID NO: 671422 - RNA, 64 nt, Homo Sapiens
cccuguagcugucuaaguuaaucuuucuauugcucguaaccaguuuuuaaaaaucauguuugac

SEQ ID NO: 671423 - RNA, 64 nt, Homo Sapiens
gacaaugucuggcugaagcccgcuuucagcacgccguaaccaggggcugacaaugcgaggucgc

SEQ ID NO: 671424 - RNA, 64 nt, Homo Sapiens
aaaacaccaggauuuagguuuauuauaugccacccguaaccauaguaacauuggcuuaccugua

SEQ ID NO: 671425 - RNA, 64 nt, Homo Sapiens
uuuuucaccuccaugucaucgcgcucaggaauaucguaaccagugaccuugacuacucagucca

SEQ ID NO: 671426 - RNA, 64 nt, Homo Sapiens
ggucagcccuagcugacaaauacccuguggaaaacguaaccacuugauguccuugcaaaugcau

SEQ ID NO: 671427 - RNA, 64 nt, Homo Sapiens
acauucaauuccagaguaguuucaaguuucacaucguaaccauuuucgcccccauggcccaugu

SEQ ID NO: 671428 - RNA, 64 nt, Homo Sapiens
uccuuucccccgcuaacuggcuccuccgcuguuucguaaccauauauuugaauagagaguaaag

SEQ ID NO: 671429 - RNA, 64 nt, Homo Sapiens
caccccauccaccuuacagggaccagggggcccacguaaccaggacccagaggguggagcucuu

SEQ ID NO: 671430 - RNA, 64 nt, Homo Sapiens
gaccagcacaugucagggaagggcucccucaucucguaaccagacuucuuuugcucugaggugu

SEQ ID NO: 671431 - RNA, 64 nt, Homo Sapiens
gaaaagagcgcaucaggccuucacacugguagaacguaaccacgagagggagaagggauggagg

SEQ ID NO: 671432 - RNA, 64 nt, Homo Sapiens
acuacaguugauccuccgcaagcagguaaugaaucguaaccaaauaacgaaccguaaaaaaagg

SEQ ID NO: 671433 - RNA, 64 nt, Homo Sapiens
auuguuaguugucaaccuuggcugauggaaaucccguaaccacuauuuguugcacugugccuug

SEQ ID NO: 671434 - RNA, 64 nt, Homo Sapiens
cacagcaccuggcccgccaaccugcaucuggaaacguaaccacuccaaagucaaaggauuugaa

SEQ ID NO: 671435 - RNA, 64 nt, Homo Sapiens
agauguaauuauugacagauuaaauagauaacuucguaaccaccagggggcagauucaauacau

SEQ ID NO: 671436 - RNA, 64 nt, Homo Sapiens
cacagagggagcagacaguggguaccacgaucuccguaaccauuugcaugugacuuagcaaggg

SEQ ID NO: 671437 - RNA, 64 nt, Homo Sapiens
cucuucggacugugagcccuccccucggagacuccguaaccaaagucuuuucugccaccuguua

SEQ ID NO: 671438 - RNA, 64 nt, Homo Sapiens
auaagcacucauguuauuaaagguuuugccuugucguaaccaaccgagccggggguguuuuguu

SEQ ID NO: 671439 - RNA, 64 nt, Homo Sapiens
acccucacugcucccaggacugccccuuccuccucguaaccaaagccuccgcagaugagguucc

SEQ ID NO: 671440 - RNA, 64 nt, Homo Sapiens
uuuaaaagguaauaauacucugaaagaaaaaugacguaaccacagcguguacuaugaaagcugu

SEQ ID NO: 671441 - RNA, 64 nt, Homo Sapiens
gauucaccuuucguuucccuuuccccaaaaguagcguaaccaacauuuaagcuugcuuaaaaac

SEQ ID NO: 671442 - RNA, 64 nt, Homo Sapiens
ggaaucacauucuuagcacaccuacaccucuugaaaauagaacaacuugcagaauugagaguga

SEQ ID NO: 671443 - RNA, 64 nt, Homo Sapiens
gaagaagauaugugaagaaaaauguauuuuuccuaaauagaaauaaaugaucccauuuuuuggu

SEQ ID NO: 671444 - RNA, 64 nt, Homo Sapiens
auuucugcauaaaagucauauuuucuaccuuuguaaauagaaaccuaucuugcacugcuaacuu

SEQ ID NO: 671445 - RNA, 64 nt, Homo Sapiens
agugauguguuuuauaucaucuuucacugaauacaaauagaaaaauuuacuugaaauguaaaaa

SEQ ID NO: 671446 - RNA, 64 nt, Homo Sapiens
ucauacauuuauuacaguucggggaaugguguugaaauagaaccacaaauagaaaguuaauaaa

SEQ ID NO: 671447 - RNA, 64 nt, Homo Sapiens
uuaauaaaggggaaugguguggucaagggcauacaaauagaaagagccuggaagauuacucuuu

SEQ ID NO: 671448 - RNA, 64 nt, Homo Sapiens
aguauauauuuuuggaguaaugcaaauagaaaaaaaauagaauauguuugccuuuauaaacugu

SEQ ID NO: 671449 - RNA, 64 nt, Homo Sapiens
aaaauagaauaaguauauauuuauaaacuguugcaaauagaaaauugcagguguuuguuugccu

SEQ ID NO: 671450 - RNA, 64 nt, Homo Sapiens
uaucuugacuauuaaacuacguauaguguugcugaaauagaaagaaaacagcauuggaauugga

SEQ ID NO: 671451 - RNA, 64 nt, Homo Sapiens
ugaaaacagaaacaagaaugagguaguggcaaugaaauagaauuauuaguauauuaugaacauu

SEQ ID NO: 671452 - RNA, 64 nt, Homo Sapiens
uuuaaauaguauauauucaguuucucacugucuuaaauagaauuaucuuaaaaaaaaaaaaacg

SEQ ID NO: 671453 - RNA, 64 nt, Homo Sapiens
uagugcccuuuugugaccucuggcugcaguugaaaaauagaaaucaacacauguuuauuuugcu

SEQ ID NO: 671454 - RNA, 64 nt, Homo Sapiens
aguuaaaccauuuaaacacauuugaaacauacaaaaauagaaaugugaaagcauuuggugaaag

SEQ ID NO: 671455 - RNA, 64 nt, Homo Sapiens
agucagaagcugccaccuuagagaacugaaauaaaaauagaaguucuuacgcuuuuuuguggua

SEQ ID NO: 671456 - RNA, 64 nt, Homo Sapiens
guuugcuuuucuuaaaacauaccaaaaaagaaaaaaauagaaaaaaaaaaaaaaaaagcuugau

SEQ ID NO: 671457 - RNA, 64 nt, Homo Sapiens
gaguguuccaaaccaguaauccacaugccaauucaaauagaacagccccuugcuagauauuacc

SEQ ID NO: 671458 - RNA, 64 nt, Homo Sapiens
aaucaccugugguauauuuauaaauaaaaauauuaaauagaagguaaaacaaaucagacauaca

SEQ ID NO: 671459 - RNA, 64 nt, Homo Sapiens
cuuuguuuaguaauagguaggaaaaugaagaagaaaauagaauguugcagaauguggagggaug

SEQ ID NO: 671460 - RNA, 64 nt, Homo Sapiens
cagaaugaauuaauggaaaauuugaaugagggauaaauagaaaggaaaguauauauguuagagu

SEQ ID NO: 671461 - RNA, 64 nt, Homo Sapiens
uaugcuuccaccaauaaaccgucucguuuauuuuaaauagaaucgaaguagacccuagaaaauu

SEQ ID NO: 671462 - RNA, 64 nt, Homo Sapiens
ccuucuaguuuuucuuguucaacuguugugccaaaaauagaauuaugcacaggcaacugugaga

SEQ ID NO: 671463 - RNA, 64 nt, Homo Sapiens
cauucccuuagagaugaggauaaccuccggcuggaaauagaaagucauauuugcauuucauguu

SEQ ID NO: 671464 - RNA, 64 nt, Homo Sapiens
ucuccuuucaguauuuggcaauaaaagaaagaagaaauagaacagcugaagucucaaaucauug

SEQ ID NO: 671465 - RNA, 64 nt, Homo Sapiens
auggcgagucagggaauaaaaagucaaaagaaacaaauagaagcuuuuuuuuuuaaaaaaugua

SEQ ID NO: 671466 - RNA, 64 nt, Homo Sapiens
uuaagauuucuuuauguggaacaucuauagagauaaauagaaauuuucaauaagauguaguaac

SEQ ID NO: 671467 - RNA, 64 nt, Homo Sapiens
ucugguagguaaauuucuuauuaaaucaaucuugaaauagaaaauguaauaacuuucuuaccau

SEQ ID NO: 671468 - RNA, 64 nt, Homo Sapiens
uacugcaaaaauccccuugucccaggauacccuaaaauagaaguauauuuugauguuuguuuau

SEQ ID NO: 671469 - RNA, 64 nt, Homo Sapiens
gagaagucugaauauugugcuuuuuguuguuuguaaauagaauugaauuuaaauacaccaggau

SEQ ID NO: 671470 - RNA, 64 nt, Homo Sapiens
uuuauacaaaaaaaaaagaacauuuccaaaacuaaaauagaaaaugcuuguggcauuuauuuuc

SEQ ID NO: 671471 - RNA, 64 nt, Homo Sapiens
guuccaaagcuuuuucaaacuagaauaaggaggcaaauagaagaaugagauacugauguccaca

SEQ ID NO: 671472 - RNA, 64 nt, Homo Sapiens
gaaaauauauucuaguagguuuuugccucccaguaaauagaaaguggaacaaaauugcgaaggc

SEQ ID NO: 671473 - RNA, 64 nt, Homo Sapiens
aaaaacaauggugaauuuuguaacuaagucauacaaauagaaggaaaagggucuugcccuugaa

SEQ ID NO: 671474 - RNA, 64 nt, Homo Sapiens
caaucaugucagucugcuuagaaauaacagaagaaaauagaauugacauugaaaucuaggaaaa

SEQ ID NO: 671475 - RNA, 64 nt, Homo Sapiens
cuuaucuuacgaaaaaaugguagcauuuuaaacaaaauagaaaguugcaaggcaaauguuuauu

SEQ ID NO: 671476 - RNA, 64 nt, Homo Sapiens
cgaacuucaagagaaguuguaaagcuagugaccuaaauagaaagaccaggguuggcuuuauuua

SEQ ID NO: 671477 - RNA, 64 nt, Homo Sapiens
caaacuacauauuuggauaaacaguugcuuaaugaaauagaaucagcauuuaguaguagaaaug

SEQ ID NO: 671478 - RNA, 64 nt, Homo Sapiens
uuauugaauauacauucuuugauuagauugaauuaaauagaaacauuaaauuucuaauugagca

SEQ ID NO: 671479 - RNA, 64 nt, Homo Sapiens
guggguggauaaaguuuucacuuguaaguaauguaaauagaaagggcuaauauggaaccaaacu

SEQ ID NO: 671480 - RNA, 64 nt, Homo Sapiens
acaagacugguaaacaugccuuuuuaaaaagcagaaauagaaauuguacauauguaccuauuuu

SEQ ID NO: 671481 - RNA, 64 nt, Homo Sapiens
uaccgauuagaucuauccauuguagaauucauguaaauagaauacuguaguauguacuuugccu

SEQ ID NO: 671482 - RNA, 64 nt, Homo Sapiens
ugaaaauuaggaguggauuggagaaauuggggggaaauagaagaguacggagaaaggaagagau

SEQ ID NO: 671483 - RNA, 64 nt, Homo Sapiens
uugucauguuucaaauaaagagaacugaaguagaaaauagaaaugccaguaaacaacauaaugu

SEQ ID NO: 671484 - RNA, 64 nt, Homo Sapiens
gucacuacugaacaaaauuguucccucuucuguuaaauagaauagguuuaaaugacuagucaaa

SEQ ID NO: 671485 - RNA, 64 nt, Homo Sapiens
uuaaucacauccuaggaauagcacaauaauugggaaauagaacccuuaucacuagaagaaccau

SEQ ID NO: 671486 - RNA, 64 nt, Homo Sapiens
uuucugaauuuguuuaaacuguaacaauaaaguaaaauagaaugcaugaaagauauucuggcga

SEQ ID NO: 671487 - RNA, 64 nt, Homo Sapiens
uguaaagucaucaggauagccauacuucuuguguaaauagaaacagauuccugcugugaauaaa

SEQ ID NO: 671488 - RNA, 64 nt, Homo Sapiens
uuccugcugugaauaaacaugaaaaaaaaaaaagaaauagaagaucugauacaauagcaaacuu

SEQ ID NO: 671489 - RNA, 64 nt, Homo Sapiens
uuuaaacuaugugccuaaucccacaccaauaacgaaauagaaguaucuaggagagaauucauaa

SEQ ID NO: 671490 - RNA, 64 nt, Homo Sapiens
cgguuuuuauuuugcuuaguuuucucaugcugaaaaauagaacgaaaaauaucaggcauaaggu

SEQ ID NO: 671491 - RNA, 64 nt, Homo Sapiens
aagaacaguucuggacuauuaccccucagcccuaaaauagaaaacacauguagacuaaauagaa

SEQ ID NO: 671492 - RNA, 64 nt, Homo Sapiens
cccucagcccuaaaauagaagacacauguagacuaaauagaaaccuucucacguugcucagacu

SEQ ID NO: 671493 - RNA, 64 nt, Homo Sapiens
gaagaaauuuauaaugaaaacucuuauuaaggagaaauagaaaaaucaauuuaaugcccuaacu

SEQ ID NO: 671494 - RNA, 64 nt, Homo Sapiens
acaucuucuuuauuauccucuuuuucuaaacgacaaauagaaauaaugggcauuucugccuuuu

SEQ ID NO: 671495 - RNA, 64 nt, Homo Sapiens
agccuuguaacuguauuuacucaaaaaauaaauaaaauagaagccaacagagugagacuccguc

SEQ ID NO: 671496 - RNA, 64 nt, Homo Sapiens
agcuggccgggugcgguggcccaaguucagauuaaaauagaagccuuaaaguaggaagguguuu

SEQ ID NO: 671497 - RNA, 64 nt, Homo Sapiens
caguuuuuaauuacacugagauaauuuugaaaagaaauagaaauuaagcuacuauauaaaacaa

SEQ ID NO: 671498 - RNA, 64 nt, Homo Sapiens
aaaaaugcuuaguuuauacaaagauacuacacaaaaauagaacaauuagucugaauuaacguau

SEQ ID NO: 671499 - RNA, 64 nt, Homo Sapiens
aauauuaaaaugugaauaaauaaauguucugauaaaauagaaaagaaaguaaauuacagugauu

SEQ ID NO: 671500 - RNA, 64 nt, Homo Sapiens
uuauaggaggcaaacuguauaaaugauagguaugaaauagaauaagaaguaaaauacaucagca

SEQ ID NO: 671501 - RNA, 64 nt, Homo Sapiens
auauguuugaugaaaacuggcucaagauguuuguaaauagaaucaagagcaaaacugcacaaac

SEQ ID NO: 671502 - RNA, 64 nt, Homo Sapiens
cacaaauagcaaguguggaagaaaaccuauuuuuaaauagaaauuuggugacagagcacaaaua

SEQ ID NO: 671503 - RNA, 64 nt, Homo Sapiens
ccuauuuuuaaauagaaaucuggugacagagcacaaauagaaaaccauauaaaaggaaaaaaau

SEQ ID NO: 671504 - RNA, 64 nt, Homo Sapiens
uagcuuuuaaacugagcuuuauuaagccaguauaaaauagaaacuuuguauaauacaaauuuuc

SEQ ID NO: 671505 - RNA, 64 nt, Homo Sapiens
caaagauacaauuaaucugauauuauauuuguugaaauagaaauuugauuguacuauaaaugau

SEQ ID NO: 671506 - RNA, 64 nt, Homo Sapiens
ccuagccaacaugacgaaaccccaucucuacugaaaauagaaaaaaaaaauuagccaggcuugc

SEQ ID NO: 671507 - RNA, 64 nt, Homo Sapiens
acaacucuacuaguacaggcaaaguaaaaaauaaaaauagaaacuauuaaaaauaaaauuaaua

SEQ ID NO: 671508 - RNA, 64 nt, Homo Sapiens
aauuagguugaaaaugccccuggaaaauacaagaaaauagaaccaguuaugaagcaaauuaaaa

SEQ ID NO: 671509 - RNA, 64 nt, Homo Sapiens
gagcuaaucaaaauaauucagccaagucuauuugaaauagaaaacugucuauuuaauauaguaa

SEQ ID NO: 671510 - RNA, 64 nt, Homo Sapiens
aauuaggaaaaaaaucuggagaacaauaugguugaaauagaaacaagagaaugcaccuagguua

SEQ ID NO: 671511 - RNA, 64 nt, Homo Sapiens
cacccuguauaguaugggaauuauuuuuuauguuaaauagaaacugaauguacuggguugaaug

SEQ ID NO: 671512 - RNA, 64 nt, Homo Sapiens
ggggguuccgagagagcaccguagggcuuuucucaaauagaaaagccagauuuugaaaaaauuu

SEQ ID NO: 671513 - RNA, 64 nt, Homo Sapiens
gacaccaugagauguuaauauucauacauguaauaaauagaaugaugaagaaacuuuguuugua

SEQ ID NO: 671514 - RNA, 64 nt, Homo Sapiens
uggaugcaaaauaucacauaguaaaugaacuuaaaaauagaaugcuaaaggagacuucugaauu

SEQ ID NO: 671515 - RNA, 64 nt, Homo Sapiens
uuguuagaauuuguuagauuuugaguuuuacauaaaauagaaauauucaugcacaauccauaau

SEQ ID NO: 671516 - RNA, 64 nt, Homo Sapiens
cuuuuccacaccaguucugcuacuuucuuuuauaaaauagaaacacugccuuuagccuucugga

SEQ ID NO: 671517 - RNA, 64 nt, Homo Sapiens
acaccuaauuguuauugguuucugaaauguuuuaaaauagaaguugcuauaacauauauuuuuu

SEQ ID NO: 671518 - RNA, 64 nt, Homo Sapiens
uugcaucauaucauuucuguccauaauuguacugaaauagaaaagugaccgcucuugcucuugg

SEQ ID NO: 671519 - RNA, 64 nt, Homo Sapiens
uggugcuuuaucugaauaggccuggaucgaaguaaaauagaaaugggacuggcuuuccacagga

SEQ ID NO: 671520 - RNA, 64 nt, Homo Sapiens
uuuuguuagguacagucuggaucauggcauguagaaauagaaauuuagaauuuuacugcagcuu

SEQ ID NO: 671521 - RNA, 64 nt, Homo Sapiens
caauguucuugguuuuaauguuccaguugcugugaaauagaacuccuacaaucaaaagacaguu

SEQ ID NO: 671522 - RNA, 64 nt, Homo Sapiens
uuaauacugggcauucauacuuugguucaaauaaaaauagaagcauaguuaaccaaagaauaug

SEQ ID NO: 671523 - RNA, 64 nt, Homo Sapiens
uuucaccuccauauuccugauauuacaauacuaaaaauagaaaaugcaaaauuugcccagaucc

SEQ ID NO: 671524 - RNA, 64 nt, Homo Sapiens
uuaauaacuuuuaguaauuacuuuuauuaauuuaaaauagaacgcuugagaggcacuuuguaaa

SEQ ID NO: 671525 - RNA, 64 nt, Homo Sapiens
uuuaaaauuaauauuaauaacuuuuauuaauuuaaaauagaaugcuuaaaauaaaauagaaugc

SEQ ID NO: 671526 - RNA, 64 nt, Homo Sapiens
acuuuuauuaauuuaaaauagaaugcuuaaaauaaaauagaaugcuugagaggcacugaguaaa

SEQ ID NO: 671527 - RNA, 64 nt, Homo Sapiens
uuuuacaugauucuuaaacugaaacuugguguaaaaauagaauugagauggccuuuuuuucaca

SEQ ID NO: 671528 - RNA, 64 nt, Homo Sapiens
caaacccacucuucauauaucuccuucacucuaaaaauagaaucuauaguuagauuccaacuuc

SEQ ID NO: 671529 - RNA, 64 nt, Homo Sapiens
agaggaaguuagagauaauuuuacuuccauugcaaaauagaagaauaggugcaaacaaacaagc

SEQ ID NO: 671530 - RNA, 64 nt, Homo Sapiens
uucaguauuuuaugauaaucaauuaaaugagcuuaaauagaaaaugguccauccuaauucacag

SEQ ID NO: 671531 - RNA, 64 nt, Homo Sapiens
cuacauuuuggcaggaauaaccaaaaaacuucagaaauagaaaaccuuuguaagcuacuuaucu

SEQ ID NO: 671532 - RNA, 64 nt, Homo Sapiens
guuuuccuguuagauggcaagagcacaaugcccaaaauagaagaugcaguuaagaauaaggggc

SEQ ID NO: 671533 - RNA, 64 nt, Homo Sapiens
uuuaaaaggguaaaacaugacuauacagaaauuuaaauagaaauaguguauauacauauaaaau

SEQ ID NO: 671534 - RNA, 64 nt, Homo Sapiens
agaaaaggccgggcauggugauuuaaaaaaauaaaaauagaagaaguccaggaccguggauugu

SEQ ID NO: 671535 - RNA, 64 nt, Homo Sapiens
auuagccagguguaguggugcccaucucuacuaaaaauagaaaaccugaccaauauggugaaac

SEQ ID NO: 671536 - RNA, 64 nt, Homo Sapiens
gcucuuuuggguaucaacaccuaggucgccagugaaauagaacacagaacaggaacuagauuau

SEQ ID NO: 671537 - RNA, 64 nt, Homo Sapiens
gcaacauagugagacccugucucuaaaaaaauaaaaauagaaauaaaguagugcuuauuguuug

SEQ ID NO: 671538 - RNA, 64 nt, Homo Sapiens
agauugugcugguucuagcucauaauaaugaaaaaaauagaauuauauuuuguaugaauuguuu

SEQ ID NO: 671539 - RNA, 64 nt, Homo Sapiens
ugguuaguugggcaaaaucauuuauuacaugcaaaaauagaaaauuauuuguuaaauucagaga

SEQ ID NO: 671540 - RNA, 64 nt, Homo Sapiens
caguauaacaccacuuccaauuaggaaaaagcauaaauagaaugaaacguuuucauuuguugau

SEQ ID NO: 671541 - RNA, 64 nt, Homo Sapiens
guuuucauuuguugauuuaguuaacuuugaucagaaauagaaacaauugcuuuguuuggcuuga

SEQ ID NO: 671542 - RNA, 64 nt, Homo Sapiens
uuugcuggagaaagcguccaauuuaguuauucuaaaauagaaaguuuuagacaugaacccuacu

SEQ ID NO: 671543 - RNA, 64 nt, Homo Sapiens
aggaucuuucaaaaaugauuauaaaauucaugugaaauagaaguguaugaauugcugcgacaau

SEQ ID NO: 671544 - RNA, 64 nt, Homo Sapiens
uucuauuauugaaaauuguauguaaaacuauuuaaaauagaauagaaggauacacacccaauua

SEQ ID NO: 671545 - RNA, 64 nt, Homo Sapiens
aucugacccuucuuuaaguuauguguguggggagaaauagaauggugcucuuaucuuucuugac

SEQ ID NO: 671546 - RNA, 64 nt, Homo Sapiens
aguuucaaucaaguuuacauuauguugcuuaaaaaaauagaaauuauucuuuaucuugcaaaga

SEQ ID NO: 671547 - RNA, 64 nt, Homo Sapiens
uggcuacucucagaauuugguugccagcugcugaaaauagaaguagaacucauugagggugcuc

SEQ ID NO: 671548 - RNA, 64 nt, Homo Sapiens
gucaguagaacucauugaggauaugggaugaagaaaauagaaaugauugguuuuguuuuauacc

SEQ ID NO: 671549 - RNA, 64 nt, Homo Sapiens
ugaccaugaaaaauaaauucucacucacugccaaaaauagaaagccaauaguggauaacaugua

SEQ ID NO: 671550 - RNA, 64 nt, Homo Sapiens
uauaaagaaaagagggagaguuucucuuuaaaaaaaauagaagccccuuguuuuaaucguuauu

SEQ ID NO: 671551 - RNA, 64 nt, Homo Sapiens
ucugauccuuugaggcucuagggcuggcaauccaaaauagaaaaggggguuuuguuuauuuuug

SEQ ID NO: 671552 - RNA, 64 nt, Homo Sapiens
gaaauugucuuuauuaaguguuauucgucccaggaaauagaaguggaagucaggguucuagggg

SEQ ID NO: 671553 - RNA, 64 nt, Homo Sapiens
uaucucuuuguuguauuuuccaugauguuucuuaaaauagaaaguuuauuuagauucagaauau

SEQ ID NO: 671554 - RNA, 64 nt, Homo Sapiens
ugguuuagugauaauaauuuuguuuuugaaauacaaauagaaaauccugaaauaauuuuuguga

SEQ ID NO: 671555 - RNA, 64 nt, Homo Sapiens
uucaagcaacucaaagauuaggaaaagaguuugaaaauagaauugagauguguuaaauaaacug

SEQ ID NO: 671556 - RNA, 64 nt, Homo Sapiens
caaucugcuuguuucugaaucaacacaugcauaaaaauagaagacaauacguucuuauaaaaua

SEQ ID NO: 671557 - RNA, 64 nt, Homo Sapiens
gaaaucaucugauguuucuauagucacuuugccagcucaaaagaaaacaauacccuauguaguu

SEQ ID NO: 671558 - RNA, 64 nt, Homo Sapiens
gcauucuuagcaaaauugccuaguauguuaauuugcucaaaauacaauguuugauuuuaugcac

SEQ ID NO: 671559 - RNA, 64 nt, Homo Sapiens
uaguauuagcauagcauucuuaaaggaaugcagugcucaaaaccuacccaaauucccgcaggau

SEQ ID NO: 671560 - RNA, 64 nt, Homo Sapiens
ucaccuuuauuucaucuucauaagaaugagaaaggcucaaaaggaagcacuuuuagaaaucuuc

SEQ ID NO: 671561 - RNA, 64 nt, Homo Sapiens
augagaggaaucacacugcaguuaccacuguacugcucaaaaacggaaugugggaaagccuuca

SEQ ID NO: 671562 - RNA, 64 nt, Homo Sapiens
augaaaaggcucauacuggagauaccaccaaucugcucaaaaacagaauguggaaaagcauucc

SEQ ID NO: 671563 - RNA, 64 nt, Homo Sapiens
aaaagucuugguuuuuaaaugauucagagcuaucgcucaaaaccuacacuucauaccuaaagga

SEQ ID NO: 671564 - RNA, 64 nt, Homo Sapiens
cuagcugcuguuucaagcugaguguuagcuuagagcucaaaauaaaacaugacugaaaguccag

SEQ ID NO: 671565 - RNA, 64 nt, Homo Sapiens
uguucuaauauuuugcuccuuuuuaaauuuuguagcucaaaagaccuuaaaggucuguaggguu

SEQ ID NO: 671566 - RNA, 64 nt, Homo Sapiens
ucagucuggaaacuuaacauuaugagccuuuucugcucaaaaaauuuucaaagauuaaaacuau

SEQ ID NO: 671567 - RNA, 64 nt, Homo Sapiens; identical to SEQ ID NO: 99247

SEQ ID NO: 671568 - RNA, 64 nt, Homo Sapiens; identical to SEQ ID NO: 99248

SEQ ID NO: 671569 - RNA, 64 nt, Homo Sapiens; identical to SEQ ID NO: 99249

SEQ ID NO: 671570 - RNA, 64 nt, Homo Sapiens; identical to SEQ ID NO: 99250

SEQ ID NO: 671571 - RNA, 64 nt, Homo Sapiens; identical to SEQ ID NO: 99251

SEQ ID NO: 671572 - RNA, 64 nt, Homo Sapiens; identical to SEQ ID NO: 99252

SEQ ID NO: 671573 - RNA, 64 nt, Homo Sapiens; identical to SEQ ID NO: 99253

SEQ ID NO: 671574 - RNA, 64 nt, Homo Sapiens; identical to SEQ ID NO: 99254

SEQ ID NO: 671575 - RNA, 64 nt, Homo Sapiens; identical to SEQ ID NO: 99255

SEQ ID NO: 671576 - RNA, 64 nt, Homo Sapiens; identical to SEQ ID NO: 99256

SEQ ID NO: 671577 - RNA, 64 nt, Homo Sapiens; identical to SEQ ID NO: 99257

SEQ ID NO: 671578 - RNA, 64 nt, Homo Sapiens; identical to SEQ ID NO: 99258

SEQ ID NO: 671579 - RNA, 64 nt, Homo Sapiens; identical to SEQ ID NO: 99259

SEQ ID NO: 671580 - RNA, 64 nt, Homo Sapiens; identical to SEQ ID NO: 99260

SEQ ID NO: 671581 - RNA, 64 nt, Homo Sapiens; identical to SEQ ID NO: 99261

SEQ ID NO: 671582 - RNA, 64 nt, Homo Sapiens; identical to SEQ ID NO: 99262

SEQ ID NO: 671583 - RNA, 64 nt, Homo Sapiens; identical to SEQ ID NO: 99263

SEQ ID NO: 671584 - RNA, 64 nt, Homo Sapiens; identical to SEQ ID NO: 99264

SEQ ID NO: 671585 - RNA, 64 nt, Homo Sapiens; identical to SEQ ID NO: 99265

SEQ ID NO: 671586 - RNA, 64 nt, Homo Sapiens; identical to SEQ ID NO: 99266

SEQ ID NO: 671587 - RNA, 64 nt, Homo Sapiens; identical to SEQ ID NO: 99267

SEQ ID NO: 671588 - RNA, 64 nt, Homo Sapiens; identical to SEQ ID NO: 99268

SEQ ID NO: 671589 - RNA, 64 nt, Homo Sapiens; identical to SEQ ID NO: 99269

SEQ ID NO: 671590 - RNA, 64 nt, Homo Sapiens; identical to SEQ ID NO: 99270

SEQ ID NO: 671591 - RNA, 64 nt, Homo Sapiens; identical to SEQ ID NO: 99271

SEQ ID NO: 671592 - RNA, 63 nt, Homo Sapiens
cacuaaagucacuuuaaagcuuuuggagaagcaggagggcauuggcuuaaccaagccgaaggc

SEQ ID NO: 671593 - RNA, 63 nt, Homo Sapiens
gccccagcugucgccuuucugaccagcaggccuggagggcaggggcacagagcagagaggagg

SEQ ID NO: 671594 - RNA, 63 nt, Homo Sapiens
gcaggccuggagggcaggggcacagagcagagaggagggcacugguggucuccugcuuagccu

SEQ ID NO: 671595 - RNA, 63 nt, Homo Sapiens
caccaugcuuccccuagaaggguucugaucaccggagggcagccccaaaggccacaguccccu

SEQ ID NO: 671596 - RNA, 63 nt, Homo Sapiens
uaagggacaggcacagcagaggugagagugggaggagggcacguaccgggugccagcccugga

SEQ ID NO: 671597 - RNA, 63 nt, Homo Sapiens
cccccauggggugccgagccugccaggccuggaggagggcagucucuuagcccccuggcuuug

SEQ ID NO: 671598 - RNA, 63 nt, Homo Sapiens
aggcuacgcagggcugaggaacgagcccugggaggagggcagacgcuggagcugaaggaaugg

SEQ ID NO: 671599 - RNA, 63 nt, Homo Sapiens
uuaguguacgauguuugcugugcuucccgccguggagggcagagccaccccacaucaggaucg

SEQ ID NO: 671600 - RNA, 63 nt, Homo Sapiens
ugcuggugucugggaccaaaaagggggaauaugggagggcagaguggggaggggaguccaugg

SEQ ID NO: 671601 - RNA, 63 nt, Homo Sapiens
aacacaaacauaagaacuggcuagcaaggcuagggagggcauguuccuuucccaguuguuacc

SEQ ID NO: 671602 - RNA, 63 nt, Homo Sapiens
gcuacauccuggcucggugggcugggcuggaaaggagggcagggggugaaacuccagcaggug

SEQ ID NO: 671603 - RNA, 63 nt, Homo Sapiens
uacaggagagaguaggugguauaggccccgcugggagggcaguauccauagacacaugcuagg

SEQ ID NO: 671604 - RNA, 63 nt, Homo Sapiens
cuaggcucugggaucccguggccuucagagcuaggagggcaccgcuagccaaguuuucugcga

SEQ ID NO: 671605 - RNA, 63 nt, Homo Sapiens
gggagaauccaaggguugagugccacagccagaggagggcagagcccagcaguguggagaccc

SEQ ID NO: 671606 - RNA, 63 nt, Homo Sapiens
auggccuuuccuucccucucaggacccccgaggggagggcaggacucccugggacacagaccc

SEQ ID NO: 671607 - RNA, 63 nt, Homo Sapiens
ggugaggagggggaagauguaccagagggagcgggagggcagauuccuggguacccaggccug

SEQ ID NO: 671608 - RNA, 63 nt, Homo Sapiens
cccccccacccacccaggauuuuccuccccacuggagggcaagccauaauuguaaccagugcc

SEQ ID NO: 671609 - RNA, 63 nt, Homo Sapiens
ggcaagguuaccagggcaccugagguggccuggggagggcagacucggccaggugcugaucgg

SEQ ID NO: 671610 - RNA, 63 nt, Homo Sapiens
gccagggcauuugcagaagcuacccucugaauuggagggcaguagggcuuggauugauguuua

SEQ ID NO: 671611 - RNA, 63 nt, Homo Sapiens
guuggcugcagguuucaucacagaaacccuuguggagggcagugucuccagcuucagccuuuc

SEQ ID NO: 671612 - RNA, 63 nt, Homo Sapiens
ucugggcucagcgggcagugacggcgggugccuggagggcagcaguaaaugggggccguuggg

SEQ ID NO: 671613 - RNA, 63 nt, Homo Sapiens
ggagggccaugugcaauauuuggaggguuuucuggagggcagcaggaaggcuggggaauuccc

SEQ ID NO: 671614 - RNA, 63 nt, Homo Sapiens
ugugucucaugcacuggcacauauggucaccuuggagggcagaccuaggagccccucugacca

SEQ ID NO: 671615 - RNA, 63 nt, Homo Sapiens
ggagggacggaaggcuggcauagacccuagcggggagggcaggacccccuucaagaggcgcca

SEQ ID NO: 671616 - RNA, 63 nt, Homo Sapiens
ugaugagagaggguguucccgccuggccagcagggagggcaguagcaccuggcuaagggcugg

SEQ ID NO: 671617 - RNA, 63 nt, Homo Sapiens
ggagccuugccaccaucccacuugaggguggggggagggcaccgagagcagagaaugggggaa

SEQ ID NO: 671618 - RNA, 63 nt, Homo Sapiens
gaccccgaggccucguggaccccagccgggacgggagggcagcuggcgggcuggggagcggcc

SEQ ID NO: 671619 - RNA, 63 nt, Homo Sapiens
cauagccacaccacaggauuguugccaggcuggggagggcaaccuuucccaggguaucugugg

SEQ ID NO: 671620 - RNA, 63 nt, Homo Sapiens
gguugaggggccaccaccacagguggcacaucuggagggcaggcagugcccacccagccccuc

SEQ ID NO: 671621 - RNA, 63 nt, Homo Sapiens
gcuuggguccaguggaggaauuuuuacagaggaggagggcagguuagaaggggaugagucaga

SEQ ID NO: 671622 - RNA, 63 nt, Homo Sapiens
ggaaguacuuagggagguuguucaaaugcugauggagggcagagauggccaucagacagagac

SEQ ID NO: 671623 - RNA, 63 nt, Homo Sapiens
guaggguagggccucugagggguggcagccauaggagggcaggucaggcaggagggcagggau

SEQ ID NO: 671624 - RNA, 63 nt, Homo Sapiens
gaugguggcagccauaggagccaggaucaggcaggagggcaggagcugagcagagaggccuaa

SEQ ID NO: 671625 - RNA, 63 nt, Homo Sapiens
caacaaggagcuggguguggaccaggagucagaggagggcaaaggcaaaacaagcccugauaa

SEQ ID NO: 671626 - RNA, 63 nt, Homo Sapiens
cuuugacaguuucaucugcugcuucguuaggcuggagggcauguucaguaagugggagagggg

SEQ ID NO: 671627 - RNA, 63 nt, Homo Sapiens
ccugacuggcuccuagggaaggggaaggcuccuggagggcagcccuaccucucccaugcccuu

SEQ ID NO: 671628 - RNA, 63 nt, Homo Sapiens
ugaaaucuuggauuuggggcugaggggugggagggagggcagagcucugcacacucaaaggcu

SEQ ID NO: 671629 - RNA, 63 nt, Homo Sapiens
uggcagcacagccacacccguucccacgucagaggagggcaaggcuggguacucagcagccac

SEQ ID NO: 671630 - RNA, 63 nt, Homo Sapiens
cagccuggagccagcccggggacuguccuggguggagggcaggugaacacaagcugcugccgg

SEQ ID NO: 671631 - RNA, 63 nt, Homo Sapiens
ggacaguuccauggcccuuccagacgacucugaggagggcaaggaggccagggacagucuugc

SEQ ID NO: 671632 - RNA, 63 nt, Homo Sapiens
gguauggcugaggagggugcgcacugggguuguggagggcaugggcagaaggaaaauggggag

SEQ ID NO: 671633 - RNA, 63 nt, Homo Sapiens
gggggcuguggccgucaguggcccaggaggaagggagggcagauggagcuggucacgcugggc

SEQ ID NO: 671634 - RNA, 63 nt, Homo Sapiens
ggcuggggcugggaugggagggguggcugaguuggagggcaagggcagcagaacuagugccag

SEQ ID NO: 671635 - RNA, 63 nt, Homo Sapiens
guccccaucacguggcaagcaugcccaagcuagggagggcagaucaagaugcccaagaugacc

SEQ ID NO: 671636 - RNA, 63 nt, Homo Sapiens
ggcaugcggcgcugugcauggggcaggcgggagggagggcauuccccuuaaagcagagaggga

SEQ ID NO: 671637 - RNA, 63 nt, Homo Sapiens
cgggagggagggcauuggcauuaaagcagagagggagggcaggcccaaaagccccagaucccc

SEQ ID NO: 671638 - RNA, 63 nt, Homo Sapiens
gcuggggggaggggauuggggggagggcaggguggagggcaagcaccucccuagagggaggga

SEQ ID NO: 671639 - RNA, 63 nt, Homo Sapiens
guggagggcaaggcuggggguagagggagggagggagggcaggugcaggaccucacaccuccc

SEQ ID NO: 671640 - RNA, 63 nt, Homo Sapiens
cuggaggagagacggggcugggcgcaagguggcggagggcaguguggguucugugucugucug

SEQ ID NO: 671641 - RNA, 63 nt, Homo Sapiens
augcccugaagaggcaggguacacauggggcugggagggcaaagauggggcggggccuccccc

SEQ ID NO: 671642 - RNA, 63 nt, Homo Sapiens
gcuacgccacagcuggacacacaugcagccccuggagggcagccucuuccugugccucgaugg

SEQ ID NO: 671643 - RNA, 63 nt, Homo Sapiens
gcagccucuuccugugccucgauggggugggugggagggcaucuucugugcguugggucaguu

SEQ ID NO: 671644 - RNA, 63 nt, Homo Sapiens
accuuguuuugccagugauaagagcaguggguuggagggcacuuggccaguuuucuguucagc

SEQ ID NO: 671645 - RNA, 63 nt, Homo Sapiens
uccaacagagggaggaaugugugccuuguucaaggagggcacgacccuuaggccuuuuucaac

SEQ ID NO: 671646 - RNA, 65 nt, Homo Sapiens; identical to SEQ ID NO: 65698

SEQ ID NO: 671647 - RNA, 65 nt, Homo Sapiens; identical to SEQ ID NO: 65699

SEQ ID NO: 671648 - RNA, 65 nt, Homo Sapiens; identical to SEQ ID NO: 65706

SEQ ID NO: 671649 - RNA, 65 nt, Homo Sapiens; identical to SEQ ID NO: 65707

SEQ ID NO: 671650 - RNA, 65 nt, Homo Sapiens; identical to SEQ ID NO: 65720

SEQ ID NO: 671651 - RNA, 65 nt, Homo Sapiens; identical to SEQ ID NO: 65721

SEQ ID NO: 671652 - RNA, 65 nt, Homo Sapiens; identical to SEQ ID NO: 65744

SEQ ID NO: 671653 - RNA, 65 nt, Homo Sapiens; identical to SEQ ID NO: 65745

SEQ ID NO: 671654 - RNA, 65 nt, Homo Sapiens; identical to SEQ ID NO: 65788

SEQ ID NO: 671655 - RNA, 65 nt, Homo Sapiens; identical to SEQ ID NO: 65789

SEQ ID NO: 671656 - RNA, 65 nt, Homo Sapiens; identical to SEQ ID NO: 65808

SEQ ID NO: 671657 - RNA, 65 nt, Homo Sapiens; identical to SEQ ID NO: 65809

SEQ ID NO: 671658 - RNA, 65 nt, Homo Sapiens; identical to SEQ ID NO: 65810

SEQ ID NO: 671659 - RNA, 65 nt, Homo Sapiens; identical to SEQ ID NO: 65811

SEQ ID NO: 671660 - RNA, 65 nt, Homo Sapiens; identical to SEQ ID NO: 65827

SEQ ID NO: 671661 - RNA, 65 nt, Homo Sapiens; identical to SEQ ID NO: 65828

SEQ ID NO: 671662 - RNA, 65 nt, Homo Sapiens; identical to SEQ ID NO: 65831

SEQ ID NO: 671663 - RNA, 56 nt, Homo Sapiens; identical to SEQ ID NO: 61369

SEQ ID NO: 671664 - RNA, 65 nt, Homo Sapiens; identical to SEQ ID NO: 65853

SEQ ID NO: 671665 - RNA, 65 nt, Homo Sapiens; identical to SEQ ID NO: 65854

SEQ ID NO: 671666 - RNA, 65 nt, Homo Sapiens; identical to SEQ ID NO: 65891

SEQ ID NO: 671667 - RNA, 65 nt, Homo Sapiens; identical to SEQ ID NO: 65892

SEQ ID NO: 671668 - RNA, 65 nt, Homo Sapiens; identical to SEQ ID NO: 65896

SEQ ID NO: 671669 - RNA, 65 nt, Homo Sapiens; identical to SEQ ID NO: 65897

SEQ ID NO: 671670 - RNA, 64 nt, Homo Sapiens
gcacagugcugagaaacaguucauccauggugccauguuaaagaaguuggaaauauaucuugaa

SEQ ID NO: 671671 - RNA, 64 nt, Homo Sapiens
auagucuuaugugcaguaacuauaaugguaaagaauguuaaauaauaaaauuuaacauuuucca

SEQ ID NO: 671672 - RNA, 64 nt, Homo Sapiens
ccugcuccccucaaaagauuuuuagucauacagaauguuaaauauuauguauucugacuuuuuu

SEQ ID NO: 671673 - RNA, 64 nt, Homo Sapiens
gaacuuuuauauauucaauuccuuuucugguguaauguuaaaguuguauagauuauuaaugcau

SEQ ID NO: 671674 - RNA, 64 nt, Homo Sapiens
auuaauggccccuaacagcaguuguacuguuuguauguuaaacuugauacauuuagaaguuaau

SEQ ID NO: 671675 - RNA, 64 nt, Homo Sapiens
guuuguauguuaaacuugauacauuuagaaguuaauguuaaagccuaauccuaaauuuuuaaaa

SEQ ID NO: 671676 - RNA, 64 nt, Homo Sapiens
gaccagacaccuguuugauaucaaagcaaggaguauguuaaaaucaaauaugaaugaauauugu

SEQ ID NO: 671677 - RNA, 64 nt, Homo Sapiens
uguuaagccuuguaguacuauuuucaacaagcaaauguuaaaugauuugacuuuaugacauugc

SEQ ID NO: 671678 - RNA, 64 nt, Homo Sapiens
agaggugaaucuucuuugacuaaaaggcucuuuuauguuaaaagaucugauuccugugauaacu

SEQ ID NO: 671679 - RNA, 64 nt, Homo Sapiens
aaaucucuacauaaaucguagaaucauugcaauuauguuaaaagauucacuuuaguuucucaca

SEQ ID NO: 671680 - RNA, 64 nt, Homo Sapiens
auaaguuuguuauauauuaaauacaguuauuaaaauguuaaaagaggaaucuaauuauaucgaa

SEQ ID NO: 671681 - RNA, 64 nt, Homo Sapiens
aaagaaaugcauaaaagacacauauuuuuauauuauguuaaaguuaaaaaaagaggauucaaca

SEQ ID NO: 671682 - RNA, 64 nt, Homo Sapiens
aggugccacuuaaauuuauuaugaacuauuuuaaauguuaaauuguuuuguagauuaucuuuua

SEQ ID NO: 671683 - RNA, 64 nt, Homo Sapiens
uagucauuaaaagaucuguuaaacaacaaucuuuauguuaaaaaaagagaauagauguuuccca

SEQ ID NO: 671684 - RNA, 64 nt, Homo Sapiens
acuucuaucaauagaguaacgcuagucuuuccagauguuaaagaacgaguccuaauuuacaaca

SEQ ID NO: 671685 - RNA, 64 nt, Homo Sapiens
uagagguaguaaaaugacacgaaguaccugauacauguuaaaaucuguuucuucuagauguucu

SEQ ID NO: 671686 - RNA, 64 nt, Homo Sapiens
gcauaacaggcaccagaugguuuauugcugcagaauguuaaacuauacuuuauaauaaaacacu

SEQ ID NO: 671687 - RNA, 64 nt, Homo Sapiens
gcugaaguuugauuuucugaugauggaugccagcauguuaaacuuguguugcuucaugccuugg

SEQ ID NO: 671688 - RNA, 64 nt, Homo Sapiens
aaaagauauaagugcuguauaaaaucagccaauuauguuaaacuagcauaucugccuuuauugu

SEQ ID NO: 671689 - RNA, 64 nt, Homo Sapiens
auugccauauugcacaugucuuaaugaaguuugaauguuaaauaaauuguauauucacuuuaaa

SEQ ID NO: 671690 - RNA, 64 nt, Homo Sapiens
aaaguuuuuuuuuauuauuuuuuuaaaauuuuguauguuaaagagaaugaguccuugauuucaa

SEQ ID NO: 671691 - RNA, 64 nt, Homo Sapiens
uaauccccuaaaauaacaguaugugggauauugaauguuaaagggauauuuuuuucuauuauuu

SEQ ID NO: 671692 - RNA, 64 nt, Homo Sapiens
ucuauuauuuuuauaauuguacaaaauuaagcaaauguuaaaaguuuuauaugcuuuauuaaug

SEQ ID NO: 671693 - RNA, 64 nt, Homo Sapiens
guaagauaauuucccugcaauagugaaggaacaaauguuaaagguuauaggcuuuuuguuaaaa

SEQ ID NO: 671694 - RNA, 64 nt, Homo Sapiens
agcuaacaauguuuguacuuuguauuuuuaauaaauguuaaauacugcauuaguauaaagaguc

SEQ ID NO: 671695 - RNA, 64 nt, Homo Sapiens
ucacgaguuaccauguauagcuuuuuuguagcaaauguuaaaaagauucccaauauuuguugua

SEQ ID NO: 671696 - RNA, 64 nt, Homo Sapiens
ugauucccaauauuuguuguuuuagacaucagaaauguuaaaguacagaagugacuucauucuu

SEQ ID NO: 671697 - RNA, 64 nt, Homo Sapiens
agacaacucuuccauuuauuuggcaauaaguuccauguuaaaauguuaaaggagauauggcuag

SEQ ID NO: 671698 - RNA, 64 nt, Homo Sapiens
agauauggcuaguggcaauauacccauauaucuuauguuaaaggucauuaaauuggaauuuucu

SEQ ID NO: 671699 - RNA, 64 nt, Homo Sapiens
gugauaaagcuauaaaauucaauaacuuuuuagaauguuaaaugaagacacuguuuccuaacau

SEQ ID NO: 671700 - RNA, 64 nt, Homo Sapiens
cacuauauuuuuuccaaaaaauaugugauuauauauguuaaaguauagauaacauuucacacuu

SEQ ID NO: 671701 - RNA, 64 nt, Homo Sapiens
ucccuuuuauuuuggucauguucauaugauauacauguuaaauuuuucuucacuaaaaccuauu

SEQ ID NO: 671702 - RNA, 64 nt, Homo Sapiens
cuuagacagaucuuaaguacuaaugcuuacaggaauguuaaauaucuuuuccuauucuuuuuua

SEQ ID NO: 671703 - RNA, 64 nt, Homo Sapiens
ucaaauaaaugcuuccuuauauuuguaucauuucauguuaaaccgauuuguuuauacacauuuu

SEQ ID NO: 671704 - RNA, 64 nt, Homo Sapiens
aacccaucuugcaggacgacguccuguggaggagauguuaaaguggcauacaccagaaaacgcu

SEQ ID NO: 671705 - RNA, 64 nt, Homo Sapiens
uagauuguuggcucacacuuuaugcuagaaagaaauguuaaaaaaaaccacuggguaugaggaa

SEQ ID NO: 671706 - RNA, 64 nt, Homo Sapiens
ugucugagucuaaagcaccggcccugagugaaucauguuaaagcacuucagaguuugcaaccuu

SEQ ID NO: 671707 - RNA, 64 nt, Homo Sapiens
aggaaaguagaauauaaaguuccagguuuucauaauguuaaaaucuaagauuacauuguaaaau

SEQ ID NO: 671708 - RNA, 64 nt, Homo Sapiens
ugggucagucuucucugaacuauugccucagauuauguuaaauuauuuuuacacauuuuuacaa

SEQ ID NO: 671709 - RNA, 64 nt, Homo Sapiens
aaaaaagugaauuugugaagcaaaguuuugccagauguuaaacuuugaauuuaauauaccagau

SEQ ID NO: 671710 - RNA, 64 nt, Homo Sapiens
aaaucucauuugucuaauugcaauuaaaagaaaaauguuaaaauauuaaaaugaaaauaaaagc

SEQ ID NO: 671711 - RNA, 64 nt, Homo Sapiens
ggccugcaucacaauugagguaauguagagcaacauguuaaagaaugaugguuagcagaagcug

SEQ ID NO: 671712 - RNA, 64 nt, Homo Sapiens
gucucuucugaugagguaacaauuagaugaaaccauguuaaagcugagaugaacacuuagaaau

SEQ ID NO: 671713 - RNA, 64 nt, Homo Sapiens
auucuaccaucccuugggucuuuguguauaaacaauguuaaauaaagguagacucagucuuuaa

SEQ ID NO: 671714 - RNA, 64 nt, Homo Sapiens
uaacuuagggacauuuugacaccccccuucccaaauguuaaaugccuucuccuuuuuaccgaua

SEQ ID NO: 671715 - RNA, 64 nt, Homo Sapiens
cccuacugugaccaaauuucuguauuacgauuuuauguuaaauuaaacuaauauggcagguuau

SEQ ID NO: 671716 - RNA, 64 nt, Homo Sapiens
aaaacaaugauuugcuaaggaacaguaaacagugauguuaaaauaguaacugccaguuaggaag

SEQ ID NO: 671717 - RNA, 64 nt, Homo Sapiens
guauuaaauggcaccugauuuaaauaauuuucaaauguuaaacaaaacgaucuguauuauuaaa

SEQ ID NO: 671718 - RNA, 64 nt, Homo Sapiens
cuguuagguugauuuuuuuuggaaucaauaugcaauguuaaacacuuuuuuaauguaaucauuu

SEQ ID NO: 671719 - RNA, 64 nt, Homo Sapiens
ggagugcuuuucuucucaauuguuagaagaauuuauguuaaacuuuaagguaaggguguaaaaa

SEQ ID NO: 671720 - RNA, 64 nt, Homo Sapiens
cccaaguaagguucucaaauguagaaaauuauaaauguuaaaaggaaguuauugaagaaaauaa

SEQ ID NO: 671721 - RNA, 64 nt, Homo Sapiens
aacucuaugguauuuuucuuauucuuguuugaucauguuaaaaauuggaccuaauaaaaguauu

SEQ ID NO: 671722 - RNA, 64 nt, Homo Sapiens
acgcaccauccucccucccaagagaggcaauuuaauguuaaaugugcucagccacauacuguag

SEQ ID NO: 671723 - RNA, 64 nt, Homo Sapiens
uugauaccauguaaaccuacgcuuuuggcugcagauguuaaauuuucugaguagcucaggugug

SEQ ID NO: 671724 - RNA, 64 nt, Homo Sapiens
agcuuuacaucauuuuuacauaucaagugguuucauguuaaaaaacaaacuccuaguccuuuag

SEQ ID NO: 671725 - RNA, 64 nt, Homo Sapiens
guaucugcuccauagguuucuguuuuuaauuucaauguuaaauacaacuacaauaugagcgaga

SEQ ID NO: 671726 - RNA, 64 nt, Homo Sapiens
caauuaaaaagcaugcugugucuuacuuaaugaaauguuaaagcgccuugcaggaaugagucac

SEQ ID NO: 671727 - RNA, 64 nt, Homo Sapiens
cguuguuuguauuuguaaggucuaguuguacaaaauguuaaagagauaccagcuucaugcaccu

SEQ ID NO: 671728 - RNA, 64 nt, Homo Sapiens
uuguaccuugaucaauguacgaauguguauauuaauguuaaaaaguuaaauagaugagauuaug

SEQ ID NO: 671729 - RNA, 64 nt, Homo Sapiens
gaugagauuauggaauguguaaaggccuguguuaauguuaaauagagaaaaaaauaacaacaac

SEQ ID NO: 671730 - RNA, 64 nt, Homo Sapiens
ugugaaugguggaaauggugaaagucuaauaaaaauguuaaauaucuuaugaugaggcuaaaua

SEQ ID NO: 671731 - RNA, 64 nt, Homo Sapiens
uggaucuuuuacaccacaucuaaguaguuuaaguauguuaaaugagagugauguuaucuaaguu

SEQ ID NO: 671732 - RNA, 64 nt, Homo Sapiens
ccaaauaauucuguaagauauaccucuuccucauauguuaaauauuuuguaaaguuuaccaauu

SEQ ID NO: 671733 - RNA, 64 nt, Homo Sapiens
uaugaugagcaaauauaaguuaaugccaaacguuauguuaaaguuauuuuuucaaauacaggau

SEQ ID NO: 671734 - RNA, 64 nt, Homo Sapiens
acuaaauauagagaggggcuacaucuauauuuaaauguuaaaacagauuuuuguaaauguuaaa

SEQ ID NO: 671735 - RNA, 64 nt, Homo Sapiens
aucuauauuuaaauguuaaaauagauuuuuguaaauguuaaaacaguugugacuucuauauuca

SEQ ID NO: 671736 - RNA, 64 nt, Homo Sapiens
uuuggauauagcaacuucuuuucacaauguuaaaauguuaaauaccuguuauaaacguugaacu

SEQ ID NO: 671737 - RNA, 64 nt, Homo Sapiens
guuaaauauuuggauauagcguugaacuuucacaauguuaaaauuaaaaagcccuguuauaaac

SEQ ID NO: 671738 - RNA, 64 nt, Homo Sapiens
uaauaugcagcauaccauagauauguuacuugaaauguuaaauuuggcugaauguuugcuauau

SEQ ID NO: 671739 - RNA, 64 nt, Homo Sapiens
auccagaaauacagaauaguaauuuaaaauacaaauguuaaauuuuaaaaagaaauuuauauaa

SEQ ID NO: 671740 - RNA, 64 nt, Homo Sapiens
acuguuguuuaagcauguuuuuguuuaaaacagaauguuaaaacuaaauagguauuuuaaaaca

SEQ ID NO: 671741 - RNA, 64 nt, Homo Sapiens
guaaaucuguugguuuuuuuauuuuaugaauacuauguuaaaauugaccuuuuaagaauguuua

SEQ ID NO: 671742 - RNA, 64 nt, Homo Sapiens
uauauucuuuuaaucaaugaauguuguaugguuuauguuaaaugaauguuugaccugaugacug

SEQ ID NO: 671743 - RNA, 64 nt, Homo Sapiens
acagucugcaauaauaaaguauguugugcauuuaauguuaaaggcccaguuuuaagugguacga

SEQ ID NO: 671744 - RNA, 64 nt, Homo Sapiens
uuuuuguuuuuccacuuaucuugaguucacuuugauguuaaaucuauugcuacuucaguuguaa

SEQ ID NO: 671745 - RNA, 64 nt, Homo Sapiens
uucucuuccauuguacauguggguuauauaccauauguuaaauaugcaauaaaguguuuacagg

SEQ ID NO: 671746 - RNA, 64 nt, Homo Sapiens
aaaaaagguguuaagucacaaggacugugacguuauguuaaaaauacauuaaaauacuuguaug

SEQ ID NO: 671747 - RNA, 64 nt, Homo Sapiens
cuguagaucccaauguuggccacagagccccacaauguuaaauucccuggaaugacuaugucag

SEQ ID NO: 671748 - RNA, 64 nt, Homo Sapiens
acuauggauuucaaaugcuuaaucucacaaagaaauguuaaauugauauaauccuguaaguaau

SEQ ID NO: 671749 - RNA, 64 nt, Homo Sapiens
acaaugaauuuaaauguguuucucauauucagguauguuaaauuguauaugguugcuuaauugu

SEQ ID NO: 671750 - RNA, 64 nt, Homo Sapiens
cagugagaaugcauuugaucuugaagccaugagcauguuaaauagagcucaggaaaggguaugu

SEQ ID NO: 671751 - RNA, 64 nt, Homo Sapiens
uguuugaaggcaucagaguaaucuucaguguggaauguuaaauaacgcuuuuauacuguauuuu

SEQ ID NO: 671752 - RNA, 64 nt, Homo Sapiens
acuaguuuaucauuaaccacuuaucaguguauugauguuaaagcauuucccuguuagcuaaaag

SEQ ID NO: 671753 - RNA, 64 nt, Homo Sapiens
ugcucugcucuaccauguuuaaagaaauauuuggauguuaaauuaacucacuaugguuuuucac

SEQ ID NO: 671754 - RNA, 64 nt, Homo Sapiens
cuaccugccuugccuguuaggucuguugaagugcauguuaaaauaauuauaugaagcagaauga

SEQ ID NO: 671755 - RNA, 64 nt, Homo Sapiens
aauauacucauuuggauauaaaucuuacccuucaauguuaaaucuacaaacuuuuauaaauguu

SEQ ID NO: 671756 - RNA, 64 nt, Homo Sapiens
caaugaaauaaauuugcaguuguuaaaaucaaaaauguuaaaauuuaauuuucuuguauuuaua

SEQ ID NO: 671757 - RNA, 64 nt, Homo Sapiens
caaaaauguuaaaaucaauguuucuuguauuuauauguuaaaauucuuuucugauuuauuuaau

SEQ ID NO: 671758 - RNA, 64 nt, Homo Sapiens
aaauuguccuuguacucucagcuccugcauggaucugggucaaguagaagguacuggggauggg

SEQ ID NO: 671759 - RNA, 64 nt, Homo Sapiens
ggaggaagccuggugaauuuagugagcagcuggccugggucacagugaccugaccucaaaccag

SEQ ID NO: 671760 - RNA, 64 nt, Homo Sapiens
gcuuuccccacagcucagcccagcucucagcaaacugggucauaagagccaauguucgucauug

SEQ ID NO: 671761 - RNA, 64 nt, Homo Sapiens
gcacccagaacugcaugguuggccaggcagaagccugggucacaaccuccccacccccagggga

SEQ ID NO: 671762 - RNA, 64 nt, Homo Sapiens
caaaacugagcauccaucccagaucugucugacucugggucagugacccugcuccgauuccaua

SEQ ID NO: 671763 - RNA, 64 nt, Homo Sapiens
uuuuauuuucuuauacaccaaaaguccugcuuuucugggucaauuuucaacuauuauuacuaau

SEQ ID NO: 671764 - RNA, 64 nt, Homo Sapiens
acaaggaggcccgggccagggacuucaccaggggcugggucacaagggcacaggguguguggaa

SEQ ID NO: 671765 - RNA, 64 nt, Homo Sapiens
ggggucuaaacagaacaggcugagagaggcgggacugggucaaguggguggagcuccuccuugc

SEQ ID NO: 671766 - RNA, 64 nt, Homo Sapiens
uuucgcugugucuccugugugcuuuguuugccuucugggucagccccgguccggagcgugguga

SEQ ID NO: 671767 - RNA, 64 nt, Homo Sapiens
cuguuagcacagcguucucaggggaaaccugccucugggucaccaugcagaagcagaagaggga

SEQ ID NO: 671768 - RNA, 64 nt, Homo Sapiens
ugcuaaccuuuucaccuccaaacauggauacuuccugggucaaggcagauuuauuuuugaaaca

SEQ ID NO: 671769 - RNA, 64 nt, Homo Sapiens
ccaacgcggugcgcaccaacgagaguacggcuaccugggucaaccuuugccccagggaaaguug

SEQ ID NO: 671770 - RNA, 64 nt, Homo Sapiens
gaugcuggagaagagcugccaggaaguguuuuuucugggucaguaaauaacaacugucauaggg

SEQ ID NO: 671771 - RNA, 64 nt, Homo Sapiens
gagccacguugcuccuaagccuggcucugucaagcugggucaggggccuugaaacuggagaagu

SEQ ID NO: 671772 - RNA, 64 nt, Homo Sapiens; identical to SEQ ID NO: 153638

SEQ ID NO: 671773 - RNA, 64 nt, Homo Sapiens; identical to SEQ ID NO: 153639

SEQ ID NO: 671774 - RNA, 64 nt, Homo Sapiens; identical to SEQ ID NO: 153640

SEQ ID NO: 671775 - RNA, 64 nt, Homo Sapiens; identical to SEQ ID NO: 153641

SEQ ID NO: 671776 - RNA, 64 nt, Homo Sapiens; identical to SEQ ID NO: 153642

SEQ ID NO: 671777 - RNA, 64 nt, Homo Sapiens; identical to SEQ ID NO: 153643

SEQ ID NO: 671778 - RNA, 64 nt, Homo Sapiens; identical to SEQ ID NO: 153644

SEQ ID NO: 671779 - RNA, 64 nt, Homo Sapiens; identical to SEQ ID NO: 153645

SEQ ID NO: 671780 - RNA, 64 nt, Homo Sapiens; identical to SEQ ID NO: 153646

SEQ ID NO: 671781 - RNA, 64 nt, Homo Sapiens; identical to SEQ ID NO: 153647

SEQ ID NO: 671782 - RNA, 64 nt, Homo Sapiens; identical to SEQ ID NO: 153648

SEQ ID NO: 671783 - RNA, 64 nt, Homo Sapiens; identical to SEQ ID NO: 153649

SEQ ID NO: 671784 - RNA, 64 nt, Homo Sapiens; identical to SEQ ID NO: 153650

SEQ ID NO: 671785 - RNA, 64 nt, Homo Sapiens; identical to SEQ ID NO: 153651

SEQ ID NO: 671786 - RNA, 64 nt, Homo Sapiens; identical to SEQ ID NO: 153652

SEQ ID NO: 671787 - RNA, 64 nt, Homo Sapiens; identical to SEQ ID NO: 153653

SEQ ID NO: 671788 - RNA, 64 nt, Homo Sapiens; identical to SEQ ID NO: 153654

SEQ ID NO: 671789 - RNA, 64 nt, Homo Sapiens; identical to SEQ ID NO: 153655

SEQ ID NO: 671790 - RNA, 64 nt, Homo Sapiens; identical to SEQ ID NO: 153656

SEQ ID NO: 671791 - RNA, 64 nt, Homo Sapiens; identical to SEQ ID NO: 153657

SEQ ID NO: 671792 - RNA, 64 nt, Homo Sapiens; identical to SEQ ID NO: 153658

SEQ ID NO: 671793 - RNA, 64 nt, Homo Sapiens; identical to SEQ ID NO: 153659

SEQ ID NO: 671794 - RNA, 64 nt, Homo Sapiens; identical to SEQ ID NO: 153660

SEQ ID NO: 671795 - RNA, 64 nt, Homo Sapiens; identical to SEQ ID NO: 153661

SEQ ID NO: 671796 - RNA, 64 nt, Homo Sapiens; identical to SEQ ID NO: 153662

SEQ ID NO: 671797 - RNA, 64 nt, Homo Sapiens; identical to SEQ ID NO: 153663

SEQ ID NO: 671798 - RNA, 64 nt, Homo Sapiens; identical to SEQ ID NO: 153664

SEQ ID NO: 671799 - RNA, 64 nt, Homo Sapiens; identical to SEQ ID NO: 153665

SEQ ID NO: 671800 - RNA, 64 nt, Homo Sapiens; identical to SEQ ID NO: 153666

SEQ ID NO: 671801 - RNA, 64 nt, Homo Sapiens; identical to SEQ ID NO: 153667

SEQ ID NO: 671802 - RNA, 64 nt, Homo Sapiens; identical to SEQ ID NO: 153668

SEQ ID NO: 671803 - RNA, 64 nt, Homo Sapiens; identical to SEQ ID NO: 153669

SEQ ID NO: 671804 - RNA, 64 nt, Homo Sapiens; identical to SEQ ID NO: 153670

SEQ ID NO: 671805 - RNA, 64 nt, Homo Sapiens; identical to SEQ ID NO: 153671

SEQ ID NO: 671806 - RNA, 64 nt, Homo Sapiens; identical to SEQ ID NO: 153672

SEQ ID NO: 671807 - RNA, 64 nt, Homo Sapiens; identical to SEQ ID NO: 153673

SEQ ID NO: 671808 - RNA, 64 nt, Homo Sapiens; identical to SEQ ID NO: 275490

SEQ ID NO: 671809 - RNA, 64 nt, Homo Sapiens; identical to SEQ ID NO: 275491

SEQ ID NO: 671810 - RNA, 64 nt, Homo Sapiens; identical to SEQ ID NO: 275492

SEQ ID NO: 671811 - RNA, 64 nt, Homo Sapiens; identical to SEQ ID NO: 275493

SEQ ID NO: 671812 - RNA, 64 nt, Homo Sapiens; identical to SEQ ID NO: 275494

SEQ ID NO: 671813 - RNA, 64 nt, Homo Sapiens; identical to SEQ ID NO: 275495

SEQ ID NO: 671814 - RNA, 64 nt, Homo Sapiens; identical to SEQ ID NO: 275496

SEQ ID NO: 671815 - RNA, 64 nt, Homo Sapiens; identical to SEQ ID NO: 275497

SEQ ID NO: 671816 - RNA, 64 nt, Homo Sapiens; identical to SEQ ID NO: 275498

SEQ ID NO: 671817 - RNA, 64 nt, Homo Sapiens; identical to SEQ ID NO: 275499

SEQ ID NO: 671818 - RNA, 64 nt, Homo Sapiens; identical to SEQ ID NO: 275500

SEQ ID NO: 671819 - RNA, 64 nt, Homo Sapiens; identical to SEQ ID NO: 275501

SEQ ID NO: 671820 - RNA, 64 nt, Homo Sapiens; identical to SEQ ID NO: 275502

SEQ ID NO: 671821 - RNA, 64 nt, Homo Sapiens; identical to SEQ ID NO: 275503

SEQ ID NO: 671822 - RNA, 64 nt, Homo Sapiens; identical to SEQ ID NO: 275504

SEQ ID NO: 671823 - RNA, 64 nt, Homo Sapiens; identical to SEQ ID NO: 275505

SEQ ID NO: 671824 - RNA, 64 nt, Homo Sapiens; identical to SEQ ID NO: 275506

SEQ ID NO: 671825 - RNA, 64 nt, Homo Sapiens; identical to SEQ ID NO: 275507

SEQ ID NO: 671826 - RNA, 64 nt, Homo Sapiens; identical to SEQ ID NO: 275508

SEQ ID NO: 671827 - RNA, 64 nt, Homo Sapiens; identical to SEQ ID NO: 275509

SEQ ID NO: 671828 - RNA, 64 nt, Homo Sapiens; identical to SEQ ID NO: 275510

SEQ ID NO: 671829 - RNA, 64 nt, Homo Sapiens; identical to SEQ ID NO: 275511

SEQ ID NO: 671830 - RNA, 64 nt, Homo Sapiens; identical to SEQ ID NO: 275512

SEQ ID NO: 671831 - RNA, 64 nt, Homo Sapiens; identical to SEQ ID NO: 275513

SEQ ID NO: 671832 - RNA, 64 nt, Homo Sapiens; identical to SEQ ID NO: 275514

SEQ ID NO: 671833 - RNA, 64 nt, Homo Sapiens; identical to SEQ ID NO: 275515

SEQ ID NO: 671834 - RNA, 64 nt, Homo Sapiens; identical to SEQ ID NO: 275516

SEQ ID NO: 671835 - RNA, 64 nt, Homo Sapiens; identical to SEQ ID NO: 275517

SEQ ID NO: 671836 - RNA, 64 nt, Homo Sapiens
cugccccugcccccuggcccccacucccccggcuccguguaaaauaaauguuccagcccaaccu

SEQ ID NO: 671837 - RNA, 64 nt, Homo Sapiens
ugaaaccacgcugcgcuuccgaugcccccgcuugccguguaaugguucagcuaaucccauggcg

SEQ ID NO: 671838 - RNA, 64 nt, Homo Sapiens
ggguauuccagaguggggauaugauuuaaaucagccguguaaccauggacccaauauuuaccag

SEQ ID NO: 671839 - RNA, 64 nt, Homo Sapiens
accugucaauacuauggagucaaauaaguggaaaccguguaaauuguggcauugucuguaauga

SEQ ID NO: 671840 - RNA, 64 nt, Homo Sapiens
ggcaguguuacauugaccccugaagagugaggacccguguaacucauauucuaugugcuucccc

SEQ ID NO: 671841 - RNA, 64 nt, Homo Sapiens
cauuaauuuuuauuuacagauugaaaaagagggaccguguaaagaaaauggaaaauaaauaucu

SEQ ID NO: 671842 - RNA, 64 nt, Homo Sapiens
aggugcaauccuagauaacaugaugccgcgccugccguguaagacuuagaugcccaucuggacg

SEQ ID NO: 671843 - RNA, 64 nt, Homo Sapiens
auaaacacauccuaucagauugcuuuaaaauguaccguguaaauuguaugaccaauguagccau

SEQ ID NO: 671844 - RNA, 64 nt, Homo Sapiens
ggaggaaagggguggaaaaagugagcuuuacuugccguguaaaauagaggcaacucccaggcca

SEQ ID NO: 671845 - RNA, 64 nt, Homo Sapiens
uaucccaccucagcggcacccaugacuguucuuuccguguaagcgcucuagaaaaaccaccaaa

SEQ ID NO: 671846 - RNA, 64 nt, Homo Sapiens
caguuugagcguuccccugagaugugcguagccuccguguaaauguccacucccauggcuuaau

SEQ ID NO: 671847 - RNA, 64 nt, Homo Sapiens
aaagagauuaauuuuaacguaacucuuucuaugcccguguaaaguaugugaaucgcaaggccug

SEQ ID NO: 671848 - RNA, 60 nt, Homo Sapiens
cugacugccaugcguuguagcugauggucuccguguaagccaaaggcccacagaggagca

SEQ ID NO: 671849 - RNA, 64 nt, Homo Sapiens
aaggcaaaauuuagccugcugacaauuucccacaccguguaaaccaaagcccuaaaauuccacu

SEQ ID NO: 671850 - RNA, 64 nt, Homo Sapiens
aguaacuacagccauuuacauuguguugucaacuccguguaaccacgcaagcaccaggcauccu

SEQ ID NO: 671851 - RNA, 64 nt, Homo Sapiens
guuuuauguguucgccuacuauuuccauuuuccuccguguaaauggaugugugaaaggcaucac

SEQ ID NO: 671852 - RNA, 64 nt, Homo Sapiens
auuacacugaggugaggcuacaagggguguguaaccguguaacacgugaaggcaaugcucaccu

SEQ ID NO: 671853 - RNA, 64 nt, Homo Sapiens
gcuuugaugccagcauccuucuuuagggauaguuccguguaaggauauuacggaaauacggaac

SEQ ID NO: 671854 - RNA, 64 nt, Homo Sapiens
gccaccaacuuuucaggcaucaauauaaauauuuccguguaauauuauugggaguagaagaaca

SEQ ID NO: 671855 - RNA, 64 nt, Homo Sapiens
aaaaugccacgugaaaaauauuugggcuguuuaaccguguaacacauguuauuaaaagcagacc

SEQ ID NO: 671856 - RNA, 64 nt, Homo Sapiens
ugagguuuaccugauucucuuaucuuggccuuggccguguaaugacauucuaacugugcaaaau

SEQ ID NO: 671857 - RNA, 64 nt, Homo Sapiens
agcauggugaacauuaccaggcaugcuagcuggcccguguaaucccaagacaaggaaaacauuc

SEQ ID NO: 671858 - RNA, 64 nt, Homo Sapiens
acuggggggcugugacagcagcugggccaggaggccguguaaugaccacacacuccucucaagc

SEQ ID NO: 671859 - RNA, 64 nt, Homo Sapiens
cccagaagagaggccgggcugcugcagaaccccgccguguaaagaggcagaaaaguugguuugg

SEQ ID NO: 671860 - RNA, 64 nt, Homo Sapiens
uggggaugggguaaaagugguucagguugguguaccguguaaagaaauuguggcacaaaaucug

SEQ ID NO: 671861 - RNA, 64 nt, Homo Sapiens
ccugcaaugaauguuuauguuuuucaaugauuagccguguaacuuaagcuaacaaagaucauaa

SEQ ID NO: 671862 - RNA, 64 nt, Homo Sapiens
gcccugcaccugugcagcgaagcuuagcguucauccguguaacccgcucaucacuggaugaaga

SEQ ID NO: 671863 - RNA, 64 nt, Homo Sapiens
gauccuagacagcgccuuaucuaugauugaguguccguguaaauaaauuccuacuuagacuuac

SEQ ID NO: 671864 - RNA, 64 nt, Homo Sapiens
ugacaaauguuugacuuugguuguguuuaaauguccguguaaaauagcugccuuuuauuuuuua

SEQ ID NO: 671865 - RNA, 64 nt, Homo Sapiens
aaccuucaccaucagcgccuuggaauaaaaaggcccguguaauugaauauuuguauuuuccaga

SEQ ID NO: 671866 - RNA, 64 nt, Homo Sapiens
aaaaacacaagaaggcauuuugcuucaauauauuccguguaauguuuuauugcauugauaaugu

SEQ ID NO: 671867 - RNA, 64 nt, Homo Sapiens
gagucugugcagguccuuguguauggaauugcacccguguaaaggaggaaauggucagugugca

SEQ ID NO: 671868 - RNA, 64 nt, Homo Sapiens
aaaaauguacacuagcauaauauuuguggcauauccguguaauggaagauuaugcaggcauuaa

SEQ ID NO: 671869 - RNA, 64 nt, Homo Sapiens
aguauaaauucuccaaauuacuuugcagggugguccguguaaauagucucuuaccuucccugau

SEQ ID NO: 671870 - RNA, 64 nt, Homo Sapiens
gagcuccaggaggugaggguauccagcugcaagaccguguaaauaagaggaguacacggugcgg

SEQ ID NO: 671871 - RNA, 64 nt, Homo Sapiens
uucuuaauuaucugacacauaggauuaagucaauccguguaaaauaauuuauaggguuuuuggg

SEQ ID NO: 671872 - RNA, 64 nt, Homo Sapiens
gcgaaugcauccuaggcgcguccuccucugauccccguguaagacugcccuggugucggcacuu

SEQ ID NO: 671873 - RNA, 64 nt, Homo Sapiens
uaaccuucagcguugcccauggcccugccacaucccguguaacauaaguggugcccaccauguu

SEQ ID NO: 671874 - RNA, 64 nt, Homo Sapiens
ggacagcugagugucauaaacuguggaauacagaccguguaacuagggcauguuguccauaucc

SEQ ID NO: 671875 - RNA, 64 nt, Homo Sapiens
uacuacucaguaugcaccacagaauaagaguuugccguguaaagacaauauccccauucgucau

SEQ ID NO: 671876 - RNA, 64 nt, Homo Sapiens
auguacauuucucaggcuaguccuuucugagggcccguguaaauggcugugcaguccugggucc

SEQ ID NO: 671877 - RNA, 64 nt, Homo Sapiens
aauuuauuacaagcauaacacaccagcccagcucccguguaaauugacgggaccugccacugca

SEQ ID NO: 671878 - RNA, 64 nt, Homo Sapiens
aaagcugcuaaauguucucuuugccauaaagacuccguguaacugugugaacacuugggauuuu

SEQ ID NO: 671879 - RNA, 64 nt, Homo Sapiens
ugcagggacaaccuguguuugccagcuggguguuccguguaaauagccagccugucucuuucuc

SEQ ID NO: 671880 - RNA, 64 nt, Homo Sapiens
agccuccuugugcaauugucugccccuccccuccccguguaaaaaggcccggcugagcccccca

SEQ ID NO: 671881 - RNA, 64 nt, Homo Sapiens
aauguacuuauaggaacaucuuuuuaaauauaugccguguaaaauuauauuaaaaggggccucc

SEQ ID NO: 671882 - RNA, 64 nt, Homo Sapiens
auucagugaagacaugcacuuuaaaccugcgaauccguguaaaaugcucuguagacaaguagaa

SEQ ID NO: 671883 - RNA, 64 nt, Homo Sapiens
cugagcccccccguccccccguauuaaaaagaccccguguaaaccaaccagaugauuaaacguu

SEQ ID NO: 671884 - RNA, 64 nt, Homo Sapiens
ugcaucuagaguuuaagaagacccguaaggccuuccguguaaccauuagugaaccccugaguua

SEQ ID NO: 671885 - RNA, 64 nt, Homo Sapiens
gaacagguguggggaagagggauggugguuugucccguguaaggggagaaggggucagaccaaa

SEQ ID NO: 671886 - RNA, 64 nt, Homo Sapiens
aagucccagugcucauccacucacgagugccgugccguguaauaucugcccaccccuuccguug

SEQ ID NO: 671887 - RNA, 64 nt, Homo Sapiens
uuuaauuuaauguguuaaaaacacaaugucccuaccguguaaauagaauccaagucaauuguga

SEQ ID NO: 671888 - RNA, 64 nt, Homo Sapiens
ugccugcguugcaaacugggcuuuguagcgucugccguguaacacccuuccucugaucgcaccg

SEQ ID NO: 671889 - RNA, 64 nt, Homo Sapiens
ggcuaaaauuacauuagauaaacuaaaauucuguccguguaacuauaaauuuugugaaugcauu

SEQ ID NO: 671890 - RNA, 64 nt, Homo Sapiens
auuaucugaaaaguaaaaaagcauuguaacaacuccguguaaagaauaauccuuuugauuugug

SEQ ID NO: 671891 - RNA, 64 nt, Homo Sapiens; identical to SEQ ID NO: 395856

SEQ ID NO: 671892 - RNA, 64 nt, Homo Sapiens; identical to SEQ ID NO: 395857

SEQ ID NO: 671893 - RNA, 64 nt, Homo Sapiens; identical to SEQ ID NO: 395858

SEQ ID NO: 671894 - RNA, 64 nt, Homo Sapiens; identical to SEQ ID NO: 395859

SEQ ID NO: 671895 - RNA, 64 nt, Homo Sapiens; identical to SEQ ID NO: 395860

SEQ ID NO: 671896 - RNA, 64 nt, Homo Sapiens; identical to SEQ ID NO: 395861

SEQ ID NO: 671897 - RNA, 64 nt, Homo Sapiens; identical to SEQ ID NO: 395862

SEQ ID NO: 671898 - RNA, 64 nt, Homo Sapiens; identical to SEQ ID NO: 395863

SEQ ID NO: 671899 - RNA, 64 nt, Homo Sapiens; identical to SEQ ID NO: 395864

SEQ ID NO: 671900 - RNA, 64 nt, Homo Sapiens; identical to SEQ ID NO: 395865

SEQ ID NO: 671901 - RNA, 61 nt, Homo Sapiens
caaggcuagcgaggcauacuaauucagaggaacagcauagcggaaaagccagccauuuacu

SEQ ID NO: 671902 - RNA, 61 nt, Homo Sapiens
gcacagcgcccuacuuccccaagcugauuuaacagcauagagcuugucugggcagagacag

SEQ ID NO: 671903 - RNA, 61 nt, Homo Sapiens
uagaaaaaugcacauuuuucguauuuucuuuacagcauagaugccaaaaugcucuggcuuu

SEQ ID NO: 671904 - RNA, 61 nt, Homo Sapiens
uaagucuugugaaacuguaucccuguuguuuacagcauauugugacaggcucuagucuccu

SEQ ID NO: 671905 - RNA, 61 nt, Homo Sapiens
acaauuuaauaaugugauauuuccuaugucuacagcauaccuuauuagguauaaaaccuac

SEQ ID NO: 671906 - RNA, 61 nt, Homo Sapiens
agauguucuaauucucuuuguaugcuuggaaacagcauagauauguugcugugguuuucag

SEQ ID NO: 671907 - RNA, 61 nt, Homo Sapiens
gccugaagcagaucagagggcuuugcaaaagacagcauagagccaucuuccugcaacuuua

SEQ ID NO: 671908 - RNA, 61 nt, Homo Sapiens
cccggguucaagcgauucuucugcugggauuacagcauaugccaccaugcccagauuauuu

SEQ ID NO: 671909 - RNA, 64 nt, Homo Sapiens; identical to SEQ ID NO: 134270

SEQ ID NO: 671910 - RNA, 64 nt, Homo Sapiens; identical to SEQ ID NO: 134271

SEQ ID NO: 671911 - RNA, 64 nt, Homo Sapiens; identical to SEQ ID NO: 134272

SEQ ID NO: 671912 - RNA, 64 nt, Homo Sapiens; identical to SEQ ID NO: 134273

SEQ ID NO: 671913 - RNA, 64 nt, Homo Sapiens; identical to SEQ ID NO: 134274

SEQ ID NO: 671914 - RNA, 64 nt, Homo Sapiens; identical to SEQ ID NO: 134275

SEQ ID NO: 671915 - RNA, 64 nt, Homo Sapiens; identical to SEQ ID NO: 134276

SEQ ID NO: 671916 - RNA, 64 nt, Homo Sapiens; identical to SEQ ID NO: 134277

SEQ ID NO: 671917 - RNA, 64 nt, Homo Sapiens; identical to SEQ ID NO: 134278

SEQ ID NO: 671918 - RNA, 64 nt, Homo Sapiens; identical to SEQ ID NO: 134279

SEQ ID NO: 671919 - RNA, 64 nt, Homo Sapiens; identical to SEQ ID NO: 134280

SEQ ID NO: 671920 - RNA, 64 nt, Homo Sapiens; identical to SEQ ID NO: 134281

SEQ ID NO: 671921 - RNA, 64 nt, Homo Sapiens; identical to SEQ ID NO: 134282

SEQ ID NO: 671922 - RNA, 64 nt, Homo Sapiens; identical to SEQ ID NO: 134283

SEQ ID NO: 671923 - RNA, 64 nt, Homo Sapiens; identical to SEQ ID NO: 134284

SEQ ID NO: 671924 - RNA, 64 nt, Homo Sapiens; identical to SEQ ID NO: 134285

SEQ ID NO: 671925 - RNA, 64 nt, Homo Sapiens; identical to SEQ ID NO: 134286

SEQ ID NO: 671926 - RNA, 64 nt, Homo Sapiens; identical to SEQ ID NO: 134287

SEQ ID NO: 671927 - RNA, 64 nt, Homo Sapiens; identical to SEQ ID NO: 134288

SEQ ID NO: 671928 - RNA, 64 nt, Homo Sapiens; identical to SEQ ID NO: 134289

SEQ ID NO: 671929 - RNA, 64 nt, Homo Sapiens; identical to SEQ ID NO: 134290

SEQ ID NO: 671930 - RNA, 64 nt, Homo Sapiens; identical to SEQ ID NO: 134291

SEQ ID NO: 671931 - RNA, 64 nt, Homo Sapiens; identical to SEQ ID NO: 134292

SEQ ID NO: 671932 - RNA, 64 nt, Homo Sapiens; identical to SEQ ID NO: 134293

SEQ ID NO: 671933 - RNA, 64 nt, Homo Sapiens; identical to SEQ ID NO: 134294

SEQ ID NO: 671934 - RNA, 64 nt, Homo Sapiens; identical to SEQ ID NO: 134295

SEQ ID NO: 671935 - RNA, 64 nt, Homo Sapiens; identical to SEQ ID NO: 134296

SEQ ID NO: 671936 - RNA, 64 nt, Homo Sapiens; identical to SEQ ID NO: 134297

SEQ ID NO: 671937 - RNA, 64 nt, Homo Sapiens; identical to SEQ ID NO: 134298

SEQ ID NO: 671938 - RNA, 64 nt, Homo Sapiens; identical to SEQ ID NO: 134299

SEQ ID NO: 671939 - RNA, 64 nt, Homo Sapiens; identical to SEQ ID NO: 134300

SEQ ID NO: 671940 - RNA, 64 nt, Homo Sapiens; identical to SEQ ID NO: 134301

SEQ ID NO: 671941 - RNA, 64 nt, Homo Sapiens; identical to SEQ ID NO: 134302

SEQ ID NO: 671942 - RNA, 64 nt, Homo Sapiens; identical to SEQ ID NO: 134303

SEQ ID NO: 671943 - RNA, 64 nt, Homo Sapiens; identical to SEQ ID NO: 169280

SEQ ID NO: 671944 - RNA, 64 nt, Homo Sapiens; identical to SEQ ID NO: 169281

SEQ ID NO: 671945 - RNA, 64 nt, Homo Sapiens; identical to SEQ ID NO: 169282

SEQ ID NO: 671946 - RNA, 64 nt, Homo Sapiens; identical to SEQ ID NO: 169283

SEQ ID NO: 671947 - RNA, 64 nt, Homo Sapiens; identical to SEQ ID NO: 169284

SEQ ID NO: 671948 - RNA, 64 nt, Homo Sapiens; identical to SEQ ID NO: 169285

SEQ ID NO: 671949 - RNA, 64 nt, Homo Sapiens; identical to SEQ ID NO: 169286

SEQ ID NO: 671950 - RNA, 64 nt, Homo Sapiens; identical to SEQ ID NO: 169287

SEQ ID NO: 671951 - RNA, 64 nt, Homo Sapiens; identical to SEQ ID NO: 169288

SEQ ID NO: 671952 - RNA, 64 nt, Homo Sapiens; identical to SEQ ID NO: 169289

SEQ ID NO: 671953 - RNA, 64 nt, Homo Sapiens; identical to SEQ ID NO: 169290

SEQ ID NO: 671954 - RNA, 64 nt, Homo Sapiens; identical to SEQ ID NO: 169291

SEQ ID NO: 671955 - RNA, 64 nt, Homo Sapiens; identical to SEQ ID NO: 169292

SEQ ID NO: 671956 - RNA, 64 nt, Homo Sapiens; identical to SEQ ID NO: 169293

SEQ ID NO: 671957 - RNA, 64 nt, Homo Sapiens; identical to SEQ ID NO: 169294

SEQ ID NO: 671958 - RNA, 64 nt, Homo Sapiens; identical to SEQ ID NO: 169295

SEQ ID NO: 671959 - RNA, 64 nt, Homo Sapiens; identical to SEQ ID NO: 169296

SEQ ID NO: 671960 - RNA, 64 nt, Homo Sapiens; identical to SEQ ID NO: 169297

SEQ ID NO: 671961 - RNA, 64 nt, Homo Sapiens; identical to SEQ ID NO: 169298

SEQ ID NO: 671962 - RNA, 64 nt, Homo Sapiens; identical to SEQ ID NO: 169299

SEQ ID NO: 671963 - RNA, 64 nt, Homo Sapiens; identical to SEQ ID NO: 169300

SEQ ID NO: 671964 - RNA, 64 nt, Homo Sapiens; identical to SEQ ID NO: 169301

SEQ ID NO: 671965 - RNA, 64 nt, Homo Sapiens; identical to SEQ ID NO: 169302

SEQ ID NO: 671966 - RNA, 64 nt, Homo Sapiens; identical to SEQ ID NO: 169303

SEQ ID NO: 671967 - RNA, 64 nt, Homo Sapiens; identical to SEQ ID NO: 169304

SEQ ID NO: 671968 - RNA, 64 nt, Homo Sapiens; identical to SEQ ID NO: 169305

SEQ ID NO: 671969 - RNA, 64 nt, Homo Sapiens; identical to SEQ ID NO: 169306

SEQ ID NO: 671970 - RNA, 64 nt, Homo Sapiens; identical to SEQ ID NO: 169307

SEQ ID NO: 671971 - RNA, 64 nt, Homo Sapiens; identical to SEQ ID NO: 97134

SEQ ID NO: 671972 - RNA, 64 nt, Homo Sapiens; identical to SEQ ID NO: 97135

SEQ ID NO: 671973 - RNA, 64 nt, Homo Sapiens; identical to SEQ ID NO: 97136

SEQ ID NO: 671974 - RNA, 64 nt, Homo Sapiens; identical to SEQ ID NO: 97137

SEQ ID NO: 671975 - RNA, 64 nt, Homo Sapiens; identical to SEQ ID NO: 97138

SEQ ID NO: 671976 - RNA, 64 nt, Homo Sapiens; identical to SEQ ID NO: 97139

SEQ ID NO: 671977 - RNA, 64 nt, Homo Sapiens; identical to SEQ ID NO: 126678

SEQ ID NO: 671978 - RNA, 64 nt, Homo Sapiens; identical to SEQ ID NO: 126679

SEQ ID NO: 671979 - RNA, 64 nt, Homo Sapiens; identical to SEQ ID NO: 126680

SEQ ID NO: 671980 - RNA, 64 nt, Homo Sapiens; identical to SEQ ID NO: 126681

SEQ ID NO: 671981 - RNA, 64 nt, Homo Sapiens; identical to SEQ ID NO: 126682

SEQ ID NO: 671982 - RNA, 64 nt, Homo Sapiens; identical to SEQ ID NO: 126683

SEQ ID NO: 671983 - RNA, 64 nt, Homo Sapiens; identical to SEQ ID NO: 126684

SEQ ID NO: 671984 - RNA, 64 nt, Homo Sapiens; identical to SEQ ID NO: 126685

SEQ ID NO: 671985 - RNA, 64 nt, Homo Sapiens; identical to SEQ ID NO: 126686

SEQ ID NO: 671986 - RNA, 64 nt, Homo Sapiens; identical to SEQ ID NO: 126687

SEQ ID NO: 671987 - RNA, 64 nt, Homo Sapiens; identical to SEQ ID NO: 126688

SEQ ID NO: 671988 - RNA, 64 nt, Homo Sapiens; identical to SEQ ID NO: 126689

SEQ ID NO: 671989 - RNA, 64 nt, Homo Sapiens; identical to SEQ ID NO: 126690

SEQ ID NO: 671990 - RNA, 64 nt, Homo Sapiens; identical to SEQ ID NO: 126691

SEQ ID NO: 671991 - RNA, 64 nt, Homo Sapiens
auuugaguccaugaaugcuaacuugaguuguguguggcagcagccuguagaaaaauauuccagc

SEQ ID NO: 671992 - RNA, 64 nt, Homo Sapiens
aucuaaaccuguaucaucuguuugaggcacuaccuggcagcaccaagugaccacuuuucuucuc

SEQ ID NO: 671993 - RNA, 64 nt, Homo Sapiens
cagcacucugcagugagagggacagucccauguguggcagcauugucccacuucagaugccagg

SEQ ID NO: 671994 - RNA, 64 nt, Homo Sapiens
cucguuugauccaguugaguugaaaggguugccuuggcagcagaggcuccucugauggcugaca

SEQ ID NO: 671995 - RNA, 64 nt, Homo Sapiens
ucagaggcuuagcucgccucuuuaggguccaugguggcagcagagaggcagaagugggagucca

SEQ ID NO: 671996 - RNA, 64 nt, Homo Sapiens
aggaugguuccuggccccucugagugacagcugguggcagcacuccuugcuggggggcacuguu

SEQ ID NO: 671997 - RNA, 64 nt, Homo Sapiens
aauacaugggcuccccgauucgcagcugucgucuuggcagcacuugucacguuggcagcacuuu

SEQ ID NO: 671998 - RNA, 64 nt, Homo Sapiens
uucgcagcugucgucuuggcagcacuugucacguuggcagcacuuugagagcaagucugagugg

SEQ ID NO: 671999 - RNA, 64 nt, Homo Sapiens
aauucuacugagucccuggcaagacugucuuaccuggcagcaaacugcugccugauuuguuggg

SEQ ID NO: 672000 - RNA, 64 nt, Homo Sapiens
acugcguaggagagggagaugauccagagacauguggcagcaggcauggcuuccccuuggccuc

SEQ ID NO: 672001 - RNA, 64 nt, Homo Sapiens
ugaaucuauugcgcgcauuugucauuuagcaagauggcagcaguccagcuguucuuugcagcug

SEQ ID NO: 672002 - RNA, 64 nt, Homo Sapiens
gguccuaggugugaccugauaccaccacccuuuguggcagcaccgggcuggacugcccugaucc

SEQ ID NO: 672003 - RNA, 64 nt, Homo Sapiens
auaccucugcauuucuggaagcaccccuaccccguggcagcagcaugaggccaggccgccuccc

SEQ ID NO: 672004 - RNA, 64 nt, Homo Sapiens
ggccuuucccucagacaagcguccagcuuuucuauggcagcagaagggccccagggugacaugu

SEQ ID NO: 672005 - RNA, 64 nt, Homo Sapiens
caugcuguuucuuggccuuuacgggagagggaaguggcagcauguagccaugucugccuugggc

SEQ ID NO: 672006 - RNA, 64 nt, Homo Sapiens
gagcccugggccuguggcuaaccucuaggcugccuggcagcagugggggauggaaaaggggagc

SEQ ID NO: 672007 - RNA, 64 nt, Homo Sapiens
agugggacaagauggacacuugagccuugggauguggcagcaucgcagcucucguucugagaca

SEQ ID NO: 672008 - RNA, 64 nt, Homo Sapiens
aagcagccgcccacagagacaggcacugugugccuggcagcaggacuuccuacccagaggaggu

SEQ ID NO: 672009 - RNA, 64 nt, Homo Sapiens
aaaggguaccccugcaaacaacuguggugggggcuggcagcagaccccccaccuggcagggcuu

SEQ ID NO: 672010 - RNA, 64 nt, Homo Sapiens
uuuuauauaaaaaugcacaccuuuaaucucuauauggcagcauauacauauauauauauaaaau

SEQ ID NO: 672011 - RNA, 64 nt, Homo Sapiens
uauauauauaaaaugcacacuuuuaaucucuauauggcagcauuuuugaggcuuuauaucugcc

SEQ ID NO: 672012 - RNA, 64 nt, Homo Sapiens
gugugcucugcacuugccuugcuccaggaugggguggcagcagaggaaugucacaggucagcag

SEQ ID NO: 672013 - RNA, 64 nt, Homo Sapiens
cccgcccguccagcagggcugucagcuuccuguguggcagcaccuggcacacuggcucuggcca

SEQ ID NO: 672014 - RNA, 64 nt, Homo Sapiens
ugccuggggcaaggccagggaggccccacccuccuggcagcagacuuuaaagaagcgagagagg

SEQ ID NO: 672015 - RNA, 64 nt, Homo Sapiens
cgggcgcgugggugcagcugccggagaguggcucuggcagcaggcgucuucaggacugcaggcu

SEQ ID NO: 672016 - RNA, 64 nt, Homo Sapiens
cagggccgugguccagucccggcgccaacaucaguggcagcagcgcauagggacguggggugca

SEQ ID NO: 672017 - RNA, 64 nt, Homo Sapiens
ugccgguggugaccuggguucgcggcagccucaguggcagcagcgcgcccagcucccugguggc

SEQ ID NO: 672018 - RNA, 64 nt, Homo Sapiens
caaaaccacggugaagauacagggaugggucagguggcagcauccuccacccucccccaacagc

SEQ ID NO: 672019 - RNA, 64 nt, Homo Sapiens
gagggaaaccaggucaccauuuuuagaagggagguggcagcauuuuucuuagcaagucagugug

SEQ ID NO: 672020 - RNA, 64 nt, Homo Sapiens
ggucagggaagugggcuuccggagggcccugagguggcagcaggaugggcaagggagagcgggu

SEQ ID NO: 672021 - RNA, 64 nt, Homo Sapiens
gacuguggggguggaccugggcccacccuggauguggcagcaccggggcugugucgguaguggu

SEQ ID NO: 672022 - RNA, 64 nt, Homo Sapiens
ggccucaacagaggccaaggaguucugugagcccuggcagcaaaaaacaccuuggggggugaag

SEQ ID NO: 672023 - RNA, 64 nt, Homo Sapiens
uuagucggcagaauuaagugcuggugucuuucacuggcagcaugaaguuagccaccaaguccuc

SEQ ID NO: 672024 - RNA, 64 nt, Homo Sapiens
cugugcugggaucugugcccccaacagcugaggguggcagcagucccuggcagcaugggaccug

SEQ ID NO: 672025 - RNA, 64 nt, Homo Sapiens
ggaccugccaacagcugaggcccuagcccugcccuggcagcauggggagcacagcagccucuga

SEQ ID NO: 672026 - RNA, 62 nt, Homo Sapiens
caaacccuagcugccaaccuacuggaccgaaagccuccaacauuguuguaggacugcaagac

SEQ ID NO: 672027 - RNA, 62 nt, Homo Sapiens
ccagcaggccaaggccaagcaccaagcucaacgccuccaagacgcuccuccaccccuuccag

SEQ ID NO: 672028 - RNA, 62 nt, Homo Sapiens
guuucgacugguccagcucuacugcaaaaaaagccuccaaggcuccaacgccccuguggcca

SEQ ID NO: 672029 - RNA, 54 nt, Homo Sapiens
ccccuguggccaacugcaaagcaggccuccaacgucgacaucgaggacccauaa

SEQ ID NO: 672030 - RNA, 62 nt, Homo Sapiens
uggucucacauacuuguaaucaaguuuuuccagccuccaagucaccuggccugggaaaguac

SEQ ID NO: 672031 - RNA, 62 nt, Homo Sapiens
cucugccaaacugaagacagccuuugugcggugccuccaacuuugccucaaaugggacagug

SEQ ID NO: 672032 - RNA, 62 nt, Homo Sapiens
uggagagacagauuugggccaaaucugccccagccuccaacucucacuacccucuguauaua

SEQ ID NO: 672033 - RNA, 62 nt, Homo Sapiens
uccccugguguagagcuuguccuucuugucaugccuccaauuaaggcugggucccauucugu

SEQ ID NO: 672034 - RNA, 62 nt, Homo Sapiens
acagcucagguucccacaccucacuuuucacagccuccaagggcagcagugcacauggagga

SEQ ID NO: 672035 - RNA, 62 nt, Homo Sapiens
cacauggaggagacgucucccacgaggccaaggccuccaaugcucaccgaugcccucugcga

SEQ ID NO: 672036 - RNA, 64 nt, Homo Sapiens; identical to SEQ ID NO: 355670

SEQ ID NO: 672037 - RNA, 64 nt, Homo Sapiens; identical to SEQ ID NO: 355671

SEQ ID NO: 672038 - RNA, 64 nt, Homo Sapiens; identical to SEQ ID NO: 355672

SEQ ID NO: 672039 - RNA, 64 nt, Homo Sapiens; identical to SEQ ID NO: 355673

SEQ ID NO: 672040 - RNA, 64 nt, Homo Sapiens; identical to SEQ ID NO: 355674

SEQ ID NO: 672041 - RNA, 64 nt, Homo Sapiens; identical to SEQ ID NO: 355675

SEQ ID NO: 672042 - RNA, 64 nt, Homo Sapiens; identical to SEQ ID NO: 355676

SEQ ID NO: 672043 - RNA, 64 nt, Homo Sapiens; identical to SEQ ID NO: 355677

SEQ ID NO: 672044 - RNA, 64 nt, Homo Sapiens; identical to SEQ ID NO: 355678

SEQ ID NO: 672045 - RNA, 64 nt, Homo Sapiens; identical to SEQ ID NO: 355679

SEQ ID NO: 672046 - RNA, 64 nt, Homo Sapiens; identical to SEQ ID NO: 355680

SEQ ID NO: 672047 - RNA, 64 nt, Homo Sapiens; identical to SEQ ID NO: 355681

SEQ ID NO: 672048 - RNA, 64 nt, Homo Sapiens; identical to SEQ ID NO: 510924

SEQ ID NO: 672049 - RNA, 64 nt, Homo Sapiens; identical to SEQ ID NO: 510925

SEQ ID NO: 672050 - RNA, 57 nt, Homo Sapiens; identical to SEQ ID NO: 510926

SEQ ID NO: 672051 - RNA, 64 nt, Homo Sapiens; identical to SEQ ID NO: 510927

SEQ ID NO: 672052 - RNA, 64 nt, Homo Sapiens; identical to SEQ ID NO: 510928

SEQ ID NO: 672053 - RNA, 64 nt, Homo Sapiens; identical to SEQ ID NO: 510929

SEQ ID NO: 672054 - RNA, 64 nt, Homo Sapiens; identical to SEQ ID NO: 510930

SEQ ID NO: 672055 - RNA, 64 nt, Homo Sapiens; identical to SEQ ID NO: 510931

SEQ ID NO: 672056 - RNA, 64 nt, Homo Sapiens; identical to SEQ ID NO: 510932

SEQ ID NO: 672057 - RNA, 64 nt, Homo Sapiens; identical to SEQ ID NO: 510933

SEQ ID NO: 672058 - RNA, 64 nt, Homo Sapiens; identical to SEQ ID NO: 510934

SEQ ID NO: 672059 - RNA, 64 nt, Homo Sapiens; identical to SEQ ID NO: 510935

SEQ ID NO: 672060 - RNA, 64 nt, Homo Sapiens; identical to SEQ ID NO: 510936

SEQ ID NO: 672061 - RNA, 64 nt, Homo Sapiens; identical to SEQ ID NO: 510937

SEQ ID NO: 672062 - RNA, 64 nt, Homo Sapiens; identical to SEQ ID NO: 510938

SEQ ID NO: 672063 - RNA, 64 nt, Homo Sapiens; identical to SEQ ID NO: 510939

SEQ ID NO: 672064 - RNA, 64 nt, Homo Sapiens; identical to SEQ ID NO: 510940

SEQ ID NO: 672065 - RNA, 64 nt, Homo Sapiens; identical to SEQ ID NO: 510941

SEQ ID NO: 672066 - RNA, 64 nt, Homo Sapiens; identical to SEQ ID NO: 510942

SEQ ID NO: 672067 - RNA, 64 nt, Homo Sapiens; identical to SEQ ID NO: 510943

SEQ ID NO: 672068 - RNA, 64 nt, Homo Sapiens; identical to SEQ ID NO: 510944

SEQ ID NO: 672069 - RNA, 64 nt, Homo Sapiens; identical to SEQ ID NO: 510945

SEQ ID NO: 672070 - RNA, 64 nt, Homo Sapiens; identical to SEQ ID NO: 510946

SEQ ID NO: 672071 - RNA, 64 nt, Homo Sapiens; identical to SEQ ID NO: 510947

SEQ ID NO: 672072 - RNA, 64 nt, Homo Sapiens; identical to SEQ ID NO: 510948

SEQ ID NO: 672073 - RNA, 64 nt, Homo Sapiens; identical to SEQ ID NO: 510949

SEQ ID NO: 672074 - RNA, 64 nt, Homo Sapiens; identical to SEQ ID NO: 510950

SEQ ID NO: 672075 - RNA, 64 nt, Homo Sapiens; identical to SEQ ID NO: 510951

SEQ ID NO: 672076 - RNA, 64 nt, Homo Sapiens; identical to SEQ ID NO: 510952

SEQ ID NO: 672077 - RNA, 64 nt, Homo Sapiens; identical to SEQ ID NO: 510953

SEQ ID NO: 672078 - RNA, 64 nt, Homo Sapiens; identical to SEQ ID NO: 510954

SEQ ID NO: 672079 - RNA, 64 nt, Homo Sapiens; identical to SEQ ID NO: 510955

SEQ ID NO: 672080 - RNA, 64 nt, Homo Sapiens; identical to SEQ ID NO: 510956

SEQ ID NO: 672081 - RNA, 64 nt, Homo Sapiens; identical to SEQ ID NO: 510957

SEQ ID NO: 672082 - RNA, 64 nt, Homo Sapiens; identical to SEQ ID NO: 510958

SEQ ID NO: 672083 - RNA, 64 nt, Homo Sapiens; identical to SEQ ID NO: 510959

SEQ ID NO: 672084 - RNA, 64 nt, Homo Sapiens; identical to SEQ ID NO: 510960

SEQ ID NO: 672085 - RNA, 64 nt, Homo Sapiens; identical to SEQ ID NO: 510961

SEQ ID NO: 672086 - RNA, 64 nt, Homo Sapiens; identical to SEQ ID NO: 510962

SEQ ID NO: 672087 - RNA, 64 nt, Homo Sapiens; identical to SEQ ID NO: 510963

SEQ ID NO: 672088 - RNA, 64 nt, Homo Sapiens; identical to SEQ ID NO: 510964

SEQ ID NO: 672089 - RNA, 64 nt, Homo Sapiens; identical to SEQ ID NO: 510965

SEQ ID NO: 672090 - RNA, 64 nt, Homo Sapiens; identical to SEQ ID NO: 510966

SEQ ID NO: 672091 - RNA, 64 nt, Homo Sapiens; identical to SEQ ID NO: 510967

SEQ ID NO: 672092 - RNA, 64 nt, Homo Sapiens; identical to SEQ ID NO: 510968

SEQ ID NO: 672093 - RNA, 64 nt, Homo Sapiens; identical to SEQ ID NO: 510969

SEQ ID NO: 672094 - RNA, 64 nt, Homo Sapiens; identical to SEQ ID NO: 510970

SEQ ID NO: 672095 - RNA, 64 nt, Homo Sapiens; identical to SEQ ID NO: 510971

SEQ ID NO: 672096 - RNA, 64 nt, Homo Sapiens; identical to SEQ ID NO: 510972

SEQ ID NO: 672097 - RNA, 64 nt, Homo Sapiens; identical to SEQ ID NO: 510973

SEQ ID NO: 672098 - RNA, 64 nt, Homo Sapiens; identical to SEQ ID NO: 510974

SEQ ID NO: 672099 - RNA, 64 nt, Homo Sapiens; identical to SEQ ID NO: 510975

SEQ ID NO: 672100 - RNA, 64 nt, Homo Sapiens; identical to SEQ ID NO: 510976

SEQ ID NO: 672101 - RNA, 64 nt, Homo Sapiens; identical to SEQ ID NO: 510977

SEQ ID NO: 672102 - RNA, 64 nt, Homo Sapiens; identical to SEQ ID NO: 510978

SEQ ID NO: 672103 - RNA, 64 nt, Homo Sapiens; identical to SEQ ID NO: 510979

SEQ ID NO: 672104 - RNA, 64 nt, Homo Sapiens; identical to SEQ ID NO: 510980

SEQ ID NO: 672105 - RNA, 64 nt, Homo Sapiens; identical to SEQ ID NO: 510981

SEQ ID NO: 672106 - RNA, 64 nt, Homo Sapiens; identical to SEQ ID NO: 510982

SEQ ID NO: 672107 - RNA, 64 nt, Homo Sapiens; identical to SEQ ID NO: 510983

SEQ ID NO: 672108 - RNA, 64 nt, Homo Sapiens
aagcuugcugaaauggaaaaugcaucucugggaaaaacaccagaccaauuuccugggcaguuga

SEQ ID NO: 672109 - RNA, 64 nt, Homo Sapiens
caaaucgauaacaacuuauaucccuuuccccuuaaaacaccagaaaauuuaccuccuuuccuuu

SEQ ID NO: 672110 - RNA, 64 nt, Homo Sapiens
uuuuagcaaaacuuuacuaauauugguuaugaugaaacaccacaacauggcacaaaacaccaaa

SEQ ID NO: 672111 - RNA, 64 nt, Homo Sapiens
uauugguuaugaugaaacacggccacauggcacaaaacaccaaaugugaaacugacaauccugu

SEQ ID NO: 672112 - RNA, 64 nt, Homo Sapiens
cucaagggcaugucuuaacgaagaucagcaaagaaaacaccaggcacccucugccacuuagaca

SEQ ID NO: 672113 - RNA, 64 nt, Homo Sapiens
caaacacuuacugacaaaucggguccugaguugaaaacaccauuugucaaagaggccuuugaag

SEQ ID NO: 672114 - RNA, 64 nt, Homo Sapiens
cauccuuuucuucugccucgccugaaucccccauaaacaccagaugauugagucuaccuucuuu

SEQ ID NO: 672115 - RNA, 64 nt, Homo Sapiens
ucccuuuuucuucugccucacuugaaucccccguaaacaccagacgauugagucuaccuucuuu

SEQ ID NO: 672116 - RNA, 64 nt, Homo Sapiens
ugaaaaagacgucaauaucugcucacaucuuacuaaacaccagagaguucaugcuuaauaaaag

SEQ ID NO: 672117 - RNA, 64 nt, Homo Sapiens
ugggaaaacaaauuuucaaaaacuacagcuuagaaaacaccagaguuuauacgaaaauauauuu

SEQ ID NO: 672118 - RNA, 64 nt, Homo Sapiens
aucucuuuagaauuacacagcuaaaaaggaaaaaaaacaccaaaauaagauaaaauaaaacaaa

SEQ ID NO: 672119 - RNA, 64 nt, Homo Sapiens
aaaacaccaaaauaagauaaaauaaaacaaauuuaaacaccaaaauaagauauaauaaaacauu

SEQ ID NO: 672120 - RNA, 60 nt, Homo Sapiens
ugagauguucauagcauguuaaaauauuuaucuuagaauuuuuuucugccuuacgauaua

SEQ ID NO: 672121 - RNA, 60 nt, Homo Sapiens
auagaucauuuugaaacuuauaaucucuucucuuagaaguuucucucauauuuaaaaacg

SEQ ID NO: 672122 - RNA, 60 nt, Homo Sapiens
cuuuuccucaagauaacugaccaaguguuuucuuagaaccaaaguuuuuaaaguugcuaa

SEQ ID NO: 672123 - RNA, 60 nt, Homo Sapiens
uuauuaaucugaagauuaaccauuuuuuugucuuagaauaucaaaaagaaaaagaaaaag

SEQ ID NO: 672124 - RNA, 60 nt, Homo Sapiens
cacugcuucaagguuucuuuuguauauaauucuuagaaugcucauuucuuuuaaaugguu

SEQ ID NO: 672125 - RNA, 60 nt, Homo Sapiens
guggaagaaacgucuucuugccaagcucauucuuagaacuuacacaucuagaacagcuuc

SEQ ID NO: 672126 - RNA, 60 nt, Homo Sapiens
cucaaguacauuauauacaggauuugaucaucuuagaaaaagcauguugagauauuuuua

SEQ ID NO: 672127 - RNA, 60 nt, Homo Sapiens
agaaacuuugauggguuaaccccuagcaggucuuagaauuaauguuuuaaaggaauaaau

SEQ ID NO: 672128 - RNA, 60 nt, Homo Sapiens
aaacaaaacuuuuacuaggguaugauggcaucuuagaauuuaaaaguuaagguuguucac

SEQ ID NO: 672129 - RNA, 60 nt, Homo Sapiens
uuuauggugauuauuuugagcucccauaagucuuagaagcguggaccauccuaguuuauu

SEQ ID NO: 672130 - RNA, 60 nt, Homo Sapiens
uuuuuggauuuuguaaaagcauuuucauucucuuagaaauucaaguauuuucaaggggag

SEQ ID NO: 672131 - RNA, 60 nt, Homo Sapiens
caaguuguucucuggagguuucuaugagguucuuagaaaaauuugguuuuaaaaucauuu

SEQ ID NO: 672132 - RNA, 60 nt, Homo Sapiens
gcuuaaaccaccacucuuaggucugcucacucuuagaacacacaauggaagaggaagggu

SEQ ID NO: 672133 - RNA, 60 nt, Homo Sapiens
ucacggauauguauaguuuuauguuuguuuucuuagaaacaaauguguuucuuugggugg

SEQ ID NO: 672134 - RNA, 60 nt, Homo Sapiens
augucuugaugaagucuuuucauuagucacucuuagaauucuaaagugcuuugcacuuuu

SEQ ID NO: 672135 - RNA, 60 nt, Homo Sapiens
cauugauuauguucaacuuuaugugugcauucuuagaagaguaagaacaaauaaaguaca

SEQ ID NO: 672136 - RNA, 60 nt, Homo Sapiens
aggaaaaaaauacaacuaaugaugcacauuucuuagaacacaauaguccauugauauacu

SEQ ID NO: 672137 - RNA, 60 nt, Homo Sapiens
agggcugugcuccugcucccagcagcccucucuuagaauauuucagauggaugagcuucu

SEQ ID NO: 672138 - RNA, 60 nt, Homo Sapiens
ccuguugguuaaggcagcugggggauaguaucuuagaaaaaagaggcagaaacagguaag

SEQ ID NO: 672139 - RNA, 60 nt, Homo Sapiens
gaacuuuuuuuuuuuuuugauacaggaagcucuuagaaaacuuuagggagcagccacaca

SEQ ID NO: 672140 - RNA, 60 nt, Homo Sapiens
ucuaaacaucuuuguugaugucccaucaauucuuagaauaaaucuuuguuagauauuagg

SEQ ID NO: 672141 - RNA, 60 nt, Homo Sapiens
ucuaagaaucuuuguuagauucccaucaauucuuagaauaucacugaugcuucuaucagg

SEQ ID NO: 672142 - RNA, 60 nt, Homo Sapiens
cugaaagcauagauuuugaacuaaaauaugucuuagaauccaguuuaggaauauguuguu

SEQ ID NO: 672143 - RNA, 60 nt, Homo Sapiens
aaagaaaaaguaugaaugguucaauuaucuucuuagaaagucauuugcaaagcacucagc

SEQ ID NO: 672144 - RNA, 60 nt, Homo Sapiens
aaugaaggugccauuuggcugaggcugcgaucuuagaaauuuuuaugaaaauuaaguaca

SEQ ID NO: 672145 - RNA, 60 nt, Homo Sapiens
uccuccauuuuuaugguaaacaaaaauaagucuuagaaaagauuaaugaaaaugaaugcc

SEQ ID NO: 672146 - RNA, 60 nt, Homo Sapiens
gagcuagcuugagucaauuuuuugcuucugucuuagaauuaagcgaucagcaucaagggc

SEQ ID NO: 672147 - RNA, 60 nt, Homo Sapiens
cccuuccccuaggccugcaucuguugucuuucuuagaaugauccaaagacuuugcacaug

SEQ ID NO: 672148 - RNA, 64 nt, Homo Sapiens; identical to SEQ ID NO: 248128

SEQ ID NO: 672149 - RNA, 64 nt, Homo Sapiens; identical to SEQ ID NO: 248129

SEQ ID NO: 672150 - RNA, 64 nt, Homo Sapiens; identical to SEQ ID NO: 248130

SEQ ID NO: 672151 - RNA, 64 nt, Homo Sapiens; identical to SEQ ID NO: 248131

SEQ ID NO: 672152 - RNA, 64 nt, Homo Sapiens; identical to SEQ ID NO: 248132

SEQ ID NO: 672153 - RNA, 64 nt, Homo Sapiens; identical to SEQ ID NO: 248133

SEQ ID NO: 672154 - RNA, 64 nt, Homo Sapiens; identical to SEQ ID NO: 248134

SEQ ID NO: 672155 - RNA, 64 nt, Homo Sapiens; identical to SEQ ID NO: 248135

SEQ ID NO: 672156 - RNA, 64 nt, Homo Sapiens; identical to SEQ ID NO: 248136

SEQ ID NO: 672157 - RNA, 64 nt, Homo Sapiens; identical to SEQ ID NO: 248137

SEQ ID NO: 672158 - RNA, 64 nt, Homo Sapiens; identical to SEQ ID NO: 248138

SEQ ID NO: 672159 - RNA, 64 nt, Homo Sapiens; identical to SEQ ID NO: 248139

SEQ ID NO: 672160 - RNA, 64 nt, Homo Sapiens; identical to SEQ ID NO: 248140

SEQ ID NO: 672161 - RNA, 64 nt, Homo Sapiens; identical to SEQ ID NO: 248141

SEQ ID NO: 672162 - RNA, 62 nt, Homo Sapiens
auucugugggagaguguggaaaggcacucuuuuuucuccauauuaguuaacaagaggugucu

SEQ ID NO: 672163 - RNA, 62 nt, Homo Sapiens
ggcuaauuucauauuuuuuaguagagacaggauuucuccauguuggucaggcuggucuugaa

SEQ ID NO: 672164 - RNA, 62 nt, Homo Sapiens
caaaucaaauauuuacauauugcuuaucacuuuuucuccauuuuaauaauggaaugaacuaa

SEQ ID NO: 672165 - RNA, 62 nt, Homo Sapiens
aguuguucacagauauuuuauguuuuuuuaauuuucuccaagaauauuuauagaauuccaaa

SEQ ID NO: 672166 - RNA, 62 nt, Homo Sapiens
uugucccuguguugucccaucugcccucccuguuucuccacaacagccugggguuguccccg

SEQ ID NO: 672167 - RNA, 62 nt, Homo Sapiens
auuuuuguuuauuuuccuuaaauuuuuagccauuucuccaugggccaccgcccagcucaugu

SEQ ID NO: 672168 - RNA, 62 nt, Homo Sapiens
uguaaaacaaguggcugcagucugggccucuauuucuccauuuggacaaggcgcuucaucuc

SEQ ID NO: 672169 - RNA, 62 nt, Homo Sapiens
uugcuaucuacucagccuuaauuuauucaguauuucuccaagacuguuuucaaacugcucac

SEQ ID NO: 672170 - RNA, 62 nt, Homo Sapiens
agaggccugggccucugauaacacuuuggcuuuuucuccauucacgcugauuuggcaaaagg

SEQ ID NO: 672171 - RNA, 62 nt, Homo Sapiens
aguauguucuucuuuuuuauguaagggacagcuuucuccacagaguccuuucugcuggugag

SEQ ID NO: 672172 - RNA, 62 nt, Homo Sapiens
ccaugagugcacaaucccugaacucacugucuuuucuccacacuuguccuaagccaagguag

SEQ ID NO: 672173 - RNA, 62 nt, Homo Sapiens
ccaacuuaggcucuuuauuaauugguuaagguuuucuccaaaaagggcauuucaacaauggg

SEQ ID NO: 672174 - RNA, 62 nt, Homo Sapiens
guguguugugaaaguuuggaaggucagaccuuuuucuccaagaaggacaagccccuguguaa

SEQ ID NO: 672175 - RNA, 62 nt, Homo Sapiens
ucuacauauuauucaugaagcauaauguugcauuucuccaaauuuuaugccugaaaggguag

SEQ ID NO: 672176 - RNA, 62 nt, Homo Sapiens
ucaucuuuuaauuccuguuaaaggaauuauucuuucuccauaauucuuucuccauaucuuuu

SEQ ID NO: 672177 - RNA, 62 nt, Homo Sapiens
ucuuuuaaggaauuauucuuacggaauuauucuuucuccauacuuaccuguaaaguuaucuu

SEQ ID NO: 672178 - RNA, 62 nt, Homo Sapiens
ccuguaccuuuugaggagccccagcuacccuuuuucuccagcugggcucugcaauuccccuc

SEQ ID NO: 672179 - RNA, 62 nt, Homo Sapiens
uucucucggcuccccauguguccugguucccguuucuccaccuagacuguaaaccucucgag

SEQ ID NO: 672180 - RNA, 62 nt, Homo Sapiens
aaacacuuugagauacuuaaguaguaaaaagauuucuccagaggaauaucaaguauaaugau

SEQ ID NO: 672181 - RNA, 62 nt, Homo Sapiens
agccuucuggcugauuguucuugugcuuccucuuucuccagagguaguucuguucugugggu

SEQ ID NO: 672182 - RNA, 62 nt, Homo Sapiens
uguuuagcaagcauauguuguuccucagcucuuuucuccagcuuuugcaguguccuggcauc

SEQ ID NO: 672183 - RNA, 62 nt, Homo Sapiens
aagugauaauuuuguguuuuucucauauaaguuuucuccagagcacccaccuucucuuccuu

SEQ ID NO: 672184 - RNA, 62 nt, Homo Sapiens
ccuccagcuaggaggaaaugagagcccuccccuuucuccaucaugugggaauaggugggcca

SEQ ID NO: 672185 - RNA, 62 nt, Homo Sapiens
acagcagacuauuguccgugucagcacggcccuuucuccagcugguccacuccagccaucag

SEQ ID NO: 672186 - RNA, 62 nt, Homo Sapiens
ucagcugguggcuagguuucuagcgcauuugauuucuccagguuugcugugucucacagagg

SEQ ID NO: 672187 - RNA, 62 nt, Homo Sapiens
auucuagaagcagaagguuguuuuuuuuuuuuuuucuccauucugaaaauagcaggacauuu

SEQ ID NO: 672188 - RNA, 62 nt, Homo Sapiens
gucaaguuuucuaggguugaauuuuuuucuuuuuucuccaugguguuaaugauauuagagau

SEQ ID NO: 672189 - RNA, 62 nt, Homo Sapiens
ucaguuuuauuuauuuauuuuuaauuuguuuuuuucuccaaguccaccagucucugaaauua

SEQ ID NO: 672190 - RNA, 62 nt, Homo Sapiens
aauggagaagaaacauccaaaagcacauuucauuucuccaaacuuuguguuuuaaauuauag

SEQ ID NO: 672191 - RNA, 62 nt, Homo Sapiens
uguaagguaauuuuaaauugucccucguauuauuucuccacgucuguuuuaguuuaaugucu

SEQ ID NO: 672192 - RNA, 62 nt, Homo Sapiens
ugggacucaggauauuaguuuuaugcaagguauuucuccaguguaaaaaggugguauguaau

SEQ ID NO: 672193 - RNA, 62 nt, Homo Sapiens
ucaaaacgagggcugauggagaggagaggaguuuucuccauaaagaaugaaaaugcaguccu

SEQ ID NO: 672194 - RNA, 62 nt, Homo Sapiens
auuuucaguuuuaaaugugggcaaaaaggcauuuucuccaagauuuuaaaacuaauucuuau

SEQ ID NO: 672195 - RNA, 62 nt, Homo Sapiens
uuucaagagcuauuuuguaaacagaugauguauuucuccauugaaaacacaauaaaaaaaaa

SEQ ID NO: 672196 - RNA, 62 nt, Homo Sapiens
cucauguccauuuuggugugcugcuguauucauuucuccaauuuuucuucuaucuguuccau

SEQ ID NO: 672197 - RNA, 62 nt, Homo Sapiens
agacaaauggaaaaaaagaggaaaaaguauuuuuucuccaccaaacuacauauuuuauuaua

SEQ ID NO: 672198 - RNA, 62 nt, Homo Sapiens
uaccuucccuucccuugaaaguagagaugagguuucuccauguuggucaggcuggucucgaa

SEQ ID NO: 672199 - RNA, 62 nt, Homo Sapiens
gcaacuggccugagcaacacagggagacucaguuucuccaaaaaaauaaaaaauuagccgau

SEQ ID NO: 672200 - RNA, 62 nt, Homo Sapiens
ugggauguugucucugcccgugauagugcaaguuucuccaguuaucucggcauccucuugaa

SEQ ID NO: 672201 - RNA, 62 nt, Homo Sapiens
uuuucucaaagaguuuacauccccgguccuuuuuucuccaacggaauauuaaaccaaacucu

SEQ ID NO: 672202 - RNA, 62 nt, Homo Sapiens
ggugauggaaaaagcgcuguuuccuugccugcuuucuccaagacagauuuucggaacacauu

SEQ ID NO: 672203 - RNA, 62 nt, Homo Sapiens
guucugcugagacugagcaccuuacagauauuuuucuccagaagauggugcuggguaauaaa

SEQ ID NO: 672204 - RNA, 62 nt, Homo Sapiens
guguccugacaggucagcccaguuucuccagauuucuccaauccacagcuucucacugccga

SEQ ID NO: 672205 - RNA, 62 nt, Homo Sapiens
uuucuccaauguguccugacucacugccgaaguuucuccagacuucccucauccacagcuuc

SEQ ID NO: 672206 - RNA, 62 nt, Homo Sapiens
uacagugcagagagcugucuugccaucacucuuuucuccacagcugcuaugguuugaaugga

SEQ ID NO: 672207 - RNA, 62 nt, Homo Sapiens
gugcaccugaggcagaucauaaucaugagcguuuucuccacuuauuauaauaccaaauugua

SEQ ID NO: 672208 - RNA, 62 nt, Homo Sapiens
aaaugcaugucauguauucuagauuuaguugauuucuccaccuuacugaauggcuucauuuc

SEQ ID NO: 672209 - RNA, 54 nt, Homo Sapiens; identical to SEQ ID NO: 221267

SEQ ID NO: 672210 - RNA, 62 nt, Homo Sapiens
aggauuagcuuggaguucucggccuaagaggcuuucuccagggcuuaccugaucucauguua

SEQ ID NO: 672211 - RNA, 62 nt, Homo Sapiens
gccuugugugaacucaccaaugccuucuccuauuucuccaaaagagaaaguaaaggcaguaa

SEQ ID NO: 672212 - RNA, 62 nt, Homo Sapiens
gcgcucuugcugggagguccgccgcagguagguuucuccagucaggccgacuccacucccac

SEQ ID NO: 672213 - RNA, 62 nt, Homo Sapiens
aagaacucgacuugucugaaaaggaacuagucuuucuccaaggccucagcuccucccugggg

SEQ ID NO: 672214 - RNA, 62 nt, Homo Sapiens
gcccugccucuacuuuccuuguuugucuuucuuuucuccauauugucaucuuuguaucucca

SEQ ID NO: 672215 - RNA, 62 nt, Homo Sapiens
ugaggucuuggucugaagaauuuucaugcuucuuucuccacccuggguccuccaucgggaac

SEQ ID NO: 672216 - RNA, 64 nt, Homo Sapiens
agccucggccucccugagcucugaccccagccucacccgaaaggccagccuggggcucuccggc

SEQ ID NO: 672217 - RNA, 64 nt, Homo Sapiens
cugugccaauaauaccauuaugugccauguacugacccgaaaggcucggccgcagagccggggc

SEQ ID NO: 672218 - RNA, 64 nt, Homo Sapiens
uucugcaaguuaauaacugccuugaauuguuugaacccgaaauaaggguucuuugguaccucua

SEQ ID NO: 672219 - RNA, 64 nt, Homo Sapiens
cucaccagauaaacuacagucuaaaaaacccucgacccgaaaccaagcgcugagauucuuccau

SEQ ID NO: 672220 - RNA, 64 nt, Homo Sapiens
gguugucauggcaucucuugauguuuccugggaaacccgaaaaaugcaguuuccauagcaaccc

SEQ ID NO: 672221 - RNA, 64 nt, Homo Sapiens
ugaaaccagcuuucauuauaaucacuauuuccauacccgaaagguuuucuuccuaggccuugcu

SEQ ID NO: 672222 - RNA, 64 nt, Homo Sapiens
aaaggagcugaaggcaggugggcuucuggcuagaacccgaaacaaggcaagagacaggccccag

SEQ ID NO: 672223 - RNA, 64 nt, Homo Sapiens
aagugccuuuccauaaggacuggggacgugcugaacccgaaaaauuucgguaccugugaaugca

SEQ ID NO: 672224 - RNA, 64 nt, Homo Sapiens
ccuuuuuacuugugugguuauguguggggcuggcacccgaaaugugugacauucagcuucuaaa

SEQ ID NO: 672225 - RNA, 64 nt, Homo Sapiens
ccuucaccagugagaagaacaaugaaugucaugaacccgaaaaaagcuucagucuggacucuac

SEQ ID NO: 672226 - RNA, 64 nt, Homo Sapiens
ugcuguuauaacucagaguccaauuccugugaauacccgaaacccaguuaugguguagcugcug

SEQ ID NO: 672227 - RNA, 64 nt, Homo Sapiens
gggcccagccccaggcugcagcccauucgcaggcacccgaaagaacuuccccaguauggugguc

SEQ ID NO: 672228 - RNA, 64 nt, Homo Sapiens
ccaugugacucagcaauccugcugcuggguauauacccgaaagaaaggaaaaggaagccaguau

SEQ ID NO: 672229 - RNA, 64 nt, Homo Sapiens
agaaggggguuuaaaaugaccuuuuuuucaguugacccgaaaguugugguuagaugauuaaaaa

SEQ ID NO: 672230 - RNA, 64 nt, Homo Sapiens
cgccccugcugucuuccccaccgcagucaccaccacccgaaaugccacguggucacugugcacu

SEQ ID NO: 672231 - RNA, 64 nt, Homo Sapiens
gcaucuuuuuuuaguuucuuaccauaagaguuugacccgaaacugcucacuucacauuggauga

SEQ ID NO: 672232 - RNA, 64 nt, Homo Sapiens
ccucccugugcccccagccucagcccaacuucuuacccgaaagcaucacugccuuggccccucc

SEQ ID NO: 672233 - RNA, 64 nt, Homo Sapiens
ggacacuggcuccgcccugguggcuccagcccccacccgaaagugcagcuccuggacagccucu

SEQ ID NO: 672234 - RNA, 64 nt, Homo Sapiens
gcaccacuugaaggagcucuaucaccagccucaaacccgaaagacugaggcauuuuccagucua

SEQ ID NO: 672235 - RNA, 64 nt, Homo Sapiens
uuucaggccccgcuugcaagccagagcagcccggacccgaaaccgggccucggauaccugcugc

SEQ ID NO: 672236 - RNA, 64 nt, Homo Sapiens
auucaccguguguacugagugcaguuuuuuucacacccgaaagucuuuacuggcuuucauagcu

SEQ ID NO: 672237 - RNA, 64 nt, Homo Sapiens
ugaacgugaagcugauaggaaaucaccccagggaacccgaaaaagaaacuugauuccucuauug

SEQ ID NO: 672238 - RNA, 64 nt, Homo Sapiens
cagaaucaagaaaauugagaugagauuugaaaggacccgaaaaugcagggguuggcuuucugac

SEQ ID NO: 672239 - RNA, 64 nt, Homo Sapiens
cccuuuugugugaauugacuaccguuguuugcaaacccgaaaauaaaagacguucauuauguau

SEQ ID NO: 672240 - RNA, 64 nt, Homo Sapiens
aggccugggccggccugaccaaccaaggaaccagacccgaaacccgccuaggaaccagaccuga

SEQ ID NO: 672241 - RNA, 64 nt, Homo Sapiens
uacuggauugccuuaaauucuucucuuacaccccacccgaaaguauucagcuggcauuuagaga

SEQ ID NO: 672242 - RNA, 64 nt, Homo Sapiens
uucuuugacaauuugugaugucugaaaaaacagaacccgaaaagcuauggugauauguacaggc

SEQ ID NO: 672243 - RNA, 64 nt, Homo Sapiens
ccuuccuugguaaaaccauucuucuacagagugaacccgaaaauacagaaaccgugccaaaaga

SEQ ID NO: 672244 - RNA, 64 nt, Homo Sapiens
ugacuauagcaaccagcuggacccggccucuggcacccgaaacuuccacccccgacggcuccug

SEQ ID NO: 672245 - RNA, 64 nt, Homo Sapiens
ugacggccugccugcaaaccugcugguggggcagacccgaaaauccagcgugcaccccgccgga

SEQ ID NO: 672246 - RNA, 64 nt, Homo Sapiens
ucacgccgucccgcagggcccagcacagccccagacccgaaaaaaguguucugcccaagauucc

SEQ ID NO: 672247 - RNA, 64 nt, Homo Sapiens
cccuccacgcucguccucuacuggggcugcccccacccgaaagacggggccucggggcacacag

SEQ ID NO: 672248 - RNA, 64 nt, Homo Sapiens
uuguguggcccauggauuugaaagaagcugcugcacccgaaacugccagugugcggugacaacg

SEQ ID NO: 672249 - RNA, 64 nt, Homo Sapiens
auggguaaccuucgaggaagauuaaaaauuagcaacccgaaagggaucuacagggccagucuac

SEQ ID NO: 672250 - RNA, 64 nt, Homo Sapiens; identical to SEQ ID NO: 465832

SEQ ID NO: 672251 - RNA, 64 nt, Homo Sapiens; identical to SEQ ID NO: 465833

SEQ ID NO: 672252 - RNA, 64 nt, Homo Sapiens; identical to SEQ ID NO: 465834

SEQ ID NO: 672253 - RNA, 64 nt, Homo Sapiens; identical to SEQ ID NO: 465835

SEQ ID NO: 672254 - RNA, 64 nt, Homo Sapiens; identical to SEQ ID NO: 465836

SEQ ID NO: 672255 - RNA, 64 nt, Homo Sapiens; identical to SEQ ID NO: 465837

SEQ ID NO: 672256 - RNA, 64 nt, Homo Sapiens; identical to SEQ ID NO: 465838

SEQ ID NO: 672257 - RNA, 64 nt, Homo Sapiens; identical to SEQ ID NO: 465839

SEQ ID NO: 672258 - RNA, 64 nt, Homo Sapiens; identical to SEQ ID NO: 465840

SEQ ID NO: 672259 - RNA, 64 nt, Homo Sapiens; identical to SEQ ID NO: 465841

SEQ ID NO: 672260 - RNA, 64 nt, Homo Sapiens; identical to SEQ ID NO: 465842

SEQ ID NO: 672261 - RNA, 64 nt, Homo Sapiens; identical to SEQ ID NO: 465843

SEQ ID NO: 672262 - RNA, 64 nt, Homo Sapiens; identical to SEQ ID NO: 465844

SEQ ID NO: 672263 - RNA, 64 nt, Homo Sapiens; identical to SEQ ID NO: 465845

SEQ ID NO: 672264 - RNA, 64 nt, Homo Sapiens; identical to SEQ ID NO: 465846

SEQ ID NO: 672265 - RNA, 64 nt, Homo Sapiens; identical to SEQ ID NO: 465847

SEQ ID NO: 672266 - RNA, 64 nt, Homo Sapiens; identical to SEQ ID NO: 465848

SEQ ID NO: 672267 - RNA, 64 nt, Homo Sapiens; identical to SEQ ID NO: 465849

SEQ ID NO: 672268 - RNA, 64 nt, Homo Sapiens; identical to SEQ ID NO: 465850

SEQ ID NO: 672269 - RNA, 64 nt, Homo Sapiens; identical to SEQ ID NO: 465851

SEQ ID NO: 672270 - RNA, 64 nt, Homo Sapiens; identical to SEQ ID NO: 465852

SEQ ID NO: 672271 - RNA, 64 nt, Homo Sapiens; identical to SEQ ID NO: 465853

SEQ ID NO: 672272 - RNA, 64 nt, Homo Sapiens; identical to SEQ ID NO: 465854

SEQ ID NO: 672273 - RNA, 64 nt, Homo Sapiens; identical to SEQ ID NO: 465855

SEQ ID NO: 672274 - RNA, 64 nt, Homo Sapiens; identical to SEQ ID NO: 465856

SEQ ID NO: 672275 - RNA, 64 nt, Homo Sapiens; identical to SEQ ID NO: 465857

SEQ ID NO: 672276 - RNA, 64 nt, Homo Sapiens; identical to SEQ ID NO: 465858

SEQ ID NO: 672277 - RNA, 64 nt, Homo Sapiens; identical to SEQ ID NO: 465859

SEQ ID NO: 672278 - RNA, 64 nt, Homo Sapiens; identical to SEQ ID NO: 465860

SEQ ID NO: 672279 - RNA, 64 nt, Homo Sapiens; identical to SEQ ID NO: 465861

SEQ ID NO: 672280 - RNA, 64 nt, Homo Sapiens; identical to SEQ ID NO: 465862

SEQ ID NO: 672281 - RNA, 64 nt, Homo Sapiens; identical to SEQ ID NO: 465863

SEQ ID NO: 672282 - RNA, 64 nt, Homo Sapiens; identical to SEQ ID NO: 465864

SEQ ID NO: 672283 - RNA, 64 nt, Homo Sapiens; identical to SEQ ID NO: 465865

SEQ ID NO: 672284 - RNA, 64 nt, Homo Sapiens; identical to SEQ ID NO: 465866

SEQ ID NO: 672285 - RNA, 64 nt, Homo Sapiens; identical to SEQ ID NO: 465867

SEQ ID NO: 672286 - RNA, 64 nt, Homo Sapiens; identical to SEQ ID NO: 465868

SEQ ID NO: 672287 - RNA, 64 nt, Homo Sapiens; identical to SEQ ID NO: 465869

SEQ ID NO: 672288 - RNA, 64 nt, Homo Sapiens; identical to SEQ ID NO: 465870

SEQ ID NO: 672289 - RNA, 64 nt, Homo Sapiens; identical to SEQ ID NO: 465871

SEQ ID NO: 672290 - RNA, 64 nt, Homo Sapiens; identical to SEQ ID NO: 465872

SEQ ID NO: 672291 - RNA, 64 nt, Homo Sapiens; identical to SEQ ID NO: 465873

SEQ ID NO: 672292 - RNA, 64 nt, Homo Sapiens; identical to SEQ ID NO: 465874

SEQ ID NO: 672293 - RNA, 64 nt, Homo Sapiens; identical to SEQ ID NO: 465875

SEQ ID NO: 672294 - RNA, 64 nt, Homo Sapiens; identical to SEQ ID NO: 465876

SEQ ID NO: 672295 - RNA, 64 nt, Homo Sapiens; identical to SEQ ID NO: 465877

SEQ ID NO: 672296 - RNA, 64 nt, Homo Sapiens; identical to SEQ ID NO: 465878

SEQ ID NO: 672297 - RNA, 64 nt, Homo Sapiens; identical to SEQ ID NO: 465879

SEQ ID NO: 672298 - RNA, 64 nt, Homo Sapiens; identical to SEQ ID NO: 465880

SEQ ID NO: 672299 - RNA, 64 nt, Homo Sapiens; identical to SEQ ID NO: 465881

SEQ ID NO: 672300 - RNA, 64 nt, Homo Sapiens; identical to SEQ ID NO: 465882

SEQ ID NO: 672301 - RNA, 64 nt, Homo Sapiens; identical to SEQ ID NO: 465883

SEQ ID NO: 672302 - RNA, 64 nt, Homo Sapiens; identical to SEQ ID NO: 154420

SEQ ID NO: 672303 - RNA, 64 nt, Homo Sapiens; identical to SEQ ID NO: 154421

SEQ ID NO: 672304 - RNA, 64 nt, Homo Sapiens; identical to SEQ ID NO: 154422

SEQ ID NO: 672305 - RNA, 64 nt, Homo Sapiens; identical to SEQ ID NO: 154423

SEQ ID NO: 672306 - RNA, 64 nt, Homo Sapiens; identical to SEQ ID NO: 154424

SEQ ID NO: 672307 - RNA, 64 nt, Homo Sapiens; identical to SEQ ID NO: 154425

SEQ ID NO: 672308 - RNA, 64 nt, Homo Sapiens; identical to SEQ ID NO: 154426

SEQ ID NO: 672309 - RNA, 64 nt, Homo Sapiens; identical to SEQ ID NO: 154427

SEQ ID NO: 672310 - RNA, 64 nt, Homo Sapiens; identical to SEQ ID NO: 154428

SEQ ID NO: 672311 - RNA, 64 nt, Homo Sapiens; identical to SEQ ID NO: 154429

SEQ ID NO: 672312 - RNA, 64 nt, Homo Sapiens; identical to SEQ ID NO: 154430

SEQ ID NO: 672313 - RNA, 64 nt, Homo Sapiens; identical to SEQ ID NO: 154431

SEQ ID NO: 672314 - RNA, 64 nt, Homo Sapiens; identical to SEQ ID NO: 154432

SEQ ID NO: 672315 - RNA, 64 nt, Homo Sapiens; identical to SEQ ID NO: 154433

SEQ ID NO: 672316 - RNA, 64 nt, Homo Sapiens; identical to SEQ ID NO: 154434

SEQ ID NO: 672317 - RNA, 64 nt, Homo Sapiens; identical to SEQ ID NO: 154435

SEQ ID NO: 672318 - RNA, 64 nt, Homo Sapiens; identical to SEQ ID NO: 154436

SEQ ID NO: 672319 - RNA, 64 nt, Homo Sapiens; identical to SEQ ID NO: 626237

SEQ ID NO: 672320 - RNA, 64 nt, Homo Sapiens; identical to SEQ ID NO: 626238

SEQ ID NO: 672321 - RNA, 64 nt, Homo Sapiens; identical to SEQ ID NO: 626239

SEQ ID NO: 672322 - RNA, 64 nt, Homo Sapiens; identical to SEQ ID NO: 626240

SEQ ID NO: 672323 - RNA, 64 nt, Homo Sapiens; identical to SEQ ID NO: 626241

SEQ ID NO: 672324 - RNA, 64 nt, Homo Sapiens; identical to SEQ ID NO: 626242

SEQ ID NO: 672325 - RNA, 64 nt, Homo Sapiens; identical to SEQ ID NO: 626243

SEQ ID NO: 672326 - RNA, 64 nt, Homo Sapiens; identical to SEQ ID NO: 626244

SEQ ID NO: 672327 - RNA, 64 nt, Homo Sapiens; identical to SEQ ID NO: 626245

SEQ ID NO: 672328 - RNA, 64 nt, Homo Sapiens; identical to SEQ ID NO: 626246

SEQ ID NO: 672329 - RNA, 64 nt, Homo Sapiens; identical to SEQ ID NO: 626247

SEQ ID NO: 672330 - RNA, 64 nt, Homo Sapiens; identical to SEQ ID NO: 626248

SEQ ID NO: 672331 - RNA, 64 nt, Homo Sapiens; identical to SEQ ID NO: 626249

SEQ ID NO: 672332 - RNA, 64 nt, Homo Sapiens; identical to SEQ ID NO: 626250

SEQ ID NO: 672333 - RNA, 64 nt, Homo Sapiens; identical to SEQ ID NO: 626251

SEQ ID NO: 672334 - RNA, 55 nt, Homo Sapiens; identical to SEQ ID NO: 626252

SEQ ID NO: 672335 - RNA, 64 nt, Homo Sapiens; identical to SEQ ID NO: 626253

SEQ ID NO: 672336 - RNA, 64 nt, Homo Sapiens; identical to SEQ ID NO: 626254

SEQ ID NO: 672337 - RNA, 64 nt, Homo Sapiens; identical to SEQ ID NO: 626255

SEQ ID NO: 672338 - RNA, 64 nt, Homo Sapiens; identical to SEQ ID NO: 626256

SEQ ID NO: 672339 - RNA, 64 nt, Homo Sapiens; identical to SEQ ID NO: 626257

SEQ ID NO: 672340 - RNA, 64 nt, Homo Sapiens; identical to SEQ ID NO: 626258

SEQ ID NO: 672341 - RNA, 64 nt, Homo Sapiens; identical to SEQ ID NO: 626259

SEQ ID NO: 672342 - RNA, 64 nt, Homo Sapiens; identical to SEQ ID NO: 626260

SEQ ID NO: 672343 - RNA, 64 nt, Homo Sapiens; identical to SEQ ID NO: 626261

SEQ ID NO: 672344 - RNA, 64 nt, Homo Sapiens; identical to SEQ ID NO: 626262

SEQ ID NO: 672345 - RNA, 64 nt, Homo Sapiens; identical to SEQ ID NO: 626263

SEQ ID NO: 672346 - RNA, 64 nt, Homo Sapiens; identical to SEQ ID NO: 626264

SEQ ID NO: 672347 - RNA, 64 nt, Homo Sapiens; identical to SEQ ID NO: 626265

SEQ ID NO: 672348 - RNA, 64 nt, Homo Sapiens; identical to SEQ ID NO: 626266

SEQ ID NO: 672349 - RNA, 64 nt, Homo Sapiens; identical to SEQ ID NO: 626267

SEQ ID NO: 672350 - RNA, 64 nt, Homo Sapiens; identical to SEQ ID NO: 626268

SEQ ID NO: 672351 - RNA, 64 nt, Homo Sapiens; identical to SEQ ID NO: 626269

SEQ ID NO: 672352 - RNA, 64 nt, Homo Sapiens; identical to SEQ ID NO: 626270

SEQ ID NO: 672353 - RNA, 64 nt, Homo Sapiens; identical to SEQ ID NO: 626271

SEQ ID NO: 672354 - RNA, 64 nt, Homo Sapiens; identical to SEQ ID NO: 626272

SEQ ID NO: 672355 - RNA, 64 nt, Homo Sapiens; identical to SEQ ID NO: 626273

SEQ ID NO: 672356 - RNA, 64 nt, Homo Sapiens; identical to SEQ ID NO: 626274

SEQ ID NO: 672357 - RNA, 64 nt, Homo Sapiens; identical to SEQ ID NO: 626275

SEQ ID NO: 672358 - RNA, 64 nt, Homo Sapiens; identical to SEQ ID NO: 626276

SEQ ID NO: 672359 - RNA, 64 nt, Homo Sapiens; identical to SEQ ID NO: 626277

SEQ ID NO: 672360 - RNA, 64 nt, Homo Sapiens; identical to SEQ ID NO: 626278

SEQ ID NO: 672361 - RNA, 64 nt, Homo Sapiens; identical to SEQ ID NO: 626279

SEQ ID NO: 672362 - RNA, 64 nt, Homo Sapiens; identical to SEQ ID NO: 626280

SEQ ID NO: 672363 - RNA, 64 nt, Homo Sapiens; identical to SEQ ID NO: 626281

SEQ ID NO: 672364 - RNA, 64 nt, Homo Sapiens; identical to SEQ ID NO: 626282

SEQ ID NO: 672365 - RNA, 64 nt, Homo Sapiens; identical to SEQ ID NO: 626283

SEQ ID NO: 672366 - RNA, 64 nt, Homo Sapiens; identical to SEQ ID NO: 626284

SEQ ID NO: 672367 - RNA, 65 nt, Homo Sapiens
uuagaaaucagaauaaguaaaaggaacguucacucacaggguacgcucauggagagagggcgcag

SEQ ID NO: 672368 - RNA, 65 nt, Homo Sapiens
gugcaauucgauccucaaucaguggguggaggauaacaggguagauucacuugugugcacuugua

SEQ ID NO: 672369 - RNA, 65 nt, Homo Sapiens
gcugucaagaggcaggggcuaguggccaggaccucacaggguaugucaaguccuucccauacuca

SEQ ID NO: 672370 - RNA, 65 nt, Homo Sapiens
ccuuccccucugccccagugugucaugcagaggugacaggguaucagacagagggcacaguccca

SEQ ID NO: 672371 - RNA, 64 nt, Homo Sapiens; identical to SEQ ID NO: 119840

SEQ ID NO: 672372 - RNA, 64 nt, Homo Sapiens; identical to SEQ ID NO: 119841

SEQ ID NO: 672373 - RNA, 64 nt, Homo Sapiens; identical to SEQ ID NO: 183604

SEQ ID NO: 672374 - RNA, 64 nt, Homo Sapiens; identical to SEQ ID NO: 183605

SEQ ID NO: 672375 - RNA, 64 nt, Homo Sapiens; identical to SEQ ID NO: 183606

SEQ ID NO: 672376 - RNA, 64 nt, Homo Sapiens; identical to SEQ ID NO: 183607

SEQ ID NO: 672377 - RNA, 64 nt, Homo Sapiens; identical to SEQ ID NO: 183608

SEQ ID NO: 672378 - RNA, 64 nt, Homo Sapiens; identical to SEQ ID NO: 183609

SEQ ID NO: 672379 - RNA, 64 nt, Homo Sapiens; identical to SEQ ID NO: 183610

SEQ ID NO: 672380 - RNA, 64 nt, Homo Sapiens; identical to SEQ ID NO: 183611

SEQ ID NO: 672381 - RNA, 64 nt, Homo Sapiens; identical to SEQ ID NO: 183610

SEQ ID NO: 672382 - RNA, 64 nt, Homo Sapiens; identical to SEQ ID NO: 183613

SEQ ID NO: 672383 - RNA, 64 nt, Homo Sapiens; identical to SEQ ID NO: 183614

SEQ ID NO: 672384 - RNA, 64 nt, Homo Sapiens; identical to SEQ ID NO: 183615

SEQ ID NO: 672385 - RNA, 64 nt, Homo Sapiens; identical to SEQ ID NO: 183616

SEQ ID NO: 672386 - RNA, 64 nt, Homo Sapiens; identical to SEQ ID NO: 183617

SEQ ID NO: 672387 - RNA, 64 nt, Homo Sapiens; identical to SEQ ID NO: 183610

SEQ ID NO: 672388 - RNA, 64 nt, Homo Sapiens; identical to SEQ ID NO: 183619

SEQ ID NO: 672389 - RNA, 64 nt, Homo Sapiens; identical to SEQ ID NO: 183620

SEQ ID NO: 672390 - RNA, 64 nt, Homo Sapiens; identical to SEQ ID NO: 183621

SEQ ID NO: 672391 - RNA, 64 nt, Homo Sapiens; identical to SEQ ID NO: 183622

SEQ ID NO: 672392 - RNA, 64 nt, Homo Sapiens; identical to SEQ ID NO: 183623

SEQ ID NO: 672393 - RNA, 64 nt, Homo Sapiens; identical to SEQ ID NO: 183624

SEQ ID NO: 672394 - RNA, 64 nt, Homo Sapiens; identical to SEQ ID NO: 178992

SEQ ID NO: 672395 - RNA, 64 nt, Homo Sapiens; identical to SEQ ID NO: 178993

SEQ ID NO: 672396 - RNA, 64 nt, Homo Sapiens; identical to SEQ ID NO: 178994

SEQ ID NO: 672397 - RNA, 64 nt, Homo Sapiens; identical to SEQ ID NO: 178995

SEQ ID NO: 672398 - RNA, 64 nt, Homo Sapiens; identical to SEQ ID NO: 178996

SEQ ID NO: 672399 - RNA, 64 nt, Homo Sapiens; identical to SEQ ID NO: 178997

SEQ ID NO: 672400 - RNA, 64 nt, Homo Sapiens; identical to SEQ ID NO: 178998

SEQ ID NO: 672401 - RNA, 64 nt, Homo Sapiens; identical to SEQ ID NO: 178999

SEQ ID NO: 672402 - RNA, 64 nt, Homo Sapiens; identical to SEQ ID NO: 179000

SEQ ID NO: 672403 - RNA, 64 nt, Homo Sapiens; identical to SEQ ID NO: 179001

SEQ ID NO: 672404 - RNA, 64 nt, Homo Sapiens; identical to SEQ ID NO: 179002

SEQ ID NO: 672405 - RNA, 64 nt, Homo Sapiens; identical to SEQ ID NO: 179003

SEQ ID NO: 672406 - RNA, 64 nt, Homo Sapiens; identical to SEQ ID NO: 179004

SEQ ID NO: 672407 - RNA, 64 nt, Homo Sapiens; identical to SEQ ID NO: 179005

SEQ ID NO: 672408 - RNA, 64 nt, Homo Sapiens; identical to SEQ ID NO: 179006

SEQ ID NO: 672409 - RNA, 64 nt, Homo Sapiens; identical to SEQ ID NO: 179007

SEQ ID NO: 672410 - RNA, 64 nt, Homo Sapiens; identical to SEQ ID NO: 179008

SEQ ID NO: 672411 - RNA, 64 nt, Homo Sapiens; identical to SEQ ID NO: 47605

SEQ ID NO: 672412 - RNA, 64 nt, Homo Sapiens; identical to SEQ ID NO: 47606

SEQ ID NO: 672413 - RNA, 64 nt, Homo Sapiens; identical to SEQ ID NO: 47607

SEQ ID NO: 672414 - RNA, 64 nt, Homo Sapiens; identical to SEQ ID NO: 47608

SEQ ID NO: 672415 - RNA, 64 nt, Homo Sapiens; identical to SEQ ID NO: 47609

SEQ ID NO: 672416 - RNA, 64 nt, Homo Sapiens; identical to SEQ ID NO: 47610

SEQ ID NO: 672417 - RNA, 64 nt, Homo Sapiens; identical to SEQ ID NO: 47611

SEQ ID NO: 672418 - RNA, 64 nt, Homo Sapiens; identical to SEQ ID NO: 47612

SEQ ID NO: 672419 - RNA, 64 nt, Homo Sapiens; identical to SEQ ID NO: 47613

SEQ ID NO: 672420 - RNA, 64 nt, Homo Sapiens; identical to SEQ ID NO: 47614

SEQ ID NO: 672421 - RNA, 64 nt, Homo Sapiens; identical to SEQ ID NO: 47615

SEQ ID NO: 672422 - RNA, 64 nt, Homo Sapiens; identical to SEQ ID NO: 47616

SEQ ID NO: 672423 - RNA, 64 nt, Homo Sapiens; identical to SEQ ID NO: 47617

SEQ ID NO: 672424 - RNA, 64 nt, Homo Sapiens; identical to SEQ ID NO: 47618

SEQ ID NO: 672425 - RNA, 64 nt, Homo Sapiens; identical to SEQ ID NO: 47619

SEQ ID NO: 672426 - RNA, 64 nt, Homo Sapiens; identical to SEQ ID NO: 47620

SEQ ID NO: 672427 - RNA, 64 nt, Homo Sapiens; identical to SEQ ID NO: 47621

SEQ ID NO: 672428 - RNA, 64 nt, Homo Sapiens; identical to SEQ ID NO: 47622

SEQ ID NO: 672429 - RNA, 64 nt, Homo Sapiens; identical to SEQ ID NO: 47623

SEQ ID NO: 672430 - RNA, 64 nt, Homo Sapiens; identical to SEQ ID NO: 47624

SEQ ID NO: 672431 - RNA, 64 nt, Homo Sapiens; identical to SEQ ID NO: 47625

SEQ ID NO: 672432 - RNA, 64 nt, Homo Sapiens; identical to SEQ ID NO: 47626

SEQ ID NO: 672433 - RNA, 64 nt, Homo Sapiens; identical to SEQ ID NO: 47627

SEQ ID NO: 672434 - RNA, 64 nt, Homo Sapiens; identical to SEQ ID NO: 47628

SEQ ID NO: 672435 - RNA, 64 nt, Homo Sapiens; identical to SEQ ID NO: 47629

SEQ ID NO: 672436 - RNA, 64 nt, Homo Sapiens; identical to SEQ ID NO: 47630

SEQ ID NO: 672437 - RNA, 64 nt, Homo Sapiens; identical to SEQ ID NO: 47631

SEQ ID NO: 672438 - RNA, 64 nt, Homo Sapiens; identical to SEQ ID NO: 47632

SEQ ID NO: 672439 - RNA, 64 nt, Homo Sapiens; identical to SEQ ID NO: 47633

SEQ ID NO: 672440 - RNA, 64 nt, Homo Sapiens; identical to SEQ ID NO: 47634

SEQ ID NO: 672441 - RNA, 64 nt, Homo Sapiens; identical to SEQ ID NO: 47635

SEQ ID NO: 672442 - RNA, 64 nt, Homo Sapiens; identical to SEQ ID NO: 47636

SEQ ID NO: 672443 - RNA, 64 nt, Homo Sapiens; identical to SEQ ID NO: 47637

SEQ ID NO: 672444 - RNA, 64 nt, Homo Sapiens; identical to SEQ ID NO: 47638

SEQ ID NO: 672445 - RNA, 64 nt, Homo Sapiens; identical to SEQ ID NO: 47639

SEQ ID NO: 672446 - RNA, 64 nt, Homo Sapiens; identical to SEQ ID NO: 47640

SEQ ID NO: 672447 - RNA, 64 nt, Homo Sapiens; identical to SEQ ID NO: 47641

SEQ ID NO: 672448 - RNA, 64 nt, Homo Sapiens; identical to SEQ ID NO: 47642

SEQ ID NO: 672449 - RNA, 64 nt, Homo Sapiens; identical to SEQ ID NO: 47643

SEQ ID NO: 672450 - RNA, 64 nt, Homo Sapiens; identical to SEQ ID NO: 47644

SEQ ID NO: 672451 - RNA, 64 nt, Homo Sapiens; identical to SEQ ID NO: 47645

SEQ ID NO: 672452 - RNA, 64 nt, Homo Sapiens; identical to SEQ ID NO: 47646

SEQ ID NO: 672453 - RNA, 64 nt, Homo Sapiens; identical to SEQ ID NO: 47647

SEQ ID NO: 672454 - RNA, 64 nt, Homo Sapiens; identical to SEQ ID NO: 47648

SEQ ID NO: 672455 - RNA, 64 nt, Homo Sapiens; identical to SEQ ID NO: 47649

SEQ ID NO: 672456 - RNA, 64 nt, Homo Sapiens; identical to SEQ ID NO: 47650

SEQ ID NO: 672457 - RNA, 64 nt, Homo Sapiens; identical to SEQ ID NO: 47651

SEQ ID NO: 672458 - RNA, 64 nt, Homo Sapiens; identical to SEQ ID NO: 47652

SEQ ID NO: 672459 - RNA, 64 nt, Homo Sapiens; identical to SEQ ID NO: 47653

SEQ ID NO: 672460 - RNA, 64 nt, Homo Sapiens; identical to SEQ ID NO: 47654

SEQ ID NO: 672461 - RNA, 64 nt, Homo Sapiens; identical to SEQ ID NO: 47655

SEQ ID NO: 672462 - RNA, 64 nt, Homo Sapiens; identical to SEQ ID NO: 47656

SEQ ID NO: 672463 - RNA, 64 nt, Homo Sapiens; identical to SEQ ID NO: 47657

SEQ ID NO: 672464 - RNA, 64 nt, Homo Sapiens; identical to SEQ ID NO: 47658

SEQ ID NO: 672465 - RNA, 64 nt, Homo Sapiens; identical to SEQ ID NO: 47659

SEQ ID NO: 672466 - RNA, 64 nt, Homo Sapiens; identical to SEQ ID NO: 47660

SEQ ID NO: 672467 - RNA, 64 nt, Homo Sapiens; identical to SEQ ID NO: 47659

SEQ ID NO: 672468 - RNA, 64 nt, Homo Sapiens; identical to SEQ ID NO: 47662

SEQ ID NO: 672469 - RNA, 64 nt, Homo Sapiens; identical to SEQ ID NO: 47663

SEQ ID NO: 672470 - RNA, 64 nt, Homo Sapiens; identical to SEQ ID NO: 47664

SEQ ID NO: 672471 - RNA, 64 nt, Homo Sapiens; identical to SEQ ID NO: 47665

SEQ ID NO: 672472 - RNA, 64 nt, Homo Sapiens; identical to SEQ ID NO: 47666

SEQ ID NO: 672473 - RNA, 64 nt, Homo Sapiens; identical to SEQ ID NO: 47667

SEQ ID NO: 672474 - RNA, 64 nt, Homo Sapiens; identical to SEQ ID NO: 47668

SEQ ID NO: 672475 - RNA, 64 nt, Homo Sapiens; identical to SEQ ID NO: 47669

SEQ ID NO: 672476 - RNA, 64 nt, Homo Sapiens; identical to SEQ ID NO: 47670

SEQ ID NO: 672477 - RNA, 64 nt, Homo Sapiens; identical to SEQ ID NO: 47671

SEQ ID NO: 672478 - RNA, 64 nt, Homo Sapiens; identical to SEQ ID NO: 47672

SEQ ID NO: 672479 - RNA, 64 nt, Homo Sapiens; identical to SEQ ID NO: 47673

SEQ ID NO: 672480 - RNA, 64 nt, Homo Sapiens; identical to SEQ ID NO: 47674

SEQ ID NO: 672481 - RNA, 64 nt, Homo Sapiens; identical to SEQ ID NO: 441022

SEQ ID NO: 672482 - RNA, 64 nt, Homo Sapiens; identical to SEQ ID NO: 441023

SEQ ID NO: 672483 - RNA, 64 nt, Homo Sapiens; identical to SEQ ID NO: 441024

SEQ ID NO: 672484 - RNA, 64 nt, Homo Sapiens; identical to SEQ ID NO: 441025

SEQ ID NO: 672485 - RNA, 64 nt, Homo Sapiens; identical to SEQ ID NO: 441026

SEQ ID NO: 672486 - RNA, 64 nt, Homo Sapiens; identical to SEQ ID NO: 441027

SEQ ID NO: 672487 - RNA, 64 nt, Homo Sapiens; identical to SEQ ID NO: 441028

SEQ ID NO: 672488 - RNA, 64 nt, Homo Sapiens; identical to SEQ ID NO: 441029

SEQ ID NO: 672489 - RNA, 64 nt, Homo Sapiens; identical to SEQ ID NO: 441030

SEQ ID NO: 672490 - RNA, 64 nt, Homo Sapiens; identical to SEQ ID NO: 441031

SEQ ID NO: 672491 - RNA, 64 nt, Homo Sapiens; identical to SEQ ID NO: 441032

SEQ ID NO: 672492 - RNA, 64 nt, Homo Sapiens; identical to SEQ ID NO: 441033

SEQ ID NO: 672493 - RNA, 64 nt, Homo Sapiens; identical to SEQ ID NO: 441034

SEQ ID NO: 672494 - RNA, 64 nt, Homo Sapiens; identical to SEQ ID NO: 441035

SEQ ID NO: 672495 - RNA, 64 nt, Homo Sapiens; identical to SEQ ID NO: 441036

SEQ ID NO: 672496 - RNA, 64 nt, Homo Sapiens; identical to SEQ ID NO: 441037

SEQ ID NO: 672497 - RNA, 64 nt, Homo Sapiens; identical to SEQ ID NO: 441038

SEQ ID NO: 672498 - RNA, 64 nt, Homo Sapiens; identical to SEQ ID NO: 441039

SEQ ID NO: 672499 - RNA, 64 nt, Homo Sapiens; identical to SEQ ID NO: 441040

SEQ ID NO: 672500 - RNA, 64 nt, Homo Sapiens; identical to SEQ ID NO: 441041

SEQ ID NO: 672501 - RNA, 64 nt, Homo Sapiens; identical to SEQ ID NO: 441042

SEQ ID NO: 672502 - RNA, 64 nt, Homo Sapiens
uuaagaugaaacauuccgguuuucucacaacacauuagcacauacuguccauuagcauaucugg

SEQ ID NO: 672503 - RNA, 64 nt, Homo Sapiens
auuuguauuauccaaaugugcuuauuucuuugccuuagcacacguuuuauggaguacuuguuau

SEQ ID NO: 672504 - RNA, 64 nt, Homo Sapiens
gcauaguaguuuuaaguaugcaguacuuugaauuuuagcacauugccucacaacauggcaagua

SEQ ID NO: 672505 - RNA, 64 nt, Homo Sapiens
guuaugugucugccacauuagccaugagaauguuuuagcacagcugugaauccagugaaaauaa

SEQ ID NO: 672506 - RNA, 64 nt, Homo Sapiens
ugcucgucccauuuagcuuacaugcggccaccccuuagcacacccccauugucagcaccccagc

SEQ ID NO: 672507 - RNA, 64 nt, Homo Sapiens
uagagggcagggaccauaggcccagagaugccccuuagcacaccuucuugcuugacucaaucua

SEQ ID NO: 672508 - RNA, 64 nt, Homo Sapiens
aacaccaacgauggccucuuaaaauacacaacuuuuagcacauauuuuaugguucucagaagcc

SEQ ID NO: 672509 - RNA, 64 nt, Homo Sapiens
gauauaagaggcacuuuauuauuugaauuauuacuuagcacauguauuuguguuuauuuuuaau

SEQ ID NO: 672510 - RNA, 64 nt, Homo Sapiens; identical to SEQ ID NO: 297969

SEQ ID NO: 672511 - RNA, 64 nt, Homo Sapiens; identical to SEQ ID NO: 297970

SEQ ID NO: 672512 - RNA, 64 nt, Homo Sapiens; identical to SEQ ID NO: 297971

SEQ ID NO: 672513 - RNA, 64 nt, Homo Sapiens; identical to SEQ ID NO: 297972

SEQ ID NO: 672514 - RNA, 64 nt, Homo Sapiens; identical to SEQ ID NO: 297973

SEQ ID NO: 672515 - RNA, 64 nt, Homo Sapiens; identical to SEQ ID NO: 297974

SEQ ID NO: 672516 - RNA, 64 nt, Homo Sapiens; identical to SEQ ID NO: 297975

SEQ ID NO: 672517 - RNA, 64 nt, Homo Sapiens; identical to SEQ ID NO: 297976

SEQ ID NO: 672518 - RNA, 64 nt, Homo Sapiens; identical to SEQ ID NO: 297977

SEQ ID NO: 672519 - RNA, 64 nt, Homo Sapiens; identical to SEQ ID NO: 297978

SEQ ID NO: 672520 - RNA, 64 nt, Homo Sapiens; identical to SEQ ID NO: 297979

SEQ ID NO: 672521 - RNA, 64 nt, Homo Sapiens; identical to SEQ ID NO: 297980

SEQ ID NO: 672522 - RNA, 64 nt, Homo Sapiens; identical to SEQ ID NO: 297981

SEQ ID NO: 672523 - RNA, 64 nt, Homo Sapiens; identical to SEQ ID NO: 297982

SEQ ID NO: 672524 - RNA, 64 nt, Homo Sapiens; identical to SEQ ID NO: 297983

SEQ ID NO: 672525 - RNA, 64 nt, Homo Sapiens; identical to SEQ ID NO: 297984

SEQ ID NO: 672526 - RNA, 64 nt, Homo Sapiens; identical to SEQ ID NO: 297985

SEQ ID NO: 672527 - RNA, 64 nt, Homo Sapiens; identical to SEQ ID NO: 297986

SEQ ID NO: 672528 - RNA, 64 nt, Homo Sapiens; identical to SEQ ID NO: 297987

SEQ ID NO: 672529 - RNA, 64 nt, Homo Sapiens; identical to SEQ ID NO: 297988

SEQ ID NO: 672530 - RNA, 64 nt, Homo Sapiens; identical to SEQ ID NO: 297989

SEQ ID NO: 672531 - RNA, 64 nt, Homo Sapiens; identical to SEQ ID NO: 297990

SEQ ID NO: 672532 - RNA, 64 nt, Homo Sapiens; identical to SEQ ID NO: 297991

SEQ ID NO: 672533 - RNA, 64 nt, Homo Sapiens; identical to SEQ ID NO: 297992

SEQ ID NO: 672534 - RNA, 64 nt, Homo Sapiens; identical to SEQ ID NO: 297993

SEQ ID NO: 672535 - RNA, 64 nt, Homo Sapiens
agcauugggaggccuuagccaagaccacagcuagauggacaaacaauuggugucaguacuuagg

SEQ ID NO: 672536 - RNA, 64 nt, Homo Sapiens
gguuuuuuacuuugacgguggcuuugcccuugacauggacaauaauuugaggaacagcacauca

SEQ ID NO: 672537 - RNA, 64 nt, Homo Sapiens
gugggguaccuacaggagagcaugcaucuucuguauggacaaaggcauacguaugagauaggca

SEQ ID NO: 672538 - RNA, 64 nt, Homo Sapiens
uccaagaaugaugccuuucaggggcaauaguagaauggacaauuuuguuauuuuuaaucaauua

SEQ ID NO: 672539 - RNA, 64 nt, Homo Sapiens
guuccgauggugcccguggucaaaagcgaaaaacauggacaauuccuauucauucuuagcacuu

SEQ ID NO: 672540 - RNA, 64 nt, Homo Sapiens
gugucaagcccucguuagcugaugagguaaaugcauggacaacuuccuaggacuucucggcucu

SEQ ID NO: 672541 - RNA, 64 nt, Homo Sapiens
cuuauggauacgaaggguacuuguaauuuuuuuaauggacaaguaacaaaauaaaagcucggca

SEQ ID NO: 672542 - RNA, 64 nt, Homo Sapiens
auuauccagaagggguacuuaggccuuaaaggaaauggacaaaacuaauaggcuaauauugcug

SEQ ID NO: 672543 - RNA, 64 nt, Homo Sapiens
aaaagugggcuaacaccaauucacucagcagcagauggacaaaaugcacagugucuagaacugc

SEQ ID NO: 672544 - RNA, 64 nt, Homo Sapiens
caaagauacauauuauuuaaagaguaugaucucuauggacaagagcuaaaauugacauaacuua

SEQ ID NO: 672545 - RNA, 64 nt, Homo Sapiens
gugccuugacguggagggugcacuugauuggaaaauggacaaaaagagauauuagaaacugacu

SEQ ID NO: 672546 - RNA, 64 nt, Homo Sapiens
acuuuuugggauagguugaaugcccugcccugaaauggacaaucucacccucuuucauaucccu

SEQ ID NO: 672547 - RNA, 64 nt, Homo Sapiens
acuggacuggaagaacaagucuauaaaaauaaaaauggacaauuaacaguggugaguggccguc

SEQ ID NO: 672548 - RNA, 64 nt, Homo Sapiens
aauaaaaauguauauaaagcauaugagcacacaaauggacaauaaaugccacagcgcaaaagcg

SEQ ID NO: 672549 - RNA, 64 nt, Homo Sapiens
auucucaaauaugaaaugggaccuaauaccaguaugugauaaauguugauguuuucuguguaca

SEQ ID NO: 672550 - RNA, 64 nt, Homo Sapiens
cuuaguaugugugguaucaggauauuuuuuaaacugugauaauacaacagauagcuuugaauga

SEQ ID NO: 672551 - RNA, 64 nt, Homo Sapiens
agugcaacucuuuuccuucagcugcaugugauuuugugauaaaguucagguaacaggaugggca

SEQ ID NO: 672552 - RNA, 64 nt, Homo Sapiens
ugcuggcaacuacuguuuaauggucaguuaaaucugugauaaugguuggaagugggugggguua

SEQ ID NO: 672553 - RNA, 64 nt, Homo Sapiens
uugaugaugaaagguggaagcaaaauaaauuuugugugauaauuuuuuugcauugugaaaaaaa

SEQ ID NO: 672554 - RNA, 64 nt, Homo Sapiens
cauaauuauuuuaauggcagguuuuuacagaguuugugauaacuuuuuaugcaugcaaaucauu

SEQ ID NO: 672555 - RNA, 64 nt, Homo Sapiens
uuuuaacuagguaucuuauggugagauggugggaugugauaaccaagauguaaguauuacauuu

SEQ ID NO: 672556 - RNA, 64 nt, Homo Sapiens
gaaacuaauucagcaggcugaaggaaaugguucaugugauaaugugggcugguauccucuagag

SEQ ID NO: 672557 - RNA, 64 nt, Homo Sapiens
caacuuguuauaaaauuuauuauuuuuagagauuugugauaauagaguuuaaaaacugcguugu

SEQ ID NO: 672558 - RNA, 64 nt, Homo Sapiens
cacaugcauuuaugugcgugcaugcauauaugugugugauaauauaauugcauacacaugccuc

SEQ ID NO: 672559 - RNA, 64 nt, Homo Sapiens
cuguuaaaaguugguaucaguaagauuuguguuuugugauaaucccuaaaucaacauaccacuu

SEQ ID NO: 672560 - RNA, 64 nt, Homo Sapiens
cugccauacggagguucggaaccuggagaacggcugugauaaguagguuuugauugagugaaag

SEQ ID NO: 672561 - RNA, 64 nt, Homo Sapiens
uucuaagaauaugagaauauaaagccaauaaaccugugauaaguuaugacaugugauaagaugg

SEQ ID NO: 672562 - RNA, 64 nt, Homo Sapiens
uggaaagccaauaaaccuguuucgagauaugacaugugauaagauuuuguuucuauuuaauguu

SEQ ID NO: 672563 - RNA, 64 nt, Homo Sapiens
ugauacauaagagauguauauguuuugggguauaugugauaauuugauacauucagauagugug

SEQ ID NO: 672564 - RNA, 64 nt, Homo Sapiens
acuaugugaaaaauuauauuugugcauaauaaaaugugauaacuuuuuacaacagaaugugauu

SEQ ID NO: 672565 - RNA, 64 nt, Homo Sapiens
uuuccuuuuugcacacauuacaggugguguguucugugauaaugaaaagcaucagaaaagcuuu

SEQ ID NO: 672566 - RNA, 64 nt, Homo Sapiens
aagcaguuccucauucacaucaacagagcgaggcugugauaacuuaggaggcagcaauccuaau

SEQ ID NO: 672567 - RNA, 64 nt, Homo Sapiens
aagcauccaccccaaauguugguuguauuuaugcugugauaaaaauaggugagagaucauauga

SEQ ID NO: 672568 - RNA, 64 nt, Homo Sapiens
augugaaugguacauacaaaaccuggcauuuucuugugauaaguuuacauuuuuaggagagugg

SEQ ID NO: 672569 - RNA, 64 nt, Homo Sapiens
aaaaaagaaaguauccucuuuggugguuaagguuugugauaaagaguuuuaacacacucgcaac

SEQ ID NO: 672570 - RNA, 64 nt, Homo Sapiens
cuauguuuguuaugagauucaaauaaaaaaauuuugugauaaaacaacaaguaaaucauauaac

SEQ ID NO: 672571 - RNA, 64 nt, Homo Sapiens
aacaugguaagccuuagcagcaucuuuucagccgugugauaauuauacagucugauuuagaagu

SEQ ID NO: 672572 - RNA, 64 nt, Homo Sapiens
gauaguacucaaaaaccugaagcuugaugagauuugugauaaguaaugcauuauuuuuuuaaag

SEQ ID NO: 672573 - RNA, 64 nt, Homo Sapiens
uugucagcuauaaauaauaaauuguguuuucuauguaaaugauucuaguuuaccuguugauucu

SEQ ID NO: 672574 - RNA, 64 nt, Homo Sapiens
ucuuauguuuuauuacauuuuauuucuaguugcuguaaaugauauauucuguuagauuaauucc

SEQ ID NO: 672575 - RNA, 64 nt, Homo Sapiens
ucuaaguggcaacauuuuuauucuucagagucagguaaaugacuauaauaguuugguuucuaau

SEQ ID NO: 672576 - RNA, 64 nt, Homo Sapiens
gucaccuuuccaguuacaggaucauauuaacuguguaaaugaauucauggguagaugauuugug

SEQ ID NO: 672577 - RNA, 64 nt, Homo Sapiens
uuguguuuaagacuaaauuuuaaguauggucgcaguaaaugaaauaaaaauauuuuaugcaugu

SEQ ID NO: 672578 - RNA, 64 nt, Homo Sapiens
uuauugauacucuuucuaaauuuagaaauuauauguaaaugauaacaauuaagucuauucuucu

SEQ ID NO: 672579 - RNA, 64 nt, Homo Sapiens
aauagagcucaugaaauacuguaacuuggggauuguaaaugaauggauacaauagguuaaggcc

SEQ ID NO: 672580 - RNA, 64 nt, Homo Sapiens
uacugugccuuaacguguuucuuaaacuuuuguaguaaaugaacauuugaaauccauuuugaua

SEQ ID NO: 672581 - RNA, 64 nt, Homo Sapiens
uugaaaaggaauuuugaaaucuccaucaacugaaguaaaugaugucugaguguuacaguaaagg

SEQ ID NO: 672582 - RNA, 64 nt, Homo Sapiens
ucuaccucuguaucuaaauguauaccauccacuuguaaaugacuauaaacuauuaugugauugc

SEQ ID NO: 672583 - RNA, 64 nt, Homo Sapiens
uacauuaccauugccacugauuuuuuuuuaaaugguaaaugaccuuguauauaaauauugccau

SEQ ID NO: 672584 - RNA, 64 nt, Homo Sapiens
acaggacaauaaauacuucaaauacuuuuaggaaguaaaugaguaggaguuuaggagggauaaa

SEQ ID NO: 672585 - RNA, 64 nt, Homo Sapiens
ugaguuugcuacugcugugggggcauguggguggguaaaugauguaaaugaugugaucuguaca

SEQ ID NO: 672586 - RNA, 64 nt, Homo Sapiens
uacugcugugggggcauguggguggguaaaugauguaaaugaugugaucuguacaaguaugugg

SEQ ID NO: 672587 - RNA, 64 nt, Homo Sapiens
aagccaccaaauguaucuuuauguauaaauccuuguaaaugauagauuccaugggugagacuuu

SEQ ID NO: 672588 - RNA, 64 nt, Homo Sapiens
agccuagcauuuauaacagaauuguugaacgucuguaaaugauuuuuuuuuuuuuugcaaagga

SEQ ID NO: 672589 - RNA, 64 nt, Homo Sapiens
cuauggucagguuauacuccuaaauguaccugauguaccugaugucucuauuagacuuuagaaa

SEQ ID NO: 672590 - RNA, 64 nt, Homo Sapiens
uaccugaugcuauggucaggcuuuagaaauaaauguaccugaugaaaaacuguucucuauuaga

SEQ ID NO: 672591 - RNA, 64 nt, Homo Sapiens
ggggcacacagcugggggugcagagcccaccuggguaccugacccccaggggaugaaaaugcaa

SEQ ID NO: 672592 - RNA, 64 nt, Homo Sapiens
uuuucucucuugggagcaauggucacagucccugguaccugaaaagguaccuaggucuaggccc

SEQ ID NO: 672593 - RNA, 64 nt, Homo Sapiens
gguguaaagccaacucgaggggaaucugaauaagcuuccaaaauuuuuuuuuuuaagaaauaaa

SEQ ID NO: 672594 - RNA, 64 nt, Homo Sapiens
uaggccacuacuuuauacuuucucucuucuguaacuuccaaagcaucccucucaguucucaugc

SEQ ID NO: 672595 - RNA, 64 nt, Homo Sapiens
cuuuuauuugcaacauuuacaguccuucaaaauccuuccaaagaauucuuauacacauuggggc

SEQ ID NO: 672596 - RNA, 64 nt, Homo Sapiens
cauuacuugauuaagauuuuacaaaagaggagcacuuccaaaauucuuauuuuuccuaacaaaa

SEQ ID NO: 672597 - RNA, 64 nt, Homo Sapiens
acuugagccuuuaauggacuuauuucuucaaauccuuccaaaaauuauuauaagcauugaaauu

SEQ ID NO: 672598 - RNA, 64 nt, Homo Sapiens
uuguuuuuacuguagaagacuugguaucauguugcuuccaaauuuuaugagcuugcuguauuuc

SEQ ID NO: 672599 - RNA, 64 nt, Homo Sapiens
aagcuagauucuugguuuuaauuuuagacugcuacuuccaaacuaugaucagguaccugcuuuc

SEQ ID NO: 672600 - RNA, 64 nt, Homo Sapiens
agguaagaagucuguggccaaagccuagaggauccuuccaaacccugacuguuaucccgguucc

SEQ ID NO: 672601 - RNA, 64 nt, Homo Sapiens
agguaagaagucuguggccaaagacgagaggauacuuccaaacacugacuauuaucccgguucc

SEQ ID NO: 672602 - RNA, 64 nt, Homo Sapiens
ggcaagaagaggacaguggaccagcuccugggaccuuccaaaacauuggcuuugacaucugcca

SEQ ID NO: 672603 - RNA, 64 nt, Homo Sapiens
cauacaaguaucuaucuggacuucccugcuagcacuuccaaacaagcucagagauguuccuccc

SEQ ID NO: 672604 - RNA, 64 nt, Homo Sapiens
gcaagcagcuggucagucuuugcucaguguccagcuuccaaagccuagacaaccuuucuguagc

SEQ ID NO: 672605 - RNA, 64 nt, Homo Sapiens
auugcuuagaacguuaaacuauuagaguauuucccuuccaaagagggauguuuggaaaaaacuc

SEQ ID NO: 672606 - RNA, 64 nt, Homo Sapiens
ugagccuuaggauccaaugaguggagaauggggacuuccaaaacccaagguuggcuauaaucuc

SEQ ID NO: 672607 - RNA, 64 nt, Homo Sapiens
uucaccauuccucaaaccuguaaguuucucacuucuuccaaauuggcuuuggcucuuucugcaa

SEQ ID NO: 672608 - RNA, 64 nt, Homo Sapiens
caucugccacaggccauauuuguggcccgugcagcuuccaaaucucauacacaacuguucccga

SEQ ID NO: 672609 - RNA, 64 nt, Homo Sapiens
aaguccuucucuuuagggcucuuacaaucuaucacuuccaaaaaguaaauggugacugauaaaa

SEQ ID NO: 672610 - RNA, 64 nt, Homo Sapiens
uggggcuugggggucaacuccccccaggacuuaccuuccaaaacaaacuuucuucacuuuguau

SEQ ID NO: 672611 - RNA, 64 nt, Homo Sapiens
guuuccccuaaucguggggguuggaccccagagucuuccaaagaauuuucacugguugccugca

SEQ ID NO: 672612 - RNA, 64 nt, Homo Sapiens
uacgacccgucagagccgacggaggaggaggagccuuccaaacagagaggugaguggggagcug

SEQ ID NO: 672613 - RNA, 64 nt, Homo Sapiens
gaucucauggccaaagucagagcgaugcuugcagcuuccaaaaaccugcaaaccagcgcuuccu

SEQ ID NO: 672614 - RNA, 64 nt, Homo Sapiens
cugccauuuaaaaaguuguagcagauuguuuccucuuccaaaguaaaauugcugugcuuuaugg

SEQ ID NO: 672615 - RNA, 64 nt, Homo Sapiens
acaugaacacccuuagaaaauguguccuaucuaucuuccaaaugcaauuugauugacugcccau

SEQ ID NO: 672616 - RNA, 64 nt, Homo Sapiens
uuuauuacauugacuucucccaagaugaaucuuccuuccaaauguguuuucuccacacaagccu

SEQ ID NO: 672617 - RNA, 64 nt, Homo Sapiens
gcaucugguucugaaaaaguauagcauguagcagcuuccaaacauauucauauugcuuaagagg

SEQ ID NO: 672618 - RNA, 64 nt, Homo Sapiens
uacagcccuggcagcccauggcaacucaaagugccuuccaaaccaaacugccccucaugagguu

SEQ ID NO: 672619 - RNA, 64 nt, Homo Sapiens
aaagacagaaacugauguuccaugcaugucccugcuuccaaagccugaccuuccaaagcuugcu

SEQ ID NO: 672620 - RNA, 64 nt, Homo Sapiens
uguuccaugcaugucccugcuuccaaagccugaccuuccaaagcuugcuuccuuccuccuggcu

SEQ ID NO: 672621 - RNA, 64 nt, Homo Sapiens
ucccagagaugaagcucccuucccagaagugcagcuuccaaaagggccgugcccgaugugcacc

SEQ ID NO: 672622 - RNA, 64 nt, Homo Sapiens
ugccugagaugaaacuuccuucccugagaugaagcuuccaaagggaaagugccagagaugaaag

SEQ ID NO: 672623 - RNA, 64 nt, Homo Sapiens
ugcccgaggcagcccuuccacuccugaggucaagcuuccaaaagugaagugaagcuccccaagg

SEQ ID NO: 672624 - RNA, 64 nt, Homo Sapiens
agggauuuuuuuuuugguugaccacucccccacacuuccaaaauuaaacaguguuuucuuagca

SEQ ID NO: 672625 - RNA, 64 nt, Homo Sapiens
uucauuaggucaguuaagggaaauauuuguaccacuuccaaacuuuucagcguuggauaaaaug

SEQ ID NO: 672626 - RNA, 64 nt, Homo Sapiens
cuguguguuuccaacaucaugguagcagcacacacuuccaaagcucagccagggacacuuaaua

SEQ ID NO: 672627 - RNA, 64 nt, Homo Sapiens
aaaagaaaacuguuuuuagaaauacauaaaaucacuuccaaauccuguugcuuauguuggguua

SEQ ID NO: 672628 - RNA, 64 nt, Homo Sapiens; identical to SEQ ID NO: 181919

SEQ ID NO: 672629 - RNA, 64 nt, Homo Sapiens; identical to SEQ ID NO: 181920

SEQ ID NO: 672630 - RNA, 64 nt, Homo Sapiens; identical to SEQ ID NO: 181921

SEQ ID NO: 672631 - RNA, 64 nt, Homo Sapiens; identical to SEQ ID NO: 181922

SEQ ID NO: 672632 - RNA, 64 nt, Homo Sapiens; identical to SEQ ID NO: 181923

SEQ ID NO: 672633 - RNA, 64 nt, Homo Sapiens; identical to SEQ ID NO: 181924

SEQ ID NO: 672634 - RNA, 64 nt, Homo Sapiens; identical to SEQ ID NO: 181925

SEQ ID NO: 672635 - RNA, 64 nt, Homo Sapiens; identical to SEQ ID NO: 181926

SEQ ID NO: 672636 - RNA, 64 nt, Homo Sapiens; identical to SEQ ID NO: 181927

SEQ ID NO: 672637 - RNA, 64 nt, Homo Sapiens; identical to SEQ ID NO: 181928

SEQ ID NO: 672638 - RNA, 64 nt, Homo Sapiens; identical to SEQ ID NO: 181929

SEQ ID NO: 672639 - RNA, 64 nt, Homo Sapiens; identical to SEQ ID NO: 181930

SEQ ID NO: 672640 - RNA, 64 nt, Homo Sapiens; identical to SEQ ID NO: 181931

SEQ ID NO: 672641 - RNA, 64 nt, Homo Sapiens; identical to SEQ ID NO: 181932

SEQ ID NO: 672642 - RNA, 64 nt, Homo Sapiens; identical to SEQ ID NO: 181933

SEQ ID NO: 672643 - RNA, 64 nt, Homo Sapiens; identical to SEQ ID NO: 181934

SEQ ID NO: 672644 - RNA, 64 nt, Homo Sapiens; identical to SEQ ID NO: 181935

SEQ ID NO: 672645 - RNA, 64 nt, Homo Sapiens; identical to SEQ ID NO: 181936

SEQ ID NO: 672646 - RNA, 64 nt, Homo Sapiens; identical to SEQ ID NO: 181937

SEQ ID NO: 672647 - RNA, 64 nt, Homo Sapiens; identical to SEQ ID NO: 181938

SEQ ID NO: 672648 - RNA, 64 nt, Homo Sapiens; identical to SEQ ID NO: 181939

SEQ ID NO: 672649 - RNA, 64 nt, Homo Sapiens; identical to SEQ ID NO: 181940

SEQ ID NO: 672650 - RNA, 64 nt, Homo Sapiens; identical to SEQ ID NO: 181941

SEQ ID NO: 672651 - RNA, 64 nt, Homo Sapiens; identical to SEQ ID NO: 181942

SEQ ID NO: 672652 - RNA, 64 nt, Homo Sapiens; identical to SEQ ID NO: 181943

SEQ ID NO: 672653 - RNA, 64 nt, Homo Sapiens; identical to SEQ ID NO: 181944

SEQ ID NO: 672654 - RNA, 64 nt, Homo Sapiens; identical to SEQ ID NO: 181945

SEQ ID NO: 672655 - RNA, 64 nt, Homo Sapiens; identical to SEQ ID NO: 181946

SEQ ID NO: 672656 - RNA, 64 nt, Homo Sapiens; identical to SEQ ID NO: 181947

SEQ ID NO: 672657 - RNA, 64 nt, Homo Sapiens; identical to SEQ ID NO: 181948

SEQ ID NO: 672658 - RNA, 64 nt, Homo Sapiens; identical to SEQ ID NO: 181949

SEQ ID NO: 672659 - RNA, 64 nt, Homo Sapiens; identical to SEQ ID NO: 181950

SEQ ID NO: 672660 - RNA, 64 nt, Homo Sapiens; identical to SEQ ID NO: 181951

SEQ ID NO: 672661 - RNA, 64 nt, Homo Sapiens; identical to SEQ ID NO: 181952

SEQ ID NO: 672662 - RNA, 64 nt, Homo Sapiens; identical to SEQ ID NO: 98538

SEQ ID NO: 672663 - RNA, 64 nt, Homo Sapiens; identical to SEQ ID NO: 98539

SEQ ID NO: 672664 - RNA, 64 nt, Homo Sapiens; identical to SEQ ID NO: 98540

SEQ ID NO: 672665 - RNA, 64 nt, Homo Sapiens; identical to SEQ ID NO: 98541

SEQ ID NO: 672666 - RNA, 64 nt, Homo Sapiens; identical to SEQ ID NO: 98542

SEQ ID NO: 672667 - RNA, 64 nt, Homo Sapiens; identical to SEQ ID NO: 98543

SEQ ID NO: 672668 - RNA, 64 nt, Homo Sapiens; identical to SEQ ID NO: 98544

SEQ ID NO: 672669 - RNA, 64 nt, Homo Sapiens; identical to SEQ ID NO: 98545

SEQ ID NO: 672670 - RNA, 64 nt, Homo Sapiens; identical to SEQ ID NO: 98546

SEQ ID NO: 672671 - RNA, 64 nt, Homo Sapiens; identical to SEQ ID NO: 98547

SEQ ID NO: 672672 - RNA, 64 nt, Homo Sapiens; identical to SEQ ID NO: 98548

SEQ ID NO: 672673 - RNA, 64 nt, Homo Sapiens; identical to SEQ ID NO: 98549

SEQ ID NO: 672674 - RNA, 64 nt, Homo Sapiens; identical to SEQ ID NO: 98550

SEQ ID NO: 672675 - RNA, 64 nt, Homo Sapiens; identical to SEQ ID NO: 98551

SEQ ID NO: 672676 - RNA, 64 nt, Homo Sapiens; identical to SEQ ID NO: 98552

SEQ ID NO: 672677 - RNA, 64 nt, Homo Sapiens; identical to SEQ ID NO: 98553

SEQ ID NO: 672678 - RNA, 64 nt, Homo Sapiens; identical to SEQ ID NO: 98554

SEQ ID NO: 672679 - RNA, 64 nt, Homo Sapiens; identical to SEQ ID NO: 98555

SEQ ID NO: 672680 - RNA, 64 nt, Homo Sapiens; identical to SEQ ID NO: 98556

SEQ ID NO: 672681 - RNA, 64 nt, Homo Sapiens; identical to SEQ ID NO: 98557

SEQ ID NO: 672682 - RNA, 64 nt, Homo Sapiens; identical to SEQ ID NO: 98558

SEQ ID NO: 672683 - RNA, 64 nt, Homo Sapiens; identical to SEQ ID NO: 98559

SEQ ID NO: 672684 - RNA, 64 nt, Homo Sapiens; identical to SEQ ID NO: 98560

SEQ ID NO: 672685 - RNA, 64 nt, Homo Sapiens; identical to SEQ ID NO: 98561

SEQ ID NO: 672686 - RNA, 64 nt, Homo Sapiens; identical to SEQ ID NO: 98562

SEQ ID NO: 672687 - RNA, 64 nt, Homo Sapiens; identical to SEQ ID NO: 98563

SEQ ID NO: 672688 - RNA, 64 nt, Homo Sapiens; identical to SEQ ID NO: 98564

SEQ ID NO: 672689 - RNA, 64 nt, Homo Sapiens; identical to SEQ ID NO: 98565

SEQ ID NO: 672690 - RNA, 64 nt, Homo Sapiens; identical to SEQ ID NO: 98566

SEQ ID NO: 672691 - RNA, 64 nt, Homo Sapiens; identical to SEQ ID NO: 98567

SEQ ID NO: 672692 - RNA, 64 nt, Homo Sapiens; identical to SEQ ID NO: 98568

SEQ ID NO: 672693 - RNA, 64 nt, Homo Sapiens; identical to SEQ ID NO: 98569

SEQ ID NO: 672694 - RNA, 64 nt, Homo Sapiens; identical to SEQ ID NO: 98570

SEQ ID NO: 672695 - RNA, 64 nt, Homo Sapiens; identical to SEQ ID NO: 225837

SEQ ID NO: 672696 - RNA, 64 nt, Homo Sapiens; identical to SEQ ID NO: 225838

SEQ ID NO: 672697 - RNA, 64 nt, Homo Sapiens; identical to SEQ ID NO: 225839

SEQ ID NO: 672698 - RNA, 64 nt, Homo Sapiens; identical to SEQ ID NO: 225840

SEQ ID NO: 672699 - RNA, 64 nt, Homo Sapiens; identical to SEQ ID NO: 225841

SEQ ID NO: 672700 - RNA, 64 nt, Homo Sapiens; identical to SEQ ID NO: 225842

SEQ ID NO: 672701 - RNA, 64 nt, Homo Sapiens; identical to SEQ ID NO: 225843

SEQ ID NO: 672702 - RNA, 64 nt, Homo Sapiens; identical to SEQ ID NO: 225844

SEQ ID NO: 672703 - RNA, 64 nt, Homo Sapiens; identical to SEQ ID NO: 225845

SEQ ID NO: 672704 - RNA, 64 nt, Homo Sapiens; identical to SEQ ID NO: 225846

SEQ ID NO: 672705 - RNA, 59 nt, Homo Sapiens
cuccauuccugaccaauaaccacccauaacuacggcauucucugugacuuccuuaaaca

SEQ ID NO: 672706 - RNA, 59 nt, Homo Sapiens
cucuccccaaccuccuuacaggacucugccuacggcaccgacggccgcuccugcuccau

SEQ ID NO: 672707 - RNA, 59 nt, Homo Sapiens
agggaaccaauuccuuuccccagggcuggcuacggcaaggggagaggcauguucuuggg

SEQ ID NO: 672708 - RNA, 59 nt, Homo Sapiens
guguguguuuugacacugagaggagagagcuacggcaggcccacaaucccaccuagccc

SEQ ID NO: 672709 - RNA, 59 nt, Homo Sapiens
ucuugcaccauuaaauaguguguuaagugcuacggcagcaaauugcuacaugugcugga

SEQ ID NO: 672710 - RNA, 59 nt, Homo Sapiens
agcuguucauggcacugaagcuugccuuccuacggcagccaucuugguucugccauccu

SEQ ID NO: 672711 - RNA, 59 nt, Homo Sapiens
ucuuuucuaaacugcauuccugugcccaccuacggcaugccucuauguauuggcuacua

SEQ ID NO: 672712 - RNA, 59 nt, Homo Sapiens
uacgucagccagaacuaacccuggaugggcuacggcagcugaaguggacgccucacuua

SEQ ID NO: 672713 - RNA, 59 nt, Homo Sapiens
ccccuggccuaggguggggacccccaaaccuacggcaaagccagcaacaguagcagccu

SEQ ID NO: 672714 - RNA, 59 nt, Homo Sapiens
aagaaagaacggagugaagccauuuaugccuacggcagcagaaagagaugaaaucuuga

SEQ ID NO: 672715 - RNA, 59 nt, Homo Sapiens
cuuugaacucaucuuugguggcuagacugcuacggcagcuucucugaugggaaaguucc

SEQ ID NO: 672716 - RNA, 59 nt, Homo Sapiens
ucuccauacuggacaaacuacaaaccugccuacggcaaccagcccaagucucaagccuc

SEQ ID NO: 672717 - RNA, 59 nt, Homo Sapiens
ucuuaugaucauuggcugccuccucgugucuacggcaucgcccggcaaaagcuagacuc

SEQ ID NO: 672718 - RNA, 59 nt, Homo Sapiens
ucauuacacugucaauguuacagucucaucuacggcaguuuccaagaaauuaagcauaa

SEQ ID NO: 672719 - RNA, 59 nt, Homo Sapiens
acagggcacaugauaccaacugcugcccacuacggcacgccgcaccggagcacggcacc

SEQ ID NO: 672720 - RNA, 59 nt, Homo Sapiens
aaccccaaagccgugagugucauagaacucuacggcauccuggacccaaccacccgaga

SEQ ID NO: 672721 - RNA, 59 nt, Homo Sapiens
gcuuucauuuaauugggcuuagacagauucuacggcacugaaauagaaaggcaguggga

SEQ ID NO: 672722 - RNA, 59 nt, Homo Sapiens
uacuacaagguaggccugccguccaacaucuacggcaaguuccccaucaucaugauggu

SEQ ID NO: 672723 - RNA, 59 nt, Homo Sapiens
agagugcaacaaaugcuucuauuccauagcuacggcauugcucaguaaguugaggucaa

SEQ ID NO: 672724 - RNA, 59 nt, Homo Sapiens
ccucacuguccccaugucccacccacguccuacggcacucaggaagcacuuggugagga

SEQ ID NO: 672725 - RNA, 59 nt, Homo Sapiens
uccgggagggcuggggcuuccccagcucucuacggcaggcgggcuccccacccccggca

SEQ ID NO: 672726 - RNA, 59 nt, Homo Sapiens
auuaaaauugucuuuuugcucccuuuuuucuacggcagcuuaugugacucuucauauaa

SEQ ID NO: 672727 - RNA, 59 nt, Homo Sapiens
acccgguuucccucccuguuuuccuaccucuacggcaagcccaaagugucuucccggga

SEQ ID NO: 672728 - RNA, 59 nt, Homo Sapiens
gacacacucgugagcaugugcaaagccaccuacggcagggagagccauguauauggcuu

SEQ ID NO: 672729 - RNA, 64 nt, Homo Sapiens; identical to SEQ ID NO: 60353

SEQ ID NO: 672730 - RNA, 64 nt, Homo Sapiens; identical to SEQ ID NO: 60354

SEQ ID NO: 672731 - RNA, 64 nt, Homo Sapiens; identical to SEQ ID NO: 60355

SEQ ID NO: 672732 - RNA, 64 nt, Homo Sapiens; identical to SEQ ID NO: 60356

SEQ ID NO: 672733 - RNA, 64 nt, Homo Sapiens; identical to SEQ ID NO: 60357

SEQ ID NO: 672734 - RNA, 64 nt, Homo Sapiens; identical to SEQ ID NO: 60358

SEQ ID NO: 672735 - RNA, 64 nt, Homo Sapiens; identical to SEQ ID NO: 60359

SEQ ID NO: 672736 - RNA, 64 nt, Homo Sapiens; identical to SEQ ID NO: 60360

SEQ ID NO: 672737 - RNA, 64 nt, Homo Sapiens; identical to SEQ ID NO: 60361

SEQ ID NO: 672738 - RNA, 64 nt, Homo Sapiens; identical to SEQ ID NO: 60362

SEQ ID NO: 672739 - RNA, 64 nt, Homo Sapiens; identical to SEQ ID NO: 60363

SEQ ID NO: 672740 - RNA, 64 nt, Homo Sapiens; identical to SEQ ID NO: 60364

SEQ ID NO: 672741 - RNA, 64 nt, Homo Sapiens; identical to SEQ ID NO: 60365

SEQ ID NO: 672742 - RNA, 64 nt, Homo Sapiens; identical to SEQ ID NO: 60366

SEQ ID NO: 672743 - RNA, 64 nt, Homo Sapiens; identical to SEQ ID NO: 60367

SEQ ID NO: 672744 - RNA, 64 nt, Homo Sapiens; identical to SEQ ID NO: 60368

SEQ ID NO: 672745 - RNA, 64 nt, Homo Sapiens; identical to SEQ ID NO: 60369

SEQ ID NO: 672746 - RNA, 64 nt, Homo Sapiens; identical to SEQ ID NO: 60370

SEQ ID NO: 672747 - RNA, 64 nt, Homo Sapiens; identical to SEQ ID NO: 60371

SEQ ID NO: 672748 - RNA, 64 nt, Homo Sapiens; identical to SEQ ID NO: 60372

SEQ ID NO: 672749 - RNA, 64 nt, Homo Sapiens; identical to SEQ ID NO: 60373

SEQ ID NO: 672750 - RNA, 64 nt, Homo Sapiens; identical to SEQ ID NO: 60374

SEQ ID NO: 672751 - RNA, 64 nt, Homo Sapiens; identical to SEQ ID NO: 223465

SEQ ID NO: 672752 - RNA, 64 nt, Homo Sapiens; identical to SEQ ID NO: 223466

SEQ ID NO: 672753 - RNA, 64 nt, Homo Sapiens; identical to SEQ ID NO: 223467

SEQ ID NO: 672754 - RNA, 64 nt, Homo Sapiens; identical to SEQ ID NO: 223468

SEQ ID NO: 672755 - RNA, 64 nt, Homo Sapiens; identical to SEQ ID NO: 223469

SEQ ID NO: 672756 - RNA, 64 nt, Homo Sapiens; identical to SEQ ID NO: 223470

SEQ ID NO: 672757 - RNA, 64 nt, Homo Sapiens; identical to SEQ ID NO: 223471

SEQ ID NO: 672758 - RNA, 64 nt, Homo Sapiens; identical to SEQ ID NO: 223472

SEQ ID NO: 672759 - RNA, 64 nt, Homo Sapiens; identical to SEQ ID NO: 223473

SEQ ID NO: 672760 - RNA, 64 nt, Homo Sapiens; identical to SEQ ID NO: 223474

SEQ ID NO: 672761 - RNA, 64 nt, Homo Sapiens; identical to SEQ ID NO: 223475

SEQ ID NO: 672762 - RNA, 64 nt, Homo Sapiens; identical to SEQ ID NO: 223476

SEQ ID NO: 672763 - RNA, 64 nt, Homo Sapiens; identical to SEQ ID NO: 223477

SEQ ID NO: 672764 - RNA, 64 nt, Homo Sapiens; identical to SEQ ID NO: 223478

SEQ ID NO: 672765 - RNA, 64 nt, Homo Sapiens; identical to SEQ ID NO: 223479

SEQ ID NO: 672766 - RNA, 64 nt, Homo Sapiens; identical to SEQ ID NO: 223480

SEQ ID NO: 672767 - RNA, 64 nt, Homo Sapiens; identical to SEQ ID NO: 223481

SEQ ID NO: 672768 - RNA, 64 nt, Homo Sapiens; identical to SEQ ID NO: 223482

SEQ ID NO: 672769 - RNA, 64 nt, Homo Sapiens; identical to SEQ ID NO: 223483

SEQ ID NO: 672770 - RNA, 64 nt, Homo Sapiens; identical to SEQ ID NO: 223484

SEQ ID NO: 672771 - RNA, 64 nt, Homo Sapiens; identical to SEQ ID NO: 223485

SEQ ID NO: 672772 - RNA, 64 nt, Homo Sapiens; identical to SEQ ID NO: 223486

SEQ ID NO: 672773 - RNA, 64 nt, Homo Sapiens; identical to SEQ ID NO: 223487

SEQ ID NO: 672774 - RNA, 64 nt, Homo Sapiens; identical to SEQ ID NO: 223488

SEQ ID NO: 672775 - RNA, 64 nt, Homo Sapiens; identical to SEQ ID NO: 223489

SEQ ID NO: 672776 - RNA, 64 nt, Homo Sapiens; identical to SEQ ID NO: 223490

SEQ ID NO: 672777 - RNA, 64 nt, Homo Sapiens; identical to SEQ ID NO: 223491

SEQ ID NO: 672778 - RNA, 64 nt, Homo Sapiens; identical to SEQ ID NO: 223492

SEQ ID NO: 672779 - RNA, 64 nt, Homo Sapiens; identical to SEQ ID NO: 223493

SEQ ID NO: 672780 - RNA, 64 nt, Homo Sapiens; identical to SEQ ID NO: 223494

SEQ ID NO: 672781 - RNA, 64 nt, Homo Sapiens; identical to SEQ ID NO: 223495

SEQ ID NO: 672782 - RNA, 64 nt, Homo Sapiens; identical to SEQ ID NO: 223496

SEQ ID NO: 672783 - RNA, 64 nt, Homo Sapiens; identical to SEQ ID NO: 223497

SEQ ID NO: 672784 - RNA, 64 nt, Homo Sapiens; identical to SEQ ID NO: 223498

SEQ ID NO: 672785 - RNA, 64 nt, Homo Sapiens; identical to SEQ ID NO: 223499

SEQ ID NO: 672786 - RNA, 64 nt, Homo Sapiens; identical to SEQ ID NO: 223500

SEQ ID NO: 672787 - RNA, 64 nt, Homo Sapiens; identical to SEQ ID NO: 223501

SEQ ID NO: 672788 - RNA, 64 nt, Homo Sapiens; identical to SEQ ID NO: 223502

SEQ ID NO: 672789 - RNA, 64 nt, Homo Sapiens; identical to SEQ ID NO: 223503

SEQ ID NO: 672790 - RNA, 64 nt, Homo Sapiens; identical to SEQ ID NO: 223504

SEQ ID NO: 672791 - RNA, 64 nt, Homo Sapiens; identical to SEQ ID NO: 223505

SEQ ID NO: 672792 - RNA, 64 nt, Homo Sapiens; identical to SEQ ID NO: 223506

SEQ ID NO: 672793 - RNA, 64 nt, Homo Sapiens; identical to SEQ ID NO: 223507

SEQ ID NO: 672794 - RNA, 64 nt, Homo Sapiens; identical to SEQ ID NO: 223508

SEQ ID NO: 672795 - RNA, 64 nt, Homo Sapiens; identical to SEQ ID NO: 223509

SEQ ID NO: 672796 - RNA, 64 nt, Homo Sapiens; identical to SEQ ID NO: 223510

SEQ ID NO: 672797 - RNA, 64 nt, Homo Sapiens; identical to SEQ ID NO: 223511

SEQ ID NO: 672798 - RNA, 64 nt, Homo Sapiens; identical to SEQ ID NO: 223512

SEQ ID NO: 672799 - RNA, 64 nt, Homo Sapiens; identical to SEQ ID NO: 223513

SEQ ID NO: 672800 - RNA, 64 nt, Homo Sapiens; identical to SEQ ID NO: 223514

SEQ ID NO: 672801 - RNA, 64 nt, Homo Sapiens; identical to SEQ ID NO: 223515

SEQ ID NO: 672802 - RNA, 64 nt, Homo Sapiens; identical to SEQ ID NO: 223516

SEQ ID NO: 672803 - RNA, 64 nt, Homo Sapiens; identical to SEQ ID NO: 223517

SEQ ID NO: 672804 - RNA, 64 nt, Homo Sapiens; identical to SEQ ID NO: 223518

SEQ ID NO: 672805 - RNA, 64 nt, Homo Sapiens; identical to SEQ ID NO: 223519

SEQ ID NO: 672806 - RNA, 64 nt, Homo Sapiens; identical to SEQ ID NO: 223520

SEQ ID NO: 672807 - RNA, 64 nt, Homo Sapiens; identical to SEQ ID NO: 223521

SEQ ID NO: 672808 - RNA, 64 nt, Homo Sapiens; identical to SEQ ID NO: 223522

SEQ ID NO: 672809 - RNA, 64 nt, Homo Sapiens; identical to SEQ ID NO: 223523

SEQ ID NO: 672810 - RNA, 64 nt, Homo Sapiens; identical to SEQ ID NO: 223524

SEQ ID NO: 672811 - RNA, 64 nt, Homo Sapiens; identical to SEQ ID NO: 223525

SEQ ID NO: 672812 - RNA, 64 nt, Homo Sapiens; identical to SEQ ID NO: 223526

SEQ ID NO: 672813 - RNA, 64 nt, Homo Sapiens; identical to SEQ ID NO: 223527

SEQ ID NO: 672814 - RNA, 64 nt, Homo Sapiens; identical to SEQ ID NO: 223528

SEQ ID NO: 672815 - RNA, 64 nt, Homo Sapiens; identical to SEQ ID NO: 223529

SEQ ID NO: 672816 - RNA, 64 nt, Homo Sapiens; identical to SEQ ID NO: 223530

SEQ ID NO: 672817 - RNA, 64 nt, Homo Sapiens; identical to SEQ ID NO: 223531

SEQ ID NO: 672818 - RNA, 64 nt, Homo Sapiens; identical to SEQ ID NO: 223532

SEQ ID NO: 672819 - RNA, 64 nt, Homo Sapiens; identical to SEQ ID NO: 223533

SEQ ID NO: 672820 - RNA, 64 nt, Homo Sapiens; identical to SEQ ID NO: 223534

SEQ ID NO: 672821 - RNA, 64 nt, Homo Sapiens; identical to SEQ ID NO: 223535

SEQ ID NO: 672822 - RNA, 64 nt, Homo Sapiens; identical to SEQ ID NO: 223536

SEQ ID NO: 672823 - RNA, 64 nt, Homo Sapiens; identical to SEQ ID NO: 223537

SEQ ID NO: 672824 - RNA, 64 nt, Homo Sapiens; identical to SEQ ID NO: 223538

SEQ ID NO: 672825 - RNA, 64 nt, Homo Sapiens; identical to SEQ ID NO: 223539

SEQ ID NO: 672826 - RNA, 64 nt, Homo Sapiens; identical to SEQ ID NO: 223540

SEQ ID NO: 672827 - RNA, 64 nt, Homo Sapiens; identical to SEQ ID NO: 223541

SEQ ID NO: 672828 - RNA, 64 nt, Homo Sapiens; identical to SEQ ID NO: 223542

SEQ ID NO: 672829 - RNA, 64 nt, Homo Sapiens; identical to SEQ ID NO: 223543

SEQ ID NO: 672830 - RNA, 64 nt, Homo Sapiens; identical to SEQ ID NO: 223544

SEQ ID NO: 672831 - RNA, 64 nt, Homo Sapiens; identical to SEQ ID NO: 223545

SEQ ID NO: 672832 - RNA, 64 nt, Homo Sapiens; identical to SEQ ID NO: 223546

SEQ ID NO: 672833 - RNA, 64 nt, Homo Sapiens; identical to SEQ ID NO: 223547

SEQ ID NO: 672834 - RNA, 64 nt, Homo Sapiens; identical to SEQ ID NO: 223548

SEQ ID NO: 672835 - RNA, 64 nt, Homo Sapiens; identical to SEQ ID NO: 223549

SEQ ID NO: 672836 - RNA, 64 nt, Homo Sapiens; identical to SEQ ID NO: 223550

SEQ ID NO: 672837 - RNA, 64 nt, Homo Sapiens; identical to SEQ ID NO: 223551

SEQ ID NO: 672838 - RNA, 64 nt, Homo Sapiens; identical to SEQ ID NO: 223552

SEQ ID NO: 672839 - RNA, 64 nt, Homo Sapiens; identical to SEQ ID NO: 223553

SEQ ID NO: 672840 - RNA, 64 nt, Homo Sapiens; identical to SEQ ID NO: 223554

SEQ ID NO: 672841 - RNA, 64 nt, Homo Sapiens; identical to SEQ ID NO: 223555

SEQ ID NO: 672842 - RNA, 64 nt, Homo Sapiens; identical to SEQ ID NO: 223556

SEQ ID NO: 672843 - RNA, 64 nt, Homo Sapiens; identical to SEQ ID NO: 223557

SEQ ID NO: 672844 - RNA, 64 nt, Homo Sapiens; identical to SEQ ID NO: 223558

SEQ ID NO: 672845 - RNA, 64 nt, Homo Sapiens; identical to SEQ ID NO: 223559

SEQ ID NO: 672846 - RNA, 64 nt, Homo Sapiens; identical to SEQ ID NO: 223560

SEQ ID NO: 672847 - RNA, 64 nt, Homo Sapiens; identical to SEQ ID NO: 223561

SEQ ID NO: 672848 - RNA, 64 nt, Homo Sapiens; identical to SEQ ID NO: 223562

SEQ ID NO: 672849 - RNA, 64 nt, Homo Sapiens; identical to SEQ ID NO: 223563

SEQ ID NO: 672850 - RNA, 64 nt, Homo Sapiens; identical to SEQ ID NO: 223564

SEQ ID NO: 672851 - RNA, 64 nt, Homo Sapiens; identical to SEQ ID NO: 223565

SEQ ID NO: 672852 - RNA, 64 nt, Homo Sapiens; identical to SEQ ID NO: 223566

SEQ ID NO: 672853 - RNA, 64 nt, Homo Sapiens; identical to SEQ ID NO: 223567

SEQ ID NO: 672854 - RNA, 64 nt, Homo Sapiens; identical to SEQ ID NO: 223568

SEQ ID NO: 672855 - RNA, 64 nt, Homo Sapiens; identical to SEQ ID NO: 223569

SEQ ID NO: 672856 - RNA, 64 nt, Homo Sapiens; identical to SEQ ID NO: 223570

SEQ ID NO: 672857 - RNA, 64 nt, Homo Sapiens; identical to SEQ ID NO: 223571

SEQ ID NO: 672858 - RNA, 64 nt, Homo Sapiens; identical to SEQ ID NO: 343068

SEQ ID NO: 672859 - RNA, 64 nt, Homo Sapiens; identical to SEQ ID NO: 343069

SEQ ID NO: 672860 - RNA, 64 nt, Homo Sapiens; identical to SEQ ID NO: 343070

SEQ ID NO: 672861 - RNA, 64 nt, Homo Sapiens; identical to SEQ ID NO: 343071

SEQ ID NO: 672862 - RNA, 64 nt, Homo Sapiens; identical to SEQ ID NO: 343072

SEQ ID NO: 672863 - RNA, 64 nt, Homo Sapiens; identical to SEQ ID NO: 343073

SEQ ID NO: 672864 - RNA, 64 nt, Homo Sapiens
aggcccugggaucgggaguuacacuacccugucccaagccgagggggccgguggaaugacuuga

SEQ ID NO: 672865 - RNA, 64 nt, Homo Sapiens
agcuuuuggagaagcaggagggcauuggcuuaaccaagccgaaggcugcuggcugggcugccua

SEQ ID NO: 672866 - RNA, 64 nt, Homo Sapiens
agaaucgcuugaacccgggagguggagguugcagcaagccgagauugugccacuguacuccagc

SEQ ID NO: 672867 - RNA, 64 nt, Homo Sapiens
uucccuccgccuucucccacauaugggauauucccaagccgaccgccacagccuucggacagac

SEQ ID NO: 672868 - RNA, 64 nt, Homo Sapiens
ggcacgagcuggggacaguuagaaggugguucuucaagccgagaccagagaacccggggccggg

SEQ ID NO: 672869 - RNA, 64 nt, Homo Sapiens
uccagaaucuauuaaaaauguuaugacuacuaugcaagccgaguguccuggccacacugaggaa

SEQ ID NO: 672870 - RNA, 64 nt, Homo Sapiens
acugccgcgugauucccgcggccauucagaaguucaagccgagaugcugacguugcugagcaac

SEQ ID NO: 672871 - RNA, 64 nt, Homo Sapiens
ugccaaccuaucgcugcuggcagcacuuuuugagcaagccgagagcacccauuuuggcuggggg

SEQ ID NO: 672872 - RNA, 64 nt, Homo Sapiens
uuuucuuguagaaauguugcagugccaugcuccucaagccgauucuggucaugcaagcauuuac

SEQ ID NO: 672873 - RNA, 64 nt, Homo Sapiens
uuauguccuuucuauagguuaagugaccccuguucaagccgaugggaugaaagaagcuugucuc

SEQ ID NO: 672874 - RNA, 64 nt, Homo Sapiens
gcugguggaaaaucacgauuguggcuugauguggcaagccgaaaccacuuggcucuggaaaucu

SEQ ID NO: 672875 - RNA, 64 nt, Homo Sapiens
cacuuuagcaguaucuguuuacaugcgcaaggaucaagccgacuaccugugcugucuacuggga

SEQ ID NO: 672876 - RNA, 64 nt, Homo Sapiens
gaaucccacauuagcuuguuaguaaugcucugaccaagccgagaugcccauucucuuagugaug

SEQ ID NO: 672877 - RNA, 64 nt, Homo Sapiens
cagggacaaacuuuccgauagggcucaguaggaucaagccgacccagagugggcaugggaugcu

SEQ ID NO: 672878 - RNA, 64 nt, Homo Sapiens
ggaucuucaguuauucgaggggaaugaggcaggucaagccgaugcuagccacuaguuugauuuu

SEQ ID NO: 672879 - RNA, 64 nt, Homo Sapiens
auucugauaggauguauaaauacuuagaugcauacaagccgauggauagaaagacagauaaaua

SEQ ID NO: 672880 - RNA, 64 nt, Homo Sapiens
cccguuauuuuuauuuuuuacuuuuugccugagacaagccgaguaugaggugguuugauuuaag

SEQ ID NO: 672881 - RNA, 57 nt, Homo Sapiens
auccugucacgucgggcuaggaggggccaagccgaagagccacccaggccacaguuc

SEQ ID NO: 672882 - RNA, 64 nt, Homo Sapiens
gcagaggccuuuguacgcaguuacaacuuuugcucaagccgagggcuuaauaaauacuaguuau

SEQ ID NO: 672883 - RNA, 64 nt, Homo Sapiens
caacugcagccaucauucauucauuuaaaguaggcaagccgagcacuaggagcugauguuugcc

SEQ ID NO: 672884 - RNA, 64 nt, Homo Sapiens
cuuccagacaaggcggaaaaugccaacaccggaacaagccgacggaggcagaaacaccagccuc

SEQ ID NO: 672885 - RNA, 64 nt, Homo Sapiens
cccacugucagccacacaccugcccccaucacaccaagccgaccucagaguuguucaucuuccu

SEQ ID NO: 672886 - RNA, 64 nt, Homo Sapiens
uaugcccaccaucccaccucuggaggaccacacucaagccgacugugcucaagagguucucgac

SEQ ID NO: 672887 - RNA, 64 nt, Homo Sapiens
aaccuguauaagcagcccaaaaacguauagcagucaagccgagcuaaauuuuccaauugcaacc

SEQ ID NO: 672888 - RNA, 64 nt, Homo Sapiens
cacagggagacgggggccugcacccaccccagaacaagccgacagagcucugagacagagcaaa

SEQ ID NO: 672889 - RNA, 64 nt, Homo Sapiens
uuggcuuuuucugguaugugcugugcuccacgaccaagccgagaaaggaccuaggguggggaag

SEQ ID NO: 672890 - RNA, 64 nt, Homo Sapiens
uauauucuaguuguuuuuguacuuuuuuugcauacaagccgaacguuugugcuucccgugcaug

SEQ ID NO: 672891 - RNA, 64 nt, Homo Sapiens
aagcccuccuuuggagcaaagaaggagcugagaacaagccgaaugaggaguuuuuauaagauug

SEQ ID NO: 672892 - RNA, 64 nt, Homo Sapiens
cauguuuaaagaucugguccccuuuaugagaaugcaagccgauccacauccugacuuaagagau

SEQ ID NO: 672893 - RNA, 64 nt, Homo Sapiens
ucuccuuguuaccguguucucgcucuccuuugagcaagccgagcgaagauucuaucccccgcag

SEQ ID NO: 672894 - RNA, 64 nt, Homo Sapiens
ccacgugaggacacagugagaagguggccgucugcaagccgaggagggggccucaggagaaacc

SEQ ID NO: 672895 - RNA, 64 nt, Homo Sapiens
accgugcugccgccguccacagcaacuacggacgcaagccgaggagcccugaaccagaagccug

SEQ ID NO: 672896 - RNA, 64 nt, Homo Sapiens
uaagcaugagaguguggagcagagucggcgagcgcaagccgagcccaucaaccuggacagcugu

SEQ ID NO: 672897 - RNA, 64 nt, Homo Sapiens
aguuuuacucugcugcaaaaugaaggcgggccugcaagccgacuacaccuacggaggcuguuga

SEQ ID NO: 672898 - RNA, 64 nt, Homo Sapiens
aaggccccucaacccugucaaggccaccuugagucaagccgacuuuauacaaaaggccacagug

SEQ ID NO: 672899 - RNA, 64 nt, Homo Sapiens
ccgccgugacugcguuuuaguucucuaaauuauccaagccgauguugcucuguccuuccucaca

SEQ ID NO: 672900 - RNA, 64 nt, Homo Sapiens
gagcuguucuguagccgggaugacagcucucgcccaagccgagcaugccccgggcccccgccuc

SEQ ID NO: 672901 - RNA, 64 nt, Homo Sapiens
gccccuucuguugugggcagccagagaggccagacaagccgagaucccacaccugcuugggagg

SEQ ID NO: 672902 - RNA, 64 nt, Homo Sapiens
ucuuccacuguggcccugcagagauccccugagccaagccgaggcaguuuccacauaagccaca

SEQ ID NO: 672903 - RNA, 64 nt, Homo Sapiens
ccuguaaucucuguaaagguuuuugggggauaaggguguuuaaccaccucccagcuuucuucuu

SEQ ID NO: 672904 - RNA, 64 nt, Homo Sapiens
augccuauucguagaguucccucagaagagccaugguguuuaugaagagaagaguagugauugc

SEQ ID NO: 672905 - RNA, 64 nt, Homo Sapiens
cugaauuuuaaaguuucagacuuaucuuuuccuugguguuuaaauuuacuaucauugcuaaaca

SEQ ID NO: 672906 - RNA, 64 nt, Homo Sapiens
gaaccugugauauaccuccauuuguccacaagaugguguuuaaaacaauuuguucagaagaacu

SEQ ID NO: 672907 - RNA, 64 nt, Homo Sapiens
cagagaugcauacaaagaauuauauauaaagaaggguguuuaauaaugauaguuauaauaauaa

SEQ ID NO: 672908 - RNA, 64 nt, Homo Sapiens
acuuggguuugcaacagcuuucugagaaaagcuagguguuuaauaguuuaacugaaaguuuaac

SEQ ID NO: 672909 - RNA, 64 nt, Homo Sapiens
gagagguuauagaguagaagugagauuagagggagguguuuaaauaauaaaaacagaaggaaau

SEQ ID NO: 672910 - RNA, 64 nt, Homo Sapiens
uaagagcaccuuccucacuuuguggaagccggaggguguuuaugaggaagcagauacauaugag

SEQ ID NO: 672911 - RNA, 64 nt, Homo Sapiens
caaccaaauuugaugcgaucauaguaagaauucugguguuuacaauauaggcacauuaccauuc

SEQ ID NO: 672912 - RNA, 64 nt, Homo Sapiens
uuuaacucuuggaagagguuaaagaaaaaaaaaagguguuuauuacauuuuucacuuuugcuaa

SEQ ID NO: 672913 - RNA, 64 nt, Homo Sapiens; identical to SEQ ID NO: 73845

SEQ ID NO: 672914 - RNA, 64 nt, Homo Sapiens; identical to SEQ ID NO: 73846

SEQ ID NO: 672915 - RNA, 64 nt, Homo Sapiens; identical to SEQ ID NO: 73847

SEQ ID NO: 672916 - RNA, 64 nt, Homo Sapiens; identical to SEQ ID NO: 73848

SEQ ID NO: 672917 - RNA, 64 nt, Homo Sapiens; identical to SEQ ID NO: 73849

SEQ ID NO: 672918 - RNA, 64 nt, Homo Sapiens; identical to SEQ ID NO: 73850

SEQ ID NO: 672919 - RNA, 64 nt, Homo Sapiens; identical to SEQ ID NO: 73851

SEQ ID NO: 672920 - RNA, 64 nt, Homo Sapiens; identical to SEQ ID NO: 73852

SEQ ID NO: 672921 - RNA, 64 nt, Homo Sapiens; identical to SEQ ID NO: 73853

SEQ ID NO: 672922 - RNA, 64 nt, Homo Sapiens; identical to SEQ ID NO: 73854

SEQ ID NO: 672923 - RNA, 64 nt, Homo Sapiens; identical to SEQ ID NO: 73855

SEQ ID NO: 672924 - RNA, 64 nt, Homo Sapiens; identical to SEQ ID NO: 73856

SEQ ID NO: 672925 - RNA, 64 nt, Homo Sapiens; identical to SEQ ID NO: 73857

SEQ ID NO: 672926 - RNA, 64 nt, Homo Sapiens; identical to SEQ ID NO: 73858

SEQ ID NO: 672927 - RNA, 64 nt, Homo Sapiens; identical to SEQ ID NO: 73859

SEQ ID NO: 672928 - RNA, 62 nt, Homo Sapiens; identical to SEQ ID NO: 73860

SEQ ID NO: 672929 - RNA, 64 nt, Homo Sapiens; identical to SEQ ID NO: 73861

SEQ ID NO: 672930 - RNA, 64 nt, Homo Sapiens; identical to SEQ ID NO: 73862

SEQ ID NO: 672931 - RNA, 64 nt, Homo Sapiens; identical to SEQ ID NO: 73863

SEQ ID NO: 672932 - RNA, 64 nt, Homo Sapiens; identical to SEQ ID NO: 73864

SEQ ID NO: 672933 - RNA, 64 nt, Homo Sapiens; identical to SEQ ID NO: 73865

SEQ ID NO: 672934 - RNA, 64 nt, Homo Sapiens; identical to SEQ ID NO: 73866

SEQ ID NO: 672935 - RNA, 64 nt, Homo Sapiens; identical to SEQ ID NO: 73867

SEQ ID NO: 672936 - RNA, 64 nt, Homo Sapiens; identical to SEQ ID NO: 73868

SEQ ID NO: 672937 - RNA, 64 nt, Homo Sapiens; identical to SEQ ID NO: 73869

SEQ ID NO: 672938 - RNA, 64 nt, Homo Sapiens; identical to SEQ ID NO: 73870

SEQ ID NO: 672939 - RNA, 64 nt, Homo Sapiens; identical to SEQ ID NO: 73871

SEQ ID NO: 672940 - RNA, 64 nt, Homo Sapiens; identical to SEQ ID NO: 73872

SEQ ID NO: 672941 - RNA, 64 nt, Homo Sapiens; identical to SEQ ID NO: 73873

SEQ ID NO: 672942 - RNA, 64 nt, Homo Sapiens; identical to SEQ ID NO: 73874

SEQ ID NO: 672943 - RNA, 64 nt, Homo Sapiens; identical to SEQ ID NO: 73875

SEQ ID NO: 672944 - RNA, 64 nt, Homo Sapiens; identical to SEQ ID NO: 73876

SEQ ID NO: 672945 - RNA, 64 nt, Homo Sapiens; identical to SEQ ID NO: 73877

SEQ ID NO: 672946 - RNA, 64 nt, Homo Sapiens; identical to SEQ ID NO: 73878

SEQ ID NO: 672947 - RNA, 64 nt, Homo Sapiens; identical to SEQ ID NO: 73879

SEQ ID NO: 672948 - RNA, 64 nt, Homo Sapiens; identical to SEQ ID NO: 73880

SEQ ID NO: 672949 - RNA, 64 nt, Homo Sapiens; identical to SEQ ID NO: 73881

SEQ ID NO: 672950 - RNA, 64 nt, Homo Sapiens; identical to SEQ ID NO: 73882

SEQ ID NO: 672951 - RNA, 64 nt, Homo Sapiens; identical to SEQ ID NO: 73883

SEQ ID NO: 672952 - RNA, 64 nt, Homo Sapiens; identical to SEQ ID NO: 73884

SEQ ID NO: 672953 - RNA, 64 nt, Homo Sapiens; identical to SEQ ID NO: 73885

SEQ ID NO: 672954 - RNA, 64 nt, Homo Sapiens; identical to SEQ ID NO: 73886

SEQ ID NO: 672955 - RNA, 64 nt, Homo Sapiens; identical to SEQ ID NO: 73887

SEQ ID NO: 672956 - RNA, 64 nt, Homo Sapiens; identical to SEQ ID NO: 73888

SEQ ID NO: 672957 - RNA, 64 nt, Homo Sapiens; identical to SEQ ID NO: 73889

SEQ ID NO: 672958 - RNA, 64 nt, Homo Sapiens; identical to SEQ ID NO: 160405

SEQ ID NO: 672959 - RNA, 64 nt, Homo Sapiens; identical to SEQ ID NO: 160406

SEQ ID NO: 672960 - RNA, 64 nt, Homo Sapiens; identical to SEQ ID NO: 160407

SEQ ID NO: 672961 - RNA, 64 nt, Homo Sapiens; identical to SEQ ID NO: 160408

SEQ ID NO: 672962 - RNA, 64 nt, Homo Sapiens; identical to SEQ ID NO: 160409

SEQ ID NO: 672963 - RNA, 64 nt, Homo Sapiens; identical to SEQ ID NO: 160410

SEQ ID NO: 672964 - RNA, 64 nt, Homo Sapiens; identical to SEQ ID NO: 160411

SEQ ID NO: 672965 - RNA, 64 nt, Homo Sapiens; identical to SEQ ID NO: 160412

SEQ ID NO: 672966 - RNA, 64 nt, Homo Sapiens; identical to SEQ ID NO: 160413

SEQ ID NO: 672967 - RNA, 64 nt, Homo Sapiens; identical to SEQ ID NO: 160414

SEQ ID NO: 672968 - RNA, 64 nt, Homo Sapiens; identical to SEQ ID NO: 160415

SEQ ID NO: 672969 - RNA, 64 nt, Homo Sapiens; identical to SEQ ID NO: 160416

SEQ ID NO: 672970 - RNA, 64 nt, Homo Sapiens; identical to SEQ ID NO: 160417

SEQ ID NO: 672971 - RNA, 64 nt, Homo Sapiens; identical to SEQ ID NO: 160418

SEQ ID NO: 672972 - RNA, 64 nt, Homo Sapiens; identical to SEQ ID NO: 160419

SEQ ID NO: 672973 - RNA, 64 nt, Homo Sapiens; identical to SEQ ID NO: 160420

SEQ ID NO: 672974 - RNA, 64 nt, Homo Sapiens; identical to SEQ ID NO: 160421

SEQ ID NO: 672975 - RNA, 64 nt, Homo Sapiens; identical to SEQ ID NO: 160422

SEQ ID NO: 672976 - RNA, 64 nt, Homo Sapiens; identical to SEQ ID NO: 160423

SEQ ID NO: 672977 - RNA, 64 nt, Homo Sapiens; identical to SEQ ID NO: 160424

SEQ ID NO: 672978 - RNA, 64 nt, Homo Sapiens; identical to SEQ ID NO: 160425

SEQ ID NO: 672979 - RNA, 64 nt, Homo Sapiens; identical to SEQ ID NO: 160426

SEQ ID NO: 672980 - RNA, 64 nt, Homo Sapiens; identical to SEQ ID NO: 160427

SEQ ID NO: 672981 - RNA, 64 nt, Homo Sapiens; identical to SEQ ID NO: 160428

SEQ ID NO: 672982 - RNA, 64 nt, Homo Sapiens; identical to SEQ ID NO: 160429

SEQ ID NO: 672983 - RNA, 64 nt, Homo Sapiens; identical to SEQ ID NO: 160430

SEQ ID NO: 672984 - RNA, 61 nt, Homo Sapiens; identical to SEQ ID NO: 160431

SEQ ID NO: 672985 - RNA, 64 nt, Homo Sapiens; identical to SEQ ID NO: 160432

SEQ ID NO: 672986 - RNA, 64 nt, Homo Sapiens; identical to SEQ ID NO: 160433

SEQ ID NO: 672987 - RNA, 64 nt, Homo Sapiens; identical to SEQ ID NO: 160434

SEQ ID NO: 672988 - RNA, 64 nt, Homo Sapiens; identical to SEQ ID NO: 160435

SEQ ID NO: 672989 - RNA, 64 nt, Homo Sapiens; identical to SEQ ID NO: 160436

SEQ ID NO: 672990 - RNA, 64 nt, Homo Sapiens; identical to SEQ ID NO: 160437

SEQ ID NO: 672991 - RNA, 64 nt, Homo Sapiens; identical to SEQ ID NO: 160438

SEQ ID NO: 672992 - RNA, 64 nt, Homo Sapiens; identical to SEQ ID NO: 160439

SEQ ID NO: 672993 - RNA, 64 nt, Homo Sapiens; identical to SEQ ID NO: 160440

SEQ ID NO: 672994 - RNA, 64 nt, Homo Sapiens; identical to SEQ ID NO: 160441

SEQ ID NO: 672995 - RNA, 64 nt, Homo Sapiens; identical to SEQ ID NO: 160442

SEQ ID NO: 672996 - RNA, 64 nt, Homo Sapiens; identical to SEQ ID NO: 160443

SEQ ID NO: 672997 - RNA, 64 nt, Homo Sapiens; identical to SEQ ID NO: 160444

SEQ ID NO: 672998 - RNA, 64 nt, Homo Sapiens; identical to SEQ ID NO: 160445

SEQ ID NO: 672999 - RNA, 64 nt, Homo Sapiens; identical to SEQ ID NO: 160446

SEQ ID NO: 673000 - RNA, 64 nt, Homo Sapiens; identical to SEQ ID NO: 160447

SEQ ID NO: 673001 - RNA, 64 nt, Homo Sapiens; identical to SEQ ID NO: 160448

SEQ ID NO: 673002 - RNA, 64 nt, Homo Sapiens; identical to SEQ ID NO: 160449

SEQ ID NO: 673003 - RNA, 64 nt, Homo Sapiens; identical to SEQ ID NO: 160450

SEQ ID NO: 673004 - RNA, 64 nt, Homo Sapiens; identical to SEQ ID NO: 160451

SEQ ID NO: 673005 - RNA, 64 nt, Homo Sapiens; identical to SEQ ID NO: 160452

SEQ ID NO: 673006 - RNA, 64 nt, Homo Sapiens; identical to SEQ ID NO: 160453

SEQ ID NO: 673007 - RNA, 64 nt, Homo Sapiens; identical to SEQ ID NO: 160454

SEQ ID NO: 673008 - RNA, 64 nt, Homo Sapiens; identical to SEQ ID NO: 160455

SEQ ID NO: 673009 - RNA, 64 nt, Homo Sapiens; identical to SEQ ID NO: 160456

SEQ ID NO: 673010 - RNA, 64 nt, Homo Sapiens; identical to SEQ ID NO: 160457

SEQ ID NO: 673011 - RNA, 64 nt, Homo Sapiens; identical to SEQ ID NO: 160458

SEQ ID NO: 673012 - RNA, 64 nt, Homo Sapiens; identical to SEQ ID NO: 160459

SEQ ID NO: 673013 - RNA, 64 nt, Homo Sapiens; identical to SEQ ID NO: 160460

SEQ ID NO: 673014 - RNA, 64 nt, Homo Sapiens; identical to SEQ ID NO: 160461

SEQ ID NO: 673015 - RNA, 64 nt, Homo Sapiens; identical to SEQ ID NO: 160462

SEQ ID NO: 673016 - RNA, 64 nt, Homo Sapiens; identical to SEQ ID NO: 160463

SEQ ID NO: 673017 - RNA, 64 nt, Homo Sapiens; identical to SEQ ID NO: 160464

SEQ ID NO: 673018 - RNA, 64 nt, Homo Sapiens; identical to SEQ ID NO: 356502

SEQ ID NO: 673019 - RNA, 64 nt, Homo Sapiens; identical to SEQ ID NO: 356503

SEQ ID NO: 673020 - RNA, 64 nt, Homo Sapiens; identical to SEQ ID NO: 356504

SEQ ID NO: 673021 - RNA, 64 nt, Homo Sapiens; identical to SEQ ID NO: 356505

SEQ ID NO: 673022 - RNA, 64 nt, Homo Sapiens; identical to SEQ ID NO: 356506

SEQ ID NO: 673023 - RNA, 64 nt, Homo Sapiens; identical to SEQ ID NO: 356507

SEQ ID NO: 673024 - RNA, 64 nt, Homo Sapiens; identical to SEQ ID NO: 356508

SEQ ID NO: 673025 - RNA, 64 nt, Homo Sapiens; identical to SEQ ID NO: 356509

SEQ ID NO: 673026 - RNA, 64 nt, Homo Sapiens; identical to SEQ ID NO: 356510

SEQ ID NO: 673027 - RNA, 64 nt, Homo Sapiens; identical to SEQ ID NO: 356511

SEQ ID NO: 673028 - RNA, 64 nt, Homo Sapiens; identical to SEQ ID NO: 356512

SEQ ID NO: 673029 - RNA, 64 nt, Homo Sapiens; identical to SEQ ID NO: 356513

SEQ ID NO: 673030 - RNA, 64 nt, Homo Sapiens; identical to SEQ ID NO: 356514

SEQ ID NO: 673031 - RNA, 64 nt, Homo Sapiens; identical to SEQ ID NO: 356515

SEQ ID NO: 673032 - RNA, 64 nt, Homo Sapiens; identical to SEQ ID NO: 356516

SEQ ID NO: 673033 - RNA, 64 nt, Homo Sapiens; identical to SEQ ID NO: 356517

SEQ ID NO: 673034 - RNA, 64 nt, Homo Sapiens; identical to SEQ ID NO: 356518

SEQ ID NO: 673035 - RNA, 64 nt, Homo Sapiens; identical to SEQ ID NO: 356519

SEQ ID NO: 673036 - RNA, 64 nt, Homo Sapiens; identical to SEQ ID NO: 356520

SEQ ID NO: 673037 - RNA, 64 nt, Homo Sapiens; identical to SEQ ID NO: 356521

SEQ ID NO: 673038 - RNA, 64 nt, Homo Sapiens; identical to SEQ ID NO: 356522

SEQ ID NO: 673039 - RNA, 64 nt, Homo Sapiens; identical to SEQ ID NO: 356523

SEQ ID NO: 673040 - RNA, 64 nt, Homo Sapiens; identical to SEQ ID NO: 356524

SEQ ID NO: 673041 - RNA, 64 nt, Homo Sapiens; identical to SEQ ID NO: 356525

SEQ ID NO: 673042 - RNA, 64 nt, Homo Sapiens; identical to SEQ ID NO: 356526

SEQ ID NO: 673043 - RNA, 64 nt, Homo Sapiens; identical to SEQ ID NO: 356527

SEQ ID NO: 673044 - RNA, 64 nt, Homo Sapiens; identical to SEQ ID NO: 356528

SEQ ID NO: 673045 - RNA, 64 nt, Homo Sapiens; identical to SEQ ID NO: 356529

SEQ ID NO: 673046 - RNA, 64 nt, Homo Sapiens; identical to SEQ ID NO: 356530

SEQ ID NO: 673047 - RNA, 64 nt, Homo Sapiens; identical to SEQ ID NO: 356531

SEQ ID NO: 673048 - RNA, 64 nt, Homo Sapiens; identical to SEQ ID NO: 356532

SEQ ID NO: 673049 - RNA, 64 nt, Homo Sapiens; identical to SEQ ID NO: 356533

SEQ ID NO: 673050 - RNA, 64 nt, Homo Sapiens; identical to SEQ ID NO: 356534

SEQ ID NO: 673051 - RNA, 64 nt, Homo Sapiens; identical to SEQ ID NO: 356535

SEQ ID NO: 673052 - RNA, 64 nt, Homo Sapiens; identical to SEQ ID NO: 356536

SEQ ID NO: 673053 - RNA, 64 nt, Homo Sapiens; identical to SEQ ID NO: 356537

SEQ ID NO: 673054 - RNA, 64 nt, Homo Sapiens; identical to SEQ ID NO: 356538

SEQ ID NO: 673055 - RNA, 64 nt, Homo Sapiens; identical to SEQ ID NO: 356539

SEQ ID NO: 673056 - RNA, 64 nt, Homo Sapiens; identical to SEQ ID NO: 356540

SEQ ID NO: 673057 - RNA, 64 nt, Homo Sapiens; identical to SEQ ID NO: 247878

SEQ ID NO: 673058 - RNA, 64 nt, Homo Sapiens; identical to SEQ ID NO: 247879

SEQ ID NO: 673059 - RNA, 64 nt, Homo Sapiens; identical to SEQ ID NO: 247880

SEQ ID NO: 673060 - RNA, 64 nt, Homo Sapiens; identical to SEQ ID NO: 247881

SEQ ID NO: 673061 - RNA, 64 nt, Homo Sapiens; identical to SEQ ID NO: 460726

SEQ ID NO: 673062 - RNA, 64 nt, Homo Sapiens; identical to SEQ ID NO: 460727

SEQ ID NO: 673063 - RNA, 64 nt, Homo Sapiens; identical to SEQ ID NO: 460728

SEQ ID NO: 673064 - RNA, 64 nt, Homo Sapiens; identical to SEQ ID NO: 460729

SEQ ID NO: 673065 - RNA, 64 nt, Homo Sapiens; identical to SEQ ID NO: 460730

SEQ ID NO: 673066 - RNA, 64 nt, Homo Sapiens; identical to SEQ ID NO: 460731

SEQ ID NO: 673067 - RNA, 64 nt, Homo Sapiens; identical to SEQ ID NO: 460732

SEQ ID NO: 673068 - RNA, 64 nt, Homo Sapiens
auagguaacccacaggcccagugccagcccucaaaggacauagacuuugaaacaagcgaauuaa

SEQ ID NO: 673069 - RNA, 64 nt, Homo Sapiens
acccaggaagggaugaucaggagaggcuucccugaggacauaauguguaagagaggugagaagu

SEQ ID NO: 673070 - RNA, 64 nt, Homo Sapiens
acgcucguugacuccgugggugaauacagcaguuaggacauacacaccaucaccuuugaaagug

SEQ ID NO: 673071 - RNA, 64 nt, Homo Sapiens
caucaccuuugaaagugcuuguuugggggagggaaggacauacggguaacuagaacuacccagc

SEQ ID NO: 673072 - RNA, 64 nt, Homo Sapiens; identical to SEQ ID NO: 284748

SEQ ID NO: 673073 - RNA, 64 nt, Homo Sapiens; identical to SEQ ID NO: 284749

SEQ ID NO: 673074 - RNA, 64 nt, Homo Sapiens; identical to SEQ ID NO: 284750

SEQ ID NO: 673075 - RNA, 64 nt, Homo Sapiens; identical to SEQ ID NO: 284751

SEQ ID NO: 673076 - RNA, 64 nt, Homo Sapiens; identical to SEQ ID NO: 284752

SEQ ID NO: 673077 - RNA, 64 nt, Homo Sapiens; identical to SEQ ID NO: 284753

SEQ ID NO: 673078 - RNA, 64 nt, Homo Sapiens; identical to SEQ ID NO: 284754

SEQ ID NO: 673079 - RNA, 64 nt, Homo Sapiens; identical to SEQ ID NO: 284755

SEQ ID NO: 673080 - RNA, 64 nt, Homo Sapiens; identical to SEQ ID NO: 284756

SEQ ID NO: 673081 - RNA, 64 nt, Homo Sapiens; identical to SEQ ID NO: 284757

SEQ ID NO: 673082 - RNA, 64 nt, Homo Sapiens; identical to SEQ ID NO: 284758

SEQ ID NO: 673083 - RNA, 64 nt, Homo Sapiens; identical to SEQ ID NO: 284759

SEQ ID NO: 673084 - RNA, 64 nt, Homo Sapiens; identical to SEQ ID NO: 284760

SEQ ID NO: 673085 - RNA, 64 nt, Homo Sapiens; identical to SEQ ID NO: 284761

SEQ ID NO: 673086 - RNA, 64 nt, Homo Sapiens; identical to SEQ ID NO: 284762

SEQ ID NO: 673087 - RNA, 64 nt, Homo Sapiens; identical to SEQ ID NO: 284763

SEQ ID NO: 673088 - RNA, 64 nt, Homo Sapiens; identical to SEQ ID NO: 284764

SEQ ID NO: 673089 - RNA, 64 nt, Homo Sapiens; identical to SEQ ID NO: 284765

SEQ ID NO: 673090 - RNA, 64 nt, Homo Sapiens; identical to SEQ ID NO: 284766

SEQ ID NO: 673091 - RNA, 64 nt, Homo Sapiens; identical to SEQ ID NO: 284767

SEQ ID NO: 673092 - RNA, 64 nt, Homo Sapiens; identical to SEQ ID NO: 284768

SEQ ID NO: 673093 - RNA, 64 nt, Homo Sapiens; identical to SEQ ID NO: 284769

SEQ ID NO: 673094 - RNA, 64 nt, Homo Sapiens; identical to SEQ ID NO: 284770

SEQ ID NO: 673095 - RNA, 64 nt, Homo Sapiens; identical to SEQ ID NO: 284771

SEQ ID NO: 673096 - RNA, 64 nt, Homo Sapiens; identical to SEQ ID NO: 284772

SEQ ID NO: 673097 - RNA, 64 nt, Homo Sapiens; identical to SEQ ID NO: 284773

SEQ ID NO: 673098 - RNA, 64 nt, Homo Sapiens; identical to SEQ ID NO: 284774

SEQ ID NO: 673099 - RNA, 64 nt, Homo Sapiens; identical to SEQ ID NO: 284775

SEQ ID NO: 673100 - RNA, 64 nt, Homo Sapiens; identical to SEQ ID NO: 284776

SEQ ID NO: 673101 - RNA, 64 nt, Homo Sapiens; identical to SEQ ID NO: 284777

SEQ ID NO: 673102 - RNA, 64 nt, Homo Sapiens; identical to SEQ ID NO: 284778

SEQ ID NO: 673103 - RNA, 64 nt, Homo Sapiens; identical to SEQ ID NO: 284779

SEQ ID NO: 673104 - RNA, 64 nt, Homo Sapiens; identical to SEQ ID NO: 284780

SEQ ID NO: 673105 - RNA, 64 nt, Homo Sapiens; identical to SEQ ID NO: 284781

SEQ ID NO: 673106 - RNA, 64 nt, Homo Sapiens; identical to SEQ ID NO: 284782

SEQ ID NO: 673107 - RNA, 64 nt, Homo Sapiens; identical to SEQ ID NO: 284783

SEQ ID NO: 673108 - RNA, 64 nt, Homo Sapiens; identical to SEQ ID NO: 284784

SEQ ID NO: 673109 - RNA, 64 nt, Homo Sapiens; identical to SEQ ID NO: 284785

SEQ ID NO: 673110 - RNA, 64 nt, Homo Sapiens; identical to SEQ ID NO: 284786

SEQ ID NO: 673111 - RNA, 64 nt, Homo Sapiens; identical to SEQ ID NO: 284787

SEQ ID NO: 673112 - RNA, 64 nt, Homo Sapiens; identical to SEQ ID NO: 284788

SEQ ID NO: 673113 - RNA, 64 nt, Homo Sapiens; identical to SEQ ID NO: 284789

SEQ ID NO: 673114 - RNA, 64 nt, Homo Sapiens; identical to SEQ ID NO: 284790

SEQ ID NO: 673115 - RNA, 64 nt, Homo Sapiens; identical to SEQ ID NO: 284791

SEQ ID NO: 673116 - RNA, 64 nt, Homo Sapiens; identical to SEQ ID NO: 284792

SEQ ID NO: 673117 - RNA, 64 nt, Homo Sapiens; identical to SEQ ID NO: 284793

SEQ ID NO: 673118 - RNA, 64 nt, Homo Sapiens; identical to SEQ ID NO: 284794

SEQ ID NO: 673119 - RNA, 64 nt, Homo Sapiens; identical to SEQ ID NO: 284795

SEQ ID NO: 673120 - RNA, 64 nt, Homo Sapiens; identical to SEQ ID NO: 284796

SEQ ID NO: 673121 - RNA, 64 nt, Homo Sapiens; identical to SEQ ID NO: 284797

SEQ ID NO: 673122 - RNA, 64 nt, Homo Sapiens; identical to SEQ ID NO: 284798

SEQ ID NO: 673123 - RNA, 64 nt, Homo Sapiens; identical to SEQ ID NO: 284799

SEQ ID NO: 673124 - RNA, 64 nt, Homo Sapiens; identical to SEQ ID NO: 284800

SEQ ID NO: 673125 - RNA, 64 nt, Homo Sapiens; identical to SEQ ID NO: 284801

SEQ ID NO: 673126 - RNA, 64 nt, Homo Sapiens; identical to SEQ ID NO: 284802

SEQ ID NO: 673127 - RNA, 64 nt, Homo Sapiens; identical to SEQ ID NO: 284803

SEQ ID NO: 673128 - RNA, 64 nt, Homo Sapiens; identical to SEQ ID NO: 284804

SEQ ID NO: 673129 - RNA, 64 nt, Homo Sapiens; identical to SEQ ID NO: 284805

SEQ ID NO: 673130 - RNA, 64 nt, Homo Sapiens; identical to SEQ ID NO: 284806

SEQ ID NO: 673131 - RNA, 64 nt, Homo Sapiens; identical to SEQ ID NO: 284807

SEQ ID NO: 673132 - RNA, 64 nt, Homo Sapiens; identical to SEQ ID NO: 284808

SEQ ID NO: 673133 - RNA, 64 nt, Homo Sapiens; identical to SEQ ID NO: 284809

SEQ ID NO: 673134 - RNA, 64 nt, Homo Sapiens; identical to SEQ ID NO: 284810

SEQ ID NO: 673135 - RNA, 64 nt, Homo Sapiens; identical to SEQ ID NO: 284811

SEQ ID NO: 673136 - RNA, 64 nt, Homo Sapiens; identical to SEQ ID NO: 284812

SEQ ID NO: 673137 - RNA, 64 nt, Homo Sapiens; identical to SEQ ID NO: 284813

SEQ ID NO: 673138 - RNA, 64 nt, Homo Sapiens; identical to SEQ ID NO: 284814

SEQ ID NO: 673139 - RNA, 64 nt, Homo Sapiens; identical to SEQ ID NO: 284815

SEQ ID NO: 673140 - RNA, 64 nt, Homo Sapiens; identical to SEQ ID NO: 284816

SEQ ID NO: 673141 - RNA, 64 nt, Homo Sapiens; identical to SEQ ID NO: 284817

SEQ ID NO: 673142 - RNA, 64 nt, Homo Sapiens; identical to SEQ ID NO: 284818

SEQ ID NO: 673143 - RNA, 64 nt, Homo Sapiens; identical to SEQ ID NO: 284819

SEQ ID NO: 673144 - RNA, 64 nt, Homo Sapiens; identical to SEQ ID NO: 284820

SEQ ID NO: 673145 - RNA, 64 nt, Homo Sapiens; identical to SEQ ID NO: 284821

SEQ ID NO: 673146 - RNA, 64 nt, Homo Sapiens; identical to SEQ ID NO: 284822

SEQ ID NO: 673147 - RNA, 64 nt, Homo Sapiens; identical to SEQ ID NO: 284823

SEQ ID NO: 673148 - RNA, 64 nt, Homo Sapiens; identical to SEQ ID NO: 284824

SEQ ID NO: 673149 - RNA, 57 nt, Homo Sapiens; identical to SEQ ID NO: 284825

SEQ ID NO: 673150 - RNA, 52 nt, Homo Sapiens; identical to SEQ ID NO: 284826

SEQ ID NO: 673151 - RNA, 64 nt, Homo Sapiens; identical to SEQ ID NO: 284827

SEQ ID NO: 673152 - RNA, 64 nt, Homo Sapiens; identical to SEQ ID NO: 284828

SEQ ID NO: 673153 - RNA, 64 nt, Homo Sapiens; identical to SEQ ID NO: 284829

SEQ ID NO: 673154 - RNA, 64 nt, Homo Sapiens; identical to SEQ ID NO: 284830

SEQ ID NO: 673155 - RNA, 64 nt, Homo Sapiens; identical to SEQ ID NO: 284831

SEQ ID NO: 673156 - RNA, 64 nt, Homo Sapiens; identical to SEQ ID NO: 284832

SEQ ID NO: 673157 - RNA, 64 nt, Homo Sapiens; identical to SEQ ID NO: 284833

SEQ ID NO: 673158 - RNA, 64 nt, Homo Sapiens; identical to SEQ ID NO: 284834

SEQ ID NO: 673159 - RNA, 64 nt, Homo Sapiens; identical to SEQ ID NO: 284835

SEQ ID NO: 673160 - RNA, 64 nt, Homo Sapiens; identical to SEQ ID NO: 284836

SEQ ID NO: 673161 - RNA, 64 nt, Homo Sapiens; identical to SEQ ID NO: 284837

SEQ ID NO: 673162 - RNA, 64 nt, Homo Sapiens; identical to SEQ ID NO: 284838

SEQ ID NO: 673163 - RNA, 64 nt, Homo Sapiens; identical to SEQ ID NO: 284839

SEQ ID NO: 673164 - RNA, 64 nt, Homo Sapiens; identical to SEQ ID NO: 284840

SEQ ID NO: 673165 - RNA, 64 nt, Homo Sapiens; identical to SEQ ID NO: 552939

SEQ ID NO: 673166 - RNA, 64 nt, Homo Sapiens; identical to SEQ ID NO: 552940

SEQ ID NO: 673167 - RNA, 64 nt, Homo Sapiens; identical to SEQ ID NO: 552941

SEQ ID NO: 673168 - RNA, 64 nt, Homo Sapiens; identical to SEQ ID NO: 552942

SEQ ID NO: 673169 - RNA, 64 nt, Homo Sapiens; identical to SEQ ID NO: 552943

SEQ ID NO: 673170 - RNA, 64 nt, Homo Sapiens; identical to SEQ ID NO: 552944

SEQ ID NO: 673171 - RNA, 64 nt, Homo Sapiens; identical to SEQ ID NO: 552945

SEQ ID NO: 673172 - RNA, 64 nt, Homo Sapiens; identical to SEQ ID NO: 552946

SEQ ID NO: 673173 - RNA, 64 nt, Homo Sapiens; identical to SEQ ID NO: 552947

SEQ ID NO: 673174 - RNA, 64 nt, Homo Sapiens; identical to SEQ ID NO: 552948

SEQ ID NO: 673175 - RNA, 64 nt, Homo Sapiens; identical to SEQ ID NO: 552949

SEQ ID NO: 673176 - RNA, 64 nt, Homo Sapiens; identical to SEQ ID NO: 552950

SEQ ID NO: 673177 - RNA, 64 nt, Homo Sapiens; identical to SEQ ID NO: 552951

SEQ ID NO: 673178 - RNA, 64 nt, Homo Sapiens; identical to SEQ ID NO: 552952

SEQ ID NO: 673179 - RNA, 64 nt, Homo Sapiens; identical to SEQ ID NO: 552953

SEQ ID NO: 673180 - RNA, 64 nt, Homo Sapiens; identical to SEQ ID NO: 552954

SEQ ID NO: 673181 - RNA, 64 nt, Homo Sapiens; identical to SEQ ID NO: 552955

SEQ ID NO: 673182 - RNA, 64 nt, Homo Sapiens; identical to SEQ ID NO: 552956

SEQ ID NO: 673183 - RNA, 64 nt, Homo Sapiens; identical to SEQ ID NO: 552957

SEQ ID NO: 673184 - RNA, 64 nt, Homo Sapiens; identical to SEQ ID NO: 552958

SEQ ID NO: 673185 - RNA, 64 nt, Homo Sapiens; identical to SEQ ID NO: 552959

SEQ ID NO: 673186 - RNA, 64 nt, Homo Sapiens; identical to SEQ ID NO: 552960

SEQ ID NO: 673187 - RNA, 64 nt, Homo Sapiens; identical to SEQ ID NO: 552961

SEQ ID NO: 673188 - RNA, 64 nt, Homo Sapiens; identical to SEQ ID NO: 552962

SEQ ID NO: 673189 - RNA, 64 nt, Homo Sapiens; identical to SEQ ID NO: 552963

SEQ ID NO: 673190 - RNA, 64 nt, Homo Sapiens; identical to SEQ ID NO: 552964

SEQ ID NO: 673191 - RNA, 64 nt, Homo Sapiens; identical to SEQ ID NO: 552965

SEQ ID NO: 673192 - RNA, 64 nt, Homo Sapiens; identical to SEQ ID NO: 552966

SEQ ID NO: 673193 - RNA, 64 nt, Homo Sapiens; identical to SEQ ID NO: 552967

SEQ ID NO: 673194 - RNA, 64 nt, Homo Sapiens; identical to SEQ ID NO: 552968

SEQ ID NO: 673195 - RNA, 64 nt, Homo Sapiens; identical to SEQ ID NO: 552969

SEQ ID NO: 673196 - RNA, 64 nt, Homo Sapiens; identical to SEQ ID NO: 552970

SEQ ID NO: 673197 - RNA, 64 nt, Homo Sapiens; identical to SEQ ID NO: 552971

SEQ ID NO: 673198 - RNA, 64 nt, Homo Sapiens; identical to SEQ ID NO: 552972

SEQ ID NO: 673199 - RNA, 64 nt, Homo Sapiens; identical to SEQ ID NO: 552973

SEQ ID NO: 673200 - RNA, 64 nt, Homo Sapiens; identical to SEQ ID NO: 552974

SEQ ID NO: 673201 - RNA, 64 nt, Homo Sapiens; identical to SEQ ID NO: 552975

SEQ ID NO: 673202 - RNA, 64 nt, Homo Sapiens; identical to SEQ ID NO: 552976

SEQ ID NO: 673203 - RNA, 64 nt, Homo Sapiens; identical to SEQ ID NO: 552977

SEQ ID NO: 673204 - RNA, 64 nt, Homo Sapiens; identical to SEQ ID NO: 552978

SEQ ID NO: 673205 - RNA, 64 nt, Homo Sapiens; identical to SEQ ID NO: 552979

SEQ ID NO: 673206 - RNA, 64 nt, Homo Sapiens; identical to SEQ ID NO: 552980

SEQ ID NO: 673207 - RNA, 64 nt, Homo Sapiens; identical to SEQ ID NO: 552981

SEQ ID NO: 673208 - RNA, 64 nt, Homo Sapiens; identical to SEQ ID NO: 552982

SEQ ID NO: 673209 - RNA, 64 nt, Homo Sapiens; identical to SEQ ID NO: 552983

SEQ ID NO: 673210 - RNA, 64 nt, Homo Sapiens; identical to SEQ ID NO: 552984

SEQ ID NO: 673211 - RNA, 64 nt, Homo Sapiens; identical to SEQ ID NO: 552985

SEQ ID NO: 673212 - RNA, 64 nt, Homo Sapiens; identical to SEQ ID NO: 552986

SEQ ID NO: 673213 - RNA, 64 nt, Homo Sapiens; identical to SEQ ID NO: 552987

SEQ ID NO: 673214 - RNA, 64 nt, Homo Sapiens; identical to SEQ ID NO: 552988

SEQ ID NO: 673215 - RNA, 64 nt, Homo Sapiens; identical to SEQ ID NO: 552989

SEQ ID NO: 673216 - RNA, 64 nt, Homo Sapiens; identical to SEQ ID NO: 552990

SEQ ID NO: 673217 - RNA, 64 nt, Homo Sapiens; identical to SEQ ID NO: 552991

SEQ ID NO: 673218 - RNA, 64 nt, Homo Sapiens; identical to SEQ ID NO: 552992

SEQ ID NO: 673219 - RNA, 64 nt, Homo Sapiens; identical to SEQ ID NO: 552993

SEQ ID NO: 673220 - RNA, 64 nt, Homo Sapiens; identical to SEQ ID NO: 552994

SEQ ID NO: 673221 - RNA, 64 nt, Homo Sapiens; identical to SEQ ID NO: 552995

SEQ ID NO: 673222 - RNA, 64 nt, Homo Sapiens; identical to SEQ ID NO: 552996

SEQ ID NO: 673223 - RNA, 64 nt, Homo Sapiens; identical to SEQ ID NO: 552997

SEQ ID NO: 673224 - RNA, 64 nt, Homo Sapiens; identical to SEQ ID NO: 552998

SEQ ID NO: 673225 - RNA, 64 nt, Homo Sapiens; identical to SEQ ID NO: 552999

SEQ ID NO: 673226 - RNA, 64 nt, Homo Sapiens; identical to SEQ ID NO: 553000

SEQ ID NO: 673227 - RNA, 64 nt, Homo Sapiens; identical to SEQ ID NO: 553001

SEQ ID NO: 673228 - RNA, 64 nt, Homo Sapiens; identical to SEQ ID NO: 553002

SEQ ID NO: 673229 - RNA, 64 nt, Homo Sapiens; identical to SEQ ID NO: 553003

SEQ ID NO: 673230 - RNA, 64 nt, Homo Sapiens; identical to SEQ ID NO: 553004

SEQ ID NO: 673231 - RNA, 64 nt, Homo Sapiens; identical to SEQ ID NO: 553005

SEQ ID NO: 673232 - RNA, 64 nt, Homo Sapiens; identical to SEQ ID NO: 553006

SEQ ID NO: 673233 - RNA, 64 nt, Homo Sapiens; identical to SEQ ID NO: 553007

SEQ ID NO: 673234 - RNA, 64 nt, Homo Sapiens; identical to SEQ ID NO: 553008

SEQ ID NO: 673235 - RNA, 64 nt, Homo Sapiens; identical to SEQ ID NO: 553009

SEQ ID NO: 673236 - RNA, 64 nt, Homo Sapiens
gaucacaucacuguacuccagccugggugacaaaaugagacauugucucuaaaauacauaagua

SEQ ID NO: 673237 - RNA, 64 nt, Homo Sapiens
cuuaauaauagagcaccagaaaaauuucuaccaaaugagacaacaacuuuaggauaaguucauc

SEQ ID NO: 673238 - RNA, 64 nt, Homo Sapiens
aguagucaguugguuuucaguuaaauacaccaacaugagacaucuucaagauucaaaaagaauu

SEQ ID NO: 673239 - RNA, 64 nt, Homo Sapiens
gucagaaacagugcuuggaauucuggaauaccacaugagacaugacacaguauaacugaugcuc

SEQ ID NO: 673240 - RNA, 64 nt, Homo Sapiens
cugcacugcgccuggugaaagcgcccacaugggcaugagacaguucuguacaggaagcauccca

SEQ ID NO: 673241 - RNA, 64 nt, Homo Sapiens
uguacaggaagcaucccagcguguaacugaaggcaugagacauccuguaaacaggaacaccuau

SEQ ID NO: 673242 - RNA, 64 nt, Homo Sapiens
cauuuuaaguuuuaagauaaaucauuuauuuuaaaugagacaaugacaaucauauuauuuuaga

SEQ ID NO: 673243 - RNA, 64 nt, Homo Sapiens
cauauuauuuuagaaucauucauuuacuauuuaaaugagacaaugauauacauuauuuuagaau

SEQ ID NO: 673244 - RNA, 63 nt, Homo Sapiens
gcaggcaaaauggacucuaguccacuuccucccaugagacagagugauggccagcuuggggac

SEQ ID NO: 673245 - RNA, 64 nt, Homo Sapiens
gauuuucccucaaaucuaucuagauuauuuuaagaugagacaagauuauugucaaucccugaau

SEQ ID NO: 673246 - RNA, 64 nt, Homo Sapiens
aaacuccuuguuauccuuguuuccuuagcuugguaugagacagaucggauccaguuucccaugc

SEQ ID NO: 673247 - RNA, 64 nt, Homo Sapiens
cuaaaaaugcaucuggcuacuuuuucauguauguaugagacagaaacuaauccuuacuauccua

SEQ ID NO: 673248 - RNA, 64 nt, Homo Sapiens
uaaaaggucaguaugaacuaccaugagacacaaaaugagacaguaauuuuggcugaucuagaua

SEQ ID NO: 673249 - RNA, 60 nt, Homo Sapiens
aaaugagacaguuaaaagguucuagauaccaugagacacaaaggacagaauuuuggcuga

SEQ ID NO: 673250 - RNA, 64 nt, Homo Sapiens
gacagaaacccuaccuaucuuucaacugauuuccaugagacaauacgaucuuucucuaguuuca

SEQ ID NO: 673251 - RNA, 64 nt, Homo Sapiens
uuuccaggaguagaaggguuuugggagcuuuuagaugagacaucguaccuuguucuggucacug

SEQ ID NO: 673252 - RNA, 64 nt, Homo Sapiens
ucugggcuccaagccaggaauaguuacucugcucaugagacagacauccgagaagccuccucag

SEQ ID NO: 673253 - RNA, 64 nt, Homo Sapiens
cacuggcugaagacaggcaaagucccgcccacauaugagacaggcucgcugccaggcugcucag

SEQ ID NO: 673254 - RNA, 64 nt, Homo Sapiens
gaaaacauacuaaugggggucuuucugugaugugaugagacauacauguaaguguauauaugug

SEQ ID NO: 673255 - RNA, 64 nt, Homo Sapiens
uugaauaucuccugcgguguauauuaacaucuugaugagacagauuuccaggcaacaaaauaau

SEQ ID NO: 673256 - RNA, 64 nt, Homo Sapiens; identical to SEQ ID NO: 146515

SEQ ID NO: 673257 - RNA, 64 nt, Homo Sapiens; identical to SEQ ID NO: 146516

SEQ ID NO: 673258 - RNA, 64 nt, Homo Sapiens; identical to SEQ ID NO: 146517

SEQ ID NO: 673259 - RNA, 64 nt, Homo Sapiens; identical to SEQ ID NO: 146518

SEQ ID NO: 673260 - RNA, 64 nt, Homo Sapiens; identical to SEQ ID NO: 146519

SEQ ID NO: 673261 - RNA, 64 nt, Homo Sapiens; identical to SEQ ID NO: 146520

SEQ ID NO: 673262 - RNA, 64 nt, Homo Sapiens; identical to SEQ ID NO: 146521

SEQ ID NO: 673263 - RNA, 64 nt, Homo Sapiens; identical to SEQ ID NO: 146522

SEQ ID NO: 673264 - RNA, 64 nt, Homo Sapiens; identical to SEQ ID NO: 146523

SEQ ID NO: 673265 - RNA, 64 nt, Homo Sapiens; identical to SEQ ID NO: 146524

SEQ ID NO: 673266 - RNA, 64 nt, Homo Sapiens; identical to SEQ ID NO: 146525

SEQ ID NO: 673267 - RNA, 64 nt, Homo Sapiens; identical to SEQ ID NO: 146526

SEQ ID NO: 673268 - RNA, 64 nt, Homo Sapiens; identical to SEQ ID NO: 146527

SEQ ID NO: 673269 - RNA, 64 nt, Homo Sapiens; identical to SEQ ID NO: 146528

SEQ ID NO: 673270 - RNA, 64 nt, Homo Sapiens; identical to SEQ ID NO: 146529

SEQ ID NO: 673271 - RNA, 64 nt, Homo Sapiens; identical to SEQ ID NO: 146530

SEQ ID NO: 673272 - RNA, 64 nt, Homo Sapiens; identical to SEQ ID NO: 146531

SEQ ID NO: 673273 - RNA, 64 nt, Homo Sapiens; identical to SEQ ID NO: 146532

SEQ ID NO: 673274 - RNA, 64 nt, Homo Sapiens; identical to SEQ ID NO: 146533

SEQ ID NO: 673275 - RNA, 64 nt, Homo Sapiens; identical to SEQ ID NO: 146534

SEQ ID NO: 673276 - RNA, 64 nt, Homo Sapiens; identical to SEQ ID NO: 146535

SEQ ID NO: 673277 - RNA, 64 nt, Homo Sapiens; identical to SEQ ID NO: 146536

SEQ ID NO: 673278 - RNA, 64 nt, Homo Sapiens; identical to SEQ ID NO: 146537

SEQ ID NO: 673279 - RNA, 64 nt, Homo Sapiens; identical to SEQ ID NO: 146538

SEQ ID NO: 673280 - RNA, 64 nt, Homo Sapiens; identical to SEQ ID NO: 146539

SEQ ID NO: 673281 - RNA, 64 nt, Homo Sapiens; identical to SEQ ID NO: 146540

SEQ ID NO: 673282 - RNA, 64 nt, Homo Sapiens; identical to SEQ ID NO: 146541

SEQ ID NO: 673283 - RNA, 64 nt, Homo Sapiens; identical to SEQ ID NO: 146542

SEQ ID NO: 673284 - RNA, 64 nt, Homo Sapiens; identical to SEQ ID NO: 146543

SEQ ID NO: 673285 - RNA, 64 nt, Homo Sapiens; identical to SEQ ID NO: 146544

SEQ ID NO: 673286 - RNA, 64 nt, Homo Sapiens; identical to SEQ ID NO: 146545

SEQ ID NO: 673287 - RNA, 64 nt, Homo Sapiens; identical to SEQ ID NO: 146546

SEQ ID NO: 673288 - RNA, 64 nt, Homo Sapiens; identical to SEQ ID NO: 146547

SEQ ID NO: 673289 - RNA, 64 nt, Homo Sapiens; identical to SEQ ID NO: 146548

SEQ ID NO: 673290 - RNA, 64 nt, Homo Sapiens; identical to SEQ ID NO: 146549

SEQ ID NO: 673291 - RNA, 64 nt, Homo Sapiens; identical to SEQ ID NO: 146550

SEQ ID NO: 673292 - RNA, 64 nt, Homo Sapiens; identical to SEQ ID NO: 146551

SEQ ID NO: 673293 - RNA, 64 nt, Homo Sapiens; identical to SEQ ID NO: 146552

SEQ ID NO: 673294 - RNA, 64 nt, Homo Sapiens; identical to SEQ ID NO: 146553

SEQ ID NO: 673295 - RNA, 64 nt, Homo Sapiens; identical to SEQ ID NO: 146554

SEQ ID NO: 673296 - RNA, 64 nt, Homo Sapiens; identical to SEQ ID NO: 146555

SEQ ID NO: 673297 - RNA, 64 nt, Homo Sapiens; identical to SEQ ID NO: 146556

SEQ ID NO: 673298 - RNA, 64 nt, Homo Sapiens; identical to SEQ ID NO: 146557

SEQ ID NO: 673299 - RNA, 64 nt, Homo Sapiens; identical to SEQ ID NO: 146558

SEQ ID NO: 673300 - RNA, 64 nt, Homo Sapiens; identical to SEQ ID NO: 146559

SEQ ID NO: 673301 - RNA, 64 nt, Homo Sapiens; identical to SEQ ID NO: 146560

SEQ ID NO: 673302 - RNA, 64 nt, Homo Sapiens; identical to SEQ ID NO: 146561

SEQ ID NO: 673303 - RNA, 64 nt, Homo Sapiens; identical to SEQ ID NO: 146562

SEQ ID NO: 673304 - RNA, 64 nt, Homo Sapiens; identical to SEQ ID NO: 146563

SEQ ID NO: 673305 - RNA, 64 nt, Homo Sapiens; identical to SEQ ID NO: 146564

SEQ ID NO: 673306 - RNA, 64 nt, Homo Sapiens; identical to SEQ ID NO: 146565

SEQ ID NO: 673307 - RNA, 64 nt, Homo Sapiens; identical to SEQ ID NO: 146566

SEQ ID NO: 673308 - RNA, 64 nt, Homo Sapiens; identical to SEQ ID NO: 146567

SEQ ID NO: 673309 - RNA, 64 nt, Homo Sapiens; identical to SEQ ID NO: 146568

SEQ ID NO: 673310 - RNA, 64 nt, Homo Sapiens; identical to SEQ ID NO: 146569

SEQ ID NO: 673311 - RNA, 64 nt, Homo Sapiens; identical to SEQ ID NO: 146570

SEQ ID NO: 673312 - RNA, 64 nt, Homo Sapiens; identical to SEQ ID NO: 146571

SEQ ID NO: 673313 - RNA, 64 nt, Homo Sapiens; identical to SEQ ID NO: 146572

SEQ ID NO: 673314 - RNA, 64 nt, Homo Sapiens; identical to SEQ ID NO: 146573

SEQ ID NO: 673315 - RNA, 64 nt, Homo Sapiens; identical to SEQ ID NO: 146574

SEQ ID NO: 673316 - RNA, 64 nt, Homo Sapiens; identical to SEQ ID NO: 146575

SEQ ID NO: 673317 - RNA, 64 nt, Homo Sapiens; identical to SEQ ID NO: 146576

SEQ ID NO: 673318 - RNA, 64 nt, Homo Sapiens; identical to SEQ ID NO: 146577

SEQ ID NO: 673319 - RNA, 64 nt, Homo Sapiens; identical to SEQ ID NO: 146578

SEQ ID NO: 673320 - RNA, 64 nt, Homo Sapiens; identical to SEQ ID NO: 146579

SEQ ID NO: 673321 - RNA, 64 nt, Homo Sapiens; identical to SEQ ID NO: 146580

SEQ ID NO: 673322 - RNA, 64 nt, Homo Sapiens; identical to SEQ ID NO: 146581

SEQ ID NO: 673323 - RNA, 64 nt, Homo Sapiens; identical to SEQ ID NO: 146582

SEQ ID NO: 673324 - RNA, 64 nt, Homo Sapiens; identical to SEQ ID NO: 146583

SEQ ID NO: 673325 - RNA, 64 nt, Homo Sapiens; identical to SEQ ID NO: 146584

SEQ ID NO: 673326 - RNA, 64 nt, Homo Sapiens; identical to SEQ ID NO: 146585

SEQ ID NO: 673327 - RNA, 64 nt, Homo Sapiens; identical to SEQ ID NO: 146586

SEQ ID NO: 673328 - RNA, 64 nt, Homo Sapiens; identical to SEQ ID NO: 146587

SEQ ID NO: 673329 - RNA, 64 nt, Homo Sapiens; identical to SEQ ID NO: 146588

SEQ ID NO: 673330 - RNA, 64 nt, Homo Sapiens; identical to SEQ ID NO: 146589

SEQ ID NO: 673331 - RNA, 64 nt, Homo Sapiens; identical to SEQ ID NO: 146590

SEQ ID NO: 673332 - RNA, 64 nt, Homo Sapiens; identical to SEQ ID NO: 146591

SEQ ID NO: 673333 - RNA, 64 nt, Homo Sapiens; identical to SEQ ID NO: 146592

SEQ ID NO: 673334 - RNA, 64 nt, Homo Sapiens; identical to SEQ ID NO: 146593

SEQ ID NO: 673335 - RNA, 64 nt, Homo Sapiens; identical to SEQ ID NO: 146594

SEQ ID NO: 673336 - RNA, 64 nt, Homo Sapiens; identical to SEQ ID NO: 146595

SEQ ID NO: 673337 - RNA, 64 nt, Homo Sapiens; identical to SEQ ID NO: 146596

SEQ ID NO: 673338 - RNA, 64 nt, Homo Sapiens; identical to SEQ ID NO: 146597

SEQ ID NO: 673339 - RNA, 64 nt, Homo Sapiens; identical to SEQ ID NO: 146598

SEQ ID NO: 673340 - RNA, 64 nt, Homo Sapiens; identical to SEQ ID NO: 146599

SEQ ID NO: 673341 - RNA, 64 nt, Homo Sapiens; identical to SEQ ID NO: 146600

SEQ ID NO: 673342 - RNA, 64 nt, Homo Sapiens; identical to SEQ ID NO: 146601

SEQ ID NO: 673343 - RNA, 64 nt, Homo Sapiens; identical to SEQ ID NO: 146602

SEQ ID NO: 673344 - RNA, 64 nt, Homo Sapiens; identical to SEQ ID NO: 146603

SEQ ID NO: 673345 - RNA, 64 nt, Homo Sapiens; identical to SEQ ID NO: 146604

SEQ ID NO: 673346 - RNA, 64 nt, Homo Sapiens; identical to SEQ ID NO: 146605

SEQ ID NO: 673347 - RNA, 64 nt, Homo Sapiens; identical to SEQ ID NO: 146606

SEQ ID NO: 673348 - RNA, 64 nt, Homo Sapiens; identical to SEQ ID NO: 146607

SEQ ID NO: 673349 - RNA, 64 nt, Homo Sapiens; identical to SEQ ID NO: 146608

SEQ ID NO: 673350 - RNA, 64 nt, Homo Sapiens; identical to SEQ ID NO: 146609

SEQ ID NO: 673351 - RNA, 64 nt, Homo Sapiens; identical to SEQ ID NO: 146610

SEQ ID NO: 673352 - RNA, 64 nt, Homo Sapiens; identical to SEQ ID NO: 146611

SEQ ID NO: 673353 - RNA, 64 nt, Homo Sapiens; identical to SEQ ID NO: 146612

SEQ ID NO: 673354 - RNA, 64 nt, Homo Sapiens; identical to SEQ ID NO: 146613

SEQ ID NO: 673355 - RNA, 64 nt, Homo Sapiens; identical to SEQ ID NO: 146614

SEQ ID NO: 673356 - RNA, 64 nt, Homo Sapiens; identical to SEQ ID NO: 146615

SEQ ID NO: 673357 - RNA, 64 nt, Homo Sapiens; identical to SEQ ID NO: 146616

SEQ ID NO: 673358 - RNA, 64 nt, Homo Sapiens; identical to SEQ ID NO: 146617

SEQ ID NO: 673359 - RNA, 64 nt, Homo Sapiens; identical to SEQ ID NO: 146618

SEQ ID NO: 673360 - RNA, 64 nt, Homo Sapiens; identical to SEQ ID NO: 146619

SEQ ID NO: 673361 - RNA, 64 nt, Homo Sapiens; identical to SEQ ID NO: 146620

SEQ ID NO: 673362 - RNA, 64 nt, Homo Sapiens; identical to SEQ ID NO: 146621

SEQ ID NO: 673363 - RNA, 64 nt, Homo Sapiens; identical to SEQ ID NO: 146622

SEQ ID NO: 673364 - RNA, 64 nt, Homo Sapiens; identical to SEQ ID NO: 146623

SEQ ID NO: 673365 - RNA, 64 nt, Homo Sapiens; identical to SEQ ID NO: 146624

SEQ ID NO: 673366 - RNA, 64 nt, Homo Sapiens; identical to SEQ ID NO: 146625

SEQ ID NO: 673367 - RNA, 64 nt, Homo Sapiens; identical to SEQ ID NO: 146626

SEQ ID NO: 673368 - RNA, 64 nt, Homo Sapiens; identical to SEQ ID NO: 146627

SEQ ID NO: 673369 - RNA, 64 nt, Homo Sapiens; identical to SEQ ID NO: 146628

SEQ ID NO: 673370 - RNA, 64 nt, Homo Sapiens; identical to SEQ ID NO: 146629

SEQ ID NO: 673371 - RNA, 64 nt, Homo Sapiens; identical to SEQ ID NO: 146630

SEQ ID NO: 673372 - RNA, 64 nt, Homo Sapiens; identical to SEQ ID NO: 146631

SEQ ID NO: 673373 - RNA, 64 nt, Homo Sapiens; identical to SEQ ID NO: 146632

SEQ ID NO: 673374 - RNA, 64 nt, Homo Sapiens; identical to SEQ ID NO: 146633

SEQ ID NO: 673375 - RNA, 64 nt, Homo Sapiens; identical to SEQ ID NO: 146634

SEQ ID NO: 673376 - RNA, 64 nt, Homo Sapiens; identical to SEQ ID NO: 146635

SEQ ID NO: 673377 - RNA, 64 nt, Homo Sapiens; identical to SEQ ID NO: 146636

SEQ ID NO: 673378 - RNA, 64 nt, Homo Sapiens; identical to SEQ ID NO: 146637

SEQ ID NO: 673379 - RNA, 64 nt, Homo Sapiens; identical to SEQ ID NO: 146638

SEQ ID NO: 673380 - RNA, 64 nt, Homo Sapiens; identical to SEQ ID NO: 146639

SEQ ID NO: 673381 - RNA, 64 nt, Homo Sapiens; identical to SEQ ID NO: 146640

SEQ ID NO: 673382 - RNA, 64 nt, Homo Sapiens; identical to SEQ ID NO: 146641

SEQ ID NO: 673383 - RNA, 64 nt, Homo Sapiens; identical to SEQ ID NO: 146642

SEQ ID NO: 673384 - RNA, 64 nt, Homo Sapiens; identical to SEQ ID NO: 146643

SEQ ID NO: 673385 - RNA, 64 nt, Homo Sapiens; identical to SEQ ID NO: 146644

SEQ ID NO: 673386 - RNA, 64 nt, Homo Sapiens; identical to SEQ ID NO: 146645

SEQ ID NO: 673387 - RNA, 64 nt, Homo Sapiens; identical to SEQ ID NO: 146646

SEQ ID NO: 673388 - RNA, 64 nt, Homo Sapiens; identical to SEQ ID NO: 146647

SEQ ID NO: 673389 - RNA, 64 nt, Homo Sapiens; identical to SEQ ID NO: 146648

SEQ ID NO: 673390 - RNA, 64 nt, Homo Sapiens; identical to SEQ ID NO: 146649

SEQ ID NO: 673391 - RNA, 64 nt, Homo Sapiens; identical to SEQ ID NO: 146650

SEQ ID NO: 673392 - RNA, 64 nt, Homo Sapiens; identical to SEQ ID NO: 146651

SEQ ID NO: 673393 - RNA, 64 nt, Homo Sapiens; identical to SEQ ID NO: 146652

SEQ ID NO: 673394 - RNA, 64 nt, Homo Sapiens; identical to SEQ ID NO: 146653

SEQ ID NO: 673395 - RNA, 64 nt, Homo Sapiens; identical to SEQ ID NO: 146654

SEQ ID NO: 673396 - RNA, 64 nt, Homo Sapiens; identical to SEQ ID NO: 146655

SEQ ID NO: 673397 - RNA, 64 nt, Homo Sapiens; identical to SEQ ID NO: 146656

SEQ ID NO: 673398 - RNA, 64 nt, Homo Sapiens; identical to SEQ ID NO: 146657

SEQ ID NO: 673399 - RNA, 64 nt, Homo Sapiens; identical to SEQ ID NO: 146658

SEQ ID NO: 673400 - RNA, 64 nt, Homo Sapiens; identical to SEQ ID NO: 146659

SEQ ID NO: 673401 - RNA, 64 nt, Homo Sapiens; identical to SEQ ID NO: 146660

SEQ ID NO: 673402 - RNA, 64 nt, Homo Sapiens; identical to SEQ ID NO: 146661

SEQ ID NO: 673403 - RNA, 64 nt, Homo Sapiens; identical to SEQ ID NO: 146662

SEQ ID NO: 673404 - RNA, 64 nt, Homo Sapiens; identical to SEQ ID NO: 146663

SEQ ID NO: 673405 - RNA, 64 nt, Homo Sapiens; identical to SEQ ID NO: 146664

SEQ ID NO: 673406 - RNA, 64 nt, Homo Sapiens; identical to SEQ ID NO: 146665

SEQ ID NO: 673407 - RNA, 64 nt, Homo Sapiens; identical to SEQ ID NO: 146666

SEQ ID NO: 673408 - RNA, 64 nt, Homo Sapiens; identical to SEQ ID NO: 146667

SEQ ID NO: 673409 - RNA, 64 nt, Homo Sapiens; identical to SEQ ID NO: 146668

SEQ ID NO: 673410 - RNA, 64 nt, Homo Sapiens; identical to SEQ ID NO: 146669

SEQ ID NO: 673411 - RNA, 64 nt, Homo Sapiens; identical to SEQ ID NO: 146670

SEQ ID NO: 673412 - RNA, 64 nt, Homo Sapiens; identical to SEQ ID NO: 146671

SEQ ID NO: 673413 - RNA, 64 nt, Homo Sapiens; identical to SEQ ID NO: 146672

SEQ ID NO: 673414 - RNA, 64 nt, Homo Sapiens; identical to SEQ ID NO: 146673

SEQ ID NO: 673415 - RNA, 64 nt, Homo Sapiens; identical to SEQ ID NO: 146674

SEQ ID NO: 673416 - RNA, 64 nt, Homo Sapiens; identical to SEQ ID NO: 146675

SEQ ID NO: 673417 - RNA, 64 nt, Homo Sapiens; identical to SEQ ID NO: 146676

SEQ ID NO: 673418 - RNA, 64 nt, Homo Sapiens; identical to SEQ ID NO: 146677

SEQ ID NO: 673419 - RNA, 64 nt, Homo Sapiens; identical to SEQ ID NO: 146678

SEQ ID NO: 673420 - RNA, 64 nt, Homo Sapiens; identical to SEQ ID NO: 146679

SEQ ID NO: 673421 - RNA, 64 nt, Homo Sapiens; identical to SEQ ID NO: 146680

SEQ ID NO: 673422 - RNA, 64 nt, Homo Sapiens; identical to SEQ ID NO: 146681

SEQ ID NO: 673423 - RNA, 64 nt, Homo Sapiens; identical to SEQ ID NO: 146682

SEQ ID NO: 673424 - RNA, 64 nt, Homo Sapiens; identical to SEQ ID NO: 146683

SEQ ID NO: 673425 - RNA, 64 nt, Homo Sapiens; identical to SEQ ID NO: 146684

SEQ ID NO: 673426 - RNA, 64 nt, Homo Sapiens; identical to SEQ ID NO: 146685

SEQ ID NO: 673427 - RNA, 64 nt, Homo Sapiens; identical to SEQ ID NO: 146686

SEQ ID NO: 673428 - RNA, 64 nt, Homo Sapiens; identical to SEQ ID NO: 146687

SEQ ID NO: 673429 - RNA, 64 nt, Homo Sapiens; identical to SEQ ID NO: 294192

SEQ ID NO: 673430 - RNA, 64 nt, Homo Sapiens; identical to SEQ ID NO: 294193

SEQ ID NO: 673431 - RNA, 64 nt, Homo Sapiens; identical to SEQ ID NO: 294194

SEQ ID NO: 673432 - RNA, 64 nt, Homo Sapiens; identical to SEQ ID NO: 294195

SEQ ID NO: 673433 - RNA, 64 nt, Homo Sapiens; identical to SEQ ID NO: 146515

SEQ ID NO: 673434 - RNA, 64 nt, Homo Sapiens; identical to SEQ ID NO: 146516

SEQ ID NO: 673435 - RNA, 64 nt, Homo Sapiens; identical to SEQ ID NO: 146517

SEQ ID NO: 673436 - RNA, 64 nt, Homo Sapiens; identical to SEQ ID NO: 146518

SEQ ID NO: 673437 - RNA, 64 nt, Homo Sapiens; identical to SEQ ID NO: 146519

SEQ ID NO: 673438 - RNA, 64 nt, Homo Sapiens; identical to SEQ ID NO: 146520

SEQ ID NO: 673439 - RNA, 64 nt, Homo Sapiens; identical to SEQ ID NO: 146521

SEQ ID NO: 673440 - RNA, 64 nt, Homo Sapiens; identical to SEQ ID NO: 146522

SEQ ID NO: 673441 - RNA, 64 nt, Homo Sapiens; identical to SEQ ID NO: 146523

SEQ ID NO: 673442 - RNA, 64 nt, Homo Sapiens; identical to SEQ ID NO: 146524

SEQ ID NO: 673443 - RNA, 64 nt, Homo Sapiens; identical to SEQ ID NO: 146525

SEQ ID NO: 673444 - RNA, 64 nt, Homo Sapiens; identical to SEQ ID NO: 146526

SEQ ID NO: 673445 - RNA, 64 nt, Homo Sapiens; identical to SEQ ID NO: 146527

SEQ ID NO: 673446 - RNA, 64 nt, Homo Sapiens; identical to SEQ ID NO: 146528

SEQ ID NO: 673447 - RNA, 64 nt, Homo Sapiens; identical to SEQ ID NO: 146529

SEQ ID NO: 673448 - RNA, 64 nt, Homo Sapiens; identical to SEQ ID NO: 146530

SEQ ID NO: 673449 - RNA, 64 nt, Homo Sapiens; identical to SEQ ID NO: 146531

SEQ ID NO: 673450 - RNA, 64 nt, Homo Sapiens; identical to SEQ ID NO: 146532

SEQ ID NO: 673451 - RNA, 64 nt, Homo Sapiens; identical to SEQ ID NO: 146533

SEQ ID NO: 673452 - RNA, 64 nt, Homo Sapiens; identical to SEQ ID NO: 146534

SEQ ID NO: 673453 - RNA, 64 nt, Homo Sapiens; identical to SEQ ID NO: 146535

SEQ ID NO: 673454 - RNA, 64 nt, Homo Sapiens; identical to SEQ ID NO: 146536

SEQ ID NO: 673455 - RNA, 64 nt, Homo Sapiens; identical to SEQ ID NO: 146537

SEQ ID NO: 673456 - RNA, 64 nt, Homo Sapiens; identical to SEQ ID NO: 146538

SEQ ID NO: 673457 - RNA, 64 nt, Homo Sapiens; identical to SEQ ID NO: 146539

SEQ ID NO: 673458 - RNA, 64 nt, Homo Sapiens; identical to SEQ ID NO: 146540

SEQ ID NO: 673459 - RNA, 64 nt, Homo Sapiens; identical to SEQ ID NO: 146541

SEQ ID NO: 673460 - RNA, 64 nt, Homo Sapiens; identical to SEQ ID NO: 146542

SEQ ID NO: 673461 - RNA, 64 nt, Homo Sapiens; identical to SEQ ID NO: 146543

SEQ ID NO: 673462 - RNA, 64 nt, Homo Sapiens; identical to SEQ ID NO: 146544

SEQ ID NO: 673463 - RNA, 64 nt, Homo Sapiens; identical to SEQ ID NO: 146545

SEQ ID NO: 673464 - RNA, 64 nt, Homo Sapiens; identical to SEQ ID NO: 146546

SEQ ID NO: 673465 - RNA, 64 nt, Homo Sapiens; identical to SEQ ID NO: 146547

SEQ ID NO: 673466 - RNA, 64 nt, Homo Sapiens; identical to SEQ ID NO: 146548

SEQ ID NO: 673467 - RNA, 64 nt, Homo Sapiens; identical to SEQ ID NO: 146549

SEQ ID NO: 673468 - RNA, 64 nt, Homo Sapiens; identical to SEQ ID NO: 146550

SEQ ID NO: 673469 - RNA, 64 nt, Homo Sapiens; identical to SEQ ID NO: 146551

SEQ ID NO: 673470 - RNA, 64 nt, Homo Sapiens; identical to SEQ ID NO: 146552

SEQ ID NO: 673471 - RNA, 64 nt, Homo Sapiens; identical to SEQ ID NO: 146553

SEQ ID NO: 673472 - RNA, 64 nt, Homo Sapiens; identical to SEQ ID NO: 146554

SEQ ID NO: 673473 - RNA, 64 nt, Homo Sapiens; identical to SEQ ID NO: 146555

SEQ ID NO: 673474 - RNA, 64 nt, Homo Sapiens; identical to SEQ ID NO: 146556

SEQ ID NO: 673475 - RNA, 64 nt, Homo Sapiens; identical to SEQ ID NO: 146557

SEQ ID NO: 673476 - RNA, 64 nt, Homo Sapiens; identical to SEQ ID NO: 146558

SEQ ID NO: 673477 - RNA, 64 nt, Homo Sapiens; identical to SEQ ID NO: 146559

SEQ ID NO: 673478 - RNA, 64 nt, Homo Sapiens; identical to SEQ ID NO: 146560

SEQ ID NO: 673479 - RNA, 64 nt, Homo Sapiens; identical to SEQ ID NO: 146561

SEQ ID NO: 673480 - RNA, 64 nt, Homo Sapiens; identical to SEQ ID NO: 146562

SEQ ID NO: 673481 - RNA, 64 nt, Homo Sapiens; identical to SEQ ID NO: 146563

SEQ ID NO: 673482 - RNA, 64 nt, Homo Sapiens; identical to SEQ ID NO: 146564

SEQ ID NO: 673483 - RNA, 64 nt, Homo Sapiens; identical to SEQ ID NO: 146565

SEQ ID NO: 673484 - RNA, 64 nt, Homo Sapiens; identical to SEQ ID NO: 146566

SEQ ID NO: 673485 - RNA, 64 nt, Homo Sapiens; identical to SEQ ID NO: 146567

SEQ ID NO: 673486 - RNA, 64 nt, Homo Sapiens; identical to SEQ ID NO: 146568

SEQ ID NO: 673487 - RNA, 64 nt, Homo Sapiens; identical to SEQ ID NO: 146569

SEQ ID NO: 673488 - RNA, 64 nt, Homo Sapiens; identical to SEQ ID NO: 146570

SEQ ID NO: 673489 - RNA, 64 nt, Homo Sapiens; identical to SEQ ID NO: 146571

SEQ ID NO: 673490 - RNA, 64 nt, Homo Sapiens; identical to SEQ ID NO: 146572

SEQ ID NO: 673491 - RNA, 64 nt, Homo Sapiens; identical to SEQ ID NO: 146573

SEQ ID NO: 673492 - RNA, 64 nt, Homo Sapiens; identical to SEQ ID NO: 146574

SEQ ID NO: 673493 - RNA, 64 nt, Homo Sapiens; identical to SEQ ID NO: 146575

SEQ ID NO: 673494 - RNA, 64 nt, Homo Sapiens; identical to SEQ ID NO: 146576

SEQ ID NO: 673495 - RNA, 64 nt, Homo Sapiens; identical to SEQ ID NO: 146577

SEQ ID NO: 673496 - RNA, 64 nt, Homo Sapiens; identical to SEQ ID NO: 146578

SEQ ID NO: 673497 - RNA, 64 nt, Homo Sapiens; identical to SEQ ID NO: 146579

SEQ ID NO: 673498 - RNA, 64 nt, Homo Sapiens; identical to SEQ ID NO: 146580

SEQ ID NO: 673499 - RNA, 64 nt, Homo Sapiens; identical to SEQ ID NO: 146581

SEQ ID NO: 673500 - RNA, 64 nt, Homo Sapiens; identical to SEQ ID NO: 146582

SEQ ID NO: 673501 - RNA, 64 nt, Homo Sapiens; identical to SEQ ID NO: 146583

SEQ ID NO: 673502 - RNA, 64 nt, Homo Sapiens; identical to SEQ ID NO: 146584

SEQ ID NO: 673503 - RNA, 64 nt, Homo Sapiens; identical to SEQ ID NO: 146585

SEQ ID NO: 673504 - RNA, 64 nt, Homo Sapiens; identical to SEQ ID NO: 146586

SEQ ID NO: 673505 - RNA, 64 nt, Homo Sapiens; identical to SEQ ID NO: 146587

SEQ ID NO: 673506 - RNA, 64 nt, Homo Sapiens; identical to SEQ ID NO: 146588

SEQ ID NO: 673507 - RNA, 64 nt, Homo Sapiens; identical to SEQ ID NO: 146589

SEQ ID NO: 673508 - RNA, 64 nt, Homo Sapiens; identical to SEQ ID NO: 146590

SEQ ID NO: 673509 - RNA, 64 nt, Homo Sapiens; identical to SEQ ID NO: 146591

SEQ ID NO: 673510 - RNA, 64 nt, Homo Sapiens; identical to SEQ ID NO: 146592

SEQ ID NO: 673511 - RNA, 64 nt, Homo Sapiens; identical to SEQ ID NO: 146593

SEQ ID NO: 673512 - RNA, 64 nt, Homo Sapiens; identical to SEQ ID NO: 146594

SEQ ID NO: 673513 - RNA, 64 nt, Homo Sapiens; identical to SEQ ID NO: 146595

SEQ ID NO: 673514 - RNA, 64 nt, Homo Sapiens; identical to SEQ ID NO: 146596

SEQ ID NO: 673515 - RNA, 64 nt, Homo Sapiens; identical to SEQ ID NO: 146597

SEQ ID NO: 673516 - RNA, 64 nt, Homo Sapiens; identical to SEQ ID NO: 146598

SEQ ID NO: 673517 - RNA, 64 nt, Homo Sapiens; identical to SEQ ID NO: 146599

SEQ ID NO: 673518 - RNA, 64 nt, Homo Sapiens; identical to SEQ ID NO: 146600

SEQ ID NO: 673519 - RNA, 64 nt, Homo Sapiens; identical to SEQ ID NO: 146601

SEQ ID NO: 673520 - RNA, 64 nt, Homo Sapiens; identical to SEQ ID NO: 146602

SEQ ID NO: 673521 - RNA, 64 nt, Homo Sapiens; identical to SEQ ID NO: 146603

SEQ ID NO: 673522 - RNA, 64 nt, Homo Sapiens; identical to SEQ ID NO: 146604

SEQ ID NO: 673523 - RNA, 64 nt, Homo Sapiens; identical to SEQ ID NO: 146605

SEQ ID NO: 673524 - RNA, 64 nt, Homo Sapiens; identical to SEQ ID NO: 146606

SEQ ID NO: 673525 - RNA, 64 nt, Homo Sapiens; identical to SEQ ID NO: 146607

SEQ ID NO: 673526 - RNA, 64 nt, Homo Sapiens; identical to SEQ ID NO: 146608

SEQ ID NO: 673527 - RNA, 64 nt, Homo Sapiens; identical to SEQ ID NO: 146609

SEQ ID NO: 673528 - RNA, 64 nt, Homo Sapiens; identical to SEQ ID NO: 146610

SEQ ID NO: 673529 - RNA, 64 nt, Homo Sapiens; identical to SEQ ID NO: 146611

SEQ ID NO: 673530 - RNA, 64 nt, Homo Sapiens; identical to SEQ ID NO: 146612

SEQ ID NO: 673531 - RNA, 64 nt, Homo Sapiens; identical to SEQ ID NO: 146613

SEQ ID NO: 673532 - RNA, 64 nt, Homo Sapiens; identical to SEQ ID NO: 146614

SEQ ID NO: 673533 - RNA, 64 nt, Homo Sapiens; identical to SEQ ID NO: 146615

SEQ ID NO: 673534 - RNA, 64 nt, Homo Sapiens; identical to SEQ ID NO: 146616

SEQ ID NO: 673535 - RNA, 64 nt, Homo Sapiens; identical to SEQ ID NO: 146617

SEQ ID NO: 673536 - RNA, 64 nt, Homo Sapiens; identical to SEQ ID NO: 146618

SEQ ID NO: 673537 - RNA, 64 nt, Homo Sapiens; identical to SEQ ID NO: 146619

SEQ ID NO: 673538 - RNA, 64 nt, Homo Sapiens; identical to SEQ ID NO: 146620

SEQ ID NO: 673539 - RNA, 64 nt, Homo Sapiens; identical to SEQ ID NO: 146621

SEQ ID NO: 673540 - RNA, 64 nt, Homo Sapiens; identical to SEQ ID NO: 146622

SEQ ID NO: 673541 - RNA, 64 nt, Homo Sapiens; identical to SEQ ID NO: 146623

SEQ ID NO: 673542 - RNA, 64 nt, Homo Sapiens; identical to SEQ ID NO: 146624

SEQ ID NO: 673543 - RNA, 64 nt, Homo Sapiens; identical to SEQ ID NO: 146625

SEQ ID NO: 673544 - RNA, 64 nt, Homo Sapiens; identical to SEQ ID NO: 146626

SEQ ID NO: 673545 - RNA, 64 nt, Homo Sapiens; identical to SEQ ID NO: 146627

SEQ ID NO: 673546 - RNA, 64 nt, Homo Sapiens; identical to SEQ ID NO: 146628

SEQ ID NO: 673547 - RNA, 64 nt, Homo Sapiens; identical to SEQ ID NO: 146629

SEQ ID NO: 673548 - RNA, 64 nt, Homo Sapiens; identical to SEQ ID NO: 146630

SEQ ID NO: 673549 - RNA, 64 nt, Homo Sapiens; identical to SEQ ID NO: 146631

SEQ ID NO: 673550 - RNA, 64 nt, Homo Sapiens; identical to SEQ ID NO: 146632

SEQ ID NO: 673551 - RNA, 64 nt, Homo Sapiens; identical to SEQ ID NO: 146633

SEQ ID NO: 673552 - RNA, 64 nt, Homo Sapiens; identical to SEQ ID NO: 146634

SEQ ID NO: 673553 - RNA, 64 nt, Homo Sapiens; identical to SEQ ID NO: 146635

SEQ ID NO: 673554 - RNA, 64 nt, Homo Sapiens; identical to SEQ ID NO: 146636

SEQ ID NO: 673555 - RNA, 64 nt, Homo Sapiens; identical to SEQ ID NO: 146637

SEQ ID NO: 673556 - RNA, 64 nt, Homo Sapiens; identical to SEQ ID NO: 146638

SEQ ID NO: 673557 - RNA, 64 nt, Homo Sapiens; identical to SEQ ID NO: 146639

SEQ ID NO: 673558 - RNA, 64 nt, Homo Sapiens; identical to SEQ ID NO: 146640

SEQ ID NO: 673559 - RNA, 64 nt, Homo Sapiens; identical to SEQ ID NO: 146641

SEQ ID NO: 673560 - RNA, 64 nt, Homo Sapiens; identical to SEQ ID NO: 146642

SEQ ID NO: 673561 - RNA, 64 nt, Homo Sapiens; identical to SEQ ID NO: 146643

SEQ ID NO: 673562 - RNA, 64 nt, Homo Sapiens; identical to SEQ ID NO: 146644

SEQ ID NO: 673563 - RNA, 64 nt, Homo Sapiens; identical to SEQ ID NO: 146645

SEQ ID NO: 673564 - RNA, 64 nt, Homo Sapiens; identical to SEQ ID NO: 146646

SEQ ID NO: 673565 - RNA, 64 nt, Homo Sapiens; identical to SEQ ID NO: 146647

SEQ ID NO: 673566 - RNA, 64 nt, Homo Sapiens; identical to SEQ ID NO: 146648

SEQ ID NO: 673567 - RNA, 64 nt, Homo Sapiens; identical to SEQ ID NO: 146649

SEQ ID NO: 673568 - RNA, 64 nt, Homo Sapiens; identical to SEQ ID NO: 146650

SEQ ID NO: 673569 - RNA, 64 nt, Homo Sapiens; identical to SEQ ID NO: 146651

SEQ ID NO: 673570 - RNA, 64 nt, Homo Sapiens; identical to SEQ ID NO: 146652

SEQ ID NO: 673571 - RNA, 64 nt, Homo Sapiens; identical to SEQ ID NO: 146653

SEQ ID NO: 673572 - RNA, 64 nt, Homo Sapiens; identical to SEQ ID NO: 146654

SEQ ID NO: 673573 - RNA, 64 nt, Homo Sapiens; identical to SEQ ID NO: 146655

SEQ ID NO: 673574 - RNA, 64 nt, Homo Sapiens; identical to SEQ ID NO: 146656

SEQ ID NO: 673575 - RNA, 64 nt, Homo Sapiens; identical to SEQ ID NO: 146657

SEQ ID NO: 673576 - RNA, 64 nt, Homo Sapiens; identical to SEQ ID NO: 146658

SEQ ID NO: 673577 - RNA, 64 nt, Homo Sapiens; identical to SEQ ID NO: 146659

SEQ ID NO: 673578 - RNA, 64 nt, Homo Sapiens; identical to SEQ ID NO: 146660

SEQ ID NO: 673579 - RNA, 64 nt, Homo Sapiens; identical to SEQ ID NO: 146661

SEQ ID NO: 673580 - RNA, 64 nt, Homo Sapiens; identical to SEQ ID NO: 146662

SEQ ID NO: 673581 - RNA, 64 nt, Homo Sapiens; identical to SEQ ID NO: 146663

SEQ ID NO: 673582 - RNA, 64 nt, Homo Sapiens; identical to SEQ ID NO: 146664

SEQ ID NO: 673583 - RNA, 64 nt, Homo Sapiens; identical to SEQ ID NO: 146665

SEQ ID NO: 673584 - RNA, 64 nt, Homo Sapiens; identical to SEQ ID NO: 146666

SEQ ID NO: 673585 - RNA, 64 nt, Homo Sapiens; identical to SEQ ID NO: 146667

SEQ ID NO: 673586 - RNA, 64 nt, Homo Sapiens; identical to SEQ ID NO: 146668

SEQ ID NO: 673587 - RNA, 64 nt, Homo Sapiens; identical to SEQ ID NO: 146669

SEQ ID NO: 673588 - RNA, 64 nt, Homo Sapiens; identical to SEQ ID NO: 146670

SEQ ID NO: 673589 - RNA, 64 nt, Homo Sapiens; identical to SEQ ID NO: 146671

SEQ ID NO: 673590 - RNA, 64 nt, Homo Sapiens; identical to SEQ ID NO: 146672

SEQ ID NO: 673591 - RNA, 64 nt, Homo Sapiens; identical to SEQ ID NO: 146673

SEQ ID NO: 673592 - RNA, 64 nt, Homo Sapiens; identical to SEQ ID NO: 146674

SEQ ID NO: 673593 - RNA, 64 nt, Homo Sapiens; identical to SEQ ID NO: 146675

SEQ ID NO: 673594 - RNA, 64 nt, Homo Sapiens; identical to SEQ ID NO: 146676

SEQ ID NO: 673595 - RNA, 64 nt, Homo Sapiens; identical to SEQ ID NO: 146677

SEQ ID NO: 673596 - RNA, 64 nt, Homo Sapiens; identical to SEQ ID NO: 146678

SEQ ID NO: 673597 - RNA, 64 nt, Homo Sapiens; identical to SEQ ID NO: 146679

SEQ ID NO: 673598 - RNA, 64 nt, Homo Sapiens; identical to SEQ ID NO: 146680

SEQ ID NO: 673599 - RNA, 64 nt, Homo Sapiens; identical to SEQ ID NO: 146681

SEQ ID NO: 673600 - RNA, 64 nt, Homo Sapiens; identical to SEQ ID NO: 146682

SEQ ID NO: 673601 - RNA, 64 nt, Homo Sapiens; identical to SEQ ID NO: 146683

SEQ ID NO: 673602 - RNA, 64 nt, Homo Sapiens; identical to SEQ ID NO: 146684

SEQ ID NO: 673603 - RNA, 64 nt, Homo Sapiens; identical to SEQ ID NO: 146685

SEQ ID NO: 673604 - RNA, 64 nt, Homo Sapiens; identical to SEQ ID NO: 146686

SEQ ID NO: 673605 - RNA, 64 nt, Homo Sapiens; identical to SEQ ID NO: 146687

SEQ ID NO: 673606 - RNA, 64 nt, Homo Sapiens; identical to SEQ ID NO: 294192

SEQ ID NO: 673607 - RNA, 64 nt, Homo Sapiens; identical to SEQ ID NO: 294193

SEQ ID NO: 673608 - RNA, 64 nt, Homo Sapiens; identical to SEQ ID NO: 294194

SEQ ID NO: 673609 - RNA, 64 nt, Homo Sapiens; identical to SEQ ID NO: 294195

SEQ ID NO: 673610 - RNA, 64 nt, Homo Sapiens; identical to SEQ ID NO: 603736

SEQ ID NO: 673611 - RNA, 64 nt, Homo Sapiens; identical to SEQ ID NO: 603737

SEQ ID NO: 673612 - RNA, 64 nt, Homo Sapiens; identical to SEQ ID NO: 153216

SEQ ID NO: 673613 - RNA, 64 nt, Homo Sapiens; identical to SEQ ID NO: 153217

SEQ ID NO: 673614 - RNA, 64 nt, Homo Sapiens; identical to SEQ ID NO: 153218

SEQ ID NO: 673615 - RNA, 64 nt, Homo Sapiens; identical to SEQ ID NO: 153219

SEQ ID NO: 673616 - RNA, 64 nt, Homo Sapiens; identical to SEQ ID NO: 153220

SEQ ID NO: 673617 - RNA, 64 nt, Homo Sapiens; identical to SEQ ID NO: 153221

SEQ ID NO: 673618 - RNA, 64 nt, Homo Sapiens; identical to SEQ ID NO: 153222

SEQ ID NO: 673619 - RNA, 64 nt, Homo Sapiens; identical to SEQ ID NO: 153223

SEQ ID NO: 673620 - RNA, 64 nt, Homo Sapiens; identical to SEQ ID NO: 153224

SEQ ID NO: 673621 - RNA, 64 nt, Homo Sapiens; identical to SEQ ID NO: 153225

SEQ ID NO: 673622 - RNA, 64 nt, Homo Sapiens; identical to SEQ ID NO: 153226

SEQ ID NO: 673623 - RNA, 64 nt, Homo Sapiens; identical to SEQ ID NO: 153227

SEQ ID NO: 673624 - RNA, 64 nt, Homo Sapiens; identical to SEQ ID NO: 153228

SEQ ID NO: 673625 - RNA, 64 nt, Homo Sapiens; identical to SEQ ID NO: 153229

SEQ ID NO: 673626 - RNA, 64 nt, Homo Sapiens; identical to SEQ ID NO: 153230

SEQ ID NO: 673627 - RNA, 64 nt, Homo Sapiens; identical to SEQ ID NO: 153231

SEQ ID NO: 673628 - RNA, 64 nt, Homo Sapiens; identical to SEQ ID NO: 153232

SEQ ID NO: 673629 - RNA, 64 nt, Homo Sapiens; identical to SEQ ID NO: 153233

SEQ ID NO: 673630 - RNA, 64 nt, Homo Sapiens; identical to SEQ ID NO: 153234

SEQ ID NO: 673631 - RNA, 64 nt, Homo Sapiens; identical to SEQ ID NO: 153235

SEQ ID NO: 673632 - RNA, 64 nt, Homo Sapiens; identical to SEQ ID NO: 153236

SEQ ID NO: 673633 - RNA, 64 nt, Homo Sapiens; identical to SEQ ID NO: 282432

SEQ ID NO: 673634 - RNA, 64 nt, Homo Sapiens; identical to SEQ ID NO: 282433

SEQ ID NO: 673635 - RNA, 64 nt, Homo Sapiens; identical to SEQ ID NO: 199794

SEQ ID NO: 673636 - RNA, 64 nt, Homo Sapiens; identical to SEQ ID NO: 199795

SEQ ID NO: 673637 - RNA, 64 nt, Homo Sapiens; identical to SEQ ID NO: 199796

SEQ ID NO: 673638 - RNA, 64 nt, Homo Sapiens; identical to SEQ ID NO: 199797

SEQ ID NO: 673639 - RNA, 64 nt, Homo Sapiens; identical to SEQ ID NO: 199798

SEQ ID NO: 673640 - RNA, 64 nt, Homo Sapiens; identical to SEQ ID NO: 199799

SEQ ID NO: 673641 - RNA, 64 nt, Homo Sapiens; identical to SEQ ID NO: 199800

SEQ ID NO: 673642 - RNA, 64 nt, Homo Sapiens; identical to SEQ ID NO: 199801

SEQ ID NO: 673643 - RNA, 64 nt, Homo Sapiens; identical to SEQ ID NO: 199802

SEQ ID NO: 673644 - RNA, 64 nt, Homo Sapiens; identical to SEQ ID NO: 199803

SEQ ID NO: 673645 - RNA, 64 nt, Homo Sapiens; identical to SEQ ID NO: 199804

SEQ ID NO: 673646 - RNA, 55 nt, Homo Sapiens; identical to SEQ ID NO: 199805

SEQ ID NO: 673647 - RNA, 64 nt, Homo Sapiens; identical to SEQ ID NO: 199806

SEQ ID NO: 673648 - RNA, 64 nt, Homo Sapiens; identical to SEQ ID NO: 199807

SEQ ID NO: 673649 - RNA, 64 nt, Homo Sapiens; identical to SEQ ID NO: 199808

SEQ ID NO: 673650 - RNA, 64 nt, Homo Sapiens; identical to SEQ ID NO: 199809

SEQ ID NO: 673651 - RNA, 64 nt, Homo Sapiens; identical to SEQ ID NO: 199810

SEQ ID NO: 673652 - RNA, 51 nt, Homo Sapiens; identical to SEQ ID NO: 199811

SEQ ID NO: 673653 - RNA, 64 nt, Homo Sapiens; identical to SEQ ID NO: 199812

SEQ ID NO: 673654 - RNA, 64 nt, Homo Sapiens; identical to SEQ ID NO: 199813

SEQ ID NO: 673655 - RNA, 64 nt, Homo Sapiens; identical to SEQ ID NO: 199814

SEQ ID NO: 673656 - RNA, 64 nt, Homo Sapiens; identical to SEQ ID NO: 199815

SEQ ID NO: 673657 - RNA, 64 nt, Homo Sapiens; identical to SEQ ID NO: 199816

SEQ ID NO: 673658 - RNA, 64 nt, Homo Sapiens; identical to SEQ ID NO: 199817

SEQ ID NO: 673659 - RNA, 64 nt, Homo Sapiens; identical to SEQ ID NO: 199818

SEQ ID NO: 673660 - RNA, 64 nt, Homo Sapiens; identical to SEQ ID NO: 199819

SEQ ID NO: 673661 - RNA, 64 nt, Homo Sapiens; identical to SEQ ID NO: 199820

SEQ ID NO: 673662 - RNA, 64 nt, Homo Sapiens; identical to SEQ ID NO: 199821

SEQ ID NO: 673663 - RNA, 64 nt, Homo Sapiens; identical to SEQ ID NO: 199822

SEQ ID NO: 673664 - RNA, 64 nt, Homo Sapiens; identical to SEQ ID NO: 199823

SEQ ID NO: 673665 - RNA, 64 nt, Homo Sapiens; identical to SEQ ID NO: 199824

SEQ ID NO: 673666 - RNA, 64 nt, Homo Sapiens; identical to SEQ ID NO: 536781

SEQ ID NO: 673667 - RNA, 64 nt, Homo Sapiens; identical to SEQ ID NO: 536782

SEQ ID NO: 673668 - RNA, 64 nt, Homo Sapiens; identical to SEQ ID NO: 536783

SEQ ID NO: 673669 - RNA, 64 nt, Homo Sapiens; identical to SEQ ID NO: 536784

SEQ ID NO: 673670 - RNA, 64 nt, Homo Sapiens; identical to SEQ ID NO: 536785

SEQ ID NO: 673671 - RNA, 64 nt, Homo Sapiens; identical to SEQ ID NO: 536786

SEQ ID NO: 673672 - RNA, 64 nt, Homo Sapiens; identical to SEQ ID NO: 536787

SEQ ID NO: 673673 - RNA, 64 nt, Homo Sapiens; identical to SEQ ID NO: 536788

SEQ ID NO: 673674 - RNA, 64 nt, Homo Sapiens; identical to SEQ ID NO: 536789

SEQ ID NO: 673675 - RNA, 64 nt, Homo Sapiens; identical to SEQ ID NO: 536790

SEQ ID NO: 673676 - RNA, 64 nt, Homo Sapiens; identical to SEQ ID NO: 536791

SEQ ID NO: 673677 - RNA, 64 nt, Homo Sapiens; identical to SEQ ID NO: 536792

SEQ ID NO: 673678 - RNA, 64 nt, Homo Sapiens; identical to SEQ ID NO: 536793

SEQ ID NO: 673679 - RNA, 64 nt, Homo Sapiens; identical to SEQ ID NO: 536794

SEQ ID NO: 673680 - RNA, 64 nt, Homo Sapiens; identical to SEQ ID NO: 536795

SEQ ID NO: 673681 - RNA, 64 nt, Homo Sapiens; identical to SEQ ID NO: 536796

SEQ ID NO: 673682 - RNA, 64 nt, Homo Sapiens; identical to SEQ ID NO: 536797

SEQ ID NO: 673683 - RNA, 64 nt, Homo Sapiens; identical to SEQ ID NO: 536798

SEQ ID NO: 673684 - RNA, 64 nt, Homo Sapiens; identical to SEQ ID NO: 536799

SEQ ID NO: 673685 - RNA, 64 nt, Homo Sapiens; identical to SEQ ID NO: 536800

SEQ ID NO: 673686 - RNA, 64 nt, Homo Sapiens; identical to SEQ ID NO: 536801

SEQ ID NO: 673687 - RNA, 64 nt, Homo Sapiens; identical to SEQ ID NO: 536802

SEQ ID NO: 673688 - RNA, 64 nt, Homo Sapiens; identical to SEQ ID NO: 536803

SEQ ID NO: 673689 - RNA, 64 nt, Homo Sapiens; identical to SEQ ID NO: 536804

SEQ ID NO: 673690 - RNA, 64 nt, Homo Sapiens; identical to SEQ ID NO: 536805

SEQ ID NO: 673691 - RNA, 64 nt, Homo Sapiens; identical to SEQ ID NO: 536806

SEQ ID NO: 673692 - RNA, 64 nt, Homo Sapiens; identical to SEQ ID NO: 536807

SEQ ID NO: 673693 - RNA, 64 nt, Homo Sapiens; identical to SEQ ID NO: 536808

SEQ ID NO: 673694 - RNA, 64 nt, Homo Sapiens; identical to SEQ ID NO: 536809

SEQ ID NO: 673695 - RNA, 64 nt, Homo Sapiens; identical to SEQ ID NO: 536810

SEQ ID NO: 673696 - RNA, 64 nt, Homo Sapiens; identical to SEQ ID NO: 536811

SEQ ID NO: 673697 - RNA, 64 nt, Homo Sapiens; identical to SEQ ID NO: 536812

SEQ ID NO: 673698 - RNA, 64 nt, Homo Sapiens; identical to SEQ ID NO: 536813

SEQ ID NO: 673699 - RNA, 64 nt, Homo Sapiens; identical to SEQ ID NO: 536814

SEQ ID NO: 673700 - RNA, 64 nt, Homo Sapiens; identical to SEQ ID NO: 536815

SEQ ID NO: 673701 - RNA, 64 nt, Homo Sapiens; identical to SEQ ID NO: 536816

SEQ ID NO: 673702 - RNA, 64 nt, Homo Sapiens; identical to SEQ ID NO: 536817

SEQ ID NO: 673703 - RNA, 64 nt, Homo Sapiens; identical to SEQ ID NO: 536818

SEQ ID NO: 673704 - RNA, 64 nt, Homo Sapiens; identical to SEQ ID NO: 536819

SEQ ID NO: 673705 - RNA, 64 nt, Homo Sapiens; identical to SEQ ID NO: 536820

SEQ ID NO: 673706 - RNA, 64 nt, Homo Sapiens; identical to SEQ ID NO: 536821

SEQ ID NO: 673707 - RNA, 64 nt, Homo Sapiens; identical to SEQ ID NO: 536822

SEQ ID NO: 673708 - RNA, 64 nt, Homo Sapiens; identical to SEQ ID NO: 536823

SEQ ID NO: 673709 - RNA, 64 nt, Homo Sapiens; identical to SEQ ID NO: 536824

SEQ ID NO: 673710 - RNA, 64 nt, Homo Sapiens; identical to SEQ ID NO: 536825

SEQ ID NO: 673711 - RNA, 64 nt, Homo Sapiens
uuucauggaauuaauuuacacguaaugagggaaguccuaggauggauagaaaaaaagcacuuac

SEQ ID NO: 673712 - RNA, 64 nt, Homo Sapiens
aucaggaaggggcugccucaggaaaauuccuagauccuaggaauucagugagacccugggaagg

SEQ ID NO: 673713 - RNA, 64 nt, Homo Sapiens
agaacaagugaaggguccugauuucuggggcugcuccuaggaccuacaaaaacagaaaugcaga

SEQ ID NO: 673714 - RNA, 64 nt, Homo Sapiens
caaagaguuuuguggggugaaggagaggaggaauuccuaggagcuuuccccaagcauaacugca

SEQ ID NO: 673715 - RNA, 64 nt, Homo Sapiens
uguuucucucuucuucccaaaaugaccuuagcuguccuaggauaguuaguaaaagacuuuuuag

SEQ ID NO: 673716 - RNA, 64 nt, Homo Sapiens
uauucgaagauguguugacagucgugaguguguauccuaggaaaggcgagcuggacucugucuc

SEQ ID NO: 673717 - RNA, 64 nt, Homo Sapiens; identical to SEQ ID NO: 117329

SEQ ID NO: 673718 - RNA, 64 nt, Homo Sapiens; identical to SEQ ID NO: 117330

SEQ ID NO: 673719 - RNA, 64 nt, Homo Sapiens; identical to SEQ ID NO: 117331

SEQ ID NO: 673720 - RNA, 64 nt, Homo Sapiens; identical to SEQ ID NO: 117332

SEQ ID NO: 673721 - RNA, 64 nt, Homo Sapiens; identical to SEQ ID NO: 117333

SEQ ID NO: 673722 - RNA, 64 nt, Homo Sapiens; identical to SEQ ID NO: 117334

SEQ ID NO: 673723 - RNA, 64 nt, Homo Sapiens; identical to SEQ ID NO: 117335

SEQ ID NO: 673724 - RNA, 64 nt, Homo Sapiens; identical to SEQ ID NO: 117336

SEQ ID NO: 673725 - RNA, 64 nt, Homo Sapiens; identical to SEQ ID NO: 117337

SEQ ID NO: 673726 - RNA, 64 nt, Homo Sapiens; identical to SEQ ID NO: 117338

SEQ ID NO: 673727 - RNA, 64 nt, Homo Sapiens; identical to SEQ ID NO: 117339

SEQ ID NO: 673728 - RNA, 64 nt, Homo Sapiens; identical to SEQ ID NO: 117340

SEQ ID NO: 673729 - RNA, 64 nt, Homo Sapiens; identical to SEQ ID NO: 117341

SEQ ID NO: 673730 - RNA, 64 nt, Homo Sapiens; identical to SEQ ID NO: 117342

SEQ ID NO: 673731 - RNA, 64 nt, Homo Sapiens; identical to SEQ ID NO: 117343

SEQ ID NO: 673732 - RNA, 64 nt, Homo Sapiens; identical to SEQ ID NO: 117344

SEQ ID NO: 673733 - RNA, 64 nt, Homo Sapiens; identical to SEQ ID NO: 117345

SEQ ID NO: 673734 - RNA, 64 nt, Homo Sapiens; identical to SEQ ID NO: 117346

SEQ ID NO: 673735 - RNA, 64 nt, Homo Sapiens; identical to SEQ ID NO: 117347

SEQ ID NO: 673736 - RNA, 64 nt, Homo Sapiens; identical to SEQ ID NO: 117348

SEQ ID NO: 673737 - RNA, 64 nt, Homo Sapiens; identical to SEQ ID NO: 117349

SEQ ID NO: 673738 - RNA, 64 nt, Homo Sapiens; identical to SEQ ID NO: 117350

SEQ ID NO: 673739 - RNA, 64 nt, Homo Sapiens; identical to SEQ ID NO: 117351

SEQ ID NO: 673740 - RNA, 64 nt, Homo Sapiens; identical to SEQ ID NO: 117352

SEQ ID NO: 673741 - RNA, 64 nt, Homo Sapiens; identical to SEQ ID NO: 117353

SEQ ID NO: 673742 - RNA, 64 nt, Homo Sapiens; identical to SEQ ID NO: 117354

SEQ ID NO: 673743 - RNA, 64 nt, Homo Sapiens; identical to SEQ ID NO: 117355

SEQ ID NO: 673744 - RNA, 64 nt, Homo Sapiens; identical to SEQ ID NO: 117356

SEQ ID NO: 673745 - RNA, 64 nt, Homo Sapiens; identical to SEQ ID NO: 117357

SEQ ID NO: 673746 - RNA, 64 nt, Homo Sapiens; identical to SEQ ID NO: 117358

SEQ ID NO: 673747 - RNA, 64 nt, Homo Sapiens; identical to SEQ ID NO: 117359

SEQ ID NO: 673748 - RNA, 64 nt, Homo Sapiens; identical to SEQ ID NO: 117360

SEQ ID NO: 673749 - RNA, 64 nt, Homo Sapiens; identical to SEQ ID NO: 117361

SEQ ID NO: 673750 - RNA, 64 nt, Homo Sapiens; identical to SEQ ID NO: 117362

SEQ ID NO: 673751 - RNA, 64 nt, Homo Sapiens; identical to SEQ ID NO: 394703

SEQ ID NO: 673752 - RNA, 64 nt, Homo Sapiens; identical to SEQ ID NO: 394704

SEQ ID NO: 673753 - RNA, 64 nt, Homo Sapiens; identical to SEQ ID NO: 170734

SEQ ID NO: 673754 - RNA, 64 nt, Homo Sapiens; identical to SEQ ID NO: 170735

SEQ ID NO: 673755 - RNA, 64 nt, Homo Sapiens; identical to SEQ ID NO: 170736

SEQ ID NO: 673756 - RNA, 64 nt, Homo Sapiens; identical to SEQ ID NO: 170737

SEQ ID NO: 673757 - RNA, 64 nt, Homo Sapiens; identical to SEQ ID NO: 170738

SEQ ID NO: 673758 - RNA, 64 nt, Homo Sapiens; identical to SEQ ID NO: 170739

SEQ ID NO: 673759 - RNA, 64 nt, Homo Sapiens; identical to SEQ ID NO: 170740

SEQ ID NO: 673760 - RNA, 64 nt, Homo Sapiens; identical to SEQ ID NO: 170741

SEQ ID NO: 673761 - RNA, 64 nt, Homo Sapiens; identical to SEQ ID NO: 170742

SEQ ID NO: 673762 - RNA, 64 nt, Homo Sapiens; identical to SEQ ID NO: 170743

SEQ ID NO: 673763 - RNA, 64 nt, Homo Sapiens; identical to SEQ ID NO: 170744

SEQ ID NO: 673764 - RNA, 64 nt, Homo Sapiens; identical to SEQ ID NO: 170745

SEQ ID NO: 673765 - RNA, 64 nt, Homo Sapiens; identical to SEQ ID NO: 170746

SEQ ID NO: 673766 - RNA, 64 nt, Homo Sapiens; identical to SEQ ID NO: 170747

SEQ ID NO: 673767 - RNA, 64 nt, Homo Sapiens; identical to SEQ ID NO: 170748

SEQ ID NO: 673768 - RNA, 64 nt, Homo Sapiens; identical to SEQ ID NO: 170749

SEQ ID NO: 673769 - RNA, 64 nt, Homo Sapiens; identical to SEQ ID NO: 170750

SEQ ID NO: 673770 - RNA, 64 nt, Homo Sapiens; identical to SEQ ID NO: 170751

SEQ ID NO: 673771 - RNA, 64 nt, Homo Sapiens; identical to SEQ ID NO: 170752

SEQ ID NO: 673772 - RNA, 64 nt, Homo Sapiens; identical to SEQ ID NO: 170753

SEQ ID NO: 673773 - RNA, 64 nt, Homo Sapiens; identical to SEQ ID NO: 170754

SEQ ID NO: 673774 - RNA, 64 nt, Homo Sapiens; identical to SEQ ID NO: 170755

SEQ ID NO: 673775 - RNA, 64 nt, Homo Sapiens; identical to SEQ ID NO: 170756

SEQ ID NO: 673776 - RNA, 64 nt, Homo Sapiens; identical to SEQ ID NO: 170757

SEQ ID NO: 673777 - RNA, 64 nt, Homo Sapiens; identical to SEQ ID NO: 170758

SEQ ID NO: 673778 - RNA, 64 nt, Homo Sapiens
uuggccaggagacccugaaacaugaaaccaaacaggcuuugauauuuuuuuuuuuuuaauuacu

SEQ ID NO: 673779 - RNA, 64 nt, Homo Sapiens
aaauacauagaaguacacagcuauuauaugcuguggcuuugagaaguuaacuuuuguggaauau

SEQ ID NO: 673780 - RNA, 64 nt, Homo Sapiens
uaaaaaaaaaaaaaaaaucccaauaguccaugaaggcuuugaucucuugggaaguucuucauag

SEQ ID NO: 673781 - RNA, 64 nt, Homo Sapiens
aagccuuuucaggcacaugguuucaacaaagccuggcuuugacauuccuuguccugaggagcac

SEQ ID NO: 673782 - RNA, 64 nt, Homo Sapiens
uauccuaaucuuccuagcccuucaggcuagaguaggcuuugauccugagaaccuugcuguugcu

SEQ ID NO: 673783 - RNA, 64 nt, Homo Sapiens
uguuaaggaagggaaagauugucauagaugguagggcuuugaaaaugcaggguaucagcugcca

SEQ ID NO: 673784 - RNA, 64 nt, Homo Sapiens
uggugucaauuuggggccuuggucaccugugaugggcuuugaugacaacuucauuucuuucugg

SEQ ID NO: 673785 - RNA, 64 nt, Homo Sapiens
uaguaugaacuggugucugcuagagcaguggcauggcuuugaccguguguucacuuguguugga

SEQ ID NO: 673786 - RNA, 64 nt, Homo Sapiens
guuugcaaugggcuuaccauccaaauaucccaaaggcuuugaccagcaaccaaguaaaaucagu

SEQ ID NO: 673787 - RNA, 64 nt, Homo Sapiens
uuuuuaaggucucuaucacuuuaaucuggaucaaggcuuugaagcaaugccucucugcauuuuu

SEQ ID NO: 673788 - RNA, 64 nt, Homo Sapiens; identical to SEQ ID NO: 72602

SEQ ID NO: 673789 - RNA, 64 nt, Homo Sapiens; identical to SEQ ID NO: 72603

SEQ ID NO: 673790 - RNA, 64 nt, Homo Sapiens; identical to SEQ ID NO: 72604

SEQ ID NO: 673791 - RNA, 64 nt, Homo Sapiens; identical to SEQ ID NO: 72605

SEQ ID NO: 673792 - RNA, 64 nt, Homo Sapiens; identical to SEQ ID NO: 72606

SEQ ID NO: 673793 - RNA, 64 nt, Homo Sapiens; identical to SEQ ID NO: 72607

SEQ ID NO: 673794 - RNA, 64 nt, Homo Sapiens; identical to SEQ ID NO: 72608

SEQ ID NO: 673795 - RNA, 64 nt, Homo Sapiens; identical to SEQ ID NO: 72609

SEQ ID NO: 673796 - RNA, 64 nt, Homo Sapiens; identical to SEQ ID NO: 72610

SEQ ID NO: 673797 - RNA, 64 nt, Homo Sapiens; identical to SEQ ID NO: 72611

SEQ ID NO: 673798 - RNA, 64 nt, Homo Sapiens; identical to SEQ ID NO: 72612

SEQ ID NO: 673799 - RNA, 64 nt, Homo Sapiens; identical to SEQ ID NO: 72613

SEQ ID NO: 673800 - RNA, 64 nt, Homo Sapiens; identical to SEQ ID NO: 72614

SEQ ID NO: 673801 - RNA, 64 nt, Homo Sapiens; identical to SEQ ID NO: 72615

SEQ ID NO: 673802 - RNA, 64 nt, Homo Sapiens; identical to SEQ ID NO: 72616

SEQ ID NO: 673803 - RNA, 64 nt, Homo Sapiens; identical to SEQ ID NO: 72617

SEQ ID NO: 673804 - RNA, 64 nt, Homo Sapiens; identical to SEQ ID NO: 72618

SEQ ID NO: 673805 - RNA, 64 nt, Homo Sapiens; identical to SEQ ID NO: 72619

SEQ ID NO: 673806 - RNA, 64 nt, Homo Sapiens; identical to SEQ ID NO: 72620

SEQ ID NO: 673807 - RNA, 64 nt, Homo Sapiens; identical to SEQ ID NO: 72621

SEQ ID NO: 673808 - RNA, 64 nt, Homo Sapiens; identical to SEQ ID NO: 72622

SEQ ID NO: 673809 - RNA, 64 nt, Homo Sapiens; identical to SEQ ID NO: 72623

SEQ ID NO: 673810 - RNA, 64 nt, Homo Sapiens; identical to SEQ ID NO: 72624

SEQ ID NO: 673811 - RNA, 64 nt, Homo Sapiens; identical to SEQ ID NO: 72625

SEQ ID NO: 673812 - RNA, 64 nt, Homo Sapiens; identical to SEQ ID NO: 72626

SEQ ID NO: 673813 - RNA, 64 nt, Homo Sapiens; identical to SEQ ID NO: 72627

SEQ ID NO: 673814 - RNA, 64 nt, Homo Sapiens; identical to SEQ ID NO: 72628

SEQ ID NO: 673815 - RNA, 64 nt, Homo Sapiens; identical to SEQ ID NO: 72629

SEQ ID NO: 673816 - RNA, 64 nt, Homo Sapiens; identical to SEQ ID NO: 72630

SEQ ID NO: 673817 - RNA, 64 nt, Homo Sapiens; identical to SEQ ID NO: 72631

SEQ ID NO: 673818 - RNA, 64 nt, Homo Sapiens; identical to SEQ ID NO: 72632

SEQ ID NO: 673819 - RNA, 64 nt, Homo Sapiens; identical to SEQ ID NO: 72633

SEQ ID NO: 673820 - RNA, 64 nt, Homo Sapiens; identical to SEQ ID NO: 72634

SEQ ID NO: 673821 - RNA, 64 nt, Homo Sapiens; identical to SEQ ID NO: 72635

SEQ ID NO: 673822 - RNA, 64 nt, Homo Sapiens; identical to SEQ ID NO: 72636

SEQ ID NO: 673823 - RNA, 64 nt, Homo Sapiens; identical to SEQ ID NO: 72637

SEQ ID NO: 673824 - RNA, 64 nt, Homo Sapiens; identical to SEQ ID NO: 72638

SEQ ID NO: 673825 - RNA, 64 nt, Homo Sapiens; identical to SEQ ID NO: 72639

SEQ ID NO: 673826 - RNA, 64 nt, Homo Sapiens; identical to SEQ ID NO: 72640

SEQ ID NO: 673827 - RNA, 64 nt, Homo Sapiens; identical to SEQ ID NO: 72641

SEQ ID NO: 673828 - RNA, 64 nt, Homo Sapiens; identical to SEQ ID NO: 72642

SEQ ID NO: 673829 - RNA, 64 nt, Homo Sapiens; identical to SEQ ID NO: 72643

SEQ ID NO: 673830 - RNA, 64 nt, Homo Sapiens; identical to SEQ ID NO: 72644

SEQ ID NO: 673831 - RNA, 64 nt, Homo Sapiens; identical to SEQ ID NO: 72645

SEQ ID NO: 673832 - RNA, 64 nt, Homo Sapiens; identical to SEQ ID NO: 156063

SEQ ID NO: 673833 - RNA, 64 nt, Homo Sapiens; identical to SEQ ID NO: 156064

SEQ ID NO: 673834 - RNA, 64 nt, Homo Sapiens; identical to SEQ ID NO: 156065

SEQ ID NO: 673835 - RNA, 64 nt, Homo Sapiens; identical to SEQ ID NO: 156066

SEQ ID NO: 673836 - RNA, 64 nt, Homo Sapiens; identical to SEQ ID NO: 156067

SEQ ID NO: 673837 - RNA, 64 nt, Homo Sapiens; identical to SEQ ID NO: 156068

SEQ ID NO: 673838 - RNA, 64 nt, Homo Sapiens; identical to SEQ ID NO: 156069

SEQ ID NO: 673839 - RNA, 64 nt, Homo Sapiens; identical to SEQ ID NO: 156070

SEQ ID NO: 673840 - RNA, 64 nt, Homo Sapiens; identical to SEQ ID NO: 156071

SEQ ID NO: 673841 - RNA, 64 nt, Homo Sapiens; identical to SEQ ID NO: 156072

SEQ ID NO: 673842 - RNA, 64 nt, Homo Sapiens; identical to SEQ ID NO: 156073

SEQ ID NO: 673843 - RNA, 64 nt, Homo Sapiens; identical to SEQ ID NO: 156074

SEQ ID NO: 673844 - RNA, 64 nt, Homo Sapiens; identical to SEQ ID NO: 156075

SEQ ID NO: 673845 - RNA, 64 nt, Homo Sapiens; identical to SEQ ID NO: 156076

SEQ ID NO: 673846 - RNA, 64 nt, Homo Sapiens; identical to SEQ ID NO: 156077

SEQ ID NO: 673847 - RNA, 64 nt, Homo Sapiens; identical to SEQ ID NO: 156078

SEQ ID NO: 673848 - RNA, 64 nt, Homo Sapiens; identical to SEQ ID NO: 156079

SEQ ID NO: 673849 - RNA, 64 nt, Homo Sapiens; identical to SEQ ID NO: 156080

SEQ ID NO: 673850 - RNA, 64 nt, Homo Sapiens; identical to SEQ ID NO: 156081

SEQ ID NO: 673851 - RNA, 64 nt, Homo Sapiens; identical to SEQ ID NO: 156082

SEQ ID NO: 673852 - RNA, 64 nt, Homo Sapiens; identical to SEQ ID NO: 156083

SEQ ID NO: 673853 - RNA, 64 nt, Homo Sapiens; identical to SEQ ID NO: 156084

SEQ ID NO: 673854 - RNA, 64 nt, Homo Sapiens; identical to SEQ ID NO: 156085

SEQ ID NO: 673855 - RNA, 64 nt, Homo Sapiens; identical to SEQ ID NO: 156086

SEQ ID NO: 673856 - RNA, 64 nt, Homo Sapiens; identical to SEQ ID NO: 156087

SEQ ID NO: 673857 - RNA, 64 nt, Homo Sapiens; identical to SEQ ID NO: 156088

SEQ ID NO: 673858 - RNA, 64 nt, Homo Sapiens; identical to SEQ ID NO: 156089

SEQ ID NO: 673859 - RNA, 64 nt, Homo Sapiens; identical to SEQ ID NO: 156090

SEQ ID NO: 673860 - RNA, 64 nt, Homo Sapiens; identical to SEQ ID NO: 156091

SEQ ID NO: 673861 - RNA, 64 nt, Homo Sapiens; identical to SEQ ID NO: 156092

SEQ ID NO: 673862 - RNA, 64 nt, Homo Sapiens; identical to SEQ ID NO: 156093

SEQ ID NO: 673863 - RNA, 64 nt, Homo Sapiens; identical to SEQ ID NO: 156094

SEQ ID NO: 673864 - RNA, 64 nt, Homo Sapiens; identical to SEQ ID NO: 156095

SEQ ID NO: 673865 - RNA, 64 nt, Homo Sapiens; identical to SEQ ID NO: 156096

SEQ ID NO: 673866 - RNA, 64 nt, Homo Sapiens; identical to SEQ ID NO: 156097

SEQ ID NO: 673867 - RNA, 64 nt, Homo Sapiens; identical to SEQ ID NO: 156098

SEQ ID NO: 673868 - RNA, 64 nt, Homo Sapiens; identical to SEQ ID NO: 156099

SEQ ID NO: 673869 - RNA, 64 nt, Homo Sapiens; identical to SEQ ID NO: 156100

SEQ ID NO: 673870 - RNA, 64 nt, Homo Sapiens; identical to SEQ ID NO: 156101

SEQ ID NO: 673871 - RNA, 64 nt, Homo Sapiens; identical to SEQ ID NO: 156102

SEQ ID NO: 673872 - RNA, 64 nt, Homo Sapiens; identical to SEQ ID NO: 156103

SEQ ID NO: 673873 - RNA, 64 nt, Homo Sapiens; identical to SEQ ID NO: 156104

SEQ ID NO: 673874 - RNA, 64 nt, Homo Sapiens; identical to SEQ ID NO: 156105

SEQ ID NO: 673875 - RNA, 64 nt, Homo Sapiens; identical to SEQ ID NO: 156106

SEQ ID NO: 673876 - RNA, 64 nt, Homo Sapiens; identical to SEQ ID NO: 156107

SEQ ID NO: 673877 - RNA, 64 nt, Homo Sapiens; identical to SEQ ID NO: 156108

SEQ ID NO: 673878 - RNA, 64 nt, Homo Sapiens; identical to SEQ ID NO: 156109

SEQ ID NO: 673879 - RNA, 64 nt, Homo Sapiens; identical to SEQ ID NO: 156110

SEQ ID NO: 673880 - RNA, 64 nt, Homo Sapiens; identical to SEQ ID NO: 156111

SEQ ID NO: 673881 - RNA, 64 nt, Homo Sapiens; identical to SEQ ID NO: 112922

SEQ ID NO: 673882 - RNA, 64 nt, Homo Sapiens; identical to SEQ ID NO: 112923

SEQ ID NO: 673883 - RNA, 64 nt, Homo Sapiens; identical to SEQ ID NO: 112924

SEQ ID NO: 673884 - RNA, 64 nt, Homo Sapiens; identical to SEQ ID NO: 112925

SEQ ID NO: 673885 - RNA, 64 nt, Homo Sapiens; identical to SEQ ID NO: 112926

SEQ ID NO: 673886 - RNA, 64 nt, Homo Sapiens; identical to SEQ ID NO: 112927

SEQ ID NO: 673887 - RNA, 64 nt, Homo Sapiens; identical to SEQ ID NO: 112928

SEQ ID NO: 673888 - RNA, 64 nt, Homo Sapiens; identical to SEQ ID NO: 112929

SEQ ID NO: 673889 - RNA, 64 nt, Homo Sapiens; identical to SEQ ID NO: 112930

SEQ ID NO: 673890 - RNA, 64 nt, Homo Sapiens; identical to SEQ ID NO: 112931

SEQ ID NO: 673891 - RNA, 64 nt, Homo Sapiens; identical to SEQ ID NO: 112932

SEQ ID NO: 673892 - RNA, 64 nt, Homo Sapiens; identical to SEQ ID NO: 112933

SEQ ID NO: 673893 - RNA, 64 nt, Homo Sapiens; identical to SEQ ID NO: 112934

SEQ ID NO: 673894 - RNA, 64 nt, Homo Sapiens; identical to SEQ ID NO: 112935

SEQ ID NO: 673895 - RNA, 64 nt, Homo Sapiens; identical to SEQ ID NO: 112936

SEQ ID NO: 673896 - RNA, 64 nt, Homo Sapiens; identical to SEQ ID NO: 112937

SEQ ID NO: 673897 - RNA, 64 nt, Homo Sapiens; identical to SEQ ID NO: 112938

SEQ ID NO: 673898 - RNA, 64 nt, Homo Sapiens; identical to SEQ ID NO: 112939

SEQ ID NO: 673899 - RNA, 64 nt, Homo Sapiens; identical to SEQ ID NO: 112940

SEQ ID NO: 673900 - RNA, 64 nt, Homo Sapiens; identical to SEQ ID NO: 112941

SEQ ID NO: 673901 - RNA, 64 nt, Homo Sapiens; identical to SEQ ID NO: 112942

SEQ ID NO: 673902 - RNA, 64 nt, Homo Sapiens; identical to SEQ ID NO: 112943

SEQ ID NO: 673903 - RNA, 64 nt, Homo Sapiens; identical to SEQ ID NO: 112944

SEQ ID NO: 673904 - RNA, 64 nt, Homo Sapiens; identical to SEQ ID NO: 112945

SEQ ID NO: 673905 - RNA, 64 nt, Homo Sapiens; identical to SEQ ID NO: 112946

SEQ ID NO: 673906 - RNA, 64 nt, Homo Sapiens; identical to SEQ ID NO: 112947

SEQ ID NO: 673907 - RNA, 64 nt, Homo Sapiens; identical to SEQ ID NO: 112948

SEQ ID NO: 673908 - RNA, 64 nt, Homo Sapiens; identical to SEQ ID NO: 112949

SEQ ID NO: 673909 - RNA, 64 nt, Homo Sapiens; identical to SEQ ID NO: 112950

SEQ ID NO: 673910 - RNA, 64 nt, Homo Sapiens; identical to SEQ ID NO: 112951

SEQ ID NO: 673911 - RNA, 64 nt, Homo Sapiens; identical to SEQ ID NO: 112952

SEQ ID NO: 673912 - RNA, 64 nt, Homo Sapiens; identical to SEQ ID NO: 112953

SEQ ID NO: 673913 - RNA, 64 nt, Homo Sapiens; identical to SEQ ID NO: 112954

SEQ ID NO: 673914 - RNA, 50 nt, Homo Sapiens; identical to SEQ ID NO: 112955

SEQ ID NO: 673915 - RNA, 64 nt, Homo Sapiens; identical to SEQ ID NO: 112956

SEQ ID NO: 673916 - RNA, 64 nt, Homo Sapiens; identical to SEQ ID NO: 112957

SEQ ID NO: 673917 - RNA, 64 nt, Homo Sapiens; identical to SEQ ID NO: 112958

SEQ ID NO: 673918 - RNA, 64 nt, Homo Sapiens; identical to SEQ ID NO: 112959

SEQ ID NO: 673919 - RNA, 64 nt, Homo Sapiens; identical to SEQ ID NO: 112960

SEQ ID NO: 673920 - RNA, 64 nt, Homo Sapiens; identical to SEQ ID NO: 112961

SEQ ID NO: 673921 - RNA, 64 nt, Homo Sapiens
agaaaaggccuagaaccaguuguucaccggauauguuggguagcgugaagcacuguugauguuu

SEQ ID NO: 673922 - RNA, 64 nt, Homo Sapiens
aaaaauggcaaaagaaaugcugcgcauuguguaaguuggguaacuguaguguugcuuagcacuu

SEQ ID NO: 673923 - RNA, 64 nt, Homo Sapiens
ggguacaauggugagccagaguacuuggcacccuguuggguauuggcacccuguuggguauugg

SEQ ID NO: 673924 - RNA, 64 nt, Homo Sapiens
ggguacuuggcacccuguuguuccuuggcacccuguuggguauuuauuuugagugccuuuugug

SEQ ID NO: 673925 - RNA, 64 nt, Homo Sapiens; identical to SEQ ID NO: 229156

SEQ ID NO: 673926 - RNA, 64 nt, Homo Sapiens; identical to SEQ ID NO: 229157

SEQ ID NO: 673927 - RNA, 64 nt, Homo Sapiens; identical to SEQ ID NO: 229158

SEQ ID NO: 673928 - RNA, 64 nt, Homo Sapiens; identical to SEQ ID NO: 229159

SEQ ID NO: 673929 - RNA, 64 nt, Homo Sapiens; identical to SEQ ID NO: 229160

SEQ ID NO: 673930 - RNA, 62 nt, Homo Sapiens; identical to SEQ ID NO: 229161

SEQ ID NO: 673931 - RNA, 64 nt, Homo Sapiens; identical to SEQ ID NO: 229162

SEQ ID NO: 673932 - RNA, 64 nt, Homo Sapiens; identical to SEQ ID NO: 229163

SEQ ID NO: 673933 - RNA, 64 nt, Homo Sapiens; identical to SEQ ID NO: 229164

SEQ ID NO: 673934 - RNA, 64 nt, Homo Sapiens; identical to SEQ ID NO: 229165

SEQ ID NO: 673935 - RNA, 64 nt, Homo Sapiens; identical to SEQ ID NO: 229166

SEQ ID NO: 673936 - RNA, 64 nt, Homo Sapiens; identical to SEQ ID NO: 229167

SEQ ID NO: 673937 - RNA, 64 nt, Homo Sapiens; identical to SEQ ID NO: 78101

SEQ ID NO: 673938 - RNA, 62 nt, Homo Sapiens; identical to SEQ ID NO: 78102

SEQ ID NO: 673939 - RNA, 64 nt, Homo Sapiens; identical to SEQ ID NO: 78103

SEQ ID NO: 673940 - RNA, 55 nt, Homo Sapiens; identical to SEQ ID NO: 78104

SEQ ID NO: 673941 - RNA, 64 nt, Homo Sapiens; identical to SEQ ID NO: 78105

SEQ ID NO: 673942 - RNA, 64 nt, Homo Sapiens; identical to SEQ ID NO: 78106

SEQ ID NO: 673943 - RNA, 64 nt, Homo Sapiens; identical to SEQ ID NO: 78107

SEQ ID NO: 673944 - RNA, 64 nt, Homo Sapiens; identical to SEQ ID NO: 78108

SEQ ID NO: 673945 - RNA, 64 nt, Homo Sapiens; identical to SEQ ID NO: 78109

SEQ ID NO: 673946 - RNA, 64 nt, Homo Sapiens; identical to SEQ ID NO: 78110

SEQ ID NO: 673947 - RNA, 64 nt, Homo Sapiens; identical to SEQ ID NO: 78111

SEQ ID NO: 673948 - RNA, 64 nt, Homo Sapiens; identical to SEQ ID NO: 78112

SEQ ID NO: 673949 - RNA, 64 nt, Homo Sapiens; identical to SEQ ID NO: 78113

SEQ ID NO: 673950 - RNA, 64 nt, Homo Sapiens; identical to SEQ ID NO: 78114

SEQ ID NO: 673951 - RNA, 64 nt, Homo Sapiens; identical to SEQ ID NO: 78115

SEQ ID NO: 673952 - RNA, 64 nt, Homo Sapiens; identical to SEQ ID NO: 78116

SEQ ID NO: 673953 - RNA, 64 nt, Homo Sapiens; identical to SEQ ID NO: 78117

SEQ ID NO: 673954 - RNA, 64 nt, Homo Sapiens; identical to SEQ ID NO: 78118

SEQ ID NO: 673955 - RNA, 64 nt, Homo Sapiens; identical to SEQ ID NO: 78119

SEQ ID NO: 673956 - RNA, 64 nt, Homo Sapiens; identical to SEQ ID NO: 78120

SEQ ID NO: 673957 - RNA, 64 nt, Homo Sapiens; identical to SEQ ID NO: 78121

SEQ ID NO: 673958 - RNA, 64 nt, Homo Sapiens; identical to SEQ ID NO: 78122

SEQ ID NO: 673959 - RNA, 64 nt, Homo Sapiens; identical to SEQ ID NO: 78123

SEQ ID NO: 673960 - RNA, 64 nt, Homo Sapiens; identical to SEQ ID NO: 78124

SEQ ID NO: 673961 - RNA, 64 nt, Homo Sapiens; identical to SEQ ID NO: 78125

SEQ ID NO: 673962 - RNA, 64 nt, Homo Sapiens; identical to SEQ ID NO: 78126

SEQ ID NO: 673963 - RNA, 64 nt, Homo Sapiens; identical to SEQ ID NO: 78127

SEQ ID NO: 673964 - RNA, 64 nt, Homo Sapiens; identical to SEQ ID NO: 78128

SEQ ID NO: 673965 - RNA, 64 nt, Homo Sapiens; identical to SEQ ID NO: 78129

SEQ ID NO: 673966 - RNA, 64 nt, Homo Sapiens; identical to SEQ ID NO: 78130

SEQ ID NO: 673967 - RNA, 64 nt, Homo Sapiens; identical to SEQ ID NO: 78131

SEQ ID NO: 673968 - RNA, 64 nt, Homo Sapiens; identical to SEQ ID NO: 78132

SEQ ID NO: 673969 - RNA, 64 nt, Homo Sapiens; identical to SEQ ID NO: 78133

SEQ ID NO: 673970 - RNA, 64 nt, Homo Sapiens; identical to SEQ ID NO: 78134

SEQ ID NO: 673971 - RNA, 64 nt, Homo Sapiens; identical to SEQ ID NO: 78135

SEQ ID NO: 673972 - RNA, 64 nt, Homo Sapiens; identical to SEQ ID NO: 78136

SEQ ID NO: 673973 - RNA, 64 nt, Homo Sapiens; identical to SEQ ID NO: 78137

SEQ ID NO: 673974 - RNA, 64 nt, Homo Sapiens; identical to SEQ ID NO: 78138

SEQ ID NO: 673975 - RNA, 64 nt, Homo Sapiens; identical to SEQ ID NO: 78139

SEQ ID NO: 673976 - RNA, 64 nt, Homo Sapiens; identical to SEQ ID NO: 78140

SEQ ID NO: 673977 - RNA, 64 nt, Homo Sapiens; identical to SEQ ID NO: 78141

SEQ ID NO: 673978 - RNA, 64 nt, Homo Sapiens; identical to SEQ ID NO: 78142

SEQ ID NO: 673979 - RNA, 64 nt, Homo Sapiens; identical to SEQ ID NO: 78143

SEQ ID NO: 673980 - RNA, 64 nt, Homo Sapiens; identical to SEQ ID NO: 78144

SEQ ID NO: 673981 - RNA, 64 nt, Homo Sapiens; identical to SEQ ID NO: 78145

SEQ ID NO: 673982 - RNA, 64 nt, Homo Sapiens; identical to SEQ ID NO: 78146

SEQ ID NO: 673983 - RNA, 64 nt, Homo Sapiens; identical to SEQ ID NO: 78147

SEQ ID NO: 673984 - RNA, 64 nt, Homo Sapiens; identical to SEQ ID NO: 78148

SEQ ID NO: 673985 - RNA, 64 nt, Homo Sapiens; identical to SEQ ID NO: 78149

SEQ ID NO: 673986 - RNA, 64 nt, Homo Sapiens; identical to SEQ ID NO: 78150

SEQ ID NO: 673987 - RNA, 64 nt, Homo Sapiens; identical to SEQ ID NO: 78151

SEQ ID NO: 673988 - RNA, 64 nt, Homo Sapiens; identical to SEQ ID NO: 78152

SEQ ID NO: 673989 - RNA, 64 nt, Homo Sapiens; identical to SEQ ID NO: 78153

SEQ ID NO: 673990 - RNA, 64 nt, Homo Sapiens; identical to SEQ ID NO: 78154

SEQ ID NO: 673991 - RNA, 64 nt, Homo Sapiens; identical to SEQ ID NO: 78155

SEQ ID NO: 673992 - RNA, 64 nt, Homo Sapiens; identical to SEQ ID NO: 78156

SEQ ID NO: 673993 - RNA, 64 nt, Homo Sapiens; identical to SEQ ID NO: 78157

SEQ ID NO: 673994 - RNA, 64 nt, Homo Sapiens; identical to SEQ ID NO: 78158

SEQ ID NO: 673995 - RNA, 64 nt, Homo Sapiens; identical to SEQ ID NO: 78159

SEQ ID NO: 673996 - RNA, 64 nt, Homo Sapiens; identical to SEQ ID NO: 78160

SEQ ID NO: 673997 - RNA, 64 nt, Homo Sapiens; identical to SEQ ID NO: 78161

SEQ ID NO: 673998 - RNA, 64 nt, Homo Sapiens; identical to SEQ ID NO: 78162

SEQ ID NO: 673999 - RNA, 64 nt, Homo Sapiens; identical to SEQ ID NO: 78163

SEQ ID NO: 674000 - RNA, 64 nt, Homo Sapiens; identical to SEQ ID NO: 78164

SEQ ID NO: 674001 - RNA, 64 nt, Homo Sapiens; identical to SEQ ID NO: 78165

SEQ ID NO: 674002 - RNA, 64 nt, Homo Sapiens; identical to SEQ ID NO: 78166

SEQ ID NO: 674003 - RNA, 64 nt, Homo Sapiens; identical to SEQ ID NO: 78167

SEQ ID NO: 674004 - RNA, 64 nt, Homo Sapiens; identical to SEQ ID NO: 78168

SEQ ID NO: 674005 - RNA, 64 nt, Homo Sapiens; identical to SEQ ID NO: 78169

SEQ ID NO: 674006 - RNA, 64 nt, Homo Sapiens; identical to SEQ ID NO: 78170

SEQ ID NO: 674007 - RNA, 64 nt, Homo Sapiens; identical to SEQ ID NO: 78171

SEQ ID NO: 674008 - RNA, 64 nt, Homo Sapiens; identical to SEQ ID NO: 78172

SEQ ID NO: 674009 - RNA, 64 nt, Homo Sapiens; identical to SEQ ID NO: 78173

SEQ ID NO: 674010 - RNA, 64 nt, Homo Sapiens; identical to SEQ ID NO: 78174

SEQ ID NO: 674011 - RNA, 64 nt, Homo Sapiens; identical to SEQ ID NO: 78175

SEQ ID NO: 674012 - RNA, 64 nt, Homo Sapiens; identical to SEQ ID NO: 78176

SEQ ID NO: 674013 - RNA, 64 nt, Homo Sapiens; identical to SEQ ID NO: 78177

SEQ ID NO: 674014 - RNA, 64 nt, Homo Sapiens; identical to SEQ ID NO: 78178

SEQ ID NO: 674015 - RNA, 64 nt, Homo Sapiens; identical to SEQ ID NO: 78179

SEQ ID NO: 674016 - RNA, 64 nt, Homo Sapiens; identical to SEQ ID NO: 78180

SEQ ID NO: 674017 - RNA, 64 nt, Homo Sapiens; identical to SEQ ID NO: 78181

SEQ ID NO: 674018 - RNA, 64 nt, Homo Sapiens; identical to SEQ ID NO: 78182

SEQ ID NO: 674019 - RNA, 64 nt, Homo Sapiens; identical to SEQ ID NO: 78183

SEQ ID NO: 674020 - RNA, 64 nt, Homo Sapiens; identical to SEQ ID NO: 78184

SEQ ID NO: 674021 - RNA, 64 nt, Homo Sapiens; identical to SEQ ID NO: 78185

SEQ ID NO: 674022 - RNA, 64 nt, Homo Sapiens; identical to SEQ ID NO: 78186

SEQ ID NO: 674023 - RNA, 64 nt, Homo Sapiens; identical to SEQ ID NO: 78187

SEQ ID NO: 674024 - RNA, 64 nt, Homo Sapiens; identical to SEQ ID NO: 78188

SEQ ID NO: 674025 - RNA, 64 nt, Homo Sapiens; identical to SEQ ID NO: 78189

SEQ ID NO: 674026 - RNA, 64 nt, Homo Sapiens; identical to SEQ ID NO: 78190

SEQ ID NO: 674027 - RNA, 64 nt, Homo Sapiens; identical to SEQ ID NO: 78191

SEQ ID NO: 674028 - RNA, 64 nt, Homo Sapiens; identical to SEQ ID NO: 78192

SEQ ID NO: 674029 - RNA, 64 nt, Homo Sapiens; identical to SEQ ID NO: 78193

SEQ ID NO: 674030 - RNA, 64 nt, Homo Sapiens; identical to SEQ ID NO: 78194

SEQ ID NO: 674031 - RNA, 64 nt, Homo Sapiens; identical to SEQ ID NO: 78195

SEQ ID NO: 674032 - RNA, 64 nt, Homo Sapiens; identical to SEQ ID NO: 78196

SEQ ID NO: 674033 - RNA, 64 nt, Homo Sapiens; identical to SEQ ID NO: 78197

SEQ ID NO: 674034 - RNA, 64 nt, Homo Sapiens; identical to SEQ ID NO: 78198

SEQ ID NO: 674035 - RNA, 64 nt, Homo Sapiens; identical to SEQ ID NO: 78199

SEQ ID NO: 674036 - RNA, 64 nt, Homo Sapiens; identical to SEQ ID NO: 78200

SEQ ID NO: 674037 - RNA, 64 nt, Homo Sapiens; identical to SEQ ID NO: 78201

SEQ ID NO: 674038 - RNA, 64 nt, Homo Sapiens; identical to SEQ ID NO: 78202

SEQ ID NO: 674039 - RNA, 64 nt, Homo Sapiens; identical to SEQ ID NO: 78203

SEQ ID NO: 674040 - RNA, 64 nt, Homo Sapiens; identical to SEQ ID NO: 78204

SEQ ID NO: 674041 - RNA, 64 nt, Homo Sapiens; identical to SEQ ID NO: 78205

SEQ ID NO: 674042 - RNA, 64 nt, Homo Sapiens; identical to SEQ ID NO: 78206

SEQ ID NO: 674043 - RNA, 64 nt, Homo Sapiens; identical to SEQ ID NO: 78207

SEQ ID NO: 674044 - RNA, 64 nt, Homo Sapiens; identical to SEQ ID NO: 78208

SEQ ID NO: 674045 - RNA, 64 nt, Homo Sapiens; identical to SEQ ID NO: 78209

SEQ ID NO: 674046 - RNA, 64 nt, Homo Sapiens; identical to SEQ ID NO: 78210

SEQ ID NO: 674047 - RNA, 64 nt, Homo Sapiens; identical to SEQ ID NO: 78211

SEQ ID NO: 674048 - RNA, 64 nt, Homo Sapiens; identical to SEQ ID NO: 78212

SEQ ID NO: 674049 - RNA, 64 nt, Homo Sapiens; identical to SEQ ID NO: 78213

SEQ ID NO: 674050 - RNA, 64 nt, Homo Sapiens; identical to SEQ ID NO: 78214

SEQ ID NO: 674051 - RNA, 64 nt, Homo Sapiens; identical to SEQ ID NO: 78215

SEQ ID NO: 674052 - RNA, 64 nt, Homo Sapiens; identical to SEQ ID NO: 78216

SEQ ID NO: 674053 - RNA, 64 nt, Homo Sapiens; identical to SEQ ID NO: 78217

SEQ ID NO: 674054 - RNA, 64 nt, Homo Sapiens; identical to SEQ ID NO: 78218

SEQ ID NO: 674055 - RNA, 64 nt, Homo Sapiens
gaggaauauaacauugcagaaauuucucauaggggcaugccagugagcaauuacuuuauaaaaa

SEQ ID NO: 674056 - RNA, 64 nt, Homo Sapiens
uacuguggauuaaaaagccuucccuaaaaagagagcaugccagucauagagacacuaauuuggc

SEQ ID NO: 674057 - RNA, 64 nt, Homo Sapiens
acauugcuuuuucuuguuugggagugaaaauugggcaugccauuugauauaugagacuuuaugu

SEQ ID NO: 674058 - RNA, 64 nt, Homo Sapiens
gucccuagacaccucaguuccggcaaugcccugugcaugccaugaacaagauuugcugcauuuc

SEQ ID NO: 674059 - RNA, 64 nt, Homo Sapiens
ucccaccucugccucccaaguaacugggacuauagcaugccaccacacccagcugauuaucaua

SEQ ID NO: 674060 - RNA, 64 nt, Homo Sapiens
ucccacuucugccucccaaguaacugggacuauagcaugccaccacacccagcugauuaucaua

SEQ ID NO: 674061 - RNA, 64 nt, Homo Sapiens; identical to SEQ ID NO: 453035

SEQ ID NO: 674062 - RNA, 64 nt, Homo Sapiens; identical to SEQ ID NO: 453036

SEQ ID NO: 674063 - RNA, 64 nt, Homo Sapiens; identical to SEQ ID NO: 637303

SEQ ID NO: 674064 - RNA, 64 nt, Homo Sapiens; identical to SEQ ID NO: 637304

SEQ ID NO: 674065 - RNA, 64 nt, Homo Sapiens; identical to SEQ ID NO: 637305

SEQ ID NO: 674066 - RNA, 64 nt, Homo Sapiens; identical to SEQ ID NO: 637306

SEQ ID NO: 674067 - RNA, 64 nt, Homo Sapiens; identical to SEQ ID NO: 637307

SEQ ID NO: 674068 - RNA, 64 nt, Homo Sapiens; identical to SEQ ID NO: 637308

SEQ ID NO: 674069 - RNA, 64 nt, Homo Sapiens; identical to SEQ ID NO: 637309

SEQ ID NO: 674070 - RNA, 64 nt, Homo Sapiens; identical to SEQ ID NO: 637310

SEQ ID NO: 674071 - RNA, 64 nt, Homo Sapiens; identical to SEQ ID NO: 637311

SEQ ID NO: 674072 - RNA, 64 nt, Homo Sapiens; identical to SEQ ID NO: 637312

SEQ ID NO: 674073 - RNA, 64 nt, Homo Sapiens; identical to SEQ ID NO: 637313

SEQ ID NO: 674074 - RNA, 64 nt, Homo Sapiens; identical to SEQ ID NO: 637314

SEQ ID NO: 674075 - RNA, 64 nt, Homo Sapiens; identical to SEQ ID NO: 637315

SEQ ID NO: 674076 - RNA, 64 nt, Homo Sapiens; identical to SEQ ID NO: 637316

SEQ ID NO: 674077 - RNA, 64 nt, Homo Sapiens; identical to SEQ ID NO: 637317

SEQ ID NO: 674078 - RNA, 64 nt, Homo Sapiens; identical to SEQ ID NO: 637318

SEQ ID NO: 674079 - RNA, 64 nt, Homo Sapiens; identical to SEQ ID NO: 637319

SEQ ID NO: 674080 - RNA, 64 nt, Homo Sapiens; identical to SEQ ID NO: 637320

SEQ ID NO: 674081 - RNA, 64 nt, Homo Sapiens; identical to SEQ ID NO: 637321

SEQ ID NO: 674082 - RNA, 64 nt, Homo Sapiens; identical to SEQ ID NO: 637322

SEQ ID NO: 674083 - RNA, 64 nt, Homo Sapiens; identical to SEQ ID NO: 637323

SEQ ID NO: 674084 - RNA, 64 nt, Homo Sapiens; identical to SEQ ID NO: 637324

SEQ ID NO: 674085 - RNA, 64 nt, Homo Sapiens; identical to SEQ ID NO: 637325

SEQ ID NO: 674086 - RNA, 64 nt, Homo Sapiens; identical to SEQ ID NO: 637326

SEQ ID NO: 674087 - RNA, 64 nt, Homo Sapiens; identical to SEQ ID NO: 348336

SEQ ID NO: 674088 - RNA, 64 nt, Homo Sapiens; identical to SEQ ID NO: 348337

SEQ ID NO: 674089 - RNA, 64 nt, Homo Sapiens; identical to SEQ ID NO: 348338

SEQ ID NO: 674090 - RNA, 64 nt, Homo Sapiens; identical to SEQ ID NO: 348339

SEQ ID NO: 674091 - RNA, 64 nt, Homo Sapiens; identical to SEQ ID NO: 348340

SEQ ID NO: 674092 - RNA, 64 nt, Homo Sapiens; identical to SEQ ID NO: 348341

SEQ ID NO: 674093 - RNA, 64 nt, Homo Sapiens; identical to SEQ ID NO: 348342

SEQ ID NO: 674094 - RNA, 64 nt, Homo Sapiens; identical to SEQ ID NO: 348343

SEQ ID NO: 674095 - RNA, 64 nt, Homo Sapiens; identical to SEQ ID NO: 348344

SEQ ID NO: 674096 - RNA, 64 nt, Homo Sapiens; identical to SEQ ID NO: 348345

SEQ ID NO: 674097 - RNA, 64 nt, Homo Sapiens; identical to SEQ ID NO: 348346

SEQ ID NO: 674098 - RNA, 64 nt, Homo Sapiens; identical to SEQ ID NO: 348347

SEQ ID NO: 674099 - RNA, 64 nt, Homo Sapiens; identical to SEQ ID NO: 348348

SEQ ID NO: 674100 - RNA, 64 nt, Homo Sapiens; identical to SEQ ID NO: 348349

SEQ ID NO: 674101 - RNA, 64 nt, Homo Sapiens; identical to SEQ ID NO: 348350

SEQ ID NO: 674102 - RNA, 64 nt, Homo Sapiens; identical to SEQ ID NO: 348351

SEQ ID NO: 674103 - RNA, 64 nt, Homo Sapiens; identical to SEQ ID NO: 516747

SEQ ID NO: 674104 - RNA, 64 nt, Homo Sapiens; identical to SEQ ID NO: 516748

SEQ ID NO: 674105 - RNA, 64 nt, Homo Sapiens; identical to SEQ ID NO: 516749

SEQ ID NO: 674106 - RNA, 64 nt, Homo Sapiens; identical to SEQ ID NO: 516750

SEQ ID NO: 674107 - RNA, 64 nt, Homo Sapiens; identical to SEQ ID NO: 516751

SEQ ID NO: 674108 - RNA, 64 nt, Homo Sapiens; identical to SEQ ID NO: 516752

SEQ ID NO: 674109 - RNA, 64 nt, Homo Sapiens; identical to SEQ ID NO: 516753

SEQ ID NO: 674110 - RNA, 64 nt, Homo Sapiens; identical to SEQ ID NO: 516754

SEQ ID NO: 674111 - RNA, 64 nt, Homo Sapiens; identical to SEQ ID NO: 516755

SEQ ID NO: 674112 - RNA, 64 nt, Homo Sapiens; identical to SEQ ID NO: 516756

SEQ ID NO: 674113 - RNA, 64 nt, Homo Sapiens; identical to SEQ ID NO: 516757

SEQ ID NO: 674114 - RNA, 64 nt, Homo Sapiens; identical to SEQ ID NO: 516758

SEQ ID NO: 674115 - RNA, 64 nt, Homo Sapiens; identical to SEQ ID NO: 516759

SEQ ID NO: 674116 - RNA, 64 nt, Homo Sapiens; identical to SEQ ID NO: 516760

SEQ ID NO: 674117 - RNA, 64 nt, Homo Sapiens; identical to SEQ ID NO: 516761

SEQ ID NO: 674118 - RNA, 64 nt, Homo Sapiens; identical to SEQ ID NO: 516762

SEQ ID NO: 674119 - RNA, 64 nt, Homo Sapiens; identical to SEQ ID NO: 516763

SEQ ID NO: 674120 - RNA, 64 nt, Homo Sapiens; identical to SEQ ID NO: 516764

SEQ ID NO: 674121 - RNA, 64 nt, Homo Sapiens; identical to SEQ ID NO: 516765

SEQ ID NO: 674122 - RNA, 64 nt, Homo Sapiens; identical to SEQ ID NO: 516766

SEQ ID NO: 674123 - RNA, 64 nt, Homo Sapiens; identical to SEQ ID NO: 516767

SEQ ID NO: 674124 - RNA, 64 nt, Homo Sapiens; identical to SEQ ID NO: 516768

SEQ ID NO: 674125 - RNA, 64 nt, Homo Sapiens; identical to SEQ ID NO: 516769

SEQ ID NO: 674126 - RNA, 64 nt, Homo Sapiens; identical to SEQ ID NO: 516770

SEQ ID NO: 674127 - RNA, 64 nt, Homo Sapiens; identical to SEQ ID NO: 516771

SEQ ID NO: 674128 - RNA, 64 nt, Homo Sapiens; identical to SEQ ID NO: 516772

SEQ ID NO: 674129 - RNA, 64 nt, Homo Sapiens; identical to SEQ ID NO: 516773

SEQ ID NO: 674130 - RNA, 64 nt, Homo Sapiens; identical to SEQ ID NO: 516774

SEQ ID NO: 674131 - RNA, 64 nt, Homo Sapiens; identical to SEQ ID NO: 516775

SEQ ID NO: 674132 - RNA, 64 nt, Homo Sapiens; identical to SEQ ID NO: 516776

SEQ ID NO: 674133 - RNA, 64 nt, Homo Sapiens; identical to SEQ ID NO: 516777

SEQ ID NO: 674134 - RNA, 64 nt, Homo Sapiens; identical to SEQ ID NO: 660962

SEQ ID NO: 674135 - RNA, 64 nt, Homo Sapiens; identical to SEQ ID NO: 660963

SEQ ID NO: 674136 - RNA, 64 nt, Homo Sapiens; identical to SEQ ID NO: 660964

SEQ ID NO: 674137 - RNA, 64 nt, Homo Sapiens; identical to SEQ ID NO: 660965

SEQ ID NO: 674138 - RNA, 64 nt, Homo Sapiens; identical to SEQ ID NO: 660966

SEQ ID NO: 674139 - RNA, 64 nt, Homo Sapiens; identical to SEQ ID NO: 660967

SEQ ID NO: 674140 - RNA, 64 nt, Homo Sapiens; identical to SEQ ID NO: 660968

SEQ ID NO: 674141 - RNA, 64 nt, Homo Sapiens; identical to SEQ ID NO: 660969

SEQ ID NO: 674142 - RNA, 64 nt, Homo Sapiens; identical to SEQ ID NO: 660970

SEQ ID NO: 674143 - RNA, 64 nt, Homo Sapiens; identical to SEQ ID NO: 660971

SEQ ID NO: 674144 - RNA, 64 nt, Homo Sapiens; identical to SEQ ID NO: 660972

SEQ ID NO: 674145 - RNA, 64 nt, Homo Sapiens; identical to SEQ ID NO: 660973

SEQ ID NO: 674146 - RNA, 64 nt, Homo Sapiens; identical to SEQ ID NO: 660974

SEQ ID NO: 674147 - RNA, 64 nt, Homo Sapiens; identical to SEQ ID NO: 660975

SEQ ID NO: 674148 - RNA, 64 nt, Homo Sapiens; identical to SEQ ID NO: 660976

SEQ ID NO: 674149 - RNA, 64 nt, Homo Sapiens; identical to SEQ ID NO: 660977

SEQ ID NO: 674150 - RNA, 64 nt, Homo Sapiens; identical to SEQ ID NO: 660978

SEQ ID NO: 674151 - RNA, 64 nt, Homo Sapiens; identical to SEQ ID NO: 660979

SEQ ID NO: 674152 - RNA, 64 nt, Homo Sapiens; identical to SEQ ID NO: 215540

SEQ ID NO: 674153 - RNA, 64 nt, Homo Sapiens; identical to SEQ ID NO: 215541

SEQ ID NO: 674154 - RNA, 64 nt, Homo Sapiens; identical to SEQ ID NO: 215542

SEQ ID NO: 674155 - RNA, 64 nt, Homo Sapiens; identical to SEQ ID NO: 215543

SEQ ID NO: 674156 - RNA, 64 nt, Homo Sapiens; identical to SEQ ID NO: 215544

SEQ ID NO: 674157 - RNA, 64 nt, Homo Sapiens; identical to SEQ ID NO: 215545

SEQ ID NO: 674158 - RNA, 64 nt, Homo Sapiens; identical to SEQ ID NO: 215546

SEQ ID NO: 674159 - RNA, 64 nt, Homo Sapiens; identical to SEQ ID NO: 215547

SEQ ID NO: 674160 - RNA, 64 nt, Homo Sapiens; identical to SEQ ID NO: 215548

SEQ ID NO: 674161 - RNA, 64 nt, Homo Sapiens; identical to SEQ ID NO: 215549

SEQ ID NO: 674162 - RNA, 64 nt, Homo Sapiens; identical to SEQ ID NO: 215550

SEQ ID NO: 674163 - RNA, 64 nt, Homo Sapiens; identical to SEQ ID NO: 215551

SEQ ID NO: 674164 - RNA, 64 nt, Homo Sapiens; identical to SEQ ID NO: 215552

SEQ ID NO: 674165 - RNA, 64 nt, Homo Sapiens; identical to SEQ ID NO: 215553

SEQ ID NO: 674166 - RNA, 64 nt, Homo Sapiens; identical to SEQ ID NO: 215554

SEQ ID NO: 674167 - RNA, 64 nt, Homo Sapiens; identical to SEQ ID NO: 215555

SEQ ID NO: 674168 - RNA, 64 nt, Homo Sapiens; identical to SEQ ID NO: 215556

SEQ ID NO: 674169 - RNA, 64 nt, Homo Sapiens; identical to SEQ ID NO: 215557

SEQ ID NO: 674170 - RNA, 64 nt, Homo Sapiens; identical to SEQ ID NO: 215558

SEQ ID NO: 674171 - RNA, 64 nt, Homo Sapiens; identical to SEQ ID NO: 215559

SEQ ID NO: 674172 - RNA, 64 nt, Homo Sapiens; identical to SEQ ID NO: 215560

SEQ ID NO: 674173 - RNA, 64 nt, Homo Sapiens; identical to SEQ ID NO: 215561

SEQ ID NO: 674174 - RNA, 64 nt, Homo Sapiens; identical to SEQ ID NO: 215562

SEQ ID NO: 674175 - RNA, 64 nt, Homo Sapiens; identical to SEQ ID NO: 215563

SEQ ID NO: 674176 - RNA, 64 nt, Homo Sapiens; identical to SEQ ID NO: 215564

SEQ ID NO: 674177 - RNA, 64 nt, Homo Sapiens; identical to SEQ ID NO: 215565

SEQ ID NO: 674178 - RNA, 64 nt, Homo Sapiens; identical to SEQ ID NO: 215566

SEQ ID NO: 674179 - RNA, 64 nt, Homo Sapiens; identical to SEQ ID NO: 215567

SEQ ID NO: 674180 - RNA, 64 nt, Homo Sapiens; identical to SEQ ID NO: 215568

SEQ ID NO: 674181 - RNA, 64 nt, Homo Sapiens; identical to SEQ ID NO: 104346

SEQ ID NO: 674182 - RNA, 64 nt, Homo Sapiens; identical to SEQ ID NO: 104347

SEQ ID NO: 674183 - RNA, 64 nt, Homo Sapiens; identical to SEQ ID NO: 104348

SEQ ID NO: 674184 - RNA, 64 nt, Homo Sapiens; identical to SEQ ID NO: 104349

SEQ ID NO: 674185 - RNA, 64 nt, Homo Sapiens; identical to SEQ ID NO: 104350

SEQ ID NO: 674186 - RNA, 64 nt, Homo Sapiens; identical to SEQ ID NO: 104351

SEQ ID NO: 674187 - RNA, 64 nt, Homo Sapiens; identical to SEQ ID NO: 104352

SEQ ID NO: 674188 - RNA, 64 nt, Homo Sapiens; identical to SEQ ID NO: 104353

SEQ ID NO: 674189 - RNA, 64 nt, Homo Sapiens; identical to SEQ ID NO: 104354

SEQ ID NO: 674190 - RNA, 64 nt, Homo Sapiens; identical to SEQ ID NO: 104355

SEQ ID NO: 674191 - RNA, 64 nt, Homo Sapiens; identical to SEQ ID NO: 104356

SEQ ID NO: 674192 - RNA, 64 nt, Homo Sapiens; identical to SEQ ID NO: 104357

SEQ ID NO: 674193 - RNA, 64 nt, Homo Sapiens; identical to SEQ ID NO: 104358

SEQ ID NO: 674194 - RNA, 64 nt, Homo Sapiens; identical to SEQ ID NO: 104359

SEQ ID NO: 674195 - RNA, 64 nt, Homo Sapiens; identical to SEQ ID NO: 104360

SEQ ID NO: 674196 - RNA, 64 nt, Homo Sapiens; identical to SEQ ID NO: 104361

SEQ ID NO: 674197 - RNA, 64 nt, Homo Sapiens; identical to SEQ ID NO: 104362

SEQ ID NO: 674198 - RNA, 64 nt, Homo Sapiens; identical to SEQ ID NO: 104363

SEQ ID NO: 674199 - RNA, 64 nt, Homo Sapiens; identical to SEQ ID NO: 104364

SEQ ID NO: 674200 - RNA, 64 nt, Homo Sapiens; identical to SEQ ID NO: 104365

SEQ ID NO: 674201 - RNA, 64 nt, Homo Sapiens; identical to SEQ ID NO: 104366

SEQ ID NO: 674202 - RNA, 64 nt, Homo Sapiens; identical to SEQ ID NO: 104367

SEQ ID NO: 674203 - RNA, 64 nt, Homo Sapiens; identical to SEQ ID NO: 104368

SEQ ID NO: 674204 - RNA, 64 nt, Homo Sapiens; identical to SEQ ID NO: 104369

SEQ ID NO: 674205 - RNA, 64 nt, Homo Sapiens; identical to SEQ ID NO: 104370

SEQ ID NO: 674206 - RNA, 64 nt, Homo Sapiens; identical to SEQ ID NO: 104371

SEQ ID NO: 674207 - RNA, 64 nt, Homo Sapiens; identical to SEQ ID NO: 104372

SEQ ID NO: 674208 - RNA, 64 nt, Homo Sapiens; identical to SEQ ID NO: 104373

SEQ ID NO: 674209 - RNA, 64 nt, Homo Sapiens; identical to SEQ ID NO: 104374

SEQ ID NO: 674210 - RNA, 64 nt, Homo Sapiens; identical to SEQ ID NO: 104375

SEQ ID NO: 674211 - RNA, 64 nt, Homo Sapiens; identical to SEQ ID NO: 104376

SEQ ID NO: 674212 - RNA, 64 nt, Homo Sapiens; identical to SEQ ID NO: 104377

SEQ ID NO: 674213 - RNA, 64 nt, Homo Sapiens; identical to SEQ ID NO: 104378

SEQ ID NO: 674214 - RNA, 64 nt, Homo Sapiens; identical to SEQ ID NO: 104379

SEQ ID NO: 674215 - RNA, 64 nt, Homo Sapiens; identical to SEQ ID NO: 104380

SEQ ID NO: 674216 - RNA, 64 nt, Homo Sapiens; identical to SEQ ID NO: 104381

SEQ ID NO: 674217 - RNA, 64 nt, Homo Sapiens; identical to SEQ ID NO: 104382

SEQ ID NO: 674218 - RNA, 64 nt, Homo Sapiens; identical to SEQ ID NO: 104383

SEQ ID NO: 674219 - RNA, 64 nt, Homo Sapiens; identical to SEQ ID NO: 104384

SEQ ID NO: 674220 - RNA, 64 nt, Homo Sapiens; identical to SEQ ID NO: 104385

SEQ ID NO: 674221 - RNA, 64 nt, Homo Sapiens; identical to SEQ ID NO: 104386

SEQ ID NO: 674222 - RNA, 64 nt, Homo Sapiens; identical to SEQ ID NO: 104387

SEQ ID NO: 674223 - RNA, 64 nt, Homo Sapiens; identical to SEQ ID NO: 104388

SEQ ID NO: 674224 - RNA, 64 nt, Homo Sapiens; identical to SEQ ID NO: 104389

SEQ ID NO: 674225 - RNA, 64 nt, Homo Sapiens; identical to SEQ ID NO: 104390

SEQ ID NO: 674226 - RNA, 64 nt, Homo Sapiens; identical to SEQ ID NO: 104391

SEQ ID NO: 674227 - RNA, 64 nt, Homo Sapiens; identical to SEQ ID NO: 104392

SEQ ID NO: 674228 - RNA, 64 nt, Homo Sapiens; identical to SEQ ID NO: 104393

SEQ ID NO: 674229 - RNA, 64 nt, Homo Sapiens; identical to SEQ ID NO: 104394

SEQ ID NO: 674230 - RNA, 64 nt, Homo Sapiens; identical to SEQ ID NO: 104395

SEQ ID NO: 674231 - RNA, 64 nt, Homo Sapiens; identical to SEQ ID NO: 104396

SEQ ID NO: 674232 - RNA, 64 nt, Homo Sapiens; identical to SEQ ID NO: 104397

SEQ ID NO: 674233 - RNA, 64 nt, Homo Sapiens; identical to SEQ ID NO: 104398

SEQ ID NO: 674234 - RNA, 64 nt, Homo Sapiens; identical to SEQ ID NO: 104399

SEQ ID NO: 674235 - RNA, 64 nt, Homo Sapiens; identical to SEQ ID NO: 104400

SEQ ID NO: 674236 - RNA, 64 nt, Homo Sapiens; identical to SEQ ID NO: 104401

SEQ ID NO: 674237 - RNA, 64 nt, Homo Sapiens; identical to SEQ ID NO: 104402

SEQ ID NO: 674238 - RNA, 64 nt, Homo Sapiens; identical to SEQ ID NO: 104403

SEQ ID NO: 674239 - RNA, 64 nt, Homo Sapiens; identical to SEQ ID NO: 104404

SEQ ID NO: 674240 - RNA, 64 nt, Homo Sapiens; identical to SEQ ID NO: 104405

SEQ ID NO: 674241 - RNA, 64 nt, Homo Sapiens; identical to SEQ ID NO: 104406

SEQ ID NO: 674242 - RNA, 64 nt, Homo Sapiens; identical to SEQ ID NO: 104407

SEQ ID NO: 674243 - RNA, 64 nt, Homo Sapiens; identical to SEQ ID NO: 104408

SEQ ID NO: 674244 - RNA, 64 nt, Homo Sapiens; identical to SEQ ID NO: 104409

SEQ ID NO: 674245 - RNA, 64 nt, Homo Sapiens; identical to SEQ ID NO: 104410

SEQ ID NO: 674246 - RNA, 64 nt, Homo Sapiens; identical to SEQ ID NO: 104411

SEQ ID NO: 674247 - RNA, 64 nt, Homo Sapiens; identical to SEQ ID NO: 104412

SEQ ID NO: 674248 - RNA, 64 nt, Homo Sapiens; identical to SEQ ID NO: 104413

SEQ ID NO: 674249 - RNA, 64 nt, Homo Sapiens; identical to SEQ ID NO: 104414

SEQ ID NO: 674250 - RNA, 64 nt, Homo Sapiens; identical to SEQ ID NO: 104415

SEQ ID NO: 674251 - RNA, 64 nt, Homo Sapiens; identical to SEQ ID NO: 104416

SEQ ID NO: 674252 - RNA, 64 nt, Homo Sapiens; identical to SEQ ID NO: 104417

SEQ ID NO: 674253 - RNA, 64 nt, Homo Sapiens; identical to SEQ ID NO: 104418

SEQ ID NO: 674254 - RNA, 64 nt, Homo Sapiens; identical to SEQ ID NO: 104419

SEQ ID NO: 674255 - RNA, 64 nt, Homo Sapiens; identical to SEQ ID NO: 104420

SEQ ID NO: 674256 - RNA, 64 nt, Homo Sapiens; identical to SEQ ID NO: 104421

SEQ ID NO: 674257 - RNA, 64 nt, Homo Sapiens; identical to SEQ ID NO: 104422

SEQ ID NO: 674258 - RNA, 64 nt, Homo Sapiens; identical to SEQ ID NO: 104423

SEQ ID NO: 674259 - RNA, 64 nt, Homo Sapiens; identical to SEQ ID NO: 104424

SEQ ID NO: 674260 - RNA, 64 nt, Homo Sapiens; identical to SEQ ID NO: 104425

SEQ ID NO: 674261 - RNA, 64 nt, Homo Sapiens; identical to SEQ ID NO: 143825

SEQ ID NO: 674262 - RNA, 64 nt, Homo Sapiens; identical to SEQ ID NO: 143826

SEQ ID NO: 674263 - RNA, 64 nt, Homo Sapiens; identical to SEQ ID NO: 143827

SEQ ID NO: 674264 - RNA, 64 nt, Homo Sapiens; identical to SEQ ID NO: 143828

SEQ ID NO: 674265 - RNA, 64 nt, Homo Sapiens; identical to SEQ ID NO: 143829

SEQ ID NO: 674266 - RNA, 64 nt, Homo Sapiens; identical to SEQ ID NO: 143830

SEQ ID NO: 674267 - RNA, 64 nt, Homo Sapiens; identical to SEQ ID NO: 143831

SEQ ID NO: 674268 - RNA, 64 nt, Homo Sapiens; identical to SEQ ID NO: 143832

SEQ ID NO: 674269 - RNA, 64 nt, Homo Sapiens; identical to SEQ ID NO: 143833

SEQ ID NO: 674270 - RNA, 64 nt, Homo Sapiens; identical to SEQ ID NO: 143834

SEQ ID NO: 674271 - RNA, 64 nt, Homo Sapiens; identical to SEQ ID NO: 143835

SEQ ID NO: 674272 - RNA, 64 nt, Homo Sapiens; identical to SEQ ID NO: 143836

SEQ ID NO: 674273 - RNA, 64 nt, Homo Sapiens; identical to SEQ ID NO: 143837

SEQ ID NO: 674274 - RNA, 64 nt, Homo Sapiens; identical to SEQ ID NO: 143838

SEQ ID NO: 674275 - RNA, 64 nt, Homo Sapiens; identical to SEQ ID NO: 143839

SEQ ID NO: 674276 - RNA, 64 nt, Homo Sapiens; identical to SEQ ID NO: 143840

SEQ ID NO: 674277 - RNA, 64 nt, Homo Sapiens; identical to SEQ ID NO: 143841

SEQ ID NO: 674278 - RNA, 64 nt, Homo Sapiens; identical to SEQ ID NO: 143842

SEQ ID NO: 674279 - RNA, 64 nt, Homo Sapiens; identical to SEQ ID NO: 143843

SEQ ID NO: 674280 - RNA, 64 nt, Homo Sapiens; identical to SEQ ID NO: 143844

SEQ ID NO: 674281 - RNA, 57 nt, Homo Sapiens; identical to SEQ ID NO: 143845

SEQ ID NO: 674282 - RNA, 54 nt, Homo Sapiens; identical to SEQ ID NO: 143846

SEQ ID NO: 674283 - RNA, 64 nt, Homo Sapiens; identical to SEQ ID NO: 143847

SEQ ID NO: 674284 - RNA, 64 nt, Homo Sapiens; identical to SEQ ID NO: 143848

SEQ ID NO: 674285 - RNA, 64 nt, Homo Sapiens; identical to SEQ ID NO: 143849

SEQ ID NO: 674286 - RNA, 64 nt, Homo Sapiens; identical to SEQ ID NO: 143850

SEQ ID NO: 674287 - RNA, 64 nt, Homo Sapiens; identical to SEQ ID NO: 143851

SEQ ID NO: 674288 - RNA, 64 nt, Homo Sapiens; identical to SEQ ID NO: 143852

SEQ ID NO: 674289 - RNA, 64 nt, Homo Sapiens; identical to SEQ ID NO: 143853

SEQ ID NO: 674290 - RNA, 64 nt, Homo Sapiens; identical to SEQ ID NO: 143854

SEQ ID NO: 674291 - RNA, 64 nt, Homo Sapiens; identical to SEQ ID NO: 143855

SEQ ID NO: 674292 - RNA, 64 nt, Homo Sapiens; identical to SEQ ID NO: 143856

SEQ ID NO: 674293 - RNA, 64 nt, Homo Sapiens; identical to SEQ ID NO: 143857

SEQ ID NO: 674294 - RNA, 64 nt, Homo Sapiens; identical to SEQ ID NO: 143858

SEQ ID NO: 674295 - RNA, 64 nt, Homo Sapiens; identical to SEQ ID NO: 143859

SEQ ID NO: 674296 - RNA, 64 nt, Homo Sapiens; identical to SEQ ID NO: 143860

SEQ ID NO: 674297 - RNA, 64 nt, Homo Sapiens; identical to SEQ ID NO: 143861

SEQ ID NO: 674298 - RNA, 64 nt, Homo Sapiens; identical to SEQ ID NO: 143862

SEQ ID NO: 674299 - RNA, 64 nt, Homo Sapiens; identical to SEQ ID NO: 143863

SEQ ID NO: 674300 - RNA, 64 nt, Homo Sapiens; identical to SEQ ID NO: 143864

SEQ ID NO: 674301 - RNA, 64 nt, Homo Sapiens; identical to SEQ ID NO: 143865

SEQ ID NO: 674302 - RNA, 64 nt, Homo Sapiens; identical to SEQ ID NO: 143866

SEQ ID NO: 674303 - RNA, 64 nt, Homo Sapiens; identical to SEQ ID NO: 143867

SEQ ID NO: 674304 - RNA, 64 nt, Homo Sapiens; identical to SEQ ID NO: 143868

SEQ ID NO: 674305 - RNA, 64 nt, Homo Sapiens; identical to SEQ ID NO: 143869

SEQ ID NO: 674306 - RNA, 64 nt, Homo Sapiens; identical to SEQ ID NO: 143870

SEQ ID NO: 674307 - RNA, 64 nt, Homo Sapiens; identical to SEQ ID NO: 143871

SEQ ID NO: 674308 - RNA, 64 nt, Homo Sapiens; identical to SEQ ID NO: 143872

SEQ ID NO: 674309 - RNA, 64 nt, Homo Sapiens; identical to SEQ ID NO: 143873

SEQ ID NO: 674310 - RNA, 64 nt, Homo Sapiens; identical to SEQ ID NO: 143874

SEQ ID NO: 674311 - RNA, 64 nt, Homo Sapiens; identical to SEQ ID NO: 143875

SEQ ID NO: 674312 - RNA, 64 nt, Homo Sapiens; identical to SEQ ID NO: 143876

SEQ ID NO: 674313 - RNA, 64 nt, Homo Sapiens; identical to SEQ ID NO: 143877

SEQ ID NO: 674314 - RNA, 64 nt, Homo Sapiens; identical to SEQ ID NO: 143878

SEQ ID NO: 674315 - RNA, 64 nt, Homo Sapiens; identical to SEQ ID NO: 143879

SEQ ID NO: 674316 - RNA, 64 nt, Homo Sapiens; identical to SEQ ID NO: 143880

SEQ ID NO: 674317 - RNA, 64 nt, Homo Sapiens; identical to SEQ ID NO: 143881

SEQ ID NO: 674318 - RNA, 64 nt, Homo Sapiens; identical to SEQ ID NO: 143882

SEQ ID NO: 674319 - RNA, 64 nt, Homo Sapiens; identical to SEQ ID NO: 143883

SEQ ID NO: 674320 - RNA, 64 nt, Homo Sapiens; identical to SEQ ID NO: 143884

SEQ ID NO: 674321 - RNA, 64 nt, Homo Sapiens; identical to SEQ ID NO: 143885

SEQ ID NO: 674322 - RNA, 64 nt, Homo Sapiens; identical to SEQ ID NO: 143886

SEQ ID NO: 674323 - RNA, 64 nt, Homo Sapiens; identical to SEQ ID NO: 143887

SEQ ID NO: 674324 - RNA, 64 nt, Homo Sapiens; identical to SEQ ID NO: 143888

SEQ ID NO: 674325 - RNA, 64 nt, Homo Sapiens; identical to SEQ ID NO: 143889

SEQ ID NO: 674326 - RNA, 64 nt, Homo Sapiens; identical to SEQ ID NO: 143890

SEQ ID NO: 674327 - RNA, 64 nt, Homo Sapiens; identical to SEQ ID NO: 143891

SEQ ID NO: 674328 - RNA, 64 nt, Homo Sapiens; identical to SEQ ID NO: 143892

SEQ ID NO: 674329 - RNA, 64 nt, Homo Sapiens; identical to SEQ ID NO: 143893

SEQ ID NO: 674330 - RNA, 64 nt, Homo Sapiens; identical to SEQ ID NO: 143894

SEQ ID NO: 674331 - RNA, 64 nt, Homo Sapiens; identical to SEQ ID NO: 143895

SEQ ID NO: 674332 - RNA, 64 nt, Homo Sapiens; identical to SEQ ID NO: 143896

SEQ ID NO: 674333 - RNA, 64 nt, Homo Sapiens; identical to SEQ ID NO: 143897

SEQ ID NO: 674334 - RNA, 64 nt, Homo Sapiens; identical to SEQ ID NO: 143898

SEQ ID NO: 674335 - RNA, 64 nt, Homo Sapiens; identical to SEQ ID NO: 143899

SEQ ID NO: 674336 - RNA, 64 nt, Homo Sapiens; identical to SEQ ID NO: 143900

SEQ ID NO: 674337 - RNA, 64 nt, Homo Sapiens; identical to SEQ ID NO: 143901

SEQ ID NO: 674338 - RNA, 64 nt, Homo Sapiens; identical to SEQ ID NO: 143902

SEQ ID NO: 674339 - RNA, 64 nt, Homo Sapiens; identical to SEQ ID NO: 143903

SEQ ID NO: 674340 - RNA, 64 nt, Homo Sapiens; identical to SEQ ID NO: 143904

SEQ ID NO: 674341 - RNA, 64 nt, Homo Sapiens; identical to SEQ ID NO: 143905

SEQ ID NO: 674342 - RNA, 64 nt, Homo Sapiens; identical to SEQ ID NO: 143906

SEQ ID NO: 674343 - RNA, 60 nt, Homo Sapiens; identical to SEQ ID NO: 143907

SEQ ID NO: 674344 - RNA, 64 nt, Homo Sapiens; identical to SEQ ID NO: 143908

SEQ ID NO: 674345 - RNA, 64 nt, Homo Sapiens; identical to SEQ ID NO: 143909

SEQ ID NO: 674346 - RNA, 64 nt, Homo Sapiens; identical to SEQ ID NO: 143910

SEQ ID NO: 674347 - RNA, 64 nt, Homo Sapiens; identical to SEQ ID NO: 143911

SEQ ID NO: 674348 - RNA, 64 nt, Homo Sapiens; identical to SEQ ID NO: 143912

SEQ ID NO: 674349 - RNA, 64 nt, Homo Sapiens; identical to SEQ ID NO: 143913

SEQ ID NO: 674350 - RNA, 64 nt, Homo Sapiens; identical to SEQ ID NO: 143914

SEQ ID NO: 674351 - RNA, 64 nt, Homo Sapiens; identical to SEQ ID NO: 143915

SEQ ID NO: 674352 - RNA, 64 nt, Homo Sapiens; identical to SEQ ID NO: 143916

SEQ ID NO: 674353 - RNA, 64 nt, Homo Sapiens; identical to SEQ ID NO: 143917

SEQ ID NO: 674354 - RNA, 64 nt, Homo Sapiens; identical to SEQ ID NO: 143918

SEQ ID NO: 674355 - RNA, 64 nt, Homo Sapiens; identical to SEQ ID NO: 143919

SEQ ID NO: 674356 - RNA, 64 nt, Homo Sapiens; identical to SEQ ID NO: 143920

SEQ ID NO: 674357 - RNA, 64 nt, Homo Sapiens; identical to SEQ ID NO: 143921

SEQ ID NO: 674358 - RNA, 64 nt, Homo Sapiens; identical to SEQ ID NO: 143922

SEQ ID NO: 674359 - RNA, 64 nt, Homo Sapiens; identical to SEQ ID NO: 143923

SEQ ID NO: 674360 - RNA, 64 nt, Homo Sapiens; identical to SEQ ID NO: 143924

SEQ ID NO: 674361 - RNA, 64 nt, Homo Sapiens; identical to SEQ ID NO: 143925

SEQ ID NO: 674362 - RNA, 64 nt, Homo Sapiens; identical to SEQ ID NO: 143926

SEQ ID NO: 674363 - RNA, 64 nt, Homo Sapiens; identical to SEQ ID NO: 143927

SEQ ID NO: 674364 - RNA, 64 nt, Homo Sapiens; identical to SEQ ID NO: 143928

SEQ ID NO: 674365 - RNA, 64 nt, Homo Sapiens; identical to SEQ ID NO: 143929

SEQ ID NO: 674366 - RNA, 64 nt, Homo Sapiens; identical to SEQ ID NO: 143930

SEQ ID NO: 674367 - RNA, 64 nt, Homo Sapiens; identical to SEQ ID NO: 143931

SEQ ID NO: 674368 - RNA, 64 nt, Homo Sapiens; identical to SEQ ID NO: 143932

SEQ ID NO: 674369 - RNA, 64 nt, Homo Sapiens; identical to SEQ ID NO: 143933

SEQ ID NO: 674370 - RNA, 64 nt, Homo Sapiens; identical to SEQ ID NO: 143934

SEQ ID NO: 674371 - RNA, 64 nt, Homo Sapiens; identical to SEQ ID NO: 143935

SEQ ID NO: 674372 - RNA, 64 nt, Homo Sapiens; identical to SEQ ID NO: 143936

SEQ ID NO: 674373 - RNA, 64 nt, Homo Sapiens; identical to SEQ ID NO: 143937

SEQ ID NO: 674374 - RNA, 64 nt, Homo Sapiens; identical to SEQ ID NO: 143938

SEQ ID NO: 674375 - RNA, 64 nt, Homo Sapiens; identical to SEQ ID NO: 143939

SEQ ID NO: 674376 - RNA, 64 nt, Homo Sapiens; identical to SEQ ID NO: 143940

SEQ ID NO: 674377 - RNA, 64 nt, Homo Sapiens; identical to SEQ ID NO: 143941

SEQ ID NO: 674378 - RNA, 64 nt, Homo Sapiens; identical to SEQ ID NO: 143942

SEQ ID NO: 674379 - RNA, 64 nt, Homo Sapiens; identical to SEQ ID NO: 143943

SEQ ID NO: 674380 - RNA, 64 nt, Homo Sapiens; identical to SEQ ID NO: 143944

SEQ ID NO: 674381 - RNA, 64 nt, Homo Sapiens; identical to SEQ ID NO: 143945

SEQ ID NO: 674382 - RNA, 64 nt, Homo Sapiens; identical to SEQ ID NO: 143946

SEQ ID NO: 674383 - RNA, 64 nt, Homo Sapiens; identical to SEQ ID NO: 143947

SEQ ID NO: 674384 - RNA, 64 nt, Homo Sapiens; identical to SEQ ID NO: 143948

SEQ ID NO: 674385 - RNA, 64 nt, Homo Sapiens; identical to SEQ ID NO: 143949

SEQ ID NO: 674386 - RNA, 64 nt, Homo Sapiens; identical to SEQ ID NO: 143950

SEQ ID NO: 674387 - RNA, 64 nt, Homo Sapiens; identical to SEQ ID NO: 143951

SEQ ID NO: 674388 - RNA, 64 nt, Homo Sapiens; identical to SEQ ID NO: 143952

SEQ ID NO: 674389 - RNA, 64 nt, Homo Sapiens; identical to SEQ ID NO: 143953

SEQ ID NO: 674390 - RNA, 64 nt, Homo Sapiens; identical to SEQ ID NO: 143954

SEQ ID NO: 674391 - RNA, 64 nt, Homo Sapiens; identical to SEQ ID NO: 143955

SEQ ID NO: 674392 - RNA, 64 nt, Homo Sapiens; identical to SEQ ID NO: 143956

SEQ ID NO: 674393 - RNA, 64 nt, Homo Sapiens; identical to SEQ ID NO: 143957

SEQ ID NO: 674394 - RNA, 64 nt, Homo Sapiens; identical to SEQ ID NO: 143958

SEQ ID NO: 674395 - RNA, 64 nt, Homo Sapiens; identical to SEQ ID NO: 143959

SEQ ID NO: 674396 - RNA, 64 nt, Homo Sapiens; identical to SEQ ID NO: 583839

SEQ ID NO: 674397 - RNA, 64 nt, Homo Sapiens; identical to SEQ ID NO: 583840

SEQ ID NO: 674398 - RNA, 64 nt, Homo Sapiens; identical to SEQ ID NO: 583841

SEQ ID NO: 674399 - RNA, 64 nt, Homo Sapiens; identical to SEQ ID NO: 583842

SEQ ID NO: 674400 - RNA, 64 nt, Homo Sapiens; identical to SEQ ID NO: 583843

SEQ ID NO: 674401 - RNA, 64 nt, Homo Sapiens; identical to SEQ ID NO: 583844

SEQ ID NO: 674402 - RNA, 64 nt, Homo Sapiens; identical to SEQ ID NO: 583845

SEQ ID NO: 674403 - RNA, 64 nt, Homo Sapiens; identical to SEQ ID NO: 583846

SEQ ID NO: 674404 - RNA, 64 nt, Homo Sapiens
uguauacuaccacuuugaauaccccaauugucaaggguaguagcaauugaaguaucucuccuua

SEQ ID NO: 674405 - RNA, 64 nt, Homo Sapiens
acuauucagcuagucagcuaauuauuucaugauuggguaguaaaaaaagggaaaauauauaaag

SEQ ID NO: 674406 - RNA, 64 nt, Homo Sapiens
ugauggagaaaucucaaguuacuggcuuuuauacuuaccaaacaucaguucuucaaauaaggac

SEQ ID NO: 674407 - RNA, 64 nt, Homo Sapiens
cugcuugauucuacuauacaucuugggcaacuaguuaccaaaugaauugugccaccauaacuga

SEQ ID NO: 674408 - RNA, 64 nt, Homo Sapiens
aauggguguaauguuuauuuacugaugcuuuauguuaccaaaacauacaguaaaaaaguagaaa

SEQ ID NO: 674409 - RNA, 64 nt, Homo Sapiens
augaaauacuuuugauaaaaaguuuauuuugugcuuaccaaaaggaaugcuuucacaauagugu

SEQ ID NO: 674410 - RNA, 64 nt, Homo Sapiens
aacacauaaauuaugagauuuuuuuuaaaaguuguuaccaaauacacauuucacauugaaucau

SEQ ID NO: 674411 - RNA, 64 nt, Homo Sapiens
uuaugcauucuuauaacauaaccucagaguaucuuuaccaaagguuuuuaaaguaaaucucuuu

SEQ ID NO: 674412 - RNA, 64 nt, Homo Sapiens
ucuccugcaucagagcaugagcgcuuuauguuaauuaccaaaacugauacaagucucuguacca

SEQ ID NO: 674413 - RNA, 64 nt, Homo Sapiens
guuggcaaacuugauguaacuuuggucauacuauuuaccaaauuacaugcaaccaugugauuac

SEQ ID NO: 674414 - RNA, 64 nt, Homo Sapiens
aggcuuuaaaccucaucuugaacccuccagccucuuaccaaaagcuuuuaaaaaugcuuuuggg

SEQ ID NO: 674415 - RNA, 64 nt, Homo Sapiens
agaaguuugacuuuuauguguuaggauuauuuacuuaccaaauuaaagaaccacuguguuaagu

SEQ ID NO: 674416 - RNA, 64 nt, Homo Sapiens
ucugagaacaguagugaccccuggcagcaauucauuaccaaaacacagacaaaccaaagguaac

SEQ ID NO: 674417 - RNA, 64 nt, Homo Sapiens
cccuaacacuugucuagcaaauggagagccuaauuuaccaaaaugaaacuuguaaauuuuugug

SEQ ID NO: 674418 - RNA, 64 nt, Homo Sapiens
gcacugagauaaauaccuggcaaaacuaaauaaauuaccaaaaaggaaaaaaaauccaccaaac

SEQ ID NO: 674419 - RNA, 64 nt, Homo Sapiens
ccccuuacgaggguguaacaucuauuuguuccucuuaccaaagcaaaaggauuggcuucauaca

SEQ ID NO: 674420 - RNA, 64 nt, Homo Sapiens
aaccauuuucuugauggaacucuuccuagaguuuuuaccaaauagcuaacuuuaguaguaaaac

SEQ ID NO: 674421 - RNA, 64 nt, Homo Sapiens
uuauauccaaagauacacuauaaaaauagaguuuuuaccaaaaaaagauguuuguucucaucuc

SEQ ID NO: 674422 - RNA, 64 nt, Homo Sapiens
cuuacucaggaaagccagcccccauaauauuguauuaccaaacaguaucgcuuuguuaggaagg

SEQ ID NO: 674423 - RNA, 64 nt, Homo Sapiens
gggcuugucacaacgugaagggcuggaauguauauuaccaaaugggaauuuccauuguagguuu

SEQ ID NO: 674424 - RNA, 64 nt, Homo Sapiens
aaaaaccugcaucuucuugaagcaucaguuuuacuuaccaaaugguuuagagucauaagaugac

SEQ ID NO: 674425 - RNA, 64 nt, Homo Sapiens
gucuggaauggcuuucugcaacucuuuuuguaguuuaccaaauauauucuaauuacagguaaua

SEQ ID NO: 674426 - RNA, 64 nt, Homo Sapiens
ucugcuauuuaugcaaaauucuguuuaucccguguuaccaaauuaccauuucagugagaagcuu

SEQ ID NO: 674427 - RNA, 64 nt, Homo Sapiens
caggaaagugaaauuguuacauaagcauaguucauuaccaaauauuccaaagauaacaacuuac

SEQ ID NO: 674428 - RNA, 64 nt, Homo Sapiens
auuccagaguucuugcccuuagauucacaaaaucuuaccaaaauuuuuauuuugaaauaaguuu

SEQ ID NO: 674429 - RNA, 64 nt, Homo Sapiens
gacaacaaaauaaaaacagagguugcuugacucauuaccaaagaggcaaagcaugugcgacccu

SEQ ID NO: 674430 - RNA, 64 nt, Homo Sapiens
gaggcaaagcaugugcgacccuuucugucuuauuuuaccaaaagauggugcaaaucuaugaccu

SEQ ID NO: 674431 - RNA, 64 nt, Homo Sapiens
uuacuguagcuuaaaagguuaguauucauugaguuuaccaaaaguaccaucggguauuuuuuaa

SEQ ID NO: 674432 - RNA, 64 nt, Homo Sapiens
gggaaaacagaggcuuuucuacaaaagccauuuguuaccaaacuuucuauuaauuaugcaucag

SEQ ID NO: 674433 - RNA, 64 nt, Homo Sapiens
gauggcugcaaauguaauuuuuuucaauaucacauuaccaaaaaaaaguuccaacaaagucccu

SEQ ID NO: 674434 - RNA, 64 nt, Homo Sapiens
gcugccaagguuacagugaaguaucuuugaguauuuaccaaagacucauacuuguuaacaauug

SEQ ID NO: 674435 - RNA, 64 nt, Homo Sapiens
acaacugucaguuuuauugauuugaucagaacuguuaccaaaaaucacgagguguaauuuuuaa

SEQ ID NO: 674436 - RNA, 64 nt, Homo Sapiens
guuuuuggaaauucacaccaacacucuucaacgguuaccaaacuagagggacaaagccacagcc

SEQ ID NO: 674437 - RNA, 64 nt, Homo Sapiens
ugauuuugaacugguaauauaaucuaaaucaagauuaccaaaauaauuucagagguugaugugg

SEQ ID NO: 674438 - RNA, 64 nt, Homo Sapiens
accaaaccacaagaaauccaaaaucauuuuagguuuaccaaacauugguggaauuccaucuuuc

SEQ ID NO: 674439 - RNA, 64 nt, Homo Sapiens
uggaaucauuauuugugcaaagggacagacagaucacuuagauugcuauacuaguggacauagg

SEQ ID NO: 674440 - RNA, 64 nt, Homo Sapiens
aaauaucuuaaaauaucuaaaacauuuuuuaaagcacuuagauugucuuacguaugugcauacu

SEQ ID NO: 674441 - RNA, 64 nt, Homo Sapiens
cuuucuaaaaacagggugaaugaauuugcauuuacacuuagacaacugcuaacuuaagaagagg

SEQ ID NO: 674442 - RNA, 64 nt, Homo Sapiens
aucaaaaaauuccuguuuuguuugcagagaccaccacuuagagaaagauuucuucaagcuccau

SEQ ID NO: 674443 - RNA, 64 nt, Homo Sapiens
aguccaaugugcuaugagcaucagcuuacuuugucacuuagagcaagcaaaacccagugcaaga

SEQ ID NO: 674444 - RNA, 64 nt, Homo Sapiens
gauuauaaaacccuucauaaaucaagaaggccaucacuuagaacgaaccccaaacaaaaaugcc

SEQ ID NO: 674445 - RNA, 64 nt, Homo Sapiens
uacccaccaagcucauacagggaaccacacccaacacuuagacaugcgaacaagcagcccccag

SEQ ID NO: 674446 - RNA, 64 nt, Homo Sapiens
guugacuuaauauauuugcuuuuuuucucaccugcacuuagaggaaauuugaacaaguuggaaa

SEQ ID NO: 674447 - RNA, 64 nt, Homo Sapiens
auucuacagucgucgauuuugccaaauugugguacacuuagaaauuuguuacucugguuguugu

SEQ ID NO: 674448 - RNA, 64 nt, Homo Sapiens
cuuuuuggauaugccacugcgcaaccuaaaagcccacuuagaaacccacaaggaggaaggaagg

SEQ ID NO: 674449 - RNA, 64 nt, Homo Sapiens
ucuuggcuguuaacugaaacgagaaagaguuugucacuuagaccuaggaaacuaagguuugagg

SEQ ID NO: 674450 - RNA, 64 nt, Homo Sapiens
aauucagaaaagcacacacugaaauuauuauugccacuuagaaauggguuccuuaaaacaaagg

SEQ ID NO: 674451 - RNA, 64 nt, Homo Sapiens
auucuuacuaaauucagaggaauaggauaaagaucacuuagagaaagggugcuuauggacauag

SEQ ID NO: 674452 - RNA, 64 nt, Homo Sapiens
ggggguucugccccuugugaaggcccauuccuggcacuuagagacagaaagaacucagcaaucu

SEQ ID NO: 674453 - RNA, 64 nt, Homo Sapiens
aaaccuuuaugucugagucugaaaugaaccuguucacuuagacuagauuuuauaguaacaaaau

SEQ ID NO: 674454 - RNA, 64 nt, Homo Sapiens
agaaaacuauugaaagaaaucacaggggaaacugcacuuagacugacagaauugaacaccaaag

SEQ ID NO: 674455 - RNA, 64 nt, Homo Sapiens
gauauuuuuaaaacaggguacaacccccugcugcacacgcuagcauaucuggaaccuacuauga

SEQ ID NO: 674456 - RNA, 64 nt, Homo Sapiens
cgacagggcagaccaaugaugccaggcagcugucacacgcuaguauuggcuucauugugaucug

SEQ ID NO: 674457 - RNA, 64 nt, Homo Sapiens
ucccuuuguauuuccucuuuccaaguugauuccaacacgcuagagcaggguuguccaauagaaa

SEQ ID NO: 674458 - RNA, 64 nt, Homo Sapiens
uucguuugugcgauugaaaucauuuaaguuuccuacacgcuaacuauuucguuuaaauuuguuu

SEQ ID NO: 674459 - RNA, 64 nt, Homo Sapiens
aacuccucugcccuucagccggaggggcugaaauacacgcuaguuuacugcaguucaucucaug

SEQ ID NO: 674460 - RNA, 64 nt, Homo Sapiens
cguggguuguauccugccagguugaguggggcucacacgcuagggugagaugucagaaagcgcu

SEQ ID NO: 674461 - RNA, 64 nt, Homo Sapiens
caagagugccccucagcugcuauucacucuucagacacgcuacuauuuguuuuauauggauuuu

SEQ ID NO: 674462 - RNA, 64 nt, Homo Sapiens
uauuuauuauacuauccuacagccacaccagaagacacgcuaaacugcuuuugaaggggcuuac

SEQ ID NO: 674463 - RNA, 64 nt, Homo Sapiens
cugccuucuuccucuguugccaugugaucucugcacacgcuagcucuccuucgccuucugccau

SEQ ID NO: 674464 - RNA, 64 nt, Homo Sapiens
aacaauuugaauuuuauuaaaaugguuguguugaacacgcuaagauaucuguauuacuugugug

SEQ ID NO: 674465 - RNA, 64 nt, Homo Sapiens
cagcauaguccuggaugcaaggaagucacagcagacacgcuagaaguguggggcucugccauga

SEQ ID NO: 674466 - RNA, 64 nt, Homo Sapiens
uuuaccaugccuggaaauuuuacaggggaagaaaacacgcuaguuauuuaacugcaagcuacua

SEQ ID NO: 674467 - RNA, 64 nt, Homo Sapiens
cgugauaauuuuuuuguuuacuguuaacuuucaaacacgcuaugugugguaguaugaaauguua

SEQ ID NO: 674468 - RNA, 64 nt, Homo Sapiens
ccccacccccacucccggccccgguucccacaggacacgcuaagaagcacagggagcauuuaac

SEQ ID NO: 674469 - RNA, 64 nt, Homo Sapiens
cccgauucacccuguccaaaagguggcuggguuuacacgcuaauauucagacuguuuuucaggg

SEQ ID NO: 674470 - RNA, 64 nt, Homo Sapiens
ucguagaucugauaacccuaucuaaaagaaagucacacgcuaaauguauucuuacauagugcuu

SEQ ID NO: 674471 - RNA, 64 nt, Homo Sapiens
cccuugaaacuugcaggauuuacuuaauaaaaauacacgcuaugagucauaauugugccaaguu

SEQ ID NO: 674472 - RNA, 64 nt, Homo Sapiens
gccgagaggacguucaaguugagaccuaccguuuacacgcuagacccgcugugcguugagguua

SEQ ID NO: 674473 - RNA, 64 nt, Homo Sapiens
guugguuaaauuuaaacauguuuuaaauacacugacacgcuacuagagaagauuuuugucauga

SEQ ID NO: 674474 - RNA, 64 nt, Homo Sapiens
uccugcacggggcuccacggagcccagcucccagacacgcuacuaagugccuaggguugcccgc

SEQ ID NO: 674475 - RNA, 64 nt, Homo Sapiens
accagccgugggaauggcugggcugccaggccagacacgcuagguucuuccaaagagucccaag

SEQ ID NO: 674476 - RNA, 64 nt, Homo Sapiens
agcuuggguaaggacaguggauaguacacacacaacacgcuauccauuugggaagcaaguagcc

SEQ ID NO: 674477 - RNA, 64 nt, Homo Sapiens
aaacagaccgugaacacaaaacaucaaguuccacacacgcuauggaaugguuaugaagggaagc

SEQ ID NO: 674478 - RNA, 64 nt, Homo Sapiens
ccuggagccugagacuggguggaaaaucacuccuacacgcuauccacccacaaacaggcuccga

SEQ ID NO: 674479 - RNA, 64 nt, Homo Sapiens
cacccacaugaacacauucguccauguccgauucacacgcuacaagauaggggauuuuuuuuuu

SEQ ID NO: 674480 - RNA, 64 nt, Homo Sapiens
cacacacacaaacccccagaaacccacaauauguacacgcuaaggaaaaacuagcacccuucug

SEQ ID NO: 674481 - RNA, 64 nt, Homo Sapiens
uucaccucuugaaagucaaaagauaugcuuuauuacacgcuauucaguaggccugaugacuaaa

SEQ ID NO: 674482 - RNA, 64 nt, Homo Sapiens; identical to SEQ ID NO: 195947

SEQ ID NO: 674483 - RNA, 64 nt, Homo Sapiens; identical to SEQ ID NO: 195948

SEQ ID NO: 674484 - RNA, 64 nt, Homo Sapiens; identical to SEQ ID NO: 195949

SEQ ID NO: 674485 - RNA, 64 nt, Homo Sapiens; identical to SEQ ID NO: 195950

SEQ ID NO: 674486 - RNA, 64 nt, Homo Sapiens; identical to SEQ ID NO: 195951

SEQ ID NO: 674487 - RNA, 64 nt, Homo Sapiens; identical to SEQ ID NO: 195952

SEQ ID NO: 674488 - RNA, 64 nt, Homo Sapiens; identical to SEQ ID NO: 195953

SEQ ID NO: 674489 - RNA, 64 nt, Homo Sapiens; identical to SEQ ID NO: 195954

SEQ ID NO: 674490 - RNA, 64 nt, Homo Sapiens; identical to SEQ ID NO: 195955

SEQ ID NO: 674491 - RNA, 64 nt, Homo Sapiens; identical to SEQ ID NO: 195956

SEQ ID NO: 674492 - RNA, 64 nt, Homo Sapiens; identical to SEQ ID NO: 195957

SEQ ID NO: 674493 - RNA, 64 nt, Homo Sapiens; identical to SEQ ID NO: 195958

SEQ ID NO: 674494 - RNA, 64 nt, Homo Sapiens; identical to SEQ ID NO: 195959

SEQ ID NO: 674495 - RNA, 64 nt, Homo Sapiens; identical to SEQ ID NO: 195960

SEQ ID NO: 674496 - RNA, 64 nt, Homo Sapiens; identical to SEQ ID NO: 56439

SEQ ID NO: 674497 - RNA, 64 nt, Homo Sapiens; identical to SEQ ID NO: 56440

SEQ ID NO: 674498 - RNA, 64 nt, Homo Sapiens; identical to SEQ ID NO: 56441

SEQ ID NO: 674499 - RNA, 64 nt, Homo Sapiens; identical to SEQ ID NO: 56442

SEQ ID NO: 674500 - RNA, 64 nt, Homo Sapiens; identical to SEQ ID NO: 56443

SEQ ID NO: 674501 - RNA, 64 nt, Homo Sapiens; identical to SEQ ID NO: 56444

SEQ ID NO: 674502 - RNA, 64 nt, Homo Sapiens; identical to SEQ ID NO: 56445

SEQ ID NO: 674503 - RNA, 64 nt, Homo Sapiens; identical to SEQ ID NO: 56446

SEQ ID NO: 674504 - RNA, 64 nt, Homo Sapiens; identical to SEQ ID NO: 56447

SEQ ID NO: 674505 - RNA, 64 nt, Homo Sapiens; identical to SEQ ID NO: 56448

SEQ ID NO: 674506 - RNA, 64 nt, Homo Sapiens; identical to SEQ ID NO: 56449

SEQ ID NO: 674507 - RNA, 64 nt, Homo Sapiens; identical to SEQ ID NO: 56450

SEQ ID NO: 674508 - RNA, 64 nt, Homo Sapiens; identical to SEQ ID NO: 56451

SEQ ID NO: 674509 - RNA, 64 nt, Homo Sapiens; identical to SEQ ID NO: 56452

SEQ ID NO: 674510 - RNA, 64 nt, Homo Sapiens; identical to SEQ ID NO: 56453

SEQ ID NO: 674511 - RNA, 64 nt, Homo Sapiens; identical to SEQ ID NO: 56454

SEQ ID NO: 674512 - RNA, 64 nt, Homo Sapiens; identical to SEQ ID NO: 56455

SEQ ID NO: 674513 - RNA, 64 nt, Homo Sapiens; identical to SEQ ID NO: 56456

SEQ ID NO: 674514 - RNA, 64 nt, Homo Sapiens; identical to SEQ ID NO: 56457

SEQ ID NO: 674515 - RNA, 64 nt, Homo Sapiens; identical to SEQ ID NO: 56458

SEQ ID NO: 674516 - RNA, 64 nt, Homo Sapiens; identical to SEQ ID NO: 56459

SEQ ID NO: 674517 - RNA, 64 nt, Homo Sapiens; identical to SEQ ID NO: 56460

SEQ ID NO: 674518 - RNA, 64 nt, Homo Sapiens; identical to SEQ ID NO: 56461

SEQ ID NO: 674519 - RNA, 64 nt, Homo Sapiens; identical to SEQ ID NO: 56462

SEQ ID NO: 674520 - RNA, 64 nt, Homo Sapiens; identical to SEQ ID NO: 56463

SEQ ID NO: 674521 - RNA, 64 nt, Homo Sapiens; identical to SEQ ID NO: 56464

SEQ ID NO: 674522 - RNA, 64 nt, Homo Sapiens; identical to SEQ ID NO: 56465

SEQ ID NO: 674523 - RNA, 64 nt, Homo Sapiens; identical to SEQ ID NO: 56466

SEQ ID NO: 674524 - RNA, 64 nt, Homo Sapiens; identical to SEQ ID NO: 56467

SEQ ID NO: 674525 - RNA, 50 nt, Homo Sapiens; identical to SEQ ID NO: 56468

SEQ ID NO: 674526 - RNA, 64 nt, Homo Sapiens; identical to SEQ ID NO: 56469

SEQ ID NO: 674527 - RNA, 64 nt, Homo Sapiens; identical to SEQ ID NO: 56470

SEQ ID NO: 674528 - RNA, 64 nt, Homo Sapiens; identical to SEQ ID NO: 56471

SEQ ID NO: 674529 - RNA, 64 nt, Homo Sapiens; identical to SEQ ID NO: 56472

SEQ ID NO: 674530 - RNA, 64 nt, Homo Sapiens; identical to SEQ ID NO: 56473

SEQ ID NO: 674531 - RNA, 64 nt, Homo Sapiens; identical to SEQ ID NO: 56474

SEQ ID NO: 674532 - RNA, 64 nt, Homo Sapiens; identical to SEQ ID NO: 56475

SEQ ID NO: 674533 - RNA, 64 nt, Homo Sapiens; identical to SEQ ID NO: 56476

SEQ ID NO: 674534 - RNA, 64 nt, Homo Sapiens; identical to SEQ ID NO: 56477

SEQ ID NO: 674535 - RNA, 64 nt, Homo Sapiens; identical to SEQ ID NO: 56478

SEQ ID NO: 674536 - RNA, 64 nt, Homo Sapiens; identical to SEQ ID NO: 56479

SEQ ID NO: 674537 - RNA, 64 nt, Homo Sapiens; identical to SEQ ID NO: 56480

SEQ ID NO: 674538 - RNA, 64 nt, Homo Sapiens; identical to SEQ ID NO: 56481

SEQ ID NO: 674539 - RNA, 64 nt, Homo Sapiens; identical to SEQ ID NO: 56482

SEQ ID NO: 674540 - RNA, 64 nt, Homo Sapiens; identical to SEQ ID NO: 56483

SEQ ID NO: 674541 - RNA, 64 nt, Homo Sapiens; identical to SEQ ID NO: 56484

SEQ ID NO: 674542 - RNA, 64 nt, Homo Sapiens; identical to SEQ ID NO: 56485

SEQ ID NO: 674543 - RNA, 64 nt, Homo Sapiens; identical to SEQ ID NO: 56486

SEQ ID NO: 674544 - RNA, 64 nt, Homo Sapiens; identical to SEQ ID NO: 56487

SEQ ID NO: 674545 - RNA, 64 nt, Homo Sapiens; identical to SEQ ID NO: 56488

SEQ ID NO: 674546 - RNA, 64 nt, Homo Sapiens; identical to SEQ ID NO: 56489

SEQ ID NO: 674547 - RNA, 64 nt, Homo Sapiens; identical to SEQ ID NO: 56490

SEQ ID NO: 674548 - RNA, 64 nt, Homo Sapiens; identical to SEQ ID NO: 56491

SEQ ID NO: 674549 - RNA, 64 nt, Homo Sapiens; identical to SEQ ID NO: 56492

SEQ ID NO: 674550 - RNA, 64 nt, Homo Sapiens; identical to SEQ ID NO: 56493

SEQ ID NO: 674551 - RNA, 64 nt, Homo Sapiens; identical to SEQ ID NO: 56494

SEQ ID NO: 674552 - RNA, 64 nt, Homo Sapiens; identical to SEQ ID NO: 56495

SEQ ID NO: 674553 - RNA, 64 nt, Homo Sapiens; identical to SEQ ID NO: 56496

SEQ ID NO: 674554 - RNA, 64 nt, Homo Sapiens; identical to SEQ ID NO: 56497

SEQ ID NO: 674555 - RNA, 64 nt, Homo Sapiens; identical to SEQ ID NO: 56498

SEQ ID NO: 674556 - RNA, 64 nt, Homo Sapiens; identical to SEQ ID NO: 56499

SEQ ID NO: 674557 - RNA, 64 nt, Homo Sapiens; identical to SEQ ID NO: 56500

SEQ ID NO: 674558 - RNA, 64 nt, Homo Sapiens; identical to SEQ ID NO: 56501

SEQ ID NO: 674559 - RNA, 64 nt, Homo Sapiens; identical to SEQ ID NO: 56502

SEQ ID NO: 674560 - RNA, 64 nt, Homo Sapiens; identical to SEQ ID NO: 56503

SEQ ID NO: 674561 - RNA, 64 nt, Homo Sapiens; identical to SEQ ID NO: 56504

SEQ ID NO: 674562 - RNA, 64 nt, Homo Sapiens; identical to SEQ ID NO: 56505

SEQ ID NO: 674563 - RNA, 64 nt, Homo Sapiens; identical to SEQ ID NO: 56506

SEQ ID NO: 674564 - RNA, 64 nt, Homo Sapiens; identical to SEQ ID NO: 56507

SEQ ID NO: 674565 - RNA, 64 nt, Homo Sapiens; identical to SEQ ID NO: 56508

SEQ ID NO: 674566 - RNA, 64 nt, Homo Sapiens; identical to SEQ ID NO: 56509

SEQ ID NO: 674567 - RNA, 64 nt, Homo Sapiens; identical to SEQ ID NO: 56510

SEQ ID NO: 674568 - RNA, 64 nt, Homo Sapiens; identical to SEQ ID NO: 56511

SEQ ID NO: 674569 - RNA, 64 nt, Homo Sapiens; identical to SEQ ID NO: 56512

SEQ ID NO: 674570 - RNA, 64 nt, Homo Sapiens; identical to SEQ ID NO: 56513

SEQ ID NO: 674571 - RNA, 64 nt, Homo Sapiens; identical to SEQ ID NO: 56514

SEQ ID NO: 674572 - RNA, 64 nt, Homo Sapiens; identical to SEQ ID NO: 56515

SEQ ID NO: 674573 - RNA, 64 nt, Homo Sapiens; identical to SEQ ID NO: 56516

SEQ ID NO: 674574 - RNA, 64 nt, Homo Sapiens; identical to SEQ ID NO: 56517

SEQ ID NO: 674575 - RNA, 64 nt, Homo Sapiens; identical to SEQ ID NO: 56518

SEQ ID NO: 674576 - RNA, 64 nt, Homo Sapiens; identical to SEQ ID NO: 56519

SEQ ID NO: 674577 - RNA, 64 nt, Homo Sapiens; identical to SEQ ID NO: 56520

SEQ ID NO: 674578 - RNA, 64 nt, Homo Sapiens; identical to SEQ ID NO: 56521

SEQ ID NO: 674579 - RNA, 64 nt, Homo Sapiens; identical to SEQ ID NO: 56522

SEQ ID NO: 674580 - RNA, 64 nt, Homo Sapiens; identical to SEQ ID NO: 56523

SEQ ID NO: 674581 - RNA, 64 nt, Homo Sapiens; identical to SEQ ID NO: 56524

SEQ ID NO: 674582 - RNA, 64 nt, Homo Sapiens; identical to SEQ ID NO: 56525

SEQ ID NO: 674583 - RNA, 64 nt, Homo Sapiens; identical to SEQ ID NO: 56526

SEQ ID NO: 674584 - RNA, 64 nt, Homo Sapiens; identical to SEQ ID NO: 56527

SEQ ID NO: 674585 - RNA, 64 nt, Homo Sapiens; identical to SEQ ID NO: 56528

SEQ ID NO: 674586 - RNA, 64 nt, Homo Sapiens; identical to SEQ ID NO: 56529

SEQ ID NO: 674587 - RNA, 64 nt, Homo Sapiens; identical to SEQ ID NO: 56530

SEQ ID NO: 674588 - RNA, 64 nt, Homo Sapiens; identical to SEQ ID NO: 56531

SEQ ID NO: 674589 - RNA, 64 nt, Homo Sapiens; identical to SEQ ID NO: 56532

SEQ ID NO: 674590 - RNA, 64 nt, Homo Sapiens; identical to SEQ ID NO: 56533

SEQ ID NO: 674591 - RNA, 64 nt, Homo Sapiens; identical to SEQ ID NO: 56534

SEQ ID NO: 674592 - RNA, 59 nt, Homo Sapiens; identical to SEQ ID NO: 56535

SEQ ID NO: 674593 - RNA, 64 nt, Homo Sapiens; identical to SEQ ID NO: 56536

SEQ ID NO: 674594 - RNA, 64 nt, Homo Sapiens; identical to SEQ ID NO: 56537

SEQ ID NO: 674595 - RNA, 64 nt, Homo Sapiens; identical to SEQ ID NO: 56538

SEQ ID NO: 674596 - RNA, 64 nt, Homo Sapiens; identical to SEQ ID NO: 56539

SEQ ID NO: 674597 - RNA, 64 nt, Homo Sapiens; identical to SEQ ID NO: 56540

SEQ ID NO: 674598 - RNA, 64 nt, Homo Sapiens; identical to SEQ ID NO: 56541

SEQ ID NO: 674599 - RNA, 64 nt, Homo Sapiens; identical to SEQ ID NO: 56542

SEQ ID NO: 674600 - RNA, 64 nt, Homo Sapiens; identical to SEQ ID NO: 56543

SEQ ID NO: 674601 - RNA, 64 nt, Homo Sapiens; identical to SEQ ID NO: 56544

SEQ ID NO: 674602 - RNA, 64 nt, Homo Sapiens; identical to SEQ ID NO: 56545

SEQ ID NO: 674603 - RNA, 64 nt, Homo Sapiens; identical to SEQ ID NO: 56546

SEQ ID NO: 674604 - RNA, 64 nt, Homo Sapiens; identical to SEQ ID NO: 56547

SEQ ID NO: 674605 - RNA, 64 nt, Homo Sapiens; identical to SEQ ID NO: 56548

SEQ ID NO: 674606 - RNA, 64 nt, Homo Sapiens; identical to SEQ ID NO: 56549

SEQ ID NO: 674607 - RNA, 64 nt, Homo Sapiens; identical to SEQ ID NO: 56550

SEQ ID NO: 674608 - RNA, 64 nt, Homo Sapiens; identical to SEQ ID NO: 56551

SEQ ID NO: 674609 - RNA, 64 nt, Homo Sapiens; identical to SEQ ID NO: 56552

SEQ ID NO: 674610 - RNA, 64 nt, Homo Sapiens; identical to SEQ ID NO: 56553

SEQ ID NO: 674611 - RNA, 64 nt, Homo Sapiens; identical to SEQ ID NO: 56554

SEQ ID NO: 674612 - RNA, 64 nt, Homo Sapiens; identical to SEQ ID NO: 56555

SEQ ID NO: 674613 - RNA, 64 nt, Homo Sapiens; identical to SEQ ID NO: 56556

SEQ ID NO: 674614 - RNA, 62 nt, Homo Sapiens; identical to SEQ ID NO: 56557

SEQ ID NO: 674615 - RNA, 58 nt, Homo Sapiens; identical to SEQ ID NO: 56558

SEQ ID NO: 674616 - RNA, 64 nt, Homo Sapiens; identical to SEQ ID NO: 56559

SEQ ID NO: 674617 - RNA, 64 nt, Homo Sapiens; identical to SEQ ID NO: 56560

SEQ ID NO: 674618 - RNA, 64 nt, Homo Sapiens; identical to SEQ ID NO: 56561

SEQ ID NO: 674619 - RNA, 64 nt, Homo Sapiens; identical to SEQ ID NO: 56562

SEQ ID NO: 674620 - RNA, 64 nt, Homo Sapiens; identical to SEQ ID NO: 56563

SEQ ID NO: 674621 - RNA, 64 nt, Homo Sapiens; identical to SEQ ID NO: 56564

SEQ ID NO: 674622 - RNA, 64 nt, Homo Sapiens; identical to SEQ ID NO: 56565

SEQ ID NO: 674623 - RNA, 64 nt, Homo Sapiens; identical to SEQ ID NO: 56566

SEQ ID NO: 674624 - RNA, 64 nt, Homo Sapiens; identical to SEQ ID NO: 56567

SEQ ID NO: 674625 - RNA, 64 nt, Homo Sapiens; identical to SEQ ID NO: 56568

SEQ ID NO: 674626 - RNA, 64 nt, Homo Sapiens; identical to SEQ ID NO: 56569

SEQ ID NO: 674627 - RNA, 64 nt, Homo Sapiens; identical to SEQ ID NO: 56570

SEQ ID NO: 674628 - RNA, 64 nt, Homo Sapiens; identical to SEQ ID NO: 56571

SEQ ID NO: 674629 - RNA, 64 nt, Homo Sapiens; identical to SEQ ID NO: 56572

SEQ ID NO: 674630 - RNA, 64 nt, Homo Sapiens; identical to SEQ ID NO: 56573

SEQ ID NO: 674631 - RNA, 64 nt, Homo Sapiens; identical to SEQ ID NO: 56574

SEQ ID NO: 674632 - RNA, 64 nt, Homo Sapiens; identical to SEQ ID NO: 56575

SEQ ID NO: 674633 - RNA, 64 nt, Homo Sapiens; identical to SEQ ID NO: 56576

SEQ ID NO: 674634 - RNA, 64 nt, Homo Sapiens; identical to SEQ ID NO: 56577

SEQ ID NO: 674635 - RNA, 64 nt, Homo Sapiens; identical to SEQ ID NO: 56578

SEQ ID NO: 674636 - RNA, 64 nt, Homo Sapiens; identical to SEQ ID NO: 56579

SEQ ID NO: 674637 - RNA, 64 nt, Homo Sapiens; identical to SEQ ID NO: 56580

SEQ ID NO: 674638 - RNA, 64 nt, Homo Sapiens; identical to SEQ ID NO: 56581

SEQ ID NO: 674639 - RNA, 64 nt, Homo Sapiens; identical to SEQ ID NO: 56582

SEQ ID NO: 674640 - RNA, 64 nt, Homo Sapiens
gguccagggcagucgugugucuuacccagcuacacagggugacauuuuggucuagaaccuaguc

SEQ ID NO: 674641 - RNA, 64 nt, Homo Sapiens
cuauacccaaggaguccugugauuugagcuucagcagggugaucuacauuugggugcuuguuuc

SEQ ID NO: 674642 - RNA, 64 nt, Homo Sapiens
aaugccaauagauaugugagauuuucacagucuccagggugacauacuuuucaaguacgguguc

SEQ ID NO: 674643 - RNA, 64 nt, Homo Sapiens
guaauuaggaacgauaccagggagcugccccugucagggugagucuguugaaucauuacaucaa

SEQ ID NO: 674644 - RNA, 64 nt, Homo Sapiens
caguauaaagauacguuugcaaucagugacuacucagggugacacccuugcccuaaagcaggag

SEQ ID NO: 674645 - RNA, 64 nt, Homo Sapiens
guggcagcucucccuggacuugcccugccuggaacagggugauuugcuggaauggaguuaccac

SEQ ID NO: 674646 - RNA, 64 nt, Homo Sapiens
uucauguuauuguuuuauacuggagaagacaaaacagggugaucugaaauguuuuacuuuucac

SEQ ID NO: 674647 - RNA, 64 nt, Homo Sapiens
agaagcuguccguggcggcuuccuugacaugaaacagggugaaguaaccucgauauuaaaauca

SEQ ID NO: 674648 - RNA, 64 nt, Homo Sapiens
ggagaaagccugugcucugguuacuugagagcuccagggugaagcaugugccuucaggggguug

SEQ ID NO: 674649 - RNA, 64 nt, Homo Sapiens
gcccagacucugcccuguugggagggggagaagccagggugauaaaugugggcuuccuuuaaag

SEQ ID NO: 674650 - RNA, 64 nt, Homo Sapiens
gggaguggagaguaggguggucuugugaguugugcagggugaagaccgcuucccugagacaggg

SEQ ID NO: 674651 - RNA, 64 nt, Homo Sapiens
accugccugcccccgggcagcacgggagggagagcagggugagcacgcuuguugguuucagaug

SEQ ID NO: 674652 - RNA, 64 nt, Homo Sapiens
ugugccuucaguacccagccagguucucuggguccagggugacucuccaaagaaauuggccuuc

SEQ ID NO: 674653 - RNA, 64 nt, Homo Sapiens
aaugaagguuuggcuacuuguauaggucugccugcagggugaaaaugccagugugaauauucua

SEQ ID NO: 674654 - RNA, 64 nt, Homo Sapiens
ccaggguggcacuguucacuggcgcugggacagucagggugaccccaccgccuaccucucuaca

SEQ ID NO: 674655 - RNA, 64 nt, Homo Sapiens
augaggaggguggcaggucuuugcagcucccggccagggugaggcggaagugagcccucauccu

SEQ ID NO: 674656 - RNA, 64 nt, Homo Sapiens
aaaugccccaguguuauuuauuccccagugacuccagggugacaaggccugcuugacuuuccag

SEQ ID NO: 674657 - RNA, 64 nt, Homo Sapiens
ucuaagcaaccacacugcuuggcccuucaagggucagggugagacgugaugggcuaggccuccg

SEQ ID NO: 674658 - RNA, 64 nt, Homo Sapiens; identical to SEQ ID NO: 337076

SEQ ID NO: 674659 - RNA, 64 nt, Homo Sapiens; identical to SEQ ID NO: 337077

SEQ ID NO: 674660 - RNA, 64 nt, Homo Sapiens; identical to SEQ ID NO: 337078

SEQ ID NO: 674661 - RNA, 64 nt, Homo Sapiens; identical to SEQ ID NO: 337079

SEQ ID NO: 674662 - RNA, 64 nt, Homo Sapiens; identical to SEQ ID NO: 337080

SEQ ID NO: 674663 - RNA, 64 nt, Homo Sapiens; identical to SEQ ID NO: 337081

SEQ ID NO: 674664 - RNA, 64 nt, Homo Sapiens; identical to SEQ ID NO: 337082

SEQ ID NO: 674665 - RNA, 64 nt, Homo Sapiens; identical to SEQ ID NO: 337083

SEQ ID NO: 674666 - RNA, 64 nt, Homo Sapiens; identical to SEQ ID NO: 337084

SEQ ID NO: 674667 - RNA, 64 nt, Homo Sapiens; identical to SEQ ID NO: 337085

SEQ ID NO: 674668 - RNA, 64 nt, Homo Sapiens; identical to SEQ ID NO: 337086

SEQ ID NO: 674669 - RNA, 64 nt, Homo Sapiens; identical to SEQ ID NO: 337087

SEQ ID NO: 674670 - RNA, 64 nt, Homo Sapiens; identical to SEQ ID NO: 337088

SEQ ID NO: 674671 - RNA, 64 nt, Homo Sapiens; identical to SEQ ID NO: 337089

SEQ ID NO: 674672 - RNA, 64 nt, Homo Sapiens; identical to SEQ ID NO: 337090

SEQ ID NO: 674673 - RNA, 64 nt, Homo Sapiens; identical to SEQ ID NO: 337091

SEQ ID NO: 674674 - RNA, 64 nt, Homo Sapiens; identical to SEQ ID NO: 337092

SEQ ID NO: 674675 - RNA, 64 nt, Homo Sapiens; identical to SEQ ID NO: 337093

SEQ ID NO: 674676 - RNA, 64 nt, Homo Sapiens; identical to SEQ ID NO: 337094

SEQ ID NO: 674677 - RNA, 64 nt, Homo Sapiens; identical to SEQ ID NO: 337095

SEQ ID NO: 674678 - RNA, 64 nt, Homo Sapiens; identical to SEQ ID NO: 337096

SEQ ID NO: 674679 - RNA, 64 nt, Homo Sapiens; identical to SEQ ID NO: 337097

SEQ ID NO: 674680 - RNA, 64 nt, Homo Sapiens; identical to SEQ ID NO: 337098

SEQ ID NO: 674681 - RNA, 64 nt, Homo Sapiens; identical to SEQ ID NO: 337099

SEQ ID NO: 674682 - RNA, 64 nt, Homo Sapiens; identical to SEQ ID NO: 337100

SEQ ID NO: 674683 - RNA, 64 nt, Homo Sapiens; identical to SEQ ID NO: 337101

SEQ ID NO: 674684 - RNA, 64 nt, Homo Sapiens; identical to SEQ ID NO: 337102

SEQ ID NO: 674685 - RNA, 64 nt, Homo Sapiens; identical to SEQ ID NO: 337103

SEQ ID NO: 674686 - RNA, 64 nt, Homo Sapiens; identical to SEQ ID NO: 337104

SEQ ID NO: 674687 - RNA, 64 nt, Homo Sapiens; identical to SEQ ID NO: 337105

SEQ ID NO: 674688 - RNA, 64 nt, Homo Sapiens; identical to SEQ ID NO: 337106

SEQ ID NO: 674689 - RNA, 64 nt, Homo Sapiens; identical to SEQ ID NO: 337107

SEQ ID NO: 674690 - RNA, 64 nt, Homo Sapiens; identical to SEQ ID NO: 337108

SEQ ID NO: 674691 - RNA, 64 nt, Homo Sapiens; identical to SEQ ID NO: 147421

SEQ ID NO: 674692 - RNA, 64 nt, Homo Sapiens; identical to SEQ ID NO: 147422

SEQ ID NO: 674693 - RNA, 64 nt, Homo Sapiens; identical to SEQ ID NO: 147423

SEQ ID NO: 674694 - RNA, 64 nt, Homo Sapiens; identical to SEQ ID NO: 147424

SEQ ID NO: 674695 - RNA, 64 nt, Homo Sapiens; identical to SEQ ID NO: 147425

SEQ ID NO: 674696 - RNA, 64 nt, Homo Sapiens; identical to SEQ ID NO: 147426

SEQ ID NO: 674697 - RNA, 64 nt, Homo Sapiens; identical to SEQ ID NO: 147427

SEQ ID NO: 674698 - RNA, 64 nt, Homo Sapiens; identical to SEQ ID NO: 147428

SEQ ID NO: 674699 - RNA, 64 nt, Homo Sapiens
ggccccuccauuuuccccauuuucuuaucucccugaccaaaauugcuuugacuucuaaauguuu

SEQ ID NO: 674700 - RNA, 64 nt, Homo Sapiens
aauacucccaggaaauagcgcaggacaucacaaggaccaaaaaggcaauucuuauuuaaauguu

SEQ ID NO: 674701 - RNA, 64 nt, Homo Sapiens
uccuuucccacuggcucuguauaaaaaacuucuggaccaaaagccaucauuggaagauuuaaaa

SEQ ID NO: 674702 - RNA, 64 nt, Homo Sapiens
agaugcgcucugcauacgcuuuucuauacacugggaccaaaaugauguugacuuaauuccaaau

SEQ ID NO: 674703 - RNA, 64 nt, Homo Sapiens
ggagcccgcucuguggggaacccgggaggagucugaccaaaaaugauucagauggugcacuggc

SEQ ID NO: 674704 - RNA, 64 nt, Homo Sapiens
agggcauggcggugcagagguagcacccagaagggaccaaaagcggcccucaggguggggcacu

SEQ ID NO: 674705 - RNA, 64 nt, Homo Sapiens
uauucucagauucaaagaaagagcaacuacuuuggaccaaaagcccauggccuggggagcuggg

SEQ ID NO: 674706 - RNA, 64 nt, Homo Sapiens
ggauaggguucuaaaggugguuuucuauccaaacgaccaaaaaaccaacaguaacaccagugaa

SEQ ID NO: 674707 - RNA, 64 nt, Homo Sapiens
uuaugggaccacauaguauaagugguccguuguugaccaaaauguuguuaugcaggcaugacug

SEQ ID NO: 674708 - RNA, 64 nt, Homo Sapiens
uauagaaacuuaauuauuagacugguaaaauaaagaccaaaauaugcagauuucuaauuggcau

SEQ ID NO: 674709 - RNA, 64 nt, Homo Sapiens
agcccuagagccaaccagucuguaggaaagagcagaccaaaaucgaaaacaccaugucauggag

SEQ ID NO: 674710 - RNA, 64 nt, Homo Sapiens
auccagcuucugugcaccucgcucauggccaccagaccaaaagcaccaaaggcaacagagucua

SEQ ID NO: 674711 - RNA, 64 nt, Homo Sapiens
uuuucuacccagagaccaagguguucuucccaaagaccaaaauauucuacccauaugucaggac

SEQ ID NO: 674712 - RNA, 64 nt, Homo Sapiens
uuuucuacccagagaccaagguuaucuuccuaaagaccaaaauauucuacccauaugucaggac

SEQ ID NO: 674713 - RNA, 64 nt, Homo Sapiens
cagggguuggcugggaggaggaagaccauucugugaccaaaauaccuuggucauuuuuuuuaua

SEQ ID NO: 674714 - RNA, 64 nt, Homo Sapiens
auuuuuuugaaugaguuuuuuaaauuuuuuagaugaccaaaacuugcagggcaggggaugccca

SEQ ID NO: 674715 - RNA, 64 nt, Homo Sapiens
acugacagauggcaaggcucaacaucuugggacagaccaaaaccacaggaagcacaugauugag

SEQ ID NO: 674716 - RNA, 64 nt, Homo Sapiens
caguguugcagagauuucucgacucugauucacugaccaaaaguugaagccugaaauaauuuag

SEQ ID NO: 674717 - RNA, 64 nt, Homo Sapiens
ccacuaagaaaaacagauucucagagaacagugugaccaaaaacaggaccccaagagcagugau

SEQ ID NO: 674718 - RNA, 64 nt, Homo Sapiens
gucucaaagucaacagcccaccaacggcggugcugaccaaaaauugaugccauggaacucaagc

SEQ ID NO: 674719 - RNA, 64 nt, Homo Sapiens
ccacuuggguaugugaauuauucaugucccagaagaccaaaaagugcucugguucugagaugag

SEQ ID NO: 674720 - RNA, 64 nt, Homo Sapiens
cacacaccugggaaagggaugcugccccaagggggaccaaaagggccggacguuacagggugaa

SEQ ID NO: 674721 - RNA, 64 nt, Homo Sapiens; identical to SEQ ID NO: 74019

SEQ ID NO: 674722 - RNA, 64 nt, Homo Sapiens; identical to SEQ ID NO: 74020

SEQ ID NO: 674723 - RNA, 64 nt, Homo Sapiens; identical to SEQ ID NO: 74021

SEQ ID NO: 674724 - RNA, 64 nt, Homo Sapiens; identical to SEQ ID NO: 74022

SEQ ID NO: 674725 - RNA, 64 nt, Homo Sapiens; identical to SEQ ID NO: 74023

SEQ ID NO: 674726 - RNA, 64 nt, Homo Sapiens; identical to SEQ ID NO: 74024

SEQ ID NO: 674727 - RNA, 64 nt, Homo Sapiens; identical to SEQ ID NO: 74025

SEQ ID NO: 674728 - RNA, 64 nt, Homo Sapiens; identical to SEQ ID NO: 74026

SEQ ID NO: 674729 - RNA, 64 nt, Homo Sapiens; identical to SEQ ID NO: 74027

SEQ ID NO: 674730 - RNA, 64 nt, Homo Sapiens; identical to SEQ ID NO: 74028

SEQ ID NO: 674731 - RNA, 64 nt, Homo Sapiens; identical to SEQ ID NO: 74029

SEQ ID NO: 674732 - RNA, 64 nt, Homo Sapiens; identical to SEQ ID NO: 74030

SEQ ID NO: 674733 - RNA, 64 nt, Homo Sapiens; identical to SEQ ID NO: 74031

SEQ ID NO: 674734 - RNA, 64 nt, Homo Sapiens; identical to SEQ ID NO: 74032

SEQ ID NO: 674735 - RNA, 64 nt, Homo Sapiens; identical to SEQ ID NO: 74033

SEQ ID NO: 674736 - RNA, 64 nt, Homo Sapiens; identical to SEQ ID NO: 74034

SEQ ID NO: 674737 - RNA, 64 nt, Homo Sapiens; identical to SEQ ID NO: 74035

SEQ ID NO: 674738 - RNA, 64 nt, Homo Sapiens; identical to SEQ ID NO: 74036

SEQ ID NO: 674739 - RNA, 64 nt, Homo Sapiens; identical to SEQ ID NO: 74037

SEQ ID NO: 674740 - RNA, 64 nt, Homo Sapiens; identical to SEQ ID NO: 74038

SEQ ID NO: 674741 - RNA, 64 nt, Homo Sapiens; identical to SEQ ID NO: 74039

SEQ ID NO: 674742 - RNA, 64 nt, Homo Sapiens; identical to SEQ ID NO: 74040

SEQ ID NO: 674743 - RNA, 64 nt, Homo Sapiens; identical to SEQ ID NO: 74041

SEQ ID NO: 674744 - RNA, 64 nt, Homo Sapiens; identical to SEQ ID NO: 74042

SEQ ID NO: 674745 - RNA, 64 nt, Homo Sapiens; identical to SEQ ID NO: 74043

SEQ ID NO: 674746 - RNA, 64 nt, Homo Sapiens; identical to SEQ ID NO: 74044

SEQ ID NO: 674747 - RNA, 64 nt, Homo Sapiens; identical to SEQ ID NO: 74045

SEQ ID NO: 674748 - RNA, 64 nt, Homo Sapiens; identical to SEQ ID NO: 74046

SEQ ID NO: 674749 - RNA, 64 nt, Homo Sapiens; identical to SEQ ID NO: 74047

SEQ ID NO: 674750 - RNA, 64 nt, Homo Sapiens; identical to SEQ ID NO: 74048

SEQ ID NO: 674751 - RNA, 64 nt, Homo Sapiens; identical to SEQ ID NO: 74049

SEQ ID NO: 674752 - RNA, 64 nt, Homo Sapiens; identical to SEQ ID NO: 74050

SEQ ID NO: 674753 - RNA, 64 nt, Homo Sapiens; identical to SEQ ID NO: 74051

SEQ ID NO: 674754 - RNA, 64 nt, Homo Sapiens; identical to SEQ ID NO: 74052

SEQ ID NO: 674755 - RNA, 64 nt, Homo Sapiens; identical to SEQ ID NO: 74053

SEQ ID NO: 674756 - RNA, 64 nt, Homo Sapiens; identical to SEQ ID NO: 74054

SEQ ID NO: 674757 - RNA, 64 nt, Homo Sapiens; identical to SEQ ID NO: 74055

SEQ ID NO: 674758 - RNA, 64 nt, Homo Sapiens; identical to SEQ ID NO: 74056

SEQ ID NO: 674759 - RNA, 64 nt, Homo Sapiens; identical to SEQ ID NO: 74057

SEQ ID NO: 674760 - RNA, 64 nt, Homo Sapiens; identical to SEQ ID NO: 74058

SEQ ID NO: 674761 - RNA, 64 nt, Homo Sapiens; identical to SEQ ID NO: 74059

SEQ ID NO: 674762 - RNA, 64 nt, Homo Sapiens; identical to SEQ ID NO: 74060

SEQ ID NO: 674763 - RNA, 64 nt, Homo Sapiens; identical to SEQ ID NO: 74061

SEQ ID NO: 674764 - RNA, 61 nt, Homo Sapiens
agacuguuuuugacaauuuuuuuaucaagaaagagcaaauaaaaagcagugguaaugaucc

SEQ ID NO: 674765 - RNA, 61 nt, Homo Sapiens
acagcucagaauuccagcaguucauccagucagagcaaaaugguuaauugcccaguuuguc

SEQ ID NO: 674766 - RNA, 61 nt, Homo Sapiens
aaauucuacacaaggcuuucaagaccaucagagagcaaaaccacauguucugucuugagga

SEQ ID NO: 674767 - RNA, 61 nt, Homo Sapiens
acauguucugucuugaggagccauagcagaaagagcaaauuagucauuauuuacugaacau

SEQ ID NO: 674768 - RNA, 61 nt, Homo Sapiens
ucuagauuggagugcugcacaaacaaacauaagagcaaagcaaaacuguaucacauagggu

SEQ ID NO: 674769 - RNA, 61 nt, Homo Sapiens
ugcuggucuugcaaguuugucuaccaguaagagagcaaaguuuccuuccuuucuucucuuu

SEQ ID NO: 674770 - RNA, 61 nt, Homo Sapiens
uaaguugucacccaauaucuuagacacuuugagagcaaagggggugcuguaaauaaguaua

SEQ ID NO: 674771 - RNA, 61 nt, Homo Sapiens
cuccaccucagaaauucugaaauggguaguaagagcaaauuuucauuuuaaagcacaccug

SEQ ID NO: 674772 - RNA, 61 nt, Homo Sapiens
aaagccacugaagaguauaaauuuuacucuaagagcaaagguugugcagugcuguguaugg

SEQ ID NO: 674773 - RNA, 61 nt, Homo Sapiens
caaaagccugaaggaaagaaauacugaaagaagagcaaauaagcuuggggaagagaauucc

SEQ ID NO: 674774 - RNA, 61 nt, Homo Sapiens
gucacuaaacuuggauaaauaaaagcaguuuagagcaaacuuaccauauuauuguuuuuaa

SEQ ID NO: 674775 - RNA, 61 nt, Homo Sapiens
agauuuuuuuuuuccuuuucaagaggguugaagagcaaagcuuuaacuauagccuagagaa

SEQ ID NO: 674776 - RNA, 61 nt, Homo Sapiens
gccaucucaaaaaauauacagccugggcaaaagagcaaaacgaucgugccacuucacucca

SEQ ID NO: 674777 - RNA, 61 nt, Homo Sapiens
ugacaaagauguguagcuguaagaauugaguagagcaaaaauaauaauaaacuuuuucaga

SEQ ID NO: 674778 - RNA, 61 nt, Homo Sapiens
agaaaucuggcuguccuuccagaaugagcagagagcaaaggggguaaccuagacuucagag

SEQ ID NO: 674779 - RNA, 61 nt, Homo Sapiens
uaacaggagaaaggacaaccucaacucugaaagagcaaaccuccuccugugucacugaaua

SEQ ID NO: 674780 - RNA, 61 nt, Homo Sapiens
aaaaauuucaacuuguauauaaggcagaaagagagcaaaugaccaauauggaauaaagaag

SEQ ID NO: 674781 - RNA, 61 nt, Homo Sapiens
uuaauaauaauucuuuuuuaggccauguuggagagcaaaaccucugggagcugaagcacac

SEQ ID NO: 674782 - RNA, 61 nt, Homo Sapiens
gcuauuuuuguuaauguaaaguaaauauuucagagcaaauuuuuuaaacuuauugcacuaa

SEQ ID NO: 674783 - RNA, 61 nt, Homo Sapiens
uauauaacuaacaauuguccaaauagaugagagagcaaaucaugugagaaaauucagaaua

SEQ ID NO: 674784 - RNA, 61 nt, Homo Sapiens
cacccucuggccccuuggcaagguuuucucaagagcaaaauuaugauuuagcuggcaggcc

SEQ ID NO: 674785 - RNA, 61 nt, Homo Sapiens
ccuuggguuucucgcauucaacucuagcaucagagcaaaaguguguguggauuccagggca

SEQ ID NO: 674786 - RNA, 61 nt, Homo Sapiens
ucuguccaaaaaaaaaaaaaccuggguaacaagagcaaaacaucgcgccauugcacuccag

SEQ ID NO: 674787 - RNA, 61 nt, Homo Sapiens
uauuauuaagauggguuggaaaaggcugaagagagcaaauagaugagaguacuaacuggaa

SEQ ID NO: 674788 - RNA, 54 nt, Homo Sapiens; identical to SEQ ID NO: 587659

SEQ ID NO: 674789 - RNA, 61 nt, Homo Sapiens
aaaguucugcguaaugagacgaaagaaccgaagagcaaacagagcauaccacuugaagaag

SEQ ID NO: 674790 - RNA, 61 nt, Homo Sapiens
agcuccggagucccugcagguaggaagacgcagagcaaaugaguuuuagcggggaggggga

SEQ ID NO: 674791 - RNA, 61 nt, Homo Sapiens
gcauuacuuaaagaugcaguaaaaaacccagagagcaaagucuuuaaauaagguagaaugg

SEQ ID NO: 674792 - RNA, 61 nt, Homo Sapiens
gcucguguucuuugucgaaggccuggcagcuagagcaaauggucccucgccauacacugau

SEQ ID NO: 674793 - RNA, 61 nt, Homo Sapiens
auuacauuggcaaauaagguuuggaagcagaagagcaaaaaaaagauauuguuaaaaugag

SEQ ID NO: 674794 - RNA, 61 nt, Homo Sapiens
gguauuuguuaaauacguuuguuuuuauugcagagcaaaaauaaaucaaauuagaagcaau

SEQ ID NO: 674795 - RNA, 61 nt, Homo Sapiens
aauacaugccacaaggaugaagcuugugaguagagcaaacaaacguuuuuccaaagaauuc

SEQ ID NO: 674796 - RNA, 61 nt, Homo Sapiens
aucccacaaaauggcccuugguggcagcaauagagcaaagguuaccuuuuuguauggugaa

SEQ ID NO: 674797 - RNA, 61 nt, Homo Sapiens
ugggcgccucacacucagaaccucauaccccagagcaaaccgauggucagggagagggcua

SEQ ID NO: 674798 - RNA, 61 nt, Homo Sapiens
accaugccauuacacucaagcuugggcaacgagagcaaaacucugucucaaaaaaaaaauu

SEQ ID NO: 674799 - RNA, 61 nt, Homo Sapiens
gcucuugucccugucgcgucuuccuggaagcagagcaaaauggagcggacucacuugaugu

SEQ ID NO: 674800 - RNA, 61 nt, Homo Sapiens
gcucagcgcgucucagcucaguggaaaaaggagagcaaacuuuccagaaccgacgcaugaa

SEQ ID NO: 674801 - RNA, 64 nt, Homo Sapiens; identical to SEQ ID NO: 264152

SEQ ID NO: 674802 - RNA, 64 nt, Homo Sapiens; identical to SEQ ID NO: 264153

SEQ ID NO: 674803 - RNA, 64 nt, Homo Sapiens; identical to SEQ ID NO: 264154

SEQ ID NO: 674804 - RNA, 64 nt, Homo Sapiens; identical to SEQ ID NO: 264155

SEQ ID NO: 674805 - RNA, 64 nt, Homo Sapiens; identical to SEQ ID NO: 264156

SEQ ID NO: 674806 - RNA, 64 nt, Homo Sapiens; identical to SEQ ID NO: 264157

SEQ ID NO: 674807 - RNA, 64 nt, Homo Sapiens; identical to SEQ ID NO: 264158

SEQ ID NO: 674808 - RNA, 64 nt, Homo Sapiens; identical to SEQ ID NO: 264159

SEQ ID NO: 674809 - RNA, 64 nt, Homo Sapiens; identical to SEQ ID NO: 264160

SEQ ID NO: 674810 - RNA, 64 nt, Homo Sapiens; identical to SEQ ID NO: 264161

SEQ ID NO: 674811 - RNA, 64 nt, Homo Sapiens; identical to SEQ ID NO: 264162

SEQ ID NO: 674812 - RNA, 64 nt, Homo Sapiens; identical to SEQ ID NO: 264163

SEQ ID NO: 674813 - RNA, 64 nt, Homo Sapiens; identical to SEQ ID NO: 264164

SEQ ID NO: 674814 - RNA, 64 nt, Homo Sapiens; identical to SEQ ID NO: 264165

SEQ ID NO: 674815 - RNA, 64 nt, Homo Sapiens; identical to SEQ ID NO: 264166

SEQ ID NO: 674816 - RNA, 64 nt, Homo Sapiens; identical to SEQ ID NO: 264167

SEQ ID NO: 674817 - RNA, 64 nt, Homo Sapiens; identical to SEQ ID NO: 264168

SEQ ID NO: 674818 - RNA, 64 nt, Homo Sapiens; identical to SEQ ID NO: 264169

SEQ ID NO: 674819 - RNA, 64 nt, Homo Sapiens; identical to SEQ ID NO: 264170

SEQ ID NO: 674820 - RNA, 64 nt, Homo Sapiens; identical to SEQ ID NO: 264171

SEQ ID NO: 674821 - RNA, 64 nt, Homo Sapiens; identical to SEQ ID NO: 520094

SEQ ID NO: 674822 - RNA, 64 nt, Homo Sapiens; identical to SEQ ID NO: 520095

SEQ ID NO: 674823 - RNA, 64 nt, Homo Sapiens; identical to SEQ ID NO: 520096

SEQ ID NO: 674824 - RNA, 64 nt, Homo Sapiens; identical to SEQ ID NO: 520097

SEQ ID NO: 674825 - RNA, 64 nt, Homo Sapiens; identical to SEQ ID NO: 520098

SEQ ID NO: 674826 - RNA, 64 nt, Homo Sapiens; identical to SEQ ID NO: 520099

SEQ ID NO: 674827 - RNA, 64 nt, Homo Sapiens; identical to SEQ ID NO: 520100

SEQ ID NO: 674828 - RNA, 64 nt, Homo Sapiens; identical to SEQ ID NO: 520101

SEQ ID NO: 674829 - RNA, 64 nt, Homo Sapiens; identical to SEQ ID NO: 520102

SEQ ID NO: 674830 - RNA, 64 nt, Homo Sapiens; identical to SEQ ID NO: 520103

SEQ ID NO: 674831 - RNA, 64 nt, Homo Sapiens; identical to SEQ ID NO: 520104

SEQ ID NO: 674832 - RNA, 64 nt, Homo Sapiens; identical to SEQ ID NO: 520105

SEQ ID NO: 674833 - RNA, 64 nt, Homo Sapiens; identical to SEQ ID NO: 520106

SEQ ID NO: 674834 - RNA, 64 nt, Homo Sapiens; identical to SEQ ID NO: 520107

SEQ ID NO: 674835 - RNA, 64 nt, Homo Sapiens; identical to SEQ ID NO: 520108

SEQ ID NO: 674836 - RNA, 64 nt, Homo Sapiens; identical to SEQ ID NO: 520109

SEQ ID NO: 674837 - RNA, 64 nt, Homo Sapiens; identical to SEQ ID NO: 520110

SEQ ID NO: 674838 - RNA, 64 nt, Homo Sapiens; identical to SEQ ID NO: 520111

SEQ ID NO: 674839 - RNA, 64 nt, Homo Sapiens; identical to SEQ ID NO: 520112

SEQ ID NO: 674840 - RNA, 64 nt, Homo Sapiens; identical to SEQ ID NO: 150737

SEQ ID NO: 674841 - RNA, 64 nt, Homo Sapiens; identical to SEQ ID NO: 150738

SEQ ID NO: 674842 - RNA, 64 nt, Homo Sapiens; identical to SEQ ID NO: 201973

SEQ ID NO: 674843 - RNA, 64 nt, Homo Sapiens; identical to SEQ ID NO: 201974

SEQ ID NO: 674844 - RNA, 64 nt, Homo Sapiens; identical to SEQ ID NO: 201975

SEQ ID NO: 674845 - RNA, 64 nt, Homo Sapiens; identical to SEQ ID NO: 201976

SEQ ID NO: 674846 - RNA, 64 nt, Homo Sapiens; identical to SEQ ID NO: 201977

SEQ ID NO: 674847 - RNA, 64 nt, Homo Sapiens; identical to SEQ ID NO: 201978

SEQ ID NO: 674848 - RNA, 64 nt, Homo Sapiens; identical to SEQ ID NO: 201979

SEQ ID NO: 674849 - RNA, 64 nt, Homo Sapiens; identical to SEQ ID NO: 201980

SEQ ID NO: 674850 - RNA, 64 nt, Homo Sapiens; identical to SEQ ID NO: 201981

SEQ ID NO: 674851 - RNA, 64 nt, Homo Sapiens; identical to SEQ ID NO: 201982

SEQ ID NO: 674852 - RNA, 64 nt, Homo Sapiens; identical to SEQ ID NO: 201983

SEQ ID NO: 674853 - RNA, 64 nt, Homo Sapiens; identical to SEQ ID NO: 201984

SEQ ID NO: 674854 - RNA, 64 nt, Homo Sapiens; identical to SEQ ID NO: 201985

SEQ ID NO: 674855 - RNA, 64 nt, Homo Sapiens; identical to SEQ ID NO: 201986

SEQ ID NO: 674856 - RNA, 64 nt, Homo Sapiens; identical to SEQ ID NO: 201987

SEQ ID NO: 674857 - RNA, 64 nt, Homo Sapiens; identical to SEQ ID NO: 201988

SEQ ID NO: 674858 - RNA, 64 nt, Homo Sapiens; identical to SEQ ID NO: 201989

SEQ ID NO: 674859 - RNA, 64 nt, Homo Sapiens; identical to SEQ ID NO: 201990

SEQ ID NO: 674860 - RNA, 64 nt, Homo Sapiens; identical to SEQ ID NO: 201991

SEQ ID NO: 674861 - RNA, 64 nt, Homo Sapiens; identical to SEQ ID NO: 201992

SEQ ID NO: 674862 - RNA, 64 nt, Homo Sapiens; identical to SEQ ID NO: 201993

SEQ ID NO: 674863 - RNA, 64 nt, Homo Sapiens; identical to SEQ ID NO: 201994

SEQ ID NO: 674864 - RNA, 64 nt, Homo Sapiens; identical to SEQ ID NO: 201995

SEQ ID NO: 674865 - RNA, 64 nt, Homo Sapiens; identical to SEQ ID NO: 201996

SEQ ID NO: 674866 - RNA, 64 nt, Homo Sapiens; identical to SEQ ID NO: 201997

SEQ ID NO: 674867 - RNA, 64 nt, Homo Sapiens; identical to SEQ ID NO: 201998

SEQ ID NO: 674868 - RNA, 64 nt, Homo Sapiens; identical to SEQ ID NO: 201999

SEQ ID NO: 674869 - RNA, 64 nt, Homo Sapiens; identical to SEQ ID NO: 202000

SEQ ID NO: 674870 - RNA, 64 nt, Homo Sapiens; identical to SEQ ID NO: 202001

SEQ ID NO: 674871 - RNA, 64 nt, Homo Sapiens; identical to SEQ ID NO: 202002

SEQ ID NO: 674872 - RNA, 64 nt, Homo Sapiens; identical to SEQ ID NO: 202003

SEQ ID NO: 674873 - RNA, 64 nt, Homo Sapiens; identical to SEQ ID NO: 202004

SEQ ID NO: 674874 - RNA, 64 nt, Homo Sapiens; identical to SEQ ID NO: 202005

SEQ ID NO: 674875 - RNA, 64 nt, Homo Sapiens; identical to SEQ ID NO: 202006

SEQ ID NO: 674876 - RNA, 64 nt, Homo Sapiens; identical to SEQ ID NO: 99150

SEQ ID NO: 674877 - RNA, 64 nt, Homo Sapiens; identical to SEQ ID NO: 99151

SEQ ID NO: 674878 - RNA, 64 nt, Homo Sapiens; identical to SEQ ID NO: 99152

SEQ ID NO: 674879 - RNA, 64 nt, Homo Sapiens; identical to SEQ ID NO: 99153

SEQ ID NO: 674880 - RNA, 64 nt, Homo Sapiens
ucauccuggccuggagaacagagcaccaggucucaucuugcaucugacaguuucugauugcccu

SEQ ID NO: 674881 - RNA, 64 nt, Homo Sapiens
aaauuaccucuguuaaggaagccaugcagaaaauaucuugcacagggugcuuauuuaucuguuu

SEQ ID NO: 674882 - RNA, 64 nt, Homo Sapiens
auuuuaucaacaaauuucaugaaaaaaagaacuuaucuugcagccaguugggauacuuuaauca

SEQ ID NO: 674883 - RNA, 64 nt, Homo Sapiens
auuuuucuuaaggcuaugcucucuucauagacacaucuugcagcccuaacaacucacugcagug

SEQ ID NO: 674884 - RNA, 64 nt, Homo Sapiens
gaagcugcauuuuuaggauugcccaucuuaagagaucuugcaggaagagauuguauuagauauu

SEQ ID NO: 674885 - RNA, 64 nt, Homo Sapiens
auuuaauuuacauucauaaacuacuauauuucccaucuugcaaaucauuuuaugucucaucugu

SEQ ID NO: 674886 - RNA, 64 nt, Homo Sapiens
uuuuuuccuagucauugggaauguagagcaguguaucuugcaugucaucggaagaauagauuuu

SEQ ID NO: 674887 - RNA, 64 nt, Homo Sapiens
ugugauuuuuccaguauuaaacaugcaugcauuaaucuugcaguuuauuuucucauuguguaug

SEQ ID NO: 674888 - RNA, 64 nt, Homo Sapiens
caaucaggagaaucucauagagggauuaccugucaucuugcaugcuuuucuagucuguccacac

SEQ ID NO: 674889 - RNA, 64 nt, Homo Sapiens
gcgcuggcugccucccuguggagcugaacuuuguaucuugcaaucccgggucuccugcugcaca

SEQ ID NO: 674890 - RNA, 64 nt, Homo Sapiens
ccuuugaaugaguuuacagaaaacugccugacuuaucuugcaucaaacuggaaacagaauugga

SEQ ID NO: 674891 - RNA, 64 nt, Homo Sapiens
aagaaaaagaaaauuucuuucuucugacacacuuaucuugcacaccuuauccuuuugaaaaggu

SEQ ID NO: 674892 - RNA, 64 nt, Homo Sapiens; identical to SEQ ID NO: 56583

SEQ ID NO: 674893 - RNA, 64 nt, Homo Sapiens; identical to SEQ ID NO: 56584

SEQ ID NO: 674894 - RNA, 64 nt, Homo Sapiens; identical to SEQ ID NO: 56585

SEQ ID NO: 674895 - RNA, 64 nt, Homo Sapiens; identical to SEQ ID NO: 56586

SEQ ID NO: 674896 - RNA, 64 nt, Homo Sapiens; identical to SEQ ID NO: 56587

SEQ ID NO: 674897 - RNA, 64 nt, Homo Sapiens; identical to SEQ ID NO: 56588

SEQ ID NO: 674898 - RNA, 64 nt, Homo Sapiens; identical to SEQ ID NO: 56589

SEQ ID NO: 674899 - RNA, 64 nt, Homo Sapiens; identical to SEQ ID NO: 56590

SEQ ID NO: 674900 - RNA, 64 nt, Homo Sapiens; identical to SEQ ID NO: 56591

SEQ ID NO: 674901 - RNA, 64 nt, Homo Sapiens; identical to SEQ ID NO: 56592

SEQ ID NO: 674902 - RNA, 64 nt, Homo Sapiens; identical to SEQ ID NO: 56593

SEQ ID NO: 674903 - RNA, 64 nt, Homo Sapiens; identical to SEQ ID NO: 56594

SEQ ID NO: 674904 - RNA, 64 nt, Homo Sapiens; identical to SEQ ID NO: 56595

SEQ ID NO: 674905 - RNA, 64 nt, Homo Sapiens; identical to SEQ ID NO: 56596

SEQ ID NO: 674906 - RNA, 64 nt, Homo Sapiens; identical to SEQ ID NO: 56597

SEQ ID NO: 674907 - RNA, 64 nt, Homo Sapiens; identical to SEQ ID NO: 56598

SEQ ID NO: 674908 - RNA, 60 nt, Homo Sapiens
uuuaugaguaaugcuuggaauaaaaacucuuaaggcaacucacugauuuacuucuagcaa

SEQ ID NO: 674909 - RNA, 60 nt, Homo Sapiens
guauuguauauaauagaucagcgauuuuuguaaggcaaacagaauuuguaaguuggcaga

SEQ ID NO: 674910 - RNA, 60 nt, Homo Sapiens
aaucuggacucucuggcuugcugugaccccuaaggcaaugcuucucuucccuggauuccu

SEQ ID NO: 674911 - RNA, 60 nt, Homo Sapiens
guggauuucauuuuguagcugcugagauguuaaggcaagccucagcaucugccccugcug

SEQ ID NO: 674912 - RNA, 64 nt, Homo Sapiens
acuuuagcuuugaggagauacuugaaacacuugaacacuugauguuguuaauagucuuacccuc

SEQ ID NO: 674913 - RNA, 64 nt, Homo Sapiens
acuugaugacuuuagcuuuguuacccuccuugaaacacuugaaccuaaguccuuguuaauaguc

SEQ ID NO: 674914 - RNA, 64 nt, Homo Sapiens
ugcaaagaguaguuuacaucuucacuuucugaagacacuugaauuuaggaccgauguaucugug

SEQ ID NO: 674915 - RNA, 64 nt, Homo Sapiens
uuucuuuuuaauacaaaaaaauguauaaaaauaaacacuugaaaaggcaaaauacuggcugguc

SEQ ID NO: 674916 - RNA, 64 nt, Homo Sapiens
gacgguguuugguuucccaucauggcacagccucacacuugaaagccccuccucccugagggag

SEQ ID NO: 674917 - RNA, 64 nt, Homo Sapiens
cagagaguugaaagcuuggauaguucauucugggacacuugagcaggguggaggaauagacuuc

SEQ ID NO: 674918 - RNA, 64 nt, Homo Sapiens
aggggugggugucagggaucacuugggaucuuugacacuugaaaaauuacaccuggcagcugcg

SEQ ID NO: 674919 - RNA, 64 nt, Homo Sapiens
uuacaugaagauaagauacucacuguucaugaauacacuugauguucaaguauuaagaccuaug

SEQ ID NO: 674920 - RNA, 64 nt, Homo Sapiens
aaaauaaauauuugguauuuaauaaguuauccugacacuugauaaaaagauaaaucucaacuuu

SEQ ID NO: 674921 - RNA, 64 nt, Homo Sapiens
ucuaguuaaaucuuaaccauuuuaauuauuuuagacacuugaguacugucgaaguauuccuucu

SEQ ID NO: 674922 - RNA, 64 nt, Homo Sapiens
gcacagggcaucaacauggccaacagcauugccaaccugagacugaaggccaaggaauauaguu

SEQ ID NO: 674923 - RNA, 64 nt, Homo Sapiens
ugucacagacuauuugguagaagaaauauuuuucaccugagagaggaagagaaauuucucuagu

SEQ ID NO: 674924 - RNA, 64 nt, Homo Sapiens
guaauuuguaaagaaaaaggguugauaaagacacaccugagauguauuaguguguucucaugcu

SEQ ID NO: 674925 - RNA, 64 nt, Homo Sapiens
acagauacuuauaaaacccugugaggccuuuuuaaccugagauuaauuccuaaggagaaacaga

SEQ ID NO: 674926 - RNA, 64 nt, Homo Sapiens
gagcugaacauuucuucacugcacaaaugugaacaccugagaugagccuuucaauaaaaguuau

SEQ ID NO: 674927 - RNA, 64 nt, Homo Sapiens
ugcucguuuuuauuccuccuacagaugcgucgagaccugagauggcuuugugaguacacagcua

SEQ ID NO: 674928 - RNA, 64 nt, Homo Sapiens
uuaagacuauucucccagucgaaggugggugggcaccugagagaccuuccucccaguaagaagg

SEQ ID NO: 674929 - RNA, 64 nt, Homo Sapiens
cagcucuacccuuccucccaccugagagguuauaaccugagagaucugagggcucaggccucca

SEQ ID NO: 674930 - RNA, 64 nt, Homo Sapiens
uuauaaccugagagacagcugggcucaggccuccaccugagagguacuaggcaguagggucuga

SEQ ID NO: 674931 - RNA, 64 nt, Homo Sapiens
agcagagccacccuagaucaucacgaacaaauccaccugagauccccccauccaacccuuagac

SEQ ID NO: 674932 - RNA, 64 nt, Homo Sapiens
ggaaacagggaguucauuuggucaaauggaaaucaccugagacaaguaaaaagggaacaucagg

SEQ ID NO: 674933 - RNA, 64 nt, Homo Sapiens
ugucccuccgucccagggggcugugcuagcacagaccugagaauggggacacaggucauucaga

SEQ ID NO: 674934 - RNA, 64 nt, Homo Sapiens
uggggcugugggcucagagcucaggagucgccuuaccugagagagauguucuagcugagagggc

SEQ ID NO: 674935 - RNA, 64 nt, Homo Sapiens
gaacuucugggccuugcuggugaugguuaaaacaaccugagauggagaggccaggagagaguau

SEQ ID NO: 674936 - RNA, 64 nt, Homo Sapiens
ggauagcagcaaaccaccuaucuggccccaacacaccugagagaauucagcagcccagacugag

SEQ ID NO: 674937 - RNA, 64 nt, Homo Sapiens
accaacucccucccguaaucggcuuuccugcuccaccugagauaccuggugugagaaucaacca

SEQ ID NO: 674938 - RNA, 64 nt, Homo Sapiens
uggaugagcugcuccaaagggccggaggacccccaccugagagacgccacagaggaagcugccu

SEQ ID NO: 674939 - RNA, 64 nt, Homo Sapiens; identical to SEQ ID NO: 179154

SEQ ID NO: 674940 - RNA, 64 nt, Homo Sapiens; identical to SEQ ID NO: 179155

SEQ ID NO: 674941 - RNA, 64 nt, Homo Sapiens; identical to SEQ ID NO: 179156

SEQ ID NO: 674942 - RNA, 64 nt, Homo Sapiens; identical to SEQ ID NO: 179157

SEQ ID NO: 674943 - RNA, 64 nt, Homo Sapiens; identical to SEQ ID NO: 179158

SEQ ID NO: 674944 - RNA, 64 nt, Homo Sapiens; identical to SEQ ID NO: 179159

SEQ ID NO: 674945 - RNA, 64 nt, Homo Sapiens; identical to SEQ ID NO: 179160

SEQ ID NO: 674946 - RNA, 64 nt, Homo Sapiens; identical to SEQ ID NO: 179161

SEQ ID NO: 674947 - RNA, 64 nt, Homo Sapiens; identical to SEQ ID NO: 179162

SEQ ID NO: 674948 - RNA, 64 nt, Homo Sapiens; identical to SEQ ID NO: 179163

SEQ ID NO: 674949 - RNA, 64 nt, Homo Sapiens; identical to SEQ ID NO: 179164

SEQ ID NO: 674950 - RNA, 64 nt, Homo Sapiens; identical to SEQ ID NO: 179165

SEQ ID NO: 674951 - RNA, 64 nt, Homo Sapiens; identical to SEQ ID NO: 179166

SEQ ID NO: 674952 - RNA, 64 nt, Homo Sapiens; identical to SEQ ID NO: 179167

SEQ ID NO: 674953 - RNA, 64 nt, Homo Sapiens; identical to SEQ ID NO: 179168

SEQ ID NO: 674954 - RNA, 64 nt, Homo Sapiens; identical to SEQ ID NO: 179169

SEQ ID NO: 674955 - RNA, 64 nt, Homo Sapiens; identical to SEQ ID NO: 179170

SEQ ID NO: 674956 - RNA, 64 nt, Homo Sapiens; identical to SEQ ID NO: 179171

SEQ ID NO: 674957 - RNA, 64 nt, Homo Sapiens; identical to SEQ ID NO: 179172

SEQ ID NO: 674958 - RNA, 64 nt, Homo Sapiens; identical to SEQ ID NO: 179173

SEQ ID NO: 674959 - RNA, 64 nt, Homo Sapiens; identical to SEQ ID NO: 179174

SEQ ID NO: 674960 - RNA, 64 nt, Homo Sapiens; identical to SEQ ID NO: 179175

SEQ ID NO: 674961 - RNA, 64 nt, Homo Sapiens; identical to SEQ ID NO: 179176

SEQ ID NO: 674962 - RNA, 64 nt, Homo Sapiens; identical to SEQ ID NO: 179177

SEQ ID NO: 674963 - RNA, 64 nt, Homo Sapiens; identical to SEQ ID NO: 179178

SEQ ID NO: 674964 - RNA, 64 nt, Homo Sapiens; identical to SEQ ID NO: 179179

SEQ ID NO: 674965 - RNA, 64 nt, Homo Sapiens; identical to SEQ ID NO: 179180

SEQ ID NO: 674966 - RNA, 64 nt, Homo Sapiens; identical to SEQ ID NO: 179181

SEQ ID NO: 674967 - RNA, 64 nt, Homo Sapiens; identical to SEQ ID NO: 179182

SEQ ID NO: 674968 - RNA, 64 nt, Homo Sapiens; identical to SEQ ID NO: 179183

SEQ ID NO: 674969 - RNA, 64 nt, Homo Sapiens; identical to SEQ ID NO: 179184

SEQ ID NO: 674970 - RNA, 64 nt, Homo Sapiens; identical to SEQ ID NO: 179185

SEQ ID NO: 674971 - RNA, 64 nt, Homo Sapiens; identical to SEQ ID NO: 179186

SEQ ID NO: 674972 - RNA, 64 nt, Homo Sapiens; identical to SEQ ID NO: 179187

SEQ ID NO: 674973 - RNA, 64 nt, Homo Sapiens; identical to SEQ ID NO: 179188

SEQ ID NO: 674974 - RNA, 64 nt, Homo Sapiens; identical to SEQ ID NO: 179189

SEQ ID NO: 674975 - RNA, 64 nt, Homo Sapiens; identical to SEQ ID NO: 179190

SEQ ID NO: 674976 - RNA, 64 nt, Homo Sapiens; identical to SEQ ID NO: 179191

SEQ ID NO: 674977 - RNA, 64 nt, Homo Sapiens; identical to SEQ ID NO: 179192

SEQ ID NO: 674978 - RNA, 64 nt, Homo Sapiens; identical to SEQ ID NO: 179193

SEQ ID NO: 674979 - RNA, 64 nt, Homo Sapiens; identical to SEQ ID NO: 179194

SEQ ID NO: 674980 - RNA, 64 nt, Homo Sapiens; identical to SEQ ID NO: 179195

SEQ ID NO: 674981 - RNA, 64 nt, Homo Sapiens; identical to SEQ ID NO: 179196

SEQ ID NO: 674982 - RNA, 64 nt, Homo Sapiens; identical to SEQ ID NO: 179197

SEQ ID NO: 674983 - RNA, 64 nt, Homo Sapiens; identical to SEQ ID NO: 179198

SEQ ID NO: 674984 - RNA, 64 nt, Homo Sapiens; identical to SEQ ID NO: 179199

SEQ ID NO: 674985 - RNA, 64 nt, Homo Sapiens; identical to SEQ ID NO: 179200

SEQ ID NO: 674986 - RNA, 64 nt, Homo Sapiens; identical to SEQ ID NO: 179201

SEQ ID NO: 674987 - RNA, 64 nt, Homo Sapiens; identical to SEQ ID NO: 179202

SEQ ID NO: 674988 - RNA, 64 nt, Homo Sapiens; identical to SEQ ID NO: 179203

SEQ ID NO: 674989 - RNA, 64 nt, Homo Sapiens; identical to SEQ ID NO: 179204

SEQ ID NO: 674990 - RNA, 64 nt, Homo Sapiens; identical to SEQ ID NO: 179205

SEQ ID NO: 674991 - RNA, 64 nt, Homo Sapiens; identical to SEQ ID NO: 179206

SEQ ID NO: 674992 - RNA, 64 nt, Homo Sapiens; identical to SEQ ID NO: 179207

SEQ ID NO: 674993 - RNA, 64 nt, Homo Sapiens; identical to SEQ ID NO: 179208

SEQ ID NO: 674994 - RNA, 64 nt, Homo Sapiens; identical to SEQ ID NO: 179209

SEQ ID NO: 674995 - RNA, 64 nt, Homo Sapiens; identical to SEQ ID NO: 179210

SEQ ID NO: 674996 - RNA, 64 nt, Homo Sapiens; identical to SEQ ID NO: 179211

SEQ ID NO: 674997 - RNA, 64 nt, Homo Sapiens; identical to SEQ ID NO: 179212

SEQ ID NO: 674998 - RNA, 64 nt, Homo Sapiens; identical to SEQ ID NO: 179213

SEQ ID NO: 674999 - RNA, 64 nt, Homo Sapiens; identical to SEQ ID NO: 179214

SEQ ID NO: 675000 - RNA, 64 nt, Homo Sapiens; identical to SEQ ID NO: 179215

SEQ ID NO: 675001 - RNA, 64 nt, Homo Sapiens; identical to SEQ ID NO: 179216

SEQ ID NO: 675002 - RNA, 64 nt, Homo Sapiens; identical to SEQ ID NO: 179217

SEQ ID NO: 675003 - RNA, 64 nt, Homo Sapiens; identical to SEQ ID NO: 179218

SEQ ID NO: 675004 - RNA, 64 nt, Homo Sapiens; identical to SEQ ID NO: 179219

SEQ ID NO: 675005 - RNA, 64 nt, Homo Sapiens; identical to SEQ ID NO: 179220

SEQ ID NO: 675006 - RNA, 64 nt, Homo Sapiens; identical to SEQ ID NO: 179221

SEQ ID NO: 675007 - RNA, 64 nt, Homo Sapiens; identical to SEQ ID NO: 179222

SEQ ID NO: 675008 - RNA, 64 nt, Homo Sapiens; identical to SEQ ID NO: 179223

SEQ ID NO: 675009 - RNA, 64 nt, Homo Sapiens; identical to SEQ ID NO: 179224

SEQ ID NO: 675010 - RNA, 64 nt, Homo Sapiens; identical to SEQ ID NO: 179225

SEQ ID NO: 675011 - RNA, 64 nt, Homo Sapiens; identical to SEQ ID NO: 179226

SEQ ID NO: 675012 - RNA, 64 nt, Homo Sapiens; identical to SEQ ID NO: 179227

SEQ ID NO: 675013 - RNA, 64 nt, Homo Sapiens; identical to SEQ ID NO: 179228

SEQ ID NO: 675014 - RNA, 64 nt, Homo Sapiens; identical to SEQ ID NO: 179229

SEQ ID NO: 675015 - RNA, 64 nt, Homo Sapiens; identical to SEQ ID NO: 179230

SEQ ID NO: 675016 - RNA, 64 nt, Homo Sapiens; identical to SEQ ID NO: 179231

SEQ ID NO: 675017 - RNA, 64 nt, Homo Sapiens; identical to SEQ ID NO: 179232

SEQ ID NO: 675018 - RNA, 64 nt, Homo Sapiens; identical to SEQ ID NO: 179233

SEQ ID NO: 675019 - RNA, 64 nt, Homo Sapiens; identical to SEQ ID NO: 179234

SEQ ID NO: 675020 - RNA, 64 nt, Homo Sapiens; identical to SEQ ID NO: 179235

SEQ ID NO: 675021 - RNA, 57 nt, Homo Sapiens; identical to SEQ ID NO: 179236

SEQ ID NO: 675022 - RNA, 64 nt, Homo Sapiens; identical to SEQ ID NO: 179237

SEQ ID NO: 675023 - RNA, 64 nt, Homo Sapiens; identical to SEQ ID NO: 179238

SEQ ID NO: 675024 - RNA, 64 nt, Homo Sapiens; identical to SEQ ID NO: 179239

SEQ ID NO: 675025 - RNA, 64 nt, Homo Sapiens; identical to SEQ ID NO: 179240

SEQ ID NO: 675026 - RNA, 64 nt, Homo Sapiens; identical to SEQ ID NO: 179241

SEQ ID NO: 675027 - RNA, 57 nt, Homo Sapiens; identical to SEQ ID NO: 179242

SEQ ID NO: 675028 - RNA, 64 nt, Homo Sapiens; identical to SEQ ID NO: 179243

SEQ ID NO: 675029 - RNA, 64 nt, Homo Sapiens; identical to SEQ ID NO: 179244

SEQ ID NO: 675030 - RNA, 64 nt, Homo Sapiens; identical to SEQ ID NO: 179245

SEQ ID NO: 675031 - RNA, 64 nt, Homo Sapiens; identical to SEQ ID NO: 179246

SEQ ID NO: 675032 - RNA, 64 nt, Homo Sapiens; identical to SEQ ID NO: 179247

SEQ ID NO: 675033 - RNA, 64 nt, Homo Sapiens; identical to SEQ ID NO: 179248

SEQ ID NO: 675034 - RNA, 64 nt, Homo Sapiens; identical to SEQ ID NO: 179249

SEQ ID NO: 675035 - RNA, 64 nt, Homo Sapiens; identical to SEQ ID NO: 179250

SEQ ID NO: 675036 - RNA, 64 nt, Homo Sapiens; identical to SEQ ID NO: 179251

SEQ ID NO: 675037 - RNA, 64 nt, Homo Sapiens; identical to SEQ ID NO: 179252

SEQ ID NO: 675038 - RNA, 64 nt, Homo Sapiens; identical to SEQ ID NO: 179253

SEQ ID NO: 675039 - RNA, 64 nt, Homo Sapiens; identical to SEQ ID NO: 179254

SEQ ID NO: 675040 - RNA, 64 nt, Homo Sapiens; identical to SEQ ID NO: 179255

SEQ ID NO: 675041 - RNA, 64 nt, Homo Sapiens; identical to SEQ ID NO: 179256

SEQ ID NO: 675042 - RNA, 64 nt, Homo Sapiens; identical to SEQ ID NO: 179257

SEQ ID NO: 675043 - RNA, 64 nt, Homo Sapiens; identical to SEQ ID NO: 179258

SEQ ID NO: 675044 - RNA, 64 nt, Homo Sapiens; identical to SEQ ID NO: 179259

SEQ ID NO: 675045 - RNA, 64 nt, Homo Sapiens; identical to SEQ ID NO: 179260

SEQ ID NO: 675046 - RNA, 64 nt, Homo Sapiens; identical to SEQ ID NO: 179261

SEQ ID NO: 675047 - RNA, 64 nt, Homo Sapiens; identical to SEQ ID NO: 179262

SEQ ID NO: 675048 - RNA, 64 nt, Homo Sapiens; identical to SEQ ID NO: 179263

SEQ ID NO: 675049 - RNA, 64 nt, Homo Sapiens; identical to SEQ ID NO: 179264

SEQ ID NO: 675050 - RNA, 64 nt, Homo Sapiens; identical to SEQ ID NO: 179265

SEQ ID NO: 675051 - RNA, 64 nt, Homo Sapiens; identical to SEQ ID NO: 179266

SEQ ID NO: 675052 - RNA, 64 nt, Homo Sapiens; identical to SEQ ID NO: 179267

SEQ ID NO: 675053 - RNA, 64 nt, Homo Sapiens; identical to SEQ ID NO: 179268

SEQ ID NO: 675054 - RNA, 64 nt, Homo Sapiens; identical to SEQ ID NO: 179269

SEQ ID NO: 675055 - RNA, 64 nt, Homo Sapiens; identical to SEQ ID NO: 179270

SEQ ID NO: 675056 - RNA, 64 nt, Homo Sapiens; identical to SEQ ID NO: 179271

SEQ ID NO: 675057 - RNA, 64 nt, Homo Sapiens; identical to SEQ ID NO: 179272

SEQ ID NO: 675058 - RNA, 64 nt, Homo Sapiens; identical to SEQ ID NO: 179273

SEQ ID NO: 675059 - RNA, 64 nt, Homo Sapiens; identical to SEQ ID NO: 179274

SEQ ID NO: 675060 - RNA, 64 nt, Homo Sapiens; identical to SEQ ID NO: 179275

SEQ ID NO: 675061 - RNA, 64 nt, Homo Sapiens; identical to SEQ ID NO: 179276

SEQ ID NO: 675062 - RNA, 64 nt, Homo Sapiens; identical to SEQ ID NO: 179277

SEQ ID NO: 675063 - RNA, 64 nt, Homo Sapiens; identical to SEQ ID NO: 179278

SEQ ID NO: 675064 - RNA, 64 nt, Homo Sapiens; identical to SEQ ID NO: 179279

SEQ ID NO: 675065 - RNA, 64 nt, Homo Sapiens; identical to SEQ ID NO: 179280

SEQ ID NO: 675066 - RNA, 64 nt, Homo Sapiens; identical to SEQ ID NO: 179281

SEQ ID NO: 675067 - RNA, 64 nt, Homo Sapiens; identical to SEQ ID NO: 179282

SEQ ID NO: 675068 - RNA, 64 nt, Homo Sapiens; identical to SEQ ID NO: 179283

SEQ ID NO: 675069 - RNA, 64 nt, Homo Sapiens; identical to SEQ ID NO: 179284

SEQ ID NO: 675070 - RNA, 64 nt, Homo Sapiens; identical to SEQ ID NO: 179285

SEQ ID NO: 675071 - RNA, 64 nt, Homo Sapiens; identical to SEQ ID NO: 179286

SEQ ID NO: 675072 - RNA, 64 nt, Homo Sapiens; identical to SEQ ID NO: 179287

SEQ ID NO: 675073 - RNA, 64 nt, Homo Sapiens; identical to SEQ ID NO: 179288

SEQ ID NO: 675074 - RNA, 64 nt, Homo Sapiens; identical to SEQ ID NO: 179289

SEQ ID NO: 675075 - RNA, 64 nt, Homo Sapiens; identical to SEQ ID NO: 179290

SEQ ID NO: 675076 - RNA, 64 nt, Homo Sapiens; identical to SEQ ID NO: 179291

SEQ ID NO: 675077 - RNA, 64 nt, Homo Sapiens; identical to SEQ ID NO: 179292

SEQ ID NO: 675078 - RNA, 64 nt, Homo Sapiens; identical to SEQ ID NO: 179293

SEQ ID NO: 675079 - RNA, 64 nt, Homo Sapiens; identical to SEQ ID NO: 179294

SEQ ID NO: 675080 - RNA, 64 nt, Homo Sapiens; identical to SEQ ID NO: 179295

SEQ ID NO: 675081 - RNA, 64 nt, Homo Sapiens; identical to SEQ ID NO: 179296

SEQ ID NO: 675082 - RNA, 64 nt, Homo Sapiens; identical to SEQ ID NO: 179297

SEQ ID NO: 675083 - RNA, 64 nt, Homo Sapiens; identical to SEQ ID NO: 179298

SEQ ID NO: 675084 - RNA, 64 nt, Homo Sapiens; identical to SEQ ID NO: 179299

SEQ ID NO: 675085 - RNA, 64 nt, Homo Sapiens; identical to SEQ ID NO: 179300

SEQ ID NO: 675086 - RNA, 64 nt, Homo Sapiens; identical to SEQ ID NO: 179301

SEQ ID NO: 675087 - RNA, 64 nt, Homo Sapiens; identical to SEQ ID NO: 179302

SEQ ID NO: 675088 - RNA, 64 nt, Homo Sapiens; identical to SEQ ID NO: 179303

SEQ ID NO: 675089 - RNA, 64 nt, Homo Sapiens; identical to SEQ ID NO: 179304

SEQ ID NO: 675090 - RNA, 64 nt, Homo Sapiens; identical to SEQ ID NO: 179305

SEQ ID NO: 675091 - RNA, 64 nt, Homo Sapiens; identical to SEQ ID NO: 179306

SEQ ID NO: 675092 - RNA, 64 nt, Homo Sapiens; identical to SEQ ID NO: 179307

SEQ ID NO: 675093 - RNA, 64 nt, Homo Sapiens; identical to SEQ ID NO: 179308

SEQ ID NO: 675094 - RNA, 64 nt, Homo Sapiens; identical to SEQ ID NO: 179309

SEQ ID NO: 675095 - RNA, 64 nt, Homo Sapiens; identical to SEQ ID NO: 179310

SEQ ID NO: 675096 - RNA, 64 nt, Homo Sapiens; identical to SEQ ID NO: 179311

SEQ ID NO: 675097 - RNA, 64 nt, Homo Sapiens; identical to SEQ ID NO: 179312

SEQ ID NO: 675098 - RNA, 64 nt, Homo Sapiens; identical to SEQ ID NO: 179313

SEQ ID NO: 675099 - RNA, 64 nt, Homo Sapiens; identical to SEQ ID NO: 179314

SEQ ID NO: 675100 - RNA, 64 nt, Homo Sapiens; identical to SEQ ID NO: 179315

SEQ ID NO: 675101 - RNA, 64 nt, Homo Sapiens; identical to SEQ ID NO: 179316

SEQ ID NO: 675102 - RNA, 64 nt, Homo Sapiens; identical to SEQ ID NO: 179317

SEQ ID NO: 675103 - RNA, 64 nt, Homo Sapiens; identical to SEQ ID NO: 179318

SEQ ID NO: 675104 - RNA, 64 nt, Homo Sapiens; identical to SEQ ID NO: 179319

SEQ ID NO: 675105 - RNA, 64 nt, Homo Sapiens; identical to SEQ ID NO: 179320

SEQ ID NO: 675106 - RNA, 64 nt, Homo Sapiens; identical to SEQ ID NO: 179321

SEQ ID NO: 675107 - RNA, 64 nt, Homo Sapiens; identical to SEQ ID NO: 179322

SEQ ID NO: 675108 - RNA, 64 nt, Homo Sapiens; identical to SEQ ID NO: 179323

SEQ ID NO: 675109 - RNA, 64 nt, Homo Sapiens; identical to SEQ ID NO: 179324

SEQ ID NO: 675110 - RNA, 64 nt, Homo Sapiens; identical to SEQ ID NO: 179325

SEQ ID NO: 675111 - RNA, 64 nt, Homo Sapiens; identical to SEQ ID NO: 179326

SEQ ID NO: 675112 - RNA, 64 nt, Homo Sapiens; identical to SEQ ID NO: 179327

SEQ ID NO: 675113 - RNA, 64 nt, Homo Sapiens; identical to SEQ ID NO: 179328

SEQ ID NO: 675114 - RNA, 64 nt, Homo Sapiens; identical to SEQ ID NO: 179329

SEQ ID NO: 675115 - RNA, 64 nt, Homo Sapiens; identical to SEQ ID NO: 179330

SEQ ID NO: 675116 - RNA, 64 nt, Homo Sapiens; identical to SEQ ID NO: 179331

SEQ ID NO: 675117 - RNA, 64 nt, Homo Sapiens; identical to SEQ ID NO: 179332

SEQ ID NO: 675118 - RNA, 64 nt, Homo Sapiens; identical to SEQ ID NO: 179333

SEQ ID NO: 675119 - RNA, 64 nt, Homo Sapiens; identical to SEQ ID NO: 179334

SEQ ID NO: 675120 - RNA, 64 nt, Homo Sapiens; identical to SEQ ID NO: 179335

SEQ ID NO: 675121 - RNA, 64 nt, Homo Sapiens; identical to SEQ ID NO: 179336

SEQ ID NO: 675122 - RNA, 64 nt, Homo Sapiens; identical to SEQ ID NO: 179337

SEQ ID NO: 675123 - RNA, 64 nt, Homo Sapiens; identical to SEQ ID NO: 179338

SEQ ID NO: 675124 - RNA, 64 nt, Homo Sapiens; identical to SEQ ID NO: 179339

SEQ ID NO: 675125 - RNA, 64 nt, Homo Sapiens; identical to SEQ ID NO: 179340

SEQ ID NO: 675126 - RNA, 64 nt, Homo Sapiens; identical to SEQ ID NO: 179341

SEQ ID NO: 675127 - RNA, 64 nt, Homo Sapiens; identical to SEQ ID NO: 179342

SEQ ID NO: 675128 - RNA, 64 nt, Homo Sapiens; identical to SEQ ID NO: 179343

SEQ ID NO: 675129 - RNA, 64 nt, Homo Sapiens; identical to SEQ ID NO: 179344

SEQ ID NO: 675130 - RNA, 64 nt, Homo Sapiens; identical to SEQ ID NO: 179345

SEQ ID NO: 675131 - RNA, 64 nt, Homo Sapiens; identical to SEQ ID NO: 179346

SEQ ID NO: 675132 - RNA, 64 nt, Homo Sapiens; identical to SEQ ID NO: 179347

SEQ ID NO: 675133 - RNA, 64 nt, Homo Sapiens; identical to SEQ ID NO: 179348

SEQ ID NO: 675134 - RNA, 64 nt, Homo Sapiens; identical to SEQ ID NO: 179349

SEQ ID NO: 675135 - RNA, 64 nt, Homo Sapiens; identical to SEQ ID NO: 179350

SEQ ID NO: 675136 - RNA, 64 nt, Homo Sapiens; identical to SEQ ID NO: 179351

SEQ ID NO: 675137 - RNA, 64 nt, Homo Sapiens; identical to SEQ ID NO: 179352

SEQ ID NO: 675138 - RNA, 64 nt, Homo Sapiens; identical to SEQ ID NO: 179353

SEQ ID NO: 675139 - RNA, 64 nt, Homo Sapiens; identical to SEQ ID NO: 179354

SEQ ID NO: 675140 - RNA, 64 nt, Homo Sapiens; identical to SEQ ID NO: 179355

SEQ ID NO: 675141 - RNA, 64 nt, Homo Sapiens; identical to SEQ ID NO: 179356

SEQ ID NO: 675142 - RNA, 64 nt, Homo Sapiens; identical to SEQ ID NO: 179357

SEQ ID NO: 675143 - RNA, 64 nt, Homo Sapiens; identical to SEQ ID NO: 179358

SEQ ID NO: 675144 - RNA, 64 nt, Homo Sapiens; identical to SEQ ID NO: 179359

SEQ ID NO: 675145 - RNA, 64 nt, Homo Sapiens; identical to SEQ ID NO: 179360

SEQ ID NO: 675146 - RNA, 64 nt, Homo Sapiens; identical to SEQ ID NO: 179361

SEQ ID NO: 675147 - RNA, 64 nt, Homo Sapiens; identical to SEQ ID NO: 179362

SEQ ID NO: 675148 - RNA, 64 nt, Homo Sapiens; identical to SEQ ID NO: 179363

SEQ ID NO: 675149 - RNA, 64 nt, Homo Sapiens; identical to SEQ ID NO: 179364

SEQ ID NO: 675150 - RNA, 64 nt, Homo Sapiens; identical to SEQ ID NO: 179365

SEQ ID NO: 675151 - RNA, 64 nt, Homo Sapiens; identical to SEQ ID NO: 179366

SEQ ID NO: 675152 - RNA, 64 nt, Homo Sapiens; identical to SEQ ID NO: 179367

SEQ ID NO: 675153 - RNA, 64 nt, Homo Sapiens; identical to SEQ ID NO: 179368

SEQ ID NO: 675154 - RNA, 64 nt, Homo Sapiens; identical to SEQ ID NO: 179369

SEQ ID NO: 675155 - RNA, 64 nt, Homo Sapiens; identical to SEQ ID NO: 179370

SEQ ID NO: 675156 - RNA, 64 nt, Homo Sapiens; identical to SEQ ID NO: 179371

SEQ ID NO: 675157 - RNA, 64 nt, Homo Sapiens; identical to SEQ ID NO: 179372

SEQ ID NO: 675158 - RNA, 64 nt, Homo Sapiens; identical to SEQ ID NO: 179373

SEQ ID NO: 675159 - RNA, 64 nt, Homo Sapiens; identical to SEQ ID NO: 179374

SEQ ID NO: 675160 - RNA, 64 nt, Homo Sapiens; identical to SEQ ID NO: 179375

SEQ ID NO: 675161 - RNA, 60 nt, Homo Sapiens
uaguccauaucaccacaaauacugaccugucuccuucacaguagaacacugagcaggaca

SEQ ID NO: 675162 - RNA, 60 nt, Homo Sapiens
uuaucuugaacugccugacuuguuauucgacuccuucaggugcaggacucacuggauaga

SEQ ID NO: 675163 - RNA, 60 nt, Homo Sapiens
uuaucuuggacugacugacuuguuauucaacuccuucaguugcaggacucacuggauaga

SEQ ID NO: 675164 - RNA, 60 nt, Homo Sapiens
agccucucugucaucuccccuucccagccccuccuucauccccugccuccuucaccagcc

SEQ ID NO: 675165 - RNA, 60 nt, Homo Sapiens
ccccuucccagccccuccuucauccccugccuccuucaccagccuggcuuuugccuggag

SEQ ID NO: 675166 - RNA, 54 nt, Homo Sapiens; identical to SEQ ID NO: 100148

SEQ ID NO: 675167 - RNA, 60 nt, Homo Sapiens
gggacuuugugcuaagccugaugaaaugugcuccuucaaucuccaugaaaccaucguaac

SEQ ID NO: 675168 - RNA, 60 nt, Homo Sapiens
aaaacacuguucucugcccuccaagaccuucuccuucaccuuuguccccaccgcagacag

SEQ ID NO: 675169 - RNA, 60 nt, Homo Sapiens
gggcuggguucuacccaggugcuaggaacacuccuucacagaugggugcuuggaggaagg

SEQ ID NO: 675170 - RNA, 60 nt, Homo Sapiens
cuagaauuuauuuuccuagcacuucaccaccuccuucaucuucuccuucaacaauaaacc

SEQ ID NO: 675171 - RNA, 60 nt, Homo Sapiens
uuccuagcacuucaccaccuccuucaucuucuccuucaacaauaaacccugagaucuuug

SEQ ID NO: 675172 - RNA, 60 nt, Homo Sapiens
cuuuauaaggcaaaaagaucuguauuuacacuccuucaccuagggauguguuuguugccc

SEQ ID NO: 675173 - RNA, 60 nt, Homo Sapiens
agcaggacugacucugggcucuacaaccagcuccuucacauaaaggguuuagagacuccc

SEQ ID NO: 675174 - RNA, 64 nt, Homo Sapiens; identical to SEQ ID NO: 476364

SEQ ID NO: 675175 - RNA, 64 nt, Homo Sapiens; identical to SEQ ID NO: 476365

SEQ ID NO: 675176 - RNA, 64 nt, Homo Sapiens; identical to SEQ ID NO: 476366

SEQ ID NO: 675177 - RNA, 64 nt, Homo Sapiens; identical to SEQ ID NO: 476367

SEQ ID NO: 675178 - RNA, 64 nt, Homo Sapiens; identical to SEQ ID NO: 476368

SEQ ID NO: 675179 - RNA, 64 nt, Homo Sapiens; identical to SEQ ID NO: 476369

SEQ ID NO: 675180 - RNA, 64 nt, Homo Sapiens; identical to SEQ ID NO: 476370

SEQ ID NO: 675181 - RNA, 64 nt, Homo Sapiens; identical to SEQ ID NO: 476371

SEQ ID NO: 675182 - RNA, 64 nt, Homo Sapiens; identical to SEQ ID NO: 476372

SEQ ID NO: 675183 - RNA, 64 nt, Homo Sapiens; identical to SEQ ID NO: 476373

SEQ ID NO: 675184 - RNA, 64 nt, Homo Sapiens; identical to SEQ ID NO: 476374

SEQ ID NO: 675185 - RNA, 64 nt, Homo Sapiens; identical to SEQ ID NO: 476375

SEQ ID NO: 675186 - RNA, 64 nt, Homo Sapiens; identical to SEQ ID NO: 476376

SEQ ID NO: 675187 - RNA, 64 nt, Homo Sapiens; identical to SEQ ID NO: 476377

SEQ ID NO: 675188 - RNA, 64 nt, Homo Sapiens; identical to SEQ ID NO: 476378

SEQ ID NO: 675189 - RNA, 64 nt, Homo Sapiens; identical to SEQ ID NO: 476379

SEQ ID NO: 675190 - RNA, 64 nt, Homo Sapiens; identical to SEQ ID NO: 476380

SEQ ID NO: 675191 - RNA, 64 nt, Homo Sapiens; identical to SEQ ID NO: 476381

SEQ ID NO: 675192 - RNA, 64 nt, Homo Sapiens; identical to SEQ ID NO: 476382

SEQ ID NO: 675193 - RNA, 64 nt, Homo Sapiens; identical to SEQ ID NO: 476383

SEQ ID NO: 675194 - RNA, 64 nt, Homo Sapiens; identical to SEQ ID NO: 520974

SEQ ID NO: 675195 - RNA, 64 nt, Homo Sapiens; identical to SEQ ID NO: 520975

SEQ ID NO: 675196 - RNA, 64 nt, Homo Sapiens; identical to SEQ ID NO: 520976

SEQ ID NO: 675197 - RNA, 64 nt, Homo Sapiens; identical to SEQ ID NO: 520977

SEQ ID NO: 675198 - RNA, 50 nt, Homo Sapiens; identical to SEQ ID NO: 520978

SEQ ID NO: 675199 - RNA, 64 nt, Homo Sapiens; identical to SEQ ID NO: 520979

SEQ ID NO: 675200 - RNA, 64 nt, Homo Sapiens; identical to SEQ ID NO: 520980

SEQ ID NO: 675201 - RNA, 64 nt, Homo Sapiens; identical to SEQ ID NO: 520981

SEQ ID NO: 675202 - RNA, 64 nt, Homo Sapiens; identical to SEQ ID NO: 520982

SEQ ID NO: 675203 - RNA, 64 nt, Homo Sapiens; identical to SEQ ID NO: 520983

SEQ ID NO: 675204 - RNA, 64 nt, Homo Sapiens; identical to SEQ ID NO: 520984

SEQ ID NO: 675205 - RNA, 64 nt, Homo Sapiens; identical to SEQ ID NO: 520985

SEQ ID NO: 675206 - RNA, 64 nt, Homo Sapiens; identical to SEQ ID NO: 520986

SEQ ID NO: 675207 - RNA, 64 nt, Homo Sapiens; identical to SEQ ID NO: 520987

SEQ ID NO: 675208 - RNA, 64 nt, Homo Sapiens; identical to SEQ ID NO: 520988

SEQ ID NO: 675209 - RNA, 64 nt, Homo Sapiens; identical to SEQ ID NO: 520989

SEQ ID NO: 675210 - RNA, 64 nt, Homo Sapiens; identical to SEQ ID NO: 520990

SEQ ID NO: 675211 - RNA, 64 nt, Homo Sapiens; identical to SEQ ID NO: 520991

SEQ ID NO: 675212 - RNA, 63 nt, Homo Sapiens
gaaugagagcaaacccucuugucucaaggaaaucgagcuuaaucccacagcaagacugcuugg

SEQ ID NO: 675213 - RNA, 63 nt, Homo Sapiens
acccgucaauuaaacaaacauuagcuaaguuaucgagcuuaaagcuuagacugugcaaagggc

SEQ ID NO: 675214 - RNA, 63 nt, Homo Sapiens
guauuuauguguauauuuguagauuuauccagccgagcuuaggaauucgcuuccaggccgugg

SEQ ID NO: 675215 - RNA, 63 nt, Homo Sapiens
acagaagcuauuauuaacuacugcaagcuaagccgagcuuaaaaaugccuuuuguuuuaaaug

SEQ ID NO: 675216 - RNA, 63 nt, Homo Sapiens
cacagcuugugaggagggcaagguugugacguucgagcuuaguucugguguuauucugucucc

SEQ ID NO: 675217 - RNA, 63 nt, Homo Sapiens
uaaauaugaauguggccacaggggagcagaguccgagcuuauccucuccccaucuccagaaga

SEQ ID NO: 675218 - RNA, 63 nt, Homo Sapiens
uucuguaugcggugacggcguauaaacgugucccgagcuuagacuucccaagguacagcugua

SEQ ID NO: 675219 - RNA, 63 nt, Homo Sapiens
uuagaccgugguguccucuggcgccccgggccgcgagcuuagccaccccguucccagcgcaug

SEQ ID NO: 675220 - RNA, 63 nt, Homo Sapiens
ugcguaaucccuguuguccuagcucucuuccagcgagcuuaauaaguccaagaaaguacuuga

SEQ ID NO: 675221 - RNA, 63 nt, Homo Sapiens
guuccuuuucucaggagaggucacucugccuuccgagcuuaugaauggagugcucuuccuccc

SEQ ID NO: 675222 - RNA, 63 nt, Homo Sapiens
cuuccccagcgcccaggaugagcgguuuaccaucgagcuuacccgggcccggcuccugucaag

SEQ ID NO: 675223 - RNA, 63 nt, Homo Sapiens
caacagaaguaucaagccaucuguaaguagacacgagcuuaaucacagguucucacuagauga

SEQ ID NO: 675224 - RNA, 63 nt, Homo Sapiens
guaggguagaaaagagcuuucagucuuuaaugucgagcuuauuaauuauauuaauuggaaugu

SEQ ID NO: 675225 - RNA, 63 nt, Homo Sapiens
ccccuuuggagggagaaucaguaacgguuuugucgagcuuaggguggcuggguucugacaacu

SEQ ID NO: 675226 - RNA, 63 nt, Homo Sapiens
caggauguggaaugcagccgugaucacacuuaccgagcuuacuuugaucuguuugucaauagc

SEQ ID NO: 675227 - RNA, 63 nt, Homo Sapiens
ucaccugcucuaaacaauugugucaggcagaaucgagcuuaauugucacccagaaaagagacc

SEQ ID NO: 675228 - RNA, 63 nt, Homo Sapiens
aaaagaaaauacaacaaaauguauauuuagacacgagcuuacauggcauaccuuauauuugua

SEQ ID NO: 675229 - RNA, 63 nt, Homo Sapiens
uagugauacacaaauuguuuaagguuauacacucgagcuuaaauagauauuuuuaaccaggug

SEQ ID NO: 675230 - RNA, 63 nt, Homo Sapiens
ccaccccauccucggucuuugcaaagaagggcccgagcuuaguuuccccaggacuggccuagg

SEQ ID NO: 675231 - RNA, 63 nt, Homo Sapiens
gccccugaguggcagggcugacucccgucgacacgagcuuagaaaguggauucacugcuuucu

SEQ ID NO: 675232 - RNA, 63 nt, Homo Sapiens
uucacuccugccuccucagcuuugcuucauguucgagcuuaccuacucuuccaggacucucug

SEQ ID NO: 675233 - RNA, 63 nt, Homo Sapiens
cccuaagcccuccuuuacccuuggccccgaccccgagcuuagcgaggagcgcagucacuccac

SEQ ID NO: 675234 - RNA, 63 nt, Homo Sapiens
ugagcugggaggagcaggguggggcacgagggacgagcuuagcucccaucgcccacaaaaggg

SEQ ID NO: 675235 - RNA, 63 nt, Homo Sapiens
aaaucucuuucagcugcgcucuucccaccgagccgagcuuacugugaguguggagauguuauc

SEQ ID NO: 675236 - RNA, 63 nt, Homo Sapiens
gaugugcuugcaaacccuucgccaugcuggccccgagcuuagggugucaccucuccuccuuca

SEQ ID NO: 675237 - RNA, 64 nt, Homo Sapiens; identical to SEQ ID NO: 72674

SEQ ID NO: 675238 - RNA, 64 nt, Homo Sapiens; identical to SEQ ID NO: 72675

SEQ ID NO: 675239 - RNA, 64 nt, Homo Sapiens; identical to SEQ ID NO: 72676

SEQ ID NO: 675240 - RNA, 64 nt, Homo Sapiens; identical to SEQ ID NO: 72677

SEQ ID NO: 675241 - RNA, 64 nt, Homo Sapiens; identical to SEQ ID NO: 72678

SEQ ID NO: 675242 - RNA, 64 nt, Homo Sapiens; identical to SEQ ID NO: 72679

SEQ ID NO: 675243 - RNA, 64 nt, Homo Sapiens; identical to SEQ ID NO: 72680

SEQ ID NO: 675244 - RNA, 64 nt, Homo Sapiens; identical to SEQ ID NO: 72681

SEQ ID NO: 675245 - RNA, 64 nt, Homo Sapiens; identical to SEQ ID NO: 72682

SEQ ID NO: 675246 - RNA, 64 nt, Homo Sapiens; identical to SEQ ID NO: 72683

SEQ ID NO: 675247 - RNA, 64 nt, Homo Sapiens; identical to SEQ ID NO: 72684

SEQ ID NO: 675248 - RNA, 64 nt, Homo Sapiens; identical to SEQ ID NO: 72685

SEQ ID NO: 675249 - RNA, 64 nt, Homo Sapiens; identical to SEQ ID NO: 72686

SEQ ID NO: 675250 - RNA, 64 nt, Homo Sapiens; identical to SEQ ID NO: 72687

SEQ ID NO: 675251 - RNA, 64 nt, Homo Sapiens; identical to SEQ ID NO: 72688

SEQ ID NO: 675252 - RNA, 64 nt, Homo Sapiens; identical to SEQ ID NO: 72689

SEQ ID NO: 675253 - RNA, 64 nt, Homo Sapiens; identical to SEQ ID NO: 72690

SEQ ID NO: 675254 - RNA, 64 nt, Homo Sapiens; identical to SEQ ID NO: 72691

SEQ ID NO: 675255 - RNA, 64 nt, Homo Sapiens; identical to SEQ ID NO: 72692

SEQ ID NO: 675256 - RNA, 64 nt, Homo Sapiens; identical to SEQ ID NO: 72693

SEQ ID NO: 675257 - RNA, 64 nt, Homo Sapiens; identical to SEQ ID NO: 72694

SEQ ID NO: 675258 - RNA, 64 nt, Homo Sapiens; identical to SEQ ID NO: 72695

SEQ ID NO: 675259 - RNA, 64 nt, Homo Sapiens; identical to SEQ ID NO: 72696

SEQ ID NO: 675260 - RNA, 64 nt, Homo Sapiens; identical to SEQ ID NO: 72697

SEQ ID NO: 675261 - RNA, 64 nt, Homo Sapiens; identical to SEQ ID NO: 72698

SEQ ID NO: 675262 - RNA, 64 nt, Homo Sapiens; identical to SEQ ID NO: 72699

SEQ ID NO: 675263 - RNA, 64 nt, Homo Sapiens; identical to SEQ ID NO: 72700

SEQ ID NO: 675264 - RNA, 64 nt, Homo Sapiens; identical to SEQ ID NO: 72701

SEQ ID NO: 675265 - RNA, 64 nt, Homo Sapiens; identical to SEQ ID NO: 72702

SEQ ID NO: 675266 - RNA, 64 nt, Homo Sapiens; identical to SEQ ID NO: 72703

SEQ ID NO: 675267 - RNA, 64 nt, Homo Sapiens; identical to SEQ ID NO: 72704

SEQ ID NO: 675268 - RNA, 64 nt, Homo Sapiens; identical to SEQ ID NO: 72705

SEQ ID NO: 675269 - RNA, 64 nt, Homo Sapiens; identical to SEQ ID NO: 72706

SEQ ID NO: 675270 - RNA, 64 nt, Homo Sapiens; identical to SEQ ID NO: 72707

SEQ ID NO: 675271 - RNA, 64 nt, Homo Sapiens; identical to SEQ ID NO: 72708

SEQ ID NO: 675272 - RNA, 64 nt, Homo Sapiens; identical to SEQ ID NO: 72709

SEQ ID NO: 675273 - RNA, 64 nt, Homo Sapiens; identical to SEQ ID NO: 72710

SEQ ID NO: 675274 - RNA, 64 nt, Homo Sapiens; identical to SEQ ID NO: 72711

SEQ ID NO: 675275 - RNA, 64 nt, Homo Sapiens; identical to SEQ ID NO: 72712

SEQ ID NO: 675276 - RNA, 64 nt, Homo Sapiens; identical to SEQ ID NO: 72713

SEQ ID NO: 675277 - RNA, 64 nt, Homo Sapiens; identical to SEQ ID NO: 72714

SEQ ID NO: 675278 - RNA, 64 nt, Homo Sapiens; identical to SEQ ID NO: 72715

SEQ ID NO: 675279 - RNA, 64 nt, Homo Sapiens; identical to SEQ ID NO: 72716

SEQ ID NO: 675280 - RNA, 64 nt, Homo Sapiens; identical to SEQ ID NO: 72717

SEQ ID NO: 675281 - RNA, 64 nt, Homo Sapiens; identical to SEQ ID NO: 72718

SEQ ID NO: 675282 - RNA, 64 nt, Homo Sapiens; identical to SEQ ID NO: 72719

SEQ ID NO: 675283 - RNA, 64 nt, Homo Sapiens; identical to SEQ ID NO: 453107

SEQ ID NO: 675284 - RNA, 64 nt, Homo Sapiens; identical to SEQ ID NO: 453108

SEQ ID NO: 675285 - RNA, 64 nt, Homo Sapiens; identical to SEQ ID NO: 453109

SEQ ID NO: 675286 - RNA, 64 nt, Homo Sapiens; identical to SEQ ID NO: 453110

SEQ ID NO: 675287 - RNA, 64 nt, Homo Sapiens; identical to SEQ ID NO: 453111

SEQ ID NO: 675288 - RNA, 64 nt, Homo Sapiens; identical to SEQ ID NO: 453112

SEQ ID NO: 675289 - RNA, 64 nt, Homo Sapiens; identical to SEQ ID NO: 453113

SEQ ID NO: 675290 - RNA, 64 nt, Homo Sapiens; identical to SEQ ID NO: 453114

SEQ ID NO: 675291 - RNA, 64 nt, Homo Sapiens; identical to SEQ ID NO: 453115

SEQ ID NO: 675292 - RNA, 64 nt, Homo Sapiens; identical to SEQ ID NO: 453116

SEQ ID NO: 675293 - RNA, 64 nt, Homo Sapiens; identical to SEQ ID NO: 453117

SEQ ID NO: 675294 - RNA, 64 nt, Homo Sapiens; identical to SEQ ID NO: 453118

SEQ ID NO: 675295 - RNA, 64 nt, Homo Sapiens; identical to SEQ ID NO: 453119

SEQ ID NO: 675296 - RNA, 64 nt, Homo Sapiens; identical to SEQ ID NO: 453120

SEQ ID NO: 675297 - RNA, 64 nt, Homo Sapiens; identical to SEQ ID NO: 453121

SEQ ID NO: 675298 - RNA, 64 nt, Homo Sapiens; identical to SEQ ID NO: 453122

SEQ ID NO: 675299 - RNA, 64 nt, Homo Sapiens; identical to SEQ ID NO: 453123

SEQ ID NO: 675300 - RNA, 64 nt, Homo Sapiens; identical to SEQ ID NO: 453124

SEQ ID NO: 675301 - RNA, 64 nt, Homo Sapiens; identical to SEQ ID NO: 453125

SEQ ID NO: 675302 - RNA, 64 nt, Homo Sapiens; identical to SEQ ID NO: 453126

SEQ ID NO: 675303 - RNA, 64 nt, Homo Sapiens
agaaaaguuuagcguuaagcaaacaauccaaaucuaagcuuagauuuggggguauucguuucuu

SEQ ID NO: 675304 - RNA, 64 nt, Homo Sapiens
uugauuuuuaaguaauuauacuuguaagaaauacuaagcuuaugggaguuggaacauuguuauc

SEQ ID NO: 675305 - RNA, 64 nt, Homo Sapiens
agcuguuuugauuaaaauuuauauucuuguuuaauaagcuuauuuuuaaacaauuuaaaagcua

SEQ ID NO: 675306 - RNA, 64 nt, Homo Sapiens
gaguaacuacagaagaacuuuaaaaaauaaaaaauaagcuuaccuuggauucuuggcuuagagu

SEQ ID NO: 675307 - RNA, 64 nt, Homo Sapiens
uuuauagaaaaugcuaagguguucaagcucacaauaagcuuaaaaauauagaaguguuugaaau

SEQ ID NO: 675308 - RNA, 64 nt, Homo Sapiens
aggcugacaugugccauuaugaaaagauuauuuuuaagcuuaaaauaaaucaaucccaguuugg

SEQ ID NO: 675309 - RNA, 64 nt, Homo Sapiens
ucauuguaaaacuuuuuuacauugcuuaauguuuuaagcuuaauagccuuugcacuuuuaaaau

SEQ ID NO: 675310 - RNA, 64 nt, Homo Sapiens
augggagagaauguaaaugugcaaagguacauauuaagcuuagggauuuuugaauuuuuacguc

SEQ ID NO: 675311 - RNA, 64 nt, Homo Sapiens; identical to SEQ ID NO: 287439

SEQ ID NO: 675312 - RNA, 64 nt, Homo Sapiens; identical to SEQ ID NO: 287440

SEQ ID NO: 675313 - RNA, 64 nt, Homo Sapiens; identical to SEQ ID NO: 287441

SEQ ID NO: 675314 - RNA, 64 nt, Homo Sapiens; identical to SEQ ID NO: 287442

SEQ ID NO: 675315 - RNA, 64 nt, Homo Sapiens; identical to SEQ ID NO: 287443

SEQ ID NO: 675316 - RNA, 64 nt, Homo Sapiens; identical to SEQ ID NO: 287444

SEQ ID NO: 675317 - RNA, 64 nt, Homo Sapiens; identical to SEQ ID NO: 287445

SEQ ID NO: 675318 - RNA, 64 nt, Homo Sapiens; identical to SEQ ID NO: 287446

SEQ ID NO: 675319 - RNA, 64 nt, Homo Sapiens; identical to SEQ ID NO: 287447

SEQ ID NO: 675320 - RNA, 64 nt, Homo Sapiens; identical to SEQ ID NO: 287448

SEQ ID NO: 675321 - RNA, 64 nt, Homo Sapiens; identical to SEQ ID NO: 287449

SEQ ID NO: 675322 - RNA, 64 nt, Homo Sapiens; identical to SEQ ID NO: 287450

SEQ ID NO: 675323 - RNA, 64 nt, Homo Sapiens; identical to SEQ ID NO: 287451

SEQ ID NO: 675324 - RNA, 64 nt, Homo Sapiens; identical to SEQ ID NO: 287452

SEQ ID NO: 675325 - RNA, 64 nt, Homo Sapiens; identical to SEQ ID NO: 287453

SEQ ID NO: 675326 - RNA, 64 nt, Homo Sapiens; identical to SEQ ID NO: 287454

SEQ ID NO: 675327 - RNA, 64 nt, Homo Sapiens; identical to SEQ ID NO: 287455

SEQ ID NO: 675328 - RNA, 64 nt, Homo Sapiens; identical to SEQ ID NO: 287456

SEQ ID NO: 675329 - RNA, 64 nt, Homo Sapiens; identical to SEQ ID NO: 287457

SEQ ID NO: 675330 - RNA, 64 nt, Homo Sapiens; identical to SEQ ID NO: 287458

SEQ ID NO: 675331 - RNA, 64 nt, Homo Sapiens; identical to SEQ ID NO: 287459

SEQ ID NO: 675332 - RNA, 64 nt, Homo Sapiens; identical to SEQ ID NO: 287460

SEQ ID NO: 675333 - RNA, 64 nt, Homo Sapiens; identical to SEQ ID NO: 287461

SEQ ID NO: 675334 - RNA, 64 nt, Homo Sapiens; identical to SEQ ID NO: 287462

SEQ ID NO: 675335 - RNA, 64 nt, Homo Sapiens; identical to SEQ ID NO: 287463

SEQ ID NO: 675336 - RNA, 64 nt, Homo Sapiens; identical to SEQ ID NO: 287464

SEQ ID NO: 675337 - RNA, 64 nt, Homo Sapiens; identical to SEQ ID NO: 287465

SEQ ID NO: 675338 - RNA, 64 nt, Homo Sapiens; identical to SEQ ID NO: 287466

SEQ ID NO: 675339 - RNA, 64 nt, Homo Sapiens; identical to SEQ ID NO: 287467

SEQ ID NO: 675340 - RNA, 64 nt, Homo Sapiens; identical to SEQ ID NO: 287468

SEQ ID NO: 675341 - RNA, 64 nt, Homo Sapiens; identical to SEQ ID NO: 287469

SEQ ID NO: 675342 - RNA, 64 nt, Homo Sapiens; identical to SEQ ID NO: 287470

SEQ ID NO: 675343 - RNA, 64 nt, Homo Sapiens; identical to SEQ ID NO: 287471

SEQ ID NO: 675344 - RNA, 64 nt, Homo Sapiens; identical to SEQ ID NO: 287472

SEQ ID NO: 675345 - RNA, 64 nt, Homo Sapiens; identical to SEQ ID NO: 287473

SEQ ID NO: 675346 - RNA, 64 nt, Homo Sapiens; identical to SEQ ID NO: 287474

SEQ ID NO: 675347 - RNA, 64 nt, Homo Sapiens; identical to SEQ ID NO: 287475

SEQ ID NO: 675348 - RNA, 64 nt, Homo Sapiens; identical to SEQ ID NO: 287476

SEQ ID NO: 675349 - RNA, 64 nt, Homo Sapiens; identical to SEQ ID NO: 287477

SEQ ID NO: 675350 - RNA, 64 nt, Homo Sapiens; identical to SEQ ID NO: 287478

SEQ ID NO: 675351 - RNA, 64 nt, Homo Sapiens; identical to SEQ ID NO: 287479

SEQ ID NO: 675352 - RNA, 64 nt, Homo Sapiens; identical to SEQ ID NO: 287480

SEQ ID NO: 675353 - RNA, 64 nt, Homo Sapiens; identical to SEQ ID NO: 287481

SEQ ID NO: 675354 - RNA, 64 nt, Homo Sapiens; identical to SEQ ID NO: 287482

SEQ ID NO: 675355 - RNA, 64 nt, Homo Sapiens; identical to SEQ ID NO: 287483

SEQ ID NO: 675356 - RNA, 64 nt, Homo Sapiens; identical to SEQ ID NO: 287484

SEQ ID NO: 675357 - RNA, 64 nt, Homo Sapiens; identical to SEQ ID NO: 287485

SEQ ID NO: 675358 - RNA, 64 nt, Homo Sapiens; identical to SEQ ID NO: 287486

SEQ ID NO: 675359 - RNA, 64 nt, Homo Sapiens; identical to SEQ ID NO: 287487

SEQ ID NO: 675360 - RNA, 64 nt, Homo Sapiens
auuauuuauuuuaccuuuuacugacaaugugaaacucgaagaaaauguucucuuuuuaaauaua

SEQ ID NO: 675361 - RNA, 64 nt, Homo Sapiens
uuaacccaaauuagaguaccaacuuaauguuuuucucgaagaaugugaaaauaauuagaccugu

SEQ ID NO: 675362 - RNA, 64 nt, Homo Sapiens
ccucuuaaaauuguauguuacuuauuuccagaaucucgaagaaaaaagaaaaaagagugguauu

SEQ ID NO: 675363 - RNA, 64 nt, Homo Sapiens
gugacaucagaaguaacuccgcucuuaacuguugcucgaagacucacgucucucugccugcugg

SEQ ID NO: 675364 - RNA, 64 nt, Homo Sapiens
gaaggacaguggggcuguaccuagaauagugguucucgaagaaugcggccugcagauccuggga

SEQ ID NO: 675365 - RNA, 64 nt, Homo Sapiens
acugcaaagguaaaaggaaauuacacaacgauuacucgaagaugauuucauuccauucuauugu

SEQ ID NO: 675366 - RNA, 64 nt, Homo Sapiens
ucuuacagacuguaucagucaauuggacagcucucucgaagagaagaaaaguauauagaucugu

SEQ ID NO: 675367 - RNA, 64 nt, Homo Sapiens
auaccgucugacauagaauccucaaaaucuuccacucgaagaaugaaauccucuugugauagag

SEQ ID NO: 675368 - RNA, 64 nt, Homo Sapiens
uaauuaacagcugagucccugaugucauccuuaucucgaagagcuuagaaacaaagagugggaa

SEQ ID NO: 675369 - RNA, 64 nt, Homo Sapiens
aaagccacauuuugcauuagacagaugacggcugcucgaagaacaaugucagaaacucgaugaa

SEQ ID NO: 675370 - RNA, 64 nt, Homo Sapiens
uuucucucaaugaaacucgcucugcaaagcacugcucgaagacuccggcccaaggaugccagga

SEQ ID NO: 675371 - RNA, 64 nt, Homo Sapiens
cgacguccauuugucgaaagucagacacuggcagcucgaagacgaacagcauuagcaaguggga

SEQ ID NO: 675372 - RNA, 64 nt, Homo Sapiens
ucccagagauuguagaaagacaggugacaaccaccucgaagagcacuggaaaugaaacagagga

SEQ ID NO: 675373 - RNA, 64 nt, Homo Sapiens
uuaauuaaggaauugcuuaucaucaaauuuauaucucgaagauuucauuucugaagagaauagu

SEQ ID NO: 675374 - RNA, 64 nt, Homo Sapiens
ugaccacuaguggggagccguggcacuccauacccucgaagauguuguacuccaccgccugcac

SEQ ID NO: 675375 - RNA, 64 nt, Homo Sapiens
gcaucugccccugcugggugcacaaugcugcuuccucgaagagaagacacagaguccaaguggc

SEQ ID NO: 675376 - RNA, 64 nt, Homo Sapiens
auacuacacacccaguuauggaauguccagaguucucgaagaaaauaaaugacuuuaggaagag

SEQ ID NO: 675377 - RNA, 64 nt, Homo Sapiens
gacuggugucagauucaucaaacaaaaaauaaaucucgaagaaaaaaaaugcacuuacaugugc

SEQ ID NO: 675378 - RNA, 64 nt, Homo Sapiens
gcuuggcacccucugcuuccuggugcugcucugacucgaagacgggacagucccuggugcacau

SEQ ID NO: 675379 - RNA, 64 nt, Homo Sapiens
acuuugucacagccucuaucacacaucuguuuuucucgaagaaaaaaauauaauuaauaaaaau

SEQ ID NO: 675380 - RNA, 64 nt, Homo Sapiens
cgagagggggaggggguaagucccucuauacccccucgaagacucucauuguuucccccacguc

SEQ ID NO: 675381 - RNA, 64 nt, Homo Sapiens
gcgacaccucuucagggguguguggaguaaauagcucgaagagcugaagacagaaaaccaguuu

SEQ ID NO: 675382 - RNA, 64 nt, Homo Sapiens
aggaccuucccacauccacguuaacuuuuacucucucgaagaagcguuuuacuuuucuuuuuuu

SEQ ID NO: 675383 - RNA, 64 nt, Homo Sapiens
gaagccccaauagcuggacagaccucggccuccccucgaagacaccucaauucacagacucuca

SEQ ID NO: 675384 - RNA, 64 nt, Homo Sapiens
uuauuaaggcacgaagaaguugguuugggcuugccucgaagauuugauaaugcugcagcccugc

SEQ ID NO: 675385 - RNA, 64 nt, Homo Sapiens
uuugcaaauggccccuugccccucaccacugccccucgaagaaugcaggcugccaccccuucua

SEQ ID NO: 675386 - RNA, 60 nt, Homo Sapiens
uaccaacacccaaguucagcauuugaacuucucgaagagcuuuaaauuuugucugacagg

SEQ ID NO: 675387 - RNA, 64 nt, Homo Sapiens
caugugaucauagucccagagacagaguugaggucucgaagaaaagauccaugaucggcuuucu

SEQ ID NO: 675388 - RNA, 64 nt, Homo Sapiens
cuuugaugauaauuuuuuuuuuaaaaauuauucucucgaagagcaacuuacgagaggacagccu

SEQ ID NO: 675389 - RNA, 64 nt, Homo Sapiens
gcuuaaguggcagaauaaugagaagacacugcagcucgaagacauauuaaugcccccuuacagc

SEQ ID NO: 675390 - RNA, 64 nt, Homo Sapiens
aaaggagaggcucuguuuccgacacucucauccucucgaagaagucuauggcauccaagacagu

SEQ ID NO: 675391 - RNA, 64 nt, Homo Sapiens
cccaggccucaugauggucuaaggaguucuuguucucgaagaaccguacccuggggaaucaacc

SEQ ID NO: 675392 - RNA, 64 nt, Homo Sapiens
cuucuauuauuucucucucccuuauauuuuacuacucgaagaaaggcagaagaaguuacaaaua

SEQ ID NO: 675393 - RNA, 64 nt, Homo Sapiens
cgggcgcggggaggccggcgcagcgcagagcgggcucgaagaaaauaauucucuauuauuuuua

SEQ ID NO: 675394 - RNA, 64 nt, Homo Sapiens
uugugccucacagcgaggcccacuucaacuuccccucgaagacgaccagugaauaagaagaccc

SEQ ID NO: 675395 - RNA, 64 nt, Homo Sapiens
uuuguuuccggaauuucaauaaagcucgauucggcucgaagaagaccccguucuuccgggaaaa

SEQ ID NO: 675396 - RNA, 64 nt, Homo Sapiens
aaaggaaacuucauccaucaacauccaucuauugcucgaagacuuggugggauggaauuaauag

SEQ ID NO: 675397 - RNA, 64 nt, Homo Sapiens
ugcagcugcugugccugauguccggacagcccugcucgaagauauagaaagagugaccugcaca

SEQ ID NO: 675398 - RNA, 64 nt, Homo Sapiens
gcacuccagccuggucaacagagcaagacuccaucucgaagaaaaaaaaaaaaaauuccccacc

SEQ ID NO: 675399 - RNA, 64 nt, Homo Sapiens
cugccagcucaccgugcccagccuccugcauccccucgaagagccuggccagagagggaagaca

SEQ ID NO: 675400 - RNA, 64 nt, Homo Sapiens
gguauggcacaguucaugcccaugaccauaaaaccucgaagauguuccuugaacagaaauucua

SEQ ID NO: 675401 - RNA, 64 nt, Homo Sapiens
acucagcacugggcggguucggaggagcgccaaccucgaagacaacgcagccaaucgcuuuccu

SEQ ID NO: 675402 - RNA, 64 nt, Homo Sapiens
agaccgagggucccagaggaauccgggcaggacccucgaagagguuugcccucagugccagcca

SEQ ID NO: 675403 - RNA, 64 nt, Homo Sapiens
ugugaggcuaaaaaggguucauaacagaaccuaccucgaagaguucaucugucaaaugggguua

SEQ ID NO: 675404 - RNA, 64 nt, Homo Sapiens
aacuuuccucuaugucuggaauuuacuuuguuuucucgaagacacuuugcuuugggguucuucu

SEQ ID NO: 675405 - RNA, 64 nt, Homo Sapiens
cuauauaggguuguuuuucccauuauuuuucucacucgaagaaacauaaaauuauuuuguuugg

SEQ ID NO: 675406 - RNA, 64 nt, Homo Sapiens
gagaaguaggaccaggccauccuuggcuccagagcucgaagaccccaagacagcccucugcucu

SEQ ID NO: 675407 - RNA, 64 nt, Homo Sapiens
augcagguggggggacaugguguggcacuaggggcucgaagacugguuucuagcacuaccgguc

SEQ ID NO: 675408 - RNA, 64 nt, Homo Sapiens
auccuggccauagcagccaagagcccaagagcagcucgaagaccugagaugcugacccagcaug

SEQ ID NO: 675409 - RNA, 64 nt, Homo Sapiens
agggauggggaugggggcuguccugguaaggucacucgaagauacuuuccaccaaagccagguu

SEQ ID NO: 675410 - RNA, 64 nt, Homo Sapiens
uauggcuagaagggaacccgugaaagggcugaagcucgaagagcggcgugggaguugggcaagg

SEQ ID NO: 675411 - RNA, 64 nt, Homo Sapiens
auggucucugacuuuggacuacgcccuuugaggacucgaagaucccgaaaaccuccuguaugcc

SEQ ID NO: 675412 - RNA, 64 nt, Homo Sapiens
cuguauuuaucggggccccggcccuuaauuuaaaucgcaguauaguccuucuaacuccgcccgc

SEQ ID NO: 675413 - RNA, 64 nt, Homo Sapiens
aaaaaaaaaaaaaucugccccaugauucuaacacucgcaguagugauaguguaucuaguuguuc

SEQ ID NO: 675414 - RNA, 64 nt, Homo Sapiens
ggguguuuucaccuuccaaggugcaugccacaguucgcaguagauccucgugcuguguuuucua

SEQ ID NO: 675415 - RNA, 64 nt, Homo Sapiens
gugcuuaaaaaacagugccgagaguauguucaguucgcaguaaguagauuuauuggaauaaaua

SEQ ID NO: 675416 - RNA, 64 nt, Homo Sapiens
aauaaagcaguucucugaggagccaagcccaggcucgcaguaucacaggaccacuugagugggc

SEQ ID NO: 675417 - RNA, 64 nt, Homo Sapiens
ugaaauuguguuuaagacuacauguuaaguauggucgcaguaaauauuuuaaaaauauuuuaug

SEQ ID NO: 675418 - RNA, 64 nt, Homo Sapiens
caugguuccuuuggcagaagugcuuuuuuuuuaaucgcaguacuauuuuuauaaagcaagaacu

SEQ ID NO: 675419 - RNA, 64 nt, Homo Sapiens
ggggugaggacagagaggagucgaggguuuauucucgcaguagaggaacuccugguggugggaa

SEQ ID NO: 675420 - RNA, 64 nt, Homo Sapiens
uugcugcuuuuacaaaaggacauucuauuuauuuucgcaguaauucucauguccccauaagcag

SEQ ID NO: 675421 - RNA, 64 nt, Homo Sapiens
guagcucaggagagcaccccuccaccccauuugcucgcaguauccuagaaucuuugugcucucg

SEQ ID NO: 675422 - RNA, 64 nt, Homo Sapiens
ccuagguacuguuuaguaugcaauauuuucauuuucgcaguauaauaauugcaccuguuaaaua

SEQ ID NO: 675423 - RNA, 64 nt, Homo Sapiens
gagccaagguggugucagagggcaacuggaugacucgcaguaccacagcacugggacagacaga

SEQ ID NO: 675424 - RNA, 64 nt, Homo Sapiens
auuguuguuauuauuauuguaaguauuaauauuaucgcaguauuguaagcuucguacaaaugug

SEQ ID NO: 675425 - RNA, 64 nt, Homo Sapiens
augacguugcagggucuucaugcaauuuuccaccucgcaguaguuaguauuuacuugccuuaaa

SEQ ID NO: 675426 - RNA, 64 nt, Homo Sapiens
uguuacuugucgaaaaaauugaagaaaagcaaucucgcaguacauauugauggaaaaagaaaaa

SEQ ID NO: 675427 - RNA, 64 nt, Homo Sapiens
aagauacgaaauuagguggucguuggaauccugaucgcaguaaagugguccuugguaacugcuc

SEQ ID NO: 675428 - RNA, 64 nt, Homo Sapiens
guuuccagccugggccccucagaugagggcugcuucgcaguaaaugugguguugagccaccuua

SEQ ID NO: 675429 - RNA, 64 nt, Homo Sapiens
cugcauggacuguauacucgauuucauguguaugucgcaguaaacaaaaccaaaccucuuucug

SEQ ID NO: 675430 - RNA, 64 nt, Homo Sapiens
ccugcaccguggccagaaaccccucauuuccuccucgcaguagcuguuucaggugcccacauca

SEQ ID NO: 675431 - RNA, 64 nt, Homo Sapiens
uuagccagacuauaccuuguguagcuucaagaacucgcaguacauuaccagcugugauucucca

SEQ ID NO: 675432 - RNA, 64 nt, Homo Sapiens
cuggguugagugagauguuggauauugcuaucaaucgcaguagucuuuccccugugugaggcug

SEQ ID NO: 675433 - RNA, 64 nt, Homo Sapiens
uacauucugccccugaaugauucugucuagaaaagcucuggaguauugaucacuacuggaaaaa

SEQ ID NO: 675434 - RNA, 64 nt, Homo Sapiens
guucaucuccagggccccaccucagaucaaagcagcucuggaugagaugggaccugcagcucuc

SEQ ID NO: 675435 - RNA, 64 nt, Homo Sapiens
aacccuguuuccugaguuugagccuguuggacccgcucuggaccccuuagauuagcucuggacc

SEQ ID NO: 675436 - RNA, 64 nt, Homo Sapiens
agccuguuggacccgcucugauuaccuuagauuagcucuggaccccaugaaucaaagacaugga

SEQ ID NO: 675437 - RNA, 64 nt, Homo Sapiens
ggagacaccugcuccaggccggaccaacuucaaagcucuggacaagacauacuuuuguagaagu

SEQ ID NO: 675438 - RNA, 64 nt, Homo Sapiens
uuugguuuuguuuucuuuuucccuuuguaagugggcucuggauugucuuggcccuaaugagaaa

SEQ ID NO: 675439 - RNA, 64 nt, Homo Sapiens
agaagacgagccacguaugaggugccugcccugggcucuggaccccgggcacacgagggacggu

SEQ ID NO: 675440 - RNA, 64 nt, Homo Sapiens
ugugccucuggguacaaaagugccucaacgacaugcucuggaaaucccaaaugccacagucuga

SEQ ID NO: 675441 - RNA, 64 nt, Homo Sapiens
cucccaccucugugaccucaggcacuagccuuuggcucuggagacagccccagagcaggguguu

SEQ ID NO: 675442 - RNA, 64 nt, Homo Sapiens
accuccccacgcccuccccuccccugcugcaggggcucuggagagaaacaauaaagagauucac

SEQ ID NO: 675443 - RNA, 64 nt, Homo Sapiens
gcccagccacaccugaguccgaggguugagggaggcucuggaaacugacuucagccugugaggg

SEQ ID NO: 675444 - RNA, 64 nt, Homo Sapiens
agaagcuggaucacucuugguugugcagggugcagcucuggagaagcguagggagaggguggau

SEQ ID NO: 675445 - RNA, 64 nt, Homo Sapiens
agggugugugggauagcgauugcauuuuccuuuugcucuggaguuucacuccccuucugggucc

SEQ ID NO: 675446 - RNA, 64 nt, Homo Sapiens
gaggacuccaguugccucagguugguucugcugugcucuggaaaguaacugcagccaccaggua

SEQ ID NO: 675447 - RNA, 64 nt, Homo Sapiens
ccuauuguuacuuccaauuuauaaucaagaaggggcucuggauccccuuuuaaauuacacacac

SEQ ID NO: 675448 - RNA, 64 nt, Homo Sapiens
agugaccuacccaaaccuuuuguucuguaaaacugcucuggaaauaccgggaagcccaguuuuc

SEQ ID NO: 675449 - RNA, 64 nt, Homo Sapiens
agcuggagcagcucauuucuugggaggcugcugugcucuggagacugcagaugcugacaggccc

SEQ ID NO: 675450 - RNA, 64 nt, Homo Sapiens
augaaggacaauugacucaaaaugccacuugguagcucuggacaaguaaauuccugugcucuga

SEQ ID NO: 675451 - RNA, 64 nt, Homo Sapiens
gcaguggugugauuagggaugaucucacucuggcgcucuggagucggggagggguuaaagacag

SEQ ID NO: 675452 - RNA, 64 nt, Homo Sapiens
cugggaaguccauaguggaguguauuggcucagagcucuggagguaaguuauaauaaacagaaa

SEQ ID NO: 675453 - RNA, 64 nt, Homo Sapiens
cuagggcaggggcagaguuuuggaaacagugcaggcucuggagccagacuggcgagauucaaau

SEQ ID NO: 675454 - RNA, 64 nt, Homo Sapiens
ggggcagaucgggggcuugaacccagguggucaggcucuggagcccacaauugucuuacccacu

SEQ ID NO: 675455 - RNA, 64 nt, Homo Sapiens
ggggccgaggccccagaugcucccucaggaagaagcucuggaguccagcauugcugugcauggc

SEQ ID NO: 675456 - RNA, 64 nt, Homo Sapiens
cugaagcccugagaaggagaggagcuccccuggggcucuggaacggugacccugccccuggcug

SEQ ID NO: 675457 - RNA, 64 nt, Homo Sapiens
gaauaaggcugccuuggaggccaggccuucuuuagcucuggaaaguggagugggcgcaggcacg

SEQ ID NO: 675458 - RNA, 64 nt, Homo Sapiens
gagcagaaccucaccccauuggaagagccagagggcucuggaguugagucuccuaacccaagau

SEQ ID NO: 675459 - RNA, 64 nt, Homo Sapiens; identical to SEQ ID NO: 603790

SEQ ID NO: 675460 - RNA, 64 nt, Homo Sapiens; identical to SEQ ID NO: 603791

SEQ ID NO: 675461 - RNA, 64 nt, Homo Sapiens; identical to SEQ ID NO: 603792

SEQ ID NO: 675462 - RNA, 64 nt, Homo Sapiens; identical to SEQ ID NO: 603793

SEQ ID NO: 675463 - RNA, 64 nt, Homo Sapiens; identical to SEQ ID NO: 603794

SEQ ID NO: 675464 - RNA, 64 nt, Homo Sapiens; identical to SEQ ID NO: 603795

SEQ ID NO: 675465 - RNA, 64 nt, Homo Sapiens; identical to SEQ ID NO: 603796

SEQ ID NO: 675466 - RNA, 64 nt, Homo Sapiens; identical to SEQ ID NO: 603797

SEQ ID NO: 675467 - RNA, 64 nt, Homo Sapiens; identical to SEQ ID NO: 603798

SEQ ID NO: 675468 - RNA, 64 nt, Homo Sapiens; identical to SEQ ID NO: 603799

SEQ ID NO: 675469 - RNA, 64 nt, Homo Sapiens; identical to SEQ ID NO: 603800

SEQ ID NO: 675470 - RNA, 64 nt, Homo Sapiens; identical to SEQ ID NO: 603801

SEQ ID NO: 675471 - RNA, 64 nt, Homo Sapiens; identical to SEQ ID NO: 603802

SEQ ID NO: 675472 - RNA, 64 nt, Homo Sapiens; identical to SEQ ID NO: 603803

SEQ ID NO: 675473 - RNA, 64 nt, Homo Sapiens; identical to SEQ ID NO: 409271

SEQ ID NO: 675474 - RNA, 64 nt, Homo Sapiens; identical to SEQ ID NO: 409272

SEQ ID NO: 675475 - RNA, 64 nt, Homo Sapiens; identical to SEQ ID NO: 409273

SEQ ID NO: 675476 - RNA, 64 nt, Homo Sapiens; identical to SEQ ID NO: 409274

SEQ ID NO: 675477 - RNA, 64 nt, Homo Sapiens; identical to SEQ ID NO: 125298

SEQ ID NO: 675478 - RNA, 64 nt, Homo Sapiens; identical to SEQ ID NO: 125299

SEQ ID NO: 675479 - RNA, 64 nt, Homo Sapiens; identical to SEQ ID NO: 125300

SEQ ID NO: 675480 - RNA, 64 nt, Homo Sapiens; identical to SEQ ID NO: 125301

SEQ ID NO: 675481 - RNA, 64 nt, Homo Sapiens; identical to SEQ ID NO: 125302

SEQ ID NO: 675482 - RNA, 64 nt, Homo Sapiens; identical to SEQ ID NO: 125303

SEQ ID NO: 675483 - RNA, 64 nt, Homo Sapiens; identical to SEQ ID NO: 125304

SEQ ID NO: 675484 - RNA, 64 nt, Homo Sapiens; identical to SEQ ID NO: 125305

SEQ ID NO: 675485 - RNA, 64 nt, Homo Sapiens; identical to SEQ ID NO: 125306

SEQ ID NO: 675486 - RNA, 64 nt, Homo Sapiens; identical to SEQ ID NO: 125307

SEQ ID NO: 675487 - RNA, 64 nt, Homo Sapiens; identical to SEQ ID NO: 125308

SEQ ID NO: 675488 - RNA, 64 nt, Homo Sapiens; identical to SEQ ID NO: 125309

SEQ ID NO: 675489 - RNA, 64 nt, Homo Sapiens; identical to SEQ ID NO: 125310

SEQ ID NO: 675490 - RNA, 64 nt, Homo Sapiens; identical to SEQ ID NO: 125311

SEQ ID NO: 675491 - RNA, 64 nt, Homo Sapiens; identical to SEQ ID NO: 125312

SEQ ID NO: 675492 - RNA, 64 nt, Homo Sapiens; identical to SEQ ID NO: 125313

SEQ ID NO: 675493 - RNA, 64 nt, Homo Sapiens; identical to SEQ ID NO: 603880

SEQ ID NO: 675494 - RNA, 64 nt, Homo Sapiens; identical to SEQ ID NO: 603881

SEQ ID NO: 675495 - RNA, 64 nt, Homo Sapiens; identical to SEQ ID NO: 603882

SEQ ID NO: 675496 - RNA, 64 nt, Homo Sapiens; identical to SEQ ID NO: 603883

SEQ ID NO: 675497 - RNA, 64 nt, Homo Sapiens; identical to SEQ ID NO: 603884

SEQ ID NO: 675498 - RNA, 64 nt, Homo Sapiens; identical to SEQ ID NO: 603885

SEQ ID NO: 675499 - RNA, 64 nt, Homo Sapiens; identical to SEQ ID NO: 603886

SEQ ID NO: 675500 - RNA, 64 nt, Homo Sapiens; identical to SEQ ID NO: 603887

SEQ ID NO: 675501 - RNA, 64 nt, Homo Sapiens; identical to SEQ ID NO: 603888

SEQ ID NO: 675502 - RNA, 64 nt, Homo Sapiens; identical to SEQ ID NO: 603889

SEQ ID NO: 675503 - RNA, 64 nt, Homo Sapiens; identical to SEQ ID NO: 603890

SEQ ID NO: 675504 - RNA, 64 nt, Homo Sapiens; identical to SEQ ID NO: 603891

SEQ ID NO: 675505 - RNA, 64 nt, Homo Sapiens; identical to SEQ ID NO: 603892

SEQ ID NO: 675506 - RNA, 64 nt, Homo Sapiens; identical to SEQ ID NO: 603893

SEQ ID NO: 675507 - RNA, 64 nt, Homo Sapiens; identical to SEQ ID NO: 603894

SEQ ID NO: 675508 - RNA, 64 nt, Homo Sapiens; identical to SEQ ID NO: 603895

SEQ ID NO: 675509 - RNA, 64 nt, Homo Sapiens; identical to SEQ ID NO: 603896

SEQ ID NO: 675510 - RNA, 64 nt, Homo Sapiens; identical to SEQ ID NO: 603897

SEQ ID NO: 675511 - RNA, 64 nt, Homo Sapiens; identical to SEQ ID NO: 603898

SEQ ID NO: 675512 - RNA, 64 nt, Homo Sapiens; identical to SEQ ID NO: 603899

SEQ ID NO: 675513 - RNA, 64 nt, Homo Sapiens; identical to SEQ ID NO: 603900

SEQ ID NO: 675514 - RNA, 64 nt, Homo Sapiens; identical to SEQ ID NO: 603901

SEQ ID NO: 675515 - RNA, 64 nt, Homo Sapiens; identical to SEQ ID NO: 603902

SEQ ID NO: 675516 - RNA, 64 nt, Homo Sapiens; identical to SEQ ID NO: 603903

SEQ ID NO: 675517 - RNA, 64 nt, Homo Sapiens; identical to SEQ ID NO: 603904

SEQ ID NO: 675518 - RNA, 64 nt, Homo Sapiens; identical to SEQ ID NO: 603905

SEQ ID NO: 675519 - RNA, 64 nt, Homo Sapiens; identical to SEQ ID NO: 603906

SEQ ID NO: 675520 - RNA, 64 nt, Homo Sapiens; identical to SEQ ID NO: 603907

SEQ ID NO: 675521 - RNA, 64 nt, Homo Sapiens; identical to SEQ ID NO: 603908

SEQ ID NO: 675522 - RNA, 64 nt, Homo Sapiens; identical to SEQ ID NO: 603909

SEQ ID NO: 675523 - RNA, 64 nt, Homo Sapiens; identical to SEQ ID NO: 603910

SEQ ID NO: 675524 - RNA, 64 nt, Homo Sapiens; identical to SEQ ID NO: 603911

SEQ ID NO: 675525 - RNA, 64 nt, Homo Sapiens; identical to SEQ ID NO: 603912

SEQ ID NO: 675526 - RNA, 64 nt, Homo Sapiens; identical to SEQ ID NO: 603913

SEQ ID NO: 675527 - RNA, 64 nt, Homo Sapiens; identical to SEQ ID NO: 603914

SEQ ID NO: 675528 - RNA, 64 nt, Homo Sapiens
guauugccacaguuuauuauacaauauuuuucaugauagccacacuuuugcuuuuaaaauaguu

SEQ ID NO: 675529 - RNA, 64 nt, Homo Sapiens
guuuaauacaucuucauucuggaaucuccuccaagauagccagauggagaacuccauguacuuu

SEQ ID NO: 675530 - RNA, 64 nt, Homo Sapiens
gaaguuuuaccuuauucuguuacaaaauaguaaugauagccaugugacaacacuagggcuguug

SEQ ID NO: 675531 - RNA, 64 nt, Homo Sapiens
uacuuuccaguggcugccaauagcucuugaaggugauagccaucugauaaaggccaauuccagg

SEQ ID NO: 675532 - RNA, 64 nt, Homo Sapiens
ugcccugcuccuggccaccuccuggagauagccagauagccagaagagccuccccgacccacua

SEQ ID NO: 675533 - RNA, 64 nt, Homo Sapiens
uagccagaugcccugcuccuacccacuaccuggagauagccagagcagucucagagccuccccg

SEQ ID NO: 675534 - RNA, 64 nt, Homo Sapiens; identical to SEQ ID NO: 51971

SEQ ID NO: 675535 - RNA, 64 nt, Homo Sapiens; identical to SEQ ID NO: 51972

SEQ ID NO: 675536 - RNA, 64 nt, Homo Sapiens; identical to SEQ ID NO: 51973

SEQ ID NO: 675537 - RNA, 64 nt, Homo Sapiens; identical to SEQ ID NO: 51974

SEQ ID NO: 675538 - RNA, 64 nt, Homo Sapiens; identical to SEQ ID NO: 51975

SEQ ID NO: 675539 - RNA, 64 nt, Homo Sapiens; identical to SEQ ID NO: 51976

SEQ ID NO: 675540 - RNA, 52 nt, Homo Sapiens; identical to SEQ ID NO: 51977

SEQ ID NO: 675541 - RNA, 64 nt, Homo Sapiens; identical to SEQ ID NO: 51978

SEQ ID NO: 675542 - RNA, 64 nt, Homo Sapiens; identical to SEQ ID NO: 51979

SEQ ID NO: 675543 - RNA, 64 nt, Homo Sapiens; identical to SEQ ID NO: 51980

SEQ ID NO: 675544 - RNA, 64 nt, Homo Sapiens; identical to SEQ ID NO: 51981

SEQ ID NO: 675545 - RNA, 64 nt, Homo Sapiens; identical to SEQ ID NO: 51982

SEQ ID NO: 675546 - RNA, 64 nt, Homo Sapiens; identical to SEQ ID NO: 51983

SEQ ID NO: 675547 - RNA, 64 nt, Homo Sapiens; identical to SEQ ID NO: 51984

SEQ ID NO: 675548 - RNA, 64 nt, Homo Sapiens; identical to SEQ ID NO: 51985

SEQ ID NO: 675549 - RNA, 64 nt, Homo Sapiens; identical to SEQ ID NO: 51986

SEQ ID NO: 675550 - RNA, 64 nt, Homo Sapiens; identical to SEQ ID NO: 51987

SEQ ID NO: 675551 - RNA, 64 nt, Homo Sapiens; identical to SEQ ID NO: 51988

SEQ ID NO: 675552 - RNA, 64 nt, Homo Sapiens; identical to SEQ ID NO: 51989

SEQ ID NO: 675553 - RNA, 64 nt, Homo Sapiens; identical to SEQ ID NO: 51990

SEQ ID NO: 675554 - RNA, 64 nt, Homo Sapiens; identical to SEQ ID NO: 51991

SEQ ID NO: 675555 - RNA, 64 nt, Homo Sapiens; identical to SEQ ID NO: 51992

SEQ ID NO: 675556 - RNA, 64 nt, Homo Sapiens; identical to SEQ ID NO: 51993

SEQ ID NO: 675557 - RNA, 64 nt, Homo Sapiens; identical to SEQ ID NO: 51994

SEQ ID NO: 675558 - RNA, 64 nt, Homo Sapiens; identical to SEQ ID NO: 51995

SEQ ID NO: 675559 - RNA, 64 nt, Homo Sapiens; identical to SEQ ID NO: 51996

SEQ ID NO: 675560 - RNA, 64 nt, Homo Sapiens; identical to SEQ ID NO: 51997

SEQ ID NO: 675561 - RNA, 64 nt, Homo Sapiens; identical to SEQ ID NO: 51998

SEQ ID NO: 675562 - RNA, 64 nt, Homo Sapiens; identical to SEQ ID NO: 51999

SEQ ID NO: 675563 - RNA, 64 nt, Homo Sapiens; identical to SEQ ID NO: 52000

SEQ ID NO: 675564 - RNA, 64 nt, Homo Sapiens; identical to SEQ ID NO: 52001

SEQ ID NO: 675565 - RNA, 64 nt, Homo Sapiens; identical to SEQ ID NO: 52002

SEQ ID NO: 675566 - RNA, 64 nt, Homo Sapiens; identical to SEQ ID NO: 52003

SEQ ID NO: 675567 - RNA, 64 nt, Homo Sapiens; identical to SEQ ID NO: 485050

SEQ ID NO: 675568 - RNA, 64 nt, Homo Sapiens; identical to SEQ ID NO: 485051

SEQ ID NO: 675569 - RNA, 64 nt, Homo Sapiens; identical to SEQ ID NO: 485052

SEQ ID NO: 675570 - RNA, 64 nt, Homo Sapiens; identical to SEQ ID NO: 485053

SEQ ID NO: 675571 - RNA, 64 nt, Homo Sapiens; identical to SEQ ID NO: 485054

SEQ ID NO: 675572 - RNA, 64 nt, Homo Sapiens; identical to SEQ ID NO: 485055

SEQ ID NO: 675573 - RNA, 64 nt, Homo Sapiens; identical to SEQ ID NO: 485056

SEQ ID NO: 675574 - RNA, 64 nt, Homo Sapiens; identical to SEQ ID NO: 485057

SEQ ID NO: 675575 - RNA, 64 nt, Homo Sapiens; identical to SEQ ID NO: 485058

SEQ ID NO: 675576 - RNA, 64 nt, Homo Sapiens; identical to SEQ ID NO: 485059

SEQ ID NO: 675577 - RNA, 64 nt, Homo Sapiens; identical to SEQ ID NO: 485060

SEQ ID NO: 675578 - RNA, 64 nt, Homo Sapiens; identical to SEQ ID NO: 485061

SEQ ID NO: 675579 - RNA, 64 nt, Homo Sapiens; identical to SEQ ID NO: 485062

SEQ ID NO: 675580 - RNA, 64 nt, Homo Sapiens; identical to SEQ ID NO: 485063

SEQ ID NO: 675581 - RNA, 64 nt, Homo Sapiens; identical to SEQ ID NO: 485064

SEQ ID NO: 675582 - RNA, 64 nt, Homo Sapiens; identical to SEQ ID NO: 485065

SEQ ID NO: 675583 - RNA, 64 nt, Homo Sapiens; identical to SEQ ID NO: 485066

SEQ ID NO: 675584 - RNA, 64 nt, Homo Sapiens; identical to SEQ ID NO: 485067

SEQ ID NO: 675585 - RNA, 64 nt, Homo Sapiens; identical to SEQ ID NO: 485068

SEQ ID NO: 675586 - RNA, 64 nt, Homo Sapiens; identical to SEQ ID NO: 485069

SEQ ID NO: 675587 - RNA, 64 nt, Homo Sapiens; identical to SEQ ID NO: 485070

SEQ ID NO: 675588 - RNA, 64 nt, Homo Sapiens; identical to SEQ ID NO: 485071

SEQ ID NO: 675589 - RNA, 64 nt, Homo Sapiens; identical to SEQ ID NO: 485072

SEQ ID NO: 675590 - RNA, 64 nt, Homo Sapiens; identical to SEQ ID NO: 485073

SEQ ID NO: 675591 - RNA, 64 nt, Homo Sapiens; identical to SEQ ID NO: 485074

SEQ ID NO: 675592 - RNA, 64 nt, Homo Sapiens; identical to SEQ ID NO: 485075

SEQ ID NO: 675593 - RNA, 64 nt, Homo Sapiens; identical to SEQ ID NO: 485076

SEQ ID NO: 675594 - RNA, 64 nt, Homo Sapiens; identical to SEQ ID NO: 485077

SEQ ID NO: 675595 - RNA, 64 nt, Homo Sapiens; identical to SEQ ID NO: 485078

SEQ ID NO: 675596 - RNA, 64 nt, Homo Sapiens; identical to SEQ ID NO: 485079

SEQ ID NO: 675597 - RNA, 64 nt, Homo Sapiens; identical to SEQ ID NO: 485080

SEQ ID NO: 675598 - RNA, 64 nt, Homo Sapiens; identical to SEQ ID NO: 485081

SEQ ID NO: 675599 - RNA, 64 nt, Homo Sapiens; identical to SEQ ID NO: 485082

SEQ ID NO: 675600 - RNA, 64 nt, Homo Sapiens; identical to SEQ ID NO: 485083

SEQ ID NO: 675601 - RNA, 64 nt, Homo Sapiens; identical to SEQ ID NO: 485084

SEQ ID NO: 675602 - RNA, 64 nt, Homo Sapiens; identical to SEQ ID NO: 485085

SEQ ID NO: 675603 - RNA, 64 nt, Homo Sapiens; identical to SEQ ID NO: 485086

SEQ ID NO: 675604 - RNA, 64 nt, Homo Sapiens; identical to SEQ ID NO: 485087

SEQ ID NO: 675605 - RNA, 64 nt, Homo Sapiens; identical to SEQ ID NO: 485088

SEQ ID NO: 675606 - RNA, 64 nt, Homo Sapiens; identical to SEQ ID NO: 485089

SEQ ID NO: 675607 - RNA, 64 nt, Homo Sapiens; identical to SEQ ID NO: 485090

SEQ ID NO: 675608 - RNA, 64 nt, Homo Sapiens; identical to SEQ ID NO: 53018

SEQ ID NO: 675609 - RNA, 64 nt, Homo Sapiens; identical to SEQ ID NO: 53019

SEQ ID NO: 675610 - RNA, 64 nt, Homo Sapiens; identical to SEQ ID NO: 53020

SEQ ID NO: 675611 - RNA, 64 nt, Homo Sapiens; identical to SEQ ID NO: 53021

SEQ ID NO: 675612 - RNA, 64 nt, Homo Sapiens; identical to SEQ ID NO: 53022

SEQ ID NO: 675613 - RNA, 64 nt, Homo Sapiens; identical to SEQ ID NO: 53023

SEQ ID NO: 675614 - RNA, 64 nt, Homo Sapiens; identical to SEQ ID NO: 53024

SEQ ID NO: 675615 - RNA, 64 nt, Homo Sapiens; identical to SEQ ID NO: 53025

SEQ ID NO: 675616 - RNA, 64 nt, Homo Sapiens; identical to SEQ ID NO: 53026

SEQ ID NO: 675617 - RNA, 64 nt, Homo Sapiens; identical to SEQ ID NO: 53027

SEQ ID NO: 675618 - RNA, 64 nt, Homo Sapiens; identical to SEQ ID NO: 53028

SEQ ID NO: 675619 - RNA, 64 nt, Homo Sapiens; identical to SEQ ID NO: 53029

SEQ ID NO: 675620 - RNA, 64 nt, Homo Sapiens; identical to SEQ ID NO: 53030

SEQ ID NO: 675621 - RNA, 64 nt, Homo Sapiens; identical to SEQ ID NO: 53031

SEQ ID NO: 675622 - RNA, 64 nt, Homo Sapiens; identical to SEQ ID NO: 53032

SEQ ID NO: 675623 - RNA, 64 nt, Homo Sapiens; identical to SEQ ID NO: 53033

SEQ ID NO: 675624 - RNA, 64 nt, Homo Sapiens; identical to SEQ ID NO: 53034

SEQ ID NO: 675625 - RNA, 64 nt, Homo Sapiens; identical to SEQ ID NO: 53035

SEQ ID NO: 675626 - RNA, 64 nt, Homo Sapiens; identical to SEQ ID NO: 53036

SEQ ID NO: 675627 - RNA, 64 nt, Homo Sapiens; identical to SEQ ID NO: 53037

SEQ ID NO: 675628 - RNA, 64 nt, Homo Sapiens; identical to SEQ ID NO: 53038

SEQ ID NO: 675629 - RNA, 64 nt, Homo Sapiens; identical to SEQ ID NO: 53039

SEQ ID NO: 675630 - RNA, 64 nt, Homo Sapiens; identical to SEQ ID NO: 53040

SEQ ID NO: 675631 - RNA, 64 nt, Homo Sapiens; identical to SEQ ID NO: 53041

SEQ ID NO: 675632 - RNA, 64 nt, Homo Sapiens; identical to SEQ ID NO: 53042

SEQ ID NO: 675633 - RNA, 64 nt, Homo Sapiens; identical to SEQ ID NO: 53043

SEQ ID NO: 675634 - RNA, 64 nt, Homo Sapiens; identical to SEQ ID NO: 53044

SEQ ID NO: 675635 - RNA, 64 nt, Homo Sapiens; identical to SEQ ID NO: 53045

SEQ ID NO: 675636 - RNA, 64 nt, Homo Sapiens; identical to SEQ ID NO: 53046

SEQ ID NO: 675637 - RNA, 64 nt, Homo Sapiens; identical to SEQ ID NO: 53047

SEQ ID NO: 675638 - RNA, 64 nt, Homo Sapiens; identical to SEQ ID NO: 53048

SEQ ID NO: 675639 - RNA, 64 nt, Homo Sapiens; identical to SEQ ID NO: 53049

SEQ ID NO: 675640 - RNA, 64 nt, Homo Sapiens; identical to SEQ ID NO: 53050

SEQ ID NO: 675641 - RNA, 64 nt, Homo Sapiens; identical to SEQ ID NO: 53051

SEQ ID NO: 675642 - RNA, 64 nt, Homo Sapiens; identical to SEQ ID NO: 53052

SEQ ID NO: 675643 - RNA, 64 nt, Homo Sapiens; identical to SEQ ID NO: 53053

SEQ ID NO: 675644 - RNA, 64 nt, Homo Sapiens; identical to SEQ ID NO: 53054

SEQ ID NO: 675645 - RNA, 64 nt, Homo Sapiens; identical to SEQ ID NO: 53055

SEQ ID NO: 675646 - RNA, 64 nt, Homo Sapiens; identical to SEQ ID NO: 53056

SEQ ID NO: 675647 - RNA, 64 nt, Homo Sapiens; identical to SEQ ID NO: 53057

SEQ ID NO: 675648 - RNA, 64 nt, Homo Sapiens; identical to SEQ ID NO: 53058

SEQ ID NO: 675649 - RNA, 64 nt, Homo Sapiens; identical to SEQ ID NO: 53059

SEQ ID NO: 675650 - RNA, 64 nt, Homo Sapiens; identical to SEQ ID NO: 101929

SEQ ID NO: 675651 - RNA, 64 nt, Homo Sapiens; identical to SEQ ID NO: 101930

SEQ ID NO: 675652 - RNA, 64 nt, Homo Sapiens; identical to SEQ ID NO: 101931

SEQ ID NO: 675653 - RNA, 64 nt, Homo Sapiens; identical to SEQ ID NO: 101932

SEQ ID NO: 675654 - RNA, 64 nt, Homo Sapiens; identical to SEQ ID NO: 101933

SEQ ID NO: 675655 - RNA, 64 nt, Homo Sapiens; identical to SEQ ID NO: 101934

SEQ ID NO: 675656 - RNA, 64 nt, Homo Sapiens; identical to SEQ ID NO: 101935

SEQ ID NO: 675657 - RNA, 64 nt, Homo Sapiens; identical to SEQ ID NO: 101936

SEQ ID NO: 675658 - RNA, 64 nt, Homo Sapiens; identical to SEQ ID NO: 101937

SEQ ID NO: 675659 - RNA, 64 nt, Homo Sapiens; identical to SEQ ID NO: 101938

SEQ ID NO: 675660 - RNA, 64 nt, Homo Sapiens; identical to SEQ ID NO: 101939

SEQ ID NO: 675661 - RNA, 64 nt, Homo Sapiens; identical to SEQ ID NO: 101940

SEQ ID NO: 675662 - RNA, 64 nt, Homo Sapiens; identical to SEQ ID NO: 101941

SEQ ID NO: 675663 - RNA, 64 nt, Homo Sapiens; identical to SEQ ID NO: 101942

SEQ ID NO: 675664 - RNA, 64 nt, Homo Sapiens; identical to SEQ ID NO: 101943

SEQ ID NO: 675665 - RNA, 64 nt, Homo Sapiens; identical to SEQ ID NO: 101944

SEQ ID NO: 675666 - RNA, 64 nt, Homo Sapiens; identical to SEQ ID NO: 101945

SEQ ID NO: 675667 - RNA, 64 nt, Homo Sapiens; identical to SEQ ID NO: 101946

SEQ ID NO: 675668 - RNA, 64 nt, Homo Sapiens; identical to SEQ ID NO: 101947

SEQ ID NO: 675669 - RNA, 64 nt, Homo Sapiens; identical to SEQ ID NO: 279900

SEQ ID NO: 675670 - RNA, 64 nt, Homo Sapiens; identical to SEQ ID NO: 279901

SEQ ID NO: 675671 - RNA, 64 nt, Homo Sapiens; identical to SEQ ID NO: 279902

SEQ ID NO: 675672 - RNA, 64 nt, Homo Sapiens; identical to SEQ ID NO: 279903

SEQ ID NO: 675673 - RNA, 64 nt, Homo Sapiens; identical to SEQ ID NO: 279904

SEQ ID NO: 675674 - RNA, 64 nt, Homo Sapiens; identical to SEQ ID NO: 279905

SEQ ID NO: 675675 - RNA, 64 nt, Homo Sapiens; identical to SEQ ID NO: 279906

SEQ ID NO: 675676 - RNA, 64 nt, Homo Sapiens; identical to SEQ ID NO: 279907

SEQ ID NO: 675677 - RNA, 64 nt, Homo Sapiens; identical to SEQ ID NO: 279908

SEQ ID NO: 675678 - RNA, 64 nt, Homo Sapiens; identical to SEQ ID NO: 279909

SEQ ID NO: 675679 - RNA, 64 nt, Homo Sapiens; identical to SEQ ID NO: 279910

SEQ ID NO: 675680 - RNA, 64 nt, Homo Sapiens; identical to SEQ ID NO: 279911

SEQ ID NO: 675681 - RNA, 64 nt, Homo Sapiens; identical to SEQ ID NO: 279912

SEQ ID NO: 675682 - RNA, 64 nt, Homo Sapiens; identical to SEQ ID NO: 279913

SEQ ID NO: 675683 - RNA, 64 nt, Homo Sapiens; identical to SEQ ID NO: 279914

SEQ ID NO: 675684 - RNA, 64 nt, Homo Sapiens; identical to SEQ ID NO: 279915

SEQ ID NO: 675685 - RNA, 64 nt, Homo Sapiens; identical to SEQ ID NO: 279916

SEQ ID NO: 675686 - RNA, 64 nt, Homo Sapiens; identical to SEQ ID NO: 279917

SEQ ID NO: 675687 - RNA, 64 nt, Homo Sapiens; identical to SEQ ID NO: 279918

SEQ ID NO: 675688 - RNA, 64 nt, Homo Sapiens; identical to SEQ ID NO: 279919

SEQ ID NO: 675689 - RNA, 64 nt, Homo Sapiens; identical to SEQ ID NO: 279920

SEQ ID NO: 675690 - RNA, 64 nt, Homo Sapiens; identical to SEQ ID NO: 279921

SEQ ID NO: 675691 - RNA, 64 nt, Homo Sapiens; identical to SEQ ID NO: 279922

SEQ ID NO: 675692 - RNA, 57 nt, Homo Sapiens; identical to SEQ ID NO: 244788

SEQ ID NO: 675693 - RNA, 64 nt, Homo Sapiens; identical to SEQ ID NO: 279924

SEQ ID NO: 675694 - RNA, 64 nt, Homo Sapiens; identical to SEQ ID NO: 279925

SEQ ID NO: 675695 - RNA, 64 nt, Homo Sapiens; identical to SEQ ID NO: 279926

SEQ ID NO: 675696 - RNA, 64 nt, Homo Sapiens; identical to SEQ ID NO: 279927

SEQ ID NO: 675697 - RNA, 64 nt, Homo Sapiens; identical to SEQ ID NO: 279928

SEQ ID NO: 675698 - RNA, 64 nt, Homo Sapiens; identical to SEQ ID NO: 279929

SEQ ID NO: 675699 - RNA, 64 nt, Homo Sapiens; identical to SEQ ID NO: 279930

SEQ ID NO: 675700 - RNA, 64 nt, Homo Sapiens; identical to SEQ ID NO: 279931

SEQ ID NO: 675701 - RNA, 64 nt, Homo Sapiens; identical to SEQ ID NO: 279932

SEQ ID NO: 675702 - RNA, 64 nt, Homo Sapiens; identical to SEQ ID NO: 279933

SEQ ID NO: 675703 - RNA, 64 nt, Homo Sapiens; identical to SEQ ID NO: 279934

SEQ ID NO: 675704 - RNA, 64 nt, Homo Sapiens; identical to SEQ ID NO: 279935

SEQ ID NO: 675705 - RNA, 64 nt, Homo Sapiens; identical to SEQ ID NO: 279936

SEQ ID NO: 675706 - RNA, 64 nt, Homo Sapiens; identical to SEQ ID NO: 279937

SEQ ID NO: 675707 - RNA, 64 nt, Homo Sapiens; identical to SEQ ID NO: 279938

SEQ ID NO: 675708 - RNA, 64 nt, Homo Sapiens
ggcugucaugguccuuugcagagcugcugcuuuuggcauucauagauaaacagcucaggcauaa

SEQ ID NO: 675709 - RNA, 64 nt, Homo Sapiens
gugaaauggagaugauaacacugugucuuagguuggcauucaggucacaugaaaggugugugga

SEQ ID NO: 675710 - RNA, 64 nt, Homo Sapiens
aagaaucuagucuuuguaauagaaguuucccaguggcauucacuagugagaguuuuagacaaau

SEQ ID NO: 675711 - RNA, 64 nt, Homo Sapiens
cuuuggugaaauguccuguacagaacaguaccuuggcauucagcagcuguaauuggggaacauu

SEQ ID NO: 675712 - RNA, 64 nt, Homo Sapiens
cagagcaaagcacuuuaaccgugccacccucucuggcauucaugaccaccugucccaggcugug

SEQ ID NO: 675713 - RNA, 64 nt, Homo Sapiens
gcugggggaaggaaagcuacggguucuaaguacaggcauucaagggcucaaacugaaagagugu

SEQ ID NO: 675714 - RNA, 64 nt, Homo Sapiens
gugacaugaugguacuaaaugucgagguauugcuggcauucaggggcuuccugcguguguaaaa

SEQ ID NO: 675715 - RNA, 64 nt, Homo Sapiens
caguggacagugggaauuaaauuaauauuugaaaggcauucauuguaaauacuguaauauauuu

SEQ ID NO: 675716 - RNA, 64 nt, Homo Sapiens
auuaaaaagcggauccaaaguaucuggggaacuuggcauucaaccugucagaggagccuuucga

SEQ ID NO: 675717 - RNA, 64 nt, Homo Sapiens
uacagacuccaacaaggccuuuccgugggagggaggcauucauccugcagucggaaguuuccuu

SEQ ID NO: 675718 - RNA, 64 nt, Homo Sapiens; identical to SEQ ID NO: 246526

SEQ ID NO: 675719 - RNA, 64 nt, Homo Sapiens; identical to SEQ ID NO: 246527

SEQ ID NO: 675720 - RNA, 64 nt, Homo Sapiens; identical to SEQ ID NO: 246528

SEQ ID NO: 675721 - RNA, 64 nt, Homo Sapiens; identical to SEQ ID NO: 246529

SEQ ID NO: 675722 - RNA, 64 nt, Homo Sapiens; identical to SEQ ID NO: 246530

SEQ ID NO: 675723 - RNA, 64 nt, Homo Sapiens; identical to SEQ ID NO: 246531

SEQ ID NO: 675724 - RNA, 64 nt, Homo Sapiens; identical to SEQ ID NO: 246532

SEQ ID NO: 675725 - RNA, 64 nt, Homo Sapiens; identical to SEQ ID NO: 246533

SEQ ID NO: 675726 - RNA, 64 nt, Homo Sapiens; identical to SEQ ID NO: 246534

SEQ ID NO: 675727 - RNA, 64 nt, Homo Sapiens; identical to SEQ ID NO: 246535

SEQ ID NO: 675728 - RNA, 64 nt, Homo Sapiens; identical to SEQ ID NO: 246536

SEQ ID NO: 675729 - RNA, 64 nt, Homo Sapiens; identical to SEQ ID NO: 246537

SEQ ID NO: 675730 - RNA, 59 nt, Homo Sapiens; identical to SEQ ID NO: 246538

SEQ ID NO: 675731 - RNA, 64 nt, Homo Sapiens; identical to SEQ ID NO: 246539

SEQ ID NO: 675732 - RNA, 64 nt, Homo Sapiens; identical to SEQ ID NO: 246540

SEQ ID NO: 675733 - RNA, 64 nt, Homo Sapiens; identical to SEQ ID NO: 246541

SEQ ID NO: 675734 - RNA, 64 nt, Homo Sapiens
uauuauauacaagcacaacauuuuggggucugugagaguacauguuguacauuuaaagcagcug

SEQ ID NO: 675735 - RNA, 64 nt, Homo Sapiens
gcacuagagggaaguguuccgucugcugcucuaaagaguacaguuugcugcaaauucugcagcu

SEQ ID NO: 675736 - RNA, 64 nt, Homo Sapiens
caggggccucauaccauaugacagggccagggcaagaguacacaccaagcccaccccauugcca

SEQ ID NO: 675737 - RNA, 64 nt, Homo Sapiens
cuggguagggggaaaaucaggcuccucccacaccagaguacagcgaccucauuccccagaaaag

SEQ ID NO: 675738 - RNA, 64 nt, Homo Sapiens
ccaacagcacccucuccagaacccucuccagaugagaguacaccugagaguacaccccaacagc

SEQ ID NO: 675739 - RNA, 64 nt, Homo Sapiens; identical to SEQ ID NO: 675738

SEQ ID NO: 675740 - RNA, 64 nt, Homo Sapiens
ccaacagcacccucuccagaacccucuccagaugagaguacaccaugggagugcccccaacagc

SEQ ID NO: 675741 - RNA, 64 nt, Homo Sapiens
gaauccguggaaggugcagcgcaaagagggcaacgcuagacacacaccaccacgaggggcaucu

SEQ ID NO: 675742 - RNA, 64 nt, Homo Sapiens
gugugguuaguaggaaucuccccgccaugcccuggcuagacaguacugugccucaggauaagga

SEQ ID NO: 675743 - RNA, 64 nt, Homo Sapiens
caccuuccagugaaauucugaaagucuuaucuuaaaaaucgauccgcuuaccaugggccuauuc

SEQ ID NO: 675744 - RNA, 64 nt, Homo Sapiens
agcuuuuuguaaaugcguccugauaaugauuaggaaaaucgaccuuuucauccaugaugaccau

SEQ ID NO: 675745 - RNA, 64 nt, Homo Sapiens; identical to SEQ ID NO: 127462

SEQ ID NO: 675746 - RNA, 64 nt, Homo Sapiens; identical to SEQ ID NO: 127463

SEQ ID NO: 675747 - RNA, 64 nt, Homo Sapiens; identical to SEQ ID NO: 127464

SEQ ID NO: 675748 - RNA, 64 nt, Homo Sapiens; identical to SEQ ID NO: 127465

SEQ ID NO: 675749 - RNA, 64 nt, Homo Sapiens; identical to SEQ ID NO: 127466

SEQ ID NO: 675750 - RNA, 64 nt, Homo Sapiens; identical to SEQ ID NO: 127467

SEQ ID NO: 675751 - RNA, 64 nt, Homo Sapiens; identical to SEQ ID NO: 127468

SEQ ID NO: 675752 - RNA, 64 nt, Homo Sapiens; identical to SEQ ID NO: 127469

SEQ ID NO: 675753 - RNA, 64 nt, Homo Sapiens; identical to SEQ ID NO: 127470

SEQ ID NO: 675754 - RNA, 64 nt, Homo Sapiens; identical to SEQ ID NO: 127471

SEQ ID NO: 675755 - RNA, 64 nt, Homo Sapiens; identical to SEQ ID NO: 127472

SEQ ID NO: 675756 - RNA, 64 nt, Homo Sapiens; identical to SEQ ID NO: 127473

SEQ ID NO: 675757 - RNA, 64 nt, Homo Sapiens; identical to SEQ ID NO: 127474

SEQ ID NO: 675758 - RNA, 64 nt, Homo Sapiens; identical to SEQ ID NO: 127475

SEQ ID NO: 675759 - RNA, 64 nt, Homo Sapiens; identical to SEQ ID NO: 127476

SEQ ID NO: 675760 - RNA, 64 nt, Homo Sapiens; identical to SEQ ID NO: 127477

SEQ ID NO: 675761 - RNA, 64 nt, Homo Sapiens; identical to SEQ ID NO: 127476

SEQ ID NO: 675762 - RNA, 64 nt, Homo Sapiens; identical to SEQ ID NO: 127477

SEQ ID NO: 675763 - RNA, 64 nt, Homo Sapiens; identical to SEQ ID NO: 127480

SEQ ID NO: 675764 - RNA, 64 nt, Homo Sapiens; identical to SEQ ID NO: 127477

SEQ ID NO: 675765 - RNA, 64 nt, Homo Sapiens; identical to SEQ ID NO: 127482

SEQ ID NO: 675766 - RNA, 64 nt, Homo Sapiens; identical to SEQ ID NO: 127483

SEQ ID NO: 675767 - RNA, 64 nt, Homo Sapiens; identical to SEQ ID NO: 127484

SEQ ID NO: 675768 - RNA, 64 nt, Homo Sapiens; identical to SEQ ID NO: 127485

SEQ ID NO: 675769 - RNA, 64 nt, Homo Sapiens; identical to SEQ ID NO: 127486

SEQ ID NO: 675770 - RNA, 64 nt, Homo Sapiens; identical to SEQ ID NO: 127487

SEQ ID NO: 675771 - RNA, 64 nt, Homo Sapiens; identical to SEQ ID NO: 127488

SEQ ID NO: 675772 - RNA, 64 nt, Homo Sapiens; identical to SEQ ID NO: 127489

SEQ ID NO: 675773 - RNA, 64 nt, Homo Sapiens; identical to SEQ ID NO: 127490

SEQ ID NO: 675774 - RNA, 64 nt, Homo Sapiens; identical to SEQ ID NO: 127491

SEQ ID NO: 675775 - RNA, 64 nt, Homo Sapiens; identical to SEQ ID NO: 127492

SEQ ID NO: 675776 - RNA, 64 nt, Homo Sapiens; identical to SEQ ID NO: 127493

SEQ ID NO: 675777 - RNA, 64 nt, Homo Sapiens; identical to SEQ ID NO: 127494

SEQ ID NO: 675778 - RNA, 64 nt, Homo Sapiens; identical to SEQ ID NO: 127495

SEQ ID NO: 675779 - RNA, 62 nt, Homo Sapiens
aaucuccucaaacccagaagguuuaaucacuucaucccaaaaaugggauugugaaugucagc

SEQ ID NO: 675780 - RNA, 62 nt, Homo Sapiens
aaaagucuagguuuuaaggcugugccagaacccaucccaauaaagagaccgagucugaaguc

SEQ ID NO: 675781 - RNA, 62 nt, Homo Sapiens
cugucaugugucucgaaaucagcagcccuccccaucccaaucccaggcagcuuguguguaca

SEQ ID NO: 675782 - RNA, 62 nt, Homo Sapiens
uaaggaaaauuggagaugcuaacauccucccccaucccaacugcaccuuaaaauaugcaugu

SEQ ID NO: 675783 - RNA, 62 nt, Homo Sapiens
caccauaucuucccauuucaaucaucccaaggcaucccaagaaacuguaaugcuguuuugga

SEQ ID NO: 675784 - RNA, 62 nt, Homo Sapiens
caucccaagacaccauaucucuguuuuggaaucaucccaagggccaaagaagaacuguaaug

SEQ ID NO: 675785 - RNA, 62 nt, Homo Sapiens
aaaaauauauuaaaaagauauauuauuauugucaucccaagaaguuaauacuaucauaguaa

SEQ ID NO: 675786 - RNA, 62 nt, Homo Sapiens
aaaaagauauuuuaaaaauuuacuauuauugucaucccaagaaauuaauacuaucauguuaa

SEQ ID NO: 675787 - RNA, 62 nt, Homo Sapiens
cugggaguuguggugggagggcaaggcccccacaucccaacuagaggguuagaggcacuuga

SEQ ID NO: 675788 - RNA, 62 nt, Homo Sapiens
ccuucuuucucuagauuguucacucccuuccccaucccaaccggaucugucucuguauuccu

SEQ ID NO: 675789 - RNA, 64 nt, Homo Sapiens; identical to SEQ ID NO: 60054

SEQ ID NO: 675790 - RNA, 64 nt, Homo Sapiens; identical to SEQ ID NO: 60055

SEQ ID NO: 675791 - RNA, 64 nt, Homo Sapiens; identical to SEQ ID NO: 60056

SEQ ID NO: 675792 - RNA, 64 nt, Homo Sapiens; identical to SEQ ID NO: 60057

SEQ ID NO: 675793 - RNA, 64 nt, Homo Sapiens; identical to SEQ ID NO: 60058

SEQ ID NO: 675794 - RNA, 64 nt, Homo Sapiens; identical to SEQ ID NO: 60059

SEQ ID NO: 675795 - RNA, 64 nt, Homo Sapiens; identical to SEQ ID NO: 60060

SEQ ID NO: 675796 - RNA, 64 nt, Homo Sapiens; identical to SEQ ID NO: 60061

SEQ ID NO: 675797 - RNA, 64 nt, Homo Sapiens; identical to SEQ ID NO: 60062

SEQ ID NO: 675798 - RNA, 64 nt, Homo Sapiens; identical to SEQ ID NO: 60063

SEQ ID NO: 675799 - RNA, 64 nt, Homo Sapiens; identical to SEQ ID NO: 60064

SEQ ID NO: 675800 - RNA, 64 nt, Homo Sapiens; identical to SEQ ID NO: 60065

SEQ ID NO: 675801 - RNA, 64 nt, Homo Sapiens; identical to SEQ ID NO: 380673

SEQ ID NO: 675802 - RNA, 64 nt, Homo Sapiens; identical to SEQ ID NO: 380674

SEQ ID NO: 675803 - RNA, 64 nt, Homo Sapiens; identical to SEQ ID NO: 380675

SEQ ID NO: 675804 - RNA, 64 nt, Homo Sapiens; identical to SEQ ID NO: 380676

SEQ ID NO: 675805 - RNA, 63 nt, Homo Sapiens; identical to SEQ ID NO: 380677

SEQ ID NO: 675806 - RNA, 64 nt, Homo Sapiens; identical to SEQ ID NO: 380678

SEQ ID NO: 675807 - RNA, 64 nt, Homo Sapiens; identical to SEQ ID NO: 380679

SEQ ID NO: 675808 - RNA, 64 nt, Homo Sapiens; identical to SEQ ID NO: 380680

SEQ ID NO: 675809 - RNA, 64 nt, Homo Sapiens; identical to SEQ ID NO: 380681

SEQ ID NO: 675810 - RNA, 64 nt, Homo Sapiens; identical to SEQ ID NO: 380682

SEQ ID NO: 675811 - RNA, 64 nt, Homo Sapiens; identical to SEQ ID NO: 380683

SEQ ID NO: 675812 - RNA, 64 nt, Homo Sapiens; identical to SEQ ID NO: 380684

SEQ ID NO: 675813 - RNA, 64 nt, Homo Sapiens; identical to SEQ ID NO: 380685

SEQ ID NO: 675814 - RNA, 64 nt, Homo Sapiens; identical to SEQ ID NO: 380686

SEQ ID NO: 675815 - RNA, 58 nt, Homo Sapiens; identical to SEQ ID NO: 380687

SEQ ID NO: 675816 - RNA, 64 nt, Homo Sapiens; identical to SEQ ID NO: 380688

SEQ ID NO: 675817 - RNA, 64 nt, Homo Sapiens; identical to SEQ ID NO: 380689

SEQ ID NO: 675818 - RNA, 64 nt, Homo Sapiens; identical to SEQ ID NO: 380690

SEQ ID NO: 675819 - RNA, 64 nt, Homo Sapiens; identical to SEQ ID NO: 380691

SEQ ID NO: 675820 - RNA, 64 nt, Homo Sapiens; identical to SEQ ID NO: 380692

SEQ ID NO: 675821 - RNA, 64 nt, Homo Sapiens; identical to SEQ ID NO: 380693

SEQ ID NO: 675822 - RNA, 64 nt, Homo Sapiens; identical to SEQ ID NO: 380694

SEQ ID NO: 675823 - RNA, 64 nt, Homo Sapiens; identical to SEQ ID NO: 380695

SEQ ID NO: 675824 - RNA, 64 nt, Homo Sapiens; identical to SEQ ID NO: 380696

SEQ ID NO: 675825 - RNA, 64 nt, Homo Sapiens; identical to SEQ ID NO: 380697

SEQ ID NO: 675826 - RNA, 64 nt, Homo Sapiens; identical to SEQ ID NO: 380698

SEQ ID NO: 675827 - RNA, 64 nt, Homo Sapiens; identical to SEQ ID NO: 380699

SEQ ID NO: 675828 - RNA, 64 nt, Homo Sapiens; identical to SEQ ID NO: 380700

SEQ ID NO: 675829 - RNA, 64 nt, Homo Sapiens; identical to SEQ ID NO: 380701

SEQ ID NO: 675830 - RNA, 64 nt, Homo Sapiens; identical to SEQ ID NO: 547068

SEQ ID NO: 675831 - RNA, 64 nt, Homo Sapiens; identical to SEQ ID NO: 547069

SEQ ID NO: 675832 - RNA, 64 nt, Homo Sapiens; identical to SEQ ID NO: 547070

SEQ ID NO: 675833 - RNA, 64 nt, Homo Sapiens; identical to SEQ ID NO: 547071

SEQ ID NO: 675834 - RNA, 64 nt, Homo Sapiens; identical to SEQ ID NO: 547072

SEQ ID NO: 675835 - RNA, 64 nt, Homo Sapiens; identical to SEQ ID NO: 547073

SEQ ID NO: 675836 - RNA, 64 nt, Homo Sapiens; identical to SEQ ID NO: 547074

SEQ ID NO: 675837 - RNA, 64 nt, Homo Sapiens; identical to SEQ ID NO: 547075

SEQ ID NO: 675838 - RNA, 64 nt, Homo Sapiens; identical to SEQ ID NO: 547076

SEQ ID NO: 675839 - RNA, 64 nt, Homo Sapiens; identical to SEQ ID NO: 547077

SEQ ID NO: 675840 - RNA, 64 nt, Homo Sapiens; identical to SEQ ID NO: 547078

SEQ ID NO: 675841 - RNA, 64 nt, Homo Sapiens; identical to SEQ ID NO: 547079

SEQ ID NO: 675842 - RNA, 64 nt, Homo Sapiens; identical to SEQ ID NO: 547080

SEQ ID NO: 675843 - RNA, 64 nt, Homo Sapiens; identical to SEQ ID NO: 547081

SEQ ID NO: 675844 - RNA, 64 nt, Homo Sapiens; identical to SEQ ID NO: 547082

SEQ ID NO: 675845 - RNA, 64 nt, Homo Sapiens; identical to SEQ ID NO: 547083

SEQ ID NO: 675846 - RNA, 64 nt, Homo Sapiens; identical to SEQ ID NO: 547084

SEQ ID NO: 675847 - RNA, 64 nt, Homo Sapiens; identical to SEQ ID NO: 547085

SEQ ID NO: 675848 - RNA, 64 nt, Homo Sapiens; identical to SEQ ID NO: 547086

SEQ ID NO: 675849 - RNA, 64 nt, Homo Sapiens; identical to SEQ ID NO: 547087

SEQ ID NO: 675850 - RNA, 64 nt, Homo Sapiens; identical to SEQ ID NO: 547088

SEQ ID NO: 675851 - RNA, 64 nt, Homo Sapiens; identical to SEQ ID NO: 547089

SEQ ID NO: 675852 - RNA, 64 nt, Homo Sapiens; identical to SEQ ID NO: 547090

SEQ ID NO: 675853 - RNA, 64 nt, Homo Sapiens; identical to SEQ ID NO: 547091

SEQ ID NO: 675854 - RNA, 64 nt, Homo Sapiens; identical to SEQ ID NO: 547092

SEQ ID NO: 675855 - RNA, 64 nt, Homo Sapiens; identical to SEQ ID NO: 547093

SEQ ID NO: 675856 - RNA, 64 nt, Homo Sapiens; identical to SEQ ID NO: 547094

SEQ ID NO: 675857 - RNA, 64 nt, Homo Sapiens; identical to SEQ ID NO: 547095

SEQ ID NO: 675858 - RNA, 64 nt, Homo Sapiens; identical to SEQ ID NO: 547096

SEQ ID NO: 675859 - RNA, 64 nt, Homo Sapiens; identical to SEQ ID NO: 547097

SEQ ID NO: 675860 - RNA, 64 nt, Homo Sapiens; identical to SEQ ID NO: 547098

SEQ ID NO: 675861 - RNA, 64 nt, Homo Sapiens; identical to SEQ ID NO: 547099

SEQ ID NO: 675862 - RNA, 64 nt, Homo Sapiens; identical to SEQ ID NO: 547100

SEQ ID NO: 675863 - RNA, 64 nt, Homo Sapiens; identical to SEQ ID NO: 547101

SEQ ID NO: 675864 - RNA, 64 nt, Homo Sapiens; identical to SEQ ID NO: 547102

SEQ ID NO: 675865 - RNA, 64 nt, Homo Sapiens; identical to SEQ ID NO: 547103

SEQ ID NO: 675866 - RNA, 64 nt, Homo Sapiens; identical to SEQ ID NO: 547104

SEQ ID NO: 675867 - RNA, 64 nt, Homo Sapiens; identical to SEQ ID NO: 547105

SEQ ID NO: 675868 - RNA, 64 nt, Homo Sapiens; identical to SEQ ID NO: 547106

SEQ ID NO: 675869 - RNA, 64 nt, Homo Sapiens; identical to SEQ ID NO: 547107

SEQ ID NO: 675870 - RNA, 64 nt, Homo Sapiens; identical to SEQ ID NO: 547108

SEQ ID NO: 675871 - RNA, 64 nt, Homo Sapiens; identical to SEQ ID NO: 547109

SEQ ID NO: 675872 - RNA, 64 nt, Homo Sapiens; identical to SEQ ID NO: 547110

SEQ ID NO: 675873 - RNA, 64 nt, Homo Sapiens; identical to SEQ ID NO: 547111

SEQ ID NO: 675874 - RNA, 64 nt, Homo Sapiens; identical to SEQ ID NO: 547112

SEQ ID NO: 675875 - RNA, 64 nt, Homo Sapiens; identical to SEQ ID NO: 547113

SEQ ID NO: 675876 - RNA, 64 nt, Homo Sapiens; identical to SEQ ID NO: 547114

SEQ ID NO: 675877 - RNA, 64 nt, Homo Sapiens; identical to SEQ ID NO: 547115

SEQ ID NO: 675878 - RNA, 64 nt, Homo Sapiens; identical to SEQ ID NO: 547116

SEQ ID NO: 675879 - RNA, 64 nt, Homo Sapiens; identical to SEQ ID NO: 547117

SEQ ID NO: 675880 - RNA, 64 nt, Homo Sapiens; identical to SEQ ID NO: 547118

SEQ ID NO: 675881 - RNA, 64 nt, Homo Sapiens; identical to SEQ ID NO: 547119

SEQ ID NO: 675882 - RNA, 64 nt, Homo Sapiens; identical to SEQ ID NO: 547120

SEQ ID NO: 675883 - RNA, 64 nt, Homo Sapiens; identical to SEQ ID NO: 547121

SEQ ID NO: 675884 - RNA, 64 nt, Homo Sapiens; identical to SEQ ID NO: 547122

SEQ ID NO: 675885 - RNA, 64 nt, Homo Sapiens; identical to SEQ ID NO: 547123

SEQ ID NO: 675886 - RNA, 64 nt, Homo Sapiens; identical to SEQ ID NO: 547124

SEQ ID NO: 675887 - RNA, 64 nt, Homo Sapiens; identical to SEQ ID NO: 547125

SEQ ID NO: 675888 - RNA, 64 nt, Homo Sapiens; identical to SEQ ID NO: 547126

SEQ ID NO: 675889 - RNA, 64 nt, Homo Sapiens; identical to SEQ ID NO: 547127

SEQ ID NO: 675890 - RNA, 64 nt, Homo Sapiens; identical to SEQ ID NO: 547128

SEQ ID NO: 675891 - RNA, 64 nt, Homo Sapiens; identical to SEQ ID NO: 547129

SEQ ID NO: 675892 - RNA, 64 nt, Homo Sapiens; identical to SEQ ID NO: 547130

SEQ ID NO: 675893 - RNA, 64 nt, Homo Sapiens
gaaauaagcugcgugugguggcucacaccuguaaucccaacacuuugggacguugaaaugggag

SEQ ID NO: 675894 - RNA, 64 nt, Homo Sapiens
aaacuaggccaggcgugguggcucacgccuguaaucccaacacuuugggaggccgaggcgggcg

SEQ ID NO: 675895 - RNA, 64 nt, Homo Sapiens
uuagcaggaugggcgcaguggcucacgccacuaaucccaacauuuuaggaggccuaggcaggag

SEQ ID NO: 675896 - RNA, 64 nt, Homo Sapiens
aaaaaaggcugggugugguggcucacacccauaaucccaacacuuuggcucagcagauugcuug

SEQ ID NO: 675897 - RNA, 64 nt, Homo Sapiens
uuuagcuagaccuuugcuuccuucuugccagcucucccaacauacccaauccuggugaucaggg

SEQ ID NO: 675898 - RNA, 64 nt, Homo Sapiens
ccuuuuaggagacugguugguuuuuuucccucuuucccaacauguuuaagaaauguaacauucu

SEQ ID NO: 675899 - RNA, 64 nt, Homo Sapiens
aacauuggccaggcacgguggcucacgccuguaaucccaacacuuuaggagaccaaggcgggca

SEQ ID NO: 675900 - RNA, 64 nt, Homo Sapiens
uuuucaagcugggccuaguggcgcacaccugcaaucccaacacuuugggaggccaagagaggaa

SEQ ID NO: 675901 - RNA, 64 nt, Homo Sapiens
ccaccugagugacagaaaucuaaacacacauccgucccaacauuccccagaccauucagaauca

SEQ ID NO: 675902 - RNA, 64 nt, Homo Sapiens
augcauuauaaguuucucaauguacaucuuuuuaucccaacacccucaaacuagaauauuuguc

SEQ ID NO: 675903 - RNA, 64 nt, Homo Sapiens
cuguacuuuauacaauucugcaguuguuucccauucccaacaaaauucuguauaccccuucaag

SEQ ID NO: 675904 - RNA, 64 nt, Homo Sapiens
cuuaacacagauguuuuuuacucgcccugcauauucccaacauaucagugguacauaaauuuau

SEQ ID NO: 675905 - RNA, 64 nt, Homo Sapiens
cccggacauguuccaagcccugccucaacuuuucucccaacacuaagcuuuccucccaacacac

SEQ ID NO: 675906 - RNA, 64 nt, Homo Sapiens
cugccucaacuuuucucccaacacuaagcuuuccucccaacacacauccaucucguguguucau

SEQ ID NO: 675907 - RNA, 64 nt, Homo Sapiens
ccgcaaagccgggcgcgguggcucacaccuguaaucccaacaguuuggaagaccgaggcgggug

SEQ ID NO: 675908 - RNA, 64 nt, Homo Sapiens
augacuucucguagauaacuucacagucauccagucccaacaccugcucuugccugguaggaac

SEQ ID NO: 675909 - RNA, 64 nt, Homo Sapiens
uugggaggcuaaggcagcuggcucaugccuguaaucccaacacuagaaaaggccgggcauggug

SEQ ID NO: 675910 - RNA, 64 nt, Homo Sapiens
ucgggaggccaaggugagaggcucacgccuauaaucccaacacuuguccuggccaguugcagug

SEQ ID NO: 675911 - RNA, 64 nt, Homo Sapiens
aggggccgggggcagucugagagaggccauucuuucccaacaccucuuggggaguuuagggugg

SEQ ID NO: 675912 - RNA, 64 nt, Homo Sapiens
cuugucacgccagacuucccacggcuccucgagaucccaacacugccagcauuucccuuccuuc

SEQ ID NO: 675913 - RNA, 64 nt, Homo Sapiens
uccuguccgcccucuuccccucuaaugcucacgcucccaacacaaggugggcagggaggcacca

SEQ ID NO: 675914 - RNA, 64 nt, Homo Sapiens
caaagcuuuccuggagagucucacuccccuccuuucccaacacuucagacugcaagugagcaaa

SEQ ID NO: 675915 - RNA, 64 nt, Homo Sapiens
aaaauguagaacuuuaaccaaagacuugucccuuuuaaagcaaaauggggauugaagggacuua

SEQ ID NO: 675916 - RNA, 64 nt, Homo Sapiens
accaaaguguuugagaacuucauccaaaccuacuuuaaagcauuaugugcaauuaaguuguuau

SEQ ID NO: 675917 - RNA, 64 nt, Homo Sapiens
acagaggaaaucuguaacagguauuuuguuucuuuuaaagcaagcaacacagaggaauuuauac

SEQ ID NO: 675918 - RNA, 64 nt, Homo Sapiens
cuaccuuaucacugcauuauucucuuuuaucuguuuaaagcauauagagaugaaguuuguaguu

SEQ ID NO: 675919 - RNA, 64 nt, Homo Sapiens
agacuuagcacauucaauaaaugauugaagaguguuaaagcauuaggucugcauuaaaagguga

SEQ ID NO: 675920 - RNA, 64 nt, Homo Sapiens
gguucucaaaguguggucccuauaaacuaacgguuuaaagcaguacauugcucuuuaaagaacu

SEQ ID NO: 675921 - RNA, 64 nt, Homo Sapiens
aaaggcuuucugaaucuucucaggcaguucagauuuaaagcaccauccaaaccuuggaaauacg

SEQ ID NO: 675922 - RNA, 64 nt, Homo Sapiens
uaacuugcauauauguuauuggauggguugucuuuuaaagcauuuacuaauguacucugaaauu

SEQ ID NO: 675923 - RNA, 64 nt, Homo Sapiens
uuggaacugacauaauuagucuugacuuacuucauuaaagcaagauucaauuccuuguucauuu

SEQ ID NO: 675924 - RNA, 64 nt, Homo Sapiens
acuucuaaggcgagccacuccacacccaggggaguuaaagcacaugaaaaagacaguggagaau

SEQ ID NO: 675925 - RNA, 64 nt, Homo Sapiens
uugaacagugugaugagaauaggaaugugguguuuuaaagcaguguugcauuuuaaucaguaau

SEQ ID NO: 675926 - RNA, 64 nt, Homo Sapiens
uuaaaaauuuagguuuuauuuagagugacuauuuuuaaagcaugauucguauuuguauuagaua

SEQ ID NO: 675927 - RNA, 64 nt, Homo Sapiens
acguuuucacagacaauaacuaaaaaugcaccuuuuaaagcacuaacugauuuagcaacacagg

SEQ ID NO: 675928 - RNA, 64 nt, Homo Sapiens
aacuugugucauugauguaauuuaaaacuuuuguuuaaagcauuacaguauuuuucugugacca

SEQ ID NO: 675929 - RNA, 64 nt, Homo Sapiens
gaccaucaauuaaugaggguuugugcuaccagaguuaaagcauaugcuaucauuguauucuuua

SEQ ID NO: 675930 - RNA, 64 nt, Homo Sapiens
caacauuguguaaaugaaucucaugcucauucauuuaaagcauuacuuuccagcccagcacucu

SEQ ID NO: 675931 - RNA, 64 nt, Homo Sapiens
guguagagggaaauuuauagucucugggacacauuuaaagcaguaaagacacaacauaccagaa

SEQ ID NO: 675932 - RNA, 64 nt, Homo Sapiens
aucucucaauguucaguguuagaagaaggggguuuuaaagcaggacacuccuuucugaaaagcc

SEQ ID NO: 675933 - RNA, 64 nt, Homo Sapiens
gcagauucaccuguaaauaugaaagaaucuucaauuaaagcauguuugugaacuuuaagguuuu

SEQ ID NO: 675934 - RNA, 64 nt, Homo Sapiens
agcacaauguucaggcauaaaauuucauagcaauuuaaagcacaagcacaauaaauuuccuuaa

SEQ ID NO: 675935 - RNA, 64 nt, Homo Sapiens
guuaucagcucacucaguuuucaaaguuugcuuuuuaaagcaaagugaagaaaauuaauuucuu

SEQ ID NO: 675936 - RNA, 64 nt, Homo Sapiens
ugguaaauuaucgcugaguuauagcuuuuaaauuuuaaagcauucaagugugaauccaaacagu

SEQ ID NO: 675937 - RNA, 64 nt, Homo Sapiens
gaaucugaaacaauuuucacuauuugaagacccuuuaaagcaguaguaagguucuguuaaaaua

SEQ ID NO: 675938 - RNA, 64 nt, Homo Sapiens
guaaauacgaauauaugccugcacagacaaauguuuaaagcacaugucccuuuaaagcauugac

SEQ ID NO: 675939 - RNA, 64 nt, Homo Sapiens
gacgcacagacaaauguuuacauaguaugucccuuuaaagcauuacuuugaaaaugaaucacca

SEQ ID NO: 675940 - RNA, 64 nt, Homo Sapiens
acagggagagucuucugugccacaggguaugggguuaaagcauggacguccuccauaaguggag

SEQ ID NO: 675941 - RNA, 64 nt, Homo Sapiens
cagcucuggacucaagacagacuggggucaaaucuuaaagcacagccugaaggauucugucuuu

SEQ ID NO: 675942 - RNA, 64 nt, Homo Sapiens
caccucuaaucaauucaggagaaacacauaucauuuaaagcaacauaggcuaaccuguagguaa

SEQ ID NO: 675943 - RNA, 64 nt, Homo Sapiens
guagacuuugacuuuuuuauuaaaaaccuuuguauuaaagcaaguuauguuauuuuucuuuuau

SEQ ID NO: 675944 - RNA, 64 nt, Homo Sapiens
gugaaaguagucuuguuuuaugaggaugucugcauuaaagcaguaaaauaagcuuuccauuuua

SEQ ID NO: 675945 - RNA, 64 nt, Homo Sapiens
aaugauauguuagugccucuguuauaugucaaguuuaaagcagggcacauuguugcagcaaaau

SEQ ID NO: 675946 - RNA, 64 nt, Homo Sapiens
gauaauguuacuaugacaacauuuuuacuguccuuuaaagcauugcaauagcguuuuuggauau

SEQ ID NO: 675947 - RNA, 64 nt, Homo Sapiens
uuuaucagaacuguucacuuucagaaaugauuuuuuaaagcauuuuguugaaaaugcgguugcu

SEQ ID NO: 675948 - RNA, 64 nt, Homo Sapiens
cggccaggauggucagugaaguuaccaggaauguuuaaagcacaaaggacuuugggugugugug

SEQ ID NO: 675949 - RNA, 64 nt, Homo Sapiens
cccuccccccucucaucuuuagaacauuuagacauuaaagcaaguuucuggugagcaauggaau

SEQ ID NO: 675950 - RNA, 64 nt, Homo Sapiens
gugcuugccaaagagauagggacgcauaugcuuuuuaaagcaaucuaaaaauaauaauaaguau

SEQ ID NO: 675951 - RNA, 64 nt, Homo Sapiens
aaacaucguuuuuuacuucuucugguagaauuuuuuaaagcauaauuggaauccuuggauaaau

SEQ ID NO: 675952 - RNA, 64 nt, Homo Sapiens
ggugugagccaccgugcccagccaaagacugcucuuaaagcaccuuuuugacagugaacauggu

SEQ ID NO: 675953 - RNA, 64 nt, Homo Sapiens
aaaauggggacaggauaaaagguggcaacuaaauuuaaagcacagaagaaaugauuuccuucua

SEQ ID NO: 675954 - RNA, 64 nt, Homo Sapiens
ugugaucaauauaacaauauuucuggccaagaaauuaaagcacaugauuuuugccauggauucc

SEQ ID NO: 675955 - RNA, 64 nt, Homo Sapiens
uucuuguaaacauuuaucauuuaacuguugcuuauuaaagcaacuuuaaaaagguaacagaauu

SEQ ID NO: 675956 - RNA, 64 nt, Homo Sapiens
gcguuaaaaaaaaaauuaacgccacgcauuguuuuuaaagcauugauacucuuuacaccaucau

SEQ ID NO: 675957 - RNA, 64 nt, Homo Sapiens
aaguaaaccaugaaauuggguaacuuuuaguugauuaaagcaaaguaaauauuuaccagcaacu

SEQ ID NO: 675958 - RNA, 64 nt, Homo Sapiens
acuaugugcccuucauaguaauaaaaucucaaucuuaaagcaugaaucuaaaacauaaauauuu

SEQ ID NO: 675959 - RNA, 64 nt, Homo Sapiens
aaauuagguuauuacuuuuuuuauaaccagauuuuuaaagcacuagguuuuaaaucagugggua

SEQ ID NO: 675960 - RNA, 64 nt, Homo Sapiens
uaauuacaaaaugagacacaccuaucuugauauuuuaaagcaauaucagaggguguaaagaagg

SEQ ID NO: 675961 - RNA, 64 nt, Homo Sapiens
auuucauucauauaugguauugcauuauuuuauuuuaaagcacuggugaggggaccucuuggug

SEQ ID NO: 675962 - RNA, 64 nt, Homo Sapiens
uccuguauauguaucuacauuuuuuguuuuuuuuuuaaagcaaauuuaggucaguguuuuuaag

SEQ ID NO: 675963 - RNA, 64 nt, Homo Sapiens
ccaggcaaagaucaucuacauucauguaucaguuuuaaagcagcgaaaacugugaacuuucugc

SEQ ID NO: 675964 - RNA, 64 nt, Homo Sapiens
ucuuccacuuaggaaaggaaaggcagaaguuccuuuaaagcacaccacucagcaggagugacag

SEQ ID NO: 675965 - RNA, 64 nt, Homo Sapiens
aaguuuagccuuugugcauguuguucagaaaagguuaaagcaacuuugccagaauguuuaaaau

SEQ ID NO: 675966 - RNA, 64 nt, Homo Sapiens
uugaguuuugcagacuugggguugggagaacaucuuaaagcauuaaagcauaguuuuuuguaug

SEQ ID NO: 675967 - RNA, 64 nt, Homo Sapiens
ugcagacuugggguugggagaacaucuuaaagcauuaaagcauaguuuuuuguauggccaaccu

SEQ ID NO: 675968 - RNA, 64 nt, Homo Sapiens; identical to SEQ ID NO: 308983

SEQ ID NO: 675969 - RNA, 64 nt, Homo Sapiens; identical to SEQ ID NO: 308984

SEQ ID NO: 675970 - RNA, 64 nt, Homo Sapiens; identical to SEQ ID NO: 308985

SEQ ID NO: 675971 - RNA, 64 nt, Homo Sapiens; identical to SEQ ID NO: 308986

SEQ ID NO: 675972 - RNA, 64 nt, Homo Sapiens; identical to SEQ ID NO: 308987

SEQ ID NO: 675973 - RNA, 64 nt, Homo Sapiens; identical to SEQ ID NO: 308988

SEQ ID NO: 675974 - RNA, 64 nt, Homo Sapiens; identical to SEQ ID NO: 308989

SEQ ID NO: 675975 - RNA, 64 nt, Homo Sapiens; identical to SEQ ID NO: 308990

SEQ ID NO: 675976 - RNA, 64 nt, Homo Sapiens; identical to SEQ ID NO: 308991

SEQ ID NO: 675977 - RNA, 64 nt, Homo Sapiens; identical to SEQ ID NO: 308992

SEQ ID NO: 675978 - RNA, 64 nt, Homo Sapiens; identical to SEQ ID NO: 308993

SEQ ID NO: 675979 - RNA, 64 nt, Homo Sapiens; identical to SEQ ID NO: 308994

SEQ ID NO: 675980 - RNA, 64 nt, Homo Sapiens; identical to SEQ ID NO: 308995

SEQ ID NO: 675981 - RNA, 64 nt, Homo Sapiens; identical to SEQ ID NO: 308996

SEQ ID NO: 675982 - RNA, 64 nt, Homo Sapiens; identical to SEQ ID NO: 308997

SEQ ID NO: 675983 - RNA, 64 nt, Homo Sapiens; identical to SEQ ID NO: 308998

SEQ ID NO: 675984 - RNA, 64 nt, Homo Sapiens; identical to SEQ ID NO: 308999

SEQ ID NO: 675985 - RNA, 64 nt, Homo Sapiens; identical to SEQ ID NO: 309000

SEQ ID NO: 675986 - RNA, 64 nt, Homo Sapiens; identical to SEQ ID NO: 309001

SEQ ID NO: 675987 - RNA, 64 nt, Homo Sapiens; identical to SEQ ID NO: 309002

SEQ ID NO: 675988 - RNA, 64 nt, Homo Sapiens; identical to SEQ ID NO: 309003

SEQ ID NO: 675989 - RNA, 64 nt, Homo Sapiens; identical to SEQ ID NO: 309004

SEQ ID NO: 675990 - RNA, 64 nt, Homo Sapiens; identical to SEQ ID NO: 309005

SEQ ID NO: 675991 - RNA, 64 nt, Homo Sapiens; identical to SEQ ID NO: 309006

SEQ ID NO: 675992 - RNA, 64 nt, Homo Sapiens; identical to SEQ ID NO: 309007

SEQ ID NO: 675993 - RNA, 64 nt, Homo Sapiens; identical to SEQ ID NO: 309008

SEQ ID NO: 675994 - RNA, 64 nt, Homo Sapiens; identical to SEQ ID NO: 309009

SEQ ID NO: 675995 - RNA, 64 nt, Homo Sapiens; identical to SEQ ID NO: 309010

SEQ ID NO: 675996 - RNA, 64 nt, Homo Sapiens; identical to SEQ ID NO: 309011

SEQ ID NO: 675997 - RNA, 64 nt, Homo Sapiens; identical to SEQ ID NO: 309012

SEQ ID NO: 675998 - RNA, 64 nt, Homo Sapiens; identical to SEQ ID NO: 309013

SEQ ID NO: 675999 - RNA, 64 nt, Homo Sapiens; identical to SEQ ID NO: 309014

SEQ ID NO: 676000 - RNA, 64 nt, Homo Sapiens; identical to SEQ ID NO: 309015

SEQ ID NO: 676001 - RNA, 64 nt, Homo Sapiens; identical to SEQ ID NO: 309016

SEQ ID NO: 676002 - RNA, 64 nt, Homo Sapiens; identical to SEQ ID NO: 309017

SEQ ID NO: 676003 - RNA, 64 nt, Homo Sapiens; identical to SEQ ID NO: 309018

SEQ ID NO: 676004 - RNA, 64 nt, Homo Sapiens; identical to SEQ ID NO: 309019

SEQ ID NO: 676005 - RNA, 64 nt, Homo Sapiens; identical to SEQ ID NO: 309020

SEQ ID NO: 676006 - RNA, 64 nt, Homo Sapiens; identical to SEQ ID NO: 309021

SEQ ID NO: 676007 - RNA, 64 nt, Homo Sapiens; identical to SEQ ID NO: 309022

SEQ ID NO: 676008 - RNA, 64 nt, Homo Sapiens; identical to SEQ ID NO: 309023

SEQ ID NO: 676009 - RNA, 64 nt, Homo Sapiens; identical to SEQ ID NO: 309024

SEQ ID NO: 676010 - RNA, 64 nt, Homo Sapiens; identical to SEQ ID NO: 309025

SEQ ID NO: 676011 - RNA, 64 nt, Homo Sapiens; identical to SEQ ID NO: 309026

SEQ ID NO: 676012 - RNA, 64 nt, Homo Sapiens; identical to SEQ ID NO: 309027

SEQ ID NO: 676013 - RNA, 64 nt, Homo Sapiens; identical to SEQ ID NO: 309028

SEQ ID NO: 676014 - RNA, 64 nt, Homo Sapiens; identical to SEQ ID NO: 309029

SEQ ID NO: 676015 - RNA, 64 nt, Homo Sapiens; identical to SEQ ID NO: 309030

SEQ ID NO: 676016 - RNA, 64 nt, Homo Sapiens; identical to SEQ ID NO: 309031

SEQ ID NO: 676017 - RNA, 64 nt, Homo Sapiens; identical to SEQ ID NO: 309032

SEQ ID NO: 676018 - RNA, 64 nt, Homo Sapiens; identical to SEQ ID NO: 309033

SEQ ID NO: 676019 - RNA, 64 nt, Homo Sapiens; identical to SEQ ID NO: 309034

SEQ ID NO: 676020 - RNA, 64 nt, Homo Sapiens; identical to SEQ ID NO: 309035

SEQ ID NO: 676021 - RNA, 64 nt, Homo Sapiens; identical to SEQ ID NO: 309036

SEQ ID NO: 676022 - RNA, 64 nt, Homo Sapiens; identical to SEQ ID NO: 309037

SEQ ID NO: 676023 - RNA, 64 nt, Homo Sapiens; identical to SEQ ID NO: 309038

SEQ ID NO: 676024 - RNA, 64 nt, Homo Sapiens; identical to SEQ ID NO: 309039

SEQ ID NO: 676025 - RNA, 64 nt, Homo Sapiens; identical to SEQ ID NO: 309040

SEQ ID NO: 676026 - RNA, 64 nt, Homo Sapiens; identical to SEQ ID NO: 309041

SEQ ID NO: 676027 - RNA, 64 nt, Homo Sapiens; identical to SEQ ID NO: 309042

SEQ ID NO: 676028 - RNA, 64 nt, Homo Sapiens; identical to SEQ ID NO: 309043

SEQ ID NO: 676029 - RNA, 64 nt, Homo Sapiens; identical to SEQ ID NO: 309044

SEQ ID NO: 676030 - RNA, 64 nt, Homo Sapiens; identical to SEQ ID NO: 309045

SEQ ID NO: 676031 - RNA, 64 nt, Homo Sapiens; identical to SEQ ID NO: 309046

SEQ ID NO: 676032 - RNA, 64 nt, Homo Sapiens; identical to SEQ ID NO: 309047

SEQ ID NO: 676033 - RNA, 64 nt, Homo Sapiens; identical to SEQ ID NO: 309048

SEQ ID NO: 676034 - RNA, 64 nt, Homo Sapiens; identical to SEQ ID NO: 309049

SEQ ID NO: 676035 - RNA, 64 nt, Homo Sapiens; identical to SEQ ID NO: 309050

SEQ ID NO: 676036 - RNA, 64 nt, Homo Sapiens; identical to SEQ ID NO: 309051

SEQ ID NO: 676037 - RNA, 64 nt, Homo Sapiens; identical to SEQ ID NO: 309052

SEQ ID NO: 676038 - RNA, 64 nt, Homo Sapiens; identical to SEQ ID NO: 309053

SEQ ID NO: 676039 - RNA, 64 nt, Homo Sapiens; identical to SEQ ID NO: 309054

SEQ ID NO: 676040 - RNA, 64 nt, Homo Sapiens; identical to SEQ ID NO: 309055

SEQ ID NO: 676041 - RNA, 64 nt, Homo Sapiens; identical to SEQ ID NO: 309056

SEQ ID NO: 676042 - RNA, 64 nt, Homo Sapiens; identical to SEQ ID NO: 309057

SEQ ID NO: 676043 - RNA, 64 nt, Homo Sapiens; identical to SEQ ID NO: 309058

SEQ ID NO: 676044 - RNA, 64 nt, Homo Sapiens; identical to SEQ ID NO: 309059

SEQ ID NO: 676045 - RNA, 64 nt, Homo Sapiens; identical to SEQ ID NO: 309060

SEQ ID NO: 676046 - RNA, 64 nt, Homo Sapiens; identical to SEQ ID NO: 309061

SEQ ID NO: 676047 - RNA, 64 nt, Homo Sapiens; identical to SEQ ID NO: 309062

SEQ ID NO: 676048 - RNA, 64 nt, Homo Sapiens; identical to SEQ ID NO: 309063

SEQ ID NO: 676049 - RNA, 64 nt, Homo Sapiens; identical to SEQ ID NO: 309064

SEQ ID NO: 676050 - RNA, 64 nt, Homo Sapiens; identical to SEQ ID NO: 309065

SEQ ID NO: 676051 - RNA, 64 nt, Homo Sapiens; identical to SEQ ID NO: 309066

SEQ ID NO: 676052 - RNA, 64 nt, Homo Sapiens; identical to SEQ ID NO: 309067

SEQ ID NO: 676053 - RNA, 64 nt, Homo Sapiens; identical to SEQ ID NO: 309068

SEQ ID NO: 676054 - RNA, 64 nt, Homo Sapiens; identical to SEQ ID NO: 309069

SEQ ID NO: 676055 - RNA, 64 nt, Homo Sapiens; identical to SEQ ID NO: 309070

SEQ ID NO: 676056 - RNA, 64 nt, Homo Sapiens; identical to SEQ ID NO: 309071

SEQ ID NO: 676057 - RNA, 64 nt, Homo Sapiens; identical to SEQ ID NO: 309072

SEQ ID NO: 676058 - RNA, 64 nt, Homo Sapiens; identical to SEQ ID NO: 309073

SEQ ID NO: 676059 - RNA, 64 nt, Homo Sapiens; identical to SEQ ID NO: 309074

SEQ ID NO: 676060 - RNA, 64 nt, Homo Sapiens; identical to SEQ ID NO: 309075

SEQ ID NO: 676061 - RNA, 64 nt, Homo Sapiens; identical to SEQ ID NO: 309076

SEQ ID NO: 676062 - RNA, 64 nt, Homo Sapiens; identical to SEQ ID NO: 309077

SEQ ID NO: 676063 - RNA, 64 nt, Homo Sapiens; identical to SEQ ID NO: 309078

SEQ ID NO: 676064 - RNA, 64 nt, Homo Sapiens; identical to SEQ ID NO: 309079

SEQ ID NO: 676065 - RNA, 64 nt, Homo Sapiens; identical to SEQ ID NO: 309080

SEQ ID NO: 676066 - RNA, 64 nt, Homo Sapiens; identical to SEQ ID NO: 309081

SEQ ID NO: 676067 - RNA, 64 nt, Homo Sapiens; identical to SEQ ID NO: 309082

SEQ ID NO: 676068 - RNA, 64 nt, Homo Sapiens; identical to SEQ ID NO: 309083

SEQ ID NO: 676069 - RNA, 64 nt, Homo Sapiens; identical to SEQ ID NO: 309084

SEQ ID NO: 676070 - RNA, 64 nt, Homo Sapiens; identical to SEQ ID NO: 309085

SEQ ID NO: 676071 - RNA, 64 nt, Homo Sapiens; identical to SEQ ID NO: 309086

SEQ ID NO: 676072 - RNA, 64 nt, Homo Sapiens; identical to SEQ ID NO: 309087

SEQ ID NO: 676073 - RNA, 64 nt, Homo Sapiens; identical to SEQ ID NO: 309088

SEQ ID NO: 676074 - RNA, 64 nt, Homo Sapiens; identical to SEQ ID NO: 309089

SEQ ID NO: 676075 - RNA, 64 nt, Homo Sapiens; identical to SEQ ID NO: 309090

SEQ ID NO: 676076 - RNA, 64 nt, Homo Sapiens; identical to SEQ ID NO: 309091

SEQ ID NO: 676077 - RNA, 64 nt, Homo Sapiens; identical to SEQ ID NO: 309092

SEQ ID NO: 676078 - RNA, 64 nt, Homo Sapiens; identical to SEQ ID NO: 309093

SEQ ID NO: 676079 - RNA, 64 nt, Homo Sapiens; identical to SEQ ID NO: 309094

SEQ ID NO: 676080 - RNA, 64 nt, Homo Sapiens; identical to SEQ ID NO: 309095

SEQ ID NO: 676081 - RNA, 64 nt, Homo Sapiens; identical to SEQ ID NO: 309096

SEQ ID NO: 676082 - RNA, 64 nt, Homo Sapiens; identical to SEQ ID NO: 309097

SEQ ID NO: 676083 - RNA, 64 nt, Homo Sapiens; identical to SEQ ID NO: 309098

SEQ ID NO: 676084 - RNA, 64 nt, Homo Sapiens; identical to SEQ ID NO: 309099

SEQ ID NO: 676085 - RNA, 64 nt, Homo Sapiens; identical to SEQ ID NO: 309100

SEQ ID NO: 676086 - RNA, 64 nt, Homo Sapiens; identical to SEQ ID NO: 309101

SEQ ID NO: 676087 - RNA, 64 nt, Homo Sapiens; identical to SEQ ID NO: 309102

SEQ ID NO: 676088 - RNA, 64 nt, Homo Sapiens; identical to SEQ ID NO: 309103

SEQ ID NO: 676089 - RNA, 64 nt, Homo Sapiens; identical to SEQ ID NO: 309104

SEQ ID NO: 676090 - RNA, 64 nt, Homo Sapiens; identical to SEQ ID NO: 309105

SEQ ID NO: 676091 - RNA, 64 nt, Homo Sapiens; identical to SEQ ID NO: 309106

SEQ ID NO: 676092 - RNA, 64 nt, Homo Sapiens; identical to SEQ ID NO: 309107

SEQ ID NO: 676093 - RNA, 64 nt, Homo Sapiens; identical to SEQ ID NO: 309108

SEQ ID NO: 676094 - RNA, 64 nt, Homo Sapiens; identical to SEQ ID NO: 309109

SEQ ID NO: 676095 - RNA, 64 nt, Homo Sapiens; identical to SEQ ID NO: 309110

SEQ ID NO: 676096 - RNA, 64 nt, Homo Sapiens; identical to SEQ ID NO: 309111

SEQ ID NO: 676097 - RNA, 64 nt, Homo Sapiens; identical to SEQ ID NO: 309112

SEQ ID NO: 676098 - RNA, 64 nt, Homo Sapiens; identical to SEQ ID NO: 309113

SEQ ID NO: 676099 - RNA, 64 nt, Homo Sapiens; identical to SEQ ID NO: 309114

SEQ ID NO: 676100 - RNA, 64 nt, Homo Sapiens; identical to SEQ ID NO: 309115

SEQ ID NO: 676101 - RNA, 64 nt, Homo Sapiens; identical to SEQ ID NO: 309116

SEQ ID NO: 676102 - RNA, 64 nt, Homo Sapiens; identical to SEQ ID NO: 309117

SEQ ID NO: 676103 - RNA, 64 nt, Homo Sapiens; identical to SEQ ID NO: 309118

SEQ ID NO: 676104 - RNA, 64 nt, Homo Sapiens; identical to SEQ ID NO: 309119

SEQ ID NO: 676105 - RNA, 64 nt, Homo Sapiens; identical to SEQ ID NO: 309120

SEQ ID NO: 676106 - RNA, 64 nt, Homo Sapiens; identical to SEQ ID NO: 309121

SEQ ID NO: 676107 - RNA, 64 nt, Homo Sapiens; identical to SEQ ID NO: 309122

SEQ ID NO: 676108 - RNA, 64 nt, Homo Sapiens; identical to SEQ ID NO: 309123

SEQ ID NO: 676109 - RNA, 64 nt, Homo Sapiens; identical to SEQ ID NO: 309124

SEQ ID NO: 676110 - RNA, 53 nt, Homo Sapiens; identical to SEQ ID NO: 309125

SEQ ID NO: 676111 - RNA, 64 nt, Homo Sapiens; identical to SEQ ID NO: 309126

SEQ ID NO: 676112 - RNA, 64 nt, Homo Sapiens; identical to SEQ ID NO: 309127

SEQ ID NO: 676113 - RNA, 64 nt, Homo Sapiens; identical to SEQ ID NO: 309128

SEQ ID NO: 676114 - RNA, 64 nt, Homo Sapiens; identical to SEQ ID NO: 309129

SEQ ID NO: 676115 - RNA, 64 nt, Homo Sapiens; identical to SEQ ID NO: 309130

SEQ ID NO: 676116 - RNA, 64 nt, Homo Sapiens; identical to SEQ ID NO: 309131

SEQ ID NO: 676117 - RNA, 64 nt, Homo Sapiens; identical to SEQ ID NO: 309132

SEQ ID NO: 676118 - RNA, 64 nt, Homo Sapiens; identical to SEQ ID NO: 309133

SEQ ID NO: 676119 - RNA, 64 nt, Homo Sapiens; identical to SEQ ID NO: 309134

SEQ ID NO: 676120 - RNA, 64 nt, Homo Sapiens; identical to SEQ ID NO: 309135

SEQ ID NO: 676121 - RNA, 64 nt, Homo Sapiens; identical to SEQ ID NO: 309136

SEQ ID NO: 676122 - RNA, 64 nt, Homo Sapiens; identical to SEQ ID NO: 309137

SEQ ID NO: 676123 - RNA, 64 nt, Homo Sapiens; identical to SEQ ID NO: 309138

SEQ ID NO: 676124 - RNA, 64 nt, Homo Sapiens; identical to SEQ ID NO: 309139

SEQ ID NO: 676125 - RNA, 64 nt, Homo Sapiens; identical to SEQ ID NO: 309140

SEQ ID NO: 676126 - RNA, 64 nt, Homo Sapiens; identical to SEQ ID NO: 309141

SEQ ID NO: 676127 - RNA, 64 nt, Homo Sapiens; identical to SEQ ID NO: 309142

SEQ ID NO: 676128 - RNA, 64 nt, Homo Sapiens; identical to SEQ ID NO: 309143

SEQ ID NO: 676129 - RNA, 64 nt, Homo Sapiens; identical to SEQ ID NO: 309144

SEQ ID NO: 676130 - RNA, 64 nt, Homo Sapiens; identical to SEQ ID NO: 309145

SEQ ID NO: 676131 - RNA, 64 nt, Homo Sapiens; identical to SEQ ID NO: 309146

SEQ ID NO: 676132 - RNA, 64 nt, Homo Sapiens; identical to SEQ ID NO: 309147

SEQ ID NO: 676133 - RNA, 64 nt, Homo Sapiens; identical to SEQ ID NO: 309148

SEQ ID NO: 676134 - RNA, 64 nt, Homo Sapiens; identical to SEQ ID NO: 309149

SEQ ID NO: 676135 - RNA, 64 nt, Homo Sapiens; identical to SEQ ID NO: 309150

SEQ ID NO: 676136 - RNA, 64 nt, Homo Sapiens; identical to SEQ ID NO: 309151

SEQ ID NO: 676137 - RNA, 64 nt, Homo Sapiens; identical to SEQ ID NO: 309152

SEQ ID NO: 676138 - RNA, 64 nt, Homo Sapiens
cccauucauccauuugucccauuaguugcuguggauuaucaaguuuugaaggaacuguacaucc

SEQ ID NO: 676139 - RNA, 64 nt, Homo Sapiens
uacauguuguacaagcucucaauuuuguucauuuauuaucaaauuuuuaaaauacaaguuuggu

SEQ ID NO: 676140 - RNA, 64 nt, Homo Sapiens
ucaaucugaugucaaauagcaaugaggugauccuauuaucaaauaaacauugcugguuucaaga

SEQ ID NO: 676141 - RNA, 64 nt, Homo Sapiens
ugaagaggagcaaggagugagacauguguguggcauuaucaaaacuaccauuugcuggaaauuu

SEQ ID NO: 676142 - RNA, 64 nt, Homo Sapiens
auacuuuaaaaucuguggcacccguucuacaugaauuaucaauauuugguaaauucaaucugua

SEQ ID NO: 676143 - RNA, 64 nt, Homo Sapiens
auuuauguaauagguauauauuuaguggccauuuauuaucaaugguaacacaauggaguacuaa

SEQ ID NO: 676144 - RNA, 64 nt, Homo Sapiens
caacuucaguuucauucacuaccauuguuuccaaauuaucaaucucugcuaguaauuaugaauu

SEQ ID NO: 676145 - RNA, 64 nt, Homo Sapiens
ucucugcuaguaauuaugaauuuaagaccauauuauuaucaaaaaccuagagaccaaucauaua

SEQ ID NO: 676146 - RNA, 64 nt, Homo Sapiens
uugucauuuuucccuaauaauccuuucucuuuuuauuaucaauacugagaugcauuuucauuuu

SEQ ID NO: 676147 - RNA, 64 nt, Homo Sapiens
uuacauaacauuaauauuguuguauuuauuuaugauuaucaauuguagacauuccuuaaguauu

SEQ ID NO: 676148 - RNA, 64 nt, Homo Sapiens
ccagaaaaacaacauugguaccuauauaaccauaauuaucaaaaccaauuucuaguaaaaauau

SEQ ID NO: 676149 - RNA, 64 nt, Homo Sapiens
cugaguagggcagugggaacgagcccuguagcaaauuaucaaacgcuguuuucuugaguuuugu

SEQ ID NO: 676150 - RNA, 64 nt, Homo Sapiens; identical to SEQ ID NO: 240065

SEQ ID NO: 676151 - RNA, 64 nt, Homo Sapiens; identical to SEQ ID NO: 240066

SEQ ID NO: 676152 - RNA, 64 nt, Homo Sapiens; identical to SEQ ID NO: 240067

SEQ ID NO: 676153 - RNA, 64 nt, Homo Sapiens; identical to SEQ ID NO: 240068

SEQ ID NO: 676154 - RNA, 64 nt, Homo Sapiens; identical to SEQ ID NO: 240069

SEQ ID NO: 676155 - RNA, 64 nt, Homo Sapiens; identical to SEQ ID NO: 240070

SEQ ID NO: 676156 - RNA, 61 nt, Homo Sapiens; identical to SEQ ID NO: 240071

SEQ ID NO: 676157 - RNA, 64 nt, Homo Sapiens; identical to SEQ ID NO: 240072

SEQ ID NO: 676158 - RNA, 64 nt, Homo Sapiens; identical to SEQ ID NO: 240073

SEQ ID NO: 676159 - RNA, 64 nt, Homo Sapiens; identical to SEQ ID NO: 240074

SEQ ID NO: 676160 - RNA, 64 nt, Homo Sapiens; identical to SEQ ID NO: 240075

SEQ ID NO: 676161 - RNA, 64 nt, Homo Sapiens; identical to SEQ ID NO: 240076

SEQ ID NO: 676162 - RNA, 64 nt, Homo Sapiens; identical to SEQ ID NO: 240077

SEQ ID NO: 676163 - RNA, 64 nt, Homo Sapiens; identical to SEQ ID NO: 240078

SEQ ID NO: 676164 - RNA, 64 nt, Homo Sapiens; identical to SEQ ID NO: 240079

SEQ ID NO: 676165 - RNA, 64 nt, Homo Sapiens; identical to SEQ ID NO: 240080

SEQ ID NO: 676166 - RNA, 64 nt, Homo Sapiens; identical to SEQ ID NO: 240081

SEQ ID NO: 676167 - RNA, 64 nt, Homo Sapiens; identical to SEQ ID NO: 240082

SEQ ID NO: 676168 - RNA, 64 nt, Homo Sapiens; identical to SEQ ID NO: 240083

SEQ ID NO: 676169 - RNA, 64 nt, Homo Sapiens; identical to SEQ ID NO: 240084

SEQ ID NO: 676170 - RNA, 64 nt, Homo Sapiens; identical to SEQ ID NO: 240085

SEQ ID NO: 676171 - RNA, 64 nt, Homo Sapiens; identical to SEQ ID NO: 240086

SEQ ID NO: 676172 - RNA, 64 nt, Homo Sapiens; identical to SEQ ID NO: 181517

SEQ ID NO: 676173 - RNA, 64 nt, Homo Sapiens; identical to SEQ ID NO: 181518

SEQ ID NO: 676174 - RNA, 64 nt, Homo Sapiens; identical to SEQ ID NO: 181519

SEQ ID NO: 676175 - RNA, 64 nt, Homo Sapiens; identical to SEQ ID NO: 181520

SEQ ID NO: 676176 - RNA, 64 nt, Homo Sapiens; identical to SEQ ID NO: 181521

SEQ ID NO: 676177 - RNA, 64 nt, Homo Sapiens; identical to SEQ ID NO: 181522

SEQ ID NO: 676178 - RNA, 64 nt, Homo Sapiens; identical to SEQ ID NO: 181523

SEQ ID NO: 676179 - RNA, 64 nt, Homo Sapiens; identical to SEQ ID NO: 181524

SEQ ID NO: 676180 - RNA, 64 nt, Homo Sapiens; identical to SEQ ID NO: 181525

SEQ ID NO: 676181 - RNA, 64 nt, Homo Sapiens; identical to SEQ ID NO: 181526

SEQ ID NO: 676182 - RNA, 64 nt, Homo Sapiens; identical to SEQ ID NO: 181527

SEQ ID NO: 676183 - RNA, 64 nt, Homo Sapiens; identical to SEQ ID NO: 181528

SEQ ID NO: 676184 - RNA, 64 nt, Homo Sapiens; identical to SEQ ID NO: 181529

SEQ ID NO: 676185 - RNA, 64 nt, Homo Sapiens; identical to SEQ ID NO: 181530

SEQ ID NO: 676186 - RNA, 64 nt, Homo Sapiens; identical to SEQ ID NO: 181531

SEQ ID NO: 676187 - RNA, 64 nt, Homo Sapiens; identical to SEQ ID NO: 181532

SEQ ID NO: 676188 - RNA, 64 nt, Homo Sapiens; identical to SEQ ID NO: 181533

SEQ ID NO: 676189 - RNA, 64 nt, Homo Sapiens; identical to SEQ ID NO: 181534

SEQ ID NO: 676190 - RNA, 64 nt, Homo Sapiens; identical to SEQ ID NO: 181535

SEQ ID NO: 676191 - RNA, 64 nt, Homo Sapiens; identical to SEQ ID NO: 181536

SEQ ID NO: 676192 - RNA, 64 nt, Homo Sapiens; identical to SEQ ID NO: 181537

SEQ ID NO: 676193 - RNA, 64 nt, Homo Sapiens; identical to SEQ ID NO: 181538

SEQ ID NO: 676194 - RNA, 64 nt, Homo Sapiens; identical to SEQ ID NO: 181539

SEQ ID NO: 676195 - RNA, 64 nt, Homo Sapiens; identical to SEQ ID NO: 181540

SEQ ID NO: 676196 - RNA, 64 nt, Homo Sapiens; identical to SEQ ID NO: 181541

SEQ ID NO: 676197 - RNA, 64 nt, Homo Sapiens; identical to SEQ ID NO: 181542

SEQ ID NO: 676198 - RNA, 64 nt, Homo Sapiens; identical to SEQ ID NO: 181543

SEQ ID NO: 676199 - RNA, 64 nt, Homo Sapiens; identical to SEQ ID NO: 181544

SEQ ID NO: 676200 - RNA, 64 nt, Homo Sapiens; identical to SEQ ID NO: 181545

SEQ ID NO: 676201 - RNA, 64 nt, Homo Sapiens; identical to SEQ ID NO: 181546

SEQ ID NO: 676202 - RNA, 64 nt, Homo Sapiens; identical to SEQ ID NO: 181547

SEQ ID NO: 676203 - RNA, 64 nt, Homo Sapiens; identical to SEQ ID NO: 181548

SEQ ID NO: 676204 - RNA, 53 nt, Homo Sapiens; identical to SEQ ID NO: 181549

SEQ ID NO: 676205 - RNA, 59 nt, Homo Sapiens; identical to SEQ ID NO: 181550

SEQ ID NO: 676206 - RNA, 64 nt, Homo Sapiens; identical to SEQ ID NO: 181551

SEQ ID NO: 676207 - RNA, 64 nt, Homo Sapiens; identical to SEQ ID NO: 181552

SEQ ID NO: 676208 - RNA, 64 nt, Homo Sapiens; identical to SEQ ID NO: 181553

SEQ ID NO: 676209 - RNA, 64 nt, Homo Sapiens; identical to SEQ ID NO: 181554

SEQ ID NO: 676210 - RNA, 64 nt, Homo Sapiens; identical to SEQ ID NO: 181555

SEQ ID NO: 676211 - RNA, 64 nt, Homo Sapiens; identical to SEQ ID NO: 181556

SEQ ID NO: 676212 - RNA, 64 nt, Homo Sapiens; identical to SEQ ID NO: 181557

SEQ ID NO: 676213 - RNA, 64 nt, Homo Sapiens; identical to SEQ ID NO: 181558

SEQ ID NO: 676214 - RNA, 64 nt, Homo Sapiens; identical to SEQ ID NO: 181559

SEQ ID NO: 676215 - RNA, 64 nt, Homo Sapiens; identical to SEQ ID NO: 181560

SEQ ID NO: 676216 - RNA, 64 nt, Homo Sapiens; identical to SEQ ID NO: 181561

SEQ ID NO: 676217 - RNA, 64 nt, Homo Sapiens; identical to SEQ ID NO: 181562

SEQ ID NO: 676218 - RNA, 64 nt, Homo Sapiens; identical to SEQ ID NO: 181563

SEQ ID NO: 676219 - RNA, 64 nt, Homo Sapiens; identical to SEQ ID NO: 181564

SEQ ID NO: 676220 - RNA, 64 nt, Homo Sapiens; identical to SEQ ID NO: 181565

SEQ ID NO: 676221 - RNA, 64 nt, Homo Sapiens; identical to SEQ ID NO: 181566

SEQ ID NO: 676222 - RNA, 64 nt, Homo Sapiens; identical to SEQ ID NO: 181567

SEQ ID NO: 676223 - RNA, 64 nt, Homo Sapiens; identical to SEQ ID NO: 181568

SEQ ID NO: 676224 - RNA, 64 nt, Homo Sapiens; identical to SEQ ID NO: 247936

SEQ ID NO: 676225 - RNA, 64 nt, Homo Sapiens; identical to SEQ ID NO: 247937

SEQ ID NO: 676226 - RNA, 64 nt, Homo Sapiens; identical to SEQ ID NO: 247938

SEQ ID NO: 676227 - RNA, 64 nt, Homo Sapiens; identical to SEQ ID NO: 247939

SEQ ID NO: 676228 - RNA, 64 nt, Homo Sapiens; identical to SEQ ID NO: 247940

SEQ ID NO: 676229 - RNA, 64 nt, Homo Sapiens; identical to SEQ ID NO: 247941

SEQ ID NO: 676230 - RNA, 64 nt, Homo Sapiens; identical to SEQ ID NO: 247942

SEQ ID NO: 676231 - RNA, 64 nt, Homo Sapiens; identical to SEQ ID NO: 247943

SEQ ID NO: 676232 - RNA, 64 nt, Homo Sapiens; identical to SEQ ID NO: 247944

SEQ ID NO: 676233 - RNA, 64 nt, Homo Sapiens; identical to SEQ ID NO: 247945

SEQ ID NO: 676234 - RNA, 64 nt, Homo Sapiens; identical to SEQ ID NO: 247946

SEQ ID NO: 676235 - RNA, 64 nt, Homo Sapiens; identical to SEQ ID NO: 247947

SEQ ID NO: 676236 - RNA, 64 nt, Homo Sapiens; identical to SEQ ID NO: 247948

SEQ ID NO: 676237 - RNA, 64 nt, Homo Sapiens; identical to SEQ ID NO: 247949

SEQ ID NO: 676238 - RNA, 64 nt, Homo Sapiens; identical to SEQ ID NO: 247950

SEQ ID NO: 676239 - RNA, 64 nt, Homo Sapiens; identical to SEQ ID NO: 247951

SEQ ID NO: 676240 - RNA, 64 nt, Homo Sapiens; identical to SEQ ID NO: 247952

SEQ ID NO: 676241 - RNA, 64 nt, Homo Sapiens; identical to SEQ ID NO: 247953

SEQ ID NO: 676242 - RNA, 64 nt, Homo Sapiens; identical to SEQ ID NO: 247954

SEQ ID NO: 676243 - RNA, 64 nt, Homo Sapiens; identical to SEQ ID NO: 247955

SEQ ID NO: 676244 - RNA, 64 nt, Homo Sapiens; identical to SEQ ID NO: 247956

SEQ ID NO: 676245 - RNA, 64 nt, Homo Sapiens; identical to SEQ ID NO: 247957

SEQ ID NO: 676246 - RNA, 64 nt, Homo Sapiens; identical to SEQ ID NO: 247958

SEQ ID NO: 676247 - RNA, 64 nt, Homo Sapiens; identical to SEQ ID NO: 247959

SEQ ID NO: 676248 - RNA, 64 nt, Homo Sapiens; identical to SEQ ID NO: 247960

SEQ ID NO: 676249 - RNA, 64 nt, Homo Sapiens; identical to SEQ ID NO: 247961

SEQ ID NO: 676250 - RNA, 64 nt, Homo Sapiens; identical to SEQ ID NO: 247962

SEQ ID NO: 676251 - RNA, 64 nt, Homo Sapiens; identical to SEQ ID NO: 247963

SEQ ID NO: 676252 - RNA, 64 nt, Homo Sapiens; identical to SEQ ID NO: 247964

SEQ ID NO: 676253 - RNA, 64 nt, Homo Sapiens; identical to SEQ ID NO: 247965

SEQ ID NO: 676254 - RNA, 64 nt, Homo Sapiens; identical to SEQ ID NO: 247966

SEQ ID NO: 676255 - RNA, 64 nt, Homo Sapiens; identical to SEQ ID NO: 247967

SEQ ID NO: 676256 - RNA, 64 nt, Homo Sapiens; identical to SEQ ID NO: 247968

SEQ ID NO: 676257 - RNA, 64 nt, Homo Sapiens; identical to SEQ ID NO: 247969

SEQ ID NO: 676258 - RNA, 64 nt, Homo Sapiens; identical to SEQ ID NO: 247970

SEQ ID NO: 676259 - RNA, 64 nt, Homo Sapiens; identical to SEQ ID NO: 247971

SEQ ID NO: 676260 - RNA, 64 nt, Homo Sapiens; identical to SEQ ID NO: 247972

SEQ ID NO: 676261 - RNA, 64 nt, Homo Sapiens; identical to SEQ ID NO: 247973

SEQ ID NO: 676262 - RNA, 64 nt, Homo Sapiens; identical to SEQ ID NO: 247974

SEQ ID NO: 676263 - RNA, 64 nt, Homo Sapiens; identical to SEQ ID NO: 247975

SEQ ID NO: 676264 - RNA, 64 nt, Homo Sapiens; identical to SEQ ID NO: 247976

SEQ ID NO: 676265 - RNA, 64 nt, Homo Sapiens; identical to SEQ ID NO: 247977

SEQ ID NO: 676266 - RNA, 64 nt, Homo Sapiens; identical to SEQ ID NO: 247978

SEQ ID NO: 676267 - RNA, 64 nt, Homo Sapiens
cccuccuguuccuccuucucagaggcauggacugugagacuacuccacaagcaauagcuccaug

SEQ ID NO: 676268 - RNA, 64 nt, Homo Sapiens
cuuuagguugaaguuugaccccucuaaaggauuaugagacuaccgcagaaaggggucugugcug

SEQ ID NO: 676269 - RNA, 64 nt, Homo Sapiens
guagugacaucugagaaauggagacuaccguaauugagacuacugaacuuuagucuaaagaauu

SEQ ID NO: 676270 - RNA, 64 nt, Homo Sapiens
guaauugagacuacuguaguuuagucuaaagaauugagacuaccaguuggaugaccuaugaacu

SEQ ID NO: 676271 - RNA, 64 nt, Homo Sapiens
guaaucaucuuuacuucuggaaggccacaucaccugagacuagguaaaguuaaagugacuuuua

SEQ ID NO: 676272 - RNA, 64 nt, Homo Sapiens
ggcaugagccacugugcccagccucacaaaguguugagacuacacaagcgauccuccugucucg

SEQ ID NO: 676273 - RNA, 64 nt, Homo Sapiens
uggagggguggagggauguuccccugagccaggcugagacuagaaccccaucuucccugagcca

SEQ ID NO: 676274 - RNA, 64 nt, Homo Sapiens
cugagacuagaaccccaucuucccugagccaggcugagacuagaaccccaucuuccccaccacg

SEQ ID NO: 676275 - RNA, 64 nt, Homo Sapiens
uuccugcccacaggaagggccacaggcccgcuaagccccaaaggcaggaucuaggugagucccu

SEQ ID NO: 676276 - RNA, 64 nt, Homo Sapiens
acuuggcuucaagaacacaaccuuaggaccuugggccccaaaagcugguggugaaaugaggagg

SEQ ID NO: 676277 - RNA, 64 nt, Homo Sapiens
ccacccacccccuaccauugagccaccaugcccagccccaaagccucuuaauugcucuaacaag

SEQ ID NO: 676278 - RNA, 64 nt, Homo Sapiens
gugcugggauuacacacgugagucaccaugcccagccccaaagccauuucuugaagaauuucuc

SEQ ID NO: 676279 - RNA, 64 nt, Homo Sapiens
ugcagauccacuuaggccccaggguccacggauggccccaaaggcugagggccccaaagccacu

SEQ ID NO: 676280 - RNA, 64 nt, Homo Sapiens
ccccaggguccacggauggccccaaaggcugagggccccaaagccacuugucuccuaggaucca

SEQ ID NO: 676281 - RNA, 64 nt, Homo Sapiens
gaaagauguuccagugaggaacccugaucucucagccccaaacacccacccaauuggcccaaca

SEQ ID NO: 676282 - RNA, 64 nt, Homo Sapiens
ugauaaagucucgguuccauggaggacuugaguggccccaaaggcugccacggugcccucaccc

SEQ ID NO: 676283 - RNA, 64 nt, Homo Sapiens
gagaagaacaucugagaaccgggcucuaaaaaaagccccaaaagacuuuccaaauuggggacaa

SEQ ID NO: 676284 - RNA, 63 nt, Homo Sapiens
aauaugcaaaagguucacuaagucaacaugccugccccaaacaccuaucugggccacaaguga

SEQ ID NO: 676285 - RNA, 64 nt, Homo Sapiens
cuccauccccaacccauccucauccccaacuacagccccaaacccagccccagacuaauccaca

SEQ ID NO: 676286 - RNA, 64 nt, Homo Sapiens
agccauccccaacucauccucauccccaacugcagccccaaacccaacccagggccauccccaa

SEQ ID NO: 676287 - RNA, 64 nt, Homo Sapiens
uggggcuucaggccagagcagccaccuacauccagccccaaaacccuugaaccuaggaccaaga

SEQ ID NO: 676288 - RNA, 64 nt, Homo Sapiens
aagauaucccucacacccagcuacccccacgccagccccaaacuacaggacaucugugaccgcc

SEQ ID NO: 676289 - RNA, 64 nt, Homo Sapiens; identical to SEQ ID NO: 380092

SEQ ID NO: 676290 - RNA, 64 nt, Homo Sapiens; identical to SEQ ID NO: 380093

SEQ ID NO: 676291 - RNA, 64 nt, Homo Sapiens; identical to SEQ ID NO: 380094

SEQ ID NO: 676292 - RNA, 64 nt, Homo Sapiens; identical to SEQ ID NO: 380095

SEQ ID NO: 676293 - RNA, 64 nt, Homo Sapiens
gugcuaggucagucuggcacguaagaugaacaucccuaccaauacagagcucaccaucucuuau

SEQ ID NO: 676294 - RNA, 64 nt, Homo Sapiens
auguucccugacacauaucuugaauggagaccucccuaccaagugaugaaaguguugaaaaacu

SEQ ID NO: 676295 - RNA, 64 nt, Homo Sapiens
aagauuaagauuauuuaugugauaaaugaaaucuccuaccaauccauccagccuuuaccaggga

SEQ ID NO: 676296 - RNA, 64 nt, Homo Sapiens
aauuuagcugggcaugguggugcacaucuguaguccuaccaacuugggaggcugaggcaggaga

SEQ ID NO: 676297 - RNA, 64 nt, Homo Sapiens; identical to SEQ ID NO: 189259

SEQ ID NO: 676298 - RNA, 64 nt, Homo Sapiens; identical to SEQ ID NO: 189260

SEQ ID NO: 676299 - RNA, 64 nt, Homo Sapiens; identical to SEQ ID NO: 189261

SEQ ID NO: 676300 - RNA, 64 nt, Homo Sapiens; identical to SEQ ID NO: 189262

SEQ ID NO: 676301 - RNA, 56 nt, Homo Sapiens; identical to SEQ ID NO: 189263

SEQ ID NO: 676302 - RNA, 64 nt, Homo Sapiens; identical to SEQ ID NO: 189264

SEQ ID NO: 676303 - RNA, 64 nt, Homo Sapiens; identical to SEQ ID NO: 189265

SEQ ID NO: 676304 - RNA, 64 nt, Homo Sapiens; identical to SEQ ID NO: 189266

SEQ ID NO: 676305 - RNA, 64 nt, Homo Sapiens; identical to SEQ ID NO: 189267

SEQ ID NO: 676306 - RNA, 64 nt, Homo Sapiens; identical to SEQ ID NO: 189268

SEQ ID NO: 676307 - RNA, 64 nt, Homo Sapiens; identical to SEQ ID NO: 189269

SEQ ID NO: 676308 - RNA, 64 nt, Homo Sapiens; identical to SEQ ID NO: 189270

SEQ ID NO: 676309 - RNA, 64 nt, Homo Sapiens; identical to SEQ ID NO: 189271

SEQ ID NO: 676310 - RNA, 64 nt, Homo Sapiens; identical to SEQ ID NO: 189272

SEQ ID NO: 676311 - RNA, 64 nt, Homo Sapiens; identical to SEQ ID NO: 189273

SEQ ID NO: 676312 - RNA, 64 nt, Homo Sapiens; identical to SEQ ID NO: 189274

SEQ ID NO: 676313 - RNA, 64 nt, Homo Sapiens; identical to SEQ ID NO: 189275

SEQ ID NO: 676314 - RNA, 64 nt, Homo Sapiens; identical to SEQ ID NO: 189276

SEQ ID NO: 676315 - RNA, 64 nt, Homo Sapiens; identical to SEQ ID NO: 189277

SEQ ID NO: 676316 - RNA, 64 nt, Homo Sapiens; identical to SEQ ID NO: 189278

SEQ ID NO: 676317 - RNA, 64 nt, Homo Sapiens; identical to SEQ ID NO: 189279

SEQ ID NO: 676318 - RNA, 64 nt, Homo Sapiens; identical to SEQ ID NO: 189280

SEQ ID NO: 676319 - RNA, 59 nt, Homo Sapiens
gcaggcugcuguagucucagguaaugaaggcacagcacagcaguacuccacauuguuuc

SEQ ID NO: 676320 - RNA, 59 nt, Homo Sapiens
cugcuguagucucagguaaugaaggcacagcacagcaguacuccacauuguuuccuauu

SEQ ID NO: 676321 - RNA, 59 nt, Homo Sapiens
ccaccacagccccagcugccucagagcaggcacagcacaaggcaggcccagccccaugg

SEQ ID NO: 676322 - RNA, 59 nt, Homo Sapiens
cuugacugugacuggcaggcaggugaggggcacagcaccccuccccggcaucugccagc

SEQ ID NO: 676323 - RNA, 59 nt, Homo Sapiens
aacguugguaaaagggcagucucugggcugcacagcagaccucuccuucccugacacuu

SEQ ID NO: 676324 - RNA, 59 nt, Homo Sapiens
cacugcucguuguaaaugcccaucuugaggcacagcagcgauuccaguucugcauguac

SEQ ID NO: 676325 - RNA, 59 nt, Homo Sapiens
cuguggcccgagggccaaccaccgagcaggcacagcacagcagugacucggugagggga

SEQ ID NO: 676326 - RNA, 59 nt, Homo Sapiens
gcccgagggccaaccaccgagcaggcacagcacagcagugacucggugaggggaggaca

SEQ ID NO: 676327 - RNA, 59 nt, Homo Sapiens
agugauggcgaggacuucccggagcugcagcacagcaacagagagcuggggcagagcgg

SEQ ID NO: 676328 - RNA, 55 nt, Homo Sapiens; identical to SEQ ID NO: 141815

SEQ ID NO: 676329 - RNA, 59 nt, Homo Sapiens
gccaugugcagggcguccccccagucauugcacagcaaaugcccaugccgggcggccuu

SEQ ID NO: 676330 - RNA, 59 nt, Homo Sapiens
ggcugcacggugcacgcauuccucccugggcacagcacaugccaaucccgcugaagagg

SEQ ID NO: 676331 - RNA, 59 nt, Homo Sapiens
ugccaaucccgcugaagaggguucucagggcacagcaacgggaucacacaguucugccu

SEQ ID NO: 676332 - RNA, 59 nt, Homo Sapiens
gguggcccauccccccucaccaggggcaggcacagcacagggauccgacuugaauuuuc

SEQ ID NO: 676333 - RNA, 59 nt, Homo Sapiens
caggacggggccggccaggugggcgggcagcacagcaaggaggcuggcuggggccuauc

SEQ ID NO: 676334 - RNA, 59 nt, Homo Sapiens
gaccccagagccaggaaccuccggugggggcacagcacacucccaccaaccaaccacac

SEQ ID NO: 676335 - RNA, 59 nt, Homo Sapiens
gaccccagaggcaggaaccuccggugggggcacagcacacucccaccaaccagccacac

SEQ ID NO: 676336 - RNA, 59 nt, Homo Sapiens
gaccccagagccaggaaccuccagugggggcacagcacacucccaccaaccagccacac

SEQ ID NO: 676337 - RNA, 59 nt, Homo Sapiens
uugguuuugcugagaucgaaaauuagguagcacagcacuaaaggaaaaaagaaaaaagc

SEQ ID NO: 676338 - RNA, 59 nt, Homo Sapiens
gggggagagggacacuccucuugacugaagcacagcaccagagcccgcgugcuggagaa

SEQ ID NO: 676339 - RNA, 59 nt, Homo Sapiens
acccgcccgcccugcugcagauacaugcggcacagcaggcacgugccuggagagaacag

SEQ ID NO: 676340 - RNA, 59 nt, Homo Sapiens
ggcacgugccuggagagaacagcuccugagcacagcacccuuggagcccucaccccgcu

SEQ ID NO: 676341 - RNA, 59 nt, Homo Sapiens
ugaagccaugugggacaguuuggggaccagcacagcaccugcccagccuguucacaugc

SEQ ID NO: 676342 - RNA, 59 nt, Homo Sapiens
uguggggugugggcaucuucaguacccaugcacagcagcuuaaugccagguggcccagg

SEQ ID NO: 676343 - RNA, 59 nt, Homo Sapiens
aaguaauucguuagaugcuuuugugcacagcacagcaucucuuuccugccagauagaaa

SEQ ID NO: 676344 - RNA, 59 nt, Homo Sapiens
gcaucaaguaauucguuagaagaaauugugcacagcacaaaaguucuuuccugccagau

SEQ ID NO: 676345 - RNA, 64 nt, Homo Sapiens
ucauuccaacuaaucaucaucuucaaguuuuccaccaagguaccuacauucuaccacgccuggg

SEQ ID NO: 676346 - RNA, 64 nt, Homo Sapiens
gccauuuaggugccuaagcaaaaggacaggcuguccaagguagaaacuguacauagccggugac

SEQ ID NO: 676347 - RNA, 64 nt, Homo Sapiens
uaucaccaugacaccugccauaccguauagagagccaagguacagccguuagagacuaucuaau

SEQ ID NO: 676348 - RNA, 64 nt, Homo Sapiens
gugccccuacugcugaccaugcaggagggcaacuccaagguaagccaggugagugugcgugggc

SEQ ID NO: 676349 - RNA, 64 nt, Homo Sapiens
cuauagaugaagacauaaaagacacugguaaacaccaagguaaaagggcccccaagguggucau

SEQ ID NO: 676350 - RNA, 64 nt, Homo Sapiens
gaaagaacccugcacccagagggccugccuggugccaagguaucccagccuggacaggcaugga

SEQ ID NO: 676351 - RNA, 64 nt, Homo Sapiens
gaguuugcuguuggugcaggaauaagggaaaggcccaagguauccaagccuggggaagggcagg

SEQ ID NO: 676352 - RNA, 64 nt, Homo Sapiens
uaguuuaagccuauaaucucagcccuuuuggaggccaagguaagaggaucgcuugaggucagga

SEQ ID NO: 676353 - RNA, 64 nt, Homo Sapiens
gcuaaccuuuuagaggcuuuauauguuguacugaccaagguagguuuguauagcagcccuauac

SEQ ID NO: 676354 - RNA, 64 nt, Homo Sapiens
uuacuauuucucuacuucagacaaaauguugcauccaagguacaucaagugaccauuugccuug

SEQ ID NO: 676355 - RNA, 64 nt, Homo Sapiens
gaaaagaugaagcuggagagagaggaaccaguugccaagguagagagcugcccgcuccugcccu

SEQ ID NO: 676356 - RNA, 64 nt, Homo Sapiens
caaccugucagagaauguucuuaggcaucaaaauccaagguagcuguaagaaaaauacuggagc

SEQ ID NO: 676357 - RNA, 64 nt, Homo Sapiens
ccuggcacugcccuguggacgauggguuccagacccaagguaguagcacugaugucucuuuacc

SEQ ID NO: 676358 - RNA, 64 nt, Homo Sapiens
aaacccugccccuguuacuguguggaaagaggccccaagguagucagggucagggagccccugg

SEQ ID NO: 676359 - RNA, 64 nt, Homo Sapiens
cuggugucauagucuucucauuugcggucccaguccaagguagguaggauagauuuuaacaucc

SEQ ID NO: 676360 - RNA, 64 nt, Homo Sapiens
aggcaccaugcuagguauuguggaucaccggcuaccaagguaccauucacucagcaaauguuca

SEQ ID NO: 676361 - RNA, 64 nt, Homo Sapiens
caggaaaauccauauuuaaacccaagauaugacaccaagguagagagcuuggugauauuuuauc

SEQ ID NO: 676362 - RNA, 64 nt, Homo Sapiens
uucucuccugcucaugugucgucggcacuugacaccaagguaaccaccugucucaaacucuaag

SEQ ID NO: 676363 - RNA, 64 nt, Homo Sapiens
cguaauaaaagaguccauccugugucuuguuugaccaagguaacgcuagauagcuagauagucu

SEQ ID NO: 676364 - RNA, 64 nt, Homo Sapiens
ccaaagaaaauauuaaggucaaaauuuuuucccaccaagguauuuacauuaaaaugauauucuu

SEQ ID NO: 676365 - RNA, 64 nt, Homo Sapiens
cagguguuugccuuauuuaaccaaaauuucuacaccaagguaaauauaaugauacugcuuuuca

SEQ ID NO: 676366 - RNA, 64 nt, Homo Sapiens
cuagagccuagaaaucucacuuuuuaaaaugcuuccaagguaagucugaugccuacccuagguu

SEQ ID NO: 676367 - RNA, 64 nt, Homo Sapiens
gaugacaaauggggugauuuggaagaggguugugccaagguauugacaaauugaaaagcaggaa

SEQ ID NO: 676368 - RNA, 64 nt, Homo Sapiens
uggcucaugcuuguaauccuagcacuuuuugaggccaagguaggaggauugcuugaguccggga

SEQ ID NO: 676369 - RNA, 64 nt, Homo Sapiens
uggcucccgccuguaaucccaguacuuuggaaagccaagguaagaggauugcuugagcccagaa

SEQ ID NO: 676370 - RNA, 64 nt, Homo Sapiens
aaagaaaugacacuuuucaugugugauuuccccuccaagguaugguuaauaaguuucacugacu

SEQ ID NO: 676371 - RNA, 64 nt, Homo Sapiens
uucaaugagaaaugaguuuaauagcauaacauuaccaagguaaucaaacuaauaaaauuccaua

SEQ ID NO: 676372 - RNA, 64 nt, Homo Sapiens
uuuauauuuggacuaagguucuugagcuuaucucccaagguacuuuccauaauuuaacacagcu

SEQ ID NO: 676373 - RNA, 64 nt, Homo Sapiens
agaugaaguucuuagcuccagguuuugggguaaaccaagguaggaacauuuuggcauuuauuuc

SEQ ID NO: 676374 - RNA, 64 nt, Homo Sapiens
ggaaaaccuuccacaugccccauccugucuuaauccaagguacuggaagaauuuaggaccacug

SEQ ID NO: 676375 - RNA, 64 nt, Homo Sapiens
gauuauuucagcuuaaaagagcuucuuauaacccccaagguacaauccuuuuacugauuaugca

SEQ ID NO: 676376 - RNA, 64 nt, Homo Sapiens
auaaaagccauuacguaugaauaaagaauuauauccaagguaauaauaaauaugcaguagugau

SEQ ID NO: 676377 - RNA, 64 nt, Homo Sapiens
uuuuuauuuaaaaaaaaacaaucugcaaucuuugccaagguacucacuguuuaaagcuuugaau

SEQ ID NO: 676378 - RNA, 64 nt, Homo Sapiens
ugaccugcguuuucugcagaauuccuuguguaagccaagguauagguggcucauuuuucauagc

SEQ ID NO: 676379 - RNA, 64 nt, Homo Sapiens
aagguacgaagauacaauacagaguuguucucguccaagguagagcugaaugucugagagaacc

SEQ ID NO: 676380 - RNA, 64 nt, Homo Sapiens
gcuguauauaaacgugucccugucuggauccuucccaagguacaagguccagcuuuacuguggc

SEQ ID NO: 676381 - RNA, 64 nt, Homo Sapiens
aaccuaaaaauagugcccaguuaaagaagggcagccaagguaguuuuuuuuucuuuuuuuuuuc

SEQ ID NO: 676382 - RNA, 64 nt, Homo Sapiens
uuuuacuuucaacuuuuuaaauguucaguucuagccaagguagacucuggagagacagaucuga

SEQ ID NO: 676383 - RNA, 64 nt, Homo Sapiens
auacaaugaagaaaacagauaacaaauuuuaagaccaagguaagauaacuaaucaaggccauuu

SEQ ID NO: 676384 - RNA, 64 nt, Homo Sapiens
ggggggcgaucugggaaucaguccccuguggauaccaagguacaacuguauuuauuaacgcuua

SEQ ID NO: 676385 - RNA, 64 nt, Homo Sapiens
gaacucacugucuuuucuccacacuuguccuaagccaagguagauuuguacguagacagacugg

SEQ ID NO: 676386 - RNA, 64 nt, Homo Sapiens
uauuucauauuugccuccuuauauauaucaaagaccaagguauuuccuucugcuucaaaagaac

SEQ ID NO: 676387 - RNA, 64 nt, Homo Sapiens
aagguaccauuugugccuggaucugaccaauagaccaagguaaaaaucucaaagaaugagacuu

SEQ ID NO: 676388 - RNA, 64 nt, Homo Sapiens
cacuugguguuugcccuucagauuuuagauuucaccaagguauuucagucuuccaguuuucaau

SEQ ID NO: 676389 - RNA, 64 nt, Homo Sapiens
gaagcaaucgggcuccgccaccacaaaaugaaacccaagguacauuuucaaaucaauguauagu

SEQ ID NO: 676390 - RNA, 64 nt, Homo Sapiens
uggaucacuugagguugggaagcacuuuaggaggccaagguagguggcucacgccuguaauccc

SEQ ID NO: 676391 - RNA, 64 nt, Homo Sapiens
uuuaaauuuacauuuuuaauuaaugacccaaaugccaagguaauauuagguuaauuaauccaau

SEQ ID NO: 676392 - RNA, 64 nt, Homo Sapiens
auguuaaaggaauauucacucaaaggaaguaacaccaagguacaaacuuucaauguccaucuuu

SEQ ID NO: 676393 - RNA, 64 nt, Homo Sapiens
uggcucaugccuguaaucccagcacuuugggaggccaagguaggcagaucaccugaggucagga

SEQ ID NO: 676394 - RNA, 64 nt, Homo Sapiens
cuuguaagcuugggcucugccgcuuuugcaaaagccaagguaaagccaggaucgcugccaaguu

SEQ ID NO: 676395 - RNA, 64 nt, Homo Sapiens
cauuaugacuuuuuucucuuaguuuaaauaaacuccaagguaacuggacuucuaaagcaccuuu

SEQ ID NO: 676396 - RNA, 64 nt, Homo Sapiens
gaaagagccauggagauaguagcagacaggcugcccaagguaugaagcagaugagggaccagca

SEQ ID NO: 676397 - RNA, 64 nt, Homo Sapiens
cacuauguccccuugaacauuaugugggagaacaccaagguagccuaggccacccaaaagugag

SEQ ID NO: 676398 - RNA, 64 nt, Homo Sapiens
aaguguacuuauuuuguugucauuucagcauuuuccaagguaccuauaccagcauucaugauag

SEQ ID NO: 676399 - RNA, 64 nt, Homo Sapiens
aacugagaagggaggcaugagaaagagggaggggccaagguaagaagugcaaagaccuugacag

SEQ ID NO: 676400 - RNA, 64 nt, Homo Sapiens
uaggaaacauuuacuuguuugugaaaacaauaccccaagguaauaggaaaaguuugaguuaagu

SEQ ID NO: 676401 - RNA, 64 nt, Homo Sapiens
ugguucccuuccguggaccagccguaauaaagagccaagguagugaugguggccacgugccucg

SEQ ID NO: 676402 - RNA, 64 nt, Homo Sapiens
gugaugcuacucacuuugauugcaaugaugauguccaagguaagcuauuaaaaggcagguuacu

SEQ ID NO: 676403 - RNA, 64 nt, Homo Sapiens
uuugcuugccuccccaggaaagaaggaauugcauccaagguauacauacauauucaucgauguu

SEQ ID NO: 676404 - RNA, 64 nt, Homo Sapiens
uccagaacuaaacccuuccuucaaccccucccccccaagguauuucgcccgcccauucuacuac

SEQ ID NO: 676405 - RNA, 64 nt, Homo Sapiens
ucuguaauuuaaagauuacuauucugaaggcaccccaagguauaagagaggugcuauucaagug

SEQ ID NO: 676406 - RNA, 64 nt, Homo Sapiens
aaugagguauaccuagaugucaaguaagacagauccaagguaacuggguaggaaaucuuuugac

SEQ ID NO: 676407 - RNA, 64 nt, Homo Sapiens
uggcucaugccuauaaucuuagcacuuugggaggccaagguaggaggauugcuugaagcuagga

SEQ ID NO: 676408 - RNA, 64 nt, Homo Sapiens
uccguuauuauuuccaauggagaccuagcccaggccaagguaaaguuaguuaauagcauuggga

SEQ ID NO: 676409 - RNA, 64 nt, Homo Sapiens
aagguaauuuuacaauauaugcugagauuaaaaaccaagguaaaaaugaucaaacauauaugaa

SEQ ID NO: 676410 - RNA, 64 nt, Homo Sapiens
auuuaauuuucuggacuuuaucauuugggaagaaccaagguagaaagaaaacagaaacguggca

SEQ ID NO: 676411 - RNA, 64 nt, Homo Sapiens
cuuagauuagagaugacuuggucacaccaccccaccaagguagaaguggacuugggcagaggag

SEQ ID NO: 676412 - RNA, 64 nt, Homo Sapiens
cagccccuggcaaugagcugccugaugaugagucccaagguacauuguucuacuguuuuauacc

SEQ ID NO: 676413 - RNA, 64 nt, Homo Sapiens
gggaaaaugcaguccaguguucucaccucugccuccaagguaggagaugucugugggugaggcu

SEQ ID NO: 676414 - RNA, 64 nt, Homo Sapiens
uauuuuagcauggcugucaaagcuuagcuuauguccaagguaagguuauaaacaacaaacuuaa

SEQ ID NO: 676415 - RNA, 64 nt, Homo Sapiens
uaaaagggcuuuccugccucuggaacugugguugccaagguauuugaguuuuccuuuuggugca

SEQ ID NO: 676416 - RNA, 64 nt, Homo Sapiens
cuauucuaauaacugcuuacuauuugcauagaggccaagguauuugaaucaaagugucuagaca

SEQ ID NO: 676417 - RNA, 64 nt, Homo Sapiens
ugcuuucucagccccacccccagguccacaguguccaagguaauggcacacauauucaugcaca

SEQ ID NO: 676418 - RNA, 64 nt, Homo Sapiens
agauguguauuuccccugaccuucaaaaaauguuccaagguaagccucguaaaggucaucccac

SEQ ID NO: 676419 - RNA, 64 nt, Homo Sapiens
aguggagcuggagcuaacuuuugggccacgguugccaagguaacauuaauuucugccccuguga

SEQ ID NO: 676420 - RNA, 64 nt, Homo Sapiens
acucuucugccugcaacauuuguucaaaaacuaaccaagguaaaauauuuauuugaaagcccaa

SEQ ID NO: 676421 - RNA, 64 nt, Homo Sapiens
ggaaacuucccgucccauauccugccucagcccgccaagguagccaucccaugaacacacugug

SEQ ID NO: 676422 - RNA, 64 nt, Homo Sapiens
gaaggauccauguuuguagugagagaaaaaaaccccaagguaacccgauaugauuuaggaugca

SEQ ID NO: 676423 - RNA, 64 nt, Homo Sapiens
ucaguagggaugaucaugggaggccuauuugacuccaagguagcagugugguaggauagagaca

SEQ ID NO: 676424 - RNA, 64 nt, Homo Sapiens
auuauguggaagaagcaaaccugauacaauuugcccaagguaaacaguuugaaaagacaaaugg

SEQ ID NO: 676425 - RNA, 64 nt, Homo Sapiens
aagcaagcagaugagagguuuuccauuuugucauccaagguagcugugcacuugccuuguugcu

SEQ ID NO: 676426 - RNA, 64 nt, Homo Sapiens
ccuucugcugcagccuggagaaaugaaacaaauaccaagguauuaaggguaaggauggacacua

SEQ ID NO: 676427 - RNA, 64 nt, Homo Sapiens
aacuuuccauacgaguauaucagaacacacccuuccaagguauguaugcucuguuguuccuguc

SEQ ID NO: 676428 - RNA, 64 nt, Homo Sapiens
uaugaccuacuuuuguaacagaccaugguuguguccaagguaaaaccacagugauauuuuugga

SEQ ID NO: 676429 - RNA, 64 nt, Homo Sapiens
uaacccucacucugcuagcaccuccucccuuuccccaagguagcacaucuggcucacuccccac

SEQ ID NO: 676430 - RNA, 64 nt, Homo Sapiens
cugugguauggaccugguggcuucuccauccuacccaagguaacagugucuugcuucaucccac

SEQ ID NO: 676431 - RNA, 64 nt, Homo Sapiens
ggccugacucccaugcaaguagcuggcuguacugccaagguaccuagguuggaguccagccuaa

SEQ ID NO: 676432 - RNA, 64 nt, Homo Sapiens
auguucugcuuaaacucaagauggaaaguccaguccaagguacacuguucaucuuuuucuucac

SEQ ID NO: 676433 - RNA, 64 nt, Homo Sapiens
agccaagaaaguaucuguuaucuccugcguaguaccaagguaggggacuaguggaucuuaucau

SEQ ID NO: 676434 - RNA, 64 nt, Homo Sapiens
cagugguauuaucuuuuaaguugucagcaaguuaccaagguauucauuaaagaacuuguaauau

SEQ ID NO: 676435 - RNA, 64 nt, Homo Sapiens
uaguggaguauuuggacuuugguacugcugucuuccaagguagcucuaaguuuugauguguggg

SEQ ID NO: 676436 - RNA, 64 nt, Homo Sapiens
ugagcaauugaggagugucucaggauagcacaggccaagguaggggaguaaaaaggaggucagg

SEQ ID NO: 676437 - RNA, 64 nt, Homo Sapiens
accugugaaauguuacguuugugcuucauuuuugccaagguaaaaauguuccaucauuucuagc

SEQ ID NO: 676438 - RNA, 64 nt, Homo Sapiens
acugugagaaaucucacuuguuuuuaguuuguugccaagguagcaccaagaccuugucuagaua

SEQ ID NO: 676439 - RNA, 64 nt, Homo Sapiens
ucaauuaaauugacuuuuuggaaacuaaauucauccaagguaguugccacuaggaucccagaag

SEQ ID NO: 676440 - RNA, 64 nt, Homo Sapiens
caucuuccccuaaugccuauuuguaggcacaagaccaagguauacaucauagggauaagauuuu

SEQ ID NO: 676441 - RNA, 64 nt, Homo Sapiens
uuguuuuuuggaaguauguaugacaauguauaaaccaagguauuuugauuuuuacagacuguuu

SEQ ID NO: 676442 - RNA, 64 nt, Homo Sapiens
ucaguuuaggaauauguugugaaagcaauuuuugccaagguagucguaaauauuuauauuccuu

SEQ ID NO: 676443 - RNA, 64 nt, Homo Sapiens
ugcaaacaguggaacauggccaucuaguuaaaguccaagguaacuggucagaagucaacuugca

SEQ ID NO: 676444 - RNA, 64 nt, Homo Sapiens
uuuauuuuagcuucccuuaaaaaguaaccagaauccaagguauuucuggaaauuuuuacuuuaa

SEQ ID NO: 676445 - RNA, 64 nt, Homo Sapiens
ucugaugacuccgccccagucuccccaccaccucccaagguauucccugaugcucccgacuccc

SEQ ID NO: 676446 - RNA, 64 nt, Homo Sapiens
gcagaacuuccaacguguagcaauacuauaagaaccaagguagcuuagaacguccuggacagac

SEQ ID NO: 676447 - RNA, 64 nt, Homo Sapiens
uaggcccugagccgacugugaauucggugcuuggccaagguaacacucaucguauucacggagu

SEQ ID NO: 676448 - RNA, 64 nt, Homo Sapiens
uuucuugcauuuugcucuccagcauuuguuccugccaagguaguggcugugauuaaaaucuuua

SEQ ID NO: 676449 - RNA, 64 nt, Homo Sapiens
agguggggcugcccaggcaauagacacacuggcaccaagguaagccaggggaaaaaaacuuucu

SEQ ID NO: 676450 - RNA, 64 nt, Homo Sapiens
acuuuaauggaaugcuuuuuaaaaaaauauaaaaccaagguaaauuauuguuucaucuucacgu

SEQ ID NO: 676451 - RNA, 64 nt, Homo Sapiens
aaaaccuuugugcauuaauaaaaaaucauuaaagccaagguauugaauuuguuucuuaaccuug

SEQ ID NO: 676452 - RNA, 64 nt, Homo Sapiens
cuggggaaugaaguauaccauuaguccaguguuaccaagguaaggaauuuucuucauuuucugu

SEQ ID NO: 676453 - RNA, 64 nt, Homo Sapiens
aaaugcuguuuaugacuucuaccaguaugauauaccaagguaaugaaggaacaacagcaacaag

SEQ ID NO: 676454 - RNA, 64 nt, Homo Sapiens
ugagagacagggcagggaauaccuugcuuagcgcccaagguagaugcugggagagcccauggga

SEQ ID NO: 676455 - RNA, 64 nt, Homo Sapiens
uuuccucucuugguguucuacuaugaccuaauucccaagguaucaguuguuguuugaagcauug

SEQ ID NO: 676456 - RNA, 64 nt, Homo Sapiens
ggguagggggagccugggucgaugaagacguggcccaagguagggcuuucucuccaaagacuaa

SEQ ID NO: 676457 - RNA, 64 nt, Homo Sapiens
gguauaagaaaagcaucagaacucucagcuuggcccaagguaccuucugugguuccccugggug

SEQ ID NO: 676458 - RNA, 64 nt, Homo Sapiens
guaaaauuucuccuccuuuaacuccuccuaccccccaagguaagaaacaaaaaacaaacaaaca

SEQ ID NO: 676459 - RNA, 64 nt, Homo Sapiens
augacaacauggugagaaaagugcaguacuacuuccaagguagcuaguguaaaggacacuugag

SEQ ID NO: 676460 - RNA, 64 nt, Homo Sapiens
ugaaauguauuacauuacguuaaagaacgggaugccaagguaaguggagguauacuucgaauuu

SEQ ID NO: 676461 - RNA, 64 nt, Homo Sapiens
cucuagccgccuaaugcacuucacagguaacuccccaagguaaaacuagacucucuuguugguu

SEQ ID NO: 676462 - RNA, 64 nt, Homo Sapiens
cagugcucagucaagggcuaaugauugcccacccccaagguaaagagccucauugcacucuacc

SEQ ID NO: 676463 - RNA, 64 nt, Homo Sapiens
cuuuuaaaauuuaaagcgugaagaucagccuuucccaagguauaacagauaaacauguaucugu

SEQ ID NO: 676464 - RNA, 64 nt, Homo Sapiens
cagcaaggcucuuucguucuuccagcaaaggcuuccaagguacaacucaaacaagccaugguuc

SEQ ID NO: 676465 - RNA, 64 nt, Homo Sapiens
cccugcuccuguaccagcaggggccacuucaaagccaagguacagggugauaacuuguggucca

SEQ ID NO: 676466 - RNA, 64 nt, Homo Sapiens
uuuuuuuucccgagaccaaguuucacucuguugcccaagguagagugcaguggcgugaucucug

SEQ ID NO: 676467 - RNA, 64 nt, Homo Sapiens
augggaccugguuucagaauuguguaucaaaagaccaagguauuacagugguguguagugcugc

SEQ ID NO: 676468 - RNA, 64 nt, Homo Sapiens
ucagcugcaacaccuguuuaugauccuggccucaccaagguauguggaccgagugacugaauuc

SEQ ID NO: 676469 - RNA, 64 nt, Homo Sapiens
aaugcuacuuuuaucuucucuaaaauuauuucccccaagguagugaaguaauuggaaugaagga

SEQ ID NO: 676470 - RNA, 64 nt, Homo Sapiens
caucuggauuuucacacaguaaagcaggaagccuccaagguaacccggcuaugggacugcagug

SEQ ID NO: 676471 - RNA, 64 nt, Homo Sapiens
ugauguccugugugcuccacagcucaccugcuugccaagguacgucuggguaguaguuucugga

SEQ ID NO: 676472 - RNA, 64 nt, Homo Sapiens
caugcauaugaggucuucccugaaacagccacagccaagguaggacagcuaccgcacaccaccc

SEQ ID NO: 676473 - RNA, 64 nt, Homo Sapiens
uuuuacuauugugguuuuuuaaggugaguagcuuccaagguagaaaccuuugaccuuucuguuc

SEQ ID NO: 676474 - RNA, 64 nt, Homo Sapiens
gucacuaaccaagccagaaacucagugcccacagccaagguaggccgcauggcacucuucccac

SEQ ID NO: 676475 - RNA, 64 nt, Homo Sapiens
gaaugugccuuuuucagagugcaguguuaauaugccaagguaggaguuuuacauuuaaauucag

SEQ ID NO: 676476 - RNA, 64 nt, Homo Sapiens
gauuucugcuaaguucuccccuucuuuguaaugaccaagguaccuuuuuuuuccuuugaacgug

SEQ ID NO: 676477 - RNA, 64 nt, Homo Sapiens
uuaaaaauaugaaucaaaauuccuguguugugugccaagguauaaaguggagaaguuagaugag

SEQ ID NO: 676478 - RNA, 64 nt, Homo Sapiens
gugggacuaaagcccagaaauuccuccucaaugcccaagguaauacuucauuucaugguauuuc

SEQ ID NO: 676479 - RNA, 64 nt, Homo Sapiens
auccuaggcugacaccuaacugguccgucauaacccaagguaccccuucccuccaagaaggauu

SEQ ID NO: 676480 - RNA, 64 nt, Homo Sapiens
cauugggcggccugcaggaaaacaccgucugagcccaagguacauuccccauuuccucuuauga

SEQ ID NO: 676481 - RNA, 64 nt, Homo Sapiens
gugaucaggguccugcaagcaguggggaagggggccaagguauuggaggacucccucccagcuu

SEQ ID NO: 676482 - RNA, 64 nt, Homo Sapiens
gaagaaucaauaucaugaaaauggcccauacugcccaagguaauuuauagauucaaugccaucc

SEQ ID NO: 676483 - RNA, 64 nt, Homo Sapiens
ucugucucuucccaccuuccaucugcacacacccccaagguaaggguacagcccggcuggcggc

SEQ ID NO: 676484 - RNA, 64 nt, Homo Sapiens
acugauguccccuuccccguguaugcccccuuccccaagguagcaagauggagggauggggcuc

SEQ ID NO: 676485 - RNA, 64 nt, Homo Sapiens
cagucuguaaaucagucaccuguguugcugcaggccaagguagaaacgcccuccgugugugcau

SEQ ID NO: 676486 - RNA, 64 nt, Homo Sapiens
cacaggaucccauccccucccccuggcacacgggccaagguacccuagugucacguucccccga

SEQ ID NO: 676487 - RNA, 64 nt, Homo Sapiens
uccauauauauacauauauuuaacaaaaugauggccaagguaguuuaagggaaaaagaauuucu

SEQ ID NO: 676488 - RNA, 64 nt, Homo Sapiens
caaggucagcccugaggccaggaaguugcugaggccaagguagccgauuuggggcucgagcaaa

SEQ ID NO: 676489 - RNA, 64 nt, Homo Sapiens
auuguaauaagcaugugccaauucugucauguucccaagguagacaugaaugcauaagaaaaaa

SEQ ID NO: 676490 - RNA, 64 nt, Homo Sapiens
uuugugcgagccuguguugcaggguuguauaaaaccaagguacuucguuaguuuugcccauuca

SEQ ID NO: 676491 - RNA, 64 nt, Homo Sapiens
ggauguuuaugcuguuugacuuuucuccuguguaccaagguauugcuuuuauuuacacgacagc

SEQ ID NO: 676492 - RNA, 64 nt, Homo Sapiens
auuaaugucuuaugucucccuaaaauguauaaaaccaagguaugccccaaccaucuuggccaca

SEQ ID NO: 676493 - RNA, 64 nt, Homo Sapiens
uccuaugauuucauagauguagcuuaggauaaggccaagguagguguugccuauauaagguuuu

SEQ ID NO: 676494 - RNA, 64 nt, Homo Sapiens
gagacauauuacuggaaguaugacauccagcaguccaagguauugacccccagguauugucuuu

SEQ ID NO: 676495 - RNA, 64 nt, Homo Sapiens
cuuguguuuuucagugugugucuucaucucaucgccaagguaggaacguuuccuguaguauguu

SEQ ID NO: 676496 - RNA, 64 nt, Homo Sapiens
gcccgcaaugggccuguaaagugccgggagguggccaagguacauggcgucacagcugagcacc

SEQ ID NO: 676497 - RNA, 64 nt, Homo Sapiens
uaguauaucaaccuuuuguuuuuaaauugaccugccaagguagcugaagaccuuuuagacaguu

SEQ ID NO: 676498 - RNA, 64 nt, Homo Sapiens
caagcauauaaaguauacuuguauguaaugauugccaagguaacagaauugcugacaucugucu

SEQ ID NO: 676499 - RNA, 64 nt, Homo Sapiens
uacucuugcuuugucaagcuguuugcuauaguuuccaagguauuauguuacucuaacucugaaa

SEQ ID NO: 676500 - RNA, 64 nt, Homo Sapiens
uuguugcuuuuuuaaaaaaagcgcugaaguuagaccaagguauacaguuuuguucuaacagaca

SEQ ID NO: 676501 - RNA, 64 nt, Homo Sapiens
agcuuuuuuuuuuacuaguuuuaaaacccaucuuccaagguauaugaauucuagaguauuuauc

SEQ ID NO: 676502 - RNA, 64 nt, Homo Sapiens
uuugauguuuaccuaagccuuuaaggcugugucaccaagguauggccacaaggaagaauagugu

SEQ ID NO: 676503 - RNA, 64 nt, Homo Sapiens
agcuguuugguuuuaaaauacuguagauaauuaaccaagguagaaugaccuuguaauguaacug

SEQ ID NO: 676504 - RNA, 64 nt, Homo Sapiens
ggaguuuccucugcucacagaaaugaccaaaagcccaagguaggccugagaggcuauacgugac

SEQ ID NO: 676505 - RNA, 64 nt, Homo Sapiens
guucagaccucagcuccugguuuguauucugacuccaagguauucaccccugagucccuugacu

SEQ ID NO: 676506 - RNA, 64 nt, Homo Sapiens
cuuccuggaguuugccguguccucacuggcuggaccaagguacuaagucagcucugggagcagc

SEQ ID NO: 676507 - RNA, 64 nt, Homo Sapiens
aaaaaaauaaaagguauuccuuggaaccaucaccccaagguaaaacuauaaucacauuuauggu

SEQ ID NO: 676508 - RNA, 64 nt, Homo Sapiens; identical to SEQ ID NO: 76855

SEQ ID NO: 676509 - RNA, 64 nt, Homo Sapiens; identical to SEQ ID NO: 76856

SEQ ID NO: 676510 - RNA, 64 nt, Homo Sapiens; identical to SEQ ID NO: 76857

SEQ ID NO: 676511 - RNA, 64 nt, Homo Sapiens; identical to SEQ ID NO: 76858

SEQ ID NO: 676512 - RNA, 64 nt, Homo Sapiens; identical to SEQ ID NO: 76859

SEQ ID NO: 676513 - RNA, 64 nt, Homo Sapiens; identical to SEQ ID NO: 76860

SEQ ID NO: 676514 - RNA, 64 nt, Homo Sapiens; identical to SEQ ID NO: 76861

SEQ ID NO: 676515 - RNA, 64 nt, Homo Sapiens; identical to SEQ ID NO: 76862

SEQ ID NO: 676516 - RNA, 64 nt, Homo Sapiens; identical to SEQ ID NO: 76863

SEQ ID NO: 676517 - RNA, 64 nt, Homo Sapiens; identical to SEQ ID NO: 76864

SEQ ID NO: 676518 - RNA, 64 nt, Homo Sapiens; identical to SEQ ID NO: 76865

SEQ ID NO: 676519 - RNA, 64 nt, Homo Sapiens; identical to SEQ ID NO: 76866

SEQ ID NO: 676520 - RNA, 64 nt, Homo Sapiens; identical to SEQ ID NO: 76867

SEQ ID NO: 676521 - RNA, 64 nt, Homo Sapiens; identical to SEQ ID NO: 76868

SEQ ID NO: 676522 - RNA, 64 nt, Homo Sapiens; identical to SEQ ID NO: 76869

SEQ ID NO: 676523 - RNA, 64 nt, Homo Sapiens; identical to SEQ ID NO: 76870

SEQ ID NO: 676524 - RNA, 64 nt, Homo Sapiens
uggcugggccuucaccaagcuuuaugaaaugccacugggacagcggaagggacaguaucguuug

SEQ ID NO: 676525 - RNA, 64 nt, Homo Sapiens
agucguuauauuugacuugagcagaaaacagggucugggacauuacagcuucccuauuuugaau

SEQ ID NO: 676526 - RNA, 64 nt, Homo Sapiens
aagagggucaguggacuuuuuccuuuauucauuucugggacagaggaaggaaagcacaacuggg

SEQ ID NO: 676527 - RNA, 64 nt, Homo Sapiens
auuuuuuuauucccacauuucacacaaagaugaccugggacaugccauccaccucccccgcaca

SEQ ID NO: 676528 - RNA, 64 nt, Homo Sapiens
aauauagccacagaaauaaaggagggaccaauaucugggacagugucuucucagaaacaaccag

SEQ ID NO: 676529 - RNA, 64 nt, Homo Sapiens
aauauagccacagaaauaaagaagggacaacaaucugggacagugucuccucagaaacaaucgg

SEQ ID NO: 676530 - RNA, 64 nt, Homo Sapiens
aauauagccacagaaauaaaggauggagaaaaaucugggacagugucuucucagaaacaaccag

SEQ ID NO: 676531 - RNA, 64 nt, Homo Sapiens
aacauagccacagaaauaaaggauggagaaaaaucugggacagugucuucucagaaaccaccag

SEQ ID NO: 676532 - RNA, 64 nt, Homo Sapiens
gaccacgcugccuguuugucggcuucuaguauuacugggacaauuucccuccagucccuggagg

SEQ ID NO: 676533 - RNA, 64 nt, Homo Sapiens
acugguugcuagcacauacucuugaugcaguaaucugggacaagagagcaggggugaacuguag

SEQ ID NO: 676534 - RNA, 64 nt, Homo Sapiens
ccuggcuacgccggcucuucgguggcaacacuaccugggacacugccuccccagucaccaaggg

SEQ ID NO: 676535 - RNA, 64 nt, Homo Sapiens
acccagcuuuggccccaugccccuguaggucccucugggacagucaccgcugggguccuggcug

SEQ ID NO: 676536 - RNA, 64 nt, Homo Sapiens
guuagaacugccugaaguuccgggacugguuuggcugggacaaaaggcauuguguguuuuguuc

SEQ ID NO: 676537 - RNA, 64 nt, Homo Sapiens
caugggacugcaucuuccgaucugguuugucgugcugggacaguuaucuuugggaagccaugug

SEQ ID NO: 676538 - RNA, 64 nt, Homo Sapiens
cuuuagauauuauuugaaaugagaagacuugggacugggacaguuguuaaggcuguuuugcuug

SEQ ID NO: 676539 - RNA, 64 nt, Homo Sapiens
gaggugacaguggaacaggcaauuauaccuaaaucugggacaggggcauuuaaaacuuugaaug

SEQ ID NO: 676540 - RNA, 64 nt, Homo Sapiens
cuccucugucaucacagcgccagggcagcugugccugggacaggagccacacagucagaggggg

SEQ ID NO: 676541 - RNA, 64 nt, Homo Sapiens
cccuucccccagugagaaggaaaaugggauaagucugggacacuguuucaguucaauaaagagg

SEQ ID NO: 676542 - RNA, 64 nt, Homo Sapiens
gaacaucucccuuccagcaucugcugguagcaggcugggacagucccuuccuucccugaaaccc

SEQ ID NO: 676543 - RNA, 64 nt, Homo Sapiens
agagggcaacuggaugacucgcaguaccacagcacugggacagacagaagccacaccuuucuuu

SEQ ID NO: 676544 - RNA, 64 nt, Homo Sapiens
ugcucuucagcggcucccugaaggccaucaaggucugggacaucgugggcacugagcugaaguu

SEQ ID NO: 676545 - RNA, 64 nt, Homo Sapiens
accuguacagcggcuccuaccagacaaucaagaucugggacauccgaacccuugacugcaucca

SEQ ID NO: 676546 - RNA, 64 nt, Homo Sapiens
ccuuucugugggggcucuagucuugcucccgaggcugggacagucccguccggagggagccauc

SEQ ID NO: 676547 - RNA, 64 nt, Homo Sapiens
cccuuuccucugucccuucuacugccuucuugggcugggacagccugacugacuucccagugga

SEQ ID NO: 676548 - RNA, 64 nt, Homo Sapiens
ugugccuucucuacugauggcaguguuuuagcugcugggacacaugacggaaguguguauuuuu

SEQ ID NO: 676549 - RNA, 64 nt, Homo Sapiens
aucuuugcuguaaagugcaaggaaauuuuaaauucugggacacugaguuagaugguaaauacug

SEQ ID NO: 676550 - RNA, 64 nt, Homo Sapiens
acgacgcaugauugguguuugaggcguuugccagcugggacaaacugcguuuggagcugugguu

SEQ ID NO: 676551 - RNA, 64 nt, Homo Sapiens
augcaagauuuuaauggugacuuguccuggcuuacugggacagucuguaugaggcaugucacca

SEQ ID NO: 676552 - RNA, 64 nt, Homo Sapiens
cuuugaaaaaagugcagauaaaacccucaucucccugggacaaagcacgugggggaaaggggug

SEQ ID NO: 676553 - RNA, 64 nt, Homo Sapiens
ggagagcucuggcuggcaucuggugggugccccucugggacaaagcuuccagaggaaggaacag

SEQ ID NO: 676554 - RNA, 64 nt, Homo Sapiens
gaaccaacaauucgucggaggcaucauggaaagacugggacagcccaggaaacaaggggucuga

SEQ ID NO: 676555 - RNA, 64 nt, Homo Sapiens
gcccuguggcaggacacacauggugagccuagcccugggacaucaggagacugggcucuggcuc

SEQ ID NO: 676556 - RNA, 64 nt, Homo Sapiens
ccuccgaagaccgcucgggcauuccgccugcgcccugggacagcggagagacggcuucucuuua

SEQ ID NO: 676557 - RNA, 64 nt, Homo Sapiens
agggagcugagcgugcaggcgcuccagggcaggccugggacagagucaaggcucagagaauaaa

SEQ ID NO: 676558 - RNA, 64 nt, Homo Sapiens
gugggguuggggaguaggggggaucccacauugccugggacaucugaaugcugauacgaaugga

SEQ ID NO: 676559 - RNA, 64 nt, Homo Sapiens
cgaauggacaggaaagggagccagagcuguauaccugggacaggccagggagccuuuagugcca

SEQ ID NO: 676560 - RNA, 64 nt, Homo Sapiens; identical to SEQ ID NO: 99947

SEQ ID NO: 676561 - RNA, 64 nt, Homo Sapiens; identical to SEQ ID NO: 99948

SEQ ID NO: 676562 - RNA, 64 nt, Homo Sapiens; identical to SEQ ID NO: 99949

SEQ ID NO: 676563 - RNA, 64 nt, Homo Sapiens; identical to SEQ ID NO: 99950

SEQ ID NO: 676564 - RNA, 64 nt, Homo Sapiens; identical to SEQ ID NO: 99951

SEQ ID NO: 676565 - RNA, 64 nt, Homo Sapiens; identical to SEQ ID NO: 99952

SEQ ID NO: 676566 - RNA, 64 nt, Homo Sapiens; identical to SEQ ID NO: 99953

SEQ ID NO: 676567 - RNA, 64 nt, Homo Sapiens; identical to SEQ ID NO: 99954

SEQ ID NO: 676568 - RNA, 64 nt, Homo Sapiens; identical to SEQ ID NO: 99955

SEQ ID NO: 676569 - RNA, 64 nt, Homo Sapiens; identical to SEQ ID NO: 99956

SEQ ID NO: 676570 - RNA, 64 nt, Homo Sapiens; identical to SEQ ID NO: 99957

SEQ ID NO: 676571 - RNA, 64 nt, Homo Sapiens; identical to SEQ ID NO: 99958

SEQ ID NO: 676572 - RNA, 64 nt, Homo Sapiens; identical to SEQ ID NO: 99959

SEQ ID NO: 676573 - RNA, 64 nt, Homo Sapiens; identical to SEQ ID NO: 99960

SEQ ID NO: 676574 - RNA, 64 nt, Homo Sapiens; identical to SEQ ID NO: 99961

SEQ ID NO: 676575 - RNA, 64 nt, Homo Sapiens; identical to SEQ ID NO: 99962

SEQ ID NO: 676576 - RNA, 64 nt, Homo Sapiens; identical to SEQ ID NO: 99963

SEQ ID NO: 676577 - RNA, 64 nt, Homo Sapiens; identical to SEQ ID NO: 99964

SEQ ID NO: 676578 - RNA, 64 nt, Homo Sapiens; identical to SEQ ID NO: 99965

SEQ ID NO: 676579 - RNA, 64 nt, Homo Sapiens; identical to SEQ ID NO: 99966

SEQ ID NO: 676580 - RNA, 64 nt, Homo Sapiens; identical to SEQ ID NO: 99967

SEQ ID NO: 676581 - RNA, 64 nt, Homo Sapiens; identical to SEQ ID NO: 99968

SEQ ID NO: 676582 - RNA, 64 nt, Homo Sapiens; identical to SEQ ID NO: 99969

SEQ ID NO: 676583 - RNA, 64 nt, Homo Sapiens; identical to SEQ ID NO: 99970

SEQ ID NO: 676584 - RNA, 64 nt, Homo Sapiens; identical to SEQ ID NO: 99971

SEQ ID NO: 676585 - RNA, 64 nt, Homo Sapiens; identical to SEQ ID NO: 99972

SEQ ID NO: 676586 - RNA, 64 nt, Homo Sapiens; identical to SEQ ID NO: 307447

SEQ ID NO: 676587 - RNA, 64 nt, Homo Sapiens; identical to SEQ ID NO: 307448

SEQ ID NO: 676588 - RNA, 64 nt, Homo Sapiens; identical to SEQ ID NO: 307449

SEQ ID NO: 676589 - RNA, 64 nt, Homo Sapiens; identical to SEQ ID NO: 307450

SEQ ID NO: 676590 - RNA, 64 nt, Homo Sapiens; identical to SEQ ID NO: 307451

SEQ ID NO: 676591 - RNA, 64 nt, Homo Sapiens; identical to SEQ ID NO: 307452

SEQ ID NO: 676592 - RNA, 64 nt, Homo Sapiens; identical to SEQ ID NO: 307453

SEQ ID NO: 676593 - RNA, 64 nt, Homo Sapiens; identical to SEQ ID NO: 307454

SEQ ID NO: 676594 - RNA, 64 nt, Homo Sapiens; identical to SEQ ID NO: 307455

SEQ ID NO: 676595 - RNA, 64 nt, Homo Sapiens; identical to SEQ ID NO: 307456

SEQ ID NO: 676596 - RNA, 64 nt, Homo Sapiens; identical to SEQ ID NO: 307457

SEQ ID NO: 676597 - RNA, 64 nt, Homo Sapiens; identical to SEQ ID NO: 307458

SEQ ID NO: 676598 - RNA, 64 nt, Homo Sapiens; identical to SEQ ID NO: 307459

SEQ ID NO: 676599 - RNA, 64 nt, Homo Sapiens; identical to SEQ ID NO: 307460

SEQ ID NO: 676600 - RNA, 64 nt, Homo Sapiens; identical to SEQ ID NO: 307461

SEQ ID NO: 676601 - RNA, 64 nt, Homo Sapiens; identical to SEQ ID NO: 307462

SEQ ID NO: 676602 - RNA, 64 nt, Homo Sapiens; identical to SEQ ID NO: 307463

SEQ ID NO: 676603 - RNA, 64 nt, Homo Sapiens; identical to SEQ ID NO: 307464

SEQ ID NO: 676604 - RNA, 64 nt, Homo Sapiens; identical to SEQ ID NO: 307465

SEQ ID NO: 676605 - RNA, 64 nt, Homo Sapiens; identical to SEQ ID NO: 307466

SEQ ID NO: 676606 - RNA, 64 nt, Homo Sapiens; identical to SEQ ID NO: 307467

SEQ ID NO: 676607 - RNA, 64 nt, Homo Sapiens; identical to SEQ ID NO: 307468

SEQ ID NO: 676608 - RNA, 64 nt, Homo Sapiens; identical to SEQ ID NO: 307469

SEQ ID NO: 676609 - RNA, 64 nt, Homo Sapiens; identical to SEQ ID NO: 307470

SEQ ID NO: 676610 - RNA, 64 nt, Homo Sapiens; identical to SEQ ID NO: 307471

SEQ ID NO: 676611 - RNA, 64 nt, Homo Sapiens; identical to SEQ ID NO: 307472

SEQ ID NO: 676612 - RNA, 64 nt, Homo Sapiens; identical to SEQ ID NO: 307473

SEQ ID NO: 676613 - RNA, 64 nt, Homo Sapiens; identical to SEQ ID NO: 307474

SEQ ID NO: 676614 - RNA, 64 nt, Homo Sapiens; identical to SEQ ID NO: 307475

SEQ ID NO: 676615 - RNA, 64 nt, Homo Sapiens; identical to SEQ ID NO: 307476

SEQ ID NO: 676616 - RNA, 64 nt, Homo Sapiens; identical to SEQ ID NO: 307477

SEQ ID NO: 676617 - RNA, 64 nt, Homo Sapiens; identical to SEQ ID NO: 307478

SEQ ID NO: 676618 - RNA, 64 nt, Homo Sapiens; identical to SEQ ID NO: 307479

SEQ ID NO: 676619 - RNA, 64 nt, Homo Sapiens; identical to SEQ ID NO: 307480

SEQ ID NO: 676620 - RNA, 64 nt, Homo Sapiens; identical to SEQ ID NO: 307481

SEQ ID NO: 676621 - RNA, 64 nt, Homo Sapiens; identical to SEQ ID NO: 307482

SEQ ID NO: 676622 - RNA, 64 nt, Homo Sapiens; identical to SEQ ID NO: 307483

SEQ ID NO: 676623 - RNA, 64 nt, Homo Sapiens; identical to SEQ ID NO: 307484

SEQ ID NO: 676624 - RNA, 64 nt, Homo Sapiens; identical to SEQ ID NO: 307485

SEQ ID NO: 676625 - RNA, 64 nt, Homo Sapiens; identical to SEQ ID NO: 307486

SEQ ID NO: 676626 - RNA, 64 nt, Homo Sapiens; identical to SEQ ID NO: 307487

SEQ ID NO: 676627 - RNA, 64 nt, Homo Sapiens; identical to SEQ ID NO: 307488

SEQ ID NO: 676628 - RNA, 64 nt, Homo Sapiens; identical to SEQ ID NO: 206878

SEQ ID NO: 676629 - RNA, 64 nt, Homo Sapiens; identical to SEQ ID NO: 206879

SEQ ID NO: 676630 - RNA, 64 nt, Homo Sapiens; identical to SEQ ID NO: 206880

SEQ ID NO: 676631 - RNA, 64 nt, Homo Sapiens; identical to SEQ ID NO: 206881

SEQ ID NO: 676632 - RNA, 64 nt, Homo Sapiens; identical to SEQ ID NO: 206882

SEQ ID NO: 676633 - RNA, 64 nt, Homo Sapiens; identical to SEQ ID NO: 206883

SEQ ID NO: 676634 - RNA, 62 nt, Homo Sapiens; identical to SEQ ID NO: 206884

SEQ ID NO: 676635 - RNA, 64 nt, Homo Sapiens; identical to SEQ ID NO: 206885

SEQ ID NO: 676636 - RNA, 64 nt, Homo Sapiens; identical to SEQ ID NO: 206886

SEQ ID NO: 676637 - RNA, 64 nt, Homo Sapiens; identical to SEQ ID NO: 206887

SEQ ID NO: 676638 - RNA, 64 nt, Homo Sapiens; identical to SEQ ID NO: 206888

SEQ ID NO: 676639 - RNA, 64 nt, Homo Sapiens; identical to SEQ ID NO: 206889

SEQ ID NO: 676640 - RNA, 64 nt, Homo Sapiens; identical to SEQ ID NO: 111411

SEQ ID NO: 676641 - RNA, 64 nt, Homo Sapiens; identical to SEQ ID NO: 111412

SEQ ID NO: 676642 - RNA, 64 nt, Homo Sapiens; identical to SEQ ID NO: 111413

SEQ ID NO: 676643 - RNA, 64 nt, Homo Sapiens; identical to SEQ ID NO: 111414

SEQ ID NO: 676644 - RNA, 64 nt, Homo Sapiens; identical to SEQ ID NO: 111415

SEQ ID NO: 676645 - RNA, 64 nt, Homo Sapiens; identical to SEQ ID NO: 111416

SEQ ID NO: 676646 - RNA, 64 nt, Homo Sapiens; identical to SEQ ID NO: 111417

SEQ ID NO: 676647 - RNA, 64 nt, Homo Sapiens; identical to SEQ ID NO: 111418

SEQ ID NO: 676648 - RNA, 64 nt, Homo Sapiens; identical to SEQ ID NO: 111419

SEQ ID NO: 676649 - RNA, 64 nt, Homo Sapiens; identical to SEQ ID NO: 111420

SEQ ID NO: 676650 - RNA, 64 nt, Homo Sapiens; identical to SEQ ID NO: 111421

SEQ ID NO: 676651 - RNA, 64 nt, Homo Sapiens; identical to SEQ ID NO: 111422

SEQ ID NO: 676652 - RNA, 64 nt, Homo Sapiens; identical to SEQ ID NO: 111423

SEQ ID NO: 676653 - RNA, 64 nt, Homo Sapiens; identical to SEQ ID NO: 111424

SEQ ID NO: 676654 - RNA, 64 nt, Homo Sapiens; identical to SEQ ID NO: 111425

SEQ ID NO: 676655 - RNA, 64 nt, Homo Sapiens; identical to SEQ ID NO: 111426

SEQ ID NO: 676656 - RNA, 64 nt, Homo Sapiens; identical to SEQ ID NO: 111427

SEQ ID NO: 676657 - RNA, 64 nt, Homo Sapiens; identical to SEQ ID NO: 111428

SEQ ID NO: 676658 - RNA, 64 nt, Homo Sapiens; identical to SEQ ID NO: 111429

SEQ ID NO: 676659 - RNA, 64 nt, Homo Sapiens; identical to SEQ ID NO: 111430

SEQ ID NO: 676660 - RNA, 64 nt, Homo Sapiens; identical to SEQ ID NO: 111431

SEQ ID NO: 676661 - RNA, 64 nt, Homo Sapiens; identical to SEQ ID NO: 111432

SEQ ID NO: 676662 - RNA, 64 nt, Homo Sapiens; identical to SEQ ID NO: 111433

SEQ ID NO: 676663 - RNA, 64 nt, Homo Sapiens; identical to SEQ ID NO: 111434

SEQ ID NO: 676664 - RNA, 58 nt, Homo Sapiens; identical to SEQ ID NO: 111435

SEQ ID NO: 676665 - RNA, 64 nt, Homo Sapiens; identical to SEQ ID NO: 111436

SEQ ID NO: 676666 - RNA, 64 nt, Homo Sapiens; identical to SEQ ID NO: 111437

SEQ ID NO: 676667 - RNA, 64 nt, Homo Sapiens; identical to SEQ ID NO: 111438

SEQ ID NO: 676668 - RNA, 64 nt, Homo Sapiens; identical to SEQ ID NO: 111439

SEQ ID NO: 676669 - RNA, 64 nt, Homo Sapiens; identical to SEQ ID NO: 111440

SEQ ID NO: 676670 - RNA, 64 nt, Homo Sapiens; identical to SEQ ID NO: 111441

SEQ ID NO: 676671 - RNA, 64 nt, Homo Sapiens; identical to SEQ ID NO: 111442

SEQ ID NO: 676672 - RNA, 64 nt, Homo Sapiens; identical to SEQ ID NO: 111443

SEQ ID NO: 676673 - RNA, 64 nt, Homo Sapiens; identical to SEQ ID NO: 111444

SEQ ID NO: 676674 - RNA, 64 nt, Homo Sapiens; identical to SEQ ID NO: 111445

SEQ ID NO: 676675 - RNA, 64 nt, Homo Sapiens; identical to SEQ ID NO: 111446

SEQ ID NO: 676676 - RNA, 64 nt, Homo Sapiens; identical to SEQ ID NO: 111447

SEQ ID NO: 676677 - RNA, 64 nt, Homo Sapiens; identical to SEQ ID NO: 111448

SEQ ID NO: 676678 - RNA, 64 nt, Homo Sapiens; identical to SEQ ID NO: 111449

SEQ ID NO: 676679 - RNA, 64 nt, Homo Sapiens; identical to SEQ ID NO: 111450

SEQ ID NO: 676680 - RNA, 64 nt, Homo Sapiens; identical to SEQ ID NO: 111451

SEQ ID NO: 676681 - RNA, 64 nt, Homo Sapiens; identical to SEQ ID NO: 111452

SEQ ID NO: 676682 - RNA, 64 nt, Homo Sapiens; identical to SEQ ID NO: 111453

SEQ ID NO: 676683 - RNA, 64 nt, Homo Sapiens; identical to SEQ ID NO: 111454

SEQ ID NO: 676684 - RNA, 64 nt, Homo Sapiens; identical to SEQ ID NO: 111455

SEQ ID NO: 676685 - RNA, 64 nt, Homo Sapiens; identical to SEQ ID NO: 111456

SEQ ID NO: 676686 - RNA, 64 nt, Homo Sapiens; identical to SEQ ID NO: 111457

SEQ ID NO: 676687 - RNA, 64 nt, Homo Sapiens; identical to SEQ ID NO: 111458

SEQ ID NO: 676688 - RNA, 64 nt, Homo Sapiens; identical to SEQ ID NO: 111459

SEQ ID NO: 676689 - RNA, 52 nt, Homo Sapiens; identical to SEQ ID NO: 111460

SEQ ID NO: 676690 - RNA, 64 nt, Homo Sapiens; identical to SEQ ID NO: 111461

SEQ ID NO: 676691 - RNA, 64 nt, Homo Sapiens; identical to SEQ ID NO: 111462

SEQ ID NO: 676692 - RNA, 64 nt, Homo Sapiens; identical to SEQ ID NO: 111463

SEQ ID NO: 676693 - RNA, 64 nt, Homo Sapiens; identical to SEQ ID NO: 111464

SEQ ID NO: 676694 - RNA, 64 nt, Homo Sapiens; identical to SEQ ID NO: 111465

SEQ ID NO: 676695 - RNA, 64 nt, Homo Sapiens; identical to SEQ ID NO: 111466

SEQ ID NO: 676696 - RNA, 64 nt, Homo Sapiens; identical to SEQ ID NO: 111467

SEQ ID NO: 676697 - RNA, 64 nt, Homo Sapiens
agaagcauuuuccccauguggcucucucacugugcguugcuaccuugcuucugugagaauucag

SEQ ID NO: 676698 - RNA, 64 nt, Homo Sapiens
aggguuuuaucuaauaaagugucucuuccauucacguugcuaccuuacccacacuuucccuucu

SEQ ID NO: 676699 - RNA, 64 nt, Homo Sapiens
aaagaauaccugagacuggguguuagucuguuugcguugcuauaaaaucucccagggugcugug

SEQ ID NO: 676700 - RNA, 64 nt, Homo Sapiens
ucaugacaauggcugccuauacugucguguggcucguugcuaaaucuuccauguucccuucuua

SEQ ID NO: 676701 - RNA, 64 nt, Homo Sapiens
gaacgguggcagagucuccuuggcaaucaaccaacguugcuaugaaauaugccucacacuguau

SEQ ID NO: 676702 - RNA, 64 nt, Homo Sapiens
cugggagaaaaccugcacucgguggcaccuacaacguugcuaauuuauuuccuuuugauaugca

SEQ ID NO: 676703 - RNA, 64 nt, Homo Sapiens
gaaagagcagagagggugggucuguugcugaacgcguugcuaaacccgacgaaucucugcaauc

SEQ ID NO: 676704 - RNA, 64 nt, Homo Sapiens
cugaaagggaagccacaccagaaaaggguuugggcguugcuaggacaaguggagccagguagag

SEQ ID NO: 676705 - RNA, 64 nt, Homo Sapiens
cugucaacauaccaagcuguggugauucaaguaccguugcuaagguguguuguuuuuuuaaaga

SEQ ID NO: 676706 - RNA, 64 nt, Homo Sapiens
agcacuuucuuuauccuugguggagacugcaauacguugcuaugaccguuuauaugcacuuuca

SEQ ID NO: 676707 - RNA, 64 nt, Homo Sapiens
gaagguucucauguggugaacccagugauguaaacguugcuauuucucagggucucauaaacuc

SEQ ID NO: 676708 - RNA, 53 nt, Homo Sapiens
guaguuugcuaaaagaugauuuucguugcuauaaaucagaaagucuaauguaa

SEQ ID NO: 676709 - RNA, 64 nt, Homo Sapiens
gauuucucuauaauaagccaacugguuaaacuuacguugcuaaaguugaucaguugugacacuu

SEQ ID NO: 676710 - RNA, 64 nt, Homo Sapiens
aaagagccaagguagugaugguggccacgugccucguugcuauuuuuaaaguaauauucagaug

SEQ ID NO: 676711 - RNA, 64 nt, Homo Sapiens
cucuuggugaggcacgagcucauucacugauuaacguugcuaaaguagaauggaagcuguucug

SEQ ID NO: 676712 - RNA, 64 nt, Homo Sapiens
uccacccauuuguuuucggcauugacggaaacaacguugcuauugcagccagugcacauuugga

SEQ ID NO: 676713 - RNA, 64 nt, Homo Sapiens
gugaauauauuuaacacuguguuaaauuaauuuacguugcuauuuuauuuuaaucauaaacaac

SEQ ID NO: 676714 - RNA, 64 nt, Homo Sapiens
gcuggaacugucuaccccagggacacacccauuucguugcuacccaaguggauucugagacagg

SEQ ID NO: 676715 - RNA, 64 nt, Homo Sapiens
augaagacuuuggaaauuucauuucagugggugucguugcuacgccucacuccaccacuuuucu

SEQ ID NO: 676716 - RNA, 64 nt, Homo Sapiens
ucaaaaaccagcaaauuuuaauuuugucccacagcguugcuaggguggcauggcuccccaucuc

SEQ ID NO: 676717 - RNA, 64 nt, Homo Sapiens
aaccagguaacccaguuagccaagauguuggaugcguugcuagaaggagaaauagaagaccuug

SEQ ID NO: 676718 - RNA, 64 nt, Homo Sapiens
gggggagggugaggauuaagauuaugucucuuuacguugcuaaguaagugagugucccuaugcg

SEQ ID NO: 676719 - RNA, 64 nt, Homo Sapiens
uuaagaaaugcuauguguacuaauugugccuuuccguugcuaaauacugaauuuuauugcuugc

SEQ ID NO: 676720 - RNA, 64 nt, Homo Sapiens
cgccaacucuguaaaccccaaguauaacacaggacguugcuauuuguugacugacacauagugc

SEQ ID NO: 676721 - RNA, 64 nt, Homo Sapiens
cuaugggacugaacuuugagacacacuaugagagcguugcuaccuguggggcaagagcauguac

SEQ ID NO: 676722 - RNA, 64 nt, Homo Sapiens
cuagguugccccuuauuuuuuauuuucccuguugcguugcuauagaugaagggugaggacaauc

SEQ ID NO: 676723 - RNA, 64 nt, Homo Sapiens
gugaaaauuccuggauggaaccucggguccuuuccguugcuaugcugccucacaagcagugaca

SEQ ID NO: 676724 - RNA, 64 nt, Homo Sapiens
caggcucggcugucuggccggggcggccggucagcguugcuagggaaggugucugggccauccu

SEQ ID NO: 676725 - RNA, 64 nt, Homo Sapiens
uccuagcaagcaggaaguuaagagcaggaggaagcguugcuaccuucacuucuccccagcucug

SEQ ID NO: 676726 - RNA, 64 nt, Homo Sapiens
agcgauaaacauucucagacccuuggagagaaaccguugcuagcuugcuggucccgaaagauug

SEQ ID NO: 676727 - RNA, 64 nt, Homo Sapiens
uuaauggcaagacuaaaugagguggggcuaucuccguugcuauacagugucagaggggccgccc

SEQ ID NO: 676728 - RNA, 64 nt, Homo Sapiens
gagugucugucuaagaacacacuaggcauagcaccguugcuaccacaauauaccuucucagucu

SEQ ID NO: 676729 - RNA, 64 nt, Homo Sapiens
ucauuuuuuuaagacaaaauugugacugauagagcguugcuauucuaaaucugcauguccucug

SEQ ID NO: 676730 - RNA, 64 nt, Homo Sapiens
uuuguuuuguuuuuguuuuuguuuccauuguuaccguugcuauggcccuuugccugucucucca

SEQ ID NO: 676731 - RNA, 64 nt, Homo Sapiens
gaaaaaaaaaacacaaaaaacaaaaaacauggcacguugcuaguuuacaggguuuugugaguuu

SEQ ID NO: 676732 - RNA, 64 nt, Homo Sapiens
uuuuguuguuuguuuggaaggcagggcaggcugccguugcuaaaugauuuaauaauauuguaau

SEQ ID NO: 676733 - RNA, 64 nt, Homo Sapiens
ucuguuaaugccugucagugucuauaggagaccacguugcuacauuuagauaaguguaauuuuc

SEQ ID NO: 676734 - RNA, 64 nt, Homo Sapiens
ggucaagcccccuuugauugaguucaucaugagccguugcuaaugccaggccaguaaaaguaua

SEQ ID NO: 676735 - RNA, 64 nt, Homo Sapiens
ggaccucuguuguacauuccgguugggggaugagcguugcuauuuaauuacuaauauuauugaa

SEQ ID NO: 676736 - RNA, 64 nt, Homo Sapiens
gacugucuccauaacaucauugggauccccaucccguugcuauuucuuuuucaccguuuuuacc

SEQ ID NO: 676737 - RNA, 64 nt, Homo Sapiens
cgccgcccugcgguugggccgguggaggcccaggcguugcuaggauugcaucaguuuuccuguu

SEQ ID NO: 676738 - RNA, 64 nt, Homo Sapiens
acacacacacacacacacacacacagagucaggccguugcuagucaguucucuucuuuccaccc

SEQ ID NO: 676739 - RNA, 64 nt, Homo Sapiens
accuccuucucuucuggacauguccaggaguggccguugcuacaagucaccuggugcuacgacc

SEQ ID NO: 676740 - RNA, 64 nt, Homo Sapiens; identical to SEQ ID NO: 127504

SEQ ID NO: 676741 - RNA, 64 nt, Homo Sapiens; identical to SEQ ID NO: 127505

SEQ ID NO: 676742 - RNA, 64 nt, Homo Sapiens; identical to SEQ ID NO: 127506

SEQ ID NO: 676743 - RNA, 64 nt, Homo Sapiens; identical to SEQ ID NO: 127507

SEQ ID NO: 676744 - RNA, 64 nt, Homo Sapiens; identical to SEQ ID NO: 127508

SEQ ID NO: 676745 - RNA, 64 nt, Homo Sapiens; identical to SEQ ID NO: 127509

SEQ ID NO: 676746 - RNA, 64 nt, Homo Sapiens; identical to SEQ ID NO: 127510

SEQ ID NO: 676747 - RNA, 64 nt, Homo Sapiens; identical to SEQ ID NO: 127511

SEQ ID NO: 676748 - RNA, 64 nt, Homo Sapiens; identical to SEQ ID NO: 127512

SEQ ID NO: 676749 - RNA, 64 nt, Homo Sapiens; identical to SEQ ID NO: 127513

SEQ ID NO: 676750 - RNA, 64 nt, Homo Sapiens; identical to SEQ ID NO: 127514

SEQ ID NO: 676751 - RNA, 64 nt, Homo Sapiens; identical to SEQ ID NO: 127514

SEQ ID NO: 676752 - RNA, 64 nt, Homo Sapiens; identical to SEQ ID NO: 127516

SEQ ID NO: 676753 - RNA, 64 nt, Homo Sapiens; identical to SEQ ID NO: 127517

SEQ ID NO: 676754 - RNA, 64 nt, Homo Sapiens; identical to SEQ ID NO: 127518

SEQ ID NO: 676755 - RNA, 64 nt, Homo Sapiens; identical to SEQ ID NO: 127519

SEQ ID NO: 676756 - RNA, 64 nt, Homo Sapiens; identical to SEQ ID NO: 127520

SEQ ID NO: 676757 - RNA, 64 nt, Homo Sapiens; identical to SEQ ID NO: 127521

SEQ ID NO: 676758 - RNA, 64 nt, Homo Sapiens; identical to SEQ ID NO: 127522

SEQ ID NO: 676759 - RNA, 64 nt, Homo Sapiens; identical to SEQ ID NO: 127523

SEQ ID NO: 676760 - RNA, 64 nt, Homo Sapiens; identical to SEQ ID NO: 127524

SEQ ID NO: 676761 - RNA, 64 nt, Homo Sapiens; identical to SEQ ID NO: 127525

SEQ ID NO: 676762 - RNA, 64 nt, Homo Sapiens; identical to SEQ ID NO: 127526

SEQ ID NO: 676763 - RNA, 64 nt, Homo Sapiens; identical to SEQ ID NO: 127527

SEQ ID NO: 676764 - RNA, 64 nt, Homo Sapiens; identical to SEQ ID NO: 127528

SEQ ID NO: 676765 - RNA, 64 nt, Homo Sapiens; identical to SEQ ID NO: 127529

SEQ ID NO: 676766 - RNA, 64 nt, Homo Sapiens; identical to SEQ ID NO: 127530

SEQ ID NO: 676767 - RNA, 64 nt, Homo Sapiens; identical to SEQ ID NO: 127531

SEQ ID NO: 676768 - RNA, 64 nt, Homo Sapiens; identical to SEQ ID NO: 127532

SEQ ID NO: 676769 - RNA, 64 nt, Homo Sapiens; identical to SEQ ID NO: 127533

SEQ ID NO: 676770 - RNA, 64 nt, Homo Sapiens; identical to SEQ ID NO: 127534

SEQ ID NO: 676771 - RNA, 64 nt, Homo Sapiens; identical to SEQ ID NO: 127535

SEQ ID NO: 676772 - RNA, 64 nt, Homo Sapiens; identical to SEQ ID NO: 127536

SEQ ID NO: 676773 - RNA, 64 nt, Homo Sapiens; identical to SEQ ID NO: 127537

SEQ ID NO: 676774 - RNA, 64 nt, Homo Sapiens; identical to SEQ ID NO: 127538

SEQ ID NO: 676775 - RNA, 64 nt, Homo Sapiens; identical to SEQ ID NO: 127539

SEQ ID NO: 676776 - RNA, 64 nt, Homo Sapiens; identical to SEQ ID NO: 127540

SEQ ID NO: 676777 - RNA, 64 nt, Homo Sapiens; identical to SEQ ID NO: 127541

SEQ ID NO: 676778 - RNA, 64 nt, Homo Sapiens; identical to SEQ ID NO: 127542

SEQ ID NO: 676779 - RNA, 64 nt, Homo Sapiens; identical to SEQ ID NO: 127543

SEQ ID NO: 676780 - RNA, 64 nt, Homo Sapiens; identical to SEQ ID NO: 127544

SEQ ID NO: 676781 - RNA, 64 nt, Homo Sapiens; identical to SEQ ID NO: 127545

SEQ ID NO: 676782 - RNA, 64 nt, Homo Sapiens; identical to SEQ ID NO: 127546

SEQ ID NO: 676783 - RNA, 64 nt, Homo Sapiens; identical to SEQ ID NO: 127547

SEQ ID NO: 676784 - RNA, 64 nt, Homo Sapiens; identical to SEQ ID NO: 127548

SEQ ID NO: 676785 - RNA, 64 nt, Homo Sapiens; identical to SEQ ID NO: 127549

SEQ ID NO: 676786 - RNA, 64 nt, Homo Sapiens; identical to SEQ ID NO: 127550

SEQ ID NO: 676787 - RNA, 64 nt, Homo Sapiens; identical to SEQ ID NO: 127551

SEQ ID NO: 676788 - RNA, 64 nt, Homo Sapiens; identical to SEQ ID NO: 127552

SEQ ID NO: 676789 - RNA, 64 nt, Homo Sapiens; identical to SEQ ID NO: 127553

SEQ ID NO: 676790 - RNA, 64 nt, Homo Sapiens; identical to SEQ ID NO: 127554

SEQ ID NO: 676791 - RNA, 64 nt, Homo Sapiens; identical to SEQ ID NO: 127555

SEQ ID NO: 676792 - RNA, 64 nt, Homo Sapiens; identical to SEQ ID NO: 127556

SEQ ID NO: 676793 - RNA, 64 nt, Homo Sapiens; identical to SEQ ID NO: 582350

SEQ ID NO: 676794 - RNA, 64 nt, Homo Sapiens; identical to SEQ ID NO: 582351

SEQ ID NO: 676795 - RNA, 64 nt, Homo Sapiens; identical to SEQ ID NO: 582352

SEQ ID NO: 676796 - RNA, 64 nt, Homo Sapiens; identical to SEQ ID NO: 582353

SEQ ID NO: 676797 - RNA, 64 nt, Homo Sapiens; identical to SEQ ID NO: 582354

SEQ ID NO: 676798 - RNA, 64 nt, Homo Sapiens; identical to SEQ ID NO: 582355

SEQ ID NO: 676799 - RNA, 64 nt, Homo Sapiens; identical to SEQ ID NO: 582356

SEQ ID NO: 676800 - RNA, 64 nt, Homo Sapiens; identical to SEQ ID NO: 582357

SEQ ID NO: 676801 - RNA, 64 nt, Homo Sapiens; identical to SEQ ID NO: 582358

SEQ ID NO: 676802 - RNA, 64 nt, Homo Sapiens; identical to SEQ ID NO: 582359

SEQ ID NO: 676803 - RNA, 64 nt, Homo Sapiens; identical to SEQ ID NO: 582360

SEQ ID NO: 676804 - RNA, 64 nt, Homo Sapiens; identical to SEQ ID NO: 582361

SEQ ID NO: 676805 - RNA, 64 nt, Homo Sapiens; identical to SEQ ID NO: 582362

SEQ ID NO: 676806 - RNA, 64 nt, Homo Sapiens; identical to SEQ ID NO: 582363

SEQ ID NO: 676807 - RNA, 64 nt, Homo Sapiens; identical to SEQ ID NO: 582364

SEQ ID NO: 676808 - RNA, 64 nt, Homo Sapiens; identical to SEQ ID NO: 582365

SEQ ID NO: 676809 - RNA, 64 nt, Homo Sapiens; identical to SEQ ID NO: 582366

SEQ ID NO: 676810 - RNA, 64 nt, Homo Sapiens; identical to SEQ ID NO: 582367

SEQ ID NO: 676811 - RNA, 64 nt, Homo Sapiens; identical to SEQ ID NO: 582368

SEQ ID NO: 676812 - RNA, 64 nt, Homo Sapiens; identical to SEQ ID NO: 582369

SEQ ID NO: 676813 - RNA, 64 nt, Homo Sapiens; identical to SEQ ID NO: 582370

SEQ ID NO: 676814 - RNA, 64 nt, Homo Sapiens; identical to SEQ ID NO: 582371

SEQ ID NO: 676815 - RNA, 64 nt, Homo Sapiens; identical to SEQ ID NO: 245756

SEQ ID NO: 676816 - RNA, 64 nt, Homo Sapiens; identical to SEQ ID NO: 245757

SEQ ID NO: 676817 - RNA, 64 nt, Homo Sapiens; identical to SEQ ID NO: 245758

SEQ ID NO: 676818 - RNA, 64 nt, Homo Sapiens; identical to SEQ ID NO: 245759

SEQ ID NO: 676819 - RNA, 64 nt, Homo Sapiens; identical to SEQ ID NO: 105402

SEQ ID NO: 676820 - RNA, 64 nt, Homo Sapiens; identical to SEQ ID NO: 105403

SEQ ID NO: 676821 - RNA, 64 nt, Homo Sapiens; identical to SEQ ID NO: 619660

SEQ ID NO: 676822 - RNA, 64 nt, Homo Sapiens; identical to SEQ ID NO: 619661

SEQ ID NO: 676823 - RNA, 64 nt, Homo Sapiens; identical to SEQ ID NO: 619662

SEQ ID NO: 676824 - RNA, 64 nt, Homo Sapiens; identical to SEQ ID NO: 619663

SEQ ID NO: 676825 - RNA, 58 nt, Homo Sapiens
ccaagcaguuucuuucaaagaagccagcaggcgaaaagcagggacugccacugcauuu

SEQ ID NO: 676826 - RNA, 58 nt, Homo Sapiens
cugccauauccccagugccagugcuugaaggcgaaacccaaaggagggugucuuggcu

SEQ ID NO: 676827 - RNA, 58 nt, Homo Sapiens
uauuauuuuauuccaagaaagaucagguaggcgaaaagaugacaggauacagagucaa

SEQ ID NO: 676828 - RNA, 58 nt, Homo Sapiens
gugggggaggugagcgcagcuggggaagaggcgaaagcugcuuagcccagcucagggg

SEQ ID NO: 676829 - RNA, 58 nt, Homo Sapiens
gaggccaaaaguuaaacguucuaaaaagaggcgaaaggaagcaagcaguucagaagag

SEQ ID NO: 676830 - RNA, 58 nt, Homo Sapiens
uaaaacugagacuguauaugagcugcugaggcgaaauacuggaaagcaacuucauccc

SEQ ID NO: 676831 - RNA, 58 nt, Homo Sapiens
cugccccgucucccguggaccacgacagaggcgaaaucuagacugcucgcuaguggaa

SEQ ID NO: 676832 - RNA, 58 nt, Homo Sapiens
cccuucagcugugacaucgugccugggaaggcgaaauauacccccagccccuuccaac

SEQ ID NO: 676833 - RNA, 58 nt, Homo Sapiens
gccugcagcacaccccacagccaaguagaggcgaaagcaguggcucauccuaccuguu

SEQ ID NO: 676834 - RNA, 58 nt, Homo Sapiens
gacacacacucgcagacgagccgccccgaggcgaaaccucgcgguuccucuucccuuc

SEQ ID NO: 676835 - RNA, 58 nt, Homo Sapiens
uuguggaaagacggugugugucgugugaaggcgaaacccgguguacauaaccccuccc

SEQ ID NO: 676836 - RNA, 58 nt, Homo Sapiens
acaggagggccaggcauguauuccucagaggcgaaacugccaaacucuuucuccuguc

SEQ ID NO: 676837 - RNA, 58 nt, Homo Sapiens
ugauucacuuuuugccccuagggaugagaggcgaaagccacuucucauacaagccccu

SEQ ID NO: 676838 - RNA, 58 nt, Homo Sapiens
aaucucccggcagugcuuggggucugagaggcgaaacggcugaugagcaaggcaggca

SEQ ID NO: 676839 - RNA, 58 nt, Homo Sapiens
ccagugggguccggacacugggccccgcaggcgaaagcacguuccagccaccaggagg

SEQ ID NO: 676840 - RNA, 58 nt, Homo Sapiens
cgggaguuggagacccgccuggcuaacaaggcgaaauccugucuguacuaaaaauaca

SEQ ID NO: 676841 - RNA, 58 nt, Homo Sapiens
cagugcuuugguaaaggucccacugcagaggcgaaagccagguaaguauugcuuccgc

SEQ ID NO: 676842 - RNA, 58 nt, Homo Sapiens
cagccacaccccucugccaccgagaugcaggcgaaaagacugaucugccuaaagcacg

SEQ ID NO: 676843 - RNA, 58 nt, Homo Sapiens
gaagcagaaaucuaggaaguguaauuuuaggcgaaaugugacuucauauacaaagccu

SEQ ID NO: 676844 - RNA, 58 nt, Homo Sapiens
augacaggaaaccugccgccgagaaggaaggcgaaagcacucuagcacugguguauau

SEQ ID NO: 676845 - RNA, 58 nt, Homo Sapiens
gccugagccgauggggccccccaggcccaggcgaaagggcagcagcauguggcccaug

SEQ ID NO: 676846 - RNA, 58 nt, Homo Sapiens
guggaauuucauucaaaggcgacaauggaggcgaaagacugauaugugccuguuucug

SEQ ID NO: 676847 - RNA, 58 nt, Homo Sapiens
caggaguucaagaccagccuggccaacaaggcgaaacccugucucuacuaaaaauaaa

SEQ ID NO: 676848 - RNA, 58 nt, Homo Sapiens
ugagggaaggaagaaacuccaggcuuccaggcgaaagcuagggcuggaagccaguucu

SEQ ID NO: 676849 - RNA, 58 nt, Homo Sapiens
gcuguggugauuggcccuguggucuaucaggcgaaaaccacagauucuccuucuaguu

SEQ ID NO: 676850 - RNA, 58 nt, Homo Sapiens
ggaugcugcauugcgaggacuaaaccacaggcgaaagaccucacucucuguaagcaua

SEQ ID NO: 676851 - RNA, 58 nt, Homo Sapiens
ugccccaagacacagggaccacgccuuuaggcgaaacacgcccaggcuccucucugac

SEQ ID NO: 676852 - RNA, 58 nt, Homo Sapiens
caggaguucgagaucauucuggccaacaaggcgaaacccugucucuaccaaaaauaca

SEQ ID NO: 676853 - RNA, 58 nt, Homo Sapiens
acuaugccuguugaucuaugggaaaucuaggcgaaaguaauggggaagauuagaaaga

SEQ ID NO: 676854 - RNA, 58 nt, Homo Sapiens
aaacucuauuuagaugcauauaauugacaggcgaaagauaaugcuaaucuugugaaaa

SEQ ID NO: 676855 - RNA, 64 nt, Homo Sapiens
ugagagauagcacagauggacauuuuagguuucucuugcagauaacuuaacacucaaauauuaa

SEQ ID NO: 676856 - RNA, 64 nt, Homo Sapiens
aguuuauuauaauucuccagggaggccugcuucacuugcagauauuuugagagauuacagaaga

SEQ ID NO: 676857 - RNA, 64 nt, Homo Sapiens
gcgcguucucacggugggcuagaaagggagacagcuugcagaugaaggguuucaccaaggaugg

SEQ ID NO: 676858 - RNA, 64 nt, Homo Sapiens
aaaggugggagagaggaaaaaauaguaacaauaccuugcagaggagcaaaaaucaguaacaaaa

SEQ ID NO: 676859 - RNA, 64 nt, Homo Sapiens
caccugcuccggcauccagcaugcagaacagcuucuugcagaagcaagaugcagcaaggagagg

SEQ ID NO: 676860 - RNA, 64 nt, Homo Sapiens
gugcucugguggaacaaguugcgugucaguucuucuugcagaaugugcucccagcagaggcugu

SEQ ID NO: 676861 - RNA, 64 nt, Homo Sapiens
agccacugcucccaguuaaaggugggucaguagccuugcagaacuguccugagaaguuauugcu

SEQ ID NO: 676862 - RNA, 64 nt, Homo Sapiens
cacuuuucacuuuccagcuaggucuguuuuucagcuugcagacaagauugagaaauccuugaaa

SEQ ID NO: 676863 - RNA, 64 nt, Homo Sapiens
uuaaggucugagacuugcugccagcucugagacacuugcagaucaaguaaagccuuuuucugcc

SEQ ID NO: 676864 - RNA, 64 nt, Homo Sapiens
ccauccauucacuccuggggaggccagcacuucgcuugcagaagucaaggccagcaagccccuc

SEQ ID NO: 676865 - RNA, 64 nt, Homo Sapiens
cccugccacaggcugcagcuaccuaggaacauuccuugcagaccccgcauugcccuuugggggu

SEQ ID NO: 676866 - RNA, 64 nt, Homo Sapiens
gaagugcagucuuugauuugauuucccuaguaaccuugcagauauguuuaaccaagccauagcc

SEQ ID NO: 676867 - RNA, 64 nt, Homo Sapiens
aguaaacacucucggaugcccuucuaugacugugcuugcagaagauucucaucgaggccccucg

SEQ ID NO: 676868 - RNA, 64 nt, Homo Sapiens
gcucucccaucuuccugcaaagaaaccagguccccuugcagacgcaacccaacggcaaagacac

SEQ ID NO: 676869 - RNA, 64 nt, Homo Sapiens
gcuuuucuaacucacaagucaaaaaccagcuggccuugcagacggucuuuaaugacagaaacac

SEQ ID NO: 676870 - RNA, 64 nt, Homo Sapiens
cccuuuauuuugguccucucguaguugugaaacacuugcagagcaaacaaagcagaggcaagaa

SEQ ID NO: 676871 - RNA, 64 nt, Homo Sapiens
uuuuuuaaaaauggaguccugcuauuuuccacuccuugcagauaauacaaauucaguuugucag

SEQ ID NO: 676872 - RNA, 64 nt, Homo Sapiens
ggaaaaaaguuuuaaaaaagaaauugaaaauugccuugcagauauuuagguacaauggaguuuu

SEQ ID NO: 676873 - RNA, 64 nt, Homo Sapiens
ccagcgcuacggacuccucccaauucugacaucucuugcagacaauacuaugcucucuacacac

SEQ ID NO: 676874 - RNA, 64 nt, Homo Sapiens
aaggaagcgacccagaaauggcagggacacuucucuugcagaccaagagggacccuggagcacc

SEQ ID NO: 676875 - RNA, 64 nt, Homo Sapiens
gugcggcaagcccagcuggucaggaaagagaauacuugcagagggguucagguuccucuuuuuc

SEQ ID NO: 676876 - RNA, 64 nt, Homo Sapiens
cuguggcuugcauuuccuacagaauugauuacuccuugcagagcggggcaguggcagugugcaa

SEQ ID NO: 676877 - RNA, 64 nt, Homo Sapiens
ugggcccaucaagagcuacucccucucccagcaccuugcagacugcuaaccacacaggccauuc

SEQ ID NO: 676878 - RNA, 60 nt, Homo Sapiens
ccugaguugccgccgagaagccuacaucaaaugcucaagcagugaggccauagcaacucc

SEQ ID NO: 676879 - RNA, 60 nt, Homo Sapiens
ccccagcuggaaguuaagagccuacaucaaaugcucaagcagugaggccauagcaauucc

SEQ ID NO: 676880 - RNA, 60 nt, Homo Sapiens
cccuuguauaaaauggcauaaaaucugaggaugcucaaguaggauccuccacugauggua

SEQ ID NO: 676881 - RNA, 60 nt, Homo Sapiens
ugccauaucuucaaccaguaauacuuuuggaugcucaaaaacaucauucuauaagucagu

SEQ ID NO: 676882 - RNA, 60 nt, Homo Sapiens
ccaagcauaauaaauuuuauaauguguuucaugcucaauuagaaaauucauuuuugagaa

SEQ ID NO: 676883 - RNA, 64 nt, Homo Sapiens; identical to SEQ ID NO: 368838

SEQ ID NO: 676884 - RNA, 64 nt, Homo Sapiens; identical to SEQ ID NO: 368839

SEQ ID NO: 676885 - RNA, 64 nt, Homo Sapiens; identical to SEQ ID NO: 368840

SEQ ID NO: 676886 - RNA, 64 nt, Homo Sapiens; identical to SEQ ID NO: 368841

SEQ ID NO: 676887 - RNA, 64 nt, Homo Sapiens; identical to SEQ ID NO: 368842

SEQ ID NO: 676888 - RNA, 64 nt, Homo Sapiens; identical to SEQ ID NO: 368843

SEQ ID NO: 676889 - RNA, 64 nt, Homo Sapiens; identical to SEQ ID NO: 368844

SEQ ID NO: 676890 - RNA, 64 nt, Homo Sapiens; identical to SEQ ID NO: 368845

SEQ ID NO: 676891 - RNA, 64 nt, Homo Sapiens; identical to SEQ ID NO: 368846

SEQ ID NO: 676892 - RNA, 64 nt, Homo Sapiens; identical to SEQ ID NO: 368847

SEQ ID NO: 676893 - RNA, 64 nt, Homo Sapiens; identical to SEQ ID NO: 368848

SEQ ID NO: 676894 - RNA, 64 nt, Homo Sapiens; identical to SEQ ID NO: 368849

SEQ ID NO: 676895 - RNA, 64 nt, Homo Sapiens; identical to SEQ ID NO: 368850

SEQ ID NO: 676896 - RNA, 64 nt, Homo Sapiens; identical to SEQ ID NO: 368851

SEQ ID NO: 676897 - RNA, 64 nt, Homo Sapiens; identical to SEQ ID NO: 368852

SEQ ID NO: 676898 - RNA, 64 nt, Homo Sapiens; identical to SEQ ID NO: 368853

SEQ ID NO: 676899 - RNA, 64 nt, Homo Sapiens; identical to SEQ ID NO: 368854

SEQ ID NO: 676900 - RNA, 64 nt, Homo Sapiens; identical to SEQ ID NO: 368855

SEQ ID NO: 676901 - RNA, 64 nt, Homo Sapiens; identical to SEQ ID NO: 368856

SEQ ID NO: 676902 - RNA, 64 nt, Homo Sapiens; identical to SEQ ID NO: 368857

SEQ ID NO: 676903 - RNA, 64 nt, Homo Sapiens; identical to SEQ ID NO: 368858

SEQ ID NO: 676904 - RNA, 64 nt, Homo Sapiens; identical to SEQ ID NO: 368859

SEQ ID NO: 676905 - RNA, 64 nt, Homo Sapiens; identical to SEQ ID NO: 368860

SEQ ID NO: 676906 - RNA, 64 nt, Homo Sapiens; identical to SEQ ID NO: 368861

SEQ ID NO: 676907 - RNA, 64 nt, Homo Sapiens
gaacuauaauuuuuaaguuauaguaauuuaacuucaucaugaauugggggucuuacucaaguac

SEQ ID NO: 676908 - RNA, 64 nt, Homo Sapiens
uccuacucauaacauaaaucgaaucugacuggcucaucaugacagaacuauaaauaaauaucua

SEQ ID NO: 676909 - RNA, 64 nt, Homo Sapiens
uucguucuaaaagugaaucaaaagacaagcaauccaucaugaaaucaucuaugaauucaucaug

SEQ ID NO: 676910 - RNA, 64 nt, Homo Sapiens
gacaagcaauccaucaugaagucaucuaugaauucaucaugaaagcaauuuaagaaauaggaaa

SEQ ID NO: 676911 - RNA, 64 nt, Homo Sapiens
aaauaccagcaguaucuaucaauccugcaaaagacaucaugagagaaaugccauauaugauaca

SEQ ID NO: 676912 - RNA, 64 nt, Homo Sapiens
agcugccaugauucuguggugcuuuaccuucuggcaucaugaaaccaccucuguauucccccgu

SEQ ID NO: 676913 - RNA, 64 nt, Homo Sapiens
uccaugcagcucuuugacaacaaaaggaugagaacaucaugaggaggaauucauugagucuugu

SEQ ID NO: 676914 - RNA, 64 nt, Homo Sapiens
uccaucuaugacaugauggggaggaaaugcuugacaucaugaagaggacggcugcaucaccaag

SEQ ID NO: 676915 - RNA, 64 nt, Homo Sapiens
aacagaaaagcaguagaauccaaaaagcacagugcaucaugagcuguccauuucuagccucuuu

SEQ ID NO: 676916 - RNA, 64 nt, Homo Sapiens
agacgagaaccgucuuuacccugaagguaacccccaucaugacugaaggcacacuucuuuuggu

SEQ ID NO: 676917 - RNA, 64 nt, Homo Sapiens
uuaacuucccgccgucgccuugccucaugcucaccaucaugaggguggagcaguggcauuucca

SEQ ID NO: 676918 - RNA, 64 nt, Homo Sapiens
cacugcagccuugaccucccgagugcaguggugccaucaugacuucucacugucacccaggcug

SEQ ID NO: 676919 - RNA, 64 nt, Homo Sapiens; identical to SEQ ID NO: 85370

SEQ ID NO: 676920 - RNA, 64 nt, Homo Sapiens; identical to SEQ ID NO: 85371

SEQ ID NO: 676921 - RNA, 64 nt, Homo Sapiens; identical to SEQ ID NO: 85372

SEQ ID NO: 676922 - RNA, 64 nt, Homo Sapiens; identical to SEQ ID NO: 85373

SEQ ID NO: 676923 - RNA, 64 nt, Homo Sapiens; identical to SEQ ID NO: 85374

SEQ ID NO: 676924 - RNA, 64 nt, Homo Sapiens; identical to SEQ ID NO: 85375

SEQ ID NO: 676925 - RNA, 64 nt, Homo Sapiens; identical to SEQ ID NO: 85376

SEQ ID NO: 676926 - RNA, 64 nt, Homo Sapiens; identical to SEQ ID NO: 85377

SEQ ID NO: 676927 - RNA, 64 nt, Homo Sapiens; identical to SEQ ID NO: 85378

SEQ ID NO: 676928 - RNA, 64 nt, Homo Sapiens; identical to SEQ ID NO: 85379

SEQ ID NO: 676929 - RNA, 64 nt, Homo Sapiens; identical to SEQ ID NO: 85380

SEQ ID NO: 676930 - RNA, 64 nt, Homo Sapiens; identical to SEQ ID NO: 85381

SEQ ID NO: 676931 - RNA, 64 nt, Homo Sapiens; identical to SEQ ID NO: 85382

SEQ ID NO: 676932 - RNA, 64 nt, Homo Sapiens; identical to SEQ ID NO: 85383

SEQ ID NO: 676933 - RNA, 64 nt, Homo Sapiens; identical to SEQ ID NO: 85384

SEQ ID NO: 676934 - RNA, 64 nt, Homo Sapiens; identical to SEQ ID NO: 85385

SEQ ID NO: 676935 - RNA, 64 nt, Homo Sapiens; identical to SEQ ID NO: 85386

SEQ ID NO: 676936 - RNA, 61 nt, Homo Sapiens
agaccugcacagaugaaggagcagagguucugaccgagaggcugagccaggccggggucug

SEQ ID NO: 676937 - RNA, 61 nt, Homo Sapiens
uccaucaccauucaccccaggggacagccucgaccgagacaaggaggcccuuaaaugacag

SEQ ID NO: 676938 - RNA, 61 nt, Homo Sapiens
ugugugugugugugcgcgcgcgccagugcaagaccgagauugagggaaagcaugucugcug

SEQ ID NO: 676939 - RNA, 61 nt, Homo Sapiens
uauuuauuggccaggaaguuggugcugcuaagaccgagaaauuuaaagaaucggacagaug

SEQ ID NO: 676940 - RNA, 61 nt, Homo Sapiens
gagugggagggagacgcaguagacagagacagaccgagagaggaauggagagacagagggg

SEQ ID NO: 676941 - RNA, 61 nt, Homo Sapiens
uuuuaagaggauagaauacauauugcacugugaccgagaacuggagcuacugcaaaugcua

SEQ ID NO: 676942 - RNA, 61 nt, Homo Sapiens
cagggugagagauucuaacgugcacagaucagaccgagaagggcucagaagagacugagcu

SEQ ID NO: 676943 - RNA, 61 nt, Homo Sapiens
ggagcaagacuucuaacggcugauugguauggaccgagauuaucuuucaauugaagugacu

SEQ ID NO: 676944 - RNA, 61 nt, Homo Sapiens
ugugccacugcacacuccaaucugggugaaagaccgagacuccgccucaaaaaaaaaaaaa

SEQ ID NO: 676945 - RNA, 61 nt, Homo Sapiens
cuuacuguacuggaaacgucaccggaaucaggaccgagagcccuaaauaagucacacagca

SEQ ID NO: 676946 - RNA, 61 nt, Homo Sapiens
cugugcggagcuggugcugccugaaaccccagaccgagaaguugaugcucggcccacgccg

SEQ ID NO: 676947 - RNA, 61 nt, Homo Sapiens
uuaucugugugucugacagugugagauguuagaccgagagaaaagcaaacaaauaaaucac

SEQ ID NO: 676948 - RNA, 59 nt, Homo Sapiens
gcauccuagucucuaucauuaaaguucuagugaccgagacccgggcugcguucucuggg

SEQ ID NO: 676949 - RNA, 61 nt, Homo Sapiens
cugccacaggaccugagacauugugguaagugaccgagaugguuugaaacucauuguuucc

SEQ ID NO: 676950 - RNA, 61 nt, Homo Sapiens
uuccaaagcaaaagaggaagccagaccuugggaccgagaacugagaaucacaagggaguug

SEQ ID NO: 676951 - RNA, 61 nt, Homo Sapiens
gaucgccccacugcacuccagccuggcaauagaccgagacuccgucuccaaaaaaaaaaaa

SEQ ID NO: 676952 - RNA, 61 nt, Homo Sapiens
agaaaugagaagaaggaacagagccugugaggaccgagaggugggcgagcugggcugggga

SEQ ID NO: 676953 - RNA, 61 nt, Homo Sapiens
cggcguaucacacacaucucgacagcaacaagaccgagaacuccucagccggggccgucca

SEQ ID NO: 676954 - RNA, 61 nt, Homo Sapiens
cugucucaaaaaaauaaaaagccugaugacagaccgagacagagcgugccgcuacacucca

SEQ ID NO: 676955 - RNA, 61 nt, Homo Sapiens
gacucaggacuuggacgccauaguggcccgggaccgagaccuucagcaguugaggcugggg

SEQ ID NO: 676956 - RNA, 61 nt, Homo Sapiens
ccgucucaaaaaaaaaaaaaccugggcgacagaccgagacuaucgcaccacugcacuccag

SEQ ID NO: 676957 - RNA, 61 nt, Homo Sapiens
uuuuaaaaauccccuucacacuuaauguacugaccgagacagaaguaccugaaaacagcug

SEQ ID NO: 676958 - RNA, 61 nt, Homo Sapiens
gccacggaagccuggggaugagagcuccugugaccgagagcucaagaggaaccauuggccu

SEQ ID NO: 676959 - RNA, 61 nt, Homo Sapiens
cggugggacacuccccuucuccgacagcagcgaccgagaccuguauaccguaucuaucuac

SEQ ID NO: 676960 - RNA, 61 nt, Homo Sapiens
auuggcccuaaauagcagaaagaagagaagugaccgagagaaccucagauucuucauugag

SEQ ID NO: 676961 - RNA, 61 nt, Homo Sapiens
gaggagguggagcugcagcugggacugugaggaccgagaagcaauggcccagcagacgaga

SEQ ID NO: 676962 - RNA, 61 nt, Homo Sapiens
guacauuggacaccugacaacccucugccaugaccgagacccccugauccuccguggacuc

SEQ ID NO: 676963 - RNA, 61 nt, Homo Sapiens
uacaaaaaggaauauuucccaaaccucuucagaccgagaaugcauggguaaaauuauuaaa

SEQ ID NO: 676964 - RNA, 61 nt, Homo Sapiens
uuaagauugcugugagcuuuaucagauaagagaccgagagaaguaagcugggucuuguuau

SEQ ID NO: 676965 - RNA, 61 nt, Homo Sapiens
caggccugggccucugcaacugcccugacaggaccgagaggccuugccccuccaccuggug

SEQ ID NO: 676966 - RNA, 61 nt, Homo Sapiens
cacauccucucacucacuucugggguugcaggaccgagaccgcguccaccugggaggcauu

SEQ ID NO: 676967 - RNA, 61 nt, Homo Sapiens
aacacucugccuaacuaucacuguaacgccagaccgagacgacacuccguaaacagcccag

SEQ ID NO: 676968 - RNA, 61 nt, Homo Sapiens
caccuucuggcaaauucaagaggcaugaguggaccgagagcacauccagcauuugcaucac

SEQ ID NO: 676969 - RNA, 61 nt, Homo Sapiens
ccuagcuucuggauccaggugaugaaugcuggaccgagagcccaugugauguccaccagug

SEQ ID NO: 676970 - RNA, 61 nt, Homo Sapiens
augaguggggugugccucguguguaaccagagaccgagagcggaguagggggggugugggu

SEQ ID NO: 676971 - RNA, 61 nt, Homo Sapiens
gaagauuggcuacuguaaagcccgggaaaacgaccgagaccaaaucuucuucagaggauca

SEQ ID NO: 676972 - RNA, 61 nt, Homo Sapiens
cucgauuacuggggacccaacuggagcgggugaccgagaucagauggccaccauccucaau

SEQ ID NO: 676973 - RNA, 61 nt, Homo Sapiens
ggaacuuacugacuguaagagguuagagguggaccgagaaggacuuuucccagucuucagu

SEQ ID NO: 676974 - RNA, 61 nt, Homo Sapiens
ccaggcgguuucacgccccacacuuuguacagaccgagaggccaguugaucugcucuguuu

SEQ ID NO: 676975 - RNA, 61 nt, Homo Sapiens
ggcccaacucuaaaguggaagaaccuuguuagaccgagagcuugccauccagccaagcugc

SEQ ID NO: 676976 - RNA, 61 nt, Homo Sapiens
gauggagggggcgaguaggguggcgauaaaggaccgagauagacagccucccagccagggc

SEQ ID NO: 676977 - RNA, 61 nt, Homo Sapiens
ugaguccuguugaagacuucgaggaggccuggaccgagauggauggacuuguauagugaga

SEQ ID NO: 676978 - RNA, 61 nt, Homo Sapiens
caguugcagggaggguagauggccccacccagaccgagagacacagugaugaccucagccu

SEQ ID NO: 676979 - RNA, 61 nt, Homo Sapiens
ccuuggaagaguccggccuggccucccccaggaccgagaucaccgcccaguaugggcuaga

SEQ ID NO: 676980 - RNA, 61 nt, Homo Sapiens
ucagauaguugcuguuuuguguuaaggaagggaccgagagauauccccuucuuuuuauggg

SEQ ID NO: 676981 - RNA, 61 nt, Homo Sapiens
guggagagugcggcgugggguggccccagaggaccgagagaaccccacccgguggggcccu

SEQ ID NO: 676982 - RNA, 61 nt, Homo Sapiens
ggucaucagcccagggcuucccuugcagcgugaccgagauaccaacccuccugcauccuug

SEQ ID NO: 676983 - RNA, 61 nt, Homo Sapiens
uagggacucagccacuugcagaacaggaugggaccgagauuucagcgagcccuccuggcgc

SEQ ID NO: 676984 - RNA, 61 nt, Homo Sapiens
aggccgaggcgagcagaucacgaggucaggagaccgagaccauccuggcuaacauggugaa

SEQ ID NO: 676985 - RNA, 61 nt, Homo Sapiens
cggucagaacugugugacucacuugaggcaggaccgagagugacauccaguugcaccuuuc

SEQ ID NO: 676986 - RNA, 61 nt, Homo Sapiens
guuccuaugacaggcccacucaaccugggcagaccgagaggcccgugcacuuuggaauggg

SEQ ID NO: 676987 - RNA, 61 nt, Homo Sapiens
gagagggagaccccauuccaaucaugguggggaccgagauacugucggaccuucacuucac

SEQ ID NO: 676988 - RNA, 61 nt, Homo Sapiens
ccuuccuagaguguuuggucggguucacagugaccgagagucagguccagcacacaccugg

SEQ ID NO: 676989 - RNA, 61 nt, Homo Sapiens
caguucaauuaacuguauaggucuuucauuagaccgagacaucacuagaaauucugggcac

SEQ ID NO: 676990 - RNA, 64 nt, Homo Sapiens
cacggaacucuguuucuaaggguguacaaaaauuugcccuuauguaaaauauguaugaagaaaa

SEQ ID NO: 676991 - RNA, 64 nt, Homo Sapiens
ucuccauuuuuaucaaauaguauacccuucuaccugcccuuagaggaauugcagaugggucuuc

SEQ ID NO: 676992 - RNA, 64 nt, Homo Sapiens
ccccuguaugacccuaugcaucuagaacuagcucugcccuuagcugggaaggcagacaccuggu

SEQ ID NO: 676993 - RNA, 64 nt, Homo Sapiens
ugcuguaugcuuuuuugccaugaccaucuccaucugcccuuaaacacaccucuccccucaaccu

SEQ ID NO: 676994 - RNA, 64 nt, Homo Sapiens
ggaugacucucagaggacauuuguggguuucuuuugcccuuacuaaacacaccucaugaucauc

SEQ ID NO: 676995 - RNA, 64 nt, Homo Sapiens
uugguaugacuuauugacaauuuaaggugggguaugcccuuaaucucgagaauucaaagggaca

SEQ ID NO: 676996 - RNA, 64 nt, Homo Sapiens
cauuugaugauucuggauuuuugcuguuuguuauugcccuuagaggggcucugaguaucuacuu

SEQ ID NO: 676997 - RNA, 64 nt, Homo Sapiens
ugaaguuauauagccuugaaaacucagugcagguugcccuuaauuuuccccaaaccccuccauc

SEQ ID NO: 676998 - RNA, 64 nt, Homo Sapiens
gaggugcgucccccguugugccugguucgugccaugcccuuacacgugcgugugagugugugug

SEQ ID NO: 676999 - RNA, 64 nt, Homo Sapiens
ccaagccacuagcccacuccccaguuggcccuucugcccuuaccccacacacaguccaacucuu

SEQ ID NO: 677000 - RNA, 64 nt, Homo Sapiens
ggaaugauuuucaaccuuucgugcauuugucaucugcccuuaaauaccuguaauuccagucuuu

SEQ ID NO: 677001 - RNA, 64 nt, Homo Sapiens
cuucauuuaugaagugaauugaucaugucuccccugcccuuaguuuacuaucaaccuaauuuca

SEQ ID NO: 677002 - RNA, 64 nt, Homo Sapiens
ugccgcucuguggccuugcccuguaaucacucagugcccuuagcuagccugacuaagucccaga

SEQ ID NO: 677003 - RNA, 64 nt, Homo Sapiens
ggucucucuugacuaccucguccaaagagagcacugcccuuagacaagaguugcuuguccugcu

SEQ ID NO: 677004 - RNA, 64 nt, Homo Sapiens
gacagugcuggagacauaguuggggguggagaacugcccuuauggagcuugcaguccagugagg

SEQ ID NO: 677005 - RNA, 64 nt, Homo Sapiens
accccagcccagaucugaauggcaugggaggugcugcccuuaaccaugacaccauuguaagagc

SEQ ID NO: 677006 - RNA, 64 nt, Homo Sapiens
gauacaccuaccuuauaggaggucgcagaaucaaugcccuuacuguuauucugaucucuguuaa

SEQ ID NO: 677007 - RNA, 64 nt, Homo Sapiens
uaacuuuguccugcuucccagaaagaaaagaacgugcccuuaacuaauguccaaguaauccuug

SEQ ID NO: 677008 - RNA, 59 nt, Homo Sapiens
cauugggcuccccagccggaacugguuaccaaggacaaggacacucugacauucggcuu

SEQ ID NO: 677009 - RNA, 59 nt, Homo Sapiens
gcuccccagccggaacugguuaccaaggacaaggacacucugacauucggcuugaucca

SEQ ID NO: 677010 - RNA, 59 nt, Homo Sapiens
cacacaggcacugccccaggacaacacaacaaggacagucacaacaaggacaacaagga

SEQ ID NO: 677011 - RNA, 59 nt, Homo Sapiens
ccaggacaacacaacaaggacagucacaacaaggacaacaaggacacaacacaacacac

SEQ ID NO: 677012 - RNA, 59 nt, Homo Sapiens
cacaacaaggacagucacaacaaggacaacaaggacacaacacaacacacaacaaggac

SEQ ID NO: 677013 - RNA, 59 nt, Homo Sapiens
ggacaacaaggacacaacacaacacacaacaaggacagucacaacaagccuagagccag

SEQ ID NO: 677014 - RNA, 59 nt, Homo Sapiens
uuccugcuacuaagacaugcugacaaaaacaaggacaaacgucuccaccaaccuuugug

SEQ ID NO: 677015 - RNA, 59 nt, Homo Sapiens
cuuggcuggcuccccauccaucuguacuucaaggacagcuuccgcagagaccagagauc

SEQ ID NO: 677016 - RNA, 59 nt, Homo Sapiens
gaaggcguccauccauucaucucauuggccaaggacaaacucuccucugggacgucugg

SEQ ID NO: 677017 - RNA, 59 nt, Homo Sapiens
acagggaccuucaaaccucgacagugaugcaaggacacagagaguaccagauagguagc

SEQ ID NO: 677018 - RNA, 59 nt, Homo Sapiens
aacgugcucaaguucaucggggugcucuacaaggacaagaggcucaacuucaucacuga

SEQ ID NO: 677019 - RNA, 59 nt, Homo Sapiens
uacccauggagccagagagugagcuuugccaaggacaucgcaucagggauggugaguga

SEQ ID NO: 677020 - RNA, 59 nt, Homo Sapiens
acaaguggauucagacugaacccccaguacaaggacauuguuuugaacuagguggacau

SEQ ID NO: 677021 - RNA, 59 nt, Homo Sapiens
caguugcuguguugaguucucuuuaaaaacaaggacaaaaccaaccagcguucaaagga

SEQ ID NO: 677022 - RNA, 59 nt, Homo Sapiens
agacaguggugauggccaucgaaaaaggacaaggacaugacuuaagauagccacaauca

SEQ ID NO: 677023 - RNA, 59 nt, Homo Sapiens
guggggucuggguccccagauggagaugacaaggacacuagggcuuggagcucgggugg

SEQ ID NO: 677024 - RNA, 59 nt, Homo Sapiens
caagaggaauuuucccucggccuuacugacaaggacaccaaccuagggugcaaacagau

SEQ ID NO: 677025 - RNA, 59 nt, Homo Sapiens
ccuagggugcaaacagauggacuaugguucaaggacacuggaauugaggagcugaucaa

SEQ ID NO: 677026 - RNA, 59 nt, Homo Sapiens
gaaaaaggaagagaaaaaguuugauaugccaaggacagauuuugaaacagacuugguaa

SEQ ID NO: 677027 - RNA, 59 nt, Homo Sapiens
gcuaauaauauuugaaggagauugccuaccaaggacaaaacaauaaauuuaaaaaucaa

SEQ ID NO: 677028 - RNA, 59 nt, Homo Sapiens
ugcagcuucuucuucgagucggagagcuacaaggacagcguccaggguagggugagagg

SEQ ID NO: 677029 - RNA, 59 nt, Homo Sapiens
agagaaguugagaggacccaugaaggaagcaaggacacggggcaggcaccuggauguug

SEQ ID NO: 677030 - RNA, 59 nt, Homo Sapiens
uuguacuuccgugggcccuccuuccagaacaaggacaacaaggacaagguugaaggguc

SEQ ID NO: 677031 - RNA, 59 nt, Homo Sapiens
cgugggcccuccuuccagaacaaggacaacaaggacaagguugaagggucuucucaucu

SEQ ID NO: 677032 - RNA, 59 nt, Homo Sapiens
gccggggcggccccagcggggaggaggagcaaggacauguaccaugccagcaagagugc

SEQ ID NO: 677033 - RNA, 59 nt, Homo Sapiens
accugccagugucuugggcauuuccuuggcaaggacauuaaagugauuucaucacagug

SEQ ID NO: 677034 - RNA, 64 nt, Homo Sapiens; identical to SEQ ID NO: 163826

SEQ ID NO: 677035 - RNA, 64 nt, Homo Sapiens; identical to SEQ ID NO: 163827

SEQ ID NO: 677036 - RNA, 64 nt, Homo Sapiens; identical to SEQ ID NO: 163828

SEQ ID NO: 677037 - RNA, 64 nt, Homo Sapiens; identical to SEQ ID NO: 163829

SEQ ID NO: 677038 - RNA, 64 nt, Homo Sapiens; identical to SEQ ID NO: 163830

SEQ ID NO: 677039 - RNA, 64 nt, Homo Sapiens; identical to SEQ ID NO: 163831

SEQ ID NO: 677040 - RNA, 64 nt, Homo Sapiens; identical to SEQ ID NO: 163832

SEQ ID NO: 677041 - RNA, 64 nt, Homo Sapiens; identical to SEQ ID NO: 163833

SEQ ID NO: 677042 - RNA, 64 nt, Homo Sapiens; identical to SEQ ID NO: 163834

SEQ ID NO: 677043 - RNA, 64 nt, Homo Sapiens; identical to SEQ ID NO: 163835

SEQ ID NO: 677044 - RNA, 64 nt, Homo Sapiens; identical to SEQ ID NO: 163836

SEQ ID NO: 677045 - RNA, 64 nt, Homo Sapiens; identical to SEQ ID NO: 163837

SEQ ID NO: 677046 - RNA, 64 nt, Homo Sapiens; identical to SEQ ID NO: 163838

SEQ ID NO: 677047 - RNA, 64 nt, Homo Sapiens; identical to SEQ ID NO: 163839

SEQ ID NO: 677048 - RNA, 64 nt, Homo Sapiens; identical to SEQ ID NO: 163840

SEQ ID NO: 677049 - RNA, 64 nt, Homo Sapiens; identical to SEQ ID NO: 163841

SEQ ID NO: 677050 - RNA, 64 nt, Homo Sapiens; identical to SEQ ID NO: 163842

SEQ ID NO: 677051 - RNA, 64 nt, Homo Sapiens; identical to SEQ ID NO: 163843

SEQ ID NO: 677052 - RNA, 64 nt, Homo Sapiens; identical to SEQ ID NO: 163844

SEQ ID NO: 677053 - RNA, 64 nt, Homo Sapiens; identical to SEQ ID NO: 163845

SEQ ID NO: 677054 - RNA, 64 nt, Homo Sapiens; identical to SEQ ID NO: 163846

SEQ ID NO: 677055 - RNA, 64 nt, Homo Sapiens; identical to SEQ ID NO: 163847

SEQ ID NO: 677056 - RNA, 64 nt, Homo Sapiens; identical to SEQ ID NO: 163848

SEQ ID NO: 677057 - RNA, 64 nt, Homo Sapiens; identical to SEQ ID NO: 163849

SEQ ID NO: 677058 - RNA, 64 nt, Homo Sapiens; identical to SEQ ID NO: 163850

SEQ ID NO: 677059 - RNA, 64 nt, Homo Sapiens; identical to SEQ ID NO: 163851

SEQ ID NO: 677060 - RNA, 64 nt, Homo Sapiens; identical to SEQ ID NO: 163852

SEQ ID NO: 677061 - RNA, 64 nt, Homo Sapiens; identical to SEQ ID NO: 163853

SEQ ID NO: 677062 - RNA, 64 nt, Homo Sapiens; identical to SEQ ID NO: 163854

SEQ ID NO: 677063 - RNA, 64 nt, Homo Sapiens; identical to SEQ ID NO: 163855

SEQ ID NO: 677064 - RNA, 64 nt, Homo Sapiens; identical to SEQ ID NO: 163856

SEQ ID NO: 677065 - RNA, 64 nt, Homo Sapiens; identical to SEQ ID NO: 163857

SEQ ID NO: 677066 - RNA, 64 nt, Homo Sapiens; identical to SEQ ID NO: 163858

SEQ ID NO: 677067 - RNA, 64 nt, Homo Sapiens; identical to SEQ ID NO: 163859

SEQ ID NO: 677068 - RNA, 64 nt, Homo Sapiens; identical to SEQ ID NO: 163860

SEQ ID NO: 677069 - RNA, 64 nt, Homo Sapiens; identical to SEQ ID NO: 163861

SEQ ID NO: 677070 - RNA, 64 nt, Homo Sapiens; identical to SEQ ID NO: 163862

SEQ ID NO: 677071 - RNA, 64 nt, Homo Sapiens; identical to SEQ ID NO: 163863

SEQ ID NO: 677072 - RNA, 64 nt, Homo Sapiens; identical to SEQ ID NO: 163864

SEQ ID NO: 677073 - RNA, 64 nt, Homo Sapiens; identical to SEQ ID NO: 163865

SEQ ID NO: 677074 - RNA, 64 nt, Homo Sapiens; identical to SEQ ID NO: 163866

SEQ ID NO: 677075 - RNA, 64 nt, Homo Sapiens; identical to SEQ ID NO: 163867

SEQ ID NO: 677076 - RNA, 64 nt, Homo Sapiens; identical to SEQ ID NO: 163868

SEQ ID NO: 677077 - RNA, 64 nt, Homo Sapiens; identical to SEQ ID NO: 163869

SEQ ID NO: 677078 - RNA, 64 nt, Homo Sapiens; identical to SEQ ID NO: 163870

SEQ ID NO: 677079 - RNA, 64 nt, Homo Sapiens; identical to SEQ ID NO: 163871

SEQ ID NO: 677080 - RNA, 64 nt, Homo Sapiens; identical to SEQ ID NO: 163872

SEQ ID NO: 677081 - RNA, 64 nt, Homo Sapiens; identical to SEQ ID NO: 163873

SEQ ID NO: 677082 - RNA, 64 nt, Homo Sapiens; identical to SEQ ID NO: 163874

SEQ ID NO: 677083 - RNA, 64 nt, Homo Sapiens; identical to SEQ ID NO: 163875

SEQ ID NO: 677084 - RNA, 64 nt, Homo Sapiens; identical to SEQ ID NO: 163876

SEQ ID NO: 677085 - RNA, 64 nt, Homo Sapiens; identical to SEQ ID NO: 163877

SEQ ID NO: 677086 - RNA, 64 nt, Homo Sapiens; identical to SEQ ID NO: 163878

SEQ ID NO: 677087 - RNA, 64 nt, Homo Sapiens; identical to SEQ ID NO: 163879

SEQ ID NO: 677088 - RNA, 64 nt, Homo Sapiens; identical to SEQ ID NO: 163880

SEQ ID NO: 677089 - RNA, 64 nt, Homo Sapiens; identical to SEQ ID NO: 163881

SEQ ID NO: 677090 - RNA, 64 nt, Homo Sapiens; identical to SEQ ID NO: 163882

SEQ ID NO: 677091 - RNA, 64 nt, Homo Sapiens; identical to SEQ ID NO: 163883

SEQ ID NO: 677092 - RNA, 64 nt, Homo Sapiens; identical to SEQ ID NO: 163884

SEQ ID NO: 677093 - RNA, 64 nt, Homo Sapiens; identical to SEQ ID NO: 163885

SEQ ID NO: 677094 - RNA, 64 nt, Homo Sapiens; identical to SEQ ID NO: 163886

SEQ ID NO: 677095 - RNA, 64 nt, Homo Sapiens; identical to SEQ ID NO: 163887

SEQ ID NO: 677096 - RNA, 64 nt, Homo Sapiens; identical to SEQ ID NO: 163888

SEQ ID NO: 677097 - RNA, 64 nt, Homo Sapiens; identical to SEQ ID NO: 163889

SEQ ID NO: 677098 - RNA, 64 nt, Homo Sapiens; identical to SEQ ID NO: 163890

SEQ ID NO: 677099 - RNA, 64 nt, Homo Sapiens; identical to SEQ ID NO: 163891

SEQ ID NO: 677100 - RNA, 64 nt, Homo Sapiens; identical to SEQ ID NO: 163892

SEQ ID NO: 677101 - RNA, 64 nt, Homo Sapiens; identical to SEQ ID NO: 163893

SEQ ID NO: 677102 - RNA, 64 nt, Homo Sapiens; identical to SEQ ID NO: 163894

SEQ ID NO: 677103 - RNA, 64 nt, Homo Sapiens; identical to SEQ ID NO: 163895

SEQ ID NO: 677104 - RNA, 64 nt, Homo Sapiens; identical to SEQ ID NO: 163896

SEQ ID NO: 677105 - RNA, 64 nt, Homo Sapiens; identical to SEQ ID NO: 163897

SEQ ID NO: 677106 - RNA, 64 nt, Homo Sapiens; identical to SEQ ID NO: 163898

SEQ ID NO: 677107 - RNA, 64 nt, Homo Sapiens; identical to SEQ ID NO: 163899

SEQ ID NO: 677108 - RNA, 64 nt, Homo Sapiens; identical to SEQ ID NO: 163900

SEQ ID NO: 677109 - RNA, 64 nt, Homo Sapiens; identical to SEQ ID NO: 163901

SEQ ID NO: 677110 - RNA, 64 nt, Homo Sapiens; identical to SEQ ID NO: 163902

SEQ ID NO: 677111 - RNA, 64 nt, Homo Sapiens; identical to SEQ ID NO: 163903

SEQ ID NO: 677112 - RNA, 64 nt, Homo Sapiens; identical to SEQ ID NO: 163904

SEQ ID NO: 677113 - RNA, 64 nt, Homo Sapiens; identical to SEQ ID NO: 163905

SEQ ID NO: 677114 - RNA, 64 nt, Homo Sapiens; identical to SEQ ID NO: 163906

SEQ ID NO: 677115 - RNA, 64 nt, Homo Sapiens; identical to SEQ ID NO: 163907

SEQ ID NO: 677116 - RNA, 64 nt, Homo Sapiens; identical to SEQ ID NO: 163908

SEQ ID NO: 677117 - RNA, 64 nt, Homo Sapiens; identical to SEQ ID NO: 163909

SEQ ID NO: 677118 - RNA, 64 nt, Homo Sapiens; identical to SEQ ID NO: 163910

SEQ ID NO: 677119 - RNA, 64 nt, Homo Sapiens; identical to SEQ ID NO: 163911

SEQ ID NO: 677120 - RNA, 64 nt, Homo Sapiens; identical to SEQ ID NO: 163912

SEQ ID NO: 677121 - RNA, 64 nt, Homo Sapiens; identical to SEQ ID NO: 163913

SEQ ID NO: 677122 - RNA, 64 nt, Homo Sapiens; identical to SEQ ID NO: 163914

SEQ ID NO: 677123 - RNA, 64 nt, Homo Sapiens; identical to SEQ ID NO: 163915

SEQ ID NO: 677124 - RNA, 64 nt, Homo Sapiens; identical to SEQ ID NO: 163916

SEQ ID NO: 677125 - RNA, 64 nt, Homo Sapiens; identical to SEQ ID NO: 163917

SEQ ID NO: 677126 - RNA, 64 nt, Homo Sapiens; identical to SEQ ID NO: 163918

SEQ ID NO: 677127 - RNA, 64 nt, Homo Sapiens; identical to SEQ ID NO: 163919

SEQ ID NO: 677128 - RNA, 64 nt, Homo Sapiens; identical to SEQ ID NO: 163920

SEQ ID NO: 677129 - RNA, 64 nt, Homo Sapiens; identical to SEQ ID NO: 163921

SEQ ID NO: 677130 - RNA, 64 nt, Homo Sapiens; identical to SEQ ID NO: 163922

SEQ ID NO: 677131 - RNA, 64 nt, Homo Sapiens; identical to SEQ ID NO: 163923

SEQ ID NO: 677132 - RNA, 64 nt, Homo Sapiens; identical to SEQ ID NO: 163924

SEQ ID NO: 677133 - RNA, 64 nt, Homo Sapiens; identical to SEQ ID NO: 163925

SEQ ID NO: 677134 - RNA, 64 nt, Homo Sapiens; identical to SEQ ID NO: 163926

SEQ ID NO: 677135 - RNA, 64 nt, Homo Sapiens; identical to SEQ ID NO: 163927

SEQ ID NO: 677136 - RNA, 64 nt, Homo Sapiens; identical to SEQ ID NO: 163928

SEQ ID NO: 677137 - RNA, 64 nt, Homo Sapiens; identical to SEQ ID NO: 163929

SEQ ID NO: 677138 - RNA, 64 nt, Homo Sapiens; identical to SEQ ID NO: 163930

SEQ ID NO: 677139 - RNA, 64 nt, Homo Sapiens; identical to SEQ ID NO: 163931

SEQ ID NO: 677140 - RNA, 64 nt, Homo Sapiens; identical to SEQ ID NO: 163932

SEQ ID NO: 677141 - RNA, 64 nt, Homo Sapiens; identical to SEQ ID NO: 163933

SEQ ID NO: 677142 - RNA, 64 nt, Homo Sapiens; identical to SEQ ID NO: 163934

SEQ ID NO: 677143 - RNA, 64 nt, Homo Sapiens; identical to SEQ ID NO: 163935

SEQ ID NO: 677144 - RNA, 64 nt, Homo Sapiens; identical to SEQ ID NO: 163936

SEQ ID NO: 677145 - RNA, 64 nt, Homo Sapiens; identical to SEQ ID NO: 163937

SEQ ID NO: 677146 - RNA, 64 nt, Homo Sapiens; identical to SEQ ID NO: 163938

SEQ ID NO: 677147 - RNA, 64 nt, Homo Sapiens; identical to SEQ ID NO: 163939

SEQ ID NO: 677148 - RNA, 64 nt, Homo Sapiens; identical to SEQ ID NO: 163940

SEQ ID NO: 677149 - RNA, 64 nt, Homo Sapiens
ccacagaguuaagugaccucaguugaaagccacagaguugaaagaucuuacacgaaagccacag

SEQ ID NO: 677150 - RNA, 64 nt, Homo Sapiens
ccacagaguugaaagccacaacacgaaagccacagaguugaaaguggcccuauaccgccaucuu

SEQ ID NO: 677151 - RNA, 64 nt, Homo Sapiens
gugcucuucuccccauuuuacaaaugagaaaucugaguugaaagagguuauaaaacucauucag

SEQ ID NO: 677152 - RNA, 64 nt, Homo Sapiens
aacucauucaggguugcucaguuaguaaguuauagaguugaaauuggagccaggccuaucugac

SEQ ID NO: 677153 - RNA, 64 nt, Homo Sapiens
agagcauggaguuuguuaagugcucucuggauuugaguugaagagcauccauuugaguugaagg

SEQ ID NO: 677154 - RNA, 64 nt, Homo Sapiens
ugcucucuggauuugaguugaagagcauccauuugaguugaaggccacagggcacaaugagcuc

SEQ ID NO: 677155 - RNA, 64 nt, Homo Sapiens
gcccugacuucugccucccucugaguggcacagggaguugaauacugcauggcgaguguaauga

SEQ ID NO: 677156 - RNA, 64 nt, Homo Sapiens
cauguagagaaaccaaacugggaaaucuuacaaggaguugaaaagauuaaugucccaaccugau

SEQ ID NO: 677157 - RNA, 64 nt, Homo Sapiens
aucacccucgcgcuaucuucacccuuaggauggugaguugaagcucgaguguguuuguacacaa

SEQ ID NO: 677158 - RNA, 64 nt, Homo Sapiens
ucccugacugauuucagccauuuuccagauuggagaguugaaagagagaaauaggggugguuau

SEQ ID NO: 677159 - RNA, 64 nt, Homo Sapiens
guacuccacaacaguaucuuagccuugcuguagggaguugaagaccuuauacuguggacgcagu

SEQ ID NO: 677160 - RNA, 64 nt, Homo Sapiens
agacaugaucucuacccuccgugcuuggaauacagaguugaauccccucuauuugucaggcucu

SEQ ID NO: 677161 - RNA, 64 nt, Homo Sapiens; identical to SEQ ID NO: 563739

SEQ ID NO: 677162 - RNA, 64 nt, Homo Sapiens; identical to SEQ ID NO: 563740

SEQ ID NO: 677163 - RNA, 64 nt, Homo Sapiens; identical to SEQ ID NO: 563741

SEQ ID NO: 677164 - RNA, 64 nt, Homo Sapiens; identical to SEQ ID NO: 563742

SEQ ID NO: 677165 - RNA, 64 nt, Homo Sapiens; identical to SEQ ID NO: 563743

SEQ ID NO: 677166 - RNA, 64 nt, Homo Sapiens; identical to SEQ ID NO: 563744

SEQ ID NO: 677167 - RNA, 64 nt, Homo Sapiens; identical to SEQ ID NO: 563745

SEQ ID NO: 677168 - RNA, 64 nt, Homo Sapiens; identical to SEQ ID NO: 563746

SEQ ID NO: 677169 - RNA, 64 nt, Homo Sapiens; identical to SEQ ID NO: 563747

SEQ ID NO: 677170 - RNA, 64 nt, Homo Sapiens; identical to SEQ ID NO: 563748

SEQ ID NO: 677171 - RNA, 64 nt, Homo Sapiens; identical to SEQ ID NO: 563749

SEQ ID NO: 677172 - RNA, 64 nt, Homo Sapiens; identical to SEQ ID NO: 563750

SEQ ID NO: 677173 - RNA, 64 nt, Homo Sapiens; identical to SEQ ID NO: 563751

SEQ ID NO: 677174 - RNA, 64 nt, Homo Sapiens; identical to SEQ ID NO: 563752

SEQ ID NO: 677175 - RNA, 64 nt, Homo Sapiens; identical to SEQ ID NO: 563753

SEQ ID NO: 677176 - RNA, 64 nt, Homo Sapiens; identical to SEQ ID NO: 563754

SEQ ID NO: 677177 - RNA, 64 nt, Homo Sapiens; identical to SEQ ID NO: 563755

SEQ ID NO: 677178 - RNA, 64 nt, Homo Sapiens; identical to SEQ ID NO: 563756

SEQ ID NO: 677179 - RNA, 64 nt, Homo Sapiens; identical to SEQ ID NO: 563757

SEQ ID NO: 677180 - RNA, 64 nt, Homo Sapiens; identical to SEQ ID NO: 563758

SEQ ID NO: 677181 - RNA, 64 nt, Homo Sapiens; identical to SEQ ID NO: 563759

SEQ ID NO: 677182 - RNA, 64 nt, Homo Sapiens; identical to SEQ ID NO: 563760

SEQ ID NO: 677183 - RNA, 64 nt, Homo Sapiens; identical to SEQ ID NO: 563761

SEQ ID NO: 677184 - RNA, 64 nt, Homo Sapiens; identical to SEQ ID NO: 563762

SEQ ID NO: 677185 - RNA, 64 nt, Homo Sapiens; identical to SEQ ID NO: 563763

SEQ ID NO: 677186 - RNA, 64 nt, Homo Sapiens; identical to SEQ ID NO: 563764

SEQ ID NO: 677187 - RNA, 64 nt, Homo Sapiens; identical to SEQ ID NO: 563765

SEQ ID NO: 677188 - RNA, 64 nt, Homo Sapiens; identical to SEQ ID NO: 563766

SEQ ID NO: 677189 - RNA, 64 nt, Homo Sapiens; identical to SEQ ID NO: 563767

SEQ ID NO: 677190 - RNA, 64 nt, Homo Sapiens; identical to SEQ ID NO: 563768

SEQ ID NO: 677191 - RNA, 64 nt, Homo Sapiens; identical to SEQ ID NO: 563769

SEQ ID NO: 677192 - RNA, 64 nt, Homo Sapiens; identical to SEQ ID NO: 563770

SEQ ID NO: 677193 - RNA, 64 nt, Homo Sapiens; identical to SEQ ID NO: 563771

SEQ ID NO: 677194 - RNA, 64 nt, Homo Sapiens; identical to SEQ ID NO: 563772

SEQ ID NO: 677195 - RNA, 64 nt, Homo Sapiens; identical to SEQ ID NO: 563773

SEQ ID NO: 677196 - RNA, 64 nt, Homo Sapiens; identical to SEQ ID NO: 563774

SEQ ID NO: 677197 - RNA, 64 nt, Homo Sapiens; identical to SEQ ID NO: 563775

SEQ ID NO: 677198 - RNA, 64 nt, Homo Sapiens; identical to SEQ ID NO: 563776

SEQ ID NO: 677199 - RNA, 64 nt, Homo Sapiens; identical to SEQ ID NO: 563777

SEQ ID NO: 677200 - RNA, 64 nt, Homo Sapiens; identical to SEQ ID NO: 563778

SEQ ID NO: 677201 - RNA, 64 nt, Homo Sapiens; identical to SEQ ID NO: 563779

SEQ ID NO: 677202 - RNA, 64 nt, Homo Sapiens; identical to SEQ ID NO: 563780

SEQ ID NO: 677203 - RNA, 64 nt, Homo Sapiens; identical to SEQ ID NO: 563781

SEQ ID NO: 677204 - RNA, 64 nt, Homo Sapiens; identical to SEQ ID NO: 563782

SEQ ID NO: 677205 - RNA, 64 nt, Homo Sapiens; identical to SEQ ID NO: 563783

SEQ ID NO: 677206 - RNA, 64 nt, Homo Sapiens; identical to SEQ ID NO: 563784

SEQ ID NO: 677207 - RNA, 64 nt, Homo Sapiens; identical to SEQ ID NO: 563785

SEQ ID NO: 677208 - RNA, 64 nt, Homo Sapiens; identical to SEQ ID NO: 563786

SEQ ID NO: 677209 - RNA, 64 nt, Homo Sapiens; identical to SEQ ID NO: 563787

SEQ ID NO: 677210 - RNA, 64 nt, Homo Sapiens; identical to SEQ ID NO: 563788

SEQ ID NO: 677211 - RNA, 64 nt, Homo Sapiens; identical to SEQ ID NO: 563789

SEQ ID NO: 677212 - RNA, 64 nt, Homo Sapiens; identical to SEQ ID NO: 563790

SEQ ID NO: 677213 - RNA, 64 nt, Homo Sapiens; identical to SEQ ID NO: 563791

SEQ ID NO: 677214 - RNA, 64 nt, Homo Sapiens; identical to SEQ ID NO: 563792

SEQ ID NO: 677215 - RNA, 64 nt, Homo Sapiens; identical to SEQ ID NO: 563793

SEQ ID NO: 677216 - RNA, 64 nt, Homo Sapiens; identical to SEQ ID NO: 563794

SEQ ID NO: 677217 - RNA, 64 nt, Homo Sapiens; identical to SEQ ID NO: 563795

SEQ ID NO: 677218 - RNA, 64 nt, Homo Sapiens; identical to SEQ ID NO: 563796

SEQ ID NO: 677219 - RNA, 64 nt, Homo Sapiens; identical to SEQ ID NO: 563797

SEQ ID NO: 677220 - RNA, 64 nt, Homo Sapiens; identical to SEQ ID NO: 563798

SEQ ID NO: 677221 - RNA, 64 nt, Homo Sapiens; identical to SEQ ID NO: 563799

SEQ ID NO: 677222 - RNA, 64 nt, Homo Sapiens; identical to SEQ ID NO: 563800

SEQ ID NO: 677223 - RNA, 64 nt, Homo Sapiens; identical to SEQ ID NO: 563801

SEQ ID NO: 677224 - RNA, 64 nt, Homo Sapiens; identical to SEQ ID NO: 563802

SEQ ID NO: 677225 - RNA, 64 nt, Homo Sapiens; identical to SEQ ID NO: 563803

SEQ ID NO: 677226 - RNA, 64 nt, Homo Sapiens; identical to SEQ ID NO: 563803

SEQ ID NO: 677227 - RNA, 64 nt, Homo Sapiens; identical to SEQ ID NO: 563803

SEQ ID NO: 677228 - RNA, 64 nt, Homo Sapiens; identical to SEQ ID NO: 563803

SEQ ID NO: 677229 - RNA, 64 nt, Homo Sapiens; identical to SEQ ID NO: 563807

SEQ ID NO: 677230 - RNA, 64 nt, Homo Sapiens; identical to SEQ ID NO: 563808

SEQ ID NO: 677231 - RNA, 64 nt, Homo Sapiens; identical to SEQ ID NO: 563809

SEQ ID NO: 677232 - RNA, 64 nt, Homo Sapiens; identical to SEQ ID NO: 563810

SEQ ID NO: 677233 - RNA, 64 nt, Homo Sapiens; identical to SEQ ID NO: 563811

SEQ ID NO: 677234 - RNA, 64 nt, Homo Sapiens; identical to SEQ ID NO: 563812

SEQ ID NO: 677235 - RNA, 64 nt, Homo Sapiens; identical to SEQ ID NO: 563813

SEQ ID NO: 677236 - RNA, 64 nt, Homo Sapiens; identical to SEQ ID NO: 563814

SEQ ID NO: 677237 - RNA, 64 nt, Homo Sapiens; identical to SEQ ID NO: 563815

SEQ ID NO: 677238 - RNA, 64 nt, Homo Sapiens; identical to SEQ ID NO: 563816

SEQ ID NO: 677239 - RNA, 64 nt, Homo Sapiens; identical to SEQ ID NO: 563817

SEQ ID NO: 677240 - RNA, 63 nt, Homo Sapiens
cauuccaaacucaccaagguggcuuauagaacagaagcagauggauaugaagaggagagggga

SEQ ID NO: 677241 - RNA, 63 nt, Homo Sapiens
gaagaaaagagggcaaagggaacaaugugaaaagaagcagaaaaucauaaaagaccauguguu

SEQ ID NO: 677242 - RNA, 63 nt, Homo Sapiens
ugaucacaucaccccgucauuguuguggagaaggaagcagaugcugcccgccagcccugcucu

SEQ ID NO: 677243 - RNA, 63 nt, Homo Sapiens
ucgcucgcacuggucagucgagaagacccaagagaagcagaaguccagcugucuucuaccacu

SEQ ID NO: 677244 - RNA, 63 nt, Homo Sapiens
gcagagcacacacuggcucauggcggggcuagggaagcagagagauguaagggaugagaagga

SEQ ID NO: 677245 - RNA, 63 nt, Homo Sapiens
gcagagcaugcagugauggaugguggaaccagggaagcagagagaggugaggaaacuuuuagg

SEQ ID NO: 677246 - RNA, 63 nt, Homo Sapiens
ugugacgaaaguggaaauggagaugguccugcagaagcagaagugcaauccagcccaugccga

SEQ ID NO: 677247 - RNA, 63 nt, Homo Sapiens
caaggugaagagauacagccuuccguauccaucgaagcagaugcucugaacccugagcaggca

SEQ ID NO: 677248 - RNA, 63 nt, Homo Sapiens
acccugcuccuaccaaucuuuuuuaaagcaguugaagcagaauguauaggugucagagaagaa

SEQ ID NO: 677249 - RNA, 63 nt, Homo Sapiens
ccaacuugccagccauguaagggagccaucuuggaagcagauccuccagccuccagucaaguc

SEQ ID NO: 677250 - RNA, 63 nt, Homo Sapiens
cugagcccauguuuucugcucaguagcagcuuggaagcagauuuggaaugguuuacuauuuug

SEQ ID NO: 677251 - RNA, 63 nt, Homo Sapiens
guuuacuauuuuggcugcucuuggggacugcgagaagcagagagaaugagagaccaguggcaa

SEQ ID NO: 677252 - RNA, 63 nt, Homo Sapiens
cugaagccggagagcugcggccgcucagccucagaagcagacuggagagaaagaggagcccuc

SEQ ID NO: 677253 - RNA, 63 nt, Homo Sapiens
gaggagaagagaagagccaagacagaagagugagaagcagaugcaccaugaggugcaaaacga

SEQ ID NO: 677254 - RNA, 63 nt, Homo Sapiens
ggagcugaguuuggcaacaacccaagugagccugaagcagauucgccccagagccuccaggcg

SEQ ID NO: 677255 - RNA, 63 nt, Homo Sapiens
ucuaacucuauacuguagagaugagucugguccgaagcagauuaguaauuuagagauaagcca

SEQ ID NO: 677256 - RNA, 63 nt, Homo Sapiens
cccagaugggccaaagaaagagccuaugaaggagaagcagaagcagacggcuggccuggcuca

SEQ ID NO: 677257 - RNA, 63 nt, Homo Sapiens
ugggccaaagaaagagccuaugaaggagaagcagaagcagacggcuggccuggcucaccuucc

SEQ ID NO: 677258 - RNA, 63 nt, Homo Sapiens
cacacacacacacacacacaugauuagaaaaaugaagcagacagcuuacaucaguuguuuguu

SEQ ID NO: 677259 - RNA, 63 nt, Homo Sapiens
ugcacuggaaccauugcuuucauuugucuucaugaagcagauuugaauuucauauuugagaga

SEQ ID NO: 677260 - RNA, 63 nt, Homo Sapiens
agcuuaucaacgaccgcuguguggacaugcagagaagcagagaagaagaaaggagcugaggag

SEQ ID NO: 677261 - RNA, 63 nt, Homo Sapiens
gaagcguuugaaggccaagaaccugauguaccugaagcagauccuguauuugcuggagaaauu

SEQ ID NO: 677262 - RNA, 63 nt, Homo Sapiens
uucucuaggauaagcuugugugguucugccagugaagcagagaaccaccugugcuguugugga

SEQ ID NO: 677263 - RNA, 63 nt, Homo Sapiens
aguuagccagacuguuuuuaaagcaccuggcgggaagcagaagguuggauccaagcccuuguu

SEQ ID NO: 677264 - RNA, 63 nt, Homo Sapiens
gugaccaggcucuggagaagcuucugccaacuggaagcagauggcuccccugugcuguuacuc

SEQ ID NO: 677265 - RNA, 63 nt, Homo Sapiens
ucggcgccgcugcucccgcccgaagccgaagccgaagcagagccgccugcaccgccgcgaagc

SEQ ID NO: 677266 - RNA, 63 nt, Homo Sapiens
ucuaggaaguugugcuugcuuuuaggcgaaauggaagcagaaaucauauacaaagccuguaau

SEQ ID NO: 677267 - RNA, 63 nt, Homo Sapiens
uagucauuuaugauuugaaagggugggaagggagaagcagacagagggaggaaaggguaggaa

SEQ ID NO: 677268 - RNA, 63 nt, Homo Sapiens
gaaaugcgcccgccuggcggacagcucccuucugaagcagagaagccuccauggucacgaagc

SEQ ID NO: 677269 - RNA, 63 nt, Homo Sapiens
aaagucugaguugggagugacaguggcuggagagaagcagaucugugcaacgugcagggcaag

SEQ ID NO: 677270 - RNA, 63 nt, Homo Sapiens
cacccugggacugcggccuuucccagcuuuauugaagcagaaugguggaacuugugccggagg

SEQ ID NO: 677271 - RNA, 63 nt, Homo Sapiens
cgugcgccuguagucccagcuacucgggaggcugaagcagaagaaucgcuugaacccgggagg

SEQ ID NO: 677272 - RNA, 63 nt, Homo Sapiens
gaucacacaacauuuauucuucuuacagguaaagaagcagauuuuagaugaaaagaucuacug

SEQ ID NO: 677273 - RNA, 63 nt, Homo Sapiens
cucgcagauggagcggcagcgccucgcucgagagaagcagaugagggaggaggcugaacgcac

SEQ ID NO: 677274 - RNA, 64 nt, Homo Sapiens; identical to SEQ ID NO: 563739

SEQ ID NO: 677275 - RNA, 64 nt, Homo Sapiens; identical to SEQ ID NO: 563740

SEQ ID NO: 677276 - RNA, 64 nt, Homo Sapiens; identical to SEQ ID NO: 563741

SEQ ID NO: 677277 - RNA, 64 nt, Homo Sapiens; identical to SEQ ID NO: 563742

SEQ ID NO: 677278 - RNA, 64 nt, Homo Sapiens; identical to SEQ ID NO: 563743

SEQ ID NO: 677279 - RNA, 64 nt, Homo Sapiens; identical to SEQ ID NO: 563744

SEQ ID NO: 677280 - RNA, 64 nt, Homo Sapiens; identical to SEQ ID NO: 563745

SEQ ID NO: 677281 - RNA, 64 nt, Homo Sapiens; identical to SEQ ID NO: 563746

SEQ ID NO: 677282 - RNA, 64 nt, Homo Sapiens; identical to SEQ ID NO: 563747

SEQ ID NO: 677283 - RNA, 64 nt, Homo Sapiens; identical to SEQ ID NO: 563748

SEQ ID NO: 677284 - RNA, 64 nt, Homo Sapiens; identical to SEQ ID NO: 563749

SEQ ID NO: 677285 - RNA, 64 nt, Homo Sapiens; identical to SEQ ID NO: 563750

SEQ ID NO: 677286 - RNA, 64 nt, Homo Sapiens; identical to SEQ ID NO: 563751

SEQ ID NO: 677287 - RNA, 64 nt, Homo Sapiens; identical to SEQ ID NO: 563752

SEQ ID NO: 677288 - RNA, 64 nt, Homo Sapiens; identical to SEQ ID NO: 563753

SEQ ID NO: 677289 - RNA, 64 nt, Homo Sapiens; identical to SEQ ID NO: 563754

SEQ ID NO: 677290 - RNA, 64 nt, Homo Sapiens; identical to SEQ ID NO: 563755

SEQ ID NO: 677291 - RNA, 64 nt, Homo Sapiens; identical to SEQ ID NO: 563756

SEQ ID NO: 677292 - RNA, 64 nt, Homo Sapiens; identical to SEQ ID NO: 563757

SEQ ID NO: 677293 - RNA, 64 nt, Homo Sapiens; identical to SEQ ID NO: 563758

SEQ ID NO: 677294 - RNA, 64 nt, Homo Sapiens; identical to SEQ ID NO: 563759

SEQ ID NO: 677295 - RNA, 64 nt, Homo Sapiens; identical to SEQ ID NO: 563760

SEQ ID NO: 677296 - RNA, 64 nt, Homo Sapiens; identical to SEQ ID NO: 563761

SEQ ID NO: 677297 - RNA, 64 nt, Homo Sapiens; identical to SEQ ID NO: 563762

SEQ ID NO: 677298 - RNA, 64 nt, Homo Sapiens; identical to SEQ ID NO: 563763

SEQ ID NO: 677299 - RNA, 64 nt, Homo Sapiens; identical to SEQ ID NO: 563764

SEQ ID NO: 677300 - RNA, 64 nt, Homo Sapiens; identical to SEQ ID NO: 563765

SEQ ID NO: 677301 - RNA, 64 nt, Homo Sapiens; identical to SEQ ID NO: 563766

SEQ ID NO: 677302 - RNA, 64 nt, Homo Sapiens; identical to SEQ ID NO: 563767

SEQ ID NO: 677303 - RNA, 64 nt, Homo Sapiens; identical to SEQ ID NO: 563768

SEQ ID NO: 677304 - RNA, 64 nt, Homo Sapiens; identical to SEQ ID NO: 563769

SEQ ID NO: 677305 - RNA, 64 nt, Homo Sapiens; identical to SEQ ID NO: 563770

SEQ ID NO: 677306 - RNA, 64 nt, Homo Sapiens; identical to SEQ ID NO: 563771

SEQ ID NO: 677307 - RNA, 64 nt, Homo Sapiens; identical to SEQ ID NO: 563772

SEQ ID NO: 677308 - RNA, 64 nt, Homo Sapiens; identical to SEQ ID NO: 563773

SEQ ID NO: 677309 - RNA, 64 nt, Homo Sapiens; identical to SEQ ID NO: 563774

SEQ ID NO: 677310 - RNA, 64 nt, Homo Sapiens; identical to SEQ ID NO: 563775

SEQ ID NO: 677311 - RNA, 64 nt, Homo Sapiens; identical to SEQ ID NO: 563776

SEQ ID NO: 677312 - RNA, 64 nt, Homo Sapiens; identical to SEQ ID NO: 563777

SEQ ID NO: 677313 - RNA, 64 nt, Homo Sapiens; identical to SEQ ID NO: 563778

SEQ ID NO: 677314 - RNA, 64 nt, Homo Sapiens; identical to SEQ ID NO: 563779

SEQ ID NO: 677315 - RNA, 64 nt, Homo Sapiens; identical to SEQ ID NO: 563780

SEQ ID NO: 677316 - RNA, 64 nt, Homo Sapiens; identical to SEQ ID NO: 563781

SEQ ID NO: 677317 - RNA, 64 nt, Homo Sapiens; identical to SEQ ID NO: 563782

SEQ ID NO: 677318 - RNA, 64 nt, Homo Sapiens; identical to SEQ ID NO: 563783

SEQ ID NO: 677319 - RNA, 64 nt, Homo Sapiens; identical to SEQ ID NO: 563784

SEQ ID NO: 677320 - RNA, 64 nt, Homo Sapiens; identical to SEQ ID NO: 563785

SEQ ID NO: 677321 - RNA, 64 nt, Homo Sapiens; identical to SEQ ID NO: 563786

SEQ ID NO: 677322 - RNA, 64 nt, Homo Sapiens; identical to SEQ ID NO: 563787

SEQ ID NO: 677323 - RNA, 64 nt, Homo Sapiens; identical to SEQ ID NO: 563788

SEQ ID NO: 677324 - RNA, 64 nt, Homo Sapiens; identical to SEQ ID NO: 563789

SEQ ID NO: 677325 - RNA, 64 nt, Homo Sapiens; identical to SEQ ID NO: 563790

SEQ ID NO: 677326 - RNA, 64 nt, Homo Sapiens; identical to SEQ ID NO: 563791

SEQ ID NO: 677327 - RNA, 64 nt, Homo Sapiens; identical to SEQ ID NO: 563792

SEQ ID NO: 677328 - RNA, 64 nt, Homo Sapiens; identical to SEQ ID NO: 563793

SEQ ID NO: 677329 - RNA, 64 nt, Homo Sapiens; identical to SEQ ID NO: 563794

SEQ ID NO: 677330 - RNA, 64 nt, Homo Sapiens; identical to SEQ ID NO: 563795

SEQ ID NO: 677331 - RNA, 64 nt, Homo Sapiens; identical to SEQ ID NO: 563796

SEQ ID NO: 677332 - RNA, 64 nt, Homo Sapiens; identical to SEQ ID NO: 563797

SEQ ID NO: 677333 - RNA, 64 nt, Homo Sapiens; identical to SEQ ID NO: 563798

SEQ ID NO: 677334 - RNA, 64 nt, Homo Sapiens; identical to SEQ ID NO: 563799

SEQ ID NO: 677335 - RNA, 64 nt, Homo Sapiens; identical to SEQ ID NO: 563800

SEQ ID NO: 677336 - RNA, 64 nt, Homo Sapiens; identical to SEQ ID NO: 563801

SEQ ID NO: 677337 - RNA, 64 nt, Homo Sapiens; identical to SEQ ID NO: 563802

SEQ ID NO: 677338 - RNA, 64 nt, Homo Sapiens; identical to SEQ ID NO: 563803

SEQ ID NO: 677339 - RNA, 64 nt, Homo Sapiens; identical to SEQ ID NO: 563803

SEQ ID NO: 677340 - RNA, 64 nt, Homo Sapiens; identical to SEQ ID NO: 563803

SEQ ID NO: 677341 - RNA, 64 nt, Homo Sapiens; identical to SEQ ID NO: 563803

SEQ ID NO: 677342 - RNA, 64 nt, Homo Sapiens; identical to SEQ ID NO: 563807

SEQ ID NO: 677343 - RNA, 64 nt, Homo Sapiens; identical to SEQ ID NO: 563808

SEQ ID NO: 677344 - RNA, 64 nt, Homo Sapiens; identical to SEQ ID NO: 563809

SEQ ID NO: 677345 - RNA, 64 nt, Homo Sapiens; identical to SEQ ID NO: 563810

SEQ ID NO: 677346 - RNA, 64 nt, Homo Sapiens; identical to SEQ ID NO: 563811

SEQ ID NO: 677347 - RNA, 64 nt, Homo Sapiens; identical to SEQ ID NO: 563812

SEQ ID NO: 677348 - RNA, 64 nt, Homo Sapiens; identical to SEQ ID NO: 563813

SEQ ID NO: 677349 - RNA, 64 nt, Homo Sapiens; identical to SEQ ID NO: 563814

SEQ ID NO: 677350 - RNA, 64 nt, Homo Sapiens; identical to SEQ ID NO: 563815

SEQ ID NO: 677351 - RNA, 64 nt, Homo Sapiens; identical to SEQ ID NO: 563816

SEQ ID NO: 677352 - RNA, 64 nt, Homo Sapiens; identical to SEQ ID NO: 563817

SEQ ID NO: 677353 - RNA, 63 nt, Homo Sapiens
ucaccugaaaucagccaggaggagcaaggacaagaugcgcacagggugguuuuccucauggau

SEQ ID NO: 677354 - RNA, 63 nt, Homo Sapiens
aagaugauuauuccugaaaguguggaugcgcuggaugcgcagggaacaucaggaaaaggccac

SEQ ID NO: 677355 - RNA, 63 nt, Homo Sapiens
cuaauucaauccuacuuuucgaacaccaaaaaugaugcgcaucaauguauuuuaucuuauuuu

SEQ ID NO: 677356 - RNA, 63 nt, Homo Sapiens
gcaggggccugcaucuggccagcaggacacagggaugcgcagggcgcccccuucuguuccagg

SEQ ID NO: 677357 - RNA, 63 nt, Homo Sapiens
caaggagaugaggagcggugaugccagcaccgggaugcgcagagcacuggaagggcuggugca

SEQ ID NO: 677358 - RNA, 63 nt, Homo Sapiens
ggcggggagaagagcauccggcaugagggcugagaugcgcaaagagugugcucgggaguggcc

SEQ ID NO: 677359 - RNA, 63 nt, Homo Sapiens
cccaucugugcauucuccugcuggugcugaguagaugcgcagcagugugcugaugggcguacg

SEQ ID NO: 677360 - RNA, 63 nt, Homo Sapiens
auuuugcaauguuuuacagaguuuuaacuugcagaugcgcacauuagccugcuauaugucaug

SEQ ID NO: 677361 - RNA, 63 nt, Homo Sapiens
uuaacuagccccuuuuccucuucacccucccaugaugcgcaguguucagaaagcugguaaguc

SEQ ID NO: 677362 - RNA, 63 nt, Homo Sapiens
gugguuugcacccaccacugaaaaagccgcggagaugcgcagcgcguacacugacuuuggggc

SEQ ID NO: 677363 - RNA, 63 nt, Homo Sapiens
gguugggggagguagggccucugcugugauugagaugcgcacacccuguggccgucacagugu

SEQ ID NO: 677364 - RNA, 63 nt, Homo Sapiens
uggauguugaugguaguacaccagccuucuguagaugcgcaagacauuccccaugcucaaggc

SEQ ID NO: 677365 - RNA, 63 nt, Homo Sapiens
uaagugcuuauccaguagaauuaauaaguaccugaugcgcauugaacgacaaucuuaagcccu

SEQ ID NO: 677366 - RNA, 63 nt, Homo Sapiens
ucuggggcuaccccaggugaacagagguggugagaugcgcagggaagaccagcucucuccagg

SEQ ID NO: 677367 - RNA, 63 nt, Homo Sapiens
uuauuuuaccuguuuuuguuucuuguuuugaaagaugcgcauucuaaccuggaggucaauguu

SEQ ID NO: 677368 - RNA, 63 nt, Homo Sapiens
augcagauaauuugcugaugaagcagaagaggggaugcgcauggcaagaacuugccuuacccc

SEQ ID NO: 677369 - RNA, 63 nt, Homo Sapiens
cugaucacccgaggggaaugucuuugugcccaagaugcgcaggcuauaucacucuuguugugc

SEQ ID NO: 677370 - RNA, 63 nt, Homo Sapiens
guaccaaggguaacccggcuccugguauggacggaugcgcaggauuuaggauaagcugucacc

SEQ ID NO: 677371 - RNA, 63 nt, Homo Sapiens
ccagagcauguaugaauaaugauaugauugacugaugcgcaguauaaauaguaaauuguugau

SEQ ID NO: 677372 - RNA, 63 nt, Homo Sapiens
ugcugucagucuugaccucuauuuccgccuggugaugcgcaguccggccuccagaacuuagca

SEQ ID NO: 677373 - RNA, 63 nt, Homo Sapiens
cggccucaacccggguccgcggggcacccgccggaugcgcagccuggccucuacuacagcgcc

SEQ ID NO: 677374 - RNA, 63 nt, Homo Sapiens
aguagugagaugaugcugguggaaguauuuauagaugcgcagugcaugaguacuuggcaagga

SEQ ID NO: 677375 - RNA, 63 nt, Homo Sapiens
cuguuuauuuacuguauacgucgaccuauuuuagaugcgcaucaguaugaaauugucucaauc

SEQ ID NO: 677376 - RNA, 63 nt, Homo Sapiens
gugaacagucccugacugccuguaggcugcguggaugcgcaacacacccccuccuucucugcu

SEQ ID NO: 677377 - RNA, 63 nt, Homo Sapiens
guguccccaacgcaggccccggccccgaccugggaugcgcacaucuagcuguggcccaggcug

SEQ ID NO: 677378 - RNA, 63 nt, Homo Sapiens
aaacuucuuuugcccccuucacaccucuuaggggaugcgcauucucggcagaaagacguuucc

SEQ ID NO: 677379 - RNA, 63 nt, Homo Sapiens
ucacggagggugacgggggucugugggucgcgugaugcgcaugguggguacgggaggguaagg

SEQ ID NO: 677380 - RNA, 63 nt, Homo Sapiens
uacguaguuuggcagaaaccacuuacggcugaugaugcgcaacccugcugacuguuucaguua

SEQ ID NO: 677381 - RNA, 63 nt, Homo Sapiens
ucucauugguuucauucuuguacugauggugaugaugcgcaggcuuuuuuacauuccuugcaa

SEQ ID NO: 677382 - RNA, 63 nt, Homo Sapiens
cccaggauucuggcaagagaggugaagaaaguggaugcgcagaguucggcuggaaaagaggac

SEQ ID NO: 677383 - RNA, 63 nt, Homo Sapiens
aacugagaccaaagaagcugcuguucuuagcaagaugcgcacugcauuccacaggugggagga

SEQ ID NO: 677384 - RNA, 63 nt, Homo Sapiens
ccugaacagacagacagacgcacacacacaacagaugcgcagcaacuccccgcccagggaccc

SEQ ID NO: 677385 - RNA, 63 nt, Homo Sapiens
gccggcacacgggcggcucacccuggacacugugaugcgcaugggcaaggccagcgcccgggg

SEQ ID NO: 677386 - RNA, 63 nt, Homo Sapiens
uaccucaugucggugcccgcaggaggaggagaagaugcgcaguggcccaggaggcggggaggg

SEQ ID NO: 677387 - RNA, 63 nt, Homo Sapiens
ggauggauggguggauggccguggauggccguggaugcgcagugccuugcauacccaaaccag

SEQ ID NO: 677388 - RNA, 63 nt, Homo Sapiens
uacaccgugcuccggcuaauaaguaaagaagcugaugcgcaagccaggaggaagaagaucggg

SEQ ID NO: 677389 - RNA, 63 nt, Homo Sapiens
gauuuuaaggaguggggaauugugaagcccacagaugcgcacgcaaugaccagcaggaaccgg

SEQ ID NO: 677390 - RNA, 63 nt, Homo Sapiens
cccaucccaagaagucgggaaaggccgaggauggaugcgcaucgacacagccacaaaccaagg

SEQ ID NO: 677391 - RNA, 63 nt, Homo Sapiens
agucuugaggaaacgaucucuauggcacagauugaugcgcacccuguucauuucuacuuaaau

SEQ ID NO: 677392 - RNA, 63 nt, Homo Sapiens
uuccucucucuuagggaauuacauuaacugagugaugcgcaaccuuucagaugcugggagagu

SEQ ID NO: 677393 - RNA, 63 nt, Homo Sapiens
cacauuggggaagaugcgcuguaggaacgcuuugaugcgcaugagagcuggaacgagugcaga

SEQ ID NO: 677394 - RNA, 64 nt, Homo Sapiens; identical to SEQ ID NO: 361150

SEQ ID NO: 677395 - RNA, 64 nt, Homo Sapiens; identical to SEQ ID NO: 361151

SEQ ID NO: 677396 - RNA, 64 nt, Homo Sapiens; identical to SEQ ID NO: 361152

SEQ ID NO: 677397 - RNA, 64 nt, Homo Sapiens; identical to SEQ ID NO: 361153

SEQ ID NO: 677398 - RNA, 64 nt, Homo Sapiens; identical to SEQ ID NO: 361154

SEQ ID NO: 677399 - RNA, 64 nt, Homo Sapiens; identical to SEQ ID NO: 361155

SEQ ID NO: 677400 - RNA, 64 nt, Homo Sapiens; identical to SEQ ID NO: 361156

SEQ ID NO: 677401 - RNA, 64 nt, Homo Sapiens; identical to SEQ ID NO: 361157

SEQ ID NO: 677402 - RNA, 64 nt, Homo Sapiens; identical to SEQ ID NO: 361158

SEQ ID NO: 677403 - RNA, 64 nt, Homo Sapiens; identical to SEQ ID NO: 361159

SEQ ID NO: 677404 - RNA, 64 nt, Homo Sapiens; identical to SEQ ID NO: 361160

SEQ ID NO: 677405 - RNA, 64 nt, Homo Sapiens; identical to SEQ ID NO: 361161

SEQ ID NO: 677406 - RNA, 64 nt, Homo Sapiens; identical to SEQ ID NO: 361162

SEQ ID NO: 677407 - RNA, 64 nt, Homo Sapiens; identical to SEQ ID NO: 361163

SEQ ID NO: 677408 - RNA, 64 nt, Homo Sapiens; identical to SEQ ID NO: 361164

SEQ ID NO: 677409 - RNA, 64 nt, Homo Sapiens; identical to SEQ ID NO: 361165

SEQ ID NO: 677410 - RNA, 64 nt, Homo Sapiens; identical to SEQ ID NO: 361166

SEQ ID NO: 677411 - RNA, 64 nt, Homo Sapiens; identical to SEQ ID NO: 361167

SEQ ID NO: 677412 - RNA, 64 nt, Homo Sapiens; identical to SEQ ID NO: 361168

SEQ ID NO: 677413 - RNA, 64 nt, Homo Sapiens; identical to SEQ ID NO: 361169

SEQ ID NO: 677414 - RNA, 64 nt, Homo Sapiens; identical to SEQ ID NO: 361170

SEQ ID NO: 677415 - RNA, 64 nt, Homo Sapiens; identical to SEQ ID NO: 361171

SEQ ID NO: 677416 - RNA, 64 nt, Homo Sapiens
uuauaugugcuccugaagcgagcacucuuuuuaucuaugauacuuccauaauaaucucuucuau

SEQ ID NO: 677417 - RNA, 64 nt, Homo Sapiens
uuacacgugcugcugaagggagcaugguuuuuaucuaugauacuuaguuaacauauauauuaca

SEQ ID NO: 677418 - RNA, 64 nt, Homo Sapiens
uugcauuuauuaaaaauguuaaaaacuugcaguucuaugauagaguuaaguucauuaggaauau

SEQ ID NO: 677419 - RNA, 64 nt, Homo Sapiens
accauuaauuuuugcauugcugagaucuuuuggccuaugauaauuagauacacugucagaaacu

SEQ ID NO: 677420 - RNA, 64 nt, Homo Sapiens
auuuccuaaaguauuuguggauauagaggaaacacuaugauaggcuuguuuuuuucccaguuuu

SEQ ID NO: 677421 - RNA, 64 nt, Homo Sapiens
auuuccaaaaguauuuguggagaggaaacacugucuaugauaggguuuuuucccaguuuuauau

SEQ ID NO: 677422 - RNA, 64 nt, Homo Sapiens
ugauauaaugaguaaaaauuuguacgcuguuaugcuaugauaaauugggccuuccuuuuuggaa

SEQ ID NO: 677423 - RNA, 64 nt, Homo Sapiens
uagugaaaagugugggaaaauuuuaggaaagugucuaugauauaacaugugaagauuuuauaaa

SEQ ID NO: 677424 - RNA, 50 nt, Homo Sapiens; identical to SEQ ID NO: 495921

SEQ ID NO: 677425 - RNA, 64 nt, Homo Sapiens
auguaauacuuaauuaaaauaaugauggaagagcuaucuggagauuaugaguaagcugauuuga

SEQ ID NO: 677426 - RNA, 64 nt, Homo Sapiens
uuuacagaagacguuugcugcacacaaaacaaaauaucuggaccaauauccaucagaaaaauga

SEQ ID NO: 677427 - RNA, 64 nt, Homo Sapiens
guagccccacucuuugaguguugauuaaaaagaauaucuggaaugaagcucuaaaacaguguca

SEQ ID NO: 677428 - RNA, 64 nt, Homo Sapiens
cccugagagacccugagaccaggagauuuuauuauaucuggagaugggagacuguggccugaac

SEQ ID NO: 677429 - RNA, 64 nt, Homo Sapiens
aggaagaaacaccccagcacucacuugugauuuuuaucuggaaagaagagccgucaucaguguc

SEQ ID NO: 677430 - RNA, 64 nt, Homo Sapiens
agaauuuucaaucaaugugucacuccuauucuguuaucuggacuuaucuggagaccacaaguac

SEQ ID NO: 677431 - RNA, 64 nt, Homo Sapiens
ccacaaguaccacuccuauucugacaguggaauauaucuggagaaugaagaaaaguauuuuugu

SEQ ID NO: 677432 - RNA, 64 nt, Homo Sapiens
uagcacuugaaagaucuaacgaacugagagccuguaucuggauuggcuuuguggcaaugaccuu

SEQ ID NO: 677433 - RNA, 64 nt, Homo Sapiens
uauuucuuuuugugaagccacugucucucugacuuaucuggaaggauuugcucaagacguccaa

SEQ ID NO: 677434 - RNA, 64 nt, Homo Sapiens
ucacaucuuccaccagcaccuuacugcccaggccuaucuggaagccaccucaccaaggaccuug

SEQ ID NO: 677435 - RNA, 64 nt, Homo Sapiens
cuuuaugugcaaaaucuguuauagcuuuaaaauauaucuggaacuuuuuagauuauuccaagcc

SEQ ID NO: 677436 - RNA, 64 nt, Homo Sapiens
gauaacacauacuccagccacagucuguauguacuaucuggaaaccuuccuguuucugcaugau

SEQ ID NO: 677437 - RNA, 64 nt, Homo Sapiens
uccugggaaggcuggcugcuugggcccuguccuguaucuggaaugggagccgaggaggacggcg

SEQ ID NO: 677438 - RNA, 64 nt, Homo Sapiens
uucaaagaagauggcauuaugccuggccuggaauuaucuggacuuuacagacgugagccaccgu

SEQ ID NO: 677439 - RNA, 64 nt, Homo Sapiens
uuuuuuuuuuuuuuuuuuuuuauuuacaaggaauuaucuggacuuuguaauuuauuaaaaaccu

SEQ ID NO: 677440 - RNA, 64 nt, Homo Sapiens
uuuugugugcauacauauucuaagccugucuuccuaucuggauuuaccuuacuuucauuguaaa

SEQ ID NO: 677441 - RNA, 64 nt, Homo Sapiens
cuaaaauguuacggaaguagcguuucugcuguacuaucuggauagcacccauugccccgggaac

SEQ ID NO: 677442 - RNA, 64 nt, Homo Sapiens; identical to SEQ ID NO: 167179

SEQ ID NO: 677443 - RNA, 64 nt, Homo Sapiens; identical to SEQ ID NO: 167180

SEQ ID NO: 677444 - RNA, 64 nt, Homo Sapiens; identical to SEQ ID NO: 167181

SEQ ID NO: 677445 - RNA, 64 nt, Homo Sapiens; identical to SEQ ID NO: 167182

SEQ ID NO: 677446 - RNA, 51 nt, Homo Sapiens; identical to SEQ ID NO: 167183

SEQ ID NO: 677447 - RNA, 64 nt, Homo Sapiens; identical to SEQ ID NO: 167184

SEQ ID NO: 677448 - RNA, 64 nt, Homo Sapiens; identical to SEQ ID NO: 167185

SEQ ID NO: 677449 - RNA, 64 nt, Homo Sapiens; identical to SEQ ID NO: 167186

SEQ ID NO: 677450 - RNA, 58 nt, Homo Sapiens; identical to SEQ ID NO: 167187

SEQ ID NO: 677451 - RNA, 64 nt, Homo Sapiens; identical to SEQ ID NO: 167188

SEQ ID NO: 677452 - RNA, 64 nt, Homo Sapiens; identical to SEQ ID NO: 167189

SEQ ID NO: 677453 - RNA, 64 nt, Homo Sapiens; identical to SEQ ID NO: 167190

SEQ ID NO: 677454 - RNA, 64 nt, Homo Sapiens; identical to SEQ ID NO: 167191

SEQ ID NO: 677455 - RNA, 64 nt, Homo Sapiens; identical to SEQ ID NO: 167192

SEQ ID NO: 677456 - RNA, 64 nt, Homo Sapiens; identical to SEQ ID NO: 167193

SEQ ID NO: 677457 - RNA, 64 nt, Homo Sapiens; identical to SEQ ID NO: 167194

SEQ ID NO: 677458 - RNA, 64 nt, Homo Sapiens; identical to SEQ ID NO: 167195

SEQ ID NO: 677459 - RNA, 64 nt, Homo Sapiens; identical to SEQ ID NO: 167196

SEQ ID NO: 677460 - RNA, 64 nt, Homo Sapiens; identical to SEQ ID NO: 167197

SEQ ID NO: 677461 - RNA, 64 nt, Homo Sapiens; identical to SEQ ID NO: 167198

SEQ ID NO: 677462 - RNA, 64 nt, Homo Sapiens; identical to SEQ ID NO: 167199

SEQ ID NO: 677463 - RNA, 64 nt, Homo Sapiens; identical to SEQ ID NO: 167200

SEQ ID NO: 677464 - RNA, 64 nt, Homo Sapiens; identical to SEQ ID NO: 167201

SEQ ID NO: 677465 - RNA, 64 nt, Homo Sapiens; identical to SEQ ID NO: 167202

SEQ ID NO: 677466 - RNA, 64 nt, Homo Sapiens; identical to SEQ ID NO: 167203

SEQ ID NO: 677467 - RNA, 64 nt, Homo Sapiens; identical to SEQ ID NO: 167204

SEQ ID NO: 677468 - RNA, 64 nt, Homo Sapiens; identical to SEQ ID NO: 167205

SEQ ID NO: 677469 - RNA, 64 nt, Homo Sapiens; identical to SEQ ID NO: 167206

SEQ ID NO: 677470 - RNA, 64 nt, Homo Sapiens; identical to SEQ ID NO: 167207

SEQ ID NO: 677471 - RNA, 64 nt, Homo Sapiens; identical to SEQ ID NO: 167208

SEQ ID NO: 677472 - RNA, 64 nt, Homo Sapiens; identical to SEQ ID NO: 167209

SEQ ID NO: 677473 - RNA, 64 nt, Homo Sapiens; identical to SEQ ID NO: 167210

SEQ ID NO: 677474 - RNA, 64 nt, Homo Sapiens; identical to SEQ ID NO: 167211

SEQ ID NO: 677475 - RNA, 64 nt, Homo Sapiens; identical to SEQ ID NO: 167212

SEQ ID NO: 677476 - RNA, 64 nt, Homo Sapiens; identical to SEQ ID NO: 167213

SEQ ID NO: 677477 - RNA, 64 nt, Homo Sapiens; identical to SEQ ID NO: 167214

SEQ ID NO: 677478 - RNA, 64 nt, Homo Sapiens; identical to SEQ ID NO: 167215

SEQ ID NO: 677479 - RNA, 64 nt, Homo Sapiens; identical to SEQ ID NO: 167216

SEQ ID NO: 677480 - RNA, 64 nt, Homo Sapiens; identical to SEQ ID NO: 167217

SEQ ID NO: 677481 - RNA, 64 nt, Homo Sapiens; identical to SEQ ID NO: 167218

SEQ ID NO: 677482 - RNA, 64 nt, Homo Sapiens; identical to SEQ ID NO: 167219

SEQ ID NO: 677483 - RNA, 64 nt, Homo Sapiens; identical to SEQ ID NO: 167220

SEQ ID NO: 677484 - RNA, 64 nt, Homo Sapiens; identical to SEQ ID NO: 167221

SEQ ID NO: 677485 - RNA, 64 nt, Homo Sapiens; identical to SEQ ID NO: 167222

SEQ ID NO: 677486 - RNA, 64 nt, Homo Sapiens; identical to SEQ ID NO: 167223

SEQ ID NO: 677487 - RNA, 64 nt, Homo Sapiens; identical to SEQ ID NO: 167224

SEQ ID NO: 677488 - RNA, 64 nt, Homo Sapiens; identical to SEQ ID NO: 167225

SEQ ID NO: 677489 - RNA, 64 nt, Homo Sapiens; identical to SEQ ID NO: 167226

SEQ ID NO: 677490 - RNA, 64 nt, Homo Sapiens; identical to SEQ ID NO: 167227

SEQ ID NO: 677491 - RNA, 64 nt, Homo Sapiens; identical to SEQ ID NO: 167228

SEQ ID NO: 677492 - RNA, 64 nt, Homo Sapiens; identical to SEQ ID NO: 167229

SEQ ID NO: 677493 - RNA, 64 nt, Homo Sapiens; identical to SEQ ID NO: 167230

SEQ ID NO: 677494 - RNA, 64 nt, Homo Sapiens; identical to SEQ ID NO: 167231

SEQ ID NO: 677495 - RNA, 64 nt, Homo Sapiens; identical to SEQ ID NO: 167232

SEQ ID NO: 677496 - RNA, 64 nt, Homo Sapiens; identical to SEQ ID NO: 167233

SEQ ID NO: 677497 - RNA, 64 nt, Homo Sapiens; identical to SEQ ID NO: 167234

SEQ ID NO: 677498 - RNA, 64 nt, Homo Sapiens; identical to SEQ ID NO: 167235

SEQ ID NO: 677499 - RNA, 64 nt, Homo Sapiens; identical to SEQ ID NO: 167236

SEQ ID NO: 677500 - RNA, 64 nt, Homo Sapiens; identical to SEQ ID NO: 167237

SEQ ID NO: 677501 - RNA, 64 nt, Homo Sapiens; identical to SEQ ID NO: 167238

SEQ ID NO: 677502 - RNA, 64 nt, Homo Sapiens; identical to SEQ ID NO: 167239

SEQ ID NO: 677503 - RNA, 64 nt, Homo Sapiens; identical to SEQ ID NO: 167240

SEQ ID NO: 677504 - RNA, 64 nt, Homo Sapiens; identical to SEQ ID NO: 167241

SEQ ID NO: 677505 - RNA, 64 nt, Homo Sapiens; identical to SEQ ID NO: 167242

SEQ ID NO: 677506 - RNA, 64 nt, Homo Sapiens; identical to SEQ ID NO: 167243

SEQ ID NO: 677507 - RNA, 64 nt, Homo Sapiens; identical to SEQ ID NO: 167244

SEQ ID NO: 677508 - RNA, 64 nt, Homo Sapiens; identical to SEQ ID NO: 167245

SEQ ID NO: 677509 - RNA, 64 nt, Homo Sapiens; identical to SEQ ID NO: 167246

SEQ ID NO: 677510 - RNA, 64 nt, Homo Sapiens; identical to SEQ ID NO: 167247

SEQ ID NO: 677511 - RNA, 64 nt, Homo Sapiens; identical to SEQ ID NO: 167248

SEQ ID NO: 677512 - RNA, 64 nt, Homo Sapiens; identical to SEQ ID NO: 167249

SEQ ID NO: 677513 - RNA, 64 nt, Homo Sapiens; identical to SEQ ID NO: 167250

SEQ ID NO: 677514 - RNA, 64 nt, Homo Sapiens; identical to SEQ ID NO: 167251

SEQ ID NO: 677515 - RNA, 64 nt, Homo Sapiens; identical to SEQ ID NO: 167252

SEQ ID NO: 677516 - RNA, 64 nt, Homo Sapiens; identical to SEQ ID NO: 167253

SEQ ID NO: 677517 - RNA, 64 nt, Homo Sapiens; identical to SEQ ID NO: 167254

SEQ ID NO: 677518 - RNA, 64 nt, Homo Sapiens; identical to SEQ ID NO: 167255

SEQ ID NO: 677519 - RNA, 64 nt, Homo Sapiens; identical to SEQ ID NO: 167256

SEQ ID NO: 677520 - RNA, 64 nt, Homo Sapiens; identical to SEQ ID NO: 167257

SEQ ID NO: 677521 - RNA, 64 nt, Homo Sapiens; identical to SEQ ID NO: 167258

SEQ ID NO: 677522 - RNA, 64 nt, Homo Sapiens; identical to SEQ ID NO: 167259

SEQ ID NO: 677523 - RNA, 64 nt, Homo Sapiens; identical to SEQ ID NO: 167260

SEQ ID NO: 677524 - RNA, 64 nt, Homo Sapiens; identical to SEQ ID NO: 167261

SEQ ID NO: 677525 - RNA, 63 nt, Homo Sapiens; identical to SEQ ID NO: 167262

SEQ ID NO: 677526 - RNA, 64 nt, Homo Sapiens; identical to SEQ ID NO: 167263

SEQ ID NO: 677527 - RNA, 64 nt, Homo Sapiens; identical to SEQ ID NO: 167264

SEQ ID NO: 677528 - RNA, 64 nt, Homo Sapiens; identical to SEQ ID NO: 167265

SEQ ID NO: 677529 - RNA, 64 nt, Homo Sapiens; identical to SEQ ID NO: 167266

SEQ ID NO: 677530 - RNA, 64 nt, Homo Sapiens; identical to SEQ ID NO: 167267

SEQ ID NO: 677531 - RNA, 64 nt, Homo Sapiens; identical to SEQ ID NO: 167268

SEQ ID NO: 677532 - RNA, 64 nt, Homo Sapiens; identical to SEQ ID NO: 167269

SEQ ID NO: 677533 - RNA, 64 nt, Homo Sapiens; identical to SEQ ID NO: 167270

SEQ ID NO: 677534 - RNA, 64 nt, Homo Sapiens; identical to SEQ ID NO: 167271

SEQ ID NO: 677535 - RNA, 64 nt, Homo Sapiens; identical to SEQ ID NO: 167272

SEQ ID NO: 677536 - RNA, 64 nt, Homo Sapiens; identical to SEQ ID NO: 167273

SEQ ID NO: 677537 - RNA, 64 nt, Homo Sapiens; identical to SEQ ID NO: 167274

SEQ ID NO: 677538 - RNA, 64 nt, Homo Sapiens; identical to SEQ ID NO: 167275

SEQ ID NO: 677539 - RNA, 64 nt, Homo Sapiens; identical to SEQ ID NO: 167276

SEQ ID NO: 677540 - RNA, 64 nt, Homo Sapiens; identical to SEQ ID NO: 167277

SEQ ID NO: 677541 - RNA, 64 nt, Homo Sapiens; identical to SEQ ID NO: 167278

SEQ ID NO: 677542 - RNA, 64 nt, Homo Sapiens; identical to SEQ ID NO: 167279

SEQ ID NO: 677543 - RNA, 64 nt, Homo Sapiens; identical to SEQ ID NO: 167280

SEQ ID NO: 677544 - RNA, 64 nt, Homo Sapiens; identical to SEQ ID NO: 167281

SEQ ID NO: 677545 - RNA, 64 nt, Homo Sapiens; identical to SEQ ID NO: 167282

SEQ ID NO: 677546 - RNA, 64 nt, Homo Sapiens; identical to SEQ ID NO: 167283

SEQ ID NO: 677547 - RNA, 64 nt, Homo Sapiens; identical to SEQ ID NO: 167284

SEQ ID NO: 677548 - RNA, 64 nt, Homo Sapiens; identical to SEQ ID NO: 167285

SEQ ID NO: 677549 - RNA, 64 nt, Homo Sapiens; identical to SEQ ID NO: 167286

SEQ ID NO: 677550 - RNA, 64 nt, Homo Sapiens; identical to SEQ ID NO: 167287

SEQ ID NO: 677551 - RNA, 64 nt, Homo Sapiens; identical to SEQ ID NO: 167288

SEQ ID NO: 677552 - RNA, 64 nt, Homo Sapiens; identical to SEQ ID NO: 167289

SEQ ID NO: 677553 - RNA, 64 nt, Homo Sapiens; identical to SEQ ID NO: 167290

SEQ ID NO: 677554 - RNA, 64 nt, Homo Sapiens; identical to SEQ ID NO: 167291

SEQ ID NO: 677555 - RNA, 64 nt, Homo Sapiens; identical to SEQ ID NO: 167292

SEQ ID NO: 677556 - RNA, 64 nt, Homo Sapiens; identical to SEQ ID NO: 167293

SEQ ID NO: 677557 - RNA, 64 nt, Homo Sapiens; identical to SEQ ID NO: 167294

SEQ ID NO: 677558 - RNA, 64 nt, Homo Sapiens; identical to SEQ ID NO: 167295

SEQ ID NO: 677559 - RNA, 64 nt, Homo Sapiens; identical to SEQ ID NO: 167296

SEQ ID NO: 677560 - RNA, 64 nt, Homo Sapiens; identical to SEQ ID NO: 167297

SEQ ID NO: 677561 - RNA, 64 nt, Homo Sapiens; identical to SEQ ID NO: 167298

SEQ ID NO: 677562 - RNA, 64 nt, Homo Sapiens; identical to SEQ ID NO: 167299

SEQ ID NO: 677563 - RNA, 64 nt, Homo Sapiens; identical to SEQ ID NO: 167300

SEQ ID NO: 677564 - RNA, 64 nt, Homo Sapiens; identical to SEQ ID NO: 167301

SEQ ID NO: 677565 - RNA, 64 nt, Homo Sapiens; identical to SEQ ID NO: 167302

SEQ ID NO: 677566 - RNA, 64 nt, Homo Sapiens; identical to SEQ ID NO: 167303

SEQ ID NO: 677567 - RNA, 64 nt, Homo Sapiens; identical to SEQ ID NO: 167304

SEQ ID NO: 677568 - RNA, 64 nt, Homo Sapiens; identical to SEQ ID NO: 167305

SEQ ID NO: 677569 - RNA, 64 nt, Homo Sapiens; identical to SEQ ID NO: 167306

SEQ ID NO: 677570 - RNA, 64 nt, Homo Sapiens
agcugcaaaacaggcugauuucaauuaggcagcacuucccaaagugcacugaggaagguggccc

SEQ ID NO: 677571 - RNA, 64 nt, Homo Sapiens
acuccugaccucaggcgauccacccccaccucggcuucccaaagugcugagauuacagguguga

SEQ ID NO: 677572 - RNA, 64 nt, Homo Sapiens
ccaaaggacuuaccaucuguuuucccuaggguuucuucccaacauuucuucauucugcauauuc

SEQ ID NO: 677573 - RNA, 64 nt, Homo Sapiens
uccccaucugaagcuggccuccucagagagaugccuucccaaacuuucagcuuaaauuuugccu

SEQ ID NO: 677574 - RNA, 64 nt, Homo Sapiens
ugaaaggugaggucacguggccucccaggccugacuucccaaccuacagcauugacgccaacuu

SEQ ID NO: 677575 - RNA, 64 nt, Homo Sapiens
uuuuauucauauuuauguucaugguugauuguaccuucccaagcccgcccagugggaugggagg

SEQ ID NO: 677576 - RNA, 64 nt, Homo Sapiens
ucugacccagaggguggaaccggccuggacuccucuucccaacuuccuccaggucauuucccag

SEQ ID NO: 677577 - RNA, 64 nt, Homo Sapiens
ggacuuguggaucauuccuuccucccugcaggagcuucccaagcuggucacagagucuccuggg

SEQ ID NO: 677578 - RNA, 64 nt, Homo Sapiens
aucagugucuagggacuaguaauucucuuacauccuucccaaaaaacccuaaaucugagucagu

SEQ ID NO: 677579 - RNA, 64 nt, Homo Sapiens
aucagugucuagggacugguauucucuaaaaauccuucccaaaagcccuaaaucugagucagua

SEQ ID NO: 677580 - RNA, 64 nt, Homo Sapiens
uggacgagccuugccugaccucuucggugcugaccuucccaaagugaugccuuacugguuuugu

SEQ ID NO: 677581 - RNA, 64 nt, Homo Sapiens
uuauguugaguuaccaauggaagccaaaaguucucuucccaaacugccaagaaugauacaggcc

SEQ ID NO: 677582 - RNA, 64 nt, Homo Sapiens
auuuuaagcauuuuguaaauuuagcuuccucuugcuucccaaagguuaacaugggaccuucugu

SEQ ID NO: 677583 - RNA, 64 nt, Homo Sapiens
uagcuugucuccucuccugugaaagaccaagacucuucccaaguguuucagugggggagaagcu

SEQ ID NO: 677584 - RNA, 64 nt, Homo Sapiens
gcugcgugagcagacaccuuagccucaggccaaccuucccaacuaaaccguucuggguuuugaa

SEQ ID NO: 677585 - RNA, 64 nt, Homo Sapiens
aggaaacggauucaggaagacacagcccucccaucuucccaaugcccacagcacucugaacagg

SEQ ID NO: 677586 - RNA, 64 nt, Homo Sapiens
uacaaucaguaaaaguuugauaaucaguauaucccuucccaacccccauugugacaguuucuuu

SEQ ID NO: 677587 - RNA, 64 nt, Homo Sapiens
uuuuuuuccuaccaagaucauucuugaucaucagcuucccaaacuaguaagucugugcaucauu

SEQ ID NO: 677588 - RNA, 64 nt, Homo Sapiens
caguuggagacugucuggccccccugguccccuccuucccaagugagucucucugggccuuagg

SEQ ID NO: 677589 - RNA, 64 nt, Homo Sapiens
ccguggcccuugaguccccauugaggcuugguuccuucccaauccaguggacuucgcaguccac

SEQ ID NO: 677590 - RNA, 64 nt, Homo Sapiens
cagcccugaggacagaugccuccuuccucuuuuccuucccaaagcaagcaagaggccguggcug

SEQ ID NO: 677591 - RNA, 64 nt, Homo Sapiens
cacaaagcaguuuuucccccgguuucagagacaacuucccaaaguccugcguccucuguccccg

SEQ ID NO: 677592 - RNA, 64 nt, Homo Sapiens
cugucuccccagaagacacaccuccccuccacuccuucccaaauucuccacaccccccuugggg

SEQ ID NO: 677593 - RNA, 64 nt, Homo Sapiens
ggcagcaucuguccccagaaucaggcagaauccacuucccaaacagagccccacgcagguucac

SEQ ID NO: 677594 - RNA, 64 nt, Homo Sapiens
auugguuuugaaaccagcuguuucccaaacucugcuucccaagggcaaccguugcuguucacac

SEQ ID NO: 677595 - RNA, 64 nt, Homo Sapiens
gagguggcaugauuguggauccccugagaucuggcuucccaagagcacuuauugacccuuccuc

SEQ ID NO: 677596 - RNA, 64 nt, Homo Sapiens
cagcuccuccccuuucaccaccagcuccucuccacuucccaagggagacuccggcaaccuucag

SEQ ID NO: 677597 - RNA, 64 nt, Homo Sapiens
ucccucccagccacgugccaguggccacagcccacuucccaacccacuguuguacccaggccuc

SEQ ID NO: 677598 - RNA, 64 nt, Homo Sapiens
gaacuccugaccucaggugauccucccaccccggcuucccaaaguucugggauuauaggcguga

SEQ ID NO: 677599 - RNA, 64 nt, Homo Sapiens
gaucaaaaaauaugucuaauguaauuaaaacacaaguucacagauuuacagugaacuugaucua

SEQ ID NO: 677600 - RNA, 64 nt, Homo Sapiens
caaguucacagauuuacagugaacuugaucuacaaguucacagauccauugugugguuuaauag

SEQ ID NO: 677601 - RNA, 64 nt, Homo Sapiens
aaacugcuaagaccaaguguggagaugucaagcuaguucacacucugaggcucagaauauguag

SEQ ID NO: 677602 - RNA, 64 nt, Homo Sapiens
uguucucaagagggccaucagaaggaagccaaagaguucacagccucagcaccaacaacucaac

SEQ ID NO: 677603 - RNA, 64 nt, Homo Sapiens
cauguaaauuaauuauuuuaucaauacuagauagaguucacaugcugacucccuggauaccuac

SEQ ID NO: 677604 - RNA, 64 nt, Homo Sapiens
uguaauuuaaaaauuaaugugagcguuuguuuuaaguucacagaaaacuuaauaauucaaauuc

SEQ ID NO: 677605 - RNA, 64 nt, Homo Sapiens
uuguggacagcuguacacugaagagucaucagagaguucacacuggagaaagaccuuuugaaug

SEQ ID NO: 677606 - RNA, 64 nt, Homo Sapiens
uuagccaaaauucccaccucauucggcaccaaaaaguucacacuagggaaagaacuuacaaaug

SEQ ID NO: 677607 - RNA, 64 nt, Homo Sapiens
uuaaccaaaauucucaucucauucagcaccagaaaguucacaccagauaaagaauguauauaua

SEQ ID NO: 677608 - RNA, 51 nt, Homo Sapiens
cagucuuauuaaacacuugagaguucacacaggagaaaggccuuaugaaug

SEQ ID NO: 677609 - RNA, 64 nt, Homo Sapiens
uucgccgaagcucuucacucuugcagcaucagagaguucacacuagagaaaggccuuaugaaug

SEQ ID NO: 677610 - RNA, 64 nt, Homo Sapiens
uuagccgaaaaucuagccuuauuauacaucugagaguucacacuggagaaaggccuuaugagug

SEQ ID NO: 677611 - RNA, 64 nt, Homo Sapiens
uugcugaaaacuccagccuuauuaaacacuugagaguucacacuggagaaaggccauaugaaug

SEQ ID NO: 677612 - RNA, 64 nt, Homo Sapiens
cuugcccaggcuuuuugcuccuucaaggccagagaguucacaccagaucaagguguuaugagug

SEQ ID NO: 677613 - RNA, 64 nt, Homo Sapiens
cucugaguguugaaggggcaacccaaggcaucacaguucacagguaaccauguuguguucuucu

SEQ ID NO: 677614 - RNA, 64 nt, Homo Sapiens
uaaauuauuuauauuacugaauuggcaaaauuacaguucacacugcagagcuagguuguccuau

SEQ ID NO: 677615 - RNA, 64 nt, Homo Sapiens; identical to SEQ ID NO: 238476

SEQ ID NO: 677616 - RNA, 64 nt, Homo Sapiens; identical to SEQ ID NO: 238477

SEQ ID NO: 677617 - RNA, 53 nt, Homo Sapiens; identical to SEQ ID NO: 238478

SEQ ID NO: 677618 - RNA, 64 nt, Homo Sapiens; identical to SEQ ID NO: 238479

SEQ ID NO: 677619 - RNA, 64 nt, Homo Sapiens; identical to SEQ ID NO: 238480

SEQ ID NO: 677620 - RNA, 64 nt, Homo Sapiens; identical to SEQ ID NO: 238481

SEQ ID NO: 677621 - RNA, 64 nt, Homo Sapiens; identical to SEQ ID NO: 238482

SEQ ID NO: 677622 - RNA, 64 nt, Homo Sapiens; identical to SEQ ID NO: 238483

SEQ ID NO: 677623 - RNA, 64 nt, Homo Sapiens; identical to SEQ ID NO: 238484

SEQ ID NO: 677624 - RNA, 64 nt, Homo Sapiens; identical to SEQ ID NO: 238485

SEQ ID NO: 677625 - RNA, 64 nt, Homo Sapiens; identical to SEQ ID NO: 238486

SEQ ID NO: 677626 - RNA, 64 nt, Homo Sapiens; identical to SEQ ID NO: 238487

SEQ ID NO: 677627 - RNA, 64 nt, Homo Sapiens; identical to SEQ ID NO: 238488

SEQ ID NO: 677628 - RNA, 64 nt, Homo Sapiens; identical to SEQ ID NO: 238489

SEQ ID NO: 677629 - RNA, 64 nt, Homo Sapiens
aucuaacaaaaaguggcauaaaauauuacaaaacauccaacacuagaaagcaaugacuaacauu

SEQ ID NO: 677630 - RNA, 64 nt, Homo Sapiens
uugacuccucuauuucuguuucaacucucgucuaauccaacagcaaauccccuugaugcuaccu

SEQ ID NO: 677631 - RNA, 64 nt, Homo Sapiens
aaucuagaagucacaagcaaagccuuuaguuuaaauccaacagaaaaugauaagcuauucuagu

SEQ ID NO: 677632 - RNA, 64 nt, Homo Sapiens
gcacucaucauuaguuaacaguaguguuuacaagauccaacaguacaguuugaauguauaauca

SEQ ID NO: 677633 - RNA, 64 nt, Homo Sapiens
auccaucugcaguuaugugcugaggugauaauucauccaacauauuuguuagcauaaauauuau

SEQ ID NO: 677634 - RNA, 64 nt, Homo Sapiens
uuuucucuuuucucugauguuuuaccuuuaaaagauccaacauccuuaccguugguauuuuuag

SEQ ID NO: 677635 - RNA, 64 nt, Homo Sapiens; identical to SEQ ID NO: 343068

SEQ ID NO: 677636 - RNA, 64 nt, Homo Sapiens; identical to SEQ ID NO: 343069

SEQ ID NO: 677637 - RNA, 64 nt, Homo Sapiens; identical to SEQ ID NO: 343070

SEQ ID NO: 677638 - RNA, 64 nt, Homo Sapiens; identical to SEQ ID NO: 343071

SEQ ID NO: 677639 - RNA, 64 nt, Homo Sapiens; identical to SEQ ID NO: 343072

SEQ ID NO: 677640 - RNA, 64 nt, Homo Sapiens; identical to SEQ ID NO: 343073

SEQ ID NO: 677641 - RNA, 63 nt, Homo Sapiens; identical to SEQ ID NO: 354303

SEQ ID NO: 677642 - RNA, 63 nt, Homo Sapiens; identical to SEQ ID NO: 354304

SEQ ID NO: 677643 - RNA, 63 nt, Homo Sapiens; identical to SEQ ID NO: 354305

SEQ ID NO: 677644 - RNA, 63 nt, Homo Sapiens; identical to SEQ ID NO: 354306

SEQ ID NO: 677645 - RNA, 63 nt, Homo Sapiens; identical to SEQ ID NO: 354307

SEQ ID NO: 677646 - RNA, 63 nt, Homo Sapiens; identical to SEQ ID NO: 354308

SEQ ID NO: 677647 - RNA, 63 nt, Homo Sapiens; identical to SEQ ID NO: 354309

SEQ ID NO: 677648 - RNA, 63 nt, Homo Sapiens; identical to SEQ ID NO: 354310

SEQ ID NO: 677649 - RNA, 64 nt, Homo Sapiens
ccccugcagcccacacagcacaacgucuuaccgugccuauuaccaagcgaguguuuguaaccau

SEQ ID NO: 677650 - RNA, 64 nt, Homo Sapiens
gauaugugcucugagcuucccugaaccaggaucugccuauuacugcugugccccauggggggcu

SEQ ID NO: 677651 - RNA, 64 nt, Homo Sapiens
ccaguuuacagucccacccacaaugcaugagagugccuauuaaaucuuuguaaguguuaucaaa

SEQ ID NO: 677652 - RNA, 64 nt, Homo Sapiens
ggucaagauacaaauguguauuaaaaaaaaaaaagccuauuaauaggguuucugcgcggugcag

SEQ ID NO: 677653 - RNA, 64 nt, Homo Sapiens
ccuacuucuuuuccaaauaagcaucagauuuaucgccuauuaugcaguaacagucaauaaaaug

SEQ ID NO: 677654 - RNA, 64 nt, Homo Sapiens
ugacagcugcuuauaaaagcaucuuagcagauaagccuauuaaaauugugcuuuuguaacaaug

SEQ ID NO: 677655 - RNA, 64 nt, Homo Sapiens
ugccaaggcauuugcaaaaacuagcugccaguuugccuauuauaaccucugcagacugugaauc

SEQ ID NO: 677656 - RNA, 64 nt, Homo Sapiens
ucuaaccuaaguaaaggcccuagaggccuucaaagccuauuauucugguuauugcaucugguga

SEQ ID NO: 677657 - RNA, 64 nt, Homo Sapiens
aggcaggggaaacgguacuuaccugcaggaaucagccuauuaacgagaugauuccuuuacucaa

SEQ ID NO: 677658 - RNA, 64 nt, Homo Sapiens
aaugcacauuuagguugauuauuuucauuauccagccuauuauuaugguguuuguauauaccac

SEQ ID NO: 677659 - RNA, 64 nt, Homo Sapiens
guaugagaguuuaagguuauucuuuucaguuguugccuauuacauauuucauguucccguggcu

SEQ ID NO: 677660 - RNA, 64 nt, Homo Sapiens
accuuuuucauuuuucucugagccaccacaccuggccuauuauggugcugggguuacaagcaug

SEQ ID NO: 677661 - RNA, 64 nt, Homo Sapiens
uucccacauccugagaaaggucaucaggaguacagccuauuauaugugauuaggauggucaagg

SEQ ID NO: 677662 - RNA, 64 nt, Homo Sapiens
cagugaacaagucuucauccuggcccaggaaauagccuauuaaaaaaugcuguccaggccaggc

SEQ ID NO: 677663 - RNA, 64 nt, Homo Sapiens
aaugaagauacgugaaauucaaaugucacaacuugccuauuauuuauuuuagugcauuuuuuug

SEQ ID NO: 677664 - RNA, 64 nt, Homo Sapiens
cuggcacaaaacaaaugcucaguggauggaagcugccuauuauuauugucguuguuguuguuug

SEQ ID NO: 677665 - RNA, 64 nt, Homo Sapiens
aagcccauggagcagggaugucacgucuugaaaagccuauuagauguuuuacaaauuuaauuuu

SEQ ID NO: 677666 - RNA, 64 nt, Homo Sapiens
aguugugaguuguuuuccucuuauuuaaacauuggccuauuauaaucuguguugguuauuuuuc

SEQ ID NO: 677667 - RNA, 64 nt, Homo Sapiens
uugugcucauccucauacaaccauuuggggaugugccuauuagggcuccguaagaacucagaug

SEQ ID NO: 677668 - RNA, 64 nt, Homo Sapiens
cugcugagcagucaugaauucacagcaauagcuugccuauuagucaggggcaaguacacuucac

SEQ ID NO: 677669 - RNA, 64 nt, Homo Sapiens
gaagucaugggauuaacuugagggucacuauugagccuauuaauuaauuauuguuuuaauaaaa

SEQ ID NO: 677670 - RNA, 64 nt, Homo Sapiens
ucacuuugguaaauacuucaugcuuucaguuuuagccuauuaauuuuagguggacaaauuuaac

SEQ ID NO: 677671 - RNA, 64 nt, Homo Sapiens
auauaaaacuuuugauucuaaaauuaaaccagcagccuauuacaagcacauucuuugauugagu

SEQ ID NO: 677672 - RNA, 64 nt, Homo Sapiens
augcugcuagacacuuuucuuucccagccgaaaagccuauuauguaauuuuuacauucauaauu

SEQ ID NO: 677673 - RNA, 64 nt, Homo Sapiens
aucaaauggaaaggagaggaaagaacucagugcugccuauuaguaguuaauucugucacucacc

SEQ ID NO: 677674 - RNA, 64 nt, Homo Sapiens
ggacuaugguaaguauagaauauuuuaucagcuugccuauuaaauuuuuuuaauaacugggggc

SEQ ID NO: 677675 - RNA, 64 nt, Homo Sapiens
ugucagcugcaagguacucuaacuaacauguccugccuauuaucuuaggcuguaacuacuuuau

SEQ ID NO: 677676 - RNA, 64 nt, Homo Sapiens
aaugacaguacuuauuaauugaauggaaacccaugccuauuagauuuucuuaguucauucugca

SEQ ID NO: 677677 - RNA, 64 nt, Homo Sapiens
aauuucauuugucugucacucuucuaaucuugaggccuauuaauaugucuucuuugaaaacuga

SEQ ID NO: 677678 - RNA, 64 nt, Homo Sapiens
gagcccucuucccagacuaaagaggaccucaguggccuauuacgggaggaugauguggugggac

SEQ ID NO: 677679 - RNA, 64 nt, Homo Sapiens
aggguauaauuauacugcuuaaaauacaguuagugccuauuaauagcuuuuuauuuccuauggg

SEQ ID NO: 677680 - RNA, 64 nt, Homo Sapiens
aucagggauuauuauucuuauuaauaacauguuggccuauuaucuggaugucccuugccuagag

SEQ ID NO: 677681 - RNA, 64 nt, Homo Sapiens
aaagauuaagaaaugauaacaaauacacauuuuggccuauuagcacaaaguaaaauaaauaaau

SEQ ID NO: 677682 - RNA, 64 nt, Homo Sapiens
ugugucuuagcaauguuguaauucacauaaggcagccuauuaacaauaaugucuucucuuuaau

SEQ ID NO: 677683 - RNA, 64 nt, Homo Sapiens
auuuuagaaauaagauaaucuuuuguaauucagggccuauuauguuaauaaaauuuuaugccug

SEQ ID NO: 677684 - RNA, 64 nt, Homo Sapiens
uuauacuuauuaaaguauacauuuuuaaauguuagccuauuaauuuacucuugauuaucaaaca

SEQ ID NO: 677685 - RNA, 64 nt, Homo Sapiens
uccuccacgacauuccuugacuuaauccauuugggccuauuauagacaaaauagagcuucuuuc

SEQ ID NO: 677686 - RNA, 64 nt, Homo Sapiens
gauguaaaaguuauuuaaauuaauauauguguuggccuauuauugcuucuaccaagaagguauu

SEQ ID NO: 677687 - RNA, 64 nt, Homo Sapiens
auauuuauaguuuuugaauggguauguucaaggagccuauuaauucugacuuuuuguccuaagu

SEQ ID NO: 677688 - RNA, 64 nt, Homo Sapiens
ucacaaucuuuggugacgggaggccauaucccaggccuauuaaacuuuaaaaauuccaaagcuc

SEQ ID NO: 677689 - RNA, 64 nt, Homo Sapiens
uuccaggaguggguacugauuccagacuccagaugccuauuauuaguuaggcuucugagcuugc

SEQ ID NO: 677690 - RNA, 64 nt, Homo Sapiens
ucaacaugcagauuugccuacucauagggacuuugccuauuaagucuaccaaauuaaaagucuu

SEQ ID NO: 677691 - RNA, 64 nt, Homo Sapiens
gcaaaauuuguaacaaaaugguuauauggaacaugccuauuaaaugaauuuuacuaucuucccu

SEQ ID NO: 677692 - RNA, 64 nt, Homo Sapiens
ugucagccuuagauaaacguucagcauuaaaaacgccuauuauuucauuuacuagcauuuuagg

SEQ ID NO: 677693 - RNA, 64 nt, Homo Sapiens
gauauuaucccucuguuuuauuacauaugucuuugccuauuaaaccuacuuuucugcuucguuu

SEQ ID NO: 677694 - RNA, 64 nt, Homo Sapiens
gaaagugagcugaagaaacucauauucuuaaguugccuauuaaaauugugcuaucuagggagga

SEQ ID NO: 677695 - RNA, 64 nt, Homo Sapiens
aaggguuuagauuuuaagaauggugcucuuucaugccuauuaucaguaaggggacuuguauuag

SEQ ID NO: 677696 - RNA, 64 nt, Homo Sapiens
gugcugggauuacaggugugagcuaccgcgcccggccuauuaucuuguacuuucuaacugagcc

SEQ ID NO: 677697 - RNA, 64 nt, Homo Sapiens
uugugaugggagggauaccuuuuuguuguuaaaagccuauuauuguuaaaggccuuuuauggaa

SEQ ID NO: 677698 - RNA, 64 nt, Homo Sapiens
gagguuucuugcagugaacgaaaugaauuuuaaugccuauuauuucuggguacuuuaacaauau

SEQ ID NO: 677699 - RNA, 64 nt, Homo Sapiens
auaaauaggacaaaucauuuccuagugauugguggccuauuauguaagcugaugaagcuuggcu

SEQ ID NO: 677700 - RNA, 64 nt, Homo Sapiens
auuauuuuuaucugaagcuagaagagacuuuauugccuauuauaaguuacaguaaauacacugu

SEQ ID NO: 677701 - RNA, 64 nt, Homo Sapiens
acuugcuauagaaaguugguguuugcuuacaguugccuauuacaaaguuauacagauugauacu

SEQ ID NO: 677702 - RNA, 64 nt, Homo Sapiens
ugagcucccagaaaacagugcucagaaaugcccugccuauuaaaccuccgaaccaacccugccc

SEQ ID NO: 677703 - RNA, 64 nt, Homo Sapiens
gucaguaauggccauuauugcuuuuacaaguggugccuauuaaauuaagaaacuguagcugcuu

SEQ ID NO: 677704 - RNA, 64 nt, Homo Sapiens
aguuggguuaaaaaucaguagcugucuuaaugcagccuauuaaguguuguauuuggcuaauuuu

SEQ ID NO: 677705 - RNA, 64 nt, Homo Sapiens
gauguaagacauuacagccuagaaaucuaaucaugccuauuaagguuaauuuggaaaauuuggg

SEQ ID NO: 677706 - RNA, 64 nt, Homo Sapiens
gaagccuucccauuuuuucaaagucuguuuaauugccuauuacuucucucaaagagaaccugaa

SEQ ID NO: 677707 - RNA, 64 nt, Homo Sapiens
ucagcauuucucacaaagugaugucugggugugugccuauuaccuuggauguuugguacugucc

SEQ ID NO: 677708 - RNA, 64 nt, Homo Sapiens
augcuucccuucccuucccacauaucaucucacugccuauuaucuggugucaccucauguaucg

SEQ ID NO: 677709 - RNA, 64 nt, Homo Sapiens
guaaaagaaaaauguggagaagugcuauaaaauugccuauuaagccguuuuauccaucagaguc

SEQ ID NO: 677710 - RNA, 64 nt, Homo Sapiens
agucucauaaauuucaguaauguguucagacagagccuauuacacacuaucuacauuuuucaua

SEQ ID NO: 677711 - RNA, 64 nt, Homo Sapiens
auuuggaauuuuuuuuagaaggcuguauauuucugccuauuaauucacucccugaguuuaguau

SEQ ID NO: 677712 - RNA, 64 nt, Homo Sapiens
cagccuaaggaaacaaguacugucgucuuuaucugccuauuacucacuuggggacccugccucg

SEQ ID NO: 677713 - RNA, 64 nt, Homo Sapiens
agccaauguuguuagcaucucguaacaugguaaagccuauuaccugaugaacaagcauuuagau

SEQ ID NO: 677714 - RNA, 64 nt, Homo Sapiens
ccaucucuaaaauugaucuaaacuuguuucccaggccuauuagguuuugagguuuuuccucaau

SEQ ID NO: 677715 - RNA, 64 nt, Homo Sapiens
guugaaauuauguauguuuacauaucaccucauggccuauuauauuaaaauauggcuauaaaua

SEQ ID NO: 677716 - RNA, 64 nt, Homo Sapiens
aauaaucuugaagggaagucagaguuuucucccugccuauuaacaaaaacccaauuuuguucau

SEQ ID NO: 677717 - RNA, 64 nt, Homo Sapiens
ggaauggggucccuagcagacuugccuggaaggagccuauuauagaggguugguuauguuggga

SEQ ID NO: 677718 - RNA, 64 nt, Homo Sapiens
uagaugugauauuuucucccugauggccugacaggccuauuaagccagauuucaguauauucuc

SEQ ID NO: 677719 - RNA, 64 nt, Homo Sapiens
uuuuuaaagaaaacuugcacagcaagucccaucagccuauuauuuaaaacucaaccccuucgau

SEQ ID NO: 677720 - RNA, 64 nt, Homo Sapiens
uucacagugaaauaaucaaugaucacuauuuuuggccuauuaguuucuaauauuaaucuccagg

SEQ ID NO: 677721 - RNA, 64 nt, Homo Sapiens
cgcauuuucaaauuuauccccguaaucaaugugggccuauuaaaaaaccaaaucaugauacaag

SEQ ID NO: 677722 - RNA, 64 nt, Homo Sapiens
ccacuaugguagacaaccauuucguggaagggcagccuauuaucccacacugcaucuagccuuu

SEQ ID NO: 677723 - RNA, 64 nt, Homo Sapiens
uuuuuauuuucuuucacucuuuugacuuguuuuagccuauuaaauuaucuguguagaaugggug

SEQ ID NO: 677724 - RNA, 64 nt, Homo Sapiens
aaucccuguaucguggaccugaauauaacauauagccuauuauaauuaguuccccugggauucu

SEQ ID NO: 677725 - RNA, 64 nt, Homo Sapiens
uguguugucauugucuccauugucuuuguccagagccuauuauuauggaaacaauaaaauuuau

SEQ ID NO: 677726 - RNA, 64 nt, Homo Sapiens
uuauaugucgccuuuuucuguucaaauuugcauggccuauuaaguuggcuggagaguguuuuau

SEQ ID NO: 677727 - RNA, 64 nt, Homo Sapiens
uauuucacuuuuuguuggucccaucuugcuaauggccuauuauuguuuauuuaucaaggauuau

SEQ ID NO: 677728 - RNA, 64 nt, Homo Sapiens
uguuucagggcaaccgcggugagaggcuuuaaaagccuauuaacuuuaaaaccuuguuauaucu

SEQ ID NO: 677729 - RNA, 64 nt, Homo Sapiens
ucauauuauuaguaguaucaugguuccauuacaggccuauuaacaucauacauugucauuaguc

SEQ ID NO: 677730 - RNA, 64 nt, Homo Sapiens
caugacguuauccaauugcaacaacuuuuuagaggccuauuaaacaauuucuacugauguagcc

SEQ ID NO: 677731 - RNA, 64 nt, Homo Sapiens
guaaaucauucaaggauucacuuauacaaccuuagccuauuauauauuucagagccaaaagugc

SEQ ID NO: 677732 - RNA, 64 nt, Homo Sapiens
guugugaccauguaacaugagagguuuugcuagggccuauuauuuuuaaccaccauuaauuagu

SEQ ID NO: 677733 - RNA, 64 nt, Homo Sapiens
gucccucucccuuggguuccauuuucuuggagcagccuauuaguucuggugggguugccgugug

SEQ ID NO: 677734 - RNA, 64 nt, Homo Sapiens
ucugggcagacuucagagacuuuguggccuggaggccuauuaagcacgacacaguaucagugga

SEQ ID NO: 677735 - RNA, 64 nt, Homo Sapiens
ccaagaaguggcucaggcaacucuggacaucucugccuauuaucagugcuggggacaccccugg

SEQ ID NO: 677736 - RNA, 64 nt, Homo Sapiens
acagggucuguccacgcaccaccuggggucugccgccuauuaaaagugccguauucuuaccucu

SEQ ID NO: 677737 - RNA, 64 nt, Homo Sapiens
ggauaauggaaacugaaaggugacgugcaaaacugccuauuacucccaggaguggaggauaauu

SEQ ID NO: 677738 - RNA, 64 nt, Homo Sapiens
uuuuguaagaauaaaacaggagccaccgcgccuggccuauuauuuugcugggauuacaggugug

SEQ ID NO: 677739 - RNA, 64 nt, Homo Sapiens
ccucugcuccuggccaggcauuucucuuucuuuugccuauuaaaaagagaaagagcuguucucc

SEQ ID NO: 677740 - RNA, 63 nt, Homo Sapiens
aguguguuugucuuuagugaaagauacaggaaggccuauuacaagauucauaccagaguuuaa

SEQ ID NO: 677741 - RNA, 64 nt, Homo Sapiens
ccagcacuuugggaggccaagcaugguggcucaugccuauuaucaaaagccccagcauggccgg

SEQ ID NO: 677742 - RNA, 64 nt, Homo Sapiens
aaaaaaaguuguuuucugaauuguauuagaagaggccuauuaaagugcgagggcaggaguauuu

SEQ ID NO: 677743 - RNA, 64 nt, Homo Sapiens
ucaacaucaagacucucugucguugggauucauggccuauuaaggagguccaaggggugagucc

SEQ ID NO: 677744 - RNA, 64 nt, Homo Sapiens
acucaagcaguauuaaucaauaugguaucacaaugccuauuaagaggcuuuuuacaaauuacuu

SEQ ID NO: 677745 - RNA, 64 nt, Homo Sapiens
ugguugcacugauauaaaaguuaaaaaauaacaugccuauuaacuucacaaaauuuauuacuuu

SEQ ID NO: 677746 - RNA, 64 nt, Homo Sapiens
ggcauaugucucugcuaagcaacauuuaucagaugccuauuaugcacucauuccauguggaaca

SEQ ID NO: 677747 - RNA, 64 nt, Homo Sapiens
uuuuaccuuaauguuuauuucccccaaaagaagugccuauuacauguuccuuucauaguuuuuc

SEQ ID NO: 677748 - RNA, 64 nt, Homo Sapiens
cuauuuuaauauguuuuuuucucuuucacagguagccuauuaaaguuaaaugguuauccaauug

SEQ ID NO: 677749 - RNA, 64 nt, Homo Sapiens
uugugcagugauguaaauauacauacuucacagagccuauuauuuuuauuuuucaauucaguuu

SEQ ID NO: 677750 - RNA, 64 nt, Homo Sapiens
aaguauuacggaaguuugcuguaguuuuugaggugccuauuauauuuuauuuuuuacaucuaug

SEQ ID NO: 677751 - RNA, 64 nt, Homo Sapiens
aggcucuugagcaacagugaagcugccauaaauauuucucaacugagguucuugggauacagau

SEQ ID NO: 677752 - RNA, 64 nt, Homo Sapiens
caaaaaugaugcgcaucaauguauuuuaucuuauuuucucaaucuccucucucuuuccuccacc

SEQ ID NO: 677753 - RNA, 64 nt, Homo Sapiens
uauguaugguaaaggaccagacucuagggcagucuuucucaaacacuugugguggaguuauggu

SEQ ID NO: 677754 - RNA, 64 nt, Homo Sapiens
uaauguuauauguggccacaugcacuuucuuuccuuucucaaaaaaggcaucccuuuuggggca

SEQ ID NO: 677755 - RNA, 64 nt, Homo Sapiens
ggaaaguaaacaguguuggcggaaaacauaaacauuucucaaguaacuaccauuauuccuacug

SEQ ID NO: 677756 - RNA, 64 nt, Homo Sapiens
auccugugaggcaaauucgccuuucucaugacaguuucucaacaguuugguaccuaguauuaug

SEQ ID NO: 677757 - RNA, 64 nt, Homo Sapiens
auuuaaaaauauucuucugauaaaaggaaauaguuuucucaacccaaaggaaagguuauuccag

SEQ ID NO: 677758 - RNA, 64 nt, Homo Sapiens
uaauuaaucuuuaagcuucacuugaaaucuuuucuuucucaaauuuaacuaagguuuuguaaca

SEQ ID NO: 677759 - RNA, 64 nt, Homo Sapiens
uccagauuggcuagauuucaauugaaauucauguuuucucaagcauggaaagggauccugauug

SEQ ID NO: 677760 - RNA, 64 nt, Homo Sapiens
gccaucggaagaugcgaguuggagcuggcuugaguuucucaaaaaaacaggaaugugagcuggg

SEQ ID NO: 677761 - RNA, 64 nt, Homo Sapiens
auccucuugagccaguaaucugaagagcagaacauuucucaagaucucguuucugugaauuuca

SEQ ID NO: 677762 - RNA, 64 nt, Homo Sapiens
aaauuuuucuuuuuuuaacuugugucuuauuucuuuucucaaaacuuucucuauacuuugucuc

SEQ ID NO: 677763 - RNA, 64 nt, Homo Sapiens
cccuuucaguuacaaccaccuuuauucaaagccuuuucucaaaguggcuagguggaugacuagu

SEQ ID NO: 677764 - RNA, 64 nt, Homo Sapiens
uacacagauaaagcaugguuucuuguggauggauuuucucaaagaaacugacgcuuggcuccuu

SEQ ID NO: 677765 - RNA, 64 nt, Homo Sapiens
cacagcuuucccuucaaagagccauugagaaacauuucucaaacaggaaauccuucuuuuacua

SEQ ID NO: 677766 - RNA, 64 nt, Homo Sapiens
uuugugaccaguuucugucugcauguaauuuggauuucucaaauacauucauuaguaauuuauc

SEQ ID NO: 677767 - RNA, 64 nt, Homo Sapiens
gcuuccauggucuugcacuauaaacuggaauggauuucucaaugcgggaccagauuaugacuag

SEQ ID NO: 677768 - RNA, 64 nt, Homo Sapiens
ccucuggaguucagaacuuaaguaucagugcaaauuucucaaccuuucuggguuagacaaagau

SEQ ID NO: 677769 - RNA, 64 nt, Homo Sapiens
uuauuguauuuuccacuuauugcuuugaguuugcuuucucaacaucaauuuuuucauugaucua

SEQ ID NO: 677770 - RNA, 64 nt, Homo Sapiens
uuuucauugaucuaugcuuuaucauuuauguccauuucucaauuacucucuuuaaaaauacuaa

SEQ ID NO: 677771 - RNA, 64 nt, Homo Sapiens
guacacuuguauuauaauaauuguucuguauacauuucucaaaugauauguacauagcuguuuc

SEQ ID NO: 677772 - RNA, 64 nt, Homo Sapiens
uaaguauuuuaaacagccugcuaaugucugguuauuucucaaagaguuuugcaauucaaaacag

SEQ ID NO: 677773 - RNA, 64 nt, Homo Sapiens
ucuuguaucaggaagaaauacaaauuuugucauguuucucaagcaguuuuucugaguaguuucu

SEQ ID NO: 677774 - RNA, 64 nt, Homo Sapiens
cauaucaaaugucaaacuuuuacaugugaaugauuuucucaaagaacauagaaaagucaauaaa

SEQ ID NO: 677775 - RNA, 64 nt, Homo Sapiens
caaaacaauuauccugucuuauuuaagcuucaguuuucucaaaaaauugcaggucuuuuaagag

SEQ ID NO: 677776 - RNA, 64 nt, Homo Sapiens
gagguucguaaacccaucagcucagcuucuguuguuucucaacuccucaccugcguaaaauugu

SEQ ID NO: 677777 - RNA, 64 nt, Homo Sapiens
uauaguucaugaacuccuuggauauacaguaguguuucucaaagcuuaguuaaaauguaaaucu

SEQ ID NO: 677778 - RNA, 64 nt, Homo Sapiens
uuuuuuuaaaagucuuaguugcagucuauaaacauuucucaacaguuauuuaaaacaguuuucu

SEQ ID NO: 677779 - RNA, 64 nt, Homo Sapiens
guguuaauuuuucugcuguaauguaugcuugauauuucucaacucagauuaauauguagcaaaa

SEQ ID NO: 677780 - RNA, 64 nt, Homo Sapiens
guaauucagcaaaauaauaccagguagcuucuuuuuucucaaaucuauauuagaauagaugaag

SEQ ID NO: 677781 - RNA, 64 nt, Homo Sapiens
aauuguguacugcacuguaauuauguuuauuuuuuuucucaacuaacauuuuauaauauauauc

SEQ ID NO: 677782 - RNA, 64 nt, Homo Sapiens
uuuguuuuuguugacaaaacuauagugcgccauguuucucaaagugaaugaguuucuuagcuuu

SEQ ID NO: 677783 - RNA, 64 nt, Homo Sapiens
ccaguauaaugauacaucguagccuaagaaauauuuucucaauguaauucccuucccagcuacc

SEQ ID NO: 677784 - RNA, 64 nt, Homo Sapiens
uguuagcccucugggcaccaaggaaacuaacagcuuucucaaagcggugaccacucaggccagc

SEQ ID NO: 677785 - RNA, 64 nt, Homo Sapiens
gucuuuaaacccuaaaucugucaauaccuuccuauuucucaauaugaugaaacccaauaaucuc

SEQ ID NO: 677786 - RNA, 64 nt, Homo Sapiens
gucuuuaagcccuaaaucugucaauaccuuccuauuucucaauacucugaugaaacccagucuc

SEQ ID NO: 677787 - RNA, 64 nt, Homo Sapiens
acuucaguuuauaauuggaagccucuucauacguuuucucaagaguccuggcucucucucugcu

SEQ ID NO: 677788 - RNA, 64 nt, Homo Sapiens
auucagcucugcucugagcgauuggagaccccaguuucucaagagagcuccucuauccgaggcc

SEQ ID NO: 677789 - RNA, 64 nt, Homo Sapiens
cagucugaaaauugauagcauuuagcauuucuuuuuucucaaaaagaaacuguaggaaauacau

SEQ ID NO: 677790 - RNA, 64 nt, Homo Sapiens
ugaauuuuaaugucccuacuugugaauaauuagcuuucucaaauguaggcuuuuuacaaauuuu

SEQ ID NO: 677791 - RNA, 64 nt, Homo Sapiens
caguucccuuaggggagcugaaauaaauucacauuuucucaaagucucauagcuuuggaggagc

SEQ ID NO: 677792 - RNA, 64 nt, Homo Sapiens
caguuaucuaaacuagauuagauccaagccaaguuuucucaacagagagcaaagggccaggcag

SEQ ID NO: 677793 - RNA, 64 nt, Homo Sapiens
aguaacuaaaaaauugugucauuuauuuuuaaauuuucucaaaaucuaaucagcauuucaaugu

SEQ ID NO: 677794 - RNA, 64 nt, Homo Sapiens
ggaccacaucaucucucacugaagaaaacagacuuuucucaaauaaauuggaaugugauuuaag

SEQ ID NO: 677795 - RNA, 64 nt, Homo Sapiens
agcaaccaguaucacuucccuagugccgauaaacuuucucaaagcuaccuccccaagacuuuac

SEQ ID NO: 677796 - RNA, 64 nt, Homo Sapiens
uugaauuaugcuacucaccauauaugaugauuuuuuucucaauuguucaauuucaacauguaug

SEQ ID NO: 677797 - RNA, 64 nt, Homo Sapiens
ccauuaaaaacugggcaaaggccaugaauagaccuuucucaaaagaauacauacauguggcaau

SEQ ID NO: 677798 - RNA, 64 nt, Homo Sapiens
auuaauucagccauuguggaaagcacugcagcgauuucucaaagacauaaaagaacauagcauu

SEQ ID NO: 677799 - RNA, 64 nt, Homo Sapiens
gcauagauagggaugugagaguggaguaccuuccuuucucaagucucgagaugccagugaaacc

SEQ ID NO: 677800 - RNA, 64 nt, Homo Sapiens
uuugcuuaugguagugggcuaacauaacagccccuuucucaagcagagaccuggccccugggcc

SEQ ID NO: 677801 - RNA, 64 nt, Homo Sapiens; identical to SEQ ID NO: 89736

SEQ ID NO: 677802 - RNA, 64 nt, Homo Sapiens; identical to SEQ ID NO: 89737

SEQ ID NO: 677803 - RNA, 64 nt, Homo Sapiens; identical to SEQ ID NO: 89738

SEQ ID NO: 677804 - RNA, 64 nt, Homo Sapiens; identical to SEQ ID NO: 89739

SEQ ID NO: 677805 - RNA, 64 nt, Homo Sapiens; identical to SEQ ID NO: 89740

SEQ ID NO: 677806 - RNA, 64 nt, Homo Sapiens; identical to SEQ ID NO: 89741

SEQ ID NO: 677807 - RNA, 64 nt, Homo Sapiens; identical to SEQ ID NO: 89742

SEQ ID NO: 677808 - RNA, 64 nt, Homo Sapiens; identical to SEQ ID NO: 89743

SEQ ID NO: 677809 - RNA, 64 nt, Homo Sapiens; identical to SEQ ID NO: 89744

SEQ ID NO: 677810 - RNA, 64 nt, Homo Sapiens; identical to SEQ ID NO: 89745

SEQ ID NO: 677811 - RNA, 64 nt, Homo Sapiens; identical to SEQ ID NO: 89746

SEQ ID NO: 677812 - RNA, 64 nt, Homo Sapiens; identical to SEQ ID NO: 89747

SEQ ID NO: 677813 - RNA, 64 nt, Homo Sapiens; identical to SEQ ID NO: 89748

SEQ ID NO: 677814 - RNA, 64 nt, Homo Sapiens; identical to SEQ ID NO: 89749

SEQ ID NO: 677815 - RNA, 64 nt, Homo Sapiens; identical to SEQ ID NO: 89750

SEQ ID NO: 677816 - RNA, 64 nt, Homo Sapiens; identical to SEQ ID NO: 89751

SEQ ID NO: 677817 - RNA, 64 nt, Homo Sapiens; identical to SEQ ID NO: 89752

SEQ ID NO: 677818 - RNA, 64 nt, Homo Sapiens; identical to SEQ ID NO: 89753

SEQ ID NO: 677819 - RNA, 64 nt, Homo Sapiens; identical to SEQ ID NO: 89754

SEQ ID NO: 677820 - RNA, 64 nt, Homo Sapiens; identical to SEQ ID NO: 89755

SEQ ID NO: 677821 - RNA, 64 nt, Homo Sapiens; identical to SEQ ID NO: 89756

SEQ ID NO: 677822 - RNA, 64 nt, Homo Sapiens; identical to SEQ ID NO: 89757

SEQ ID NO: 677823 - RNA, 64 nt, Homo Sapiens; identical to SEQ ID NO: 162025

SEQ ID NO: 677824 - RNA, 64 nt, Homo Sapiens; identical to SEQ ID NO: 162026

SEQ ID NO: 677825 - RNA, 64 nt, Homo Sapiens; identical to SEQ ID NO: 162027

SEQ ID NO: 677826 - RNA, 64 nt, Homo Sapiens; identical to SEQ ID NO: 162028

SEQ ID NO: 677827 - RNA, 64 nt, Homo Sapiens; identical to SEQ ID NO: 162029

SEQ ID NO: 677828 - RNA, 64 nt, Homo Sapiens; identical to SEQ ID NO: 162030

SEQ ID NO: 677829 - RNA, 64 nt, Homo Sapiens; identical to SEQ ID NO: 162031

SEQ ID NO: 677830 - RNA, 64 nt, Homo Sapiens; identical to SEQ ID NO: 162032

SEQ ID NO: 677831 - RNA, 64 nt, Homo Sapiens; identical to SEQ ID NO: 162033

SEQ ID NO: 677832 - RNA, 64 nt, Homo Sapiens; identical to SEQ ID NO: 162034

SEQ ID NO: 677833 - RNA, 64 nt, Homo Sapiens; identical to SEQ ID NO: 162035

SEQ ID NO: 677834 - RNA, 64 nt, Homo Sapiens; identical to SEQ ID NO: 162036

SEQ ID NO: 677835 - RNA, 64 nt, Homo Sapiens; identical to SEQ ID NO: 162037

SEQ ID NO: 677836 - RNA, 64 nt, Homo Sapiens; identical to SEQ ID NO: 162038

SEQ ID NO: 677837 - RNA, 64 nt, Homo Sapiens; identical to SEQ ID NO: 162039

SEQ ID NO: 677838 - RNA, 64 nt, Homo Sapiens; identical to SEQ ID NO: 162040

SEQ ID NO: 677839 - RNA, 64 nt, Homo Sapiens; identical to SEQ ID NO: 162041

SEQ ID NO: 677840 - RNA, 64 nt, Homo Sapiens; identical to SEQ ID NO: 162042

SEQ ID NO: 677841 - RNA, 64 nt, Homo Sapiens; identical to SEQ ID NO: 162043

SEQ ID NO: 677842 - RNA, 64 nt, Homo Sapiens; identical to SEQ ID NO: 162044

SEQ ID NO: 677843 - RNA, 64 nt, Homo Sapiens; identical to SEQ ID NO: 162045

SEQ ID NO: 677844 - RNA, 64 nt, Homo Sapiens; identical to SEQ ID NO: 162046

SEQ ID NO: 677845 - RNA, 64 nt, Homo Sapiens; identical to SEQ ID NO: 162047

SEQ ID NO: 677846 - RNA, 64 nt, Homo Sapiens; identical to SEQ ID NO: 162048

SEQ ID NO: 677847 - RNA, 64 nt, Homo Sapiens; identical to SEQ ID NO: 162049

SEQ ID NO: 677848 - RNA, 64 nt, Homo Sapiens; identical to SEQ ID NO: 162050

SEQ ID NO: 677849 - RNA, 64 nt, Homo Sapiens; identical to SEQ ID NO: 162051

SEQ ID NO: 677850 - RNA, 64 nt, Homo Sapiens; identical to SEQ ID NO: 162052

SEQ ID NO: 677851 - RNA, 64 nt, Homo Sapiens; identical to SEQ ID NO: 162053

SEQ ID NO: 677852 - RNA, 64 nt, Homo Sapiens; identical to SEQ ID NO: 162054

SEQ ID NO: 677853 - RNA, 64 nt, Homo Sapiens; identical to SEQ ID NO: 162055

SEQ ID NO: 677854 - RNA, 64 nt, Homo Sapiens; identical to SEQ ID NO: 162056

SEQ ID NO: 677855 - RNA, 64 nt, Homo Sapiens; identical to SEQ ID NO: 162057

SEQ ID NO: 677856 - RNA, 64 nt, Homo Sapiens; identical to SEQ ID NO: 225055

SEQ ID NO: 677857 - RNA, 64 nt, Homo Sapiens; identical to SEQ ID NO: 225056

SEQ ID NO: 677858 - RNA, 64 nt, Homo Sapiens; identical to SEQ ID NO: 225057

SEQ ID NO: 677859 - RNA, 64 nt, Homo Sapiens; identical to SEQ ID NO: 225058

SEQ ID NO: 677860 - RNA, 64 nt, Homo Sapiens; identical to SEQ ID NO: 225059

SEQ ID NO: 677861 - RNA, 64 nt, Homo Sapiens; identical to SEQ ID NO: 225060

SEQ ID NO: 677862 - RNA, 64 nt, Homo Sapiens; identical to SEQ ID NO: 225061

SEQ ID NO: 677863 - RNA, 64 nt, Homo Sapiens; identical to SEQ ID NO: 225062

SEQ ID NO: 677864 - RNA, 64 nt, Homo Sapiens; identical to SEQ ID NO: 225063

SEQ ID NO: 677865 - RNA, 64 nt, Homo Sapiens; identical to SEQ ID NO: 225064

SEQ ID NO: 677866 - RNA, 64 nt, Homo Sapiens; identical to SEQ ID NO: 225065

SEQ ID NO: 677867 - RNA, 64 nt, Homo Sapiens; identical to SEQ ID NO: 225066

SEQ ID NO: 677868 - RNA, 64 nt, Homo Sapiens; identical to SEQ ID NO: 225067

SEQ ID NO: 677869 - RNA, 64 nt, Homo Sapiens; identical to SEQ ID NO: 225068

SEQ ID NO: 677870 - RNA, 64 nt, Homo Sapiens; identical to SEQ ID NO: 225069

SEQ ID NO: 677871 - RNA, 64 nt, Homo Sapiens; identical to SEQ ID NO: 225070

SEQ ID NO: 677872 - RNA, 64 nt, Homo Sapiens; identical to SEQ ID NO: 225071

SEQ ID NO: 677873 - RNA, 64 nt, Homo Sapiens; identical to SEQ ID NO: 225072

SEQ ID NO: 677874 - RNA, 64 nt, Homo Sapiens; identical to SEQ ID NO: 225073

SEQ ID NO: 677875 - RNA, 64 nt, Homo Sapiens; identical to SEQ ID NO: 225074

SEQ ID NO: 677876 - RNA, 64 nt, Homo Sapiens; identical to SEQ ID NO: 225075

SEQ ID NO: 677877 - RNA, 64 nt, Homo Sapiens; identical to SEQ ID NO: 225076

SEQ ID NO: 677878 - RNA, 64 nt, Homo Sapiens; identical to SEQ ID NO: 225077

SEQ ID NO: 677879 - RNA, 64 nt, Homo Sapiens; identical to SEQ ID NO: 225078

SEQ ID NO: 677880 - RNA, 64 nt, Homo Sapiens
acuguggccugcgucuccugaauaaaacuuccugaucuggaaccgacucuuccugcaugucagc

SEQ ID NO: 677881 - RNA, 64 nt, Homo Sapiens
aauggggccaccucuugccagccucaguuuccccaucuggaaaaaaguucccaaaccuccuugu

SEQ ID NO: 677882 - RNA, 64 nt, Homo Sapiens
agugcagagcuccuacccacguuguuccuauggaaucuggaaugucagagaagagucauuuuau

SEQ ID NO: 677883 - RNA, 64 nt, Homo Sapiens
cauguuguauugcagauaauucaagugccagucuaucuggaaucuaacaucauagccacagaaa

SEQ ID NO: 677884 - RNA, 64 nt, Homo Sapiens
cuaccaccaaucccgaucggacaagacaccugugaucuggaaauucuuauuagcuccccgcucc

SEQ ID NO: 677885 - RNA, 64 nt, Homo Sapiens
ccacgaccaaucccgaucggcugacuccacggggaucuggaaauugcccaggaaagaacuucag

SEQ ID NO: 677886 - RNA, 64 nt, Homo Sapiens
ggaagaaacaccccagcacacacuugugauuuuuaucuggaaaaaagagccgucaucagugucu

SEQ ID NO: 677887 - RNA, 64 nt, Homo Sapiens
auuauaaaggagaaagaagauacaagguggggaaaucuggaaaaagauuucagacauuaggcug

SEQ ID NO: 677888 - RNA, 64 nt, Homo Sapiens
uuauuuugagaggugggugauaugugagagagaaaucuggaaccuucuucuggguagauacagg

SEQ ID NO: 677889 - RNA, 64 nt, Homo Sapiens
uuuuucaugacaauguaauuuguguaacuguugaaucuggaaauugaucagcauuaaagggcac

SEQ ID NO: 677890 - RNA, 64 nt, Homo Sapiens
gugauacagcucuggcuuucugagcacacuacggaucuggaaaauacuggaaaaugugauacuu

SEQ ID NO: 677891 - RNA, 64 nt, Homo Sapiens
gaauucagaauucuuaggcaaccuucauaccuuuaucuggaaaaugccuucucuccagacaaua

SEQ ID NO: 677892 - RNA, 64 nt, Homo Sapiens
aagcaggaauuuauacauuggguaccagagcuaaaucuggaaaacacauuuggaaugagcuucc

SEQ ID NO: 677893 - RNA, 64 nt, Homo Sapiens
cuucuuccuagccuggaagcuggugaagcuaggcaucuggaagauuccuuccuucuccugggac

SEQ ID NO: 677894 - RNA, 64 nt, Homo Sapiens
uuccaggaacuuuucaccuguagauccacugaagaucuggaaaauugguauguggcaaugcuaa

SEQ ID NO: 677895 - RNA, 64 nt, Homo Sapiens
cacaucuuccaccagcaccuuacugcccaggccuaucuggaagccaccucaccaaggaccuugg

SEQ ID NO: 677896 - RNA, 64 nt, Homo Sapiens
uuuaugugcaaaaucuguuauagcuuuaaaauauaucuggaacuuuuuagauuauuccaagccu

SEQ ID NO: 677897 - RNA, 64 nt, Homo Sapiens
auaacacauacuccagccacagucuguauguacuaucuggaaagcuuccuguuucugcaugauc

SEQ ID NO: 677898 - RNA, 64 nt, Homo Sapiens
ccugggaaggcuggcugcuggggcccuguccuguaucuggaauuggagccgaggaggacggcgu

SEQ ID NO: 677899 - RNA, 64 nt, Homo Sapiens
ucagccuggccagacacaggcaugauggcaacagaucuggaaccucccaggacccugaaggggc

SEQ ID NO: 677900 - RNA, 64 nt, Homo Sapiens
cagacucagacauuggcaccggggucuggaguugaucuggaaccaauggggccagauccagccu

SEQ ID NO: 677901 - RNA, 64 nt, Homo Sapiens
cuuuuaaucaguuaaauugucuuggagucaagagaucuggaaauaagaaaugaaagaaaugacu

SEQ ID NO: 677902 - RNA, 64 nt, Homo Sapiens
gugagaucuguaagaaaugauuugcuaaagagaaaucuggaaguacaaaugauuucagaucaug

SEQ ID NO: 677903 - RNA, 64 nt, Homo Sapiens; identical to SEQ ID NO: 74555

SEQ ID NO: 677904 - RNA, 64 nt, Homo Sapiens; identical to SEQ ID NO: 74556

SEQ ID NO: 677905 - RNA, 64 nt, Homo Sapiens; identical to SEQ ID NO: 74557

SEQ ID NO: 677906 - RNA, 64 nt, Homo Sapiens; identical to SEQ ID NO: 74558

SEQ ID NO: 677907 - RNA, 64 nt, Homo Sapiens; identical to SEQ ID NO: 74559

SEQ ID NO: 677908 - RNA, 64 nt, Homo Sapiens; identical to SEQ ID NO: 74560

SEQ ID NO: 677909 - RNA, 64 nt, Homo Sapiens; identical to SEQ ID NO: 443317

SEQ ID NO: 677910 - RNA, 64 nt, Homo Sapiens; identical to SEQ ID NO: 443318

SEQ ID NO: 677911 - RNA, 64 nt, Homo Sapiens; identical to SEQ ID NO: 443319

SEQ ID NO: 677912 - RNA, 64 nt, Homo Sapiens; identical to SEQ ID NO: 443320

SEQ ID NO: 677913 - RNA, 64 nt, Homo Sapiens; identical to SEQ ID NO: 443321

SEQ ID NO: 677914 - RNA, 64 nt, Homo Sapiens; identical to SEQ ID NO: 443322

SEQ ID NO: 677915 - RNA, 64 nt, Homo Sapiens; identical to SEQ ID NO: 443323

SEQ ID NO: 677916 - RNA, 64 nt, Homo Sapiens; identical to SEQ ID NO: 443324

SEQ ID NO: 677917 - RNA, 64 nt, Homo Sapiens; identical to SEQ ID NO: 443325

SEQ ID NO: 677918 - RNA, 64 nt, Homo Sapiens; identical to SEQ ID NO: 443326

SEQ ID NO: 677919 - RNA, 64 nt, Homo Sapiens; identical to SEQ ID NO: 443327

SEQ ID NO: 677920 - RNA, 64 nt, Homo Sapiens; identical to SEQ ID NO: 443328

SEQ ID NO: 677921 - RNA, 64 nt, Homo Sapiens; identical to SEQ ID NO: 443329

SEQ ID NO: 677922 - RNA, 64 nt, Homo Sapiens; identical to SEQ ID NO: 443330

SEQ ID NO: 677923 - RNA, 64 nt, Homo Sapiens; identical to SEQ ID NO: 443331

SEQ ID NO: 677924 - RNA, 64 nt, Homo Sapiens; identical to SEQ ID NO: 443332

SEQ ID NO: 677925 - RNA, 64 nt, Homo Sapiens; identical to SEQ ID NO: 443333

SEQ ID NO: 677926 - RNA, 64 nt, Homo Sapiens; identical to SEQ ID NO: 443334

SEQ ID NO: 677927 - RNA, 64 nt, Homo Sapiens; identical to SEQ ID NO: 443335

SEQ ID NO: 677928 - RNA, 64 nt, Homo Sapiens; identical to SEQ ID NO: 443336

SEQ ID NO: 677929 - RNA, 64 nt, Homo Sapiens; identical to SEQ ID NO: 443337

SEQ ID NO: 677930 - RNA, 64 nt, Homo Sapiens; identical to SEQ ID NO: 443338

SEQ ID NO: 677931 - RNA, 64 nt, Homo Sapiens; identical to SEQ ID NO: 443339

SEQ ID NO: 677932 - RNA, 64 nt, Homo Sapiens; identical to SEQ ID NO: 443340

SEQ ID NO: 677933 - RNA, 64 nt, Homo Sapiens; identical to SEQ ID NO: 443341

SEQ ID NO: 677934 - RNA, 64 nt, Homo Sapiens; identical to SEQ ID NO: 443342

SEQ ID NO: 677935 - RNA, 64 nt, Homo Sapiens; identical to SEQ ID NO: 443343

SEQ ID NO: 677936 - RNA, 64 nt, Homo Sapiens; identical to SEQ ID NO: 443344

SEQ ID NO: 677937 - RNA, 64 nt, Homo Sapiens
aagaggaagaagaagaggaaguaguugaaaaugaugaggagauagccuuuucaggcaaggacaa

SEQ ID NO: 677938 - RNA, 64 nt, Homo Sapiens
uuucaggcaaggacaagccagcuucagagaauagugaggagaagcugaucaguaaguuugacaa

SEQ ID NO: 677939 - RNA, 64 nt, Homo Sapiens
gcuguaguuuuuaaaaauguuuuuaguuaaacguugaggagaaaaaaaaaaaaggcuuuucccc

SEQ ID NO: 677940 - RNA, 64 nt, Homo Sapiens
uagccaugcugacucaugaacagcucuuuuaucaugaggagaggauccccagaacucagcaacc

SEQ ID NO: 677941 - RNA, 64 nt, Homo Sapiens
guaaauugagguuuggggauauuugagggauacaugaggagagaaaguacuacagaggggaacc

SEQ ID NO: 677942 - RNA, 64 nt, Homo Sapiens
cacacgugacagaugaagaaaccaagggggcugcugaggagaccuggugcagggacuaauccug

SEQ ID NO: 677943 - RNA, 64 nt, Homo Sapiens
gcaguguggaaagugagaaaaaccuccauuguggugaggagaauacuucaaugucccuuguccu

SEQ ID NO: 677944 - RNA, 64 nt, Homo Sapiens
uagcaucugacuuugagucacagaaaccuuaaacugaggagacaauaguucagaaccuuuuuaa

SEQ ID NO: 677945 - RNA, 64 nt, Homo Sapiens
gccauuugcucuugccaaagugagauagauguacugaggagauaauugaaaagucagacucugu

SEQ ID NO: 677946 - RNA, 64 nt, Homo Sapiens
aagcauaaaaauauagcauauuaaucauagacuuugaggagagagaaugcauaagugccauccu

SEQ ID NO: 677947 - RNA, 64 nt, Homo Sapiens
uccuuuuucccuuuguuuuuacucaaaaauuacaugaggagaaagcuuuuuugcuacauagucu

SEQ ID NO: 677948 - RNA, 64 nt, Homo Sapiens
aggcugugcucucaggacagccccauuuuagggaugaggagacuucaccacgcccuccccuccc

SEQ ID NO: 677949 - RNA, 64 nt, Homo Sapiens
auccugaauguccucauuuuacagaugaggacauugaggagaagagacuuacccaggcucacac

SEQ ID NO: 677950 - RNA, 64 nt, Homo Sapiens
cccccugugugcugggugagguggccugggagcgugaggagaggugaaccugggggccauccug

SEQ ID NO: 677951 - RNA, 64 nt, Homo Sapiens
gggucggcucagcaggaggacagguagaacagggugaggagaggcccagguggcccagguggug

SEQ ID NO: 677952 - RNA, 64 nt, Homo Sapiens
gaagaaaauggcugcccauuaggaaacagaguugugaggagaaagaagugcuuugcaaggcuuc

SEQ ID NO: 677953 - RNA, 64 nt, Homo Sapiens
ggggaaggguacagagaaacgaggaauaggggccugaggagagaaagaccaagauaucaggaau

SEQ ID NO: 677954 - RNA, 64 nt, Homo Sapiens
uggaagugggcgaaaaaucucuuuccuuugaugcugaggagaaagauucacuucuuaccaugca

SEQ ID NO: 677955 - RNA, 63 nt, Homo Sapiens
ugcuuucagcccucaccuaacuagguccccaugugaggagaucacucagaaaagaccuccuag

SEQ ID NO: 677956 - RNA, 64 nt, Homo Sapiens
gcugggcggcagugaggugucaccccccuccagcugaggagaccaggcccaguggcagggguuu

SEQ ID NO: 677957 - RNA, 64 nt, Homo Sapiens
acgggggaagugagaggaaagaggcgggggcgggugaggagacuggccccaggccccagccacg

SEQ ID NO: 677958 - RNA, 64 nt, Homo Sapiens
cuaacccagcaguugccccacccuguguaguuguugaggagaagaagccucaacuuacccagga

SEQ ID NO: 677959 - RNA, 64 nt, Homo Sapiens
aaaauccucugccggaagcagaagcugggaaaauugaggagaguccuuucagugucgagguaua

SEQ ID NO: 677960 - RNA, 64 nt, Homo Sapiens
aguuugaaacccucuacaaugagcacaagagcugugaggagaagucagugaagaacaccagcau

SEQ ID NO: 677961 - RNA, 64 nt, Homo Sapiens
caacccaagcagaugacaggcacaggccaccgcaugaggagauggagggcgggacugggccgcc

SEQ ID NO: 677962 - RNA, 64 nt, Homo Sapiens
gagggggaguugcagaaagagagggcagugagggugaggagaggggaucuggggacuugggugu

SEQ ID NO: 677963 - RNA, 64 nt, Homo Sapiens
caaggguucugcgaagaggcaguggaagaaggcaugaggagagggucucuugagaauuugccaa

SEQ ID NO: 677964 - RNA, 64 nt, Homo Sapiens
ccauugguguaggaaaugagacccucucugaagcugaggagagcacguugaucugaacuuuaaa

SEQ ID NO: 677965 - RNA, 64 nt, Homo Sapiens
cuggagaaggugcagauucaaagugagcggcuccugaggagagccgccaaggcugcucgccuuc

SEQ ID NO: 677966 - RNA, 64 nt, Homo Sapiens
ucaagagcaguugacucacugaugaaggcccuggugaggagaaagcacucuguucuucgccuac

SEQ ID NO: 677967 - RNA, 64 nt, Homo Sapiens
cuccagcuauguaucgggaaccaugaucuauuuaugaggagaaggaaagccgauucuuuggaag

SEQ ID NO: 677968 - RNA, 64 nt, Homo Sapiens
aagcaacaauggccaacgaagcacugaugcggucugaggagacagcugaccuguuggcugaaaa

SEQ ID NO: 677969 - RNA, 64 nt, Homo Sapiens; identical to SEQ ID NO: 125533

SEQ ID NO: 677970 - RNA, 64 nt, Homo Sapiens; identical to SEQ ID NO: 125534

SEQ ID NO: 677971 - RNA, 64 nt, Homo Sapiens; identical to SEQ ID NO: 125535

SEQ ID NO: 677972 - RNA, 64 nt, Homo Sapiens; identical to SEQ ID NO: 125536

SEQ ID NO: 677973 - RNA, 64 nt, Homo Sapiens; identical to SEQ ID NO: 125537

SEQ ID NO: 677974 - RNA, 64 nt, Homo Sapiens; identical to SEQ ID NO: 125538

SEQ ID NO: 677975 - RNA, 64 nt, Homo Sapiens; identical to SEQ ID NO: 125539

SEQ ID NO: 677976 - RNA, 64 nt, Homo Sapiens; identical to SEQ ID NO: 125540

SEQ ID NO: 677977 - RNA, 64 nt, Homo Sapiens; identical to SEQ ID NO: 125541

SEQ ID NO: 677978 - RNA, 64 nt, Homo Sapiens; identical to SEQ ID NO: 125542

SEQ ID NO: 677979 - RNA, 64 nt, Homo Sapiens; identical to SEQ ID NO: 125543

SEQ ID NO: 677980 - RNA, 64 nt, Homo Sapiens; identical to SEQ ID NO: 125544

SEQ ID NO: 677981 - RNA, 64 nt, Homo Sapiens; identical to SEQ ID NO: 125545

SEQ ID NO: 677982 - RNA, 64 nt, Homo Sapiens; identical to SEQ ID NO: 125546

SEQ ID NO: 677983 - RNA, 64 nt, Homo Sapiens; identical to SEQ ID NO: 125547

SEQ ID NO: 677984 - RNA, 64 nt, Homo Sapiens; identical to SEQ ID NO: 125548

SEQ ID NO: 677985 - RNA, 64 nt, Homo Sapiens; identical to SEQ ID NO: 125549

SEQ ID NO: 677986 - RNA, 64 nt, Homo Sapiens; identical to SEQ ID NO: 125550

SEQ ID NO: 677987 - RNA, 64 nt, Homo Sapiens; identical to SEQ ID NO: 125551

SEQ ID NO: 677988 - RNA, 64 nt, Homo Sapiens; identical to SEQ ID NO: 125552

SEQ ID NO: 677989 - RNA, 64 nt, Homo Sapiens; identical to SEQ ID NO: 125553

SEQ ID NO: 677990 - RNA, 64 nt, Homo Sapiens; identical to SEQ ID NO: 125554

SEQ ID NO: 677991 - RNA, 64 nt, Homo Sapiens; identical to SEQ ID NO: 125555

SEQ ID NO: 677992 - RNA, 64 nt, Homo Sapiens; identical to SEQ ID NO: 125556

SEQ ID NO: 677993 - RNA, 64 nt, Homo Sapiens; identical to SEQ ID NO: 125557

SEQ ID NO: 677994 - RNA, 64 nt, Homo Sapiens; identical to SEQ ID NO: 125558

SEQ ID NO: 677995 - RNA, 64 nt, Homo Sapiens; identical to SEQ ID NO: 125559

SEQ ID NO: 677996 - RNA, 64 nt, Homo Sapiens; identical to SEQ ID NO: 125560

SEQ ID NO: 677997 - RNA, 64 nt, Homo Sapiens; identical to SEQ ID NO: 125561

SEQ ID NO: 677998 - RNA, 64 nt, Homo Sapiens; identical to SEQ ID NO: 125562

SEQ ID NO: 677999 - RNA, 64 nt, Homo Sapiens; identical to SEQ ID NO: 125563

SEQ ID NO: 678000 - RNA, 64 nt, Homo Sapiens; identical to SEQ ID NO: 125564

SEQ ID NO: 678001 - RNA, 64 nt, Homo Sapiens; identical to SEQ ID NO: 125565

SEQ ID NO: 678002 - RNA, 64 nt, Homo Sapiens; identical to SEQ ID NO: 125566

SEQ ID NO: 678003 - RNA, 64 nt, Homo Sapiens; identical to SEQ ID NO: 125567

SEQ ID NO: 678004 - RNA, 64 nt, Homo Sapiens; identical to SEQ ID NO: 125568

SEQ ID NO: 678005 - RNA, 64 nt, Homo Sapiens; identical to SEQ ID NO: 56766

SEQ ID NO: 678006 - RNA, 64 nt, Homo Sapiens; identical to SEQ ID NO: 56767

SEQ ID NO: 678007 - RNA, 64 nt, Homo Sapiens; identical to SEQ ID NO: 56768

SEQ ID NO: 678008 - RNA, 64 nt, Homo Sapiens; identical to SEQ ID NO: 56769

SEQ ID NO: 678009 - RNA, 64 nt, Homo Sapiens; identical to SEQ ID NO: 56770

SEQ ID NO: 678010 - RNA, 64 nt, Homo Sapiens; identical to SEQ ID NO: 56771

SEQ ID NO: 678011 - RNA, 64 nt, Homo Sapiens; identical to SEQ ID NO: 56772

SEQ ID NO: 678012 - RNA, 64 nt, Homo Sapiens; identical to SEQ ID NO: 56773

SEQ ID NO: 678013 - RNA, 64 nt, Homo Sapiens; identical to SEQ ID NO: 56774

SEQ ID NO: 678014 - RNA, 64 nt, Homo Sapiens; identical to SEQ ID NO: 56775

SEQ ID NO: 678015 - RNA, 64 nt, Homo Sapiens; identical to SEQ ID NO: 56776

SEQ ID NO: 678016 - RNA, 64 nt, Homo Sapiens; identical to SEQ ID NO: 56777

SEQ ID NO: 678017 - RNA, 64 nt, Homo Sapiens; identical to SEQ ID NO: 56778

SEQ ID NO: 678018 - RNA, 64 nt, Homo Sapiens; identical to SEQ ID NO: 56779

SEQ ID NO: 678019 - RNA, 64 nt, Homo Sapiens; identical to SEQ ID NO: 56780

SEQ ID NO: 678020 - RNA, 64 nt, Homo Sapiens; identical to SEQ ID NO: 56781

SEQ ID NO: 678021 - RNA, 64 nt, Homo Sapiens; identical to SEQ ID NO: 56782

SEQ ID NO: 678022 - RNA, 64 nt, Homo Sapiens; identical to SEQ ID NO: 56783

SEQ ID NO: 678023 - RNA, 64 nt, Homo Sapiens; identical to SEQ ID NO: 56784

SEQ ID NO: 678024 - RNA, 64 nt, Homo Sapiens; identical to SEQ ID NO: 56785

SEQ ID NO: 678025 - RNA, 64 nt, Homo Sapiens; identical to SEQ ID NO: 56786

SEQ ID NO: 678026 - RNA, 64 nt, Homo Sapiens; identical to SEQ ID NO: 56787

SEQ ID NO: 678027 - RNA, 64 nt, Homo Sapiens; identical to SEQ ID NO: 56788

SEQ ID NO: 678028 - RNA, 64 nt, Homo Sapiens; identical to SEQ ID NO: 56789

SEQ ID NO: 678029 - RNA, 64 nt, Homo Sapiens; identical to SEQ ID NO: 56790

SEQ ID NO: 678030 - RNA, 64 nt, Homo Sapiens; identical to SEQ ID NO: 56791

SEQ ID NO: 678031 - RNA, 64 nt, Homo Sapiens; identical to SEQ ID NO: 56792

SEQ ID NO: 678032 - RNA, 64 nt, Homo Sapiens; identical to SEQ ID NO: 56793

SEQ ID NO: 678033 - RNA, 64 nt, Homo Sapiens; identical to SEQ ID NO: 56794

SEQ ID NO: 678034 - RNA, 64 nt, Homo Sapiens; identical to SEQ ID NO: 56795

SEQ ID NO: 678035 - RNA, 64 nt, Homo Sapiens; identical to SEQ ID NO: 56796

SEQ ID NO: 678036 - RNA, 64 nt, Homo Sapiens; identical to SEQ ID NO: 56797

SEQ ID NO: 678037 - RNA, 64 nt, Homo Sapiens; identical to SEQ ID NO: 56798

SEQ ID NO: 678038 - RNA, 64 nt, Homo Sapiens; identical to SEQ ID NO: 56799

SEQ ID NO: 678039 - RNA, 64 nt, Homo Sapiens; identical to SEQ ID NO: 56800

SEQ ID NO: 678040 - RNA, 64 nt, Homo Sapiens; identical to SEQ ID NO: 56801

SEQ ID NO: 678041 - RNA, 64 nt, Homo Sapiens; identical to SEQ ID NO: 56802

SEQ ID NO: 678042 - RNA, 64 nt, Homo Sapiens; identical to SEQ ID NO: 56803

SEQ ID NO: 678043 - RNA, 64 nt, Homo Sapiens; identical to SEQ ID NO: 56804

SEQ ID NO: 678044 - RNA, 64 nt, Homo Sapiens; identical to SEQ ID NO: 56805

SEQ ID NO: 678045 - RNA, 64 nt, Homo Sapiens; identical to SEQ ID NO: 56806

SEQ ID NO: 678046 - RNA, 64 nt, Homo Sapiens; identical to SEQ ID NO: 56807

SEQ ID NO: 678047 - RNA, 64 nt, Homo Sapiens; identical to SEQ ID NO: 56808

SEQ ID NO: 678048 - RNA, 64 nt, Homo Sapiens; identical to SEQ ID NO: 56809

SEQ ID NO: 678049 - RNA, 64 nt, Homo Sapiens; identical to SEQ ID NO: 56810

SEQ ID NO: 678050 - RNA, 64 nt, Homo Sapiens; identical to SEQ ID NO: 56811

SEQ ID NO: 678051 - RNA, 63 nt, Homo Sapiens; identical to SEQ ID NO: 56812

SEQ ID NO: 678052 - RNA, 64 nt, Homo Sapiens; identical to SEQ ID NO: 56813

SEQ ID NO: 678053 - RNA, 64 nt, Homo Sapiens; identical to SEQ ID NO: 56814

SEQ ID NO: 678054 - RNA, 64 nt, Homo Sapiens; identical to SEQ ID NO: 56815

SEQ ID NO: 678055 - RNA, 64 nt, Homo Sapiens; identical to SEQ ID NO: 56816

SEQ ID NO: 678056 - RNA, 64 nt, Homo Sapiens; identical to SEQ ID NO: 56817

SEQ ID NO: 678057 - RNA, 64 nt, Homo Sapiens; identical to SEQ ID NO: 56818

SEQ ID NO: 678058 - RNA, 64 nt, Homo Sapiens; identical to SEQ ID NO: 56819

SEQ ID NO: 678059 - RNA, 64 nt, Homo Sapiens; identical to SEQ ID NO: 56820

SEQ ID NO: 678060 - RNA, 64 nt, Homo Sapiens; identical to SEQ ID NO: 56821

SEQ ID NO: 678061 - RNA, 64 nt, Homo Sapiens; identical to SEQ ID NO: 56822

SEQ ID NO: 678062 - RNA, 64 nt, Homo Sapiens; identical to SEQ ID NO: 56823

SEQ ID NO: 678063 - RNA, 64 nt, Homo Sapiens; identical to SEQ ID NO: 56824

SEQ ID NO: 678064 - RNA, 64 nt, Homo Sapiens; identical to SEQ ID NO: 56825

SEQ ID NO: 678065 - RNA, 64 nt, Homo Sapiens; identical to SEQ ID NO: 56826

SEQ ID NO: 678066 - RNA, 64 nt, Homo Sapiens; identical to SEQ ID NO: 56827

SEQ ID NO: 678067 - RNA, 64 nt, Homo Sapiens; identical to SEQ ID NO: 56828

SEQ ID NO: 678068 - RNA, 64 nt, Homo Sapiens; identical to SEQ ID NO: 56829

SEQ ID NO: 678069 - RNA, 64 nt, Homo Sapiens; identical to SEQ ID NO: 56830

SEQ ID NO: 678070 - RNA, 64 nt, Homo Sapiens; identical to SEQ ID NO: 56831

SEQ ID NO: 678071 - RNA, 64 nt, Homo Sapiens; identical to SEQ ID NO: 56832

SEQ ID NO: 678072 - RNA, 64 nt, Homo Sapiens; identical to SEQ ID NO: 56833

SEQ ID NO: 678073 - RNA, 64 nt, Homo Sapiens; identical to SEQ ID NO: 56834

SEQ ID NO: 678074 - RNA, 64 nt, Homo Sapiens
gcccaggccccacccgcacccaaagccauggcccgccgccgagacaggggaaacaggccaccgc

SEQ ID NO: 678075 - RNA, 64 nt, Homo Sapiens
ccccucuucccgccuugcgccgggggcgcggggcgccgccgagcgaacccggccaugaccuggg

SEQ ID NO: 678076 - RNA, 64 nt, Homo Sapiens; identical to SEQ ID NO: 56439

SEQ ID NO: 678077 - RNA, 64 nt, Homo Sapiens; identical to SEQ ID NO: 56440

SEQ ID NO: 678078 - RNA, 64 nt, Homo Sapiens; identical to SEQ ID NO: 56441

SEQ ID NO: 678079 - RNA, 64 nt, Homo Sapiens; identical to SEQ ID NO: 56442

SEQ ID NO: 678080 - RNA, 64 nt, Homo Sapiens; identical to SEQ ID NO: 56443

SEQ ID NO: 678081 - RNA, 64 nt, Homo Sapiens; identical to SEQ ID NO: 56444

SEQ ID NO: 678082 - RNA, 64 nt, Homo Sapiens; identical to SEQ ID NO: 56445

SEQ ID NO: 678083 - RNA, 64 nt, Homo Sapiens; identical to SEQ ID NO: 56446

SEQ ID NO: 678084 - RNA, 64 nt, Homo Sapiens; identical to SEQ ID NO: 56447

SEQ ID NO: 678085 - RNA, 64 nt, Homo Sapiens; identical to SEQ ID NO: 56448

SEQ ID NO: 678086 - RNA, 64 nt, Homo Sapiens; identical to SEQ ID NO: 56449

SEQ ID NO: 678087 - RNA, 64 nt, Homo Sapiens; identical to SEQ ID NO: 56450

SEQ ID NO: 678088 - RNA, 64 nt, Homo Sapiens; identical to SEQ ID NO: 56451

SEQ ID NO: 678089 - RNA, 64 nt, Homo Sapiens; identical to SEQ ID NO: 56452

SEQ ID NO: 678090 - RNA, 64 nt, Homo Sapiens; identical to SEQ ID NO: 56453

SEQ ID NO: 678091 - RNA, 64 nt, Homo Sapiens; identical to SEQ ID NO: 56454

SEQ ID NO: 678092 - RNA, 64 nt, Homo Sapiens; identical to SEQ ID NO: 56455

SEQ ID NO: 678093 - RNA, 64 nt, Homo Sapiens; identical to SEQ ID NO: 56456

SEQ ID NO: 678094 - RNA, 64 nt, Homo Sapiens; identical to SEQ ID NO: 56457

SEQ ID NO: 678095 - RNA, 64 nt, Homo Sapiens; identical to SEQ ID NO: 56458

SEQ ID NO: 678096 - RNA, 64 nt, Homo Sapiens; identical to SEQ ID NO: 56459

SEQ ID NO: 678097 - RNA, 64 nt, Homo Sapiens; identical to SEQ ID NO: 56460

SEQ ID NO: 678098 - RNA, 64 nt, Homo Sapiens; identical to SEQ ID NO: 56461

SEQ ID NO: 678099 - RNA, 64 nt, Homo Sapiens; identical to SEQ ID NO: 56462

SEQ ID NO: 678100 - RNA, 64 nt, Homo Sapiens; identical to SEQ ID NO: 56463

SEQ ID NO: 678101 - RNA, 64 nt, Homo Sapiens; identical to SEQ ID NO: 56464

SEQ ID NO: 678102 - RNA, 64 nt, Homo Sapiens; identical to SEQ ID NO: 56465

SEQ ID NO: 678103 - RNA, 64 nt, Homo Sapiens; identical to SEQ ID NO: 56466

SEQ ID NO: 678104 - RNA, 64 nt, Homo Sapiens; identical to SEQ ID NO: 56467

SEQ ID NO: 678105 - RNA, 50 nt, Homo Sapiens; identical to SEQ ID NO: 56468

SEQ ID NO: 678106 - RNA, 64 nt, Homo Sapiens; identical to SEQ ID NO: 56469

SEQ ID NO: 678107 - RNA, 64 nt, Homo Sapiens; identical to SEQ ID NO: 56470

SEQ ID NO: 678108 - RNA, 64 nt, Homo Sapiens; identical to SEQ ID NO: 56471

SEQ ID NO: 678109 - RNA, 64 nt, Homo Sapiens; identical to SEQ ID NO: 56472

SEQ ID NO: 678110 - RNA, 64 nt, Homo Sapiens; identical to SEQ ID NO: 56473

SEQ ID NO: 678111 - RNA, 64 nt, Homo Sapiens; identical to SEQ ID NO: 56474

SEQ ID NO: 678112 - RNA, 64 nt, Homo Sapiens; identical to SEQ ID NO: 56475

SEQ ID NO: 678113 - RNA, 64 nt, Homo Sapiens; identical to SEQ ID NO: 56476

SEQ ID NO: 678114 - RNA, 64 nt, Homo Sapiens; identical to SEQ ID NO: 56477

SEQ ID NO: 678115 - RNA, 64 nt, Homo Sapiens; identical to SEQ ID NO: 56478

SEQ ID NO: 678116 - RNA, 64 nt, Homo Sapiens; identical to SEQ ID NO: 56479

SEQ ID NO: 678117 - RNA, 64 nt, Homo Sapiens; identical to SEQ ID NO: 56480

SEQ ID NO: 678118 - RNA, 64 nt, Homo Sapiens; identical to SEQ ID NO: 56481

SEQ ID NO: 678119 - RNA, 64 nt, Homo Sapiens; identical to SEQ ID NO: 56482

SEQ ID NO: 678120 - RNA, 64 nt, Homo Sapiens; identical to SEQ ID NO: 56483

SEQ ID NO: 678121 - RNA, 64 nt, Homo Sapiens; identical to SEQ ID NO: 56484

SEQ ID NO: 678122 - RNA, 64 nt, Homo Sapiens; identical to SEQ ID NO: 56485

SEQ ID NO: 678123 - RNA, 64 nt, Homo Sapiens; identical to SEQ ID NO: 56486

SEQ ID NO: 678124 - RNA, 64 nt, Homo Sapiens; identical to SEQ ID NO: 56487

SEQ ID NO: 678125 - RNA, 64 nt, Homo Sapiens; identical to SEQ ID NO: 56488

SEQ ID NO: 678126 - RNA, 64 nt, Homo Sapiens; identical to SEQ ID NO: 56489

SEQ ID NO: 678127 - RNA, 64 nt, Homo Sapiens; identical to SEQ ID NO: 56490

SEQ ID NO: 678128 - RNA, 64 nt, Homo Sapiens; identical to SEQ ID NO: 56491

SEQ ID NO: 678129 - RNA, 64 nt, Homo Sapiens; identical to SEQ ID NO: 56492

SEQ ID NO: 678130 - RNA, 64 nt, Homo Sapiens; identical to SEQ ID NO: 56493

SEQ ID NO: 678131 - RNA, 64 nt, Homo Sapiens; identical to SEQ ID NO: 56494

SEQ ID NO: 678132 - RNA, 64 nt, Homo Sapiens; identical to SEQ ID NO: 56495

SEQ ID NO: 678133 - RNA, 64 nt, Homo Sapiens; identical to SEQ ID NO: 56496

SEQ ID NO: 678134 - RNA, 64 nt, Homo Sapiens; identical to SEQ ID NO: 56497

SEQ ID NO: 678135 - RNA, 64 nt, Homo Sapiens; identical to SEQ ID NO: 56498

SEQ ID NO: 678136 - RNA, 64 nt, Homo Sapiens; identical to SEQ ID NO: 56499

SEQ ID NO: 678137 - RNA, 64 nt, Homo Sapiens; identical to SEQ ID NO: 56500

SEQ ID NO: 678138 - RNA, 64 nt, Homo Sapiens; identical to SEQ ID NO: 56501

SEQ ID NO: 678139 - RNA, 64 nt, Homo Sapiens; identical to SEQ ID NO: 56502

SEQ ID NO: 678140 - RNA, 64 nt, Homo Sapiens; identical to SEQ ID NO: 56503

SEQ ID NO: 678141 - RNA, 64 nt, Homo Sapiens; identical to SEQ ID NO: 56504

SEQ ID NO: 678142 - RNA, 64 nt, Homo Sapiens; identical to SEQ ID NO: 56505

SEQ ID NO: 678143 - RNA, 64 nt, Homo Sapiens; identical to SEQ ID NO: 56506

SEQ ID NO: 678144 - RNA, 64 nt, Homo Sapiens; identical to SEQ ID NO: 56507

SEQ ID NO: 678145 - RNA, 64 nt, Homo Sapiens; identical to SEQ ID NO: 56508

SEQ ID NO: 678146 - RNA, 64 nt, Homo Sapiens; identical to SEQ ID NO: 56509

SEQ ID NO: 678147 - RNA, 64 nt, Homo Sapiens; identical to SEQ ID NO: 56510

SEQ ID NO: 678148 - RNA, 64 nt, Homo Sapiens; identical to SEQ ID NO: 56511

SEQ ID NO: 678149 - RNA, 64 nt, Homo Sapiens; identical to SEQ ID NO: 56512

SEQ ID NO: 678150 - RNA, 64 nt, Homo Sapiens; identical to SEQ ID NO: 56513

SEQ ID NO: 678151 - RNA, 64 nt, Homo Sapiens; identical to SEQ ID NO: 56514

SEQ ID NO: 678152 - RNA, 64 nt, Homo Sapiens; identical to SEQ ID NO: 56515

SEQ ID NO: 678153 - RNA, 64 nt, Homo Sapiens; identical to SEQ ID NO: 56516

SEQ ID NO: 678154 - RNA, 64 nt, Homo Sapiens; identical to SEQ ID NO: 56517

SEQ ID NO: 678155 - RNA, 64 nt, Homo Sapiens; identical to SEQ ID NO: 56518

SEQ ID NO: 678156 - RNA, 64 nt, Homo Sapiens; identical to SEQ ID NO: 56519

SEQ ID NO: 678157 - RNA, 64 nt, Homo Sapiens; identical to SEQ ID NO: 56520

SEQ ID NO: 678158 - RNA, 64 nt, Homo Sapiens; identical to SEQ ID NO: 56521

SEQ ID NO: 678159 - RNA, 64 nt, Homo Sapiens; identical to SEQ ID NO: 56522

SEQ ID NO: 678160 - RNA, 64 nt, Homo Sapiens; identical to SEQ ID NO: 56523

SEQ ID NO: 678161 - RNA, 64 nt, Homo Sapiens; identical to SEQ ID NO: 56524

SEQ ID NO: 678162 - RNA, 64 nt, Homo Sapiens; identical to SEQ ID NO: 56525

SEQ ID NO: 678163 - RNA, 64 nt, Homo Sapiens; identical to SEQ ID NO: 56526

SEQ ID NO: 678164 - RNA, 64 nt, Homo Sapiens; identical to SEQ ID NO: 56527

SEQ ID NO: 678165 - RNA, 64 nt, Homo Sapiens; identical to SEQ ID NO: 56528

SEQ ID NO: 678166 - RNA, 64 nt, Homo Sapiens; identical to SEQ ID NO: 56529

SEQ ID NO: 678167 - RNA, 64 nt, Homo Sapiens; identical to SEQ ID NO: 56530

SEQ ID NO: 678168 - RNA, 64 nt, Homo Sapiens; identical to SEQ ID NO: 56531

SEQ ID NO: 678169 - RNA, 64 nt, Homo Sapiens; identical to SEQ ID NO: 56532

SEQ ID NO: 678170 - RNA, 64 nt, Homo Sapiens; identical to SEQ ID NO: 56533

SEQ ID NO: 678171 - RNA, 64 nt, Homo Sapiens; identical to SEQ ID NO: 56534

SEQ ID NO: 678172 - RNA, 59 nt, Homo Sapiens; identical to SEQ ID NO: 56535

SEQ ID NO: 678173 - RNA, 64 nt, Homo Sapiens; identical to SEQ ID NO: 56536

SEQ ID NO: 678174 - RNA, 64 nt, Homo Sapiens; identical to SEQ ID NO: 56537

SEQ ID NO: 678175 - RNA, 64 nt, Homo Sapiens; identical to SEQ ID NO: 56538

SEQ ID NO: 678176 - RNA, 64 nt, Homo Sapiens; identical to SEQ ID NO: 56539

SEQ ID NO: 678177 - RNA, 64 nt, Homo Sapiens; identical to SEQ ID NO: 56540

SEQ ID NO: 678178 - RNA, 64 nt, Homo Sapiens; identical to SEQ ID NO: 56541

SEQ ID NO: 678179 - RNA, 64 nt, Homo Sapiens; identical to SEQ ID NO: 56542

SEQ ID NO: 678180 - RNA, 64 nt, Homo Sapiens; identical to SEQ ID NO: 56543

SEQ ID NO: 678181 - RNA, 64 nt, Homo Sapiens; identical to SEQ ID NO: 56544

SEQ ID NO: 678182 - RNA, 64 nt, Homo Sapiens; identical to SEQ ID NO: 56545

SEQ ID NO: 678183 - RNA, 64 nt, Homo Sapiens; identical to SEQ ID NO: 56546

SEQ ID NO: 678184 - RNA, 64 nt, Homo Sapiens; identical to SEQ ID NO: 56547

SEQ ID NO: 678185 - RNA, 64 nt, Homo Sapiens; identical to SEQ ID NO: 56548

SEQ ID NO: 678186 - RNA, 64 nt, Homo Sapiens; identical to SEQ ID NO: 56549

SEQ ID NO: 678187 - RNA, 64 nt, Homo Sapiens; identical to SEQ ID NO: 56550

SEQ ID NO: 678188 - RNA, 64 nt, Homo Sapiens; identical to SEQ ID NO: 56551

SEQ ID NO: 678189 - RNA, 64 nt, Homo Sapiens; identical to SEQ ID NO: 56552

SEQ ID NO: 678190 - RNA, 64 nt, Homo Sapiens; identical to SEQ ID NO: 56553

SEQ ID NO: 678191 - RNA, 64 nt, Homo Sapiens; identical to SEQ ID NO: 56554

SEQ ID NO: 678192 - RNA, 64 nt, Homo Sapiens; identical to SEQ ID NO: 56555

SEQ ID NO: 678193 - RNA, 64 nt, Homo Sapiens; identical to SEQ ID NO: 56556

SEQ ID NO: 678194 - RNA, 62 nt, Homo Sapiens; identical to SEQ ID NO: 56557

SEQ ID NO: 678195 - RNA, 58 nt, Homo Sapiens; identical to SEQ ID NO: 56558

SEQ ID NO: 678196 - RNA, 64 nt, Homo Sapiens; identical to SEQ ID NO: 56559

SEQ ID NO: 678197 - RNA, 64 nt, Homo Sapiens; identical to SEQ ID NO: 56560

SEQ ID NO: 678198 - RNA, 64 nt, Homo Sapiens; identical to SEQ ID NO: 56561

SEQ ID NO: 678199 - RNA, 64 nt, Homo Sapiens; identical to SEQ ID NO: 56562

SEQ ID NO: 678200 - RNA, 64 nt, Homo Sapiens; identical to SEQ ID NO: 56563

SEQ ID NO: 678201 - RNA, 64 nt, Homo Sapiens; identical to SEQ ID NO: 56564

SEQ ID NO: 678202 - RNA, 64 nt, Homo Sapiens; identical to SEQ ID NO: 56565

SEQ ID NO: 678203 - RNA, 64 nt, Homo Sapiens; identical to SEQ ID NO: 56566

SEQ ID NO: 678204 - RNA, 64 nt, Homo Sapiens; identical to SEQ ID NO: 56567

SEQ ID NO: 678205 - RNA, 64 nt, Homo Sapiens; identical to SEQ ID NO: 56568

SEQ ID NO: 678206 - RNA, 64 nt, Homo Sapiens; identical to SEQ ID NO: 56569

SEQ ID NO: 678207 - RNA, 64 nt, Homo Sapiens; identical to SEQ ID NO: 56570

SEQ ID NO: 678208 - RNA, 64 nt, Homo Sapiens; identical to SEQ ID NO: 56571

SEQ ID NO: 678209 - RNA, 64 nt, Homo Sapiens; identical to SEQ ID NO: 56572

SEQ ID NO: 678210 - RNA, 64 nt, Homo Sapiens; identical to SEQ ID NO: 56573

SEQ ID NO: 678211 - RNA, 64 nt, Homo Sapiens; identical to SEQ ID NO: 56574

SEQ ID NO: 678212 - RNA, 64 nt, Homo Sapiens; identical to SEQ ID NO: 56575

SEQ ID NO: 678213 - RNA, 64 nt, Homo Sapiens; identical to SEQ ID NO: 56576

SEQ ID NO: 678214 - RNA, 64 nt, Homo Sapiens; identical to SEQ ID NO: 56577

SEQ ID NO: 678215 - RNA, 64 nt, Homo Sapiens; identical to SEQ ID NO: 56578

SEQ ID NO: 678216 - RNA, 64 nt, Homo Sapiens; identical to SEQ ID NO: 56579

SEQ ID NO: 678217 - RNA, 64 nt, Homo Sapiens; identical to SEQ ID NO: 56580

SEQ ID NO: 678218 - RNA, 64 nt, Homo Sapiens; identical to SEQ ID NO: 56581

SEQ ID NO: 678219 - RNA, 64 nt, Homo Sapiens; identical to SEQ ID NO: 56582

SEQ ID NO: 678220 - RNA, 60 nt, Homo Sapiens
cuccccgccuucuuggugacaaauagugagggcuccuauaccuuguccuuccugcuugcc

SEQ ID NO: 678221 - RNA, 60 nt, Homo Sapiens
aagacaacucuaggggaccauuuugccuggggcuccuagcaaaccuuuuuauuuauuuua

SEQ ID NO: 678222 - RNA, 60 nt, Homo Sapiens
aucaacgcgcggcugaacaugggcauccuaggcuccuacgacccucagcagaucuucaag

SEQ ID NO: 678223 - RNA, 60 nt, Homo Sapiens
cugguggcugcccagagcuaccuguacagcggcuccuaccagacaaucaaggugcgcuug

SEQ ID NO: 678224 - RNA, 60 nt, Homo Sapiens
uaccagaagggcuucaaagauauaggguguggcuccuaccagcaaacagcugaaagagga

SEQ ID NO: 678225 - RNA, 60 nt, Homo Sapiens
ccuaaggaagccagucaccuucugggcaagggcuccuaucuuuccucccuauccauggca

SEQ ID NO: 678226 - RNA, 64 nt, Homo Sapiens; identical to SEQ ID NO: 363631

SEQ ID NO: 678227 - RNA, 64 nt, Homo Sapiens; identical to SEQ ID NO: 363632

SEQ ID NO: 678228 - RNA, 64 nt, Homo Sapiens; identical to SEQ ID NO: 363633

SEQ ID NO: 678229 - RNA, 64 nt, Homo Sapiens; identical to SEQ ID NO: 363634

SEQ ID NO: 678230 - RNA, 64 nt, Homo Sapiens; identical to SEQ ID NO: 363635

SEQ ID NO: 678231 - RNA, 64 nt, Homo Sapiens; identical to SEQ ID NO: 363636

SEQ ID NO: 678232 - RNA, 64 nt, Homo Sapiens; identical to SEQ ID NO: 363637

SEQ ID NO: 678233 - RNA, 64 nt, Homo Sapiens; identical to SEQ ID NO: 363638

SEQ ID NO: 678234 - RNA, 64 nt, Homo Sapiens; identical to SEQ ID NO: 363639

SEQ ID NO: 678235 - RNA, 64 nt, Homo Sapiens; identical to SEQ ID NO: 363640

SEQ ID NO: 678236 - RNA, 64 nt, Homo Sapiens; identical to SEQ ID NO: 363641

SEQ ID NO: 678237 - RNA, 64 nt, Homo Sapiens; identical to SEQ ID NO: 363642

SEQ ID NO: 678238 - RNA, 63 nt, Homo Sapiens; identical to SEQ ID NO: 363643

SEQ ID NO: 678239 - RNA, 64 nt, Homo Sapiens; identical to SEQ ID NO: 363644

SEQ ID NO: 678240 - RNA, 64 nt, Homo Sapiens; identical to SEQ ID NO: 363645

SEQ ID NO: 678241 - RNA, 64 nt, Homo Sapiens; identical to SEQ ID NO: 363646

SEQ ID NO: 678242 - RNA, 64 nt, Homo Sapiens; identical to SEQ ID NO: 363647

SEQ ID NO: 678243 - RNA, 64 nt, Homo Sapiens; identical to SEQ ID NO: 363648

SEQ ID NO: 678244 - RNA, 64 nt, Homo Sapiens; identical to SEQ ID NO: 363649

SEQ ID NO: 678245 - RNA, 64 nt, Homo Sapiens; identical to SEQ ID NO: 363650

SEQ ID NO: 678246 - RNA, 64 nt, Homo Sapiens; identical to SEQ ID NO: 363651

SEQ ID NO: 678247 - RNA, 64 nt, Homo Sapiens; identical to SEQ ID NO: 363652

SEQ ID NO: 678248 - RNA, 64 nt, Homo Sapiens; identical to SEQ ID NO: 363653

SEQ ID NO: 678249 - RNA, 64 nt, Homo Sapiens; identical to SEQ ID NO: 363654

SEQ ID NO: 678250 - RNA, 64 nt, Homo Sapiens; identical to SEQ ID NO: 363655

SEQ ID NO: 678251 - RNA, 64 nt, Homo Sapiens; identical to SEQ ID NO: 363656

SEQ ID NO: 678252 - RNA, 64 nt, Homo Sapiens; identical to SEQ ID NO: 363657

SEQ ID NO: 678253 - RNA, 64 nt, Homo Sapiens; identical to SEQ ID NO: 363658

SEQ ID NO: 678254 - RNA, 64 nt, Homo Sapiens; identical to SEQ ID NO: 363659

SEQ ID NO: 678255 - RNA, 64 nt, Homo Sapiens; identical to SEQ ID NO: 363660

SEQ ID NO: 678256 - RNA, 64 nt, Homo Sapiens; identical to SEQ ID NO: 363661

SEQ ID NO: 678257 - RNA, 64 nt, Homo Sapiens; identical to SEQ ID NO: 363662

SEQ ID NO: 678258 - RNA, 64 nt, Homo Sapiens; identical to SEQ ID NO: 363663

SEQ ID NO: 678259 - RNA, 64 nt, Homo Sapiens; identical to SEQ ID NO: 363664

SEQ ID NO: 678260 - RNA, 64 nt, Homo Sapiens; identical to SEQ ID NO: 363665

SEQ ID NO: 678261 - RNA, 57 nt, Homo Sapiens; identical to SEQ ID NO: 262389

SEQ ID NO: 678262 - RNA, 64 nt, Homo Sapiens; identical to SEQ ID NO: 363667

SEQ ID NO: 678263 - RNA, 64 nt, Homo Sapiens; identical to SEQ ID NO: 363668

SEQ ID NO: 678264 - RNA, 64 nt, Homo Sapiens; identical to SEQ ID NO: 363669

SEQ ID NO: 678265 - RNA, 64 nt, Homo Sapiens; identical to SEQ ID NO: 363670

SEQ ID NO: 678266 - RNA, 64 nt, Homo Sapiens; identical to SEQ ID NO: 363671

SEQ ID NO: 678267 - RNA, 64 nt, Homo Sapiens; identical to SEQ ID NO: 363672

SEQ ID NO: 678268 - RNA, 64 nt, Homo Sapiens; identical to SEQ ID NO: 363673

SEQ ID NO: 678269 - RNA, 64 nt, Homo Sapiens; identical to SEQ ID NO: 363674

SEQ ID NO: 678270 - RNA, 64 nt, Homo Sapiens; identical to SEQ ID NO: 363675

SEQ ID NO: 678271 - RNA, 64 nt, Homo Sapiens; identical to SEQ ID NO: 363676

SEQ ID NO: 678272 - RNA, 64 nt, Homo Sapiens; identical to SEQ ID NO: 363677

SEQ ID NO: 678273 - RNA, 64 nt, Homo Sapiens; identical to SEQ ID NO: 363678

SEQ ID NO: 678274 - RNA, 64 nt, Homo Sapiens; identical to SEQ ID NO: 363679

SEQ ID NO: 678275 - RNA, 64 nt, Homo Sapiens; identical to SEQ ID NO: 363680

SEQ ID NO: 678276 - RNA, 64 nt, Homo Sapiens; identical to SEQ ID NO: 209092

SEQ ID NO: 678277 - RNA, 64 nt, Homo Sapiens; identical to SEQ ID NO: 209093

SEQ ID NO: 678278 - RNA, 64 nt, Homo Sapiens; identical to SEQ ID NO: 209094

SEQ ID NO: 678279 - RNA, 64 nt, Homo Sapiens; identical to SEQ ID NO: 209095

SEQ ID NO: 678280 - RNA, 64 nt, Homo Sapiens; identical to SEQ ID NO: 209096

SEQ ID NO: 678281 - RNA, 64 nt, Homo Sapiens; identical to SEQ ID NO: 209097

SEQ ID NO: 678282 - RNA, 64 nt, Homo Sapiens; identical to SEQ ID NO: 209098

SEQ ID NO: 678283 - RNA, 64 nt, Homo Sapiens; identical to SEQ ID NO: 209099

SEQ ID NO: 678284 - RNA, 64 nt, Homo Sapiens; identical to SEQ ID NO: 209100

SEQ ID NO: 678285 - RNA, 64 nt, Homo Sapiens; identical to SEQ ID NO: 209101

SEQ ID NO: 678286 - RNA, 64 nt, Homo Sapiens; identical to SEQ ID NO: 209102

SEQ ID NO: 678287 - RNA, 64 nt, Homo Sapiens; identical to SEQ ID NO: 209103

SEQ ID NO: 678288 - RNA, 64 nt, Homo Sapiens; identical to SEQ ID NO: 209104

SEQ ID NO: 678289 - RNA, 64 nt, Homo Sapiens; identical to SEQ ID NO: 209105

SEQ ID NO: 678290 - RNA, 64 nt, Homo Sapiens; identical to SEQ ID NO: 209106

SEQ ID NO: 678291 - RNA, 64 nt, Homo Sapiens; identical to SEQ ID NO: 209107

SEQ ID NO: 678292 - RNA, 64 nt, Homo Sapiens; identical to SEQ ID NO: 209108

SEQ ID NO: 678293 - RNA, 64 nt, Homo Sapiens; identical to SEQ ID NO: 209109

SEQ ID NO: 678294 - RNA, 64 nt, Homo Sapiens; identical to SEQ ID NO: 209110

SEQ ID NO: 678295 - RNA, 64 nt, Homo Sapiens; identical to SEQ ID NO: 209111

SEQ ID NO: 678296 - RNA, 64 nt, Homo Sapiens; identical to SEQ ID NO: 209112

SEQ ID NO: 678297 - RNA, 64 nt, Homo Sapiens; identical to SEQ ID NO: 209113

SEQ ID NO: 678298 - RNA, 59 nt, Homo Sapiens; identical to SEQ ID NO: 209114

SEQ ID NO: 678299 - RNA, 64 nt, Homo Sapiens; identical to SEQ ID NO: 209115

SEQ ID NO: 678300 - RNA, 64 nt, Homo Sapiens; identical to SEQ ID NO: 209116

SEQ ID NO: 678301 - RNA, 64 nt, Homo Sapiens; identical to SEQ ID NO: 209117

SEQ ID NO: 678302 - RNA, 64 nt, Homo Sapiens; identical to SEQ ID NO: 209118

SEQ ID NO: 678303 - RNA, 64 nt, Homo Sapiens; identical to SEQ ID NO: 209119

SEQ ID NO: 678304 - RNA, 64 nt, Homo Sapiens; identical to SEQ ID NO: 209120

SEQ ID NO: 678305 - RNA, 64 nt, Homo Sapiens; identical to SEQ ID NO: 209121

SEQ ID NO: 678306 - RNA, 64 nt, Homo Sapiens; identical to SEQ ID NO: 209122

SEQ ID NO: 678307 - RNA, 64 nt, Homo Sapiens; identical to SEQ ID NO: 209123

SEQ ID NO: 678308 - RNA, 64 nt, Homo Sapiens; identical to SEQ ID NO: 209124

SEQ ID NO: 678309 - RNA, 64 nt, Homo Sapiens; identical to SEQ ID NO: 209125

SEQ ID NO: 678310 - RNA, 64 nt, Homo Sapiens; identical to SEQ ID NO: 209126

SEQ ID NO: 678311 - RNA, 64 nt, Homo Sapiens; identical to SEQ ID NO: 209127

SEQ ID NO: 678312 - RNA, 64 nt, Homo Sapiens; identical to SEQ ID NO: 209128

SEQ ID NO: 678313 - RNA, 64 nt, Homo Sapiens; identical to SEQ ID NO: 209129

SEQ ID NO: 678314 - RNA, 64 nt, Homo Sapiens; identical to SEQ ID NO: 209130

SEQ ID NO: 678315 - RNA, 64 nt, Homo Sapiens; identical to SEQ ID NO: 209131

SEQ ID NO: 678316 - RNA, 64 nt, Homo Sapiens; identical to SEQ ID NO: 209132

SEQ ID NO: 678317 - RNA, 64 nt, Homo Sapiens; identical to SEQ ID NO: 209133

SEQ ID NO: 678318 - RNA, 64 nt, Homo Sapiens; identical to SEQ ID NO: 209134

SEQ ID NO: 678319 - RNA, 64 nt, Homo Sapiens; identical to SEQ ID NO: 209135

SEQ ID NO: 678320 - RNA, 64 nt, Homo Sapiens; identical to SEQ ID NO: 209136

SEQ ID NO: 678321 - RNA, 64 nt, Homo Sapiens; identical to SEQ ID NO: 209137

SEQ ID NO: 678322 - RNA, 64 nt, Homo Sapiens; identical to SEQ ID NO: 209138

SEQ ID NO: 678323 - RNA, 64 nt, Homo Sapiens; identical to SEQ ID NO: 209139

SEQ ID NO: 678324 - RNA, 64 nt, Homo Sapiens; identical to SEQ ID NO: 209140

SEQ ID NO: 678325 - RNA, 64 nt, Homo Sapiens; identical to SEQ ID NO: 209141

SEQ ID NO: 678326 - RNA, 64 nt, Homo Sapiens; identical to SEQ ID NO: 209142

SEQ ID NO: 678327 - RNA, 64 nt, Homo Sapiens; identical to SEQ ID NO: 209143

SEQ ID NO: 678328 - RNA, 64 nt, Homo Sapiens; identical to SEQ ID NO: 209144

SEQ ID NO: 678329 - RNA, 64 nt, Homo Sapiens; identical to SEQ ID NO: 209145

SEQ ID NO: 678330 - RNA, 64 nt, Homo Sapiens; identical to SEQ ID NO: 556078

SEQ ID NO: 678331 - RNA, 64 nt, Homo Sapiens; identical to SEQ ID NO: 556079

SEQ ID NO: 678332 - RNA, 64 nt, Homo Sapiens; identical to SEQ ID NO: 556080

SEQ ID NO: 678333 - RNA, 64 nt, Homo Sapiens; identical to SEQ ID NO: 556081

SEQ ID NO: 678334 - RNA, 64 nt, Homo Sapiens; identical to SEQ ID NO: 556082

SEQ ID NO: 678335 - RNA, 64 nt, Homo Sapiens; identical to SEQ ID NO: 556083

SEQ ID NO: 678336 - RNA, 64 nt, Homo Sapiens; identical to SEQ ID NO: 556084

SEQ ID NO: 678337 - RNA, 64 nt, Homo Sapiens; identical to SEQ ID NO: 556085

SEQ ID NO: 678338 - RNA, 64 nt, Homo Sapiens; identical to SEQ ID NO: 556086

SEQ ID NO: 678339 - RNA, 64 nt, Homo Sapiens; identical to SEQ ID NO: 556087

SEQ ID NO: 678340 - RNA, 64 nt, Homo Sapiens; identical to SEQ ID NO: 556088

SEQ ID NO: 678341 - RNA, 64 nt, Homo Sapiens; identical to SEQ ID NO: 556089

SEQ ID NO: 678342 - RNA, 64 nt, Homo Sapiens; identical to SEQ ID NO: 556090

SEQ ID NO: 678343 - RNA, 64 nt, Homo Sapiens; identical to SEQ ID NO: 556091

SEQ ID NO: 678344 - RNA, 64 nt, Homo Sapiens; identical to SEQ ID NO: 556092

SEQ ID NO: 678345 - RNA, 64 nt, Homo Sapiens; identical to SEQ ID NO: 556093

SEQ ID NO: 678346 - RNA, 64 nt, Homo Sapiens; identical to SEQ ID NO: 556094

SEQ ID NO: 678347 - RNA, 64 nt, Homo Sapiens; identical to SEQ ID NO: 556095

SEQ ID NO: 678348 - RNA, 61 nt, Homo Sapiens
gaguugguaaaggguuaauaugaguuuuacccagacucaagacauccauaauuuggggccc

SEQ ID NO: 678349 - RNA, 61 nt, Homo Sapiens
gggcuggauuuugguucccuagccucguguccagacucagaaagggcaggaccaauggcug

SEQ ID NO: 678350 - RNA, 61 nt, Homo Sapiens
gcagcacuuccacaccaagacucugucccugcagacucaguggccccgcuccugcccauuc

SEQ ID NO: 678351 - RNA, 61 nt, Homo Sapiens
ccacugccuugccagucuugaucuucucuggcagacucagcugggcgggcagcagcucccc

SEQ ID NO: 678352 - RNA, 61 nt, Homo Sapiens
caccucggaaaaauaccaacucagugaaauacagacucaaguuucgcuuuggauaauauuc

SEQ ID NO: 678353 - RNA, 61 nt, Homo Sapiens
ccugccucagccucccaaguagcugggauuacagacucaugccaccacgccagcuaauuuu

SEQ ID NO: 678354 - RNA, 61 nt, Homo Sapiens
gcguucccuccagaacucccgccacagucuccagacucaugaggcuccaccgcacagaaga

SEQ ID NO: 678355 - RNA, 61 nt, Homo Sapiens
accaucuacuauugauuuuauuucuugaggccagacucauccccagugcuauucagggucc

SEQ ID NO: 678356 - RNA, 61 nt, Homo Sapiens
gugggcugagugcugaguguccugugggcaucagacucagcauggccagcauuacccuuua

SEQ ID NO: 678357 - RNA, 61 nt, Homo Sapiens
cuuuuuuaaacaauaaaugucuaucuaauuccagacucacgaacuuguucaaccaucacca

SEQ ID NO: 678358 - RNA, 64 nt, Homo Sapiens; identical to SEQ ID NO: 276395

SEQ ID NO: 678359 - RNA, 64 nt, Homo Sapiens; identical to SEQ ID NO: 276396

SEQ ID NO: 678360 - RNA, 64 nt, Homo Sapiens; identical to SEQ ID NO: 276397

SEQ ID NO: 678361 - RNA, 64 nt, Homo Sapiens; identical to SEQ ID NO: 276398

SEQ ID NO: 678362 - RNA, 64 nt, Homo Sapiens; identical to SEQ ID NO: 276399

SEQ ID NO: 678363 - RNA, 64 nt, Homo Sapiens; identical to SEQ ID NO: 276400

SEQ ID NO: 678364 - RNA, 64 nt, Homo Sapiens; identical to SEQ ID NO: 276401

SEQ ID NO: 678365 - RNA, 64 nt, Homo Sapiens; identical to SEQ ID NO: 276402

SEQ ID NO: 678366 - RNA, 64 nt, Homo Sapiens; identical to SEQ ID NO: 276403

SEQ ID NO: 678367 - RNA, 64 nt, Homo Sapiens; identical to SEQ ID NO: 276404

SEQ ID NO: 678368 - RNA, 64 nt, Homo Sapiens; identical to SEQ ID NO: 276405

SEQ ID NO: 678369 - RNA, 64 nt, Homo Sapiens; identical to SEQ ID NO: 276406

SEQ ID NO: 678370 - RNA, 64 nt, Homo Sapiens; identical to SEQ ID NO: 276407

SEQ ID NO: 678371 - RNA, 64 nt, Homo Sapiens; identical to SEQ ID NO: 276408

SEQ ID NO: 678372 - RNA, 64 nt, Homo Sapiens; identical to SEQ ID NO: 276409

SEQ ID NO: 678373 - RNA, 64 nt, Homo Sapiens; identical to SEQ ID NO: 276410

SEQ ID NO: 678374 - RNA, 64 nt, Homo Sapiens; identical to SEQ ID NO: 276411

SEQ ID NO: 678375 - RNA, 64 nt, Homo Sapiens; identical to SEQ ID NO: 276412

SEQ ID NO: 678376 - RNA, 64 nt, Homo Sapiens; identical to SEQ ID NO: 276413

SEQ ID NO: 678377 - RNA, 64 nt, Homo Sapiens; identical to SEQ ID NO: 276414

SEQ ID NO: 678378 - RNA, 64 nt, Homo Sapiens; identical to SEQ ID NO: 276415

SEQ ID NO: 678379 - RNA, 64 nt, Homo Sapiens; identical to SEQ ID NO: 276416

SEQ ID NO: 678380 - RNA, 64 nt, Homo Sapiens; identical to SEQ ID NO: 276417

SEQ ID NO: 678381 - RNA, 64 nt, Homo Sapiens; identical to SEQ ID NO: 276418

SEQ ID NO: 678382 - RNA, 64 nt, Homo Sapiens; identical to SEQ ID NO: 276419

SEQ ID NO: 678383 - RNA, 64 nt, Homo Sapiens; identical to SEQ ID NO: 276420

SEQ ID NO: 678384 - RNA, 64 nt, Homo Sapiens
uggcccugggcccaggugggggucgccugcuuccuucccggacaggguccugcaguggccaaug

SEQ ID NO: 678385 - RNA, 64 nt, Homo Sapiens
uggcugagagcaguccugcagccucauuccuuaguucccggagcuggcaagggcuggagccccg

SEQ ID NO: 678386 - RNA, 64 nt, Homo Sapiens
acagcccugggagggggcuauagcccucagucaguucccggagcuggggugggcccauaauagu

SEQ ID NO: 678387 - RNA, 64 nt, Homo Sapiens
ccuccucucgccuggacccaguuaugaggugccuuucccggaacgugugugcugcgcugaguga

SEQ ID NO: 678388 - RNA, 64 nt, Homo Sapiens
uuuaagugucucuacaacuuuauuugaauccccuuucccggaauugguuuuugacuuaaauucc

SEQ ID NO: 678389 - RNA, 64 nt, Homo Sapiens
auccagcugggcuagaggcuacugucucugccucuucccggagacccugugucuuuuucgccaa

SEQ ID NO: 678390 - RNA, 64 nt, Homo Sapiens
auccgaaagacaaggugaacuuggguccuaucccuucccggauguagccaugauggaaaggauc

SEQ ID NO: 678391 - RNA, 64 nt, Homo Sapiens
ugggguggccacuuaucuguccaggacugauucuuucccggagauccugcacugguccuauccc

SEQ ID NO: 678392 - RNA, 64 nt, Homo Sapiens
gaugucaugagaucccuggcuucuccccauguuguucccggacaagggcagaagggaggcaugg

SEQ ID NO: 678393 - RNA, 64 nt, Homo Sapiens
ugcggcgaugccacgggccuuacacugugugugcuucccggaccggcacgcagcuuccuucaag

SEQ ID NO: 678394 - RNA, 64 nt, Homo Sapiens
aagcugucuuuauaagcaggaugcucauagugguuucccggagccaguagucacgguggaccau

SEQ ID NO: 678395 - RNA, 64 nt, Homo Sapiens
caguagggugugaagcugggagcagaucauguauuucccggagacgugggaccuugcuggcaug

SEQ ID NO: 678396 - RNA, 62 nt, Homo Sapiens
augggucucagccgagccucgccgcgugaagguucccggaggcagccuaugccucccacuag

SEQ ID NO: 678397 - RNA, 64 nt, Homo Sapiens
gugcccuccuucccagcacuaucaugugucacguuucccggacucugccccuacaucucagcug

SEQ ID NO: 678398 - RNA, 64 nt, Homo Sapiens
ggacacugacucccaugcacauucacugggcaccuucccggagccugccgccucacccuucagc

SEQ ID NO: 678399 - RNA, 64 nt, Homo Sapiens
cgguugcccacuucacagguagugcuauggacaguucccggaaaaggaccuggucaccccagca

SEQ ID NO: 678400 - RNA, 64 nt, Homo Sapiens
aggugggaccgauguggcacacgccagcugcgguuucccggagcguggagaggcagugcugcug

SEQ ID NO: 678401 - RNA, 64 nt, Homo Sapiens
aauuagggaagacguaugguucaagcagcaaaaguucccggaacuauagcaauucacgcauucu

SEQ ID NO: 678402 - RNA, 64 nt, Homo Sapiens
cagcgcggccucaaccaggguggaaagcagauauuucccggacccucccacccaggugccccgu

SEQ ID NO: 678403 - RNA, 64 nt, Homo Sapiens
cggaggccggcgccuuccccucgucgcuuccgcuuucccggacgcuugugcagcgcggcgccgc

SEQ ID NO: 678404 - RNA, 64 nt, Homo Sapiens
ugggaaaaaucgugaugauggguaaggggaaaacuucccggaaggcaauggggcaaggaaaaag

SEQ ID NO: 678405 - RNA, 64 nt, Homo Sapiens
ccggugccccaggggcggcuggcacagugcccccuucccggacggguggcaggcccuggagagg

SEQ ID NO: 678406 - RNA, 64 nt, Homo Sapiens
ucccacucccucugccgcacgccgcccgucuauguucccggacuuuguccagugcagugcccuc

SEQ ID NO: 678407 - RNA, 64 nt, Homo Sapiens
ucuuuggcaacuucuguauuaugcacgugaagccuucccggagccagcgagcauaugcugcaug

SEQ ID NO: 678408 - RNA, 64 nt, Homo Sapiens
gguaaaaaaaaaaaaaaaaaucauacagcucuucuucccggaacgccccugcaccucugcuccg

SEQ ID NO: 678409 - RNA, 64 nt, Homo Sapiens
gucugcucccgucuggcugccagacguccuucucuucccggauaagaagcagaggaccuuccag

SEQ ID NO: 678410 - RNA, 64 nt, Homo Sapiens
ccacgcaugugaguugggucgagggagcaguaccuucccggaguuacugcucagaauuuggagg

SEQ ID NO: 678411 - RNA, 59 nt, Homo Sapiens
ccugccgccggaaaagaugaagcuggcccuucccggagucaccccgaugauuacucuuu

SEQ ID NO: 678412 - RNA, 64 nt, Homo Sapiens
auuacugguuuuguaacuuguucugguaauguccuucccggacucuuuuuaaaugucucccccu

SEQ ID NO: 678413 - RNA, 64 nt, Homo Sapiens
cggucacagccaguccagaggccaguugccugccuucccggaccccuccccggguuggcucucc

SEQ ID NO: 678414 - RNA, 64 nt, Homo Sapiens
cugcguccucagcgggcugagcugccagagagucuucccggaccuauucccguccuaugcauuc

SEQ ID NO: 678415 - RNA, 64 nt, Homo Sapiens
cgccuggguccaaugcucaggugcuggggccugguucccggagaagugugccuucucucucccu

SEQ ID NO: 678416 - RNA, 64 nt, Homo Sapiens
ucaucagaacuuugaauuuuuugggguugcuuuuuucccggaauauuuguaaucuuuuaccacu

SEQ ID NO: 678417 - RNA, 64 nt, Homo Sapiens
cuuccaccccacugggcccauucccucucccucauucccggaccugaguccugagacacuuagc

SEQ ID NO: 678418 - RNA, 64 nt, Homo Sapiens
gggcauucaucauugugcuggccucuuucccuuguucccggaugccaacaaggcaaggucaccu

SEQ ID NO: 678419 - RNA, 64 nt, Homo Sapiens
ccgcgccuagcucagccaaucagucuguugugguuucccggauuugaaauacaggagcagagua

SEQ ID NO: 678420 - RNA, 64 nt, Homo Sapiens
ucuucugguagccgugcagggggcuagucuguucuucccggacacugaccacacucccuacuca

SEQ ID NO: 678421 - RNA, 64 nt, Homo Sapiens
acgggaaccugagacagcuccagcuucgcagcccuucccggagcuacagggggauccucuagca

SEQ ID NO: 678422 - RNA, 64 nt, Homo Sapiens
agaggccugaggagcccagagcacuugacugagcuucccggaaacuggcccuaaccugucuguc

SEQ ID NO: 678423 - RNA, 64 nt, Homo Sapiens
caccccuccaguuuugccugagaaggggcagauguucccggagcagaagacgucuccccuucuc

SEQ ID NO: 678424 - RNA, 64 nt, Homo Sapiens
ugugaaaccugggagaccagaguccccuuuaggguucccggagcuccgggaagacccgcccauc

SEQ ID NO: 678425 - RNA, 64 nt, Homo Sapiens
aauccucuucauucauugcuuugaaacagccugauucccggaagcuuaucuuggauguuuuaga

SEQ ID NO: 678426 - RNA, 64 nt, Homo Sapiens
cccucucaggagagugugcaacuggccagccaauuucccggagccaucacccucacccacucug

SEQ ID NO: 678427 - RNA, 64 nt, Homo Sapiens
cucugccgaggcugcuggaaucgacuggggcaucuucccggaaucagauucaaaggugaggagg

SEQ ID NO: 678428 - RNA, 64 nt, Homo Sapiens
gcaagcagggcucugccccaaagccaacuuggcuuucccggacuacauuucccugugcugacgg

SEQ ID NO: 678429 - RNA, 64 nt, Homo Sapiens
ccagggaauucauacugugauaaccaauuaccuuuucccggauuugcugagggaggaccucagu

SEQ ID NO: 678430 - RNA, 64 nt, Homo Sapiens
uagaaaaccagcucagcacugugacaucagguuuuucccggacuccucuccccugccugcccug

SEQ ID NO: 678431 - RNA, 64 nt, Homo Sapiens
gcaucgcugacccccacgccgagggcuugccguuuucccggaggacguggacuuuugugagaca

SEQ ID NO: 678432 - RNA, 64 nt, Homo Sapiens
cuggcccuguggccaggaggcgagaagguggcuguucccggauugacggcuuuuucccgggggc

SEQ ID NO: 678433 - RNA, 64 nt, Homo Sapiens
agggacgcuguuugguucuaugugguuggucuguuucccggacaagaaaaauugcaaucaaaug

SEQ ID NO: 678434 - RNA, 64 nt, Homo Sapiens
agcuccgccuccccugcccucccaccugggcaccuucccggaccaggccccgacccuguuguga

SEQ ID NO: 678435 - RNA, 64 nt, Homo Sapiens
ccgcccacccgggacccgccgggcguggaggggcuucccggacaccccgcuggagaggcaccau

SEQ ID NO: 678436 - RNA, 64 nt, Homo Sapiens
ccacgcuucuccuccgugccucugugccccuaucuucccggagaugguuuguaauggaaccuuu

SEQ ID NO: 678437 - RNA, 64 nt, Homo Sapiens
gcacuaggcugggagcucugcaguuccauggcccuucccggacuacucugaggagggcaaggga

SEQ ID NO: 678438 - RNA, 64 nt, Homo Sapiens
cagggagccgccgugaugagcacagccaacccaguucccggagggcuggggcggugcaggcucu

SEQ ID NO: 678439 - RNA, 64 nt, Homo Sapiens
gugccucacucaccugggacgcucggugaggacguucccggacagaagcagugacacucccguc

SEQ ID NO: 678440 - RNA, 64 nt, Homo Sapiens
gaaacugugaaugcuucugaagcaaacaggaagauucccggaggacccaggggacgcgcuggaa

SEQ ID NO: 678441 - RNA, 64 nt, Homo Sapiens
gaaucagcugcugacugucuaccugccaugcugguucccggaaugggcccugaccagccccggc

SEQ ID NO: 678442 - RNA, 64 nt, Homo Sapiens
gcauuccugccgcgcucccccgaccagaggauucuucccggaagcugcagcgcgagggcuccgg

SEQ ID NO: 678443 - RNA, 64 nt, Homo Sapiens
gagcggggaacgcgacguacccgcaggcagguacuucccggagcccccacacccuugauccgcc

SEQ ID NO: 678444 - RNA, 64 nt, Homo Sapiens
cggaagccaggaggaaacuaucuagaauggauuuuucccggagcauccaggcuuaccugcuugg

SEQ ID NO: 678445 - RNA, 64 nt, Homo Sapiens
agcucuggguguuugugaguuuguuggucugaguuucccggaugugcucugugccaucggcucc

SEQ ID NO: 678446 - RNA, 61 nt, Homo Sapiens; identical to SEQ ID NO: 286917

SEQ ID NO: 678447 - RNA, 64 nt, Homo Sapiens; identical to SEQ ID NO: 286918

SEQ ID NO: 678448 - RNA, 64 nt, Homo Sapiens; identical to SEQ ID NO: 286919

SEQ ID NO: 678449 - RNA, 64 nt, Homo Sapiens; identical to SEQ ID NO: 286920

SEQ ID NO: 678450 - RNA, 64 nt, Homo Sapiens; identical to SEQ ID NO: 286921

SEQ ID NO: 678451 - RNA, 64 nt, Homo Sapiens; identical to SEQ ID NO: 286922

SEQ ID NO: 678452 - RNA, 64 nt, Homo Sapiens; identical to SEQ ID NO: 286923

SEQ ID NO: 678453 - RNA, 64 nt, Homo Sapiens; identical to SEQ ID NO: 286924

SEQ ID NO: 678454 - RNA, 64 nt, Homo Sapiens; identical to SEQ ID NO: 286925

SEQ ID NO: 678455 - RNA, 64 nt, Homo Sapiens; identical to SEQ ID NO: 286926

SEQ ID NO: 678456 - RNA, 64 nt, Homo Sapiens; identical to SEQ ID NO: 286927

SEQ ID NO: 678457 - RNA, 64 nt, Homo Sapiens; identical to SEQ ID NO: 286928

SEQ ID NO: 678458 - RNA, 64 nt, Homo Sapiens; identical to SEQ ID NO: 286929

SEQ ID NO: 678459 - RNA, 64 nt, Homo Sapiens; identical to SEQ ID NO: 286930

SEQ ID NO: 678460 - RNA, 64 nt, Homo Sapiens; identical to SEQ ID NO: 286931

SEQ ID NO: 678461 - RNA, 64 nt, Homo Sapiens; identical to SEQ ID NO: 286932

SEQ ID NO: 678462 - RNA, 64 nt, Homo Sapiens; identical to SEQ ID NO: 286933

SEQ ID NO: 678463 - RNA, 64 nt, Homo Sapiens; identical to SEQ ID NO: 286934

SEQ ID NO: 678464 - RNA, 64 nt, Homo Sapiens; identical to SEQ ID NO: 286935

SEQ ID NO: 678465 - RNA, 64 nt, Homo Sapiens; identical to SEQ ID NO: 286936

SEQ ID NO: 678466 - RNA, 64 nt, Homo Sapiens; identical to SEQ ID NO: 286937

SEQ ID NO: 678467 - RNA, 64 nt, Homo Sapiens; identical to SEQ ID NO: 286938

SEQ ID NO: 678468 - RNA, 64 nt, Homo Sapiens; identical to SEQ ID NO: 286939

SEQ ID NO: 678469 - RNA, 64 nt, Homo Sapiens; identical to SEQ ID NO: 286940

SEQ ID NO: 678470 - RNA, 64 nt, Homo Sapiens; identical to SEQ ID NO: 286941

SEQ ID NO: 678471 - RNA, 64 nt, Homo Sapiens; identical to SEQ ID NO: 286942

SEQ ID NO: 678472 - RNA, 64 nt, Homo Sapiens; identical to SEQ ID NO: 286943

SEQ ID NO: 678473 - RNA, 64 nt, Homo Sapiens; identical to SEQ ID NO: 286944

SEQ ID NO: 678474 - RNA, 64 nt, Homo Sapiens; identical to SEQ ID NO: 286945

SEQ ID NO: 678475 - RNA, 64 nt, Homo Sapiens; identical to SEQ ID NO: 286946

SEQ ID NO: 678476 - RNA, 64 nt, Homo Sapiens; identical to SEQ ID NO: 286947

SEQ ID NO: 678477 - RNA, 64 nt, Homo Sapiens; identical to SEQ ID NO: 286948

SEQ ID NO: 678478 - RNA, 64 nt, Homo Sapiens; identical to SEQ ID NO: 286949

SEQ ID NO: 678479 - RNA, 64 nt, Homo Sapiens; identical to SEQ ID NO: 286950

SEQ ID NO: 678480 - RNA, 64 nt, Homo Sapiens; identical to SEQ ID NO: 286951

SEQ ID NO: 678481 - RNA, 64 nt, Homo Sapiens; identical to SEQ ID NO: 286952

SEQ ID NO: 678482 - RNA, 64 nt, Homo Sapiens; identical to SEQ ID NO: 286953

SEQ ID NO: 678483 - RNA, 64 nt, Homo Sapiens; identical to SEQ ID NO: 286954

SEQ ID NO: 678484 - RNA, 64 nt, Homo Sapiens; identical to SEQ ID NO: 286955

SEQ ID NO: 678485 - RNA, 64 nt, Homo Sapiens; identical to SEQ ID NO: 286956

SEQ ID NO: 678486 - RNA, 64 nt, Homo Sapiens; identical to SEQ ID NO: 286957

SEQ ID NO: 678487 - RNA, 64 nt, Homo Sapiens; identical to SEQ ID NO: 286958

SEQ ID NO: 678488 - RNA, 64 nt, Homo Sapiens; identical to SEQ ID NO: 286959

SEQ ID NO: 678489 - RNA, 64 nt, Homo Sapiens; identical to SEQ ID NO: 286960

SEQ ID NO: 678490 - RNA, 64 nt, Homo Sapiens; identical to SEQ ID NO: 286961

SEQ ID NO: 678491 - RNA, 64 nt, Homo Sapiens; identical to SEQ ID NO: 286962

SEQ ID NO: 678492 - RNA, 64 nt, Homo Sapiens; identical to SEQ ID NO: 286963

SEQ ID NO: 678493 - RNA, 64 nt, Homo Sapiens; identical to SEQ ID NO: 286964

SEQ ID NO: 678494 - RNA, 64 nt, Homo Sapiens; identical to SEQ ID NO: 286965

SEQ ID NO: 678495 - RNA, 64 nt, Homo Sapiens; identical to SEQ ID NO: 286966

SEQ ID NO: 678496 - RNA, 64 nt, Homo Sapiens; identical to SEQ ID NO: 286967

SEQ ID NO: 678497 - RNA, 64 nt, Homo Sapiens; identical to SEQ ID NO: 286968

SEQ ID NO: 678498 - RNA, 64 nt, Homo Sapiens; identical to SEQ ID NO: 286969

SEQ ID NO: 678499 - RNA, 64 nt, Homo Sapiens; identical to SEQ ID NO: 286970

SEQ ID NO: 678500 - RNA, 64 nt, Homo Sapiens; identical to SEQ ID NO: 286971

SEQ ID NO: 678501 - RNA, 64 nt, Homo Sapiens; identical to SEQ ID NO: 286972

SEQ ID NO: 678502 - RNA, 64 nt, Homo Sapiens; identical to SEQ ID NO: 286973

SEQ ID NO: 678503 - RNA, 64 nt, Homo Sapiens; identical to SEQ ID NO: 286974

SEQ ID NO: 678504 - RNA, 64 nt, Homo Sapiens; identical to SEQ ID NO: 286975

SEQ ID NO: 678505 - RNA, 64 nt, Homo Sapiens; identical to SEQ ID NO: 286976

SEQ ID NO: 678506 - RNA, 64 nt, Homo Sapiens; identical to SEQ ID NO: 286977

SEQ ID NO: 678507 - RNA, 64 nt, Homo Sapiens; identical to SEQ ID NO: 286978

SEQ ID NO: 678508 - RNA, 64 nt, Homo Sapiens; identical to SEQ ID NO: 286979

SEQ ID NO: 678509 - RNA, 64 nt, Homo Sapiens; identical to SEQ ID NO: 286980

SEQ ID NO: 678510 - RNA, 64 nt, Homo Sapiens; identical to SEQ ID NO: 286981

SEQ ID NO: 678511 - RNA, 64 nt, Homo Sapiens; identical to SEQ ID NO: 286982

SEQ ID NO: 678512 - RNA, 64 nt, Homo Sapiens; identical to SEQ ID NO: 286983

SEQ ID NO: 678513 - RNA, 64 nt, Homo Sapiens; identical to SEQ ID NO: 286984

SEQ ID NO: 678514 - RNA, 64 nt, Homo Sapiens; identical to SEQ ID NO: 286985

SEQ ID NO: 678515 - RNA, 64 nt, Homo Sapiens; identical to SEQ ID NO: 286986

SEQ ID NO: 678516 - RNA, 64 nt, Homo Sapiens; identical to SEQ ID NO: 286987

SEQ ID NO: 678517 - RNA, 64 nt, Homo Sapiens; identical to SEQ ID NO: 286988

SEQ ID NO: 678518 - RNA, 64 nt, Homo Sapiens; identical to SEQ ID NO: 286989

SEQ ID NO: 678519 - RNA, 64 nt, Homo Sapiens; identical to SEQ ID NO: 286990

SEQ ID NO: 678520 - RNA, 64 nt, Homo Sapiens
agggcagacgccgugugucuguuucacggauuccguuggugaaccuguaaaaacaaaacaaaca

SEQ ID NO: 678521 - RNA, 64 nt, Homo Sapiens
aggcccuuaaaugacagccugcauuugcuagacgguuggugaguggcaucaaaugugugacuua

SEQ ID NO: 678522 - RNA, 64 nt, Homo Sapiens
aucacaucagaguggcugagggcaguugcucuguguuggugaaauugcuguggggguaucgggg

SEQ ID NO: 678523 - RNA, 64 nt, Homo Sapiens
agccuuccugucaacagcgacaggaaaucucuagguuggugagugcuggugaugugagccuaca

SEQ ID NO: 678524 - RNA, 64 nt, Homo Sapiens
ucauuuuacaaagcaguuuucugaauggggauuaguuggugauuguuuguaacaaauaugcuaa

SEQ ID NO: 678525 - RNA, 64 nt, Homo Sapiens
uuauuacugccacaucuccaugcaucagcaaaauguuggugacauuuuucuagccuggcagaac

SEQ ID NO: 678526 - RNA, 64 nt, Homo Sapiens
gugagaucuguuagcggcagaguccuaaagcacaguuggugauuccgaaucugacuuuggugac

SEQ ID NO: 678527 - RNA, 64 nt, Homo Sapiens
ugcgcagccggcuguggacgcccuuuggaaaagaguuggugaaaccccaucugggauuccuggg

SEQ ID NO: 678528 - RNA, 64 nt, Homo Sapiens
aucuaauaacauuaaaaugcggaaaauaugcaugguuggugagagcagaacuuaucucaggaaa

SEQ ID NO: 678529 - RNA, 64 nt, Homo Sapiens
aagaacuucagucuucugagacauuucugaaaagguuggugauguuuuaggcauagaacuacag

SEQ ID NO: 678530 - RNA, 64 nt, Homo Sapiens
uuaauaucaucuaaaaauaaagcauugaagugaaguuggugaaaauuuguuccuggucuaauuu

SEQ ID NO: 678531 - RNA, 64 nt, Homo Sapiens
cuucacauuuuuuccaccacacccaccaguagcuguuggugauugcauggugucucggugcaug

SEQ ID NO: 678532 - RNA, 64 nt, Homo Sapiens; identical to SEQ ID NO: 189531

SEQ ID NO: 678533 - RNA, 64 nt, Homo Sapiens; identical to SEQ ID NO: 189532

SEQ ID NO: 678534 - RNA, 64 nt, Homo Sapiens; identical to SEQ ID NO: 189533

SEQ ID NO: 678535 - RNA, 64 nt, Homo Sapiens; identical to SEQ ID NO: 189534

SEQ ID NO: 678536 - RNA, 64 nt, Homo Sapiens; identical to SEQ ID NO: 189535

SEQ ID NO: 678537 - RNA, 64 nt, Homo Sapiens; identical to SEQ ID NO: 189536

SEQ ID NO: 678538 - RNA, 64 nt, Homo Sapiens; identical to SEQ ID NO: 189537

SEQ ID NO: 678539 - RNA, 64 nt, Homo Sapiens; identical to SEQ ID NO: 189538

SEQ ID NO: 678540 - RNA, 64 nt, Homo Sapiens; identical to SEQ ID NO: 189539

SEQ ID NO: 678541 - RNA, 64 nt, Homo Sapiens; identical to SEQ ID NO: 189540

SEQ ID NO: 678542 - RNA, 64 nt, Homo Sapiens; identical to SEQ ID NO: 189541

SEQ ID NO: 678543 - RNA, 64 nt, Homo Sapiens; identical to SEQ ID NO: 189542

SEQ ID NO: 678544 - RNA, 64 nt, Homo Sapiens; identical to SEQ ID NO: 189543

SEQ ID NO: 678545 - RNA, 64 nt, Homo Sapiens; identical to SEQ ID NO: 189544

SEQ ID NO: 678546 - RNA, 64 nt, Homo Sapiens; identical to SEQ ID NO: 189545

SEQ ID NO: 678547 - RNA, 64 nt, Homo Sapiens; identical to SEQ ID NO: 189546

SEQ ID NO: 678548 - RNA, 64 nt, Homo Sapiens; identical to SEQ ID NO: 189547

SEQ ID NO: 678549 - RNA, 64 nt, Homo Sapiens; identical to SEQ ID NO: 189548

SEQ ID NO: 678550 - RNA, 64 nt, Homo Sapiens; identical to SEQ ID NO: 189549

SEQ ID NO: 678551 - RNA, 64 nt, Homo Sapiens; identical to SEQ ID NO: 189550

SEQ ID NO: 678552 - RNA, 64 nt, Homo Sapiens; identical to SEQ ID NO: 189551

SEQ ID NO: 678553 - RNA, 64 nt, Homo Sapiens; identical to SEQ ID NO: 189552

SEQ ID NO: 678554 - RNA, 64 nt, Homo Sapiens; identical to SEQ ID NO: 189553

SEQ ID NO: 678555 - RNA, 64 nt, Homo Sapiens; identical to SEQ ID NO: 189554

SEQ ID NO: 678556 - RNA, 64 nt, Homo Sapiens; identical to SEQ ID NO: 189555

SEQ ID NO: 678557 - RNA, 64 nt, Homo Sapiens; identical to SEQ ID NO: 189556

SEQ ID NO: 678558 - RNA, 64 nt, Homo Sapiens; identical to SEQ ID NO: 189557

SEQ ID NO: 678559 - RNA, 64 nt, Homo Sapiens; identical to SEQ ID NO: 189558

SEQ ID NO: 678560 - RNA, 64 nt, Homo Sapiens; identical to SEQ ID NO: 189559

SEQ ID NO: 678561 - RNA, 53 nt, Homo Sapiens; identical to SEQ ID NO: 189560

SEQ ID NO: 678562 - RNA, 64 nt, Homo Sapiens; identical to SEQ ID NO: 189561

SEQ ID NO: 678563 - RNA, 64 nt, Homo Sapiens; identical to SEQ ID NO: 189562

SEQ ID NO: 678564 - RNA, 63 nt, Homo Sapiens; identical to SEQ ID NO: 189563

SEQ ID NO: 678565 - RNA, 64 nt, Homo Sapiens; identical to SEQ ID NO: 189564

SEQ ID NO: 678566 - RNA, 64 nt, Homo Sapiens; identical to SEQ ID NO: 189565

SEQ ID NO: 678567 - RNA, 64 nt, Homo Sapiens; identical to SEQ ID NO: 189566

SEQ ID NO: 678568 - RNA, 64 nt, Homo Sapiens; identical to SEQ ID NO: 189567

SEQ ID NO: 678569 - RNA, 64 nt, Homo Sapiens; identical to SEQ ID NO: 189568

SEQ ID NO: 678570 - RNA, 64 nt, Homo Sapiens; identical to SEQ ID NO: 189569

SEQ ID NO: 678571 - RNA, 64 nt, Homo Sapiens; identical to SEQ ID NO: 189570

SEQ ID NO: 678572 - RNA, 64 nt, Homo Sapiens; identical to SEQ ID NO: 189571

SEQ ID NO: 678573 - RNA, 64 nt, Homo Sapiens; identical to SEQ ID NO: 189572

SEQ ID NO: 678574 - RNA, 64 nt, Homo Sapiens; identical to SEQ ID NO: 189573

SEQ ID NO: 678575 - RNA, 64 nt, Homo Sapiens; identical to SEQ ID NO: 189574

SEQ ID NO: 678576 - RNA, 64 nt, Homo Sapiens; identical to SEQ ID NO: 189575

SEQ ID NO: 678577 - RNA, 64 nt, Homo Sapiens; identical to SEQ ID NO: 189576

SEQ ID NO: 678578 - RNA, 64 nt, Homo Sapiens; identical to SEQ ID NO: 189577

SEQ ID NO: 678579 - RNA, 64 nt, Homo Sapiens; identical to SEQ ID NO: 189578

SEQ ID NO: 678580 - RNA, 64 nt, Homo Sapiens; identical to SEQ ID NO: 189579

SEQ ID NO: 678581 - RNA, 64 nt, Homo Sapiens; identical to SEQ ID NO: 189580

SEQ ID NO: 678582 - RNA, 64 nt, Homo Sapiens; identical to SEQ ID NO: 189581

SEQ ID NO: 678583 - RNA, 64 nt, Homo Sapiens; identical to SEQ ID NO: 189582

SEQ ID NO: 678584 - RNA, 64 nt, Homo Sapiens; identical to SEQ ID NO: 189583

SEQ ID NO: 678585 - RNA, 64 nt, Homo Sapiens; identical to SEQ ID NO: 189584

SEQ ID NO: 678586 - RNA, 64 nt, Homo Sapiens; identical to SEQ ID NO: 189585

SEQ ID NO: 678587 - RNA, 64 nt, Homo Sapiens; identical to SEQ ID NO: 189586

SEQ ID NO: 678588 - RNA, 64 nt, Homo Sapiens; identical to SEQ ID NO: 189587

SEQ ID NO: 678589 - RNA, 64 nt, Homo Sapiens; identical to SEQ ID NO: 189588

SEQ ID NO: 678590 - RNA, 64 nt, Homo Sapiens; identical to SEQ ID NO: 189589

SEQ ID NO: 678591 - RNA, 64 nt, Homo Sapiens; identical to SEQ ID NO: 189590

SEQ ID NO: 678592 - RNA, 64 nt, Homo Sapiens; identical to SEQ ID NO: 189591

SEQ ID NO: 678593 - RNA, 64 nt, Homo Sapiens; identical to SEQ ID NO: 189592

SEQ ID NO: 678594 - RNA, 64 nt, Homo Sapiens; identical to SEQ ID NO: 189593

SEQ ID NO: 678595 - RNA, 64 nt, Homo Sapiens; identical to SEQ ID NO: 189594

SEQ ID NO: 678596 - RNA, 64 nt, Homo Sapiens; identical to SEQ ID NO: 189595

SEQ ID NO: 678597 - RNA, 64 nt, Homo Sapiens; identical to SEQ ID NO: 189596

SEQ ID NO: 678598 - RNA, 64 nt, Homo Sapiens; identical to SEQ ID NO: 189597

SEQ ID NO: 678599 - RNA, 64 nt, Homo Sapiens; identical to SEQ ID NO: 189598

SEQ ID NO: 678600 - RNA, 64 nt, Homo Sapiens; identical to SEQ ID NO: 94750

SEQ ID NO: 678601 - RNA, 64 nt, Homo Sapiens; identical to SEQ ID NO: 94751

SEQ ID NO: 678602 - RNA, 64 nt, Homo Sapiens; identical to SEQ ID NO: 94752

SEQ ID NO: 678603 - RNA, 64 nt, Homo Sapiens; identical to SEQ ID NO: 94753

SEQ ID NO: 678604 - RNA, 64 nt, Homo Sapiens; identical to SEQ ID NO: 94754

SEQ ID NO: 678605 - RNA, 64 nt, Homo Sapiens; identical to SEQ ID NO: 94755

SEQ ID NO: 678606 - RNA, 64 nt, Homo Sapiens; identical to SEQ ID NO: 94756

SEQ ID NO: 678607 - RNA, 64 nt, Homo Sapiens; identical to SEQ ID NO: 94757

SEQ ID NO: 678608 - RNA, 64 nt, Homo Sapiens; identical to SEQ ID NO: 94758

SEQ ID NO: 678609 - RNA, 64 nt, Homo Sapiens; identical to SEQ ID NO: 94759

SEQ ID NO: 678610 - RNA, 64 nt, Homo Sapiens; identical to SEQ ID NO: 94760

SEQ ID NO: 678611 - RNA, 64 nt, Homo Sapiens; identical to SEQ ID NO: 94761

SEQ ID NO: 678612 - RNA, 64 nt, Homo Sapiens; identical to SEQ ID NO: 94762

SEQ ID NO: 678613 - RNA, 64 nt, Homo Sapiens; identical to SEQ ID NO: 94763

SEQ ID NO: 678614 - RNA, 64 nt, Homo Sapiens; identical to SEQ ID NO: 94764

SEQ ID NO: 678615 - RNA, 64 nt, Homo Sapiens; identical to SEQ ID NO: 94765

SEQ ID NO: 678616 - RNA, 64 nt, Homo Sapiens; identical to SEQ ID NO: 94766

SEQ ID NO: 678617 - RNA, 64 nt, Homo Sapiens; identical to SEQ ID NO: 94767

SEQ ID NO: 678618 - RNA, 64 nt, Homo Sapiens; identical to SEQ ID NO: 94768

SEQ ID NO: 678619 - RNA, 64 nt, Homo Sapiens; identical to SEQ ID NO: 94769

SEQ ID NO: 678620 - RNA, 64 nt, Homo Sapiens; identical to SEQ ID NO: 94770

SEQ ID NO: 678621 - RNA, 64 nt, Homo Sapiens; identical to SEQ ID NO: 94771

SEQ ID NO: 678622 - RNA, 64 nt, Homo Sapiens; identical to SEQ ID NO: 94772

SEQ ID NO: 678623 - RNA, 64 nt, Homo Sapiens; identical to SEQ ID NO: 94773

SEQ ID NO: 678624 - RNA, 64 nt, Homo Sapiens; identical to SEQ ID NO: 94774

SEQ ID NO: 678625 - RNA, 64 nt, Homo Sapiens; identical to SEQ ID NO: 94775

SEQ ID NO: 678626 - RNA, 64 nt, Homo Sapiens; identical to SEQ ID NO: 94776

SEQ ID NO: 678627 - RNA, 64 nt, Homo Sapiens; identical to SEQ ID NO: 94777

SEQ ID NO: 678628 - RNA, 64 nt, Homo Sapiens; identical to SEQ ID NO: 94778

SEQ ID NO: 678629 - RNA, 64 nt, Homo Sapiens; identical to SEQ ID NO: 94779

SEQ ID NO: 678630 - RNA, 64 nt, Homo Sapiens; identical to SEQ ID NO: 94780

SEQ ID NO: 678631 - RNA, 64 nt, Homo Sapiens; identical to SEQ ID NO: 94781

SEQ ID NO: 678632 - RNA, 64 nt, Homo Sapiens; identical to SEQ ID NO: 94782

SEQ ID NO: 678633 - RNA, 64 nt, Homo Sapiens; identical to SEQ ID NO: 94783

SEQ ID NO: 678634 - RNA, 64 nt, Homo Sapiens; identical to SEQ ID NO: 94784

SEQ ID NO: 678635 - RNA, 64 nt, Homo Sapiens; identical to SEQ ID NO: 94785

SEQ ID NO: 678636 - RNA, 64 nt, Homo Sapiens; identical to SEQ ID NO: 94786

SEQ ID NO: 678637 - RNA, 64 nt, Homo Sapiens; identical to SEQ ID NO: 94787

SEQ ID NO: 678638 - RNA, 64 nt, Homo Sapiens; identical to SEQ ID NO: 94788

SEQ ID NO: 678639 - RNA, 64 nt, Homo Sapiens; identical to SEQ ID NO: 94789

SEQ ID NO: 678640 - RNA, 64 nt, Homo Sapiens; identical to SEQ ID NO: 94790

SEQ ID NO: 678641 - RNA, 64 nt, Homo Sapiens; identical to SEQ ID NO: 94791

SEQ ID NO: 678642 - RNA, 64 nt, Homo Sapiens; identical to SEQ ID NO: 94792

SEQ ID NO: 678643 - RNA, 64 nt, Homo Sapiens; identical to SEQ ID NO: 94793

SEQ ID NO: 678644 - RNA, 64 nt, Homo Sapiens; identical to SEQ ID NO: 94794

SEQ ID NO: 678645 - RNA, 64 nt, Homo Sapiens; identical to SEQ ID NO: 94795

SEQ ID NO: 678646 - RNA, 64 nt, Homo Sapiens; identical to SEQ ID NO: 94796

SEQ ID NO: 678647 - RNA, 64 nt, Homo Sapiens; identical to SEQ ID NO: 94797

SEQ ID NO: 678648 - RNA, 64 nt, Homo Sapiens; identical to SEQ ID NO: 94798

SEQ ID NO: 678649 - RNA, 64 nt, Homo Sapiens; identical to SEQ ID NO: 94799

SEQ ID NO: 678650 - RNA, 64 nt, Homo Sapiens; identical to SEQ ID NO: 94800

SEQ ID NO: 678651 - RNA, 64 nt, Homo Sapiens; identical to SEQ ID NO: 94801

SEQ ID NO: 678652 - RNA, 64 nt, Homo Sapiens; identical to SEQ ID NO: 94802

SEQ ID NO: 678653 - RNA, 64 nt, Homo Sapiens; identical to SEQ ID NO: 94803

SEQ ID NO: 678654 - RNA, 64 nt, Homo Sapiens; identical to SEQ ID NO: 94804

SEQ ID NO: 678655 - RNA, 64 nt, Homo Sapiens; identical to SEQ ID NO: 94805

SEQ ID NO: 678656 - RNA, 64 nt, Homo Sapiens; identical to SEQ ID NO: 94806

SEQ ID NO: 678657 - RNA, 64 nt, Homo Sapiens; identical to SEQ ID NO: 94807

SEQ ID NO: 678658 - RNA, 64 nt, Homo Sapiens; identical to SEQ ID NO: 94808

SEQ ID NO: 678659 - RNA, 64 nt, Homo Sapiens; identical to SEQ ID NO: 94809

SEQ ID NO: 678660 - RNA, 64 nt, Homo Sapiens; identical to SEQ ID NO: 94810

SEQ ID NO: 678661 - RNA, 64 nt, Homo Sapiens; identical to SEQ ID NO: 94811

SEQ ID NO: 678662 - RNA, 64 nt, Homo Sapiens; identical to SEQ ID NO: 94812

SEQ ID NO: 678663 - RNA, 64 nt, Homo Sapiens; identical to SEQ ID NO: 94813

SEQ ID NO: 678664 - RNA, 64 nt, Homo Sapiens; identical to SEQ ID NO: 94814

SEQ ID NO: 678665 - RNA, 64 nt, Homo Sapiens; identical to SEQ ID NO: 94815

SEQ ID NO: 678666 - RNA, 64 nt, Homo Sapiens; identical to SEQ ID NO: 94816

SEQ ID NO: 678667 - RNA, 64 nt, Homo Sapiens; identical to SEQ ID NO: 94817

SEQ ID NO: 678668 - RNA, 64 nt, Homo Sapiens; identical to SEQ ID NO: 94818

SEQ ID NO: 678669 - RNA, 64 nt, Homo Sapiens; identical to SEQ ID NO: 94819

SEQ ID NO: 678670 - RNA, 64 nt, Homo Sapiens; identical to SEQ ID NO: 94820

SEQ ID NO: 678671 - RNA, 64 nt, Homo Sapiens; identical to SEQ ID NO: 94821

SEQ ID NO: 678672 - RNA, 64 nt, Homo Sapiens; identical to SEQ ID NO: 94822

SEQ ID NO: 678673 - RNA, 64 nt, Homo Sapiens; identical to SEQ ID NO: 94823

SEQ ID NO: 678674 - RNA, 64 nt, Homo Sapiens; identical to SEQ ID NO: 94824

SEQ ID NO: 678675 - RNA, 64 nt, Homo Sapiens; identical to SEQ ID NO: 94825

SEQ ID NO: 678676 - RNA, 64 nt, Homo Sapiens; identical to SEQ ID NO: 94826

SEQ ID NO: 678677 - RNA, 64 nt, Homo Sapiens; identical to SEQ ID NO: 94827

SEQ ID NO: 678678 - RNA, 64 nt, Homo Sapiens; identical to SEQ ID NO: 94828

SEQ ID NO: 678679 - RNA, 64 nt, Homo Sapiens; identical to SEQ ID NO: 94829

SEQ ID NO: 678680 - RNA, 64 nt, Homo Sapiens; identical to SEQ ID NO: 94830

SEQ ID NO: 678681 - RNA, 64 nt, Homo Sapiens; identical to SEQ ID NO: 94831

SEQ ID NO: 678682 - RNA, 64 nt, Homo Sapiens; identical to SEQ ID NO: 94832

SEQ ID NO: 678683 - RNA, 64 nt, Homo Sapiens; identical to SEQ ID NO: 94833

SEQ ID NO: 678684 - RNA, 64 nt, Homo Sapiens; identical to SEQ ID NO: 94834

SEQ ID NO: 678685 - RNA, 64 nt, Homo Sapiens; identical to SEQ ID NO: 94835

SEQ ID NO: 678686 - RNA, 64 nt, Homo Sapiens
ccaaggccuuuuucauaaacgaugucaauaggaauugcauuaguguuuuucuuauccaaguaaa

SEQ ID NO: 678687 - RNA, 64 nt, Homo Sapiens
cauaugcuucccagagaagcuuagaaguacguuuuugcauuauuuuuauuucuguaaaauuugu

SEQ ID NO: 678688 - RNA, 64 nt, Homo Sapiens
uguggaggcucaaacuugugaauguaaaacuugguugcauuauuuauguagaagggcuguuaaa

SEQ ID NO: 678689 - RNA, 64 nt, Homo Sapiens
acucuguacugcucauauuagugguccucaugaauugcauuaagcagauucauguaaggacuaa

SEQ ID NO: 678690 - RNA, 64 nt, Homo Sapiens
gcaguauaaacacuagguauaauaggauuugaaauugcauuacaguucauaaaaauugaaaaug

SEQ ID NO: 678691 - RNA, 64 nt, Homo Sapiens
uguuuauuuucugaguuucaacgcugaccuuuucuugcauuauuguuucauuuuaaugauagug

SEQ ID NO: 678692 - RNA, 64 nt, Homo Sapiens
aucauagcaccaccuaucagcacugaaaacucuuuugcauuaagggaucauugcaagagcagcg

SEQ ID NO: 678693 - RNA, 64 nt, Homo Sapiens
cagauuucauaauuuuuuucaaaguuuggaauauuugcauuauacuuaccaguugggcauccca

SEQ ID NO: 678694 - RNA, 64 nt, Homo Sapiens
aucacaaaaugcagucgaauauauauaugaaaacuugcauuaggugauaaagugacuauuuuaa

SEQ ID NO: 678695 - RNA, 64 nt, Homo Sapiens
cuaugaaauuguccagauguguucaggaacaugauugcauuagagcaaugacuguauuuuguug

SEQ ID NO: 678696 - RNA, 64 nt, Homo Sapiens
cucuuuuuaucgggaauaguagguaauaauuauuuugcauuaaacaaaccgaaugugaaauacc

SEQ ID NO: 678697 - RNA, 64 nt, Homo Sapiens
gauuaugauucuuaucccaaaaauuaagaguauuuugcauuagucgagaaauacaacauuuaaa

SEQ ID NO: 678698 - RNA, 64 nt, Homo Sapiens
aaauuauguaaauuauguaaauuaucaggcaaauuugcauuaaauuacagaaauuuaauucaga

SEQ ID NO: 678699 - RNA, 64 nt, Homo Sapiens
gugaaagggagaagugacauugcaucaaagcaucuugcauuaugcaauuuuuauauuaaccaga

SEQ ID NO: 678700 - RNA, 64 nt, Homo Sapiens
ugccgagugagaaggccacaguaucucaugcuguuugcauuacagaacugcagcuuuucuacuc

SEQ ID NO: 678701 - RNA, 64 nt, Homo Sapiens
gaaaugugcuuuuuagagcuuccuaaugcauguguugcauuauugcagcauuagaaaaggagag

SEQ ID NO: 678702 - RNA, 64 nt, Homo Sapiens
auuaagauuuuuaaacugaaguugaccauacagguugcauuagcccuaacuggcuucauguaag

SEQ ID NO: 678703 - RNA, 64 nt, Homo Sapiens
agugccuggccugggaaagaaggggaagaaacaauugcauuauauccaaagauacacuauaaaa

SEQ ID NO: 678704 - RNA, 64 nt, Homo Sapiens
uucugaacuauaauaggguuuaaauuaaaauugguugcauuauuuaaaguaccuguaucuagau

SEQ ID NO: 678705 - RNA, 64 nt, Homo Sapiens
ggcugcauucuugccuuacuuuuuguaaacguuuuugcauuacagugcuaaccugcuuuucucu

SEQ ID NO: 678706 - RNA, 64 nt, Homo Sapiens
cgccccccucaucuccacccucccccauaucuguuugcauuaggaguuccacgaccauggugga

SEQ ID NO: 678707 - RNA, 64 nt, Homo Sapiens
aagauuggaacccagacuugcaguccagcgcuguuugcauuaaaagggugggugagucaggacc

SEQ ID NO: 678708 - RNA, 64 nt, Homo Sapiens
aauccuggagcagaccauagauacacccaaauuauugcauuaagguacacguagacagacacac

SEQ ID NO: 678709 - RNA, 64 nt, Homo Sapiens
aguuacaaccuagagagauuuguuuucuaaugcuuugcauuaucuauuucaaaacacauuuaac

SEQ ID NO: 678710 - RNA, 64 nt, Homo Sapiens
uaaagcagccucuugcaaugaaccuagccagcuguugcauuagcaauuauauuguugaagcaau

SEQ ID NO: 678711 - RNA, 64 nt, Homo Sapiens
aauuauauuguugaagcaaugaaaagagcugcuuuugcauuauggaguugcucuaaaauguuug

SEQ ID NO: 678712 - RNA, 64 nt, Homo Sapiens
guguuaggucaagcagugcccuuggugguuacucuugcauuacuaagugguagaagguccugau

SEQ ID NO: 678713 - RNA, 64 nt, Homo Sapiens
aaaugggccuuuuguaaaugguuuaguaaccagauugcauuaugucuucgaguaguuugauuug

SEQ ID NO: 678714 - RNA, 64 nt, Homo Sapiens
uguacacauauccaguuauauaauugcuuccuaguugcauuauauggcaaaugagauuuuguac

SEQ ID NO: 678715 - RNA, 64 nt, Homo Sapiens
auauguguuuaaauauuauauuagcuuauuucucuugcauuaauaguacugcuguuuuuguuuu

SEQ ID NO: 678716 - RNA, 64 nt, Homo Sapiens
uuuuauugauuuaaugacaaaaggagaccuguagcagucaaagagaguuaaauauauauuguua

SEQ ID NO: 678717 - RNA, 64 nt, Homo Sapiens
cauuuuuuuccagugaggaucacuucagaugaggcagucaaaauuucagagggccaggcaagag

SEQ ID NO: 678718 - RNA, 64 nt, Homo Sapiens
ugagccagccucuggaucgaccuccguuuccccucagucaaacugugugcuaggaacagccuuc

SEQ ID NO: 678719 - RNA, 64 nt, Homo Sapiens
uuuaugaggaaaugagaucaaaauaauuuuauuucagucaaacauccuaaacauucuucaguga

SEQ ID NO: 678720 - RNA, 64 nt, Homo Sapiens
aagcacaugaauguaaugaauguggaaaagcuuucagucaaaccucaugccuuauucagcauca

SEQ ID NO: 678721 - RNA, 64 nt, Homo Sapiens
aauuccauugcugcaaugaaugugaaaaagccaucagucaaagaaacuaccuuguuuaguauca

SEQ ID NO: 678722 - RNA, 64 nt, Homo Sapiens
uucuuuuguuuguuuugauuugcucuguuuuauucagucaaaucuagaguuugaauccucugcu

SEQ ID NO: 678723 - RNA, 64 nt, Homo Sapiens
uguugaaaaaaaaaacuggcaaagugaaaagauacagucaaaaaucuagaauuucuuuaauuuu

SEQ ID NO: 678724 - RNA, 64 nt, Homo Sapiens
ggcuucuuauuaaauacaauaacuaauuuuaaaucagucaaauuauugcacagaaaugggaaau

SEQ ID NO: 678725 - RNA, 64 nt, Homo Sapiens
ggcucuagcucugauaacacucugcagaucaacacagucaaagccgccugcaucuagugcugcu

SEQ ID NO: 678726 - RNA, 64 nt, Homo Sapiens
aagagaaaaaagauaaaguauugugccuccuacacagucaaagaacagcagguuacucagcagu

SEQ ID NO: 678727 - RNA, 64 nt, Homo Sapiens
gaaauugaagaguucuaaggcuuucaaaaacacucagucaaaaauuuaaaaucuuaaaugugua

SEQ ID NO: 678728 - RNA, 64 nt, Homo Sapiens
acaaccccaucucuauucuuggcuucuguugaaacagucaaauaaauccacaaguuaaugccua

SEQ ID NO: 678729 - RNA, 64 nt, Homo Sapiens; identical to SEQ ID NO: 340884

SEQ ID NO: 678730 - RNA, 64 nt, Homo Sapiens; identical to SEQ ID NO: 340885

SEQ ID NO: 678731 - RNA, 64 nt, Homo Sapiens
gggugucguuuucacauaugacaauguugcauuuaugaugcaguuucaaguaccaaaacguuga

SEQ ID NO: 678732 - RNA, 64 nt, Homo Sapiens
augaugcaguuucaaguaccaaaacguugaauugaugaugcaguuuucauauaucgagauguuc

SEQ ID NO: 678733 - RNA, 64 nt, Homo Sapiens
acaucuacguguagcacuacauugccauagcaucaugaugcaaccacaccuaagcgucaucguc

SEQ ID NO: 678734 - RNA, 64 nt, Homo Sapiens
guguuuugaaaguugucauuugugugaacgggagaugaugcacuucaggcuguuuccuaaagga

SEQ ID NO: 678735 - RNA, 64 nt, Homo Sapiens
uauucagccuuuuuagugaagcuguguauucauguagagggaugcuccauuuccccucuucuga

SEQ ID NO: 678736 - RNA, 64 nt, Homo Sapiens
acucccacagccaaaagaauguaguggaucagcuuagagggaacggggaguguuccagcugcug

SEQ ID NO: 678737 - RNA, 64 nt, Homo Sapiens
gagccaaaaggauagagaaacuguccagacaugauagagggacagagggggagaaaacuguacu

SEQ ID NO: 678738 - RNA, 64 nt, Homo Sapiens
gagggagggcaggguggaggaccucacaccucccuagagggagggaacaguugaggucugcagg

SEQ ID NO: 678739 - RNA, 64 nt, Homo Sapiens; identical to SEQ ID NO: 281104

SEQ ID NO: 678740 - RNA, 64 nt, Homo Sapiens; identical to SEQ ID NO: 281105

SEQ ID NO: 678741 - RNA, 64 nt, Homo Sapiens; identical to SEQ ID NO: 281106

SEQ ID NO: 678742 - RNA, 64 nt, Homo Sapiens; identical to SEQ ID NO: 281107

SEQ ID NO: 678743 - RNA, 64 nt, Homo Sapiens; identical to SEQ ID NO: 281108

SEQ ID NO: 678744 - RNA, 64 nt, Homo Sapiens; identical to SEQ ID NO: 281109

SEQ ID NO: 678745 - RNA, 64 nt, Homo Sapiens; identical to SEQ ID NO: 281110

SEQ ID NO: 678746 - RNA, 64 nt, Homo Sapiens; identical to SEQ ID NO: 281111

SEQ ID NO: 678747 - RNA, 64 nt, Homo Sapiens; identical to SEQ ID NO: 281112

SEQ ID NO: 678748 - RNA, 64 nt, Homo Sapiens; identical to SEQ ID NO: 281113

SEQ ID NO: 678749 - RNA, 64 nt, Homo Sapiens; identical to SEQ ID NO: 281114

SEQ ID NO: 678750 - RNA, 64 nt, Homo Sapiens; identical to SEQ ID NO: 281115

SEQ ID NO: 678751 - RNA, 64 nt, Homo Sapiens; identical to SEQ ID NO: 281116

SEQ ID NO: 678752 - RNA, 64 nt, Homo Sapiens; identical to SEQ ID NO: 281117

SEQ ID NO: 678753 - RNA, 64 nt, Homo Sapiens; identical to SEQ ID NO: 281118

SEQ ID NO: 678754 - RNA, 64 nt, Homo Sapiens; identical to SEQ ID NO: 281119

SEQ ID NO: 678755 - RNA, 64 nt, Homo Sapiens; identical to SEQ ID NO: 299842

SEQ ID NO: 678756 - RNA, 64 nt, Homo Sapiens; identical to SEQ ID NO: 299843

SEQ ID NO: 678757 - RNA, 64 nt, Homo Sapiens; identical to SEQ ID NO: 299844

SEQ ID NO: 678758 - RNA, 64 nt, Homo Sapiens; identical to SEQ ID NO: 299845

SEQ ID NO: 678759 - RNA, 64 nt, Homo Sapiens; identical to SEQ ID NO: 299846

SEQ ID NO: 678760 - RNA, 64 nt, Homo Sapiens; identical to SEQ ID NO: 299847

SEQ ID NO: 678761 - RNA, 64 nt, Homo Sapiens; identical to SEQ ID NO: 299848

SEQ ID NO: 678762 - RNA, 64 nt, Homo Sapiens; identical to SEQ ID NO: 299849

SEQ ID NO: 678763 - RNA, 64 nt, Homo Sapiens; identical to SEQ ID NO: 299850

SEQ ID NO: 678764 - RNA, 64 nt, Homo Sapiens; identical to SEQ ID NO: 299851

SEQ ID NO: 678765 - RNA, 64 nt, Homo Sapiens; identical to SEQ ID NO: 299852

SEQ ID NO: 678766 - RNA, 64 nt, Homo Sapiens; identical to SEQ ID NO: 299853

SEQ ID NO: 678767 - RNA, 64 nt, Homo Sapiens; identical to SEQ ID NO: 299854

SEQ ID NO: 678768 - RNA, 64 nt, Homo Sapiens; identical to SEQ ID NO: 299855

SEQ ID NO: 678769 - RNA, 64 nt, Homo Sapiens; identical to SEQ ID NO: 299856

SEQ ID NO: 678770 - RNA, 64 nt, Homo Sapiens; identical to SEQ ID NO: 299857

SEQ ID NO: 678771 - RNA, 64 nt, Homo Sapiens; identical to SEQ ID NO: 299858

SEQ ID NO: 678772 - RNA, 64 nt, Homo Sapiens; identical to SEQ ID NO: 299859

SEQ ID NO: 678773 - RNA, 64 nt, Homo Sapiens; identical to SEQ ID NO: 299860

SEQ ID NO: 678774 - RNA, 64 nt, Homo Sapiens; identical to SEQ ID NO: 286003

SEQ ID NO: 678775 - RNA, 64 nt, Homo Sapiens; identical to SEQ ID NO: 286004

SEQ ID NO: 678776 - RNA, 64 nt, Homo Sapiens; identical to SEQ ID NO: 286005

SEQ ID NO: 678777 - RNA, 64 nt, Homo Sapiens; identical to SEQ ID NO: 286006

SEQ ID NO: 678778 - RNA, 64 nt, Homo Sapiens; identical to SEQ ID NO: 286007

SEQ ID NO: 678779 - RNA, 64 nt, Homo Sapiens; identical to SEQ ID NO: 286008

SEQ ID NO: 678780 - RNA, 64 nt, Homo Sapiens; identical to SEQ ID NO: 286009

SEQ ID NO: 678781 - RNA, 64 nt, Homo Sapiens; identical to SEQ ID NO: 286010

SEQ ID NO: 678782 - RNA, 64 nt, Homo Sapiens; identical to SEQ ID NO: 286011

SEQ ID NO: 678783 - RNA, 64 nt, Homo Sapiens; identical to SEQ ID NO: 286012

SEQ ID NO: 678784 - RNA, 64 nt, Homo Sapiens; identical to SEQ ID NO: 286013

SEQ ID NO: 678785 - RNA, 64 nt, Homo Sapiens; identical to SEQ ID NO: 286014

SEQ ID NO: 678786 - RNA, 64 nt, Homo Sapiens; identical to SEQ ID NO: 286015

SEQ ID NO: 678787 - RNA, 64 nt, Homo Sapiens; identical to SEQ ID NO: 286016

SEQ ID NO: 678788 - RNA, 64 nt, Homo Sapiens; identical to SEQ ID NO: 286017

SEQ ID NO: 678789 - RNA, 64 nt, Homo Sapiens; identical to SEQ ID NO: 286018

SEQ ID NO: 678790 - RNA, 64 nt, Homo Sapiens; identical to SEQ ID NO: 286019

SEQ ID NO: 678791 - RNA, 64 nt, Homo Sapiens; identical to SEQ ID NO: 286020

SEQ ID NO: 678792 - RNA, 64 nt, Homo Sapiens; identical to SEQ ID NO: 286021

SEQ ID NO: 678793 - RNA, 64 nt, Homo Sapiens; identical to SEQ ID NO: 286022

SEQ ID NO: 678794 - RNA, 64 nt, Homo Sapiens; identical to SEQ ID NO: 286023

SEQ ID NO: 678795 - RNA, 64 nt, Homo Sapiens; identical to SEQ ID NO: 286024

SEQ ID NO: 678796 - RNA, 64 nt, Homo Sapiens; identical to SEQ ID NO: 108245

SEQ ID NO: 678797 - RNA, 64 nt, Homo Sapiens; identical to SEQ ID NO: 108246

SEQ ID NO: 678798 - RNA, 64 nt, Homo Sapiens; identical to SEQ ID NO: 108247

SEQ ID NO: 678799 - RNA, 64 nt, Homo Sapiens; identical to SEQ ID NO: 108248

SEQ ID NO: 678800 - RNA, 64 nt, Homo Sapiens; identical to SEQ ID NO: 108249

SEQ ID NO: 678801 - RNA, 64 nt, Homo Sapiens; identical to SEQ ID NO: 108250

SEQ ID NO: 678802 - RNA, 64 nt, Homo Sapiens; identical to SEQ ID NO: 108251

SEQ ID NO: 678803 - RNA, 64 nt, Homo Sapiens; identical to SEQ ID NO: 108252

SEQ ID NO: 678804 - RNA, 64 nt, Homo Sapiens; identical to SEQ ID NO: 108253

SEQ ID NO: 678805 - RNA, 64 nt, Homo Sapiens; identical to SEQ ID NO: 108254

SEQ ID NO: 678806 - RNA, 64 nt, Homo Sapiens; identical to SEQ ID NO: 108255

SEQ ID NO: 678807 - RNA, 64 nt, Homo Sapiens; identical to SEQ ID NO: 108256

SEQ ID NO: 678808 - RNA, 64 nt, Homo Sapiens; identical to SEQ ID NO: 108257

SEQ ID NO: 678809 - RNA, 64 nt, Homo Sapiens; identical to SEQ ID NO: 108258

SEQ ID NO: 678810 - RNA, 64 nt, Homo Sapiens; identical to SEQ ID NO: 108259

SEQ ID NO: 678811 - RNA, 64 nt, Homo Sapiens; identical to SEQ ID NO: 108260

SEQ ID NO: 678812 - RNA, 64 nt, Homo Sapiens; identical to SEQ ID NO: 108261

SEQ ID NO: 678813 - RNA, 64 nt, Homo Sapiens; identical to SEQ ID NO: 108262

SEQ ID NO: 678814 - RNA, 64 nt, Homo Sapiens; identical to SEQ ID NO: 108263

SEQ ID NO: 678815 - RNA, 64 nt, Homo Sapiens; identical to SEQ ID NO: 108264

SEQ ID NO: 678816 - RNA, 64 nt, Homo Sapiens; identical to SEQ ID NO: 108265

SEQ ID NO: 678817 - RNA, 64 nt, Homo Sapiens; identical to SEQ ID NO: 108266

SEQ ID NO: 678818 - RNA, 64 nt, Homo Sapiens; identical to SEQ ID NO: 108267

SEQ ID NO: 678819 - RNA, 64 nt, Homo Sapiens; identical to SEQ ID NO: 108268

SEQ ID NO: 678820 - RNA, 64 nt, Homo Sapiens; identical to SEQ ID NO: 108269

SEQ ID NO: 678821 - RNA, 64 nt, Homo Sapiens; identical to SEQ ID NO: 108270

SEQ ID NO: 678822 - RNA, 64 nt, Homo Sapiens; identical to SEQ ID NO: 108271

SEQ ID NO: 678823 - RNA, 64 nt, Homo Sapiens; identical to SEQ ID NO: 108272

SEQ ID NO: 678824 - RNA, 64 nt, Homo Sapiens; identical to SEQ ID NO: 108273

SEQ ID NO: 678825 - RNA, 64 nt, Homo Sapiens; identical to SEQ ID NO: 108274

SEQ ID NO: 678826 - RNA, 64 nt, Homo Sapiens; identical to SEQ ID NO: 108275

SEQ ID NO: 678827 - RNA, 64 nt, Homo Sapiens; identical to SEQ ID NO: 108276

SEQ ID NO: 678828 - RNA, 64 nt, Homo Sapiens; identical to SEQ ID NO: 108277

SEQ ID NO: 678829 - RNA, 64 nt, Homo Sapiens; identical to SEQ ID NO: 108278

SEQ ID NO: 678830 - RNA, 64 nt, Homo Sapiens; identical to SEQ ID NO: 108279

SEQ ID NO: 678831 - RNA, 64 nt, Homo Sapiens; identical to SEQ ID NO: 108280

SEQ ID NO: 678832 - RNA, 64 nt, Homo Sapiens; identical to SEQ ID NO: 108281

SEQ ID NO: 678833 - RNA, 64 nt, Homo Sapiens; identical to SEQ ID NO: 108282

SEQ ID NO: 678834 - RNA, 64 nt, Homo Sapiens; identical to SEQ ID NO: 108283

SEQ ID NO: 678835 - RNA, 64 nt, Homo Sapiens; identical to SEQ ID NO: 108284

SEQ ID NO: 678836 - RNA, 64 nt, Homo Sapiens; identical to SEQ ID NO: 58517

SEQ ID NO: 678837 - RNA, 64 nt, Homo Sapiens; identical to SEQ ID NO: 58518

SEQ ID NO: 678838 - RNA, 64 nt, Homo Sapiens; identical to SEQ ID NO: 58519

SEQ ID NO: 678839 - RNA, 64 nt, Homo Sapiens; identical to SEQ ID NO: 58520

SEQ ID NO: 678840 - RNA, 64 nt, Homo Sapiens; identical to SEQ ID NO: 58521

SEQ ID NO: 678841 - RNA, 64 nt, Homo Sapiens; identical to SEQ ID NO: 58522

SEQ ID NO: 678842 - RNA, 64 nt, Homo Sapiens; identical to SEQ ID NO: 58523

SEQ ID NO: 678843 - RNA, 64 nt, Homo Sapiens; identical to SEQ ID NO: 58524

SEQ ID NO: 678844 - RNA, 64 nt, Homo Sapiens; identical to SEQ ID NO: 58525

SEQ ID NO: 678845 - RNA, 64 nt, Homo Sapiens; identical to SEQ ID NO: 58526

SEQ ID NO: 678846 - RNA, 64 nt, Homo Sapiens; identical to SEQ ID NO: 58527

SEQ ID NO: 678847 - RNA, 64 nt, Homo Sapiens; identical to SEQ ID NO: 58528

SEQ ID NO: 678848 - RNA, 64 nt, Homo Sapiens; identical to SEQ ID NO: 58529

SEQ ID NO: 678849 - RNA, 64 nt, Homo Sapiens; identical to SEQ ID NO: 58530

SEQ ID NO: 678850 - RNA, 64 nt, Homo Sapiens; identical to SEQ ID NO: 58531

SEQ ID NO: 678851 - RNA, 64 nt, Homo Sapiens; identical to SEQ ID NO: 58532

SEQ ID NO: 678852 - RNA, 64 nt, Homo Sapiens; identical to SEQ ID NO: 382264

SEQ ID NO: 678853 - RNA, 64 nt, Homo Sapiens; identical to SEQ ID NO: 382265

SEQ ID NO: 678854 - RNA, 64 nt, Homo Sapiens; identical to SEQ ID NO: 382266

SEQ ID NO: 678855 - RNA, 64 nt, Homo Sapiens; identical to SEQ ID NO: 382267

SEQ ID NO: 678856 - RNA, 64 nt, Homo Sapiens; identical to SEQ ID NO: 382268

SEQ ID NO: 678857 - RNA, 64 nt, Homo Sapiens; identical to SEQ ID NO: 382269

SEQ ID NO: 678858 - RNA, 64 nt, Homo Sapiens; identical to SEQ ID NO: 382270

SEQ ID NO: 678859 - RNA, 64 nt, Homo Sapiens; identical to SEQ ID NO: 382271

SEQ ID NO: 678860 - RNA, 64 nt, Homo Sapiens; identical to SEQ ID NO: 382272

SEQ ID NO: 678861 - RNA, 64 nt, Homo Sapiens; identical to SEQ ID NO: 382273

SEQ ID NO: 678862 - RNA, 62 nt, Homo Sapiens
gaauucaguguaguuuauacggggcaaccugccagcaucacaguuggggcugaagacgagca

SEQ ID NO: 678863 - RNA, 62 nt, Homo Sapiens
ucugaggaguaaaacggcaccagagacuuuugcagcaucagacaagggggcugcugaaaucg

SEQ ID NO: 678864 - RNA, 62 nt, Homo Sapiens
cagagugggggcuccuuaagccuccaggccagcagcaucagcaucaccugggagauuguuag

SEQ ID NO: 678865 - RNA, 62 nt, Homo Sapiens
gggggcuccuuaagccuccaggccagcagcaucagcaucaccugggagauuguuaggaaugc

SEQ ID NO: 678866 - RNA, 62 nt, Homo Sapiens
aagcaaagauacuaauuuuuaauacccacugccagcaucaaaaauccacacacaacucugag

SEQ ID NO: 678867 - RNA, 62 nt, Homo Sapiens
gcaacgcugcggaucuuggugcuagaacggaacagcaucacaugugcuuucuuuaccaacug

SEQ ID NO: 678868 - RNA, 62 nt, Homo Sapiens
guguccagacuuugaacuugccugccagccuucagcaucaggaaaggccaaguccugggugu

SEQ ID NO: 678869 - RNA, 62 nt, Homo Sapiens
acauguuuucgaacacagaauagcucuuuucucagcaucauuauugcucuuucagcaucugu

SEQ ID NO: 678870 - RNA, 62 nt, Homo Sapiens
acggccuacuucccaauauccccugugugcugcagcaucaccuccccuggccguccugucau

SEQ ID NO: 678871 - RNA, 62 nt, Homo Sapiens
ccccuggagggcugugguccacaagugagaggcagcaucagggaaaguccgcuuguaaaagc

SEQ ID NO: 678872 - RNA, 62 nt, Homo Sapiens
gaaaagacuucagauugaauucacaucuuauucagcaucaaagaauucacacaggagagaaa

SEQ ID NO: 678873 - RNA, 62 nt, Homo Sapiens
gaaaagcuuucagucaaaccucaugccuuauucagcaucacaaaaugcauaggaaagagaaa

SEQ ID NO: 678874 - RNA, 62 nt, Homo Sapiens
guaaagccuucagucauagcucagccauugcucagcaucagauaauucacaccagagagaaa

SEQ ID NO: 678875 - RNA, 62 nt, Homo Sapiens
aaaaccauacacacacacacacacacacaaaucagcaucauaagggaauguagccuuccaac

SEQ ID NO: 678876 - RNA, 62 nt, Homo Sapiens
gaacacacuugugaccuuaguacuuggucauccagcaucauacaggcaucuccaaguuagac

SEQ ID NO: 678877 - RNA, 62 nt, Homo Sapiens
aucauacaggcaucuccaaguuagacucuaugcagcaucaucuuuugcagcauuccucugcu

SEQ ID NO: 678878 - RNA, 62 nt, Homo Sapiens
gugauuaguaauuugucuguuugugcaugugacagcaucaaucuggccugcagucagcauca

SEQ ID NO: 678879 - RNA, 62 nt, Homo Sapiens
gugcaugugacagcaucaaucuggccugcagucagcaucauuagcccugagauggugacagg

SEQ ID NO: 678880 - RNA, 62 nt, Homo Sapiens
ccccggugccuaugggguccggccauuuccgccagcaucacuagaguccccagaacucaugu

SEQ ID NO: 678881 - RNA, 62 nt, Homo Sapiens
gccuuaaucguggccucccuggagccccaccucagcaucacucacaaggggccucccaaaaa

SEQ ID NO: 678882 - RNA, 62 nt, Homo Sapiens
gccucauggaauggaaugucuccacuucacuccagcaucaacaaguggggaauucugaugga

SEQ ID NO: 678883 - RNA, 62 nt, Homo Sapiens
caguuuauaccuugccuguaguccagucucuccagcaucaauuccaucagcacaaagacaua

SEQ ID NO: 678884 - RNA, 62 nt, Homo Sapiens
cccauccaggggcuacaggggggagcccacagcagcaucagagugaguuacccagggcucca

SEQ ID NO: 678885 - RNA, 62 nt, Homo Sapiens
ucccucaagcuuaaugauccuccaaagaaccucagcaucagcucccacuguuaaggacucug

SEQ ID NO: 678886 - RNA, 62 nt, Homo Sapiens
cccuugguggcugcuggaaggggagagguucucagcaucaggccaccuccaccccaaugcca

SEQ ID NO: 678887 - RNA, 62 nt, Homo Sapiens
uggauaaugggaggaaaaguugcugcuuccuucagcaucaaagccuuuccuugggaaucugc

SEQ ID NO: 678888 - RNA, 62 nt, Homo Sapiens
guccugguuccaucucugcuggcaggcuuuuccagcaucacuuuaugugaugacuugaucga

SEQ ID NO: 678889 - RNA, 62 nt, Homo Sapiens
agauaaccaaacucguccucuuuggaauccagcagcaucauagccuuagaauucggaagugu

SEQ ID NO: 678890 - RNA, 64 nt, Homo Sapiens
gaaaggucacagaaggaaaauaauauaauaaagugacaacuaugcaaaucacaucuugaugaga

SEQ ID NO: 678891 - RNA, 64 nt, Homo Sapiens
aaggucacagaaggaaaauaauauuauauaaagugacaacuaugcaaaucacaucuugaugagg

SEQ ID NO: 678892 - RNA, 64 nt, Homo Sapiens
gagccccuucugguccuggcuagggcaaauuuuagacaacuauuuucucuguaagugaagauug

SEQ ID NO: 678893 - RNA, 64 nt, Homo Sapiens
agguaaauugcuuaaucauuuggccaaauaauuagacaacuauaagauuuuggauauauuauuu

SEQ ID NO: 678894 - RNA, 64 nt, Homo Sapiens
agauuacaggcaugacccaccgcgucaagccucugacaacuauugaauuuguaagcugcuaugc

SEQ ID NO: 678895 - RNA, 64 nt, Homo Sapiens
gacaucuguugaaauaagcucauaugguggaaacgacaacuauauuaugaauuauuuucagaaa

SEQ ID NO: 678896 - RNA, 64 nt, Homo Sapiens
uaaaguagugagauagauucccaggcccaaaggagacaacuaacgaucagugccagaacugugc

SEQ ID NO: 678897 - RNA, 64 nt, Homo Sapiens
ucggccuuuuggggguggguaucuguagucagccgacaacuauuaauaaaacaaagggcacagc

SEQ ID NO: 678898 - RNA, 64 nt, Homo Sapiens
gacuugcucauuguucagacuuuagaugauaauggacaacuauauuccuuuccuagagucaccu

SEQ ID NO: 678899 - RNA, 64 nt, Homo Sapiens
ucuuagccuagauugagcuuagauugccucucuagacaacuaccccuuaguuauaauucugugu

SEQ ID NO: 678900 - RNA, 64 nt, Homo Sapiens
accuuuuuuuccuuuuuaauuaaaucccacgaaugacaacuaccuucuacauuuucauuuggac

SEQ ID NO: 678901 - RNA, 64 nt, Homo Sapiens
caaguagacgaaacaaguucuaaaaugcaauuaggacaacuaacaauaaccuuuggacugcagg

SEQ ID NO: 678902 - RNA, 64 nt, Homo Sapiens
ccaacuuuuuccaaagugcguaagaaaaguuggugacaacuaaaauauauguaaacuuuuuuug

SEQ ID NO: 678903 - RNA, 64 nt, Homo Sapiens
gaccugugggugugcccuggucucagugugaugugacaacuauguccuuggaggguaucagcag

SEQ ID NO: 678904 - RNA, 64 nt, Homo Sapiens
ugaaaccacugagcuauugggaacaagacuuagagacaacuauuugcguggauuuuuuuuuuuu

SEQ ID NO: 678905 - RNA, 64 nt, Homo Sapiens
ugauaaauaguaacugagguaccagaugaaucaggacaacuaugcacucuuauaagagcauuua

SEQ ID NO: 678906 - RNA, 64 nt, Homo Sapiens
ugccgcuuauucauugccuugauuuucuucaaaagacaacuauaaucauucaaaaauuccaagu

SEQ ID NO: 678907 - RNA, 64 nt, Homo Sapiens
agccaaggcccaccaaggaguggagcaccucugggacaacuaaguaugccagagccuugcagga

SEQ ID NO: 678908 - RNA, 64 nt, Homo Sapiens
auagguaagaaaaugcagccauuuggggaggauggacaacuacaucucuucugcccccagccau

SEQ ID NO: 678909 - RNA, 64 nt, Homo Sapiens
cucaucuccaguauccugcuuucagcuucuguuggacaacuagccaugggauuuuaucugugga

SEQ ID NO: 678910 - RNA, 64 nt, Homo Sapiens
uccacagcauuuacauuguaaaauaauacaguaugacaacuauuuuuucuuguuauuauucucu

SEQ ID NO: 678911 - RNA, 64 nt, Homo Sapiens
auacuuucuacuuuuucuagugagcuucugggaagacaacuaggccuaaccuaagcaaaaccac

SEQ ID NO: 678912 - RNA, 64 nt, Homo Sapiens
cuaccucggaucaagccaccagaaaacaauucuggacaacuaaaccaggcagggccagaauuac

SEQ ID NO: 678913 - RNA, 64 nt, Homo Sapiens
auuagcuuaguuuucucaugcuugauuaaaacaagacaacuaaagcuaaucauuccucuucuag

SEQ ID NO: 678914 - RNA, 64 nt, Homo Sapiens
caaggcauucagcaguuucugugaauuuguuugugacaacuaaaaguauuguucguucugauau

SEQ ID NO: 678915 - RNA, 64 nt, Homo Sapiens
acauuccauuguuaugguccguaacauugagaaugacaacuaaaacuuaaugcagacauauaaa

SEQ ID NO: 678916 - RNA, 64 nt, Homo Sapiens
gaaccagcuacguauacuggcccuaaauugcuaugacaacuaauaugcauagcuugggcaauag

SEQ ID NO: 678917 - RNA, 64 nt, Homo Sapiens
cucaguucaucugauuucuggucccuccuuucucgacaacuauaauacuaacccuuuucucagg

SEQ ID NO: 678918 - RNA, 64 nt, Homo Sapiens
cuaacagaaauacaaggcuacgaacaguuuaguggacaacuaaaucagacucuugccuuugcac

SEQ ID NO: 678919 - RNA, 64 nt, Homo Sapiens
gaagauuuaugguuaugggucuggcugggaagaagacaacuauaaauacauauucuuggguguc

SEQ ID NO: 678920 - RNA, 64 nt, Homo Sapiens
ccgagcuggaccaacacaauucaccgguugaauggacaacuaacacuccccaacucugccugua

SEQ ID NO: 678921 - RNA, 64 nt, Homo Sapiens
aagagagaauguggacucuggacuguccugcugggacaacuaaguaauaagcuggggaagugag

SEQ ID NO: 678922 - RNA, 64 nt, Homo Sapiens
uuuuauuauauguuuucugagagcauggcuauaagacaacuauacuagcuuucaucaaaaaugg

SEQ ID NO: 678923 - RNA, 64 nt, Homo Sapiens
aaaaauuuuauuguaauauuggugcucccuuuuggacaacuacaaaggucacauugcuuaccca

SEQ ID NO: 678924 - RNA, 62 nt, Homo Sapiens
acucuucgaagagggauuaaaaggugcaaaaagacaacuaaaauacccauuuggaccaaaag

SEQ ID NO: 678925 - RNA, 64 nt, Homo Sapiens
uucugcuguauaaaaaccaagagccagacaauuagacaacuauggaggaaugaaaggcaauuca

SEQ ID NO: 678926 - RNA, 64 nt, Homo Sapiens
uuugaaggaaguuaaaagguuccuguauaagaaagacaacuacuaaaagaggaggucagaguga

SEQ ID NO: 678927 - RNA, 64 nt, Homo Sapiens
aaccaauaaaaucaggaguuugcagaugaggcuggacaacuacucuugagcucagucaaucugg

SEQ ID NO: 678928 - RNA, 64 nt, Homo Sapiens
aaaaucaugaaaaucagcuguuuuauuugcauaggacaacuaaccugucuguguaacuuuguuu

SEQ ID NO: 678929 - RNA, 64 nt, Homo Sapiens
gguguguuagcccacaguucgaaagugaaguccugacaacuaguucuaacuugauuggaauuag

SEQ ID NO: 678930 - RNA, 64 nt, Homo Sapiens
cauaguaaguaauacuagacuaguaaaaacaccugacaacuaaaaaauguuucagauuaaauga

SEQ ID NO: 678931 - RNA, 64 nt, Homo Sapiens
gcccucauuagccuuucuugaacagugccauuaagacaacuacaacgaggggcaucguuugaag

SEQ ID NO: 678932 - RNA, 64 nt, Homo Sapiens
augaaugucugucuuguuuguuauugugaaguaagacaacuauaagaagacuguuuuuaguagc

SEQ ID NO: 678933 - RNA, 64 nt, Homo Sapiens
ucaaaaguuaauuaaugacugccucugaaaccuugacaacuaauucagauuuuuuagcaauaac

SEQ ID NO: 678934 - RNA, 64 nt, Homo Sapiens
cagaucuccaaaauggaagcuaaaugguggacuugacaacuauucacccuaccucagaucauag

SEQ ID NO: 678935 - RNA, 64 nt, Homo Sapiens
cagcgagcuccguguagaccugguggacuuugaggacaacuaccaguuugcuaaguacagauca

SEQ ID NO: 678936 - RNA, 64 nt, Homo Sapiens
uaagcaacugacauggaacuguuuuuuuugguaugacaacuaauaacaaugugugcucuguaug

SEQ ID NO: 678937 - RNA, 64 nt, Homo Sapiens
aaacaccaaacuaucucauuuaaagcuguauuuggacaacuaaaauaccaaaacaacaaaauua

SEQ ID NO: 678938 - RNA, 64 nt, Homo Sapiens
aaaugucuugguaauugcuauuguaaagcuuuuugacaacuaauuuuucugaucaugaaacuga

SEQ ID NO: 678939 - RNA, 64 nt, Homo Sapiens
auguugaccucgagccgagggagagggagcgcuggacaacuagacuagccucaccgaggugccg

SEQ ID NO: 678940 - RNA, 64 nt, Homo Sapiens
gacaaguauuuucaaugacugaaauauagcuucugacaacuaugcagaggcauuuuagagacau

SEQ ID NO: 678941 - RNA, 64 nt, Homo Sapiens
uauagaugccagccaccuccugguagucacuauggacaacuaaugagaugcaaagucuuuugga

SEQ ID NO: 678942 - RNA, 64 nt, Homo Sapiens
uauuuaagacuuuaagacuugauuauauauuauagacaacuaaaaaaaauuuaagaaaauuaca

SEQ ID NO: 678943 - RNA, 64 nt, Homo Sapiens
acaaaugauaaaaauguuuauucuccaacaucaagacaacuaaaaacauucaguaauacgcuau

SEQ ID NO: 678944 - RNA, 64 nt, Homo Sapiens
agaacaagcuuuauuuuauuacgaguauauuaaugacaacuaauuccuguuccaauucuaccug

SEQ ID NO: 678945 - RNA, 64 nt, Homo Sapiens
aaucauguggcaucuauguauaauaaaagaaagagacaacuauauuacucaauuucauauacau

SEQ ID NO: 678946 - RNA, 64 nt, Homo Sapiens
auuaggacuguauaaguacuaugauuugcucuuugacaacuaaaguguaaauauaugucugaua

SEQ ID NO: 678947 - RNA, 64 nt, Homo Sapiens
uagcccaaacucugcuucuaugguagggcaugaggacaacuauucagcaugguuuuagcuucuu

SEQ ID NO: 678948 - RNA, 64 nt, Homo Sapiens
uugucuguuaaaugaacuugauagcuaauaaaaagacaacuagccaucaaaaucauauguuucu

SEQ ID NO: 678949 - RNA, 64 nt, Homo Sapiens
aaaaccagcaccacaucgcugaaggggaaaaacugacaacuaacaagaggggugagaaaacaaa

SEQ ID NO: 678950 - RNA, 64 nt, Homo Sapiens
gcugaguuugggugcacccugggaacuccucagggacaacuacuccuccuucccaaacccucuu

SEQ ID NO: 678951 - RNA, 64 nt, Homo Sapiens
ugguuaagaauuuccaguauaaaaaaauuggcaagacaacuauaaagacaauuuauuguuuaaa

SEQ ID NO: 678952 - RNA, 64 nt, Homo Sapiens
ccuuucguguuuuuccacagacaugaacuuaagagacaacuaaguguauuuaucacuaaaaagu

SEQ ID NO: 678953 - RNA, 64 nt, Homo Sapiens
guagaagauuucacacacacacgcgugugugggagacaacuaaagguauugaagguacuaauua

SEQ ID NO: 678954 - RNA, 64 nt, Homo Sapiens
gaagaugcauaagaaaugcccaagucacucagaggacaacuacccauauuccagacucugagcu

SEQ ID NO: 678955 - RNA, 64 nt, Homo Sapiens
uuauaacuuguucuauauugcaguuccaaugaaggacaacuaauaaaaaagaguguguugaugg

SEQ ID NO: 678956 - RNA, 64 nt, Homo Sapiens
guuaauaagaucucaguugccaaaccaauaaagugacaacuaaucagcauauugucacuuaggu

SEQ ID NO: 678957 - RNA, 64 nt, Homo Sapiens
agcccagcugggauuggugugugcaaaggugcuagacaacuaggaaacaauauaacuuucuuga

SEQ ID NO: 678958 - RNA, 64 nt, Homo Sapiens
uuaaggggaagauaagauuuagucuguauggcaugacaacuacuuauuuuuguuaauauuaaaa

SEQ ID NO: 678959 - RNA, 64 nt, Homo Sapiens
uugauguuuuugcauucuuugaguucaguuuaaagacaacuacgagcaucuguaaccaaucuga

SEQ ID NO: 678960 - RNA, 64 nt, Homo Sapiens
aagaugaucuagcucccgguagaggaucaccggugacaacuauagcaguuguauuguguaacaa

SEQ ID NO: 678961 - RNA, 64 nt, Homo Sapiens
ugacccagagcaaagcuuucccuaugguuccaaagacaacuaguauucaacaaaccuuguauag

SEQ ID NO: 678962 - RNA, 64 nt, Homo Sapiens
aaaaagguggauuauuuaauaaacagcacuuuuagacaacuagcuaucaaagcuagaucucagc

SEQ ID NO: 678963 - RNA, 64 nt, Homo Sapiens
agcaucuguaaccaaucugagaguucaguuuaaagacaacuacguugauguuuuugcauucuuu

SEQ ID NO: 678964 - RNA, 64 nt, Homo Sapiens
gaucacuugagcccaggaguuuuagacuagccuggacaacuaagugagacuccaucucuacaaa

SEQ ID NO: 678965 - RNA, 64 nt, Homo Sapiens
ucaccauuuuggucagaagcauacauuccugucagacaacuaguugucugacagaaauguuagg

SEQ ID NO: 678966 - RNA, 64 nt, Homo Sapiens
ugaggguuuacugugaagugcugaggacaguguugacaacuaacucguuuuccuagauggaaac

SEQ ID NO: 678967 - RNA, 64 nt, Homo Sapiens
ugcugugagugcgccucaccagaaccaguuaagagacaacuaucaauucuugagacccaaauua

SEQ ID NO: 678968 - RNA, 64 nt, Homo Sapiens
gguuaguuacuaacuggacuccuagucauggcaggacaacuaguaucacuguggccucacuuga

SEQ ID NO: 678969 - RNA, 64 nt, Homo Sapiens
gauuugcuucuauguccagaaauggaaaagaacagacaacuaaugauaggggaaauggugaagc

SEQ ID NO: 678970 - RNA, 64 nt, Homo Sapiens
cagggcccagcaguguuccuccaucagcauguuagacaacuacacaguauguuguuaguuuuga

SEQ ID NO: 678971 - RNA, 64 nt, Homo Sapiens
ccugaugcauuaggcugcaaucuccaagcauuuggacaacuagcucugugguugccaccugcca

SEQ ID NO: 678972 - RNA, 64 nt, Homo Sapiens
guuccugccuuugcugagacguaaaggugaacaagacaacuacagaacuuuucuuagucuuugg

SEQ ID NO: 678973 - RNA, 64 nt, Homo Sapiens
aagcuaugguagcaaacaguauaaaaucuagcuggacaacuaagcucaugcaucaguucauagc

SEQ ID NO: 678974 - RNA, 64 nt, Homo Sapiens
ccugaaucccuucugggaaguaauaaugaccauugacaacuaagaaguagacaccaugcuaaag

SEQ ID NO: 678975 - RNA, 64 nt, Homo Sapiens
ccaacaugaugcaguuaucuugcauacaacugaagacaacuaacccuuuccccaacagagccca

SEQ ID NO: 678976 - RNA, 64 nt, Homo Sapiens
ccucuuccccuggaagcugcacaucacgcagaaggacaacuacagggucuacaacacgaugcca

SEQ ID NO: 678977 - RNA, 64 nt, Homo Sapiens
acaggucuucuuuccugccagagggagcucugaagacaacuagagaauucugggccugaaauuu

SEQ ID NO: 678978 - RNA, 64 nt, Homo Sapiens
uuugaaagccccagaaaucaguguuggccaugaugacaacuacagaaaaaccagaggcagcuuc

SEQ ID NO: 678979 - RNA, 64 nt, Homo Sapiens
uauccuggugccuaagaaacuucugccucccacagacaacuaagugcuuauucaaagacuaggu

SEQ ID NO: 678980 - RNA, 64 nt, Homo Sapiens
uuacccaugggacaacagagcuccuucauuuuuggacaacuacuguaaucauuuuuuuuuuagg

SEQ ID NO: 678981 - RNA, 64 nt, Homo Sapiens
uuuaagugaaggucaugcaucccauaauggcaaagacaacuaaauuuuuuuucuguaaucauag

SEQ ID NO: 678982 - RNA, 64 nt, Homo Sapiens
gguaaugaguagugcuguucauauuacuuuaguucuauagcauacuugcaucuuuaacaugcua

SEQ ID NO: 678983 - RNA, 64 nt, Homo Sapiens
acuagcccagaacaguuuaaugguacuuacugagcuauagcauagcugcuuaguuguuuuugag

SEQ ID NO: 678984 - RNA, 64 nt, Homo Sapiens
uauuucuuuguuuggguauuagcucuauuuugaucuauagcacaguuuuguaauucagaucauc

SEQ ID NO: 678985 - RNA, 64 nt, Homo Sapiens
auucucuguuauaaaggggcaacuccaucugguccuauagcaucuuuacuacugauuuuuuuuu

SEQ ID NO: 678986 - RNA, 64 nt, Homo Sapiens
gaucuagcucccgguagaggaucaccggugacaacuauagcaguuguauuguguaacaaguacu

SEQ ID NO: 678987 - RNA, 64 nt, Homo Sapiens
uuuuuuuaaaccaucguuaauauacugaagugagcuauagcacauaucaugugcuuaguuuguu

SEQ ID NO: 678988 - RNA, 64 nt, Homo Sapiens
gauccucccaccucugccucccaaguaacugggacuauagcaugccaccacacccagcugauua

SEQ ID NO: 678989 - RNA, 64 nt, Homo Sapiens
gauccucccacuucugccucccaaguaacugggacuauagcaugccaccacacccagcugauua

SEQ ID NO: 678990 - RNA, 64 nt, Homo Sapiens
gagcuuuguaaugggaauaaugaaucauuguggugguugagauguaagucugauguucuuucca

SEQ ID NO: 678991 - RNA, 64 nt, Homo Sapiens
accugacuuaaggggcugggaucaauggugcugagguugagaaaagaauuauccagacaaaaau

SEQ ID NO: 678992 - RNA, 64 nt, Homo Sapiens
gucaaagguacgggccagcuugugccuaauagaagguugagaccagcagagacugcugugaguu

SEQ ID NO: 678993 - RNA, 64 nt, Homo Sapiens
cgcaaaucugagguuucccguugguuguuaauuugguugagauaaacauuccuuuuuaaggaaa

SEQ ID NO: 678994 - RNA, 64 nt, Homo Sapiens
aggagaacaguaucuugguuaauugcuacugaaagguugagaaaggaaugguuugauauuuacc

SEQ ID NO: 678995 - RNA, 64 nt, Homo Sapiens
uguuccugcugccaguucuuuccucuuuaggcgugguugagaaaaagcagaaacuuuacauaaa

SEQ ID NO: 678996 - RNA, 64 nt, Homo Sapiens
aggguugccaacccauuuguaugacuucaacaacgucaaggagggcauuuagaauuuagaaucu

SEQ ID NO: 678997 - RNA, 64 nt, Homo Sapiens
uuuuaacuugcuauucacaaucaggacaaccaaagucaaggacccagaugaaccacaaggcagc

SEQ ID NO: 678998 - RNA, 64 nt, Homo Sapiens
ucugcucaauuaaagauguuugaauccaaaggaagucaaggaagaaaaagcauggaaaggaaga

SEQ ID NO: 678999 - RNA, 64 nt, Homo Sapiens
gaaagguuuggaugacugaaauauuuccucuacagucaaggacuuuggcaugugguggcugaaa

SEQ ID NO: 679000 - RNA, 64 nt, Homo Sapiens
uccggaggaccacaucuuucaagacuucugaugggucaaggaaaaagaugccaacauacccgua

SEQ ID NO: 679001 - RNA, 64 nt, Homo Sapiens
ugcuaccauacuuacuucaaacccaaugacuacugucaaggacauauuuucaguacauaaauac

SEQ ID NO: 679002 - RNA, 63 nt, Homo Sapiens; identical to SEQ ID NO: 530191

SEQ ID NO: 679003 - RNA, 64 nt, Homo Sapiens; identical to SEQ ID NO: 530192

SEQ ID NO: 679004 - RNA, 64 nt, Homo Sapiens; identical to SEQ ID NO: 530193

SEQ ID NO: 679005 - RNA, 64 nt, Homo Sapiens; identical to SEQ ID NO: 530194

SEQ ID NO: 679006 - RNA, 64 nt, Homo Sapiens; identical to SEQ ID NO: 530195

SEQ ID NO: 679007 - RNA, 64 nt, Homo Sapiens; identical to SEQ ID NO: 530196

SEQ ID NO: 679008 - RNA, 64 nt, Homo Sapiens; identical to SEQ ID NO: 530197

SEQ ID NO: 679009 - RNA, 64 nt, Homo Sapiens; identical to SEQ ID NO: 530198

SEQ ID NO: 679010 - RNA, 64 nt, Homo Sapiens; identical to SEQ ID NO: 530199

SEQ ID NO: 679011 - RNA, 64 nt, Homo Sapiens; identical to SEQ ID NO: 530200

SEQ ID NO: 679012 - RNA, 64 nt, Homo Sapiens; identical to SEQ ID NO: 530201

SEQ ID NO: 679013 - RNA, 64 nt, Homo Sapiens; identical to SEQ ID NO: 530202

SEQ ID NO: 679014 - RNA, 64 nt, Homo Sapiens; identical to SEQ ID NO: 530203

SEQ ID NO: 679015 - RNA, 64 nt, Homo Sapiens; identical to SEQ ID NO: 530204

SEQ ID NO: 679016 - RNA, 64 nt, Homo Sapiens; identical to SEQ ID NO: 530205

SEQ ID NO: 679017 - RNA, 64 nt, Homo Sapiens; identical to SEQ ID NO: 530206

SEQ ID NO: 679018 - RNA, 64 nt, Homo Sapiens; identical to SEQ ID NO: 530207

SEQ ID NO: 679019 - RNA, 64 nt, Homo Sapiens; identical to SEQ ID NO: 530208

SEQ ID NO: 679020 - RNA, 64 nt, Homo Sapiens; identical to SEQ ID NO: 530209

SEQ ID NO: 679021 - RNA, 64 nt, Homo Sapiens; identical to SEQ ID NO: 530210

SEQ ID NO: 679022 - RNA, 64 nt, Homo Sapiens; identical to SEQ ID NO: 530211

SEQ ID NO: 679023 - RNA, 64 nt, Homo Sapiens; identical to SEQ ID NO: 530212

SEQ ID NO: 679024 - RNA, 64 nt, Homo Sapiens; identical to SEQ ID NO: 530213

SEQ ID NO: 679025 - RNA, 64 nt, Homo Sapiens; identical to SEQ ID NO: 530214

SEQ ID NO: 679026 - RNA, 64 nt, Homo Sapiens; identical to SEQ ID NO: 530215

SEQ ID NO: 679027 - RNA, 64 nt, Homo Sapiens; identical to SEQ ID NO: 530216

SEQ ID NO: 679028 - RNA, 64 nt, Homo Sapiens; identical to SEQ ID NO: 530217

SEQ ID NO: 679029 - RNA, 64 nt, Homo Sapiens; identical to SEQ ID NO: 530218

SEQ ID NO: 679030 - RNA, 64 nt, Homo Sapiens; identical to SEQ ID NO: 530219

SEQ ID NO: 679031 - RNA, 64 nt, Homo Sapiens; identical to SEQ ID NO: 530220

SEQ ID NO: 679032 - RNA, 64 nt, Homo Sapiens; identical to SEQ ID NO: 530221

SEQ ID NO: 679033 - RNA, 63 nt, Homo Sapiens; identical to SEQ ID NO: 530222

SEQ ID NO: 679034 - RNA, 64 nt, Homo Sapiens; identical to SEQ ID NO: 530223

SEQ ID NO: 679035 - RNA, 64 nt, Homo Sapiens; identical to SEQ ID NO: 530224

SEQ ID NO: 679036 - RNA, 64 nt, Homo Sapiens; identical to SEQ ID NO: 530225

SEQ ID NO: 679037 - RNA, 64 nt, Homo Sapiens; identical to SEQ ID NO: 530226

SEQ ID NO: 679038 - RNA, 64 nt, Homo Sapiens; identical to SEQ ID NO: 530227

SEQ ID NO: 679039 - RNA, 64 nt, Homo Sapiens; identical to SEQ ID NO: 530228

SEQ ID NO: 679040 - RNA, 64 nt, Homo Sapiens; identical to SEQ ID NO: 530229

SEQ ID NO: 679041 - RNA, 64 nt, Homo Sapiens; identical to SEQ ID NO: 530230

SEQ ID NO: 679042 - RNA, 64 nt, Homo Sapiens; identical to SEQ ID NO: 530231

SEQ ID NO: 679043 - RNA, 64 nt, Homo Sapiens; identical to SEQ ID NO: 530232

SEQ ID NO: 679044 - RNA, 64 nt, Homo Sapiens; identical to SEQ ID NO: 530233

SEQ ID NO: 679045 - RNA, 64 nt, Homo Sapiens; identical to SEQ ID NO: 530234

SEQ ID NO: 679046 - RNA, 64 nt, Homo Sapiens; identical to SEQ ID NO: 530235

SEQ ID NO: 679047 - RNA, 64 nt, Homo Sapiens; identical to SEQ ID NO: 530236

SEQ ID NO: 679048 - RNA, 64 nt, Homo Sapiens; identical to SEQ ID NO: 530237

SEQ ID NO: 679049 - RNA, 64 nt, Homo Sapiens; identical to SEQ ID NO: 530238

SEQ ID NO: 679050 - RNA, 64 nt, Homo Sapiens; identical to SEQ ID NO: 530239

SEQ ID NO: 679051 - RNA, 64 nt, Homo Sapiens; identical to SEQ ID NO: 530240

SEQ ID NO: 679052 - RNA, 64 nt, Homo Sapiens; identical to SEQ ID NO: 530241

SEQ ID NO: 679053 - RNA, 64 nt, Homo Sapiens; identical to SEQ ID NO: 530242

SEQ ID NO: 679054 - RNA, 64 nt, Homo Sapiens; identical to SEQ ID NO: 530243

SEQ ID NO: 679055 - RNA, 64 nt, Homo Sapiens; identical to SEQ ID NO: 530244

SEQ ID NO: 679056 - RNA, 64 nt, Homo Sapiens; identical to SEQ ID NO: 530245

SEQ ID NO: 679057 - RNA, 64 nt, Homo Sapiens; identical to SEQ ID NO: 530246

SEQ ID NO: 679058 - RNA, 64 nt, Homo Sapiens; identical to SEQ ID NO: 530247

SEQ ID NO: 679059 - RNA, 64 nt, Homo Sapiens; identical to SEQ ID NO: 530248

SEQ ID NO: 679060 - RNA, 64 nt, Homo Sapiens; identical to SEQ ID NO: 530249

SEQ ID NO: 679061 - RNA, 64 nt, Homo Sapiens; identical to SEQ ID NO: 530250

SEQ ID NO: 679062 - RNA, 64 nt, Homo Sapiens; identical to SEQ ID NO: 530251

SEQ ID NO: 679063 - RNA, 64 nt, Homo Sapiens; identical to SEQ ID NO: 530252

SEQ ID NO: 679064 - RNA, 64 nt, Homo Sapiens; identical to SEQ ID NO: 530253

SEQ ID NO: 679065 - RNA, 64 nt, Homo Sapiens; identical to SEQ ID NO: 530254

SEQ ID NO: 679066 - RNA, 64 nt, Homo Sapiens; identical to SEQ ID NO: 530255

SEQ ID NO: 679067 - RNA, 64 nt, Homo Sapiens; identical to SEQ ID NO: 530256

SEQ ID NO: 679068 - RNA, 64 nt, Homo Sapiens; identical to SEQ ID NO: 530257

SEQ ID NO: 679069 - RNA, 64 nt, Homo Sapiens; identical to SEQ ID NO: 530258

SEQ ID NO: 679070 - RNA, 64 nt, Homo Sapiens; identical to SEQ ID NO: 530259

SEQ ID NO: 679071 - RNA, 64 nt, Homo Sapiens; identical to SEQ ID NO: 530260

SEQ ID NO: 679072 - RNA, 64 nt, Homo Sapiens; identical to SEQ ID NO: 530261

SEQ ID NO: 679073 - RNA, 64 nt, Homo Sapiens; identical to SEQ ID NO: 530262

SEQ ID NO: 679074 - RNA, 64 nt, Homo Sapiens; identical to SEQ ID NO: 530263

SEQ ID NO: 679075 - RNA, 64 nt, Homo Sapiens; identical to SEQ ID NO: 530264

SEQ ID NO: 679076 - RNA, 64 nt, Homo Sapiens; identical to SEQ ID NO: 530265

SEQ ID NO: 679077 - RNA, 64 nt, Homo Sapiens; identical to SEQ ID NO: 530266

SEQ ID NO: 679078 - RNA, 64 nt, Homo Sapiens; identical to SEQ ID NO: 530267

SEQ ID NO: 679079 - RNA, 64 nt, Homo Sapiens; identical to SEQ ID NO: 530268

SEQ ID NO: 679080 - RNA, 64 nt, Homo Sapiens; identical to SEQ ID NO: 530269

SEQ ID NO: 679081 - RNA, 64 nt, Homo Sapiens; identical to SEQ ID NO: 530270

SEQ ID NO: 679082 - RNA, 64 nt, Homo Sapiens; identical to SEQ ID NO: 530271

SEQ ID NO: 679083 - RNA, 64 nt, Homo Sapiens; identical to SEQ ID NO: 530272

SEQ ID NO: 679084 - RNA, 64 nt, Homo Sapiens; identical to SEQ ID NO: 530273

SEQ ID NO: 679085 - RNA, 64 nt, Homo Sapiens; identical to SEQ ID NO: 530274

SEQ ID NO: 679086 - RNA, 64 nt, Homo Sapiens; identical to SEQ ID NO: 530275

SEQ ID NO: 679087 - RNA, 64 nt, Homo Sapiens; identical to SEQ ID NO: 530276

SEQ ID NO: 679088 - RNA, 64 nt, Homo Sapiens; identical to SEQ ID NO: 530277

SEQ ID NO: 679089 - RNA, 64 nt, Homo Sapiens; identical to SEQ ID NO: 530278

SEQ ID NO: 679090 - RNA, 64 nt, Homo Sapiens; identical to SEQ ID NO: 530279

SEQ ID NO: 679091 - RNA, 64 nt, Homo Sapiens; identical to SEQ ID NO: 530280

SEQ ID NO: 679092 - RNA, 64 nt, Homo Sapiens; identical to SEQ ID NO: 530281

SEQ ID NO: 679093 - RNA, 64 nt, Homo Sapiens; identical to SEQ ID NO: 530282

SEQ ID NO: 679094 - RNA, 64 nt, Homo Sapiens; identical to SEQ ID NO: 530283

SEQ ID NO: 679095 - RNA, 64 nt, Homo Sapiens; identical to SEQ ID NO: 530284

SEQ ID NO: 679096 - RNA, 64 nt, Homo Sapiens; identical to SEQ ID NO: 530285

SEQ ID NO: 679097 - RNA, 64 nt, Homo Sapiens; identical to SEQ ID NO: 530286

SEQ ID NO: 679098 - RNA, 64 nt, Homo Sapiens; identical to SEQ ID NO: 530287

SEQ ID NO: 679099 - RNA, 64 nt, Homo Sapiens; identical to SEQ ID NO: 530288

SEQ ID NO: 679100 - RNA, 64 nt, Homo Sapiens; identical to SEQ ID NO: 530289

SEQ ID NO: 679101 - RNA, 64 nt, Homo Sapiens; identical to SEQ ID NO: 530290

SEQ ID NO: 679102 - RNA, 64 nt, Homo Sapiens; identical to SEQ ID NO: 530291

SEQ ID NO: 679103 - RNA, 64 nt, Homo Sapiens; identical to SEQ ID NO: 530292

SEQ ID NO: 679104 - RNA, 64 nt, Homo Sapiens; identical to SEQ ID NO: 530293

SEQ ID NO: 679105 - RNA, 64 nt, Homo Sapiens; identical to SEQ ID NO: 530294

SEQ ID NO: 679106 - RNA, 64 nt, Homo Sapiens; identical to SEQ ID NO: 530295

SEQ ID NO: 679107 - RNA, 64 nt, Homo Sapiens; identical to SEQ ID NO: 530296

SEQ ID NO: 679108 - RNA, 64 nt, Homo Sapiens; identical to SEQ ID NO: 530297

SEQ ID NO: 679109 - RNA, 64 nt, Homo Sapiens; identical to SEQ ID NO: 530298

SEQ ID NO: 679110 - RNA, 64 nt, Homo Sapiens; identical to SEQ ID NO: 530299

SEQ ID NO: 679111 - RNA, 64 nt, Homo Sapiens; identical to SEQ ID NO: 530300

SEQ ID NO: 679112 - RNA, 64 nt, Homo Sapiens; identical to SEQ ID NO: 530301

SEQ ID NO: 679113 - RNA, 64 nt, Homo Sapiens; identical to SEQ ID NO: 530302

SEQ ID NO: 679114 - RNA, 64 nt, Homo Sapiens; identical to SEQ ID NO: 530303

SEQ ID NO: 679115 - RNA, 64 nt, Homo Sapiens; identical to SEQ ID NO: 530304

SEQ ID NO: 679116 - RNA, 64 nt, Homo Sapiens; identical to SEQ ID NO: 530305

SEQ ID NO: 679117 - RNA, 64 nt, Homo Sapiens; identical to SEQ ID NO: 530306

SEQ ID NO: 679118 - RNA, 64 nt, Homo Sapiens; identical to SEQ ID NO: 530307

SEQ ID NO: 679119 - RNA, 64 nt, Homo Sapiens; identical to SEQ ID NO: 530308

SEQ ID NO: 679120 - RNA, 64 nt, Homo Sapiens; identical to SEQ ID NO: 530309

SEQ ID NO: 679121 - RNA, 64 nt, Homo Sapiens; identical to SEQ ID NO: 530310

SEQ ID NO: 679122 - RNA, 64 nt, Homo Sapiens; identical to SEQ ID NO: 530311

SEQ ID NO: 679123 - RNA, 64 nt, Homo Sapiens; identical to SEQ ID NO: 530312

SEQ ID NO: 679124 - RNA, 64 nt, Homo Sapiens; identical to SEQ ID NO: 530313

SEQ ID NO: 679125 - RNA, 64 nt, Homo Sapiens; identical to SEQ ID NO: 530314

SEQ ID NO: 679126 - RNA, 64 nt, Homo Sapiens; identical to SEQ ID NO: 530315

SEQ ID NO: 679127 - RNA, 64 nt, Homo Sapiens; identical to SEQ ID NO: 530316

SEQ ID NO: 679128 - RNA, 64 nt, Homo Sapiens; identical to SEQ ID NO: 530317

SEQ ID NO: 679129 - RNA, 64 nt, Homo Sapiens; identical to SEQ ID NO: 530318

SEQ ID NO: 679130 - RNA, 64 nt, Homo Sapiens; identical to SEQ ID NO: 530319

SEQ ID NO: 679131 - RNA, 64 nt, Homo Sapiens; identical to SEQ ID NO: 530320

SEQ ID NO: 679132 - RNA, 64 nt, Homo Sapiens; identical to SEQ ID NO: 530321

SEQ ID NO: 679133 - RNA, 64 nt, Homo Sapiens; identical to SEQ ID NO: 530322

SEQ ID NO: 679134 - RNA, 64 nt, Homo Sapiens; identical to SEQ ID NO: 530323

SEQ ID NO: 679135 - RNA, 64 nt, Homo Sapiens; identical to SEQ ID NO: 530324

SEQ ID NO: 679136 - RNA, 64 nt, Homo Sapiens; identical to SEQ ID NO: 530325

SEQ ID NO: 679137 - RNA, 64 nt, Homo Sapiens; identical to SEQ ID NO: 530326

SEQ ID NO: 679138 - RNA, 64 nt, Homo Sapiens; identical to SEQ ID NO: 530327

SEQ ID NO: 679139 - RNA, 64 nt, Homo Sapiens; identical to SEQ ID NO: 530328

SEQ ID NO: 679140 - RNA, 64 nt, Homo Sapiens; identical to SEQ ID NO: 530329

SEQ ID NO: 679141 - RNA, 64 nt, Homo Sapiens; identical to SEQ ID NO: 530330

SEQ ID NO: 679142 - RNA, 64 nt, Homo Sapiens; identical to SEQ ID NO: 530331

SEQ ID NO: 679143 - RNA, 64 nt, Homo Sapiens; identical to SEQ ID NO: 530332

SEQ ID NO: 679144 - RNA, 64 nt, Homo Sapiens; identical to SEQ ID NO: 530333

SEQ ID NO: 679145 - RNA, 64 nt, Homo Sapiens; identical to SEQ ID NO: 530334

SEQ ID NO: 679146 - RNA, 64 nt, Homo Sapiens; identical to SEQ ID NO: 530335

SEQ ID NO: 679147 - RNA, 64 nt, Homo Sapiens; identical to SEQ ID NO: 530336

SEQ ID NO: 679148 - RNA, 64 nt, Homo Sapiens; identical to SEQ ID NO: 530337

SEQ ID NO: 679149 - RNA, 64 nt, Homo Sapiens; identical to SEQ ID NO: 530338

SEQ ID NO: 679150 - RNA, 64 nt, Homo Sapiens; identical to SEQ ID NO: 530339

SEQ ID NO: 679151 - RNA, 64 nt, Homo Sapiens; identical to SEQ ID NO: 530340

SEQ ID NO: 679152 - RNA, 64 nt, Homo Sapiens; identical to SEQ ID NO: 530341

SEQ ID NO: 679153 - RNA, 64 nt, Homo Sapiens; identical to SEQ ID NO: 530342

SEQ ID NO: 679154 - RNA, 64 nt, Homo Sapiens; identical to SEQ ID NO: 530343

SEQ ID NO: 679155 - RNA, 64 nt, Homo Sapiens; identical to SEQ ID NO: 530344

SEQ ID NO: 679156 - RNA, 64 nt, Homo Sapiens; identical to SEQ ID NO: 530345

SEQ ID NO: 679157 - RNA, 64 nt, Homo Sapiens; identical to SEQ ID NO: 82929

SEQ ID NO: 679158 - RNA, 64 nt, Homo Sapiens; identical to SEQ ID NO: 82930

SEQ ID NO: 679159 - RNA, 64 nt, Homo Sapiens; identical to SEQ ID NO: 82931

SEQ ID NO: 679160 - RNA, 64 nt, Homo Sapiens; identical to SEQ ID NO: 82932

SEQ ID NO: 679161 - RNA, 64 nt, Homo Sapiens; identical to SEQ ID NO: 82933

SEQ ID NO: 679162 - RNA, 64 nt, Homo Sapiens; identical to SEQ ID NO: 82934

SEQ ID NO: 679163 - RNA, 64 nt, Homo Sapiens; identical to SEQ ID NO: 82935

SEQ ID NO: 679164 - RNA, 64 nt, Homo Sapiens; identical to SEQ ID NO: 82936

SEQ ID NO: 679165 - RNA, 64 nt, Homo Sapiens; identical to SEQ ID NO: 82937

SEQ ID NO: 679166 - RNA, 64 nt, Homo Sapiens; identical to SEQ ID NO: 82938

SEQ ID NO: 679167 - RNA, 64 nt, Homo Sapiens; identical to SEQ ID NO: 82939

SEQ ID NO: 679168 - RNA, 64 nt, Homo Sapiens; identical to SEQ ID NO: 82940

SEQ ID NO: 679169 - RNA, 64 nt, Homo Sapiens; identical to SEQ ID NO: 82941

SEQ ID NO: 679170 - RNA, 64 nt, Homo Sapiens; identical to SEQ ID NO: 82942

SEQ ID NO: 679171 - RNA, 64 nt, Homo Sapiens; identical to SEQ ID NO: 82943

SEQ ID NO: 679172 - RNA, 64 nt, Homo Sapiens; identical to SEQ ID NO: 82944

SEQ ID NO: 679173 - RNA, 64 nt, Homo Sapiens; identical to SEQ ID NO: 82945

SEQ ID NO: 679174 - RNA, 64 nt, Homo Sapiens; identical to SEQ ID NO: 82946

SEQ ID NO: 679175 - RNA, 64 nt, Homo Sapiens; identical to SEQ ID NO: 82947

SEQ ID NO: 679176 - RNA, 64 nt, Homo Sapiens; identical to SEQ ID NO: 82948

SEQ ID NO: 679177 - RNA, 64 nt, Homo Sapiens; identical to SEQ ID NO: 82949

SEQ ID NO: 679178 - RNA, 64 nt, Homo Sapiens; identical to SEQ ID NO: 82950

SEQ ID NO: 679179 - RNA, 64 nt, Homo Sapiens; identical to SEQ ID NO: 82951

SEQ ID NO: 679180 - RNA, 64 nt, Homo Sapiens; identical to SEQ ID NO: 82952

SEQ ID NO: 679181 - RNA, 64 nt, Homo Sapiens; identical to SEQ ID NO: 82953

SEQ ID NO: 679182 - RNA, 64 nt, Homo Sapiens; identical to SEQ ID NO: 82954

SEQ ID NO: 679183 - RNA, 64 nt, Homo Sapiens; identical to SEQ ID NO: 82955

SEQ ID NO: 679184 - RNA, 64 nt, Homo Sapiens; identical to SEQ ID NO: 82956

SEQ ID NO: 679185 - RNA, 64 nt, Homo Sapiens; identical to SEQ ID NO: 82957

SEQ ID NO: 679186 - RNA, 64 nt, Homo Sapiens; identical to SEQ ID NO: 82958

SEQ ID NO: 679187 - RNA, 64 nt, Homo Sapiens; identical to SEQ ID NO: 82959

SEQ ID NO: 679188 - RNA, 64 nt, Homo Sapiens; identical to SEQ ID NO: 82960

SEQ ID NO: 679189 - RNA, 64 nt, Homo Sapiens; identical to SEQ ID NO: 82961

SEQ ID NO: 679190 - RNA, 64 nt, Homo Sapiens; identical to SEQ ID NO: 82962

SEQ ID NO: 679191 - RNA, 64 nt, Homo Sapiens; identical to SEQ ID NO: 82963

SEQ ID NO: 679192 - RNA, 64 nt, Homo Sapiens; identical to SEQ ID NO: 82964

SEQ ID NO: 679193 - RNA, 64 nt, Homo Sapiens; identical to SEQ ID NO: 82965

SEQ ID NO: 679194 - RNA, 64 nt, Homo Sapiens; identical to SEQ ID NO: 82966

SEQ ID NO: 679195 - RNA, 64 nt, Homo Sapiens; identical to SEQ ID NO: 82967

SEQ ID NO: 679196 - RNA, 64 nt, Homo Sapiens; identical to SEQ ID NO: 82968

SEQ ID NO: 679197 - RNA, 64 nt, Homo Sapiens; identical to SEQ ID NO: 82969

SEQ ID NO: 679198 - RNA, 64 nt, Homo Sapiens; identical to SEQ ID NO: 82970

SEQ ID NO: 679199 - RNA, 64 nt, Homo Sapiens; identical to SEQ ID NO: 82971

SEQ ID NO: 679200 - RNA, 64 nt, Homo Sapiens; identical to SEQ ID NO: 82972

SEQ ID NO: 679201 - RNA, 64 nt, Homo Sapiens; identical to SEQ ID NO: 82973

SEQ ID NO: 679202 - RNA, 64 nt, Homo Sapiens; identical to SEQ ID NO: 82974

SEQ ID NO: 679203 - RNA, 64 nt, Homo Sapiens; identical to SEQ ID NO: 82975

SEQ ID NO: 679204 - RNA, 64 nt, Homo Sapiens; identical to SEQ ID NO: 82976

SEQ ID NO: 679205 - RNA, 64 nt, Homo Sapiens; identical to SEQ ID NO: 82977

SEQ ID NO: 679206 - RNA, 64 nt, Homo Sapiens; identical to SEQ ID NO: 82978

SEQ ID NO: 679207 - RNA, 64 nt, Homo Sapiens; identical to SEQ ID NO: 82979

SEQ ID NO: 679208 - RNA, 64 nt, Homo Sapiens; identical to SEQ ID NO: 82980

SEQ ID NO: 679209 - RNA, 64 nt, Homo Sapiens; identical to SEQ ID NO: 82981

SEQ ID NO: 679210 - RNA, 64 nt, Homo Sapiens; identical to SEQ ID NO: 82982

SEQ ID NO: 679211 - RNA, 64 nt, Homo Sapiens
agcuuccaaggcacuuugaaaucauuccaguauauuugggaagaauugagugaaugagaaugcu

SEQ ID NO: 679212 - RNA, 64 nt, Homo Sapiens
acgucaggauuuuaacuaguacugcuuuguugacuuugggaaauggugccacucaaaagcaacu

SEQ ID NO: 679213 - RNA, 64 nt, Homo Sapiens
gcuuugaggaauuuugacagcuguugacaugggauuugggaaaggugaagcugugacuggaggg

SEQ ID NO: 679214 - RNA, 64 nt, Homo Sapiens
gaacacccguggacuuguguauauggucauaggcuuugggaagacaggacguaaaggaaaauga

SEQ ID NO: 679215 - RNA, 64 nt, Homo Sapiens
ggcuacugccauccagcuuucaguggcaucuuguuuugggaacugauuauagagaaucauauau

SEQ ID NO: 679216 - RNA, 64 nt, Homo Sapiens
agucuuaagagaguuuuauugugucuauggcagguuugggaaagguaagaaauggguccuuuuu

SEQ ID NO: 679217 - RNA, 64 nt, Homo Sapiens
gaggaggggagugguggguugacaccccaagugguuugggaaaguuggggcagugagggcuuag

SEQ ID NO: 679218 - RNA, 64 nt, Homo Sapiens
uauggaggaggacuuuuagaacaaacaaacuuuguuugggaagcagcaaaguucaguuucagca

SEQ ID NO: 679219 - RNA, 64 nt, Homo Sapiens
gucauauaggaaacagaaagcaugacaguggccuuuugggaacccaaguuacguccuggugaaa

SEQ ID NO: 679220 - RNA, 64 nt, Homo Sapiens
ggagguaauugggucuuggcuucaaugccacccuuuugggaagcccuaaaccaagugagguguu

SEQ ID NO: 679221 - RNA, 64 nt, Homo Sapiens
uucuucauugugcacacaggacaaaucugaucucuuugggaaaaaauagaaauaaaacaaucuc

SEQ ID NO: 679222 - RNA, 64 nt, Homo Sapiens
gcuuuucuauaauaaaaagagguucuaaccauuauuugggaacaaagagaguuuucaucuuuuu

SEQ ID NO: 679223 - RNA, 64 nt, Homo Sapiens
ugcuguccugcaguagaaggugccgugagcaggcuuugggaacacuggccugggucucccuggu

SEQ ID NO: 679224 - RNA, 64 nt, Homo Sapiens
auccuagcuuuuuccuggaaagcccgcuagaagguuugggaacgaggggaaaguucucagaacu

SEQ ID NO: 679225 - RNA, 64 nt, Homo Sapiens
uaguguauuuuauaaaaauuauaauauucuuuauuuugggaaauuaaguugacaccaauguguc

SEQ ID NO: 679226 - RNA, 64 nt, Homo Sapiens
caaacauacaaaugaaucagauuugguuuucuucuuugggaaacauagaaaucccaguucucua

SEQ ID NO: 679227 - RNA, 64 nt, Homo Sapiens
uuguuuagguuauaugggaaccagucuacuauuauuugggaaaaccuuaauguguauagagacc

SEQ ID NO: 679228 - RNA, 64 nt, Homo Sapiens
agaucuauucuaacucauuauauugugugcuaaauuugggaaacuuucucuaauccacugaaau

SEQ ID NO: 679229 - RNA, 64 nt, Homo Sapiens
gguauauauccgccuggcauuucacaaaacagccuuugggaaaugcugaauuaaagugaauugu

SEQ ID NO: 679230 - RNA, 64 nt, Homo Sapiens
uaggcaugguggcucacaccuguaaucccagcauuuugggaagcuaagauggguggaucacuug

SEQ ID NO: 679231 - RNA, 64 nt, Homo Sapiens
accaagguagaauuuaauuugaaacguggcaucauuugggaagaguuuuaagaggaagaaaaca

SEQ ID NO: 679232 - RNA, 64 nt, Homo Sapiens
ggcaugaaagcaucuacugucgguucaucggcuguuugggaaauguuugacaggaguggaaaag

SEQ ID NO: 679233 - RNA, 64 nt, Homo Sapiens
aauacucucuuauuuugcuacauucccuucucuauuugggaaacuauuugagaaucucuaccac

SEQ ID NO: 679234 - RNA, 64 nt, Homo Sapiens
aaagagauguuccccugagcacuuccuccagcguuuugggaaggaccaguaacagcagggcugg

SEQ ID NO: 679235 - RNA, 64 nt, Homo Sapiens
caaggcgggcagcucaccuguguaaucccugcacuuugggaagccgagugugguggcuuaugcc

SEQ ID NO: 679236 - RNA, 64 nt, Homo Sapiens
uaaaaggauccucuucacuuuccaugaggccccguuugggaaaagggaggagcaacguggaacu

SEQ ID NO: 679237 - RNA, 64 nt, Homo Sapiens
uagcagaaugguccgcuucuggagucccuuugucuuugggaaagauuuuucaguuacccuuuaa

SEQ ID NO: 679238 - RNA, 64 nt, Homo Sapiens
cuuagaauaaagaacgagaauugauauuacaaauuuugggaaauaaauaaacuaaagccuggau

SEQ ID NO: 679239 - RNA, 64 nt, Homo Sapiens
gcugaacacuucauucuucuuguggucagaugaguuugggaaauuugggggaaaaaggggauuc

SEQ ID NO: 679240 - RNA, 64 nt, Homo Sapiens
cuacuuauggaguggaaaccuaguuguuaguugcuuugggaagcaguauguagugaagaaaauu

SEQ ID NO: 679241 - RNA, 64 nt, Homo Sapiens
cucuuagauaguacagugagugucagaugguuuuuuugggaaaagagagcacacacucccuaau

SEQ ID NO: 679242 - RNA, 64 nt, Homo Sapiens
uuuaaaguaaaaguuucaaagcuuucauuuuaauuuugggaaauccuacucuccuucuuuuucu

SEQ ID NO: 679243 - RNA, 64 nt, Homo Sapiens
uuugacuuccuugggacucuuguaaagggcuacauuugggaacagcaggcuucccuggugccga

SEQ ID NO: 679244 - RNA, 64 nt, Homo Sapiens
augggcauaaucagguaguugaaaaaucaagguauuugggaaaccagaugaaaugucaauauaa

SEQ ID NO: 679245 - RNA, 64 nt, Homo Sapiens
cuucccggugccagguccagauuucccuccaugauuugggaaccagcuuaggcaaaagaguccc

SEQ ID NO: 679246 - RNA, 64 nt, Homo Sapiens
uauaauaacucuguacuuugguuucagggugacauuugggaaggauuuuguuuagaauuaaugg

SEQ ID NO: 679247 - RNA, 64 nt, Homo Sapiens
auauuaauggaggauauuccucggaaaaacagacuuugggaaugaaggagggacucaggaucau

SEQ ID NO: 679248 - RNA, 64 nt, Homo Sapiens
cauaagcauuugcccucaccaugguuuauaaaacuuugggaaaacggaauauucagaaauaggu

SEQ ID NO: 679249 - RNA, 64 nt, Homo Sapiens
aaggaauguaauauuauggauuaagugugggggguuugggaaggagauuuaauacuuuaauguu

SEQ ID NO: 679250 - RNA, 64 nt, Homo Sapiens
auaggaaugacuguuucaaacugucuuucauacauuugggaaaggcccgcugaggacuagcuuu

SEQ ID NO: 679251 - RNA, 64 nt, Homo Sapiens
cccaucuauggcuguagaucaggauacagcuuccuuugggaagcguagcuucuguguucccgua

SEQ ID NO: 679252 - RNA, 64 nt, Homo Sapiens
auuaaaggauguuugagggcccuguagaccugucuuugggaaacaaucaaagguaauuuuauua

SEQ ID NO: 679253 - RNA, 64 nt, Homo Sapiens
cacuacagcugaacuuuucaucaucucauucacauuugggaaacgaacaggagaugagcaaagc

SEQ ID NO: 679254 - RNA, 64 nt, Homo Sapiens
guauacuuauaaugggaaacuuugcaaggacauuuuugggaagcaaugcugggcagcguuuuug

SEQ ID NO: 679255 - RNA, 64 nt, Homo Sapiens
uaaguauaaugcugaucugacaauugacguguaauuugggaagucauuuugauaauuuugcuua

SEQ ID NO: 679256 - RNA, 64 nt, Homo Sapiens
gauaagggccuccccaguccucuccgggagaugauuugggaaauuuuauaaugcuuguucuguu

SEQ ID NO: 679257 - RNA, 64 nt, Homo Sapiens
cauagaacugauggaggcuuacaugagcuuauauuuugggaacaaauugccugaccucguuauc

SEQ ID NO: 679258 - RNA, 64 nt, Homo Sapiens
ugauuguauuguauuaaaauaugagccuaggaaauuugggaacauguauugagacuguauuguu

SEQ ID NO: 679259 - RNA, 64 nt, Homo Sapiens
ggcaucaaugggugguauuuaguuuuuauuuaguuuugggaauaaagauguauaaaaauccuga

SEQ ID NO: 679260 - RNA, 64 nt, Homo Sapiens
ggaugaauaucucuuuuuacugggagggaagggcuuugggaaggcuguauuggguagugggagg

SEQ ID NO: 679261 - RNA, 64 nt, Homo Sapiens
uguguguaauggucuugagaaaaagggcuacagauuugggaagccagcuuucaugagguuacag

SEQ ID NO: 679262 - RNA, 64 nt, Homo Sapiens
cagaugggucaugcuuuugcugguccacauggcauuugggaaagcccuggcucaccaaugcguc

SEQ ID NO: 679263 - RNA, 64 nt, Homo Sapiens
ccaagugggugaaucaccuguguaaucccagcacuuugggaagccgggcauguuggcucccgcc

SEQ ID NO: 679264 - RNA, 64 nt, Homo Sapiens
agucguauucucucucucuccuggcaaccacgaguuugggaagcaggccuggcccagagucacg

SEQ ID NO: 679265 - RNA, 64 nt, Homo Sapiens
accaaagaggcuuugauugauaucaaaaaucugguuugggaaaucagaguagauaauguucauu

SEQ ID NO: 679266 - RNA, 64 nt, Homo Sapiens
ucgaugaaaaagcguucagagugcucugcuuuuauuugggaauuuuucuauuuagcaaaaauga

SEQ ID NO: 679267 - RNA, 64 nt, Homo Sapiens
ggauagcuugagccauauucaugccucaugugcauuugggaacauucuaaccuuaacagauaau

SEQ ID NO: 679268 - RNA, 54 nt, Homo Sapiens
ccucuugccagauguaggccucauuuugggaaagacaggagaauucacagguag

SEQ ID NO: 679269 - RNA, 64 nt, Homo Sapiens
uuaaaaaaaaggucagaaggacaaagcugguuuguuugggaaauggacugaucgaaagaaaacu

SEQ ID NO: 679270 - RNA, 64 nt, Homo Sapiens
ucagccauaccucuuaacaccucauagaacacacuuugggaaacaguggggguaggaaaacucg

SEQ ID NO: 679271 - RNA, 64 nt, Homo Sapiens
gcuuagaaacuggaaauacuaucauuuuuuccuguuugggaagaaaagggaagaaaacacuguu

SEQ ID NO: 679272 - RNA, 64 nt, Homo Sapiens
uaaagggaagaaaacacuguuaacuuggaugaguuuugggaaguugcuugaacuuacaggugau

SEQ ID NO: 679273 - RNA, 64 nt, Homo Sapiens
ucuuuaucuuuuuuaaauucaucaccaugcuuauuuugggaaaccacagcuaaccauuaugcca

SEQ ID NO: 679274 - RNA, 64 nt, Homo Sapiens
agcaggaaaugugcauguggcaucuuggaauaccuuugggaagccuucucacugucagugacac

SEQ ID NO: 679275 - RNA, 64 nt, Homo Sapiens; identical to SEQ ID NO: 674439

SEQ ID NO: 679276 - RNA, 64 nt, Homo Sapiens; identical to SEQ ID NO: 674440

SEQ ID NO: 679277 - RNA, 64 nt, Homo Sapiens; identical to SEQ ID NO: 674441

SEQ ID NO: 679278 - RNA, 64 nt, Homo Sapiens; identical to SEQ ID NO: 674442

SEQ ID NO: 679279 - RNA, 64 nt, Homo Sapiens; identical to SEQ ID NO: 674443

SEQ ID NO: 679280 - RNA, 64 nt, Homo Sapiens; identical to SEQ ID NO: 674444

SEQ ID NO: 679281 - RNA, 64 nt, Homo Sapiens; identical to SEQ ID NO: 674445

SEQ ID NO: 679282 - RNA, 64 nt, Homo Sapiens; identical to SEQ ID NO: 674446

SEQ ID NO: 679283 - RNA, 64 nt, Homo Sapiens; identical to SEQ ID NO: 674447

SEQ ID NO: 679284 - RNA, 64 nt, Homo Sapiens; identical to SEQ ID NO: 674448

SEQ ID NO: 679285 - RNA, 64 nt, Homo Sapiens; identical to SEQ ID NO: 674449

SEQ ID NO: 679286 - RNA, 64 nt, Homo Sapiens; identical to SEQ ID NO: 674450

SEQ ID NO: 679287 - RNA, 64 nt, Homo Sapiens; identical to SEQ ID NO: 674451

SEQ ID NO: 679288 - RNA, 64 nt, Homo Sapiens; identical to SEQ ID NO: 674452

SEQ ID NO: 679289 - RNA, 64 nt, Homo Sapiens; identical to SEQ ID NO: 674453

SEQ ID NO: 679290 - RNA, 64 nt, Homo Sapiens; identical to SEQ ID NO: 674454

SEQ ID NO: 679291 - RNA, 64 nt, Homo Sapiens; identical to SEQ ID NO: 113667

SEQ ID NO: 679292 - RNA, 64 nt, Homo Sapiens; identical to SEQ ID NO: 113668

SEQ ID NO: 679293 - RNA, 64 nt, Homo Sapiens; identical to SEQ ID NO: 113669

SEQ ID NO: 679294 - RNA, 64 nt, Homo Sapiens; identical to SEQ ID NO: 113670

SEQ ID NO: 679295 - RNA, 64 nt, Homo Sapiens; identical to SEQ ID NO: 113671

SEQ ID NO: 679296 - RNA, 64 nt, Homo Sapiens; identical to SEQ ID NO: 113672

SEQ ID NO: 679297 - RNA, 64 nt, Homo Sapiens; identical to SEQ ID NO: 113673

SEQ ID NO: 679298 - RNA, 64 nt, Homo Sapiens; identical to SEQ ID NO: 113674

SEQ ID NO: 679299 - RNA, 64 nt, Homo Sapiens; identical to SEQ ID NO: 113675

SEQ ID NO: 679300 - RNA, 64 nt, Homo Sapiens; identical to SEQ ID NO: 113676

SEQ ID NO: 679301 - RNA, 64 nt, Homo Sapiens; identical to SEQ ID NO: 113677

SEQ ID NO: 679302 - RNA, 64 nt, Homo Sapiens; identical to SEQ ID NO: 113678

SEQ ID NO: 679303 - RNA, 64 nt, Homo Sapiens; identical to SEQ ID NO: 113679

SEQ ID NO: 679304 - RNA, 64 nt, Homo Sapiens; identical to SEQ ID NO: 113680

SEQ ID NO: 679305 - RNA, 64 nt, Homo Sapiens; identical to SEQ ID NO: 113681

SEQ ID NO: 679306 - RNA, 64 nt, Homo Sapiens; identical to SEQ ID NO: 113682

SEQ ID NO: 679307 - RNA, 64 nt, Homo Sapiens; identical to SEQ ID NO: 113683

SEQ ID NO: 679308 - RNA, 64 nt, Homo Sapiens; identical to SEQ ID NO: 113684

SEQ ID NO: 679309 - RNA, 64 nt, Homo Sapiens; identical to SEQ ID NO: 113685

SEQ ID NO: 679310 - RNA, 64 nt, Homo Sapiens; identical to SEQ ID NO: 113686

SEQ ID NO: 679311 - RNA, 64 nt, Homo Sapiens; identical to SEQ ID NO: 113687

SEQ ID NO: 679312 - RNA, 64 nt, Homo Sapiens; identical to SEQ ID NO: 113688

SEQ ID NO: 679313 - RNA, 64 nt, Homo Sapiens; identical to SEQ ID NO: 113689

SEQ ID NO: 679314 - RNA, 62 nt, Homo Sapiens; identical to SEQ ID NO: 113690

SEQ ID NO: 679315 - RNA, 64 nt, Homo Sapiens; identical to SEQ ID NO: 113691

SEQ ID NO: 679316 - RNA, 59 nt, Homo Sapiens; identical to SEQ ID NO: 113692

SEQ ID NO: 679317 - RNA, 64 nt, Homo Sapiens; identical to SEQ ID NO: 113693

SEQ ID NO: 679318 - RNA, 64 nt, Homo Sapiens; identical to SEQ ID NO: 113694

SEQ ID NO: 679319 - RNA, 64 nt, Homo Sapiens; identical to SEQ ID NO: 113695

SEQ ID NO: 679320 - RNA, 64 nt, Homo Sapiens; identical to SEQ ID NO: 113696

SEQ ID NO: 679321 - RNA, 64 nt, Homo Sapiens; identical to SEQ ID NO: 113697

SEQ ID NO: 679322 - RNA, 64 nt, Homo Sapiens; identical to SEQ ID NO: 113698

SEQ ID NO: 679323 - RNA, 64 nt, Homo Sapiens; identical to SEQ ID NO: 113699

SEQ ID NO: 679324 - RNA, 64 nt, Homo Sapiens; identical to SEQ ID NO: 113700

SEQ ID NO: 679325 - RNA, 64 nt, Homo Sapiens; identical to SEQ ID NO: 113701

SEQ ID NO: 679326 - RNA, 64 nt, Homo Sapiens; identical to SEQ ID NO: 113702

SEQ ID NO: 679327 - RNA, 64 nt, Homo Sapiens; identical to SEQ ID NO: 113703

SEQ ID NO: 679328 - RNA, 64 nt, Homo Sapiens; identical to SEQ ID NO: 113704

SEQ ID NO: 679329 - RNA, 64 nt, Homo Sapiens; identical to SEQ ID NO: 113705

SEQ ID NO: 679330 - RNA, 64 nt, Homo Sapiens; identical to SEQ ID NO: 113706

SEQ ID NO: 679331 - RNA, 64 nt, Homo Sapiens; identical to SEQ ID NO: 113707

SEQ ID NO: 679332 - RNA, 64 nt, Homo Sapiens; identical to SEQ ID NO: 113708

SEQ ID NO: 679333 - RNA, 64 nt, Homo Sapiens; identical to SEQ ID NO: 113709

SEQ ID NO: 679334 - RNA, 64 nt, Homo Sapiens; identical to SEQ ID NO: 113710

SEQ ID NO: 679335 - RNA, 64 nt, Homo Sapiens; identical to SEQ ID NO: 113711

SEQ ID NO: 679336 - RNA, 64 nt, Homo Sapiens; identical to SEQ ID NO: 113712

SEQ ID NO: 679337 - RNA, 64 nt, Homo Sapiens; identical to SEQ ID NO: 113713

SEQ ID NO: 679338 - RNA, 64 nt, Homo Sapiens; identical to SEQ ID NO: 113714

SEQ ID NO: 679339 - RNA, 64 nt, Homo Sapiens; identical to SEQ ID NO: 113715

SEQ ID NO: 679340 - RNA, 64 nt, Homo Sapiens; identical to SEQ ID NO: 113716

SEQ ID NO: 679341 - RNA, 64 nt, Homo Sapiens; identical to SEQ ID NO: 113717

SEQ ID NO: 679342 - RNA, 64 nt, Homo Sapiens; identical to SEQ ID NO: 113718

SEQ ID NO: 679343 - RNA, 64 nt, Homo Sapiens; identical to SEQ ID NO: 113719

SEQ ID NO: 679344 - RNA, 64 nt, Homo Sapiens; identical to SEQ ID NO: 113720

SEQ ID NO: 679345 - RNA, 64 nt, Homo Sapiens; identical to SEQ ID NO: 113721

SEQ ID NO: 679346 - RNA, 64 nt, Homo Sapiens; identical to SEQ ID NO: 113722

SEQ ID NO: 679347 - RNA, 64 nt, Homo Sapiens; identical to SEQ ID NO: 113723

SEQ ID NO: 679348 - RNA, 64 nt, Homo Sapiens; identical to SEQ ID NO: 113724

SEQ ID NO: 679349 - RNA, 64 nt, Homo Sapiens; identical to SEQ ID NO: 113725

SEQ ID NO: 679350 - RNA, 64 nt, Homo Sapiens; identical to SEQ ID NO: 113726

SEQ ID NO: 679351 - RNA, 64 nt, Homo Sapiens; identical to SEQ ID NO: 113727

SEQ ID NO: 679352 - RNA, 64 nt, Homo Sapiens; identical to SEQ ID NO: 113728

SEQ ID NO: 679353 - RNA, 64 nt, Homo Sapiens; identical to SEQ ID NO: 113729

SEQ ID NO: 679354 - RNA, 64 nt, Homo Sapiens; identical to SEQ ID NO: 113730

SEQ ID NO: 679355 - RNA, 64 nt, Homo Sapiens; identical to SEQ ID NO: 113731

SEQ ID NO: 679356 - RNA, 64 nt, Homo Sapiens; identical to SEQ ID NO: 113732

SEQ ID NO: 679357 - RNA, 64 nt, Homo Sapiens; identical to SEQ ID NO: 113733

SEQ ID NO: 679358 - RNA, 64 nt, Homo Sapiens; identical to SEQ ID NO: 113734

SEQ ID NO: 679359 - RNA, 64 nt, Homo Sapiens; identical to SEQ ID NO: 113735

SEQ ID NO: 679360 - RNA, 64 nt, Homo Sapiens; identical to SEQ ID NO: 113736

SEQ ID NO: 679361 - RNA, 64 nt, Homo Sapiens; identical to SEQ ID NO: 113737

SEQ ID NO: 679362 - RNA, 64 nt, Homo Sapiens; identical to SEQ ID NO: 113738

SEQ ID NO: 679363 - RNA, 64 nt, Homo Sapiens; identical to SEQ ID NO: 113739

SEQ ID NO: 679364 - RNA, 64 nt, Homo Sapiens; identical to SEQ ID NO: 113740

SEQ ID NO: 679365 - RNA, 64 nt, Homo Sapiens; identical to SEQ ID NO: 113741

SEQ ID NO: 679366 - RNA, 64 nt, Homo Sapiens; identical to SEQ ID NO: 113742

SEQ ID NO: 679367 - RNA, 64 nt, Homo Sapiens; identical to SEQ ID NO: 113743

SEQ ID NO: 679368 - RNA, 64 nt, Homo Sapiens; identical to SEQ ID NO: 113744

SEQ ID NO: 679369 - RNA, 64 nt, Homo Sapiens; identical to SEQ ID NO: 113745

SEQ ID NO: 679370 - RNA, 64 nt, Homo Sapiens; identical to SEQ ID NO: 113746

SEQ ID NO: 679371 - RNA, 64 nt, Homo Sapiens; identical to SEQ ID NO: 113747

SEQ ID NO: 679372 - RNA, 64 nt, Homo Sapiens; identical to SEQ ID NO: 113748

SEQ ID NO: 679373 - RNA, 64 nt, Homo Sapiens; identical to SEQ ID NO: 113749

SEQ ID NO: 679374 - RNA, 64 nt, Homo Sapiens; identical to SEQ ID NO: 113750

SEQ ID NO: 679375 - RNA, 64 nt, Homo Sapiens; identical to SEQ ID NO: 113751

SEQ ID NO: 679376 - RNA, 64 nt, Homo Sapiens; identical to SEQ ID NO: 113752

SEQ ID NO: 679377 - RNA, 64 nt, Homo Sapiens; identical to SEQ ID NO: 113753

SEQ ID NO: 679378 - RNA, 64 nt, Homo Sapiens; identical to SEQ ID NO: 113754

SEQ ID NO: 679379 - RNA, 64 nt, Homo Sapiens; identical to SEQ ID NO: 113755

SEQ ID NO: 679380 - RNA, 64 nt, Homo Sapiens; identical to SEQ ID NO: 113756

SEQ ID NO: 679381 - RNA, 64 nt, Homo Sapiens; identical to SEQ ID NO: 113757

SEQ ID NO: 679382 - RNA, 64 nt, Homo Sapiens; identical to SEQ ID NO: 113758

SEQ ID NO: 679383 - RNA, 64 nt, Homo Sapiens; identical to SEQ ID NO: 113759

SEQ ID NO: 679384 - RNA, 64 nt, Homo Sapiens; identical to SEQ ID NO: 113760

SEQ ID NO: 679385 - RNA, 64 nt, Homo Sapiens; identical to SEQ ID NO: 113761

SEQ ID NO: 679386 - RNA, 64 nt, Homo Sapiens; identical to SEQ ID NO: 113762

SEQ ID NO: 679387 - RNA, 64 nt, Homo Sapiens; identical to SEQ ID NO: 113763

SEQ ID NO: 679388 - RNA, 64 nt, Homo Sapiens; identical to SEQ ID NO: 113764

SEQ ID NO: 679389 - RNA, 61 nt, Homo Sapiens; identical to SEQ ID NO: 113765

SEQ ID NO: 679390 - RNA, 64 nt, Homo Sapiens; identical to SEQ ID NO: 113766

SEQ ID NO: 679391 - RNA, 64 nt, Homo Sapiens; identical to SEQ ID NO: 113767

SEQ ID NO: 679392 - RNA, 64 nt, Homo Sapiens; identical to SEQ ID NO: 113768

SEQ ID NO: 679393 - RNA, 64 nt, Homo Sapiens; identical to SEQ ID NO: 113769

SEQ ID NO: 679394 - RNA, 64 nt, Homo Sapiens; identical to SEQ ID NO: 113770

SEQ ID NO: 679395 - RNA, 64 nt, Homo Sapiens; identical to SEQ ID NO: 113771

SEQ ID NO: 679396 - RNA, 64 nt, Homo Sapiens; identical to SEQ ID NO: 113772

SEQ ID NO: 679397 - RNA, 64 nt, Homo Sapiens; identical to SEQ ID NO: 113773

SEQ ID NO: 679398 - RNA, 64 nt, Homo Sapiens; identical to SEQ ID NO: 113774

SEQ ID NO: 679399 - RNA, 64 nt, Homo Sapiens; identical to SEQ ID NO: 113775

SEQ ID NO: 679400 - RNA, 64 nt, Homo Sapiens; identical to SEQ ID NO: 113776

SEQ ID NO: 679401 - RNA, 64 nt, Homo Sapiens; identical to SEQ ID NO: 113777

SEQ ID NO: 679402 - RNA, 64 nt, Homo Sapiens; identical to SEQ ID NO: 113778

SEQ ID NO: 679403 - RNA, 64 nt, Homo Sapiens; identical to SEQ ID NO: 113779

SEQ ID NO: 679404 - RNA, 64 nt, Homo Sapiens; identical to SEQ ID NO: 113780

SEQ ID NO: 679405 - RNA, 64 nt, Homo Sapiens; identical to SEQ ID NO: 113781

SEQ ID NO: 679406 - RNA, 64 nt, Homo Sapiens; identical to SEQ ID NO: 113782

SEQ ID NO: 679407 - RNA, 64 nt, Homo Sapiens; identical to SEQ ID NO: 113783

SEQ ID NO: 679408 - RNA, 64 nt, Homo Sapiens; identical to SEQ ID NO: 113784

SEQ ID NO: 679409 - RNA, 64 nt, Homo Sapiens; identical to SEQ ID NO: 113785

SEQ ID NO: 679410 - RNA, 64 nt, Homo Sapiens; identical to SEQ ID NO: 113786

SEQ ID NO: 679411 - RNA, 64 nt, Homo Sapiens; identical to SEQ ID NO: 113787

SEQ ID NO: 679412 - RNA, 64 nt, Homo Sapiens; identical to SEQ ID NO: 113788

SEQ ID NO: 679413 - RNA, 64 nt, Homo Sapiens; identical to SEQ ID NO: 113789

SEQ ID NO: 679414 - RNA, 64 nt, Homo Sapiens; identical to SEQ ID NO: 113790

SEQ ID NO: 679415 - RNA, 64 nt, Homo Sapiens; identical to SEQ ID NO: 113791

SEQ ID NO: 679416 - RNA, 64 nt, Homo Sapiens; identical to SEQ ID NO: 113792

SEQ ID NO: 679417 - RNA, 64 nt, Homo Sapiens; identical to SEQ ID NO: 113793

SEQ ID NO: 679418 - RNA, 64 nt, Homo Sapiens; identical to SEQ ID NO: 113794

SEQ ID NO: 679419 - RNA, 64 nt, Homo Sapiens; identical to SEQ ID NO: 113795

SEQ ID NO: 679420 - RNA, 64 nt, Homo Sapiens; identical to SEQ ID NO: 113796

SEQ ID NO: 679421 - RNA, 64 nt, Homo Sapiens; identical to SEQ ID NO: 113797

SEQ ID NO: 679422 - RNA, 64 nt, Homo Sapiens; identical to SEQ ID NO: 113798

SEQ ID NO: 679423 - RNA, 64 nt, Homo Sapiens; identical to SEQ ID NO: 113799

SEQ ID NO: 679424 - RNA, 64 nt, Homo Sapiens; identical to SEQ ID NO: 113800

SEQ ID NO: 679425 - RNA, 64 nt, Homo Sapiens; identical to SEQ ID NO: 113801

SEQ ID NO: 679426 - RNA, 64 nt, Homo Sapiens; identical to SEQ ID NO: 113802

SEQ ID NO: 679427 - RNA, 64 nt, Homo Sapiens; identical to SEQ ID NO: 113803

SEQ ID NO: 679428 - RNA, 64 nt, Homo Sapiens; identical to SEQ ID NO: 113804

SEQ ID NO: 679429 - RNA, 64 nt, Homo Sapiens; identical to SEQ ID NO: 113805

SEQ ID NO: 679430 - RNA, 64 nt, Homo Sapiens; identical to SEQ ID NO: 113806

SEQ ID NO: 679431 - RNA, 64 nt, Homo Sapiens; identical to SEQ ID NO: 113807

SEQ ID NO: 679432 - RNA, 64 nt, Homo Sapiens; identical to SEQ ID NO: 113808

SEQ ID NO: 679433 - RNA, 64 nt, Homo Sapiens; identical to SEQ ID NO: 113809

SEQ ID NO: 679434 - RNA, 64 nt, Homo Sapiens; identical to SEQ ID NO: 113810

SEQ ID NO: 679435 - RNA, 64 nt, Homo Sapiens; identical to SEQ ID NO: 113811

SEQ ID NO: 679436 - RNA, 63 nt, Homo Sapiens
ugcuuuuucacacugaaaccagugugaaugcuaggucagaagcgcaggagaacgccaccgccu

SEQ ID NO: 679437 - RNA, 52 nt, Homo Sapiens
ucuaccacguuucuggauacugggucagaauuuuuaacagauaaaagaauga

SEQ ID NO: 679438 - RNA, 63 nt, Homo Sapiens
ccaggccagcugggcucuaaggcagucucaaugggucagaaacgugacggagcaucguggcac

SEQ ID NO: 679439 - RNA, 63 nt, Homo Sapiens
aggaccggguggaagggaugucuuuuucuccagggucagaaacaccuggacacaggccugcuc

SEQ ID NO: 679440 - RNA, 63 nt, Homo Sapiens
gcaucguuuggagauacaaagcgagcaguucuuggucagaacccuccucugcuuuucauugug

SEQ ID NO: 679441 - RNA, 63 nt, Homo Sapiens
gcauuuugggaggcugagguggccagaucccaaggucagaagaucgagaccauccuggcuaac

SEQ ID NO: 679442 - RNA, 63 nt, Homo Sapiens
ucaagagcacccuggcuaacguggaucaccuaaggucagaaguacuuugguagacugauguga

SEQ ID NO: 679443 - RNA, 63 nt, Homo Sapiens
uugaaaccagcauggccaacauaggucacuugaggucagaaguacgguuggaggccaaggcac

SEQ ID NO: 679444 - RNA, 64 nt, Homo Sapiens; identical to SEQ ID NO: 383478

SEQ ID NO: 679445 - RNA, 64 nt, Homo Sapiens; identical to SEQ ID NO: 383479

SEQ ID NO: 679446 - RNA, 64 nt, Homo Sapiens; identical to SEQ ID NO: 383480

SEQ ID NO: 679447 - RNA, 64 nt, Homo Sapiens; identical to SEQ ID NO: 383481

SEQ ID NO: 679448 - RNA, 64 nt, Homo Sapiens; identical to SEQ ID NO: 383482

SEQ ID NO: 679449 - RNA, 64 nt, Homo Sapiens; identical to SEQ ID NO: 383483

SEQ ID NO: 679450 - RNA, 64 nt, Homo Sapiens; identical to SEQ ID NO: 383484

SEQ ID NO: 679451 - RNA, 64 nt, Homo Sapiens; identical to SEQ ID NO: 383485

SEQ ID NO: 679452 - RNA, 64 nt, Homo Sapiens; identical to SEQ ID NO: 383486

SEQ ID NO: 679453 - RNA, 64 nt, Homo Sapiens; identical to SEQ ID NO: 383487

SEQ ID NO: 679454 - RNA, 64 nt, Homo Sapiens; identical to SEQ ID NO: 383488

SEQ ID NO: 679455 - RNA, 64 nt, Homo Sapiens; identical to SEQ ID NO: 383489

SEQ ID NO: 679456 - RNA, 64 nt, Homo Sapiens; identical to SEQ ID NO: 383490

SEQ ID NO: 679457 - RNA, 64 nt, Homo Sapiens; identical to SEQ ID NO: 383491

SEQ ID NO: 679458 - RNA, 64 nt, Homo Sapiens; identical to SEQ ID NO: 383492

SEQ ID NO: 679459 - RNA, 64 nt, Homo Sapiens; identical to SEQ ID NO: 383493

SEQ ID NO: 679460 - RNA, 64 nt, Homo Sapiens; identical to SEQ ID NO: 383494

SEQ ID NO: 679461 - RNA, 64 nt, Homo Sapiens; identical to SEQ ID NO: 383495

SEQ ID NO: 679462 - RNA, 64 nt, Homo Sapiens; identical to SEQ ID NO: 383496

SEQ ID NO: 679463 - RNA, 64 nt, Homo Sapiens; identical to SEQ ID NO: 383497

SEQ ID NO: 679464 - RNA, 64 nt, Homo Sapiens; identical to SEQ ID NO: 383498

SEQ ID NO: 679465 - RNA, 64 nt, Homo Sapiens; identical to SEQ ID NO: 383499

SEQ ID NO: 679466 - RNA, 64 nt, Homo Sapiens; identical to SEQ ID NO: 383500

SEQ ID NO: 679467 - RNA, 64 nt, Homo Sapiens; identical to SEQ ID NO: 383501

SEQ ID NO: 679468 - RNA, 64 nt, Homo Sapiens; identical to SEQ ID NO: 383502

SEQ ID NO: 679469 - RNA, 64 nt, Homo Sapiens; identical to SEQ ID NO: 383503

SEQ ID NO: 679470 - RNA, 64 nt, Homo Sapiens; identical to SEQ ID NO: 383504

SEQ ID NO: 679471 - RNA, 64 nt, Homo Sapiens; identical to SEQ ID NO: 383505

SEQ ID NO: 679472 - RNA, 64 nt, Homo Sapiens; identical to SEQ ID NO: 383506

SEQ ID NO: 679473 - RNA, 64 nt, Homo Sapiens; identical to SEQ ID NO: 383507

SEQ ID NO: 679474 - RNA, 64 nt, Homo Sapiens; identical to SEQ ID NO: 383508

SEQ ID NO: 679475 - RNA, 64 nt, Homo Sapiens; identical to SEQ ID NO: 383509

SEQ ID NO: 679476 - RNA, 64 nt, Homo Sapiens; identical to SEQ ID NO: 383510

SEQ ID NO: 679477 - RNA, 64 nt, Homo Sapiens; identical to SEQ ID NO: 383511

SEQ ID NO: 679478 - RNA, 64 nt, Homo Sapiens; identical to SEQ ID NO: 383512

SEQ ID NO: 679479 - RNA, 64 nt, Homo Sapiens; identical to SEQ ID NO: 383513

SEQ ID NO: 679480 - RNA, 64 nt, Homo Sapiens; identical to SEQ ID NO: 383514

SEQ ID NO: 679481 - RNA, 64 nt, Homo Sapiens; identical to SEQ ID NO: 383515

SEQ ID NO: 679482 - RNA, 64 nt, Homo Sapiens; identical to SEQ ID NO: 383516

SEQ ID NO: 679483 - RNA, 64 nt, Homo Sapiens; identical to SEQ ID NO: 383517

SEQ ID NO: 679484 - RNA, 64 nt, Homo Sapiens; identical to SEQ ID NO: 383518

SEQ ID NO: 679485 - RNA, 64 nt, Homo Sapiens; identical to SEQ ID NO: 383519

SEQ ID NO: 679486 - RNA, 64 nt, Homo Sapiens; identical to SEQ ID NO: 383520

SEQ ID NO: 679487 - RNA, 64 nt, Homo Sapiens; identical to SEQ ID NO: 383521

SEQ ID NO: 679488 - RNA, 64 nt, Homo Sapiens; identical to SEQ ID NO: 383522

SEQ ID NO: 679489 - RNA, 64 nt, Homo Sapiens; identical to SEQ ID NO: 383523

SEQ ID NO: 679490 - RNA, 64 nt, Homo Sapiens; identical to SEQ ID NO: 383524

SEQ ID NO: 679491 - RNA, 64 nt, Homo Sapiens; identical to SEQ ID NO: 383525

SEQ ID NO: 679492 - RNA, 64 nt, Homo Sapiens; identical to SEQ ID NO: 383526

SEQ ID NO: 679493 - RNA, 64 nt, Homo Sapiens; identical to SEQ ID NO: 383527

SEQ ID NO: 679494 - RNA, 64 nt, Homo Sapiens; identical to SEQ ID NO: 383528

SEQ ID NO: 679495 - RNA, 64 nt, Homo Sapiens; identical to SEQ ID NO: 383529

SEQ ID NO: 679496 - RNA, 64 nt, Homo Sapiens; identical to SEQ ID NO: 383530

SEQ ID NO: 679497 - RNA, 64 nt, Homo Sapiens; identical to SEQ ID NO: 383531

SEQ ID NO: 679498 - RNA, 64 nt, Homo Sapiens; identical to SEQ ID NO: 383532

SEQ ID NO: 679499 - RNA, 64 nt, Homo Sapiens; identical to SEQ ID NO: 383533

SEQ ID NO: 679500 - RNA, 64 nt, Homo Sapiens; identical to SEQ ID NO: 383534

SEQ ID NO: 679501 - RNA, 64 nt, Homo Sapiens; identical to SEQ ID NO: 383535

SEQ ID NO: 679502 - RNA, 64 nt, Homo Sapiens; identical to SEQ ID NO: 383536

SEQ ID NO: 679503 - RNA, 64 nt, Homo Sapiens; identical to SEQ ID NO: 383537

SEQ ID NO: 679504 - RNA, 64 nt, Homo Sapiens; identical to SEQ ID NO: 383538

SEQ ID NO: 679505 - RNA, 64 nt, Homo Sapiens; identical to SEQ ID NO: 383539

SEQ ID NO: 679506 - RNA, 64 nt, Homo Sapiens; identical to SEQ ID NO: 383540

SEQ ID NO: 679507 - RNA, 64 nt, Homo Sapiens; identical to SEQ ID NO: 383541

SEQ ID NO: 679508 - RNA, 64 nt, Homo Sapiens; identical to SEQ ID NO: 383542

SEQ ID NO: 679509 - RNA, 64 nt, Homo Sapiens; identical to SEQ ID NO: 383543

SEQ ID NO: 679510 - RNA, 64 nt, Homo Sapiens; identical to SEQ ID NO: 383544

SEQ ID NO: 679511 - RNA, 64 nt, Homo Sapiens; identical to SEQ ID NO: 383545

SEQ ID NO: 679512 - RNA, 64 nt, Homo Sapiens; identical to SEQ ID NO: 383546

SEQ ID NO: 679513 - RNA, 64 nt, Homo Sapiens; identical to SEQ ID NO: 383547

SEQ ID NO: 679514 - RNA, 64 nt, Homo Sapiens; identical to SEQ ID NO: 383548

SEQ ID NO: 679515 - RNA, 64 nt, Homo Sapiens; identical to SEQ ID NO: 383549

SEQ ID NO: 679516 - RNA, 64 nt, Homo Sapiens; identical to SEQ ID NO: 383550

SEQ ID NO: 679517 - RNA, 64 nt, Homo Sapiens; identical to SEQ ID NO: 383551

SEQ ID NO: 679518 - RNA, 64 nt, Homo Sapiens; identical to SEQ ID NO: 383552

SEQ ID NO: 679519 - RNA, 64 nt, Homo Sapiens; identical to SEQ ID NO: 383553

SEQ ID NO: 679520 - RNA, 64 nt, Homo Sapiens; identical to SEQ ID NO: 383554

SEQ ID NO: 679521 - RNA, 64 nt, Homo Sapiens; identical to SEQ ID NO: 383555

SEQ ID NO: 679522 - RNA, 64 nt, Homo Sapiens; identical to SEQ ID NO: 383556

SEQ ID NO: 679523 - RNA, 64 nt, Homo Sapiens; identical to SEQ ID NO: 383557

SEQ ID NO: 679524 - RNA, 64 nt, Homo Sapiens; identical to SEQ ID NO: 383558

SEQ ID NO: 679525 - RNA, 64 nt, Homo Sapiens; identical to SEQ ID NO: 383559

SEQ ID NO: 679526 - RNA, 64 nt, Homo Sapiens; identical to SEQ ID NO: 383560

SEQ ID NO: 679527 - RNA, 64 nt, Homo Sapiens; identical to SEQ ID NO: 383561

SEQ ID NO: 679528 - RNA, 64 nt, Homo Sapiens; identical to SEQ ID NO: 383562

SEQ ID NO: 679529 - RNA, 64 nt, Homo Sapiens; identical to SEQ ID NO: 383563

SEQ ID NO: 679530 - RNA, 64 nt, Homo Sapiens; identical to SEQ ID NO: 383564

SEQ ID NO: 679531 - RNA, 64 nt, Homo Sapiens; identical to SEQ ID NO: 383565

SEQ ID NO: 679532 - RNA, 64 nt, Homo Sapiens; identical to SEQ ID NO: 383566

SEQ ID NO: 679533 - RNA, 64 nt, Homo Sapiens; identical to SEQ ID NO: 383567

SEQ ID NO: 679534 - RNA, 64 nt, Homo Sapiens; identical to SEQ ID NO: 383568

SEQ ID NO: 679535 - RNA, 64 nt, Homo Sapiens; identical to SEQ ID NO: 383569

SEQ ID NO: 679536 - RNA, 64 nt, Homo Sapiens; identical to SEQ ID NO: 383570

SEQ ID NO: 679537 - RNA, 64 nt, Homo Sapiens; identical to SEQ ID NO: 383571

SEQ ID NO: 679538 - RNA, 64 nt, Homo Sapiens; identical to SEQ ID NO: 383572

SEQ ID NO: 679539 - RNA, 64 nt, Homo Sapiens; identical to SEQ ID NO: 383573

SEQ ID NO: 679540 - RNA, 64 nt, Homo Sapiens; identical to SEQ ID NO: 383574

SEQ ID NO: 679541 - RNA, 64 nt, Homo Sapiens; identical to SEQ ID NO: 383575

SEQ ID NO: 679542 - RNA, 64 nt, Homo Sapiens; identical to SEQ ID NO: 383576

SEQ ID NO: 679543 - RNA, 64 nt, Homo Sapiens; identical to SEQ ID NO: 383577

SEQ ID NO: 679544 - RNA, 64 nt, Homo Sapiens; identical to SEQ ID NO: 383578

SEQ ID NO: 679545 - RNA, 64 nt, Homo Sapiens; identical to SEQ ID NO: 383579

SEQ ID NO: 679546 - RNA, 64 nt, Homo Sapiens; identical to SEQ ID NO: 383580

SEQ ID NO: 679547 - RNA, 64 nt, Homo Sapiens; identical to SEQ ID NO: 383581

SEQ ID NO: 679548 - RNA, 64 nt, Homo Sapiens; identical to SEQ ID NO: 383582

SEQ ID NO: 679549 - RNA, 64 nt, Homo Sapiens; identical to SEQ ID NO: 383583

SEQ ID NO: 679550 - RNA, 64 nt, Homo Sapiens; identical to SEQ ID NO: 383584

SEQ ID NO: 679551 - RNA, 64 nt, Homo Sapiens; identical to SEQ ID NO: 383585

SEQ ID NO: 679552 - RNA, 64 nt, Homo Sapiens; identical to SEQ ID NO: 383586

SEQ ID NO: 679553 - RNA, 64 nt, Homo Sapiens; identical to SEQ ID NO: 383587

SEQ ID NO: 679554 - RNA, 64 nt, Homo Sapiens; identical to SEQ ID NO: 383588

SEQ ID NO: 679555 - RNA, 64 nt, Homo Sapiens; identical to SEQ ID NO: 383589

SEQ ID NO: 679556 - RNA, 64 nt, Homo Sapiens; identical to SEQ ID NO: 383590

SEQ ID NO: 679557 - RNA, 64 nt, Homo Sapiens; identical to SEQ ID NO: 383591

SEQ ID NO: 679558 - RNA, 64 nt, Homo Sapiens; identical to SEQ ID NO: 383592

SEQ ID NO: 679559 - RNA, 64 nt, Homo Sapiens; identical to SEQ ID NO: 383593

SEQ ID NO: 679560 - RNA, 64 nt, Homo Sapiens; identical to SEQ ID NO: 383594

SEQ ID NO: 679561 - RNA, 64 nt, Homo Sapiens; identical to SEQ ID NO: 383595

SEQ ID NO: 679562 - RNA, 64 nt, Homo Sapiens; identical to SEQ ID NO: 383596

SEQ ID NO: 679563 - RNA, 64 nt, Homo Sapiens; identical to SEQ ID NO: 383597

SEQ ID NO: 679564 - RNA, 64 nt, Homo Sapiens; identical to SEQ ID NO: 383598

SEQ ID NO: 679565 - RNA, 64 nt, Homo Sapiens; identical to SEQ ID NO: 383599

SEQ ID NO: 679566 - RNA, 64 nt, Homo Sapiens; identical to SEQ ID NO: 383600

SEQ ID NO: 679567 - RNA, 64 nt, Homo Sapiens; identical to SEQ ID NO: 383601

SEQ ID NO: 679568 - RNA, 64 nt, Homo Sapiens; identical to SEQ ID NO: 383602

SEQ ID NO: 679569 - RNA, 64 nt, Homo Sapiens; identical to SEQ ID NO: 383603

SEQ ID NO: 679570 - RNA, 64 nt, Homo Sapiens; identical to SEQ ID NO: 383604

SEQ ID NO: 679571 - RNA, 64 nt, Homo Sapiens; identical to SEQ ID NO: 383605

SEQ ID NO: 679572 - RNA, 59 nt, Homo Sapiens; identical to SEQ ID NO: 383606

SEQ ID NO: 679573 - RNA, 64 nt, Homo Sapiens; identical to SEQ ID NO: 383607

SEQ ID NO: 679574 - RNA, 64 nt, Homo Sapiens; identical to SEQ ID NO: 383608

SEQ ID NO: 679575 - RNA, 64 nt, Homo Sapiens; identical to SEQ ID NO: 383609

SEQ ID NO: 679576 - RNA, 64 nt, Homo Sapiens; identical to SEQ ID NO: 383610

SEQ ID NO: 679577 - RNA, 64 nt, Homo Sapiens; identical to SEQ ID NO: 383611

SEQ ID NO: 679578 - RNA, 64 nt, Homo Sapiens; identical to SEQ ID NO: 383612

SEQ ID NO: 679579 - RNA, 64 nt, Homo Sapiens; identical to SEQ ID NO: 383613

SEQ ID NO: 679580 - RNA, 64 nt, Homo Sapiens; identical to SEQ ID NO: 383614

SEQ ID NO: 679581 - RNA, 64 nt, Homo Sapiens; identical to SEQ ID NO: 383615

SEQ ID NO: 679582 - RNA, 58 nt, Homo Sapiens; identical to SEQ ID NO: 383616

SEQ ID NO: 679583 - RNA, 64 nt, Homo Sapiens; identical to SEQ ID NO: 383617

SEQ ID NO: 679584 - RNA, 64 nt, Homo Sapiens; identical to SEQ ID NO: 383618

SEQ ID NO: 679585 - RNA, 64 nt, Homo Sapiens; identical to SEQ ID NO: 383619

SEQ ID NO: 679586 - RNA, 64 nt, Homo Sapiens; identical to SEQ ID NO: 383620

SEQ ID NO: 679587 - RNA, 64 nt, Homo Sapiens; identical to SEQ ID NO: 383621

SEQ ID NO: 679588 - RNA, 64 nt, Homo Sapiens; identical to SEQ ID NO: 383622

SEQ ID NO: 679589 - RNA, 64 nt, Homo Sapiens; identical to SEQ ID NO: 383623

SEQ ID NO: 679590 - RNA, 64 nt, Homo Sapiens; identical to SEQ ID NO: 383624

SEQ ID NO: 679591 - RNA, 64 nt, Homo Sapiens; identical to SEQ ID NO: 383625

SEQ ID NO: 679592 - RNA, 64 nt, Homo Sapiens; identical to SEQ ID NO: 383626

SEQ ID NO: 679593 - RNA, 64 nt, Homo Sapiens; identical to SEQ ID NO: 383627

SEQ ID NO: 679594 - RNA, 64 nt, Homo Sapiens; identical to SEQ ID NO: 383628

SEQ ID NO: 679595 - RNA, 64 nt, Homo Sapiens; identical to SEQ ID NO: 383629

SEQ ID NO: 679596 - RNA, 64 nt, Homo Sapiens; identical to SEQ ID NO: 383630

SEQ ID NO: 679597 - RNA, 64 nt, Homo Sapiens; identical to SEQ ID NO: 383631

SEQ ID NO: 679598 - RNA, 64 nt, Homo Sapiens; identical to SEQ ID NO: 383632

SEQ ID NO: 679599 - RNA, 64 nt, Homo Sapiens; identical to SEQ ID NO: 383633

SEQ ID NO: 679600 - RNA, 64 nt, Homo Sapiens; identical to SEQ ID NO: 383634

SEQ ID NO: 679601 - RNA, 64 nt, Homo Sapiens; identical to SEQ ID NO: 383635

SEQ ID NO: 679602 - RNA, 64 nt, Homo Sapiens; identical to SEQ ID NO: 383636

SEQ ID NO: 679603 - RNA, 64 nt, Homo Sapiens; identical to SEQ ID NO: 383637

SEQ ID NO: 679604 - RNA, 64 nt, Homo Sapiens; identical to SEQ ID NO: 383638

SEQ ID NO: 679605 - RNA, 64 nt, Homo Sapiens; identical to SEQ ID NO: 383639

SEQ ID NO: 679606 - RNA, 64 nt, Homo Sapiens; identical to SEQ ID NO: 383640

SEQ ID NO: 679607 - RNA, 64 nt, Homo Sapiens; identical to SEQ ID NO: 383641

SEQ ID NO: 679608 - RNA, 64 nt, Homo Sapiens; identical to SEQ ID NO: 383642

SEQ ID NO: 679609 - RNA, 64 nt, Homo Sapiens; identical to SEQ ID NO: 383643

SEQ ID NO: 679610 - RNA, 64 nt, Homo Sapiens; identical to SEQ ID NO: 383644

SEQ ID NO: 679611 - RNA, 64 nt, Homo Sapiens; identical to SEQ ID NO: 383645

SEQ ID NO: 679612 - RNA, 64 nt, Homo Sapiens; identical to SEQ ID NO: 383646

SEQ ID NO: 679613 - RNA, 64 nt, Homo Sapiens; identical to SEQ ID NO: 383647

SEQ ID NO: 679614 - RNA, 64 nt, Homo Sapiens; identical to SEQ ID NO: 293538

SEQ ID NO: 679615 - RNA, 64 nt, Homo Sapiens; identical to SEQ ID NO: 293539

SEQ ID NO: 679616 - RNA, 64 nt, Homo Sapiens; identical to SEQ ID NO: 293540

SEQ ID NO: 679617 - RNA, 64 nt, Homo Sapiens; identical to SEQ ID NO: 293541

SEQ ID NO: 679618 - RNA, 64 nt, Homo Sapiens; identical to SEQ ID NO: 293542

SEQ ID NO: 679619 - RNA, 64 nt, Homo Sapiens; identical to SEQ ID NO: 293543

SEQ ID NO: 679620 - RNA, 64 nt, Homo Sapiens; identical to SEQ ID NO: 293544

SEQ ID NO: 679621 - RNA, 64 nt, Homo Sapiens; identical to SEQ ID NO: 293545

SEQ ID NO: 679622 - RNA, 64 nt, Homo Sapiens; identical to SEQ ID NO: 293546

SEQ ID NO: 679623 - RNA, 64 nt, Homo Sapiens; identical to SEQ ID NO: 293547

SEQ ID NO: 679624 - RNA, 64 nt, Homo Sapiens; identical to SEQ ID NO: 293548

SEQ ID NO: 679625 - RNA, 64 nt, Homo Sapiens; identical to SEQ ID NO: 293549

SEQ ID NO: 679626 - RNA, 64 nt, Homo Sapiens; identical to SEQ ID NO: 293550

SEQ ID NO: 679627 - RNA, 64 nt, Homo Sapiens; identical to SEQ ID NO: 293551

SEQ ID NO: 679628 - RNA, 64 nt, Homo Sapiens; identical to SEQ ID NO: 293552

SEQ ID NO: 679629 - RNA, 64 nt, Homo Sapiens; identical to SEQ ID NO: 293553

SEQ ID NO: 679630 - RNA, 64 nt, Homo Sapiens; identical to SEQ ID NO: 293554

SEQ ID NO: 679631 - RNA, 64 nt, Homo Sapiens; identical to SEQ ID NO: 293555

SEQ ID NO: 679632 - RNA, 64 nt, Homo Sapiens; identical to SEQ ID NO: 293556

SEQ ID NO: 679633 - RNA, 64 nt, Homo Sapiens; identical to SEQ ID NO: 293557

SEQ ID NO: 679634 - RNA, 64 nt, Homo Sapiens; identical to SEQ ID NO: 293558

SEQ ID NO: 679635 - RNA, 64 nt, Homo Sapiens; identical to SEQ ID NO: 293559

SEQ ID NO: 679636 - RNA, 64 nt, Homo Sapiens; identical to SEQ ID NO: 293560

SEQ ID NO: 679637 - RNA, 64 nt, Homo Sapiens; identical to SEQ ID NO: 293561

SEQ ID NO: 679638 - RNA, 64 nt, Homo Sapiens; identical to SEQ ID NO: 293562

SEQ ID NO: 679639 - RNA, 64 nt, Homo Sapiens; identical to SEQ ID NO: 293563

SEQ ID NO: 679640 - RNA, 64 nt, Homo Sapiens; identical to SEQ ID NO: 293564

SEQ ID NO: 679641 - RNA, 64 nt, Homo Sapiens; identical to SEQ ID NO: 293565

SEQ ID NO: 679642 - RNA, 64 nt, Homo Sapiens; identical to SEQ ID NO: 293566

SEQ ID NO: 679643 - RNA, 64 nt, Homo Sapiens; identical to SEQ ID NO: 293567

SEQ ID NO: 679644 - RNA, 64 nt, Homo Sapiens; identical to SEQ ID NO: 293568

SEQ ID NO: 679645 - RNA, 64 nt, Homo Sapiens; identical to SEQ ID NO: 293569

SEQ ID NO: 679646 - RNA, 64 nt, Homo Sapiens; identical to SEQ ID NO: 293570

SEQ ID NO: 679647 - RNA, 64 nt, Homo Sapiens; identical to SEQ ID NO: 293571

SEQ ID NO: 679648 - RNA, 64 nt, Homo Sapiens; identical to SEQ ID NO: 221340

SEQ ID NO: 679649 - RNA, 64 nt, Homo Sapiens; identical to SEQ ID NO: 221341

SEQ ID NO: 679650 - RNA, 64 nt, Homo Sapiens; identical to SEQ ID NO: 221342

SEQ ID NO: 679651 - RNA, 64 nt, Homo Sapiens; identical to SEQ ID NO: 221343

SEQ ID NO: 679652 - RNA, 64 nt, Homo Sapiens; identical to SEQ ID NO: 221344

SEQ ID NO: 679653 - RNA, 64 nt, Homo Sapiens; identical to SEQ ID NO: 221345

SEQ ID NO: 679654 - RNA, 64 nt, Homo Sapiens; identical to SEQ ID NO: 221346

SEQ ID NO: 679655 - RNA, 64 nt, Homo Sapiens; identical to SEQ ID NO: 221347

SEQ ID NO: 679656 - RNA, 64 nt, Homo Sapiens; identical to SEQ ID NO: 221348

SEQ ID NO: 679657 - RNA, 64 nt, Homo Sapiens; identical to SEQ ID NO: 221349

SEQ ID NO: 679658 - RNA, 64 nt, Homo Sapiens; identical to SEQ ID NO: 221350

SEQ ID NO: 679659 - RNA, 64 nt, Homo Sapiens; identical to SEQ ID NO: 221351

SEQ ID NO: 679660 - RNA, 64 nt, Homo Sapiens; identical to SEQ ID NO: 221352

SEQ ID NO: 679661 - RNA, 64 nt, Homo Sapiens; identical to SEQ ID NO: 221353

SEQ ID NO: 679662 - RNA, 64 nt, Homo Sapiens; identical to SEQ ID NO: 221354

SEQ ID NO: 679663 - RNA, 64 nt, Homo Sapiens; identical to SEQ ID NO: 221355

SEQ ID NO: 679664 - RNA, 64 nt, Homo Sapiens; identical to SEQ ID NO: 221356

SEQ ID NO: 679665 - RNA, 64 nt, Homo Sapiens; identical to SEQ ID NO: 221357

SEQ ID NO: 679666 - RNA, 64 nt, Homo Sapiens; identical to SEQ ID NO: 221358

SEQ ID NO: 679667 - RNA, 64 nt, Homo Sapiens; identical to SEQ ID NO: 221359

SEQ ID NO: 679668 - RNA, 64 nt, Homo Sapiens; identical to SEQ ID NO: 221360

SEQ ID NO: 679669 - RNA, 64 nt, Homo Sapiens; identical to SEQ ID NO: 221361

SEQ ID NO: 679670 - RNA, 64 nt, Homo Sapiens; identical to SEQ ID NO: 221362

SEQ ID NO: 679671 - RNA, 64 nt, Homo Sapiens; identical to SEQ ID NO: 221363

SEQ ID NO: 679672 - RNA, 64 nt, Homo Sapiens; identical to SEQ ID NO: 221364

SEQ ID NO: 679673 - RNA, 64 nt, Homo Sapiens; identical to SEQ ID NO: 221365

SEQ ID NO: 679674 - RNA, 64 nt, Homo Sapiens; identical to SEQ ID NO: 221366

SEQ ID NO: 679675 - RNA, 64 nt, Homo Sapiens; identical to SEQ ID NO: 221367

SEQ ID NO: 679676 - RNA, 64 nt, Homo Sapiens; identical to SEQ ID NO: 221368

SEQ ID NO: 679677 - RNA, 64 nt, Homo Sapiens; identical to SEQ ID NO: 221369

SEQ ID NO: 679678 - RNA, 64 nt, Homo Sapiens; identical to SEQ ID NO: 221370

SEQ ID NO: 679679 - RNA, 64 nt, Homo Sapiens; identical to SEQ ID NO: 221371

SEQ ID NO: 679680 - RNA, 64 nt, Homo Sapiens; identical to SEQ ID NO: 221372

SEQ ID NO: 679681 - RNA, 64 nt, Homo Sapiens; identical to SEQ ID NO: 221373

SEQ ID NO: 679682 - RNA, 64 nt, Homo Sapiens; identical to SEQ ID NO: 221374

SEQ ID NO: 679683 - RNA, 64 nt, Homo Sapiens; identical to SEQ ID NO: 221375

SEQ ID NO: 679684 - RNA, 64 nt, Homo Sapiens; identical to SEQ ID NO: 221376

SEQ ID NO: 679685 - RNA, 64 nt, Homo Sapiens; identical to SEQ ID NO: 221377

SEQ ID NO: 679686 - RNA, 64 nt, Homo Sapiens; identical to SEQ ID NO: 221378

SEQ ID NO: 679687 - RNA, 64 nt, Homo Sapiens; identical to SEQ ID NO: 221379

SEQ ID NO: 679688 - RNA, 64 nt, Homo Sapiens; identical to SEQ ID NO: 221380

SEQ ID NO: 679689 - RNA, 64 nt, Homo Sapiens; identical to SEQ ID NO: 221381

SEQ ID NO: 679690 - RNA, 64 nt, Homo Sapiens; identical to SEQ ID NO: 221382

SEQ ID NO: 679691 - RNA, 64 nt, Homo Sapiens; identical to SEQ ID NO: 221383

SEQ ID NO: 679692 - RNA, 64 nt, Homo Sapiens; identical to SEQ ID NO: 221384

SEQ ID NO: 679693 - RNA, 64 nt, Homo Sapiens; identical to SEQ ID NO: 221385

SEQ ID NO: 679694 - RNA, 64 nt, Homo Sapiens; identical to SEQ ID NO: 221386

SEQ ID NO: 679695 - RNA, 64 nt, Homo Sapiens; identical to SEQ ID NO: 221387

SEQ ID NO: 679696 - RNA, 64 nt, Homo Sapiens; identical to SEQ ID NO: 245089

SEQ ID NO: 679697 - RNA, 64 nt, Homo Sapiens; identical to SEQ ID NO: 245090

SEQ ID NO: 679698 - RNA, 64 nt, Homo Sapiens; identical to SEQ ID NO: 245091

SEQ ID NO: 679699 - RNA, 56 nt, Homo Sapiens; identical to SEQ ID NO: 238493

SEQ ID NO: 679700 - RNA, 64 nt, Homo Sapiens; identical to SEQ ID NO: 245093

SEQ ID NO: 679701 - RNA, 64 nt, Homo Sapiens; identical to SEQ ID NO: 245094

SEQ ID NO: 679702 - RNA, 64 nt, Homo Sapiens; identical to SEQ ID NO: 245095

SEQ ID NO: 679703 - RNA, 64 nt, Homo Sapiens; identical to SEQ ID NO: 245096

SEQ ID NO: 679704 - RNA, 64 nt, Homo Sapiens; identical to SEQ ID NO: 245097

SEQ ID NO: 679705 - RNA, 64 nt, Homo Sapiens; identical to SEQ ID NO: 245098

SEQ ID NO: 679706 - RNA, 64 nt, Homo Sapiens; identical to SEQ ID NO: 245099

SEQ ID NO: 679707 - RNA, 64 nt, Homo Sapiens; identical to SEQ ID NO: 245100

SEQ ID NO: 679708 - RNA, 64 nt, Homo Sapiens; identical to SEQ ID NO: 245101

SEQ ID NO: 679709 - RNA, 64 nt, Homo Sapiens; identical to SEQ ID NO: 245102

SEQ ID NO: 679710 - RNA, 64 nt, Homo Sapiens; identical to SEQ ID NO: 533731

SEQ ID NO: 679711 - RNA, 64 nt, Homo Sapiens; identical to SEQ ID NO: 533732

SEQ ID NO: 679712 - RNA, 64 nt, Homo Sapiens; identical to SEQ ID NO: 533733

SEQ ID NO: 679713 - RNA, 64 nt, Homo Sapiens; identical to SEQ ID NO: 533734

SEQ ID NO: 679714 - RNA, 64 nt, Homo Sapiens; identical to SEQ ID NO: 533735

SEQ ID NO: 679715 - RNA, 64 nt, Homo Sapiens; identical to SEQ ID NO: 533736

SEQ ID NO: 679716 - RNA, 64 nt, Homo Sapiens; identical to SEQ ID NO: 533737

SEQ ID NO: 679717 - RNA, 64 nt, Homo Sapiens; identical to SEQ ID NO: 533738

SEQ ID NO: 679718 - RNA, 64 nt, Homo Sapiens
caggguuuuuuuuuuuuuguuuaagcugacucuuugcucuaauuuuggaaaaaaagaaauguga

SEQ ID NO: 679719 - RNA, 64 nt, Homo Sapiens
gcacguuguggggucgggggguggggcggggaagugcucuaacuuuucuuaagguuuuguugcu

SEQ ID NO: 679720 - RNA, 64 nt, Homo Sapiens
auggguaauaguuguacuacuuuaguuguggcuuugcucuaagauuauuuuugucuauuucuau

SEQ ID NO: 679721 - RNA, 64 nt, Homo Sapiens
uuaaaagauggggaagcuuagacaacauagacugugcucuaaguuuagcuauuauuuuuuuaau

SEQ ID NO: 679722 - RNA, 64 nt, Homo Sapiens
auuuaugauaaaaaugcauuuuaaugccaguaucugcucuaaauuucugacuuagauacugauu

SEQ ID NO: 679723 - RNA, 64 nt, Homo Sapiens
aggacacagcaugcagcagcagcauuuguaacacugcucuaacuacuaaucauagauccugacc

SEQ ID NO: 679724 - RNA, 64 nt, Homo Sapiens
ggucucuuuauauacucaggcaccacaggccgcaugcucuaaucauuauaaaguauuaagacaa

SEQ ID NO: 679725 - RNA, 64 nt, Homo Sapiens
cuuauuguuugaauuuauacgauuaaucagaaugugcucuaaagagggaguaccucuaaagaca

SEQ ID NO: 679726 - RNA, 64 nt, Homo Sapiens; identical to SEQ ID NO: 276789

SEQ ID NO: 679727 - RNA, 64 nt, Homo Sapiens; identical to SEQ ID NO: 276790

SEQ ID NO: 679728 - RNA, 64 nt, Homo Sapiens; identical to SEQ ID NO: 276791

SEQ ID NO: 679729 - RNA, 64 nt, Homo Sapiens; identical to SEQ ID NO: 276792

SEQ ID NO: 679730 - RNA, 64 nt, Homo Sapiens; identical to SEQ ID NO: 276793

SEQ ID NO: 679731 - RNA, 64 nt, Homo Sapiens; identical to SEQ ID NO: 276794

SEQ ID NO: 679732 - RNA, 64 nt, Homo Sapiens; identical to SEQ ID NO: 276795

SEQ ID NO: 679733 - RNA, 64 nt, Homo Sapiens; identical to SEQ ID NO: 276796

SEQ ID NO: 679734 - RNA, 64 nt, Homo Sapiens; identical to SEQ ID NO: 276797

SEQ ID NO: 679735 - RNA, 64 nt, Homo Sapiens; identical to SEQ ID NO: 276798

SEQ ID NO: 679736 - RNA, 64 nt, Homo Sapiens; identical to SEQ ID NO: 276799

SEQ ID NO: 679737 - RNA, 64 nt, Homo Sapiens; identical to SEQ ID NO: 276800

SEQ ID NO: 679738 - RNA, 64 nt, Homo Sapiens; identical to SEQ ID NO: 276801

SEQ ID NO: 679739 - RNA, 64 nt, Homo Sapiens; identical to SEQ ID NO: 276802

SEQ ID NO: 679740 - RNA, 64 nt, Homo Sapiens; identical to SEQ ID NO: 276803

SEQ ID NO: 679741 - RNA, 64 nt, Homo Sapiens; identical to SEQ ID NO: 276804

SEQ ID NO: 679742 - RNA, 64 nt, Homo Sapiens; identical to SEQ ID NO: 276805

SEQ ID NO: 679743 - RNA, 64 nt, Homo Sapiens; identical to SEQ ID NO: 276806

SEQ ID NO: 679744 - RNA, 64 nt, Homo Sapiens; identical to SEQ ID NO: 276807

SEQ ID NO: 679745 - RNA, 64 nt, Homo Sapiens; identical to SEQ ID NO: 276808

SEQ ID NO: 679746 - RNA, 64 nt, Homo Sapiens; identical to SEQ ID NO: 276809

SEQ ID NO: 679747 - RNA, 64 nt, Homo Sapiens; identical to SEQ ID NO: 276810

SEQ ID NO: 679748 - RNA, 64 nt, Homo Sapiens; identical to SEQ ID NO: 276811

SEQ ID NO: 679749 - RNA, 64 nt, Homo Sapiens; identical to SEQ ID NO: 276812

SEQ ID NO: 679750 - RNA, 64 nt, Homo Sapiens; identical to SEQ ID NO: 276813

SEQ ID NO: 679751 - RNA, 64 nt, Homo Sapiens; identical to SEQ ID NO: 276814

SEQ ID NO: 679752 - RNA, 64 nt, Homo Sapiens; identical to SEQ ID NO: 276815

SEQ ID NO: 679753 - RNA, 64 nt, Homo Sapiens; identical to SEQ ID NO: 276816

SEQ ID NO: 679754 - RNA, 64 nt, Homo Sapiens; identical to SEQ ID NO: 276817

SEQ ID NO: 679755 - RNA, 64 nt, Homo Sapiens; identical to SEQ ID NO: 276818

SEQ ID NO: 679756 - RNA, 64 nt, Homo Sapiens; identical to SEQ ID NO: 276819

SEQ ID NO: 679757 - RNA, 64 nt, Homo Sapiens; identical to SEQ ID NO: 276820

SEQ ID NO: 679758 - RNA, 64 nt, Homo Sapiens; identical to SEQ ID NO: 276821

SEQ ID NO: 679759 - RNA, 64 nt, Homo Sapiens; identical to SEQ ID NO: 276822

SEQ ID NO: 679760 - RNA, 64 nt, Homo Sapiens; identical to SEQ ID NO: 276823

SEQ ID NO: 679761 - RNA, 64 nt, Homo Sapiens; identical to SEQ ID NO: 276824

SEQ ID NO: 679762 - RNA, 64 nt, Homo Sapiens; identical to SEQ ID NO: 276825

SEQ ID NO: 679763 - RNA, 64 nt, Homo Sapiens; identical to SEQ ID NO: 276826

SEQ ID NO: 679764 - RNA, 64 nt, Homo Sapiens; identical to SEQ ID NO: 276827

SEQ ID NO: 679765 - RNA, 64 nt, Homo Sapiens; identical to SEQ ID NO: 276828

SEQ ID NO: 679766 - RNA, 64 nt, Homo Sapiens; identical to SEQ ID NO: 276829

SEQ ID NO: 679767 - RNA, 64 nt, Homo Sapiens; identical to SEQ ID NO: 276830

SEQ ID NO: 679768 - RNA, 64 nt, Homo Sapiens; identical to SEQ ID NO: 276831

SEQ ID NO: 679769 - RNA, 64 nt, Homo Sapiens; identical to SEQ ID NO: 276832

SEQ ID NO: 679770 - RNA, 64 nt, Homo Sapiens; identical to SEQ ID NO: 276833

SEQ ID NO: 679771 - RNA, 64 nt, Homo Sapiens; identical to SEQ ID NO: 276834

SEQ ID NO: 679772 - RNA, 64 nt, Homo Sapiens; identical to SEQ ID NO: 276835

SEQ ID NO: 679773 - RNA, 64 nt, Homo Sapiens; identical to SEQ ID NO: 276836

SEQ ID NO: 679774 - RNA, 64 nt, Homo Sapiens; identical to SEQ ID NO: 276837

SEQ ID NO: 679775 - RNA, 64 nt, Homo Sapiens; identical to SEQ ID NO: 276838

SEQ ID NO: 679776 - RNA, 64 nt, Homo Sapiens; identical to SEQ ID NO: 276839

SEQ ID NO: 679777 - RNA, 64 nt, Homo Sapiens; identical to SEQ ID NO: 276840

SEQ ID NO: 679778 - RNA, 64 nt, Homo Sapiens; identical to SEQ ID NO: 276841

SEQ ID NO: 679779 - RNA, 64 nt, Homo Sapiens; identical to SEQ ID NO: 276842

SEQ ID NO: 679780 - RNA, 64 nt, Homo Sapiens; identical to SEQ ID NO: 276843

SEQ ID NO: 679781 - RNA, 64 nt, Homo Sapiens; identical to SEQ ID NO: 276844

SEQ ID NO: 679782 - RNA, 64 nt, Homo Sapiens; identical to SEQ ID NO: 276845

SEQ ID NO: 679783 - RNA, 64 nt, Homo Sapiens; identical to SEQ ID NO: 276846

SEQ ID NO: 679784 - RNA, 64 nt, Homo Sapiens; identical to SEQ ID NO: 276847

SEQ ID NO: 679785 - RNA, 64 nt, Homo Sapiens; identical to SEQ ID NO: 276848

SEQ ID NO: 679786 - RNA, 64 nt, Homo Sapiens; identical to SEQ ID NO: 276849

SEQ ID NO: 679787 - RNA, 64 nt, Homo Sapiens; identical to SEQ ID NO: 276850

SEQ ID NO: 679788 - RNA, 64 nt, Homo Sapiens; identical to SEQ ID NO: 276851

SEQ ID NO: 679789 - RNA, 64 nt, Homo Sapiens; identical to SEQ ID NO: 276852

SEQ ID NO: 679790 - RNA, 64 nt, Homo Sapiens; identical to SEQ ID NO: 276853

SEQ ID NO: 679791 - RNA, 64 nt, Homo Sapiens; identical to SEQ ID NO: 276854

SEQ ID NO: 679792 - RNA, 64 nt, Homo Sapiens; identical to SEQ ID NO: 276855

SEQ ID NO: 679793 - RNA, 64 nt, Homo Sapiens; identical to SEQ ID NO: 276856

SEQ ID NO: 679794 - RNA, 64 nt, Homo Sapiens; identical to SEQ ID NO: 276857

SEQ ID NO: 679795 - RNA, 64 nt, Homo Sapiens; identical to SEQ ID NO: 172184

SEQ ID NO: 679796 - RNA, 64 nt, Homo Sapiens; identical to SEQ ID NO: 172185

SEQ ID NO: 679797 - RNA, 64 nt, Homo Sapiens; identical to SEQ ID NO: 172186

SEQ ID NO: 679798 - RNA, 64 nt, Homo Sapiens; identical to SEQ ID NO: 172187

SEQ ID NO: 679799 - RNA, 64 nt, Homo Sapiens; identical to SEQ ID NO: 172188

SEQ ID NO: 679800 - RNA, 64 nt, Homo Sapiens; identical to SEQ ID NO: 172189

SEQ ID NO: 679801 - RNA, 64 nt, Homo Sapiens; identical to SEQ ID NO: 172190

SEQ ID NO: 679802 - RNA, 64 nt, Homo Sapiens; identical to SEQ ID NO: 172191

SEQ ID NO: 679803 - RNA, 64 nt, Homo Sapiens; identical to SEQ ID NO: 172192

SEQ ID NO: 679804 - RNA, 64 nt, Homo Sapiens; identical to SEQ ID NO: 172193

SEQ ID NO: 679805 - RNA, 64 nt, Homo Sapiens; identical to SEQ ID NO: 172194

SEQ ID NO: 679806 - RNA, 64 nt, Homo Sapiens; identical to SEQ ID NO: 172195

SEQ ID NO: 679807 - RNA, 64 nt, Homo Sapiens; identical to SEQ ID NO: 172196

SEQ ID NO: 679808 - RNA, 64 nt, Homo Sapiens; identical to SEQ ID NO: 172197

SEQ ID NO: 679809 - RNA, 64 nt, Homo Sapiens; identical to SEQ ID NO: 172198

SEQ ID NO: 679810 - RNA, 64 nt, Homo Sapiens; identical to SEQ ID NO: 172199

SEQ ID NO: 679811 - RNA, 64 nt, Homo Sapiens; identical to SEQ ID NO: 172200

SEQ ID NO: 679812 - RNA, 64 nt, Homo Sapiens; identical to SEQ ID NO: 172201

SEQ ID NO: 679813 - RNA, 64 nt, Homo Sapiens; identical to SEQ ID NO: 172202

SEQ ID NO: 679814 - RNA, 64 nt, Homo Sapiens; identical to SEQ ID NO: 172203

SEQ ID NO: 679815 - RNA, 64 nt, Homo Sapiens; identical to SEQ ID NO: 172204

SEQ ID NO: 679816 - RNA, 64 nt, Homo Sapiens; identical to SEQ ID NO: 172205

SEQ ID NO: 679817 - RNA, 64 nt, Homo Sapiens; identical to SEQ ID NO: 172206

SEQ ID NO: 679818 - RNA, 64 nt, Homo Sapiens; identical to SEQ ID NO: 172207

SEQ ID NO: 679819 - RNA, 64 nt, Homo Sapiens; identical to SEQ ID NO: 172208

SEQ ID NO: 679820 - RNA, 64 nt, Homo Sapiens; identical to SEQ ID NO: 172209

SEQ ID NO: 679821 - RNA, 64 nt, Homo Sapiens; identical to SEQ ID NO: 172210

SEQ ID NO: 679822 - RNA, 64 nt, Homo Sapiens; identical to SEQ ID NO: 172211

SEQ ID NO: 679823 - RNA, 64 nt, Homo Sapiens; identical to SEQ ID NO: 172212

SEQ ID NO: 679824 - RNA, 64 nt, Homo Sapiens; identical to SEQ ID NO: 172213

SEQ ID NO: 679825 - RNA, 64 nt, Homo Sapiens; identical to SEQ ID NO: 172214

SEQ ID NO: 679826 - RNA, 64 nt, Homo Sapiens; identical to SEQ ID NO: 172215

SEQ ID NO: 679827 - RNA, 64 nt, Homo Sapiens; identical to SEQ ID NO: 172216

SEQ ID NO: 679828 - RNA, 64 nt, Homo Sapiens; identical to SEQ ID NO: 172217

SEQ ID NO: 679829 - RNA, 64 nt, Homo Sapiens; identical to SEQ ID NO: 172218

SEQ ID NO: 679830 - RNA, 64 nt, Homo Sapiens; identical to SEQ ID NO: 172219

SEQ ID NO: 679831 - RNA, 64 nt, Homo Sapiens; identical to SEQ ID NO: 172220

SEQ ID NO: 679832 - RNA, 64 nt, Homo Sapiens; identical to SEQ ID NO: 172221

SEQ ID NO: 679833 - RNA, 64 nt, Homo Sapiens; identical to SEQ ID NO: 172222

SEQ ID NO: 679834 - RNA, 64 nt, Homo Sapiens; identical to SEQ ID NO: 172223

SEQ ID NO: 679835 - RNA, 64 nt, Homo Sapiens; identical to SEQ ID NO: 172224

SEQ ID NO: 679836 - RNA, 64 nt, Homo Sapiens; identical to SEQ ID NO: 172225

SEQ ID NO: 679837 - RNA, 64 nt, Homo Sapiens; identical to SEQ ID NO: 172226

SEQ ID NO: 679838 - RNA, 64 nt, Homo Sapiens; identical to SEQ ID NO: 172227

SEQ ID NO: 679839 - RNA, 64 nt, Homo Sapiens; identical to SEQ ID NO: 172228

SEQ ID NO: 679840 - RNA, 64 nt, Homo Sapiens; identical to SEQ ID NO: 172229

SEQ ID NO: 679841 - RNA, 64 nt, Homo Sapiens; identical to SEQ ID NO: 172230

SEQ ID NO: 679842 - RNA, 64 nt, Homo Sapiens; identical to SEQ ID NO: 172231

SEQ ID NO: 679843 - RNA, 64 nt, Homo Sapiens; identical to SEQ ID NO: 172232

SEQ ID NO: 679844 - RNA, 64 nt, Homo Sapiens; identical to SEQ ID NO: 172233

SEQ ID NO: 679845 - RNA, 64 nt, Homo Sapiens; identical to SEQ ID NO: 172234

SEQ ID NO: 679846 - RNA, 64 nt, Homo Sapiens; identical to SEQ ID NO: 172235

SEQ ID NO: 679847 - RNA, 64 nt, Homo Sapiens; identical to SEQ ID NO: 172236

SEQ ID NO: 679848 - RNA, 64 nt, Homo Sapiens; identical to SEQ ID NO: 172237

SEQ ID NO: 679849 - RNA, 64 nt, Homo Sapiens; identical to SEQ ID NO: 172238

SEQ ID NO: 679850 - RNA, 64 nt, Homo Sapiens
gucauacucacacaaagggaagaaaacaccaggccagaacuauaacaucuaaaacuaaauaaau

SEQ ID NO: 679851 - RNA, 64 nt, Homo Sapiens
aauacgaggaaaggagaguggcagagagaagagacagaacuaaaguccaaggggacaaauaaag

SEQ ID NO: 679852 - RNA, 64 nt, Homo Sapiens
ccuacaguuucuccugcguacccuuccagggccucagaacuacccccgggggccucagaacuac

SEQ ID NO: 679853 - RNA, 64 nt, Homo Sapiens
ccuuccagggccucagaacuacccccgggggccucagaacuacccccuggaccugcagcuccgc

SEQ ID NO: 679854 - RNA, 64 nt, Homo Sapiens
augcauugauucuaacaaacuguaaugcccucaacagaacuaauuuuacuaauacaauacugug

SEQ ID NO: 679855 - RNA, 64 nt, Homo Sapiens
auagccaaucuauacaucauggguaaacuuaacccagaacuauaaaauguaguugucucagucc

SEQ ID NO: 679856 - RNA, 64 nt, Homo Sapiens
gacaaauugaucagaagaagugcaguagcuuuuccagaacuauguaguuuccucuccugcucug

SEQ ID NO: 679857 - RNA, 64 nt, Homo Sapiens
gccugagcccaacccacaucaugagggacagaaccagaacuagaccuuacaguuuuccuagcug

SEQ ID NO: 679858 - RNA, 64 nt, Homo Sapiens
gccuucuagggauuuauuuuucccauaguguaucaguuguuaugccacaauaacaacaauaaua

SEQ ID NO: 679859 - RNA, 64 nt, Homo Sapiens
aacauuacuaagccccaguucuaucguuggaaggaguuguuauucuuuuguuguucccuuaugc

SEQ ID NO: 679860 - RNA, 64 nt, Homo Sapiens
uggguagcucccugauuuggagccagcuguuuccaguuguuacugaaguuaucuguguuauuug

SEQ ID NO: 679861 - RNA, 64 nt, Homo Sapiens
acucaaaguaagauuuaugaauuauuuaaaugauaguuguuacuuggaacagccacuugagagg

SEQ ID NO: 679862 - RNA, 64 nt, Homo Sapiens
auucauguugaaugccuuuuugcaaugaugacugaguuguuaucauaguauuuuaaaaccugua

SEQ ID NO: 679863 - RNA, 64 nt, Homo Sapiens
cuaccaggcuuuccaucugaauaguaaauuaaacaguuguuaucaaaaugauuuuaaagacuau

SEQ ID NO: 679864 - RNA, 64 nt, Homo Sapiens
auucacagcgcuaugcaauucuuaauuuucauuaaguuguuauuucaguuuuaaauguaccuuc

SEQ ID NO: 679865 - RNA, 64 nt, Homo Sapiens
cuucuacuucagucuucucucacuuugauuugcuaguuguuaucaauuaaugacaauuacaaac

SEQ ID NO: 679866 - RNA, 64 nt, Homo Sapiens
aaauaucauuuuuaguauaucuugucgaucuuuaaguuguuacuauuguguuauucaugucuuu

SEQ ID NO: 679867 - RNA, 64 nt, Homo Sapiens
auuuauaacacuuaauacaauguaaaugcuauguaguuguuauaccauacugguuagugaauaa

SEQ ID NO: 679868 - RNA, 64 nt, Homo Sapiens
acauccaauuaaugaugucugcucuuauguacauaguuguuaauaacucuuagccuacaaggug

SEQ ID NO: 679869 - RNA, 64 nt, Homo Sapiens
uagagcuaguucucaaagcuauggaacagcagguaguuguuauguugacgucuuuggaguugac

SEQ ID NO: 679870 - RNA, 64 nt, Homo Sapiens
auuguuucuggaaacugcuucaguucuuauuaccaguuguuagucggaaaacucaaaauggugg

SEQ ID NO: 679871 - RNA, 64 nt, Homo Sapiens
aacaugaauaccaacggaaauuggagaauucuggaguuguuaugaagcacauugcagauuguuc

SEQ ID NO: 679872 - RNA, 64 nt, Homo Sapiens
auaagguauuugcauuuuagaagcucuggccaguaguuguuaagauguuggcauuaauggcauu

SEQ ID NO: 679873 - RNA, 64 nt, Homo Sapiens
augggggacagugaggaggacacaccagcccauuaguuguuaaucaucaaucacaucugauugu

SEQ ID NO: 679874 - RNA, 64 nt, Homo Sapiens
auacauagaggugauaaguaaacugcacuuuugaaguuguuaaaaaucuuuucccauauaaucc

SEQ ID NO: 679875 - RNA, 64 nt, Homo Sapiens
caguuguugcaaauagaugauauuucuaagagacaguuguuagggcaagaaaucacauaacuuu

SEQ ID NO: 679876 - RNA, 64 nt, Homo Sapiens
cuguauuuuucaauuugcauaauacuauguaaauaguuguuauacuuauaccuaucacaaugua

SEQ ID NO: 679877 - RNA, 64 nt, Homo Sapiens
caauguauuuccgugaggccauccagacuaacauaguuguuaccucaacuggggaaggauccac

SEQ ID NO: 679878 - RNA, 64 nt, Homo Sapiens
aacuucaagcaaaugaaauggacaaugcagauaaaguuguuaucaacacgucgggaguaugugu

SEQ ID NO: 679879 - RNA, 64 nt, Homo Sapiens
gaagcaauuccuuuuauuucuuucaccuuucauaaguuguuaucuagucaauguaauguauauu

SEQ ID NO: 679880 - RNA, 64 nt, Homo Sapiens
cucggguacugugaugaugggugaggaagacccccaagcauagaguugugacuccaagagcaga

SEQ ID NO: 679881 - RNA, 64 nt, Homo Sapiens
cuuggugccguggugauggcagcagggaagagcccaagcauagaggucaugacuccaagagcag

SEQ ID NO: 679882 - RNA, 64 nt, Homo Sapiens
aggggaauaugcuaaauguuaccaccagagggcacaagcauaucacuuuuaguaaggaaauuac

SEQ ID NO: 679883 - RNA, 64 nt, Homo Sapiens
gcuacacuaagacugaauuaucuuauuagucuggcaagcauauaaaguauacuuguauguaaug

SEQ ID NO: 679884 - RNA, 64 nt, Homo Sapiens
cucccuugagucucaauugauauuuauaauaaugcaagcauaccgugugugguggugguugugg

SEQ ID NO: 679885 - RNA, 64 nt, Homo Sapiens
aagugauuuauauuuuuaauaaauauguguuggacaagcauagacaacuugggauccugaagau

SEQ ID NO: 679886 - RNA, 64 nt, Homo Sapiens; identical to SEQ ID NO: 179925

SEQ ID NO: 679887 - RNA, 64 nt, Homo Sapiens; identical to SEQ ID NO: 179926

SEQ ID NO: 679888 - RNA, 64 nt, Homo Sapiens; identical to SEQ ID NO: 179927

SEQ ID NO: 679889 - RNA, 64 nt, Homo Sapiens; identical to SEQ ID NO: 179928

SEQ ID NO: 679890 - RNA, 64 nt, Homo Sapiens; identical to SEQ ID NO: 179929

SEQ ID NO: 679891 - RNA, 64 nt, Homo Sapiens; identical to SEQ ID NO: 179930

SEQ ID NO: 679892 - RNA, 64 nt, Homo Sapiens; identical to SEQ ID NO: 179931

SEQ ID NO: 679893 - RNA, 64 nt, Homo Sapiens; identical to SEQ ID NO: 179932

SEQ ID NO: 679894 - RNA, 64 nt, Homo Sapiens; identical to SEQ ID NO: 179933

SEQ ID NO: 679895 - RNA, 64 nt, Homo Sapiens; identical to SEQ ID NO: 179934

SEQ ID NO: 679896 - RNA, 64 nt, Homo Sapiens; identical to SEQ ID NO: 179935

SEQ ID NO: 679897 - RNA, 64 nt, Homo Sapiens; identical to SEQ ID NO: 179936

SEQ ID NO: 679898 - RNA, 64 nt, Homo Sapiens; identical to SEQ ID NO: 179937

SEQ ID NO: 679899 - RNA, 64 nt, Homo Sapiens; identical to SEQ ID NO: 179938

SEQ ID NO: 679900 - RNA, 64 nt, Homo Sapiens; identical to SEQ ID NO: 179939

SEQ ID NO: 679901 - RNA, 64 nt, Homo Sapiens; identical to SEQ ID NO: 179940

SEQ ID NO: 679902 - RNA, 64 nt, Homo Sapiens; identical to SEQ ID NO: 179941

SEQ ID NO: 679903 - RNA, 64 nt, Homo Sapiens; identical to SEQ ID NO: 179942

SEQ ID NO: 679904 - RNA, 64 nt, Homo Sapiens; identical to SEQ ID NO: 179943

SEQ ID NO: 679905 - RNA, 64 nt, Homo Sapiens; identical to SEQ ID NO: 247175

SEQ ID NO: 679906 - RNA, 64 nt, Homo Sapiens; identical to SEQ ID NO: 247176

SEQ ID NO: 679907 - RNA, 64 nt, Homo Sapiens; identical to SEQ ID NO: 247177

SEQ ID NO: 679908 - RNA, 64 nt, Homo Sapiens; identical to SEQ ID NO: 247178

SEQ ID NO: 679909 - RNA, 64 nt, Homo Sapiens; identical to SEQ ID NO: 247179

SEQ ID NO: 679910 - RNA, 64 nt, Homo Sapiens; identical to SEQ ID NO: 247180

SEQ ID NO: 679911 - RNA, 64 nt, Homo Sapiens; identical to SEQ ID NO: 247181

SEQ ID NO: 679912 - RNA, 64 nt, Homo Sapiens; identical to SEQ ID NO: 247182

SEQ ID NO: 679913 - RNA, 64 nt, Homo Sapiens; identical to SEQ ID NO: 247183

SEQ ID NO: 679914 - RNA, 64 nt, Homo Sapiens; identical to SEQ ID NO: 247184

SEQ ID NO: 679915 - RNA, 64 nt, Homo Sapiens; identical to SEQ ID NO: 247185

SEQ ID NO: 679916 - RNA, 64 nt, Homo Sapiens; identical to SEQ ID NO: 247186

SEQ ID NO: 679917 - RNA, 64 nt, Homo Sapiens; identical to SEQ ID NO: 247187

SEQ ID NO: 679918 - RNA, 64 nt, Homo Sapiens; identical to SEQ ID NO: 247188

SEQ ID NO: 679919 - RNA, 64 nt, Homo Sapiens; identical to SEQ ID NO: 247189

SEQ ID NO: 679920 - RNA, 64 nt, Homo Sapiens; identical to SEQ ID NO: 247190

SEQ ID NO: 679921 - RNA, 64 nt, Homo Sapiens; identical to SEQ ID NO: 247191

SEQ ID NO: 679922 - RNA, 64 nt, Homo Sapiens; identical to SEQ ID NO: 247192

SEQ ID NO: 679923 - RNA, 64 nt, Homo Sapiens; identical to SEQ ID NO: 247193

SEQ ID NO: 679924 - RNA, 64 nt, Homo Sapiens; identical to SEQ ID NO: 247194

SEQ ID NO: 679925 - RNA, 64 nt, Homo Sapiens; identical to SEQ ID NO: 247195

SEQ ID NO: 679926 - RNA, 64 nt, Homo Sapiens; identical to SEQ ID NO: 247196

SEQ ID NO: 679927 - RNA, 64 nt, Homo Sapiens; identical to SEQ ID NO: 247197

SEQ ID NO: 679928 - RNA, 64 nt, Homo Sapiens; identical to SEQ ID NO: 247198

SEQ ID NO: 679929 - RNA, 64 nt, Homo Sapiens; identical to SEQ ID NO: 247199

SEQ ID NO: 679930 - RNA, 64 nt, Homo Sapiens; identical to SEQ ID NO: 247200

SEQ ID NO: 679931 - RNA, 64 nt, Homo Sapiens; identical to SEQ ID NO: 247201

SEQ ID NO: 679932 - RNA, 61 nt, Homo Sapiens; identical to SEQ ID NO: 247202

SEQ ID NO: 679933 - RNA, 64 nt, Homo Sapiens; identical to SEQ ID NO: 247203

SEQ ID NO: 679934 - RNA, 64 nt, Homo Sapiens; identical to SEQ ID NO: 247204

SEQ ID NO: 679935 - RNA, 64 nt, Homo Sapiens; identical to SEQ ID NO: 247205

SEQ ID NO: 679936 - RNA, 64 nt, Homo Sapiens; identical to SEQ ID NO: 247206

SEQ ID NO: 679937 - RNA, 64 nt, Homo Sapiens; identical to SEQ ID NO: 247207

SEQ ID NO: 679938 - RNA, 64 nt, Homo Sapiens; identical to SEQ ID NO: 247208

SEQ ID NO: 679939 - RNA, 64 nt, Homo Sapiens; identical to SEQ ID NO: 247209

SEQ ID NO: 679940 - RNA, 64 nt, Homo Sapiens; identical to SEQ ID NO: 247210

SEQ ID NO: 679941 - RNA, 64 nt, Homo Sapiens; identical to SEQ ID NO: 247211

SEQ ID NO: 679942 - RNA, 64 nt, Homo Sapiens; identical to SEQ ID NO: 247212

SEQ ID NO: 679943 - RNA, 64 nt, Homo Sapiens; identical to SEQ ID NO: 247213

SEQ ID NO: 679944 - RNA, 64 nt, Homo Sapiens; identical to SEQ ID NO: 247214

SEQ ID NO: 679945 - RNA, 64 nt, Homo Sapiens; identical to SEQ ID NO: 247215

SEQ ID NO: 679946 - RNA, 64 nt, Homo Sapiens; identical to SEQ ID NO: 247216

SEQ ID NO: 679947 - RNA, 64 nt, Homo Sapiens; identical to SEQ ID NO: 247217

SEQ ID NO: 679948 - RNA, 64 nt, Homo Sapiens; identical to SEQ ID NO: 247218

SEQ ID NO: 679949 - RNA, 64 nt, Homo Sapiens; identical to SEQ ID NO: 247219

SEQ ID NO: 679950 - RNA, 64 nt, Homo Sapiens; identical to SEQ ID NO: 247220

SEQ ID NO: 679951 - RNA, 64 nt, Homo Sapiens; identical to SEQ ID NO: 247221

SEQ ID NO: 679952 - RNA, 64 nt, Homo Sapiens; identical to SEQ ID NO: 247222

SEQ ID NO: 679953 - RNA, 64 nt, Homo Sapiens; identical to SEQ ID NO: 247223

SEQ ID NO: 679954 - RNA, 64 nt, Homo Sapiens; identical to SEQ ID NO: 247224

SEQ ID NO: 679955 - RNA, 64 nt, Homo Sapiens; identical to SEQ ID NO: 247225

SEQ ID NO: 679956 - RNA, 64 nt, Homo Sapiens; identical to SEQ ID NO: 247226

SEQ ID NO: 679957 - RNA, 64 nt, Homo Sapiens; identical to SEQ ID NO: 247227

SEQ ID NO: 679958 - RNA, 64 nt, Homo Sapiens; identical to SEQ ID NO: 247228

SEQ ID NO: 679959 - RNA, 64 nt, Homo Sapiens; identical to SEQ ID NO: 247229

SEQ ID NO: 679960 - RNA, 64 nt, Homo Sapiens; identical to SEQ ID NO: 247230

SEQ ID NO: 679961 - RNA, 64 nt, Homo Sapiens; identical to SEQ ID NO: 247231

SEQ ID NO: 679962 - RNA, 64 nt, Homo Sapiens; identical to SEQ ID NO: 247232

SEQ ID NO: 679963 - RNA, 64 nt, Homo Sapiens; identical to SEQ ID NO: 247233

SEQ ID NO: 679964 - RNA, 64 nt, Homo Sapiens; identical to SEQ ID NO: 247234

SEQ ID NO: 679965 - RNA, 64 nt, Homo Sapiens; identical to SEQ ID NO: 247235

SEQ ID NO: 679966 - RNA, 64 nt, Homo Sapiens; identical to SEQ ID NO: 247236

SEQ ID NO: 679967 - RNA, 64 nt, Homo Sapiens; identical to SEQ ID NO: 247237

SEQ ID NO: 679968 - RNA, 64 nt, Homo Sapiens; identical to SEQ ID NO: 247238

SEQ ID NO: 679969 - RNA, 64 nt, Homo Sapiens; identical to SEQ ID NO: 247239

SEQ ID NO: 679970 - RNA, 64 nt, Homo Sapiens; identical to SEQ ID NO: 247240

SEQ ID NO: 679971 - RNA, 64 nt, Homo Sapiens; identical to SEQ ID NO: 247241

SEQ ID NO: 679972 - RNA, 64 nt, Homo Sapiens; identical to SEQ ID NO: 247242

SEQ ID NO: 679973 - RNA, 64 nt, Homo Sapiens; identical to SEQ ID NO: 247243

SEQ ID NO: 679974 - RNA, 64 nt, Homo Sapiens; identical to SEQ ID NO: 247244

SEQ ID NO: 679975 - RNA, 64 nt, Homo Sapiens; identical to SEQ ID NO: 247245

SEQ ID NO: 679976 - RNA, 64 nt, Homo Sapiens; identical to SEQ ID NO: 247246

SEQ ID NO: 679977 - RNA, 64 nt, Homo Sapiens; identical to SEQ ID NO: 247247

SEQ ID NO: 679978 - RNA, 64 nt, Homo Sapiens; identical to SEQ ID NO: 247248

SEQ ID NO: 679979 - RNA, 64 nt, Homo Sapiens; identical to SEQ ID NO: 247249

SEQ ID NO: 679980 - RNA, 64 nt, Homo Sapiens; identical to SEQ ID NO: 247250

SEQ ID NO: 679981 - RNA, 64 nt, Homo Sapiens; identical to SEQ ID NO: 247251

SEQ ID NO: 679982 - RNA, 64 nt, Homo Sapiens; identical to SEQ ID NO: 247252

SEQ ID NO: 679983 - RNA, 64 nt, Homo Sapiens; identical to SEQ ID NO: 74555

SEQ ID NO: 679984 - RNA, 64 nt, Homo Sapiens; identical to SEQ ID NO: 74556

SEQ ID NO: 679985 - RNA, 64 nt, Homo Sapiens; identical to SEQ ID NO: 74557

SEQ ID NO: 679986 - RNA, 64 nt, Homo Sapiens; identical to SEQ ID NO: 74558

SEQ ID NO: 679987 - RNA, 64 nt, Homo Sapiens; identical to SEQ ID NO: 74559

SEQ ID NO: 679988 - RNA, 64 nt, Homo Sapiens; identical to SEQ ID NO: 74560

SEQ ID NO: 679989 - RNA, 64 nt, Homo Sapiens
uugacaguggccugcugcacuggcggauuggugggggggacaccacugagcauauccagaccca

SEQ ID NO: 679990 - RNA, 64 nt, Homo Sapiens
agauggcugugguacugcuggccaaccuggcucagggggacagccuggcagcucgugccauugc

SEQ ID NO: 679991 - RNA, 64 nt, Homo Sapiens
ggucagucugucgggugggggcuggaauggggaagggggacaaguguaauauuaagugccuuga

SEQ ID NO: 679992 - RNA, 64 nt, Homo Sapiens
uaacagaacgagcaaaguaaucuggguuagggaugggggacagaagugacauauguauuguuua

SEQ ID NO: 679993 - RNA, 64 nt, Homo Sapiens
agggaggaggcacuucuucccagggaguaauccugggggacagcuguggggagaguggaagagg

SEQ ID NO: 679994 - RNA, 64 nt, Homo Sapiens
gaaaauggagcccaaguagcgacuggcccaggcagggggacagggaacugaccacggccuggag

SEQ ID NO: 679995 - RNA, 64 nt, Homo Sapiens
ucucaaugcccucguaucaauaagaccgggguaagggggacaggauacuugucacauauuugaa

SEQ ID NO: 679996 - RNA, 64 nt, Homo Sapiens
ugcagcucccacuucuuuagccgggcagcuguuugggggacaagagagggccagggucugugcu

SEQ ID NO: 679997 - RNA, 64 nt, Homo Sapiens
gccgcucagggugcagugagagggucagggcaaugggggacaaucagccaaggaggugggggca

SEQ ID NO: 679998 - RNA, 64 nt, Homo Sapiens
caaggaugauggaccccucaggcgugggaggucugggggacagagcagggugggagcaggggcu

SEQ ID NO: 679999 - RNA, 64 nt, Homo Sapiens
gcuacacucgucuccacugugggguuggugauuugggggacaguagcccaggccuugggaccug

SEQ ID NO: 680000 - RNA, 64 nt, Homo Sapiens
aagccuguccugucucuauuugggagggaggaaugggggacauaccuuucaaugucccuggagu

SEQ ID NO: 680001 - RNA, 64 nt, Homo Sapiens; identical to SEQ ID NO: 80199

SEQ ID NO: 680002 - RNA, 64 nt, Homo Sapiens; identical to SEQ ID NO: 80200

SEQ ID NO: 680003 - RNA, 64 nt, Homo Sapiens; identical to SEQ ID NO: 80201

SEQ ID NO: 680004 - RNA, 64 nt, Homo Sapiens; identical to SEQ ID NO: 80202

SEQ ID NO: 680005 - RNA, 64 nt, Homo Sapiens; identical to SEQ ID NO: 80203

SEQ ID NO: 680006 - RNA, 64 nt, Homo Sapiens; identical to SEQ ID NO: 80204

SEQ ID NO: 680007 - RNA, 64 nt, Homo Sapiens; identical to SEQ ID NO: 80205

SEQ ID NO: 680008 - RNA, 64 nt, Homo Sapiens; identical to SEQ ID NO: 80206

SEQ ID NO: 680009 - RNA, 64 nt, Homo Sapiens; identical to SEQ ID NO: 80207

SEQ ID NO: 680010 - RNA, 64 nt, Homo Sapiens; identical to SEQ ID NO: 80208

SEQ ID NO: 680011 - RNA, 64 nt, Homo Sapiens; identical to SEQ ID NO: 80209

SEQ ID NO: 680012 - RNA, 64 nt, Homo Sapiens; identical to SEQ ID NO: 80210

SEQ ID NO: 680013 - RNA, 64 nt, Homo Sapiens; identical to SEQ ID NO: 80211

SEQ ID NO: 680014 - RNA, 64 nt, Homo Sapiens; identical to SEQ ID NO: 80212

SEQ ID NO: 680015 - RNA, 64 nt, Homo Sapiens; identical to SEQ ID NO: 80213

SEQ ID NO: 680016 - RNA, 64 nt, Homo Sapiens; identical to SEQ ID NO: 80214

SEQ ID NO: 680017 - RNA, 64 nt, Homo Sapiens; identical to SEQ ID NO: 80215

SEQ ID NO: 680018 - RNA, 64 nt, Homo Sapiens; identical to SEQ ID NO: 80216

SEQ ID NO: 680019 - RNA, 64 nt, Homo Sapiens; identical to SEQ ID NO: 80217

SEQ ID NO: 680020 - RNA, 64 nt, Homo Sapiens; identical to SEQ ID NO: 80218

SEQ ID NO: 680021 - RNA, 64 nt, Homo Sapiens; identical to SEQ ID NO: 80219

SEQ ID NO: 680022 - RNA, 64 nt, Homo Sapiens; identical to SEQ ID NO: 80220

SEQ ID NO: 680023 - RNA, 64 nt, Homo Sapiens; identical to SEQ ID NO: 80221

SEQ ID NO: 680024 - RNA, 64 nt, Homo Sapiens; identical to SEQ ID NO: 80222

SEQ ID NO: 680025 - RNA, 64 nt, Homo Sapiens; identical to SEQ ID NO: 80223

SEQ ID NO: 680026 - RNA, 64 nt, Homo Sapiens; identical to SEQ ID NO: 80224

SEQ ID NO: 680027 - RNA, 64 nt, Homo Sapiens; identical to SEQ ID NO: 80225

SEQ ID NO: 680028 - RNA, 64 nt, Homo Sapiens; identical to SEQ ID NO: 80226

SEQ ID NO: 680029 - RNA, 64 nt, Homo Sapiens; identical to SEQ ID NO: 80227

SEQ ID NO: 680030 - RNA, 64 nt, Homo Sapiens; identical to SEQ ID NO: 80228

SEQ ID NO: 680031 - RNA, 64 nt, Homo Sapiens; identical to SEQ ID NO: 80229

SEQ ID NO: 680032 - RNA, 64 nt, Homo Sapiens; identical to SEQ ID NO: 80230

SEQ ID NO: 680033 - RNA, 64 nt, Homo Sapiens; identical to SEQ ID NO: 80231

SEQ ID NO: 680034 - RNA, 52 nt, Homo Sapiens; identical to SEQ ID NO: 80232

SEQ ID NO: 680035 - RNA, 64 nt, Homo Sapiens; identical to SEQ ID NO: 80233

SEQ ID NO: 680036 - RNA, 64 nt, Homo Sapiens; identical to SEQ ID NO: 80234

SEQ ID NO: 680037 - RNA, 64 nt, Homo Sapiens; identical to SEQ ID NO: 80235

SEQ ID NO: 680038 - RNA, 64 nt, Homo Sapiens; identical to SEQ ID NO: 80236

SEQ ID NO: 680039 - RNA, 64 nt, Homo Sapiens; identical to SEQ ID NO: 80237

SEQ ID NO: 680040 - RNA, 64 nt, Homo Sapiens; identical to SEQ ID NO: 80238

SEQ ID NO: 680041 - RNA, 64 nt, Homo Sapiens; identical to SEQ ID NO: 80239

SEQ ID NO: 680042 - RNA, 64 nt, Homo Sapiens; identical to SEQ ID NO: 80240

SEQ ID NO: 680043 - RNA, 64 nt, Homo Sapiens; identical to SEQ ID NO: 80241

SEQ ID NO: 680044 - RNA, 64 nt, Homo Sapiens; identical to SEQ ID NO: 80242

SEQ ID NO: 680045 - RNA, 64 nt, Homo Sapiens; identical to SEQ ID NO: 80243

SEQ ID NO: 680046 - RNA, 64 nt, Homo Sapiens; identical to SEQ ID NO: 80244

SEQ ID NO: 680047 - RNA, 64 nt, Homo Sapiens; identical to SEQ ID NO: 80245

SEQ ID NO: 680048 - RNA, 64 nt, Homo Sapiens; identical to SEQ ID NO: 80246

SEQ ID NO: 680049 - RNA, 64 nt, Homo Sapiens; identical to SEQ ID NO: 80247

SEQ ID NO: 680050 - RNA, 64 nt, Homo Sapiens; identical to SEQ ID NO: 80248

SEQ ID NO: 680051 - RNA, 64 nt, Homo Sapiens; identical to SEQ ID NO: 80249

SEQ ID NO: 680052 - RNA, 64 nt, Homo Sapiens; identical to SEQ ID NO: 80250

SEQ ID NO: 680053 - RNA, 64 nt, Homo Sapiens; identical to SEQ ID NO: 80251

SEQ ID NO: 680054 - RNA, 64 nt, Homo Sapiens; identical to SEQ ID NO: 80252

SEQ ID NO: 680055 - RNA, 64 nt, Homo Sapiens; identical to SEQ ID NO: 80253

SEQ ID NO: 680056 - RNA, 64 nt, Homo Sapiens; identical to SEQ ID NO: 80254

SEQ ID NO: 680057 - RNA, 64 nt, Homo Sapiens; identical to SEQ ID NO: 80255

SEQ ID NO: 680058 - RNA, 64 nt, Homo Sapiens; identical to SEQ ID NO: 80256

SEQ ID NO: 680059 - RNA, 64 nt, Homo Sapiens; identical to SEQ ID NO: 80257

SEQ ID NO: 680060 - RNA, 64 nt, Homo Sapiens; identical to SEQ ID NO: 80258

SEQ ID NO: 680061 - RNA, 64 nt, Homo Sapiens; identical to SEQ ID NO: 80259

SEQ ID NO: 680062 - RNA, 64 nt, Homo Sapiens; identical to SEQ ID NO: 80260

SEQ ID NO: 680063 - RNA, 64 nt, Homo Sapiens; identical to SEQ ID NO: 80261

SEQ ID NO: 680064 - RNA, 64 nt, Homo Sapiens; identical to SEQ ID NO: 80262

SEQ ID NO: 680065 - RNA, 64 nt, Homo Sapiens; identical to SEQ ID NO: 80263

SEQ ID NO: 680066 - RNA, 64 nt, Homo Sapiens; identical to SEQ ID NO: 80264

SEQ ID NO: 680067 - RNA, 64 nt, Homo Sapiens; identical to SEQ ID NO: 80265

SEQ ID NO: 680068 - RNA, 64 nt, Homo Sapiens; identical to SEQ ID NO: 80266

SEQ ID NO: 680069 - RNA, 64 nt, Homo Sapiens; identical to SEQ ID NO: 80267

SEQ ID NO: 680070 - RNA, 64 nt, Homo Sapiens; identical to SEQ ID NO: 80268

SEQ ID NO: 680071 - RNA, 64 nt, Homo Sapiens; identical to SEQ ID NO: 80269

SEQ ID NO: 680072 - RNA, 64 nt, Homo Sapiens; identical to SEQ ID NO: 80270

SEQ ID NO: 680073 - RNA, 64 nt, Homo Sapiens; identical to SEQ ID NO: 80271

SEQ ID NO: 680074 - RNA, 64 nt, Homo Sapiens; identical to SEQ ID NO: 80272

SEQ ID NO: 680075 - RNA, 64 nt, Homo Sapiens; identical to SEQ ID NO: 80273

SEQ ID NO: 680076 - RNA, 64 nt, Homo Sapiens; identical to SEQ ID NO: 80274

SEQ ID NO: 680077 - RNA, 64 nt, Homo Sapiens; identical to SEQ ID NO: 80275

SEQ ID NO: 680078 - RNA, 64 nt, Homo Sapiens; identical to SEQ ID NO: 80276

SEQ ID NO: 680079 - RNA, 64 nt, Homo Sapiens; identical to SEQ ID NO: 80277

SEQ ID NO: 680080 - RNA, 64 nt, Homo Sapiens; identical to SEQ ID NO: 80278

SEQ ID NO: 680081 - RNA, 64 nt, Homo Sapiens; identical to SEQ ID NO: 80279

SEQ ID NO: 680082 - RNA, 64 nt, Homo Sapiens; identical to SEQ ID NO: 80280

SEQ ID NO: 680083 - RNA, 64 nt, Homo Sapiens; identical to SEQ ID NO: 80281

SEQ ID NO: 680084 - RNA, 64 nt, Homo Sapiens; identical to SEQ ID NO: 80282

SEQ ID NO: 680085 - RNA, 64 nt, Homo Sapiens; identical to SEQ ID NO: 80283

SEQ ID NO: 680086 - RNA, 64 nt, Homo Sapiens; identical to SEQ ID NO: 80284

SEQ ID NO: 680087 - RNA, 64 nt, Homo Sapiens; identical to SEQ ID NO: 80285

SEQ ID NO: 680088 - RNA, 64 nt, Homo Sapiens; identical to SEQ ID NO: 80286

SEQ ID NO: 680089 - RNA, 64 nt, Homo Sapiens; identical to SEQ ID NO: 80287

SEQ ID NO: 680090 - RNA, 64 nt, Homo Sapiens; identical to SEQ ID NO: 80288

SEQ ID NO: 680091 - RNA, 64 nt, Homo Sapiens; identical to SEQ ID NO: 80289

SEQ ID NO: 680092 - RNA, 64 nt, Homo Sapiens; identical to SEQ ID NO: 80290

SEQ ID NO: 680093 - RNA, 64 nt, Homo Sapiens; identical to SEQ ID NO: 80291

SEQ ID NO: 680094 - RNA, 64 nt, Homo Sapiens; identical to SEQ ID NO: 80292

SEQ ID NO: 680095 - RNA, 64 nt, Homo Sapiens; identical to SEQ ID NO: 80293

SEQ ID NO: 680096 - RNA, 64 nt, Homo Sapiens; identical to SEQ ID NO: 80294

SEQ ID NO: 680097 - RNA, 64 nt, Homo Sapiens; identical to SEQ ID NO: 80295

SEQ ID NO: 680098 - RNA, 64 nt, Homo Sapiens; identical to SEQ ID NO: 80296

SEQ ID NO: 680099 - RNA, 64 nt, Homo Sapiens; identical to SEQ ID NO: 80297

SEQ ID NO: 680100 - RNA, 64 nt, Homo Sapiens; identical to SEQ ID NO: 80298

SEQ ID NO: 680101 - RNA, 64 nt, Homo Sapiens; identical to SEQ ID NO: 80299

SEQ ID NO: 680102 - RNA, 64 nt, Homo Sapiens; identical to SEQ ID NO: 80300

SEQ ID NO: 680103 - RNA, 64 nt, Homo Sapiens; identical to SEQ ID NO: 80301

SEQ ID NO: 680104 - RNA, 64 nt, Homo Sapiens; identical to SEQ ID NO: 80302

SEQ ID NO: 680105 - RNA, 64 nt, Homo Sapiens; identical to SEQ ID NO: 80303

SEQ ID NO: 680106 - RNA, 64 nt, Homo Sapiens; identical to SEQ ID NO: 80304

SEQ ID NO: 680107 - RNA, 64 nt, Homo Sapiens; identical to SEQ ID NO: 80305

SEQ ID NO: 680108 - RNA, 64 nt, Homo Sapiens; identical to SEQ ID NO: 80306

SEQ ID NO: 680109 - RNA, 64 nt, Homo Sapiens; identical to SEQ ID NO: 80307

SEQ ID NO: 680110 - RNA, 64 nt, Homo Sapiens; identical to SEQ ID NO: 80308

SEQ ID NO: 680111 - RNA, 64 nt, Homo Sapiens; identical to SEQ ID NO: 80309

SEQ ID NO: 680112 - RNA, 64 nt, Homo Sapiens; identical to SEQ ID NO: 80310

SEQ ID NO: 680113 - RNA, 64 nt, Homo Sapiens; identical to SEQ ID NO: 80311

SEQ ID NO: 680114 - RNA, 64 nt, Homo Sapiens; identical to SEQ ID NO: 80312

SEQ ID NO: 680115 - RNA, 64 nt, Homo Sapiens; identical to SEQ ID NO: 80313

SEQ ID NO: 680116 - RNA, 64 nt, Homo Sapiens; identical to SEQ ID NO: 80314

SEQ ID NO: 680117 - RNA, 64 nt, Homo Sapiens; identical to SEQ ID NO: 80315

SEQ ID NO: 680118 - RNA, 64 nt, Homo Sapiens; identical to SEQ ID NO: 80316

SEQ ID NO: 680119 - RNA, 64 nt, Homo Sapiens; identical to SEQ ID NO: 80317

SEQ ID NO: 680120 - RNA, 64 nt, Homo Sapiens; identical to SEQ ID NO: 80318

SEQ ID NO: 680121 - RNA, 64 nt, Homo Sapiens; identical to SEQ ID NO: 80319

SEQ ID NO: 680122 - RNA, 64 nt, Homo Sapiens; identical to SEQ ID NO: 80320

SEQ ID NO: 680123 - RNA, 64 nt, Homo Sapiens; identical to SEQ ID NO: 80321

SEQ ID NO: 680124 - RNA, 64 nt, Homo Sapiens; identical to SEQ ID NO: 80322

SEQ ID NO: 680125 - RNA, 64 nt, Homo Sapiens; identical to SEQ ID NO: 80323

SEQ ID NO: 680126 - RNA, 64 nt, Homo Sapiens; identical to SEQ ID NO: 80324

SEQ ID NO: 680127 - RNA, 51 nt, Homo Sapiens; identical to SEQ ID NO: 80325

SEQ ID NO: 680128 - RNA, 64 nt, Homo Sapiens; identical to SEQ ID NO: 80326

SEQ ID NO: 680129 - RNA, 64 nt, Homo Sapiens; identical to SEQ ID NO: 80327

SEQ ID NO: 680130 - RNA, 64 nt, Homo Sapiens; identical to SEQ ID NO: 80328

SEQ ID NO: 680131 - RNA, 64 nt, Homo Sapiens; identical to SEQ ID NO: 80329

SEQ ID NO: 680132 - RNA, 64 nt, Homo Sapiens; identical to SEQ ID NO: 80330

SEQ ID NO: 680133 - RNA, 62 nt, Homo Sapiens; identical to SEQ ID NO: 80331

SEQ ID NO: 680134 - RNA, 64 nt, Homo Sapiens; identical to SEQ ID NO: 80332

SEQ ID NO: 680135 - RNA, 64 nt, Homo Sapiens; identical to SEQ ID NO: 80333

SEQ ID NO: 680136 - RNA, 64 nt, Homo Sapiens; identical to SEQ ID NO: 80334

SEQ ID NO: 680137 - RNA, 54 nt, Homo Sapiens; identical to SEQ ID NO: 80335

SEQ ID NO: 680138 - RNA, 64 nt, Homo Sapiens; identical to SEQ ID NO: 80336

SEQ ID NO: 680139 - RNA, 64 nt, Homo Sapiens; identical to SEQ ID NO: 80337

SEQ ID NO: 680140 - RNA, 64 nt, Homo Sapiens; identical to SEQ ID NO: 80338

SEQ ID NO: 680141 - RNA, 64 nt, Homo Sapiens; identical to SEQ ID NO: 80339

SEQ ID NO: 680142 - RNA, 64 nt, Homo Sapiens; identical to SEQ ID NO: 80340

SEQ ID NO: 680143 - RNA, 64 nt, Homo Sapiens; identical to SEQ ID NO: 80341

SEQ ID NO: 680144 - RNA, 64 nt, Homo Sapiens; identical to SEQ ID NO: 80342

SEQ ID NO: 680145 - RNA, 64 nt, Homo Sapiens; identical to SEQ ID NO: 80343

SEQ ID NO: 680146 - RNA, 64 nt, Homo Sapiens; identical to SEQ ID NO: 80344

SEQ ID NO: 680147 - RNA, 64 nt, Homo Sapiens; identical to SEQ ID NO: 80345

SEQ ID NO: 680148 - RNA, 64 nt, Homo Sapiens; identical to SEQ ID NO: 80346

SEQ ID NO: 680149 - RNA, 64 nt, Homo Sapiens; identical to SEQ ID NO: 80347

SEQ ID NO: 680150 - RNA, 64 nt, Homo Sapiens; identical to SEQ ID NO: 80348

SEQ ID NO: 680151 - RNA, 64 nt, Homo Sapiens; identical to SEQ ID NO: 80349

SEQ ID NO: 680152 - RNA, 64 nt, Homo Sapiens; identical to SEQ ID NO: 80350

SEQ ID NO: 680153 - RNA, 64 nt, Homo Sapiens; identical to SEQ ID NO: 80351

SEQ ID NO: 680154 - RNA, 59 nt, Homo Sapiens; identical to SEQ ID NO: 80352

SEQ ID NO: 680155 - RNA, 64 nt, Homo Sapiens; identical to SEQ ID NO: 80353

SEQ ID NO: 680156 - RNA, 64 nt, Homo Sapiens; identical to SEQ ID NO: 80354

SEQ ID NO: 680157 - RNA, 64 nt, Homo Sapiens; identical to SEQ ID NO: 80355

SEQ ID NO: 680158 - RNA, 64 nt, Homo Sapiens; identical to SEQ ID NO: 80356

SEQ ID NO: 680159 - RNA, 64 nt, Homo Sapiens; identical to SEQ ID NO: 80357

SEQ ID NO: 680160 - RNA, 64 nt, Homo Sapiens; identical to SEQ ID NO: 80358

SEQ ID NO: 680161 - RNA, 64 nt, Homo Sapiens; identical to SEQ ID NO: 80359

SEQ ID NO: 680162 - RNA, 64 nt, Homo Sapiens; identical to SEQ ID NO: 80360

SEQ ID NO: 680163 - RNA, 64 nt, Homo Sapiens; identical to SEQ ID NO: 80361

SEQ ID NO: 680164 - RNA, 64 nt, Homo Sapiens; identical to SEQ ID NO: 80362

SEQ ID NO: 680165 - RNA, 64 nt, Homo Sapiens; identical to SEQ ID NO: 80363

SEQ ID NO: 680166 - RNA, 64 nt, Homo Sapiens; identical to SEQ ID NO: 80364

SEQ ID NO: 680167 - RNA, 64 nt, Homo Sapiens; identical to SEQ ID NO: 80365

SEQ ID NO: 680168 - RNA, 64 nt, Homo Sapiens; identical to SEQ ID NO: 80366

SEQ ID NO: 680169 - RNA, 64 nt, Homo Sapiens; identical to SEQ ID NO: 80367

SEQ ID NO: 680170 - RNA, 64 nt, Homo Sapiens; identical to SEQ ID NO: 80368

SEQ ID NO: 680171 - RNA, 64 nt, Homo Sapiens; identical to SEQ ID NO: 80369

SEQ ID NO: 680172 - RNA, 64 nt, Homo Sapiens; identical to SEQ ID NO: 80370

SEQ ID NO: 680173 - RNA, 64 nt, Homo Sapiens; identical to SEQ ID NO: 80371

SEQ ID NO: 680174 - RNA, 64 nt, Homo Sapiens; identical to SEQ ID NO: 80372

SEQ ID NO: 680175 - RNA, 64 nt, Homo Sapiens; identical to SEQ ID NO: 80373

SEQ ID NO: 680176 - RNA, 64 nt, Homo Sapiens; identical to SEQ ID NO: 80374

SEQ ID NO: 680177 - RNA, 64 nt, Homo Sapiens; identical to SEQ ID NO: 80375

SEQ ID NO: 680178 - RNA, 64 nt, Homo Sapiens; identical to SEQ ID NO: 80376

SEQ ID NO: 680179 - RNA, 64 nt, Homo Sapiens; identical to SEQ ID NO: 80377

SEQ ID NO: 680180 - RNA, 64 nt, Homo Sapiens; identical to SEQ ID NO: 80378

SEQ ID NO: 680181 - RNA, 64 nt, Homo Sapiens; identical to SEQ ID NO: 80379

SEQ ID NO: 680182 - RNA, 64 nt, Homo Sapiens; identical to SEQ ID NO: 80380

SEQ ID NO: 680183 - RNA, 64 nt, Homo Sapiens; identical to SEQ ID NO: 80381

SEQ ID NO: 680184 - RNA, 64 nt, Homo Sapiens; identical to SEQ ID NO: 80382

SEQ ID NO: 680185 - RNA, 64 nt, Homo Sapiens; identical to SEQ ID NO: 80383

SEQ ID NO: 680186 - RNA, 64 nt, Homo Sapiens; identical to SEQ ID NO: 80384

SEQ ID NO: 680187 - RNA, 64 nt, Homo Sapiens; identical to SEQ ID NO: 80385

SEQ ID NO: 680188 - RNA, 64 nt, Homo Sapiens; identical to SEQ ID NO: 80386

SEQ ID NO: 680189 - RNA, 64 nt, Homo Sapiens; identical to SEQ ID NO: 80387

SEQ ID NO: 680190 - RNA, 64 nt, Homo Sapiens; identical to SEQ ID NO: 80388

SEQ ID NO: 680191 - RNA, 64 nt, Homo Sapiens; identical to SEQ ID NO: 80389

SEQ ID NO: 680192 - RNA, 64 nt, Homo Sapiens; identical to SEQ ID NO: 80390

SEQ ID NO: 680193 - RNA, 64 nt, Homo Sapiens; identical to SEQ ID NO: 80391

SEQ ID NO: 680194 - RNA, 53 nt, Homo Sapiens; identical to SEQ ID NO: 80392

SEQ ID NO: 680195 - RNA, 64 nt, Homo Sapiens; identical to SEQ ID NO: 80393

SEQ ID NO: 680196 - RNA, 64 nt, Homo Sapiens; identical to SEQ ID NO: 80394

SEQ ID NO: 680197 - RNA, 64 nt, Homo Sapiens; identical to SEQ ID NO: 80395

SEQ ID NO: 680198 - RNA, 64 nt, Homo Sapiens; identical to SEQ ID NO: 80396

SEQ ID NO: 680199 - RNA, 64 nt, Homo Sapiens; identical to SEQ ID NO: 80397

SEQ ID NO: 680200 - RNA, 64 nt, Homo Sapiens; identical to SEQ ID NO: 80398

SEQ ID NO: 680201 - RNA, 64 nt, Homo Sapiens; identical to SEQ ID NO: 80399

SEQ ID NO: 680202 - RNA, 64 nt, Homo Sapiens; identical to SEQ ID NO: 80400

SEQ ID NO: 680203 - RNA, 64 nt, Homo Sapiens; identical to SEQ ID NO: 80401

SEQ ID NO: 680204 - RNA, 64 nt, Homo Sapiens; identical to SEQ ID NO: 80402

SEQ ID NO: 680205 - RNA, 64 nt, Homo Sapiens; identical to SEQ ID NO: 80403

SEQ ID NO: 680206 - RNA, 64 nt, Homo Sapiens; identical to SEQ ID NO: 80404

SEQ ID NO: 680207 - RNA, 64 nt, Homo Sapiens; identical to SEQ ID NO: 80405

SEQ ID NO: 680208 - RNA, 64 nt, Homo Sapiens; identical to SEQ ID NO: 80406

SEQ ID NO: 680209 - RNA, 64 nt, Homo Sapiens; identical to SEQ ID NO: 80407

SEQ ID NO: 680210 - RNA, 64 nt, Homo Sapiens; identical to SEQ ID NO: 80408

SEQ ID NO: 680211 - RNA, 64 nt, Homo Sapiens; identical to SEQ ID NO: 80409

SEQ ID NO: 680212 - RNA, 64 nt, Homo Sapiens; identical to SEQ ID NO: 80410

SEQ ID NO: 680213 - RNA, 64 nt, Homo Sapiens; identical to SEQ ID NO: 80411

SEQ ID NO: 680214 - RNA, 64 nt, Homo Sapiens; identical to SEQ ID NO: 80412

SEQ ID NO: 680215 - RNA, 64 nt, Homo Sapiens; identical to SEQ ID NO: 80413

SEQ ID NO: 680216 - RNA, 64 nt, Homo Sapiens; identical to SEQ ID NO: 80414

SEQ ID NO: 680217 - RNA, 64 nt, Homo Sapiens; identical to SEQ ID NO: 80415

SEQ ID NO: 680218 - RNA, 64 nt, Homo Sapiens; identical to SEQ ID NO: 80416

SEQ ID NO: 680219 - RNA, 64 nt, Homo Sapiens; identical to SEQ ID NO: 80417

SEQ ID NO: 680220 - RNA, 64 nt, Homo Sapiens; identical to SEQ ID NO: 80418

SEQ ID NO: 680221 - RNA, 64 nt, Homo Sapiens
cacugcauuccaaccugggugaugaagugagacucuccaaaaaaaaaaaagaaauuauuaaucc

SEQ ID NO: 680222 - RNA, 64 nt, Homo Sapiens
caacuuaggcucuuuauuaauugguuaagguuuucuccaaaaagggcauuucaacaaugggaau

SEQ ID NO: 680223 - RNA, 64 nt, Homo Sapiens
auuauauuuaagaugcucaaaagaauaguuaguacuccaaaaauuuuuaacaguuacagcaaua

SEQ ID NO: 680224 - RNA, 64 nt, Homo Sapiens
cucaggaauuaaacuuuuaaagaacuuuuaccgacuccaaaaauucuuuccucugcucacuuua

SEQ ID NO: 680225 - RNA, 64 nt, Homo Sapiens
ugggucacuuccaccacugguaaagccagaacuucuccaaaaagaaccuugcaaaaaguccagu

SEQ ID NO: 680226 - RNA, 64 nt, Homo Sapiens
gauggggaacagcuugaccuucauccaccccuaacuccaaaacuaucaagguacgacaguggca

SEQ ID NO: 680227 - RNA, 64 nt, Homo Sapiens
augcauuuaccaggcuuguuuuccuuagaaccuccuccaaaaauguacuugaacuugguagugu

SEQ ID NO: 680228 - RNA, 64 nt, Homo Sapiens
uauuugaaauauauuacaguauuuauaucagacccuccaaaaagucauuuuuaauuuauaucag

SEQ ID NO: 680229 - RNA, 64 nt, Homo Sapiens
uggcaccgcccugcaucccuaauaccaaaucugacuccaaaauuguggggugugacauacaagu

SEQ ID NO: 680230 - RNA, 64 nt, Homo Sapiens
auuacuacgccuccccacacgcccagaccccucacuccaaaauccuacuggcuguagcagagaa

SEQ ID NO: 680231 - RNA, 64 nt, Homo Sapiens
agauuuaaaaaaagauuucgcguccaaaagauuccuccaaaaaauggaggaagacuuuugccuc

SEQ ID NO: 680232 - RNA, 64 nt, Homo Sapiens
uccuucgagaaaaaauuuaucuugaugaaaacuccuccaaaaggguauccagggcucauguuca

SEQ ID NO: 680233 - RNA, 64 nt, Homo Sapiens
agcauuucagaaugguuccuauaugaggagaaaccuccaaaaccgguaaugccgcugucaucaa

SEQ ID NO: 680234 - RNA, 64 nt, Homo Sapiens
aaaaaaaaaaaaaaagaauugagcaagacuccgucuccaaaaaagcacuccagccugggcaaca

SEQ ID NO: 680235 - RNA, 64 nt, Homo Sapiens
gguugcugaugacaucaccacucccugggucugucuccaaaaaugcacuggcccccaaggucag

SEQ ID NO: 680236 - RNA, 64 nt, Homo Sapiens
gccugggcgcugguccuuucuuccggccccuccccuccaaaaugugccuauugcuagagcuccu

SEQ ID NO: 680237 - RNA, 64 nt, Homo Sapiens
aaaugaauuugaagacaagccaacaaacccugcacuccaaaaaagcaaaacagacccuaauuuu

SEQ ID NO: 680238 - RNA, 64 nt, Homo Sapiens
aacucacaaagcaugaaccauuacuccaaaacaacuccaaaaacgucuacauguuccuaaaucu

SEQ ID NO: 680239 - RNA, 64 nt, Homo Sapiens
acuccaaaaacaacucacaauuccuaaaucuuuacuccaaaacaauauucucuuugucuacaug

SEQ ID NO: 680240 - RNA, 64 nt, Homo Sapiens
cuggcauggguaaaccagcuuuacaucucagucacuccaaaaaaggaaacaucaugccaacaac

SEQ ID NO: 680241 - RNA, 64 nt, Homo Sapiens
ugucauugaaucugucacucagaagaaucaaggccuccaaaauuccuaaaacagugguauccaa

SEQ ID NO: 680242 - RNA, 64 nt, Homo Sapiens
aaugccuguacacacuagcaaaacauuuucaucacuccaaaauaaccaccuuuaacuauuucca

SEQ ID NO: 680243 - RNA, 64 nt, Homo Sapiens
cucaggaaucaagaucagcaaaaauuuaagggggcuccaaaaaauaaggcuuugccucaggcac

SEQ ID NO: 680244 - RNA, 64 nt, Homo Sapiens; identical to SEQ ID NO: 237976

SEQ ID NO: 680245 - RNA, 64 nt, Homo Sapiens; identical to SEQ ID NO: 237977

SEQ ID NO: 680246 - RNA, 64 nt, Homo Sapiens; identical to SEQ ID NO: 237978

SEQ ID NO: 680247 - RNA, 64 nt, Homo Sapiens; identical to SEQ ID NO: 237979

SEQ ID NO: 680248 - RNA, 64 nt, Homo Sapiens; identical to SEQ ID NO: 237980

SEQ ID NO: 680249 - RNA, 64 nt, Homo Sapiens; identical to SEQ ID NO: 237981

SEQ ID NO: 680250 - RNA, 64 nt, Homo Sapiens; identical to SEQ ID NO: 237982

SEQ ID NO: 680251 - RNA, 64 nt, Homo Sapiens; identical to SEQ ID NO: 237983

SEQ ID NO: 680252 - RNA, 64 nt, Homo Sapiens; identical to SEQ ID NO: 237984

SEQ ID NO: 680253 - RNA, 64 nt, Homo Sapiens; identical to SEQ ID NO: 237985

SEQ ID NO: 680254 - RNA, 64 nt, Homo Sapiens; identical to SEQ ID NO: 237986

SEQ ID NO: 680255 - RNA, 64 nt, Homo Sapiens; identical to SEQ ID NO: 237987

SEQ ID NO: 680256 - RNA, 64 nt, Homo Sapiens; identical to SEQ ID NO: 237988

SEQ ID NO: 680257 - RNA, 64 nt, Homo Sapiens; identical to SEQ ID NO: 237989

SEQ ID NO: 680258 - RNA, 64 nt, Homo Sapiens; identical to SEQ ID NO: 237990

SEQ ID NO: 680259 - RNA, 64 nt, Homo Sapiens; identical to SEQ ID NO: 237991

SEQ ID NO: 680260 - RNA, 64 nt, Homo Sapiens; identical to SEQ ID NO: 237992

SEQ ID NO: 680261 - RNA, 64 nt, Homo Sapiens; identical to SEQ ID NO: 237993

SEQ ID NO: 680262 - RNA, 64 nt, Homo Sapiens; identical to SEQ ID NO: 237994

SEQ ID NO: 680263 - RNA, 64 nt, Homo Sapiens; identical to SEQ ID NO: 237995

SEQ ID NO: 680264 - RNA, 64 nt, Homo Sapiens; identical to SEQ ID NO: 237996

SEQ ID NO: 680265 - RNA, 64 nt, Homo Sapiens; identical to SEQ ID NO: 237997

SEQ ID NO: 680266 - RNA, 64 nt, Homo Sapiens; identical to SEQ ID NO: 237998

SEQ ID NO: 680267 - RNA, 64 nt, Homo Sapiens; identical to SEQ ID NO: 237999

SEQ ID NO: 680268 - RNA, 64 nt, Homo Sapiens; identical to SEQ ID NO: 238000

SEQ ID NO: 680269 - RNA, 64 nt, Homo Sapiens; identical to SEQ ID NO: 238001

SEQ ID NO: 680270 - RNA, 64 nt, Homo Sapiens; identical to SEQ ID NO: 238002

SEQ ID NO: 680271 - RNA, 64 nt, Homo Sapiens; identical to SEQ ID NO: 238003

SEQ ID NO: 680272 - RNA, 64 nt, Homo Sapiens; identical to SEQ ID NO: 238004

SEQ ID NO: 680273 - RNA, 64 nt, Homo Sapiens; identical to SEQ ID NO: 238005

SEQ ID NO: 680274 - RNA, 64 nt, Homo Sapiens; identical to SEQ ID NO: 238006

SEQ ID NO: 680275 - RNA, 64 nt, Homo Sapiens; identical to SEQ ID NO: 238007

SEQ ID NO: 680276 - RNA, 64 nt, Homo Sapiens; identical to SEQ ID NO: 238008

SEQ ID NO: 680277 - RNA, 64 nt, Homo Sapiens; identical to SEQ ID NO: 238009

SEQ ID NO: 680278 - RNA, 64 nt, Homo Sapiens; identical to SEQ ID NO: 238010

SEQ ID NO: 680279 - RNA, 64 nt, Homo Sapiens; identical to SEQ ID NO: 238011

SEQ ID NO: 680280 - RNA, 64 nt, Homo Sapiens; identical to SEQ ID NO: 238012

SEQ ID NO: 680281 - RNA, 64 nt, Homo Sapiens; identical to SEQ ID NO: 238013

SEQ ID NO: 680282 - RNA, 64 nt, Homo Sapiens; identical to SEQ ID NO: 238014

SEQ ID NO: 680283 - RNA, 64 nt, Homo Sapiens; identical to SEQ ID NO: 238015

SEQ ID NO: 680284 - RNA, 64 nt, Homo Sapiens; identical to SEQ ID NO: 238016

SEQ ID NO: 680285 - RNA, 64 nt, Homo Sapiens; identical to SEQ ID NO: 238017

SEQ ID NO: 680286 - RNA, 64 nt, Homo Sapiens; identical to SEQ ID NO: 238018

SEQ ID NO: 680287 - RNA, 64 nt, Homo Sapiens; identical to SEQ ID NO: 238019

SEQ ID NO: 680288 - RNA, 64 nt, Homo Sapiens; identical to SEQ ID NO: 238020

SEQ ID NO: 680289 - RNA, 64 nt, Homo Sapiens; identical to SEQ ID NO: 238021

SEQ ID NO: 680290 - RNA, 64 nt, Homo Sapiens; identical to SEQ ID NO: 238022

SEQ ID NO: 680291 - RNA, 64 nt, Homo Sapiens; identical to SEQ ID NO: 238023

SEQ ID NO: 680292 - RNA, 64 nt, Homo Sapiens; identical to SEQ ID NO: 238024

SEQ ID NO: 680293 - RNA, 64 nt, Homo Sapiens; identical to SEQ ID NO: 238025

SEQ ID NO: 680294 - RNA, 64 nt, Homo Sapiens; identical to SEQ ID NO: 102753

SEQ ID NO: 680295 - RNA, 64 nt, Homo Sapiens; identical to SEQ ID NO: 102754

SEQ ID NO: 680296 - RNA, 64 nt, Homo Sapiens; identical to SEQ ID NO: 102755

SEQ ID NO: 680297 - RNA, 64 nt, Homo Sapiens; identical to SEQ ID NO: 102756

SEQ ID NO: 680298 - RNA, 64 nt, Homo Sapiens; identical to SEQ ID NO: 102757

SEQ ID NO: 680299 - RNA, 64 nt, Homo Sapiens; identical to SEQ ID NO: 102758

SEQ ID NO: 680300 - RNA, 64 nt, Homo Sapiens; identical to SEQ ID NO: 102759

SEQ ID NO: 680301 - RNA, 64 nt, Homo Sapiens; identical to SEQ ID NO: 102760

SEQ ID NO: 680302 - RNA, 64 nt, Homo Sapiens; identical to SEQ ID NO: 102761

SEQ ID NO: 680303 - RNA, 64 nt, Homo Sapiens; identical to SEQ ID NO: 102762

SEQ ID NO: 680304 - RNA, 64 nt, Homo Sapiens; identical to SEQ ID NO: 102763

SEQ ID NO: 680305 - RNA, 64 nt, Homo Sapiens; identical to SEQ ID NO: 102764

SEQ ID NO: 680306 - RNA, 64 nt, Homo Sapiens; identical to SEQ ID NO: 102765

SEQ ID NO: 680307 - RNA, 64 nt, Homo Sapiens; identical to SEQ ID NO: 102766

SEQ ID NO: 680308 - RNA, 64 nt, Homo Sapiens; identical to SEQ ID NO: 102767

SEQ ID NO: 680309 - RNA, 64 nt, Homo Sapiens; identical to SEQ ID NO: 102768

SEQ ID NO: 680310 - RNA, 64 nt, Homo Sapiens; identical to SEQ ID NO: 102769

SEQ ID NO: 680311 - RNA, 64 nt, Homo Sapiens; identical to SEQ ID NO: 102770

SEQ ID NO: 680312 - RNA, 64 nt, Homo Sapiens; identical to SEQ ID NO: 102771

SEQ ID NO: 680313 - RNA, 64 nt, Homo Sapiens; identical to SEQ ID NO: 102772

SEQ ID NO: 680314 - RNA, 64 nt, Homo Sapiens; identical to SEQ ID NO: 102773

SEQ ID NO: 680315 - RNA, 64 nt, Homo Sapiens; identical to SEQ ID NO: 102774

SEQ ID NO: 680316 - RNA, 64 nt, Homo Sapiens; identical to SEQ ID NO: 102775

SEQ ID NO: 680317 - RNA, 64 nt, Homo Sapiens; identical to SEQ ID NO: 102776

SEQ ID NO: 680318 - RNA, 64 nt, Homo Sapiens; identical to SEQ ID NO: 102777

SEQ ID NO: 680319 - RNA, 64 nt, Homo Sapiens; identical to SEQ ID NO: 102778

SEQ ID NO: 680320 - RNA, 64 nt, Homo Sapiens; identical to SEQ ID NO: 102779

SEQ ID NO: 680321 - RNA, 64 nt, Homo Sapiens; identical to SEQ ID NO: 102780

SEQ ID NO: 680322 - RNA, 64 nt, Homo Sapiens; identical to SEQ ID NO: 102781

SEQ ID NO: 680323 - RNA, 64 nt, Homo Sapiens; identical to SEQ ID NO: 102782

SEQ ID NO: 680324 - RNA, 64 nt, Homo Sapiens; identical to SEQ ID NO: 102783

SEQ ID NO: 680325 - RNA, 64 nt, Homo Sapiens; identical to SEQ ID NO: 102784

SEQ ID NO: 680326 - RNA, 64 nt, Homo Sapiens; identical to SEQ ID NO: 102785

SEQ ID NO: 680327 - RNA, 64 nt, Homo Sapiens; identical to SEQ ID NO: 102786

SEQ ID NO: 680328 - RNA, 64 nt, Homo Sapiens; identical to SEQ ID NO: 102787

SEQ ID NO: 680329 - RNA, 64 nt, Homo Sapiens; identical to SEQ ID NO: 102788

SEQ ID NO: 680330 - RNA, 64 nt, Homo Sapiens; identical to SEQ ID NO: 102789

SEQ ID NO: 680331 - RNA, 64 nt, Homo Sapiens; identical to SEQ ID NO: 102790

SEQ ID NO: 680332 - RNA, 64 nt, Homo Sapiens; identical to SEQ ID NO: 102791

SEQ ID NO: 680333 - RNA, 64 nt, Homo Sapiens; identical to SEQ ID NO: 102792

SEQ ID NO: 680334 - RNA, 64 nt, Homo Sapiens; identical to SEQ ID NO: 102793

SEQ ID NO: 680335 - RNA, 64 nt, Homo Sapiens; identical to SEQ ID NO: 102794

SEQ ID NO: 680336 - RNA, 64 nt, Homo Sapiens; identical to SEQ ID NO: 102795

SEQ ID NO: 680337 - RNA, 64 nt, Homo Sapiens; identical to SEQ ID NO: 102796

SEQ ID NO: 680338 - RNA, 64 nt, Homo Sapiens; identical to SEQ ID NO: 102797

SEQ ID NO: 680339 - RNA, 64 nt, Homo Sapiens; identical to SEQ ID NO: 102798

SEQ ID NO: 680340 - RNA, 64 nt, Homo Sapiens; identical to SEQ ID NO: 102799

SEQ ID NO: 680341 - RNA, 64 nt, Homo Sapiens; identical to SEQ ID NO: 102800

SEQ ID NO: 680342 - RNA, 64 nt, Homo Sapiens; identical to SEQ ID NO: 102801

SEQ ID NO: 680343 - RNA, 64 nt, Homo Sapiens; identical to SEQ ID NO: 102802

SEQ ID NO: 680344 - RNA, 64 nt, Homo Sapiens; identical to SEQ ID NO: 102803

SEQ ID NO: 680345 - RNA, 64 nt, Homo Sapiens; identical to SEQ ID NO: 102804

SEQ ID NO: 680346 - RNA, 64 nt, Homo Sapiens; identical to SEQ ID NO: 102805

SEQ ID NO: 680347 - RNA, 64 nt, Homo Sapiens; identical to SEQ ID NO: 102806

SEQ ID NO: 680348 - RNA, 64 nt, Homo Sapiens; identical to SEQ ID NO: 102807

SEQ ID NO: 680349 - RNA, 64 nt, Homo Sapiens; identical to SEQ ID NO: 102808

SEQ ID NO: 680350 - RNA, 64 nt, Homo Sapiens; identical to SEQ ID NO: 102809

SEQ ID NO: 680351 - RNA, 64 nt, Homo Sapiens; identical to SEQ ID NO: 102810

SEQ ID NO: 680352 - RNA, 64 nt, Homo Sapiens; identical to SEQ ID NO: 102811

SEQ ID NO: 680353 - RNA, 64 nt, Homo Sapiens; identical to SEQ ID NO: 102812

SEQ ID NO: 680354 - RNA, 64 nt, Homo Sapiens; identical to SEQ ID NO: 102813

SEQ ID NO: 680355 - RNA, 64 nt, Homo Sapiens; identical to SEQ ID NO: 102814

SEQ ID NO: 680356 - RNA, 64 nt, Homo Sapiens; identical to SEQ ID NO: 102815

SEQ ID NO: 680357 - RNA, 64 nt, Homo Sapiens
aagaaaagggagaaguugaggcacguugcccaagguugcacagcgucacucacauugagaguaa

SEQ ID NO: 680358 - RNA, 64 nt, Homo Sapiens
uugagaaccuaaugcacucuuggccacacacugaguugcacauagcggaagagcauguggugau

SEQ ID NO: 680359 - RNA, 64 nt, Homo Sapiens
uuuagaauuuuuuguagggacagggccucacucuguugcacaagcuggucuugaacuccuggcc

SEQ ID NO: 680360 - RNA, 64 nt, Homo Sapiens
auggguuucagcaagaaagucugugaugugaccaguugcacauguuuuccccuaaaagcuuacu

SEQ ID NO: 680361 - RNA, 64 nt, Homo Sapiens
ccuugagugccacccccagggaagaacauaaaggguugcacaaugccacccauccacuccuugc

SEQ ID NO: 680362 - RNA, 64 nt, Homo Sapiens
ggcuagagcccaggucugccgacacccugugcuuguugcacacuugauuugcuaaggcuggaga

SEQ ID NO: 680363 - RNA, 64 nt, Homo Sapiens; identical to SEQ ID NO: 216073

SEQ ID NO: 680364 - RNA, 64 nt, Homo Sapiens; identical to SEQ ID NO: 216074

SEQ ID NO: 680365 - RNA, 64 nt, Homo Sapiens; identical to SEQ ID NO: 216075

SEQ ID NO: 680366 - RNA, 64 nt, Homo Sapiens; identical to SEQ ID NO: 216076

SEQ ID NO: 680367 - RNA, 64 nt, Homo Sapiens; identical to SEQ ID NO: 216077

SEQ ID NO: 680368 - RNA, 64 nt, Homo Sapiens; identical to SEQ ID NO: 216078

SEQ ID NO: 680369 - RNA, 64 nt, Homo Sapiens; identical to SEQ ID NO: 216079

SEQ ID NO: 680370 - RNA, 64 nt, Homo Sapiens; identical to SEQ ID NO: 216080

SEQ ID NO: 680371 - RNA, 64 nt, Homo Sapiens; identical to SEQ ID NO: 216081

SEQ ID NO: 680372 - RNA, 64 nt, Homo Sapiens; identical to SEQ ID NO: 216082

SEQ ID NO: 680373 - RNA, 64 nt, Homo Sapiens; identical to SEQ ID NO: 216083

SEQ ID NO: 680374 - RNA, 64 nt, Homo Sapiens; identical to SEQ ID NO: 216084

SEQ ID NO: 680375 - RNA, 64 nt, Homo Sapiens; identical to SEQ ID NO: 216085

SEQ ID NO: 680376 - RNA, 64 nt, Homo Sapiens; identical to SEQ ID NO: 216086

SEQ ID NO: 680377 - RNA, 64 nt, Homo Sapiens; identical to SEQ ID NO: 216087

SEQ ID NO: 680378 - RNA, 64 nt, Homo Sapiens; identical to SEQ ID NO: 216088

SEQ ID NO: 680379 - RNA, 64 nt, Homo Sapiens; identical to SEQ ID NO: 216089

SEQ ID NO: 680380 - RNA, 64 nt, Homo Sapiens; identical to SEQ ID NO: 216090

SEQ ID NO: 680381 - RNA, 64 nt, Homo Sapiens; identical to SEQ ID NO: 216091

SEQ ID NO: 680382 - RNA, 64 nt, Homo Sapiens; identical to SEQ ID NO: 216092

SEQ ID NO: 680383 - RNA, 64 nt, Homo Sapiens; identical to SEQ ID NO: 216093

SEQ ID NO: 680384 - RNA, 64 nt, Homo Sapiens; identical to SEQ ID NO: 216094

SEQ ID NO: 680385 - RNA, 64 nt, Homo Sapiens; identical to SEQ ID NO: 216095

SEQ ID NO: 680386 - RNA, 64 nt, Homo Sapiens; identical to SEQ ID NO: 216096

SEQ ID NO: 680387 - RNA, 64 nt, Homo Sapiens; identical to SEQ ID NO: 216097

SEQ ID NO: 680388 - RNA, 64 nt, Homo Sapiens; identical to SEQ ID NO: 216098

SEQ ID NO: 680389 - RNA, 64 nt, Homo Sapiens; identical to SEQ ID NO: 216099

SEQ ID NO: 680390 - RNA, 64 nt, Homo Sapiens; identical to SEQ ID NO: 216100

SEQ ID NO: 680391 - RNA, 64 nt, Homo Sapiens; identical to SEQ ID NO: 216101

SEQ ID NO: 680392 - RNA, 64 nt, Homo Sapiens; identical to SEQ ID NO: 216102

SEQ ID NO: 680393 - RNA, 64 nt, Homo Sapiens; identical to SEQ ID NO: 216103

SEQ ID NO: 680394 - RNA, 64 nt, Homo Sapiens; identical to SEQ ID NO: 216104

SEQ ID NO: 680395 - RNA, 64 nt, Homo Sapiens; identical to SEQ ID NO: 216105

SEQ ID NO: 680396 - RNA, 64 nt, Homo Sapiens; identical to SEQ ID NO: 216106

SEQ ID NO: 680397 - RNA, 64 nt, Homo Sapiens; identical to SEQ ID NO: 216107

SEQ ID NO: 680398 - RNA, 64 nt, Homo Sapiens; identical to SEQ ID NO: 216108

SEQ ID NO: 680399 - RNA, 64 nt, Homo Sapiens; identical to SEQ ID NO: 216109

SEQ ID NO: 680400 - RNA, 64 nt, Homo Sapiens; identical to SEQ ID NO: 216110

SEQ ID NO: 680401 - RNA, 64 nt, Homo Sapiens; identical to SEQ ID NO: 216111

SEQ ID NO: 680402 - RNA, 64 nt, Homo Sapiens; identical to SEQ ID NO: 216112

SEQ ID NO: 680403 - RNA, 64 nt, Homo Sapiens; identical to SEQ ID NO: 216113

SEQ ID NO: 680404 - RNA, 64 nt, Homo Sapiens; identical to SEQ ID NO: 216114

SEQ ID NO: 680405 - RNA, 64 nt, Homo Sapiens; identical to SEQ ID NO: 216115

SEQ ID NO: 680406 - RNA, 64 nt, Homo Sapiens; identical to SEQ ID NO: 216116

SEQ ID NO: 680407 - RNA, 64 nt, Homo Sapiens; identical to SEQ ID NO: 216117

SEQ ID NO: 680408 - RNA, 64 nt, Homo Sapiens; identical to SEQ ID NO: 216118

SEQ ID NO: 680409 - RNA, 64 nt, Homo Sapiens; identical to SEQ ID NO: 216119

SEQ ID NO: 680410 - RNA, 64 nt, Homo Sapiens; identical to SEQ ID NO: 216120

SEQ ID NO: 680411 - RNA, 64 nt, Homo Sapiens; identical to SEQ ID NO: 216121

SEQ ID NO: 680412 - RNA, 64 nt, Homo Sapiens; identical to SEQ ID NO: 216121

SEQ ID NO: 680413 - RNA, 64 nt, Homo Sapiens; identical to SEQ ID NO: 216123

SEQ ID NO: 680414 - RNA, 64 nt, Homo Sapiens; identical to SEQ ID NO: 216124

SEQ ID NO: 680415 - RNA, 64 nt, Homo Sapiens; identical to SEQ ID NO: 216125

SEQ ID NO: 680416 - RNA, 64 nt, Homo Sapiens; identical to SEQ ID NO: 216126

SEQ ID NO: 680417 - RNA, 64 nt, Homo Sapiens; identical to SEQ ID NO: 216127

SEQ ID NO: 680418 - RNA, 64 nt, Homo Sapiens; identical to SEQ ID NO: 216128

SEQ ID NO: 680419 - RNA, 64 nt, Homo Sapiens; identical to SEQ ID NO: 216129

SEQ ID NO: 680420 - RNA, 64 nt, Homo Sapiens; identical to SEQ ID NO: 216130

SEQ ID NO: 680421 - RNA, 64 nt, Homo Sapiens; identical to SEQ ID NO: 216131

SEQ ID NO: 680422 - RNA, 64 nt, Homo Sapiens; identical to SEQ ID NO: 216132

SEQ ID NO: 680423 - RNA, 64 nt, Homo Sapiens; identical to SEQ ID NO: 216133

SEQ ID NO: 680424 - RNA, 64 nt, Homo Sapiens; identical to SEQ ID NO: 216134

SEQ ID NO: 680425 - RNA, 64 nt, Homo Sapiens; identical to SEQ ID NO: 216135

SEQ ID NO: 680426 - RNA, 64 nt, Homo Sapiens; identical to SEQ ID NO: 216136

SEQ ID NO: 680427 - RNA, 64 nt, Homo Sapiens; identical to SEQ ID NO: 216137

SEQ ID NO: 680428 - RNA, 64 nt, Homo Sapiens; identical to SEQ ID NO: 216138

SEQ ID NO: 680429 - RNA, 64 nt, Homo Sapiens; identical to SEQ ID NO: 216139

SEQ ID NO: 680430 - RNA, 64 nt, Homo Sapiens; identical to SEQ ID NO: 216140

SEQ ID NO: 680431 - RNA, 64 nt, Homo Sapiens; identical to SEQ ID NO: 216141

SEQ ID NO: 680432 - RNA, 64 nt, Homo Sapiens; identical to SEQ ID NO: 216142

SEQ ID NO: 680433 - RNA, 64 nt, Homo Sapiens; identical to SEQ ID NO: 216143

SEQ ID NO: 680434 - RNA, 63 nt, Homo Sapiens
uaaggaugucuuuacacugaugggcugucaugucuccaccacuuuucccucugcuguggguuc

SEQ ID NO: 680435 - RNA, 63 nt, Homo Sapiens
aggacccugucuuuggguuugaccuacccaggucuccaccaucucuccugugucuguccuccg

SEQ ID NO: 680436 - RNA, 63 nt, Homo Sapiens
cacucaccccuagcccugguaagacccuguguccuccaccauggaggauucgagcaucaggcu

SEQ ID NO: 680437 - RNA, 63 nt, Homo Sapiens
aaggggaccccgagaacccuugagugcaccugccuccaccagcggagaguacauuugcuuuaa

SEQ ID NO: 680438 - RNA, 63 nt, Homo Sapiens
ccuaucauuuuucuuuuuagcauauagcuugcucuccaccaggaaaggaaaggcugauguuuc

SEQ ID NO: 680439 - RNA, 63 nt, Homo Sapiens
ugaagucccucucacgcagccuaagaacagcagcuccaccaaagagcugggcggcguccacac

SEQ ID NO: 680440 - RNA, 63 nt, Homo Sapiens
gcugcuugugggggcaccugggaggucaaaggucuccaccacaucaaccuauuuuguuuuacc

SEQ ID NO: 680441 - RNA, 63 nt, Homo Sapiens
aggccuuccaaacagcuccgucgccccuagcaacuccaccauugggcacugccaugcagagac

SEQ ID NO: 680442 - RNA, 63 nt, Homo Sapiens
uguacagguaacuaauucuguauucacagacaacuccaccaauucuauggugugacaucaccu

SEQ ID NO: 680443 - RNA, 63 nt, Homo Sapiens
accaguggugccacauguggccccuuucugccccuccaccaguuggugggacauucuacagaa

SEQ ID NO: 680444 - RNA, 63 nt, Homo Sapiens
ccccuuucugagcccuuccuugguggugaccagcuccaccaagcacaauuuagccaugucauc

SEQ ID NO: 680445 - RNA, 63 nt, Homo Sapiens
cccagguggacuugcagcccgggcccucuuccccuccaccacaaugguagcuggacuucccca

SEQ ID NO: 680446 - RNA, 63 nt, Homo Sapiens
uaaaacugagguggggauggggagaggcuuugccuccaccauucccaccccacccuccccuua

SEQ ID NO: 680447 - RNA, 63 nt, Homo Sapiens
uucaggaauuuuguaaucucauaacuuuccaagcuccaccacuuccuaaaucuuaagaacuuu

SEQ ID NO: 680448 - RNA, 63 nt, Homo Sapiens
gcccuuggcugccagccuacccugccugcacuccuccaccaucacaaucucacccaaacuccu

SEQ ID NO: 680449 - RNA, 63 nt, Homo Sapiens
aggcggguuuccuggguccccucuccagcaagccuccaccagcaagcucggcccagagcuucc

SEQ ID NO: 680450 - RNA, 63 nt, Homo Sapiens
augaccgagacccccugauccuccguggacucacuccaccagcuuccuauaacuuggacgaug

SEQ ID NO: 680451 - RNA, 63 nt, Homo Sapiens
cggccaguuaacaagaagauggugugagguguucuccaccagucucuccuguuugagacuguu

SEQ ID NO: 680452 - RNA, 63 nt, Homo Sapiens
ccaucagaaggagaaggaagcccuggcuuguaacuccaccaaccugggacccuuuccuuccuu

SEQ ID NO: 680453 - RNA, 63 nt, Homo Sapiens
caaaagucaaaaggugccugcuucuuauucucacuccaccacccgugauguaggguaaggugc

SEQ ID NO: 680454 - RNA, 63 nt, Homo Sapiens
ucucggccugccaguucucaugcagcucuggagcuccaccaacagaguaacugcacgccuuug

SEQ ID NO: 680455 - RNA, 63 nt, Homo Sapiens
agugcugguugccuccuacuaccaggaaagccacuccaccagugagcccucgggaccugcugc

SEQ ID NO: 680456 - RNA, 63 nt, Homo Sapiens
ccuuggaugcccucuaguugaggccugcacaggcuccaccagggcugcuccacgaggaagcuc

SEQ ID NO: 680457 - RNA, 63 nt, Homo Sapiens
ccccagcaaggucagcugcccagauugggcacacuccaccagagggggugggggcuucaagua

SEQ ID NO: 680458 - RNA, 63 nt, Homo Sapiens
ucuauagacauuaggaagggagugagacggcuccuccaccauccucagccagugcaacccauu

SEQ ID NO: 680459 - RNA, 63 nt, Homo Sapiens
ccccugaacuccugagcgacagaagccccaggccuccaccagccuugaacccuugcaaagggg

SEQ ID NO: 680460 - RNA, 63 nt, Homo Sapiens
ggguggggaggagaaaaucccaccuccccugaccuccaccaccuccaccaccaccaccaccac

SEQ ID NO: 680461 - RNA, 63 nt, Homo Sapiens
ggagaaaaucccaccuccccugaccuccaccaccuccaccaccaccaccaccaccaccaccac

SEQ ID NO: 680462 - RNA, 63 nt, Homo Sapiens
uccuaaaucuuaagaacuuuauaacuuuccaagcuccaccacuuucaggaauuuuguaaucuc

SEQ ID NO: 680463 - RNA, 63 nt, Homo Sapiens
cccacccacccuccccuuaaggagagccuuugccuccaccauuuaaaacugagguggggaugg

SEQ ID NO: 680464 - RNA, 63 nt, Homo Sapiens
cugggucccaggcagcuuucagcuucaaagcugcuccaccauguaugcacccagaggggacuc

SEQ ID NO: 680465 - RNA, 63 nt, Homo Sapiens
aacuccacccgaccccagcaugcuaucacagaacuccaccagccagaaaggagaugccaauuc

SEQ ID NO: 680466 - RNA, 63 nt, Homo Sapiens
caaggaggugggggcaagggcccaggcuccuggcuccaccagcccaggugugcacaggggccu

SEQ ID NO: 680467 - RNA, 63 nt, Homo Sapiens
ggaccucagcugucccuccuugcuccaggccuucuccaccacaucaucuccuuggucacccuc

SEQ ID NO: 680468 - RNA, 64 nt, Homo Sapiens; identical to SEQ ID NO: 216073

SEQ ID NO: 680469 - RNA, 64 nt, Homo Sapiens; identical to SEQ ID NO: 216074

SEQ ID NO: 680470 - RNA, 64 nt, Homo Sapiens; identical to SEQ ID NO: 216075

SEQ ID NO: 680471 - RNA, 64 nt, Homo Sapiens; identical to SEQ ID NO: 216076

SEQ ID NO: 680472 - RNA, 64 nt, Homo Sapiens; identical to SEQ ID NO: 216077

SEQ ID NO: 680473 - RNA, 64 nt, Homo Sapiens; identical to SEQ ID NO: 216078

SEQ ID NO: 680474 - RNA, 64 nt, Homo Sapiens; identical to SEQ ID NO: 216079

SEQ ID NO: 680475 - RNA, 64 nt, Homo Sapiens; identical to SEQ ID NO: 216080

SEQ ID NO: 680476 - RNA, 64 nt, Homo Sapiens; identical to SEQ ID NO: 216081

SEQ ID NO: 680477 - RNA, 64 nt, Homo Sapiens; identical to SEQ ID NO: 216082

SEQ ID NO: 680478 - RNA, 64 nt, Homo Sapiens; identical to SEQ ID NO: 216083

SEQ ID NO: 680479 - RNA, 64 nt, Homo Sapiens; identical to SEQ ID NO: 216084

SEQ ID NO: 680480 - RNA, 64 nt, Homo Sapiens; identical to SEQ ID NO: 216085

SEQ ID NO: 680481 - RNA, 64 nt, Homo Sapiens; identical to SEQ ID NO: 216086

SEQ ID NO: 680482 - RNA, 64 nt, Homo Sapiens; identical to SEQ ID NO: 216087

SEQ ID NO: 680483 - RNA, 64 nt, Homo Sapiens; identical to SEQ ID NO: 216088

SEQ ID NO: 680484 - RNA, 64 nt, Homo Sapiens; identical to SEQ ID NO: 216089

SEQ ID NO: 680485 - RNA, 64 nt, Homo Sapiens; identical to SEQ ID NO: 216090

SEQ ID NO: 680486 - RNA, 64 nt, Homo Sapiens; identical to SEQ ID NO: 216091

SEQ ID NO: 680487 - RNA, 64 nt, Homo Sapiens; identical to SEQ ID NO: 216092

SEQ ID NO: 680488 - RNA, 64 nt, Homo Sapiens; identical to SEQ ID NO: 216093

SEQ ID NO: 680489 - RNA, 64 nt, Homo Sapiens; identical to SEQ ID NO: 216094

SEQ ID NO: 680490 - RNA, 64 nt, Homo Sapiens; identical to SEQ ID NO: 216095

SEQ ID NO: 680491 - RNA, 64 nt, Homo Sapiens; identical to SEQ ID NO: 216096

SEQ ID NO: 680492 - RNA, 64 nt, Homo Sapiens; identical to SEQ ID NO: 216097

SEQ ID NO: 680493 - RNA, 64 nt, Homo Sapiens; identical to SEQ ID NO: 216098

SEQ ID NO: 680494 - RNA, 64 nt, Homo Sapiens; identical to SEQ ID NO: 216099

SEQ ID NO: 680495 - RNA, 64 nt, Homo Sapiens; identical to SEQ ID NO: 216100

SEQ ID NO: 680496 - RNA, 64 nt, Homo Sapiens; identical to SEQ ID NO: 216101

SEQ ID NO: 680497 - RNA, 64 nt, Homo Sapiens; identical to SEQ ID NO: 216102

SEQ ID NO: 680498 - RNA, 64 nt, Homo Sapiens; identical to SEQ ID NO: 216103

SEQ ID NO: 680499 - RNA, 64 nt, Homo Sapiens; identical to SEQ ID NO: 216104

SEQ ID NO: 680500 - RNA, 64 nt, Homo Sapiens; identical to SEQ ID NO: 216105

SEQ ID NO: 680501 - RNA, 64 nt, Homo Sapiens; identical to SEQ ID NO: 216106

SEQ ID NO: 680502 - RNA, 64 nt, Homo Sapiens; identical to SEQ ID NO: 216107

SEQ ID NO: 680503 - RNA, 64 nt, Homo Sapiens; identical to SEQ ID NO: 216108

SEQ ID NO: 680504 - RNA, 64 nt, Homo Sapiens; identical to SEQ ID NO: 216109

SEQ ID NO: 680505 - RNA, 64 nt, Homo Sapiens; identical to SEQ ID NO: 216110

SEQ ID NO: 680506 - RNA, 64 nt, Homo Sapiens; identical to SEQ ID NO: 216111

SEQ ID NO: 680507 - RNA, 64 nt, Homo Sapiens; identical to SEQ ID NO: 216112

SEQ ID NO: 680508 - RNA, 64 nt, Homo Sapiens; identical to SEQ ID NO: 216113

SEQ ID NO: 680509 - RNA, 64 nt, Homo Sapiens; identical to SEQ ID NO: 216114

SEQ ID NO: 680510 - RNA, 64 nt, Homo Sapiens; identical to SEQ ID NO: 216115

SEQ ID NO: 680511 - RNA, 64 nt, Homo Sapiens; identical to SEQ ID NO: 216116

SEQ ID NO: 680512 - RNA, 64 nt, Homo Sapiens; identical to SEQ ID NO: 216117

SEQ ID NO: 680513 - RNA, 64 nt, Homo Sapiens; identical to SEQ ID NO: 216118

SEQ ID NO: 680514 - RNA, 64 nt, Homo Sapiens; identical to SEQ ID NO: 216119

SEQ ID NO: 680515 - RNA, 64 nt, Homo Sapiens; identical to SEQ ID NO: 216120

SEQ ID NO: 680516 - RNA, 64 nt, Homo Sapiens; identical to SEQ ID NO: 216121

SEQ ID NO: 680517 - RNA, 64 nt, Homo Sapiens; identical to SEQ ID NO: 216121

SEQ ID NO: 680518 - RNA, 64 nt, Homo Sapiens; identical to SEQ ID NO: 216123

SEQ ID NO: 680519 - RNA, 64 nt, Homo Sapiens; identical to SEQ ID NO: 216124

SEQ ID NO: 680520 - RNA, 64 nt, Homo Sapiens; identical to SEQ ID NO: 216125

SEQ ID NO: 680521 - RNA, 64 nt, Homo Sapiens; identical to SEQ ID NO: 216126

SEQ ID NO: 680522 - RNA, 64 nt, Homo Sapiens; identical to SEQ ID NO: 216127

SEQ ID NO: 680523 - RNA, 64 nt, Homo Sapiens; identical to SEQ ID NO: 216128

SEQ ID NO: 680524 - RNA, 64 nt, Homo Sapiens; identical to SEQ ID NO: 216129

SEQ ID NO: 680525 - RNA, 64 nt, Homo Sapiens; identical to SEQ ID NO: 216130

SEQ ID NO: 680526 - RNA, 64 nt, Homo Sapiens; identical to SEQ ID NO: 216131

SEQ ID NO: 680527 - RNA, 64 nt, Homo Sapiens; identical to SEQ ID NO: 216132

SEQ ID NO: 680528 - RNA, 64 nt, Homo Sapiens; identical to SEQ ID NO: 216133

SEQ ID NO: 680529 - RNA, 64 nt, Homo Sapiens; identical to SEQ ID NO: 216134

SEQ ID NO: 680530 - RNA, 64 nt, Homo Sapiens; identical to SEQ ID NO: 216135

SEQ ID NO: 680531 - RNA, 64 nt, Homo Sapiens; identical to SEQ ID NO: 216136

SEQ ID NO: 680532 - RNA, 64 nt, Homo Sapiens; identical to SEQ ID NO: 216137

SEQ ID NO: 680533 - RNA, 64 nt, Homo Sapiens; identical to SEQ ID NO: 216138

SEQ ID NO: 680534 - RNA, 64 nt, Homo Sapiens; identical to SEQ ID NO: 216139

SEQ ID NO: 680535 - RNA, 64 nt, Homo Sapiens; identical to SEQ ID NO: 216140

SEQ ID NO: 680536 - RNA, 64 nt, Homo Sapiens; identical to SEQ ID NO: 216141

SEQ ID NO: 680537 - RNA, 64 nt, Homo Sapiens; identical to SEQ ID NO: 216142

SEQ ID NO: 680538 - RNA, 64 nt, Homo Sapiens; identical to SEQ ID NO: 216143

SEQ ID NO: 680539 - RNA, 63 nt, Homo Sapiens; identical to SEQ ID NO: 680434

SEQ ID NO: 680540 - RNA, 63 nt, Homo Sapiens; identical to SEQ ID NO: 680435

SEQ ID NO: 680541 - RNA, 63 nt, Homo Sapiens; identical to SEQ ID NO: 680436

SEQ ID NO: 680542 - RNA, 63 nt, Homo Sapiens; identical to SEQ ID NO: 680437

SEQ ID NO: 680543 - RNA, 63 nt, Homo Sapiens; identical to SEQ ID NO: 680438

SEQ ID NO: 680544 - RNA, 63 nt, Homo Sapiens; identical to SEQ ID NO: 680439

SEQ ID NO: 680545 - RNA, 63 nt, Homo Sapiens; identical to SEQ ID NO: 680440

SEQ ID NO: 680546 - RNA, 63 nt, Homo Sapiens; identical to SEQ ID NO: 680441

SEQ ID NO: 680547 - RNA, 63 nt, Homo Sapiens; identical to SEQ ID NO: 680442

SEQ ID NO: 680548 - RNA, 63 nt, Homo Sapiens; identical to SEQ ID NO: 680443

SEQ ID NO: 680549 - RNA, 63 nt, Homo Sapiens; identical to SEQ ID NO: 680444

SEQ ID NO: 680550 - RNA, 63 nt, Homo Sapiens; identical to SEQ ID NO: 680445

SEQ ID NO: 680551 - RNA, 63 nt, Homo Sapiens; identical to SEQ ID NO: 680446

SEQ ID NO: 680552 - RNA, 63 nt, Homo Sapiens; identical to SEQ ID NO: 680447

SEQ ID NO: 680553 - RNA, 63 nt, Homo Sapiens; identical to SEQ ID NO: 680448

SEQ ID NO: 680554 - RNA, 63 nt, Homo Sapiens; identical to SEQ ID NO: 680449

SEQ ID NO: 680555 - RNA, 63 nt, Homo Sapiens; identical to SEQ ID NO: 680450

SEQ ID NO: 680556 - RNA, 63 nt, Homo Sapiens; identical to SEQ ID NO: 680451

SEQ ID NO: 680557 - RNA, 63 nt, Homo Sapiens; identical to SEQ ID NO: 680452

SEQ ID NO: 680558 - RNA, 63 nt, Homo Sapiens; identical to SEQ ID NO: 680453

SEQ ID NO: 680559 - RNA, 63 nt, Homo Sapiens; identical to SEQ ID NO: 680454

SEQ ID NO: 680560 - RNA, 63 nt, Homo Sapiens; identical to SEQ ID NO: 680455

SEQ ID NO: 680561 - RNA, 63 nt, Homo Sapiens; identical to SEQ ID NO: 680456

SEQ ID NO: 680562 - RNA, 63 nt, Homo Sapiens; identical to SEQ ID NO: 680457

SEQ ID NO: 680563 - RNA, 63 nt, Homo Sapiens; identical to SEQ ID NO: 680458

SEQ ID NO: 680564 - RNA, 63 nt, Homo Sapiens; identical to SEQ ID NO: 680459

SEQ ID NO: 680565 - RNA, 63 nt, Homo Sapiens; identical to SEQ ID NO: 680460

SEQ ID NO: 680566 - RNA, 63 nt, Homo Sapiens; identical to SEQ ID NO: 680461

SEQ ID NO: 680567 - RNA, 63 nt, Homo Sapiens; identical to SEQ ID NO: 680462

SEQ ID NO: 680568 - RNA, 63 nt, Homo Sapiens; identical to SEQ ID NO: 680463

SEQ ID NO: 680569 - RNA, 63 nt, Homo Sapiens; identical to SEQ ID NO: 680464

SEQ ID NO: 680570 - RNA, 63 nt, Homo Sapiens; identical to SEQ ID NO: 680465

SEQ ID NO: 680571 - RNA, 63 nt, Homo Sapiens; identical to SEQ ID NO: 680466

SEQ ID NO: 680572 - RNA, 63 nt, Homo Sapiens; identical to SEQ ID NO: 680467

SEQ ID NO: 680573 - RNA, 64 nt, Homo Sapiens; identical to SEQ ID NO: 331879

SEQ ID NO: 680574 - RNA, 64 nt, Homo Sapiens; identical to SEQ ID NO: 331880

SEQ ID NO: 680575 - RNA, 64 nt, Homo Sapiens; identical to SEQ ID NO: 331881

SEQ ID NO: 680576 - RNA, 64 nt, Homo Sapiens; identical to SEQ ID NO: 331882

SEQ ID NO: 680577 - RNA, 64 nt, Homo Sapiens; identical to SEQ ID NO: 331883

SEQ ID NO: 680578 - RNA, 64 nt, Homo Sapiens; identical to SEQ ID NO: 331884

SEQ ID NO: 680579 - RNA, 64 nt, Homo Sapiens
aaaaaaggcugguguucaccagccaaacaaaacugaaccacaaacugaccccaguggaaaacaa

SEQ ID NO: 680580 - RNA, 64 nt, Homo Sapiens
caauucgaaugggguagaaaauauagcaaaugcagaaccacaaauuugcuggaagaaacuaaaa

SEQ ID NO: 680581 - RNA, 64 nt, Homo Sapiens
ccuuggccucccaaugcucugggauuacagacaugaaccacagugccuguuguagaaauuuuua

SEQ ID NO: 680582 - RNA, 64 nt, Homo Sapiens
auuggaaaguggcagcuaaacauuaaauucgcaugaaccacagaugcuggagaucaccagaccg

SEQ ID NO: 680583 - RNA, 64 nt, Homo Sapiens
uagggacacuguguuaucaaccauuaagaagaaagaaccacaagccucccaaguauuuggguuc

SEQ ID NO: 680584 - RNA, 64 nt, Homo Sapiens
agcaauccuccugccucagcuuccugaguagcuggaaccacaggugugugcuaccgugccuggc

SEQ ID NO: 680585 - RNA, 64 nt, Homo Sapiens
uguuaugagcaagagugugaggcaagagaagcuggaaccacauucagagaguauccuguagauu

SEQ ID NO: 680586 - RNA, 64 nt, Homo Sapiens
uggguugccuucugcagcuguaguaucaguuuuugaaccacaguaaugggaagaaagacaaaug

SEQ ID NO: 680587 - RNA, 64 nt, Homo Sapiens
cccugauucucccucuggguaaccagucccaggugaaccacaccauccugcaguacuaucgcug

SEQ ID NO: 680588 - RNA, 64 nt, Homo Sapiens
uucuguaacacacuaacaaaagcaugaaaaauaggaaccacaccaaugcaacauuugugcagaa

SEQ ID NO: 680589 - RNA, 64 nt, Homo Sapiens; identical to SEQ ID NO: 209384

SEQ ID NO: 680590 - RNA, 64 nt, Homo Sapiens; identical to SEQ ID NO: 209385

SEQ ID NO: 680591 - RNA, 64 nt, Homo Sapiens; identical to SEQ ID NO: 209386

SEQ ID NO: 680592 - RNA, 64 nt, Homo Sapiens; identical to SEQ ID NO: 209387

SEQ ID NO: 680593 - RNA, 64 nt, Homo Sapiens; identical to SEQ ID NO: 209388

SEQ ID NO: 680594 - RNA, 64 nt, Homo Sapiens; identical to SEQ ID NO: 209389

SEQ ID NO: 680595 - RNA, 64 nt, Homo Sapiens; identical to SEQ ID NO: 209390

SEQ ID NO: 680596 - RNA, 64 nt, Homo Sapiens; identical to SEQ ID NO: 209391

SEQ ID NO: 680597 - RNA, 64 nt, Homo Sapiens; identical to SEQ ID NO: 209392

SEQ ID NO: 680598 - RNA, 64 nt, Homo Sapiens; identical to SEQ ID NO: 209393

SEQ ID NO: 680599 - RNA, 64 nt, Homo Sapiens; identical to SEQ ID NO: 209394

SEQ ID NO: 680600 - RNA, 64 nt, Homo Sapiens; identical to SEQ ID NO: 209395

SEQ ID NO: 680601 - RNA, 61 nt, Homo Sapiens; identical to SEQ ID NO: 209396

SEQ ID NO: 680602 - RNA, 64 nt, Homo Sapiens; identical to SEQ ID NO: 209397

SEQ ID NO: 680603 - RNA, 64 nt, Homo Sapiens; identical to SEQ ID NO: 209398

SEQ ID NO: 680604 - RNA, 64 nt, Homo Sapiens; identical to SEQ ID NO: 209399

SEQ ID NO: 680605 - RNA, 64 nt, Homo Sapiens; identical to SEQ ID NO: 209400

SEQ ID NO: 680606 - RNA, 64 nt, Homo Sapiens; identical to SEQ ID NO: 209401

SEQ ID NO: 680607 - RNA, 64 nt, Homo Sapiens; identical to SEQ ID NO: 209402

SEQ ID NO: 680608 - RNA, 64 nt, Homo Sapiens; identical to SEQ ID NO: 209403

SEQ ID NO: 680609 - RNA, 64 nt, Homo Sapiens; identical to SEQ ID NO: 209404

SEQ ID NO: 680610 - RNA, 64 nt, Homo Sapiens; identical to SEQ ID NO: 209405

SEQ ID NO: 680611 - RNA, 64 nt, Homo Sapiens; identical to SEQ ID NO: 209406

SEQ ID NO: 680612 - RNA, 64 nt, Homo Sapiens; identical to SEQ ID NO: 209407

SEQ ID NO: 680613 - RNA, 64 nt, Homo Sapiens; identical to SEQ ID NO: 74140

SEQ ID NO: 680614 - RNA, 64 nt, Homo Sapiens; identical to SEQ ID NO: 74141

SEQ ID NO: 680615 - RNA, 64 nt, Homo Sapiens; identical to SEQ ID NO: 74142

SEQ ID NO: 680616 - RNA, 64 nt, Homo Sapiens; identical to SEQ ID NO: 74143

SEQ ID NO: 680617 - RNA, 64 nt, Homo Sapiens; identical to SEQ ID NO: 74144

SEQ ID NO: 680618 - RNA, 64 nt, Homo Sapiens; identical to SEQ ID NO: 74145

SEQ ID NO: 680619 - RNA, 64 nt, Homo Sapiens; identical to SEQ ID NO: 74146

SEQ ID NO: 680620 - RNA, 64 nt, Homo Sapiens; identical to SEQ ID NO: 74147

SEQ ID NO: 680621 - RNA, 64 nt, Homo Sapiens; identical to SEQ ID NO: 74148

SEQ ID NO: 680622 - RNA, 64 nt, Homo Sapiens; identical to SEQ ID NO: 74149

SEQ ID NO: 680623 - RNA, 64 nt, Homo Sapiens; identical to SEQ ID NO: 74150

SEQ ID NO: 680624 - RNA, 64 nt, Homo Sapiens; identical to SEQ ID NO: 74151

SEQ ID NO: 680625 - RNA, 64 nt, Homo Sapiens; identical to SEQ ID NO: 74152

SEQ ID NO: 680626 - RNA, 64 nt, Homo Sapiens; identical to SEQ ID NO: 74153

SEQ ID NO: 680627 - RNA, 64 nt, Homo Sapiens; identical to SEQ ID NO: 74154

SEQ ID NO: 680628 - RNA, 64 nt, Homo Sapiens; identical to SEQ ID NO: 74155

SEQ ID NO: 680629 - RNA, 64 nt, Homo Sapiens; identical to SEQ ID NO: 74156

SEQ ID NO: 680630 - RNA, 64 nt, Homo Sapiens; identical to SEQ ID NO: 74157

SEQ ID NO: 680631 - RNA, 64 nt, Homo Sapiens; identical to SEQ ID NO: 74158

SEQ ID NO: 680632 - RNA, 64 nt, Homo Sapiens; identical to SEQ ID NO: 74159

SEQ ID NO: 680633 - RNA, 64 nt, Homo Sapiens; identical to SEQ ID NO: 74160

SEQ ID NO: 680634 - RNA, 64 nt, Homo Sapiens; identical to SEQ ID NO: 74161

SEQ ID NO: 680635 - RNA, 64 nt, Homo Sapiens; identical to SEQ ID NO: 74162

SEQ ID NO: 680636 - RNA, 64 nt, Homo Sapiens; identical to SEQ ID NO: 74163

SEQ ID NO: 680637 - RNA, 64 nt, Homo Sapiens; identical to SEQ ID NO: 74164

SEQ ID NO: 680638 - RNA, 64 nt, Homo Sapiens; identical to SEQ ID NO: 74165

SEQ ID NO: 680639 - RNA, 64 nt, Homo Sapiens; identical to SEQ ID NO: 74166

SEQ ID NO: 680640 - RNA, 64 nt, Homo Sapiens; identical to SEQ ID NO: 74167

SEQ ID NO: 680641 - RNA, 64 nt, Homo Sapiens; identical to SEQ ID NO: 74168

SEQ ID NO: 680642 - RNA, 64 nt, Homo Sapiens; identical to SEQ ID NO: 74169

SEQ ID NO: 680643 - RNA, 64 nt, Homo Sapiens; identical to SEQ ID NO: 74170

SEQ ID NO: 680644 - RNA, 64 nt, Homo Sapiens; identical to SEQ ID NO: 74171

SEQ ID NO: 680645 - RNA, 64 nt, Homo Sapiens; identical to SEQ ID NO: 74172

SEQ ID NO: 680646 - RNA, 64 nt, Homo Sapiens; identical to SEQ ID NO: 74173

SEQ ID NO: 680647 - RNA, 64 nt, Homo Sapiens; identical to SEQ ID NO: 74174

SEQ ID NO: 680648 - RNA, 64 nt, Homo Sapiens; identical to SEQ ID NO: 74175

SEQ ID NO: 680649 - RNA, 64 nt, Homo Sapiens; identical to SEQ ID NO: 74176

SEQ ID NO: 680650 - RNA, 64 nt, Homo Sapiens; identical to SEQ ID NO: 74177

SEQ ID NO: 680651 - RNA, 64 nt, Homo Sapiens; identical to SEQ ID NO: 74178

SEQ ID NO: 680652 - RNA, 64 nt, Homo Sapiens; identical to SEQ ID NO: 74179

SEQ ID NO: 680653 - RNA, 64 nt, Homo Sapiens; identical to SEQ ID NO: 74180

SEQ ID NO: 680654 - RNA, 64 nt, Homo Sapiens; identical to SEQ ID NO: 74181

SEQ ID NO: 680655 - RNA, 64 nt, Homo Sapiens; identical to SEQ ID NO: 74182

SEQ ID NO: 680656 - RNA, 64 nt, Homo Sapiens; identical to SEQ ID NO: 74183

SEQ ID NO: 680657 - RNA, 64 nt, Homo Sapiens; identical to SEQ ID NO: 74184

SEQ ID NO: 680658 - RNA, 64 nt, Homo Sapiens; identical to SEQ ID NO: 74185

SEQ ID NO: 680659 - RNA, 64 nt, Homo Sapiens; identical to SEQ ID NO: 74186

SEQ ID NO: 680660 - RNA, 64 nt, Homo Sapiens; identical to SEQ ID NO: 74187

SEQ ID NO: 680661 - RNA, 64 nt, Homo Sapiens; identical to SEQ ID NO: 74188

SEQ ID NO: 680662 - RNA, 64 nt, Homo Sapiens; identical to SEQ ID NO: 74189

SEQ ID NO: 680663 - RNA, 64 nt, Homo Sapiens; identical to SEQ ID NO: 74190

SEQ ID NO: 680664 - RNA, 64 nt, Homo Sapiens; identical to SEQ ID NO: 74191

SEQ ID NO: 680665 - RNA, 64 nt, Homo Sapiens; identical to SEQ ID NO: 74192

SEQ ID NO: 680666 - RNA, 64 nt, Homo Sapiens; identical to SEQ ID NO: 74193

SEQ ID NO: 680667 - RNA, 64 nt, Homo Sapiens; identical to SEQ ID NO: 74194

SEQ ID NO: 680668 - RNA, 64 nt, Homo Sapiens; identical to SEQ ID NO: 74195

SEQ ID NO: 680669 - RNA, 64 nt, Homo Sapiens; identical to SEQ ID NO: 74196

SEQ ID NO: 680670 - RNA, 64 nt, Homo Sapiens; identical to SEQ ID NO: 74197

SEQ ID NO: 680671 - RNA, 64 nt, Homo Sapiens; identical to SEQ ID NO: 74198

SEQ ID NO: 680672 - RNA, 64 nt, Homo Sapiens; identical to SEQ ID NO: 74199

SEQ ID NO: 680673 - RNA, 64 nt, Homo Sapiens; identical to SEQ ID NO: 74200

SEQ ID NO: 680674 - RNA, 64 nt, Homo Sapiens; identical to SEQ ID NO: 74201

SEQ ID NO: 680675 - RNA, 64 nt, Homo Sapiens; identical to SEQ ID NO: 74202

SEQ ID NO: 680676 - RNA, 64 nt, Homo Sapiens; identical to SEQ ID NO: 74203

SEQ ID NO: 680677 - RNA, 64 nt, Homo Sapiens; identical to SEQ ID NO: 74204

SEQ ID NO: 680678 - RNA, 64 nt, Homo Sapiens; identical to SEQ ID NO: 74205

SEQ ID NO: 680679 - RNA, 64 nt, Homo Sapiens; identical to SEQ ID NO: 74206

SEQ ID NO: 680680 - RNA, 64 nt, Homo Sapiens; identical to SEQ ID NO: 74207

SEQ ID NO: 680681 - RNA, 64 nt, Homo Sapiens; identical to SEQ ID NO: 74208

SEQ ID NO: 680682 - RNA, 64 nt, Homo Sapiens; identical to SEQ ID NO: 74209

SEQ ID NO: 680683 - RNA, 64 nt, Homo Sapiens; identical to SEQ ID NO: 74210

SEQ ID NO: 680684 - RNA, 64 nt, Homo Sapiens; identical to SEQ ID NO: 74211

SEQ ID NO: 680685 - RNA, 64 nt, Homo Sapiens; identical to SEQ ID NO: 74212

SEQ ID NO: 680686 - RNA, 64 nt, Homo Sapiens; identical to SEQ ID NO: 74213

SEQ ID NO: 680687 - RNA, 64 nt, Homo Sapiens; identical to SEQ ID NO: 74214

SEQ ID NO: 680688 - RNA, 64 nt, Homo Sapiens; identical to SEQ ID NO: 74215

SEQ ID NO: 680689 - RNA, 64 nt, Homo Sapiens; identical to SEQ ID NO: 74216

SEQ ID NO: 680690 - RNA, 58 nt, Homo Sapiens; identical to SEQ ID NO: 74217

SEQ ID NO: 680691 - RNA, 64 nt, Homo Sapiens; identical to SEQ ID NO: 74218

SEQ ID NO: 680692 - RNA, 64 nt, Homo Sapiens; identical to SEQ ID NO: 74219

SEQ ID NO: 680693 - RNA, 64 nt, Homo Sapiens; identical to SEQ ID NO: 74220

SEQ ID NO: 680694 - RNA, 64 nt, Homo Sapiens; identical to SEQ ID NO: 74221

SEQ ID NO: 680695 - RNA, 56 nt, Homo Sapiens; identical to SEQ ID NO: 74222

SEQ ID NO: 680696 - RNA, 64 nt, Homo Sapiens; identical to SEQ ID NO: 74223

SEQ ID NO: 680697 - RNA, 64 nt, Homo Sapiens; identical to SEQ ID NO: 74224

SEQ ID NO: 680698 - RNA, 64 nt, Homo Sapiens; identical to SEQ ID NO: 74225

SEQ ID NO: 680699 - RNA, 64 nt, Homo Sapiens; identical to SEQ ID NO: 74226

SEQ ID NO: 680700 - RNA, 64 nt, Homo Sapiens; identical to SEQ ID NO: 74227

SEQ ID NO: 680701 - RNA, 64 nt, Homo Sapiens; identical to SEQ ID NO: 74228

SEQ ID NO: 680702 - RNA, 53 nt, Homo Sapiens; identical to SEQ ID NO: 74229

SEQ ID NO: 680703 - RNA, 64 nt, Homo Sapiens; identical to SEQ ID NO: 74230

SEQ ID NO: 680704 - RNA, 64 nt, Homo Sapiens; identical to SEQ ID NO: 74231

SEQ ID NO: 680705 - RNA, 64 nt, Homo Sapiens; identical to SEQ ID NO: 74232

SEQ ID NO: 680706 - RNA, 64 nt, Homo Sapiens; identical to SEQ ID NO: 74233

SEQ ID NO: 680707 - RNA, 64 nt, Homo Sapiens; identical to SEQ ID NO: 74234

SEQ ID NO: 680708 - RNA, 64 nt, Homo Sapiens; identical to SEQ ID NO: 74235

SEQ ID NO: 680709 - RNA, 64 nt, Homo Sapiens; identical to SEQ ID NO: 74236

SEQ ID NO: 680710 - RNA, 64 nt, Homo Sapiens; identical to SEQ ID NO: 74237

SEQ ID NO: 680711 - RNA, 64 nt, Homo Sapiens; identical to SEQ ID NO: 74238

SEQ ID NO: 680712 - RNA, 64 nt, Homo Sapiens; identical to SEQ ID NO: 74239

SEQ ID NO: 680713 - RNA, 64 nt, Homo Sapiens; identical to SEQ ID NO: 74240

SEQ ID NO: 680714 - RNA, 64 nt, Homo Sapiens; identical to SEQ ID NO: 74241

SEQ ID NO: 680715 - RNA, 64 nt, Homo Sapiens; identical to SEQ ID NO: 74242

SEQ ID NO: 680716 - RNA, 64 nt, Homo Sapiens; identical to SEQ ID NO: 74243

SEQ ID NO: 680717 - RNA, 64 nt, Homo Sapiens; identical to SEQ ID NO: 74244

SEQ ID NO: 680718 - RNA, 64 nt, Homo Sapiens; identical to SEQ ID NO: 74245

SEQ ID NO: 680719 - RNA, 64 nt, Homo Sapiens; identical to SEQ ID NO: 74246

SEQ ID NO: 680720 - RNA, 64 nt, Homo Sapiens; identical to SEQ ID NO: 74247

SEQ ID NO: 680721 - RNA, 64 nt, Homo Sapiens; identical to SEQ ID NO: 74248

SEQ ID NO: 680722 - RNA, 64 nt, Homo Sapiens; identical to SEQ ID NO: 74249

SEQ ID NO: 680723 - RNA, 64 nt, Homo Sapiens; identical to SEQ ID NO: 74250

SEQ ID NO: 680724 - RNA, 64 nt, Homo Sapiens; identical to SEQ ID NO: 74251

SEQ ID NO: 680725 - RNA, 64 nt, Homo Sapiens; identical to SEQ ID NO: 74252

SEQ ID NO: 680726 - RNA, 64 nt, Homo Sapiens; identical to SEQ ID NO: 74253

SEQ ID NO: 680727 - RNA, 64 nt, Homo Sapiens; identical to SEQ ID NO: 74254

SEQ ID NO: 680728 - RNA, 64 nt, Homo Sapiens; identical to SEQ ID NO: 74255

SEQ ID NO: 680729 - RNA, 64 nt, Homo Sapiens; identical to SEQ ID NO: 74256

SEQ ID NO: 680730 - RNA, 64 nt, Homo Sapiens; identical to SEQ ID NO: 74257

SEQ ID NO: 680731 - RNA, 64 nt, Homo Sapiens; identical to SEQ ID NO: 74258

SEQ ID NO: 680732 - RNA, 64 nt, Homo Sapiens; identical to SEQ ID NO: 74259

SEQ ID NO: 680733 - RNA, 64 nt, Homo Sapiens; identical to SEQ ID NO: 74260

SEQ ID NO: 680734 - RNA, 64 nt, Homo Sapiens; identical to SEQ ID NO: 74261

SEQ ID NO: 680735 - RNA, 64 nt, Homo Sapiens; identical to SEQ ID NO: 74262

SEQ ID NO: 680736 - RNA, 64 nt, Homo Sapiens; identical to SEQ ID NO: 74263

SEQ ID NO: 680737 - RNA, 64 nt, Homo Sapiens; identical to SEQ ID NO: 74264

SEQ ID NO: 680738 - RNA, 64 nt, Homo Sapiens
uuggcagccuugaaguugggggaggaggacacucccaucagaacgggggcugggagauguuccu

SEQ ID NO: 680739 - RNA, 64 nt, Homo Sapiens
cuggcagccccaaaacugggccuggaggacacucccaucagaacgcugggggccugaagacauu

SEQ ID NO: 680740 - RNA, 64 nt, Homo Sapiens
gcuguccuccuggacccaucagugugagcuaauuccaucagacuaagcaccucuuucauuuuuu

SEQ ID NO: 680741 - RNA, 64 nt, Homo Sapiens
cccccuccuccuccaacccaggcacguucuccagccaucagagguggacuggcucauaugugaa

SEQ ID NO: 680742 - RNA, 64 nt, Homo Sapiens
augaccacuguaggagugauaucagaccaugggaccaucagaccuggauaaauagauugggacc

SEQ ID NO: 680743 - RNA, 64 nt, Homo Sapiens
augggaccaucagaccaugauaaauagauugggaccaucagaccauaaauguuggauggaugga

SEQ ID NO: 680744 - RNA, 64 nt, Homo Sapiens
gacgaucugaacauagggugcuggacuuuuuuggccaucagaugaucugccacugagcccaggu

SEQ ID NO: 680745 - RNA, 64 nt, Homo Sapiens
gaauaaaauaggaaucaacuuuccauuuauaauaccaucagaaaaugaaaacgaaguuaaauaa

SEQ ID NO: 680746 - RNA, 64 nt, Homo Sapiens
acacccuggccuccuacacggauaggggacucagccaucagacauggccuccaugauggaagau

SEQ ID NO: 680747 - RNA, 64 nt, Homo Sapiens
gacacuccaauggggaugggaccuuuccccuccuccaucagaggugcucugacccuagguuaca

SEQ ID NO: 680748 - RNA, 64 nt, Homo Sapiens
uguaaccuugagacgagaauuccaaggagugucaccaucagaggcuucucuucauugugucaaa

SEQ ID NO: 680749 - RNA, 64 nt, Homo Sapiens
gagacuucaaaugcugaugggacaguggugauggccaucagacagaaaaaggacaaggacauga

SEQ ID NO: 680750 - RNA, 64 nt, Homo Sapiens
agcagggacgggguguagggccagguuugaaaggccaucagauugccaucuuggacucuccucc

SEQ ID NO: 680751 - RNA, 64 nt, Homo Sapiens
agagagaaaggucggguuacccacaaagggaagcccaucagacucacagcugaccucuuggcag

SEQ ID NO: 680752 - RNA, 64 nt, Homo Sapiens
aauaucaucacugaucccacagaaauacaaacuaccaucagagaauacuacaaacaccucuaug

SEQ ID NO: 680753 - RNA, 64 nt, Homo Sapiens
aaacuaaagaccuucugcacagcaaaagaaacuaccaucagagucaacaggcaaccuacaaaau

SEQ ID NO: 680754 - RNA, 64 nt, Homo Sapiens
cuuuuggugguugauggccacugcaaaccuggcaccaucagaucucuucugaucucuugcccca

SEQ ID NO: 680755 - RNA, 64 nt, Homo Sapiens
ucugaccucacagaagaugcccagggcccagaagccaucagaauuaucaguggagaagcaccuu

SEQ ID NO: 680756 - RNA, 64 nt, Homo Sapiens; identical to SEQ ID NO: 173010

SEQ ID NO: 680757 - RNA, 64 nt, Homo Sapiens; identical to SEQ ID NO: 173011

SEQ ID NO: 680758 - RNA, 64 nt, Homo Sapiens; identical to SEQ ID NO: 173012

SEQ ID NO: 680759 - RNA, 64 nt, Homo Sapiens; identical to SEQ ID NO: 173013

SEQ ID NO: 680760 - RNA, 64 nt, Homo Sapiens; identical to SEQ ID NO: 173014

SEQ ID NO: 680761 - RNA, 64 nt, Homo Sapiens; identical to SEQ ID NO: 173015

SEQ ID NO: 680762 - RNA, 64 nt, Homo Sapiens; identical to SEQ ID NO: 173016

SEQ ID NO: 680763 - RNA, 64 nt, Homo Sapiens; identical to SEQ ID NO: 173017

SEQ ID NO: 680764 - RNA, 64 nt, Homo Sapiens; identical to SEQ ID NO: 173018

SEQ ID NO: 680765 - RNA, 64 nt, Homo Sapiens; identical to SEQ ID NO: 173019

SEQ ID NO: 680766 - RNA, 64 nt, Homo Sapiens; identical to SEQ ID NO: 173020

SEQ ID NO: 680767 - RNA, 64 nt, Homo Sapiens; identical to SEQ ID NO: 173021

SEQ ID NO: 680768 - RNA, 64 nt, Homo Sapiens; identical to SEQ ID NO: 173022

SEQ ID NO: 680769 - RNA, 64 nt, Homo Sapiens; identical to SEQ ID NO: 173023

SEQ ID NO: 680770 - RNA, 64 nt, Homo Sapiens; identical to SEQ ID NO: 173024

SEQ ID NO: 680771 - RNA, 64 nt, Homo Sapiens; identical to SEQ ID NO: 173025

SEQ ID NO: 680772 - RNA, 64 nt, Homo Sapiens; identical to SEQ ID NO: 173026

SEQ ID NO: 680773 - RNA, 64 nt, Homo Sapiens; identical to SEQ ID NO: 173027

SEQ ID NO: 680774 - RNA, 64 nt, Homo Sapiens; identical to SEQ ID NO: 173028

SEQ ID NO: 680775 - RNA, 64 nt, Homo Sapiens; identical to SEQ ID NO: 173029

SEQ ID NO: 680776 - RNA, 64 nt, Homo Sapiens; identical to SEQ ID NO: 173030

SEQ ID NO: 680777 - RNA, 64 nt, Homo Sapiens; identical to SEQ ID NO: 173031

SEQ ID NO: 680778 - RNA, 64 nt, Homo Sapiens; identical to SEQ ID NO: 173032

SEQ ID NO: 680779 - RNA, 64 nt, Homo Sapiens; identical to SEQ ID NO: 173033

SEQ ID NO: 680780 - RNA, 64 nt, Homo Sapiens; identical to SEQ ID NO: 173034

SEQ ID NO: 680781 - RNA, 64 nt, Homo Sapiens; identical to SEQ ID NO: 173035

SEQ ID NO: 680782 - RNA, 64 nt, Homo Sapiens; identical to SEQ ID NO: 173036

SEQ ID NO: 680783 - RNA, 64 nt, Homo Sapiens; identical to SEQ ID NO: 173037

SEQ ID NO: 680784 - RNA, 64 nt, Homo Sapiens; identical to SEQ ID NO: 173038

SEQ ID NO: 680785 - RNA, 64 nt, Homo Sapiens; identical to SEQ ID NO: 173039

SEQ ID NO: 680786 - RNA, 64 nt, Homo Sapiens; identical to SEQ ID NO: 173040

SEQ ID NO: 680787 - RNA, 64 nt, Homo Sapiens; identical to SEQ ID NO: 173041

SEQ ID NO: 680788 - RNA, 64 nt, Homo Sapiens; identical to SEQ ID NO: 173042

SEQ ID NO: 680789 - RNA, 64 nt, Homo Sapiens; identical to SEQ ID NO: 173043

SEQ ID NO: 680790 - RNA, 64 nt, Homo Sapiens; identical to SEQ ID NO: 173044

SEQ ID NO: 680791 - RNA, 64 nt, Homo Sapiens; identical to SEQ ID NO: 91418

SEQ ID NO: 680792 - RNA, 64 nt, Homo Sapiens; identical to SEQ ID NO: 91419

SEQ ID NO: 680793 - RNA, 56 nt, Homo Sapiens; identical to SEQ ID NO: 91420

SEQ ID NO: 680794 - RNA, 64 nt, Homo Sapiens; identical to SEQ ID NO: 91421

SEQ ID NO: 680795 - RNA, 64 nt, Homo Sapiens; identical to SEQ ID NO: 91422

SEQ ID NO: 680796 - RNA, 64 nt, Homo Sapiens; identical to SEQ ID NO: 91423

SEQ ID NO: 680797 - RNA, 64 nt, Homo Sapiens; identical to SEQ ID NO: 91424

SEQ ID NO: 680798 - RNA, 64 nt, Homo Sapiens; identical to SEQ ID NO: 91425

SEQ ID NO: 680799 - RNA, 64 nt, Homo Sapiens; identical to SEQ ID NO: 91426

SEQ ID NO: 680800 - RNA, 64 nt, Homo Sapiens; identical to SEQ ID NO: 91427

SEQ ID NO: 680801 - RNA, 64 nt, Homo Sapiens; identical to SEQ ID NO: 91428

SEQ ID NO: 680802 - RNA, 64 nt, Homo Sapiens; identical to SEQ ID NO: 91429

SEQ ID NO: 680803 - RNA, 64 nt, Homo Sapiens; identical to SEQ ID NO: 91430

SEQ ID NO: 680804 - RNA, 64 nt, Homo Sapiens; identical to SEQ ID NO: 91431

SEQ ID NO: 680805 - RNA, 64 nt, Homo Sapiens; identical to SEQ ID NO: 91432

SEQ ID NO: 680806 - RNA, 64 nt, Homo Sapiens; identical to SEQ ID NO: 91433

SEQ ID NO: 680807 - RNA, 64 nt, Homo Sapiens; identical to SEQ ID NO: 91434

SEQ ID NO: 680808 - RNA, 64 nt, Homo Sapiens; identical to SEQ ID NO: 91435

SEQ ID NO: 680809 - RNA, 64 nt, Homo Sapiens; identical to SEQ ID NO: 91436

SEQ ID NO: 680810 - RNA, 64 nt, Homo Sapiens; identical to SEQ ID NO: 217395

SEQ ID NO: 680811 - RNA, 64 nt, Homo Sapiens; identical to SEQ ID NO: 217396

SEQ ID NO: 680812 - RNA, 64 nt, Homo Sapiens; identical to SEQ ID NO: 217397

SEQ ID NO: 680813 - RNA, 64 nt, Homo Sapiens; identical to SEQ ID NO: 217398

SEQ ID NO: 680814 - RNA, 64 nt, Homo Sapiens; identical to SEQ ID NO: 217399

SEQ ID NO: 680815 - RNA, 64 nt, Homo Sapiens; identical to SEQ ID NO: 217400

SEQ ID NO: 680816 - RNA, 64 nt, Homo Sapiens; identical to SEQ ID NO: 217401

SEQ ID NO: 680817 - RNA, 64 nt, Homo Sapiens; identical to SEQ ID NO: 217402

SEQ ID NO: 680818 - RNA, 64 nt, Homo Sapiens; identical to SEQ ID NO: 217403

SEQ ID NO: 680819 - RNA, 64 nt, Homo Sapiens; identical to SEQ ID NO: 217404

SEQ ID NO: 680820 - RNA, 64 nt, Homo Sapiens; identical to SEQ ID NO: 217405

SEQ ID NO: 680821 - RNA, 64 nt, Homo Sapiens; identical to SEQ ID NO: 217406

SEQ ID NO: 680822 - RNA, 64 nt, Homo Sapiens; identical to SEQ ID NO: 217407

SEQ ID NO: 680823 - RNA, 64 nt, Homo Sapiens; identical to SEQ ID NO: 217408

SEQ ID NO: 680824 - RNA, 64 nt, Homo Sapiens; identical to SEQ ID NO: 217409

SEQ ID NO: 680825 - RNA, 64 nt, Homo Sapiens; identical to SEQ ID NO: 217410

SEQ ID NO: 680826 - RNA, 64 nt, Homo Sapiens; identical to SEQ ID NO: 217411

SEQ ID NO: 680827 - RNA, 64 nt, Homo Sapiens; identical to SEQ ID NO: 217412

SEQ ID NO: 680828 - RNA, 64 nt, Homo Sapiens; identical to SEQ ID NO: 217413

SEQ ID NO: 680829 - RNA, 64 nt, Homo Sapiens; identical to SEQ ID NO: 217414

SEQ ID NO: 680830 - RNA, 64 nt, Homo Sapiens; identical to SEQ ID NO: 217415

SEQ ID NO: 680831 - RNA, 64 nt, Homo Sapiens; identical to SEQ ID NO: 217416

SEQ ID NO: 680832 - RNA, 64 nt, Homo Sapiens; identical to SEQ ID NO: 215681

SEQ ID NO: 680833 - RNA, 64 nt, Homo Sapiens; identical to SEQ ID NO: 215682

SEQ ID NO: 680834 - RNA, 64 nt, Homo Sapiens; identical to SEQ ID NO: 215683

SEQ ID NO: 680835 - RNA, 64 nt, Homo Sapiens; identical to SEQ ID NO: 215684

SEQ ID NO: 680836 - RNA, 64 nt, Homo Sapiens; identical to SEQ ID NO: 215685

SEQ ID NO: 680837 - RNA, 64 nt, Homo Sapiens; identical to SEQ ID NO: 215686

SEQ ID NO: 680838 - RNA, 64 nt, Homo Sapiens; identical to SEQ ID NO: 215687

SEQ ID NO: 680839 - RNA, 64 nt, Homo Sapiens; identical to SEQ ID NO: 215688

SEQ ID NO: 680840 - RNA, 64 nt, Homo Sapiens; identical to SEQ ID NO: 215689

SEQ ID NO: 680841 - RNA, 64 nt, Homo Sapiens; identical to SEQ ID NO: 215690

SEQ ID NO: 680842 - RNA, 64 nt, Homo Sapiens; identical to SEQ ID NO: 215691

SEQ ID NO: 680843 - RNA, 64 nt, Homo Sapiens; identical to SEQ ID NO: 215692

SEQ ID NO: 680844 - RNA, 64 nt, Homo Sapiens; identical to SEQ ID NO: 215693

SEQ ID NO: 680845 - RNA, 64 nt, Homo Sapiens; identical to SEQ ID NO: 215694

SEQ ID NO: 680846 - RNA, 64 nt, Homo Sapiens; identical to SEQ ID NO: 215695

SEQ ID NO: 680847 - RNA, 64 nt, Homo Sapiens; identical to SEQ ID NO: 215696

SEQ ID NO: 680848 - RNA, 64 nt, Homo Sapiens; identical to SEQ ID NO: 215697

SEQ ID NO: 680849 - RNA, 64 nt, Homo Sapiens; identical to SEQ ID NO: 215698

SEQ ID NO: 680850 - RNA, 64 nt, Homo Sapiens; identical to SEQ ID NO: 215699

SEQ ID NO: 680851 - RNA, 64 nt, Homo Sapiens; identical to SEQ ID NO: 215700

SEQ ID NO: 680852 - RNA, 64 nt, Homo Sapiens; identical to SEQ ID NO: 215701

SEQ ID NO: 680853 - RNA, 64 nt, Homo Sapiens; identical to SEQ ID NO: 215702

SEQ ID NO: 680854 - RNA, 64 nt, Homo Sapiens
ugauguccauuccaucauuagggcuacucgcaaaagaccauauguugauucuaccuguguucug

SEQ ID NO: 680855 - RNA, 64 nt, Homo Sapiens
gggaucugacugaagccagaggcucuguaaaaucagaccauaguggaaguccucagcccccugg

SEQ ID NO: 680856 - RNA, 64 nt, Homo Sapiens
uuucagaucuccuuggagcaguagaguaccugguagaccauaauaguggaaaagggucuaguuu

SEQ ID NO: 680857 - RNA, 64 nt, Homo Sapiens
gaucucaagugagauagcagagcaagaugccaaaagaccauaaauagaguaagguuucuauaga

SEQ ID NO: 680858 - RNA, 64 nt, Homo Sapiens
gaagacuuucuggcucuuaacuggggaguaguggagaccauaggagaggacucuccucccucac

SEQ ID NO: 680859 - RNA, 64 nt, Homo Sapiens
gcuuugauaauguccaaauacucugaaaugcacuagaccauauaacugugaugaaauaugaaac

SEQ ID NO: 680860 - RNA, 64 nt, Homo Sapiens
caugauugucuuuaugcauccccaaucuuaauugagaccauacuuguauaagauuuuuguaaua

SEQ ID NO: 680861 - RNA, 64 nt, Homo Sapiens
ugcagguuaaccaauuaguuugugguauaaccauagaccauagcuacauaccuauauauaaacu

SEQ ID NO: 680862 - RNA, 64 nt, Homo Sapiens
ggcuucaaaacuagaagugcacguccuauggaagagaccauaaacacacaccucuccuucauuc

SEQ ID NO: 680863 - RNA, 64 nt, Homo Sapiens
gcccagguagccuaaaauauagucauugcaagggagaccauauggugcuacaguagcagaguug

SEQ ID NO: 680864 - RNA, 64 nt, Homo Sapiens
auggcuugaaaugcuaugucaaaauccuugacauagaccauagccauuuuucuccuuaaaaauu

SEQ ID NO: 680865 - RNA, 64 nt, Homo Sapiens
cagacuaaauacaacacuugauuuuaucaccuacagaccauaugcagaguuaagccucagaaua

SEQ ID NO: 680866 - RNA, 64 nt, Homo Sapiens
cugcacuguguuugcaugaggggauggagaggacagaccauauaagaggauggggacagagugu

SEQ ID NO: 680867 - RNA, 64 nt, Homo Sapiens
uacuggccuuuguuucacauauuuaggcugccccagaccauaucagcagcauugaagugggaag

SEQ ID NO: 680868 - RNA, 64 nt, Homo Sapiens
gggaaaggauucauguggaaaggagaaacaaauaagaccauaaaucagcuuuuugucuuuucug

SEQ ID NO: 680869 - RNA, 64 nt, Homo Sapiens
uagucucacauugauaauugucuagaaauaccauagaccauauaaugaaaaauaaugaucucug

SEQ ID NO: 680870 - RNA, 64 nt, Homo Sapiens
ccuugccuuuuugauccaaauuccuagcauaucaagaccauacccucccuuauuuuccacauca

SEQ ID NO: 680871 - RNA, 64 nt, Homo Sapiens
uucucucccuccauuucuaccccuagaccuccagagaccauauucaccuuaucccaggaaccug

SEQ ID NO: 680872 - RNA, 64 nt, Homo Sapiens
gacgaggcacuuuggaaccaguacucacauaaucagaccauauacagaacgcauuuuuaaucug

SEQ ID NO: 680873 - RNA, 64 nt, Homo Sapiens
gcugaagcggguggaucaugaggucagaagaucaagaccauacuggcuaacacggugaaacccc

SEQ ID NO: 680874 - RNA, 64 nt, Homo Sapiens
auuaaaaauaauagcuggcuauuauagaaaauuuagaccauacagagauguagaaagaacauaa

SEQ ID NO: 680875 - RNA, 64 nt, Homo Sapiens
agaauaaguauagcuagagauauaguaauaaacaagaccauaagauaaagugaacuugcuuguu

SEQ ID NO: 680876 - RNA, 64 nt, Homo Sapiens
gaaaaagauuauagaggagggaagagccuucuguagaccauauaguguuaucaucucuguuaua

SEQ ID NO: 680877 - RNA, 64 nt, Homo Sapiens
uuuaaagaaauguuuauacaucuuuucuuucuacagaccauauucuuuacaacuuagguuuuac

SEQ ID NO: 680878 - RNA, 64 nt, Homo Sapiens
guuacauuauuaucaacaauuaaaaauugugaucagaccauaauucaauguuucuucuagguuc

SEQ ID NO: 680879 - RNA, 64 nt, Homo Sapiens
uaagggcgaaaacauuaccaagaaaaauaauaaaagaccauaaauauugaaggaaaaggacuca

SEQ ID NO: 680880 - RNA, 64 nt, Homo Sapiens
cuggcuuggugacuuugcuucacuacagguuaaaagaccauaagcaaacugguuauuuaaaaug

SEQ ID NO: 680881 - RNA, 64 nt, Homo Sapiens
acaaauugaaaaucugaagaccgaugcugcaagcagaccauaugcagaugugcgaguuauugac

SEQ ID NO: 680882 - RNA, 64 nt, Homo Sapiens
cagauuauuacuggcuccaaaggaugaguagauaagaccauaagaauuggaucaauguaaaucc

SEQ ID NO: 680883 - RNA, 64 nt, Homo Sapiens
aguuuauaaaugucugugcacuauauuaauuagaagaccauagaacaugccagcagguuggcua

SEQ ID NO: 680884 - RNA, 64 nt, Homo Sapiens
uuuacauuauuuuuacguugauuauuuuagugaaagaccauaugaagaagcauuuuuaauauua

SEQ ID NO: 680885 - RNA, 64 nt, Homo Sapiens
ucaccaguuuuuauuuggagccguuuuauuguguagaccauauuuacauauuuggauaaguaca

SEQ ID NO: 680886 - RNA, 64 nt, Homo Sapiens
aucaaaauaggauuucuuaaauuuuucaacccccagaccauacugacucaacauggagucucac

SEQ ID NO: 680887 - RNA, 64 nt, Homo Sapiens
guaagagucuuguuaaaaugaauguccuccucuaagaccauauuaacuauuuauuaacuaaugu

SEQ ID NO: 680888 - RNA, 53 nt, Homo Sapiens
aggccaacccaaaauaagcacucagaccauaggaacucucugcuggguucuga

SEQ ID NO: 680889 - RNA, 64 nt, Homo Sapiens
uucaagucaucuuagcagcuauauuaggaauccuagaccauauugaugggagaauauguuuaaa

SEQ ID NO: 680890 - RNA, 64 nt, Homo Sapiens
ugaugauagaccuaauacauaaggucauaaacaaagaccauaauuuucuuuauaaagcuuuuug

SEQ ID NO: 680891 - RNA, 64 nt, Homo Sapiens
ucauaaaaccuuuugaauuauuuuucauacuauuagaccauaucaacagacaugggcuuugauu

SEQ ID NO: 680892 - RNA, 64 nt, Homo Sapiens
uugacugguggcauggaauuuaaaaaaaaaagccagaccauaguaaguuuucuuuacuguuggu

SEQ ID NO: 680893 - RNA, 64 nt, Homo Sapiens
gaccaacauagugaaaccccagaucaagagaucaagaccauagucccaagguggguagaucacg

SEQ ID NO: 680894 - RNA, 64 nt, Homo Sapiens
ucaguccuuuagauuuauuuauggcuguacagguagaccauaaucuuuaauguauguauguaua

SEQ ID NO: 680895 - RNA, 64 nt, Homo Sapiens
ccccuuaccccaaagagaaagaguuugaaacucgagaccauaaagauauucuuuaguggaggcu

SEQ ID NO: 680896 - RNA, 64 nt, Homo Sapiens
acaguacuuguuuuuaguugucaugccuauguuuagaccauaucuuaauguauucacaaagaau

SEQ ID NO: 680897 - RNA, 63 nt, Homo Sapiens
guggauauaaaauagaacaccugacuuugcucuuagaccauaacccccgaacuuacuauguuc

SEQ ID NO: 680898 - RNA, 64 nt, Homo Sapiens
uuaccugguaucccauggauuuugugcuugggacagaccauaaaugauggaaaaugucaacaca

SEQ ID NO: 680899 - RNA, 64 nt, Homo Sapiens
gugucagccaccuugauaaauaauauuuagugggagaccauaauuuuuaaaugugucauuaaac

SEQ ID NO: 680900 - RNA, 64 nt, Homo Sapiens
aaguauuaaaaccauucuaucuacagacuggccgagaccauaucucagagguccaccucuuacc

SEQ ID NO: 680901 - RNA, 64 nt, Homo Sapiens
aggaaguguuuauuugccucuaauugggccugagagaccauagggagguuggggcucacugagg

SEQ ID NO: 680902 - RNA, 64 nt, Homo Sapiens
auugcuauuuuugcugugauaaugguauuaugcaagaccauauucucaauuauuuggauaugca

SEQ ID NO: 680903 - RNA, 64 nt, Homo Sapiens
aaguuauccuuccauuuuggccuccugaguagcuagaccauagguaugcaucaccacacccugc

SEQ ID NO: 680904 - RNA, 64 nt, Homo Sapiens
ggaaaguuaugauccuccaagacccuuaauugauagaccauaccagguucugcaggucagcauc

SEQ ID NO: 680905 - RNA, 64 nt, Homo Sapiens
ggcuggagcucuccugcuugccaccugccugucaagaccauaguuguacugcugcugcuucauu

SEQ ID NO: 680906 - RNA, 64 nt, Homo Sapiens
aaaauaguugaauauacauuuuguuucucucauaagaccauauucccuuuaaaagaguaagcuu

SEQ ID NO: 680907 - RNA, 64 nt, Homo Sapiens
agggcgacuccugugugacuucuggagcagagggagaccauacuuuuggagaaaugaauguuug

SEQ ID NO: 680908 - RNA, 64 nt, Homo Sapiens
uaucugacaucagaaaagcagcaacuuucuguauagaccauacaaguuacuaguuuuggcaccu

SEQ ID NO: 680909 - RNA, 64 nt, Homo Sapiens
caaacucuguuuugggaucuccccauaggaagacagaccauaggugagguuuuguacuuacuuu

SEQ ID NO: 680910 - RNA, 64 nt, Homo Sapiens
aauuguacagauaauccacaagucaggcugacacagaccauaagccuagacuauauccaacccc

SEQ ID NO: 680911 - RNA, 64 nt, Homo Sapiens
aaacauuuuggaaacuucacaugcauuccgcuugagaccauaguguuuaaucuauggcaccaag

SEQ ID NO: 680912 - RNA, 64 nt, Homo Sapiens
gauucccuguuguauuaaaaaaucuugagaaaauagaccauaaucgcuuaugcuacuuaaucag

SEQ ID NO: 680913 - RNA, 64 nt, Homo Sapiens
ucaccccagauuccuugaccgcacuggaugguggagaccauaggcacgauucuguccagaguga

SEQ ID NO: 680914 - RNA, 64 nt, Homo Sapiens
gagacacagaggaaggacaaacaggcacaaagggagaccauaaggaagaggcgaguagggcaca

SEQ ID NO: 680915 - RNA, 64 nt, Homo Sapiens
uauaugguccuuagaaaagaaguuguguauauagagaccauaauuucucucuaaauuguauaua

SEQ ID NO: 680916 - RNA, 64 nt, Homo Sapiens
gcaguuuuucacaaauucaugcuuacguauuucuagaccauaaagugccaucagcuaaugccag

SEQ ID NO: 680917 - RNA, 64 nt, Homo Sapiens
aaaaaaaaaccacaccuaaaauagaccacugaggagaccauagagcggaugcuuucaugcaccc

SEQ ID NO: 680918 - RNA, 64 nt, Homo Sapiens
aggagacauucaacaggaguaugaaaugagaguuagaccauaugggcugacaacaccauaaaua

SEQ ID NO: 680919 - RNA, 64 nt, Homo Sapiens
gauaacugagaauuuaaaaauaagaaaauacauaagaccauaacagccaacagguggcaggacc

SEQ ID NO: 680920 - RNA, 64 nt, Homo Sapiens
uauuggugagcacaauguauucauuuaauggcauagaccauaccagaccuaauuugcaaguauu

SEQ ID NO: 680921 - RNA, 64 nt, Homo Sapiens
ucuuugauguuucugaacauuguguuaagugaugagaccauauugaaacuucuaagguaucauc

SEQ ID NO: 680922 - RNA, 64 nt, Homo Sapiens
ucugacccacccagccccuggcgguuggccccccagaccauaccagccuaggcccagcuccucc

SEQ ID NO: 680923 - RNA, 64 nt, Homo Sapiens
cuuugaauuaaauuuguuuugacaaaauguuaauagaccauauucuacaaugaaauauuuuaca

SEQ ID NO: 680924 - RNA, 64 nt, Homo Sapiens
caaaaaguaaacuuucuuuagauuuucaaugcagagaccauaauauuaaagaaaaauuccuaca

SEQ ID NO: 680925 - RNA, 64 nt, Homo Sapiens
aaauuaucaaucucugcuaguaauuaugaauuuaagaccauauuauuaucaaaaaccuagagac

SEQ ID NO: 680926 - RNA, 64 nt, Homo Sapiens
cuaaguuagacucuuccccucuuggaaaucagguagaccauauuuauggacacugccuuagccu

SEQ ID NO: 680927 - RNA, 64 nt, Homo Sapiens
auaauuuuaugguaccuguuucagaucaguagggagaccauauacuuaaaugccuucuguaguu

SEQ ID NO: 680928 - RNA, 64 nt, Homo Sapiens
aguuucuccaaaaguggucauuaucaccuuugucagaccauaagaaucuggggaaauaauaaaa

SEQ ID NO: 680929 - RNA, 64 nt, Homo Sapiens
cauauuauuccugggauaaauuugguugguguagagaccauaugugagacccaccagguccagu

SEQ ID NO: 680930 - RNA, 64 nt, Homo Sapiens
aguaauuuuaaugucuuuauguugccacauguuaagaccauaauguaguuauaaauggaaaugu

SEQ ID NO: 680931 - RNA, 64 nt, Homo Sapiens
gcuucauguuuucucugacucauggaucugguagagaccauagacaugauauagacuaacuucc

SEQ ID NO: 680932 - RNA, 64 nt, Homo Sapiens
ccuuauggagcucacacuccaguggcagacaaacagaccauaaauaaggaaacgaugaaauaag

SEQ ID NO: 680933 - RNA, 60 nt, Homo Sapiens
cccaccggggugggcacuaagcuaugggagagaccauagcugcagaaaccaacccugccc

SEQ ID NO: 680934 - RNA, 64 nt, Homo Sapiens
gagccgggaggcacuccucccaaacacuccacucagaccauaaagcacuccuguuucacucugc

SEQ ID NO: 680935 - RNA, 64 nt, Homo Sapiens
guaguuauaaauggaaauguguugccacauguuaagaccauaauaguaauuuuaaugucuuuau

SEQ ID NO: 680936 - RNA, 64 nt, Homo Sapiens
ugaaagaaauaacauuuuuuuuuuuucuauuuguagaccauaucgacaaugcucauuaauauua

SEQ ID NO: 680937 - RNA, 64 nt, Homo Sapiens
ugcauguuuuuuaaccugcuuuuccccauagcacagaccauaagaaacaacaaauggggccggg

SEQ ID NO: 680938 - RNA, 64 nt, Homo Sapiens
acaguuuaaauguauaucuuuuaugucucuacucagaccauauuuuuaaaggggugccucauua

SEQ ID NO: 680939 - RNA, 64 nt, Homo Sapiens
cagaagucaauaggccuauuuauuaauauuuuacagaccauauuaccuggauuaccagggacua

SEQ ID NO: 680940 - RNA, 64 nt, Homo Sapiens
agaagauuacgacuccuagcgccuucugccccccagaccauagccccuuuuaguugguuuuagu

SEQ ID NO: 680941 - RNA, 64 nt, Homo Sapiens
uuuuucacaagggaacucauacugucuacacaucagaccauaguugcuuaggaaaccuuuaaaa

SEQ ID NO: 680942 - RNA, 64 nt, Homo Sapiens
uuccuauuauuuaucuguucuuugcuacuguuuuagaccauauuuuccauuugugguacuaaaa

SEQ ID NO: 680943 - RNA, 64 nt, Homo Sapiens
caaaaccucuccacuccacuaguuucuucaaagaagaccauauagccagggcuugcaagaagua

SEQ ID NO: 680944 - RNA, 64 nt, Homo Sapiens
uguguacuacacagaagcugcuuaguugggucucagaccauaaguuuugaaggauguagggagc

SEQ ID NO: 680945 - RNA, 64 nt, Homo Sapiens
aaaugaacugcaaacucuaaagggaauaaaguguagaccauaugcagaagccugauugguuagu

SEQ ID NO: 680946 - RNA, 64 nt, Homo Sapiens
acagugaguagccuauauguaaauuauuugagaaagaccauaacguguguguggcuuugaaaac

SEQ ID NO: 680947 - RNA, 64 nt, Homo Sapiens
ccauagguuuagggcuuuaccccuuuauagggaaagaccauauugucccucagaccugggaccu

SEQ ID NO: 680948 - RNA, 64 nt, Homo Sapiens
acauacauaaggagagaagguacagugaugaaggagaccauaauucuguaguguugaugauccu

SEQ ID NO: 680949 - RNA, 64 nt, Homo Sapiens
uuacugaagaaagcaccaagucuuaauggaacaaagaccauagaaugaauuauuuuaucuccuc

SEQ ID NO: 680950 - RNA, 64 nt, Homo Sapiens
uuuuauuugaaauuuuaagucaaguccuuuauaaagaccauagcaguggaaaacaguguacuuu

SEQ ID NO: 680951 - RNA, 64 nt, Homo Sapiens
aaccacacccaaaauggacccccacuaccuucccagaccauauaucuccccuugaucauagucc

SEQ ID NO: 680952 - RNA, 64 nt, Homo Sapiens
uaugcuauuaaaauauauuggaaaggguuuuuugagaccauaugaagccaacaguaagccccag

SEQ ID NO: 680953 - RNA, 64 nt, Homo Sapiens
aacagacaccaaaggaacaaccuguauuucugauagaccauacucuugaagcuaucauauagau

SEQ ID NO: 680954 - RNA, 64 nt, Homo Sapiens
ugaagcuguuauuuucagucaagaauccuggagcagaccauagcuacacccaaauuauugcauu

SEQ ID NO: 680955 - RNA, 64 nt, Homo Sapiens
auggcuauuagaaauccacauucuuacacaagaaagaccauauuagaaucuaaggaaaacaugc

SEQ ID NO: 680956 - RNA, 64 nt, Homo Sapiens
uuuaguuuuaagccacuaggcuuuuuaaagccaaagaccauaguagucaaaauuuuuugacuuu

SEQ ID NO: 680957 - RNA, 64 nt, Homo Sapiens
cacaaaauauuuaauguguuacacaaguguuauuagaccauagcuauacaauaauguuguugua

SEQ ID NO: 680958 - RNA, 64 nt, Homo Sapiens
uguauucacuuguguuugaugaacuaucuuuaaaagaccauaggucuaucauuauuucuuagac

SEQ ID NO: 680959 - RNA, 64 nt, Homo Sapiens
cuugagccauguuguuugaauugcugccaauagcagaccauaucccuaucauguuguuggcuca

SEQ ID NO: 680960 - RNA, 64 nt, Homo Sapiens
agacaagacucuggggaugggaaugacuuccucgagaccauacagccaggaaauagcggugaau

SEQ ID NO: 680961 - RNA, 64 nt, Homo Sapiens
uucauuaauaucagaaauuuacaauagcauuuuaagaccauaguaggauucuagcauaccgugu

SEQ ID NO: 680962 - RNA, 53 nt, Homo Sapiens
uacauaaaaaagaaacaugacucagaccauaagcuuuucaugccagaugucaa

SEQ ID NO: 680963 - RNA, 64 nt, Homo Sapiens
caaaaaaaaaaaaaguugccugggugacagagagagaccauauccacgccacugcacuccaguc

SEQ ID NO: 680964 - RNA, 64 nt, Homo Sapiens
ugggauaaaccaccauugcuaguccucaggaauuagaccauauuuaguauaggaguuggggcaa

SEQ ID NO: 680965 - RNA, 64 nt, Homo Sapiens
ggaucaaccgcaggcuuucuucagucccuuggucagaccauaaacugcauuuuugauucuuugu

SEQ ID NO: 680966 - RNA, 64 nt, Homo Sapiens
gcuagugacuugaaaagaaagagagaaggaaaagagaccauauuaaguccaugccaguugcuug

SEQ ID NO: 680967 - RNA, 64 nt, Homo Sapiens
cacauucacugucucagcuggcuguuacucucucagaccauauggcaaaguuuuccaagaaaau

SEQ ID NO: 680968 - RNA, 64 nt, Homo Sapiens
caaccaggagcuuauuauaguggggaacuucaaaagaccauaaugcagauuacuuuuucaaguu

SEQ ID NO: 680969 - RNA, 64 nt, Homo Sapiens
auagaucccccauccucucacccucuccuccaggagaccauaagaagacgccacagauuuccuu

SEQ ID NO: 680970 - RNA, 64 nt, Homo Sapiens
aacaaauggaaggauggagcagaacugugauuucagaccauauaagaaaacauguccacucugc

SEQ ID NO: 680971 - RNA, 64 nt, Homo Sapiens
uuuuauagagaaaggguuuuaacaacauaaauuuagaccauaacuauauacaguugccuuauaa

SEQ ID NO: 680972 - RNA, 64 nt, Homo Sapiens
caguccacaggcaccguuccagccucaacuggacagaccauaaacacuuuacuuggguuuacca

SEQ ID NO: 680973 - RNA, 64 nt, Homo Sapiens
caacucaggaagcauuugacucguuguacuucagagaccauaaaugacaagguuuugacauuuu

SEQ ID NO: 680974 - RNA, 64 nt, Homo Sapiens
uccucuaguaucaaaauugguguguguucacaauagaccauaacaugugaggcuacuucuaaga

SEQ ID NO: 680975 - RNA, 64 nt, Homo Sapiens
uaauauuguuuaaauucuaggucaaagcaauuagagaccauacccccuaaugacaucaccaaca

SEQ ID NO: 680976 - RNA, 64 nt, Homo Sapiens
gcuguuuugugugcucucuugcuaaagaccgcagagaccauaccuguugucaaagaggguguaa

SEQ ID NO: 680977 - RNA, 64 nt, Homo Sapiens
caguaucuagucguggauauaauuaaaacgcugaagaccauaaccuuuugggucaacuguuggu

SEQ ID NO: 680978 - RNA, 64 nt, Homo Sapiens
aaaaaagaaaagaaaaagaaaugaauggguucaaagaccauaaucaugcauaucacauaagacc

SEQ ID NO: 680979 - RNA, 64 nt, Homo Sapiens
aguuuccaauaugugaauacagggaagcaccaacagaccauaucaguaacuucgagugaguuuc

SEQ ID NO: 680980 - RNA, 64 nt, Homo Sapiens
cggaccccucguccucccccggaggguggggcacagaccauagagagugcuccccagaaccaga

SEQ ID NO: 680981 - RNA, 64 nt, Homo Sapiens
ggacagaaacuuuacuaaugaauaaccguuagcuagaccauagauuaguuuuuguucaaggcuu

SEQ ID NO: 680982 - RNA, 64 nt, Homo Sapiens
ugacccaucuggcauugccauuccuguuuggauuagaccauaguaaaugauaaaagggugaggg

SEQ ID NO: 680983 - RNA, 64 nt, Homo Sapiens
gaaaaacaacagccauaaugugagaggccaugugagaccauaugccaucagugucguccccugc

SEQ ID NO: 680984 - RNA, 64 nt, Homo Sapiens
uucugcguguauguguuugcacaugaguguuuguagaccauagaccauuaaaaaauacggaauu

SEQ ID NO: 680985 - RNA, 64 nt, Homo Sapiens
gugccugccuugcauuuuccuucuggugcugugaagaccauaggcuggcaggcagcugagauga

SEQ ID NO: 680986 - RNA, 64 nt, Homo Sapiens
aauguguuuuccugagaguuacagguguuuccagagaccauagaugaccaccugggugccaguu

SEQ ID NO: 680987 - RNA, 64 nt, Homo Sapiens
accccugacccaugagaagacauuaaaguucaggagaccauaggucccaggugauucacagcca

SEQ ID NO: 680988 - RNA, 64 nt, Homo Sapiens
ggccagagagggaaaaggcaggugcuuuuggcagagaccauaagagaaaccugccaaggagcau

SEQ ID NO: 680989 - RNA, 64 nt, Homo Sapiens
ggguccacccacagagcacuacagagccucugaaagaccauagcaccaagcgagccccuucaga

SEQ ID NO: 680990 - RNA, 64 nt, Homo Sapiens
ugucuuuugcuauauucuccaagauuaucucuuaagaccauaugcccccuguuuuaauguuucu

SEQ ID NO: 680991 - RNA, 64 nt, Homo Sapiens
uugggcagcugaacuuuucugcuuuccucaaaucagaccauaugagaggauauauucuaugcau

SEQ ID NO: 680992 - RNA, 64 nt, Homo Sapiens
uuagccccacucacccucuucaaacagaguggagagaccauauuccuaugggcucaugguuuga

SEQ ID NO: 680993 - RNA, 64 nt, Homo Sapiens
cuuggagguagaaacaaaccgaguauuuuuuugaagaccauaugggaaaauucaaguuacagug

SEQ ID NO: 680994 - RNA, 64 nt, Homo Sapiens
uaauaaccaaacauaacauuaccuuuggauacgaagaccauacaacaaacucaaguuaugucau

SEQ ID NO: 680995 - RNA, 64 nt, Homo Sapiens
agaagucauuuugauuuucaagucuucuuuuuucagaccauacacacagguaagugaaugccaa

SEQ ID NO: 680996 - RNA, 64 nt, Homo Sapiens
uugagaacccaugggcuagccuccaggggucuucagaccauacugaaaagggucucagggacuc

SEQ ID NO: 680997 - RNA, 64 nt, Homo Sapiens
uuauuguuuugauguaauggaacuuaaggauaaaagaccauaauauuugcuguuaaaauaaaua

SEQ ID NO: 680998 - RNA, 64 nt, Homo Sapiens
caagccauuuaaaaaauauuuauauauacauaguagcaaauaguuuuauagauuuauuuguauc

SEQ ID NO: 680999 - RNA, 64 nt, Homo Sapiens
uaaaagugauuuuagcccuaggcccgaaaugacuagcaaauaucauuuucuguaugaauugugg

SEQ ID NO: 681000 - RNA, 64 nt, Homo Sapiens
caauuuuccuaaguuucuuugaggguuccaugggagcaaauaucuaaauaauggccugguaggu

SEQ ID NO: 681001 - RNA, 64 nt, Homo Sapiens
acugacagccuccaccuugagcacuauucuaaggagcaaauaccuuagcucccuugagcugguu

SEQ ID NO: 681002 - RNA, 64 nt, Homo Sapiens
uauuauucuccuaaacgaauaaagcauacuauaaagcaaauaucgcaaauauuuuaugccaaga

SEQ ID NO: 681003 - RNA, 64 nt, Homo Sapiens
uuaugccaagaaaagcauacguaacuuuaugucuagcaaauauucuagguuccugcacuuuuug

SEQ ID NO: 681004 - RNA, 64 nt, Homo Sapiens
guuaaaaguuucaucagaaacuuuacauaucuuuagcaaauauauuuuuauauguguauggcau

SEQ ID NO: 681005 - RNA, 64 nt, Homo Sapiens
cuuaaaaauaaaauaacugaaagaaauagaauucagcaaauaguuauuuuuugcacuugaacug

SEQ ID NO: 681006 - RNA, 64 nt, Homo Sapiens
aauaaaagacaaaaggacauaaagucaaguugugagcaaauagaacacggaaaaccuuuauuuu

SEQ ID NO: 681007 - RNA, 64 nt, Homo Sapiens
cuauaauagauccacguuacuaaccaguauaauaagcaaauacaguauguuuauuuguuaaucc

SEQ ID NO: 681008 - RNA, 64 nt, Homo Sapiens
gucaaggcugcaaucacuuuaauaguuucuuuuuagcaaauaaauguucauugaugaagugccu

SEQ ID NO: 681009 - RNA, 64 nt, Homo Sapiens
uuacguucuauaaagucacugcgaacacugaauuagcaaauauagaaccuaggggaaauacaag

SEQ ID NO: 681010 - RNA, 64 nt, Homo Sapiens
uccuuuucuucaguuccucagcuccucucauuucagcaaauauccauuuucaaggugcagaaca

SEQ ID NO: 681011 - RNA, 64 nt, Homo Sapiens
acuucaugcaauguacuuguucuaagcaaauuaaagcaaauauuuauuuaacauuguuacugag

SEQ ID NO: 681012 - RNA, 64 nt, Homo Sapiens
uauuaaaacaauaaugcaauuagaauuugggagaagcaaauauagguccuguguuaaacacuac

SEQ ID NO: 681013 - RNA, 64 nt, Homo Sapiens
caaucaccaccagguaucaaaucaacuuuuaugcagcaaauauaugauucuagugucugacuuu

SEQ ID NO: 681014 - RNA, 64 nt, Homo Sapiens
ucaucucugucacauuagacuauccaucaugaccagcaaauacucauuuuaggaaaaaaaaaag

SEQ ID NO: 681015 - RNA, 64 nt, Homo Sapiens
acccuccuagcuuuccauuugguuuagaacauaaagcaaauagacacagucauacugucacugc

SEQ ID NO: 681016 - RNA, 64 nt, Homo Sapiens
uuaaagguaaaauccaucugaucuagaagucacaagcaaauaucuuaguuuaaauccaacagaa

SEQ ID NO: 681017 - RNA, 64 nt, Homo Sapiens
uucaucacugucaggcugccucauuaguuaacaaagcaaauaugaagauccaacagugcacuca

SEQ ID NO: 681018 - RNA, 64 nt, Homo Sapiens
gcagcguuauguggaucauuuguaggcuaaacuaagcaaauaaucuaugaauagcacuuuauga

SEQ ID NO: 681019 - RNA, 64 nt, Homo Sapiens
auggagaacuucaguguuuacccucaacucaaguagcaaauaucagcauuaaauuagcuuuuua

SEQ ID NO: 681020 - RNA, 64 nt, Homo Sapiens
cugaaaaagcccauuuuagaaccuguuuaauaagagcaaauauaggggaaaaucuuugaaauga

SEQ ID NO: 681021 - RNA, 64 nt, Homo Sapiens
aaauacaugugagaagaaaaaaauggauuuuuuuagcaaauaauuaacuaagcuucuaaaugcc

SEQ ID NO: 681022 - RNA, 64 nt, Homo Sapiens
acucauuuugcauuuaaaaggaauaaaaaggacuagcaaauaaaugugcuuuuaacauauuuga

SEQ ID NO: 681023 - RNA, 64 nt, Homo Sapiens
acucacucauuucuuggggugcauaagauauaaaagcaaauaugugagacugaauucuugcaau

SEQ ID NO: 681024 - RNA, 64 nt, Homo Sapiens
uuauuaagauggguuggaggaaaaggcugaagagagcaaauauaugaugagaguacuaacugga

SEQ ID NO: 681025 - RNA, 56 nt, Homo Sapiens
auuauaugaaaguccucugcgaggagagcaaauaucuuggagccuucuuacuauag

SEQ ID NO: 681026 - RNA, 64 nt, Homo Sapiens
cagcauuaaauauugcauuuaaaaauuauacuguagcaaauacauuuaaaaauuaaucacaacg

SEQ ID NO: 681027 - RNA, 64 nt, Homo Sapiens
uccuuguuuuguugauuagaacaacacagaaaaaagcaaauauaaauuuuuaaugacuccauuu

SEQ ID NO: 681028 - RNA, 64 nt, Homo Sapiens
agaaaggugcaggagguaccuuaacucaccccucagcaaauaccuaugucaacaguauaaguua

SEQ ID NO: 681029 - RNA, 64 nt, Homo Sapiens
uuguauuucuagcauuacuagauauuaaaaguuaagcaaauagauuaaugacguauacauaggc

SEQ ID NO: 681030 - RNA, 64 nt, Homo Sapiens; identical to SEQ ID NO: 603880

SEQ ID NO: 681031 - RNA, 64 nt, Homo Sapiens; identical to SEQ ID NO: 603881

SEQ ID NO: 681032 - RNA, 64 nt, Homo Sapiens; identical to SEQ ID NO: 603882

SEQ ID NO: 681033 - RNA, 64 nt, Homo Sapiens; identical to SEQ ID NO: 603883

SEQ ID NO: 681034 - RNA, 64 nt, Homo Sapiens; identical to SEQ ID NO: 603884

SEQ ID NO: 681035 - RNA, 64 nt, Homo Sapiens; identical to SEQ ID NO: 603885

SEQ ID NO: 681036 - RNA, 64 nt, Homo Sapiens; identical to SEQ ID NO: 603886

SEQ ID NO: 681037 - RNA, 64 nt, Homo Sapiens; identical to SEQ ID NO: 603887

SEQ ID NO: 681038 - RNA, 64 nt, Homo Sapiens; identical to SEQ ID NO: 603888

SEQ ID NO: 681039 - RNA, 64 nt, Homo Sapiens; identical to SEQ ID NO: 603889

SEQ ID NO: 681040 - RNA, 64 nt, Homo Sapiens; identical to SEQ ID NO: 603890

SEQ ID NO: 681041 - RNA, 64 nt, Homo Sapiens; identical to SEQ ID NO: 603891

SEQ ID NO: 681042 - RNA, 64 nt, Homo Sapiens; identical to SEQ ID NO: 603892

SEQ ID NO: 681043 - RNA, 64 nt, Homo Sapiens; identical to SEQ ID NO: 603893

SEQ ID NO: 681044 - RNA, 64 nt, Homo Sapiens; identical to SEQ ID NO: 603894

SEQ ID NO: 681045 - RNA, 64 nt, Homo Sapiens; identical to SEQ ID NO: 603895

SEQ ID NO: 681046 - RNA, 64 nt, Homo Sapiens; identical to SEQ ID NO: 603896

SEQ ID NO: 681047 - RNA, 64 nt, Homo Sapiens; identical to SEQ ID NO: 603897

SEQ ID NO: 681048 - RNA, 64 nt, Homo Sapiens; identical to SEQ ID NO: 603898

SEQ ID NO: 681049 - RNA, 64 nt, Homo Sapiens; identical to SEQ ID NO: 603899

SEQ ID NO: 681050 - RNA, 64 nt, Homo Sapiens; identical to SEQ ID NO: 603900

SEQ ID NO: 681051 - RNA, 64 nt, Homo Sapiens; identical to SEQ ID NO: 603901

SEQ ID NO: 681052 - RNA, 64 nt, Homo Sapiens; identical to SEQ ID NO: 603902

SEQ ID NO: 681053 - RNA, 64 nt, Homo Sapiens; identical to SEQ ID NO: 603903

SEQ ID NO: 681054 - RNA, 64 nt, Homo Sapiens; identical to SEQ ID NO: 603904

SEQ ID NO: 681055 - RNA, 64 nt, Homo Sapiens; identical to SEQ ID NO: 603905

SEQ ID NO: 681056 - RNA, 64 nt, Homo Sapiens; identical to SEQ ID NO: 603906

SEQ ID NO: 681057 - RNA, 64 nt, Homo Sapiens; identical to SEQ ID NO: 603907

SEQ ID NO: 681058 - RNA, 64 nt, Homo Sapiens; identical to SEQ ID NO: 603908

SEQ ID NO: 681059 - RNA, 64 nt, Homo Sapiens; identical to SEQ ID NO: 603909

SEQ ID NO: 681060 - RNA, 64 nt, Homo Sapiens; identical to SEQ ID NO: 603910

SEQ ID NO: 681061 - RNA, 64 nt, Homo Sapiens; identical to SEQ ID NO: 603911

SEQ ID NO: 681062 - RNA, 64 nt, Homo Sapiens; identical to SEQ ID NO: 603912

SEQ ID NO: 681063 - RNA, 64 nt, Homo Sapiens; identical to SEQ ID NO: 603913

SEQ ID NO: 681064 - RNA, 64 nt, Homo Sapiens; identical to SEQ ID NO: 603914

SEQ ID NO: 681065 - RNA, 64 nt, Homo Sapiens; identical to SEQ ID NO: 83782

SEQ ID NO: 681066 - RNA, 64 nt, Homo Sapiens; identical to SEQ ID NO: 83783

SEQ ID NO: 681067 - RNA, 64 nt, Homo Sapiens; identical to SEQ ID NO: 83784

SEQ ID NO: 681068 - RNA, 64 nt, Homo Sapiens; identical to SEQ ID NO: 83785

SEQ ID NO: 681069 - RNA, 64 nt, Homo Sapiens; identical to SEQ ID NO: 83786

SEQ ID NO: 681070 - RNA, 64 nt, Homo Sapiens; identical to SEQ ID NO: 83787

SEQ ID NO: 681071 - RNA, 64 nt, Homo Sapiens; identical to SEQ ID NO: 83788

SEQ ID NO: 681072 - RNA, 64 nt, Homo Sapiens; identical to SEQ ID NO: 83789

SEQ ID NO: 681073 - RNA, 64 nt, Homo Sapiens; identical to SEQ ID NO: 83790

SEQ ID NO: 681074 - RNA, 64 nt, Homo Sapiens; identical to SEQ ID NO: 83791

SEQ ID NO: 681075 - RNA, 64 nt, Homo Sapiens; identical to SEQ ID NO: 83792

SEQ ID NO: 681076 - RNA, 64 nt, Homo Sapiens; identical to SEQ ID NO: 83793

SEQ ID NO: 681077 - RNA, 64 nt, Homo Sapiens; identical to SEQ ID NO: 83794

SEQ ID NO: 681078 - RNA, 64 nt, Homo Sapiens; identical to SEQ ID NO: 83795

SEQ ID NO: 681079 - RNA, 64 nt, Homo Sapiens; identical to SEQ ID NO: 83796

SEQ ID NO: 681080 - RNA, 64 nt, Homo Sapiens; identical to SEQ ID NO: 83797

SEQ ID NO: 681081 - RNA, 64 nt, Homo Sapiens; identical to SEQ ID NO: 83798

SEQ ID NO: 681082 - RNA, 64 nt, Homo Sapiens; identical to SEQ ID NO: 83799

SEQ ID NO: 681083 - RNA, 64 nt, Homo Sapiens; identical to SEQ ID NO: 83800

SEQ ID NO: 681084 - RNA, 64 nt, Homo Sapiens; identical to SEQ ID NO: 83801

SEQ ID NO: 681085 - RNA, 64 nt, Homo Sapiens; identical to SEQ ID NO: 83802

SEQ ID NO: 681086 - RNA, 64 nt, Homo Sapiens; identical to SEQ ID NO: 83803

SEQ ID NO: 681087 - RNA, 64 nt, Homo Sapiens; identical to SEQ ID NO: 83804

SEQ ID NO: 681088 - RNA, 64 nt, Homo Sapiens; identical to SEQ ID NO: 83805

SEQ ID NO: 681089 - RNA, 64 nt, Homo Sapiens; identical to SEQ ID NO: 83806

SEQ ID NO: 681090 - RNA, 64 nt, Homo Sapiens; identical to SEQ ID NO: 83807

SEQ ID NO: 681091 - RNA, 64 nt, Homo Sapiens; identical to SEQ ID NO: 83808

SEQ ID NO: 681092 - RNA, 64 nt, Homo Sapiens; identical to SEQ ID NO: 83809

SEQ ID NO: 681093 - RNA, 64 nt, Homo Sapiens; identical to SEQ ID NO: 83810

SEQ ID NO: 681094 - RNA, 64 nt, Homo Sapiens; identical to SEQ ID NO: 83811

SEQ ID NO: 681095 - RNA, 64 nt, Homo Sapiens; identical to SEQ ID NO: 83812

SEQ ID NO: 681096 - RNA, 64 nt, Homo Sapiens; identical to SEQ ID NO: 83813

SEQ ID NO: 681097 - RNA, 64 nt, Homo Sapiens; identical to SEQ ID NO: 223145

SEQ ID NO: 681098 - RNA, 64 nt, Homo Sapiens; identical to SEQ ID NO: 223146

SEQ ID NO: 681099 - RNA, 64 nt, Homo Sapiens; identical to SEQ ID NO: 223147

SEQ ID NO: 681100 - RNA, 64 nt, Homo Sapiens; identical to SEQ ID NO: 223148

SEQ ID NO: 681101 - RNA, 64 nt, Homo Sapiens; identical to SEQ ID NO: 223149

SEQ ID NO: 681102 - RNA, 64 nt, Homo Sapiens; identical to SEQ ID NO: 223150

SEQ ID NO: 681103 - RNA, 64 nt, Homo Sapiens; identical to SEQ ID NO: 223151

SEQ ID NO: 681104 - RNA, 64 nt, Homo Sapiens; identical to SEQ ID NO: 223152

SEQ ID NO: 681105 - RNA, 64 nt, Homo Sapiens; identical to SEQ ID NO: 223153

SEQ ID NO: 681106 - RNA, 64 nt, Homo Sapiens; identical to SEQ ID NO: 223154

SEQ ID NO: 681107 - RNA, 64 nt, Homo Sapiens; identical to SEQ ID NO: 223155

SEQ ID NO: 681108 - RNA, 64 nt, Homo Sapiens; identical to SEQ ID NO: 223156

SEQ ID NO: 681109 - RNA, 64 nt, Homo Sapiens; identical to SEQ ID NO: 223157

SEQ ID NO: 681110 - RNA, 64 nt, Homo Sapiens; identical to SEQ ID NO: 223158

SEQ ID NO: 681111 - RNA, 64 nt, Homo Sapiens; identical to SEQ ID NO: 223159

SEQ ID NO: 681112 - RNA, 64 nt, Homo Sapiens; identical to SEQ ID NO: 223160

SEQ ID NO: 681113 - RNA, 64 nt, Homo Sapiens; identical to SEQ ID NO: 223161

SEQ ID NO: 681114 - RNA, 64 nt, Homo Sapiens; identical to SEQ ID NO: 223162

SEQ ID NO: 681115 - RNA, 64 nt, Homo Sapiens; identical to SEQ ID NO: 223163

SEQ ID NO: 681116 - RNA, 64 nt, Homo Sapiens; identical to SEQ ID NO: 223164

SEQ ID NO: 681117 - RNA, 64 nt, Homo Sapiens; identical to SEQ ID NO: 223165

SEQ ID NO: 681118 - RNA, 64 nt, Homo Sapiens; identical to SEQ ID NO: 223166

SEQ ID NO: 681119 - RNA, 64 nt, Homo Sapiens; identical to SEQ ID NO: 223167

SEQ ID NO: 681120 - RNA, 64 nt, Homo Sapiens; identical to SEQ ID NO: 223168

SEQ ID NO: 681121 - RNA, 64 nt, Homo Sapiens; identical to SEQ ID NO: 223169

SEQ ID NO: 681122 - RNA, 64 nt, Homo Sapiens; identical to SEQ ID NO: 223170

SEQ ID NO: 681123 - RNA, 64 nt, Homo Sapiens; identical to SEQ ID NO: 223171

SEQ ID NO: 681124 - RNA, 64 nt, Homo Sapiens; identical to SEQ ID NO: 223172

SEQ ID NO: 681125 - RNA, 64 nt, Homo Sapiens; identical to SEQ ID NO: 223173

SEQ ID NO: 681126 - RNA, 64 nt, Homo Sapiens; identical to SEQ ID NO: 223174

SEQ ID NO: 681127 - RNA, 64 nt, Homo Sapiens; identical to SEQ ID NO: 223175

SEQ ID NO: 681128 - RNA, 64 nt, Homo Sapiens; identical to SEQ ID NO: 223176

SEQ ID NO: 681129 - RNA, 64 nt, Homo Sapiens; identical to SEQ ID NO: 223177

SEQ ID NO: 681130 - RNA, 64 nt, Homo Sapiens; identical to SEQ ID NO: 223178

SEQ ID NO: 681131 - RNA, 64 nt, Homo Sapiens; identical to SEQ ID NO: 223179

SEQ ID NO: 681132 - RNA, 64 nt, Homo Sapiens; identical to SEQ ID NO: 223180

SEQ ID NO: 681133 - RNA, 64 nt, Homo Sapiens; identical to SEQ ID NO: 223181

SEQ ID NO: 681134 - RNA, 64 nt, Homo Sapiens; identical to SEQ ID NO: 223182

SEQ ID NO: 681135 - RNA, 64 nt, Homo Sapiens; identical to SEQ ID NO: 223183

SEQ ID NO: 681136 - RNA, 64 nt, Homo Sapiens; identical to SEQ ID NO: 223184

SEQ ID NO: 681137 - RNA, 64 nt, Homo Sapiens; identical to SEQ ID NO: 223185

SEQ ID NO: 681138 - RNA, 64 nt, Homo Sapiens; identical to SEQ ID NO: 223186

SEQ ID NO: 681139 - RNA, 64 nt, Homo Sapiens; identical to SEQ ID NO: 223187

SEQ ID NO: 681140 - RNA, 64 nt, Homo Sapiens; identical to SEQ ID NO: 223188

SEQ ID NO: 681141 - RNA, 64 nt, Homo Sapiens; identical to SEQ ID NO: 223189

SEQ ID NO: 681142 - RNA, 64 nt, Homo Sapiens; identical to SEQ ID NO: 223190

SEQ ID NO: 681143 - RNA, 64 nt, Homo Sapiens; identical to SEQ ID NO: 223191

SEQ ID NO: 681144 - RNA, 64 nt, Homo Sapiens; identical to SEQ ID NO: 223192

SEQ ID NO: 681145 - RNA, 64 nt, Homo Sapiens; identical to SEQ ID NO: 223193

SEQ ID NO: 681146 - RNA, 64 nt, Homo Sapiens; identical to SEQ ID NO: 223194

SEQ ID NO: 681147 - RNA, 64 nt, Homo Sapiens; identical to SEQ ID NO: 223195

SEQ ID NO: 681148 - RNA, 57 nt, Homo Sapiens; identical to SEQ ID NO: 223196

SEQ ID NO: 681149 - RNA, 64 nt, Homo Sapiens; identical to SEQ ID NO: 223197

SEQ ID NO: 681150 - RNA, 54 nt, Homo Sapiens; identical to SEQ ID NO: 223198

SEQ ID NO: 681151 - RNA, 64 nt, Homo Sapiens
aagugcugcucugcucugcccacccuggguucugcauuccuaugggugacccaauuauucagac

SEQ ID NO: 681152 - RNA, 64 nt, Homo Sapiens
cuauauuuuugucuucuuccuuuccccucuuugccauuccuaccuugcauuuuuccugucagug

SEQ ID NO: 681153 - RNA, 64 nt, Homo Sapiens
gaacagagugaggacaggcugguaauagccguggcauuccuacacucuguuagucauuauguug

SEQ ID NO: 681154 - RNA, 64 nt, Homo Sapiens
ugucaucagaugaccuugacaggaaugaguauuccauuccuaggaaucacggguaaggaggauu

SEQ ID NO: 681155 - RNA, 64 nt, Homo Sapiens
cgagaguaucacagccaggaugacccuugggucccauuccuaagacaugguuacuuuauuuucc

SEQ ID NO: 681156 - RNA, 64 nt, Homo Sapiens
aggguggggcacccuuuucucgccgcaagaagcccauuccuauggaagucuagcaaagcaauac

SEQ ID NO: 681157 - RNA, 64 nt, Homo Sapiens
cuuggucucuauagcaguguuauguggcccaagucauuccuaaucuccccauuccuacaauuuc

SEQ ID NO: 681158 - RNA, 64 nt, Homo Sapiens
auuucuauguggcccaagucggucuuuuccuccccauuccuacaccagugggucugguggugcu

SEQ ID NO: 681159 - RNA, 64 nt, Homo Sapiens; identical to SEQ ID NO: 197404

SEQ ID NO: 681160 - RNA, 64 nt, Homo Sapiens; identical to SEQ ID NO: 197405

SEQ ID NO: 681161 - RNA, 64 nt, Homo Sapiens; identical to SEQ ID NO: 197469

SEQ ID NO: 681162 - RNA, 64 nt, Homo Sapiens; identical to SEQ ID NO: 197470

SEQ ID NO: 681163 - RNA, 64 nt, Homo Sapiens; identical to SEQ ID NO: 197517

SEQ ID NO: 681164 - RNA, 64 nt, Homo Sapiens; identical to SEQ ID NO: 197518

SEQ ID NO: 681165 - RNA, 64 nt, Homo Sapiens; identical to SEQ ID NO: 197519

SEQ ID NO: 681166 - RNA, 64 nt, Homo Sapiens; identical to SEQ ID NO: 197520

SEQ ID NO: 681167 - RNA, 64 nt, Homo Sapiens; identical to SEQ ID NO: 197521

SEQ ID NO: 681168 - RNA, 64 nt, Homo Sapiens; identical to SEQ ID NO: 197543

SEQ ID NO: 681169 - RNA, 64 nt, Homo Sapiens; identical to SEQ ID NO: 197544

SEQ ID NO: 681170 - RNA, 64 nt, Homo Sapiens; identical to SEQ ID NO: 54817

SEQ ID NO: 681171 - RNA, 64 nt, Homo Sapiens; identical to SEQ ID NO: 54818

SEQ ID NO: 681172 - RNA, 64 nt, Homo Sapiens; identical to SEQ ID NO: 54819

SEQ ID NO: 681173 - RNA, 64 nt, Homo Sapiens; identical to SEQ ID NO: 54820

SEQ ID NO: 681174 - RNA, 64 nt, Homo Sapiens; identical to SEQ ID NO: 54821

SEQ ID NO: 681175 - RNA, 64 nt, Homo Sapiens; identical to SEQ ID NO: 54822

SEQ ID NO: 681176 - RNA, 64 nt, Homo Sapiens; identical to SEQ ID NO: 54823

SEQ ID NO: 681177 - RNA, 64 nt, Homo Sapiens; identical to SEQ ID NO: 54824

SEQ ID NO: 681178 - RNA, 64 nt, Homo Sapiens; identical to SEQ ID NO: 54825

SEQ ID NO: 681179 - RNA, 64 nt, Homo Sapiens; identical to SEQ ID NO: 54826

SEQ ID NO: 681180 - RNA, 64 nt, Homo Sapiens; identical to SEQ ID NO: 54827

SEQ ID NO: 681181 - RNA, 64 nt, Homo Sapiens; identical to SEQ ID NO: 54828

SEQ ID NO: 681182 - RNA, 64 nt, Homo Sapiens; identical to SEQ ID NO: 54829

SEQ ID NO: 681183 - RNA, 64 nt, Homo Sapiens; identical to SEQ ID NO: 54830

SEQ ID NO: 681184 - RNA, 64 nt, Homo Sapiens; identical to SEQ ID NO: 54831

SEQ ID NO: 681185 - RNA, 64 nt, Homo Sapiens; identical to SEQ ID NO: 54832

SEQ ID NO: 681186 - RNA, 64 nt, Homo Sapiens; identical to SEQ ID NO: 54833

SEQ ID NO: 681187 - RNA, 64 nt, Homo Sapiens; identical to SEQ ID NO: 54834

SEQ ID NO: 681188 - RNA, 64 nt, Homo Sapiens; identical to SEQ ID NO: 54835

SEQ ID NO: 681189 - RNA, 64 nt, Homo Sapiens; identical to SEQ ID NO: 54836

SEQ ID NO: 681190 - RNA, 64 nt, Homo Sapiens; identical to SEQ ID NO: 54837

SEQ ID NO: 681191 - RNA, 64 nt, Homo Sapiens; identical to SEQ ID NO: 54838

SEQ ID NO: 681192 - RNA, 64 nt, Homo Sapiens; identical to SEQ ID NO: 54839

SEQ ID NO: 681193 - RNA, 64 nt, Homo Sapiens; identical to SEQ ID NO: 54840

SEQ ID NO: 681194 - RNA, 64 nt, Homo Sapiens; identical to SEQ ID NO: 54841

SEQ ID NO: 681195 - RNA, 64 nt, Homo Sapiens; identical to SEQ ID NO: 54842

SEQ ID NO: 681196 - RNA, 64 nt, Homo Sapiens; identical to SEQ ID NO: 54843

SEQ ID NO: 681197 - RNA, 64 nt, Homo Sapiens; identical to SEQ ID NO: 54844

SEQ ID NO: 681198 - RNA, 64 nt, Homo Sapiens; identical to SEQ ID NO: 54845

SEQ ID NO: 681199 - RNA, 64 nt, Homo Sapiens; identical to SEQ ID NO: 54846

SEQ ID NO: 681200 - RNA, 64 nt, Homo Sapiens; identical to SEQ ID NO: 54847

SEQ ID NO: 681201 - RNA, 64 nt, Homo Sapiens; identical to SEQ ID NO: 54848

SEQ ID NO: 681202 - RNA, 64 nt, Homo Sapiens; identical to SEQ ID NO: 54849

SEQ ID NO: 681203 - RNA, 64 nt, Homo Sapiens; identical to SEQ ID NO: 54850

SEQ ID NO: 681204 - RNA, 64 nt, Homo Sapiens; identical to SEQ ID NO: 54851

SEQ ID NO: 681205 - RNA, 64 nt, Homo Sapiens; identical to SEQ ID NO: 54852

SEQ ID NO: 681206 - RNA, 64 nt, Homo Sapiens; identical to SEQ ID NO: 54853

SEQ ID NO: 681207 - RNA, 64 nt, Homo Sapiens; identical to SEQ ID NO: 54854

SEQ ID NO: 681208 - RNA, 64 nt, Homo Sapiens; identical to SEQ ID NO: 54855

SEQ ID NO: 681209 - RNA, 64 nt, Homo Sapiens; identical to SEQ ID NO: 54856

SEQ ID NO: 681210 - RNA, 64 nt, Homo Sapiens; identical to SEQ ID NO: 54857

SEQ ID NO: 681211 - RNA, 64 nt, Homo Sapiens; identical to SEQ ID NO: 54858

SEQ ID NO: 681212 - RNA, 64 nt, Homo Sapiens; identical to SEQ ID NO: 54859

SEQ ID NO: 681213 - RNA, 64 nt, Homo Sapiens; identical to SEQ ID NO: 54860

SEQ ID NO: 681214 - RNA, 64 nt, Homo Sapiens; identical to SEQ ID NO: 54861

SEQ ID NO: 681215 - RNA, 64 nt, Homo Sapiens; identical to SEQ ID NO: 54862

SEQ ID NO: 681216 - RNA, 64 nt, Homo Sapiens; identical to SEQ ID NO: 54863

SEQ ID NO: 681217 - RNA, 64 nt, Homo Sapiens; identical to SEQ ID NO: 54864

SEQ ID NO: 681218 - RNA, 64 nt, Homo Sapiens; identical to SEQ ID NO: 54865

SEQ ID NO: 681219 - RNA, 64 nt, Homo Sapiens; identical to SEQ ID NO: 54866

SEQ ID NO: 681220 - RNA, 64 nt, Homo Sapiens; identical to SEQ ID NO: 54867

SEQ ID NO: 681221 - RNA, 64 nt, Homo Sapiens; identical to SEQ ID NO: 54868

SEQ ID NO: 681222 - RNA, 64 nt, Homo Sapiens; identical to SEQ ID NO: 54869

SEQ ID NO: 681223 - RNA, 64 nt, Homo Sapiens; identical to SEQ ID NO: 54870

SEQ ID NO: 681224 - RNA, 64 nt, Homo Sapiens; identical to SEQ ID NO: 54871

SEQ ID NO: 681225 - RNA, 64 nt, Homo Sapiens; identical to SEQ ID NO: 54872

SEQ ID NO: 681226 - RNA, 64 nt, Homo Sapiens; identical to SEQ ID NO: 54870

SEQ ID NO: 681227 - RNA, 64 nt, Homo Sapiens; identical to SEQ ID NO: 54871

SEQ ID NO: 681228 - RNA, 64 nt, Homo Sapiens; identical to SEQ ID NO: 54872

SEQ ID NO: 681229 - RNA, 64 nt, Homo Sapiens; identical to SEQ ID NO: 54870

SEQ ID NO: 681230 - RNA, 64 nt, Homo Sapiens; identical to SEQ ID NO: 54877

SEQ ID NO: 681231 - RNA, 64 nt, Homo Sapiens; identical to SEQ ID NO: 54878

SEQ ID NO: 681232 - RNA, 64 nt, Homo Sapiens; identical to SEQ ID NO: 54879

SEQ ID NO: 681233 - RNA, 64 nt, Homo Sapiens; identical to SEQ ID NO: 54880

SEQ ID NO: 681234 - RNA, 64 nt, Homo Sapiens; identical to SEQ ID NO: 54881

SEQ ID NO: 681235 - RNA, 64 nt, Homo Sapiens; identical to SEQ ID NO: 54882

SEQ ID NO: 681236 - RNA, 64 nt, Homo Sapiens; identical to SEQ ID NO: 54883

SEQ ID NO: 681237 - RNA, 64 nt, Homo Sapiens; identical to SEQ ID NO: 54884

SEQ ID NO: 681238 - RNA, 64 nt, Homo Sapiens; identical to SEQ ID NO: 54885

SEQ ID NO: 681239 - RNA, 64 nt, Homo Sapiens; identical to SEQ ID NO: 54886

SEQ ID NO: 681240 - RNA, 64 nt, Homo Sapiens; identical to SEQ ID NO: 54887

SEQ ID NO: 681241 - RNA, 64 nt, Homo Sapiens; identical to SEQ ID NO: 54888

SEQ ID NO: 681242 - RNA, 64 nt, Homo Sapiens; identical to SEQ ID NO: 54889

SEQ ID NO: 681243 - RNA, 64 nt, Homo Sapiens; identical to SEQ ID NO: 54890

SEQ ID NO: 681244 - RNA, 64 nt, Homo Sapiens; identical to SEQ ID NO: 54891

SEQ ID NO: 681245 - RNA, 64 nt, Homo Sapiens; identical to SEQ ID NO: 54892

SEQ ID NO: 681246 - RNA, 64 nt, Homo Sapiens; identical to SEQ ID NO: 54893

SEQ ID NO: 681247 - RNA, 64 nt, Homo Sapiens; identical to SEQ ID NO: 54894

SEQ ID NO: 681248 - RNA, 64 nt, Homo Sapiens; identical to SEQ ID NO: 54895

SEQ ID NO: 681249 - RNA, 64 nt, Homo Sapiens; identical to SEQ ID NO: 54896

SEQ ID NO: 681250 - RNA, 64 nt, Homo Sapiens
cuugaucucagagguguuuaaauccuagcucucacugugggauugcaaucucuggauaccuuca

SEQ ID NO: 681251 - RNA, 64 nt, Homo Sapiens
acagaugagucuuucagaggccaagcuccucuggcugugggaccggguuuaauaacaugagucc

SEQ ID NO: 681252 - RNA, 64 nt, Homo Sapiens
caaagccuauuuugcugagucaaaaggauggaaacugugggagucuuacuuccuuauuuaucug

SEQ ID NO: 681253 - RNA, 64 nt, Homo Sapiens
cuuggaagcagcuugaguguaaaucuggauaaagcugugggauucauggauugcccaacuuucc

SEQ ID NO: 681254 - RNA, 64 nt, Homo Sapiens
agaaaccucuugccuccagauuuggguggagccucugugggaaccauaggaagugugugggcug

SEQ ID NO: 681255 - RNA, 64 nt, Homo Sapiens
aguucugguggggucacccucccuguccucccgccugugggagggagggagggcuggcucaggc

SEQ ID NO: 681256 - RNA, 64 nt, Homo Sapiens
aaauaggccuggacuauuuaaggagugagugucacugugggaagaauaagagggggacugucuu

SEQ ID NO: 681257 - RNA, 64 nt, Homo Sapiens
gagacaauuacuugcaugggguaacccaguaauacugugggaugcaacuucuagggcauggcug

SEQ ID NO: 681258 - RNA, 64 nt, Homo Sapiens
caguuguucugagcacauuucccaggugccccgacugugggacuagcaagcugcccagcccugg

SEQ ID NO: 681259 - RNA, 64 nt, Homo Sapiens
cgcagagccugacgcucagcggucaccugccgcccugugggagcgcucuggcucugccucagga

SEQ ID NO: 681260 - RNA, 64 nt, Homo Sapiens
ccuuuggugacuucacagugaagucuugcccucucugugggauaucacaucagugguuccaaga

SEQ ID NO: 681261 - RNA, 64 nt, Homo Sapiens
uuaaauacauuccaugcccuccccagaaaauagucugugggagucaguugccuuggugccaggu

SEQ ID NO: 681262 - RNA, 64 nt, Homo Sapiens
cuucacuucagccuuucagucccucucucucugccugugggaaucuggacacauuuugggaggc

SEQ ID NO: 681263 - RNA, 64 nt, Homo Sapiens
ggaaucuggacacauuuugggaggccucccaaggcugugggacgugcuugcucuggcagcugca

SEQ ID NO: 681264 - RNA, 64 nt, Homo Sapiens
uaguuaauucuucaaaagauaucauugcuuuuaacugugggacuauaauaauuucugauuauaa

SEQ ID NO: 681265 - RNA, 64 nt, Homo Sapiens
agaauagacucuauuuucucacguacaauuguaucugugggaagcaacuauugauugcauucaa

SEQ ID NO: 681266 - RNA, 64 nt, Homo Sapiens
gcugucccuuauuucaacccguucccucuuccagcugugggaccauucccaagcuucaggaugu

SEQ ID NO: 681267 - RNA, 64 nt, Homo Sapiens
agagaugagggucagauaggccugacuuuacuugcugugggaagggaagaguucuucccuuagc

SEQ ID NO: 681268 - RNA, 64 nt, Homo Sapiens
aaaagacauuuacaacuaggccagggauuagccacugugggaggguggacaggcaaugguucag

SEQ ID NO: 681269 - RNA, 64 nt, Homo Sapiens
uuggugagcuguguauuuccuaggagguagaaaacugugggaaacuguggcuaauaaaaacuaa

SEQ ID NO: 681270 - RNA, 64 nt, Homo Sapiens
gugagacuuaucagaugggacgcuugccccaagacugugggauaaaccaccauugcuaguccuc

SEQ ID NO: 681271 - RNA, 64 nt, Homo Sapiens
cugggugcaguaguuuacgccuguaaucccagcacugugggaggccgaggcggauggaucaccu

SEQ ID NO: 681272 - RNA, 64 nt, Homo Sapiens
cauguggagacacuccuauaaggagaguucaagccugugggaguagaaaaaucucauucccaga

SEQ ID NO: 681273 - RNA, 64 nt, Homo Sapiens
caucugcuugguuggcuggcagcugagagcccugcugugggagagcgaagggggucaaaggaag

SEQ ID NO: 681274 - RNA, 64 nt, Homo Sapiens
uucucccucacuccccuccccaggcauuggucaccugugggacccccugcugucaugaaggggc

SEQ ID NO: 681275 - RNA, 64 nt, Homo Sapiens
gcccuagccccugcugucauccucucucuagucccugugggacagaaagucccugccuuccaca

SEQ ID NO: 681276 - RNA, 64 nt, Homo Sapiens
cccuuucccucgacgacagucgagggcucgggcucugugggacugugggagcuagggucugcgg

SEQ ID NO: 681277 - RNA, 64 nt, Homo Sapiens
cucgacgacagucgagggcucgggcucugugggacugugggagcuagggucugcggggcgccug

SEQ ID NO: 681278 - RNA, 64 nt, Homo Sapiens
ucaggaaguucgagauuccuagaugauuauuguacugugggaggcauguugugcuuuuguagag

SEQ ID NO: 681279 - RNA, 64 nt, Homo Sapiens
gcuguacuucuaagacaaagguccucgggucagacugugggaauccuuuuaaguuuccaucagu

SEQ ID NO: 681280 - RNA, 64 nt, Homo Sapiens
cagagcuccuugcagugccuucuuccuuguuuaccugugggaggaaacacuuuuuuugucaggg

SEQ ID NO: 681281 - RNA, 64 nt, Homo Sapiens
ugcauucuagaaaguagaagauguaauaaauguacugugggacauguuaauaagugcuauaaag

SEQ ID NO: 681282 - RNA, 64 nt, Homo Sapiens
gacgggccccuguuugccaucucggggguguucccugugggagggugagugggugaggccgagc

SEQ ID NO: 681283 - RNA, 64 nt, Homo Sapiens
cucccagaaggaccccaggcccuggggaggguggcugugggaggccaaguccacugcccggaag

SEQ ID NO: 681284 - RNA, 64 nt, Homo Sapiens
cucucaugcacaaccagcccuuccacgugccugccugugggacaggagggggagcgugggaugc

SEQ ID NO: 681285 - RNA, 64 nt, Homo Sapiens
gaguccacguaacugaccuguacuccacgaggcccugugggaacgguccaggcugguccugccc

SEQ ID NO: 681286 - RNA, 64 nt, Homo Sapiens
guugaccguauucugggcaaccccccaccaugggcugugggagaauggaaagggaagggaauuu

SEQ ID NO: 681287 - RNA, 64 nt, Homo Sapiens
gaguuggaauguucgacagcuguccagcucugcucugugggaagcugcgauggacgugaggacg

SEQ ID NO: 681288 - RNA, 64 nt, Homo Sapiens
ccuggauaugugggugagggaugcuaggcaccgccugugggaccccaaaauccaggcugggaac

SEQ ID NO: 681289 - RNA, 64 nt, Homo Sapiens
cggggagggacugagcagugagggccugggcaggcugugggagccuggccauggaacugugagg

SEQ ID NO: 681290 - RNA, 59 nt, Homo Sapiens; identical to SEQ ID NO: 76155

SEQ ID NO: 681291 - RNA, 64 nt, Homo Sapiens; identical to SEQ ID NO: 76156

SEQ ID NO: 681292 - RNA, 64 nt, Homo Sapiens; identical to SEQ ID NO: 76157

SEQ ID NO: 681293 - RNA, 64 nt, Homo Sapiens; identical to SEQ ID NO: 76158

SEQ ID NO: 681294 - RNA, 64 nt, Homo Sapiens; identical to SEQ ID NO: 76159

SEQ ID NO: 681295 - RNA, 64 nt, Homo Sapiens; identical to SEQ ID NO: 76160

SEQ ID NO: 681296 - RNA, 64 nt, Homo Sapiens; identical to SEQ ID NO: 76161

SEQ ID NO: 681297 - RNA, 64 nt, Homo Sapiens; identical to SEQ ID NO: 76162

SEQ ID NO: 681298 - RNA, 64 nt, Homo Sapiens; identical to SEQ ID NO: 76163

SEQ ID NO: 681299 - RNA, 64 nt, Homo Sapiens; identical to SEQ ID NO: 76164

SEQ ID NO: 681300 - RNA, 64 nt, Homo Sapiens; identical to SEQ ID NO: 76165

SEQ ID NO: 681301 - RNA, 64 nt, Homo Sapiens; identical to SEQ ID NO: 76166

SEQ ID NO: 681302 - RNA, 64 nt, Homo Sapiens; identical to SEQ ID NO: 76167

SEQ ID NO: 681303 - RNA, 64 nt, Homo Sapiens; identical to SEQ ID NO: 76168

SEQ ID NO: 681304 - RNA, 64 nt, Homo Sapiens; identical to SEQ ID NO: 76169

SEQ ID NO: 681305 - RNA, 58 nt, Homo Sapiens; identical to SEQ ID NO: 76170

SEQ ID NO: 681306 - RNA, 64 nt, Homo Sapiens; identical to SEQ ID NO: 76171

SEQ ID NO: 681307 - RNA, 64 nt, Homo Sapiens; identical to SEQ ID NO: 76172

SEQ ID NO: 681308 - RNA, 64 nt, Homo Sapiens; identical to SEQ ID NO: 76173

SEQ ID NO: 681309 - RNA, 64 nt, Homo Sapiens; identical to SEQ ID NO: 76174

SEQ ID NO: 681310 - RNA, 64 nt, Homo Sapiens; identical to SEQ ID NO: 76175

SEQ ID NO: 681311 - RNA, 52 nt, Homo Sapiens; identical to SEQ ID NO: 76176

SEQ ID NO: 681312 - RNA, 64 nt, Homo Sapiens; identical to SEQ ID NO: 76177

SEQ ID NO: 681313 - RNA, 64 nt, Homo Sapiens; identical to SEQ ID NO: 76178

SEQ ID NO: 681314 - RNA, 64 nt, Homo Sapiens; identical to SEQ ID NO: 76179

SEQ ID NO: 681315 - RNA, 64 nt, Homo Sapiens; identical to SEQ ID NO: 76180

SEQ ID NO: 681316 - RNA, 64 nt, Homo Sapiens; identical to SEQ ID NO: 76181

SEQ ID NO: 681317 - RNA, 64 nt, Homo Sapiens; identical to SEQ ID NO: 76182

SEQ ID NO: 681318 - RNA, 64 nt, Homo Sapiens; identical to SEQ ID NO: 76183

SEQ ID NO: 681319 - RNA, 64 nt, Homo Sapiens; identical to SEQ ID NO: 76184

SEQ ID NO: 681320 - RNA, 64 nt, Homo Sapiens; identical to SEQ ID NO: 76185

SEQ ID NO: 681321 - RNA, 64 nt, Homo Sapiens; identical to SEQ ID NO: 76186

SEQ ID NO: 681322 - RNA, 64 nt, Homo Sapiens; identical to SEQ ID NO: 76187

SEQ ID NO: 681323 - RNA, 64 nt, Homo Sapiens; identical to SEQ ID NO: 76188

SEQ ID NO: 681324 - RNA, 64 nt, Homo Sapiens; identical to SEQ ID NO: 76189

SEQ ID NO: 681325 - RNA, 64 nt, Homo Sapiens; identical to SEQ ID NO: 76190

SEQ ID NO: 681326 - RNA, 64 nt, Homo Sapiens; identical to SEQ ID NO: 76191

SEQ ID NO: 681327 - RNA, 64 nt, Homo Sapiens; identical to SEQ ID NO: 76192

SEQ ID NO: 681328 - RNA, 64 nt, Homo Sapiens; identical to SEQ ID NO: 76193

SEQ ID NO: 681329 - RNA, 64 nt, Homo Sapiens; identical to SEQ ID NO: 76194

SEQ ID NO: 681330 - RNA, 64 nt, Homo Sapiens; identical to SEQ ID NO: 76195

SEQ ID NO: 681331 - RNA, 64 nt, Homo Sapiens; identical to SEQ ID NO: 76196

SEQ ID NO: 681332 - RNA, 64 nt, Homo Sapiens; identical to SEQ ID NO: 76197

SEQ ID NO: 681333 - RNA, 64 nt, Homo Sapiens; identical to SEQ ID NO: 76198

SEQ ID NO: 681334 - RNA, 64 nt, Homo Sapiens; identical to SEQ ID NO: 76199

SEQ ID NO: 681335 - RNA, 64 nt, Homo Sapiens; identical to SEQ ID NO: 76200

SEQ ID NO: 681336 - RNA, 64 nt, Homo Sapiens; identical to SEQ ID NO: 76201

SEQ ID NO: 681337 - RNA, 64 nt, Homo Sapiens; identical to SEQ ID NO: 76202

SEQ ID NO: 681338 - RNA, 64 nt, Homo Sapiens; identical to SEQ ID NO: 76203

SEQ ID NO: 681339 - RNA, 64 nt, Homo Sapiens; identical to SEQ ID NO: 76204

SEQ ID NO: 681340 - RNA, 64 nt, Homo Sapiens; identical to SEQ ID NO: 76205

SEQ ID NO: 681341 - RNA, 64 nt, Homo Sapiens; identical to SEQ ID NO: 76206

SEQ ID NO: 681342 - RNA, 64 nt, Homo Sapiens; identical to SEQ ID NO: 76207

SEQ ID NO: 681343 - RNA, 64 nt, Homo Sapiens; identical to SEQ ID NO: 76208

SEQ ID NO: 681344 - RNA, 64 nt, Homo Sapiens; identical to SEQ ID NO: 76209

SEQ ID NO: 681345 - RNA, 64 nt, Homo Sapiens; identical to SEQ ID NO: 76210

SEQ ID NO: 681346 - RNA, 64 nt, Homo Sapiens; identical to SEQ ID NO: 76211

SEQ ID NO: 681347 - RNA, 64 nt, Homo Sapiens; identical to SEQ ID NO: 76212

SEQ ID NO: 681348 - RNA, 64 nt, Homo Sapiens; identical to SEQ ID NO: 76213

SEQ ID NO: 681349 - RNA, 64 nt, Homo Sapiens; identical to SEQ ID NO: 76214

SEQ ID NO: 681350 - RNA, 64 nt, Homo Sapiens; identical to SEQ ID NO: 76215

SEQ ID NO: 681351 - RNA, 64 nt, Homo Sapiens; identical to SEQ ID NO: 76216

SEQ ID NO: 681352 - RNA, 64 nt, Homo Sapiens; identical to SEQ ID NO: 76217

SEQ ID NO: 681353 - RNA, 64 nt, Homo Sapiens; identical to SEQ ID NO: 76218

SEQ ID NO: 681354 - RNA, 64 nt, Homo Sapiens; identical to SEQ ID NO: 76219

SEQ ID NO: 681355 - RNA, 64 nt, Homo Sapiens; identical to SEQ ID NO: 76220

SEQ ID NO: 681356 - RNA, 64 nt, Homo Sapiens; identical to SEQ ID NO: 76221

SEQ ID NO: 681357 - RNA, 64 nt, Homo Sapiens; identical to SEQ ID NO: 76222

SEQ ID NO: 681358 - RNA, 64 nt, Homo Sapiens; identical to SEQ ID NO: 76223

SEQ ID NO: 681359 - RNA, 64 nt, Homo Sapiens; identical to SEQ ID NO: 76224

SEQ ID NO: 681360 - RNA, 64 nt, Homo Sapiens; identical to SEQ ID NO: 76225

SEQ ID NO: 681361 - RNA, 64 nt, Homo Sapiens
cugacugcuggcuggcgaggaggcugcgagcguggaaucggaagcgaccgcgggcuuuuuugcc

SEQ ID NO: 681362 - RNA, 64 nt, Homo Sapiens
ucauucauggaccaguagauuguugaaaguuggugaaucggauuauaagcuucuagcuaacaca

SEQ ID NO: 681363 - RNA, 64 nt, Homo Sapiens
ggaaguuggugcugcuaagaccgagaaauuuaaagaaucggacagauggacgcagagaaccaga

SEQ ID NO: 681364 - RNA, 64 nt, Homo Sapiens
ucugggccuguaaucccagucaguaacauggcaggaaucggacucccaguuuguuggaguagga

SEQ ID NO: 681365 - RNA, 64 nt, Homo Sapiens
aaccacaaguuaucuggccuuuuagaucuuuuuggaaucggaccugguugaguaaggaccucuu

SEQ ID NO: 681366 - RNA, 64 nt, Homo Sapiens
auagagcuuuucugcauccuacuccagauacacugaaucggaaucccuagggcuagagccuaga

SEQ ID NO: 681367 - RNA, 64 nt, Homo Sapiens
gaguuggugcagcuccaggucauuccuggggugggaaucggaucaucccugacucagcuuuuac

SEQ ID NO: 681368 - RNA, 64 nt, Homo Sapiens
cauuuucauuuuccuaaccgagccaacuggaaacgaaucggagccuucugccaaacaauaauaa

SEQ ID NO: 681369 - RNA, 64 nt, Homo Sapiens
agccuuagaaaauugccuguggggaguauuuggugaaucggaaagagauuucaagcgucaagug

SEQ ID NO: 681370 - RNA, 64 nt, Homo Sapiens
uccggagugugaagauucaggcaucagccuucuagaaucggagccuccuguugcccucacaaga

SEQ ID NO: 681371 - RNA, 64 nt, Homo Sapiens
cccaugcaugagagacucuccuccuuuccagagagaaucggaucgcaccacguguggcagccug

SEQ ID NO: 681372 - RNA, 64 nt, Homo Sapiens
aaugcucaggcagaacgggguacauccacaggaggaaucggacgagaggaugugacauucgguc

SEQ ID NO: 681373 - RNA, 64 nt, Homo Sapiens
gauuagggagguagaaucaauaagacucagugaagaaucggauguggggguaagggcacaugug

SEQ ID NO: 681374 - RNA, 64 nt, Homo Sapiens
gcgcgcacgcggaucccccgcgcuuacugugcgagaaucggagggaaguguguugcagaaccga

SEQ ID NO: 681375 - RNA, 64 nt, Homo Sapiens
ucccccacuuggagaguuugaggaauggaaaugagaaucggaggagaaauaaggccagaggcuc

SEQ ID NO: 681376 - RNA, 64 nt, Homo Sapiens
guggcugcuuucuuuuggugacccuccagggguggaaucggagugugucugcccgcccuuguga

SEQ ID NO: 681377 - RNA, 64 nt, Homo Sapiens
gagccuuacgugcccgagggauaauuguaauguugaaucggacaugugccuuccaaaucaugcc

SEQ ID NO: 681378 - RNA, 64 nt, Homo Sapiens
gauagucucaugcagaaaauuguauugaggggaugaaucggaacaagacuguuggacaguggug

SEQ ID NO: 681379 - RNA, 64 nt, Homo Sapiens
ccugucgauuagacuggacaaugacacuguucaggaaucggaaugcucugacauucugauucga

SEQ ID NO: 681380 - RNA, 64 nt, Homo Sapiens
aggaggcugaggcaggagaauagccugaaccugggaaucggagguugcagagccaagaucgccc

SEQ ID NO: 681381 - RNA, 64 nt, Homo Sapiens
cuaacaaaguuuucaugugcauaaaaugguucaugaaucggagaauaguagauauauuuuauua

SEQ ID NO: 681382 - RNA, 64 nt, Homo Sapiens
ccaugcaucugugaucaaugaacuaugugguuuugaaucggauguagaccauuaguacuacuac

SEQ ID NO: 681383 - RNA, 64 nt, Homo Sapiens
aaaccgcauacacguucaccgagaaagggagagggaaucggagggagcagcggaaugcggcgaa

SEQ ID NO: 681384 - RNA, 64 nt, Homo Sapiens
gggcaccucuguguuucucuaggccggggacugggaaucggagugugccacagcugugcugagg

SEQ ID NO: 681385 - RNA, 64 nt, Homo Sapiens
gucuuuguaacugauucuggaacuaagagaaaaagaaucggauggagacagugaaaaauagaug

SEQ ID NO: 681386 - RNA, 64 nt, Homo Sapiens
cuccacagcggaggagaccagcucagaggcccaggaaucggagcgaagcagagagguggagaac

SEQ ID NO: 681387 - RNA, 64 nt, Homo Sapiens
ggugaugccagcaguuccugagaacacauggagggaaucggacaauuaguucauuuccaauccc

SEQ ID NO: 681388 - RNA, 64 nt, Homo Sapiens
acgcuggcuccauaucgugauauuuuuguggacggaaucggaacuucggcaaagcagccugagu

SEQ ID NO: 681389 - RNA, 64 nt, Homo Sapiens
cucuggggguugggacccagaucccagacuugcugaaucggaauaaugcaaauucucaagccgc

SEQ ID NO: 681390 - RNA, 64 nt, Homo Sapiens
aacuggaaaauauaucugaauaggcaaaacguaugaaucggauuaaauguuguccuguacuuac

SEQ ID NO: 681391 - RNA, 64 nt, Homo Sapiens
cugugccguauugauaaggagggugcaguagaaagaaucggaauuaaugcuuugaauuccuugg

SEQ ID NO: 681392 - RNA, 64 nt, Homo Sapiens
acuacuccccaagcuccuccccgaacucaacucggaaucggaagcaaggcgcagccagcuccuc

SEQ ID NO: 681393 - RNA, 64 nt, Homo Sapiens
gaggcagguuagugacaguucuucauagaagguggaaucggacagaacugcuccucugugugua

SEQ ID NO: 681394 - RNA, 64 nt, Homo Sapiens
cucauccuuucucacacuucugccccccgucaccgaaucggacacugcuccccugcgaccgccc

SEQ ID NO: 681395 - RNA, 64 nt, Homo Sapiens
ccccuuacugggggaggguccuugcaauuccagcgaaucggaggccaggccaggacguccuugc

SEQ ID NO: 681396 - RNA, 64 nt, Homo Sapiens
caugcuggauaggaccugggaugcugcuggagcugaaucggaugccaccaaggcucgguccagc

SEQ ID NO: 681397 - RNA, 64 nt, Homo Sapiens
ccucagacccacagccgcaaagacagccggcagggaaucggaacagcggccucuaagagcugag

SEQ ID NO: 681398 - RNA, 64 nt, Homo Sapiens
aagggcagcccuggccuugcccgcgccaggcccugaaucggaaaagagggccaucccuaagccu

SEQ ID NO: 681399 - RNA, 64 nt, Homo Sapiens
cccugguugagagcuaagacgauaguuuaaaugggaaucggaucuuuucacucgcuucguccua

SEQ ID NO: 681400 - RNA, 64 nt, Homo Sapiens
ggcacuacugcccggccaguccaggcucaggcaggaaucggacgcuggggcccgggcucugcac

SEQ ID NO: 681401 - RNA, 64 nt, Homo Sapiens
uccucuuuuuguaggcagaacaguaucaaaagaagaaucggaagaugcuugugauuuuaauauu

SEQ ID NO: 681402 - RNA, 64 nt, Homo Sapiens
uguuguauugccuggggugaaaagcugaaaaguggaaucggagccgagguggccgaggcagguc

SEQ ID NO: 681403 - RNA, 64 nt, Homo Sapiens
agaaugaacgugggcccucgggugggaagacuaggaaucggaagcuucuagggcuucacauccc

SEQ ID NO: 681404 - RNA, 63 nt, Homo Sapiens
cacacacacacacacacacacgccgcacccccuaccccccaaaauagaaucauccauucccau

SEQ ID NO: 681405 - RNA, 63 nt, Homo Sapiens
gugugggggaccugcagagaacuugcugacuuaaccccccauaucgucuugacuguuuucccu

SEQ ID NO: 681406 - RNA, 63 nt, Homo Sapiens
ugaaacgguuugagagacgcggccucuaauuccaccccccaagcuuccuuuuuaucauaacgc

SEQ ID NO: 681407 - RNA, 63 nt, Homo Sapiens
aagggacuggacgcccucauguaagguuaacccaccccccagccuauccccuuccucauccau

SEQ ID NO: 681408 - RNA, 63 nt, Homo Sapiens
ucgcaggugucugaggccagagggucugggcgcaccccccaggccugaggcuguggccuccaa

SEQ ID NO: 681409 - RNA, 63 nt, Homo Sapiens
ggacgcccaugccaggcccgcacgaccgggucgaccccccaggcccucuccugccagacagcc

SEQ ID NO: 681410 - RNA, 63 nt, Homo Sapiens
cuuaggacuuggcccuguuaugagcugacccccaccccccaccccccaccccccccccccgcc

SEQ ID NO: 681411 - RNA, 63 nt, Homo Sapiens
cuuggcccuguuaugagcugacccccaccccccaccccccaccccccccccccgccaacuccu

SEQ ID NO: 681412 - RNA, 63 nt, Homo Sapiens
ucaucugugguccaggccggcaucguccuggccaccccccagaucuggugccugcuggccggc

SEQ ID NO: 681413 - RNA, 63 nt, Homo Sapiens
gucguccaccccaggacgagccaucagggacagaccccccacccccaaggcugcagccacacc

SEQ ID NO: 681414 - RNA, 63 nt, Homo Sapiens
gcucgggguuuuuuauuuauaaaaccucuccccaccccccaccccccaacuuccuggguuuuc

SEQ ID NO: 681415 - RNA, 63 nt, Homo Sapiens
guuuuuuauuuauaaaaccucuccccaccccccaccccccaacuuccuggguuuucucauugu

SEQ ID NO: 681416 - RNA, 63 nt, Homo Sapiens
aaaaggaaaaaaugaaugagcccgcugcugcccaccccccacagccacgagccaccacugccu

SEQ ID NO: 681417 - RNA, 63 nt, Homo Sapiens
cuucucccuacacucccagcagaggcugugaccaccccccaucaagcccuucuugcuuuugag

SEQ ID NO: 681418 - RNA, 63 nt, Homo Sapiens
ucuggggccucaucacugugccucccauccuguaccccccauugggccuccccugcuaucccu

SEQ ID NO: 681419 - RNA, 63 nt, Homo Sapiens
cuccaggagcuaguggagggcagcagcuuggguaccccccaacuaggggggagggggguggca

SEQ ID NO: 681420 - RNA, 63 nt, Homo Sapiens
gcgucagcuccuaccucugaccuuucaccccccaccccccacaucaccuuugaccuugccuca

SEQ ID NO: 681421 - RNA, 63 nt, Homo Sapiens
ccccacagcgucagcuccuaugccucaccuuucaccccccacccugcaguucaccuuugaccu

SEQ ID NO: 681422 - RNA, 63 nt, Homo Sapiens
ugagccccagcuccuaccucugccucaccuuuaaccccccacccugcacuucaccgcugaccu

SEQ ID NO: 681423 - RNA, 63 nt, Homo Sapiens
ucugcuuuuagcuucccuaucagcuguaggcauaccccccaagugcuuuuauacauuuuucug

SEQ ID NO: 681424 - RNA, 63 nt, Homo Sapiens
uaaccauuguuggcaaccugaacuuugaaugcuaccccccaaguugauuuaggggcuuuggag

SEQ ID NO: 681425 - RNA, 63 nt, Homo Sapiens
uacagcacuggcuuuucuuucaggagugagacaaccccccaggaguaucagggauugugggga

SEQ ID NO: 681426 - RNA, 63 nt, Homo Sapiens
acacccuccucccagggaggccaaaacuggcucaccccccagaucagggacugaagggggacc

SEQ ID NO: 681427 - RNA, 63 nt, Homo Sapiens
cccuccucccucagacccagcccaggaguccagaccccccagcccagccccuccucccucaga

SEQ ID NO: 681428 - RNA, 63 nt, Homo Sapiens; identical to SEQ ID NO: 681427

SEQ ID NO: 681429 - RNA, 63 nt, Homo Sapiens
ggagggguagugcuccacagcuuuuccuuccccaccccccagccuuagaugccucgcucuuuu

SEQ ID NO: 681430 - RNA, 63 nt, Homo Sapiens
acuccugcugucuaccucuccucacaccccagcaccccccauuuuuucaaaccuugguaucug

SEQ ID NO: 681431 - RNA, 63 nt, Homo Sapiens
uuucaacuuccugcuggaaacuagagguggggcaccccccaccccccagccucgcacuguguc

SEQ ID NO: 681432 - RNA, 63 nt, Homo Sapiens
uuccugcuggaaacuagagguggggcaccccccaccccccagccucgcacuguguccuugggg

SEQ ID NO: 681433 - RNA, 64 nt, Homo Sapiens; identical to SEQ ID NO: 45744

SEQ ID NO: 681434 - RNA, 64 nt, Homo Sapiens; identical to SEQ ID NO: 45745

SEQ ID NO: 681435 - RNA, 64 nt, Homo Sapiens; identical to SEQ ID NO: 45746

SEQ ID NO: 681436 - RNA, 64 nt, Homo Sapiens; identical to SEQ ID NO: 45747

SEQ ID NO: 681437 - RNA, 64 nt, Homo Sapiens; identical to SEQ ID NO: 45748

SEQ ID NO: 681438 - RNA, 64 nt, Homo Sapiens; identical to SEQ ID NO: 45749

SEQ ID NO: 681439 - RNA, 64 nt, Homo Sapiens; identical to SEQ ID NO: 45750

SEQ ID NO: 681440 - RNA, 64 nt, Homo Sapiens; identical to SEQ ID NO: 45751

SEQ ID NO: 681441 - RNA, 64 nt, Homo Sapiens; identical to SEQ ID NO: 45752

SEQ ID NO: 681442 - RNA, 64 nt, Homo Sapiens; identical to SEQ ID NO: 45753

SEQ ID NO: 681443 - RNA, 64 nt, Homo Sapiens; identical to SEQ ID NO: 45754

SEQ ID NO: 681444 - RNA, 64 nt, Homo Sapiens; identical to SEQ ID NO: 45755

SEQ ID NO: 681445 - RNA, 64 nt, Homo Sapiens; identical to SEQ ID NO: 45756

SEQ ID NO: 681446 - RNA, 64 nt, Homo Sapiens; identical to SEQ ID NO: 45757

SEQ ID NO: 681447 - RNA, 64 nt, Homo Sapiens; identical to SEQ ID NO: 45758

SEQ ID NO: 681448 - RNA, 64 nt, Homo Sapiens; identical to SEQ ID NO: 45759

SEQ ID NO: 681449 - RNA, 64 nt, Homo Sapiens; identical to SEQ ID NO: 45760

SEQ ID NO: 681450 - RNA, 64 nt, Homo Sapiens; identical to SEQ ID NO: 45761

SEQ ID NO: 681451 - RNA, 64 nt, Homo Sapiens; identical to SEQ ID NO: 45762

SEQ ID NO: 681452 - RNA, 64 nt, Homo Sapiens; identical to SEQ ID NO: 45763

SEQ ID NO: 681453 - RNA, 64 nt, Homo Sapiens; identical to SEQ ID NO: 45764

SEQ ID NO: 681454 - RNA, 64 nt, Homo Sapiens; identical to SEQ ID NO: 45765

SEQ ID NO: 681455 - RNA, 64 nt, Homo Sapiens; identical to SEQ ID NO: 45766

SEQ ID NO: 681456 - RNA, 64 nt, Homo Sapiens; identical to SEQ ID NO: 45767

SEQ ID NO: 681457 - RNA, 64 nt, Homo Sapiens; identical to SEQ ID NO: 45768

SEQ ID NO: 681458 - RNA, 64 nt, Homo Sapiens; identical to SEQ ID NO: 45769

SEQ ID NO: 681459 - RNA, 64 nt, Homo Sapiens; identical to SEQ ID NO: 45770

SEQ ID NO: 681460 - RNA, 64 nt, Homo Sapiens; identical to SEQ ID NO: 45771

SEQ ID NO: 681461 - RNA, 64 nt, Homo Sapiens; identical to SEQ ID NO: 45772

SEQ ID NO: 681462 - RNA, 64 nt, Homo Sapiens; identical to SEQ ID NO: 45773

SEQ ID NO: 681463 - RNA, 64 nt, Homo Sapiens; identical to SEQ ID NO: 45774

SEQ ID NO: 681464 - RNA, 64 nt, Homo Sapiens; identical to SEQ ID NO: 45775

SEQ ID NO: 681465 - RNA, 64 nt, Homo Sapiens; identical to SEQ ID NO: 45776

SEQ ID NO: 681466 - RNA, 64 nt, Homo Sapiens; identical to SEQ ID NO: 45777

SEQ ID NO: 681467 - RNA, 64 nt, Homo Sapiens; identical to SEQ ID NO: 45778

SEQ ID NO: 681468 - RNA, 64 nt, Homo Sapiens; identical to SEQ ID NO: 45779

SEQ ID NO: 681469 - RNA, 64 nt, Homo Sapiens
gccgcgaccucaguguggcuuuuacaggacuccccccgagcaucagcagggaccccggcggacg

SEQ ID NO: 681470 - RNA, 64 nt, Homo Sapiens
uuccuggguucaagugauucucuugccuuagccucccgagcagcugggauuauaggcguccacc

SEQ ID NO: 681471 - RNA, 64 nt, Homo Sapiens
aguaaaauuguuuuuucuguccgcaacacuggcucccgagcagcuuuuguuaaagcaguagguu

SEQ ID NO: 681472 - RNA, 64 nt, Homo Sapiens
ucagcuggccuccgaagagccguggacuguccuacccgagcacuugauucugguagcuccuucu

SEQ ID NO: 681473 - RNA, 64 nt, Homo Sapiens
ccuccagaaccgacaguuccagcaaaagcagcggcccgagcagaagaucgaggacaucagcaau

SEQ ID NO: 681474 - RNA, 64 nt, Homo Sapiens
uggccagaguccacucccuuccuggcugugucaccccgagcagcucauccaccauggaggucau

SEQ ID NO: 681475 - RNA, 64 nt, Homo Sapiens; identical to SEQ ID NO: 73345

SEQ ID NO: 681476 - RNA, 64 nt, Homo Sapiens; identical to SEQ ID NO: 73346

SEQ ID NO: 681477 - RNA, 64 nt, Homo Sapiens; identical to SEQ ID NO: 73347

SEQ ID NO: 681478 - RNA, 64 nt, Homo Sapiens; identical to SEQ ID NO: 73348

SEQ ID NO: 681479 - RNA, 64 nt, Homo Sapiens; identical to SEQ ID NO: 73349

SEQ ID NO: 681480 - RNA, 64 nt, Homo Sapiens; identical to SEQ ID NO: 73350

SEQ ID NO: 681481 - RNA, 64 nt, Homo Sapiens; identical to SEQ ID NO: 73351

SEQ ID NO: 681482 - RNA, 64 nt, Homo Sapiens; identical to SEQ ID NO: 73352

SEQ ID NO: 681483 - RNA, 64 nt, Homo Sapiens; identical to SEQ ID NO: 73353

SEQ ID NO: 681484 - RNA, 64 nt, Homo Sapiens; identical to SEQ ID NO: 73354

SEQ ID NO: 681485 - RNA, 64 nt, Homo Sapiens; identical to SEQ ID NO: 73355

SEQ ID NO: 681486 - RNA, 64 nt, Homo Sapiens; identical to SEQ ID NO: 73356

SEQ ID NO: 681487 - RNA, 64 nt, Homo Sapiens; identical to SEQ ID NO: 73357

SEQ ID NO: 681488 - RNA, 52 nt, Homo Sapiens; identical to SEQ ID NO: 73358

SEQ ID NO: 681489 - RNA, 64 nt, Homo Sapiens; identical to SEQ ID NO: 73359

SEQ ID NO: 681490 - RNA, 64 nt, Homo Sapiens; identical to SEQ ID NO: 73360

SEQ ID NO: 681491 - RNA, 64 nt, Homo Sapiens; identical to SEQ ID NO: 73361

SEQ ID NO: 681492 - RNA, 64 nt, Homo Sapiens; identical to SEQ ID NO: 73362

SEQ ID NO: 681493 - RNA, 64 nt, Homo Sapiens; identical to SEQ ID NO: 73363

SEQ ID NO: 681494 - RNA, 64 nt, Homo Sapiens; identical to SEQ ID NO: 73364

SEQ ID NO: 681495 - RNA, 64 nt, Homo Sapiens; identical to SEQ ID NO: 73365

SEQ ID NO: 681496 - RNA, 64 nt, Homo Sapiens; identical to SEQ ID NO: 73366

SEQ ID NO: 681497 - RNA, 64 nt, Homo Sapiens; identical to SEQ ID NO: 73367

SEQ ID NO: 681498 - RNA, 64 nt, Homo Sapiens; identical to SEQ ID NO: 73368

SEQ ID NO: 681499 - RNA, 64 nt, Homo Sapiens; identical to SEQ ID NO: 73369

SEQ ID NO: 681500 - RNA, 64 nt, Homo Sapiens; identical to SEQ ID NO: 73370

SEQ ID NO: 681501 - RNA, 64 nt, Homo Sapiens; identical to SEQ ID NO: 73371

SEQ ID NO: 681502 - RNA, 64 nt, Homo Sapiens; identical to SEQ ID NO: 73372

SEQ ID NO: 681503 - RNA, 64 nt, Homo Sapiens; identical to SEQ ID NO: 73373

SEQ ID NO: 681504 - RNA, 64 nt, Homo Sapiens; identical to SEQ ID NO: 73374

SEQ ID NO: 681505 - RNA, 64 nt, Homo Sapiens; identical to SEQ ID NO: 73375

SEQ ID NO: 681506 - RNA, 64 nt, Homo Sapiens; identical to SEQ ID NO: 73376

SEQ ID NO: 681507 - RNA, 64 nt, Homo Sapiens; identical to SEQ ID NO: 73377

SEQ ID NO: 681508 - RNA, 64 nt, Homo Sapiens; identical to SEQ ID NO: 73378

SEQ ID NO: 681509 - RNA, 64 nt, Homo Sapiens; identical to SEQ ID NO: 73379

SEQ ID NO: 681510 - RNA, 64 nt, Homo Sapiens; identical to SEQ ID NO: 73380

SEQ ID NO: 681511 - RNA, 64 nt, Homo Sapiens; identical to SEQ ID NO: 73381

SEQ ID NO: 681512 - RNA, 64 nt, Homo Sapiens; identical to SEQ ID NO: 73382

SEQ ID NO: 681513 - RNA, 64 nt, Homo Sapiens; identical to SEQ ID NO: 73383

SEQ ID NO: 681514 - RNA, 64 nt, Homo Sapiens; identical to SEQ ID NO: 73384

SEQ ID NO: 681515 - RNA, 64 nt, Homo Sapiens; identical to SEQ ID NO: 73385

SEQ ID NO: 681516 - RNA, 64 nt, Homo Sapiens; identical to SEQ ID NO: 73386

SEQ ID NO: 681517 - RNA, 64 nt, Homo Sapiens; identical to SEQ ID NO: 73387

SEQ ID NO: 681518 - RNA, 64 nt, Homo Sapiens; identical to SEQ ID NO: 73388

SEQ ID NO: 681519 - RNA, 64 nt, Homo Sapiens; identical to SEQ ID NO: 73389

SEQ ID NO: 681520 - RNA, 64 nt, Homo Sapiens; identical to SEQ ID NO: 655929

SEQ ID NO: 681521 - RNA, 64 nt, Homo Sapiens; identical to SEQ ID NO: 655930

SEQ ID NO: 681522 - RNA, 64 nt, Homo Sapiens; identical to SEQ ID NO: 655931

SEQ ID NO: 681523 - RNA, 64 nt, Homo Sapiens; identical to SEQ ID NO: 655932

SEQ ID NO: 681524 - RNA, 64 nt, Homo Sapiens; identical to SEQ ID NO: 168534

SEQ ID NO: 681525 - RNA, 64 nt, Homo Sapiens; identical to SEQ ID NO: 168535

SEQ ID NO: 681526 - RNA, 64 nt, Homo Sapiens; identical to SEQ ID NO: 168536

SEQ ID NO: 681527 - RNA, 64 nt, Homo Sapiens; identical to SEQ ID NO: 168537

SEQ ID NO: 681528 - RNA, 64 nt, Homo Sapiens; identical to SEQ ID NO: 168538

SEQ ID NO: 681529 - RNA, 64 nt, Homo Sapiens; identical to SEQ ID NO: 168539

SEQ ID NO: 681530 - RNA, 64 nt, Homo Sapiens; identical to SEQ ID NO: 168540

SEQ ID NO: 681531 - RNA, 64 nt, Homo Sapiens; identical to SEQ ID NO: 168541

SEQ ID NO: 681532 - RNA, 64 nt, Homo Sapiens; identical to SEQ ID NO: 168542

SEQ ID NO: 681533 - RNA, 64 nt, Homo Sapiens; identical to SEQ ID NO: 168543

SEQ ID NO: 681534 - RNA, 64 nt, Homo Sapiens; identical to SEQ ID NO: 168544

SEQ ID NO: 681535 - RNA, 64 nt, Homo Sapiens; identical to SEQ ID NO: 168545

SEQ ID NO: 681536 - RNA, 64 nt, Homo Sapiens; identical to SEQ ID NO: 108766

SEQ ID NO: 681537 - RNA, 64 nt, Homo Sapiens; identical to SEQ ID NO: 108767

SEQ ID NO: 681538 - RNA, 64 nt, Homo Sapiens; identical to SEQ ID NO: 108768

SEQ ID NO: 681539 - RNA, 64 nt, Homo Sapiens; identical to SEQ ID NO: 108769

SEQ ID NO: 681540 - RNA, 64 nt, Homo Sapiens; identical to SEQ ID NO: 108770

SEQ ID NO: 681541 - RNA, 64 nt, Homo Sapiens; identical to SEQ ID NO: 108771

SEQ ID NO: 681542 - RNA, 64 nt, Homo Sapiens; identical to SEQ ID NO: 108772

SEQ ID NO: 681543 - RNA, 64 nt, Homo Sapiens; identical to SEQ ID NO: 108773

SEQ ID NO: 681544 - RNA, 64 nt, Homo Sapiens; identical to SEQ ID NO: 108774

SEQ ID NO: 681545 - RNA, 64 nt, Homo Sapiens; identical to SEQ ID NO: 108775

SEQ ID NO: 681546 - RNA, 64 nt, Homo Sapiens; identical to SEQ ID NO: 108776

SEQ ID NO: 681547 - RNA, 64 nt, Homo Sapiens; identical to SEQ ID NO: 108777

SEQ ID NO: 681548 - RNA, 64 nt, Homo Sapiens; identical to SEQ ID NO: 108778

SEQ ID NO: 681549 - RNA, 64 nt, Homo Sapiens; identical to SEQ ID NO: 108779

SEQ ID NO: 681550 - RNA, 64 nt, Homo Sapiens; identical to SEQ ID NO: 108780

SEQ ID NO: 681551 - RNA, 64 nt, Homo Sapiens; identical to SEQ ID NO: 108781

SEQ ID NO: 681552 - RNA, 64 nt, Homo Sapiens; identical to SEQ ID NO: 108782

SEQ ID NO: 681553 - RNA, 64 nt, Homo Sapiens; identical to SEQ ID NO: 108783

SEQ ID NO: 681554 - RNA, 64 nt, Homo Sapiens; identical to SEQ ID NO: 108784

SEQ ID NO: 681555 - RNA, 64 nt, Homo Sapiens; identical to SEQ ID NO: 108785

SEQ ID NO: 681556 - RNA, 64 nt, Homo Sapiens; identical to SEQ ID NO: 108786

SEQ ID NO: 681557 - RNA, 64 nt, Homo Sapiens; identical to SEQ ID NO: 108787

SEQ ID NO: 681558 - RNA, 64 nt, Homo Sapiens; identical to SEQ ID NO: 108788

SEQ ID NO: 681559 - RNA, 64 nt, Homo Sapiens; identical to SEQ ID NO: 108789

SEQ ID NO: 681560 - RNA, 64 nt, Homo Sapiens; identical to SEQ ID NO: 108790

SEQ ID NO: 681561 - RNA, 64 nt, Homo Sapiens; identical to SEQ ID NO: 108791

SEQ ID NO: 681562 - RNA, 64 nt, Homo Sapiens; identical to SEQ ID NO: 108792

SEQ ID NO: 681563 - RNA, 64 nt, Homo Sapiens; identical to SEQ ID NO: 108793

SEQ ID NO: 681564 - RNA, 64 nt, Homo Sapiens; identical to SEQ ID NO: 108794

SEQ ID NO: 681565 - RNA, 64 nt, Homo Sapiens; identical to SEQ ID NO: 108795

SEQ ID NO: 681566 - RNA, 64 nt, Homo Sapiens; identical to SEQ ID NO: 108796

SEQ ID NO: 681567 - RNA, 64 nt, Homo Sapiens; identical to SEQ ID NO: 108797

SEQ ID NO: 681568 - RNA, 64 nt, Homo Sapiens; identical to SEQ ID NO: 108798

SEQ ID NO: 681569 - RNA, 64 nt, Homo Sapiens; identical to SEQ ID NO: 108799

SEQ ID NO: 681570 - RNA, 64 nt, Homo Sapiens; identical to SEQ ID NO: 108800

SEQ ID NO: 681571 - RNA, 64 nt, Homo Sapiens; identical to SEQ ID NO: 108801

SEQ ID NO: 681572 - RNA, 64 nt, Homo Sapiens; identical to SEQ ID NO: 108802

SEQ ID NO: 681573 - RNA, 64 nt, Homo Sapiens; identical to SEQ ID NO: 108803

SEQ ID NO: 681574 - RNA, 64 nt, Homo Sapiens; identical to SEQ ID NO: 108804

SEQ ID NO: 681575 - RNA, 64 nt, Homo Sapiens; identical to SEQ ID NO: 108805

SEQ ID NO: 681576 - RNA, 64 nt, Homo Sapiens; identical to SEQ ID NO: 108806

SEQ ID NO: 681577 - RNA, 64 nt, Homo Sapiens; identical to SEQ ID NO: 108807

SEQ ID NO: 681578 - RNA, 64 nt, Homo Sapiens; identical to SEQ ID NO: 108808

SEQ ID NO: 681579 - RNA, 64 nt, Homo Sapiens; identical to SEQ ID NO: 108809

SEQ ID NO: 681580 - RNA, 64 nt, Homo Sapiens; identical to SEQ ID NO: 108810

SEQ ID NO: 681581 - RNA, 64 nt, Homo Sapiens; identical to SEQ ID NO: 108811

SEQ ID NO: 681582 - RNA, 64 nt, Homo Sapiens; identical to SEQ ID NO: 108812

SEQ ID NO: 681583 - RNA, 64 nt, Homo Sapiens; identical to SEQ ID NO: 108813

SEQ ID NO: 681584 - RNA, 64 nt, Homo Sapiens; identical to SEQ ID NO: 108814

SEQ ID NO: 681585 - RNA, 64 nt, Homo Sapiens; identical to SEQ ID NO: 108815

SEQ ID NO: 681586 - RNA, 64 nt, Homo Sapiens; identical to SEQ ID NO: 108816

SEQ ID NO: 681587 - RNA, 64 nt, Homo Sapiens; identical to SEQ ID NO: 108817

SEQ ID NO: 681588 - RNA, 64 nt, Homo Sapiens; identical to SEQ ID NO: 108818

SEQ ID NO: 681589 - RNA, 64 nt, Homo Sapiens; identical to SEQ ID NO: 108819

SEQ ID NO: 681590 - RNA, 64 nt, Homo Sapiens; identical to SEQ ID NO: 108820

SEQ ID NO: 681591 - RNA, 64 nt, Homo Sapiens; identical to SEQ ID NO: 108821

SEQ ID NO: 681592 - RNA, 64 nt, Homo Sapiens; identical to SEQ ID NO: 108822

SEQ ID NO: 681593 - RNA, 64 nt, Homo Sapiens; identical to SEQ ID NO: 108823

SEQ ID NO: 681594 - RNA, 64 nt, Homo Sapiens; identical to SEQ ID NO: 108824

SEQ ID NO: 681595 - RNA, 64 nt, Homo Sapiens; identical to SEQ ID NO: 108825

SEQ ID NO: 681596 - RNA, 64 nt, Homo Sapiens; identical to SEQ ID NO: 91583

SEQ ID NO: 681597 - RNA, 64 nt, Homo Sapiens; identical to SEQ ID NO: 91584

SEQ ID NO: 681598 - RNA, 64 nt, Homo Sapiens; identical to SEQ ID NO: 79755

SEQ ID NO: 681599 - RNA, 64 nt, Homo Sapiens; identical to SEQ ID NO: 79756

SEQ ID NO: 681600 - RNA, 64 nt, Homo Sapiens; identical to SEQ ID NO: 79757

SEQ ID NO: 681601 - RNA, 64 nt, Homo Sapiens; identical to SEQ ID NO: 79758

SEQ ID NO: 681602 - RNA, 64 nt, Homo Sapiens; identical to SEQ ID NO: 79759

SEQ ID NO: 681603 - RNA, 64 nt, Homo Sapiens; identical to SEQ ID NO: 79760

SEQ ID NO: 681604 - RNA, 64 nt, Homo Sapiens; identical to SEQ ID NO: 79761

SEQ ID NO: 681605 - RNA, 64 nt, Homo Sapiens; identical to SEQ ID NO: 79762

SEQ ID NO: 681606 - RNA, 64 nt, Homo Sapiens; identical to SEQ ID NO: 79763

SEQ ID NO: 681607 - RNA, 64 nt, Homo Sapiens; identical to SEQ ID NO: 79764

SEQ ID NO: 681608 - RNA, 64 nt, Homo Sapiens; identical to SEQ ID NO: 79765

SEQ ID NO: 681609 - RNA, 64 nt, Homo Sapiens; identical to SEQ ID NO: 79766

SEQ ID NO: 681610 - RNA, 64 nt, Homo Sapiens; identical to SEQ ID NO: 79767

SEQ ID NO: 681611 - RNA, 64 nt, Homo Sapiens; identical to SEQ ID NO: 79768

SEQ ID NO: 681612 - RNA, 64 nt, Homo Sapiens; identical to SEQ ID NO: 79769

SEQ ID NO: 681613 - RNA, 64 nt, Homo Sapiens; identical to SEQ ID NO: 79770

SEQ ID NO: 681614 - RNA, 64 nt, Homo Sapiens; identical to SEQ ID NO: 79771

SEQ ID NO: 681615 - RNA, 64 nt, Homo Sapiens; identical to SEQ ID NO: 79772

SEQ ID NO: 681616 - RNA, 64 nt, Homo Sapiens; identical to SEQ ID NO: 79773

SEQ ID NO: 681617 - RNA, 64 nt, Homo Sapiens; identical to SEQ ID NO: 79774

SEQ ID NO: 681618 - RNA, 64 nt, Homo Sapiens; identical to SEQ ID NO: 79775

SEQ ID NO: 681619 - RNA, 64 nt, Homo Sapiens; identical to SEQ ID NO: 79776

SEQ ID NO: 681620 - RNA, 64 nt, Homo Sapiens; identical to SEQ ID NO: 79777

SEQ ID NO: 681621 - RNA, 64 nt, Homo Sapiens; identical to SEQ ID NO: 79778

SEQ ID NO: 681622 - RNA, 64 nt, Homo Sapiens; identical to SEQ ID NO: 79779

SEQ ID NO: 681623 - RNA, 64 nt, Homo Sapiens; identical to SEQ ID NO: 79780

SEQ ID NO: 681624 - RNA, 64 nt, Homo Sapiens; identical to SEQ ID NO: 79781

SEQ ID NO: 681625 - RNA, 64 nt, Homo Sapiens; identical to SEQ ID NO: 79782

SEQ ID NO: 681626 - RNA, 64 nt, Homo Sapiens; identical to SEQ ID NO: 79783

SEQ ID NO: 681627 - RNA, 64 nt, Homo Sapiens; identical to SEQ ID NO: 79784

SEQ ID NO: 681628 - RNA, 64 nt, Homo Sapiens; identical to SEQ ID NO: 79785

SEQ ID NO: 681629 - RNA, 64 nt, Homo Sapiens; identical to SEQ ID NO: 79786

SEQ ID NO: 681630 - RNA, 64 nt, Homo Sapiens; identical to SEQ ID NO: 79787

SEQ ID NO: 681631 - RNA, 64 nt, Homo Sapiens; identical to SEQ ID NO: 79788

SEQ ID NO: 681632 - RNA, 64 nt, Homo Sapiens; identical to SEQ ID NO: 79789

SEQ ID NO: 681633 - RNA, 64 nt, Homo Sapiens; identical to SEQ ID NO: 79790

SEQ ID NO: 681634 - RNA, 64 nt, Homo Sapiens; identical to SEQ ID NO: 79791

SEQ ID NO: 681635 - RNA, 64 nt, Homo Sapiens; identical to SEQ ID NO: 79792

SEQ ID NO: 681636 - RNA, 64 nt, Homo Sapiens; identical to SEQ ID NO: 79793

SEQ ID NO: 681637 - RNA, 64 nt, Homo Sapiens; identical to SEQ ID NO: 79794

SEQ ID NO: 681638 - RNA, 64 nt, Homo Sapiens; identical to SEQ ID NO: 79795

SEQ ID NO: 681639 - RNA, 64 nt, Homo Sapiens; identical to SEQ ID NO: 79796

SEQ ID NO: 681640 - RNA, 64 nt, Homo Sapiens; identical to SEQ ID NO: 79797

SEQ ID NO: 681641 - RNA, 64 nt, Homo Sapiens; identical to SEQ ID NO: 79798

SEQ ID NO: 681642 - RNA, 64 nt, Homo Sapiens; identical to SEQ ID NO: 79799

SEQ ID NO: 681643 - RNA, 64 nt, Homo Sapiens; identical to SEQ ID NO: 79800

SEQ ID NO: 681644 - RNA, 64 nt, Homo Sapiens; identical to SEQ ID NO: 79801

SEQ ID NO: 681645 - RNA, 64 nt, Homo Sapiens; identical to SEQ ID NO: 79802

SEQ ID NO: 681646 - RNA, 64 nt, Homo Sapiens; identical to SEQ ID NO: 79803

SEQ ID NO: 681647 - RNA, 64 nt, Homo Sapiens; identical to SEQ ID NO: 238652

SEQ ID NO: 681648 - RNA, 64 nt, Homo Sapiens; identical to SEQ ID NO: 238653

SEQ ID NO: 681649 - RNA, 64 nt, Homo Sapiens; identical to SEQ ID NO: 238654

SEQ ID NO: 681650 - RNA, 64 nt, Homo Sapiens; identical to SEQ ID NO: 238655

SEQ ID NO: 681651 - RNA, 64 nt, Homo Sapiens; identical to SEQ ID NO: 238656

SEQ ID NO: 681652 - RNA, 64 nt, Homo Sapiens; identical to SEQ ID NO: 238657

SEQ ID NO: 681653 - RNA, 64 nt, Homo Sapiens; identical to SEQ ID NO: 238658

SEQ ID NO: 681654 - RNA, 64 nt, Homo Sapiens; identical to SEQ ID NO: 238659

SEQ ID NO: 681655 - RNA, 64 nt, Homo Sapiens; identical to SEQ ID NO: 238660

SEQ ID NO: 681656 - RNA, 64 nt, Homo Sapiens; identical to SEQ ID NO: 238661

SEQ ID NO: 681657 - RNA, 64 nt, Homo Sapiens; identical to SEQ ID NO: 238662

SEQ ID NO: 681658 - RNA, 64 nt, Homo Sapiens; identical to SEQ ID NO: 238663

SEQ ID NO: 681659 - RNA, 64 nt, Homo Sapiens; identical to SEQ ID NO: 238664

SEQ ID NO: 681660 - RNA, 64 nt, Homo Sapiens; identical to SEQ ID NO: 238665

SEQ ID NO: 681661 - RNA, 64 nt, Homo Sapiens; identical to SEQ ID NO: 238666

SEQ ID NO: 681662 - RNA, 64 nt, Homo Sapiens; identical to SEQ ID NO: 238667

SEQ ID NO: 681663 - RNA, 64 nt, Homo Sapiens; identical to SEQ ID NO: 238668

SEQ ID NO: 681664 - RNA, 64 nt, Homo Sapiens; identical to SEQ ID NO: 238669

SEQ ID NO: 681665 - RNA, 64 nt, Homo Sapiens; identical to SEQ ID NO: 238670

SEQ ID NO: 681666 - RNA, 64 nt, Homo Sapiens; identical to SEQ ID NO: 238671

SEQ ID NO: 681667 - RNA, 64 nt, Homo Sapiens; identical to SEQ ID NO: 238672

SEQ ID NO: 681668 - RNA, 64 nt, Homo Sapiens; identical to SEQ ID NO: 238673

SEQ ID NO: 681669 - RNA, 64 nt, Homo Sapiens; identical to SEQ ID NO: 238674

SEQ ID NO: 681670 - RNA, 64 nt, Homo Sapiens; identical to SEQ ID NO: 238675

SEQ ID NO: 681671 - RNA, 64 nt, Homo Sapiens; identical to SEQ ID NO: 238676

SEQ ID NO: 681672 - RNA, 64 nt, Homo Sapiens; identical to SEQ ID NO: 238677

SEQ ID NO: 681673 - RNA, 64 nt, Homo Sapiens; identical to SEQ ID NO: 238678

SEQ ID NO: 681674 - RNA, 64 nt, Homo Sapiens; identical to SEQ ID NO: 238679

SEQ ID NO: 681675 - RNA, 64 nt, Homo Sapiens; identical to SEQ ID NO: 238680

SEQ ID NO: 681676 - RNA, 64 nt, Homo Sapiens; identical to SEQ ID NO: 238681

SEQ ID NO: 681677 - RNA, 64 nt, Homo Sapiens; identical to SEQ ID NO: 238682

SEQ ID NO: 681678 - RNA, 64 nt, Homo Sapiens; identical to SEQ ID NO: 238683

SEQ ID NO: 681679 - RNA, 64 nt, Homo Sapiens; identical to SEQ ID NO: 238684

SEQ ID NO: 681680 - RNA, 64 nt, Homo Sapiens; identical to SEQ ID NO: 238685

SEQ ID NO: 681681 - RNA, 64 nt, Homo Sapiens; identical to SEQ ID NO: 238686

SEQ ID NO: 681682 - RNA, 64 nt, Homo Sapiens; identical to SEQ ID NO: 238687

SEQ ID NO: 681683 - RNA, 64 nt, Homo Sapiens; identical to SEQ ID NO: 238688

SEQ ID NO: 681684 - RNA, 64 nt, Homo Sapiens; identical to SEQ ID NO: 238689

SEQ ID NO: 681685 - RNA, 64 nt, Homo Sapiens; identical to SEQ ID NO: 238690

SEQ ID NO: 681686 - RNA, 64 nt, Homo Sapiens; identical to SEQ ID NO: 238691

SEQ ID NO: 681687 - RNA, 64 nt, Homo Sapiens; identical to SEQ ID NO: 238692

SEQ ID NO: 681688 - RNA, 64 nt, Homo Sapiens; identical to SEQ ID NO: 238693

SEQ ID NO: 681689 - RNA, 64 nt, Homo Sapiens; identical to SEQ ID NO: 238694

SEQ ID NO: 681690 - RNA, 64 nt, Homo Sapiens; identical to SEQ ID NO: 238695

SEQ ID NO: 681691 - RNA, 64 nt, Homo Sapiens; identical to SEQ ID NO: 238696

SEQ ID NO: 681692 - RNA, 64 nt, Homo Sapiens; identical to SEQ ID NO: 238697

SEQ ID NO: 681693 - RNA, 64 nt, Homo Sapiens; identical to SEQ ID NO: 238698

SEQ ID NO: 681694 - RNA, 64 nt, Homo Sapiens; identical to SEQ ID NO: 238699

SEQ ID NO: 681695 - RNA, 64 nt, Homo Sapiens; identical to SEQ ID NO: 238700

SEQ ID NO: 681696 - RNA, 64 nt, Homo Sapiens; identical to SEQ ID NO: 238701

SEQ ID NO: 681697 - RNA, 64 nt, Homo Sapiens; identical to SEQ ID NO: 238702

SEQ ID NO: 681698 - RNA, 64 nt, Homo Sapiens; identical to SEQ ID NO: 238703

SEQ ID NO: 681699 - RNA, 64 nt, Homo Sapiens; identical to SEQ ID NO: 238704

SEQ ID NO: 681700 - RNA, 64 nt, Homo Sapiens; identical to SEQ ID NO: 238705

SEQ ID NO: 681701 - RNA, 64 nt, Homo Sapiens; identical to SEQ ID NO: 238706

SEQ ID NO: 681702 - RNA, 64 nt, Homo Sapiens; identical to SEQ ID NO: 238707

SEQ ID NO: 681703 - RNA, 64 nt, Homo Sapiens; identical to SEQ ID NO: 238708

SEQ ID NO: 681704 - RNA, 64 nt, Homo Sapiens; identical to SEQ ID NO: 238709

SEQ ID NO: 681705 - RNA, 64 nt, Homo Sapiens; identical to SEQ ID NO: 238710

SEQ ID NO: 681706 - RNA, 64 nt, Homo Sapiens; identical to SEQ ID NO: 238711

SEQ ID NO: 681707 - RNA, 64 nt, Homo Sapiens; identical to SEQ ID NO: 238712

SEQ ID NO: 681708 - RNA, 64 nt, Homo Sapiens; identical to SEQ ID NO: 238713

SEQ ID NO: 681709 - RNA, 64 nt, Homo Sapiens; identical to SEQ ID NO: 238714

SEQ ID NO: 681710 - RNA, 64 nt, Homo Sapiens; identical to SEQ ID NO: 238715

SEQ ID NO: 681711 - RNA, 64 nt, Homo Sapiens; identical to SEQ ID NO: 238716

SEQ ID NO: 681712 - RNA, 64 nt, Homo Sapiens; identical to SEQ ID NO: 238717

SEQ ID NO: 681713 - RNA, 64 nt, Homo Sapiens; identical to SEQ ID NO: 238718

SEQ ID NO: 681714 - RNA, 64 nt, Homo Sapiens; identical to SEQ ID NO: 238719

SEQ ID NO: 681715 - RNA, 63 nt, Homo Sapiens; identical to SEQ ID NO: 188776

SEQ ID NO: 681716 - RNA, 63 nt, Homo Sapiens; identical to SEQ ID NO: 188777

SEQ ID NO: 681717 - RNA, 63 nt, Homo Sapiens; identical to SEQ ID NO: 188778

SEQ ID NO: 681718 - RNA, 63 nt, Homo Sapiens; identical to SEQ ID NO: 188779

SEQ ID NO: 681719 - RNA, 63 nt, Homo Sapiens; identical to SEQ ID NO: 188780

SEQ ID NO: 681720 - RNA, 63 nt, Homo Sapiens; identical to SEQ ID NO: 188781

SEQ ID NO: 681721 - RNA, 63 nt, Homo Sapiens; identical to SEQ ID NO: 188782

SEQ ID NO: 681722 - RNA, 63 nt, Homo Sapiens; identical to SEQ ID NO: 188783

SEQ ID NO: 681723 - RNA, 63 nt, Homo Sapiens; identical to SEQ ID NO: 188784

SEQ ID NO: 681724 - RNA, 63 nt, Homo Sapiens; identical to SEQ ID NO: 188785

SEQ ID NO: 681725 - RNA, 63 nt, Homo Sapiens; identical to SEQ ID NO: 188786

SEQ ID NO: 681726 - RNA, 63 nt, Homo Sapiens; identical to SEQ ID NO: 188787

SEQ ID NO: 681727 - RNA, 63 nt, Homo Sapiens; identical to SEQ ID NO: 188788

SEQ ID NO: 681728 - RNA, 63 nt, Homo Sapiens; identical to SEQ ID NO: 188789

SEQ ID NO: 681729 - RNA, 63 nt, Homo Sapiens; identical to SEQ ID NO: 188790

SEQ ID NO: 681730 - RNA, 63 nt, Homo Sapiens; identical to SEQ ID NO: 188791

SEQ ID NO: 681731 - RNA, 63 nt, Homo Sapiens; identical to SEQ ID NO: 188792

SEQ ID NO: 681732 - RNA, 63 nt, Homo Sapiens; identical to SEQ ID NO: 188793

SEQ ID NO: 681733 - RNA, 61 nt, Homo Sapiens; identical to SEQ ID NO: 188794

SEQ ID NO: 681734 - RNA, 63 nt, Homo Sapiens; identical to SEQ ID NO: 188795

SEQ ID NO: 681735 - RNA, 63 nt, Homo Sapiens; identical to SEQ ID NO: 188796

SEQ ID NO: 681736 - RNA, 63 nt, Homo Sapiens; identical to SEQ ID NO: 188797

SEQ ID NO: 681737 - RNA, 63 nt, Homo Sapiens; identical to SEQ ID NO: 188798

SEQ ID NO: 681738 - RNA, 63 nt, Homo Sapiens; identical to SEQ ID NO: 188799

SEQ ID NO: 681739 - RNA, 63 nt, Homo Sapiens; identical to SEQ ID NO: 188800

SEQ ID NO: 681740 - RNA, 63 nt, Homo Sapiens; identical to SEQ ID NO: 188801

SEQ ID NO: 681741 - RNA, 63 nt, Homo Sapiens; identical to SEQ ID NO: 188802

SEQ ID NO: 681742 - RNA, 63 nt, Homo Sapiens; identical to SEQ ID NO: 188803

SEQ ID NO: 681743 - RNA, 63 nt, Homo Sapiens; identical to SEQ ID NO: 188804

SEQ ID NO: 681744 - RNA, 63 nt, Homo Sapiens; identical to SEQ ID NO: 188805

SEQ ID NO: 681745 - RNA, 63 nt, Homo Sapiens; identical to SEQ ID NO: 188806

SEQ ID NO: 681746 - RNA, 63 nt, Homo Sapiens; identical to SEQ ID NO: 188807

SEQ ID NO: 681747 - RNA, 63 nt, Homo Sapiens; identical to SEQ ID NO: 188808

SEQ ID NO: 681748 - RNA, 63 nt, Homo Sapiens; identical to SEQ ID NO: 188809

SEQ ID NO: 681749 - RNA, 63 nt, Homo Sapiens; identical to SEQ ID NO: 188810

SEQ ID NO: 681750 - RNA, 63 nt, Homo Sapiens; identical to SEQ ID NO: 188811

SEQ ID NO: 681751 - RNA, 63 nt, Homo Sapiens; identical to SEQ ID NO: 188812

SEQ ID NO: 681752 - RNA, 64 nt, Homo Sapiens; identical to SEQ ID NO: 175198

SEQ ID NO: 681753 - RNA, 64 nt, Homo Sapiens; identical to SEQ ID NO: 175199

SEQ ID NO: 681754 - RNA, 64 nt, Homo Sapiens; identical to SEQ ID NO: 175200

SEQ ID NO: 681755 - RNA, 64 nt, Homo Sapiens; identical to SEQ ID NO: 175201

SEQ ID NO: 681756 - RNA, 64 nt, Homo Sapiens; identical to SEQ ID NO: 175202

SEQ ID NO: 681757 - RNA, 64 nt, Homo Sapiens; identical to SEQ ID NO: 175203

SEQ ID NO: 681758 - RNA, 64 nt, Homo Sapiens; identical to SEQ ID NO: 175204

SEQ ID NO: 681759 - RNA, 64 nt, Homo Sapiens; identical to SEQ ID NO: 175205

SEQ ID NO: 681760 - RNA, 64 nt, Homo Sapiens; identical to SEQ ID NO: 175206

SEQ ID NO: 681761 - RNA, 64 nt, Homo Sapiens; identical to SEQ ID NO: 175207

SEQ ID NO: 681762 - RNA, 64 nt, Homo Sapiens; identical to SEQ ID NO: 175208

SEQ ID NO: 681763 - RNA, 64 nt, Homo Sapiens; identical to SEQ ID NO: 175209

SEQ ID NO: 681764 - RNA, 64 nt, Homo Sapiens; identical to SEQ ID NO: 175210

SEQ ID NO: 681765 - RNA, 64 nt, Homo Sapiens; identical to SEQ ID NO: 175211

SEQ ID NO: 681766 - RNA, 64 nt, Homo Sapiens; identical to SEQ ID NO: 312696

SEQ ID NO: 681767 - RNA, 64 nt, Homo Sapiens; identical to SEQ ID NO: 312697

SEQ ID NO: 681768 - RNA, 64 nt, Homo Sapiens; identical to SEQ ID NO: 610890

SEQ ID NO: 681769 - RNA, 64 nt, Homo Sapiens; identical to SEQ ID NO: 610891

SEQ ID NO: 681770 - RNA, 64 nt, Homo Sapiens; identical to SEQ ID NO: 610892

SEQ ID NO: 681771 - RNA, 64 nt, Homo Sapiens; identical to SEQ ID NO: 610893

SEQ ID NO: 681772 - RNA, 64 nt, Homo Sapiens; identical to SEQ ID NO: 610894

SEQ ID NO: 681773 - RNA, 64 nt, Homo Sapiens
ucaguaagcuuucaauuuugauacacaguucauuauucauaacuugaggcaguaauuacagugg

SEQ ID NO: 681774 - RNA, 64 nt, Homo Sapiens
aauugcuuucugauucguguagucucucccacagauucauaaacuuuuaugacuuauauuguuu

SEQ ID NO: 681775 - RNA, 64 nt, Homo Sapiens
cuuugguacaaguuuacaugcaauucauaaaucuauucauaaguaaugucuauguuuucuacuc

SEQ ID NO: 681776 - RNA, 64 nt, Homo Sapiens
cuauucauaagucuuugguauguuuucuacuccaauucauaaauccucaagguagaaaugucua

SEQ ID NO: 681777 - RNA, 64 nt, Homo Sapiens
accgaucaagcauuuugacaggaagcccuucauuauucauaacauuguaugcugaccaagacgu

SEQ ID NO: 681778 - RNA, 64 nt, Homo Sapiens
guuuaagauaaaauacaaacuuuaccuaccccaaauucauaaaguacauuuagugcuguauagc

SEQ ID NO: 681779 - RNA, 64 nt, Homo Sapiens
uuuacuugcauacuuaugagaauuucacauuggaauucauaaugguaaaacaacauacaucugc

SEQ ID NO: 681780 - RNA, 64 nt, Homo Sapiens
ccauucguuguggacccacagauugcaucuuuaaauucauaauaaguuuccuuaacuaucuuau

SEQ ID NO: 681781 - RNA, 64 nt, Homo Sapiens
uaugcauacauauauacacacauauguauauaaaauucauaaugaauauauuugccuauauucu

SEQ ID NO: 681782 - RNA, 64 nt, Homo Sapiens
gaagucacccugggaaucacaguggucuaccugcauucauaauuccaggaucugugaagagcac

SEQ ID NO: 681783 - RNA, 64 nt, Homo Sapiens
acacuauaguagaaaaguuuggggcacucaucccauucauaauuauuuuacauuuaaauuacug

SEQ ID NO: 681784 - RNA, 64 nt, Homo Sapiens
uuacggcuuuauugaaaacauugauauauugaauauucauaaauuuuaauuuaacuuucuuuua

SEQ ID NO: 681785 - RNA, 64 nt, Homo Sapiens
gagggcaaggcugguggcagguacuaugaauguaauucauaauuuaaaaggaaaacuaaaaacu

SEQ ID NO: 681786 - RNA, 64 nt, Homo Sapiens
auguucaaaugauguagauugucuuagaaugaauauucauaaguacucagaacucuuaagaugc

SEQ ID NO: 681787 - RNA, 64 nt, Homo Sapiens
acgagaagaauucagaaaacuuuauaaagcacauauucauaauaaguaaccgacaauauauuua

SEQ ID NO: 681788 - RNA, 64 nt, Homo Sapiens
aaaaucaaguagcugauguggaagccaaacacauauucauaaaacagcaagcaacuucccuggg

SEQ ID NO: 681789 - RNA, 64 nt, Homo Sapiens
ucucaucauucuguuggcuaguggaagaauuaaaauucauaaaguugcaaaagccacaacagua

SEQ ID NO: 681790 - RNA, 64 nt, Homo Sapiens
gcuucccauggaguuuugcuuaucccuuauaguaauucauaaauacauugccuucuguuuugua

SEQ ID NO: 681791 - RNA, 64 nt, Homo Sapiens
agagcuccaaguguauuaaacaugacagccauucauucauaaagaucuggauuugcuuuaccuu

SEQ ID NO: 681792 - RNA, 64 nt, Homo Sapiens
uuuguuuuuaaaucugugaugcuuuucaaauuuaauucauaauaaauugaugcaauuucauacu

SEQ ID NO: 681793 - RNA, 64 nt, Homo Sapiens
ucuguuaguguuugaauaucuucauuccucucaaauucauaacaguucuauuuaacugaauuaa

SEQ ID NO: 681794 - RNA, 64 nt, Homo Sapiens
uuacuuugucagaggcacaaaaggguuuaaacugauucauaauaaauaucuguacuucuucgau

SEQ ID NO: 681795 - RNA, 64 nt, Homo Sapiens
ucuagcagaaccuuuccaaaaguuuuauauugagauucauaacaacaccaagaauugauuuugu

SEQ ID NO: 681796 - RNA, 64 nt, Homo Sapiens
ggacagcuaaguaccaaauaacuaauccauugacauucauaaugcgcccccaaaaauacugaag

SEQ ID NO: 681797 - RNA, 64 nt, Homo Sapiens
ugcaaauauuacuauuuuccuuuucugacuuaucauucauaaguaauuuaacauuccauguaac

SEQ ID NO: 681798 - RNA, 64 nt, Homo Sapiens
uauuugaagugaaguuauaaaagggcaaauccagauucauaaacuaucaccucggauuucuugu

SEQ ID NO: 681799 - RNA, 64 nt, Homo Sapiens
acaguggauagauuaaaggcauuuaauauuuguaauucauaauaacuguagaaauggcccuaaa

SEQ ID NO: 681800 - RNA, 64 nt, Homo Sapiens
ccuucuaaaguguacaauucaguggugugaguauauucauaagauuuauacuuggugucuauuc

SEQ ID NO: 681801 - RNA, 64 nt, Homo Sapiens
gugaguauauucauaagauuuauacuuggugucuauucauaagacuuauauccagcauauucau

SEQ ID NO: 681802 - RNA, 64 nt, Homo Sapiens
cuuggugucuauucauaagacuuauauccagcauauucauaacuagagccauaucacagaugca

SEQ ID NO: 681803 - RNA, 64 nt, Homo Sapiens
uuuuaguuuaaugugcucuuuagauuaagucauaauucauaaaaugagucugcuguugaacuau

SEQ ID NO: 681804 - RNA, 64 nt, Homo Sapiens
uguuaauggaagcuuuuugauacuagauugccaaauucauaaaaacacaauacuuaauguauug

SEQ ID NO: 681805 - RNA, 64 nt, Homo Sapiens
gucuuuauaugcucagauucgguugggcguuagaauucauaaaagcaaugaaugcucaaguugg

SEQ ID NO: 681806 - RNA, 64 nt, Homo Sapiens
uugcaguuuuaugucuuuuauggaauuugcuccaauucauaaauuuuccuuguuuuauucccuu

SEQ ID NO: 681807 - RNA, 64 nt, Homo Sapiens
agucugaaacucugcgcucuaguacugcuguuaagauacacaacuuguuucuuaguucauauaa

SEQ ID NO: 681808 - RNA, 64 nt, Homo Sapiens
uacacaacuuguuucuuaguucauauaaucucgggauacacacacacacacacauauauauaca

SEQ ID NO: 681809 - RNA, 64 nt, Homo Sapiens
acaguucacagcaaauuguuguauuaaaugauuagauacacagguauuuucuuauagaagcaau

SEQ ID NO: 681810 - RNA, 64 nt, Homo Sapiens
auuauguuaagaggcuuuaaauguuuuguacauagauacacaugaaauaaagugaaauuuaugu

SEQ ID NO: 681811 - RNA, 64 nt, Homo Sapiens
aagauaacuuuuuuuaaaaaccaaaaucaugaaugauacacaugccauugcaccagcuuguccu

SEQ ID NO: 681812 - RNA, 64 nt, Homo Sapiens
uaaaagagaaaaaaggaacaugcucauucuaccagauacacauuacauguauuaugcuucuaaa

SEQ ID NO: 681813 - RNA, 64 nt, Homo Sapiens
uaguuucuuuuuuaauagaaaauguguugcuuuggauacacacauauuaauacuuacgguuuua

SEQ ID NO: 681814 - RNA, 64 nt, Homo Sapiens
agggacuguauuucuguggaggugggcuauugaagauacacaagcacccgcccugcccuucccu

SEQ ID NO: 681815 - RNA, 64 nt, Homo Sapiens
uaucugucuacaguauuggcucuucugcgaggcugauacacaaggccucucuuccacaugauca

SEQ ID NO: 681816 - RNA, 64 nt, Homo Sapiens
aacaagaacugccugaagaagaguccaagcuacagauacacagcgugugcauugcggcugucac

SEQ ID NO: 681817 - RNA, 64 nt, Homo Sapiens
cuuguguauauauguacauagagcuacagauccagauacacacacuguauauaaagcgcaugua

SEQ ID NO: 681818 - RNA, 64 nt, Homo Sapiens
caugcacagguucucaaccaugugugcuugugaugauacacacacaguguugacguuucccaga

SEQ ID NO: 681819 - RNA, 64 nt, Homo Sapiens; identical to SEQ ID NO: 463809

SEQ ID NO: 681820 - RNA, 64 nt, Homo Sapiens; identical to SEQ ID NO: 463810

SEQ ID NO: 681821 - RNA, 63 nt, Homo Sapiens; identical to SEQ ID NO: 463811

SEQ ID NO: 681822 - RNA, 64 nt, Homo Sapiens; identical to SEQ ID NO: 463812

SEQ ID NO: 681823 - RNA, 64 nt, Homo Sapiens; identical to SEQ ID NO: 463813

SEQ ID NO: 681824 - RNA, 64 nt, Homo Sapiens; identical to SEQ ID NO: 463814

SEQ ID NO: 681825 - RNA, 64 nt, Homo Sapiens
ugaggugacagcucauuagcggggagagagauggagcaucgagugacacugggccauccaggcg

SEQ ID NO: 681826 - RNA, 64 nt, Homo Sapiens
uuuugugaauugccagcguuguguguuuucugggagcaucgaagcucuguuucggaagagcugu

SEQ ID NO: 681827 - RNA, 64 nt, Homo Sapiens
aagagcuggcgucuuagaacucccuggcuuauauagcaucgacaaagaacaguaaauuuuuaga

SEQ ID NO: 681828 - RNA, 64 nt, Homo Sapiens
uucuguagcucugaccuugacuaaacucucuuccagcaucgauggagguugcauucccuacuuc

SEQ ID NO: 681829 - RNA, 64 nt, Homo Sapiens
ugauuucuccaaccacucauggcuggaagaaaagagcaucgacucuguaggauucucaccgugg

SEQ ID NO: 681830 - RNA, 64 nt, Homo Sapiens
cgagcucguggugggugcuccagaccuaagaaauagcaucgaugccucuguacgcgcagaucaa

SEQ ID NO: 681831 - RNA, 64 nt, Homo Sapiens
uucccuccaccugauuuucauaagugauguuauuagcaucgagaguaaucuagaaaguguuaug

SEQ ID NO: 681832 - RNA, 64 nt, Homo Sapiens
cccaagggguaggcaauucuaucuccaacauccaagcaucgaaaagcagagaauagaaaaugua

SEQ ID NO: 681833 - RNA, 64 nt, Homo Sapiens
auaaguaagaugcauuuacuuagcuccucuggccagcaucgaauaacuucuaaaggaagcagaa

SEQ ID NO: 681834 - RNA, 64 nt, Homo Sapiens
augggcuagguaaaagggggcugcuuuucuguuaagcaucgauagguaaguugauggauaaaag

SEQ ID NO: 681835 - RNA, 64 nt, Homo Sapiens
gauacaucaguaugagaggacgucccaucaacaaagcaucgaugauggacagucucacacuauu

SEQ ID NO: 681836 - RNA, 64 nt, Homo Sapiens
ggcuaaaggucuagaugagacuuggaaggcaaggagcaucgaaauuugagauacccaggacccu

SEQ ID NO: 681837 - RNA, 64 nt, Homo Sapiens
gcuccugucccuggguucaggcugugcuucuggaagcaucgaaaugggaugucugagccuugag

SEQ ID NO: 681838 - RNA, 64 nt, Homo Sapiens
ucugaaaaccagaaagaagucuugucauugcagcagcaucgauuccggugauagaguuuguauc

SEQ ID NO: 681839 - RNA, 64 nt, Homo Sapiens
ugaagucccacguguccggucaccaaggccugggagcaucgacgacacgcauagauccacgagg

SEQ ID NO: 681840 - RNA, 64 nt, Homo Sapiens
gugucacuuaaaauauuaguguuguccauagaagagcaucgacugcugugaccucugugccacu

SEQ ID NO: 681841 - RNA, 64 nt, Homo Sapiens
augagacgucauugauuuuacuuccgugacagccagcaucgaacagaccaacagauggccagcc

SEQ ID NO: 681842 - RNA, 64 nt, Homo Sapiens
accuccccauucacacccccuagugccacaaauaagcaucgagcggggcaucuugcaagaccuu

SEQ ID NO: 681843 - RNA, 64 nt, Homo Sapiens
gugucccgugagugugaguguggcagugagaagaagcaucgagggcgaggggaauaugaaaguu

SEQ ID NO: 681844 - RNA, 64 nt, Homo Sapiens
gucuucuuugucuucuuucuuccuggcgccccguagcaucgaguaggggcgccagcuugggcuc

SEQ ID NO: 681845 - RNA, 64 nt, Homo Sapiens
ggaaaugagccagcccaagggcaucauccucagcagcaucgaggaagggccgaggaaugugaag

SEQ ID NO: 681846 - RNA, 64 nt, Homo Sapiens
aggcgcauaauggagaguugaacagccuguagagagcaucgacauagcaauggagggaaacaga

SEQ ID NO: 681847 - RNA, 64 nt, Homo Sapiens
ccugugcccucuggaaaaauggauaugacaguccagcaucgauggcuuccucucuuccugugaa

SEQ ID NO: 681848 - RNA, 64 nt, Homo Sapiens
uccaagcccagaugccaagcccagcggcucaugaagcaucgagccagucacccagggaagccuc

SEQ ID NO: 681849 - RNA, 64 nt, Homo Sapiens
uccccuaauauuuuccuugugcaauucagacuuaagcaucgaguuuuuaccaucuuccacuuua

SEQ ID NO: 681850 - RNA, 64 nt, Homo Sapiens
uaggagggaaacggcaaccaaccugcgaaaguggagcaucgaggaugggccugccuccccagug

SEQ ID NO: 681851 - RNA, 64 nt, Homo Sapiens
uaucuggaucucuguuaugugccauuuuucuucuagcaucgagauacaauaaaaaaaaaaaaaa

SEQ ID NO: 681852 - RNA, 64 nt, Homo Sapiens
ugaacugcuguugggaaccaccacgcagaccaccagcaucgacauguggugaggagauacgguu

SEQ ID NO: 681853 - RNA, 64 nt, Homo Sapiens
caaagcagaguuuuaaccugccagcauaaccucuagcaucgauuauguucucugcacuguuugg

SEQ ID NO: 681854 - RNA, 64 nt, Homo Sapiens
uuuucuugcuuuuuucccauccauagagcaugacagcaucgauucucauugaggagaaaccuug

SEQ ID NO: 681855 - RNA, 64 nt, Homo Sapiens
caacaccaaccugacaagguacacaccuguugucagcaucgagcuucauccacauccacaccuc

SEQ ID NO: 681856 - RNA, 64 nt, Homo Sapiens
ugaagcauccccgugacaaaccagagugggcagaagcaucgagagcgugacaggaaaucccaag

SEQ ID NO: 681857 - RNA, 64 nt, Homo Sapiens
ccuucccaacgauaguaacaggaaaugacucuuuagcaucgauaccucaacaucaauuuagggu

SEQ ID NO: 681858 - RNA, 64 nt, Homo Sapiens
aaagaaaaaaagccaugauguucaggaaagcuuaagcaucgaaagaggauagagucaaggucag

SEQ ID NO: 681859 - RNA, 64 nt, Homo Sapiens
aaugauuucauauugaucuuuuuaucaugauccucccuaucaagcacuaaaaaguugaaccauu

SEQ ID NO: 681860 - RNA, 64 nt, Homo Sapiens
guucaaaaaugccauuuuuaauauuuguauaauacccuaucaugugaguauaccuuaacuaagc

SEQ ID NO: 681861 - RNA, 64 nt, Homo Sapiens
aagauuuaauccuuauaccauguuggacauuugccccuaucaguugcuccucaggaaucuucug

SEQ ID NO: 681862 - RNA, 64 nt, Homo Sapiens
cuuaguauucuuccuugaggcucacaucaugugucccuaucacucuuacuacucuggucagucu

SEQ ID NO: 681863 - RNA, 60 nt, Homo Sapiens
cagcacccucagggucuuaaggucuucaugcccuaucacaaauaccucuuuuaucugucc

SEQ ID NO: 681864 - RNA, 64 nt, Homo Sapiens
acagggaucucagcucuggcgaaguuggagaauucccuaucagcgggcagccccaggcugucug

SEQ ID NO: 681865 - RNA, 64 nt, Homo Sapiens
guuagaggccuaauuuuauaagcaaucucccugucccuaucacuaagaaacauuguuugguggc

SEQ ID NO: 681866 - RNA, 64 nt, Homo Sapiens
gaagcuuuuuagugcauuagacccuccuuuuuuucccuaucacuuuauuaauuucuucacaccu

SEQ ID NO: 681867 - RNA, 64 nt, Homo Sapiens
acucccagcccuugcugggggaaagugacaaauccccuaucaacagaggcuuccaaucagugug

SEQ ID NO: 681868 - RNA, 64 nt, Homo Sapiens
ucugccucacaguggguaaacaaacaagaacugacccuaucaccuuuuaggauguugguuccug

SEQ ID NO: 681869 - RNA, 64 nt, Homo Sapiens
uuauuaacauggaacccacagcugcagagccaaccccuaucauuuggaggagagucucugacca

SEQ ID NO: 681870 - RNA, 64 nt, Homo Sapiens
auguuuugaaauaagacauaaaacauuccaaauacccuaucaccgaggauccugcauccucuuc

SEQ ID NO: 681871 - RNA, 64 nt, Homo Sapiens
guaguaaauaaugcuuugaaauugaaccuuugugcccuaucacccaacgcuccaaagucauaau

SEQ ID NO: 681872 - RNA, 64 nt, Homo Sapiens
gggugugcaagaagcccaugugaccugugacacccccuaucaguucagcagaaguggaaugaca

SEQ ID NO: 681873 - RNA, 64 nt, Homo Sapiens
ucacucucugcucaccaucccucugccuuuuacucccuaucaugacuccccaucugaagcuggc

SEQ ID NO: 681874 - RNA, 64 nt, Homo Sapiens
acauaucaauucaacacauuuuaagagauacauucccuaucaaaauuuucaagagaagaaaaaa

SEQ ID NO: 681875 - RNA, 64 nt, Homo Sapiens
auaaaauuugaaaaaaaaaacacaaacaguaaagcccuaucaguacaccaguuuuaaaaugagc

SEQ ID NO: 681876 - RNA, 64 nt, Homo Sapiens
cuucuccuuccuuuacuccuguccauucuuguggcccuaucagcucaaauuuuacuugaugucu

SEQ ID NO: 681877 - RNA, 64 nt, Homo Sapiens
uuucaaacagauuuguggcuaaccaaaaaagucacccuaucagguguccuuaaaacaaaacaaa

SEQ ID NO: 681878 - RNA, 64 nt, Homo Sapiens
agcccuagcugccuugcagccccaaaccccaggacccuaucagcccccugggacucccuggccc

SEQ ID NO: 681879 - RNA, 64 nt, Homo Sapiens
gccuuaaaauggaauugaaaaacucuuuauuuuccccuaucauuuauuggaugggugggugggg

SEQ ID NO: 681880 - RNA, 64 nt, Homo Sapiens
ccccaggcuccuccauauggcccagggcuuaccacccuaucacacguggccuugucuagaccca

SEQ ID NO: 681881 - RNA, 64 nt, Homo Sapiens
ugaagggauggacagcaugaccucaagugcccuccccuaucaaacgacgcuugaccuuccuggg

SEQ ID NO: 681882 - RNA, 64 nt, Homo Sapiens
aaggugaaaagauaaccugcugugauugaaaagacccuaucaaguaaucaagauuugaagcuuu

SEQ ID NO: 681883 - RNA, 64 nt, Homo Sapiens
aacgaugaggaaaaaagauuagacacaaguuuggcccuaucaaauuuuuuuuuuuuuuuacugu

SEQ ID NO: 681884 - RNA, 64 nt, Homo Sapiens
ucccacaaugaggcugagugcagcccacacuacgcccuaucacuuccacuucaccaggucacca

SEQ ID NO: 681885 - RNA, 64 nt, Homo Sapiens
auuucaccaagccaauaccacacagagucauugacccuaucauugacaaaaaggccaagagaau

SEQ ID NO: 681886 - RNA, 64 nt, Homo Sapiens
auauauagaguuucuuuuucugaguguguaggcucccuaucauuaaaaauauuaaauuuugaau

SEQ ID NO: 681887 - RNA, 64 nt, Homo Sapiens
cgguuacuguuccugaaaagaaaaagccaccuagcccuaucaagccaaagauuccccuuucugc

SEQ ID NO: 681888 - RNA, 64 nt, Homo Sapiens
cauuguagcccucuuauucuaauagaacucacugcccuaucauauuuauuguauauacuuaaaa

SEQ ID NO: 681889 - RNA, 64 nt, Homo Sapiens
ccucaucuuuuuuaauuuuauuauccggcugcuccccuaucagacuguuccuuuuuugauuuuc

SEQ ID NO: 681890 - RNA, 64 nt, Homo Sapiens
ccuugagcucuucugagcuaaggcagccuucagucccuaucagcgccuccuuuacuucccagag

SEQ ID NO: 681891 - RNA, 64 nt, Homo Sapiens
cacaggcuuagggcaguucagaacccacuuguuucccuaucagagggacacagugaaguggagg

SEQ ID NO: 681892 - RNA, 64 nt, Homo Sapiens
acagggaggauacagaaguauugcagcccagauccccuaucagggggacagcuggugggcaaag

SEQ ID NO: 681893 - RNA, 64 nt, Homo Sapiens
cuggcccagauacaaguacccuuaggauuucucucccuaucaaggggucaucaucucuacauuc

SEQ ID NO: 681894 - RNA, 64 nt, Homo Sapiens
aagaggauuuuaacagcaaaaacacaauuucccucccuaucaacgggggcgagcaaccucaagg

SEQ ID NO: 681895 - RNA, 64 nt, Homo Sapiens
cugcuucugaaaauucaguuuugaauaucucuuucccuaucaugaucuaccuugucugucagag

SEQ ID NO: 681896 - RNA, 64 nt, Homo Sapiens
auuuagcauaucuagacuaccuauuugaaaggaacccuaucaacugucuuauguacguuacaug

SEQ ID NO: 681897 - RNA, 64 nt, Homo Sapiens
cauauggauauaagauuuggcucauaaugaugagcccuaucauuugauuugaguucuaucauuu

SEQ ID NO: 681898 - RNA, 64 nt, Homo Sapiens
caauuaugagaggcuaggucauccaaagagaagacccuaucaauguagguugcaaaaucuaacc

SEQ ID NO: 681899 - RNA, 64 nt, Homo Sapiens
gaaggcuccugugccaugucuuagacauugcaugcccuaucaauuacuauaauccugagccaug

SEQ ID NO: 681900 - RNA, 64 nt, Homo Sapiens
ugcuccuaaucccuccaaucucccuaaaauaauacccuaucaucgcccaagcuucuguaguagc

SEQ ID NO: 681901 - RNA, 64 nt, Homo Sapiens
acgguguagccaccauccugaagauagcuguucucccuaucaugugucuagcaagcagccuccu

SEQ ID NO: 681902 - RNA, 64 nt, Homo Sapiens
caauuucauuuuaaucauugucuucuccauuucucccuaucacucuaucccugacacucuggaa

SEQ ID NO: 681903 - RNA, 64 nt, Homo Sapiens
cuaggucuacagccaguggaaacuuaccccugagcccuaucaacaagcccauacaacucaacca

SEQ ID NO: 681904 - RNA, 64 nt, Homo Sapiens
ugauaauuugacaaauagcuauaauaggaacacucccuaucaccaacauauuuugguuaguaua

SEQ ID NO: 681905 - RNA, 64 nt, Homo Sapiens
agaguucaacuguuacucuuuucuuucaucaauccccuaucaguuagaacugcaggccaguucc

SEQ ID NO: 681906 - RNA, 64 nt, Homo Sapiens
ucagcaaguggaacagcagcuugguuucuauugucccuaucauucuuccuucuauguuuugguu

SEQ ID NO: 681907 - RNA, 64 nt, Homo Sapiens
auacaaauaaaucaaucuauauaaaucuucacugcccuaucaaacaccccucacauacuauaaa

SEQ ID NO: 681908 - RNA, 64 nt, Homo Sapiens
uauuuacaucuauguaucuauuauagacaauuugcccuaucauucccacucuaauauucaacaa

SEQ ID NO: 681909 - RNA, 64 nt, Homo Sapiens
ucuauucaccuuuuucagaggugacaaccacaaacccuaucagacacccccacgcccagucacg

SEQ ID NO: 681910 - RNA, 64 nt, Homo Sapiens
ugauuuuucuuauuuacagaucuuuuuuuuuucccccuaucaguaucuguugacaaaugacaga

SEQ ID NO: 681911 - RNA, 64 nt, Homo Sapiens
acagcaggaaauuuuuaaacauccuaaauuuucucccuaucaaaugucuuuauauuuuaucuuc

SEQ ID NO: 681912 - RNA, 64 nt, Homo Sapiens
cucaaaccugugucuggggugugggcucacagaucccuaucagccugguucgugggagggcucu

SEQ ID NO: 681913 - RNA, 56 nt, Homo Sapiens
agugcaugcuguggccagacaccugccccuaucacucugagcauaaaacucauuaa

SEQ ID NO: 681914 - RNA, 64 nt, Homo Sapiens
cuuccccuucccucuagcauacaaaaguggaccucccuaucaugccccaucaagguuugagucc

SEQ ID NO: 681915 - RNA, 64 nt, Homo Sapiens
agcugcugcuucccuuccagugcuauugcacaaacccuaucaagucucugcuauucaugaaucu

SEQ ID NO: 681916 - RNA, 64 nt, Homo Sapiens
ucagugggaaccucugagagcauuuuccuguucccccuaucaaccgcccccagugauaacaucu

SEQ ID NO: 681917 - RNA, 64 nt, Homo Sapiens
gggcucuacccugugacaagcaucuaccucagaccccuaucaugccuggcuacccuguuguuuu

SEQ ID NO: 681918 - RNA, 64 nt, Homo Sapiens
uggccccggaaggugaauggccugcucucccuggcccuaucagccugugaacuucacuuaggcc

SEQ ID NO: 681919 - RNA, 64 nt, Homo Sapiens
ucaaaagagcuggggccaggaucaaacaccagaacccuaucaagguggagacaagcucagucua

SEQ ID NO: 681920 - RNA, 64 nt, Homo Sapiens
aggcuacuggcuaauaggaacagauaacuggguccccuaucacaucuggagcuguuucuacauu

SEQ ID NO: 681921 - RNA, 64 nt, Homo Sapiens
uuuuguauuuuaaugcaauuaucuuuuaauucuucccuaucaccaccaaaagcagucacugcaa

SEQ ID NO: 681922 - RNA, 64 nt, Homo Sapiens
uaauuuugguuuauuaauagacagauugaugcugcccuaucaauccauggaccaaggauggaau

SEQ ID NO: 681923 - RNA, 64 nt, Homo Sapiens
ucuagcauaguaaacuacggcaaguucauuaccucccuaucaguuugggcuagguaguggggac

SEQ ID NO: 681924 - RNA, 64 nt, Homo Sapiens
aacuguccaguggacuggacuauggggcggcagacccuaucaucuaagggggaagaggagaggg

SEQ ID NO: 681925 - RNA, 64 nt, Homo Sapiens
acguaauuuuuucccugacgucuuuaaaauugaacccuaucaugaaaugauaauuucuuccuga

SEQ ID NO: 681926 - RNA, 64 nt, Homo Sapiens
auuggaagugguuucuuugacuuucaaggucauucccuaucaguuacuacuaagaguucucuua

SEQ ID NO: 681927 - RNA, 64 nt, Homo Sapiens
ccuugccaucccugcagcccagcugguggugcugcccuaucagaugcugcugcaugcggccacu

SEQ ID NO: 681928 - RNA, 64 nt, Homo Sapiens
cuuauuggcucuuuuaccuccuacuuuucucacucccuaucagggauauuuuggggggggaugg

SEQ ID NO: 681929 - RNA, 64 nt, Homo Sapiens
ggaaucauuccuggguuucucuuggcucucccagcccuaucacagccuggagcgaauccguccu

SEQ ID NO: 681930 - RNA, 64 nt, Homo Sapiens
aggggaacugcuccaccugacaccccaccugugccccuaucaucuggacugaaguucuugcaga

SEQ ID NO: 681931 - RNA, 64 nt, Homo Sapiens
auuaccgccccugucucucucucucucuucauuccccuaucaacucauuuuucugcuccugcuu

SEQ ID NO: 681932 - RNA, 64 nt, Homo Sapiens
acaaauaaaaauauaccuuuaaaacugauggguucccuaucaaaugguuaaaugacccugaacu

SEQ ID NO: 681933 - RNA, 64 nt, Homo Sapiens
uggagagcccacaaggcauaacucuaaaaauugacccuaucaacuaucuugaagaacccuuuca

SEQ ID NO: 681934 - RNA, 64 nt, Homo Sapiens
ccagggcauauacuaaccuguuugcuuuuuaucccccuaucaguaggucuguguugucuagauc

SEQ ID NO: 681935 - RNA, 64 nt, Homo Sapiens
cuaguauaaugauuuugaaucccccaucccuccucccuaucaaauccuggaaccccagcccacu

SEQ ID NO: 681936 - RNA, 64 nt, Homo Sapiens
aacuaucaaauaaauaaauaucuaucaccccucucccuaucauuaaaagauaauacccauuugu

SEQ ID NO: 681937 - RNA, 63 nt, Homo Sapiens
aaaaaaaaagaaagaaaaaagcaacagagugagacccuaucacccacugccauuuccuccugg

SEQ ID NO: 681938 - RNA, 64 nt, Homo Sapiens
caaaugauguuauuuuggacacauuggucaucuucccuaucacagaguacugugagcccacccc

SEQ ID NO: 681939 - RNA, 64 nt, Homo Sapiens
uguuguuugaauugcugccaauagcagaccauaucccuaucauguuguuggcucaacuguuuuu

SEQ ID NO: 681940 - RNA, 64 nt, Homo Sapiens
aaacagcccuccagugcccaccugccucacuccucccuaucauguaccgugaaaacccccucug

SEQ ID NO: 681941 - RNA, 64 nt, Homo Sapiens
ccuuuacagugccuagugcuuuauaaauuauucccccuaucauuuccaugucauuccuuuauuu

SEQ ID NO: 681942 - RNA, 64 nt, Homo Sapiens
ugccuauaagaauuugcuggucugggaaaaccugcccuaucaaugaguauguugccgugguuac

SEQ ID NO: 681943 - RNA, 64 nt, Homo Sapiens
aaaauuuacaucguuucucaccuagugguuacagcccuaucacugauuuauguccuugccauua

SEQ ID NO: 681944 - RNA, 64 nt, Homo Sapiens
uagacuugauuucaaauucuuaaguucagccuuucccuaucaaucacaaaucauguauuggaaa

SEQ ID NO: 681945 - RNA, 64 nt, Homo Sapiens
ccuuggcucccuguccugcucccggcuucccuuacccuaucacuggccucaggcccccgcaggc

SEQ ID NO: 681946 - RNA, 64 nt, Homo Sapiens
gcgggugggaaagcugcaggcccaggccuugcuucccuaucaggcuugggcauaggggugugcc

SEQ ID NO: 681947 - RNA, 64 nt, Homo Sapiens
guuuguuggacuguuccacugccccuccuccucacccuaucacccauggaucguaauguaaaau

SEQ ID NO: 681948 - RNA, 64 nt, Homo Sapiens
gcuuggggguuuuugaagucuuuaauauuuuaagcccuaucacugacacaucagcauguuuucu

SEQ ID NO: 681949 - RNA, 64 nt, Homo Sapiens
gcugugacuagaucaggcagucagaauaguguuccccuaucaaggcccuacuugggcccaaguu

SEQ ID NO: 681950 - RNA, 64 nt, Homo Sapiens
aguuaggauuagguuuagaaggugaugaaaaccacccuaucauccgugugaggauguggaugga

SEQ ID NO: 681951 - RNA, 64 nt, Homo Sapiens
ugguuuuggagaaaacaaggaaucaggacauccccccuaucagggaugagaagcacaccucaga

SEQ ID NO: 681952 - RNA, 64 nt, Homo Sapiens
ccauacuggggugggcuggaccuugcccuucccucccuaucacuuccuugaguaggugggcucc

SEQ ID NO: 681953 - RNA, 64 nt, Homo Sapiens
acugcccagaacaguggcccauagcagggaccugcccuaucaaaauaucagguguauggaggug

SEQ ID NO: 681954 - RNA, 64 nt, Homo Sapiens
uuucaauaucaugaaagaacacacuagggagaaacccuaucaauguaagcaaugugcaaaagcc

SEQ ID NO: 681955 - RNA, 64 nt, Homo Sapiens
acacacacacacacacacacacuugaaacuaucacccuaucagugguauuggacauaucuguua

SEQ ID NO: 681956 - RNA, 64 nt, Homo Sapiens
caguagagagagauguccaguguucugagccucacccuaucagucucugagcuuggaagaagcc

SEQ ID NO: 681957 - RNA, 64 nt, Homo Sapiens
guaaagaaugugggaagguuacaaaggagagaaacccuaucaguuaauagacaucagagaauuc

SEQ ID NO: 681958 - RNA, 64 nt, Homo Sapiens
cuguguauauaaugcuuucuugauugacccaucucccuaucaucaaaugacuucuagucuagaa

SEQ ID NO: 681959 - RNA, 64 nt, Homo Sapiens
uauuuugccauuggaagguuaacuuuaaaaugagcccuaucacugagaaauacguguuucauga

SEQ ID NO: 681960 - RNA, 64 nt, Homo Sapiens
guucaauaacaaagguuacuguugagaaaaaagacccuaucauagauuuacaagugacaacgug

SEQ ID NO: 681961 - RNA, 64 nt, Homo Sapiens
uuugaaauucugaacaccgucagcacccucucuucccuaucaugggucaucugaccccuguccg

SEQ ID NO: 681962 - RNA, 64 nt, Homo Sapiens
aaguuacguaacauuuacuccuuuguaaauguuucccuaucaucagacaaaacucaauaaaaau

SEQ ID NO: 681963 - RNA, 64 nt, Homo Sapiens
agagcuaggccaagccuaugccccucuauuguuccccuaucauaacuuggguugaggcuggguu

SEQ ID NO: 681964 - RNA, 64 nt, Homo Sapiens
uuaaaaacaaaaagugguccacuuuucccuguagcccuaucauauuaugaagggaguuuagcug

SEQ ID NO: 681965 - RNA, 64 nt, Homo Sapiens
agagcuaguaaggcagcaccaaaucaccuugguucccuaucaguuauuuuagaaauggcuuuau

SEQ ID NO: 681966 - RNA, 64 nt, Homo Sapiens
gguagccaugcugacucaugcccagcucuuuuaucaugaggagagcauccccagaacucagcaa

SEQ ID NO: 681967 - RNA, 64 nt, Homo Sapiens
gaguaaauugagguuuggggccauuugagggauacaugaggagagaaaguacuacagaggggaa

SEQ ID NO: 681968 - RNA, 64 nt, Homo Sapiens
acggcacaacacaaucuugaaccuaaccacgcagcaugaggaaaaccagaauucuguuauaggc

SEQ ID NO: 681969 - RNA, 64 nt, Homo Sapiens
aacaguugaauccagccugauguuggucaaaaaucaugaggagguguuacauaggugguauuac

SEQ ID NO: 681970 - RNA, 64 nt, Homo Sapiens
uuaauuucagcuuauaugggugucuucauuugaacaugaggaauauuagguuauauuuucagca

SEQ ID NO: 681971 - RNA, 64 nt, Homo Sapiens
gguaucugccagcauucaagguuuuggaucauuucaugaggaucuuuccuuugacugggugcug

SEQ ID NO: 681972 - RNA, 64 nt, Homo Sapiens
ucagaaggccaggaagccagaauucugcuccugccaugaggagcuaagagggcucaagauugug

SEQ ID NO: 681973 - RNA, 64 nt, Homo Sapiens
cugcaacccuauaagagggcagggaugguccugccaugaggaggagcugcaggaagcccugccc

SEQ ID NO: 681974 - RNA, 64 nt, Homo Sapiens; identical to SEQ ID NO: 573978

SEQ ID NO: 681975 - RNA, 64 nt, Homo Sapiens; identical to SEQ ID NO: 573979

SEQ ID NO: 681976 - RNA, 64 nt, Homo Sapiens; identical to SEQ ID NO: 573980

SEQ ID NO: 681977 - RNA, 64 nt, Homo Sapiens; identical to SEQ ID NO: 573981

SEQ ID NO: 681978 - RNA, 64 nt, Homo Sapiens; identical to SEQ ID NO: 573982

SEQ ID NO: 681979 - RNA, 64 nt, Homo Sapiens; identical to SEQ ID NO: 573983

SEQ ID NO: 681980 - RNA, 64 nt, Homo Sapiens; identical to SEQ ID NO: 573984

SEQ ID NO: 681981 - RNA, 64 nt, Homo Sapiens; identical to SEQ ID NO: 573985

SEQ ID NO: 681982 - RNA, 64 nt, Homo Sapiens; identical to SEQ ID NO: 573986

SEQ ID NO: 681983 - RNA, 64 nt, Homo Sapiens; identical to SEQ ID NO: 573987

SEQ ID NO: 681984 - RNA, 64 nt, Homo Sapiens; identical to SEQ ID NO: 573988

SEQ ID NO: 681985 - RNA, 64 nt, Homo Sapiens; identical to SEQ ID NO: 573989

SEQ ID NO: 681986 - RNA, 64 nt, Homo Sapiens; identical to SEQ ID NO: 573990

SEQ ID NO: 681987 - RNA, 64 nt, Homo Sapiens; identical to SEQ ID NO: 573991

SEQ ID NO: 681988 - RNA, 64 nt, Homo Sapiens; identical to SEQ ID NO: 573992

SEQ ID NO: 681989 - RNA, 64 nt, Homo Sapiens; identical to SEQ ID NO: 573993

SEQ ID NO: 681990 - RNA, 64 nt, Homo Sapiens; identical to SEQ ID NO: 573994

SEQ ID NO: 681991 - RNA, 64 nt, Homo Sapiens; identical to SEQ ID NO: 573995

SEQ ID NO: 681992 - RNA, 64 nt, Homo Sapiens; identical to SEQ ID NO: 573996

SEQ ID NO: 681993 - RNA, 62 nt, Homo Sapiens; identical to SEQ ID NO: 573997

SEQ ID NO: 681994 - RNA, 64 nt, Homo Sapiens; identical to SEQ ID NO: 210241

SEQ ID NO: 681995 - RNA, 64 nt, Homo Sapiens; identical to SEQ ID NO: 210242

SEQ ID NO: 681996 - RNA, 64 nt, Homo Sapiens; identical to SEQ ID NO: 210243

SEQ ID NO: 681997 - RNA, 64 nt, Homo Sapiens; identical to SEQ ID NO: 210244

SEQ ID NO: 681998 - RNA, 64 nt, Homo Sapiens; identical to SEQ ID NO: 210245

SEQ ID NO: 681999 - RNA, 64 nt, Homo Sapiens; identical to SEQ ID NO: 210246

SEQ ID NO: 682000 - RNA, 64 nt, Homo Sapiens; identical to SEQ ID NO: 210247

SEQ ID NO: 682001 - RNA, 64 nt, Homo Sapiens; identical to SEQ ID NO: 210248

SEQ ID NO: 682002 - RNA, 64 nt, Homo Sapiens; identical to SEQ ID NO: 210249

SEQ ID NO: 682003 - RNA, 64 nt, Homo Sapiens; identical to SEQ ID NO: 210250

SEQ ID NO: 682004 - RNA, 64 nt, Homo Sapiens; identical to SEQ ID NO: 210251

SEQ ID NO: 682005 - RNA, 64 nt, Homo Sapiens; identical to SEQ ID NO: 210252

SEQ ID NO: 682006 - RNA, 64 nt, Homo Sapiens; identical to SEQ ID NO: 210253

SEQ ID NO: 682007 - RNA, 62 nt, Homo Sapiens; identical to SEQ ID NO: 210254

SEQ ID NO: 682008 - RNA, 64 nt, Homo Sapiens; identical to SEQ ID NO: 210255

SEQ ID NO: 682009 - RNA, 64 nt, Homo Sapiens; identical to SEQ ID NO: 210256

SEQ ID NO: 682010 - RNA, 64 nt, Homo Sapiens; identical to SEQ ID NO: 210257

SEQ ID NO: 682011 - RNA, 64 nt, Homo Sapiens; identical to SEQ ID NO: 210258

SEQ ID NO: 682012 - RNA, 64 nt, Homo Sapiens; identical to SEQ ID NO: 210259

SEQ ID NO: 682013 - RNA, 64 nt, Homo Sapiens; identical to SEQ ID NO: 210260

SEQ ID NO: 682014 - RNA, 64 nt, Homo Sapiens; identical to SEQ ID NO: 210261

SEQ ID NO: 682015 - RNA, 64 nt, Homo Sapiens; identical to SEQ ID NO: 210262

SEQ ID NO: 682016 - RNA, 64 nt, Homo Sapiens; identical to SEQ ID NO: 210263

SEQ ID NO: 682017 - RNA, 64 nt, Homo Sapiens; identical to SEQ ID NO: 210264

SEQ ID NO: 682018 - RNA, 64 nt, Homo Sapiens; identical to SEQ ID NO: 210265

SEQ ID NO: 682019 - RNA, 64 nt, Homo Sapiens; identical to SEQ ID NO: 210266

SEQ ID NO: 682020 - RNA, 64 nt, Homo Sapiens; identical to SEQ ID NO: 210267

SEQ ID NO: 682021 - RNA, 64 nt, Homo Sapiens; identical to SEQ ID NO: 210268

SEQ ID NO: 682022 - RNA, 64 nt, Homo Sapiens; identical to SEQ ID NO: 210269

SEQ ID NO: 682023 - RNA, 64 nt, Homo Sapiens; identical to SEQ ID NO: 210270

SEQ ID NO: 682024 - RNA, 64 nt, Homo Sapiens; identical to SEQ ID NO: 210271

SEQ ID NO: 682025 - RNA, 64 nt, Homo Sapiens; identical to SEQ ID NO: 210272

SEQ ID NO: 682026 - RNA, 64 nt, Homo Sapiens; identical to SEQ ID NO: 210273

SEQ ID NO: 682027 - RNA, 64 nt, Homo Sapiens; identical to SEQ ID NO: 210274

SEQ ID NO: 682028 - RNA, 64 nt, Homo Sapiens; identical to SEQ ID NO: 210275

SEQ ID NO: 682029 - RNA, 64 nt, Homo Sapiens; identical to SEQ ID NO: 210276

SEQ ID NO: 682030 - RNA, 64 nt, Homo Sapiens; identical to SEQ ID NO: 210277

SEQ ID NO: 682031 - RNA, 64 nt, Homo Sapiens; identical to SEQ ID NO: 210278

SEQ ID NO: 682032 - RNA, 64 nt, Homo Sapiens; identical to SEQ ID NO: 85480

SEQ ID NO: 682033 - RNA, 64 nt, Homo Sapiens; identical to SEQ ID NO: 85481

SEQ ID NO: 682034 - RNA, 64 nt, Homo Sapiens; identical to SEQ ID NO: 85482

SEQ ID NO: 682035 - RNA, 64 nt, Homo Sapiens; identical to SEQ ID NO: 85483

SEQ ID NO: 682036 - RNA, 64 nt, Homo Sapiens; identical to SEQ ID NO: 85484

SEQ ID NO: 682037 - RNA, 64 nt, Homo Sapiens; identical to SEQ ID NO: 85485

SEQ ID NO: 682038 - RNA, 64 nt, Homo Sapiens; identical to SEQ ID NO: 85486

SEQ ID NO: 682039 - RNA, 64 nt, Homo Sapiens; identical to SEQ ID NO: 85487

SEQ ID NO: 682040 - RNA, 64 nt, Homo Sapiens; identical to SEQ ID NO: 85488

SEQ ID NO: 682041 - RNA, 64 nt, Homo Sapiens; identical to SEQ ID NO: 85489

SEQ ID NO: 682042 - RNA, 64 nt, Homo Sapiens; identical to SEQ ID NO: 85490

SEQ ID NO: 682043 - RNA, 64 nt, Homo Sapiens; identical to SEQ ID NO: 85491

SEQ ID NO: 682044 - RNA, 64 nt, Homo Sapiens; identical to SEQ ID NO: 85492

SEQ ID NO: 682045 - RNA, 64 nt, Homo Sapiens; identical to SEQ ID NO: 85493

SEQ ID NO: 682046 - RNA, 64 nt, Homo Sapiens; identical to SEQ ID NO: 85494

SEQ ID NO: 682047 - RNA, 64 nt, Homo Sapiens; identical to SEQ ID NO: 85495

SEQ ID NO: 682048 - RNA, 64 nt, Homo Sapiens; identical to SEQ ID NO: 85496

SEQ ID NO: 682049 - RNA, 64 nt, Homo Sapiens; identical to SEQ ID NO: 85497

SEQ ID NO: 682050 - RNA, 64 nt, Homo Sapiens; identical to SEQ ID NO: 85498

SEQ ID NO: 682051 - RNA, 64 nt, Homo Sapiens; identical to SEQ ID NO: 85499

SEQ ID NO: 682052 - RNA, 64 nt, Homo Sapiens; identical to SEQ ID NO: 85500

SEQ ID NO: 682053 - RNA, 64 nt, Homo Sapiens; identical to SEQ ID NO: 85501

SEQ ID NO: 682054 - RNA, 64 nt, Homo Sapiens; identical to SEQ ID NO: 85502

SEQ ID NO: 682055 - RNA, 64 nt, Homo Sapiens; identical to SEQ ID NO: 85503

SEQ ID NO: 682056 - RNA, 64 nt, Homo Sapiens; identical to SEQ ID NO: 85504

SEQ ID NO: 682057 - RNA, 64 nt, Homo Sapiens; identical to SEQ ID NO: 85505

SEQ ID NO: 682058 - RNA, 64 nt, Homo Sapiens; identical to SEQ ID NO: 85506

SEQ ID NO: 682059 - RNA, 64 nt, Homo Sapiens; identical to SEQ ID NO: 85507

SEQ ID NO: 682060 - RNA, 64 nt, Homo Sapiens; identical to SEQ ID NO: 85508

SEQ ID NO: 682061 - RNA, 64 nt, Homo Sapiens; identical to SEQ ID NO: 85509

SEQ ID NO: 682062 - RNA, 64 nt, Homo Sapiens; identical to SEQ ID NO: 85510

SEQ ID NO: 682063 - RNA, 64 nt, Homo Sapiens; identical to SEQ ID NO: 85511

SEQ ID NO: 682064 - RNA, 64 nt, Homo Sapiens; identical to SEQ ID NO: 85512

SEQ ID NO: 682065 - RNA, 64 nt, Homo Sapiens; identical to SEQ ID NO: 85513

SEQ ID NO: 682066 - RNA, 64 nt, Homo Sapiens; identical to SEQ ID NO: 85514

SEQ ID NO: 682067 - RNA, 64 nt, Homo Sapiens; identical to SEQ ID NO: 85515

SEQ ID NO: 682068 - RNA, 64 nt, Homo Sapiens; identical to SEQ ID NO: 85516

SEQ ID NO: 682069 - RNA, 64 nt, Homo Sapiens; identical to SEQ ID NO: 85517

SEQ ID NO: 682070 - RNA, 64 nt, Homo Sapiens; identical to SEQ ID NO: 85518

SEQ ID NO: 682071 - RNA, 64 nt, Homo Sapiens; identical to SEQ ID NO: 85519

SEQ ID NO: 682072 - RNA, 64 nt, Homo Sapiens; identical to SEQ ID NO: 85520

SEQ ID NO: 682073 - RNA, 64 nt, Homo Sapiens; identical to SEQ ID NO: 85521

SEQ ID NO: 682074 - RNA, 64 nt, Homo Sapiens; identical to SEQ ID NO: 85522

SEQ ID NO: 682075 - RNA, 64 nt, Homo Sapiens; identical to SEQ ID NO: 85523

SEQ ID NO: 682076 - RNA, 64 nt, Homo Sapiens; identical to SEQ ID NO: 55647

SEQ ID NO: 682077 - RNA, 64 nt, Homo Sapiens; identical to SEQ ID NO: 55648

SEQ ID NO: 682078 - RNA, 64 nt, Homo Sapiens; identical to SEQ ID NO: 55649

SEQ ID NO: 682079 - RNA, 64 nt, Homo Sapiens; identical to SEQ ID NO: 55650

SEQ ID NO: 682080 - RNA, 64 nt, Homo Sapiens; identical to SEQ ID NO: 55651

SEQ ID NO: 682081 - RNA, 64 nt, Homo Sapiens; identical to SEQ ID NO: 55652

SEQ ID NO: 682082 - RNA, 64 nt, Homo Sapiens; identical to SEQ ID NO: 55653

SEQ ID NO: 682083 - RNA, 64 nt, Homo Sapiens; identical to SEQ ID NO: 55654

SEQ ID NO: 682084 - RNA, 64 nt, Homo Sapiens; identical to SEQ ID NO: 55655

SEQ ID NO: 682085 - RNA, 64 nt, Homo Sapiens; identical to SEQ ID NO: 55656

SEQ ID NO: 682086 - RNA, 64 nt, Homo Sapiens; identical to SEQ ID NO: 55657

SEQ ID NO: 682087 - RNA, 64 nt, Homo Sapiens; identical to SEQ ID NO: 55658

SEQ ID NO: 682088 - RNA, 64 nt, Homo Sapiens; identical to SEQ ID NO: 55659

SEQ ID NO: 682089 - RNA, 64 nt, Homo Sapiens; identical to SEQ ID NO: 55660

SEQ ID NO: 682090 - RNA, 64 nt, Homo Sapiens; identical to SEQ ID NO: 55661

SEQ ID NO: 682091 - RNA, 64 nt, Homo Sapiens; identical to SEQ ID NO: 55662

SEQ ID NO: 682092 - RNA, 64 nt, Homo Sapiens; identical to SEQ ID NO: 55663

SEQ ID NO: 682093 - RNA, 64 nt, Homo Sapiens; identical to SEQ ID NO: 55664

SEQ ID NO: 682094 - RNA, 64 nt, Homo Sapiens; identical to SEQ ID NO: 55665

SEQ ID NO: 682095 - RNA, 64 nt, Homo Sapiens; identical to SEQ ID NO: 55666

SEQ ID NO: 682096 - RNA, 64 nt, Homo Sapiens
aaucugagggcagcagacuuuuaucagcuugaguuuaugucauuugauggacuugguucaacaa

SEQ ID NO: 682097 - RNA, 64 nt, Homo Sapiens
gacuucagaaaacagucugucagacaaaaaggccuuaugucaccacugguaccucaguuuccuc

SEQ ID NO: 682098 - RNA, 64 nt, Homo Sapiens
aucaguauaucuucuuuggguugauuuuuuuuuguuaugucacauguguuuaagccuacaauca

SEQ ID NO: 682099 - RNA, 64 nt, Homo Sapiens
acucuaaagauuuugcuguuacuugugaagacuuuuaugucacuguugcggagaaaggagucau

SEQ ID NO: 682100 - RNA, 64 nt, Homo Sapiens
augaaaacuguuuguuucauugaguugucagaaauuaugucaaacauggauauauuuaugucac

SEQ ID NO: 682101 - RNA, 64 nt, Homo Sapiens
gaguugucagaaauuaugucucacauggauauauuuaugucacuaugucaaacaaaauaggagc

SEQ ID NO: 682102 - RNA, 64 nt, Homo Sapiens
cuaagguauguguuacauauaugauuuuggaauuuuaugucauguuauuagcucuacuacuuga

SEQ ID NO: 682103 - RNA, 64 nt, Homo Sapiens
ucacaugauuuggagaaauuaagacuuugggcucuuaugucacaggagaggugggauucauuac

SEQ ID NO: 682104 - RNA, 64 nt, Homo Sapiens
ggacccuagaauccuugugauuuuucuuagcaccuuaugucagggaaaccuaaacugaggucag

SEQ ID NO: 682105 - RNA, 64 nt, Homo Sapiens
gcuagugaguggugcaguccaggacaccuuugcuuuaugucacuuacacggucaccuggagccg

SEQ ID NO: 682106 - RNA, 64 nt, Homo Sapiens
cuucaggaugcauugcaaucauccuuuucuuaaauuaugucacuagucuuuuauuuuuuccccu

SEQ ID NO: 682107 - RNA, 64 nt, Homo Sapiens
gcuuucuugguggacuaguauaguauacggucaguuaugucaauguuucauggucaauaaaaag

SEQ ID NO: 682108 - RNA, 64 nt, Homo Sapiens
cugcacuucuuguucaaaaaccaggccccccaccuuaugucaacuccccauggauuggggccuc

SEQ ID NO: 682109 - RNA, 64 nt, Homo Sapiens
cugaaauucucuaauuuuuucuuuggaaaaauucuuaugucaagaucgauggggaacucacuuc

SEQ ID NO: 682110 - RNA, 64 nt, Homo Sapiens
uuacuucaaaggcguaguuuagaaacaacaaguauuaugucaacgaaccauuaaaaauuugaga

SEQ ID NO: 682111 - RNA, 64 nt, Homo Sapiens
ucuuucuaucacauggcagcgggggucuuuucucuuaugucagccuuccagcuuuucacugugu

SEQ ID NO: 682112 - RNA, 64 nt, Homo Sapiens
uauuuuaggggagauguagguguagaauuauugcuuaugucauuucuuaagcaguuaugcucuu

SEQ ID NO: 682113 - RNA, 64 nt, Homo Sapiens
auaguaauaaaauuacuucuguugaguaaacuuuuuaugucaucguaaaagcugaaaaaauccc

SEQ ID NO: 682114 - RNA, 64 nt, Homo Sapiens
augugccuccagagugauaacucaguaguuauuauuaugucaaacuagauaaaagugguucuuu

SEQ ID NO: 682115 - RNA, 64 nt, Homo Sapiens
accucccuugccuuuguuucagcaggauuuauuuuuaugucaucaauggcaccauauuuggccu

SEQ ID NO: 682116 - RNA, 64 nt, Homo Sapiens
accuguaccugggguugcagaaagccgguguccagggacucaagcccacccccucucaggcaca

SEQ ID NO: 682117 - RNA, 64 nt, Homo Sapiens
guuccuucccccgccgccacaggcaggcucaccugggacucaacuccaagggcuuggccuggaa

SEQ ID NO: 682118 - RNA, 58 nt, Homo Sapiens
augggauacauugucauccucaacuucucagaucuauauacugccaacaaagaagacu

SEQ ID NO: 682119 - RNA, 58 nt, Homo Sapiens
aauguagggaauuuuucccuagcuguuucagaucuauuuagauguuuguuucaagacc

SEQ ID NO: 682120 - RNA, 58 nt, Homo Sapiens
caucuaggauaauuaagguaugccaagccagaucuaggcaugucaguggcaugaugcu

SEQ ID NO: 682121 - RNA, 58 nt, Homo Sapiens
cuaacucauuaacccaguuguugggaaacagaucuauugaaauuauugugugcuaaau

SEQ ID NO: 682122 - RNA, 64 nt, Homo Sapiens; identical to SEQ ID NO: 429907

SEQ ID NO: 682123 - RNA, 64 nt, Homo Sapiens; identical to SEQ ID NO: 429908

SEQ ID NO: 682124 - RNA, 64 nt, Homo Sapiens; identical to SEQ ID NO: 429909

SEQ ID NO: 682125 - RNA, 64 nt, Homo Sapiens; identical to SEQ ID NO: 429910

SEQ ID NO: 682126 - RNA, 64 nt, Homo Sapiens; identical to SEQ ID NO: 429911

SEQ ID NO: 682127 - RNA, 64 nt, Homo Sapiens; identical to SEQ ID NO: 429912

SEQ ID NO: 682128 - RNA, 64 nt, Homo Sapiens; identical to SEQ ID NO: 429913

SEQ ID NO: 682129 - RNA, 64 nt, Homo Sapiens; identical to SEQ ID NO: 429914

SEQ ID NO: 682130 - RNA, 64 nt, Homo Sapiens; identical to SEQ ID NO: 429915

SEQ ID NO: 682131 - RNA, 64 nt, Homo Sapiens; identical to SEQ ID NO: 429916

SEQ ID NO: 682132 - RNA, 64 nt, Homo Sapiens; identical to SEQ ID NO: 429917

SEQ ID NO: 682133 - RNA, 64 nt, Homo Sapiens; identical to SEQ ID NO: 429918

SEQ ID NO: 682134 - RNA, 64 nt, Homo Sapiens; identical to SEQ ID NO: 429919

SEQ ID NO: 682135 - RNA, 64 nt, Homo Sapiens; identical to SEQ ID NO: 429920

SEQ ID NO: 682136 - RNA, 64 nt, Homo Sapiens; identical to SEQ ID NO: 429921

SEQ ID NO: 682137 - RNA, 64 nt, Homo Sapiens; identical to SEQ ID NO: 429922

SEQ ID NO: 682138 - RNA, 64 nt, Homo Sapiens; identical to SEQ ID NO: 141176

SEQ ID NO: 682139 - RNA, 64 nt, Homo Sapiens; identical to SEQ ID NO: 141177

SEQ ID NO: 682140 - RNA, 64 nt, Homo Sapiens; identical to SEQ ID NO: 141178

SEQ ID NO: 682141 - RNA, 64 nt, Homo Sapiens; identical to SEQ ID NO: 141179

SEQ ID NO: 682142 - RNA, 64 nt, Homo Sapiens; identical to SEQ ID NO: 141180

SEQ ID NO: 682143 - RNA, 64 nt, Homo Sapiens; identical to SEQ ID NO: 141181

SEQ ID NO: 682144 - RNA, 64 nt, Homo Sapiens; identical to SEQ ID NO: 141182

SEQ ID NO: 682145 - RNA, 64 nt, Homo Sapiens; identical to SEQ ID NO: 141183

SEQ ID NO: 682146 - RNA, 64 nt, Homo Sapiens; identical to SEQ ID NO: 141184

SEQ ID NO: 682147 - RNA, 64 nt, Homo Sapiens; identical to SEQ ID NO: 141185

SEQ ID NO: 682148 - RNA, 64 nt, Homo Sapiens; identical to SEQ ID NO: 141186

SEQ ID NO: 682149 - RNA, 64 nt, Homo Sapiens; identical to SEQ ID NO: 141187

SEQ ID NO: 682150 - RNA, 64 nt, Homo Sapiens; identical to SEQ ID NO: 141188

SEQ ID NO: 682151 - RNA, 64 nt, Homo Sapiens; identical to SEQ ID NO: 141189

SEQ ID NO: 682152 - RNA, 64 nt, Homo Sapiens; identical to SEQ ID NO: 141190

SEQ ID NO: 682153 - RNA, 64 nt, Homo Sapiens; identical to SEQ ID NO: 141191

SEQ ID NO: 682154 - RNA, 64 nt, Homo Sapiens; identical to SEQ ID NO: 141192

SEQ ID NO: 682155 - RNA, 64 nt, Homo Sapiens; identical to SEQ ID NO: 141193

SEQ ID NO: 682156 - RNA, 64 nt, Homo Sapiens; identical to SEQ ID NO: 141194

SEQ ID NO: 682157 - RNA, 64 nt, Homo Sapiens; identical to SEQ ID NO: 141195

SEQ ID NO: 682158 - RNA, 64 nt, Homo Sapiens; identical to SEQ ID NO: 141196

SEQ ID NO: 682159 - RNA, 64 nt, Homo Sapiens; identical to SEQ ID NO: 141197

SEQ ID NO: 682160 - RNA, 64 nt, Homo Sapiens; identical to SEQ ID NO: 141198

SEQ ID NO: 682161 - RNA, 64 nt, Homo Sapiens; identical to SEQ ID NO: 141199

SEQ ID NO: 682162 - RNA, 64 nt, Homo Sapiens; identical to SEQ ID NO: 141200

SEQ ID NO: 682163 - RNA, 64 nt, Homo Sapiens; identical to SEQ ID NO: 141201

SEQ ID NO: 682164 - RNA, 64 nt, Homo Sapiens; identical to SEQ ID NO: 141202

SEQ ID NO: 682165 - RNA, 64 nt, Homo Sapiens; identical to SEQ ID NO: 141203

SEQ ID NO: 682166 - RNA, 64 nt, Homo Sapiens; identical to SEQ ID NO: 141204

SEQ ID NO: 682167 - RNA, 64 nt, Homo Sapiens; identical to SEQ ID NO: 141205

SEQ ID NO: 682168 - RNA, 64 nt, Homo Sapiens; identical to SEQ ID NO: 141206

SEQ ID NO: 682169 - RNA, 64 nt, Homo Sapiens; identical to SEQ ID NO: 141207

SEQ ID NO: 682170 - RNA, 64 nt, Homo Sapiens; identical to SEQ ID NO: 141208

SEQ ID NO: 682171 - RNA, 64 nt, Homo Sapiens; identical to SEQ ID NO: 141209

SEQ ID NO: 682172 - RNA, 64 nt, Homo Sapiens; identical to SEQ ID NO: 141210

SEQ ID NO: 682173 - RNA, 64 nt, Homo Sapiens; identical to SEQ ID NO: 141211

SEQ ID NO: 682174 - RNA, 64 nt, Homo Sapiens; identical to SEQ ID NO: 141212

SEQ ID NO: 682175 - RNA, 64 nt, Homo Sapiens; identical to SEQ ID NO: 141213

SEQ ID NO: 682176 - RNA, 64 nt, Homo Sapiens; identical to SEQ ID NO: 141214

SEQ ID NO: 682177 - RNA, 64 nt, Homo Sapiens; identical to SEQ ID NO: 141215

SEQ ID NO: 682178 - RNA, 64 nt, Homo Sapiens; identical to SEQ ID NO: 141216

SEQ ID NO: 682179 - RNA, 64 nt, Homo Sapiens; identical to SEQ ID NO: 141217

SEQ ID NO: 682180 - RNA, 64 nt, Homo Sapiens; identical to SEQ ID NO: 141218

SEQ ID NO: 682181 - RNA, 64 nt, Homo Sapiens; identical to SEQ ID NO: 141219

SEQ ID NO: 682182 - RNA, 64 nt, Homo Sapiens; identical to SEQ ID NO: 141220

SEQ ID NO: 682183 - RNA, 64 nt, Homo Sapiens; identical to SEQ ID NO: 141221

SEQ ID NO: 682184 - RNA, 64 nt, Homo Sapiens
ugaggggugggagggagugagaagaacauuuuacuuaaaugauuagcucaauuuauguuuauug

SEQ ID NO: 682185 - RNA, 64 nt, Homo Sapiens
gaugcuuuaauugaguuuaagagccaauccaaauuuaaaugauaucaucugcagucaaauaacu

SEQ ID NO: 682186 - RNA, 64 nt, Homo Sapiens
uaaguuguuucuuagggguugggacgcuuacuaauuaaaugauucaucagacauuuuuuuucua

SEQ ID NO: 682187 - RNA, 64 nt, Homo Sapiens
aguuuaaggggaaauaggcuuuacuauagaacauuuaaaugaucuuggggaugguuaaaacaaa

SEQ ID NO: 682188 - RNA, 64 nt, Homo Sapiens
aaacuaaauugaccaugcauauaauauucuuuguuuaaaugaaagcauacuguugaaacccgca

SEQ ID NO: 682189 - RNA, 64 nt, Homo Sapiens
cuucuagauauucuaguauuugcuucugguggaauuaaaugacgguaaaauuggcuaauuauuu

SEQ ID NO: 682190 - RNA, 64 nt, Homo Sapiens
uagaauuuuauugaaaggccuagguauuaauuuuuuaaaugagugcuuuaacuuaaaacaggcg

SEQ ID NO: 682191 - RNA, 64 nt, Homo Sapiens
aguaucuguaaccucccacugcaucagaagcagguuaaaugaagucuugugaauuuguaauaga

SEQ ID NO: 682192 - RNA, 64 nt, Homo Sapiens
cuggaacaugccucugcauuucugaguguagaaauuaaaugaagccacucacaguccuuugauu

SEQ ID NO: 682193 - RNA, 64 nt, Homo Sapiens
acaggcuuaggacucugugccaaaaaucucuauuuuaaaugaaaauauuuauauaaaaauacau

SEQ ID NO: 682194 - RNA, 64 nt, Homo Sapiens
uauagauaaggcagcuaaauuaauucacuguuaguuaaaugagcuauaccuauaaacuaguacc

SEQ ID NO: 682195 - RNA, 64 nt, Homo Sapiens
ugauugauauauguuauuucaucaaaacaacuuuuuaaaugaacgcacuuuucaucuugguaau

SEQ ID NO: 682196 - RNA, 64 nt, Homo Sapiens
auuguagaauuagaaugggauuuacuguacuguuuuaaaugagauuggcuucagaauccauuac

SEQ ID NO: 682197 - RNA, 64 nt, Homo Sapiens
cauuacaguuaccuuacauagcacuugauacguguuaaaugaacauaugaauguaauuuauaua

SEQ ID NO: 682198 - RNA, 64 nt, Homo Sapiens
acuuauuaucuugagagcaaauaacuuggaaaauuuaaaugagauaaugcaguugcaacugugu

SEQ ID NO: 682199 - RNA, 64 nt, Homo Sapiens
aucuucauugugaaacccuuccccugugcugagauuaaaugaacucuaagauuauuaaauagua

SEQ ID NO: 682200 - RNA, 64 nt, Homo Sapiens
aagauguuauaguaaauuuauuuuauuuuagauauuaaaugauguuuuauuagauaaauuucaa

SEQ ID NO: 682201 - RNA, 64 nt, Homo Sapiens
uuuauuauguacaaauagauucuuauaauauuauuuaaaugacugcauuuuuaaauacaaggcu

SEQ ID NO: 682202 - RNA, 64 nt, Homo Sapiens
auugaacuaauuuauacuuuaaaguauuucuggguuaaaugaaacaaugaaauuuuuuaguaug

SEQ ID NO: 682203 - RNA, 64 nt, Homo Sapiens
cuuagugaagcauaaaguuaccuacaucaauuaauuaaaugaacuuauguacagaaaacaugua

SEQ ID NO: 682204 - RNA, 64 nt, Homo Sapiens
auaaagcuauaaaauucaauaacuuuuuagaauguuaaaugaagacacuguuuccuaacaucag

SEQ ID NO: 682205 - RNA, 64 nt, Homo Sapiens
aaagugcugcugauaugauacaaguagacaaaauuuaaaugaaauuuugucacauucuauggaa

SEQ ID NO: 682206 - RNA, 64 nt, Homo Sapiens
cuuaaaaauaaaggcauauugucgacaguaucuuuuaaaugaguuuuccuaaaguuuguguuuu

SEQ ID NO: 682207 - RNA, 64 nt, Homo Sapiens
uuaauuuuaacauuuuauuuuuggguaagaugauuuaaaugauucuaguacugaaauuacuaaa

SEQ ID NO: 682208 - RNA, 64 nt, Homo Sapiens
caauacaagaaaauuauuucuaagcacaaccauauuaaaugaauguugaccuucugauugaaua

SEQ ID NO: 682209 - RNA, 64 nt, Homo Sapiens
aauaaggcaacuauauaagucaguuaaacugaaauuaaaugaacggaaaagggcaaaaucgcuu

SEQ ID NO: 682210 - RNA, 64 nt, Homo Sapiens
acagucuugccagucagcaauuucuaacagcauuuuaaaugaguuugauguacaguaaauauug

SEQ ID NO: 682211 - RNA, 64 nt, Homo Sapiens
agcaguucucugcugcaauauucccauugaccacuuaaaugaccauaaguggucauuuaagaac

SEQ ID NO: 682212 - RNA, 64 nt, Homo Sapiens
gauccuggauugagacgaaugccauuggaaccuguuaaaugaguaguuuguuaugugucuggaa

SEQ ID NO: 682213 - RNA, 64 nt, Homo Sapiens
cugcaucugauaaaguugagagacaguaacacaauuaaaugacuuagaaacaauguuugcuuuu

SEQ ID NO: 682214 - RNA, 64 nt, Homo Sapiens
caaugcucacauuaauuugcccauauuuuaaguguuaaaugaauuuuuaauuuuuuaaaugaaa

SEQ ID NO: 682215 - RNA, 64 nt, Homo Sapiens
ccauauuuuaaguguuaaauguauuuuuaauuuuuuaaaugaaauuaguuuuugaaguguugaa

SEQ ID NO: 682216 - RNA, 64 nt, Homo Sapiens
cuauauuaguuuauuguuaggaucaaugauaaauuuaaaugaccucagaucuuugcaccagaua

SEQ ID NO: 682217 - RNA, 64 nt, Homo Sapiens
aguggaguuuaaaaauugucucuuuucaacuuauuuaaaugacagcaccugagaagaggaaccg

SEQ ID NO: 682218 - RNA, 64 nt, Homo Sapiens
auuucuuccugcagugauucgaacaugauugagcuuaaaugaucaaugaaauuaaaaggcaaaa

SEQ ID NO: 682219 - RNA, 64 nt, Homo Sapiens
uuaaaaggcaaaagaacaugcuaauauuaaucucuuaaaugaaaacuguaaagcuuuuaugacu

SEQ ID NO: 682220 - RNA, 64 nt, Homo Sapiens
caaucauuuuaaguuuuaaguagaaucauuuauuuuaaaugagaaugagacaaucauauuauuu

SEQ ID NO: 682221 - RNA, 64 nt, Homo Sapiens
caaucauauuauuuuagaaugaaucauuuacuauuuaaaugagagaaggauauacauuauuuua

SEQ ID NO: 682222 - RNA, 64 nt, Homo Sapiens
cugaggaaugaaaaaagauuuugugagcaacagauuaaaugaugugguucuuguguuauaaaug

SEQ ID NO: 682223 - RNA, 64 nt, Homo Sapiens
ugaguacccaaaagaaaugucucaaaaaaaaaaguuaaaugacugcgacagagcgagacuccgu

SEQ ID NO: 682224 - RNA, 64 nt, Homo Sapiens
aguaugcugucaaauuaucguggguugaaacuuguuaaaugagauuucaacugacuuagugaua

SEQ ID NO: 682225 - RNA, 64 nt, Homo Sapiens
uuaaccacuuaaugugaugaaauauuccuaaaaguuaaaugacuauuaaagcauauauuguugc

SEQ ID NO: 682226 - RNA, 64 nt, Homo Sapiens
aaugagcuuauuagucauaggcagaaauagcaaauuaaaugauuuagacaugccuuagguaacu

SEQ ID NO: 682227 - RNA, 64 nt, Homo Sapiens
uggugcauauuuugcaacaugagauuucugugucuuaaaugauuauaauccaccacuaccaaga

SEQ ID NO: 682228 - RNA, 64 nt, Homo Sapiens
uuuuaaagcacuuuagaaaagaaaaauguguagauuaaaugagugauaauuccgaccuaccucu

SEQ ID NO: 682229 - RNA, 64 nt, Homo Sapiens
cuuaagcaugauucuuuuggcuuacauuuuuauauuaaaugaacuuuuuaccugauucagaugu

SEQ ID NO: 682230 - RNA, 64 nt, Homo Sapiens
caccauccucccucccacccgaggcaauuuaauguuaaaugacgucagccacauacuguagaga

SEQ ID NO: 682231 - RNA, 64 nt, Homo Sapiens
aaaggaccaugcgauugguguaccugagaaagcuuuaaaugagaauccuccagcucuuaaagcu

SEQ ID NO: 682232 - RNA, 64 nt, Homo Sapiens
uuuguauucucagacacugagcgaagccuuaacuuuaaaugacauuguuguuucaaaaugaaca

SEQ ID NO: 682233 - RNA, 64 nt, Homo Sapiens
gcuucuagaaacuuccagcguugaaaaaauagacuuaaaugaauaaaaauucauaacagcaacc

SEQ ID NO: 682234 - RNA, 64 nt, Homo Sapiens
aaaugguaauauaacaauauaugauauauaaaccuuaaaugaaaaaaaugaucuauugcagaua

SEQ ID NO: 682235 - RNA, 64 nt, Homo Sapiens
uuuauuuaaagaaaaaaaaggcaguauucccuuuuuaaaugagcuuucaggaaguugcugagaa

SEQ ID NO: 682236 - RNA, 64 nt, Homo Sapiens
gcacagugaaaugaaaauuuauauucuuauaauuuuaaaugaggacauuggauguuauuugcuu

SEQ ID NO: 682237 - RNA, 64 nt, Homo Sapiens
ugaaauuuuucaugaugcuaugaaagcuauuuuuuuaaaugaauaaacguaauuauuauuuaaa

SEQ ID NO: 682238 - RNA, 64 nt, Homo Sapiens
gcuauuuuuuuaaaugaauuaacguaauuauuauuuaaaugaaauauauacagagauaaagcua

SEQ ID NO: 682239 - RNA, 64 nt, Homo Sapiens
gaacagaaauaagaauuaaugaaaauuuaaaagauuaaaugaaugagaagaaaugauucauaaa

SEQ ID NO: 682240 - RNA, 64 nt, Homo Sapiens
aaauaauuuaaaacaaauuaaagugauauaugaguuaaaugaccaagcagacuugauuccagga

SEQ ID NO: 682241 - RNA, 64 nt, Homo Sapiens
cuuuaucugcaucauugcuguuuguuacuauaaauuaaaugaaccucauggaaagguugaggug

SEQ ID NO: 682242 - RNA, 64 nt, Homo Sapiens
cuaggucaagcuguguaaaagucauuuauguuauuuaaaugauguacuguacugcuguuuacau

SEQ ID NO: 682243 - RNA, 64 nt, Homo Sapiens
accuaaaggacaguauauuauuuccucccucucuuuaaaugaccuuccuguaagggggcuccau

SEQ ID NO: 682244 - RNA, 64 nt, Homo Sapiens
ccuuaccccauuacugcgguaaauucuuggugcauuaaaugaagcugggucucaauccccuugg

SEQ ID NO: 682245 - RNA, 64 nt, Homo Sapiens
ugcaagagagaaaaaucugauuucaggauguauuuuaaaugagcacaucuuaugaucaaauaac

SEQ ID NO: 682246 - RNA, 64 nt, Homo Sapiens
aauuaaaauuuguguuuauuauucuuuaguguuguuaaaugaaauuaaaacauuuauauaccuc

SEQ ID NO: 682247 - RNA, 64 nt, Homo Sapiens
augaaacacuacaaauuuauucuuccugauuccuuuaaaugaaugcagaaauuaaaugaauuuu

SEQ ID NO: 682248 - RNA, 64 nt, Homo Sapiens
uuuucuuccugauuccuuuagcaggcagcagaaauuaaaugaauagaauuuuugaagugacugg

SEQ ID NO: 682249 - RNA, 64 nt, Homo Sapiens
acucagguuuaauagucuuauaaaaaguaaucaguuaaaugauuacuugcuuauaaauaucuaa

SEQ ID NO: 682250 - RNA, 64 nt, Homo Sapiens
uacuucaggaaaugaauauaaaauagguucacaguuaaaugaauaagcuuuuguuuauuugugg

SEQ ID NO: 682251 - RNA, 64 nt, Homo Sapiens
cauagaucagaauuuuaaauuaaagguuuuuucuuuaaaugauuuguauuacuuuauuaaaacu

SEQ ID NO: 682252 - RNA, 64 nt, Homo Sapiens
gcccggaggcuuccgaaucuagcaaagcagcauauuaaaugacuccaccugcgcaguccuugug

SEQ ID NO: 682253 - RNA, 64 nt, Homo Sapiens
gcaggcccugugcucauagccugcauguagaugauuaaaugagguaaauacuuaccuacauaca

SEQ ID NO: 682254 - RNA, 64 nt, Homo Sapiens
aggagggaguaacagaaagagacacuggaaacauuuaaaugaucuuuaguuguugcauuuuucg

SEQ ID NO: 682255 - RNA, 64 nt, Homo Sapiens
cuuaaauuacucaauuuaaaguaaaacagaacuuuuaaaugaaguaaaggaagaauaagucacu

SEQ ID NO: 682256 - RNA, 64 nt, Homo Sapiens
auuuuauuuuaaaggcuuaacucugaguaucauauuaaaugaauuaaauuauguauuuuauugc

SEQ ID NO: 682257 - RNA, 64 nt, Homo Sapiens
uugaaaagucgauuaaauuaauagcucucuauuuuuaaaugaauuagcugagcuuucuaaaaug

SEQ ID NO: 682258 - RNA, 64 nt, Homo Sapiens
guuaaaauuacaaauuaaaucagcugaaauugcuuuaaaugaugugguuuauucuuuuucuuua

SEQ ID NO: 682259 - RNA, 64 nt, Homo Sapiens
uacauguauauuguguaugggauagcagaugucuuuaaaugaaauuacauuucugauacaugca

SEQ ID NO: 682260 - RNA, 64 nt, Homo Sapiens
aaauggauuuuucucucugcuuuuaaaauuugauuuaaaugaaguagauucuaagguucaagau

SEQ ID NO: 682261 - RNA, 64 nt, Homo Sapiens
gguuauacuguuuuuaaugaucuggucauucaguuuaaaugaauggguuuuuaaagacagcaag

SEQ ID NO: 682262 - RNA, 64 nt, Homo Sapiens
ugguaaaaugauguuugagcauccagaggcuuaauuaaaugaugcaauugcuaucuauuuuuuu

SEQ ID NO: 682263 - RNA, 64 nt, Homo Sapiens
ccagugacucccaguucucaguuccccaaaucuuuuaaaugaaguuuuacaagucagauuuuuu

SEQ ID NO: 682264 - RNA, 64 nt, Homo Sapiens
agcuuaaugacuuacuuagaauuuauccuuuauuuuaaaugaucuguacuaucuagugucuaaa

SEQ ID NO: 682265 - RNA, 64 nt, Homo Sapiens
aagcagcacacauuguguuaacuuaugucucuuguuaaaugagcuuaaugucuuuguguuuugu

SEQ ID NO: 682266 - RNA, 64 nt, Homo Sapiens
uauugaaaaauguuacagacaacuugccugauuuuuaaaugagcguaaaaggcccucuaaccua

SEQ ID NO: 682267 - RNA, 64 nt, Homo Sapiens
aagugacaccgagguuuuuaucgaagcauuucacuuaaaugaacaaaucauggcuguuauauua

SEQ ID NO: 682268 - RNA, 64 nt, Homo Sapiens
guuacaaauuuuuuaauuuccaaaauaaucuauauuaaaugaggguuucugaucuguacuuugu

SEQ ID NO: 682269 - RNA, 64 nt, Homo Sapiens
uugauuugaucuuuguuuaaaugccaaaauguacuuaaaugaguuacuuagaaugccauaaaau

SEQ ID NO: 682270 - RNA, 64 nt, Homo Sapiens
gcacucaguauucuuccugaacauucaacuuuaguuaaaugaagagaagugcaaauugacuuuu

SEQ ID NO: 682271 - RNA, 64 nt, Homo Sapiens
auuaucaagguuuuaacaaucaccugaaauauaauuaaaugacagucuagugaccuguucagga

SEQ ID NO: 682272 - RNA, 64 nt, Homo Sapiens
auucuaaauguuguauuuuauaaaauuuguauuuuuaaaugaaaaaaaauucuuaauauuuuca

SEQ ID NO: 682273 - RNA, 64 nt, Homo Sapiens
ccacccuguguuuuaaaauaaauucaccaaaagauuaaaugaaagaauguaggacuuaugaucc

SEQ ID NO: 682274 - RNA, 64 nt, Homo Sapiens
uuauggcaucuacccuguagagcugcuaucaauauuaaaugaagcuuuuucaaaauuuaaauug

SEQ ID NO: 682275 - RNA, 64 nt, Homo Sapiens
uucaucugguuuccucuuucuuaccagaccacccuuaaaugacugaccucccaaaguggguggc

SEQ ID NO: 682276 - RNA, 64 nt, Homo Sapiens
gcuggcugucuucuagagguaaguucugagauucuuaaaugagauggauuuccuccuuccuucc

SEQ ID NO: 682277 - RNA, 64 nt, Homo Sapiens
uauauuugaaauguguugcccugaauauuuauaguuaaaugauugcuugucuccugaauguccu

SEQ ID NO: 682278 - RNA, 64 nt, Homo Sapiens
augacugcccugugcuggccaaaagauuuuuauuuuaaaugaauagugagucagaucuauugcu

SEQ ID NO: 682279 - RNA, 64 nt, Homo Sapiens
gcuugccagcuucuagcuugagagaagggauauuuuaaaugagaucauuaacgugaaacuauua

SEQ ID NO: 682280 - RNA, 64 nt, Homo Sapiens
ugguggugguuauuuggucuuuaagugaacugucuuaaaugagaaacguuuuugucauuuugac

SEQ ID NO: 682281 - RNA, 64 nt, Homo Sapiens
gacauaucagagcaguguauuucuggaucauuuuuuaaaugaccucuucuaaaacauaacuguc

SEQ ID NO: 682282 - RNA, 64 nt, Homo Sapiens
acacacacacacacacgugcacacacacacacauuuaaaugauauaaaaagaagagguugaaag

SEQ ID NO: 682283 - RNA, 64 nt, Homo Sapiens
auuuuauaaucagacuuagauuguguuuagaauauuaaaugacugggcacccucuucuugguuu

SEQ ID NO: 682284 - RNA, 64 nt, Homo Sapiens
accuucuuaaaacagaaaauuuaaguaaagucuuuuaaaugaaaccuguaaaaguauugacucu

SEQ ID NO: 682285 - RNA, 64 nt, Homo Sapiens
agucuggagauaauuuugcaacucauguuauggguuaaaugaauauuuuuguaaaaguaaaagc

SEQ ID NO: 682286 - RNA, 64 nt, Homo Sapiens
guaaguuuuucauccuuuuuuucaagugaugauguuaaaugaagauguguuuuguaucuucccu

SEQ ID NO: 682287 - RNA, 64 nt, Homo Sapiens
guuagcaaguuagauuuuccccucucuucucgcuuuaaaugauuccugcugcugcuccugcuuu

SEQ ID NO: 682288 - RNA, 64 nt, Homo Sapiens; identical to SEQ ID NO: 176114

SEQ ID NO: 682289 - RNA, 64 nt, Homo Sapiens; identical to SEQ ID NO: 176115

SEQ ID NO: 682290 - RNA, 64 nt, Homo Sapiens; identical to SEQ ID NO: 176116

SEQ ID NO: 682291 - RNA, 64 nt, Homo Sapiens; identical to SEQ ID NO: 176117

SEQ ID NO: 682292 - RNA, 64 nt, Homo Sapiens; identical to SEQ ID NO: 176118

SEQ ID NO: 682293 - RNA, 64 nt, Homo Sapiens; identical to SEQ ID NO: 176119

SEQ ID NO: 682294 - RNA, 64 nt, Homo Sapiens; identical to SEQ ID NO: 176120

SEQ ID NO: 682295 - RNA, 64 nt, Homo Sapiens; identical to SEQ ID NO: 176121

SEQ ID NO: 682296 - RNA, 64 nt, Homo Sapiens; identical to SEQ ID NO: 176122

SEQ ID NO: 682297 - RNA, 64 nt, Homo Sapiens; identical to SEQ ID NO: 176123

SEQ ID NO: 682298 - RNA, 64 nt, Homo Sapiens; identical to SEQ ID NO: 176124

SEQ ID NO: 682299 - RNA, 64 nt, Homo Sapiens; identical to SEQ ID NO: 176125

SEQ ID NO: 682300 - RNA, 64 nt, Homo Sapiens; identical to SEQ ID NO: 176126

SEQ ID NO: 682301 - RNA, 64 nt, Homo Sapiens; identical to SEQ ID NO: 176127

SEQ ID NO: 682302 - RNA, 64 nt, Homo Sapiens; identical to SEQ ID NO: 176128

SEQ ID NO: 682303 - RNA, 64 nt, Homo Sapiens; identical to SEQ ID NO: 176129

SEQ ID NO: 682304 - RNA, 64 nt, Homo Sapiens; identical to SEQ ID NO: 176130

SEQ ID NO: 682305 - RNA, 64 nt, Homo Sapiens; identical to SEQ ID NO: 176131

SEQ ID NO: 682306 - RNA, 64 nt, Homo Sapiens; identical to SEQ ID NO: 176132

SEQ ID NO: 682307 - RNA, 64 nt, Homo Sapiens; identical to SEQ ID NO: 176133

SEQ ID NO: 682308 - RNA, 64 nt, Homo Sapiens; identical to SEQ ID NO: 176134

SEQ ID NO: 682309 - RNA, 64 nt, Homo Sapiens; identical to SEQ ID NO: 176135

SEQ ID NO: 682310 - RNA, 64 nt, Homo Sapiens; identical to SEQ ID NO: 176136

SEQ ID NO: 682311 - RNA, 64 nt, Homo Sapiens; identical to SEQ ID NO: 176137

SEQ ID NO: 682312 - RNA, 64 nt, Homo Sapiens; identical to SEQ ID NO: 176138

SEQ ID NO: 682313 - RNA, 64 nt, Homo Sapiens; identical to SEQ ID NO: 176139

SEQ ID NO: 682314 - RNA, 64 nt, Homo Sapiens; identical to SEQ ID NO: 176140

SEQ ID NO: 682315 - RNA, 64 nt, Homo Sapiens; identical to SEQ ID NO: 176141

SEQ ID NO: 682316 - RNA, 64 nt, Homo Sapiens; identical to SEQ ID NO: 176142

SEQ ID NO: 682317 - RNA, 64 nt, Homo Sapiens; identical to SEQ ID NO: 176143

SEQ ID NO: 682318 - RNA, 64 nt, Homo Sapiens; identical to SEQ ID NO: 176144

SEQ ID NO: 682319 - RNA, 64 nt, Homo Sapiens; identical to SEQ ID NO: 176145

SEQ ID NO: 682320 - RNA, 64 nt, Homo Sapiens; identical to SEQ ID NO: 176146

SEQ ID NO: 682321 - RNA, 64 nt, Homo Sapiens; identical to SEQ ID NO: 176147

SEQ ID NO: 682322 - RNA, 64 nt, Homo Sapiens; identical to SEQ ID NO: 176148

SEQ ID NO: 682323 - RNA, 64 nt, Homo Sapiens; identical to SEQ ID NO: 176149

SEQ ID NO: 682324 - RNA, 64 nt, Homo Sapiens; identical to SEQ ID NO: 176150

SEQ ID NO: 682325 - RNA, 64 nt, Homo Sapiens; identical to SEQ ID NO: 176151

SEQ ID NO: 682326 - RNA, 64 nt, Homo Sapiens; identical to SEQ ID NO: 176152

SEQ ID NO: 682327 - RNA, 64 nt, Homo Sapiens; identical to SEQ ID NO: 176153

SEQ ID NO: 682328 - RNA, 64 nt, Homo Sapiens; identical to SEQ ID NO: 176154

SEQ ID NO: 682329 - RNA, 64 nt, Homo Sapiens; identical to SEQ ID NO: 176155

SEQ ID NO: 682330 - RNA, 64 nt, Homo Sapiens; identical to SEQ ID NO: 176156

SEQ ID NO: 682331 - RNA, 57 nt, Homo Sapiens; identical to SEQ ID NO: 176157

SEQ ID NO: 682332 - RNA, 64 nt, Homo Sapiens; identical to SEQ ID NO: 176158

SEQ ID NO: 682333 - RNA, 64 nt, Homo Sapiens; identical to SEQ ID NO: 176159

SEQ ID NO: 682334 - RNA, 64 nt, Homo Sapiens; identical to SEQ ID NO: 176160

SEQ ID NO: 682335 - RNA, 64 nt, Homo Sapiens; identical to SEQ ID NO: 176161

SEQ ID NO: 682336 - RNA, 64 nt, Homo Sapiens; identical to SEQ ID NO: 176162

SEQ ID NO: 682337 - RNA, 64 nt, Homo Sapiens; identical to SEQ ID NO: 176163

SEQ ID NO: 682338 - RNA, 64 nt, Homo Sapiens; identical to SEQ ID NO: 176164

SEQ ID NO: 682339 - RNA, 64 nt, Homo Sapiens; identical to SEQ ID NO: 176165

SEQ ID NO: 682340 - RNA, 64 nt, Homo Sapiens; identical to SEQ ID NO: 176166

SEQ ID NO: 682341 - RNA, 64 nt, Homo Sapiens; identical to SEQ ID NO: 176167

SEQ ID NO: 682342 - RNA, 64 nt, Homo Sapiens; identical to SEQ ID NO: 176168

SEQ ID NO: 682343 - RNA, 64 nt, Homo Sapiens; identical to SEQ ID NO: 176169

SEQ ID NO: 682344 - RNA, 64 nt, Homo Sapiens; identical to SEQ ID NO: 176170

SEQ ID NO: 682345 - RNA, 64 nt, Homo Sapiens; identical to SEQ ID NO: 176171

SEQ ID NO: 682346 - RNA, 64 nt, Homo Sapiens; identical to SEQ ID NO: 176172

SEQ ID NO: 682347 - RNA, 64 nt, Homo Sapiens; identical to SEQ ID NO: 176173

SEQ ID NO: 682348 - RNA, 64 nt, Homo Sapiens; identical to SEQ ID NO: 176174

SEQ ID NO: 682349 - RNA, 64 nt, Homo Sapiens; identical to SEQ ID NO: 176175

SEQ ID NO: 682350 - RNA, 64 nt, Homo Sapiens; identical to SEQ ID NO: 176176

SEQ ID NO: 682351 - RNA, 64 nt, Homo Sapiens; identical to SEQ ID NO: 176177

SEQ ID NO: 682352 - RNA, 64 nt, Homo Sapiens; identical to SEQ ID NO: 176178

SEQ ID NO: 682353 - RNA, 64 nt, Homo Sapiens; identical to SEQ ID NO: 176179

SEQ ID NO: 682354 - RNA, 64 nt, Homo Sapiens; identical to SEQ ID NO: 176180

SEQ ID NO: 682355 - RNA, 64 nt, Homo Sapiens; identical to SEQ ID NO: 176181

SEQ ID NO: 682356 - RNA, 64 nt, Homo Sapiens; identical to SEQ ID NO: 176182

SEQ ID NO: 682357 - RNA, 64 nt, Homo Sapiens; identical to SEQ ID NO: 176183

SEQ ID NO: 682358 - RNA, 64 nt, Homo Sapiens; identical to SEQ ID NO: 176184

SEQ ID NO: 682359 - RNA, 64 nt, Homo Sapiens; identical to SEQ ID NO: 176185

SEQ ID NO: 682360 - RNA, 64 nt, Homo Sapiens; identical to SEQ ID NO: 176186

SEQ ID NO: 682361 - RNA, 64 nt, Homo Sapiens; identical to SEQ ID NO: 176187

SEQ ID NO: 682362 - RNA, 64 nt, Homo Sapiens; identical to SEQ ID NO: 176188

SEQ ID NO: 682363 - RNA, 64 nt, Homo Sapiens; identical to SEQ ID NO: 176189

SEQ ID NO: 682364 - RNA, 64 nt, Homo Sapiens; identical to SEQ ID NO: 176190

SEQ ID NO: 682365 - RNA, 64 nt, Homo Sapiens; identical to SEQ ID NO: 176191

SEQ ID NO: 682366 - RNA, 64 nt, Homo Sapiens; identical to SEQ ID NO: 176192

SEQ ID NO: 682367 - RNA, 64 nt, Homo Sapiens; identical to SEQ ID NO: 176193

SEQ ID NO: 682368 - RNA, 53 nt, Homo Sapiens; identical to SEQ ID NO: 176194

SEQ ID NO: 682369 - RNA, 64 nt, Homo Sapiens; identical to SEQ ID NO: 176195

SEQ ID NO: 682370 - RNA, 64 nt, Homo Sapiens; identical to SEQ ID NO: 176196

SEQ ID NO: 682371 - RNA, 64 nt, Homo Sapiens; identical to SEQ ID NO: 176197

SEQ ID NO: 682372 - RNA, 64 nt, Homo Sapiens; identical to SEQ ID NO: 176198

SEQ ID NO: 682373 - RNA, 64 nt, Homo Sapiens; identical to SEQ ID NO: 176199

SEQ ID NO: 682374 - RNA, 64 nt, Homo Sapiens; identical to SEQ ID NO: 176200

SEQ ID NO: 682375 - RNA, 64 nt, Homo Sapiens; identical to SEQ ID NO: 176201

SEQ ID NO: 682376 - RNA, 64 nt, Homo Sapiens; identical to SEQ ID NO: 176202

SEQ ID NO: 682377 - RNA, 64 nt, Homo Sapiens; identical to SEQ ID NO: 176203

SEQ ID NO: 682378 - RNA, 64 nt, Homo Sapiens; identical to SEQ ID NO: 176204

SEQ ID NO: 682379 - RNA, 64 nt, Homo Sapiens; identical to SEQ ID NO: 176205

SEQ ID NO: 682380 - RNA, 64 nt, Homo Sapiens; identical to SEQ ID NO: 176206

SEQ ID NO: 682381 - RNA, 64 nt, Homo Sapiens; identical to SEQ ID NO: 176207

SEQ ID NO: 682382 - RNA, 64 nt, Homo Sapiens; identical to SEQ ID NO: 176208

SEQ ID NO: 682383 - RNA, 64 nt, Homo Sapiens; identical to SEQ ID NO: 176209

SEQ ID NO: 682384 - RNA, 64 nt, Homo Sapiens; identical to SEQ ID NO: 176210

SEQ ID NO: 682385 - RNA, 64 nt, Homo Sapiens; identical to SEQ ID NO: 176211

SEQ ID NO: 682386 - RNA, 64 nt, Homo Sapiens; identical to SEQ ID NO: 176212

SEQ ID NO: 682387 - RNA, 64 nt, Homo Sapiens; identical to SEQ ID NO: 176213

SEQ ID NO: 682388 - RNA, 64 nt, Homo Sapiens; identical to SEQ ID NO: 176214

SEQ ID NO: 682389 - RNA, 64 nt, Homo Sapiens; identical to SEQ ID NO: 176215

SEQ ID NO: 682390 - RNA, 64 nt, Homo Sapiens; identical to SEQ ID NO: 176216

SEQ ID NO: 682391 - RNA, 64 nt, Homo Sapiens; identical to SEQ ID NO: 176217

SEQ ID NO: 682392 - RNA, 64 nt, Homo Sapiens; identical to SEQ ID NO: 176218

SEQ ID NO: 682393 - RNA, 64 nt, Homo Sapiens; identical to SEQ ID NO: 176219

SEQ ID NO: 682394 - RNA, 64 nt, Homo Sapiens; identical to SEQ ID NO: 176220

SEQ ID NO: 682395 - RNA, 64 nt, Homo Sapiens; identical to SEQ ID NO: 176221

SEQ ID NO: 682396 - RNA, 64 nt, Homo Sapiens; identical to SEQ ID NO: 176222

SEQ ID NO: 682397 - RNA, 64 nt, Homo Sapiens; identical to SEQ ID NO: 176223

SEQ ID NO: 682398 - RNA, 64 nt, Homo Sapiens; identical to SEQ ID NO: 176224

SEQ ID NO: 682399 - RNA, 64 nt, Homo Sapiens; identical to SEQ ID NO: 176225

SEQ ID NO: 682400 - RNA, 64 nt, Homo Sapiens; identical to SEQ ID NO: 176226

SEQ ID NO: 682401 - RNA, 64 nt, Homo Sapiens; identical to SEQ ID NO: 176227

SEQ ID NO: 682402 - RNA, 64 nt, Homo Sapiens; identical to SEQ ID NO: 176228

SEQ ID NO: 682403 - RNA, 64 nt, Homo Sapiens; identical to SEQ ID NO: 176229

SEQ ID NO: 682404 - RNA, 64 nt, Homo Sapiens; identical to SEQ ID NO: 176230

SEQ ID NO: 682405 - RNA, 64 nt, Homo Sapiens; identical to SEQ ID NO: 176231

SEQ ID NO: 682406 - RNA, 64 nt, Homo Sapiens; identical to SEQ ID NO: 176232

SEQ ID NO: 682407 - RNA, 64 nt, Homo Sapiens; identical to SEQ ID NO: 176233

SEQ ID NO: 682408 - RNA, 64 nt, Homo Sapiens; identical to SEQ ID NO: 176234

SEQ ID NO: 682409 - RNA, 64 nt, Homo Sapiens; identical to SEQ ID NO: 176235

SEQ ID NO: 682410 - RNA, 64 nt, Homo Sapiens; identical to SEQ ID NO: 176236

SEQ ID NO: 682411 - RNA, 64 nt, Homo Sapiens; identical to SEQ ID NO: 176237

SEQ ID NO: 682412 - RNA, 64 nt, Homo Sapiens; identical to SEQ ID NO: 176238

SEQ ID NO: 682413 - RNA, 51 nt, Homo Sapiens; identical to SEQ ID NO: 176239

SEQ ID NO: 682414 - RNA, 64 nt, Homo Sapiens; identical to SEQ ID NO: 176240

SEQ ID NO: 682415 - RNA, 64 nt, Homo Sapiens; identical to SEQ ID NO: 176241

SEQ ID NO: 682416 - RNA, 64 nt, Homo Sapiens; identical to SEQ ID NO: 176242

SEQ ID NO: 682417 - RNA, 64 nt, Homo Sapiens; identical to SEQ ID NO: 176243

SEQ ID NO: 682418 - RNA, 64 nt, Homo Sapiens; identical to SEQ ID NO: 176244

SEQ ID NO: 682419 - RNA, 64 nt, Homo Sapiens; identical to SEQ ID NO: 176245

SEQ ID NO: 682420 - RNA, 64 nt, Homo Sapiens; identical to SEQ ID NO: 176246

SEQ ID NO: 682421 - RNA, 64 nt, Homo Sapiens; identical to SEQ ID NO: 176247

SEQ ID NO: 682422 - RNA, 64 nt, Homo Sapiens; identical to SEQ ID NO: 176248

SEQ ID NO: 682423 - RNA, 64 nt, Homo Sapiens; identical to SEQ ID NO: 176249

SEQ ID NO: 682424 - RNA, 64 nt, Homo Sapiens; identical to SEQ ID NO: 176250

SEQ ID NO: 682425 - RNA, 64 nt, Homo Sapiens; identical to SEQ ID NO: 176251

SEQ ID NO: 682426 - RNA, 64 nt, Homo Sapiens; identical to SEQ ID NO: 176252

SEQ ID NO: 682427 - RNA, 64 nt, Homo Sapiens; identical to SEQ ID NO: 176253

SEQ ID NO: 682428 - RNA, 64 nt, Homo Sapiens; identical to SEQ ID NO: 176254

SEQ ID NO: 682429 - RNA, 64 nt, Homo Sapiens; identical to SEQ ID NO: 176255

SEQ ID NO: 682430 - RNA, 64 nt, Homo Sapiens; identical to SEQ ID NO: 176256

SEQ ID NO: 682431 - RNA, 64 nt, Homo Sapiens; identical to SEQ ID NO: 176257

SEQ ID NO: 682432 - RNA, 64 nt, Homo Sapiens; identical to SEQ ID NO: 176258

SEQ ID NO: 682433 - RNA, 64 nt, Homo Sapiens; identical to SEQ ID NO: 176259

SEQ ID NO: 682434 - RNA, 64 nt, Homo Sapiens; identical to SEQ ID NO: 176260

SEQ ID NO: 682435 - RNA, 64 nt, Homo Sapiens; identical to SEQ ID NO: 176261

SEQ ID NO: 682436 - RNA, 64 nt, Homo Sapiens; identical to SEQ ID NO: 176262

SEQ ID NO: 682437 - RNA, 64 nt, Homo Sapiens; identical to SEQ ID NO: 176263

SEQ ID NO: 682438 - RNA, 64 nt, Homo Sapiens; identical to SEQ ID NO: 176264

SEQ ID NO: 682439 - RNA, 64 nt, Homo Sapiens; identical to SEQ ID NO: 176265

SEQ ID NO: 682440 - RNA, 64 nt, Homo Sapiens; identical to SEQ ID NO: 176266

SEQ ID NO: 682441 - RNA, 64 nt, Homo Sapiens; identical to SEQ ID NO: 176267

SEQ ID NO: 682442 - RNA, 64 nt, Homo Sapiens; identical to SEQ ID NO: 176268

SEQ ID NO: 682443 - RNA, 64 nt, Homo Sapiens; identical to SEQ ID NO: 176269

SEQ ID NO: 682444 - RNA, 53 nt, Homo Sapiens; identical to SEQ ID NO: 176270

SEQ ID NO: 682445 - RNA, 64 nt, Homo Sapiens; identical to SEQ ID NO: 176271

SEQ ID NO: 682446 - RNA, 64 nt, Homo Sapiens; identical to SEQ ID NO: 176272

SEQ ID NO: 682447 - RNA, 64 nt, Homo Sapiens; identical to SEQ ID NO: 229070

SEQ ID NO: 682448 - RNA, 64 nt, Homo Sapiens; identical to SEQ ID NO: 229071

SEQ ID NO: 682449 - RNA, 64 nt, Homo Sapiens; identical to SEQ ID NO: 229072

SEQ ID NO: 682450 - RNA, 64 nt, Homo Sapiens; identical to SEQ ID NO: 229073

SEQ ID NO: 682451 - RNA, 64 nt, Homo Sapiens; identical to SEQ ID NO: 229074

SEQ ID NO: 682452 - RNA, 59 nt, Homo Sapiens; identical to SEQ ID NO: 229075

SEQ ID NO: 682453 - RNA, 64 nt, Homo Sapiens; identical to SEQ ID NO: 229076

SEQ ID NO: 682454 - RNA, 64 nt, Homo Sapiens; identical to SEQ ID NO: 229077

SEQ ID NO: 682455 - RNA, 64 nt, Homo Sapiens; identical to SEQ ID NO: 259689

SEQ ID NO: 682456 - RNA, 64 nt, Homo Sapiens; identical to SEQ ID NO: 259690

SEQ ID NO: 682457 - RNA, 64 nt, Homo Sapiens; identical to SEQ ID NO: 259691

SEQ ID NO: 682458 - RNA, 64 nt, Homo Sapiens; identical to SEQ ID NO: 259692

SEQ ID NO: 682459 - RNA, 64 nt, Homo Sapiens; identical to SEQ ID NO: 259693

SEQ ID NO: 682460 - RNA, 64 nt, Homo Sapiens; identical to SEQ ID NO: 259694

SEQ ID NO: 682461 - RNA, 64 nt, Homo Sapiens; identical to SEQ ID NO: 259695

SEQ ID NO: 682462 - RNA, 64 nt, Homo Sapiens; identical to SEQ ID NO: 259696

SEQ ID NO: 682463 - RNA, 64 nt, Homo Sapiens
uuuucgaaguaguagauucucagaucuuuauucuaacaauuacaugauuugaaaacaguacuca

SEQ ID NO: 682464 - RNA, 64 nt, Homo Sapiens
uuuaaaaaauguuuuguaaauccagguguauuuuaacaauuaaaugccuauuuuguuauauguu

SEQ ID NO: 682465 - RNA, 64 nt, Homo Sapiens
cuuucauaagacuauuuuaaauagaaauuauuucaacaauuaaaguaauguugaccaucccccu

SEQ ID NO: 682466 - RNA, 64 nt, Homo Sapiens
cauguuaaugaauauuuuugcaguuguaaagcauaacaauuacaacuacacaucuauuucuaaa

SEQ ID NO: 682467 - RNA, 64 nt, Homo Sapiens
gagaucaguauuguaacguaugugaauagaugauaacaauuaauauuacuaaaagucccacaug

SEQ ID NO: 682468 - RNA, 64 nt, Homo Sapiens
ucucagagggcaacuuuauuuauaauaacaauuaaacaauuauuagacugucuuggaaaaaaaa

SEQ ID NO: 682469 - RNA, 64 nt, Homo Sapiens
caauuauuucucagagggcaaaaaaaaauauaauaacaauuaaaacagaugaagacugucuugg

SEQ ID NO: 682470 - RNA, 64 nt, Homo Sapiens
gaaaacaaguacuuuaguaucaggacaggaguugaacaauuagguuagcagauggagaugagag

SEQ ID NO: 682471 - RNA, 64 nt, Homo Sapiens
uaugguggcaauaucacaagggaggagagaggaaaacaauuaucuucucuacuuggauuaugag

SEQ ID NO: 682472 - RNA, 64 nt, Homo Sapiens
uucuaaaaagucaauucaucuaguuaagucgcugaacaauuaccugccaaaugcuauacugugu

SEQ ID NO: 682473 - RNA, 64 nt, Homo Sapiens
agagcagggugggguaaggaggagaaaauaaaccaacaauuaggucugcauuuucucaggcagu

SEQ ID NO: 682474 - RNA, 64 nt, Homo Sapiens; identical to SEQ ID NO: 544188

SEQ ID NO: 682475 - RNA, 64 nt, Homo Sapiens; identical to SEQ ID NO: 544189

SEQ ID NO: 682476 - RNA, 64 nt, Homo Sapiens; identical to SEQ ID NO: 544190

SEQ ID NO: 682477 - RNA, 64 nt, Homo Sapiens; identical to SEQ ID NO: 544191

SEQ ID NO: 682478 - RNA, 64 nt, Homo Sapiens; identical to SEQ ID NO: 544192

SEQ ID NO: 682479 - RNA, 64 nt, Homo Sapiens; identical to SEQ ID NO: 544193

SEQ ID NO: 682480 - RNA, 64 nt, Homo Sapiens; identical to SEQ ID NO: 544194

SEQ ID NO: 682481 - RNA, 64 nt, Homo Sapiens; identical to SEQ ID NO: 544195

SEQ ID NO: 682482 - RNA, 64 nt, Homo Sapiens; identical to SEQ ID NO: 544196

SEQ ID NO: 682483 - RNA, 64 nt, Homo Sapiens; identical to SEQ ID NO: 544197

SEQ ID NO: 682484 - RNA, 64 nt, Homo Sapiens; identical to SEQ ID NO: 544198

SEQ ID NO: 682485 - RNA, 64 nt, Homo Sapiens; identical to SEQ ID NO: 544199

SEQ ID NO: 682486 - RNA, 64 nt, Homo Sapiens; identical to SEQ ID NO: 544200

SEQ ID NO: 682487 - RNA, 63 nt, Homo Sapiens; identical to SEQ ID NO: 544201

SEQ ID NO: 682488 - RNA, 64 nt, Homo Sapiens; identical to SEQ ID NO: 544202

SEQ ID NO: 682489 - RNA, 64 nt, Homo Sapiens; identical to SEQ ID NO: 544203

SEQ ID NO: 682490 - RNA, 64 nt, Homo Sapiens; identical to SEQ ID NO: 544204

SEQ ID NO: 682491 - RNA, 64 nt, Homo Sapiens; identical to SEQ ID NO: 544205

SEQ ID NO: 682492 - RNA, 64 nt, Homo Sapiens; identical to SEQ ID NO: 544206

SEQ ID NO: 682493 - RNA, 64 nt, Homo Sapiens; identical to SEQ ID NO: 544207

SEQ ID NO: 682494 - RNA, 64 nt, Homo Sapiens; identical to SEQ ID NO: 544208

SEQ ID NO: 682495 - RNA, 64 nt, Homo Sapiens; identical to SEQ ID NO: 544209

SEQ ID NO: 682496 - RNA, 64 nt, Homo Sapiens; identical to SEQ ID NO: 544210

SEQ ID NO: 682497 - RNA, 64 nt, Homo Sapiens; identical to SEQ ID NO: 544211

SEQ ID NO: 682498 - RNA, 64 nt, Homo Sapiens; identical to SEQ ID NO: 544212

SEQ ID NO: 682499 - RNA, 64 nt, Homo Sapiens; identical to SEQ ID NO: 544213

SEQ ID NO: 682500 - RNA, 64 nt, Homo Sapiens; identical to SEQ ID NO: 544214

SEQ ID NO: 682501 - RNA, 64 nt, Homo Sapiens; identical to SEQ ID NO: 544215

SEQ ID NO: 682502 - RNA, 64 nt, Homo Sapiens; identical to SEQ ID NO: 544216

SEQ ID NO: 682503 - RNA, 64 nt, Homo Sapiens; identical to SEQ ID NO: 544217

SEQ ID NO: 682504 - RNA, 64 nt, Homo Sapiens; identical to SEQ ID NO: 544218

SEQ ID NO: 682505 - RNA, 64 nt, Homo Sapiens; identical to SEQ ID NO: 544219

SEQ ID NO: 682506 - RNA, 64 nt, Homo Sapiens; identical to SEQ ID NO: 544220

SEQ ID NO: 682507 - RNA, 64 nt, Homo Sapiens; identical to SEQ ID NO: 544221

SEQ ID NO: 682508 - RNA, 64 nt, Homo Sapiens; identical to SEQ ID NO: 544222

SEQ ID NO: 682509 - RNA, 64 nt, Homo Sapiens; identical to SEQ ID NO: 544223

SEQ ID NO: 682510 - RNA, 64 nt, Homo Sapiens; identical to SEQ ID NO: 544224

SEQ ID NO: 682511 - RNA, 64 nt, Homo Sapiens; identical to SEQ ID NO: 544225

SEQ ID NO: 682512 - RNA, 64 nt, Homo Sapiens; identical to SEQ ID NO: 544226

SEQ ID NO: 682513 - RNA, 64 nt, Homo Sapiens; identical to SEQ ID NO: 544227

SEQ ID NO: 682514 - RNA, 64 nt, Homo Sapiens; identical to SEQ ID NO: 544228

SEQ ID NO: 682515 - RNA, 64 nt, Homo Sapiens; identical to SEQ ID NO: 544229

SEQ ID NO: 682516 - RNA, 64 nt, Homo Sapiens; identical to SEQ ID NO: 544230

SEQ ID NO: 682517 - RNA, 64 nt, Homo Sapiens; identical to SEQ ID NO: 544231

SEQ ID NO: 682518 - RNA, 64 nt, Homo Sapiens; identical to SEQ ID NO: 544232

SEQ ID NO: 682519 - RNA, 64 nt, Homo Sapiens; identical to SEQ ID NO: 544233

SEQ ID NO: 682520 - RNA, 64 nt, Homo Sapiens; identical to SEQ ID NO: 544234

SEQ ID NO: 682521 - RNA, 64 nt, Homo Sapiens; identical to SEQ ID NO: 544235

SEQ ID NO: 682522 - RNA, 64 nt, Homo Sapiens; identical to SEQ ID NO: 544236

SEQ ID NO: 682523 - RNA, 64 nt, Homo Sapiens; identical to SEQ ID NO: 544237

SEQ ID NO: 682524 - RNA, 64 nt, Homo Sapiens; identical to SEQ ID NO: 544238

SEQ ID NO: 682525 - RNA, 64 nt, Homo Sapiens; identical to SEQ ID NO: 544239

SEQ ID NO: 682526 - RNA, 64 nt, Homo Sapiens; identical to SEQ ID NO: 544240

SEQ ID NO: 682527 - RNA, 64 nt, Homo Sapiens; identical to SEQ ID NO: 544241

SEQ ID NO: 682528 - RNA, 64 nt, Homo Sapiens; identical to SEQ ID NO: 544242

SEQ ID NO: 682529 - RNA, 64 nt, Homo Sapiens; identical to SEQ ID NO: 544243

SEQ ID NO: 682530 - RNA, 64 nt, Homo Sapiens; identical to SEQ ID NO: 544244

SEQ ID NO: 682531 - RNA, 64 nt, Homo Sapiens; identical to SEQ ID NO: 544245

SEQ ID NO: 682532 - RNA, 64 nt, Homo Sapiens; identical to SEQ ID NO: 544246

SEQ ID NO: 682533 - RNA, 64 nt, Homo Sapiens; identical to SEQ ID NO: 544247

SEQ ID NO: 682534 - RNA, 64 nt, Homo Sapiens; identical to SEQ ID NO: 544248

SEQ ID NO: 682535 - RNA, 64 nt, Homo Sapiens; identical to SEQ ID NO: 544249

SEQ ID NO: 682536 - RNA, 64 nt, Homo Sapiens; identical to SEQ ID NO: 544250

SEQ ID NO: 682537 - RNA, 64 nt, Homo Sapiens; identical to SEQ ID NO: 544251

SEQ ID NO: 682538 - RNA, 64 nt, Homo Sapiens; identical to SEQ ID NO: 544252

SEQ ID NO: 682539 - RNA, 64 nt, Homo Sapiens; identical to SEQ ID NO: 544253

SEQ ID NO: 682540 - RNA, 64 nt, Homo Sapiens; identical to SEQ ID NO: 544254

SEQ ID NO: 682541 - RNA, 64 nt, Homo Sapiens; identical to SEQ ID NO: 544255

SEQ ID NO: 682542 - RNA, 64 nt, Homo Sapiens; identical to SEQ ID NO: 544256

SEQ ID NO: 682543 - RNA, 64 nt, Homo Sapiens; identical to SEQ ID NO: 544257

SEQ ID NO: 682544 - RNA, 64 nt, Homo Sapiens; identical to SEQ ID NO: 544258

SEQ ID NO: 682545 - RNA, 64 nt, Homo Sapiens; identical to SEQ ID NO: 544259

SEQ ID NO: 682546 - RNA, 64 nt, Homo Sapiens; identical to SEQ ID NO: 544260

SEQ ID NO: 682547 - RNA, 64 nt, Homo Sapiens; identical to SEQ ID NO: 544261

SEQ ID NO: 682548 - RNA, 64 nt, Homo Sapiens; identical to SEQ ID NO: 544262

SEQ ID NO: 682549 - RNA, 64 nt, Homo Sapiens; identical to SEQ ID NO: 544263

SEQ ID NO: 682550 - RNA, 64 nt, Homo Sapiens; identical to SEQ ID NO: 544264

SEQ ID NO: 682551 - RNA, 64 nt, Homo Sapiens; identical to SEQ ID NO: 544265

SEQ ID NO: 682552 - RNA, 64 nt, Homo Sapiens; identical to SEQ ID NO: 544266

SEQ ID NO: 682553 - RNA, 64 nt, Homo Sapiens; identical to SEQ ID NO: 544267

SEQ ID NO: 682554 - RNA, 64 nt, Homo Sapiens; identical to SEQ ID NO: 544268

SEQ ID NO: 682555 - RNA, 64 nt, Homo Sapiens; identical to SEQ ID NO: 544269

SEQ ID NO: 682556 - RNA, 64 nt, Homo Sapiens; identical to SEQ ID NO: 544270

SEQ ID NO: 682557 - RNA, 64 nt, Homo Sapiens; identical to SEQ ID NO: 544271

SEQ ID NO: 682558 - RNA, 64 nt, Homo Sapiens; identical to SEQ ID NO: 544272

SEQ ID NO: 682559 - RNA, 64 nt, Homo Sapiens; identical to SEQ ID NO: 544273

SEQ ID NO: 682560 - RNA, 64 nt, Homo Sapiens; identical to SEQ ID NO: 544274

SEQ ID NO: 682561 - RNA, 64 nt, Homo Sapiens; identical to SEQ ID NO: 544275

SEQ ID NO: 682562 - RNA, 64 nt, Homo Sapiens; identical to SEQ ID NO: 544276

SEQ ID NO: 682563 - RNA, 64 nt, Homo Sapiens; identical to SEQ ID NO: 544277

SEQ ID NO: 682564 - RNA, 64 nt, Homo Sapiens; identical to SEQ ID NO: 544278

SEQ ID NO: 682565 - RNA, 64 nt, Homo Sapiens; identical to SEQ ID NO: 544279

SEQ ID NO: 682566 - RNA, 64 nt, Homo Sapiens; identical to SEQ ID NO: 544280

SEQ ID NO: 682567 - RNA, 64 nt, Homo Sapiens; identical to SEQ ID NO: 544281

SEQ ID NO: 682568 - RNA, 64 nt, Homo Sapiens; identical to SEQ ID NO: 544282

SEQ ID NO: 682569 - RNA, 64 nt, Homo Sapiens; identical to SEQ ID NO: 544283

SEQ ID NO: 682570 - RNA, 64 nt, Homo Sapiens; identical to SEQ ID NO: 544284

SEQ ID NO: 682571 - RNA, 64 nt, Homo Sapiens; identical to SEQ ID NO: 544285

SEQ ID NO: 682572 - RNA, 64 nt, Homo Sapiens; identical to SEQ ID NO: 544286

SEQ ID NO: 682573 - RNA, 64 nt, Homo Sapiens; identical to SEQ ID NO: 544287

SEQ ID NO: 682574 - RNA, 64 nt, Homo Sapiens; identical to SEQ ID NO: 544288

SEQ ID NO: 682575 - RNA, 64 nt, Homo Sapiens; identical to SEQ ID NO: 544289

SEQ ID NO: 682576 - RNA, 64 nt, Homo Sapiens; identical to SEQ ID NO: 544290

SEQ ID NO: 682577 - RNA, 64 nt, Homo Sapiens; identical to SEQ ID NO: 544291

SEQ ID NO: 682578 - RNA, 64 nt, Homo Sapiens; identical to SEQ ID NO: 544292

SEQ ID NO: 682579 - RNA, 64 nt, Homo Sapiens; identical to SEQ ID NO: 544293

SEQ ID NO: 682580 - RNA, 64 nt, Homo Sapiens; identical to SEQ ID NO: 544294

SEQ ID NO: 682581 - RNA, 64 nt, Homo Sapiens; identical to SEQ ID NO: 544295

SEQ ID NO: 682582 - RNA, 64 nt, Homo Sapiens; identical to SEQ ID NO: 544296

SEQ ID NO: 682583 - RNA, 64 nt, Homo Sapiens; identical to SEQ ID NO: 544297

SEQ ID NO: 682584 - RNA, 64 nt, Homo Sapiens; identical to SEQ ID NO: 544298

SEQ ID NO: 682585 - RNA, 64 nt, Homo Sapiens; identical to SEQ ID NO: 544299

SEQ ID NO: 682586 - RNA, 64 nt, Homo Sapiens; identical to SEQ ID NO: 544300

SEQ ID NO: 682587 - RNA, 64 nt, Homo Sapiens; identical to SEQ ID NO: 544301

SEQ ID NO: 682588 - RNA, 64 nt, Homo Sapiens; identical to SEQ ID NO: 544302

SEQ ID NO: 682589 - RNA, 64 nt, Homo Sapiens; identical to SEQ ID NO: 544303

SEQ ID NO: 682590 - RNA, 64 nt, Homo Sapiens; identical to SEQ ID NO: 544304

SEQ ID NO: 682591 - RNA, 64 nt, Homo Sapiens; identical to SEQ ID NO: 544305

SEQ ID NO: 682592 - RNA, 64 nt, Homo Sapiens; identical to SEQ ID NO: 544306

SEQ ID NO: 682593 - RNA, 64 nt, Homo Sapiens; identical to SEQ ID NO: 544307

SEQ ID NO: 682594 - RNA, 64 nt, Homo Sapiens; identical to SEQ ID NO: 544308

SEQ ID NO: 682595 - RNA, 64 nt, Homo Sapiens; identical to SEQ ID NO: 544309

SEQ ID NO: 682596 - RNA, 64 nt, Homo Sapiens; identical to SEQ ID NO: 544310

SEQ ID NO: 682597 - RNA, 64 nt, Homo Sapiens; identical to SEQ ID NO: 544311

SEQ ID NO: 682598 - RNA, 64 nt, Homo Sapiens; identical to SEQ ID NO: 544312

SEQ ID NO: 682599 - RNA, 64 nt, Homo Sapiens; identical to SEQ ID NO: 544313

SEQ ID NO: 682600 - RNA, 63 nt, Homo Sapiens; identical to SEQ ID NO: 544314

SEQ ID NO: 682601 - RNA, 64 nt, Homo Sapiens; identical to SEQ ID NO: 544315

SEQ ID NO: 682602 - RNA, 64 nt, Homo Sapiens; identical to SEQ ID NO: 544316

SEQ ID NO: 682603 - RNA, 64 nt, Homo Sapiens; identical to SEQ ID NO: 544317

SEQ ID NO: 682604 - RNA, 64 nt, Homo Sapiens; identical to SEQ ID NO: 544318

SEQ ID NO: 682605 - RNA, 64 nt, Homo Sapiens; identical to SEQ ID NO: 544319

SEQ ID NO: 682606 - RNA, 64 nt, Homo Sapiens; identical to SEQ ID NO: 544320

SEQ ID NO: 682607 - RNA, 64 nt, Homo Sapiens; identical to SEQ ID NO: 544321

SEQ ID NO: 682608 - RNA, 64 nt, Homo Sapiens; identical to SEQ ID NO: 544322

SEQ ID NO: 682609 - RNA, 64 nt, Homo Sapiens; identical to SEQ ID NO: 544323

SEQ ID NO: 682610 - RNA, 64 nt, Homo Sapiens; identical to SEQ ID NO: 544324

SEQ ID NO: 682611 - RNA, 64 nt, Homo Sapiens; identical to SEQ ID NO: 544325

SEQ ID NO: 682612 - RNA, 64 nt, Homo Sapiens; identical to SEQ ID NO: 544326

SEQ ID NO: 682613 - RNA, 64 nt, Homo Sapiens; identical to SEQ ID NO: 544327

SEQ ID NO: 682614 - RNA, 64 nt, Homo Sapiens; identical to SEQ ID NO: 544328

SEQ ID NO: 682615 - RNA, 64 nt, Homo Sapiens; identical to SEQ ID NO: 544329

SEQ ID NO: 682616 - RNA, 64 nt, Homo Sapiens; identical to SEQ ID NO: 544330

SEQ ID NO: 682617 - RNA, 64 nt, Homo Sapiens; identical to SEQ ID NO: 544331

SEQ ID NO: 682618 - RNA, 64 nt, Homo Sapiens; identical to SEQ ID NO: 544332

SEQ ID NO: 682619 - RNA, 64 nt, Homo Sapiens; identical to SEQ ID NO: 544333

SEQ ID NO: 682620 - RNA, 64 nt, Homo Sapiens; identical to SEQ ID NO: 544334

SEQ ID NO: 682621 - RNA, 64 nt, Homo Sapiens; identical to SEQ ID NO: 544335

SEQ ID NO: 682622 - RNA, 64 nt, Homo Sapiens; identical to SEQ ID NO: 544336

SEQ ID NO: 682623 - RNA, 64 nt, Homo Sapiens; identical to SEQ ID NO: 544337

SEQ ID NO: 682624 - RNA, 64 nt, Homo Sapiens; identical to SEQ ID NO: 544338

SEQ ID NO: 682625 - RNA, 64 nt, Homo Sapiens; identical to SEQ ID NO: 544339

SEQ ID NO: 682626 - RNA, 64 nt, Homo Sapiens; identical to SEQ ID NO: 544340

SEQ ID NO: 682627 - RNA, 64 nt, Homo Sapiens; identical to SEQ ID NO: 544341

SEQ ID NO: 682628 - RNA, 64 nt, Homo Sapiens; identical to SEQ ID NO: 544342

SEQ ID NO: 682629 - RNA, 64 nt, Homo Sapiens; identical to SEQ ID NO: 544343

SEQ ID NO: 682630 - RNA, 64 nt, Homo Sapiens; identical to SEQ ID NO: 544344

SEQ ID NO: 682631 - RNA, 64 nt, Homo Sapiens; identical to SEQ ID NO: 544345

SEQ ID NO: 682632 - RNA, 64 nt, Homo Sapiens; identical to SEQ ID NO: 544346

SEQ ID NO: 682633 - RNA, 64 nt, Homo Sapiens; identical to SEQ ID NO: 544347

SEQ ID NO: 682634 - RNA, 64 nt, Homo Sapiens; identical to SEQ ID NO: 544348

SEQ ID NO: 682635 - RNA, 64 nt, Homo Sapiens; identical to SEQ ID NO: 544349

SEQ ID NO: 682636 - RNA, 64 nt, Homo Sapiens; identical to SEQ ID NO: 544350

SEQ ID NO: 682637 - RNA, 64 nt, Homo Sapiens; identical to SEQ ID NO: 544351

SEQ ID NO: 682638 - RNA, 64 nt, Homo Sapiens; identical to SEQ ID NO: 544352

SEQ ID NO: 682639 - RNA, 64 nt, Homo Sapiens; identical to SEQ ID NO: 544353

SEQ ID NO: 682640 - RNA, 64 nt, Homo Sapiens; identical to SEQ ID NO: 544354

SEQ ID NO: 682641 - RNA, 64 nt, Homo Sapiens; identical to SEQ ID NO: 544355

SEQ ID NO: 682642 - RNA, 64 nt, Homo Sapiens; identical to SEQ ID NO: 544356

SEQ ID NO: 682643 - RNA, 64 nt, Homo Sapiens; identical to SEQ ID NO: 544357

SEQ ID NO: 682644 - RNA, 64 nt, Homo Sapiens; identical to SEQ ID NO: 544358

SEQ ID NO: 682645 - RNA, 64 nt, Homo Sapiens; identical to SEQ ID NO: 544359

SEQ ID NO: 682646 - RNA, 64 nt, Homo Sapiens; identical to SEQ ID NO: 544360

SEQ ID NO: 682647 - RNA, 64 nt, Homo Sapiens; identical to SEQ ID NO: 544361

SEQ ID NO: 682648 - RNA, 64 nt, Homo Sapiens; identical to SEQ ID NO: 544362

SEQ ID NO: 682649 - RNA, 64 nt, Homo Sapiens; identical to SEQ ID NO: 544363

SEQ ID NO: 682650 - RNA, 64 nt, Homo Sapiens; identical to SEQ ID NO: 544364

SEQ ID NO: 682651 - RNA, 64 nt, Homo Sapiens; identical to SEQ ID NO: 544365

SEQ ID NO: 682652 - RNA, 64 nt, Homo Sapiens; identical to SEQ ID NO: 544366

SEQ ID NO: 682653 - RNA, 64 nt, Homo Sapiens; identical to SEQ ID NO: 544367

SEQ ID NO: 682654 - RNA, 64 nt, Homo Sapiens; identical to SEQ ID NO: 544368

SEQ ID NO: 682655 - RNA, 64 nt, Homo Sapiens; identical to SEQ ID NO: 544369

SEQ ID NO: 682656 - RNA, 64 nt, Homo Sapiens; identical to SEQ ID NO: 544370

SEQ ID NO: 682657 - RNA, 64 nt, Homo Sapiens; identical to SEQ ID NO: 544371

SEQ ID NO: 682658 - RNA, 64 nt, Homo Sapiens; identical to SEQ ID NO: 544372

SEQ ID NO: 682659 - RNA, 64 nt, Homo Sapiens; identical to SEQ ID NO: 544373

SEQ ID NO: 682660 - RNA, 64 nt, Homo Sapiens; identical to SEQ ID NO: 544374

SEQ ID NO: 682661 - RNA, 64 nt, Homo Sapiens; identical to SEQ ID NO: 544375

SEQ ID NO: 682662 - RNA, 64 nt, Homo Sapiens; identical to SEQ ID NO: 544376

SEQ ID NO: 682663 - RNA, 64 nt, Homo Sapiens; identical to SEQ ID NO: 544377

SEQ ID NO: 682664 - RNA, 64 nt, Homo Sapiens; identical to SEQ ID NO: 544378

SEQ ID NO: 682665 - RNA, 64 nt, Homo Sapiens; identical to SEQ ID NO: 544379

SEQ ID NO: 682666 - RNA, 64 nt, Homo Sapiens; identical to SEQ ID NO: 544380

SEQ ID NO: 682667 - RNA, 64 nt, Homo Sapiens; identical to SEQ ID NO: 544381

SEQ ID NO: 682668 - RNA, 64 nt, Homo Sapiens; identical to SEQ ID NO: 544382

SEQ ID NO: 682669 - RNA, 64 nt, Homo Sapiens; identical to SEQ ID NO: 544383

SEQ ID NO: 682670 - RNA, 64 nt, Homo Sapiens; identical to SEQ ID NO: 544384

SEQ ID NO: 682671 - RNA, 64 nt, Homo Sapiens; identical to SEQ ID NO: 544385

SEQ ID NO: 682672 - RNA, 64 nt, Homo Sapiens; identical to SEQ ID NO: 544386

SEQ ID NO: 682673 - RNA, 64 nt, Homo Sapiens; identical to SEQ ID NO: 212680

SEQ ID NO: 682674 - RNA, 64 nt, Homo Sapiens; identical to SEQ ID NO: 212681

SEQ ID NO: 682675 - RNA, 64 nt, Homo Sapiens; identical to SEQ ID NO: 212682

SEQ ID NO: 682676 - RNA, 64 nt, Homo Sapiens; identical to SEQ ID NO: 212683

SEQ ID NO: 682677 - RNA, 64 nt, Homo Sapiens; identical to SEQ ID NO: 212684

SEQ ID NO: 682678 - RNA, 64 nt, Homo Sapiens; identical to SEQ ID NO: 212685

SEQ ID NO: 682679 - RNA, 64 nt, Homo Sapiens; identical to SEQ ID NO: 212686

SEQ ID NO: 682680 - RNA, 64 nt, Homo Sapiens; identical to SEQ ID NO: 212687

SEQ ID NO: 682681 - RNA, 64 nt, Homo Sapiens; identical to SEQ ID NO: 82031

SEQ ID NO: 682682 - RNA, 64 nt, Homo Sapiens; identical to SEQ ID NO: 82032

SEQ ID NO: 682683 - RNA, 64 nt, Homo Sapiens; identical to SEQ ID NO: 82033

SEQ ID NO: 682684 - RNA, 64 nt, Homo Sapiens; identical to SEQ ID NO: 82034

SEQ ID NO: 682685 - RNA, 64 nt, Homo Sapiens; identical to SEQ ID NO: 82035

SEQ ID NO: 682686 - RNA, 64 nt, Homo Sapiens; identical to SEQ ID NO: 82036

SEQ ID NO: 682687 - RNA, 64 nt, Homo Sapiens; identical to SEQ ID NO: 82037

SEQ ID NO: 682688 - RNA, 64 nt, Homo Sapiens; identical to SEQ ID NO: 82038

SEQ ID NO: 682689 - RNA, 64 nt, Homo Sapiens; identical to SEQ ID NO: 82039

SEQ ID NO: 682690 - RNA, 64 nt, Homo Sapiens; identical to SEQ ID NO: 82040

SEQ ID NO: 682691 - RNA, 64 nt, Homo Sapiens; identical to SEQ ID NO: 82041

SEQ ID NO: 682692 - RNA, 64 nt, Homo Sapiens; identical to SEQ ID NO: 82042

SEQ ID NO: 682693 - RNA, 64 nt, Homo Sapiens; identical to SEQ ID NO: 82043

SEQ ID NO: 682694 - RNA, 64 nt, Homo Sapiens; identical to SEQ ID NO: 82044

SEQ ID NO: 682695 - RNA, 64 nt, Homo Sapiens; identical to SEQ ID NO: 82045

SEQ ID NO: 682696 - RNA, 64 nt, Homo Sapiens; identical to SEQ ID NO: 82046

SEQ ID NO: 682697 - RNA, 64 nt, Homo Sapiens; identical to SEQ ID NO: 82047

SEQ ID NO: 682698 - RNA, 64 nt, Homo Sapiens; identical to SEQ ID NO: 82048

SEQ ID NO: 682699 - RNA, 64 nt, Homo Sapiens; identical to SEQ ID NO: 82049

SEQ ID NO: 682700 - RNA, 64 nt, Homo Sapiens; identical to SEQ ID NO: 82050

SEQ ID NO: 682701 - RNA, 64 nt, Homo Sapiens; identical to SEQ ID NO: 82051

SEQ ID NO: 682702 - RNA, 64 nt, Homo Sapiens; identical to SEQ ID NO: 82052

SEQ ID NO: 682703 - RNA, 64 nt, Homo Sapiens; identical to SEQ ID NO: 82053

SEQ ID NO: 682704 - RNA, 64 nt, Homo Sapiens; identical to SEQ ID NO: 82054

SEQ ID NO: 682705 - RNA, 64 nt, Homo Sapiens; identical to SEQ ID NO: 82055

SEQ ID NO: 682706 - RNA, 64 nt, Homo Sapiens; identical to SEQ ID NO: 82056

SEQ ID NO: 682707 - RNA, 64 nt, Homo Sapiens; identical to SEQ ID NO: 82057

SEQ ID NO: 682708 - RNA, 64 nt, Homo Sapiens; identical to SEQ ID NO: 82058

SEQ ID NO: 682709 - RNA, 64 nt, Homo Sapiens; identical to SEQ ID NO: 82059

SEQ ID NO: 682710 - RNA, 64 nt, Homo Sapiens; identical to SEQ ID NO: 82060

SEQ ID NO: 682711 - RNA, 64 nt, Homo Sapiens; identical to SEQ ID NO: 82061

SEQ ID NO: 682712 - RNA, 64 nt, Homo Sapiens; identical to SEQ ID NO: 51918

SEQ ID NO: 682713 - RNA, 64 nt, Homo Sapiens; identical to SEQ ID NO: 51919

SEQ ID NO: 682714 - RNA, 64 nt, Homo Sapiens; identical to SEQ ID NO: 51920

SEQ ID NO: 682715 - RNA, 64 nt, Homo Sapiens; identical to SEQ ID NO: 51921

SEQ ID NO: 682716 - RNA, 64 nt, Homo Sapiens; identical to SEQ ID NO: 51922

SEQ ID NO: 682717 - RNA, 64 nt, Homo Sapiens; identical to SEQ ID NO: 51923

SEQ ID NO: 682718 - RNA, 64 nt, Homo Sapiens; identical to SEQ ID NO: 51924

SEQ ID NO: 682719 - RNA, 64 nt, Homo Sapiens; identical to SEQ ID NO: 51925

SEQ ID NO: 682720 - RNA, 64 nt, Homo Sapiens; identical to SEQ ID NO: 51926

SEQ ID NO: 682721 - RNA, 64 nt, Homo Sapiens; identical to SEQ ID NO: 51927

SEQ ID NO: 682722 - RNA, 64 nt, Homo Sapiens; identical to SEQ ID NO: 51928

SEQ ID NO: 682723 - RNA, 64 nt, Homo Sapiens; identical to SEQ ID NO: 51929

SEQ ID NO: 682724 - RNA, 64 nt, Homo Sapiens; identical to SEQ ID NO: 51930

SEQ ID NO: 682725 - RNA, 64 nt, Homo Sapiens; identical to SEQ ID NO: 51931

SEQ ID NO: 682726 - RNA, 64 nt, Homo Sapiens; identical to SEQ ID NO: 51932

SEQ ID NO: 682727 - RNA, 64 nt, Homo Sapiens; identical to SEQ ID NO: 51933

SEQ ID NO: 682728 - RNA, 64 nt, Homo Sapiens; identical to SEQ ID NO: 51934

SEQ ID NO: 682729 - RNA, 64 nt, Homo Sapiens; identical to SEQ ID NO: 51935

SEQ ID NO: 682730 - RNA, 64 nt, Homo Sapiens; identical to SEQ ID NO: 51936

SEQ ID NO: 682731 - RNA, 64 nt, Homo Sapiens; identical to SEQ ID NO: 51937

SEQ ID NO: 682732 - RNA, 64 nt, Homo Sapiens; identical to SEQ ID NO: 51938

SEQ ID NO: 682733 - RNA, 64 nt, Homo Sapiens; identical to SEQ ID NO: 51939

SEQ ID NO: 682734 - RNA, 64 nt, Homo Sapiens; identical to SEQ ID NO: 51940

SEQ ID NO: 682735 - RNA, 64 nt, Homo Sapiens; identical to SEQ ID NO: 51941

SEQ ID NO: 682736 - RNA, 64 nt, Homo Sapiens; identical to SEQ ID NO: 51942

SEQ ID NO: 682737 - RNA, 64 nt, Homo Sapiens; identical to SEQ ID NO: 51943

SEQ ID NO: 682738 - RNA, 64 nt, Homo Sapiens; identical to SEQ ID NO: 51944

SEQ ID NO: 682739 - RNA, 62 nt, Homo Sapiens
gcugcuaaacaaucauuggaucacaauccucaucagacaaacccaucuguaaaaaaaaugag

SEQ ID NO: 682740 - RNA, 62 nt, Homo Sapiens
ucaaauuuaagggaauaauuuauaccaucuuuucagacaagaauguacagcaaaaauaaggg

SEQ ID NO: 682741 - RNA, 62 nt, Homo Sapiens
ccauuucuccccaccacggauacacagcugcaucagacaaugucugcagggcuucucuuguu

SEQ ID NO: 682742 - RNA, 62 nt, Homo Sapiens
gcaaggccucgugccccugcugugaggacuucucagacaaaguuccaucugaucagcugugg

SEQ ID NO: 682743 - RNA, 62 nt, Homo Sapiens
ccuuuucuccuguguaucuuuuguguuugguuucagacaaaaauguuauuuauuagcccuaa

SEQ ID NO: 682744 - RNA, 62 nt, Homo Sapiens
uuaacccuuuucuccuguguuuguguuugauuucagacaaaaaaguuauuuauuagcccuaa

SEQ ID NO: 682745 - RNA, 62 nt, Homo Sapiens
guucagugaggaaaaaaaggaggaaaaaacauucagacaaauugaggaaaacauguucagug

SEQ ID NO: 682746 - RNA, 62 nt, Homo Sapiens
guucagugugagugaggaaagcagccacaguuucagacaaauaugcaucuugaagcaacaaa

SEQ ID NO: 682747 - RNA, 64 nt, Homo Sapiens
gucucuaacuguacaggagacuucucugccugggcugggaaaggggccuuucuuuuguuuugca

SEQ ID NO: 682748 - RNA, 64 nt, Homo Sapiens
aaugcuuguggguauauuggauagcucagaaaaucugggaaaucaaaguggcucaauagcugug

SEQ ID NO: 682749 - RNA, 64 nt, Homo Sapiens
cuguguguagaagcagcaggacagccugucaucacugggaaagaggccagaagagccguuuggc

SEQ ID NO: 682750 - RNA, 64 nt, Homo Sapiens
ggggaggugccugagcuggggccuggagaggggccugggaaaggaaaaccagggauagcuauuu

SEQ ID NO: 682751 - RNA, 64 nt, Homo Sapiens
caggagagagaucuagaaaguggguucacuagagcugggaaacagggagccccuaggaaagcag

SEQ ID NO: 682752 - RNA, 64 nt, Homo Sapiens
aaaaccugguuccuguccucaaaauaaggggcaccugggaaaacagaggaaucuaccuguggug

SEQ ID NO: 682753 - RNA, 64 nt, Homo Sapiens
ccuccccuuuuccacacgaaauuuuauggcucuucugggaaacuuugcuugcagugcuuucuua

SEQ ID NO: 682754 - RNA, 64 nt, Homo Sapiens
guccaaaagaaucagaauuugcucguuaacuaugcugggaaacgguaaagugucuggucuggga

SEQ ID NO: 682755 - RNA, 64 nt, Homo Sapiens
augaagcuugaugcaagaacccuugaguaaaugucugggaaagcuccuccuccucuccacguuc

SEQ ID NO: 682756 - RNA, 64 nt, Homo Sapiens
agaaaaaguggggugaucuuacauucuuuuaauucugggaaauucaugguaauacagauaaaau

SEQ ID NO: 682757 - RNA, 64 nt, Homo Sapiens
acagcagaaccucuaccucgugcuucuagcucaccugggaaauagagagugcuugcuacucacc

SEQ ID NO: 682758 - RNA, 64 nt, Homo Sapiens
gaaagaaaagagguauuccgcuauguuaucgauucugggaaaauauaaccaucgaugauguugu

SEQ ID NO: 682759 - RNA, 64 nt, Homo Sapiens
ccagaccuggauucugaguuaugggagcauaguacugggaaaccugggagcacaguacugggaa

SEQ ID NO: 682760 - RNA, 64 nt, Homo Sapiens
ggagcauaguacugggaaacaugggagcacaguacugggaaaugugggagcauaguacugggaa

SEQ ID NO: 682761 - RNA, 64 nt, Homo Sapiens
ggagcacaguacugggaaauaugggagcauaguacugggaaaugggaguucacaguacucggaa

SEQ ID NO: 682762 - RNA, 64 nt, Homo Sapiens
ggaguucacaguacucggaagggagcccacaguacugggaaaggggagcacaguacugggaaau

SEQ ID NO: 682763 - RNA, 64 nt, Homo Sapiens
ggagcccacaguacugggaaaugggagcacaguacugggaaaugggagcacacaguacugggaa

SEQ ID NO: 682764 - RNA, 64 nt, Homo Sapiens
ggagcacaguacugggaaaugggagcacacaguacugggaaaugggcauacaguacugagaaau

SEQ ID NO: 682765 - RNA, 64 nt, Homo Sapiens
ggcauacaguacugagaaauaugggagcacaguacugggaaaugugggaguacacuacugagaa

SEQ ID NO: 682766 - RNA, 64 nt, Homo Sapiens
ggggcucacagcacugcaaaaugggagcacaguacugggaaaugugggagcacaguacugggaa

SEQ ID NO: 682767 - RNA, 64 nt, Homo Sapiens
ggagcacaguacugggaaauaugggagcacaguacugggaaaugugggagcacaguacuaggaa

SEQ ID NO: 682768 - RNA, 64 nt, Homo Sapiens
ggagcacaguacuaggaaaucugugagcacaguacugggaaaugccgggcauguuggcucacac

SEQ ID NO: 682769 - RNA, 64 nt, Homo Sapiens
aagaagagagcuuuuuuauaugugcuagucuucccugggaaacucacuaaucauuaguuaagac

SEQ ID NO: 682770 - RNA, 64 nt, Homo Sapiens
gguagucacagagaaaggguaugugaccaauauacugggaaagaauuuaaguuuuucagauaau

SEQ ID NO: 682771 - RNA, 64 nt, Homo Sapiens
cagagcugugauuuuuggcaccucaaugccgucccugggaaagcgucugccaugaccaaggaag

SEQ ID NO: 682772 - RNA, 64 nt, Homo Sapiens
acccugguguuacacaacugcaggaauccagauucugggaaacaggccugaccaggaacuacug

SEQ ID NO: 682773 - RNA, 64 nt, Homo Sapiens
aaguucgguaaggaaaugucaaauaggauucuugcugggaaagguuuuuuaaaagucccccaac

SEQ ID NO: 682774 - RNA, 64 nt, Homo Sapiens
aaggucgguuuccgcccucuagcuguggggccugcugggaaaccccagccuccagagaccgagc

SEQ ID NO: 682775 - RNA, 64 nt, Homo Sapiens
acaguuucuuugacauauuugggaaaugacuuuucugggaaauguagaagucauggacuuuucu

SEQ ID NO: 682776 - RNA, 64 nt, Homo Sapiens
acuuuucugggaaaugacagagucauggacuuuucugggaaaugguugguagaauccauguaga

SEQ ID NO: 682777 - RNA, 64 nt, Homo Sapiens
aaccuugggaccaugucacgcaagagauucagcacugggaaagauauaauugaaacaaaauagu

SEQ ID NO: 682778 - RNA, 64 nt, Homo Sapiens
cagcccgaacacugucagacucuaauuggcgacccugggaaacaguugcccugcuauucuuuaa

SEQ ID NO: 682779 - RNA, 64 nt, Homo Sapiens
gaugcuauucuauucugcugaaggcagucuuucucugggaaaugcuaaaagcaugggaaaugua

SEQ ID NO: 682780 - RNA, 64 nt, Homo Sapiens
cuaagcugucccagccccucuucuguuccaaaggcugggaaaaagcuggugcuggugcaaggac

SEQ ID NO: 682781 - RNA, 64 nt, Homo Sapiens
agaagaguaaacaggaaaccgcacccccucccuucugggaaacacccuccuccuguccuccccc

SEQ ID NO: 682782 - RNA, 64 nt, Homo Sapiens
caacaucauuccaaaaagaauuggacagcuacuucugggaaaaaucagcgcuuaaaaaaacaaa

SEQ ID NO: 682783 - RNA, 64 nt, Homo Sapiens
auccauucagaaguuuuguuguuuuacucuaaagcugggaaaggaaaugagagggaaaagaccc

SEQ ID NO: 682784 - RNA, 64 nt, Homo Sapiens
ucaccaagcaggagaguuaaggauucaccaugagcugggaaaugcuuuugccaugaguaugagc

SEQ ID NO: 682785 - RNA, 64 nt, Homo Sapiens
acuucugauggaugcauggggcucugggggaaugcugggaaaaugggcaagcagagugcacagc

SEQ ID NO: 682786 - RNA, 64 nt, Homo Sapiens
uggcugcugcagggcacauggagggaccuacccucugggaaagcccuugugucccucccagagu

SEQ ID NO: 682787 - RNA, 64 nt, Homo Sapiens
caggaaauguaccugaaaaggauuuuagaaaacccugggaaaacccaccacaccaccacaaaau

SEQ ID NO: 682788 - RNA, 64 nt, Homo Sapiens
aagagaguucauugacaguguuaggaugugaaggcugggaaacacuuauuuugcuucaagaguu

SEQ ID NO: 682789 - RNA, 64 nt, Homo Sapiens
caccccagacccucuucagcuacagccacagguccugggaaagaagugggaucuagggcccugg

SEQ ID NO: 682790 - RNA, 64 nt, Homo Sapiens
gugggccaugaaaggagaggauggauagggauggcugggaaauggagaucacugaaguacacag

SEQ ID NO: 682791 - RNA, 64 nt, Homo Sapiens
ccaggccgcaggagugggauccccaccccaucagcugggaaagcggacuaaagaaauggguguc

SEQ ID NO: 682792 - RNA, 64 nt, Homo Sapiens
cuagagcccccuuuggccccucugucauuccaggcugggaaaguaaccccgccuuccagcacuu

SEQ ID NO: 682793 - RNA, 64 nt, Homo Sapiens
gcaccuggaagguuuccaugggguacaguggcaccugggaaaagagaggugcccccaagugaag

SEQ ID NO: 682794 - RNA, 64 nt, Homo Sapiens
ugacugcgauucugaagaacgaguuuugaugaugcugggaaaagccuugggccuggcuucuuaa

SEQ ID NO: 682795 - RNA, 64 nt, Homo Sapiens
cugagugaaaggauggccucacaaucuugaguaacugggaaaguguuugacuucguuccugaau

SEQ ID NO: 682796 - RNA, 64 nt, Homo Sapiens
gugaaaacuauuuaagauaaguccugcucacaaacugggaaagucacacagcugagaagccggc

SEQ ID NO: 682797 - RNA, 64 nt, Homo Sapiens; identical to SEQ ID NO: 206011

SEQ ID NO: 682798 - RNA, 64 nt, Homo Sapiens; identical to SEQ ID NO: 206012

SEQ ID NO: 682799 - RNA, 64 nt, Homo Sapiens; identical to SEQ ID NO: 206013

SEQ ID NO: 682800 - RNA, 64 nt, Homo Sapiens; identical to SEQ ID NO: 206014

SEQ ID NO: 682801 - RNA, 64 nt, Homo Sapiens; identical to SEQ ID NO: 206015

SEQ ID NO: 682802 - RNA, 64 nt, Homo Sapiens; identical to SEQ ID NO: 206016

SEQ ID NO: 682803 - RNA, 64 nt, Homo Sapiens; identical to SEQ ID NO: 206017

SEQ ID NO: 682804 - RNA, 64 nt, Homo Sapiens; identical to SEQ ID NO: 206018

SEQ ID NO: 682805 - RNA, 64 nt, Homo Sapiens; identical to SEQ ID NO: 206019

SEQ ID NO: 682806 - RNA, 64 nt, Homo Sapiens; identical to SEQ ID NO: 206020

SEQ ID NO: 682807 - RNA, 64 nt, Homo Sapiens; identical to SEQ ID NO: 366005

SEQ ID NO: 682808 - RNA, 64 nt, Homo Sapiens; identical to SEQ ID NO: 366006

SEQ ID NO: 682809 - RNA, 64 nt, Homo Sapiens; identical to SEQ ID NO: 366007

SEQ ID NO: 682810 - RNA, 64 nt, Homo Sapiens; identical to SEQ ID NO: 366008

SEQ ID NO: 682811 - RNA, 64 nt, Homo Sapiens; identical to SEQ ID NO: 366009

SEQ ID NO: 682812 - RNA, 64 nt, Homo Sapiens; identical to SEQ ID NO: 366010

SEQ ID NO: 682813 - RNA, 64 nt, Homo Sapiens; identical to SEQ ID NO: 366011

SEQ ID NO: 682814 - RNA, 64 nt, Homo Sapiens; identical to SEQ ID NO: 366012

SEQ ID NO: 682815 - RNA, 64 nt, Homo Sapiens; identical to SEQ ID NO: 366013

SEQ ID NO: 682816 - RNA, 64 nt, Homo Sapiens; identical to SEQ ID NO: 366014

SEQ ID NO: 682817 - RNA, 64 nt, Homo Sapiens; identical to SEQ ID NO: 366015

SEQ ID NO: 682818 - RNA, 64 nt, Homo Sapiens; identical to SEQ ID NO: 366016

SEQ ID NO: 682819 - RNA, 64 nt, Homo Sapiens; identical to SEQ ID NO: 366017

SEQ ID NO: 682820 - RNA, 64 nt, Homo Sapiens; identical to SEQ ID NO: 366018

SEQ ID NO: 682821 - RNA, 64 nt, Homo Sapiens; identical to SEQ ID NO: 366019

SEQ ID NO: 682822 - RNA, 64 nt, Homo Sapiens; identical to SEQ ID NO: 366020

SEQ ID NO: 682823 - RNA, 64 nt, Homo Sapiens; identical to SEQ ID NO: 366021

SEQ ID NO: 682824 - RNA, 64 nt, Homo Sapiens; identical to SEQ ID NO: 366022

SEQ ID NO: 682825 - RNA, 64 nt, Homo Sapiens; identical to SEQ ID NO: 366023

SEQ ID NO: 682826 - RNA, 64 nt, Homo Sapiens; identical to SEQ ID NO: 366024

SEQ ID NO: 682827 - RNA, 64 nt, Homo Sapiens; identical to SEQ ID NO: 115714

SEQ ID NO: 682828 - RNA, 64 nt, Homo Sapiens; identical to SEQ ID NO: 115715

SEQ ID NO: 682829 - RNA, 64 nt, Homo Sapiens; identical to SEQ ID NO: 115716

SEQ ID NO: 682830 - RNA, 64 nt, Homo Sapiens; identical to SEQ ID NO: 115717

SEQ ID NO: 682831 - RNA, 64 nt, Homo Sapiens; identical to SEQ ID NO: 115718

SEQ ID NO: 682832 - RNA, 64 nt, Homo Sapiens; identical to SEQ ID NO: 115719

SEQ ID NO: 682833 - RNA, 64 nt, Homo Sapiens; identical to SEQ ID NO: 115720

SEQ ID NO: 682834 - RNA, 64 nt, Homo Sapiens; identical to SEQ ID NO: 115721

SEQ ID NO: 682835 - RNA, 64 nt, Homo Sapiens; identical to SEQ ID NO: 115722

SEQ ID NO: 682836 - RNA, 64 nt, Homo Sapiens; identical to SEQ ID NO: 115723

SEQ ID NO: 682837 - RNA, 64 nt, Homo Sapiens; identical to SEQ ID NO: 115724

SEQ ID NO: 682838 - RNA, 64 nt, Homo Sapiens; identical to SEQ ID NO: 115725

SEQ ID NO: 682839 - RNA, 64 nt, Homo Sapiens; identical to SEQ ID NO: 115726

SEQ ID NO: 682840 - RNA, 64 nt, Homo Sapiens; identical to SEQ ID NO: 115727

SEQ ID NO: 682841 - RNA, 64 nt, Homo Sapiens; identical to SEQ ID NO: 115728

SEQ ID NO: 682842 - RNA, 64 nt, Homo Sapiens; identical to SEQ ID NO: 115729

SEQ ID NO: 682843 - RNA, 64 nt, Homo Sapiens; identical to SEQ ID NO: 115730

SEQ ID NO: 682844 - RNA, 64 nt, Homo Sapiens; identical to SEQ ID NO: 115731

SEQ ID NO: 682845 - RNA, 64 nt, Homo Sapiens; identical to SEQ ID NO: 115732

SEQ ID NO: 682846 - RNA, 64 nt, Homo Sapiens; identical to SEQ ID NO: 115733

SEQ ID NO: 682847 - RNA, 64 nt, Homo Sapiens; identical to SEQ ID NO: 115734

SEQ ID NO: 682848 - RNA, 64 nt, Homo Sapiens; identical to SEQ ID NO: 115735

SEQ ID NO: 682849 - RNA, 64 nt, Homo Sapiens; identical to SEQ ID NO: 115736

SEQ ID NO: 682850 - RNA, 64 nt, Homo Sapiens; identical to SEQ ID NO: 115737

SEQ ID NO: 682851 - RNA, 64 nt, Homo Sapiens; identical to SEQ ID NO: 115738

SEQ ID NO: 682852 - RNA, 64 nt, Homo Sapiens; identical to SEQ ID NO: 115739

SEQ ID NO: 682853 - RNA, 64 nt, Homo Sapiens
uugucccugauuuuauuuucaccaguuaauuuaauagcucaaaaccauugggagguuuugaaaa

SEQ ID NO: 682854 - RNA, 64 nt, Homo Sapiens
uuuuuuguuuguuuuuuucucagguuagcuauuauagcucaagccaugacaauuuuuagagcug

SEQ ID NO: 682855 - RNA, 64 nt, Homo Sapiens
agcugggaaagacugacugagacacucccccuguuagcucaacagaucugcauuuggcugcuuc

SEQ ID NO: 682856 - RNA, 64 nt, Homo Sapiens
aucugagggaagauuuauguuucguuuuggaggauagcucaaguugaauuuucuuuccagccag

SEQ ID NO: 682857 - RNA, 64 nt, Homo Sapiens
gagccaaguacaguaguuuaucuuaaaauaaggguagcucaaaggguugacaccuauuuauaau

SEQ ID NO: 682858 - RNA, 64 nt, Homo Sapiens
uaaauaauugauuuuaaauaguagacauucuuacuagcucaauuuaaccucacuagcuucaaga

SEQ ID NO: 682859 - RNA, 64 nt, Homo Sapiens; identical to SEQ ID NO: 237274

SEQ ID NO: 682860 - RNA, 64 nt, Homo Sapiens; identical to SEQ ID NO: 237275

SEQ ID NO: 682861 - RNA, 64 nt, Homo Sapiens; identical to SEQ ID NO: 237276

SEQ ID NO: 682862 - RNA, 64 nt, Homo Sapiens; identical to SEQ ID NO: 237277

SEQ ID NO: 682863 - RNA, 64 nt, Homo Sapiens; identical to SEQ ID NO: 165107

SEQ ID NO: 682864 - RNA, 64 nt, Homo Sapiens; identical to SEQ ID NO: 165108

SEQ ID NO: 682865 - RNA, 64 nt, Homo Sapiens; identical to SEQ ID NO: 165109

SEQ ID NO: 682866 - RNA, 64 nt, Homo Sapiens; identical to SEQ ID NO: 165110

SEQ ID NO: 682867 - RNA, 64 nt, Homo Sapiens; identical to SEQ ID NO: 165111

SEQ ID NO: 682868 - RNA, 64 nt, Homo Sapiens; identical to SEQ ID NO: 165112

SEQ ID NO: 682869 - RNA, 64 nt, Homo Sapiens; identical to SEQ ID NO: 165113

SEQ ID NO: 682870 - RNA, 64 nt, Homo Sapiens; identical to SEQ ID NO: 165114

SEQ ID NO: 682871 - RNA, 64 nt, Homo Sapiens; identical to SEQ ID NO: 165115

SEQ ID NO: 682872 - RNA, 64 nt, Homo Sapiens; identical to SEQ ID NO: 165116

SEQ ID NO: 682873 - RNA, 64 nt, Homo Sapiens; identical to SEQ ID NO: 165117

SEQ ID NO: 682874 - RNA, 64 nt, Homo Sapiens; identical to SEQ ID NO: 165118

SEQ ID NO: 682875 - RNA, 64 nt, Homo Sapiens; identical to SEQ ID NO: 165119

SEQ ID NO: 682876 - RNA, 64 nt, Homo Sapiens; identical to SEQ ID NO: 165120

SEQ ID NO: 682877 - RNA, 64 nt, Homo Sapiens; identical to SEQ ID NO: 165121

SEQ ID NO: 682878 - RNA, 64 nt, Homo Sapiens; identical to SEQ ID NO: 165122

SEQ ID NO: 682879 - RNA, 64 nt, Homo Sapiens; identical to SEQ ID NO: 165123

SEQ ID NO: 682880 - RNA, 64 nt, Homo Sapiens; identical to SEQ ID NO: 165124

SEQ ID NO: 682881 - RNA, 64 nt, Homo Sapiens; identical to SEQ ID NO: 165125

SEQ ID NO: 682882 - RNA, 64 nt, Homo Sapiens; identical to SEQ ID NO: 165126

SEQ ID NO: 682883 - RNA, 64 nt, Homo Sapiens; identical to SEQ ID NO: 165127

SEQ ID NO: 682884 - RNA, 64 nt, Homo Sapiens; identical to SEQ ID NO: 165128

SEQ ID NO: 682885 - RNA, 64 nt, Homo Sapiens; identical to SEQ ID NO: 165129

SEQ ID NO: 682886 - RNA, 64 nt, Homo Sapiens; identical to SEQ ID NO: 165130

SEQ ID NO: 682887 - RNA, 64 nt, Homo Sapiens; identical to SEQ ID NO: 165131

SEQ ID NO: 682888 - RNA, 64 nt, Homo Sapiens; identical to SEQ ID NO: 165132

SEQ ID NO: 682889 - RNA, 64 nt, Homo Sapiens; identical to SEQ ID NO: 165133

SEQ ID NO: 682890 - RNA, 64 nt, Homo Sapiens; identical to SEQ ID NO: 165134

SEQ ID NO: 682891 - RNA, 64 nt, Homo Sapiens; identical to SEQ ID NO: 165135

SEQ ID NO: 682892 - RNA, 64 nt, Homo Sapiens; identical to SEQ ID NO: 165136

SEQ ID NO: 682893 - RNA, 64 nt, Homo Sapiens; identical to SEQ ID NO: 165137

SEQ ID NO: 682894 - RNA, 64 nt, Homo Sapiens; identical to SEQ ID NO: 165138

SEQ ID NO: 682895 - RNA, 64 nt, Homo Sapiens; identical to SEQ ID NO: 165139

SEQ ID NO: 682896 - RNA, 64 nt, Homo Sapiens; identical to SEQ ID NO: 165140

SEQ ID NO: 682897 - RNA, 64 nt, Homo Sapiens; identical to SEQ ID NO: 165141

SEQ ID NO: 682898 - RNA, 64 nt, Homo Sapiens; identical to SEQ ID NO: 165142

SEQ ID NO: 682899 - RNA, 64 nt, Homo Sapiens; identical to SEQ ID NO: 165143

SEQ ID NO: 682900 - RNA, 64 nt, Homo Sapiens; identical to SEQ ID NO: 165144

SEQ ID NO: 682901 - RNA, 64 nt, Homo Sapiens; identical to SEQ ID NO: 165145

SEQ ID NO: 682902 - RNA, 64 nt, Homo Sapiens; identical to SEQ ID NO: 165146

SEQ ID NO: 682903 - RNA, 64 nt, Homo Sapiens; identical to SEQ ID NO: 165147

SEQ ID NO: 682904 - RNA, 64 nt, Homo Sapiens; identical to SEQ ID NO: 165148

SEQ ID NO: 682905 - RNA, 64 nt, Homo Sapiens; identical to SEQ ID NO: 165149

SEQ ID NO: 682906 - RNA, 64 nt, Homo Sapiens; identical to SEQ ID NO: 165150

SEQ ID NO: 682907 - RNA, 64 nt, Homo Sapiens; identical to SEQ ID NO: 165151

SEQ ID NO: 682908 - RNA, 64 nt, Homo Sapiens; identical to SEQ ID NO: 165152

SEQ ID NO: 682909 - RNA, 64 nt, Homo Sapiens; identical to SEQ ID NO: 165153

SEQ ID NO: 682910 - RNA, 64 nt, Homo Sapiens; identical to SEQ ID NO: 165154

SEQ ID NO: 682911 - RNA, 64 nt, Homo Sapiens; identical to SEQ ID NO: 165155

SEQ ID NO: 682912 - RNA, 64 nt, Homo Sapiens; identical to SEQ ID NO: 165156

SEQ ID NO: 682913 - RNA, 60 nt, Homo Sapiens
uguuaccuuuuccaccucucauuguuuuccccagaacauuguagauggggguuggcagag

SEQ ID NO: 682914 - RNA, 60 nt, Homo Sapiens
cgaugugggcauccugggguucuuagggucccagaacaagccccaggcaagcuggaacuu

SEQ ID NO: 682915 - RNA, 60 nt, Homo Sapiens
ggucaacucccaggccucagaugcaggggcccagaacaccugcucucaccugagccccag

SEQ ID NO: 682916 - RNA, 60 nt, Homo Sapiens
ugcucucaccugaaccccaggugaaggggcccagaacaccugcucucaccugagccccag

SEQ ID NO: 682917 - RNA, 60 nt, Homo Sapiens
aauauccuaaaauacagaaccuugaccucuccagaacacugagggcgaaugacauuacag

SEQ ID NO: 682918 - RNA, 60 nt, Homo Sapiens
uacugaaaagcugaaauuuaagaacacaucccagaacaauagcaucuaauuugcacaacu

SEQ ID NO: 682919 - RNA, 60 nt, Homo Sapiens
uggaaguguggaaaggagguaaccuggcacccagaacagugguucucagucccaccccaa

SEQ ID NO: 682920 - RNA, 60 nt, Homo Sapiens
ggaucggcuuccuuacccagccuuugaaagccagaacaaucuguuuucggaucugugguu

SEQ ID NO: 682921 - RNA, 60 nt, Homo Sapiens
uaguguagaugaaaauguggcccacucccuccagaacauuuucccuucccucccccuuca

SEQ ID NO: 682922 - RNA, 60 nt, Homo Sapiens
cugccccucaaggaagggugucguggccuuccagaacaguacucccacugucuccagaag

SEQ ID NO: 682923 - RNA, 60 nt, Homo Sapiens
ucagcaggagaugagacuaugaauuggcauccagaacaggagauuuagagcaaaaucuaa

SEQ ID NO: 682924 - RNA, 60 nt, Homo Sapiens
uggagagcugaucagccaggcacagaaucuccagaacaaccuagagagugaaugcuaauu

SEQ ID NO: 682925 - RNA, 60 nt, Homo Sapiens
ggagggucagccaccaagcugggagcugagccagaacaggagugaugucucugcccuucc

SEQ ID NO: 682926 - RNA, 60 nt, Homo Sapiens
gcuuggagcauuggguaucugaugucugcaccagaacaagagaaccucugacgguggaga

SEQ ID NO: 682927 - RNA, 60 nt, Homo Sapiens
uuguuuacauaaguuccuauagaaugcauuccagaacaaaaaauauaaccauuuaaagaa

SEQ ID NO: 682928 - RNA, 60 nt, Homo Sapiens
ucauuauguuuccuaacugugcagcugauuccagaacaaaaccacuugccucuuucucca

SEQ ID NO: 682929 - RNA, 60 nt, Homo Sapiens
cauggcacauuuguuuaauaacuugaaggcccagaacacuuucuccuugguuaaaauuau

SEQ ID NO: 682930 - RNA, 60 nt, Homo Sapiens
acaaaaguuuuaaaucguagaaaauuuuggccagaacauucagaaugccaaaugaaggcu

SEQ ID NO: 682931 - RNA, 60 nt, Homo Sapiens
agccccucugggcagcaggaaacuaccagaccagaacacgaaaggaggaaaagucccacc

SEQ ID NO: 682932 - RNA, 60 nt, Homo Sapiens
aggccacaggcuggcacuacacugcagaacccagaacagauccccaaucaauacacacac

SEQ ID NO: 682933 - RNA, 60 nt, Homo Sapiens
uucugugugccuccuuucagccccaaaaaaccagaacaaggacucgguucuguguuggga

SEQ ID NO: 682934 - RNA, 60 nt, Homo Sapiens
caguguggacaacugcccaucaaaaaagaaccagaacacauacuugcacuggaucuuacg

SEQ ID NO: 682935 - RNA, 60 nt, Homo Sapiens
uaggagggugucuuuggaccguggauagugccagaacacuggccucaacaccuucugaac

SEQ ID NO: 682936 - RNA, 60 nt, Homo Sapiens
agggaagcacaugaucaugggaaugauagcccagaacaaaaagaaaucuugucuuaccac

SEQ ID NO: 682937 - RNA, 60 nt, Homo Sapiens
uacaugucauuugacugucucacuuuuuacccagaacaguaacaacccacaccgucuucc

SEQ ID NO: 682938 - RNA, 60 nt, Homo Sapiens
aacauugaaguuuauuuggauaucaaggucccagaacaaggaagucacuuuucaguggau

SEQ ID NO: 682939 - RNA, 60 nt, Homo Sapiens
cauaaaccagagaugauaaaacagauacuuccagaacauagugugcuucaaaacauuaau

SEQ ID NO: 682940 - RNA, 60 nt, Homo Sapiens
agguaggaugugacaaauggugucaaccauccagaacacauuccucccucaauagugaag

SEQ ID NO: 682941 - RNA, 60 nt, Homo Sapiens
aaguccugaaaauccaaaaccuugaaagauccagaacaaaucgaaaguucuagaaacugc

SEQ ID NO: 682942 - RNA, 64 nt, Homo Sapiens
ugcaagaagagaucuuaggucucuucuuuuauaccaagcucaucuuuuauaccaagcugugcag

SEQ ID NO: 682943 - RNA, 64 nt, Homo Sapiens
uagaaaauuccccugugcaugguauuaccuuuuucaagcucagauucaucuaauccucaacugu

SEQ ID NO: 682944 - RNA, 64 nt, Homo Sapiens
aaccagauucaugagcuuucuacccgcugaacuccaagcucaccaagccccacaaaauuccugu

SEQ ID NO: 682945 - RNA, 64 nt, Homo Sapiens
ugcuggacgugagaauguugugggggcaacucugcaagcucaccucucaaucggacaccagagg

SEQ ID NO: 682946 - RNA, 64 nt, Homo Sapiens
ucuuggcagguuugagacaguuccagaaagaacccaagcucaagacgcaggacgagcucaguug

SEQ ID NO: 682947 - RNA, 64 nt, Homo Sapiens
ccagugugaauuuuauuaaugcuaucaucucgaccaagcucaaagccuacuuauuagaaacaau

SEQ ID NO: 682948 - RNA, 64 nt, Homo Sapiens
ucuguagauaguauacuaucuacacucugcucaacaagcucagaaauuaaauauuuuuaauaau

SEQ ID NO: 682949 - RNA, 64 nt, Homo Sapiens
acguaacauggaauacaagcuugaaucugggaaacaagcucaaaaaacagugaaaaaaaaagua

SEQ ID NO: 682950 - RNA, 64 nt, Homo Sapiens
aggggcuuguacccuggucacuuggcugccauggcaagcucaucguuccuccggcaccaguguc

SEQ ID NO: 682951 - RNA, 64 nt, Homo Sapiens
ucucacccagcaagguugacugcccuaugcagugcaagcucacuagugggguccaccuucuucu

SEQ ID NO: 682952 - RNA, 64 nt, Homo Sapiens
uuaacauguauccacuguaaacguuugucguguacaagcucagagcuuggacagaauuuuuugu

SEQ ID NO: 682953 - RNA, 64 nt, Homo Sapiens
uugauaaucauauagcgaaggcauauuuuucuuccaagcucaagucaggauugugacuauauau

SEQ ID NO: 682954 - RNA, 64 nt, Homo Sapiens
ggagccaguaaacagaggaguacaggugaagcaccaagcucaaagcguggacaggugugccgac

SEQ ID NO: 682955 - RNA, 64 nt, Homo Sapiens
uauuugguuuggccaucucuggaugccugauugccaagcucaggaccaggcaaugugacuuugc

SEQ ID NO: 682956 - RNA, 64 nt, Homo Sapiens
uugagguggacccccgagggugccccuucaccaucaagcucagcgcccggaaguaagugccccu

SEQ ID NO: 682957 - RNA, 64 nt, Homo Sapiens
ccugcuacucagacguccuggacgaaaaccagagcaagcucagcgaggaccucauggaguuccg

SEQ ID NO: 682958 - RNA, 64 nt, Homo Sapiens; identical to SEQ ID NO: 256790

SEQ ID NO: 682959 - RNA, 64 nt, Homo Sapiens; identical to SEQ ID NO: 256791

SEQ ID NO: 682960 - RNA, 64 nt, Homo Sapiens; identical to SEQ ID NO: 256792

SEQ ID NO: 682961 - RNA, 64 nt, Homo Sapiens; identical to SEQ ID NO: 256793

SEQ ID NO: 682962 - RNA, 64 nt, Homo Sapiens; identical to SEQ ID NO: 256794

SEQ ID NO: 682963 - RNA, 53 nt, Homo Sapiens; identical to SEQ ID NO: 256795

SEQ ID NO: 682964 - RNA, 64 nt, Homo Sapiens; identical to SEQ ID NO: 256796

SEQ ID NO: 682965 - RNA, 64 nt, Homo Sapiens; identical to SEQ ID NO: 256797

SEQ ID NO: 682966 - RNA, 64 nt, Homo Sapiens; identical to SEQ ID NO: 256798

SEQ ID NO: 682967 - RNA, 64 nt, Homo Sapiens; identical to SEQ ID NO: 256799

SEQ ID NO: 682968 - RNA, 64 nt, Homo Sapiens; identical to SEQ ID NO: 256800

SEQ ID NO: 682969 - RNA, 64 nt, Homo Sapiens; identical to SEQ ID NO: 256801

SEQ ID NO: 682970 - RNA, 64 nt, Homo Sapiens; identical to SEQ ID NO: 256802

SEQ ID NO: 682971 - RNA, 64 nt, Homo Sapiens; identical to SEQ ID NO: 256803

SEQ ID NO: 682972 - RNA, 64 nt, Homo Sapiens; identical to SEQ ID NO: 256804

SEQ ID NO: 682973 - RNA, 64 nt, Homo Sapiens; identical to SEQ ID NO: 256805

SEQ ID NO: 682974 - RNA, 64 nt, Homo Sapiens; identical to SEQ ID NO: 256806

SEQ ID NO: 682975 - RNA, 64 nt, Homo Sapiens; identical to SEQ ID NO: 256807

SEQ ID NO: 682976 - RNA, 64 nt, Homo Sapiens; identical to SEQ ID NO: 256808

SEQ ID NO: 682977 - RNA, 64 nt, Homo Sapiens; identical to SEQ ID NO: 256809

SEQ ID NO: 682978 - RNA, 64 nt, Homo Sapiens; identical to SEQ ID NO: 256810

SEQ ID NO: 682979 - RNA, 64 nt, Homo Sapiens; identical to SEQ ID NO: 256811

SEQ ID NO: 682980 - RNA, 64 nt, Homo Sapiens; identical to SEQ ID NO: 256812

SEQ ID NO: 682981 - RNA, 64 nt, Homo Sapiens; identical to SEQ ID NO: 256813

SEQ ID NO: 682982 - RNA, 64 nt, Homo Sapiens; identical to SEQ ID NO: 256814

SEQ ID NO: 682983 - RNA, 64 nt, Homo Sapiens; identical to SEQ ID NO: 256815

SEQ ID NO: 682984 - RNA, 64 nt, Homo Sapiens; identical to SEQ ID NO: 256816

SEQ ID NO: 682985 - RNA, 64 nt, Homo Sapiens; identical to SEQ ID NO: 256817

SEQ ID NO: 682986 - RNA, 64 nt, Homo Sapiens; identical to SEQ ID NO: 256818

SEQ ID NO: 682987 - RNA, 64 nt, Homo Sapiens; identical to SEQ ID NO: 256819

SEQ ID NO: 682988 - RNA, 64 nt, Homo Sapiens; identical to SEQ ID NO: 256820

SEQ ID NO: 682989 - RNA, 64 nt, Homo Sapiens; identical to SEQ ID NO: 256821

SEQ ID NO: 682990 - RNA, 64 nt, Homo Sapiens; identical to SEQ ID NO: 256822

SEQ ID NO: 682991 - RNA, 64 nt, Homo Sapiens; identical to SEQ ID NO: 256823

SEQ ID NO: 682992 - RNA, 64 nt, Homo Sapiens; identical to SEQ ID NO: 256824

SEQ ID NO: 682993 - RNA, 64 nt, Homo Sapiens; identical to SEQ ID NO: 256825

SEQ ID NO: 682994 - RNA, 64 nt, Homo Sapiens; identical to SEQ ID NO: 256826

SEQ ID NO: 682995 - RNA, 64 nt, Homo Sapiens; identical to SEQ ID NO: 256827

SEQ ID NO: 682996 - RNA, 64 nt, Homo Sapiens; identical to SEQ ID NO: 256828

SEQ ID NO: 682997 - RNA, 64 nt, Homo Sapiens; identical to SEQ ID NO: 256829

SEQ ID NO: 682998 - RNA, 64 nt, Homo Sapiens; identical to SEQ ID NO: 256830

SEQ ID NO: 682999 - RNA, 64 nt, Homo Sapiens; identical to SEQ ID NO: 256831

SEQ ID NO: 683000 - RNA, 64 nt, Homo Sapiens; identical to SEQ ID NO: 256832

SEQ ID NO: 683001 - RNA, 64 nt, Homo Sapiens; identical to SEQ ID NO: 256833

SEQ ID NO: 683002 - RNA, 64 nt, Homo Sapiens; identical to SEQ ID NO: 256834

SEQ ID NO: 683003 - RNA, 64 nt, Homo Sapiens; identical to SEQ ID NO: 256835

SEQ ID NO: 683004 - RNA, 64 nt, Homo Sapiens; identical to SEQ ID NO: 256836

SEQ ID NO: 683005 - RNA, 64 nt, Homo Sapiens; identical to SEQ ID NO: 256837

SEQ ID NO: 683006 - RNA, 64 nt, Homo Sapiens; identical to SEQ ID NO: 256838

SEQ ID NO: 683007 - RNA, 64 nt, Homo Sapiens; identical to SEQ ID NO: 256839

SEQ ID NO: 683008 - RNA, 64 nt, Homo Sapiens; identical to SEQ ID NO: 256840

SEQ ID NO: 683009 - RNA, 64 nt, Homo Sapiens; identical to SEQ ID NO: 256841

SEQ ID NO: 683010 - RNA, 64 nt, Homo Sapiens; identical to SEQ ID NO: 256842

SEQ ID NO: 683011 - RNA, 64 nt, Homo Sapiens; identical to SEQ ID NO: 256843

SEQ ID NO: 683012 - RNA, 64 nt, Homo Sapiens; identical to SEQ ID NO: 256844

SEQ ID NO: 683013 - RNA, 64 nt, Homo Sapiens; identical to SEQ ID NO: 256845

SEQ ID NO: 683014 - RNA, 64 nt, Homo Sapiens; identical to SEQ ID NO: 256846

SEQ ID NO: 683015 - RNA, 64 nt, Homo Sapiens; identical to SEQ ID NO: 256847

SEQ ID NO: 683016 - RNA, 64 nt, Homo Sapiens; identical to SEQ ID NO: 256848

SEQ ID NO: 683017 - RNA, 64 nt, Homo Sapiens; identical to SEQ ID NO: 256849

SEQ ID NO: 683018 - RNA, 64 nt, Homo Sapiens; identical to SEQ ID NO: 256850

SEQ ID NO: 683019 - RNA, 64 nt, Homo Sapiens; identical to SEQ ID NO: 256851

SEQ ID NO: 683020 - RNA, 64 nt, Homo Sapiens; identical to SEQ ID NO: 256852

SEQ ID NO: 683021 - RNA, 64 nt, Homo Sapiens; identical to SEQ ID NO: 256853

SEQ ID NO: 683022 - RNA, 64 nt, Homo Sapiens; identical to SEQ ID NO: 256854

SEQ ID NO: 683023 - RNA, 64 nt, Homo Sapiens; identical to SEQ ID NO: 256855

SEQ ID NO: 683024 - RNA, 64 nt, Homo Sapiens; identical to SEQ ID NO: 256856

SEQ ID NO: 683025 - RNA, 64 nt, Homo Sapiens; identical to SEQ ID NO: 256857

SEQ ID NO: 683026 - RNA, 64 nt, Homo Sapiens; identical to SEQ ID NO: 256858

SEQ ID NO: 683027 - RNA, 64 nt, Homo Sapiens; identical to SEQ ID NO: 256859

SEQ ID NO: 683028 - RNA, 64 nt, Homo Sapiens; identical to SEQ ID NO: 256860

SEQ ID NO: 683029 - RNA, 64 nt, Homo Sapiens; identical to SEQ ID NO: 256861

SEQ ID NO: 683030 - RNA, 64 nt, Homo Sapiens; identical to SEQ ID NO: 256862

SEQ ID NO: 683031 - RNA, 64 nt, Homo Sapiens; identical to SEQ ID NO: 256863

SEQ ID NO: 683032 - RNA, 64 nt, Homo Sapiens; identical to SEQ ID NO: 256864

SEQ ID NO: 683033 - RNA, 64 nt, Homo Sapiens; identical to SEQ ID NO: 256865

SEQ ID NO: 683034 - RNA, 64 nt, Homo Sapiens; identical to SEQ ID NO: 256866

SEQ ID NO: 683035 - RNA, 64 nt, Homo Sapiens; identical to SEQ ID NO: 256867

SEQ ID NO: 683036 - RNA, 64 nt, Homo Sapiens; identical to SEQ ID NO: 256868

SEQ ID NO: 683037 - RNA, 64 nt, Homo Sapiens; identical to SEQ ID NO: 256869

SEQ ID NO: 683038 - RNA, 64 nt, Homo Sapiens; identical to SEQ ID NO: 256870

SEQ ID NO: 683039 - RNA, 64 nt, Homo Sapiens; identical to SEQ ID NO: 256871

SEQ ID NO: 683040 - RNA, 64 nt, Homo Sapiens; identical to SEQ ID NO: 256872

SEQ ID NO: 683041 - RNA, 64 nt, Homo Sapiens; identical to SEQ ID NO: 256873

SEQ ID NO: 683042 - RNA, 59 nt, Homo Sapiens; identical to SEQ ID NO: 256874

SEQ ID NO: 683043 - RNA, 64 nt, Homo Sapiens; identical to SEQ ID NO: 256875

SEQ ID NO: 683044 - RNA, 64 nt, Homo Sapiens; identical to SEQ ID NO: 256876

SEQ ID NO: 683045 - RNA, 64 nt, Homo Sapiens; identical to SEQ ID NO: 256877

SEQ ID NO: 683046 - RNA, 64 nt, Homo Sapiens; identical to SEQ ID NO: 256878

SEQ ID NO: 683047 - RNA, 64 nt, Homo Sapiens; identical to SEQ ID NO: 256879

SEQ ID NO: 683048 - RNA, 64 nt, Homo Sapiens; identical to SEQ ID NO: 256880

SEQ ID NO: 683049 - RNA, 64 nt, Homo Sapiens; identical to SEQ ID NO: 256881

SEQ ID NO: 683050 - RNA, 64 nt, Homo Sapiens; identical to SEQ ID NO: 256882

SEQ ID NO: 683051 - RNA, 64 nt, Homo Sapiens; identical to SEQ ID NO: 256883

SEQ ID NO: 683052 - RNA, 64 nt, Homo Sapiens; identical to SEQ ID NO: 256884

SEQ ID NO: 683053 - RNA, 64 nt, Homo Sapiens; identical to SEQ ID NO: 256885

SEQ ID NO: 683054 - RNA, 64 nt, Homo Sapiens; identical to SEQ ID NO: 256886

SEQ ID NO: 683055 - RNA, 64 nt, Homo Sapiens; identical to SEQ ID NO: 536323

SEQ ID NO: 683056 - RNA, 64 nt, Homo Sapiens; identical to SEQ ID NO: 536324

SEQ ID NO: 683057 - RNA, 64 nt, Homo Sapiens; identical to SEQ ID NO: 536325

SEQ ID NO: 683058 - RNA, 64 nt, Homo Sapiens; identical to SEQ ID NO: 536326

SEQ ID NO: 683059 - RNA, 64 nt, Homo Sapiens; identical to SEQ ID NO: 536327

SEQ ID NO: 683060 - RNA, 64 nt, Homo Sapiens; identical to SEQ ID NO: 536328

SEQ ID NO: 683061 - RNA, 64 nt, Homo Sapiens; identical to SEQ ID NO: 536329

SEQ ID NO: 683062 - RNA, 64 nt, Homo Sapiens; identical to SEQ ID NO: 536330

SEQ ID NO: 683063 - RNA, 64 nt, Homo Sapiens; identical to SEQ ID NO: 536331

SEQ ID NO: 683064 - RNA, 64 nt, Homo Sapiens; identical to SEQ ID NO: 536332

SEQ ID NO: 683065 - RNA, 64 nt, Homo Sapiens; identical to SEQ ID NO: 536333

SEQ ID NO: 683066 - RNA, 64 nt, Homo Sapiens; identical to SEQ ID NO: 536334

SEQ ID NO: 683067 - RNA, 64 nt, Homo Sapiens; identical to SEQ ID NO: 536335

SEQ ID NO: 683068 - RNA, 64 nt, Homo Sapiens; identical to SEQ ID NO: 536336

SEQ ID NO: 683069 - RNA, 64 nt, Homo Sapiens; identical to SEQ ID NO: 536337

SEQ ID NO: 683070 - RNA, 64 nt, Homo Sapiens; identical to SEQ ID NO: 536338

SEQ ID NO: 683071 - RNA, 64 nt, Homo Sapiens; identical to SEQ ID NO: 123248

SEQ ID NO: 683072 - RNA, 64 nt, Homo Sapiens; identical to SEQ ID NO: 123249

SEQ ID NO: 683073 - RNA, 64 nt, Homo Sapiens; identical to SEQ ID NO: 123250

SEQ ID NO: 683074 - RNA, 64 nt, Homo Sapiens; identical to SEQ ID NO: 123251

SEQ ID NO: 683075 - RNA, 64 nt, Homo Sapiens; identical to SEQ ID NO: 123252

SEQ ID NO: 683076 - RNA, 64 nt, Homo Sapiens; identical to SEQ ID NO: 123253

SEQ ID NO: 683077 - RNA, 64 nt, Homo Sapiens; identical to SEQ ID NO: 123254

SEQ ID NO: 683078 - RNA, 64 nt, Homo Sapiens; identical to SEQ ID NO: 123255

SEQ ID NO: 683079 - RNA, 64 nt, Homo Sapiens; identical to SEQ ID NO: 123256

SEQ ID NO: 683080 - RNA, 64 nt, Homo Sapiens; identical to SEQ ID NO: 123257

SEQ ID NO: 683081 - RNA, 64 nt, Homo Sapiens; identical to SEQ ID NO: 123258

SEQ ID NO: 683082 - RNA, 64 nt, Homo Sapiens; identical to SEQ ID NO: 123259

SEQ ID NO: 683083 - RNA, 64 nt, Homo Sapiens; identical to SEQ ID NO: 123260

SEQ ID NO: 683084 - RNA, 64 nt, Homo Sapiens; identical to SEQ ID NO: 123261

SEQ ID NO: 683085 - RNA, 64 nt, Homo Sapiens; identical to SEQ ID NO: 123262

SEQ ID NO: 683086 - RNA, 64 nt, Homo Sapiens; identical to SEQ ID NO: 123263

SEQ ID NO: 683087 - RNA, 64 nt, Homo Sapiens; identical to SEQ ID NO: 123264

SEQ ID NO: 683088 - RNA, 64 nt, Homo Sapiens; identical to SEQ ID NO: 123265

SEQ ID NO: 683089 - RNA, 64 nt, Homo Sapiens; identical to SEQ ID NO: 123266

SEQ ID NO: 683090 - RNA, 64 nt, Homo Sapiens; identical to SEQ ID NO: 123267

SEQ ID NO: 683091 - RNA, 64 nt, Homo Sapiens; identical to SEQ ID NO: 123268

SEQ ID NO: 683092 - RNA, 64 nt, Homo Sapiens; identical to SEQ ID NO: 123269

SEQ ID NO: 683093 - RNA, 64 nt, Homo Sapiens; identical to SEQ ID NO: 123270

SEQ ID NO: 683094 - RNA, 64 nt, Homo Sapiens; identical to SEQ ID NO: 123271

SEQ ID NO: 683095 - RNA, 64 nt, Homo Sapiens; identical to SEQ ID NO: 123272

SEQ ID NO: 683096 - RNA, 64 nt, Homo Sapiens; identical to SEQ ID NO: 123273

SEQ ID NO: 683097 - RNA, 64 nt, Homo Sapiens; identical to SEQ ID NO: 123274

SEQ ID NO: 683098 - RNA, 64 nt, Homo Sapiens; identical to SEQ ID NO: 123275

SEQ ID NO: 683099 - RNA, 64 nt, Homo Sapiens; identical to SEQ ID NO: 123276

SEQ ID NO: 683100 - RNA, 64 nt, Homo Sapiens; identical to SEQ ID NO: 123277

SEQ ID NO: 683101 - RNA, 64 nt, Homo Sapiens; identical to SEQ ID NO: 123278

SEQ ID NO: 683102 - RNA, 64 nt, Homo Sapiens; identical to SEQ ID NO: 123279

SEQ ID NO: 683103 - RNA, 64 nt, Homo Sapiens; identical to SEQ ID NO: 123280

SEQ ID NO: 683104 - RNA, 64 nt, Homo Sapiens; identical to SEQ ID NO: 123281

SEQ ID NO: 683105 - RNA, 64 nt, Homo Sapiens; identical to SEQ ID NO: 123282

SEQ ID NO: 683106 - RNA, 64 nt, Homo Sapiens; identical to SEQ ID NO: 123283

SEQ ID NO: 683107 - RNA, 64 nt, Homo Sapiens; identical to SEQ ID NO: 123284

SEQ ID NO: 683108 - RNA, 64 nt, Homo Sapiens; identical to SEQ ID NO: 123285

SEQ ID NO: 683109 - RNA, 64 nt, Homo Sapiens; identical to SEQ ID NO: 123286

SEQ ID NO: 683110 - RNA, 64 nt, Homo Sapiens; identical to SEQ ID NO: 123287

SEQ ID NO: 683111 - RNA, 64 nt, Homo Sapiens; identical to SEQ ID NO: 123288

SEQ ID NO: 683112 - RNA, 64 nt, Homo Sapiens; identical to SEQ ID NO: 123289

SEQ ID NO: 683113 - RNA, 64 nt, Homo Sapiens; identical to SEQ ID NO: 123290

SEQ ID NO: 683114 - RNA, 64 nt, Homo Sapiens; identical to SEQ ID NO: 123291

SEQ ID NO: 683115 - RNA, 64 nt, Homo Sapiens; identical to SEQ ID NO: 503392

SEQ ID NO: 683116 - RNA, 64 nt, Homo Sapiens; identical to SEQ ID NO: 503393

SEQ ID NO: 683117 - RNA, 64 nt, Homo Sapiens; identical to SEQ ID NO: 503394

SEQ ID NO: 683118 - RNA, 64 nt, Homo Sapiens; identical to SEQ ID NO: 503395

SEQ ID NO: 683119 - RNA, 64 nt, Homo Sapiens; identical to SEQ ID NO: 503396

SEQ ID NO: 683120 - RNA, 64 nt, Homo Sapiens; identical to SEQ ID NO: 503397

SEQ ID NO: 683121 - RNA, 64 nt, Homo Sapiens; identical to SEQ ID NO: 503398

SEQ ID NO: 683122 - RNA, 64 nt, Homo Sapiens; identical to SEQ ID NO: 503399

SEQ ID NO: 683123 - RNA, 64 nt, Homo Sapiens; identical to SEQ ID NO: 503400

SEQ ID NO: 683124 - RNA, 64 nt, Homo Sapiens; identical to SEQ ID NO: 503401

SEQ ID NO: 683125 - RNA, 64 nt, Homo Sapiens; identical to SEQ ID NO: 503402

SEQ ID NO: 683126 - RNA, 64 nt, Homo Sapiens; identical to SEQ ID NO: 503403

SEQ ID NO: 683127 - RNA, 64 nt, Homo Sapiens; identical to SEQ ID NO: 503404

SEQ ID NO: 683128 - RNA, 64 nt, Homo Sapiens; identical to SEQ ID NO: 503405

SEQ ID NO: 683129 - RNA, 64 nt, Homo Sapiens; identical to SEQ ID NO: 503406

SEQ ID NO: 683130 - RNA, 64 nt, Homo Sapiens; identical to SEQ ID NO: 503407

SEQ ID NO: 683131 - RNA, 64 nt, Homo Sapiens; identical to SEQ ID NO: 172545

SEQ ID NO: 683132 - RNA, 64 nt, Homo Sapiens; identical to SEQ ID NO: 172546

SEQ ID NO: 683133 - RNA, 64 nt, Homo Sapiens; identical to SEQ ID NO: 172547

SEQ ID NO: 683134 - RNA, 64 nt, Homo Sapiens; identical to SEQ ID NO: 172548

SEQ ID NO: 683135 - RNA, 64 nt, Homo Sapiens; identical to SEQ ID NO: 172549

SEQ ID NO: 683136 - RNA, 64 nt, Homo Sapiens; identical to SEQ ID NO: 172550

SEQ ID NO: 683137 - RNA, 64 nt, Homo Sapiens; identical to SEQ ID NO: 172551

SEQ ID NO: 683138 - RNA, 64 nt, Homo Sapiens; identical to SEQ ID NO: 172552

SEQ ID NO: 683139 - RNA, 64 nt, Homo Sapiens; identical to SEQ ID NO: 172553

SEQ ID NO: 683140 - RNA, 64 nt, Homo Sapiens; identical to SEQ ID NO: 172554

SEQ ID NO: 683141 - RNA, 64 nt, Homo Sapiens; identical to SEQ ID NO: 172555

SEQ ID NO: 683142 - RNA, 64 nt, Homo Sapiens; identical to SEQ ID NO: 172556

SEQ ID NO: 683143 - RNA, 64 nt, Homo Sapiens; identical to SEQ ID NO: 172557

SEQ ID NO: 683144 - RNA, 64 nt, Homo Sapiens; identical to SEQ ID NO: 172558

SEQ ID NO: 683145 - RNA, 64 nt, Homo Sapiens; identical to SEQ ID NO: 172559

SEQ ID NO: 683146 - RNA, 64 nt, Homo Sapiens; identical to SEQ ID NO: 172560

SEQ ID NO: 683147 - RNA, 64 nt, Homo Sapiens; identical to SEQ ID NO: 172561

SEQ ID NO: 683148 - RNA, 64 nt, Homo Sapiens; identical to SEQ ID NO: 172562

SEQ ID NO: 683149 - RNA, 64 nt, Homo Sapiens; identical to SEQ ID NO: 172563

SEQ ID NO: 683150 - RNA, 64 nt, Homo Sapiens; identical to SEQ ID NO: 172564

SEQ ID NO: 683151 - RNA, 64 nt, Homo Sapiens; identical to SEQ ID NO: 172565

SEQ ID NO: 683152 - RNA, 64 nt, Homo Sapiens; identical to SEQ ID NO: 172566

SEQ ID NO: 683153 - RNA, 64 nt, Homo Sapiens; identical to SEQ ID NO: 172567

SEQ ID NO: 683154 - RNA, 64 nt, Homo Sapiens; identical to SEQ ID NO: 172568

SEQ ID NO: 683155 - RNA, 64 nt, Homo Sapiens; identical to SEQ ID NO: 172569

SEQ ID NO: 683156 - RNA, 64 nt, Homo Sapiens; identical to SEQ ID NO: 172570

SEQ ID NO: 683157 - RNA, 64 nt, Homo Sapiens; identical to SEQ ID NO: 172571

SEQ ID NO: 683158 - RNA, 64 nt, Homo Sapiens; identical to SEQ ID NO: 172572

SEQ ID NO: 683159 - RNA, 64 nt, Homo Sapiens; identical to SEQ ID NO: 172573

SEQ ID NO: 683160 - RNA, 64 nt, Homo Sapiens; identical to SEQ ID NO: 172574

SEQ ID NO: 683161 - RNA, 64 nt, Homo Sapiens; identical to SEQ ID NO: 172575

SEQ ID NO: 683162 - RNA, 53 nt, Homo Sapiens; identical to SEQ ID NO: 172576

SEQ ID NO: 683163 - RNA, 64 nt, Homo Sapiens; identical to SEQ ID NO: 172577

SEQ ID NO: 683164 - RNA, 64 nt, Homo Sapiens; identical to SEQ ID NO: 172578

SEQ ID NO: 683165 - RNA, 64 nt, Homo Sapiens
aggcagugaauuuccagcaccaggggagaaggggcgucuucaggagggcuucgggguuuugcuu

SEQ ID NO: 683166 - RNA, 64 nt, Homo Sapiens
cuucagagauguaucuugucuuugucaggcccuucgucuucauggcccaccuguuuucugccgu

SEQ ID NO: 683167 - RNA, 64 nt, Homo Sapiens
gaacaaagaagcugugaccccagcaggaugucuaauaugugaggaaaugagauguccaccuaaa

SEQ ID NO: 683168 - RNA, 64 nt, Homo Sapiens
auaugugaggaaaugagauguccaccuaaaauucauaugugacaaaauuaucucgaccuuacau

SEQ ID NO: 683169 - RNA, 64 nt, Homo Sapiens
uaauuuuuuuaaauaucuccacaaaugccaauagauaugugaguuuuucacagucuccagggug

SEQ ID NO: 683170 - RNA, 64 nt, Homo Sapiens
gagaaugaugcauuaacugacgauaacucagugcauaugugaaaccacagcagcuucaucuuua

SEQ ID NO: 683171 - RNA, 64 nt, Homo Sapiens
uuaguaugaaauuuacuacaccaaagaaaugccaauaugugacauuuaaaauauaaagcuacau

SEQ ID NO: 683172 - RNA, 64 nt, Homo Sapiens
aaaaugagacuagacagauuauuuuugcuccucuauaugugaggaauuuguucggaauacacua

SEQ ID NO: 683173 - RNA, 64 nt, Homo Sapiens
acaaccuaaagaucucuguguucauacgccccagauaugugaguuacaugagauggcacaguga

SEQ ID NO: 683174 - RNA, 64 nt, Homo Sapiens
uuguaaaucugccuaaagauuuuuugcauauuauauaugugaauuuugguuguaaguucauaac

SEQ ID NO: 683175 - RNA, 64 nt, Homo Sapiens
auuuacauuuaauagaaacauaucuagcauauguauaugugauuuuuuuuuuuuuuuugagacc

SEQ ID NO: 683176 - RNA, 64 nt, Homo Sapiens
gaauuacaggcaugagccaccgcgccuggccuguauaugugauuucuaaaaaauagaugcaugc

SEQ ID NO: 683177 - RNA, 64 nt, Homo Sapiens
ccuucuuuuagaucuuccuugggccuuuggaaaaauaugugacaagugaauguaagucugugcc

SEQ ID NO: 683178 - RNA, 64 nt, Homo Sapiens
gcaaauauguuuagguaaacugaccuauaacagaauaugugaaaugaauuuggaaauaaugcaa

SEQ ID NO: 683179 - RNA, 64 nt, Homo Sapiens
guucaaacauuuuuggugagugcugcuuuuauaaauaugugaugucacauauuucagugacagc

SEQ ID NO: 683180 - RNA, 64 nt, Homo Sapiens
ucuggguuuuguuuuuuaauauacuuuuuaauggauaugugaaaacugaaggaaauguuaaagg

SEQ ID NO: 683181 - RNA, 64 nt, Homo Sapiens
uaaaaguagaauaaacacaauaagcuguuuuuauauaugugaaauuuuguguucaguacaauua

SEQ ID NO: 683182 - RNA, 64 nt, Homo Sapiens
uggcaaaucucuauuaggaauuggaaaaugugcaauaugugauguugcaagacauagaauagug

SEQ ID NO: 683183 - RNA, 64 nt, Homo Sapiens
agaaauuguaccaauuuuacucuaauguugauuaauaugugaaauagggaggcauuuacagucc

SEQ ID NO: 683184 - RNA, 64 nt, Homo Sapiens
uaguaaggaggacagaaaacagaaggagagagaaauaugugaggcaauguaagaggaagggugg

SEQ ID NO: 683185 - RNA, 64 nt, Homo Sapiens
cucuugauaaaaaaugcacaaaaaaucacuuuguauaugugaguuucacugcauuguauauuuu

SEQ ID NO: 683186 - RNA, 64 nt, Homo Sapiens
caaagaauguauucuucauagguuuauucuuuuaauaugugaacuauuauuaaaguuuacucug

SEQ ID NO: 683187 - RNA, 64 nt, Homo Sapiens
uaaugaacauaaaaugcuauuuauaauaacaaguauaugugaaauuucuuauuguaagacuacu

SEQ ID NO: 683188 - RNA, 64 nt, Homo Sapiens
gaaauuacaaucaaguaacuaaggccuugaguucauaugugacacugaaugcacuagcuuccuu

SEQ ID NO: 683189 - RNA, 64 nt, Homo Sapiens
aaaaugaaacaaauacuuguuaggaaaguagcaaauaugugagcauccaaaaaaaaugaaaacc

SEQ ID NO: 683190 - RNA, 64 nt, Homo Sapiens
guuaauaaagaaaagauuucuaaggaaaaccaaaauaugugaguaaagugaaauauagauauuu

SEQ ID NO: 683191 - RNA, 64 nt, Homo Sapiens
gggauuuucugacguaagauuuucauuuguaggaauaugugaugucaaauggaagacucagaag

SEQ ID NO: 683192 - RNA, 64 nt, Homo Sapiens
uggguuaaauuugaaagcaauucucuauauauaaauaugugaaauauuaugaucugaacuuagc

SEQ ID NO: 683193 - RNA, 64 nt, Homo Sapiens; identical to SEQ ID NO: 309727

SEQ ID NO: 683194 - RNA, 64 nt, Homo Sapiens; identical to SEQ ID NO: 309728

SEQ ID NO: 683195 - RNA, 62 nt, Homo Sapiens
aaugaauugaggaagugaaaagaggaagggagaagggagagggaaaggaaaaaaaggaagag

SEQ ID NO: 683196 - RNA, 62 nt, Homo Sapiens
ggagaggaaugaauugaggaggaagagagaggaagggagaagaaaagcagaaaggaaaaaaa

SEQ ID NO: 683197 - RNA, 62 nt, Homo Sapiens
gagacucaucugacacuucuaacuuuggggacaagggagagacaaaagggagagccccacaa

SEQ ID NO: 683198 - RNA, 62 nt, Homo Sapiens
cccacaaaacuuuggggacaagagggaaacaaaagggagagcgggcaacacaguuccauucu

SEQ ID NO: 683199 - RNA, 62 nt, Homo Sapiens
ggcagugggaaaagaggugaugugagcuggaaaagggagaaaaaggcccggcccaggaccac

SEQ ID NO: 683200 - RNA, 62 nt, Homo Sapiens
aaaagcaagccagaagcagacaacucuaggacaagggagaaccccauucccucuuuaucuau

SEQ ID NO: 683201 - RNA, 62 nt, Homo Sapiens
caauaaaaaaaugacuccuaguuguguuuggaaagggagagaagagaugucugaggaagguc

SEQ ID NO: 683202 - RNA, 62 nt, Homo Sapiens
gccaccacgcagccuuggcuccuacagcccaaaagggagaauggagggaggcuccaggcuuu

SEQ ID NO: 683203 - RNA, 62 nt, Homo Sapiens
aaacucuucugaggaucauuugugaagggagaaagggagagaaaugaucuuggaauauuugc

SEQ ID NO: 683204 - RNA, 62 nt, Homo Sapiens
gggagagaaaacucuucugaauauuugcugugaagggagaaaacugaaauaaugaucuugga

SEQ ID NO: 683205 - RNA, 62 nt, Homo Sapiens
aaaaaaacaaaaaaacaaaaagcaaagcccaaaagggagaaagaagauuaaugcagagaaag

SEQ ID NO: 683206 - RNA, 62 nt, Homo Sapiens
auuucaaagcuacuguuccucuagggaggguaaagggagacugcucuggguccuguuauuug

SEQ ID NO: 683207 - RNA, 62 nt, Homo Sapiens
accucuuagcaaagcccugugcagaaaagaaaaagggagaaaaaccgccaaauuguuucaga

SEQ ID NO: 683208 - RNA, 62 nt, Homo Sapiens
guggcauaacuuuuuggaacggggugagaaggaagggagaagcugguggcugggacccucca

SEQ ID NO: 683209 - RNA, 62 nt, Homo Sapiens
ggucugugugguugucuucacgggcaaucaggaagggagagagcuggggaccauauucugca

SEQ ID NO: 683210 - RNA, 62 nt, Homo Sapiens
gcaaugcagccaaauccgaggaagagaaacugaagggagaaguagauggcaaugguuaugau

SEQ ID NO: 683211 - RNA, 62 nt, Homo Sapiens
aggggucgccaacacuugugggacagagggagaagggagaacuuuuaucauugcaggccagu

SEQ ID NO: 683212 - RNA, 62 nt, Homo Sapiens
gaaauacaaggagggccucugaauuaccugauaagggagagguaugggaccugcuaagugug

SEQ ID NO: 683213 - RNA, 62 nt, Homo Sapiens
gugucagugacacaguuucccacugcaaacagaagggagaaacaagcacuugauuaacacaa

SEQ ID NO: 683214 - RNA, 62 nt, Homo Sapiens
cuaacagauaggccaaaguauccuauccacccaagggagacaggacucuuuaaaaucuggua

SEQ ID NO: 683215 - RNA, 62 nt, Homo Sapiens
uaaauucuccauuauguucguugauugugaagaagggagaguauuugauaagagaaaugcau

SEQ ID NO: 683216 - RNA, 62 nt, Homo Sapiens
gagcaguaugccacuucuuaagaaauuauccaaagggagaaauuuccuuugaugggcuuaaa

SEQ ID NO: 683217 - RNA, 62 nt, Homo Sapiens
guguccucagccgacacucacgagggcagugcaagggagaaccugccagcccagccccacca

SEQ ID NO: 683218 - RNA, 62 nt, Homo Sapiens
aaagcgugguucuguaagaaaucagagggagaaagggagagaagggggagggagacaaccca

SEQ ID NO: 683219 - RNA, 62 nt, Homo Sapiens
aagaagaagucuaaaagaaaacaucauuugcaaagggagagaggggcaagcaugauauguug

SEQ ID NO: 683220 - RNA, 62 nt, Homo Sapiens
uucugaucuuugggcauggccaggggaagcagaagggagacucuaggaguugaaauggguca

SEQ ID NO: 683221 - RNA, 62 nt, Homo Sapiens
uacugggaggugcaagacaggcuguucaugaaaagggagacuccauuguaccuggcacaagg

SEQ ID NO: 683222 - RNA, 62 nt, Homo Sapiens
gagcuagagggacaaagagagguggggaugagaagggagagaagguucaaguuccacuucuu

SEQ ID NO: 683223 - RNA, 62 nt, Homo Sapiens
uuuuagucaguaagacgauagaguuuuauauuaagggagacagaccuucagaaacuaaggag

SEQ ID NO: 683224 - RNA, 62 nt, Homo Sapiens
aaaccugaauauuauuaccaccacagaugcaaaagggagaauucucucuaacucuggguauc

SEQ ID NO: 683225 - RNA, 62 nt, Homo Sapiens
caagcuggcugugaacugucggaggggaagggaagggagagggcuggggcuggggguggcug

SEQ ID NO: 683226 - RNA, 62 nt, Homo Sapiens
uagagaggggcccgugaaguguuugcucaguuaagggagagggaaguggguggagcaucagc

SEQ ID NO: 683227 - RNA, 64 nt, Homo Sapiens; identical to SEQ ID NO: 209051

SEQ ID NO: 683228 - RNA, 64 nt, Homo Sapiens; identical to SEQ ID NO: 209052

SEQ ID NO: 683229 - RNA, 64 nt, Homo Sapiens; identical to SEQ ID NO: 209053

SEQ ID NO: 683230 - RNA, 64 nt, Homo Sapiens; identical to SEQ ID NO: 209054

SEQ ID NO: 683231 - RNA, 60 nt, Homo Sapiens; identical to SEQ ID NO: 550573

SEQ ID NO: 683232 - RNA, 64 nt, Homo Sapiens; identical to SEQ ID NO: 550574

SEQ ID NO: 683233 - RNA, 64 nt, Homo Sapiens; identical to SEQ ID NO: 550575

SEQ ID NO: 683234 - RNA, 64 nt, Homo Sapiens; identical to SEQ ID NO: 550576

SEQ ID NO: 683235 - RNA, 64 nt, Homo Sapiens; identical to SEQ ID NO: 550577

SEQ ID NO: 683236 - RNA, 64 nt, Homo Sapiens; identical to SEQ ID NO: 550578

SEQ ID NO: 683237 - RNA, 64 nt, Homo Sapiens; identical to SEQ ID NO: 550579

SEQ ID NO: 683238 - RNA, 64 nt, Homo Sapiens; identical to SEQ ID NO: 550580

SEQ ID NO: 683239 - RNA, 64 nt, Homo Sapiens; identical to SEQ ID NO: 550581

SEQ ID NO: 683240 - RNA, 64 nt, Homo Sapiens; identical to SEQ ID NO: 550582

SEQ ID NO: 683241 - RNA, 64 nt, Homo Sapiens; identical to SEQ ID NO: 550583

SEQ ID NO: 683242 - RNA, 64 nt, Homo Sapiens; identical to SEQ ID NO: 550584

SEQ ID NO: 683243 - RNA, 64 nt, Homo Sapiens; identical to SEQ ID NO: 550585

SEQ ID NO: 683244 - RNA, 64 nt, Homo Sapiens; identical to SEQ ID NO: 550586

SEQ ID NO: 683245 - RNA, 64 nt, Homo Sapiens; identical to SEQ ID NO: 550587

SEQ ID NO: 683246 - RNA, 64 nt, Homo Sapiens; identical to SEQ ID NO: 550588

SEQ ID NO: 683247 - RNA, 64 nt, Homo Sapiens; identical to SEQ ID NO: 550589

SEQ ID NO: 683248 - RNA, 64 nt, Homo Sapiens; identical to SEQ ID NO: 550590

SEQ ID NO: 683249 - RNA, 64 nt, Homo Sapiens; identical to SEQ ID NO: 159659

SEQ ID NO: 683250 - RNA, 64 nt, Homo Sapiens; identical to SEQ ID NO: 159660

SEQ ID NO: 683251 - RNA, 64 nt, Homo Sapiens; identical to SEQ ID NO: 159661

SEQ ID NO: 683252 - RNA, 64 nt, Homo Sapiens; identical to SEQ ID NO: 159662

SEQ ID NO: 683253 - RNA, 64 nt, Homo Sapiens; identical to SEQ ID NO: 159663

SEQ ID NO: 683254 - RNA, 64 nt, Homo Sapiens; identical to SEQ ID NO: 159664

SEQ ID NO: 683255 - RNA, 64 nt, Homo Sapiens; identical to SEQ ID NO: 159665

SEQ ID NO: 683256 - RNA, 64 nt, Homo Sapiens; identical to SEQ ID NO: 159666

SEQ ID NO: 683257 - RNA, 64 nt, Homo Sapiens; identical to SEQ ID NO: 159667

SEQ ID NO: 683258 - RNA, 64 nt, Homo Sapiens; identical to SEQ ID NO: 159668

SEQ ID NO: 683259 - RNA, 64 nt, Homo Sapiens; identical to SEQ ID NO: 323443

SEQ ID NO: 683260 - RNA, 64 nt, Homo Sapiens; identical to SEQ ID NO: 323444

SEQ ID NO: 683261 - RNA, 64 nt, Homo Sapiens; identical to SEQ ID NO: 323445

SEQ ID NO: 683262 - RNA, 64 nt, Homo Sapiens; identical to SEQ ID NO: 323446

SEQ ID NO: 683263 - RNA, 64 nt, Homo Sapiens; identical to SEQ ID NO: 323447

SEQ ID NO: 683264 - RNA, 64 nt, Homo Sapiens; identical to SEQ ID NO: 323448

SEQ ID NO: 683265 - RNA, 64 nt, Homo Sapiens; identical to SEQ ID NO: 323449

SEQ ID NO: 683266 - RNA, 64 nt, Homo Sapiens; identical to SEQ ID NO: 323450

SEQ ID NO: 683267 - RNA, 64 nt, Homo Sapiens; identical to SEQ ID NO: 323451

SEQ ID NO: 683268 - RNA, 64 nt, Homo Sapiens; identical to SEQ ID NO: 323452

SEQ ID NO: 683269 - RNA, 64 nt, Homo Sapiens; identical to SEQ ID NO: 147168

SEQ ID NO: 683270 - RNA, 64 nt, Homo Sapiens; identical to SEQ ID NO: 147169

SEQ ID NO: 683271 - RNA, 64 nt, Homo Sapiens; identical to SEQ ID NO: 147170

SEQ ID NO: 683272 - RNA, 64 nt, Homo Sapiens; identical to SEQ ID NO: 147171

SEQ ID NO: 683273 - RNA, 64 nt, Homo Sapiens; identical to SEQ ID NO: 147172

SEQ ID NO: 683274 - RNA, 64 nt, Homo Sapiens; identical to SEQ ID NO: 147173

SEQ ID NO: 683275 - RNA, 64 nt, Homo Sapiens; identical to SEQ ID NO: 147174

SEQ ID NO: 683276 - RNA, 64 nt, Homo Sapiens; identical to SEQ ID NO: 147175

SEQ ID NO: 683277 - RNA, 64 nt, Homo Sapiens; identical to SEQ ID NO: 147176

SEQ ID NO: 683278 - RNA, 64 nt, Homo Sapiens; identical to SEQ ID NO: 147177

SEQ ID NO: 683279 - RNA, 64 nt, Homo Sapiens; identical to SEQ ID NO: 147178

SEQ ID NO: 683280 - RNA, 64 nt, Homo Sapiens; identical to SEQ ID NO: 147179

SEQ ID NO: 683281 - RNA, 64 nt, Homo Sapiens; identical to SEQ ID NO: 39347

SEQ ID NO: 683282 - RNA, 64 nt, Homo Sapiens; identical to SEQ ID NO: 39348

SEQ ID NO: 683283 - RNA, 64 nt, Homo Sapiens; identical to SEQ ID NO: 39349

SEQ ID NO: 683284 - RNA, 64 nt, Homo Sapiens; identical to SEQ ID NO: 39350

SEQ ID NO: 683285 - RNA, 64 nt, Homo Sapiens; identical to SEQ ID NO: 39351

SEQ ID NO: 683286 - RNA, 64 nt, Homo Sapiens; identical to SEQ ID NO: 39352

SEQ ID NO: 683287 - RNA, 64 nt, Homo Sapiens; identical to SEQ ID NO: 39353

SEQ ID NO: 683288 - RNA, 64 nt, Homo Sapiens; identical to SEQ ID NO: 39354

SEQ ID NO: 683289 - RNA, 64 nt, Homo Sapiens; identical to SEQ ID NO: 39355

SEQ ID NO: 683290 - RNA, 64 nt, Homo Sapiens; identical to SEQ ID NO: 39356

SEQ ID NO: 683291 - RNA, 64 nt, Homo Sapiens; identical to SEQ ID NO: 39357

SEQ ID NO: 683292 - RNA, 64 nt, Homo Sapiens; identical to SEQ ID NO: 39358

SEQ ID NO: 683293 - RNA, 64 nt, Homo Sapiens; identical to SEQ ID NO: 39359

SEQ ID NO: 683294 - RNA, 64 nt, Homo Sapiens; identical to SEQ ID NO: 39360

SEQ ID NO: 683295 - RNA, 64 nt, Homo Sapiens; identical to SEQ ID NO: 39361

SEQ ID NO: 683296 - RNA, 64 nt, Homo Sapiens; identical to SEQ ID NO: 39362

SEQ ID NO: 683297 - RNA, 64 nt, Homo Sapiens; identical to SEQ ID NO: 39363

SEQ ID NO: 683298 - RNA, 64 nt, Homo Sapiens; identical to SEQ ID NO: 39364

SEQ ID NO: 683299 - RNA, 64 nt, Homo Sapiens; identical to SEQ ID NO: 39365

SEQ ID NO: 683300 - RNA, 64 nt, Homo Sapiens; identical to SEQ ID NO: 39366

SEQ ID NO: 683301 - RNA, 64 nt, Homo Sapiens; identical to SEQ ID NO: 39367

SEQ ID NO: 683302 - RNA, 64 nt, Homo Sapiens; identical to SEQ ID NO: 39368

SEQ ID NO: 683303 - RNA, 64 nt, Homo Sapiens; identical to SEQ ID NO: 39369

SEQ ID NO: 683304 - RNA, 64 nt, Homo Sapiens; identical to SEQ ID NO: 39370

SEQ ID NO: 683305 - RNA, 64 nt, Homo Sapiens; identical to SEQ ID NO: 39371

SEQ ID NO: 683306 - RNA, 64 nt, Homo Sapiens; identical to SEQ ID NO: 39372

SEQ ID NO: 683307 - RNA, 64 nt, Homo Sapiens; identical to SEQ ID NO: 39373

SEQ ID NO: 683308 - RNA, 64 nt, Homo Sapiens; identical to SEQ ID NO: 39374

SEQ ID NO: 683309 - RNA, 64 nt, Homo Sapiens; identical to SEQ ID NO: 39375

SEQ ID NO: 683310 - RNA, 64 nt, Homo Sapiens; identical to SEQ ID NO: 39376

SEQ ID NO: 683311 - RNA, 64 nt, Homo Sapiens; identical to SEQ ID NO: 39377

SEQ ID NO: 683312 - RNA, 64 nt, Homo Sapiens; identical to SEQ ID NO: 39378

SEQ ID NO: 683313 - RNA, 64 nt, Homo Sapiens; identical to SEQ ID NO: 39379

SEQ ID NO: 683314 - RNA, 64 nt, Homo Sapiens; identical to SEQ ID NO: 39380

SEQ ID NO: 683315 - RNA, 64 nt, Homo Sapiens; identical to SEQ ID NO: 39381

SEQ ID NO: 683316 - RNA, 64 nt, Homo Sapiens; identical to SEQ ID NO: 39382

SEQ ID NO: 683317 - RNA, 64 nt, Homo Sapiens; identical to SEQ ID NO: 39383

SEQ ID NO: 683318 - RNA, 64 nt, Homo Sapiens; identical to SEQ ID NO: 39384

SEQ ID NO: 683319 - RNA, 64 nt, Homo Sapiens; identical to SEQ ID NO: 39385

SEQ ID NO: 683320 - RNA, 64 nt, Homo Sapiens; identical to SEQ ID NO: 39386

SEQ ID NO: 683321 - RNA, 64 nt, Homo Sapiens; identical to SEQ ID NO: 39387

SEQ ID NO: 683322 - RNA, 64 nt, Homo Sapiens; identical to SEQ ID NO: 39388

SEQ ID NO: 683323 - RNA, 64 nt, Homo Sapiens; identical to SEQ ID NO: 39389

SEQ ID NO: 683324 - RNA, 64 nt, Homo Sapiens; identical to SEQ ID NO: 39390

SEQ ID NO: 683325 - RNA, 64 nt, Homo Sapiens; identical to SEQ ID NO: 39391

SEQ ID NO: 683326 - RNA, 64 nt, Homo Sapiens; identical to SEQ ID NO: 39392

SEQ ID NO: 683327 - RNA, 64 nt, Homo Sapiens; identical to SEQ ID NO: 39393

SEQ ID NO: 683328 - RNA, 64 nt, Homo Sapiens; identical to SEQ ID NO: 39394

SEQ ID NO: 683329 - RNA, 64 nt, Homo Sapiens; identical to SEQ ID NO: 39395

SEQ ID NO: 683330 - RNA, 64 nt, Homo Sapiens; identical to SEQ ID NO: 39396

SEQ ID NO: 683331 - RNA, 64 nt, Homo Sapiens; identical to SEQ ID NO: 39397

SEQ ID NO: 683332 - RNA, 64 nt, Homo Sapiens; identical to SEQ ID NO: 39398

SEQ ID NO: 683333 - RNA, 64 nt, Homo Sapiens; identical to SEQ ID NO: 39399

SEQ ID NO: 683334 - RNA, 64 nt, Homo Sapiens; identical to SEQ ID NO: 39400

SEQ ID NO: 683335 - RNA, 64 nt, Homo Sapiens; identical to SEQ ID NO: 39401

SEQ ID NO: 683336 - RNA, 64 nt, Homo Sapiens; identical to SEQ ID NO: 39402

SEQ ID NO: 683337 - RNA, 64 nt, Homo Sapiens; identical to SEQ ID NO: 39403

SEQ ID NO: 683338 - RNA, 64 nt, Homo Sapiens; identical to SEQ ID NO: 39404

SEQ ID NO: 683339 - RNA, 64 nt, Homo Sapiens; identical to SEQ ID NO: 39405

SEQ ID NO: 683340 - RNA, 64 nt, Homo Sapiens; identical to SEQ ID NO: 39406

SEQ ID NO: 683341 - RNA, 64 nt, Homo Sapiens; identical to SEQ ID NO: 39407

SEQ ID NO: 683342 - RNA, 64 nt, Homo Sapiens; identical to SEQ ID NO: 39408

SEQ ID NO: 683343 - RNA, 64 nt, Homo Sapiens; identical to SEQ ID NO: 39409

SEQ ID NO: 683344 - RNA, 64 nt, Homo Sapiens; identical to SEQ ID NO: 39410

SEQ ID NO: 683345 - RNA, 64 nt, Homo Sapiens; identical to SEQ ID NO: 39411

SEQ ID NO: 683346 - RNA, 64 nt, Homo Sapiens; identical to SEQ ID NO: 39412

SEQ ID NO: 683347 - RNA, 64 nt, Homo Sapiens; identical to SEQ ID NO: 39413

SEQ ID NO: 683348 - RNA, 64 nt, Homo Sapiens; identical to SEQ ID NO: 39414

SEQ ID NO: 683349 - RNA, 64 nt, Homo Sapiens; identical to SEQ ID NO: 39415

SEQ ID NO: 683350 - RNA, 64 nt, Homo Sapiens; identical to SEQ ID NO: 39416

SEQ ID NO: 683351 - RNA, 64 nt, Homo Sapiens; identical to SEQ ID NO: 39417

SEQ ID NO: 683352 - RNA, 64 nt, Homo Sapiens; identical to SEQ ID NO: 39418

SEQ ID NO: 683353 - RNA, 64 nt, Homo Sapiens; identical to SEQ ID NO: 39419

SEQ ID NO: 683354 - RNA, 64 nt, Homo Sapiens; identical to SEQ ID NO: 39420

SEQ ID NO: 683355 - RNA, 64 nt, Homo Sapiens; identical to SEQ ID NO: 39421

SEQ ID NO: 683356 - RNA, 64 nt, Homo Sapiens; identical to SEQ ID NO: 39422

SEQ ID NO: 683357 - RNA, 64 nt, Homo Sapiens; identical to SEQ ID NO: 39423

SEQ ID NO: 683358 - RNA, 64 nt, Homo Sapiens; identical to SEQ ID NO: 39424

SEQ ID NO: 683359 - RNA, 64 nt, Homo Sapiens; identical to SEQ ID NO: 39425

SEQ ID NO: 683360 - RNA, 64 nt, Homo Sapiens; identical to SEQ ID NO: 39426

SEQ ID NO: 683361 - RNA, 64 nt, Homo Sapiens; identical to SEQ ID NO: 39427

SEQ ID NO: 683362 - RNA, 64 nt, Homo Sapiens; identical to SEQ ID NO: 39428

SEQ ID NO: 683363 - RNA, 64 nt, Homo Sapiens; identical to SEQ ID NO: 39429

SEQ ID NO: 683364 - RNA, 64 nt, Homo Sapiens; identical to SEQ ID NO: 39430

SEQ ID NO: 683365 - RNA, 64 nt, Homo Sapiens; identical to SEQ ID NO: 39431

SEQ ID NO: 683366 - RNA, 64 nt, Homo Sapiens; identical to SEQ ID NO: 39432

SEQ ID NO: 683367 - RNA, 64 nt, Homo Sapiens; identical to SEQ ID NO: 39433

SEQ ID NO: 683368 - RNA, 64 nt, Homo Sapiens; identical to SEQ ID NO: 39434

SEQ ID NO: 683369 - RNA, 64 nt, Homo Sapiens; identical to SEQ ID NO: 39435

SEQ ID NO: 683370 - RNA, 64 nt, Homo Sapiens; identical to SEQ ID NO: 39436

SEQ ID NO: 683371 - RNA, 64 nt, Homo Sapiens; identical to SEQ ID NO: 39437

SEQ ID NO: 683372 - RNA, 64 nt, Homo Sapiens; identical to SEQ ID NO: 39438

SEQ ID NO: 683373 - RNA, 64 nt, Homo Sapiens; identical to SEQ ID NO: 39439

SEQ ID NO: 683374 - RNA, 64 nt, Homo Sapiens; identical to SEQ ID NO: 39440

SEQ ID NO: 683375 - RNA, 64 nt, Homo Sapiens; identical to SEQ ID NO: 39441

SEQ ID NO: 683376 - RNA, 64 nt, Homo Sapiens; identical to SEQ ID NO: 39442

SEQ ID NO: 683377 - RNA, 64 nt, Homo Sapiens; identical to SEQ ID NO: 39443

SEQ ID NO: 683378 - RNA, 64 nt, Homo Sapiens; identical to SEQ ID NO: 39444

SEQ ID NO: 683379 - RNA, 64 nt, Homo Sapiens; identical to SEQ ID NO: 39445

SEQ ID NO: 683380 - RNA, 64 nt, Homo Sapiens; identical to SEQ ID NO: 39446

SEQ ID NO: 683381 - RNA, 64 nt, Homo Sapiens; identical to SEQ ID NO: 39447

SEQ ID NO: 683382 - RNA, 64 nt, Homo Sapiens; identical to SEQ ID NO: 39448

SEQ ID NO: 683383 - RNA, 64 nt, Homo Sapiens; identical to SEQ ID NO: 39449

SEQ ID NO: 683384 - RNA, 64 nt, Homo Sapiens; identical to SEQ ID NO: 39450

SEQ ID NO: 683385 - RNA, 64 nt, Homo Sapiens; identical to SEQ ID NO: 39451

SEQ ID NO: 683386 - RNA, 64 nt, Homo Sapiens; identical to SEQ ID NO: 39452

SEQ ID NO: 683387 - RNA, 64 nt, Homo Sapiens; identical to SEQ ID NO: 39453

SEQ ID NO: 683388 - RNA, 64 nt, Homo Sapiens; identical to SEQ ID NO: 39454

SEQ ID NO: 683389 - RNA, 64 nt, Homo Sapiens; identical to SEQ ID NO: 39455

SEQ ID NO: 683390 - RNA, 64 nt, Homo Sapiens; identical to SEQ ID NO: 39456

SEQ ID NO: 683391 - RNA, 64 nt, Homo Sapiens; identical to SEQ ID NO: 39457

SEQ ID NO: 683392 - RNA, 64 nt, Homo Sapiens; identical to SEQ ID NO: 39458

SEQ ID NO: 683393 - RNA, 64 nt, Homo Sapiens; identical to SEQ ID NO: 39459

SEQ ID NO: 683394 - RNA, 64 nt, Homo Sapiens; identical to SEQ ID NO: 39460

SEQ ID NO: 683395 - RNA, 64 nt, Homo Sapiens; identical to SEQ ID NO: 39461

SEQ ID NO: 683396 - RNA, 64 nt, Homo Sapiens; identical to SEQ ID NO: 39462

SEQ ID NO: 683397 - RNA, 64 nt, Homo Sapiens; identical to SEQ ID NO: 39463

SEQ ID NO: 683398 - RNA, 64 nt, Homo Sapiens; identical to SEQ ID NO: 39464

SEQ ID NO: 683399 - RNA, 64 nt, Homo Sapiens; identical to SEQ ID NO: 39465

SEQ ID NO: 683400 - RNA, 64 nt, Homo Sapiens; identical to SEQ ID NO: 39466

SEQ ID NO: 683401 - RNA, 64 nt, Homo Sapiens; identical to SEQ ID NO: 39467

SEQ ID NO: 683402 - RNA, 64 nt, Homo Sapiens; identical to SEQ ID NO: 39468

SEQ ID NO: 683403 - RNA, 64 nt, Homo Sapiens; identical to SEQ ID NO: 39469

SEQ ID NO: 683404 - RNA, 64 nt, Homo Sapiens; identical to SEQ ID NO: 39470

SEQ ID NO: 683405 - RNA, 64 nt, Homo Sapiens; identical to SEQ ID NO: 39471

SEQ ID NO: 683406 - RNA, 64 nt, Homo Sapiens; identical to SEQ ID NO: 39472

SEQ ID NO: 683407 - RNA, 64 nt, Homo Sapiens; identical to SEQ ID NO: 39473

SEQ ID NO: 683408 - RNA, 64 nt, Homo Sapiens; identical to SEQ ID NO: 39474

SEQ ID NO: 683409 - RNA, 64 nt, Homo Sapiens; identical to SEQ ID NO: 39475

SEQ ID NO: 683410 - RNA, 64 nt, Homo Sapiens; identical to SEQ ID NO: 39476

SEQ ID NO: 683411 - RNA, 64 nt, Homo Sapiens; identical to SEQ ID NO: 39477

SEQ ID NO: 683412 - RNA, 64 nt, Homo Sapiens; identical to SEQ ID NO: 39478

SEQ ID NO: 683413 - RNA, 64 nt, Homo Sapiens; identical to SEQ ID NO: 39479

SEQ ID NO: 683414 - RNA, 64 nt, Homo Sapiens; identical to SEQ ID NO: 39480

SEQ ID NO: 683415 - RNA, 64 nt, Homo Sapiens; identical to SEQ ID NO: 39481

SEQ ID NO: 683416 - RNA, 64 nt, Homo Sapiens; identical to SEQ ID NO: 39482

SEQ ID NO: 683417 - RNA, 64 nt, Homo Sapiens; identical to SEQ ID NO: 39483

SEQ ID NO: 683418 - RNA, 64 nt, Homo Sapiens; identical to SEQ ID NO: 39484

SEQ ID NO: 683419 - RNA, 64 nt, Homo Sapiens; identical to SEQ ID NO: 39485

SEQ ID NO: 683420 - RNA, 64 nt, Homo Sapiens; identical to SEQ ID NO: 39486

SEQ ID NO: 683421 - RNA, 64 nt, Homo Sapiens; identical to SEQ ID NO: 39487

SEQ ID NO: 683422 - RNA, 64 nt, Homo Sapiens; identical to SEQ ID NO: 39488

SEQ ID NO: 683423 - RNA, 64 nt, Homo Sapiens; identical to SEQ ID NO: 39489

SEQ ID NO: 683424 - RNA, 64 nt, Homo Sapiens; identical to SEQ ID NO: 39490

SEQ ID NO: 683425 - RNA, 64 nt, Homo Sapiens; identical to SEQ ID NO: 39491

SEQ ID NO: 683426 - RNA, 64 nt, Homo Sapiens; identical to SEQ ID NO: 39492

SEQ ID NO: 683427 - RNA, 64 nt, Homo Sapiens; identical to SEQ ID NO: 39493

SEQ ID NO: 683428 - RNA, 64 nt, Homo Sapiens; identical to SEQ ID NO: 39494

SEQ ID NO: 683429 - RNA, 64 nt, Homo Sapiens; identical to SEQ ID NO: 39495

SEQ ID NO: 683430 - RNA, 64 nt, Homo Sapiens; identical to SEQ ID NO: 39496

SEQ ID NO: 683431 - RNA, 64 nt, Homo Sapiens; identical to SEQ ID NO: 39497

SEQ ID NO: 683432 - RNA, 64 nt, Homo Sapiens; identical to SEQ ID NO: 39498

SEQ ID NO: 683433 - RNA, 64 nt, Homo Sapiens; identical to SEQ ID NO: 39499

SEQ ID NO: 683434 - RNA, 64 nt, Homo Sapiens; identical to SEQ ID NO: 39500

SEQ ID NO: 683435 - RNA, 64 nt, Homo Sapiens; identical to SEQ ID NO: 39501

SEQ ID NO: 683436 - RNA, 64 nt, Homo Sapiens; identical to SEQ ID NO: 39502

SEQ ID NO: 683437 - RNA, 64 nt, Homo Sapiens; identical to SEQ ID NO: 39503

SEQ ID NO: 683438 - RNA, 64 nt, Homo Sapiens; identical to SEQ ID NO: 39504

SEQ ID NO: 683439 - RNA, 64 nt, Homo Sapiens; identical to SEQ ID NO: 39505

SEQ ID NO: 683440 - RNA, 64 nt, Homo Sapiens; identical to SEQ ID NO: 39506

SEQ ID NO: 683441 - RNA, 64 nt, Homo Sapiens; identical to SEQ ID NO: 39507

SEQ ID NO: 683442 - RNA, 64 nt, Homo Sapiens; identical to SEQ ID NO: 39508

SEQ ID NO: 683443 - RNA, 64 nt, Homo Sapiens; identical to SEQ ID NO: 39509

SEQ ID NO: 683444 - RNA, 64 nt, Homo Sapiens; identical to SEQ ID NO: 39510

SEQ ID NO: 683445 - RNA, 64 nt, Homo Sapiens; identical to SEQ ID NO: 39511

SEQ ID NO: 683446 - RNA, 64 nt, Homo Sapiens; identical to SEQ ID NO: 39512

SEQ ID NO: 683447 - RNA, 64 nt, Homo Sapiens; identical to SEQ ID NO: 39513

SEQ ID NO: 683448 - RNA, 64 nt, Homo Sapiens; identical to SEQ ID NO: 39514

SEQ ID NO: 683449 - RNA, 64 nt, Homo Sapiens; identical to SEQ ID NO: 39515

SEQ ID NO: 683450 - RNA, 64 nt, Homo Sapiens; identical to SEQ ID NO: 39516

SEQ ID NO: 683451 - RNA, 64 nt, Homo Sapiens; identical to SEQ ID NO: 39517

SEQ ID NO: 683452 - RNA, 64 nt, Homo Sapiens; identical to SEQ ID NO: 39518

SEQ ID NO: 683453 - RNA, 64 nt, Homo Sapiens; identical to SEQ ID NO: 39519

SEQ ID NO: 683454 - RNA, 64 nt, Homo Sapiens; identical to SEQ ID NO: 39520

SEQ ID NO: 683455 - RNA, 64 nt, Homo Sapiens; identical to SEQ ID NO: 39521

SEQ ID NO: 683456 - RNA, 64 nt, Homo Sapiens; identical to SEQ ID NO: 39522

SEQ ID NO: 683457 - RNA, 64 nt, Homo Sapiens; identical to SEQ ID NO: 39523

SEQ ID NO: 683458 - RNA, 64 nt, Homo Sapiens; identical to SEQ ID NO: 39524

SEQ ID NO: 683459 - RNA, 64 nt, Homo Sapiens; identical to SEQ ID NO: 39525

SEQ ID NO: 683460 - RNA, 64 nt, Homo Sapiens; identical to SEQ ID NO: 39526

SEQ ID NO: 683461 - RNA, 64 nt, Homo Sapiens; identical to SEQ ID NO: 39527

SEQ ID NO: 683462 - RNA, 64 nt, Homo Sapiens; identical to SEQ ID NO: 39528

SEQ ID NO: 683463 - RNA, 64 nt, Homo Sapiens; identical to SEQ ID NO: 39529

SEQ ID NO: 683464 - RNA, 64 nt, Homo Sapiens; identical to SEQ ID NO: 39530

SEQ ID NO: 683465 - RNA, 64 nt, Homo Sapiens; identical to SEQ ID NO: 39531

SEQ ID NO: 683466 - RNA, 64 nt, Homo Sapiens; identical to SEQ ID NO: 39532

SEQ ID NO: 683467 - RNA, 64 nt, Homo Sapiens; identical to SEQ ID NO: 39533

SEQ ID NO: 683468 - RNA, 64 nt, Homo Sapiens; identical to SEQ ID NO: 39534

SEQ ID NO: 683469 - RNA, 64 nt, Homo Sapiens; identical to SEQ ID NO: 39535

SEQ ID NO: 683470 - RNA, 64 nt, Homo Sapiens; identical to SEQ ID NO: 39536

SEQ ID NO: 683471 - RNA, 64 nt, Homo Sapiens; identical to SEQ ID NO: 39537

SEQ ID NO: 683472 - RNA, 64 nt, Homo Sapiens; identical to SEQ ID NO: 39538

SEQ ID NO: 683473 - RNA, 64 nt, Homo Sapiens; identical to SEQ ID NO: 39539

SEQ ID NO: 683474 - RNA, 64 nt, Homo Sapiens; identical to SEQ ID NO: 39540

SEQ ID NO: 683475 - RNA, 64 nt, Homo Sapiens; identical to SEQ ID NO: 39541

SEQ ID NO: 683476 - RNA, 64 nt, Homo Sapiens; identical to SEQ ID NO: 39542

SEQ ID NO: 683477 - RNA, 64 nt, Homo Sapiens; identical to SEQ ID NO: 39543

SEQ ID NO: 683478 - RNA, 64 nt, Homo Sapiens; identical to SEQ ID NO: 39544

SEQ ID NO: 683479 - RNA, 64 nt, Homo Sapiens; identical to SEQ ID NO: 39545

SEQ ID NO: 683480 - RNA, 64 nt, Homo Sapiens; identical to SEQ ID NO: 39546

SEQ ID NO: 683481 - RNA, 64 nt, Homo Sapiens; identical to SEQ ID NO: 39547

SEQ ID NO: 683482 - RNA, 64 nt, Homo Sapiens; identical to SEQ ID NO: 39548

SEQ ID NO: 683483 - RNA, 64 nt, Homo Sapiens; identical to SEQ ID NO: 39549

SEQ ID NO: 683484 - RNA, 64 nt, Homo Sapiens; identical to SEQ ID NO: 39550

SEQ ID NO: 683485 - RNA, 64 nt, Homo Sapiens; identical to SEQ ID NO: 39551

SEQ ID NO: 683486 - RNA, 64 nt, Homo Sapiens; identical to SEQ ID NO: 39552

SEQ ID NO: 683487 - RNA, 64 nt, Homo Sapiens; identical to SEQ ID NO: 39553

SEQ ID NO: 683488 - RNA, 64 nt, Homo Sapiens; identical to SEQ ID NO: 39554

SEQ ID NO: 683489 - RNA, 64 nt, Homo Sapiens; identical to SEQ ID NO: 39555

SEQ ID NO: 683490 - RNA, 64 nt, Homo Sapiens; identical to SEQ ID NO: 39556

SEQ ID NO: 683491 - RNA, 64 nt, Homo Sapiens; identical to SEQ ID NO: 39557

SEQ ID NO: 683492 - RNA, 64 nt, Homo Sapiens; identical to SEQ ID NO: 39558

SEQ ID NO: 683493 - RNA, 64 nt, Homo Sapiens; identical to SEQ ID NO: 39559

SEQ ID NO: 683494 - RNA, 64 nt, Homo Sapiens; identical to SEQ ID NO: 39560

SEQ ID NO: 683495 - RNA, 64 nt, Homo Sapiens; identical to SEQ ID NO: 39561

SEQ ID NO: 683496 - RNA, 64 nt, Homo Sapiens; identical to SEQ ID NO: 39562

SEQ ID NO: 683497 - RNA, 64 nt, Homo Sapiens; identical to SEQ ID NO: 39563

SEQ ID NO: 683498 - RNA, 64 nt, Homo Sapiens; identical to SEQ ID NO: 39564

SEQ ID NO: 683499 - RNA, 64 nt, Homo Sapiens; identical to SEQ ID NO: 39565

SEQ ID NO: 683500 - RNA, 64 nt, Homo Sapiens; identical to SEQ ID NO: 39566

SEQ ID NO: 683501 - RNA, 64 nt, Homo Sapiens; identical to SEQ ID NO: 39567

SEQ ID NO: 683502 - RNA, 64 nt, Homo Sapiens; identical to SEQ ID NO: 39568

SEQ ID NO: 683503 - RNA, 64 nt, Homo Sapiens; identical to SEQ ID NO: 39569

SEQ ID NO: 683504 - RNA, 64 nt, Homo Sapiens; identical to SEQ ID NO: 39570

SEQ ID NO: 683505 - RNA, 64 nt, Homo Sapiens; identical to SEQ ID NO: 39571

SEQ ID NO: 683506 - RNA, 64 nt, Homo Sapiens; identical to SEQ ID NO: 39572

SEQ ID NO: 683507 - RNA, 64 nt, Homo Sapiens; identical to SEQ ID NO: 39573

SEQ ID NO: 683508 - RNA, 64 nt, Homo Sapiens; identical to SEQ ID NO: 39574

SEQ ID NO: 683509 - RNA, 64 nt, Homo Sapiens; identical to SEQ ID NO: 39575

SEQ ID NO: 683510 - RNA, 64 nt, Homo Sapiens; identical to SEQ ID NO: 39576

SEQ ID NO: 683511 - RNA, 64 nt, Homo Sapiens; identical to SEQ ID NO: 39577

SEQ ID NO: 683512 - RNA, 64 nt, Homo Sapiens; identical to SEQ ID NO: 39578

SEQ ID NO: 683513 - RNA, 64 nt, Homo Sapiens; identical to SEQ ID NO: 39579

SEQ ID NO: 683514 - RNA, 64 nt, Homo Sapiens; identical to SEQ ID NO: 39580

SEQ ID NO: 683515 - RNA, 64 nt, Homo Sapiens; identical to SEQ ID NO: 39581

SEQ ID NO: 683516 - RNA, 64 nt, Homo Sapiens; identical to SEQ ID NO: 39582

SEQ ID NO: 683517 - RNA, 64 nt, Homo Sapiens; identical to SEQ ID NO: 39583

SEQ ID NO: 683518 - RNA, 64 nt, Homo Sapiens; identical to SEQ ID NO: 39584

SEQ ID NO: 683519 - RNA, 64 nt, Homo Sapiens; identical to SEQ ID NO: 39585

SEQ ID NO: 683520 - RNA, 64 nt, Homo Sapiens; identical to SEQ ID NO: 39586

SEQ ID NO: 683521 - RNA, 64 nt, Homo Sapiens; identical to SEQ ID NO: 39587

SEQ ID NO: 683522 - RNA, 64 nt, Homo Sapiens; identical to SEQ ID NO: 39588

SEQ ID NO: 683523 - RNA, 64 nt, Homo Sapiens; identical to SEQ ID NO: 39589

SEQ ID NO: 683524 - RNA, 64 nt, Homo Sapiens; identical to SEQ ID NO: 39590

SEQ ID NO: 683525 - RNA, 64 nt, Homo Sapiens; identical to SEQ ID NO: 39591

SEQ ID NO: 683526 - RNA, 64 nt, Homo Sapiens; identical to SEQ ID NO: 39592

SEQ ID NO: 683527 - RNA, 64 nt, Homo Sapiens; identical to SEQ ID NO: 39593

SEQ ID NO: 683528 - RNA, 64 nt, Homo Sapiens; identical to SEQ ID NO: 39594

SEQ ID NO: 683529 - RNA, 64 nt, Homo Sapiens; identical to SEQ ID NO: 39595

SEQ ID NO: 683530 - RNA, 64 nt, Homo Sapiens; identical to SEQ ID NO: 39596

SEQ ID NO: 683531 - RNA, 64 nt, Homo Sapiens; identical to SEQ ID NO: 39597

SEQ ID NO: 683532 - RNA, 64 nt, Homo Sapiens; identical to SEQ ID NO: 39598

SEQ ID NO: 683533 - RNA, 64 nt, Homo Sapiens; identical to SEQ ID NO: 39599

SEQ ID NO: 683534 - RNA, 64 nt, Homo Sapiens; identical to SEQ ID NO: 39600

SEQ ID NO: 683535 - RNA, 64 nt, Homo Sapiens; identical to SEQ ID NO: 39601

SEQ ID NO: 683536 - RNA, 64 nt, Homo Sapiens; identical to SEQ ID NO: 39602

SEQ ID NO: 683537 - RNA, 64 nt, Homo Sapiens; identical to SEQ ID NO: 39603

SEQ ID NO: 683538 - RNA, 64 nt, Homo Sapiens; identical to SEQ ID NO: 39604

SEQ ID NO: 683539 - RNA, 64 nt, Homo Sapiens; identical to SEQ ID NO: 39605

SEQ ID NO: 683540 - RNA, 64 nt, Homo Sapiens; identical to SEQ ID NO: 39606

SEQ ID NO: 683541 - RNA, 64 nt, Homo Sapiens; identical to SEQ ID NO: 39607

SEQ ID NO: 683542 - RNA, 64 nt, Homo Sapiens; identical to SEQ ID NO: 39608

SEQ ID NO: 683543 - RNA, 64 nt, Homo Sapiens; identical to SEQ ID NO: 39609

SEQ ID NO: 683544 - RNA, 64 nt, Homo Sapiens; identical to SEQ ID NO: 39610

SEQ ID NO: 683545 - RNA, 64 nt, Homo Sapiens; identical to SEQ ID NO: 39611

SEQ ID NO: 683546 - RNA, 64 nt, Homo Sapiens; identical to SEQ ID NO: 39612

SEQ ID NO: 683547 - RNA, 64 nt, Homo Sapiens; identical to SEQ ID NO: 39613

SEQ ID NO: 683548 - RNA, 64 nt, Homo Sapiens; identical to SEQ ID NO: 39614

SEQ ID NO: 683549 - RNA, 64 nt, Homo Sapiens; identical to SEQ ID NO: 39615

SEQ ID NO: 683550 - RNA, 64 nt, Homo Sapiens; identical to SEQ ID NO: 39616

SEQ ID NO: 683551 - RNA, 64 nt, Homo Sapiens; identical to SEQ ID NO: 39617

SEQ ID NO: 683552 - RNA, 64 nt, Homo Sapiens; identical to SEQ ID NO: 39618

SEQ ID NO: 683553 - RNA, 64 nt, Homo Sapiens; identical to SEQ ID NO: 39619

SEQ ID NO: 683554 - RNA, 64 nt, Homo Sapiens; identical to SEQ ID NO: 39620

SEQ ID NO: 683555 - RNA, 64 nt, Homo Sapiens; identical to SEQ ID NO: 39621

SEQ ID NO: 683556 - RNA, 64 nt, Homo Sapiens; identical to SEQ ID NO: 39622

SEQ ID NO: 683557 - RNA, 64 nt, Homo Sapiens; identical to SEQ ID NO: 39623

SEQ ID NO: 683558 - RNA, 64 nt, Homo Sapiens; identical to SEQ ID NO: 39624

SEQ ID NO: 683559 - RNA, 64 nt, Homo Sapiens; identical to SEQ ID NO: 39625

SEQ ID NO: 683560 - RNA, 64 nt, Homo Sapiens; identical to SEQ ID NO: 39626

SEQ ID NO: 683561 - RNA, 64 nt, Homo Sapiens; identical to SEQ ID NO: 39627

SEQ ID NO: 683562 - RNA, 64 nt, Homo Sapiens; identical to SEQ ID NO: 39628

SEQ ID NO: 683563 - RNA, 64 nt, Homo Sapiens; identical to SEQ ID NO: 39629

SEQ ID NO: 683564 - RNA, 64 nt, Homo Sapiens; identical to SEQ ID NO: 39630

SEQ ID NO: 683565 - RNA, 64 nt, Homo Sapiens; identical to SEQ ID NO: 39631

SEQ ID NO: 683566 - RNA, 64 nt, Homo Sapiens; identical to SEQ ID NO: 39632

SEQ ID NO: 683567 - RNA, 64 nt, Homo Sapiens; identical to SEQ ID NO: 39633

SEQ ID NO: 683568 - RNA, 64 nt, Homo Sapiens; identical to SEQ ID NO: 39634

SEQ ID NO: 683569 - RNA, 64 nt, Homo Sapiens; identical to SEQ ID NO: 39635

SEQ ID NO: 683570 - RNA, 64 nt, Homo Sapiens; identical to SEQ ID NO: 39636

SEQ ID NO: 683571 - RNA, 64 nt, Homo Sapiens; identical to SEQ ID NO: 39637

SEQ ID NO: 683572 - RNA, 64 nt, Homo Sapiens; identical to SEQ ID NO: 39638

SEQ ID NO: 683573 - RNA, 64 nt, Homo Sapiens; identical to SEQ ID NO: 39639

SEQ ID NO: 683574 - RNA, 64 nt, Homo Sapiens; identical to SEQ ID NO: 39640

SEQ ID NO: 683575 - RNA, 64 nt, Homo Sapiens; identical to SEQ ID NO: 39641

SEQ ID NO: 683576 - RNA, 64 nt, Homo Sapiens; identical to SEQ ID NO: 39642

SEQ ID NO: 683577 - RNA, 64 nt, Homo Sapiens; identical to SEQ ID NO: 39643

SEQ ID NO: 683578 - RNA, 64 nt, Homo Sapiens; identical to SEQ ID NO: 39644

SEQ ID NO: 683579 - RNA, 64 nt, Homo Sapiens; identical to SEQ ID NO: 39645

SEQ ID NO: 683580 - RNA, 64 nt, Homo Sapiens; identical to SEQ ID NO: 39646

SEQ ID NO: 683581 - RNA, 64 nt, Homo Sapiens; identical to SEQ ID NO: 39647

SEQ ID NO: 683582 - RNA, 64 nt, Homo Sapiens; identical to SEQ ID NO: 39648

SEQ ID NO: 683583 - RNA, 64 nt, Homo Sapiens; identical to SEQ ID NO: 39649

SEQ ID NO: 683584 - RNA, 64 nt, Homo Sapiens; identical to SEQ ID NO: 39650

SEQ ID NO: 683585 - RNA, 64 nt, Homo Sapiens; identical to SEQ ID NO: 39651

SEQ ID NO: 683586 - RNA, 64 nt, Homo Sapiens; identical to SEQ ID NO: 39652

SEQ ID NO: 683587 - RNA, 64 nt, Homo Sapiens; identical to SEQ ID NO: 39653

SEQ ID NO: 683588 - RNA, 64 nt, Homo Sapiens; identical to SEQ ID NO: 39654

SEQ ID NO: 683589 - RNA, 64 nt, Homo Sapiens; identical to SEQ ID NO: 39655

SEQ ID NO: 683590 - RNA, 64 nt, Homo Sapiens; identical to SEQ ID NO: 39656

SEQ ID NO: 683591 - RNA, 64 nt, Homo Sapiens; identical to SEQ ID NO: 39657

SEQ ID NO: 683592 - RNA, 64 nt, Homo Sapiens; identical to SEQ ID NO: 39658

SEQ ID NO: 683593 - RNA, 64 nt, Homo Sapiens; identical to SEQ ID NO: 39659

SEQ ID NO: 683594 - RNA, 64 nt, Homo Sapiens; identical to SEQ ID NO: 39660

SEQ ID NO: 683595 - RNA, 64 nt, Homo Sapiens; identical to SEQ ID NO: 39661

SEQ ID NO: 683596 - RNA, 64 nt, Homo Sapiens; identical to SEQ ID NO: 39662

SEQ ID NO: 683597 - RNA, 64 nt, Homo Sapiens; identical to SEQ ID NO: 39663

SEQ ID NO: 683598 - RNA, 64 nt, Homo Sapiens; identical to SEQ ID NO: 39664

SEQ ID NO: 683599 - RNA, 64 nt, Homo Sapiens; identical to SEQ ID NO: 39665

SEQ ID NO: 683600 - RNA, 64 nt, Homo Sapiens; identical to SEQ ID NO: 39666

SEQ ID NO: 683601 - RNA, 64 nt, Homo Sapiens; identical to SEQ ID NO: 39667

SEQ ID NO: 683602 - RNA, 64 nt, Homo Sapiens; identical to SEQ ID NO: 39668

SEQ ID NO: 683603 - RNA, 64 nt, Homo Sapiens; identical to SEQ ID NO: 39669

SEQ ID NO: 683604 - RNA, 64 nt, Homo Sapiens; identical to SEQ ID NO: 39670

SEQ ID NO: 683605 - RNA, 64 nt, Homo Sapiens; identical to SEQ ID NO: 39671

SEQ ID NO: 683606 - RNA, 64 nt, Homo Sapiens; identical to SEQ ID NO: 39672

SEQ ID NO: 683607 - RNA, 64 nt, Homo Sapiens; identical to SEQ ID NO: 39673

SEQ ID NO: 683608 - RNA, 64 nt, Homo Sapiens; identical to SEQ ID NO: 39674

SEQ ID NO: 683609 - RNA, 64 nt, Homo Sapiens; identical to SEQ ID NO: 39675

SEQ ID NO: 683610 - RNA, 64 nt, Homo Sapiens; identical to SEQ ID NO: 39676

SEQ ID NO: 683611 - RNA, 64 nt, Homo Sapiens; identical to SEQ ID NO: 39677

SEQ ID NO: 683612 - RNA, 64 nt, Homo Sapiens; identical to SEQ ID NO: 39678

SEQ ID NO: 683613 - RNA, 64 nt, Homo Sapiens; identical to SEQ ID NO: 39679

SEQ ID NO: 683614 - RNA, 64 nt, Homo Sapiens; identical to SEQ ID NO: 39680

SEQ ID NO: 683615 - RNA, 64 nt, Homo Sapiens; identical to SEQ ID NO: 39681

SEQ ID NO: 683616 - RNA, 64 nt, Homo Sapiens; identical to SEQ ID NO: 39682

SEQ ID NO: 683617 - RNA, 64 nt, Homo Sapiens; identical to SEQ ID NO: 39683

SEQ ID NO: 683618 - RNA, 64 nt, Homo Sapiens; identical to SEQ ID NO: 39684

SEQ ID NO: 683619 - RNA, 64 nt, Homo Sapiens; identical to SEQ ID NO: 39685

SEQ ID NO: 683620 - RNA, 64 nt, Homo Sapiens; identical to SEQ ID NO: 39686

SEQ ID NO: 683621 - RNA, 64 nt, Homo Sapiens; identical to SEQ ID NO: 39687

SEQ ID NO: 683622 - RNA, 64 nt, Homo Sapiens; identical to SEQ ID NO: 39688

SEQ ID NO: 683623 - RNA, 64 nt, Homo Sapiens; identical to SEQ ID NO: 39689

SEQ ID NO: 683624 - RNA, 64 nt, Homo Sapiens; identical to SEQ ID NO: 39690

SEQ ID NO: 683625 - RNA, 64 nt, Homo Sapiens; identical to SEQ ID NO: 39691

SEQ ID NO: 683626 - RNA, 64 nt, Homo Sapiens; identical to SEQ ID NO: 39692

SEQ ID NO: 683627 - RNA, 64 nt, Homo Sapiens; identical to SEQ ID NO: 39693

SEQ ID NO: 683628 - RNA, 64 nt, Homo Sapiens; identical to SEQ ID NO: 39694

SEQ ID NO: 683629 - RNA, 64 nt, Homo Sapiens; identical to SEQ ID NO: 39695

SEQ ID NO: 683630 - RNA, 64 nt, Homo Sapiens; identical to SEQ ID NO: 39696

SEQ ID NO: 683631 - RNA, 64 nt, Homo Sapiens; identical to SEQ ID NO: 39697

SEQ ID NO: 683632 - RNA, 64 nt, Homo Sapiens; identical to SEQ ID NO: 39698

SEQ ID NO: 683633 - RNA, 64 nt, Homo Sapiens; identical to SEQ ID NO: 39699

SEQ ID NO: 683634 - RNA, 64 nt, Homo Sapiens; identical to SEQ ID NO: 39700

SEQ ID NO: 683635 - RNA, 64 nt, Homo Sapiens; identical to SEQ ID NO: 39701

SEQ ID NO: 683636 - RNA, 64 nt, Homo Sapiens; identical to SEQ ID NO: 39702

SEQ ID NO: 683637 - RNA, 64 nt, Homo Sapiens; identical to SEQ ID NO: 39703

SEQ ID NO: 683638 - RNA, 64 nt, Homo Sapiens; identical to SEQ ID NO: 39704

SEQ ID NO: 683639 - RNA, 64 nt, Homo Sapiens; identical to SEQ ID NO: 39705

SEQ ID NO: 683640 - RNA, 64 nt, Homo Sapiens; identical to SEQ ID NO: 39706

SEQ ID NO: 683641 - RNA, 64 nt, Homo Sapiens; identical to SEQ ID NO: 39707

SEQ ID NO: 683642 - RNA, 64 nt, Homo Sapiens; identical to SEQ ID NO: 39708

SEQ ID NO: 683643 - RNA, 64 nt, Homo Sapiens; identical to SEQ ID NO: 39709

SEQ ID NO: 683644 - RNA, 64 nt, Homo Sapiens; identical to SEQ ID NO: 39710

SEQ ID NO: 683645 - RNA, 64 nt, Homo Sapiens; identical to SEQ ID NO: 39711

SEQ ID NO: 683646 - RNA, 64 nt, Homo Sapiens; identical to SEQ ID NO: 39712

SEQ ID NO: 683647 - RNA, 64 nt, Homo Sapiens; identical to SEQ ID NO: 39713

SEQ ID NO: 683648 - RNA, 64 nt, Homo Sapiens; identical to SEQ ID NO: 39714

SEQ ID NO: 683649 - RNA, 64 nt, Homo Sapiens; identical to SEQ ID NO: 39715

SEQ ID NO: 683650 - RNA, 64 nt, Homo Sapiens; identical to SEQ ID NO: 39716

SEQ ID NO: 683651 - RNA, 64 nt, Homo Sapiens; identical to SEQ ID NO: 39717

SEQ ID NO: 683652 - RNA, 64 nt, Homo Sapiens; identical to SEQ ID NO: 39718

SEQ ID NO: 683653 - RNA, 64 nt, Homo Sapiens; identical to SEQ ID NO: 39719

SEQ ID NO: 683654 - RNA, 64 nt, Homo Sapiens; identical to SEQ ID NO: 39720

SEQ ID NO: 683655 - RNA, 64 nt, Homo Sapiens; identical to SEQ ID NO: 39721

SEQ ID NO: 683656 - RNA, 64 nt, Homo Sapiens; identical to SEQ ID NO: 39722

SEQ ID NO: 683657 - RNA, 64 nt, Homo Sapiens; identical to SEQ ID NO: 39723

SEQ ID NO: 683658 - RNA, 64 nt, Homo Sapiens; identical to SEQ ID NO: 39724

SEQ ID NO: 683659 - RNA, 64 nt, Homo Sapiens; identical to SEQ ID NO: 39725

SEQ ID NO: 683660 - RNA, 64 nt, Homo Sapiens; identical to SEQ ID NO: 39726

SEQ ID NO: 683661 - RNA, 64 nt, Homo Sapiens; identical to SEQ ID NO: 39727

SEQ ID NO: 683662 - RNA, 64 nt, Homo Sapiens; identical to SEQ ID NO: 39728

SEQ ID NO: 683663 - RNA, 64 nt, Homo Sapiens; identical to SEQ ID NO: 39729

SEQ ID NO: 683664 - RNA, 64 nt, Homo Sapiens; identical to SEQ ID NO: 39730

SEQ ID NO: 683665 - RNA, 64 nt, Homo Sapiens; identical to SEQ ID NO: 39731

SEQ ID NO: 683666 - RNA, 64 nt, Homo Sapiens; identical to SEQ ID NO: 39732

SEQ ID NO: 683667 - RNA, 64 nt, Homo Sapiens; identical to SEQ ID NO: 39733

SEQ ID NO: 683668 - RNA, 64 nt, Homo Sapiens; identical to SEQ ID NO: 39734

SEQ ID NO: 683669 - RNA, 64 nt, Homo Sapiens; identical to SEQ ID NO: 39735

SEQ ID NO: 683670 - RNA, 64 nt, Homo Sapiens; identical to SEQ ID NO: 39736

SEQ ID NO: 683671 - RNA, 64 nt, Homo Sapiens; identical to SEQ ID NO: 39737

SEQ ID NO: 683672 - RNA, 64 nt, Homo Sapiens; identical to SEQ ID NO: 39738

SEQ ID NO: 683673 - RNA, 64 nt, Homo Sapiens; identical to SEQ ID NO: 39739

SEQ ID NO: 683674 - RNA, 64 nt, Homo Sapiens; identical to SEQ ID NO: 39740

SEQ ID NO: 683675 - RNA, 64 nt, Homo Sapiens; identical to SEQ ID NO: 39741

SEQ ID NO: 683676 - RNA, 64 nt, Homo Sapiens; identical to SEQ ID NO: 39742

SEQ ID NO: 683677 - RNA, 64 nt, Homo Sapiens; identical to SEQ ID NO: 39743

SEQ ID NO: 683678 - RNA, 64 nt, Homo Sapiens; identical to SEQ ID NO: 39744

SEQ ID NO: 683679 - RNA, 64 nt, Homo Sapiens; identical to SEQ ID NO: 39745

SEQ ID NO: 683680 - RNA, 64 nt, Homo Sapiens; identical to SEQ ID NO: 39746

SEQ ID NO: 683681 - RNA, 64 nt, Homo Sapiens; identical to SEQ ID NO: 39747

SEQ ID NO: 683682 - RNA, 64 nt, Homo Sapiens; identical to SEQ ID NO: 39748

SEQ ID NO: 683683 - RNA, 64 nt, Homo Sapiens; identical to SEQ ID NO: 39749

SEQ ID NO: 683684 - RNA, 64 nt, Homo Sapiens; identical to SEQ ID NO: 39750

SEQ ID NO: 683685 - RNA, 64 nt, Homo Sapiens; identical to SEQ ID NO: 39751

SEQ ID NO: 683686 - RNA, 64 nt, Homo Sapiens; identical to SEQ ID NO: 39752

SEQ ID NO: 683687 - RNA, 64 nt, Homo Sapiens; identical to SEQ ID NO: 39753

SEQ ID NO: 683688 - RNA, 64 nt, Homo Sapiens; identical to SEQ ID NO: 39754

SEQ ID NO: 683689 - RNA, 64 nt, Homo Sapiens; identical to SEQ ID NO: 39755

SEQ ID NO: 683690 - RNA, 64 nt, Homo Sapiens; identical to SEQ ID NO: 39756

SEQ ID NO: 683691 - RNA, 64 nt, Homo Sapiens; identical to SEQ ID NO: 39757

SEQ ID NO: 683692 - RNA, 64 nt, Homo Sapiens; identical to SEQ ID NO: 39758

SEQ ID NO: 683693 - RNA, 64 nt, Homo Sapiens; identical to SEQ ID NO: 39759

SEQ ID NO: 683694 - RNA, 64 nt, Homo Sapiens; identical to SEQ ID NO: 39760

SEQ ID NO: 683695 - RNA, 64 nt, Homo Sapiens; identical to SEQ ID NO: 39761

SEQ ID NO: 683696 - RNA, 64 nt, Homo Sapiens; identical to SEQ ID NO: 39762

SEQ ID NO: 683697 - RNA, 64 nt, Homo Sapiens; identical to SEQ ID NO: 39763

SEQ ID NO: 683698 - RNA, 64 nt, Homo Sapiens; identical to SEQ ID NO: 39764

SEQ ID NO: 683699 - RNA, 64 nt, Homo Sapiens; identical to SEQ ID NO: 39765

SEQ ID NO: 683700 - RNA, 64 nt, Homo Sapiens; identical to SEQ ID NO: 39766

SEQ ID NO: 683701 - RNA, 64 nt, Homo Sapiens; identical to SEQ ID NO: 39767

SEQ ID NO: 683702 - RNA, 64 nt, Homo Sapiens; identical to SEQ ID NO: 39768

SEQ ID NO: 683703 - RNA, 64 nt, Homo Sapiens; identical to SEQ ID NO: 39769

SEQ ID NO: 683704 - RNA, 64 nt, Homo Sapiens; identical to SEQ ID NO: 39770

SEQ ID NO: 683705 - RNA, 64 nt, Homo Sapiens; identical to SEQ ID NO: 39771

SEQ ID NO: 683706 - RNA, 64 nt, Homo Sapiens; identical to SEQ ID NO: 39772

SEQ ID NO: 683707 - RNA, 64 nt, Homo Sapiens; identical to SEQ ID NO: 39773

SEQ ID NO: 683708 - RNA, 64 nt, Homo Sapiens; identical to SEQ ID NO: 39774

SEQ ID NO: 683709 - RNA, 64 nt, Homo Sapiens; identical to SEQ ID NO: 39775

SEQ ID NO: 683710 - RNA, 64 nt, Homo Sapiens; identical to SEQ ID NO: 39776

SEQ ID NO: 683711 - RNA, 64 nt, Homo Sapiens; identical to SEQ ID NO: 39777

SEQ ID NO: 683712 - RNA, 64 nt, Homo Sapiens; identical to SEQ ID NO: 39778

SEQ ID NO: 683713 - RNA, 64 nt, Homo Sapiens; identical to SEQ ID NO: 39779

SEQ ID NO: 683714 - RNA, 64 nt, Homo Sapiens; identical to SEQ ID NO: 39780

SEQ ID NO: 683715 - RNA, 64 nt, Homo Sapiens; identical to SEQ ID NO: 39781

SEQ ID NO: 683716 - RNA, 64 nt, Homo Sapiens; identical to SEQ ID NO: 39782

SEQ ID NO: 683717 - RNA, 64 nt, Homo Sapiens; identical to SEQ ID NO: 39783

SEQ ID NO: 683718 - RNA, 64 nt, Homo Sapiens; identical to SEQ ID NO: 39784

SEQ ID NO: 683719 - RNA, 64 nt, Homo Sapiens; identical to SEQ ID NO: 39785

SEQ ID NO: 683720 - RNA, 64 nt, Homo Sapiens; identical to SEQ ID NO: 39786

SEQ ID NO: 683721 - RNA, 64 nt, Homo Sapiens; identical to SEQ ID NO: 39787

SEQ ID NO: 683722 - RNA, 64 nt, Homo Sapiens; identical to SEQ ID NO: 39788

SEQ ID NO: 683723 - RNA, 64 nt, Homo Sapiens; identical to SEQ ID NO: 39789

SEQ ID NO: 683724 - RNA, 64 nt, Homo Sapiens; identical to SEQ ID NO: 39790

SEQ ID NO: 683725 - RNA, 64 nt, Homo Sapiens; identical to SEQ ID NO: 39791

SEQ ID NO: 683726 - RNA, 64 nt, Homo Sapiens; identical to SEQ ID NO: 39792

SEQ ID NO: 683727 - RNA, 64 nt, Homo Sapiens; identical to SEQ ID NO: 39793

SEQ ID NO: 683728 - RNA, 64 nt, Homo Sapiens; identical to SEQ ID NO: 39794

SEQ ID NO: 683729 - RNA, 64 nt, Homo Sapiens; identical to SEQ ID NO: 39795

SEQ ID NO: 683730 - RNA, 64 nt, Homo Sapiens; identical to SEQ ID NO: 39796

SEQ ID NO: 683731 - RNA, 64 nt, Homo Sapiens; identical to SEQ ID NO: 39797

SEQ ID NO: 683732 - RNA, 64 nt, Homo Sapiens; identical to SEQ ID NO: 39798

SEQ ID NO: 683733 - RNA, 64 nt, Homo Sapiens; identical to SEQ ID NO: 39799

SEQ ID NO: 683734 - RNA, 64 nt, Homo Sapiens; identical to SEQ ID NO: 39800

SEQ ID NO: 683735 - RNA, 64 nt, Homo Sapiens; identical to SEQ ID NO: 39801

SEQ ID NO: 683736 - RNA, 64 nt, Homo Sapiens; identical to SEQ ID NO: 39802

SEQ ID NO: 683737 - RNA, 64 nt, Homo Sapiens; identical to SEQ ID NO: 39803

SEQ ID NO: 683738 - RNA, 64 nt, Homo Sapiens; identical to SEQ ID NO: 39804

SEQ ID NO: 683739 - RNA, 64 nt, Homo Sapiens; identical to SEQ ID NO: 39805

SEQ ID NO: 683740 - RNA, 64 nt, Homo Sapiens; identical to SEQ ID NO: 39806

SEQ ID NO: 683741 - RNA, 64 nt, Homo Sapiens; identical to SEQ ID NO: 39807

SEQ ID NO: 683742 - RNA, 64 nt, Homo Sapiens; identical to SEQ ID NO: 39808

SEQ ID NO: 683743 - RNA, 64 nt, Homo Sapiens; identical to SEQ ID NO: 39809

SEQ ID NO: 683744 - RNA, 64 nt, Homo Sapiens; identical to SEQ ID NO: 39810

SEQ ID NO: 683745 - RNA, 64 nt, Homo Sapiens; identical to SEQ ID NO: 39811

SEQ ID NO: 683746 - RNA, 64 nt, Homo Sapiens; identical to SEQ ID NO: 39812

SEQ ID NO: 683747 - RNA, 64 nt, Homo Sapiens; identical to SEQ ID NO: 39813

SEQ ID NO: 683748 - RNA, 64 nt, Homo Sapiens; identical to SEQ ID NO: 39814

SEQ ID NO: 683749 - RNA, 64 nt, Homo Sapiens; identical to SEQ ID NO: 39815

SEQ ID NO: 683750 - RNA, 64 nt, Homo Sapiens; identical to SEQ ID NO: 39816

SEQ ID NO: 683751 - RNA, 64 nt, Homo Sapiens; identical to SEQ ID NO: 39817

SEQ ID NO: 683752 - RNA, 64 nt, Homo Sapiens; identical to SEQ ID NO: 39818

SEQ ID NO: 683753 - RNA, 64 nt, Homo Sapiens; identical to SEQ ID NO: 39819

SEQ ID NO: 683754 - RNA, 64 nt, Homo Sapiens; identical to SEQ ID NO: 39820

SEQ ID NO: 683755 - RNA, 64 nt, Homo Sapiens; identical to SEQ ID NO: 39821

SEQ ID NO: 683756 - RNA, 64 nt, Homo Sapiens; identical to SEQ ID NO: 39822

SEQ ID NO: 683757 - RNA, 64 nt, Homo Sapiens; identical to SEQ ID NO: 39823

SEQ ID NO: 683758 - RNA, 64 nt, Homo Sapiens; identical to SEQ ID NO: 39824

SEQ ID NO: 683759 - RNA, 64 nt, Homo Sapiens; identical to SEQ ID NO: 39825

SEQ ID NO: 683760 - RNA, 64 nt, Homo Sapiens; identical to SEQ ID NO: 39826

SEQ ID NO: 683761 - RNA, 64 nt, Homo Sapiens; identical to SEQ ID NO: 39827

SEQ ID NO: 683762 - RNA, 64 nt, Homo Sapiens; identical to SEQ ID NO: 39828

SEQ ID NO: 683763 - RNA, 64 nt, Homo Sapiens; identical to SEQ ID NO: 39829

SEQ ID NO: 683764 - RNA, 64 nt, Homo Sapiens; identical to SEQ ID NO: 39830

SEQ ID NO: 683765 - RNA, 64 nt, Homo Sapiens; identical to SEQ ID NO: 39831

SEQ ID NO: 683766 - RNA, 64 nt, Homo Sapiens; identical to SEQ ID NO: 39832

SEQ ID NO: 683767 - RNA, 64 nt, Homo Sapiens; identical to SEQ ID NO: 39833

SEQ ID NO: 683768 - RNA, 64 nt, Homo Sapiens; identical to SEQ ID NO: 39834

SEQ ID NO: 683769 - RNA, 64 nt, Homo Sapiens; identical to SEQ ID NO: 39835

SEQ ID NO: 683770 - RNA, 64 nt, Homo Sapiens; identical to SEQ ID NO: 39836

SEQ ID NO: 683771 - RNA, 64 nt, Homo Sapiens; identical to SEQ ID NO: 39837

SEQ ID NO: 683772 - RNA, 64 nt, Homo Sapiens; identical to SEQ ID NO: 39838

SEQ ID NO: 683773 - RNA, 64 nt, Homo Sapiens; identical to SEQ ID NO: 39839

SEQ ID NO: 683774 - RNA, 64 nt, Homo Sapiens; identical to SEQ ID NO: 39840

SEQ ID NO: 683775 - RNA, 64 nt, Homo Sapiens; identical to SEQ ID NO: 39841

SEQ ID NO: 683776 - RNA, 64 nt, Homo Sapiens; identical to SEQ ID NO: 39842

SEQ ID NO: 683777 - RNA, 64 nt, Homo Sapiens; identical to SEQ ID NO: 39843

SEQ ID NO: 683778 - RNA, 64 nt, Homo Sapiens; identical to SEQ ID NO: 39844

SEQ ID NO: 683779 - RNA, 64 nt, Homo Sapiens; identical to SEQ ID NO: 39845

SEQ ID NO: 683780 - RNA, 64 nt, Homo Sapiens; identical to SEQ ID NO: 39846

SEQ ID NO: 683781 - RNA, 64 nt, Homo Sapiens; identical to SEQ ID NO: 39847

SEQ ID NO: 683782 - RNA, 64 nt, Homo Sapiens; identical to SEQ ID NO: 39848

SEQ ID NO: 683783 - RNA, 64 nt, Homo Sapiens; identical to SEQ ID NO: 39849

SEQ ID NO: 683784 - RNA, 64 nt, Homo Sapiens; identical to SEQ ID NO: 39850

SEQ ID NO: 683785 - RNA, 64 nt, Homo Sapiens; identical to SEQ ID NO: 39851

SEQ ID NO: 683786 - RNA, 64 nt, Homo Sapiens; identical to SEQ ID NO: 39852

SEQ ID NO: 683787 - RNA, 64 nt, Homo Sapiens; identical to SEQ ID NO: 39853

SEQ ID NO: 683788 - RNA, 64 nt, Homo Sapiens; identical to SEQ ID NO: 39854

SEQ ID NO: 683789 - RNA, 64 nt, Homo Sapiens; identical to SEQ ID NO: 39855

SEQ ID NO: 683790 - RNA, 64 nt, Homo Sapiens; identical to SEQ ID NO: 39856

SEQ ID NO: 683791 - RNA, 64 nt, Homo Sapiens; identical to SEQ ID NO: 39857

SEQ ID NO: 683792 - RNA, 64 nt, Homo Sapiens; identical to SEQ ID NO: 39858

SEQ ID NO: 683793 - RNA, 64 nt, Homo Sapiens; identical to SEQ ID NO: 39859

SEQ ID NO: 683794 - RNA, 64 nt, Homo Sapiens; identical to SEQ ID NO: 39860

SEQ ID NO: 683795 - RNA, 64 nt, Homo Sapiens; identical to SEQ ID NO: 39861

SEQ ID NO: 683796 - RNA, 64 nt, Homo Sapiens; identical to SEQ ID NO: 39862

SEQ ID NO: 683797 - RNA, 64 nt, Homo Sapiens; identical to SEQ ID NO: 39863

SEQ ID NO: 683798 - RNA, 64 nt, Homo Sapiens; identical to SEQ ID NO: 39864

SEQ ID NO: 683799 - RNA, 64 nt, Homo Sapiens; identical to SEQ ID NO: 39865

SEQ ID NO: 683800 - RNA, 64 nt, Homo Sapiens; identical to SEQ ID NO: 39866

SEQ ID NO: 683801 - RNA, 64 nt, Homo Sapiens; identical to SEQ ID NO: 39867

SEQ ID NO: 683802 - RNA, 64 nt, Homo Sapiens; identical to SEQ ID NO: 39868

SEQ ID NO: 683803 - RNA, 64 nt, Homo Sapiens; identical to SEQ ID NO: 39869

SEQ ID NO: 683804 - RNA, 64 nt, Homo Sapiens; identical to SEQ ID NO: 39870

SEQ ID NO: 683805 - RNA, 64 nt, Homo Sapiens; identical to SEQ ID NO: 39871

SEQ ID NO: 683806 - RNA, 64 nt, Homo Sapiens; identical to SEQ ID NO: 39872

SEQ ID NO: 683807 - RNA, 64 nt, Homo Sapiens; identical to SEQ ID NO: 39873

SEQ ID NO: 683808 - RNA, 64 nt, Homo Sapiens; identical to SEQ ID NO: 39874

SEQ ID NO: 683809 - RNA, 64 nt, Homo Sapiens; identical to SEQ ID NO: 39875

SEQ ID NO: 683810 - RNA, 64 nt, Homo Sapiens; identical to SEQ ID NO: 39876

SEQ ID NO: 683811 - RNA, 64 nt, Homo Sapiens; identical to SEQ ID NO: 39877

SEQ ID NO: 683812 - RNA, 64 nt, Homo Sapiens; identical to SEQ ID NO: 39878

SEQ ID NO: 683813 - RNA, 64 nt, Homo Sapiens; identical to SEQ ID NO: 39879

SEQ ID NO: 683814 - RNA, 64 nt, Homo Sapiens; identical to SEQ ID NO: 39880

SEQ ID NO: 683815 - RNA, 64 nt, Homo Sapiens; identical to SEQ ID NO: 39881

SEQ ID NO: 683816 - RNA, 64 nt, Homo Sapiens; identical to SEQ ID NO: 39882

SEQ ID NO: 683817 - RNA, 64 nt, Homo Sapiens; identical to SEQ ID NO: 39883

SEQ ID NO: 683818 - RNA, 64 nt, Homo Sapiens; identical to SEQ ID NO: 39884

SEQ ID NO: 683819 - RNA, 64 nt, Homo Sapiens; identical to SEQ ID NO: 39885

SEQ ID NO: 683820 - RNA, 64 nt, Homo Sapiens; identical to SEQ ID NO: 39886

SEQ ID NO: 683821 - RNA, 64 nt, Homo Sapiens; identical to SEQ ID NO: 39887

SEQ ID NO: 683822 - RNA, 64 nt, Homo Sapiens; identical to SEQ ID NO: 39888

SEQ ID NO: 683823 - RNA, 64 nt, Homo Sapiens; identical to SEQ ID NO: 39889

SEQ ID NO: 683824 - RNA, 64 nt, Homo Sapiens; identical to SEQ ID NO: 39890

SEQ ID NO: 683825 - RNA, 64 nt, Homo Sapiens; identical to SEQ ID NO: 39891

SEQ ID NO: 683826 - RNA, 64 nt, Homo Sapiens; identical to SEQ ID NO: 39892

SEQ ID NO: 683827 - RNA, 64 nt, Homo Sapiens; identical to SEQ ID NO: 39893

SEQ ID NO: 683828 - RNA, 64 nt, Homo Sapiens; identical to SEQ ID NO: 39894

SEQ ID NO: 683829 - RNA, 64 nt, Homo Sapiens; identical to SEQ ID NO: 39895

SEQ ID NO: 683830 - RNA, 64 nt, Homo Sapiens; identical to SEQ ID NO: 39896

SEQ ID NO: 683831 - RNA, 64 nt, Homo Sapiens; identical to SEQ ID NO: 39897

SEQ ID NO: 683832 - RNA, 64 nt, Homo Sapiens; identical to SEQ ID NO: 39898

SEQ ID NO: 683833 - RNA, 64 nt, Homo Sapiens; identical to SEQ ID NO: 39899

SEQ ID NO: 683834 - RNA, 64 nt, Homo Sapiens; identical to SEQ ID NO: 39900

SEQ ID NO: 683835 - RNA, 64 nt, Homo Sapiens; identical to SEQ ID NO: 39901

SEQ ID NO: 683836 - RNA, 64 nt, Homo Sapiens; identical to SEQ ID NO: 39902

SEQ ID NO: 683837 - RNA, 64 nt, Homo Sapiens; identical to SEQ ID NO: 39903

SEQ ID NO: 683838 - RNA, 64 nt, Homo Sapiens; identical to SEQ ID NO: 39904

SEQ ID NO: 683839 - RNA, 64 nt, Homo Sapiens; identical to SEQ ID NO: 39905

SEQ ID NO: 683840 - RNA, 64 nt, Homo Sapiens; identical to SEQ ID NO: 39906

SEQ ID NO: 683841 - RNA, 64 nt, Homo Sapiens; identical to SEQ ID NO: 39907

SEQ ID NO: 683842 - RNA, 64 nt, Homo Sapiens; identical to SEQ ID NO: 39908

SEQ ID NO: 683843 - RNA, 64 nt, Homo Sapiens; identical to SEQ ID NO: 39909

SEQ ID NO: 683844 - RNA, 64 nt, Homo Sapiens; identical to SEQ ID NO: 39910

SEQ ID NO: 683845 - RNA, 64 nt, Homo Sapiens; identical to SEQ ID NO: 39911

SEQ ID NO: 683846 - RNA, 64 nt, Homo Sapiens; identical to SEQ ID NO: 39912

SEQ ID NO: 683847 - RNA, 64 nt, Homo Sapiens; identical to SEQ ID NO: 39913

SEQ ID NO: 683848 - RNA, 64 nt, Homo Sapiens; identical to SEQ ID NO: 39914

SEQ ID NO: 683849 - RNA, 64 nt, Homo Sapiens; identical to SEQ ID NO: 39915

SEQ ID NO: 683850 - RNA, 64 nt, Homo Sapiens; identical to SEQ ID NO: 39916

SEQ ID NO: 683851 - RNA, 64 nt, Homo Sapiens; identical to SEQ ID NO: 39917

SEQ ID NO: 683852 - RNA, 64 nt, Homo Sapiens; identical to SEQ ID NO: 39918

SEQ ID NO: 683853 - RNA, 64 nt, Homo Sapiens; identical to SEQ ID NO: 39919

SEQ ID NO: 683854 - RNA, 64 nt, Homo Sapiens; identical to SEQ ID NO: 39920

SEQ ID NO: 683855 - RNA, 64 nt, Homo Sapiens; identical to SEQ ID NO: 39921

SEQ ID NO: 683856 - RNA, 64 nt, Homo Sapiens; identical to SEQ ID NO: 39922

SEQ ID NO: 683857 - RNA, 64 nt, Homo Sapiens; identical to SEQ ID NO: 39923

SEQ ID NO: 683858 - RNA, 64 nt, Homo Sapiens; identical to SEQ ID NO: 39924

SEQ ID NO: 683859 - RNA, 64 nt, Homo Sapiens; identical to SEQ ID NO: 39925

SEQ ID NO: 683860 - RNA, 64 nt, Homo Sapiens; identical to SEQ ID NO: 39926

SEQ ID NO: 683861 - RNA, 64 nt, Homo Sapiens; identical to SEQ ID NO: 39927

SEQ ID NO: 683862 - RNA, 64 nt, Homo Sapiens; identical to SEQ ID NO: 39928

SEQ ID NO: 683863 - RNA, 64 nt, Homo Sapiens; identical to SEQ ID NO: 39929

SEQ ID NO: 683864 - RNA, 64 nt, Homo Sapiens; identical to SEQ ID NO: 39930

SEQ ID NO: 683865 - RNA, 64 nt, Homo Sapiens; identical to SEQ ID NO: 39931

SEQ ID NO: 683866 - RNA, 64 nt, Homo Sapiens; identical to SEQ ID NO: 39932

SEQ ID NO: 683867 - RNA, 64 nt, Homo Sapiens; identical to SEQ ID NO: 39933

SEQ ID NO: 683868 - RNA, 64 nt, Homo Sapiens; identical to SEQ ID NO: 39934

SEQ ID NO: 683869 - RNA, 64 nt, Homo Sapiens; identical to SEQ ID NO: 39935

SEQ ID NO: 683870 - RNA, 64 nt, Homo Sapiens; identical to SEQ ID NO: 39936

SEQ ID NO: 683871 - RNA, 64 nt, Homo Sapiens; identical to SEQ ID NO: 39937

SEQ ID NO: 683872 - RNA, 64 nt, Homo Sapiens; identical to SEQ ID NO: 39938

SEQ ID NO: 683873 - RNA, 64 nt, Homo Sapiens; identical to SEQ ID NO: 39939

SEQ ID NO: 683874 - RNA, 64 nt, Homo Sapiens; identical to SEQ ID NO: 39940

SEQ ID NO: 683875 - RNA, 64 nt, Homo Sapiens; identical to SEQ ID NO: 39941

SEQ ID NO: 683876 - RNA, 64 nt, Homo Sapiens; identical to SEQ ID NO: 39942

SEQ ID NO: 683877 - RNA, 64 nt, Homo Sapiens; identical to SEQ ID NO: 39943

SEQ ID NO: 683878 - RNA, 64 nt, Homo Sapiens; identical to SEQ ID NO: 39944

SEQ ID NO: 683879 - RNA, 64 nt, Homo Sapiens; identical to SEQ ID NO: 39945

SEQ ID NO: 683880 - RNA, 64 nt, Homo Sapiens; identical to SEQ ID NO: 39946

SEQ ID NO: 683881 - RNA, 64 nt, Homo Sapiens; identical to SEQ ID NO: 39947

SEQ ID NO: 683882 - RNA, 64 nt, Homo Sapiens; identical to SEQ ID NO: 39948

SEQ ID NO: 683883 - RNA, 64 nt, Homo Sapiens; identical to SEQ ID NO: 39949

SEQ ID NO: 683884 - RNA, 64 nt, Homo Sapiens; identical to SEQ ID NO: 39950

SEQ ID NO: 683885 - RNA, 64 nt, Homo Sapiens; identical to SEQ ID NO: 39951

SEQ ID NO: 683886 - RNA, 64 nt, Homo Sapiens; identical to SEQ ID NO: 39952

SEQ ID NO: 683887 - RNA, 64 nt, Homo Sapiens; identical to SEQ ID NO: 39953

SEQ ID NO: 683888 - RNA, 64 nt, Homo Sapiens; identical to SEQ ID NO: 39954

SEQ ID NO: 683889 - RNA, 64 nt, Homo Sapiens; identical to SEQ ID NO: 39955

SEQ ID NO: 683890 - RNA, 64 nt, Homo Sapiens; identical to SEQ ID NO: 39956

SEQ ID NO: 683891 - RNA, 64 nt, Homo Sapiens; identical to SEQ ID NO: 39957

SEQ ID NO: 683892 - RNA, 64 nt, Homo Sapiens; identical to SEQ ID NO: 39958

SEQ ID NO: 683893 - RNA, 64 nt, Homo Sapiens; identical to SEQ ID NO: 39959

SEQ ID NO: 683894 - RNA, 64 nt, Homo Sapiens; identical to SEQ ID NO: 39960

SEQ ID NO: 683895 - RNA, 64 nt, Homo Sapiens; identical to SEQ ID NO: 39961

SEQ ID NO: 683896 - RNA, 64 nt, Homo Sapiens; identical to SEQ ID NO: 39962

SEQ ID NO: 683897 - RNA, 64 nt, Homo Sapiens; identical to SEQ ID NO: 39963

SEQ ID NO: 683898 - RNA, 64 nt, Homo Sapiens; identical to SEQ ID NO: 39964

SEQ ID NO: 683899 - RNA, 64 nt, Homo Sapiens; identical to SEQ ID NO: 39965

SEQ ID NO: 683900 - RNA, 64 nt, Homo Sapiens; identical to SEQ ID NO: 39966

SEQ ID NO: 683901 - RNA, 64 nt, Homo Sapiens; identical to SEQ ID NO: 39967

SEQ ID NO: 683902 - RNA, 64 nt, Homo Sapiens; identical to SEQ ID NO: 39968

SEQ ID NO: 683903 - RNA, 64 nt, Homo Sapiens; identical to SEQ ID NO: 39969

SEQ ID NO: 683904 - RNA, 64 nt, Homo Sapiens; identical to SEQ ID NO: 39970

SEQ ID NO: 683905 - RNA, 64 nt, Homo Sapiens; identical to SEQ ID NO: 39971

SEQ ID NO: 683906 - RNA, 64 nt, Homo Sapiens; identical to SEQ ID NO: 39972

SEQ ID NO: 683907 - RNA, 64 nt, Homo Sapiens; identical to SEQ ID NO: 39973

SEQ ID NO: 683908 - RNA, 64 nt, Homo Sapiens; identical to SEQ ID NO: 39974

SEQ ID NO: 683909 - RNA, 64 nt, Homo Sapiens; identical to SEQ ID NO: 39975

SEQ ID NO: 683910 - RNA, 64 nt, Homo Sapiens; identical to SEQ ID NO: 39976

SEQ ID NO: 683911 - RNA, 64 nt, Homo Sapiens; identical to SEQ ID NO: 39977

SEQ ID NO: 683912 - RNA, 64 nt, Homo Sapiens; identical to SEQ ID NO: 39978

SEQ ID NO: 683913 - RNA, 64 nt, Homo Sapiens; identical to SEQ ID NO: 39979

SEQ ID NO: 683914 - RNA, 64 nt, Homo Sapiens; identical to SEQ ID NO: 39980

SEQ ID NO: 683915 - RNA, 64 nt, Homo Sapiens; identical to SEQ ID NO: 39981

SEQ ID NO: 683916 - RNA, 64 nt, Homo Sapiens; identical to SEQ ID NO: 39982

SEQ ID NO: 683917 - RNA, 64 nt, Homo Sapiens; identical to SEQ ID NO: 39983

SEQ ID NO: 683918 - RNA, 64 nt, Homo Sapiens; identical to SEQ ID NO: 39984

SEQ ID NO: 683919 - RNA, 64 nt, Homo Sapiens; identical to SEQ ID NO: 39985

SEQ ID NO: 683920 - RNA, 64 nt, Homo Sapiens; identical to SEQ ID NO: 39986

SEQ ID NO: 683921 - RNA, 64 nt, Homo Sapiens; identical to SEQ ID NO: 39987

SEQ ID NO: 683922 - RNA, 64 nt, Homo Sapiens; identical to SEQ ID NO: 39988

SEQ ID NO: 683923 - RNA, 64 nt, Homo Sapiens; identical to SEQ ID NO: 39989

SEQ ID NO: 683924 - RNA, 64 nt, Homo Sapiens; identical to SEQ ID NO: 39990

SEQ ID NO: 683925 - RNA, 64 nt, Homo Sapiens; identical to SEQ ID NO: 39991

SEQ ID NO: 683926 - RNA, 64 nt, Homo Sapiens; identical to SEQ ID NO: 39992

SEQ ID NO: 683927 - RNA, 64 nt, Homo Sapiens; identical to SEQ ID NO: 39993

SEQ ID NO: 683928 - RNA, 64 nt, Homo Sapiens; identical to SEQ ID NO: 39994

SEQ ID NO: 683929 - RNA, 64 nt, Homo Sapiens; identical to SEQ ID NO: 39995

SEQ ID NO: 683930 - RNA, 64 nt, Homo Sapiens; identical to SEQ ID NO: 39996

SEQ ID NO: 683931 - RNA, 64 nt, Homo Sapiens; identical to SEQ ID NO: 39997

SEQ ID NO: 683932 - RNA, 64 nt, Homo Sapiens; identical to SEQ ID NO: 39998

SEQ ID NO: 683933 - RNA, 64 nt, Homo Sapiens; identical to SEQ ID NO: 39999

SEQ ID NO: 683934 - RNA, 64 nt, Homo Sapiens; identical to SEQ ID NO: 40000

SEQ ID NO: 683935 - RNA, 64 nt, Homo Sapiens; identical to SEQ ID NO: 40001

SEQ ID NO: 683936 - RNA, 64 nt, Homo Sapiens; identical to SEQ ID NO: 40002

SEQ ID NO: 683937 - RNA, 64 nt, Homo Sapiens; identical to SEQ ID NO: 40003

SEQ ID NO: 683938 - RNA, 64 nt, Homo Sapiens; identical to SEQ ID NO: 40004

SEQ ID NO: 683939 - RNA, 64 nt, Homo Sapiens; identical to SEQ ID NO: 40005

SEQ ID NO: 683940 - RNA, 64 nt, Homo Sapiens; identical to SEQ ID NO: 40006

SEQ ID NO: 683941 - RNA, 64 nt, Homo Sapiens; identical to SEQ ID NO: 40007

SEQ ID NO: 683942 - RNA, 64 nt, Homo Sapiens; identical to SEQ ID NO: 40008

SEQ ID NO: 683943 - RNA, 64 nt, Homo Sapiens; identical to SEQ ID NO: 40009

SEQ ID NO: 683944 - RNA, 64 nt, Homo Sapiens; identical to SEQ ID NO: 40010

SEQ ID NO: 683945 - RNA, 64 nt, Homo Sapiens; identical to SEQ ID NO: 40011

SEQ ID NO: 683946 - RNA, 64 nt, Homo Sapiens; identical to SEQ ID NO: 40012

SEQ ID NO: 683947 - RNA, 64 nt, Homo Sapiens; identical to SEQ ID NO: 40013

SEQ ID NO: 683948 - RNA, 64 nt, Homo Sapiens; identical to SEQ ID NO: 40014

SEQ ID NO: 683949 - RNA, 64 nt, Homo Sapiens; identical to SEQ ID NO: 40015

SEQ ID NO: 683950 - RNA, 64 nt, Homo Sapiens; identical to SEQ ID NO: 40016

SEQ ID NO: 683951 - RNA, 64 nt, Homo Sapiens; identical to SEQ ID NO: 40017

SEQ ID NO: 683952 - RNA, 64 nt, Homo Sapiens; identical to SEQ ID NO: 40018

SEQ ID NO: 683953 - RNA, 64 nt, Homo Sapiens; identical to SEQ ID NO: 40019

SEQ ID NO: 683954 - RNA, 64 nt, Homo Sapiens; identical to SEQ ID NO: 40020

SEQ ID NO: 683955 - RNA, 64 nt, Homo Sapiens; identical to SEQ ID NO: 40021

SEQ ID NO: 683956 - RNA, 64 nt, Homo Sapiens; identical to SEQ ID NO: 40022

SEQ ID NO: 683957 - RNA, 64 nt, Homo Sapiens; identical to SEQ ID NO: 40023

SEQ ID NO: 683958 - RNA, 64 nt, Homo Sapiens; identical to SEQ ID NO: 40024

SEQ ID NO: 683959 - RNA, 64 nt, Homo Sapiens; identical to SEQ ID NO: 40025

SEQ ID NO: 683960 - RNA, 64 nt, Homo Sapiens; identical to SEQ ID NO: 40026

SEQ ID NO: 683961 - RNA, 64 nt, Homo Sapiens; identical to SEQ ID NO: 40027

SEQ ID NO: 683962 - RNA, 64 nt, Homo Sapiens; identical to SEQ ID NO: 40028

SEQ ID NO: 683963 - RNA, 64 nt, Homo Sapiens; identical to SEQ ID NO: 40029

SEQ ID NO: 683964 - RNA, 64 nt, Homo Sapiens; identical to SEQ ID NO: 40030

SEQ ID NO: 683965 - RNA, 64 nt, Homo Sapiens; identical to SEQ ID NO: 40031

SEQ ID NO: 683966 - RNA, 64 nt, Homo Sapiens; identical to SEQ ID NO: 40032

SEQ ID NO: 683967 - RNA, 64 nt, Homo Sapiens; identical to SEQ ID NO: 40033

SEQ ID NO: 683968 - RNA, 64 nt, Homo Sapiens; identical to SEQ ID NO: 40034

SEQ ID NO: 683969 - RNA, 64 nt, Homo Sapiens; identical to SEQ ID NO: 40035

SEQ ID NO: 683970 - RNA, 64 nt, Homo Sapiens; identical to SEQ ID NO: 40036

SEQ ID NO: 683971 - RNA, 64 nt, Homo Sapiens; identical to SEQ ID NO: 40037

SEQ ID NO: 683972 - RNA, 64 nt, Homo Sapiens; identical to SEQ ID NO: 40038

SEQ ID NO: 683973 - RNA, 64 nt, Homo Sapiens; identical to SEQ ID NO: 40039

SEQ ID NO: 683974 - RNA, 64 nt, Homo Sapiens; identical to SEQ ID NO: 40040

SEQ ID NO: 683975 - RNA, 64 nt, Homo Sapiens; identical to SEQ ID NO: 40041

SEQ ID NO: 683976 - RNA, 64 nt, Homo Sapiens; identical to SEQ ID NO: 40042

SEQ ID NO: 683977 - RNA, 64 nt, Homo Sapiens; identical to SEQ ID NO: 40043

SEQ ID NO: 683978 - RNA, 64 nt, Homo Sapiens; identical to SEQ ID NO: 40044

SEQ ID NO: 683979 - RNA, 64 nt, Homo Sapiens; identical to SEQ ID NO: 40045

SEQ ID NO: 683980 - RNA, 64 nt, Homo Sapiens; identical to SEQ ID NO: 40046

SEQ ID NO: 683981 - RNA, 64 nt, Homo Sapiens; identical to SEQ ID NO: 40047

SEQ ID NO: 683982 - RNA, 64 nt, Homo Sapiens; identical to SEQ ID NO: 40048

SEQ ID NO: 683983 - RNA, 64 nt, Homo Sapiens; identical to SEQ ID NO: 40049

SEQ ID NO: 683984 - RNA, 64 nt, Homo Sapiens; identical to SEQ ID NO: 40050

SEQ ID NO: 683985 - RNA, 64 nt, Homo Sapiens; identical to SEQ ID NO: 40051

SEQ ID NO: 683986 - RNA, 64 nt, Homo Sapiens; identical to SEQ ID NO: 40052

SEQ ID NO: 683987 - RNA, 64 nt, Homo Sapiens; identical to SEQ ID NO: 40053

SEQ ID NO: 683988 - RNA, 64 nt, Homo Sapiens; identical to SEQ ID NO: 40054

SEQ ID NO: 683989 - RNA, 64 nt, Homo Sapiens; identical to SEQ ID NO: 40055

SEQ ID NO: 683990 - RNA, 64 nt, Homo Sapiens; identical to SEQ ID NO: 40056

SEQ ID NO: 683991 - RNA, 64 nt, Homo Sapiens; identical to SEQ ID NO: 40057

SEQ ID NO: 683992 - RNA, 64 nt, Homo Sapiens; identical to SEQ ID NO: 40058

SEQ ID NO: 683993 - RNA, 64 nt, Homo Sapiens; identical to SEQ ID NO: 40059

SEQ ID NO: 683994 - RNA, 64 nt, Homo Sapiens; identical to SEQ ID NO: 40060

SEQ ID NO: 683995 - RNA, 64 nt, Homo Sapiens; identical to SEQ ID NO: 40061

SEQ ID NO: 683996 - RNA, 64 nt, Homo Sapiens; identical to SEQ ID NO: 40062

SEQ ID NO: 683997 - RNA, 64 nt, Homo Sapiens; identical to SEQ ID NO: 40063

SEQ ID NO: 683998 - RNA, 64 nt, Homo Sapiens; identical to SEQ ID NO: 40064

SEQ ID NO: 683999 - RNA, 64 nt, Homo Sapiens; identical to SEQ ID NO: 40065

SEQ ID NO: 684000 - RNA, 64 nt, Homo Sapiens; identical to SEQ ID NO: 40066

SEQ ID NO: 684001 - RNA, 64 nt, Homo Sapiens; identical to SEQ ID NO: 40067

SEQ ID NO: 684002 - RNA, 64 nt, Homo Sapiens; identical to SEQ ID NO: 40068

SEQ ID NO: 684003 - RNA, 64 nt, Homo Sapiens; identical to SEQ ID NO: 40069

SEQ ID NO: 684004 - RNA, 64 nt, Homo Sapiens; identical to SEQ ID NO: 40070

SEQ ID NO: 684005 - RNA, 64 nt, Homo Sapiens; identical to SEQ ID NO: 40071

SEQ ID NO: 684006 - RNA, 64 nt, Homo Sapiens; identical to SEQ ID NO: 40072

SEQ ID NO: 684007 - RNA, 64 nt, Homo Sapiens; identical to SEQ ID NO: 40073

SEQ ID NO: 684008 - RNA, 64 nt, Homo Sapiens; identical to SEQ ID NO: 40074

SEQ ID NO: 684009 - RNA, 64 nt, Homo Sapiens; identical to SEQ ID NO: 40075

SEQ ID NO: 684010 - RNA, 64 nt, Homo Sapiens; identical to SEQ ID NO: 40076

SEQ ID NO: 684011 - RNA, 64 nt, Homo Sapiens; identical to SEQ ID NO: 40077

SEQ ID NO: 684012 - RNA, 64 nt, Homo Sapiens; identical to SEQ ID NO: 40078

SEQ ID NO: 684013 - RNA, 64 nt, Homo Sapiens; identical to SEQ ID NO: 40079

SEQ ID NO: 684014 - RNA, 64 nt, Homo Sapiens; identical to SEQ ID NO: 40080

SEQ ID NO: 684015 - RNA, 64 nt, Homo Sapiens; identical to SEQ ID NO: 40081

SEQ ID NO: 684016 - RNA, 64 nt, Homo Sapiens; identical to SEQ ID NO: 40082

SEQ ID NO: 684017 - RNA, 64 nt, Homo Sapiens; identical to SEQ ID NO: 40083

SEQ ID NO: 684018 - RNA, 64 nt, Homo Sapiens; identical to SEQ ID NO: 40084

SEQ ID NO: 684019 - RNA, 64 nt, Homo Sapiens; identical to SEQ ID NO: 40085

SEQ ID NO: 684020 - RNA, 64 nt, Homo Sapiens; identical to SEQ ID NO: 40086

SEQ ID NO: 684021 - RNA, 64 nt, Homo Sapiens; identical to SEQ ID NO: 40087

SEQ ID NO: 684022 - RNA, 64 nt, Homo Sapiens; identical to SEQ ID NO: 40088

SEQ ID NO: 684023 - RNA, 64 nt, Homo Sapiens; identical to SEQ ID NO: 40089

SEQ ID NO: 684024 - RNA, 64 nt, Homo Sapiens; identical to SEQ ID NO: 40090

SEQ ID NO: 684025 - RNA, 64 nt, Homo Sapiens; identical to SEQ ID NO: 40091

SEQ ID NO: 684026 - RNA, 64 nt, Homo Sapiens; identical to SEQ ID NO: 40092

SEQ ID NO: 684027 - RNA, 64 nt, Homo Sapiens; identical to SEQ ID NO: 40093

SEQ ID NO: 684028 - RNA, 64 nt, Homo Sapiens; identical to SEQ ID NO: 40094

SEQ ID NO: 684029 - RNA, 64 nt, Homo Sapiens; identical to SEQ ID NO: 40095

SEQ ID NO: 684030 - RNA, 64 nt, Homo Sapiens; identical to SEQ ID NO: 40096

SEQ ID NO: 684031 - RNA, 64 nt, Homo Sapiens; identical to SEQ ID NO: 40097

SEQ ID NO: 684032 - RNA, 64 nt, Homo Sapiens; identical to SEQ ID NO: 40098

SEQ ID NO: 684033 - RNA, 64 nt, Homo Sapiens; identical to SEQ ID NO: 40099

SEQ ID NO: 684034 - RNA, 64 nt, Homo Sapiens; identical to SEQ ID NO: 40100

SEQ ID NO: 684035 - RNA, 64 nt, Homo Sapiens; identical to SEQ ID NO: 40101

SEQ ID NO: 684036 - RNA, 64 nt, Homo Sapiens; identical to SEQ ID NO: 40102

SEQ ID NO: 684037 - RNA, 64 nt, Homo Sapiens; identical to SEQ ID NO: 40103

SEQ ID NO: 684038 - RNA, 64 nt, Homo Sapiens; identical to SEQ ID NO: 40104

SEQ ID NO: 684039 - RNA, 64 nt, Homo Sapiens; identical to SEQ ID NO: 40105

SEQ ID NO: 684040 - RNA, 64 nt, Homo Sapiens; identical to SEQ ID NO: 40106

SEQ ID NO: 684041 - RNA, 64 nt, Homo Sapiens; identical to SEQ ID NO: 40107

SEQ ID NO: 684042 - RNA, 64 nt, Homo Sapiens; identical to SEQ ID NO: 40108

SEQ ID NO: 684043 - RNA, 64 nt, Homo Sapiens; identical to SEQ ID NO: 40109

SEQ ID NO: 684044 - RNA, 64 nt, Homo Sapiens; identical to SEQ ID NO: 40110

SEQ ID NO: 684045 - RNA, 64 nt, Homo Sapiens; identical to SEQ ID NO: 40111

SEQ ID NO: 684046 - RNA, 64 nt, Homo Sapiens; identical to SEQ ID NO: 40112

SEQ ID NO: 684047 - RNA, 64 nt, Homo Sapiens; identical to SEQ ID NO: 40113

SEQ ID NO: 684048 - RNA, 64 nt, Homo Sapiens; identical to SEQ ID NO: 40114

SEQ ID NO: 684049 - RNA, 64 nt, Homo Sapiens; identical to SEQ ID NO: 40115

SEQ ID NO: 684050 - RNA, 64 nt, Homo Sapiens; identical to SEQ ID NO: 40116

SEQ ID NO: 684051 - RNA, 64 nt, Homo Sapiens; identical to SEQ ID NO: 40117

SEQ ID NO: 684052 - RNA, 64 nt, Homo Sapiens; identical to SEQ ID NO: 40118

SEQ ID NO: 684053 - RNA, 64 nt, Homo Sapiens; identical to SEQ ID NO: 40119

SEQ ID NO: 684054 - RNA, 64 nt, Homo Sapiens; identical to SEQ ID NO: 40120

SEQ ID NO: 684055 - RNA, 64 nt, Homo Sapiens; identical to SEQ ID NO: 40121

SEQ ID NO: 684056 - RNA, 64 nt, Homo Sapiens; identical to SEQ ID NO: 40122

SEQ ID NO: 684057 - RNA, 64 nt, Homo Sapiens; identical to SEQ ID NO: 40123

SEQ ID NO: 684058 - RNA, 64 nt, Homo Sapiens; identical to SEQ ID NO: 40124

SEQ ID NO: 684059 - RNA, 64 nt, Homo Sapiens; identical to SEQ ID NO: 40125

SEQ ID NO: 684060 - RNA, 64 nt, Homo Sapiens; identical to SEQ ID NO: 40126

SEQ ID NO: 684061 - RNA, 64 nt, Homo Sapiens; identical to SEQ ID NO: 40127

SEQ ID NO: 684062 - RNA, 64 nt, Homo Sapiens; identical to SEQ ID NO: 40128

SEQ ID NO: 684063 - RNA, 64 nt, Homo Sapiens; identical to SEQ ID NO: 40129

SEQ ID NO: 684064 - RNA, 64 nt, Homo Sapiens; identical to SEQ ID NO: 40130

SEQ ID NO: 684065 - RNA, 64 nt, Homo Sapiens; identical to SEQ ID NO: 40131

SEQ ID NO: 684066 - RNA, 64 nt, Homo Sapiens; identical to SEQ ID NO: 40132

SEQ ID NO: 684067 - RNA, 64 nt, Homo Sapiens; identical to SEQ ID NO: 40133

SEQ ID NO: 684068 - RNA, 64 nt, Homo Sapiens; identical to SEQ ID NO: 40134

SEQ ID NO: 684069 - RNA, 64 nt, Homo Sapiens; identical to SEQ ID NO: 40135

SEQ ID NO: 684070 - RNA, 64 nt, Homo Sapiens; identical to SEQ ID NO: 40136

SEQ ID NO: 684071 - RNA, 64 nt, Homo Sapiens; identical to SEQ ID NO: 40137

SEQ ID NO: 684072 - RNA, 64 nt, Homo Sapiens; identical to SEQ ID NO: 40138

SEQ ID NO: 684073 - RNA, 64 nt, Homo Sapiens; identical to SEQ ID NO: 40139

SEQ ID NO: 684074 - RNA, 64 nt, Homo Sapiens; identical to SEQ ID NO: 40140

SEQ ID NO: 684075 - RNA, 64 nt, Homo Sapiens; identical to SEQ ID NO: 40141

SEQ ID NO: 684076 - RNA, 64 nt, Homo Sapiens; identical to SEQ ID NO: 40142

SEQ ID NO: 684077 - RNA, 64 nt, Homo Sapiens; identical to SEQ ID NO: 40143

SEQ ID NO: 684078 - RNA, 64 nt, Homo Sapiens; identical to SEQ ID NO: 40144

SEQ ID NO: 684079 - RNA, 64 nt, Homo Sapiens; identical to SEQ ID NO: 40145

SEQ ID NO: 684080 - RNA, 64 nt, Homo Sapiens; identical to SEQ ID NO: 40146

SEQ ID NO: 684081 - RNA, 64 nt, Homo Sapiens; identical to SEQ ID NO: 40147

SEQ ID NO: 684082 - RNA, 64 nt, Homo Sapiens; identical to SEQ ID NO: 40148

SEQ ID NO: 684083 - RNA, 64 nt, Homo Sapiens; identical to SEQ ID NO: 40149

SEQ ID NO: 684084 - RNA, 64 nt, Homo Sapiens; identical to SEQ ID NO: 40150

SEQ ID NO: 684085 - RNA, 64 nt, Homo Sapiens; identical to SEQ ID NO: 40151

SEQ ID NO: 684086 - RNA, 64 nt, Homo Sapiens; identical to SEQ ID NO: 40152

SEQ ID NO: 684087 - RNA, 64 nt, Homo Sapiens; identical to SEQ ID NO: 40153

SEQ ID NO: 684088 - RNA, 64 nt, Homo Sapiens; identical to SEQ ID NO: 40154

SEQ ID NO: 684089 - RNA, 64 nt, Homo Sapiens; identical to SEQ ID NO: 40155

SEQ ID NO: 684090 - RNA, 64 nt, Homo Sapiens; identical to SEQ ID NO: 40156

SEQ ID NO: 684091 - RNA, 64 nt, Homo Sapiens; identical to SEQ ID NO: 40157

SEQ ID NO: 684092 - RNA, 64 nt, Homo Sapiens; identical to SEQ ID NO: 40158

SEQ ID NO: 684093 - RNA, 64 nt, Homo Sapiens; identical to SEQ ID NO: 40159

SEQ ID NO: 684094 - RNA, 64 nt, Homo Sapiens; identical to SEQ ID NO: 40160

SEQ ID NO: 684095 - RNA, 64 nt, Homo Sapiens; identical to SEQ ID NO: 40161

SEQ ID NO: 684096 - RNA, 64 nt, Homo Sapiens; identical to SEQ ID NO: 40162

SEQ ID NO: 684097 - RNA, 64 nt, Homo Sapiens; identical to SEQ ID NO: 40163

SEQ ID NO: 684098 - RNA, 64 nt, Homo Sapiens; identical to SEQ ID NO: 40164

SEQ ID NO: 684099 - RNA, 64 nt, Homo Sapiens; identical to SEQ ID NO: 40165

SEQ ID NO: 684100 - RNA, 64 nt, Homo Sapiens; identical to SEQ ID NO: 40166

SEQ ID NO: 684101 - RNA, 64 nt, Homo Sapiens; identical to SEQ ID NO: 40167

SEQ ID NO: 684102 - RNA, 64 nt, Homo Sapiens; identical to SEQ ID NO: 40168

SEQ ID NO: 684103 - RNA, 64 nt, Homo Sapiens; identical to SEQ ID NO: 40169

SEQ ID NO: 684104 - RNA, 64 nt, Homo Sapiens; identical to SEQ ID NO: 40170

SEQ ID NO: 684105 - RNA, 64 nt, Homo Sapiens; identical to SEQ ID NO: 40171

SEQ ID NO: 684106 - RNA, 64 nt, Homo Sapiens; identical to SEQ ID NO: 40172

SEQ ID NO: 684107 - RNA, 64 nt, Homo Sapiens; identical to SEQ ID NO: 40173

SEQ ID NO: 684108 - RNA, 64 nt, Homo Sapiens; identical to SEQ ID NO: 40174

SEQ ID NO: 684109 - RNA, 64 nt, Homo Sapiens; identical to SEQ ID NO: 40175

SEQ ID NO: 684110 - RNA, 64 nt, Homo Sapiens; identical to SEQ ID NO: 40176

SEQ ID NO: 684111 - RNA, 64 nt, Homo Sapiens; identical to SEQ ID NO: 40177

SEQ ID NO: 684112 - RNA, 64 nt, Homo Sapiens; identical to SEQ ID NO: 40178

SEQ ID NO: 684113 - RNA, 64 nt, Homo Sapiens; identical to SEQ ID NO: 40179

SEQ ID NO: 684114 - RNA, 64 nt, Homo Sapiens; identical to SEQ ID NO: 40180

SEQ ID NO: 684115 - RNA, 64 nt, Homo Sapiens; identical to SEQ ID NO: 40181

SEQ ID NO: 684116 - RNA, 64 nt, Homo Sapiens; identical to SEQ ID NO: 40182

SEQ ID NO: 684117 - RNA, 64 nt, Homo Sapiens; identical to SEQ ID NO: 40183

SEQ ID NO: 684118 - RNA, 64 nt, Homo Sapiens; identical to SEQ ID NO: 40184

SEQ ID NO: 684119 - RNA, 64 nt, Homo Sapiens; identical to SEQ ID NO: 40185

SEQ ID NO: 684120 - RNA, 64 nt, Homo Sapiens; identical to SEQ ID NO: 40186

SEQ ID NO: 684121 - RNA, 64 nt, Homo Sapiens; identical to SEQ ID NO: 40187

SEQ ID NO: 684122 - RNA, 64 nt, Homo Sapiens; identical to SEQ ID NO: 40188

SEQ ID NO: 684123 - RNA, 64 nt, Homo Sapiens; identical to SEQ ID NO: 40189

SEQ ID NO: 684124 - RNA, 64 nt, Homo Sapiens; identical to SEQ ID NO: 40190

SEQ ID NO: 684125 - RNA, 64 nt, Homo Sapiens; identical to SEQ ID NO: 40191

SEQ ID NO: 684126 - RNA, 64 nt, Homo Sapiens; identical to SEQ ID NO: 40192

SEQ ID NO: 684127 - RNA, 64 nt, Homo Sapiens; identical to SEQ ID NO: 40193

SEQ ID NO: 684128 - RNA, 64 nt, Homo Sapiens; identical to SEQ ID NO: 40194

SEQ ID NO: 684129 - RNA, 64 nt, Homo Sapiens; identical to SEQ ID NO: 40195

SEQ ID NO: 684130 - RNA, 64 nt, Homo Sapiens; identical to SEQ ID NO: 40196

SEQ ID NO: 684131 - RNA, 64 nt, Homo Sapiens; identical to SEQ ID NO: 40197

SEQ ID NO: 684132 - RNA, 64 nt, Homo Sapiens; identical to SEQ ID NO: 40198

SEQ ID NO: 684133 - RNA, 64 nt, Homo Sapiens; identical to SEQ ID NO: 40199

SEQ ID NO: 684134 - RNA, 64 nt, Homo Sapiens; identical to SEQ ID NO: 40200

SEQ ID NO: 684135 - RNA, 64 nt, Homo Sapiens; identical to SEQ ID NO: 40201

SEQ ID NO: 684136 - RNA, 64 nt, Homo Sapiens; identical to SEQ ID NO: 40202

SEQ ID NO: 684137 - RNA, 64 nt, Homo Sapiens; identical to SEQ ID NO: 40203

SEQ ID NO: 684138 - RNA, 64 nt, Homo Sapiens; identical to SEQ ID NO: 40204

SEQ ID NO: 684139 - RNA, 64 nt, Homo Sapiens; identical to SEQ ID NO: 40205

SEQ ID NO: 684140 - RNA, 64 nt, Homo Sapiens; identical to SEQ ID NO: 40206

SEQ ID NO: 684141 - RNA, 64 nt, Homo Sapiens; identical to SEQ ID NO: 40207

SEQ ID NO: 684142 - RNA, 64 nt, Homo Sapiens; identical to SEQ ID NO: 40208

SEQ ID NO: 684143 - RNA, 64 nt, Homo Sapiens; identical to SEQ ID NO: 40209

SEQ ID NO: 684144 - RNA, 64 nt, Homo Sapiens; identical to SEQ ID NO: 40210

SEQ ID NO: 684145 - RNA, 64 nt, Homo Sapiens; identical to SEQ ID NO: 40211

SEQ ID NO: 684146 - RNA, 64 nt, Homo Sapiens; identical to SEQ ID NO: 40212

SEQ ID NO: 684147 - RNA, 64 nt, Homo Sapiens; identical to SEQ ID NO: 40213

SEQ ID NO: 684148 - RNA, 64 nt, Homo Sapiens; identical to SEQ ID NO: 40214

SEQ ID NO: 684149 - RNA, 64 nt, Homo Sapiens; identical to SEQ ID NO: 40215

SEQ ID NO: 684150 - RNA, 64 nt, Homo Sapiens; identical to SEQ ID NO: 40216

SEQ ID NO: 684151 - RNA, 64 nt, Homo Sapiens; identical to SEQ ID NO: 40217

SEQ ID NO: 684152 - RNA, 64 nt, Homo Sapiens; identical to SEQ ID NO: 40218

SEQ ID NO: 684153 - RNA, 64 nt, Homo Sapiens; identical to SEQ ID NO: 40219

SEQ ID NO: 684154 - RNA, 64 nt, Homo Sapiens; identical to SEQ ID NO: 40220

SEQ ID NO: 684155 - RNA, 64 nt, Homo Sapiens; identical to SEQ ID NO: 40221

SEQ ID NO: 684156 - RNA, 64 nt, Homo Sapiens; identical to SEQ ID NO: 40222

SEQ ID NO: 684157 - RNA, 64 nt, Homo Sapiens; identical to SEQ ID NO: 40223

SEQ ID NO: 684158 - RNA, 64 nt, Homo Sapiens; identical to SEQ ID NO: 40224

SEQ ID NO: 684159 - RNA, 64 nt, Homo Sapiens; identical to SEQ ID NO: 40225

SEQ ID NO: 684160 - RNA, 64 nt, Homo Sapiens; identical to SEQ ID NO: 40226

SEQ ID NO: 684161 - RNA, 64 nt, Homo Sapiens; identical to SEQ ID NO: 40227

SEQ ID NO: 684162 - RNA, 64 nt, Homo Sapiens; identical to SEQ ID NO: 40228

SEQ ID NO: 684163 - RNA, 64 nt, Homo Sapiens; identical to SEQ ID NO: 40229

SEQ ID NO: 684164 - RNA, 64 nt, Homo Sapiens; identical to SEQ ID NO: 40230

SEQ ID NO: 684165 - RNA, 64 nt, Homo Sapiens; identical to SEQ ID NO: 40231

SEQ ID NO: 684166 - RNA, 64 nt, Homo Sapiens; identical to SEQ ID NO: 40232

SEQ ID NO: 684167 - RNA, 64 nt, Homo Sapiens; identical to SEQ ID NO: 40233

SEQ ID NO: 684168 - RNA, 64 nt, Homo Sapiens; identical to SEQ ID NO: 40234

SEQ ID NO: 684169 - RNA, 64 nt, Homo Sapiens; identical to SEQ ID NO: 40235

SEQ ID NO: 684170 - RNA, 64 nt, Homo Sapiens; identical to SEQ ID NO: 40236

SEQ ID NO: 684171 - RNA, 64 nt, Homo Sapiens; identical to SEQ ID NO: 40237

SEQ ID NO: 684172 - RNA, 64 nt, Homo Sapiens; identical to SEQ ID NO: 40238

SEQ ID NO: 684173 - RNA, 64 nt, Homo Sapiens; identical to SEQ ID NO: 40239

SEQ ID NO: 684174 - RNA, 64 nt, Homo Sapiens; identical to SEQ ID NO: 40240

SEQ ID NO: 684175 - RNA, 64 nt, Homo Sapiens; identical to SEQ ID NO: 40241

SEQ ID NO: 684176 - RNA, 64 nt, Homo Sapiens; identical to SEQ ID NO: 40242

SEQ ID NO: 684177 - RNA, 64 nt, Homo Sapiens; identical to SEQ ID NO: 40243

SEQ ID NO: 684178 - RNA, 64 nt, Homo Sapiens; identical to SEQ ID NO: 40244

SEQ ID NO: 684179 - RNA, 64 nt, Homo Sapiens; identical to SEQ ID NO: 40245

SEQ ID NO: 684180 - RNA, 64 nt, Homo Sapiens; identical to SEQ ID NO: 40246

SEQ ID NO: 684181 - RNA, 64 nt, Homo Sapiens; identical to SEQ ID NO: 40247

SEQ ID NO: 684182 - RNA, 64 nt, Homo Sapiens; identical to SEQ ID NO: 40248

SEQ ID NO: 684183 - RNA, 64 nt, Homo Sapiens; identical to SEQ ID NO: 40249

SEQ ID NO: 684184 - RNA, 64 nt, Homo Sapiens; identical to SEQ ID NO: 40250

SEQ ID NO: 684185 - RNA, 64 nt, Homo Sapiens; identical to SEQ ID NO: 40251

SEQ ID NO: 684186 - RNA, 64 nt, Homo Sapiens; identical to SEQ ID NO: 40252

SEQ ID NO: 684187 - RNA, 64 nt, Homo Sapiens; identical to SEQ ID NO: 40253

SEQ ID NO: 684188 - RNA, 64 nt, Homo Sapiens; identical to SEQ ID NO: 40254

SEQ ID NO: 684189 - RNA, 64 nt, Homo Sapiens; identical to SEQ ID NO: 40255

SEQ ID NO: 684190 - RNA, 64 nt, Homo Sapiens; identical to SEQ ID NO: 40256

SEQ ID NO: 684191 - RNA, 64 nt, Homo Sapiens; identical to SEQ ID NO: 40257

SEQ ID NO: 684192 - RNA, 64 nt, Homo Sapiens; identical to SEQ ID NO: 40258

SEQ ID NO: 684193 - RNA, 64 nt, Homo Sapiens; identical to SEQ ID NO: 40259

SEQ ID NO: 684194 - RNA, 64 nt, Homo Sapiens; identical to SEQ ID NO: 40260

SEQ ID NO: 684195 - RNA, 64 nt, Homo Sapiens; identical to SEQ ID NO: 40261

SEQ ID NO: 684196 - RNA, 64 nt, Homo Sapiens; identical to SEQ ID NO: 40262

SEQ ID NO: 684197 - RNA, 64 nt, Homo Sapiens; identical to SEQ ID NO: 40263

SEQ ID NO: 684198 - RNA, 64 nt, Homo Sapiens; identical to SEQ ID NO: 40264

SEQ ID NO: 684199 - RNA, 64 nt, Homo Sapiens; identical to SEQ ID NO: 40265

SEQ ID NO: 684200 - RNA, 64 nt, Homo Sapiens; identical to SEQ ID NO: 40266

SEQ ID NO: 684201 - RNA, 64 nt, Homo Sapiens; identical to SEQ ID NO: 40267

SEQ ID NO: 684202 - RNA, 64 nt, Homo Sapiens; identical to SEQ ID NO: 40268

SEQ ID NO: 684203 - RNA, 64 nt, Homo Sapiens; identical to SEQ ID NO: 40269

SEQ ID NO: 684204 - RNA, 64 nt, Homo Sapiens; identical to SEQ ID NO: 40270

SEQ ID NO: 684205 - RNA, 64 nt, Homo Sapiens; identical to SEQ ID NO: 40271

SEQ ID NO: 684206 - RNA, 64 nt, Homo Sapiens; identical to SEQ ID NO: 40272

SEQ ID NO: 684207 - RNA, 64 nt, Homo Sapiens; identical to SEQ ID NO: 40273

SEQ ID NO: 684208 - RNA, 64 nt, Homo Sapiens; identical to SEQ ID NO: 40274

SEQ ID NO: 684209 - RNA, 64 nt, Homo Sapiens; identical to SEQ ID NO: 40275

SEQ ID NO: 684210 - RNA, 64 nt, Homo Sapiens; identical to SEQ ID NO: 40276

SEQ ID NO: 684211 - RNA, 64 nt, Homo Sapiens; identical to SEQ ID NO: 40277

SEQ ID NO: 684212 - RNA, 64 nt, Homo Sapiens; identical to SEQ ID NO: 40278

SEQ ID NO: 684213 - RNA, 64 nt, Homo Sapiens; identical to SEQ ID NO: 40279

SEQ ID NO: 684214 - RNA, 64 nt, Homo Sapiens; identical to SEQ ID NO: 40280

SEQ ID NO: 684215 - RNA, 64 nt, Homo Sapiens; identical to SEQ ID NO: 40281

SEQ ID NO: 684216 - RNA, 64 nt, Homo Sapiens; identical to SEQ ID NO: 40282

SEQ ID NO: 684217 - RNA, 64 nt, Homo Sapiens; identical to SEQ ID NO: 40283

SEQ ID NO: 684218 - RNA, 64 nt, Homo Sapiens; identical to SEQ ID NO: 40284

SEQ ID NO: 684219 - RNA, 64 nt, Homo Sapiens; identical to SEQ ID NO: 40285

SEQ ID NO: 684220 - RNA, 64 nt, Homo Sapiens; identical to SEQ ID NO: 40286

SEQ ID NO: 684221 - RNA, 64 nt, Homo Sapiens; identical to SEQ ID NO: 40287

SEQ ID NO: 684222 - RNA, 64 nt, Homo Sapiens; identical to SEQ ID NO: 40288

SEQ ID NO: 684223 - RNA, 64 nt, Homo Sapiens; identical to SEQ ID NO: 40289

SEQ ID NO: 684224 - RNA, 64 nt, Homo Sapiens; identical to SEQ ID NO: 40290

SEQ ID NO: 684225 - RNA, 64 nt, Homo Sapiens; identical to SEQ ID NO: 40291

SEQ ID NO: 684226 - RNA, 64 nt, Homo Sapiens; identical to SEQ ID NO: 40292

SEQ ID NO: 684227 - RNA, 64 nt, Homo Sapiens; identical to SEQ ID NO: 40293

SEQ ID NO: 684228 - RNA, 64 nt, Homo Sapiens; identical to SEQ ID NO: 40294

SEQ ID NO: 684229 - RNA, 64 nt, Homo Sapiens; identical to SEQ ID NO: 40295

SEQ ID NO: 684230 - RNA, 64 nt, Homo Sapiens; identical to SEQ ID NO: 40296

SEQ ID NO: 684231 - RNA, 64 nt, Homo Sapiens; identical to SEQ ID NO: 40297

SEQ ID NO: 684232 - RNA, 64 nt, Homo Sapiens; identical to SEQ ID NO: 40298

SEQ ID NO: 684233 - RNA, 64 nt, Homo Sapiens; identical to SEQ ID NO: 40299

SEQ ID NO: 684234 - RNA, 64 nt, Homo Sapiens; identical to SEQ ID NO: 40300

SEQ ID NO: 684235 - RNA, 64 nt, Homo Sapiens; identical to SEQ ID NO: 40301

SEQ ID NO: 684236 - RNA, 64 nt, Homo Sapiens; identical to SEQ ID NO: 40302

SEQ ID NO: 684237 - RNA, 64 nt, Homo Sapiens; identical to SEQ ID NO: 40303

SEQ ID NO: 684238 - RNA, 64 nt, Homo Sapiens; identical to SEQ ID NO: 40304

SEQ ID NO: 684239 - RNA, 64 nt, Homo Sapiens; identical to SEQ ID NO: 40305

SEQ ID NO: 684240 - RNA, 64 nt, Homo Sapiens; identical to SEQ ID NO: 40306

SEQ ID NO: 684241 - RNA, 64 nt, Homo Sapiens; identical to SEQ ID NO: 40307

SEQ ID NO: 684242 - RNA, 64 nt, Homo Sapiens; identical to SEQ ID NO: 40308

SEQ ID NO: 684243 - RNA, 64 nt, Homo Sapiens; identical to SEQ ID NO: 40309

SEQ ID NO: 684244 - RNA, 64 nt, Homo Sapiens; identical to SEQ ID NO: 40310

SEQ ID NO: 684245 - RNA, 64 nt, Homo Sapiens; identical to SEQ ID NO: 40311

SEQ ID NO: 684246 - RNA, 64 nt, Homo Sapiens; identical to SEQ ID NO: 40312

SEQ ID NO: 684247 - RNA, 64 nt, Homo Sapiens; identical to SEQ ID NO: 40313

SEQ ID NO: 684248 - RNA, 64 nt, Homo Sapiens; identical to SEQ ID NO: 40314

SEQ ID NO: 684249 - RNA, 64 nt, Homo Sapiens; identical to SEQ ID NO: 40315

SEQ ID NO: 684250 - RNA, 64 nt, Homo Sapiens; identical to SEQ ID NO: 40316

SEQ ID NO: 684251 - RNA, 64 nt, Homo Sapiens; identical to SEQ ID NO: 40317

SEQ ID NO: 684252 - RNA, 64 nt, Homo Sapiens; identical to SEQ ID NO: 40318

SEQ ID NO: 684253 - RNA, 64 nt, Homo Sapiens; identical to SEQ ID NO: 40319

SEQ ID NO: 684254 - RNA, 64 nt, Homo Sapiens; identical to SEQ ID NO: 40320

SEQ ID NO: 684255 - RNA, 64 nt, Homo Sapiens; identical to SEQ ID NO: 40321

SEQ ID NO: 684256 - RNA, 64 nt, Homo Sapiens; identical to SEQ ID NO: 40322

SEQ ID NO: 684257 - RNA, 64 nt, Homo Sapiens; identical to SEQ ID NO: 40323

SEQ ID NO: 684258 - RNA, 64 nt, Homo Sapiens; identical to SEQ ID NO: 40324

SEQ ID NO: 684259 - RNA, 64 nt, Homo Sapiens; identical to SEQ ID NO: 40325

SEQ ID NO: 684260 - RNA, 64 nt, Homo Sapiens; identical to SEQ ID NO: 40326

SEQ ID NO: 684261 - RNA, 64 nt, Homo Sapiens; identical to SEQ ID NO: 40327

SEQ ID NO: 684262 - RNA, 64 nt, Homo Sapiens; identical to SEQ ID NO: 40328

SEQ ID NO: 684263 - RNA, 64 nt, Homo Sapiens; identical to SEQ ID NO: 40329

SEQ ID NO: 684264 - RNA, 64 nt, Homo Sapiens; identical to SEQ ID NO: 40330

SEQ ID NO: 684265 - RNA, 64 nt, Homo Sapiens; identical to SEQ ID NO: 40331

SEQ ID NO: 684266 - RNA, 64 nt, Homo Sapiens; identical to SEQ ID NO: 40332

SEQ ID NO: 684267 - RNA, 64 nt, Homo Sapiens; identical to SEQ ID NO: 40333

SEQ ID NO: 684268 - RNA, 64 nt, Homo Sapiens; identical to SEQ ID NO: 40334

SEQ ID NO: 684269 - RNA, 64 nt, Homo Sapiens; identical to SEQ ID NO: 40335

SEQ ID NO: 684270 - RNA, 64 nt, Homo Sapiens; identical to SEQ ID NO: 40336

SEQ ID NO: 684271 - RNA, 64 nt, Homo Sapiens; identical to SEQ ID NO: 40337

SEQ ID NO: 684272 - RNA, 64 nt, Homo Sapiens; identical to SEQ ID NO: 40338

SEQ ID NO: 684273 - RNA, 64 nt, Homo Sapiens; identical to SEQ ID NO: 40339

SEQ ID NO: 684274 - RNA, 64 nt, Homo Sapiens; identical to SEQ ID NO: 40340

SEQ ID NO: 684275 - RNA, 64 nt, Homo Sapiens; identical to SEQ ID NO: 40341

SEQ ID NO: 684276 - RNA, 64 nt, Homo Sapiens; identical to SEQ ID NO: 40342

SEQ ID NO: 684277 - RNA, 64 nt, Homo Sapiens; identical to SEQ ID NO: 40343

SEQ ID NO: 684278 - RNA, 64 nt, Homo Sapiens; identical to SEQ ID NO: 40344

SEQ ID NO: 684279 - RNA, 64 nt, Homo Sapiens; identical to SEQ ID NO: 40345

SEQ ID NO: 684280 - RNA, 64 nt, Homo Sapiens; identical to SEQ ID NO: 40346

SEQ ID NO: 684281 - RNA, 64 nt, Homo Sapiens; identical to SEQ ID NO: 40347

SEQ ID NO: 684282 - RNA, 64 nt, Homo Sapiens; identical to SEQ ID NO: 40348

SEQ ID NO: 684283 - RNA, 64 nt, Homo Sapiens; identical to SEQ ID NO: 40349

SEQ ID NO: 684284 - RNA, 64 nt, Homo Sapiens; identical to SEQ ID NO: 40350

SEQ ID NO: 684285 - RNA, 64 nt, Homo Sapiens; identical to SEQ ID NO: 40351

SEQ ID NO: 684286 - RNA, 64 nt, Homo Sapiens; identical to SEQ ID NO: 40352

SEQ ID NO: 684287 - RNA, 64 nt, Homo Sapiens; identical to SEQ ID NO: 40353

SEQ ID NO: 684288 - RNA, 64 nt, Homo Sapiens; identical to SEQ ID NO: 40354

SEQ ID NO: 684289 - RNA, 64 nt, Homo Sapiens; identical to SEQ ID NO: 40355

SEQ ID NO: 684290 - RNA, 64 nt, Homo Sapiens; identical to SEQ ID NO: 40356

SEQ ID NO: 684291 - RNA, 64 nt, Homo Sapiens; identical to SEQ ID NO: 40357

SEQ ID NO: 684292 - RNA, 64 nt, Homo Sapiens; identical to SEQ ID NO: 40358

SEQ ID NO: 684293 - RNA, 64 nt, Homo Sapiens; identical to SEQ ID NO: 40359

SEQ ID NO: 684294 - RNA, 64 nt, Homo Sapiens; identical to SEQ ID NO: 40360

SEQ ID NO: 684295 - RNA, 64 nt, Homo Sapiens; identical to SEQ ID NO: 40361

SEQ ID NO: 684296 - RNA, 64 nt, Homo Sapiens; identical to SEQ ID NO: 40362

SEQ ID NO: 684297 - RNA, 64 nt, Homo Sapiens; identical to SEQ ID NO: 40363

SEQ ID NO: 684298 - RNA, 64 nt, Homo Sapiens; identical to SEQ ID NO: 40364

SEQ ID NO: 684299 - RNA, 64 nt, Homo Sapiens; identical to SEQ ID NO: 40365

SEQ ID NO: 684300 - RNA, 64 nt, Homo Sapiens; identical to SEQ ID NO: 40366

SEQ ID NO: 684301 - RNA, 64 nt, Homo Sapiens; identical to SEQ ID NO: 40367

SEQ ID NO: 684302 - RNA, 64 nt, Homo Sapiens; identical to SEQ ID NO: 40368

SEQ ID NO: 684303 - RNA, 64 nt, Homo Sapiens; identical to SEQ ID NO: 40369

SEQ ID NO: 684304 - RNA, 64 nt, Homo Sapiens; identical to SEQ ID NO: 40370

SEQ ID NO: 684305 - RNA, 64 nt, Homo Sapiens; identical to SEQ ID NO: 40371

SEQ ID NO: 684306 - RNA, 64 nt, Homo Sapiens; identical to SEQ ID NO: 40372

SEQ ID NO: 684307 - RNA, 64 nt, Homo Sapiens; identical to SEQ ID NO: 40373

SEQ ID NO: 684308 - RNA, 64 nt, Homo Sapiens; identical to SEQ ID NO: 40374

SEQ ID NO: 684309 - RNA, 64 nt, Homo Sapiens; identical to SEQ ID NO: 40375

SEQ ID NO: 684310 - RNA, 64 nt, Homo Sapiens; identical to SEQ ID NO: 40376

SEQ ID NO: 684311 - RNA, 64 nt, Homo Sapiens; identical to SEQ ID NO: 40377

SEQ ID NO: 684312 - RNA, 64 nt, Homo Sapiens; identical to SEQ ID NO: 40378

SEQ ID NO: 684313 - RNA, 64 nt, Homo Sapiens; identical to SEQ ID NO: 40379

SEQ ID NO: 684314 - RNA, 64 nt, Homo Sapiens; identical to SEQ ID NO: 40380

SEQ ID NO: 684315 - RNA, 64 nt, Homo Sapiens; identical to SEQ ID NO: 40381

SEQ ID NO: 684316 - RNA, 64 nt, Homo Sapiens; identical to SEQ ID NO: 40382

SEQ ID NO: 684317 - RNA, 64 nt, Homo Sapiens; identical to SEQ ID NO: 40383

SEQ ID NO: 684318 - RNA, 64 nt, Homo Sapiens; identical to SEQ ID NO: 40384

SEQ ID NO: 684319 - RNA, 64 nt, Homo Sapiens; identical to SEQ ID NO: 40385

SEQ ID NO: 684320 - RNA, 64 nt, Homo Sapiens; identical to SEQ ID NO: 40386

SEQ ID NO: 684321 - RNA, 64 nt, Homo Sapiens; identical to SEQ ID NO: 40387

SEQ ID NO: 684322 - RNA, 64 nt, Homo Sapiens; identical to SEQ ID NO: 40388

SEQ ID NO: 684323 - RNA, 64 nt, Homo Sapiens; identical to SEQ ID NO: 40389

SEQ ID NO: 684324 - RNA, 64 nt, Homo Sapiens; identical to SEQ ID NO: 40390

SEQ ID NO: 684325 - RNA, 64 nt, Homo Sapiens; identical to SEQ ID NO: 40391

SEQ ID NO: 684326 - RNA, 64 nt, Homo Sapiens; identical to SEQ ID NO: 40392

SEQ ID NO: 684327 - RNA, 64 nt, Homo Sapiens; identical to SEQ ID NO: 40393

SEQ ID NO: 684328 - RNA, 64 nt, Homo Sapiens; identical to SEQ ID NO: 40394

SEQ ID NO: 684329 - RNA, 64 nt, Homo Sapiens; identical to SEQ ID NO: 40395

SEQ ID NO: 684330 - RNA, 64 nt, Homo Sapiens; identical to SEQ ID NO: 40396

SEQ ID NO: 684331 - RNA, 64 nt, Homo Sapiens; identical to SEQ ID NO: 40397

SEQ ID NO: 684332 - RNA, 64 nt, Homo Sapiens; identical to SEQ ID NO: 40398

SEQ ID NO: 684333 - RNA, 64 nt, Homo Sapiens; identical to SEQ ID NO: 40399

SEQ ID NO: 684334 - RNA, 64 nt, Homo Sapiens; identical to SEQ ID NO: 40400

SEQ ID NO: 684335 - RNA, 64 nt, Homo Sapiens; identical to SEQ ID NO: 40401

SEQ ID NO: 684336 - RNA, 64 nt, Homo Sapiens; identical to SEQ ID NO: 40402

SEQ ID NO: 684337 - RNA, 64 nt, Homo Sapiens; identical to SEQ ID NO: 40403

SEQ ID NO: 684338 - RNA, 64 nt, Homo Sapiens; identical to SEQ ID NO: 40404

SEQ ID NO: 684339 - RNA, 64 nt, Homo Sapiens; identical to SEQ ID NO: 40405

SEQ ID NO: 684340 - RNA, 64 nt, Homo Sapiens; identical to SEQ ID NO: 40406

SEQ ID NO: 684341 - RNA, 64 nt, Homo Sapiens; identical to SEQ ID NO: 40407

SEQ ID NO: 684342 - RNA, 64 nt, Homo Sapiens; identical to SEQ ID NO: 40408

SEQ ID NO: 684343 - RNA, 64 nt, Homo Sapiens; identical to SEQ ID NO: 40409

SEQ ID NO: 684344 - RNA, 64 nt, Homo Sapiens; identical to SEQ ID NO: 40410

SEQ ID NO: 684345 - RNA, 64 nt, Homo Sapiens; identical to SEQ ID NO: 40411

SEQ ID NO: 684346 - RNA, 64 nt, Homo Sapiens; identical to SEQ ID NO: 40412

SEQ ID NO: 684347 - RNA, 64 nt, Homo Sapiens; identical to SEQ ID NO: 40413

SEQ ID NO: 684348 - RNA, 64 nt, Homo Sapiens; identical to SEQ ID NO: 40414

SEQ ID NO: 684349 - RNA, 64 nt, Homo Sapiens; identical to SEQ ID NO: 40415

SEQ ID NO: 684350 - RNA, 64 nt, Homo Sapiens; identical to SEQ ID NO: 40416

SEQ ID NO: 684351 - RNA, 64 nt, Homo Sapiens; identical to SEQ ID NO: 40417

SEQ ID NO: 684352 - RNA, 64 nt, Homo Sapiens; identical to SEQ ID NO: 40418

SEQ ID NO: 684353 - RNA, 64 nt, Homo Sapiens; identical to SEQ ID NO: 40419

SEQ ID NO: 684354 - RNA, 64 nt, Homo Sapiens; identical to SEQ ID NO: 40420

SEQ ID NO: 684355 - RNA, 64 nt, Homo Sapiens; identical to SEQ ID NO: 40421

SEQ ID NO: 684356 - RNA, 64 nt, Homo Sapiens; identical to SEQ ID NO: 40422

SEQ ID NO: 684357 - RNA, 64 nt, Homo Sapiens; identical to SEQ ID NO: 40423

SEQ ID NO: 684358 - RNA, 64 nt, Homo Sapiens; identical to SEQ ID NO: 40424

SEQ ID NO: 684359 - RNA, 64 nt, Homo Sapiens; identical to SEQ ID NO: 40425

SEQ ID NO: 684360 - RNA, 64 nt, Homo Sapiens; identical to SEQ ID NO: 40426

SEQ ID NO: 684361 - RNA, 64 nt, Homo Sapiens; identical to SEQ ID NO: 40427

SEQ ID NO: 684362 - RNA, 64 nt, Homo Sapiens; identical to SEQ ID NO: 40428

SEQ ID NO: 684363 - RNA, 64 nt, Homo Sapiens; identical to SEQ ID NO: 40429

SEQ ID NO: 684364 - RNA, 64 nt, Homo Sapiens; identical to SEQ ID NO: 40430

SEQ ID NO: 684365 - RNA, 64 nt, Homo Sapiens; identical to SEQ ID NO: 40431

SEQ ID NO: 684366 - RNA, 64 nt, Homo Sapiens; identical to SEQ ID NO: 40432

SEQ ID NO: 684367 - RNA, 64 nt, Homo Sapiens; identical to SEQ ID NO: 40433

SEQ ID NO: 684368 - RNA, 64 nt, Homo Sapiens; identical to SEQ ID NO: 40434

SEQ ID NO: 684369 - RNA, 64 nt, Homo Sapiens; identical to SEQ ID NO: 40435

SEQ ID NO: 684370 - RNA, 64 nt, Homo Sapiens; identical to SEQ ID NO: 40436

SEQ ID NO: 684371 - RNA, 64 nt, Homo Sapiens; identical to SEQ ID NO: 40437

SEQ ID NO: 684372 - RNA, 64 nt, Homo Sapiens; identical to SEQ ID NO: 40438

SEQ ID NO: 684373 - RNA, 64 nt, Homo Sapiens; identical to SEQ ID NO: 40439

SEQ ID NO: 684374 - RNA, 64 nt, Homo Sapiens; identical to SEQ ID NO: 40440

SEQ ID NO: 684375 - RNA, 64 nt, Homo Sapiens; identical to SEQ ID NO: 40441

SEQ ID NO: 684376 - RNA, 64 nt, Homo Sapiens; identical to SEQ ID NO: 40442

SEQ ID NO: 684377 - RNA, 64 nt, Homo Sapiens; identical to SEQ ID NO: 40443

SEQ ID NO: 684378 - RNA, 64 nt, Homo Sapiens; identical to SEQ ID NO: 40444

SEQ ID NO: 684379 - RNA, 64 nt, Homo Sapiens; identical to SEQ ID NO: 40445

SEQ ID NO: 684380 - RNA, 64 nt, Homo Sapiens; identical to SEQ ID NO: 40446

SEQ ID NO: 684381 - RNA, 64 nt, Homo Sapiens; identical to SEQ ID NO: 40447

SEQ ID NO: 684382 - RNA, 64 nt, Homo Sapiens; identical to SEQ ID NO: 40448

SEQ ID NO: 684383 - RNA, 64 nt, Homo Sapiens; identical to SEQ ID NO: 40449

SEQ ID NO: 684384 - RNA, 64 nt, Homo Sapiens; identical to SEQ ID NO: 40450

SEQ ID NO: 684385 - RNA, 64 nt, Homo Sapiens; identical to SEQ ID NO: 40451

SEQ ID NO: 684386 - RNA, 64 nt, Homo Sapiens; identical to SEQ ID NO: 40452

SEQ ID NO: 684387 - RNA, 64 nt, Homo Sapiens; identical to SEQ ID NO: 40453

SEQ ID NO: 684388 - RNA, 64 nt, Homo Sapiens; identical to SEQ ID NO: 40454

SEQ ID NO: 684389 - RNA, 64 nt, Homo Sapiens; identical to SEQ ID NO: 40455

SEQ ID NO: 684390 - RNA, 64 nt, Homo Sapiens; identical to SEQ ID NO: 40456

SEQ ID NO: 684391 - RNA, 64 nt, Homo Sapiens; identical to SEQ ID NO: 40457

SEQ ID NO: 684392 - RNA, 64 nt, Homo Sapiens; identical to SEQ ID NO: 40458

SEQ ID NO: 684393 - RNA, 64 nt, Homo Sapiens; identical to SEQ ID NO: 40459

SEQ ID NO: 684394 - RNA, 64 nt, Homo Sapiens; identical to SEQ ID NO: 40460

SEQ ID NO: 684395 - RNA, 64 nt, Homo Sapiens; identical to SEQ ID NO: 40461

SEQ ID NO: 684396 - RNA, 64 nt, Homo Sapiens; identical to SEQ ID NO: 40462

SEQ ID NO: 684397 - RNA, 64 nt, Homo Sapiens; identical to SEQ ID NO: 40463

SEQ ID NO: 684398 - RNA, 64 nt, Homo Sapiens; identical to SEQ ID NO: 40464

SEQ ID NO: 684399 - RNA, 64 nt, Homo Sapiens; identical to SEQ ID NO: 40465

SEQ ID NO: 684400 - RNA, 64 nt, Homo Sapiens; identical to SEQ ID NO: 40466

SEQ ID NO: 684401 - RNA, 64 nt, Homo Sapiens; identical to SEQ ID NO: 40467

SEQ ID NO: 684402 - RNA, 64 nt, Homo Sapiens; identical to SEQ ID NO: 40468

SEQ ID NO: 684403 - RNA, 64 nt, Homo Sapiens; identical to SEQ ID NO: 40469

SEQ ID NO: 684404 - RNA, 64 nt, Homo Sapiens; identical to SEQ ID NO: 40470

SEQ ID NO: 684405 - RNA, 64 nt, Homo Sapiens; identical to SEQ ID NO: 40471

SEQ ID NO: 684406 - RNA, 64 nt, Homo Sapiens; identical to SEQ ID NO: 40472

SEQ ID NO: 684407 - RNA, 64 nt, Homo Sapiens; identical to SEQ ID NO: 40473

SEQ ID NO: 684408 - RNA, 64 nt, Homo Sapiens; identical to SEQ ID NO: 40474

SEQ ID NO: 684409 - RNA, 64 nt, Homo Sapiens; identical to SEQ ID NO: 40475

SEQ ID NO: 684410 - RNA, 64 nt, Homo Sapiens; identical to SEQ ID NO: 40476

SEQ ID NO: 684411 - RNA, 64 nt, Homo Sapiens; identical to SEQ ID NO: 40477

SEQ ID NO: 684412 - RNA, 64 nt, Homo Sapiens; identical to SEQ ID NO: 40478

SEQ ID NO: 684413 - RNA, 64 nt, Homo Sapiens; identical to SEQ ID NO: 40479

SEQ ID NO: 684414 - RNA, 64 nt, Homo Sapiens; identical to SEQ ID NO: 40480

SEQ ID NO: 684415 - RNA, 64 nt, Homo Sapiens; identical to SEQ ID NO: 40481

SEQ ID NO: 684416 - RNA, 64 nt, Homo Sapiens; identical to SEQ ID NO: 40482

SEQ ID NO: 684417 - RNA, 64 nt, Homo Sapiens; identical to SEQ ID NO: 40483

SEQ ID NO: 684418 - RNA, 64 nt, Homo Sapiens; identical to SEQ ID NO: 40484

SEQ ID NO: 684419 - RNA, 64 nt, Homo Sapiens; identical to SEQ ID NO: 40485

SEQ ID NO: 684420 - RNA, 64 nt, Homo Sapiens; identical to SEQ ID NO: 40486

SEQ ID NO: 684421 - RNA, 64 nt, Homo Sapiens; identical to SEQ ID NO: 40487

SEQ ID NO: 684422 - RNA, 64 nt, Homo Sapiens; identical to SEQ ID NO: 40488

SEQ ID NO: 684423 - RNA, 64 nt, Homo Sapiens; identical to SEQ ID NO: 40489

SEQ ID NO: 684424 - RNA, 64 nt, Homo Sapiens; identical to SEQ ID NO: 40490

SEQ ID NO: 684425 - RNA, 64 nt, Homo Sapiens; identical to SEQ ID NO: 40491

SEQ ID NO: 684426 - RNA, 64 nt, Homo Sapiens; identical to SEQ ID NO: 40492

SEQ ID NO: 684427 - RNA, 64 nt, Homo Sapiens; identical to SEQ ID NO: 40493

SEQ ID NO: 684428 - RNA, 64 nt, Homo Sapiens; identical to SEQ ID NO: 40494

SEQ ID NO: 684429 - RNA, 64 nt, Homo Sapiens; identical to SEQ ID NO: 40495

SEQ ID NO: 684430 - RNA, 64 nt, Homo Sapiens; identical to SEQ ID NO: 40496

SEQ ID NO: 684431 - RNA, 64 nt, Homo Sapiens; identical to SEQ ID NO: 40497

SEQ ID NO: 684432 - RNA, 64 nt, Homo Sapiens; identical to SEQ ID NO: 40498

SEQ ID NO: 684433 - RNA, 64 nt, Homo Sapiens; identical to SEQ ID NO: 40499

SEQ ID NO: 684434 - RNA, 64 nt, Homo Sapiens; identical to SEQ ID NO: 40500

SEQ ID NO: 684435 - RNA, 64 nt, Homo Sapiens; identical to SEQ ID NO: 40501

SEQ ID NO: 684436 - RNA, 64 nt, Homo Sapiens; identical to SEQ ID NO: 40502

SEQ ID NO: 684437 - RNA, 64 nt, Homo Sapiens; identical to SEQ ID NO: 40503

SEQ ID NO: 684438 - RNA, 64 nt, Homo Sapiens; identical to SEQ ID NO: 40504

SEQ ID NO: 684439 - RNA, 64 nt, Homo Sapiens; identical to SEQ ID NO: 40505

SEQ ID NO: 684440 - RNA, 64 nt, Homo Sapiens; identical to SEQ ID NO: 40506

SEQ ID NO: 684441 - RNA, 64 nt, Homo Sapiens; identical to SEQ ID NO: 40507

SEQ ID NO: 684442 - RNA, 64 nt, Homo Sapiens; identical to SEQ ID NO: 40508

SEQ ID NO: 684443 - RNA, 64 nt, Homo Sapiens; identical to SEQ ID NO: 40509

SEQ ID NO: 684444 - RNA, 64 nt, Homo Sapiens; identical to SEQ ID NO: 40510

SEQ ID NO: 684445 - RNA, 64 nt, Homo Sapiens; identical to SEQ ID NO: 40511

SEQ ID NO: 684446 - RNA, 64 nt, Homo Sapiens; identical to SEQ ID NO: 40512

SEQ ID NO: 684447 - RNA, 64 nt, Homo Sapiens; identical to SEQ ID NO: 40513

SEQ ID NO: 684448 - RNA, 64 nt, Homo Sapiens; identical to SEQ ID NO: 40514

SEQ ID NO: 684449 - RNA, 64 nt, Homo Sapiens; identical to SEQ ID NO: 40515

SEQ ID NO: 684450 - RNA, 64 nt, Homo Sapiens; identical to SEQ ID NO: 40516

SEQ ID NO: 684451 - RNA, 64 nt, Homo Sapiens; identical to SEQ ID NO: 40517

SEQ ID NO: 684452 - RNA, 64 nt, Homo Sapiens; identical to SEQ ID NO: 40518

SEQ ID NO: 684453 - RNA, 64 nt, Homo Sapiens; identical to SEQ ID NO: 40519

SEQ ID NO: 684454 - RNA, 64 nt, Homo Sapiens; identical to SEQ ID NO: 40520

SEQ ID NO: 684455 - RNA, 64 nt, Homo Sapiens; identical to SEQ ID NO: 40521

SEQ ID NO: 684456 - RNA, 64 nt, Homo Sapiens; identical to SEQ ID NO: 40522

SEQ ID NO: 684457 - RNA, 64 nt, Homo Sapiens; identical to SEQ ID NO: 40523

SEQ ID NO: 684458 - RNA, 64 nt, Homo Sapiens; identical to SEQ ID NO: 40524

SEQ ID NO: 684459 - RNA, 64 nt, Homo Sapiens; identical to SEQ ID NO: 40525

SEQ ID NO: 684460 - RNA, 64 nt, Homo Sapiens; identical to SEQ ID NO: 40526

SEQ ID NO: 684461 - RNA, 64 nt, Homo Sapiens; identical to SEQ ID NO: 40527

SEQ ID NO: 684462 - RNA, 64 nt, Homo Sapiens; identical to SEQ ID NO: 40528

SEQ ID NO: 684463 - RNA, 64 nt, Homo Sapiens; identical to SEQ ID NO: 40529

SEQ ID NO: 684464 - RNA, 64 nt, Homo Sapiens; identical to SEQ ID NO: 40530

SEQ ID NO: 684465 - RNA, 64 nt, Homo Sapiens; identical to SEQ ID NO: 40531

SEQ ID NO: 684466 - RNA, 64 nt, Homo Sapiens; identical to SEQ ID NO: 40532

SEQ ID NO: 684467 - RNA, 64 nt, Homo Sapiens; identical to SEQ ID NO: 40533

SEQ ID NO: 684468 - RNA, 64 nt, Homo Sapiens; identical to SEQ ID NO: 40534

SEQ ID NO: 684469 - RNA, 64 nt, Homo Sapiens; identical to SEQ ID NO: 40535

SEQ ID NO: 684470 - RNA, 64 nt, Homo Sapiens; identical to SEQ ID NO: 40536

SEQ ID NO: 684471 - RNA, 64 nt, Homo Sapiens; identical to SEQ ID NO: 40537

SEQ ID NO: 684472 - RNA, 64 nt, Homo Sapiens; identical to SEQ ID NO: 40538

SEQ ID NO: 684473 - RNA, 64 nt, Homo Sapiens; identical to SEQ ID NO: 40539

SEQ ID NO: 684474 - RNA, 64 nt, Homo Sapiens; identical to SEQ ID NO: 40540

SEQ ID NO: 684475 - RNA, 64 nt, Homo Sapiens; identical to SEQ ID NO: 40541

SEQ ID NO: 684476 - RNA, 64 nt, Homo Sapiens; identical to SEQ ID NO: 40542

SEQ ID NO: 684477 - RNA, 64 nt, Homo Sapiens; identical to SEQ ID NO: 40543

SEQ ID NO: 684478 - RNA, 64 nt, Homo Sapiens; identical to SEQ ID NO: 40544

SEQ ID NO: 684479 - RNA, 64 nt, Homo Sapiens; identical to SEQ ID NO: 40545

SEQ ID NO: 684480 - RNA, 64 nt, Homo Sapiens; identical to SEQ ID NO: 40546

SEQ ID NO: 684481 - RNA, 64 nt, Homo Sapiens; identical to SEQ ID NO: 40547

SEQ ID NO: 684482 - RNA, 64 nt, Homo Sapiens; identical to SEQ ID NO: 40548

SEQ ID NO: 684483 - RNA, 64 nt, Homo Sapiens; identical to SEQ ID NO: 40549

SEQ ID NO: 684484 - RNA, 64 nt, Homo Sapiens; identical to SEQ ID NO: 40550

SEQ ID NO: 684485 - RNA, 64 nt, Homo Sapiens; identical to SEQ ID NO: 40551

SEQ ID NO: 684486 - RNA, 64 nt, Homo Sapiens; identical to SEQ ID NO: 40552

SEQ ID NO: 684487 - RNA, 64 nt, Homo Sapiens; identical to SEQ ID NO: 40553

SEQ ID NO: 684488 - RNA, 64 nt, Homo Sapiens; identical to SEQ ID NO: 40554

SEQ ID NO: 684489 - RNA, 64 nt, Homo Sapiens; identical to SEQ ID NO: 40555

SEQ ID NO: 684490 - RNA, 64 nt, Homo Sapiens; identical to SEQ ID NO: 40556

SEQ ID NO: 684491 - RNA, 64 nt, Homo Sapiens; identical to SEQ ID NO: 40557

SEQ ID NO: 684492 - RNA, 64 nt, Homo Sapiens; identical to SEQ ID NO: 40558

SEQ ID NO: 684493 - RNA, 64 nt, Homo Sapiens; identical to SEQ ID NO: 40559

SEQ ID NO: 684494 - RNA, 64 nt, Homo Sapiens; identical to SEQ ID NO: 40560

SEQ ID NO: 684495 - RNA, 64 nt, Homo Sapiens; identical to SEQ ID NO: 40561

SEQ ID NO: 684496 - RNA, 64 nt, Homo Sapiens; identical to SEQ ID NO: 40562

SEQ ID NO: 684497 - RNA, 64 nt, Homo Sapiens; identical to SEQ ID NO: 40563

SEQ ID NO: 684498 - RNA, 64 nt, Homo Sapiens; identical to SEQ ID NO: 40564

SEQ ID NO: 684499 - RNA, 64 nt, Homo Sapiens; identical to SEQ ID NO: 40565

SEQ ID NO: 684500 - RNA, 64 nt, Homo Sapiens; identical to SEQ ID NO: 40566

SEQ ID NO: 684501 - RNA, 64 nt, Homo Sapiens; identical to SEQ ID NO: 40567

SEQ ID NO: 684502 - RNA, 64 nt, Homo Sapiens; identical to SEQ ID NO: 40568

SEQ ID NO: 684503 - RNA, 64 nt, Homo Sapiens; identical to SEQ ID NO: 40569

SEQ ID NO: 684504 - RNA, 64 nt, Homo Sapiens; identical to SEQ ID NO: 40570

SEQ ID NO: 684505 - RNA, 64 nt, Homo Sapiens; identical to SEQ ID NO: 40571

SEQ ID NO: 684506 - RNA, 64 nt, Homo Sapiens; identical to SEQ ID NO: 40572

SEQ ID NO: 684507 - RNA, 64 nt, Homo Sapiens; identical to SEQ ID NO: 40573

SEQ ID NO: 684508 - RNA, 64 nt, Homo Sapiens; identical to SEQ ID NO: 40574

SEQ ID NO: 684509 - RNA, 64 nt, Homo Sapiens; identical to SEQ ID NO: 40575

SEQ ID NO: 684510 - RNA, 64 nt, Homo Sapiens; identical to SEQ ID NO: 40576

SEQ ID NO: 684511 - RNA, 64 nt, Homo Sapiens; identical to SEQ ID NO: 40577

SEQ ID NO: 684512 - RNA, 64 nt, Homo Sapiens; identical to SEQ ID NO: 40578

SEQ ID NO: 684513 - RNA, 64 nt, Homo Sapiens; identical to SEQ ID NO: 40579

SEQ ID NO: 684514 - RNA, 64 nt, Homo Sapiens; identical to SEQ ID NO: 40580

SEQ ID NO: 684515 - RNA, 64 nt, Homo Sapiens; identical to SEQ ID NO: 40581

SEQ ID NO: 684516 - RNA, 64 nt, Homo Sapiens; identical to SEQ ID NO: 40582

SEQ ID NO: 684517 - RNA, 64 nt, Homo Sapiens; identical to SEQ ID NO: 40583

SEQ ID NO: 684518 - RNA, 64 nt, Homo Sapiens; identical to SEQ ID NO: 40584

SEQ ID NO: 684519 - RNA, 64 nt, Homo Sapiens; identical to SEQ ID NO: 40585

SEQ ID NO: 684520 - RNA, 64 nt, Homo Sapiens; identical to SEQ ID NO: 40586

SEQ ID NO: 684521 - RNA, 64 nt, Homo Sapiens; identical to SEQ ID NO: 40587

SEQ ID NO: 684522 - RNA, 64 nt, Homo Sapiens; identical to SEQ ID NO: 40588

SEQ ID NO: 684523 - RNA, 64 nt, Homo Sapiens; identical to SEQ ID NO: 40589

SEQ ID NO: 684524 - RNA, 64 nt, Homo Sapiens; identical to SEQ ID NO: 40590

SEQ ID NO: 684525 - RNA, 64 nt, Homo Sapiens; identical to SEQ ID NO: 40591

SEQ ID NO: 684526 - RNA, 64 nt, Homo Sapiens; identical to SEQ ID NO: 40592

SEQ ID NO: 684527 - RNA, 64 nt, Homo Sapiens; identical to SEQ ID NO: 40593

SEQ ID NO: 684528 - RNA, 64 nt, Homo Sapiens; identical to SEQ ID NO: 40594

SEQ ID NO: 684529 - RNA, 64 nt, Homo Sapiens; identical to SEQ ID NO: 40595

SEQ ID NO: 684530 - RNA, 64 nt, Homo Sapiens; identical to SEQ ID NO: 40596

SEQ ID NO: 684531 - RNA, 64 nt, Homo Sapiens; identical to SEQ ID NO: 40597

SEQ ID NO: 684532 - RNA, 64 nt, Homo Sapiens; identical to SEQ ID NO: 40598

SEQ ID NO: 684533 - RNA, 64 nt, Homo Sapiens; identical to SEQ ID NO: 40599

SEQ ID NO: 684534 - RNA, 64 nt, Homo Sapiens; identical to SEQ ID NO: 40600

SEQ ID NO: 684535 - RNA, 64 nt, Homo Sapiens; identical to SEQ ID NO: 40601

SEQ ID NO: 684536 - RNA, 64 nt, Homo Sapiens; identical to SEQ ID NO: 40602

SEQ ID NO: 684537 - RNA, 64 nt, Homo Sapiens; identical to SEQ ID NO: 40603

SEQ ID NO: 684538 - RNA, 64 nt, Homo Sapiens; identical to SEQ ID NO: 40604

SEQ ID NO: 684539 - RNA, 64 nt, Homo Sapiens; identical to SEQ ID NO: 40605

SEQ ID NO: 684540 - RNA, 64 nt, Homo Sapiens; identical to SEQ ID NO: 40606

SEQ ID NO: 684541 - RNA, 64 nt, Homo Sapiens; identical to SEQ ID NO: 40607

SEQ ID NO: 684542 - RNA, 64 nt, Homo Sapiens; identical to SEQ ID NO: 40608

SEQ ID NO: 684543 - RNA, 64 nt, Homo Sapiens; identical to SEQ ID NO: 40609

SEQ ID NO: 684544 - RNA, 64 nt, Homo Sapiens; identical to SEQ ID NO: 40610

SEQ ID NO: 684545 - RNA, 64 nt, Homo Sapiens; identical to SEQ ID NO: 40611

SEQ ID NO: 684546 - RNA, 64 nt, Homo Sapiens; identical to SEQ ID NO: 40612

SEQ ID NO: 684547 - RNA, 64 nt, Homo Sapiens; identical to SEQ ID NO: 40613

SEQ ID NO: 684548 - RNA, 64 nt, Homo Sapiens; identical to SEQ ID NO: 40614

SEQ ID NO: 684549 - RNA, 64 nt, Homo Sapiens; identical to SEQ ID NO: 40615

SEQ ID NO: 684550 - RNA, 64 nt, Homo Sapiens; identical to SEQ ID NO: 40616

SEQ ID NO: 684551 - RNA, 64 nt, Homo Sapiens; identical to SEQ ID NO: 40617

SEQ ID NO: 684552 - RNA, 64 nt, Homo Sapiens; identical to SEQ ID NO: 40618

SEQ ID NO: 684553 - RNA, 64 nt, Homo Sapiens; identical to SEQ ID NO: 40619

SEQ ID NO: 684554 - RNA, 64 nt, Homo Sapiens; identical to SEQ ID NO: 40620

SEQ ID NO: 684555 - RNA, 64 nt, Homo Sapiens; identical to SEQ ID NO: 40621

SEQ ID NO: 684556 - RNA, 64 nt, Homo Sapiens; identical to SEQ ID NO: 40622

SEQ ID NO: 684557 - RNA, 64 nt, Homo Sapiens; identical to SEQ ID NO: 40623

SEQ ID NO: 684558 - RNA, 64 nt, Homo Sapiens; identical to SEQ ID NO: 40624

SEQ ID NO: 684559 - RNA, 64 nt, Homo Sapiens; identical to SEQ ID NO: 40625

SEQ ID NO: 684560 - RNA, 64 nt, Homo Sapiens; identical to SEQ ID NO: 40626

SEQ ID NO: 684561 - RNA, 64 nt, Homo Sapiens; identical to SEQ ID NO: 40627

SEQ ID NO: 684562 - RNA, 64 nt, Homo Sapiens; identical to SEQ ID NO: 40628

SEQ ID NO: 684563 - RNA, 64 nt, Homo Sapiens; identical to SEQ ID NO: 40629

SEQ ID NO: 684564 - RNA, 64 nt, Homo Sapiens; identical to SEQ ID NO: 40630

SEQ ID NO: 684565 - RNA, 64 nt, Homo Sapiens; identical to SEQ ID NO: 40631

SEQ ID NO: 684566 - RNA, 64 nt, Homo Sapiens; identical to SEQ ID NO: 40632

SEQ ID NO: 684567 - RNA, 64 nt, Homo Sapiens; identical to SEQ ID NO: 40633

SEQ ID NO: 684568 - RNA, 64 nt, Homo Sapiens; identical to SEQ ID NO: 40634

SEQ ID NO: 684569 - RNA, 64 nt, Homo Sapiens; identical to SEQ ID NO: 40635

SEQ ID NO: 684570 - RNA, 64 nt, Homo Sapiens; identical to SEQ ID NO: 40636

SEQ ID NO: 684571 - RNA, 64 nt, Homo Sapiens; identical to SEQ ID NO: 40637

SEQ ID NO: 684572 - RNA, 64 nt, Homo Sapiens; identical to SEQ ID NO: 40638

SEQ ID NO: 684573 - RNA, 64 nt, Homo Sapiens; identical to SEQ ID NO: 40639

SEQ ID NO: 684574 - RNA, 64 nt, Homo Sapiens; identical to SEQ ID NO: 40640

SEQ ID NO: 684575 - RNA, 64 nt, Homo Sapiens; identical to SEQ ID NO: 40641

SEQ ID NO: 684576 - RNA, 64 nt, Homo Sapiens; identical to SEQ ID NO: 40642

SEQ ID NO: 684577 - RNA, 64 nt, Homo Sapiens; identical to SEQ ID NO: 40643

SEQ ID NO: 684578 - RNA, 64 nt, Homo Sapiens; identical to SEQ ID NO: 40644

SEQ ID NO: 684579 - RNA, 64 nt, Homo Sapiens; identical to SEQ ID NO: 40645

SEQ ID NO: 684580 - RNA, 64 nt, Homo Sapiens; identical to SEQ ID NO: 40646

SEQ ID NO: 684581 - RNA, 64 nt, Homo Sapiens; identical to SEQ ID NO: 40647

SEQ ID NO: 684582 - RNA, 64 nt, Homo Sapiens; identical to SEQ ID NO: 40648

SEQ ID NO: 684583 - RNA, 64 nt, Homo Sapiens; identical to SEQ ID NO: 40649

SEQ ID NO: 684584 - RNA, 64 nt, Homo Sapiens; identical to SEQ ID NO: 40650

SEQ ID NO: 684585 - RNA, 64 nt, Homo Sapiens; identical to SEQ ID NO: 40651

SEQ ID NO: 684586 - RNA, 64 nt, Homo Sapiens; identical to SEQ ID NO: 40652

SEQ ID NO: 684587 - RNA, 64 nt, Homo Sapiens; identical to SEQ ID NO: 40653

SEQ ID NO: 684588 - RNA, 64 nt, Homo Sapiens; identical to SEQ ID NO: 40654

SEQ ID NO: 684589 - RNA, 64 nt, Homo Sapiens; identical to SEQ ID NO: 40655

SEQ ID NO: 684590 - RNA, 64 nt, Homo Sapiens; identical to SEQ ID NO: 40656

SEQ ID NO: 684591 - RNA, 64 nt, Homo Sapiens; identical to SEQ ID NO: 40657

SEQ ID NO: 684592 - RNA, 64 nt, Homo Sapiens; identical to SEQ ID NO: 40658

SEQ ID NO: 684593 - RNA, 64 nt, Homo Sapiens; identical to SEQ ID NO: 40659

SEQ ID NO: 684594 - RNA, 64 nt, Homo Sapiens; identical to SEQ ID NO: 40660

SEQ ID NO: 684595 - RNA, 64 nt, Homo Sapiens; identical to SEQ ID NO: 40661

SEQ ID NO: 684596 - RNA, 64 nt, Homo Sapiens; identical to SEQ ID NO: 40662

SEQ ID NO: 684597 - RNA, 64 nt, Homo Sapiens; identical to SEQ ID NO: 40663

SEQ ID NO: 684598 - RNA, 64 nt, Homo Sapiens; identical to SEQ ID NO: 40664

SEQ ID NO: 684599 - RNA, 64 nt, Homo Sapiens; identical to SEQ ID NO: 40665

SEQ ID NO: 684600 - RNA, 64 nt, Homo Sapiens; identical to SEQ ID NO: 40666

SEQ ID NO: 684601 - RNA, 64 nt, Homo Sapiens; identical to SEQ ID NO: 40667

SEQ ID NO: 684602 - RNA, 64 nt, Homo Sapiens; identical to SEQ ID NO: 40668

SEQ ID NO: 684603 - RNA, 64 nt, Homo Sapiens; identical to SEQ ID NO: 40669

SEQ ID NO: 684604 - RNA, 64 nt, Homo Sapiens; identical to SEQ ID NO: 40670

SEQ ID NO: 684605 - RNA, 64 nt, Homo Sapiens; identical to SEQ ID NO: 40671

SEQ ID NO: 684606 - RNA, 64 nt, Homo Sapiens; identical to SEQ ID NO: 40672

SEQ ID NO: 684607 - RNA, 64 nt, Homo Sapiens; identical to SEQ ID NO: 40673

SEQ ID NO: 684608 - RNA, 64 nt, Homo Sapiens; identical to SEQ ID NO: 40674

SEQ ID NO: 684609 - RNA, 64 nt, Homo Sapiens; identical to SEQ ID NO: 40675

SEQ ID NO: 684610 - RNA, 64 nt, Homo Sapiens; identical to SEQ ID NO: 40676

SEQ ID NO: 684611 - RNA, 64 nt, Homo Sapiens; identical to SEQ ID NO: 40677

SEQ ID NO: 684612 - RNA, 64 nt, Homo Sapiens; identical to SEQ ID NO: 40678

SEQ ID NO: 684613 - RNA, 64 nt, Homo Sapiens; identical to SEQ ID NO: 40679

SEQ ID NO: 684614 - RNA, 64 nt, Homo Sapiens; identical to SEQ ID NO: 40680

SEQ ID NO: 684615 - RNA, 64 nt, Homo Sapiens; identical to SEQ ID NO: 40681

SEQ ID NO: 684616 - RNA, 64 nt, Homo Sapiens; identical to SEQ ID NO: 40682

SEQ ID NO: 684617 - RNA, 64 nt, Homo Sapiens; identical to SEQ ID NO: 40683

SEQ ID NO: 684618 - RNA, 64 nt, Homo Sapiens; identical to SEQ ID NO: 40684

SEQ ID NO: 684619 - RNA, 64 nt, Homo Sapiens; identical to SEQ ID NO: 40685

SEQ ID NO: 684620 - RNA, 64 nt, Homo Sapiens; identical to SEQ ID NO: 40686

SEQ ID NO: 684621 - RNA, 64 nt, Homo Sapiens; identical to SEQ ID NO: 40687

SEQ ID NO: 684622 - RNA, 64 nt, Homo Sapiens; identical to SEQ ID NO: 40688

SEQ ID NO: 684623 - RNA, 64 nt, Homo Sapiens; identical to SEQ ID NO: 40689

SEQ ID NO: 684624 - RNA, 64 nt, Homo Sapiens; identical to SEQ ID NO: 40690

SEQ ID NO: 684625 - RNA, 64 nt, Homo Sapiens; identical to SEQ ID NO: 40691

SEQ ID NO: 684626 - RNA, 64 nt, Homo Sapiens; identical to SEQ ID NO: 40692

SEQ ID NO: 684627 - RNA, 64 nt, Homo Sapiens; identical to SEQ ID NO: 40693

SEQ ID NO: 684628 - RNA, 64 nt, Homo Sapiens; identical to SEQ ID NO: 40694

SEQ ID NO: 684629 - RNA, 64 nt, Homo Sapiens; identical to SEQ ID NO: 40695

SEQ ID NO: 684630 - RNA, 64 nt, Homo Sapiens; identical to SEQ ID NO: 40696

SEQ ID NO: 684631 - RNA, 64 nt, Homo Sapiens; identical to SEQ ID NO: 40697

SEQ ID NO: 684632 - RNA, 64 nt, Homo Sapiens; identical to SEQ ID NO: 40698

SEQ ID NO: 684633 - RNA, 64 nt, Homo Sapiens; identical to SEQ ID NO: 40699

SEQ ID NO: 684634 - RNA, 64 nt, Homo Sapiens; identical to SEQ ID NO: 40700

SEQ ID NO: 684635 - RNA, 64 nt, Homo Sapiens; identical to SEQ ID NO: 40701

SEQ ID NO: 684636 - RNA, 64 nt, Homo Sapiens; identical to SEQ ID NO: 40702

SEQ ID NO: 684637 - RNA, 64 nt, Homo Sapiens; identical to SEQ ID NO: 40703

SEQ ID NO: 684638 - RNA, 64 nt, Homo Sapiens; identical to SEQ ID NO: 40704

SEQ ID NO: 684639 - RNA, 64 nt, Homo Sapiens; identical to SEQ ID NO: 40705

SEQ ID NO: 684640 - RNA, 64 nt, Homo Sapiens; identical to SEQ ID NO: 40706

SEQ ID NO: 684641 - RNA, 64 nt, Homo Sapiens; identical to SEQ ID NO: 40707

SEQ ID NO: 684642 - RNA, 64 nt, Homo Sapiens; identical to SEQ ID NO: 40708

SEQ ID NO: 684643 - RNA, 64 nt, Homo Sapiens; identical to SEQ ID NO: 40709

SEQ ID NO: 684644 - RNA, 64 nt, Homo Sapiens; identical to SEQ ID NO: 40710

SEQ ID NO: 684645 - RNA, 64 nt, Homo Sapiens; identical to SEQ ID NO: 40711

SEQ ID NO: 684646 - RNA, 64 nt, Homo Sapiens; identical to SEQ ID NO: 40712

SEQ ID NO: 684647 - RNA, 64 nt, Homo Sapiens; identical to SEQ ID NO: 40713

SEQ ID NO: 684648 - RNA, 64 nt, Homo Sapiens; identical to SEQ ID NO: 40714

SEQ ID NO: 684649 - RNA, 64 nt, Homo Sapiens; identical to SEQ ID NO: 40715

SEQ ID NO: 684650 - RNA, 64 nt, Homo Sapiens; identical to SEQ ID NO: 40716

SEQ ID NO: 684651 - RNA, 64 nt, Homo Sapiens; identical to SEQ ID NO: 40717

SEQ ID NO: 684652 - RNA, 64 nt, Homo Sapiens; identical to SEQ ID NO: 40718

SEQ ID NO: 684653 - RNA, 64 nt, Homo Sapiens; identical to SEQ ID NO: 40719

SEQ ID NO: 684654 - RNA, 64 nt, Homo Sapiens; identical to SEQ ID NO: 40720

SEQ ID NO: 684655 - RNA, 64 nt, Homo Sapiens; identical to SEQ ID NO: 40721

SEQ ID NO: 684656 - RNA, 64 nt, Homo Sapiens; identical to SEQ ID NO: 40722

SEQ ID NO: 684657 - RNA, 64 nt, Homo Sapiens; identical to SEQ ID NO: 40723

SEQ ID NO: 684658 - RNA, 64 nt, Homo Sapiens; identical to SEQ ID NO: 40724

SEQ ID NO: 684659 - RNA, 64 nt, Homo Sapiens; identical to SEQ ID NO: 40725

SEQ ID NO: 684660 - RNA, 64 nt, Homo Sapiens; identical to SEQ ID NO: 40726

SEQ ID NO: 684661 - RNA, 64 nt, Homo Sapiens; identical to SEQ ID NO: 40727

SEQ ID NO: 684662 - RNA, 64 nt, Homo Sapiens; identical to SEQ ID NO: 40728

SEQ ID NO: 684663 - RNA, 64 nt, Homo Sapiens; identical to SEQ ID NO: 40729

SEQ ID NO: 684664 - RNA, 64 nt, Homo Sapiens; identical to SEQ ID NO: 40730

SEQ ID NO: 684665 - RNA, 64 nt, Homo Sapiens; identical to SEQ ID NO: 40731

SEQ ID NO: 684666 - RNA, 64 nt, Homo Sapiens; identical to SEQ ID NO: 40732

SEQ ID NO: 684667 - RNA, 64 nt, Homo Sapiens; identical to SEQ ID NO: 40733

SEQ ID NO: 684668 - RNA, 64 nt, Homo Sapiens; identical to SEQ ID NO: 40734

SEQ ID NO: 684669 - RNA, 64 nt, Homo Sapiens; identical to SEQ ID NO: 40735

SEQ ID NO: 684670 - RNA, 64 nt, Homo Sapiens; identical to SEQ ID NO: 40736

SEQ ID NO: 684671 - RNA, 64 nt, Homo Sapiens; identical to SEQ ID NO: 40737

SEQ ID NO: 684672 - RNA, 64 nt, Homo Sapiens; identical to SEQ ID NO: 40738

SEQ ID NO: 684673 - RNA, 64 nt, Homo Sapiens; identical to SEQ ID NO: 40739

SEQ ID NO: 684674 - RNA, 64 nt, Homo Sapiens; identical to SEQ ID NO: 40740

SEQ ID NO: 684675 - RNA, 64 nt, Homo Sapiens; identical to SEQ ID NO: 40741

SEQ ID NO: 684676 - RNA, 64 nt, Homo Sapiens; identical to SEQ ID NO: 40742

SEQ ID NO: 684677 - RNA, 64 nt, Homo Sapiens; identical to SEQ ID NO: 40743

SEQ ID NO: 684678 - RNA, 64 nt, Homo Sapiens; identical to SEQ ID NO: 40744

SEQ ID NO: 684679 - RNA, 64 nt, Homo Sapiens; identical to SEQ ID NO: 40745

SEQ ID NO: 684680 - RNA, 64 nt, Homo Sapiens; identical to SEQ ID NO: 40746

SEQ ID NO: 684681 - RNA, 64 nt, Homo Sapiens; identical to SEQ ID NO: 40747

SEQ ID NO: 684682 - RNA, 64 nt, Homo Sapiens; identical to SEQ ID NO: 40748

SEQ ID NO: 684683 - RNA, 64 nt, Homo Sapiens; identical to SEQ ID NO: 40749

SEQ ID NO: 684684 - RNA, 64 nt, Homo Sapiens; identical to SEQ ID NO: 40750

SEQ ID NO: 684685 - RNA, 64 nt, Homo Sapiens; identical to SEQ ID NO: 40751

SEQ ID NO: 684686 - RNA, 64 nt, Homo Sapiens; identical to SEQ ID NO: 40752

SEQ ID NO: 684687 - RNA, 64 nt, Homo Sapiens; identical to SEQ ID NO: 40753

SEQ ID NO: 684688 - RNA, 64 nt, Homo Sapiens; identical to SEQ ID NO: 40754

SEQ ID NO: 684689 - RNA, 64 nt, Homo Sapiens; identical to SEQ ID NO: 40755

SEQ ID NO: 684690 - RNA, 64 nt, Homo Sapiens; identical to SEQ ID NO: 40756

SEQ ID NO: 684691 - RNA, 64 nt, Homo Sapiens; identical to SEQ ID NO: 40757

SEQ ID NO: 684692 - RNA, 64 nt, Homo Sapiens; identical to SEQ ID NO: 40758

SEQ ID NO: 684693 - RNA, 64 nt, Homo Sapiens; identical to SEQ ID NO: 40759

SEQ ID NO: 684694 - RNA, 64 nt, Homo Sapiens; identical to SEQ ID NO: 40760

SEQ ID NO: 684695 - RNA, 64 nt, Homo Sapiens; identical to SEQ ID NO: 40761

SEQ ID NO: 684696 - RNA, 64 nt, Homo Sapiens; identical to SEQ ID NO: 40762

SEQ ID NO: 684697 - RNA, 64 nt, Homo Sapiens; identical to SEQ ID NO: 40763

SEQ ID NO: 684698 - RNA, 64 nt, Homo Sapiens; identical to SEQ ID NO: 40764

SEQ ID NO: 684699 - RNA, 64 nt, Homo Sapiens; identical to SEQ ID NO: 40765

SEQ ID NO: 684700 - RNA, 64 nt, Homo Sapiens; identical to SEQ ID NO: 40766

SEQ ID NO: 684701 - RNA, 64 nt, Homo Sapiens; identical to SEQ ID NO: 40767

SEQ ID NO: 684702 - RNA, 64 nt, Homo Sapiens; identical to SEQ ID NO: 40768

SEQ ID NO: 684703 - RNA, 64 nt, Homo Sapiens; identical to SEQ ID NO: 40769

SEQ ID NO: 684704 - RNA, 64 nt, Homo Sapiens; identical to SEQ ID NO: 40770

SEQ ID NO: 684705 - RNA, 64 nt, Homo Sapiens; identical to SEQ ID NO: 40771

SEQ ID NO: 684706 - RNA, 64 nt, Homo Sapiens; identical to SEQ ID NO: 40772

SEQ ID NO: 684707 - RNA, 64 nt, Homo Sapiens; identical to SEQ ID NO: 40773

SEQ ID NO: 684708 - RNA, 64 nt, Homo Sapiens; identical to SEQ ID NO: 40774

SEQ ID NO: 684709 - RNA, 64 nt, Homo Sapiens; identical to SEQ ID NO: 40775

SEQ ID NO: 684710 - RNA, 64 nt, Homo Sapiens; identical to SEQ ID NO: 40776

SEQ ID NO: 684711 - RNA, 64 nt, Homo Sapiens; identical to SEQ ID NO: 40777

SEQ ID NO: 684712 - RNA, 64 nt, Homo Sapiens; identical to SEQ ID NO: 40778

SEQ ID NO: 684713 - RNA, 64 nt, Homo Sapiens; identical to SEQ ID NO: 40779

SEQ ID NO: 684714 - RNA, 64 nt, Homo Sapiens; identical to SEQ ID NO: 40780

SEQ ID NO: 684715 - RNA, 64 nt, Homo Sapiens; identical to SEQ ID NO: 40781

SEQ ID NO: 684716 - RNA, 64 nt, Homo Sapiens; identical to SEQ ID NO: 40782

SEQ ID NO: 684717 - RNA, 64 nt, Homo Sapiens; identical to SEQ ID NO: 40783

SEQ ID NO: 684718 - RNA, 64 nt, Homo Sapiens; identical to SEQ ID NO: 40784

SEQ ID NO: 684719 - RNA, 64 nt, Homo Sapiens; identical to SEQ ID NO: 40785

SEQ ID NO: 684720 - RNA, 64 nt, Homo Sapiens; identical to SEQ ID NO: 40786

SEQ ID NO: 684721 - RNA, 64 nt, Homo Sapiens; identical to SEQ ID NO: 40787

SEQ ID NO: 684722 - RNA, 64 nt, Homo Sapiens; identical to SEQ ID NO: 40788

SEQ ID NO: 684723 - RNA, 64 nt, Homo Sapiens; identical to SEQ ID NO: 40789

SEQ ID NO: 684724 - RNA, 64 nt, Homo Sapiens; identical to SEQ ID NO: 40790

SEQ ID NO: 684725 - RNA, 64 nt, Homo Sapiens; identical to SEQ ID NO: 40791

SEQ ID NO: 684726 - RNA, 64 nt, Homo Sapiens; identical to SEQ ID NO: 40792

SEQ ID NO: 684727 - RNA, 64 nt, Homo Sapiens; identical to SEQ ID NO: 40793

SEQ ID NO: 684728 - RNA, 64 nt, Homo Sapiens; identical to SEQ ID NO: 40794

SEQ ID NO: 684729 - RNA, 64 nt, Homo Sapiens; identical to SEQ ID NO: 40795

SEQ ID NO: 684730 - RNA, 64 nt, Homo Sapiens; identical to SEQ ID NO: 40796

SEQ ID NO: 684731 - RNA, 64 nt, Homo Sapiens; identical to SEQ ID NO: 40797

SEQ ID NO: 684732 - RNA, 64 nt, Homo Sapiens; identical to SEQ ID NO: 40798

SEQ ID NO: 684733 - RNA, 64 nt, Homo Sapiens; identical to SEQ ID NO: 40799

SEQ ID NO: 684734 - RNA, 64 nt, Homo Sapiens; identical to SEQ ID NO: 40800

SEQ ID NO: 684735 - RNA, 64 nt, Homo Sapiens; identical to SEQ ID NO: 40801

SEQ ID NO: 684736 - RNA, 64 nt, Homo Sapiens; identical to SEQ ID NO: 40802

SEQ ID NO: 684737 - RNA, 64 nt, Homo Sapiens; identical to SEQ ID NO: 40803

SEQ ID NO: 684738 - RNA, 64 nt, Homo Sapiens; identical to SEQ ID NO: 40804

SEQ ID NO: 684739 - RNA, 64 nt, Homo Sapiens; identical to SEQ ID NO: 40805

SEQ ID NO: 684740 - RNA, 64 nt, Homo Sapiens; identical to SEQ ID NO: 40806

SEQ ID NO: 684741 - RNA, 64 nt, Homo Sapiens; identical to SEQ ID NO: 40807

SEQ ID NO: 684742 - RNA, 64 nt, Homo Sapiens; identical to SEQ ID NO: 40808

SEQ ID NO: 684743 - RNA, 64 nt, Homo Sapiens; identical to SEQ ID NO: 40809

SEQ ID NO: 684744 - RNA, 64 nt, Homo Sapiens; identical to SEQ ID NO: 40810

SEQ ID NO: 684745 - RNA, 64 nt, Homo Sapiens; identical to SEQ ID NO: 40811

SEQ ID NO: 684746 - RNA, 64 nt, Homo Sapiens; identical to SEQ ID NO: 40812

SEQ ID NO: 684747 - RNA, 64 nt, Homo Sapiens; identical to SEQ ID NO: 40813

SEQ ID NO: 684748 - RNA, 64 nt, Homo Sapiens; identical to SEQ ID NO: 40814

SEQ ID NO: 684749 - RNA, 64 nt, Homo Sapiens; identical to SEQ ID NO: 40815

SEQ ID NO: 684750 - RNA, 64 nt, Homo Sapiens; identical to SEQ ID NO: 40816

SEQ ID NO: 684751 - RNA, 64 nt, Homo Sapiens; identical to SEQ ID NO: 40817

SEQ ID NO: 684752 - RNA, 64 nt, Homo Sapiens; identical to SEQ ID NO: 40818

SEQ ID NO: 684753 - RNA, 64 nt, Homo Sapiens; identical to SEQ ID NO: 40819

SEQ ID NO: 684754 - RNA, 64 nt, Homo Sapiens; identical to SEQ ID NO: 40820

SEQ ID NO: 684755 - RNA, 64 nt, Homo Sapiens; identical to SEQ ID NO: 40821

SEQ ID NO: 684756 - RNA, 64 nt, Homo Sapiens; identical to SEQ ID NO: 40822

SEQ ID NO: 684757 - RNA, 64 nt, Homo Sapiens; identical to SEQ ID NO: 40823

SEQ ID NO: 684758 - RNA, 64 nt, Homo Sapiens; identical to SEQ ID NO: 40824

SEQ ID NO: 684759 - RNA, 64 nt, Homo Sapiens; identical to SEQ ID NO: 40825

SEQ ID NO: 684760 - RNA, 64 nt, Homo Sapiens; identical to SEQ ID NO: 40826

SEQ ID NO: 684761 - RNA, 64 nt, Homo Sapiens; identical to SEQ ID NO: 40827

SEQ ID NO: 684762 - RNA, 64 nt, Homo Sapiens; identical to SEQ ID NO: 40828

SEQ ID NO: 684763 - RNA, 64 nt, Homo Sapiens; identical to SEQ ID NO: 40829

SEQ ID NO: 684764 - RNA, 64 nt, Homo Sapiens; identical to SEQ ID NO: 40830

SEQ ID NO: 684765 - RNA, 64 nt, Homo Sapiens; identical to SEQ ID NO: 40831

SEQ ID NO: 684766 - RNA, 64 nt, Homo Sapiens; identical to SEQ ID NO: 40832

SEQ ID NO: 684767 - RNA, 64 nt, Homo Sapiens; identical to SEQ ID NO: 40833

SEQ ID NO: 684768 - RNA, 64 nt, Homo Sapiens; identical to SEQ ID NO: 40834

SEQ ID NO: 684769 - RNA, 64 nt, Homo Sapiens; identical to SEQ ID NO: 40835

SEQ ID NO: 684770 - RNA, 64 nt, Homo Sapiens; identical to SEQ ID NO: 40836

SEQ ID NO: 684771 - RNA, 64 nt, Homo Sapiens; identical to SEQ ID NO: 40837

SEQ ID NO: 684772 - RNA, 64 nt, Homo Sapiens; identical to SEQ ID NO: 40838

SEQ ID NO: 684773 - RNA, 64 nt, Homo Sapiens; identical to SEQ ID NO: 40839

SEQ ID NO: 684774 - RNA, 64 nt, Homo Sapiens; identical to SEQ ID NO: 40840

SEQ ID NO: 684775 - RNA, 64 nt, Homo Sapiens; identical to SEQ ID NO: 40841

SEQ ID NO: 684776 - RNA, 64 nt, Homo Sapiens; identical to SEQ ID NO: 40842

SEQ ID NO: 684777 - RNA, 64 nt, Homo Sapiens; identical to SEQ ID NO: 40843

SEQ ID NO: 684778 - RNA, 64 nt, Homo Sapiens; identical to SEQ ID NO: 40844

SEQ ID NO: 684779 - RNA, 64 nt, Homo Sapiens; identical to SEQ ID NO: 40845

SEQ ID NO: 684780 - RNA, 64 nt, Homo Sapiens; identical to SEQ ID NO: 40846

SEQ ID NO: 684781 - RNA, 64 nt, Homo Sapiens; identical to SEQ ID NO: 40847

SEQ ID NO: 684782 - RNA, 64 nt, Homo Sapiens; identical to SEQ ID NO: 40848

SEQ ID NO: 684783 - RNA, 64 nt, Homo Sapiens; identical to SEQ ID NO: 40849

SEQ ID NO: 684784 - RNA, 64 nt, Homo Sapiens; identical to SEQ ID NO: 40850

SEQ ID NO: 684785 - RNA, 64 nt, Homo Sapiens; identical to SEQ ID NO: 40851

SEQ ID NO: 684786 - RNA, 64 nt, Homo Sapiens; identical to SEQ ID NO: 40852

SEQ ID NO: 684787 - RNA, 64 nt, Homo Sapiens; identical to SEQ ID NO: 40853

SEQ ID NO: 684788 - RNA, 64 nt, Homo Sapiens; identical to SEQ ID NO: 40854

SEQ ID NO: 684789 - RNA, 64 nt, Homo Sapiens; identical to SEQ ID NO: 40855

SEQ ID NO: 684790 - RNA, 64 nt, Homo Sapiens; identical to SEQ ID NO: 40856

SEQ ID NO: 684791 - RNA, 64 nt, Homo Sapiens; identical to SEQ ID NO: 40857

SEQ ID NO: 684792 - RNA, 64 nt, Homo Sapiens; identical to SEQ ID NO: 40858

SEQ ID NO: 684793 - RNA, 64 nt, Homo Sapiens; identical to SEQ ID NO: 40859

SEQ ID NO: 684794 - RNA, 64 nt, Homo Sapiens; identical to SEQ ID NO: 40860

SEQ ID NO: 684795 - RNA, 64 nt, Homo Sapiens; identical to SEQ ID NO: 40861

SEQ ID NO: 684796 - RNA, 64 nt, Homo Sapiens; identical to SEQ ID NO: 40862

SEQ ID NO: 684797 - RNA, 64 nt, Homo Sapiens; identical to SEQ ID NO: 40863

SEQ ID NO: 684798 - RNA, 64 nt, Homo Sapiens; identical to SEQ ID NO: 40864

SEQ ID NO: 684799 - RNA, 64 nt, Homo Sapiens; identical to SEQ ID NO: 40865

SEQ ID NO: 684800 - RNA, 64 nt, Homo Sapiens; identical to SEQ ID NO: 40866

SEQ ID NO: 684801 - RNA, 64 nt, Homo Sapiens; identical to SEQ ID NO: 40867

SEQ ID NO: 684802 - RNA, 64 nt, Homo Sapiens; identical to SEQ ID NO: 40868

SEQ ID NO: 684803 - RNA, 64 nt, Homo Sapiens; identical to SEQ ID NO: 40869

SEQ ID NO: 684804 - RNA, 64 nt, Homo Sapiens; identical to SEQ ID NO: 40870

SEQ ID NO: 684805 - RNA, 64 nt, Homo Sapiens; identical to SEQ ID NO: 40871

SEQ ID NO: 684806 - RNA, 64 nt, Homo Sapiens; identical to SEQ ID NO: 40872

SEQ ID NO: 684807 - RNA, 64 nt, Homo Sapiens; identical to SEQ ID NO: 40873

SEQ ID NO: 684808 - RNA, 64 nt, Homo Sapiens; identical to SEQ ID NO: 40874

SEQ ID NO: 684809 - RNA, 64 nt, Homo Sapiens; identical to SEQ ID NO: 40875

SEQ ID NO: 684810 - RNA, 64 nt, Homo Sapiens; identical to SEQ ID NO: 40876

SEQ ID NO: 684811 - RNA, 64 nt, Homo Sapiens; identical to SEQ ID NO: 40877

SEQ ID NO: 684812 - RNA, 64 nt, Homo Sapiens; identical to SEQ ID NO: 40878

SEQ ID NO: 684813 - RNA, 64 nt, Homo Sapiens; identical to SEQ ID NO: 40879

SEQ ID NO: 684814 - RNA, 64 nt, Homo Sapiens; identical to SEQ ID NO: 40880

SEQ ID NO: 684815 - RNA, 64 nt, Homo Sapiens; identical to SEQ ID NO: 40881

SEQ ID NO: 684816 - RNA, 64 nt, Homo Sapiens; identical to SEQ ID NO: 40882

SEQ ID NO: 684817 - RNA, 64 nt, Homo Sapiens; identical to SEQ ID NO: 40883

SEQ ID NO: 684818 - RNA, 64 nt, Homo Sapiens; identical to SEQ ID NO: 40884

SEQ ID NO: 684819 - RNA, 64 nt, Homo Sapiens; identical to SEQ ID NO: 40885

SEQ ID NO: 684820 - RNA, 64 nt, Homo Sapiens; identical to SEQ ID NO: 40886

SEQ ID NO: 684821 - RNA, 64 nt, Homo Sapiens; identical to SEQ ID NO: 40887

SEQ ID NO: 684822 - RNA, 64 nt, Homo Sapiens; identical to SEQ ID NO: 40888

SEQ ID NO: 684823 - RNA, 64 nt, Homo Sapiens; identical to SEQ ID NO: 40889

SEQ ID NO: 684824 - RNA, 64 nt, Homo Sapiens; identical to SEQ ID NO: 40890

SEQ ID NO: 684825 - RNA, 64 nt, Homo Sapiens; identical to SEQ ID NO: 40891

SEQ ID NO: 684826 - RNA, 64 nt, Homo Sapiens; identical to SEQ ID NO: 40892

SEQ ID NO: 684827 - RNA, 64 nt, Homo Sapiens; identical to SEQ ID NO: 40893

SEQ ID NO: 684828 - RNA, 64 nt, Homo Sapiens; identical to SEQ ID NO: 40894

SEQ ID NO: 684829 - RNA, 64 nt, Homo Sapiens; identical to SEQ ID NO: 40895

SEQ ID NO: 684830 - RNA, 64 nt, Homo Sapiens; identical to SEQ ID NO: 40896

SEQ ID NO: 684831 - RNA, 64 nt, Homo Sapiens; identical to SEQ ID NO: 40897

SEQ ID NO: 684832 - RNA, 64 nt, Homo Sapiens; identical to SEQ ID NO: 40898

SEQ ID NO: 684833 - RNA, 64 nt, Homo Sapiens; identical to SEQ ID NO: 40899

SEQ ID NO: 684834 - RNA, 64 nt, Homo Sapiens; identical to SEQ ID NO: 40900

SEQ ID NO: 684835 - RNA, 64 nt, Homo Sapiens; identical to SEQ ID NO: 40901

SEQ ID NO: 684836 - RNA, 64 nt, Homo Sapiens; identical to SEQ ID NO: 40902

SEQ ID NO: 684837 - RNA, 64 nt, Homo Sapiens; identical to SEQ ID NO: 40903

SEQ ID NO: 684838 - RNA, 64 nt, Homo Sapiens; identical to SEQ ID NO: 40904

SEQ ID NO: 684839 - RNA, 64 nt, Homo Sapiens; identical to SEQ ID NO: 40905

SEQ ID NO: 684840 - RNA, 64 nt, Homo Sapiens; identical to SEQ ID NO: 40906

SEQ ID NO: 684841 - RNA, 64 nt, Homo Sapiens; identical to SEQ ID NO: 40907

SEQ ID NO: 684842 - RNA, 64 nt, Homo Sapiens; identical to SEQ ID NO: 40908

SEQ ID NO: 684843 - RNA, 64 nt, Homo Sapiens; identical to SEQ ID NO: 40909

SEQ ID NO: 684844 - RNA, 64 nt, Homo Sapiens; identical to SEQ ID NO: 40910

SEQ ID NO: 684845 - RNA, 64 nt, Homo Sapiens; identical to SEQ ID NO: 40911

SEQ ID NO: 684846 - RNA, 64 nt, Homo Sapiens; identical to SEQ ID NO: 40912

SEQ ID NO: 684847 - RNA, 64 nt, Homo Sapiens; identical to SEQ ID NO: 40913

SEQ ID NO: 684848 - RNA, 64 nt, Homo Sapiens; identical to SEQ ID NO: 40914

SEQ ID NO: 684849 - RNA, 64 nt, Homo Sapiens; identical to SEQ ID NO: 40915

SEQ ID NO: 684850 - RNA, 64 nt, Homo Sapiens; identical to SEQ ID NO: 40916

SEQ ID NO: 684851 - RNA, 64 nt, Homo Sapiens; identical to SEQ ID NO: 40917

SEQ ID NO: 684852 - RNA, 64 nt, Homo Sapiens; identical to SEQ ID NO: 40918

SEQ ID NO: 684853 - RNA, 64 nt, Homo Sapiens; identical to SEQ ID NO: 40919

SEQ ID NO: 684854 - RNA, 64 nt, Homo Sapiens; identical to SEQ ID NO: 40920

SEQ ID NO: 684855 - RNA, 64 nt, Homo Sapiens; identical to SEQ ID NO: 40921

SEQ ID NO: 684856 - RNA, 64 nt, Homo Sapiens; identical to SEQ ID NO: 40922

SEQ ID NO: 684857 - RNA, 64 nt, Homo Sapiens; identical to SEQ ID NO: 40923

SEQ ID NO: 684858 - RNA, 64 nt, Homo Sapiens; identical to SEQ ID NO: 40924

SEQ ID NO: 684859 - RNA, 64 nt, Homo Sapiens; identical to SEQ ID NO: 40925

SEQ ID NO: 684860 - RNA, 64 nt, Homo Sapiens; identical to SEQ ID NO: 40926

SEQ ID NO: 684861 - RNA, 64 nt, Homo Sapiens; identical to SEQ ID NO: 40927

SEQ ID NO: 684862 - RNA, 64 nt, Homo Sapiens; identical to SEQ ID NO: 40928

SEQ ID NO: 684863 - RNA, 64 nt, Homo Sapiens; identical to SEQ ID NO: 40929

SEQ ID NO: 684864 - RNA, 64 nt, Homo Sapiens; identical to SEQ ID NO: 40930

SEQ ID NO: 684865 - RNA, 64 nt, Homo Sapiens; identical to SEQ ID NO: 40931

SEQ ID NO: 684866 - RNA, 64 nt, Homo Sapiens; identical to SEQ ID NO: 40932

SEQ ID NO: 684867 - RNA, 64 nt, Homo Sapiens; identical to SEQ ID NO: 40933

SEQ ID NO: 684868 - RNA, 64 nt, Homo Sapiens; identical to SEQ ID NO: 40934

SEQ ID NO: 684869 - RNA, 64 nt, Homo Sapiens; identical to SEQ ID NO: 40935

SEQ ID NO: 684870 - RNA, 64 nt, Homo Sapiens; identical to SEQ ID NO: 40936

SEQ ID NO: 684871 - RNA, 64 nt, Homo Sapiens; identical to SEQ ID NO: 40937

SEQ ID NO: 684872 - RNA, 64 nt, Homo Sapiens; identical to SEQ ID NO: 40938

SEQ ID NO: 684873 - RNA, 64 nt, Homo Sapiens; identical to SEQ ID NO: 40939

SEQ ID NO: 684874 - RNA, 64 nt, Homo Sapiens; identical to SEQ ID NO: 40940

SEQ ID NO: 684875 - RNA, 64 nt, Homo Sapiens; identical to SEQ ID NO: 40941

SEQ ID NO: 684876 - RNA, 64 nt, Homo Sapiens; identical to SEQ ID NO: 40942

SEQ ID NO: 684877 - RNA, 64 nt, Homo Sapiens; identical to SEQ ID NO: 40943

SEQ ID NO: 684878 - RNA, 64 nt, Homo Sapiens; identical to SEQ ID NO: 40944

SEQ ID NO: 684879 - RNA, 64 nt, Homo Sapiens; identical to SEQ ID NO: 40945

SEQ ID NO: 684880 - RNA, 64 nt, Homo Sapiens; identical to SEQ ID NO: 40946

SEQ ID NO: 684881 - RNA, 64 nt, Homo Sapiens; identical to SEQ ID NO: 40947

SEQ ID NO: 684882 - RNA, 64 nt, Homo Sapiens; identical to SEQ ID NO: 40948

SEQ ID NO: 684883 - RNA, 64 nt, Homo Sapiens; identical to SEQ ID NO: 40949

SEQ ID NO: 684884 - RNA, 64 nt, Homo Sapiens; identical to SEQ ID NO: 40950

SEQ ID NO: 684885 - RNA, 64 nt, Homo Sapiens; identical to SEQ ID NO: 40951

SEQ ID NO: 684886 - RNA, 64 nt, Homo Sapiens; identical to SEQ ID NO: 40952

SEQ ID NO: 684887 - RNA, 64 nt, Homo Sapiens; identical to SEQ ID NO: 40953

SEQ ID NO: 684888 - RNA, 64 nt, Homo Sapiens; identical to SEQ ID NO: 40954

SEQ ID NO: 684889 - RNA, 64 nt, Homo Sapiens; identical to SEQ ID NO: 40955

SEQ ID NO: 684890 - RNA, 64 nt, Homo Sapiens; identical to SEQ ID NO: 40956

SEQ ID NO: 684891 - RNA, 64 nt, Homo Sapiens; identical to SEQ ID NO: 40957

SEQ ID NO: 684892 - RNA, 64 nt, Homo Sapiens; identical to SEQ ID NO: 40958

SEQ ID NO: 684893 - RNA, 64 nt, Homo Sapiens; identical to SEQ ID NO: 40959

SEQ ID NO: 684894 - RNA, 64 nt, Homo Sapiens; identical to SEQ ID NO: 40960

SEQ ID NO: 684895 - RNA, 64 nt, Homo Sapiens; identical to SEQ ID NO: 40961

SEQ ID NO: 684896 - RNA, 64 nt, Homo Sapiens; identical to SEQ ID NO: 40962

SEQ ID NO: 684897 - RNA, 64 nt, Homo Sapiens; identical to SEQ ID NO: 40963

SEQ ID NO: 684898 - RNA, 64 nt, Homo Sapiens; identical to SEQ ID NO: 40964

SEQ ID NO: 684899 - RNA, 64 nt, Homo Sapiens; identical to SEQ ID NO: 40965

SEQ ID NO: 684900 - RNA, 64 nt, Homo Sapiens; identical to SEQ ID NO: 40966

SEQ ID NO: 684901 - RNA, 64 nt, Homo Sapiens; identical to SEQ ID NO: 40967

SEQ ID NO: 684902 - RNA, 64 nt, Homo Sapiens; identical to SEQ ID NO: 40968

SEQ ID NO: 684903 - RNA, 64 nt, Homo Sapiens; identical to SEQ ID NO: 40969

SEQ ID NO: 684904 - RNA, 64 nt, Homo Sapiens; identical to SEQ ID NO: 40970

SEQ ID NO: 684905 - RNA, 64 nt, Homo Sapiens; identical to SEQ ID NO: 40971

SEQ ID NO: 684906 - RNA, 64 nt, Homo Sapiens; identical to SEQ ID NO: 40972

SEQ ID NO: 684907 - RNA, 64 nt, Homo Sapiens; identical to SEQ ID NO: 40973

SEQ ID NO: 684908 - RNA, 64 nt, Homo Sapiens; identical to SEQ ID NO: 40974

SEQ ID NO: 684909 - RNA, 64 nt, Homo Sapiens; identical to SEQ ID NO: 40975

SEQ ID NO: 684910 - RNA, 64 nt, Homo Sapiens; identical to SEQ ID NO: 40976

SEQ ID NO: 684911 - RNA, 64 nt, Homo Sapiens; identical to SEQ ID NO: 40977

SEQ ID NO: 684912 - RNA, 64 nt, Homo Sapiens; identical to SEQ ID NO: 40978

SEQ ID NO: 684913 - RNA, 64 nt, Homo Sapiens; identical to SEQ ID NO: 40979

SEQ ID NO: 684914 - RNA, 64 nt, Homo Sapiens; identical to SEQ ID NO: 40980

SEQ ID NO: 684915 - RNA, 64 nt, Homo Sapiens; identical to SEQ ID NO: 40981

SEQ ID NO: 684916 - RNA, 64 nt, Homo Sapiens; identical to SEQ ID NO: 40982

SEQ ID NO: 684917 - RNA, 64 nt, Homo Sapiens; identical to SEQ ID NO: 40983

SEQ ID NO: 684918 - RNA, 64 nt, Homo Sapiens; identical to SEQ ID NO: 40984

SEQ ID NO: 684919 - RNA, 64 nt, Homo Sapiens; identical to SEQ ID NO: 40985

SEQ ID NO: 684920 - RNA, 64 nt, Homo Sapiens; identical to SEQ ID NO: 40986

SEQ ID NO: 684921 - RNA, 64 nt, Homo Sapiens; identical to SEQ ID NO: 40987

SEQ ID NO: 684922 - RNA, 64 nt, Homo Sapiens; identical to SEQ ID NO: 40988

SEQ ID NO: 684923 - RNA, 64 nt, Homo Sapiens; identical to SEQ ID NO: 40989

SEQ ID NO: 684924 - RNA, 64 nt, Homo Sapiens; identical to SEQ ID NO: 40990

SEQ ID NO: 684925 - RNA, 64 nt, Homo Sapiens; identical to SEQ ID NO: 40991

SEQ ID NO: 684926 - RNA, 64 nt, Homo Sapiens; identical to SEQ ID NO: 40992

SEQ ID NO: 684927 - RNA, 64 nt, Homo Sapiens; identical to SEQ ID NO: 40993

SEQ ID NO: 684928 - RNA, 64 nt, Homo Sapiens; identical to SEQ ID NO: 40994

SEQ ID NO: 684929 - RNA, 64 nt, Homo Sapiens; identical to SEQ ID NO: 40995

SEQ ID NO: 684930 - RNA, 64 nt, Homo Sapiens; identical to SEQ ID NO: 40996

SEQ ID NO: 684931 - RNA, 64 nt, Homo Sapiens; identical to SEQ ID NO: 40997

SEQ ID NO: 684932 - RNA, 64 nt, Homo Sapiens; identical to SEQ ID NO: 40998

SEQ ID NO: 684933 - RNA, 64 nt, Homo Sapiens; identical to SEQ ID NO: 40999

SEQ ID NO: 684934 - RNA, 64 nt, Homo Sapiens; identical to SEQ ID NO: 41000

SEQ ID NO: 684935 - RNA, 64 nt, Homo Sapiens; identical to SEQ ID NO: 41001

SEQ ID NO: 684936 - RNA, 64 nt, Homo Sapiens; identical to SEQ ID NO: 41002

SEQ ID NO: 684937 - RNA, 64 nt, Homo Sapiens; identical to SEQ ID NO: 41003

SEQ ID NO: 684938 - RNA, 64 nt, Homo Sapiens; identical to SEQ ID NO: 41004

SEQ ID NO: 684939 - RNA, 64 nt, Homo Sapiens; identical to SEQ ID NO: 41005

SEQ ID NO: 684940 - RNA, 64 nt, Homo Sapiens; identical to SEQ ID NO: 41006

SEQ ID NO: 684941 - RNA, 63 nt, Homo Sapiens; identical to SEQ ID NO: 41007

SEQ ID NO: 684942 - RNA, 64 nt, Homo Sapiens; identical to SEQ ID NO: 41008

SEQ ID NO: 684943 - RNA, 64 nt, Homo Sapiens; identical to SEQ ID NO: 41009

SEQ ID NO: 684944 - RNA, 64 nt, Homo Sapiens; identical to SEQ ID NO: 41010

SEQ ID NO: 684945 - RNA, 64 nt, Homo Sapiens; identical to SEQ ID NO: 41011

SEQ ID NO: 684946 - RNA, 64 nt, Homo Sapiens; identical to SEQ ID NO: 41012

SEQ ID NO: 684947 - RNA, 64 nt, Homo Sapiens; identical to SEQ ID NO: 41013

SEQ ID NO: 684948 - RNA, 64 nt, Homo Sapiens; identical to SEQ ID NO: 41014

SEQ ID NO: 684949 - RNA, 64 nt, Homo Sapiens; identical to SEQ ID NO: 41015

SEQ ID NO: 684950 - RNA, 64 nt, Homo Sapiens; identical to SEQ ID NO: 41016

SEQ ID NO: 684951 - RNA, 64 nt, Homo Sapiens; identical to SEQ ID NO: 41017

SEQ ID NO: 684952 - RNA, 64 nt, Homo Sapiens; identical to SEQ ID NO: 41018

SEQ ID NO: 684953 - RNA, 64 nt, Homo Sapiens; identical to SEQ ID NO: 41019

SEQ ID NO: 684954 - RNA, 64 nt, Homo Sapiens; identical to SEQ ID NO: 41020

SEQ ID NO: 684955 - RNA, 64 nt, Homo Sapiens; identical to SEQ ID NO: 41021

SEQ ID NO: 684956 - RNA, 64 nt, Homo Sapiens; identical to SEQ ID NO: 41022

SEQ ID NO: 684957 - RNA, 64 nt, Homo Sapiens; identical to SEQ ID NO: 41023

SEQ ID NO: 684958 - RNA, 64 nt, Homo Sapiens; identical to SEQ ID NO: 41024

SEQ ID NO: 684959 - RNA, 64 nt, Homo Sapiens; identical to SEQ ID NO: 41025

SEQ ID NO: 684960 - RNA, 64 nt, Homo Sapiens; identical to SEQ ID NO: 41026

SEQ ID NO: 684961 - RNA, 64 nt, Homo Sapiens; identical to SEQ ID NO: 41027

SEQ ID NO: 684962 - RNA, 64 nt, Homo Sapiens; identical to SEQ ID NO: 41028

SEQ ID NO: 684963 - RNA, 64 nt, Homo Sapiens; identical to SEQ ID NO: 41029

SEQ ID NO: 684964 - RNA, 64 nt, Homo Sapiens; identical to SEQ ID NO: 41030

SEQ ID NO: 684965 - RNA, 64 nt, Homo Sapiens; identical to SEQ ID NO: 41031

SEQ ID NO: 684966 - RNA, 64 nt, Homo Sapiens; identical to SEQ ID NO: 41032

SEQ ID NO: 684967 - RNA, 64 nt, Homo Sapiens; identical to SEQ ID NO: 41033

SEQ ID NO: 684968 - RNA, 64 nt, Homo Sapiens; identical to SEQ ID NO: 41034

SEQ ID NO: 684969 - RNA, 64 nt, Homo Sapiens; identical to SEQ ID NO: 41035

SEQ ID NO: 684970 - RNA, 64 nt, Homo Sapiens; identical to SEQ ID NO: 41036

SEQ ID NO: 684971 - RNA, 64 nt, Homo Sapiens; identical to SEQ ID NO: 41037

SEQ ID NO: 684972 - RNA, 64 nt, Homo Sapiens; identical to SEQ ID NO: 41038

SEQ ID NO: 684973 - RNA, 64 nt, Homo Sapiens; identical to SEQ ID NO: 41039

SEQ ID NO: 684974 - RNA, 64 nt, Homo Sapiens; identical to SEQ ID NO: 41040

SEQ ID NO: 684975 - RNA, 64 nt, Homo Sapiens; identical to SEQ ID NO: 41041

SEQ ID NO: 684976 - RNA, 64 nt, Homo Sapiens; identical to SEQ ID NO: 41042

SEQ ID NO: 684977 - RNA, 64 nt, Homo Sapiens; identical to SEQ ID NO: 41043

SEQ ID NO: 684978 - RNA, 64 nt, Homo Sapiens; identical to SEQ ID NO: 41044

SEQ ID NO: 684979 - RNA, 64 nt, Homo Sapiens; identical to SEQ ID NO: 41045

SEQ ID NO: 684980 - RNA, 64 nt, Homo Sapiens; identical to SEQ ID NO: 41046

SEQ ID NO: 684981 - RNA, 64 nt, Homo Sapiens; identical to SEQ ID NO: 41047

SEQ ID NO: 684982 - RNA, 64 nt, Homo Sapiens; identical to SEQ ID NO: 41048

SEQ ID NO: 684983 - RNA, 64 nt, Homo Sapiens; identical to SEQ ID NO: 41049

SEQ ID NO: 684984 - RNA, 64 nt, Homo Sapiens; identical to SEQ ID NO: 41050

SEQ ID NO: 684985 - RNA, 64 nt, Homo Sapiens; identical to SEQ ID NO: 41051

SEQ ID NO: 684986 - RNA, 64 nt, Homo Sapiens; identical to SEQ ID NO: 41052

SEQ ID NO: 684987 - RNA, 64 nt, Homo Sapiens; identical to SEQ ID NO: 41053

SEQ ID NO: 684988 - RNA, 64 nt, Homo Sapiens; identical to SEQ ID NO: 41054

SEQ ID NO: 684989 - RNA, 64 nt, Homo Sapiens; identical to SEQ ID NO: 41055

SEQ ID NO: 684990 - RNA, 64 nt, Homo Sapiens; identical to SEQ ID NO: 41056

SEQ ID NO: 684991 - RNA, 64 nt, Homo Sapiens; identical to SEQ ID NO: 41057

SEQ ID NO: 684992 - RNA, 64 nt, Homo Sapiens; identical to SEQ ID NO: 41058

SEQ ID NO: 684993 - RNA, 64 nt, Homo Sapiens; identical to SEQ ID NO: 41059

SEQ ID NO: 684994 - RNA, 64 nt, Homo Sapiens; identical to SEQ ID NO: 41060

SEQ ID NO: 684995 - RNA, 64 nt, Homo Sapiens; identical to SEQ ID NO: 41061

SEQ ID NO: 684996 - RNA, 64 nt, Homo Sapiens; identical to SEQ ID NO: 41062

SEQ ID NO: 684997 - RNA, 64 nt, Homo Sapiens; identical to SEQ ID NO: 41063

SEQ ID NO: 684998 - RNA, 64 nt, Homo Sapiens; identical to SEQ ID NO: 41064

SEQ ID NO: 684999 - RNA, 64 nt, Homo Sapiens; identical to SEQ ID NO: 41065

SEQ ID NO: 685000 - RNA, 64 nt, Homo Sapiens; identical to SEQ ID NO: 41066

SEQ ID NO: 685001 - RNA, 64 nt, Homo Sapiens; identical to SEQ ID NO: 41067

SEQ ID NO: 685002 - RNA, 64 nt, Homo Sapiens; identical to SEQ ID NO: 41068

SEQ ID NO: 685003 - RNA, 64 nt, Homo Sapiens; identical to SEQ ID NO: 41069

SEQ ID NO: 685004 - RNA, 64 nt, Homo Sapiens; identical to SEQ ID NO: 41070

SEQ ID NO: 685005 - RNA, 64 nt, Homo Sapiens; identical to SEQ ID NO: 41071

SEQ ID NO: 685006 - RNA, 64 nt, Homo Sapiens; identical to SEQ ID NO: 41072

SEQ ID NO: 685007 - RNA, 64 nt, Homo Sapiens; identical to SEQ ID NO: 41073

SEQ ID NO: 685008 - RNA, 64 nt, Homo Sapiens; identical to SEQ ID NO: 41074

SEQ ID NO: 685009 - RNA, 64 nt, Homo Sapiens; identical to SEQ ID NO: 41075

SEQ ID NO: 685010 - RNA, 64 nt, Homo Sapiens; identical to SEQ ID NO: 41076

SEQ ID NO: 685011 - RNA, 64 nt, Homo Sapiens; identical to SEQ ID NO: 41077

SEQ ID NO: 685012 - RNA, 64 nt, Homo Sapiens; identical to SEQ ID NO: 41078

SEQ ID NO: 685013 - RNA, 64 nt, Homo Sapiens; identical to SEQ ID NO: 41079

SEQ ID NO: 685014 - RNA, 64 nt, Homo Sapiens; identical to SEQ ID NO: 41080

SEQ ID NO: 685015 - RNA, 64 nt, Homo Sapiens; identical to SEQ ID NO: 41081

SEQ ID NO: 685016 - RNA, 64 nt, Homo Sapiens; identical to SEQ ID NO: 41082

SEQ ID NO: 685017 - RNA, 64 nt, Homo Sapiens; identical to SEQ ID NO: 41083

SEQ ID NO: 685018 - RNA, 64 nt, Homo Sapiens; identical to SEQ ID NO: 41084

SEQ ID NO: 685019 - RNA, 64 nt, Homo Sapiens; identical to SEQ ID NO: 41085

SEQ ID NO: 685020 - RNA, 64 nt, Homo Sapiens; identical to SEQ ID NO: 41086

SEQ ID NO: 685021 - RNA, 64 nt, Homo Sapiens; identical to SEQ ID NO: 41087

SEQ ID NO: 685022 - RNA, 64 nt, Homo Sapiens; identical to SEQ ID NO: 41088

SEQ ID NO: 685023 - RNA, 64 nt, Homo Sapiens; identical to SEQ ID NO: 41089

SEQ ID NO: 685024 - RNA, 64 nt, Homo Sapiens; identical to SEQ ID NO: 41090

SEQ ID NO: 685025 - RNA, 64 nt, Homo Sapiens; identical to SEQ ID NO: 41091

SEQ ID NO: 685026 - RNA, 64 nt, Homo Sapiens; identical to SEQ ID NO: 41092

SEQ ID NO: 685027 - RNA, 64 nt, Homo Sapiens; identical to SEQ ID NO: 41093

SEQ ID NO: 685028 - RNA, 64 nt, Homo Sapiens; identical to SEQ ID NO: 41094

SEQ ID NO: 685029 - RNA, 64 nt, Homo Sapiens; identical to SEQ ID NO: 41095

SEQ ID NO: 685030 - RNA, 64 nt, Homo Sapiens; identical to SEQ ID NO: 41096

SEQ ID NO: 685031 - RNA, 64 nt, Homo Sapiens; identical to SEQ ID NO: 41097

SEQ ID NO: 685032 - RNA, 64 nt, Homo Sapiens; identical to SEQ ID NO: 41098

SEQ ID NO: 685033 - RNA, 64 nt, Homo Sapiens; identical to SEQ ID NO: 41099

SEQ ID NO: 685034 - RNA, 64 nt, Homo Sapiens; identical to SEQ ID NO: 41100

SEQ ID NO: 685035 - RNA, 64 nt, Homo Sapiens; identical to SEQ ID NO: 41101

SEQ ID NO: 685036 - RNA, 64 nt, Homo Sapiens; identical to SEQ ID NO: 41102

SEQ ID NO: 685037 - RNA, 64 nt, Homo Sapiens; identical to SEQ ID NO: 41103

SEQ ID NO: 685038 - RNA, 64 nt, Homo Sapiens; identical to SEQ ID NO: 41104

SEQ ID NO: 685039 - RNA, 64 nt, Homo Sapiens; identical to SEQ ID NO: 41105

SEQ ID NO: 685040 - RNA, 64 nt, Homo Sapiens; identical to SEQ ID NO: 41106

SEQ ID NO: 685041 - RNA, 64 nt, Homo Sapiens; identical to SEQ ID NO: 41107

SEQ ID NO: 685042 - RNA, 64 nt, Homo Sapiens; identical to SEQ ID NO: 41108

SEQ ID NO: 685043 - RNA, 64 nt, Homo Sapiens; identical to SEQ ID NO: 41109

SEQ ID NO: 685044 - RNA, 64 nt, Homo Sapiens; identical to SEQ ID NO: 41110

SEQ ID NO: 685045 - RNA, 64 nt, Homo Sapiens; identical to SEQ ID NO: 41111

SEQ ID NO: 685046 - RNA, 64 nt, Homo Sapiens; identical to SEQ ID NO: 41112

SEQ ID NO: 685047 - RNA, 64 nt, Homo Sapiens; identical to SEQ ID NO: 41113

SEQ ID NO: 685048 - RNA, 64 nt, Homo Sapiens; identical to SEQ ID NO: 41114

SEQ ID NO: 685049 - RNA, 64 nt, Homo Sapiens; identical to SEQ ID NO: 41115

SEQ ID NO: 685050 - RNA, 64 nt, Homo Sapiens; identical to SEQ ID NO: 41116

SEQ ID NO: 685051 - RNA, 64 nt, Homo Sapiens; identical to SEQ ID NO: 41117

SEQ ID NO: 685052 - RNA, 64 nt, Homo Sapiens; identical to SEQ ID NO: 41118

SEQ ID NO: 685053 - RNA, 64 nt, Homo Sapiens; identical to SEQ ID NO: 41119

SEQ ID NO: 685054 - RNA, 64 nt, Homo Sapiens; identical to SEQ ID NO: 41120

SEQ ID NO: 685055 - RNA, 64 nt, Homo Sapiens; identical to SEQ ID NO: 41121

SEQ ID NO: 685056 - RNA, 64 nt, Homo Sapiens; identical to SEQ ID NO: 41122

SEQ ID NO: 685057 - RNA, 64 nt, Homo Sapiens; identical to SEQ ID NO: 41123

SEQ ID NO: 685058 - RNA, 64 nt, Homo Sapiens; identical to SEQ ID NO: 41124

SEQ ID NO: 685059 - RNA, 64 nt, Homo Sapiens; identical to SEQ ID NO: 41125

SEQ ID NO: 685060 - RNA, 64 nt, Homo Sapiens; identical to SEQ ID NO: 41126

SEQ ID NO: 685061 - RNA, 64 nt, Homo Sapiens; identical to SEQ ID NO: 41127

SEQ ID NO: 685062 - RNA, 64 nt, Homo Sapiens; identical to SEQ ID NO: 41128

SEQ ID NO: 685063 - RNA, 64 nt, Homo Sapiens; identical to SEQ ID NO: 41129

SEQ ID NO: 685064 - RNA, 64 nt, Homo Sapiens; identical to SEQ ID NO: 41130

SEQ ID NO: 685065 - RNA, 64 nt, Homo Sapiens; identical to SEQ ID NO: 41131

SEQ ID NO: 685066 - RNA, 64 nt, Homo Sapiens; identical to SEQ ID NO: 41132

SEQ ID NO: 685067 - RNA, 64 nt, Homo Sapiens; identical to SEQ ID NO: 41133

SEQ ID NO: 685068 - RNA, 64 nt, Homo Sapiens; identical to SEQ ID NO: 41134

SEQ ID NO: 685069 - RNA, 64 nt, Homo Sapiens; identical to SEQ ID NO: 41135

SEQ ID NO: 685070 - RNA, 64 nt, Homo Sapiens; identical to SEQ ID NO: 41136

SEQ ID NO: 685071 - RNA, 64 nt, Homo Sapiens; identical to SEQ ID NO: 41137

SEQ ID NO: 685072 - RNA, 64 nt, Homo Sapiens; identical to SEQ ID NO: 41138

SEQ ID NO: 685073 - RNA, 64 nt, Homo Sapiens; identical to SEQ ID NO: 41139

SEQ ID NO: 685074 - RNA, 64 nt, Homo Sapiens; identical to SEQ ID NO: 41140

SEQ ID NO: 685075 - RNA, 64 nt, Homo Sapiens; identical to SEQ ID NO: 41141

SEQ ID NO: 685076 - RNA, 64 nt, Homo Sapiens; identical to SEQ ID NO: 41142

SEQ ID NO: 685077 - RNA, 64 nt, Homo Sapiens; identical to SEQ ID NO: 41143

SEQ ID NO: 685078 - RNA, 64 nt, Homo Sapiens; identical to SEQ ID NO: 41144

SEQ ID NO: 685079 - RNA, 64 nt, Homo Sapiens; identical to SEQ ID NO: 41145

SEQ ID NO: 685080 - RNA, 64 nt, Homo Sapiens; identical to SEQ ID NO: 41146

SEQ ID NO: 685081 - RNA, 64 nt, Homo Sapiens; identical to SEQ ID NO: 41147

SEQ ID NO: 685082 - RNA, 64 nt, Homo Sapiens; identical to SEQ ID NO: 41148

SEQ ID NO: 685083 - RNA, 64 nt, Homo Sapiens; identical to SEQ ID NO: 41149

SEQ ID NO: 685084 - RNA, 64 nt, Homo Sapiens; identical to SEQ ID NO: 41150

SEQ ID NO: 685085 - RNA, 64 nt, Homo Sapiens; identical to SEQ ID NO: 41151

SEQ ID NO: 685086 - RNA, 64 nt, Homo Sapiens; identical to SEQ ID NO: 41152

SEQ ID NO: 685087 - RNA, 64 nt, Homo Sapiens; identical to SEQ ID NO: 41153

SEQ ID NO: 685088 - RNA, 64 nt, Homo Sapiens; identical to SEQ ID NO: 41154

SEQ ID NO: 685089 - RNA, 64 nt, Homo Sapiens; identical to SEQ ID NO: 41155

SEQ ID NO: 685090 - RNA, 64 nt, Homo Sapiens; identical to SEQ ID NO: 41156

SEQ ID NO: 685091 - RNA, 64 nt, Homo Sapiens; identical to SEQ ID NO: 41157

SEQ ID NO: 685092 - RNA, 64 nt, Homo Sapiens; identical to SEQ ID NO: 41158

SEQ ID NO: 685093 - RNA, 64 nt, Homo Sapiens; identical to SEQ ID NO: 41159

SEQ ID NO: 685094 - RNA, 64 nt, Homo Sapiens; identical to SEQ ID NO: 41160

SEQ ID NO: 685095 - RNA, 64 nt, Homo Sapiens; identical to SEQ ID NO: 41161

SEQ ID NO: 685096 - RNA, 64 nt, Homo Sapiens; identical to SEQ ID NO: 41162

SEQ ID NO: 685097 - RNA, 64 nt, Homo Sapiens; identical to SEQ ID NO: 41163

SEQ ID NO: 685098 - RNA, 64 nt, Homo Sapiens; identical to SEQ ID NO: 41164

SEQ ID NO: 685099 - RNA, 64 nt, Homo Sapiens; identical to SEQ ID NO: 41165

SEQ ID NO: 685100 - RNA, 64 nt, Homo Sapiens; identical to SEQ ID NO: 41166

SEQ ID NO: 685101 - RNA, 64 nt, Homo Sapiens; identical to SEQ ID NO: 41167

SEQ ID NO: 685102 - RNA, 64 nt, Homo Sapiens; identical to SEQ ID NO: 41168

SEQ ID NO: 685103 - RNA, 64 nt, Homo Sapiens; identical to SEQ ID NO: 41169

SEQ ID NO: 685104 - RNA, 64 nt, Homo Sapiens; identical to SEQ ID NO: 41170

SEQ ID NO: 685105 - RNA, 64 nt, Homo Sapiens; identical to SEQ ID NO: 41171

SEQ ID NO: 685106 - RNA, 64 nt, Homo Sapiens; identical to SEQ ID NO: 41172

SEQ ID NO: 685107 - RNA, 64 nt, Homo Sapiens; identical to SEQ ID NO: 41173

SEQ ID NO: 685108 - RNA, 64 nt, Homo Sapiens; identical to SEQ ID NO: 41174

SEQ ID NO: 685109 - RNA, 64 nt, Homo Sapiens; identical to SEQ ID NO: 41175

SEQ ID NO: 685110 - RNA, 64 nt, Homo Sapiens; identical to SEQ ID NO: 41176

SEQ ID NO: 685111 - RNA, 64 nt, Homo Sapiens; identical to SEQ ID NO: 41177

SEQ ID NO: 685112 - RNA, 64 nt, Homo Sapiens; identical to SEQ ID NO: 41178

SEQ ID NO: 685113 - RNA, 64 nt, Homo Sapiens; identical to SEQ ID NO: 41179

SEQ ID NO: 685114 - RNA, 64 nt, Homo Sapiens; identical to SEQ ID NO: 41180

SEQ ID NO: 685115 - RNA, 64 nt, Homo Sapiens; identical to SEQ ID NO: 41181

SEQ ID NO: 685116 - RNA, 64 nt, Homo Sapiens; identical to SEQ ID NO: 41182

SEQ ID NO: 685117 - RNA, 64 nt, Homo Sapiens; identical to SEQ ID NO: 41183

SEQ ID NO: 685118 - RNA, 64 nt, Homo Sapiens; identical to SEQ ID NO: 41184

SEQ ID NO: 685119 - RNA, 64 nt, Homo Sapiens; identical to SEQ ID NO: 41185

SEQ ID NO: 685120 - RNA, 64 nt, Homo Sapiens; identical to SEQ ID NO: 41186

SEQ ID NO: 685121 - RNA, 64 nt, Homo Sapiens; identical to SEQ ID NO: 41187

SEQ ID NO: 685122 - RNA, 64 nt, Homo Sapiens; identical to SEQ ID NO: 41188

SEQ ID NO: 685123 - RNA, 64 nt, Homo Sapiens; identical to SEQ ID NO: 41189

SEQ ID NO: 685124 - RNA, 64 nt, Homo Sapiens; identical to SEQ ID NO: 41190

SEQ ID NO: 685125 - RNA, 64 nt, Homo Sapiens; identical to SEQ ID NO: 41191

SEQ ID NO: 685126 - RNA, 64 nt, Homo Sapiens; identical to SEQ ID NO: 41192

SEQ ID NO: 685127 - RNA, 64 nt, Homo Sapiens; identical to SEQ ID NO: 41193

SEQ ID NO: 685128 - RNA, 64 nt, Homo Sapiens; identical to SEQ ID NO: 41194

SEQ ID NO: 685129 - RNA, 64 nt, Homo Sapiens; identical to SEQ ID NO: 41195

SEQ ID NO: 685130 - RNA, 64 nt, Homo Sapiens; identical to SEQ ID NO: 41196

SEQ ID NO: 685131 - RNA, 64 nt, Homo Sapiens; identical to SEQ ID NO: 41197

SEQ ID NO: 685132 - RNA, 64 nt, Homo Sapiens; identical to SEQ ID NO: 41198

SEQ ID NO: 685133 - RNA, 64 nt, Homo Sapiens; identical to SEQ ID NO: 41199

SEQ ID NO: 685134 - RNA, 64 nt, Homo Sapiens; identical to SEQ ID NO: 41200

SEQ ID NO: 685135 - RNA, 64 nt, Homo Sapiens; identical to SEQ ID NO: 41201

SEQ ID NO: 685136 - RNA, 64 nt, Homo Sapiens; identical to SEQ ID NO: 41202

SEQ ID NO: 685137 - RNA, 64 nt, Homo Sapiens; identical to SEQ ID NO: 41203

SEQ ID NO: 685138 - RNA, 64 nt, Homo Sapiens; identical to SEQ ID NO: 41204

SEQ ID NO: 685139 - RNA, 64 nt, Homo Sapiens; identical to SEQ ID NO: 41205

SEQ ID NO: 685140 - RNA, 64 nt, Homo Sapiens; identical to SEQ ID NO: 41206

SEQ ID NO: 685141 - RNA, 64 nt, Homo Sapiens; identical to SEQ ID NO: 41207

SEQ ID NO: 685142 - RNA, 64 nt, Homo Sapiens; identical to SEQ ID NO: 41208

SEQ ID NO: 685143 - RNA, 64 nt, Homo Sapiens; identical to SEQ ID NO: 41209

SEQ ID NO: 685144 - RNA, 64 nt, Homo Sapiens; identical to SEQ ID NO: 41210

SEQ ID NO: 685145 - RNA, 64 nt, Homo Sapiens; identical to SEQ ID NO: 41211

SEQ ID NO: 685146 - RNA, 64 nt, Homo Sapiens; identical to SEQ ID NO: 41212

SEQ ID NO: 685147 - RNA, 64 nt, Homo Sapiens; identical to SEQ ID NO: 41213

SEQ ID NO: 685148 - RNA, 64 nt, Homo Sapiens; identical to SEQ ID NO: 41214

SEQ ID NO: 685149 - RNA, 64 nt, Homo Sapiens; identical to SEQ ID NO: 41215

SEQ ID NO: 685150 - RNA, 64 nt, Homo Sapiens; identical to SEQ ID NO: 41216

SEQ ID NO: 685151 - RNA, 64 nt, Homo Sapiens; identical to SEQ ID NO: 41217

SEQ ID NO: 685152 - RNA, 64 nt, Homo Sapiens; identical to SEQ ID NO: 41218

SEQ ID NO: 685153 - RNA, 64 nt, Homo Sapiens; identical to SEQ ID NO: 41219

SEQ ID NO: 685154 - RNA, 64 nt, Homo Sapiens; identical to SEQ ID NO: 41220

SEQ ID NO: 685155 - RNA, 64 nt, Homo Sapiens; identical to SEQ ID NO: 41221

SEQ ID NO: 685156 - RNA, 64 nt, Homo Sapiens; identical to SEQ ID NO: 41222

SEQ ID NO: 685157 - RNA, 64 nt, Homo Sapiens; identical to SEQ ID NO: 41223

SEQ ID NO: 685158 - RNA, 64 nt, Homo Sapiens; identical to SEQ ID NO: 41224

SEQ ID NO: 685159 - RNA, 64 nt, Homo Sapiens; identical to SEQ ID NO: 41225

SEQ ID NO: 685160 - RNA, 64 nt, Homo Sapiens; identical to SEQ ID NO: 41226

SEQ ID NO: 685161 - RNA, 64 nt, Homo Sapiens; identical to SEQ ID NO: 41227

SEQ ID NO: 685162 - RNA, 64 nt, Homo Sapiens; identical to SEQ ID NO: 41228

SEQ ID NO: 685163 - RNA, 64 nt, Homo Sapiens; identical to SEQ ID NO: 41229

SEQ ID NO: 685164 - RNA, 64 nt, Homo Sapiens; identical to SEQ ID NO: 41230

SEQ ID NO: 685165 - RNA, 64 nt, Homo Sapiens; identical to SEQ ID NO: 41231

SEQ ID NO: 685166 - RNA, 64 nt, Homo Sapiens; identical to SEQ ID NO: 41232

SEQ ID NO: 685167 - RNA, 64 nt, Homo Sapiens; identical to SEQ ID NO: 41233

SEQ ID NO: 685168 - RNA, 64 nt, Homo Sapiens; identical to SEQ ID NO: 41234

SEQ ID NO: 685169 - RNA, 64 nt, Homo Sapiens; identical to SEQ ID NO: 41235

SEQ ID NO: 685170 - RNA, 62 nt, Homo Sapiens; identical to SEQ ID NO: 41236

SEQ ID NO: 685171 - RNA, 60 nt, Homo Sapiens; identical to SEQ ID NO: 41237

SEQ ID NO: 685172 - RNA, 58 nt, Homo Sapiens; identical to SEQ ID NO: 41238

SEQ ID NO: 685173 - RNA, 56 nt, Homo Sapiens; identical to SEQ ID NO: 41239

SEQ ID NO: 685174 - RNA, 54 nt, Homo Sapiens; identical to SEQ ID NO: 41240

SEQ ID NO: 685175 - RNA, 64 nt, Homo Sapiens; identical to SEQ ID NO: 41241

SEQ ID NO: 685176 - RNA, 64 nt, Homo Sapiens; identical to SEQ ID NO: 41242

SEQ ID NO: 685177 - RNA, 64 nt, Homo Sapiens; identical to SEQ ID NO: 41243

SEQ ID NO: 685178 - RNA, 64 nt, Homo Sapiens; identical to SEQ ID NO: 41244

SEQ ID NO: 685179 - RNA, 64 nt, Homo Sapiens; identical to SEQ ID NO: 41245

SEQ ID NO: 685180 - RNA, 64 nt, Homo Sapiens; identical to SEQ ID NO: 41246

SEQ ID NO: 685181 - RNA, 64 nt, Homo Sapiens; identical to SEQ ID NO: 41247

SEQ ID NO: 685182 - RNA, 64 nt, Homo Sapiens; identical to SEQ ID NO: 41248

SEQ ID NO: 685183 - RNA, 64 nt, Homo Sapiens; identical to SEQ ID NO: 41249

SEQ ID NO: 685184 - RNA, 64 nt, Homo Sapiens; identical to SEQ ID NO: 41250

SEQ ID NO: 685185 - RNA, 64 nt, Homo Sapiens; identical to SEQ ID NO: 41251

SEQ ID NO: 685186 - RNA, 64 nt, Homo Sapiens; identical to SEQ ID NO: 41252

SEQ ID NO: 685187 - RNA, 64 nt, Homo Sapiens; identical to SEQ ID NO: 41253

SEQ ID NO: 685188 - RNA, 64 nt, Homo Sapiens; identical to SEQ ID NO: 41254

SEQ ID NO: 685189 - RNA, 64 nt, Homo Sapiens; identical to SEQ ID NO: 41255

SEQ ID NO: 685190 - RNA, 64 nt, Homo Sapiens; identical to SEQ ID NO: 41256

SEQ ID NO: 685191 - RNA, 64 nt, Homo Sapiens; identical to SEQ ID NO: 41257

SEQ ID NO: 685192 - RNA, 64 nt, Homo Sapiens; identical to SEQ ID NO: 41258

SEQ ID NO: 685193 - RNA, 64 nt, Homo Sapiens; identical to SEQ ID NO: 41259

SEQ ID NO: 685194 - RNA, 64 nt, Homo Sapiens; identical to SEQ ID NO: 41260

SEQ ID NO: 685195 - RNA, 64 nt, Homo Sapiens; identical to SEQ ID NO: 41261

SEQ ID NO: 685196 - RNA, 64 nt, Homo Sapiens; identical to SEQ ID NO: 41262

SEQ ID NO: 685197 - RNA, 64 nt, Homo Sapiens; identical to SEQ ID NO: 41263

SEQ ID NO: 685198 - RNA, 64 nt, Homo Sapiens; identical to SEQ ID NO: 41264

SEQ ID NO: 685199 - RNA, 64 nt, Homo Sapiens; identical to SEQ ID NO: 41265

SEQ ID NO: 685200 - RNA, 64 nt, Homo Sapiens; identical to SEQ ID NO: 41266

SEQ ID NO: 685201 - RNA, 64 nt, Homo Sapiens; identical to SEQ ID NO: 41267

SEQ ID NO: 685202 - RNA, 64 nt, Homo Sapiens; identical to SEQ ID NO: 41268

SEQ ID NO: 685203 - RNA, 64 nt, Homo Sapiens; identical to SEQ ID NO: 41269

SEQ ID NO: 685204 - RNA, 64 nt, Homo Sapiens; identical to SEQ ID NO: 41270

SEQ ID NO: 685205 - RNA, 64 nt, Homo Sapiens; identical to SEQ ID NO: 41271

SEQ ID NO: 685206 - RNA, 64 nt, Homo Sapiens; identical to SEQ ID NO: 41272

SEQ ID NO: 685207 - RNA, 64 nt, Homo Sapiens; identical to SEQ ID NO: 41273

SEQ ID NO: 685208 - RNA, 64 nt, Homo Sapiens; identical to SEQ ID NO: 41274

SEQ ID NO: 685209 - RNA, 64 nt, Homo Sapiens; identical to SEQ ID NO: 41275

SEQ ID NO: 685210 - RNA, 64 nt, Homo Sapiens; identical to SEQ ID NO: 41276

SEQ ID NO: 685211 - RNA, 64 nt, Homo Sapiens; identical to SEQ ID NO: 41277

SEQ ID NO: 685212 - RNA, 64 nt, Homo Sapiens; identical to SEQ ID NO: 41278

SEQ ID NO: 685213 - RNA, 64 nt, Homo Sapiens; identical to SEQ ID NO: 41279

SEQ ID NO: 685214 - RNA, 64 nt, Homo Sapiens; identical to SEQ ID NO: 41280

SEQ ID NO: 685215 - RNA, 64 nt, Homo Sapiens; identical to SEQ ID NO: 41281

SEQ ID NO: 685216 - RNA, 64 nt, Homo Sapiens; identical to SEQ ID NO: 41282

SEQ ID NO: 685217 - RNA, 64 nt, Homo Sapiens; identical to SEQ ID NO: 41283

SEQ ID NO: 685218 - RNA, 64 nt, Homo Sapiens; identical to SEQ ID NO: 41284

SEQ ID NO: 685219 - RNA, 64 nt, Homo Sapiens; identical to SEQ ID NO: 41285

SEQ ID NO: 685220 - RNA, 64 nt, Homo Sapiens; identical to SEQ ID NO: 41286

SEQ ID NO: 685221 - RNA, 64 nt, Homo Sapiens; identical to SEQ ID NO: 41287

SEQ ID NO: 685222 - RNA, 64 nt, Homo Sapiens; identical to SEQ ID NO: 41288

SEQ ID NO: 685223 - RNA, 64 nt, Homo Sapiens; identical to SEQ ID NO: 41289

SEQ ID NO: 685224 - RNA, 64 nt, Homo Sapiens; identical to SEQ ID NO: 41290

SEQ ID NO: 685225 - RNA, 64 nt, Homo Sapiens; identical to SEQ ID NO: 41291

SEQ ID NO: 685226 - RNA, 64 nt, Homo Sapiens; identical to SEQ ID NO: 41292

SEQ ID NO: 685227 - RNA, 64 nt, Homo Sapiens; identical to SEQ ID NO: 41293

SEQ ID NO: 685228 - RNA, 64 nt, Homo Sapiens; identical to SEQ ID NO: 41294

SEQ ID NO: 685229 - RNA, 64 nt, Homo Sapiens; identical to SEQ ID NO: 41295

SEQ ID NO: 685230 - RNA, 64 nt, Homo Sapiens; identical to SEQ ID NO: 41296

SEQ ID NO: 685231 - RNA, 64 nt, Homo Sapiens; identical to SEQ ID NO: 41297

SEQ ID NO: 685232 - RNA, 64 nt, Homo Sapiens; identical to SEQ ID NO: 41298

SEQ ID NO: 685233 - RNA, 64 nt, Homo Sapiens; identical to SEQ ID NO: 41299

SEQ ID NO: 685234 - RNA, 64 nt, Homo Sapiens; identical to SEQ ID NO: 41300

SEQ ID NO: 685235 - RNA, 64 nt, Homo Sapiens; identical to SEQ ID NO: 41301

SEQ ID NO: 685236 - RNA, 64 nt, Homo Sapiens; identical to SEQ ID NO: 41302

SEQ ID NO: 685237 - RNA, 64 nt, Homo Sapiens; identical to SEQ ID NO: 41303

SEQ ID NO: 685238 - RNA, 64 nt, Homo Sapiens; identical to SEQ ID NO: 41304

SEQ ID NO: 685239 - RNA, 64 nt, Homo Sapiens; identical to SEQ ID NO: 41305

SEQ ID NO: 685240 - RNA, 64 nt, Homo Sapiens; identical to SEQ ID NO: 41306

SEQ ID NO: 685241 - RNA, 64 nt, Homo Sapiens; identical to SEQ ID NO: 41307

SEQ ID NO: 685242 - RNA, 64 nt, Homo Sapiens; identical to SEQ ID NO: 41308

SEQ ID NO: 685243 - RNA, 64 nt, Homo Sapiens; identical to SEQ ID NO: 41309

SEQ ID NO: 685244 - RNA, 64 nt, Homo Sapiens; identical to SEQ ID NO: 41310

SEQ ID NO: 685245 - RNA, 64 nt, Homo Sapiens; identical to SEQ ID NO: 41311

SEQ ID NO: 685246 - RNA, 64 nt, Homo Sapiens; identical to SEQ ID NO: 41312

SEQ ID NO: 685247 - RNA, 64 nt, Homo Sapiens; identical to SEQ ID NO: 41313

SEQ ID NO: 685248 - RNA, 64 nt, Homo Sapiens; identical to SEQ ID NO: 41314

SEQ ID NO: 685249 - RNA, 64 nt, Homo Sapiens; identical to SEQ ID NO: 41315

SEQ ID NO: 685250 - RNA, 64 nt, Homo Sapiens; identical to SEQ ID NO: 41316

SEQ ID NO: 685251 - RNA, 64 nt, Homo Sapiens; identical to SEQ ID NO: 41317

SEQ ID NO: 685252 - RNA, 64 nt, Homo Sapiens; identical to SEQ ID NO: 41318

SEQ ID NO: 685253 - RNA, 64 nt, Homo Sapiens; identical to SEQ ID NO: 41319

SEQ ID NO: 685254 - RNA, 64 nt, Homo Sapiens; identical to SEQ ID NO: 41320

SEQ ID NO: 685255 - RNA, 64 nt, Homo Sapiens; identical to SEQ ID NO: 41321

SEQ ID NO: 685256 - RNA, 64 nt, Homo Sapiens; identical to SEQ ID NO: 41322

SEQ ID NO: 685257 - RNA, 64 nt, Homo Sapiens; identical to SEQ ID NO: 41323

SEQ ID NO: 685258 - RNA, 64 nt, Homo Sapiens; identical to SEQ ID NO: 41324

SEQ ID NO: 685259 - RNA, 64 nt, Homo Sapiens; identical to SEQ ID NO: 41325

SEQ ID NO: 685260 - RNA, 64 nt, Homo Sapiens; identical to SEQ ID NO: 41326

SEQ ID NO: 685261 - RNA, 64 nt, Homo Sapiens; identical to SEQ ID NO: 41327

SEQ ID NO: 685262 - RNA, 64 nt, Homo Sapiens; identical to SEQ ID NO: 41328

SEQ ID NO: 685263 - RNA, 64 nt, Homo Sapiens; identical to SEQ ID NO: 41329

SEQ ID NO: 685264 - RNA, 64 nt, Homo Sapiens; identical to SEQ ID NO: 41330

SEQ ID NO: 685265 - RNA, 64 nt, Homo Sapiens; identical to SEQ ID NO: 41331

SEQ ID NO: 685266 - RNA, 64 nt, Homo Sapiens; identical to SEQ ID NO: 41332

SEQ ID NO: 685267 - RNA, 64 nt, Homo Sapiens; identical to SEQ ID NO: 41333

SEQ ID NO: 685268 - RNA, 64 nt, Homo Sapiens; identical to SEQ ID NO: 41334

SEQ ID NO: 685269 - RNA, 64 nt, Homo Sapiens; identical to SEQ ID NO: 41335

SEQ ID NO: 685270 - RNA, 64 nt, Homo Sapiens; identical to SEQ ID NO: 41336

SEQ ID NO: 685271 - RNA, 64 nt, Homo Sapiens; identical to SEQ ID NO: 41337

SEQ ID NO: 685272 - RNA, 64 nt, Homo Sapiens; identical to SEQ ID NO: 41338

SEQ ID NO: 685273 - RNA, 64 nt, Homo Sapiens; identical to SEQ ID NO: 41339

SEQ ID NO: 685274 - RNA, 64 nt, Homo Sapiens; identical to SEQ ID NO: 41340

SEQ ID NO: 685275 - RNA, 64 nt, Homo Sapiens; identical to SEQ ID NO: 41341

SEQ ID NO: 685276 - RNA, 64 nt, Homo Sapiens; identical to SEQ ID NO: 41342

SEQ ID NO: 685277 - RNA, 64 nt, Homo Sapiens; identical to SEQ ID NO: 41343

SEQ ID NO: 685278 - RNA, 64 nt, Homo Sapiens; identical to SEQ ID NO: 41344

SEQ ID NO: 685279 - RNA, 64 nt, Homo Sapiens; identical to SEQ ID NO: 41345

SEQ ID NO: 685280 - RNA, 64 nt, Homo Sapiens; identical to SEQ ID NO: 41346

SEQ ID NO: 685281 - RNA, 64 nt, Homo Sapiens; identical to SEQ ID NO: 41347

SEQ ID NO: 685282 - RNA, 64 nt, Homo Sapiens; identical to SEQ ID NO: 41348

SEQ ID NO: 685283 - RNA, 64 nt, Homo Sapiens; identical to SEQ ID NO: 41349

SEQ ID NO: 685284 - RNA, 64 nt, Homo Sapiens; identical to SEQ ID NO: 41350

SEQ ID NO: 685285 - RNA, 64 nt, Homo Sapiens; identical to SEQ ID NO: 41351

SEQ ID NO: 685286 - RNA, 64 nt, Homo Sapiens; identical to SEQ ID NO: 41352

SEQ ID NO: 685287 - RNA, 64 nt, Homo Sapiens; identical to SEQ ID NO: 41353

SEQ ID NO: 685288 - RNA, 64 nt, Homo Sapiens; identical to SEQ ID NO: 41354

SEQ ID NO: 685289 - RNA, 64 nt, Homo Sapiens; identical to SEQ ID NO: 41355

SEQ ID NO: 685290 - RNA, 64 nt, Homo Sapiens; identical to SEQ ID NO: 41356

SEQ ID NO: 685291 - RNA, 64 nt, Homo Sapiens; identical to SEQ ID NO: 41357

SEQ ID NO: 685292 - RNA, 64 nt, Homo Sapiens; identical to SEQ ID NO: 41358

SEQ ID NO: 685293 - RNA, 64 nt, Homo Sapiens; identical to SEQ ID NO: 41359

SEQ ID NO: 685294 - RNA, 64 nt, Homo Sapiens; identical to SEQ ID NO: 41360

SEQ ID NO: 685295 - RNA, 64 nt, Homo Sapiens; identical to SEQ ID NO: 41361

SEQ ID NO: 685296 - RNA, 64 nt, Homo Sapiens; identical to SEQ ID NO: 41362

SEQ ID NO: 685297 - RNA, 64 nt, Homo Sapiens; identical to SEQ ID NO: 41363

SEQ ID NO: 685298 - RNA, 64 nt, Homo Sapiens; identical to SEQ ID NO: 41364

SEQ ID NO: 685299 - RNA, 64 nt, Homo Sapiens; identical to SEQ ID NO: 41365

SEQ ID NO: 685300 - RNA, 64 nt, Homo Sapiens; identical to SEQ ID NO: 41366

SEQ ID NO: 685301 - RNA, 64 nt, Homo Sapiens; identical to SEQ ID NO: 41367

SEQ ID NO: 685302 - RNA, 64 nt, Homo Sapiens; identical to SEQ ID NO: 41368

SEQ ID NO: 685303 - RNA, 64 nt, Homo Sapiens; identical to SEQ ID NO: 41369

SEQ ID NO: 685304 - RNA, 64 nt, Homo Sapiens; identical to SEQ ID NO: 41370

SEQ ID NO: 685305 - RNA, 64 nt, Homo Sapiens; identical to SEQ ID NO: 41371

SEQ ID NO: 685306 - RNA, 64 nt, Homo Sapiens; identical to SEQ ID NO: 41372

SEQ ID NO: 685307 - RNA, 64 nt, Homo Sapiens; identical to SEQ ID NO: 41373

SEQ ID NO: 685308 - RNA, 64 nt, Homo Sapiens; identical to SEQ ID NO: 41374

SEQ ID NO: 685309 - RNA, 64 nt, Homo Sapiens; identical to SEQ ID NO: 41375

SEQ ID NO: 685310 - RNA, 64 nt, Homo Sapiens; identical to SEQ ID NO: 41376

SEQ ID NO: 685311 - RNA, 64 nt, Homo Sapiens; identical to SEQ ID NO: 41377

SEQ ID NO: 685312 - RNA, 64 nt, Homo Sapiens; identical to SEQ ID NO: 41378

SEQ ID NO: 685313 - RNA, 64 nt, Homo Sapiens; identical to SEQ ID NO: 41379

SEQ ID NO: 685314 - RNA, 64 nt, Homo Sapiens; identical to SEQ ID NO: 41380

SEQ ID NO: 685315 - RNA, 64 nt, Homo Sapiens; identical to SEQ ID NO: 41381

SEQ ID NO: 685316 - RNA, 64 nt, Homo Sapiens; identical to SEQ ID NO: 41382

SEQ ID NO: 685317 - RNA, 64 nt, Homo Sapiens; identical to SEQ ID NO: 41383

SEQ ID NO: 685318 - RNA, 64 nt, Homo Sapiens; identical to SEQ ID NO: 41384

SEQ ID NO: 685319 - RNA, 64 nt, Homo Sapiens; identical to SEQ ID NO: 41385

SEQ ID NO: 685320 - RNA, 64 nt, Homo Sapiens; identical to SEQ ID NO: 41386

SEQ ID NO: 685321 - RNA, 64 nt, Homo Sapiens; identical to SEQ ID NO: 41387

SEQ ID NO: 685322 - RNA, 64 nt, Homo Sapiens; identical to SEQ ID NO: 41388

SEQ ID NO: 685323 - RNA, 64 nt, Homo Sapiens; identical to SEQ ID NO: 41389

SEQ ID NO: 685324 - RNA, 64 nt, Homo Sapiens; identical to SEQ ID NO: 41390

SEQ ID NO: 685325 - RNA, 64 nt, Homo Sapiens; identical to SEQ ID NO: 41391

SEQ ID NO: 685326 - RNA, 64 nt, Homo Sapiens; identical to SEQ ID NO: 41392

SEQ ID NO: 685327 - RNA, 64 nt, Homo Sapiens; identical to SEQ ID NO: 41393

SEQ ID NO: 685328 - RNA, 64 nt, Homo Sapiens; identical to SEQ ID NO: 41394

SEQ ID NO: 685329 - RNA, 64 nt, Homo Sapiens; identical to SEQ ID NO: 41395

SEQ ID NO: 685330 - RNA, 64 nt, Homo Sapiens; identical to SEQ ID NO: 41396

SEQ ID NO: 685331 - RNA, 64 nt, Homo Sapiens; identical to SEQ ID NO: 41397

SEQ ID NO: 685332 - RNA, 64 nt, Homo Sapiens; identical to SEQ ID NO: 41398

SEQ ID NO: 685333 - RNA, 64 nt, Homo Sapiens; identical to SEQ ID NO: 41399

SEQ ID NO: 685334 - RNA, 64 nt, Homo Sapiens; identical to SEQ ID NO: 41400

SEQ ID NO: 685335 - RNA, 64 nt, Homo Sapiens; identical to SEQ ID NO: 41401

SEQ ID NO: 685336 - RNA, 64 nt, Homo Sapiens; identical to SEQ ID NO: 41402

SEQ ID NO: 685337 - RNA, 64 nt, Homo Sapiens; identical to SEQ ID NO: 41403

SEQ ID NO: 685338 - RNA, 64 nt, Homo Sapiens; identical to SEQ ID NO: 41404

SEQ ID NO: 685339 - RNA, 64 nt, Homo Sapiens; identical to SEQ ID NO: 41405

SEQ ID NO: 685340 - RNA, 64 nt, Homo Sapiens; identical to SEQ ID NO: 41406

SEQ ID NO: 685341 - RNA, 64 nt, Homo Sapiens; identical to SEQ ID NO: 41407

SEQ ID NO: 685342 - RNA, 64 nt, Homo Sapiens; identical to SEQ ID NO: 41408

SEQ ID NO: 685343 - RNA, 64 nt, Homo Sapiens; identical to SEQ ID NO: 41409

SEQ ID NO: 685344 - RNA, 64 nt, Homo Sapiens; identical to SEQ ID NO: 41410

SEQ ID NO: 685345 - RNA, 64 nt, Homo Sapiens; identical to SEQ ID NO: 41411

SEQ ID NO: 685346 - RNA, 64 nt, Homo Sapiens; identical to SEQ ID NO: 41412

SEQ ID NO: 685347 - RNA, 64 nt, Homo Sapiens; identical to SEQ ID NO: 41413

SEQ ID NO: 685348 - RNA, 64 nt, Homo Sapiens; identical to SEQ ID NO: 41414

SEQ ID NO: 685349 - RNA, 64 nt, Homo Sapiens; identical to SEQ ID NO: 41415

SEQ ID NO: 685350 - RNA, 64 nt, Homo Sapiens; identical to SEQ ID NO: 41416

SEQ ID NO: 685351 - RNA, 64 nt, Homo Sapiens; identical to SEQ ID NO: 41417

SEQ ID NO: 685352 - RNA, 64 nt, Homo Sapiens; identical to SEQ ID NO: 41418

SEQ ID NO: 685353 - RNA, 64 nt, Homo Sapiens; identical to SEQ ID NO: 41419

SEQ ID NO: 685354 - RNA, 64 nt, Homo Sapiens; identical to SEQ ID NO: 41420

SEQ ID NO: 685355 - RNA, 64 nt, Homo Sapiens; identical to SEQ ID NO: 41421

SEQ ID NO: 685356 - RNA, 64 nt, Homo Sapiens; identical to SEQ ID NO: 41422

SEQ ID NO: 685357 - RNA, 64 nt, Homo Sapiens; identical to SEQ ID NO: 41423

SEQ ID NO: 685358 - RNA, 64 nt, Homo Sapiens; identical to SEQ ID NO: 41424

SEQ ID NO: 685359 - RNA, 64 nt, Homo Sapiens; identical to SEQ ID NO: 41425

SEQ ID NO: 685360 - RNA, 64 nt, Homo Sapiens; identical to SEQ ID NO: 41426

SEQ ID NO: 685361 - RNA, 64 nt, Homo Sapiens; identical to SEQ ID NO: 41427

SEQ ID NO: 685362 - RNA, 64 nt, Homo Sapiens; identical to SEQ ID NO: 41428

SEQ ID NO: 685363 - RNA, 64 nt, Homo Sapiens; identical to SEQ ID NO: 41429

SEQ ID NO: 685364 - RNA, 64 nt, Homo Sapiens; identical to SEQ ID NO: 41430

SEQ ID NO: 685365 - RNA, 64 nt, Homo Sapiens; identical to SEQ ID NO: 41431

SEQ ID NO: 685366 - RNA, 64 nt, Homo Sapiens; identical to SEQ ID NO: 41432

SEQ ID NO: 685367 - RNA, 64 nt, Homo Sapiens; identical to SEQ ID NO: 41433

SEQ ID NO: 685368 - RNA, 64 nt, Homo Sapiens; identical to SEQ ID NO: 41434

SEQ ID NO: 685369 - RNA, 64 nt, Homo Sapiens; identical to SEQ ID NO: 41435

SEQ ID NO: 685370 - RNA, 64 nt, Homo Sapiens; identical to SEQ ID NO: 41436

SEQ ID NO: 685371 - RNA, 64 nt, Homo Sapiens; identical to SEQ ID NO: 41437

SEQ ID NO: 685372 - RNA, 64 nt, Homo Sapiens; identical to SEQ ID NO: 41438

SEQ ID NO: 685373 - RNA, 64 nt, Homo Sapiens; identical to SEQ ID NO: 41439

SEQ ID NO: 685374 - RNA, 64 nt, Homo Sapiens; identical to SEQ ID NO: 41440

SEQ ID NO: 685375 - RNA, 64 nt, Homo Sapiens; identical to SEQ ID NO: 41441

SEQ ID NO: 685376 - RNA, 64 nt, Homo Sapiens; identical to SEQ ID NO: 41442

SEQ ID NO: 685377 - RNA, 64 nt, Homo Sapiens; identical to SEQ ID NO: 41443

SEQ ID NO: 685378 - RNA, 64 nt, Homo Sapiens; identical to SEQ ID NO: 41444

SEQ ID NO: 685379 - RNA, 64 nt, Homo Sapiens; identical to SEQ ID NO: 41445

SEQ ID NO: 685380 - RNA, 64 nt, Homo Sapiens; identical to SEQ ID NO: 41446

SEQ ID NO: 685381 - RNA, 64 nt, Homo Sapiens; identical to SEQ ID NO: 41447

SEQ ID NO: 685382 - RNA, 64 nt, Homo Sapiens; identical to SEQ ID NO: 41448

SEQ ID NO: 685383 - RNA, 64 nt, Homo Sapiens; identical to SEQ ID NO: 41449

SEQ ID NO: 685384 - RNA, 64 nt, Homo Sapiens; identical to SEQ ID NO: 41450

SEQ ID NO: 685385 - RNA, 64 nt, Homo Sapiens; identical to SEQ ID NO: 41451

SEQ ID NO: 685386 - RNA, 64 nt, Homo Sapiens; identical to SEQ ID NO: 41452

SEQ ID NO: 685387 - RNA, 64 nt, Homo Sapiens; identical to SEQ ID NO: 41453

SEQ ID NO: 685388 - RNA, 64 nt, Homo Sapiens; identical to SEQ ID NO: 41454

SEQ ID NO: 685389 - RNA, 64 nt, Homo Sapiens; identical to SEQ ID NO: 41455

SEQ ID NO: 685390 - RNA, 64 nt, Homo Sapiens; identical to SEQ ID NO: 41456

SEQ ID NO: 685391 - RNA, 64 nt, Homo Sapiens; identical to SEQ ID NO: 41457

SEQ ID NO: 685392 - RNA, 64 nt, Homo Sapiens; identical to SEQ ID NO: 41458

SEQ ID NO: 685393 - RNA, 64 nt, Homo Sapiens; identical to SEQ ID NO: 41459

SEQ ID NO: 685394 - RNA, 64 nt, Homo Sapiens; identical to SEQ ID NO: 41460

SEQ ID NO: 685395 - RNA, 64 nt, Homo Sapiens; identical to SEQ ID NO: 41461

SEQ ID NO: 685396 - RNA, 64 nt, Homo Sapiens; identical to SEQ ID NO: 41462

SEQ ID NO: 685397 - RNA, 64 nt, Homo Sapiens; identical to SEQ ID NO: 41463

SEQ ID NO: 685398 - RNA, 64 nt, Homo Sapiens; identical to SEQ ID NO: 41464

SEQ ID NO: 685399 - RNA, 64 nt, Homo Sapiens; identical to SEQ ID NO: 41465

SEQ ID NO: 685400 - RNA, 64 nt, Homo Sapiens; identical to SEQ ID NO: 41466

SEQ ID NO: 685401 - RNA, 64 nt, Homo Sapiens; identical to SEQ ID NO: 41467

SEQ ID NO: 685402 - RNA, 64 nt, Homo Sapiens; identical to SEQ ID NO: 41468

SEQ ID NO: 685403 - RNA, 64 nt, Homo Sapiens; identical to SEQ ID NO: 41469

SEQ ID NO: 685404 - RNA, 64 nt, Homo Sapiens; identical to SEQ ID NO: 41470

SEQ ID NO: 685405 - RNA, 64 nt, Homo Sapiens; identical to SEQ ID NO: 41471

SEQ ID NO: 685406 - RNA, 64 nt, Homo Sapiens; identical to SEQ ID NO: 41472

SEQ ID NO: 685407 - RNA, 64 nt, Homo Sapiens; identical to SEQ ID NO: 41473

SEQ ID NO: 685408 - RNA, 64 nt, Homo Sapiens; identical to SEQ ID NO: 41474

SEQ ID NO: 685409 - RNA, 64 nt, Homo Sapiens; identical to SEQ ID NO: 41475

SEQ ID NO: 685410 - RNA, 64 nt, Homo Sapiens; identical to SEQ ID NO: 41476

SEQ ID NO: 685411 - RNA, 64 nt, Homo Sapiens; identical to SEQ ID NO: 41477

SEQ ID NO: 685412 - RNA, 64 nt, Homo Sapiens; identical to SEQ ID NO: 41478

SEQ ID NO: 685413 - RNA, 64 nt, Homo Sapiens; identical to SEQ ID NO: 41479

SEQ ID NO: 685414 - RNA, 64 nt, Homo Sapiens; identical to SEQ ID NO: 41480

SEQ ID NO: 685415 - RNA, 64 nt, Homo Sapiens; identical to SEQ ID NO: 41481

SEQ ID NO: 685416 - RNA, 64 nt, Homo Sapiens; identical to SEQ ID NO: 41482

SEQ ID NO: 685417 - RNA, 64 nt, Homo Sapiens; identical to SEQ ID NO: 41483

SEQ ID NO: 685418 - RNA, 64 nt, Homo Sapiens; identical to SEQ ID NO: 41484

SEQ ID NO: 685419 - RNA, 64 nt, Homo Sapiens; identical to SEQ ID NO: 41485

SEQ ID NO: 685420 - RNA, 64 nt, Homo Sapiens; identical to SEQ ID NO: 41486

SEQ ID NO: 685421 - RNA, 64 nt, Homo Sapiens; identical to SEQ ID NO: 41487

SEQ ID NO: 685422 - RNA, 64 nt, Homo Sapiens; identical to SEQ ID NO: 41488

SEQ ID NO: 685423 - RNA, 64 nt, Homo Sapiens; identical to SEQ ID NO: 41489

SEQ ID NO: 685424 - RNA, 64 nt, Homo Sapiens; identical to SEQ ID NO: 41490

SEQ ID NO: 685425 - RNA, 64 nt, Homo Sapiens; identical to SEQ ID NO: 41491

SEQ ID NO: 685426 - RNA, 64 nt, Homo Sapiens; identical to SEQ ID NO: 41492

SEQ ID NO: 685427 - RNA, 64 nt, Homo Sapiens; identical to SEQ ID NO: 41493

SEQ ID NO: 685428 - RNA, 64 nt, Homo Sapiens; identical to SEQ ID NO: 41494

SEQ ID NO: 685429 - RNA, 64 nt, Homo Sapiens; identical to SEQ ID NO: 41495

SEQ ID NO: 685430 - RNA, 64 nt, Homo Sapiens; identical to SEQ ID NO: 41496

SEQ ID NO: 685431 - RNA, 64 nt, Homo Sapiens; identical to SEQ ID NO: 41497

SEQ ID NO: 685432 - RNA, 64 nt, Homo Sapiens; identical to SEQ ID NO: 41498

SEQ ID NO: 685433 - RNA, 64 nt, Homo Sapiens; identical to SEQ ID NO: 41499

SEQ ID NO: 685434 - RNA, 64 nt, Homo Sapiens; identical to SEQ ID NO: 41500

SEQ ID NO: 685435 - RNA, 64 nt, Homo Sapiens; identical to SEQ ID NO: 41501

SEQ ID NO: 685436 - RNA, 64 nt, Homo Sapiens; identical to SEQ ID NO: 41502

SEQ ID NO: 685437 - RNA, 64 nt, Homo Sapiens; identical to SEQ ID NO: 41503

SEQ ID NO: 685438 - RNA, 64 nt, Homo Sapiens; identical to SEQ ID NO: 41504

SEQ ID NO: 685439 - RNA, 64 nt, Homo Sapiens; identical to SEQ ID NO: 41505

SEQ ID NO: 685440 - RNA, 64 nt, Homo Sapiens; identical to SEQ ID NO: 41506

SEQ ID NO: 685441 - RNA, 64 nt, Homo Sapiens; identical to SEQ ID NO: 41507

SEQ ID NO: 685442 - RNA, 64 nt, Homo Sapiens; identical to SEQ ID NO: 41508

SEQ ID NO: 685443 - RNA, 64 nt, Homo Sapiens; identical to SEQ ID NO: 41509

SEQ ID NO: 685444 - RNA, 64 nt, Homo Sapiens; identical to SEQ ID NO: 41510

SEQ ID NO: 685445 - RNA, 64 nt, Homo Sapiens; identical to SEQ ID NO: 41511

SEQ ID NO: 685446 - RNA, 64 nt, Homo Sapiens; identical to SEQ ID NO: 41512

SEQ ID NO: 685447 - RNA, 64 nt, Homo Sapiens; identical to SEQ ID NO: 41513

SEQ ID NO: 685448 - RNA, 64 nt, Homo Sapiens; identical to SEQ ID NO: 41514

SEQ ID NO: 685449 - RNA, 64 nt, Homo Sapiens; identical to SEQ ID NO: 41515

SEQ ID NO: 685450 - RNA, 64 nt, Homo Sapiens; identical to SEQ ID NO: 41516

SEQ ID NO: 685451 - RNA, 64 nt, Homo Sapiens; identical to SEQ ID NO: 41517

SEQ ID NO: 685452 - RNA, 64 nt, Homo Sapiens; identical to SEQ ID NO: 41518

SEQ ID NO: 685453 - RNA, 64 nt, Homo Sapiens; identical to SEQ ID NO: 41519

SEQ ID NO: 685454 - RNA, 64 nt, Homo Sapiens; identical to SEQ ID NO: 41520

SEQ ID NO: 685455 - RNA, 64 nt, Homo Sapiens; identical to SEQ ID NO: 41521

SEQ ID NO: 685456 - RNA, 64 nt, Homo Sapiens; identical to SEQ ID NO: 41522

SEQ ID NO: 685457 - RNA, 64 nt, Homo Sapiens; identical to SEQ ID NO: 41523

SEQ ID NO: 685458 - RNA, 64 nt, Homo Sapiens; identical to SEQ ID NO: 41524

SEQ ID NO: 685459 - RNA, 64 nt, Homo Sapiens; identical to SEQ ID NO: 41525

SEQ ID NO: 685460 - RNA, 64 nt, Homo Sapiens; identical to SEQ ID NO: 41526

SEQ ID NO: 685461 - RNA, 64 nt, Homo Sapiens; identical to SEQ ID NO: 41527

SEQ ID NO: 685462 - RNA, 64 nt, Homo Sapiens; identical to SEQ ID NO: 41528

SEQ ID NO: 685463 - RNA, 64 nt, Homo Sapiens; identical to SEQ ID NO: 41529

SEQ ID NO: 685464 - RNA, 64 nt, Homo Sapiens; identical to SEQ ID NO: 41530

SEQ ID NO: 685465 - RNA, 64 nt, Homo Sapiens; identical to SEQ ID NO: 41531

SEQ ID NO: 685466 - RNA, 64 nt, Homo Sapiens; identical to SEQ ID NO: 41532

SEQ ID NO: 685467 - RNA, 64 nt, Homo Sapiens; identical to SEQ ID NO: 41533

SEQ ID NO: 685468 - RNA, 64 nt, Homo Sapiens; identical to SEQ ID NO: 41534

SEQ ID NO: 685469 - RNA, 64 nt, Homo Sapiens; identical to SEQ ID NO: 41535

SEQ ID NO: 685470 - RNA, 64 nt, Homo Sapiens; identical to SEQ ID NO: 41536

SEQ ID NO: 685471 - RNA, 64 nt, Homo Sapiens; identical to SEQ ID NO: 41537

SEQ ID NO: 685472 - RNA, 64 nt, Homo Sapiens; identical to SEQ ID NO: 41538

SEQ ID NO: 685473 - RNA, 64 nt, Homo Sapiens; identical to SEQ ID NO: 41539

SEQ ID NO: 685474 - RNA, 64 nt, Homo Sapiens; identical to SEQ ID NO: 41540

SEQ ID NO: 685475 - RNA, 64 nt, Homo Sapiens; identical to SEQ ID NO: 41541

SEQ ID NO: 685476 - RNA, 64 nt, Homo Sapiens; identical to SEQ ID NO: 41542

SEQ ID NO: 685477 - RNA, 64 nt, Homo Sapiens; identical to SEQ ID NO: 41543

SEQ ID NO: 685478 - RNA, 64 nt, Homo Sapiens; identical to SEQ ID NO: 41544

SEQ ID NO: 685479 - RNA, 64 nt, Homo Sapiens; identical to SEQ ID NO: 41545

SEQ ID NO: 685480 - RNA, 64 nt, Homo Sapiens; identical to SEQ ID NO: 41546

SEQ ID NO: 685481 - RNA, 64 nt, Homo Sapiens; identical to SEQ ID NO: 41547

SEQ ID NO: 685482 - RNA, 64 nt, Homo Sapiens; identical to SEQ ID NO: 41548

SEQ ID NO: 685483 - RNA, 64 nt, Homo Sapiens; identical to SEQ ID NO: 41549

SEQ ID NO: 685484 - RNA, 64 nt, Homo Sapiens; identical to SEQ ID NO: 41550

SEQ ID NO: 685485 - RNA, 64 nt, Homo Sapiens; identical to SEQ ID NO: 41551

SEQ ID NO: 685486 - RNA, 64 nt, Homo Sapiens; identical to SEQ ID NO: 41552

SEQ ID NO: 685487 - RNA, 64 nt, Homo Sapiens; identical to SEQ ID NO: 41553

SEQ ID NO: 685488 - RNA, 64 nt, Homo Sapiens; identical to SEQ ID NO: 41554

SEQ ID NO: 685489 - RNA, 64 nt, Homo Sapiens; identical to SEQ ID NO: 41555

SEQ ID NO: 685490 - RNA, 64 nt, Homo Sapiens; identical to SEQ ID NO: 41556

SEQ ID NO: 685491 - RNA, 64 nt, Homo Sapiens; identical to SEQ ID NO: 41557

SEQ ID NO: 685492 - RNA, 64 nt, Homo Sapiens; identical to SEQ ID NO: 41558

SEQ ID NO: 685493 - RNA, 64 nt, Homo Sapiens; identical to SEQ ID NO: 41559

SEQ ID NO: 685494 - RNA, 64 nt, Homo Sapiens; identical to SEQ ID NO: 41560

SEQ ID NO: 685495 - RNA, 64 nt, Homo Sapiens; identical to SEQ ID NO: 41561

SEQ ID NO: 685496 - RNA, 64 nt, Homo Sapiens; identical to SEQ ID NO: 41562

SEQ ID NO: 685497 - RNA, 64 nt, Homo Sapiens; identical to SEQ ID NO: 41563

SEQ ID NO: 685498 - RNA, 64 nt, Homo Sapiens; identical to SEQ ID NO: 41564

SEQ ID NO: 685499 - RNA, 64 nt, Homo Sapiens; identical to SEQ ID NO: 41565

SEQ ID NO: 685500 - RNA, 64 nt, Homo Sapiens; identical to SEQ ID NO: 41566

SEQ ID NO: 685501 - RNA, 64 nt, Homo Sapiens; identical to SEQ ID NO: 41567

SEQ ID NO: 685502 - RNA, 64 nt, Homo Sapiens; identical to SEQ ID NO: 41568

SEQ ID NO: 685503 - RNA, 64 nt, Homo Sapiens; identical to SEQ ID NO: 41569

SEQ ID NO: 685504 - RNA, 64 nt, Homo Sapiens; identical to SEQ ID NO: 41570

SEQ ID NO: 685505 - RNA, 64 nt, Homo Sapiens; identical to SEQ ID NO: 41571

SEQ ID NO: 685506 - RNA, 64 nt, Homo Sapiens; identical to SEQ ID NO: 41572

SEQ ID NO: 685507 - RNA, 64 nt, Homo Sapiens; identical to SEQ ID NO: 41573

SEQ ID NO: 685508 - RNA, 64 nt, Homo Sapiens; identical to SEQ ID NO: 41574

SEQ ID NO: 685509 - RNA, 64 nt, Homo Sapiens; identical to SEQ ID NO: 41575

SEQ ID NO: 685510 - RNA, 64 nt, Homo Sapiens; identical to SEQ ID NO: 41576

SEQ ID NO: 685511 - RNA, 64 nt, Homo Sapiens; identical to SEQ ID NO: 41577

SEQ ID NO: 685512 - RNA, 64 nt, Homo Sapiens; identical to SEQ ID NO: 41578

SEQ ID NO: 685513 - RNA, 64 nt, Homo Sapiens; identical to SEQ ID NO: 41579

SEQ ID NO: 685514 - RNA, 64 nt, Homo Sapiens; identical to SEQ ID NO: 41580

SEQ ID NO: 685515 - RNA, 64 nt, Homo Sapiens; identical to SEQ ID NO: 41581

SEQ ID NO: 685516 - RNA, 64 nt, Homo Sapiens; identical to SEQ ID NO: 41582

SEQ ID NO: 685517 - RNA, 64 nt, Homo Sapiens; identical to SEQ ID NO: 41583

SEQ ID NO: 685518 - RNA, 64 nt, Homo Sapiens; identical to SEQ ID NO: 41584

SEQ ID NO: 685519 - RNA, 64 nt, Homo Sapiens; identical to SEQ ID NO: 41585

SEQ ID NO: 685520 - RNA, 64 nt, Homo Sapiens; identical to SEQ ID NO: 41586

SEQ ID NO: 685521 - RNA, 64 nt, Homo Sapiens; identical to SEQ ID NO: 41587

SEQ ID NO: 685522 - RNA, 64 nt, Homo Sapiens; identical to SEQ ID NO: 41588

SEQ ID NO: 685523 - RNA, 64 nt, Homo Sapiens; identical to SEQ ID NO: 41589

SEQ ID NO: 685524 - RNA, 64 nt, Homo Sapiens; identical to SEQ ID NO: 41590

SEQ ID NO: 685525 - RNA, 64 nt, Homo Sapiens; identical to SEQ ID NO: 41591

SEQ ID NO: 685526 - RNA, 64 nt, Homo Sapiens; identical to SEQ ID NO: 41592

SEQ ID NO: 685527 - RNA, 64 nt, Homo Sapiens; identical to SEQ ID NO: 41593

SEQ ID NO: 685528 - RNA, 64 nt, Homo Sapiens; identical to SEQ ID NO: 41594

SEQ ID NO: 685529 - RNA, 64 nt, Homo Sapiens; identical to SEQ ID NO: 41595

SEQ ID NO: 685530 - RNA, 64 nt, Homo Sapiens; identical to SEQ ID NO: 41596

SEQ ID NO: 685531 - RNA, 64 nt, Homo Sapiens; identical to SEQ ID NO: 41597

SEQ ID NO: 685532 - RNA, 64 nt, Homo Sapiens; identical to SEQ ID NO: 41598

SEQ ID NO: 685533 - RNA, 64 nt, Homo Sapiens; identical to SEQ ID NO: 41599

SEQ ID NO: 685534 - RNA, 64 nt, Homo Sapiens; identical to SEQ ID NO: 41600

SEQ ID NO: 685535 - RNA, 64 nt, Homo Sapiens; identical to SEQ ID NO: 41601

SEQ ID NO: 685536 - RNA, 64 nt, Homo Sapiens; identical to SEQ ID NO: 41602

SEQ ID NO: 685537 - RNA, 64 nt, Homo Sapiens; identical to SEQ ID NO: 41603

SEQ ID NO: 685538 - RNA, 64 nt, Homo Sapiens; identical to SEQ ID NO: 41604

SEQ ID NO: 685539 - RNA, 64 nt, Homo Sapiens; identical to SEQ ID NO: 41605

SEQ ID NO: 685540 - RNA, 64 nt, Homo Sapiens; identical to SEQ ID NO: 41606

SEQ ID NO: 685541 - RNA, 64 nt, Homo Sapiens; identical to SEQ ID NO: 41607

SEQ ID NO: 685542 - RNA, 64 nt, Homo Sapiens; identical to SEQ ID NO: 41608

SEQ ID NO: 685543 - RNA, 64 nt, Homo Sapiens; identical to SEQ ID NO: 41609

SEQ ID NO: 685544 - RNA, 64 nt, Homo Sapiens; identical to SEQ ID NO: 41610

SEQ ID NO: 685545 - RNA, 64 nt, Homo Sapiens; identical to SEQ ID NO: 41611

SEQ ID NO: 685546 - RNA, 64 nt, Homo Sapiens; identical to SEQ ID NO: 41612

SEQ ID NO: 685547 - RNA, 64 nt, Homo Sapiens; identical to SEQ ID NO: 41613

SEQ ID NO: 685548 - RNA, 64 nt, Homo Sapiens; identical to SEQ ID NO: 41614

SEQ ID NO: 685549 - RNA, 64 nt, Homo Sapiens; identical to SEQ ID NO: 41615

SEQ ID NO: 685550 - RNA, 64 nt, Homo Sapiens; identical to SEQ ID NO: 41616

SEQ ID NO: 685551 - RNA, 64 nt, Homo Sapiens; identical to SEQ ID NO: 41617

SEQ ID NO: 685552 - RNA, 64 nt, Homo Sapiens; identical to SEQ ID NO: 41618

SEQ ID NO: 685553 - RNA, 64 nt, Homo Sapiens; identical to SEQ ID NO: 41619

SEQ ID NO: 685554 - RNA, 64 nt, Homo Sapiens; identical to SEQ ID NO: 41620

SEQ ID NO: 685555 - RNA, 64 nt, Homo Sapiens; identical to SEQ ID NO: 41621

SEQ ID NO: 685556 - RNA, 63 nt, Homo Sapiens; identical to SEQ ID NO: 41622

SEQ ID NO: 685557 - RNA, 64 nt, Homo Sapiens; identical to SEQ ID NO: 41623

SEQ ID NO: 685558 - RNA, 64 nt, Homo Sapiens; identical to SEQ ID NO: 41624

SEQ ID NO: 685559 - RNA, 64 nt, Homo Sapiens; identical to SEQ ID NO: 41625

SEQ ID NO: 685560 - RNA, 64 nt, Homo Sapiens; identical to SEQ ID NO: 41626

SEQ ID NO: 685561 - RNA, 64 nt, Homo Sapiens; identical to SEQ ID NO: 41627

SEQ ID NO: 685562 - RNA, 64 nt, Homo Sapiens; identical to SEQ ID NO: 41628

SEQ ID NO: 685563 - RNA, 64 nt, Homo Sapiens; identical to SEQ ID NO: 41629

SEQ ID NO: 685564 - RNA, 64 nt, Homo Sapiens; identical to SEQ ID NO: 41630

SEQ ID NO: 685565 - RNA, 64 nt, Homo Sapiens; identical to SEQ ID NO: 41631

SEQ ID NO: 685566 - RNA, 64 nt, Homo Sapiens; identical to SEQ ID NO: 41632

SEQ ID NO: 685567 - RNA, 64 nt, Homo Sapiens; identical to SEQ ID NO: 41633

SEQ ID NO: 685568 - RNA, 64 nt, Homo Sapiens; identical to SEQ ID NO: 41634

SEQ ID NO: 685569 - RNA, 64 nt, Homo Sapiens; identical to SEQ ID NO: 41635

SEQ ID NO: 685570 - RNA, 64 nt, Homo Sapiens; identical to SEQ ID NO: 41636

SEQ ID NO: 685571 - RNA, 64 nt, Homo Sapiens; identical to SEQ ID NO: 41637

SEQ ID NO: 685572 - RNA, 64 nt, Homo Sapiens; identical to SEQ ID NO: 41638

SEQ ID NO: 685573 - RNA, 64 nt, Homo Sapiens; identical to SEQ ID NO: 41639

SEQ ID NO: 685574 - RNA, 64 nt, Homo Sapiens; identical to SEQ ID NO: 41640

SEQ ID NO: 685575 - RNA, 64 nt, Homo Sapiens; identical to SEQ ID NO: 41641

SEQ ID NO: 685576 - RNA, 64 nt, Homo Sapiens; identical to SEQ ID NO: 41642

SEQ ID NO: 685577 - RNA, 64 nt, Homo Sapiens; identical to SEQ ID NO: 41643

SEQ ID NO: 685578 - RNA, 64 nt, Homo Sapiens; identical to SEQ ID NO: 41644

SEQ ID NO: 685579 - RNA, 64 nt, Homo Sapiens; identical to SEQ ID NO: 41645

SEQ ID NO: 685580 - RNA, 64 nt, Homo Sapiens; identical to SEQ ID NO: 41646

SEQ ID NO: 685581 - RNA, 64 nt, Homo Sapiens; identical to SEQ ID NO: 41647

SEQ ID NO: 685582 - RNA, 64 nt, Homo Sapiens; identical to SEQ ID NO: 41648

SEQ ID NO: 685583 - RNA, 64 nt, Homo Sapiens; identical to SEQ ID NO: 41649

SEQ ID NO: 685584 - RNA, 64 nt, Homo Sapiens; identical to SEQ ID NO: 41650

SEQ ID NO: 685585 - RNA, 64 nt, Homo Sapiens; identical to SEQ ID NO: 41651

SEQ ID NO: 685586 - RNA, 64 nt, Homo Sapiens; identical to SEQ ID NO: 41652

SEQ ID NO: 685587 - RNA, 64 nt, Homo Sapiens; identical to SEQ ID NO: 41653

SEQ ID NO: 685588 - RNA, 64 nt, Homo Sapiens; identical to SEQ ID NO: 41654

SEQ ID NO: 685589 - RNA, 64 nt, Homo Sapiens; identical to SEQ ID NO: 41655

SEQ ID NO: 685590 - RNA, 64 nt, Homo Sapiens; identical to SEQ ID NO: 41656

SEQ ID NO: 685591 - RNA, 64 nt, Homo Sapiens; identical to SEQ ID NO: 41657

SEQ ID NO: 685592 - RNA, 64 nt, Homo Sapiens; identical to SEQ ID NO: 41658

SEQ ID NO: 685593 - RNA, 64 nt, Homo Sapiens; identical to SEQ ID NO: 41659

SEQ ID NO: 685594 - RNA, 64 nt, Homo Sapiens; identical to SEQ ID NO: 41660

SEQ ID NO: 685595 - RNA, 64 nt, Homo Sapiens; identical to SEQ ID NO: 41661

SEQ ID NO: 685596 - RNA, 64 nt, Homo Sapiens; identical to SEQ ID NO: 41662

SEQ ID NO: 685597 - RNA, 64 nt, Homo Sapiens; identical to SEQ ID NO: 41663

SEQ ID NO: 685598 - RNA, 64 nt, Homo Sapiens; identical to SEQ ID NO: 41664

SEQ ID NO: 685599 - RNA, 64 nt, Homo Sapiens; identical to SEQ ID NO: 41665

SEQ ID NO: 685600 - RNA, 64 nt, Homo Sapiens; identical to SEQ ID NO: 41666

SEQ ID NO: 685601 - RNA, 64 nt, Homo Sapiens; identical to SEQ ID NO: 41667

SEQ ID NO: 685602 - RNA, 64 nt, Homo Sapiens; identical to SEQ ID NO: 41668

SEQ ID NO: 685603 - RNA, 64 nt, Homo Sapiens; identical to SEQ ID NO: 41669

SEQ ID NO: 685604 - RNA, 64 nt, Homo Sapiens; identical to SEQ ID NO: 41670

SEQ ID NO: 685605 - RNA, 64 nt, Homo Sapiens; identical to SEQ ID NO: 41671

SEQ ID NO: 685606 - RNA, 64 nt, Homo Sapiens; identical to SEQ ID NO: 41672

SEQ ID NO: 685607 - RNA, 64 nt, Homo Sapiens; identical to SEQ ID NO: 41673

SEQ ID NO: 685608 - RNA, 64 nt, Homo Sapiens; identical to SEQ ID NO: 41674

SEQ ID NO: 685609 - RNA, 64 nt, Homo Sapiens; identical to SEQ ID NO: 41675

SEQ ID NO: 685610 - RNA, 64 nt, Homo Sapiens; identical to SEQ ID NO: 41676

SEQ ID NO: 685611 - RNA, 64 nt, Homo Sapiens; identical to SEQ ID NO: 41677

SEQ ID NO: 685612 - RNA, 64 nt, Homo Sapiens; identical to SEQ ID NO: 41678

SEQ ID NO: 685613 - RNA, 64 nt, Homo Sapiens; identical to SEQ ID NO: 41679

SEQ ID NO: 685614 - RNA, 64 nt, Homo Sapiens; identical to SEQ ID NO: 41680

SEQ ID NO: 685615 - RNA, 64 nt, Homo Sapiens; identical to SEQ ID NO: 41681

SEQ ID NO: 685616 - RNA, 64 nt, Homo Sapiens; identical to SEQ ID NO: 41682

SEQ ID NO: 685617 - RNA, 64 nt, Homo Sapiens; identical to SEQ ID NO: 41683

SEQ ID NO: 685618 - RNA, 64 nt, Homo Sapiens; identical to SEQ ID NO: 41684

SEQ ID NO: 685619 - RNA, 64 nt, Homo Sapiens; identical to SEQ ID NO: 41685

SEQ ID NO: 685620 - RNA, 64 nt, Homo Sapiens; identical to SEQ ID NO: 41686

SEQ ID NO: 685621 - RNA, 64 nt, Homo Sapiens; identical to SEQ ID NO: 41687

SEQ ID NO: 685622 - RNA, 64 nt, Homo Sapiens; identical to SEQ ID NO: 41688

SEQ ID NO: 685623 - RNA, 64 nt, Homo Sapiens; identical to SEQ ID NO: 41689

SEQ ID NO: 685624 - RNA, 64 nt, Homo Sapiens; identical to SEQ ID NO: 41690

SEQ ID NO: 685625 - RNA, 64 nt, Homo Sapiens; identical to SEQ ID NO: 41691

SEQ ID NO: 685626 - RNA, 64 nt, Homo Sapiens; identical to SEQ ID NO: 41692

SEQ ID NO: 685627 - RNA, 64 nt, Homo Sapiens; identical to SEQ ID NO: 41693

SEQ ID NO: 685628 - RNA, 64 nt, Homo Sapiens; identical to SEQ ID NO: 41694

SEQ ID NO: 685629 - RNA, 64 nt, Homo Sapiens; identical to SEQ ID NO: 41695

SEQ ID NO: 685630 - RNA, 64 nt, Homo Sapiens; identical to SEQ ID NO: 41696

SEQ ID NO: 685631 - RNA, 64 nt, Homo Sapiens; identical to SEQ ID NO: 41697

SEQ ID NO: 685632 - RNA, 64 nt, Homo Sapiens; identical to SEQ ID NO: 41698

SEQ ID NO: 685633 - RNA, 64 nt, Homo Sapiens; identical to SEQ ID NO: 41699

SEQ ID NO: 685634 - RNA, 64 nt, Homo Sapiens; identical to SEQ ID NO: 41700

SEQ ID NO: 685635 - RNA, 64 nt, Homo Sapiens; identical to SEQ ID NO: 41701

SEQ ID NO: 685636 - RNA, 64 nt, Homo Sapiens; identical to SEQ ID NO: 41702

SEQ ID NO: 685637 - RNA, 64 nt, Homo Sapiens; identical to SEQ ID NO: 41703

SEQ ID NO: 685638 - RNA, 64 nt, Homo Sapiens; identical to SEQ ID NO: 41704

SEQ ID NO: 685639 - RNA, 64 nt, Homo Sapiens; identical to SEQ ID NO: 41705

SEQ ID NO: 685640 - RNA, 64 nt, Homo Sapiens; identical to SEQ ID NO: 41706

SEQ ID NO: 685641 - RNA, 64 nt, Homo Sapiens; identical to SEQ ID NO: 41707

SEQ ID NO: 685642 - RNA, 64 nt, Homo Sapiens; identical to SEQ ID NO: 41708

SEQ ID NO: 685643 - RNA, 64 nt, Homo Sapiens; identical to SEQ ID NO: 41709

SEQ ID NO: 685644 - RNA, 64 nt, Homo Sapiens; identical to SEQ ID NO: 41710

SEQ ID NO: 685645 - RNA, 64 nt, Homo Sapiens; identical to SEQ ID NO: 41711

SEQ ID NO: 685646 - RNA, 64 nt, Homo Sapiens; identical to SEQ ID NO: 41712

SEQ ID NO: 685647 - RNA, 64 nt, Homo Sapiens; identical to SEQ ID NO: 41713

SEQ ID NO: 685648 - RNA, 64 nt, Homo Sapiens; identical to SEQ ID NO: 41714

SEQ ID NO: 685649 - RNA, 64 nt, Homo Sapiens; identical to SEQ ID NO: 41715

SEQ ID NO: 685650 - RNA, 64 nt, Homo Sapiens; identical to SEQ ID NO: 41716

SEQ ID NO: 685651 - RNA, 64 nt, Homo Sapiens; identical to SEQ ID NO: 41717

SEQ ID NO: 685652 - RNA, 64 nt, Homo Sapiens; identical to SEQ ID NO: 41718

SEQ ID NO: 685653 - RNA, 64 nt, Homo Sapiens; identical to SEQ ID NO: 41719

SEQ ID NO: 685654 - RNA, 64 nt, Homo Sapiens; identical to SEQ ID NO: 41720

SEQ ID NO: 685655 - RNA, 64 nt, Homo Sapiens; identical to SEQ ID NO: 41721

SEQ ID NO: 685656 - RNA, 64 nt, Homo Sapiens; identical to SEQ ID NO: 41722

SEQ ID NO: 685657 - RNA, 64 nt, Homo Sapiens; identical to SEQ ID NO: 41723

SEQ ID NO: 685658 - RNA, 64 nt, Homo Sapiens; identical to SEQ ID NO: 41724

SEQ ID NO: 685659 - RNA, 64 nt, Homo Sapiens; identical to SEQ ID NO: 41725

SEQ ID NO: 685660 - RNA, 64 nt, Homo Sapiens; identical to SEQ ID NO: 41726

SEQ ID NO: 685661 - RNA, 64 nt, Homo Sapiens; identical to SEQ ID NO: 41727

SEQ ID NO: 685662 - RNA, 64 nt, Homo Sapiens; identical to SEQ ID NO: 41728

SEQ ID NO: 685663 - RNA, 64 nt, Homo Sapiens; identical to SEQ ID NO: 41729

SEQ ID NO: 685664 - RNA, 64 nt, Homo Sapiens; identical to SEQ ID NO: 41730

SEQ ID NO: 685665 - RNA, 64 nt, Homo Sapiens; identical to SEQ ID NO: 41731

SEQ ID NO: 685666 - RNA, 64 nt, Homo Sapiens; identical to SEQ ID NO: 41732

SEQ ID NO: 685667 - RNA, 64 nt, Homo Sapiens; identical to SEQ ID NO: 41733

SEQ ID NO: 685668 - RNA, 64 nt, Homo Sapiens; identical to SEQ ID NO: 41734

SEQ ID NO: 685669 - RNA, 64 nt, Homo Sapiens; identical to SEQ ID NO: 41735

SEQ ID NO: 685670 - RNA, 64 nt, Homo Sapiens; identical to SEQ ID NO: 41736

SEQ ID NO: 685671 - RNA, 64 nt, Homo Sapiens; identical to SEQ ID NO: 41737

SEQ ID NO: 685672 - RNA, 64 nt, Homo Sapiens; identical to SEQ ID NO: 41738

SEQ ID NO: 685673 - RNA, 64 nt, Homo Sapiens; identical to SEQ ID NO: 41739

SEQ ID NO: 685674 - RNA, 64 nt, Homo Sapiens; identical to SEQ ID NO: 41740

SEQ ID NO: 685675 - RNA, 64 nt, Homo Sapiens; identical to SEQ ID NO: 41741

SEQ ID NO: 685676 - RNA, 64 nt, Homo Sapiens; identical to SEQ ID NO: 41742

SEQ ID NO: 685677 - RNA, 64 nt, Homo Sapiens; identical to SEQ ID NO: 41743

SEQ ID NO: 685678 - RNA, 64 nt, Homo Sapiens; identical to SEQ ID NO: 41744

SEQ ID NO: 685679 - RNA, 64 nt, Homo Sapiens; identical to SEQ ID NO: 41745

SEQ ID NO: 685680 - RNA, 64 nt, Homo Sapiens; identical to SEQ ID NO: 41746

SEQ ID NO: 685681 - RNA, 64 nt, Homo Sapiens; identical to SEQ ID NO: 41747

SEQ ID NO: 685682 - RNA, 64 nt, Homo Sapiens; identical to SEQ ID NO: 41748

SEQ ID NO: 685683 - RNA, 64 nt, Homo Sapiens; identical to SEQ ID NO: 41749

SEQ ID NO: 685684 - RNA, 64 nt, Homo Sapiens; identical to SEQ ID NO: 41750

SEQ ID NO: 685685 - RNA, 64 nt, Homo Sapiens; identical to SEQ ID NO: 41751

SEQ ID NO: 685686 - RNA, 64 nt, Homo Sapiens; identical to SEQ ID NO: 41752

SEQ ID NO: 685687 - RNA, 64 nt, Homo Sapiens; identical to SEQ ID NO: 41753

SEQ ID NO: 685688 - RNA, 64 nt, Homo Sapiens; identical to SEQ ID NO: 41754

SEQ ID NO: 685689 - RNA, 64 nt, Homo Sapiens; identical to SEQ ID NO: 41755

SEQ ID NO: 685690 - RNA, 64 nt, Homo Sapiens; identical to SEQ ID NO: 41756

SEQ ID NO: 685691 - RNA, 64 nt, Homo Sapiens; identical to SEQ ID NO: 41757

SEQ ID NO: 685692 - RNA, 64 nt, Homo Sapiens; identical to SEQ ID NO: 41758

SEQ ID NO: 685693 - RNA, 64 nt, Homo Sapiens; identical to SEQ ID NO: 41759

SEQ ID NO: 685694 - RNA, 64 nt, Homo Sapiens; identical to SEQ ID NO: 41760

SEQ ID NO: 685695 - RNA, 64 nt, Homo Sapiens; identical to SEQ ID NO: 41761

SEQ ID NO: 685696 - RNA, 64 nt, Homo Sapiens; identical to SEQ ID NO: 41762

SEQ ID NO: 685697 - RNA, 64 nt, Homo Sapiens; identical to SEQ ID NO: 41763

SEQ ID NO: 685698 - RNA, 64 nt, Homo Sapiens; identical to SEQ ID NO: 41764

SEQ ID NO: 685699 - RNA, 64 nt, Homo Sapiens; identical to SEQ ID NO: 41765

SEQ ID NO: 685700 - RNA, 64 nt, Homo Sapiens; identical to SEQ ID NO: 41766

SEQ ID NO: 685701 - RNA, 64 nt, Homo Sapiens; identical to SEQ ID NO: 41767

SEQ ID NO: 685702 - RNA, 64 nt, Homo Sapiens; identical to SEQ ID NO: 41768

SEQ ID NO: 685703 - RNA, 64 nt, Homo Sapiens; identical to SEQ ID NO: 41769

SEQ ID NO: 685704 - RNA, 64 nt, Homo Sapiens; identical to SEQ ID NO: 41770

SEQ ID NO: 685705 - RNA, 64 nt, Homo Sapiens; identical to SEQ ID NO: 41771

SEQ ID NO: 685706 - RNA, 64 nt, Homo Sapiens; identical to SEQ ID NO: 41772

SEQ ID NO: 685707 - RNA, 64 nt, Homo Sapiens; identical to SEQ ID NO: 41773

SEQ ID NO: 685708 - RNA, 64 nt, Homo Sapiens; identical to SEQ ID NO: 41774

SEQ ID NO: 685709 - RNA, 64 nt, Homo Sapiens; identical to SEQ ID NO: 41775

SEQ ID NO: 685710 - RNA, 64 nt, Homo Sapiens; identical to SEQ ID NO: 41776

SEQ ID NO: 685711 - RNA, 64 nt, Homo Sapiens; identical to SEQ ID NO: 41777

SEQ ID NO: 685712 - RNA, 64 nt, Homo Sapiens; identical to SEQ ID NO: 41778

SEQ ID NO: 685713 - RNA, 64 nt, Homo Sapiens; identical to SEQ ID NO: 41779

SEQ ID NO: 685714 - RNA, 64 nt, Homo Sapiens; identical to SEQ ID NO: 41780

SEQ ID NO: 685715 - RNA, 64 nt, Homo Sapiens; identical to SEQ ID NO: 41781

SEQ ID NO: 685716 - RNA, 64 nt, Homo Sapiens; identical to SEQ ID NO: 41782

SEQ ID NO: 685717 - RNA, 64 nt, Homo Sapiens; identical to SEQ ID NO: 41783

SEQ ID NO: 685718 - RNA, 64 nt, Homo Sapiens; identical to SEQ ID NO: 41784

SEQ ID NO: 685719 - RNA, 64 nt, Homo Sapiens; identical to SEQ ID NO: 41785

SEQ ID NO: 685720 - RNA, 64 nt, Homo Sapiens; identical to SEQ ID NO: 41786

SEQ ID NO: 685721 - RNA, 64 nt, Homo Sapiens; identical to SEQ ID NO: 41787

SEQ ID NO: 685722 - RNA, 64 nt, Homo Sapiens; identical to SEQ ID NO: 41788

SEQ ID NO: 685723 - RNA, 64 nt, Homo Sapiens; identical to SEQ ID NO: 41789

SEQ ID NO: 685724 - RNA, 64 nt, Homo Sapiens; identical to SEQ ID NO: 41790

SEQ ID NO: 685725 - RNA, 64 nt, Homo Sapiens; identical to SEQ ID NO: 41791

SEQ ID NO: 685726 - RNA, 64 nt, Homo Sapiens; identical to SEQ ID NO: 41792

SEQ ID NO: 685727 - RNA, 64 nt, Homo Sapiens; identical to SEQ ID NO: 41793

SEQ ID NO: 685728 - RNA, 64 nt, Homo Sapiens; identical to SEQ ID NO: 41794

SEQ ID NO: 685729 - RNA, 64 nt, Homo Sapiens; identical to SEQ ID NO: 41795

SEQ ID NO: 685730 - RNA, 64 nt, Homo Sapiens; identical to SEQ ID NO: 41796

SEQ ID NO: 685731 - RNA, 64 nt, Homo Sapiens; identical to SEQ ID NO: 41797

SEQ ID NO: 685732 - RNA, 64 nt, Homo Sapiens; identical to SEQ ID NO: 41798

SEQ ID NO: 685733 - RNA, 64 nt, Homo Sapiens; identical to SEQ ID NO: 41799

SEQ ID NO: 685734 - RNA, 64 nt, Homo Sapiens; identical to SEQ ID NO: 41800

SEQ ID NO: 685735 - RNA, 64 nt, Homo Sapiens; identical to SEQ ID NO: 41801

SEQ ID NO: 685736 - RNA, 64 nt, Homo Sapiens; identical to SEQ ID NO: 41802

SEQ ID NO: 685737 - RNA, 64 nt, Homo Sapiens; identical to SEQ ID NO: 41803

SEQ ID NO: 685738 - RNA, 64 nt, Homo Sapiens; identical to SEQ ID NO: 41804

SEQ ID NO: 685739 - RNA, 64 nt, Homo Sapiens; identical to SEQ ID NO: 41805

SEQ ID NO: 685740 - RNA, 64 nt, Homo Sapiens; identical to SEQ ID NO: 41806

SEQ ID NO: 685741 - RNA, 64 nt, Homo Sapiens; identical to SEQ ID NO: 41807

SEQ ID NO: 685742 - RNA, 64 nt, Homo Sapiens; identical to SEQ ID NO: 41808

SEQ ID NO: 685743 - RNA, 64 nt, Homo Sapiens; identical to SEQ ID NO: 41809

SEQ ID NO: 685744 - RNA, 64 nt, Homo Sapiens; identical to SEQ ID NO: 41810

SEQ ID NO: 685745 - RNA, 64 nt, Homo Sapiens; identical to SEQ ID NO: 41811

SEQ ID NO: 685746 - RNA, 64 nt, Homo Sapiens; identical to SEQ ID NO: 41812

SEQ ID NO: 685747 - RNA, 64 nt, Homo Sapiens; identical to SEQ ID NO: 41813

SEQ ID NO: 685748 - RNA, 64 nt, Homo Sapiens; identical to SEQ ID NO: 41814

SEQ ID NO: 685749 - RNA, 64 nt, Homo Sapiens; identical to SEQ ID NO: 41815

SEQ ID NO: 685750 - RNA, 64 nt, Homo Sapiens; identical to SEQ ID NO: 41816

SEQ ID NO: 685751 - RNA, 64 nt, Homo Sapiens; identical to SEQ ID NO: 41817

SEQ ID NO: 685752 - RNA, 64 nt, Homo Sapiens; identical to SEQ ID NO: 41818

SEQ ID NO: 685753 - RNA, 64 nt, Homo Sapiens; identical to SEQ ID NO: 41819

SEQ ID NO: 685754 - RNA, 64 nt, Homo Sapiens; identical to SEQ ID NO: 41820

SEQ ID NO: 685755 - RNA, 64 nt, Homo Sapiens; identical to SEQ ID NO: 41821

SEQ ID NO: 685756 - RNA, 64 nt, Homo Sapiens; identical to SEQ ID NO: 41822

SEQ ID NO: 685757 - RNA, 64 nt, Homo Sapiens; identical to SEQ ID NO: 41823

SEQ ID NO: 685758 - RNA, 64 nt, Homo Sapiens; identical to SEQ ID NO: 41824

SEQ ID NO: 685759 - RNA, 64 nt, Homo Sapiens; identical to SEQ ID NO: 41825

SEQ ID NO: 685760 - RNA, 64 nt, Homo Sapiens; identical to SEQ ID NO: 41826

SEQ ID NO: 685761 - RNA, 64 nt, Homo Sapiens; identical to SEQ ID NO: 41827

SEQ ID NO: 685762 - RNA, 64 nt, Homo Sapiens; identical to SEQ ID NO: 41828

SEQ ID NO: 685763 - RNA, 64 nt, Homo Sapiens; identical to SEQ ID NO: 41829

SEQ ID NO: 685764 - RNA, 64 nt, Homo Sapiens; identical to SEQ ID NO: 41830

SEQ ID NO: 685765 - RNA, 64 nt, Homo Sapiens; identical to SEQ ID NO: 41831

SEQ ID NO: 685766 - RNA, 64 nt, Homo Sapiens; identical to SEQ ID NO: 41832

SEQ ID NO: 685767 - RNA, 64 nt, Homo Sapiens; identical to SEQ ID NO: 41833

SEQ ID NO: 685768 - RNA, 64 nt, Homo Sapiens; identical to SEQ ID NO: 41834

SEQ ID NO: 685769 - RNA, 64 nt, Homo Sapiens; identical to SEQ ID NO: 41835

SEQ ID NO: 685770 - RNA, 64 nt, Homo Sapiens; identical to SEQ ID NO: 41836

SEQ ID NO: 685771 - RNA, 64 nt, Homo Sapiens; identical to SEQ ID NO: 41837

SEQ ID NO: 685772 - RNA, 64 nt, Homo Sapiens; identical to SEQ ID NO: 41838

SEQ ID NO: 685773 - RNA, 64 nt, Homo Sapiens; identical to SEQ ID NO: 41839

SEQ ID NO: 685774 - RNA, 64 nt, Homo Sapiens; identical to SEQ ID NO: 41840

SEQ ID NO: 685775 - RNA, 64 nt, Homo Sapiens; identical to SEQ ID NO: 41841

SEQ ID NO: 685776 - RNA, 64 nt, Homo Sapiens; identical to SEQ ID NO: 41842

SEQ ID NO: 685777 - RNA, 64 nt, Homo Sapiens; identical to SEQ ID NO: 41843

SEQ ID NO: 685778 - RNA, 64 nt, Homo Sapiens; identical to SEQ ID NO: 41844

SEQ ID NO: 685779 - RNA, 64 nt, Homo Sapiens; identical to SEQ ID NO: 41845

SEQ ID NO: 685780 - RNA, 64 nt, Homo Sapiens; identical to SEQ ID NO: 41846

SEQ ID NO: 685781 - RNA, 64 nt, Homo Sapiens; identical to SEQ ID NO: 41847

SEQ ID NO: 685782 - RNA, 64 nt, Homo Sapiens; identical to SEQ ID NO: 41848

SEQ ID NO: 685783 - RNA, 64 nt, Homo Sapiens; identical to SEQ ID NO: 41849

SEQ ID NO: 685784 - RNA, 64 nt, Homo Sapiens; identical to SEQ ID NO: 41850

SEQ ID NO: 685785 - RNA, 64 nt, Homo Sapiens; identical to SEQ ID NO: 41851

SEQ ID NO: 685786 - RNA, 64 nt, Homo Sapiens; identical to SEQ ID NO: 41852

SEQ ID NO: 685787 - RNA, 64 nt, Homo Sapiens; identical to SEQ ID NO: 41853

SEQ ID NO: 685788 - RNA, 64 nt, Homo Sapiens; identical to SEQ ID NO: 41854

SEQ ID NO: 685789 - RNA, 64 nt, Homo Sapiens; identical to SEQ ID NO: 41855

SEQ ID NO: 685790 - RNA, 64 nt, Homo Sapiens; identical to SEQ ID NO: 41856

SEQ ID NO: 685791 - RNA, 64 nt, Homo Sapiens; identical to SEQ ID NO: 41857

SEQ ID NO: 685792 - RNA, 64 nt, Homo Sapiens; identical to SEQ ID NO: 41858

SEQ ID NO: 685793 - RNA, 64 nt, Homo Sapiens; identical to SEQ ID NO: 41859

SEQ ID NO: 685794 - RNA, 64 nt, Homo Sapiens; identical to SEQ ID NO: 41860

SEQ ID NO: 685795 - RNA, 64 nt, Homo Sapiens; identical to SEQ ID NO: 41861

SEQ ID NO: 685796 - RNA, 64 nt, Homo Sapiens; identical to SEQ ID NO: 41862

SEQ ID NO: 685797 - RNA, 64 nt, Homo Sapiens; identical to SEQ ID NO: 41863

SEQ ID NO: 685798 - RNA, 64 nt, Homo Sapiens; identical to SEQ ID NO: 41864

SEQ ID NO: 685799 - RNA, 64 nt, Homo Sapiens; identical to SEQ ID NO: 41865

SEQ ID NO: 685800 - RNA, 64 nt, Homo Sapiens; identical to SEQ ID NO: 41866

SEQ ID NO: 685801 - RNA, 64 nt, Homo Sapiens; identical to SEQ ID NO: 41867

SEQ ID NO: 685802 - RNA, 64 nt, Homo Sapiens; identical to SEQ ID NO: 41868

SEQ ID NO: 685803 - RNA, 64 nt, Homo Sapiens; identical to SEQ ID NO: 41869

SEQ ID NO: 685804 - RNA, 64 nt, Homo Sapiens; identical to SEQ ID NO: 41870

SEQ ID NO: 685805 - RNA, 64 nt, Homo Sapiens; identical to SEQ ID NO: 41871

SEQ ID NO: 685806 - RNA, 64 nt, Homo Sapiens; identical to SEQ ID NO: 41872

SEQ ID NO: 685807 - RNA, 64 nt, Homo Sapiens; identical to SEQ ID NO: 41873

SEQ ID NO: 685808 - RNA, 64 nt, Homo Sapiens; identical to SEQ ID NO: 41874

SEQ ID NO: 685809 - RNA, 64 nt, Homo Sapiens; identical to SEQ ID NO: 41875

SEQ ID NO: 685810 - RNA, 64 nt, Homo Sapiens; identical to SEQ ID NO: 41876

SEQ ID NO: 685811 - RNA, 64 nt, Homo Sapiens; identical to SEQ ID NO: 41877

SEQ ID NO: 685812 - RNA, 64 nt, Homo Sapiens; identical to SEQ ID NO: 41878

SEQ ID NO: 685813 - RNA, 64 nt, Homo Sapiens; identical to SEQ ID NO: 41879

SEQ ID NO: 685814 - RNA, 64 nt, Homo Sapiens; identical to SEQ ID NO: 41880

SEQ ID NO: 685815 - RNA, 64 nt, Homo Sapiens; identical to SEQ ID NO: 41881

SEQ ID NO: 685816 - RNA, 64 nt, Homo Sapiens; identical to SEQ ID NO: 41882

SEQ ID NO: 685817 - RNA, 64 nt, Homo Sapiens; identical to SEQ ID NO: 41883

SEQ ID NO: 685818 - RNA, 64 nt, Homo Sapiens; identical to SEQ ID NO: 41884

SEQ ID NO: 685819 - RNA, 64 nt, Homo Sapiens; identical to SEQ ID NO: 41885

SEQ ID NO: 685820 - RNA, 64 nt, Homo Sapiens; identical to SEQ ID NO: 41886

SEQ ID NO: 685821 - RNA, 64 nt, Homo Sapiens; identical to SEQ ID NO: 41887

SEQ ID NO: 685822 - RNA, 64 nt, Homo Sapiens; identical to SEQ ID NO: 41888

SEQ ID NO: 685823 - RNA, 64 nt, Homo Sapiens; identical to SEQ ID NO: 41889

SEQ ID NO: 685824 - RNA, 64 nt, Homo Sapiens; identical to SEQ ID NO: 41890

SEQ ID NO: 685825 - RNA, 64 nt, Homo Sapiens; identical to SEQ ID NO: 41891

SEQ ID NO: 685826 - RNA, 64 nt, Homo Sapiens; identical to SEQ ID NO: 41892

SEQ ID NO: 685827 - RNA, 64 nt, Homo Sapiens; identical to SEQ ID NO: 41893

SEQ ID NO: 685828 - RNA, 64 nt, Homo Sapiens; identical to SEQ ID NO: 41894

SEQ ID NO: 685829 - RNA, 64 nt, Homo Sapiens; identical to SEQ ID NO: 41895

SEQ ID NO: 685830 - RNA, 64 nt, Homo Sapiens; identical to SEQ ID NO: 41896

SEQ ID NO: 685831 - RNA, 64 nt, Homo Sapiens; identical to SEQ ID NO: 41897

SEQ ID NO: 685832 - RNA, 64 nt, Homo Sapiens; identical to SEQ ID NO: 41898

SEQ ID NO: 685833 - RNA, 64 nt, Homo Sapiens; identical to SEQ ID NO: 41899

SEQ ID NO: 685834 - RNA, 64 nt, Homo Sapiens; identical to SEQ ID NO: 41900

SEQ ID NO: 685835 - RNA, 64 nt, Homo Sapiens; identical to SEQ ID NO: 41901

SEQ ID NO: 685836 - RNA, 64 nt, Homo Sapiens; identical to SEQ ID NO: 41902

SEQ ID NO: 685837 - RNA, 64 nt, Homo Sapiens; identical to SEQ ID NO: 41903

SEQ ID NO: 685838 - RNA, 64 nt, Homo Sapiens; identical to SEQ ID NO: 41904

SEQ ID NO: 685839 - RNA, 64 nt, Homo Sapiens; identical to SEQ ID NO: 41905

SEQ ID NO: 685840 - RNA, 64 nt, Homo Sapiens; identical to SEQ ID NO: 41906

SEQ ID NO: 685841 - RNA, 64 nt, Homo Sapiens; identical to SEQ ID NO: 41907

SEQ ID NO: 685842 - RNA, 64 nt, Homo Sapiens; identical to SEQ ID NO: 41908

SEQ ID NO: 685843 - RNA, 64 nt, Homo Sapiens; identical to SEQ ID NO: 41909

SEQ ID NO: 685844 - RNA, 64 nt, Homo Sapiens; identical to SEQ ID NO: 41910

SEQ ID NO: 685845 - RNA, 64 nt, Homo Sapiens; identical to SEQ ID NO: 41911

SEQ ID NO: 685846 - RNA, 64 nt, Homo Sapiens; identical to SEQ ID NO: 41912

SEQ ID NO: 685847 - RNA, 64 nt, Homo Sapiens; identical to SEQ ID NO: 41913

SEQ ID NO: 685848 - RNA, 64 nt, Homo Sapiens; identical to SEQ ID NO: 41914

SEQ ID NO: 685849 - RNA, 64 nt, Homo Sapiens; identical to SEQ ID NO: 41915

SEQ ID NO: 685850 - RNA, 64 nt, Homo Sapiens; identical to SEQ ID NO: 41916

SEQ ID NO: 685851 - RNA, 64 nt, Homo Sapiens; identical to SEQ ID NO: 41917

SEQ ID NO: 685852 - RNA, 64 nt, Homo Sapiens; identical to SEQ ID NO: 41918

SEQ ID NO: 685853 - RNA, 64 nt, Homo Sapiens; identical to SEQ ID NO: 41919

SEQ ID NO: 685854 - RNA, 64 nt, Homo Sapiens; identical to SEQ ID NO: 41920

SEQ ID NO: 685855 - RNA, 64 nt, Homo Sapiens; identical to SEQ ID NO: 41921

SEQ ID NO: 685856 - RNA, 64 nt, Homo Sapiens; identical to SEQ ID NO: 41922

SEQ ID NO: 685857 - RNA, 64 nt, Homo Sapiens; identical to SEQ ID NO: 41923

SEQ ID NO: 685858 - RNA, 64 nt, Homo Sapiens; identical to SEQ ID NO: 41924

SEQ ID NO: 685859 - RNA, 64 nt, Homo Sapiens; identical to SEQ ID NO: 41925

SEQ ID NO: 685860 - RNA, 64 nt, Homo Sapiens; identical to SEQ ID NO: 41926

SEQ ID NO: 685861 - RNA, 64 nt, Homo Sapiens; identical to SEQ ID NO: 41927

SEQ ID NO: 685862 - RNA, 64 nt, Homo Sapiens; identical to SEQ ID NO: 41928

SEQ ID NO: 685863 - RNA, 64 nt, Homo Sapiens; identical to SEQ ID NO: 41929

SEQ ID NO: 685864 - RNA, 64 nt, Homo Sapiens; identical to SEQ ID NO: 41930

SEQ ID NO: 685865 - RNA, 64 nt, Homo Sapiens; identical to SEQ ID NO: 41931

SEQ ID NO: 685866 - RNA, 64 nt, Homo Sapiens; identical to SEQ ID NO: 41932

SEQ ID NO: 685867 - RNA, 64 nt, Homo Sapiens; identical to SEQ ID NO: 41933

SEQ ID NO: 685868 - RNA, 64 nt, Homo Sapiens; identical to SEQ ID NO: 41934

SEQ ID NO: 685869 - RNA, 64 nt, Homo Sapiens; identical to SEQ ID NO: 41935

SEQ ID NO: 685870 - RNA, 64 nt, Homo Sapiens; identical to SEQ ID NO: 41936

SEQ ID NO: 685871 - RNA, 64 nt, Homo Sapiens; identical to SEQ ID NO: 41937

SEQ ID NO: 685872 - RNA, 64 nt, Homo Sapiens; identical to SEQ ID NO: 41938

SEQ ID NO: 685873 - RNA, 64 nt, Homo Sapiens; identical to SEQ ID NO: 41939

SEQ ID NO: 685874 - RNA, 64 nt, Homo Sapiens; identical to SEQ ID NO: 41940

SEQ ID NO: 685875 - RNA, 64 nt, Homo Sapiens; identical to SEQ ID NO: 41941

SEQ ID NO: 685876 - RNA, 64 nt, Homo Sapiens; identical to SEQ ID NO: 41942

SEQ ID NO: 685877 - RNA, 64 nt, Homo Sapiens; identical to SEQ ID NO: 41943

SEQ ID NO: 685878 - RNA, 64 nt, Homo Sapiens; identical to SEQ ID NO: 41944

SEQ ID NO: 685879 - RNA, 64 nt, Homo Sapiens; identical to SEQ ID NO: 41945

SEQ ID NO: 685880 - RNA, 64 nt, Homo Sapiens; identical to SEQ ID NO: 41946

SEQ ID NO: 685881 - RNA, 64 nt, Homo Sapiens; identical to SEQ ID NO: 41947

SEQ ID NO: 685882 - RNA, 64 nt, Homo Sapiens; identical to SEQ ID NO: 41948

SEQ ID NO: 685883 - RNA, 64 nt, Homo Sapiens; identical to SEQ ID NO: 41949

SEQ ID NO: 685884 - RNA, 64 nt, Homo Sapiens; identical to SEQ ID NO: 41950

SEQ ID NO: 685885 - RNA, 64 nt, Homo Sapiens; identical to SEQ ID NO: 41951

SEQ ID NO: 685886 - RNA, 64 nt, Homo Sapiens; identical to SEQ ID NO: 41952

SEQ ID NO: 685887 - RNA, 64 nt, Homo Sapiens; identical to SEQ ID NO: 41953

SEQ ID NO: 685888 - RNA, 64 nt, Homo Sapiens; identical to SEQ ID NO: 41954

SEQ ID NO: 685889 - RNA, 64 nt, Homo Sapiens; identical to SEQ ID NO: 41955

SEQ ID NO: 685890 - RNA, 64 nt, Homo Sapiens; identical to SEQ ID NO: 41956

SEQ ID NO: 685891 - RNA, 64 nt, Homo Sapiens; identical to SEQ ID NO: 41957

SEQ ID NO: 685892 - RNA, 64 nt, Homo Sapiens; identical to SEQ ID NO: 41958

SEQ ID NO: 685893 - RNA, 64 nt, Homo Sapiens; identical to SEQ ID NO: 41959

SEQ ID NO: 685894 - RNA, 64 nt, Homo Sapiens; identical to SEQ ID NO: 41960

SEQ ID NO: 685895 - RNA, 64 nt, Homo Sapiens; identical to SEQ ID NO: 41961

SEQ ID NO: 685896 - RNA, 64 nt, Homo Sapiens; identical to SEQ ID NO: 41962

SEQ ID NO: 685897 - RNA, 64 nt, Homo Sapiens; identical to SEQ ID NO: 41963

SEQ ID NO: 685898 - RNA, 64 nt, Homo Sapiens; identical to SEQ ID NO: 41964

SEQ ID NO: 685899 - RNA, 64 nt, Homo Sapiens; identical to SEQ ID NO: 41965

SEQ ID NO: 685900 - RNA, 64 nt, Homo Sapiens; identical to SEQ ID NO: 41966

SEQ ID NO: 685901 - RNA, 64 nt, Homo Sapiens; identical to SEQ ID NO: 41967

SEQ ID NO: 685902 - RNA, 64 nt, Homo Sapiens; identical to SEQ ID NO: 41968

SEQ ID NO: 685903 - RNA, 64 nt, Homo Sapiens; identical to SEQ ID NO: 41969

SEQ ID NO: 685904 - RNA, 64 nt, Homo Sapiens; identical to SEQ ID NO: 41970

SEQ ID NO: 685905 - RNA, 64 nt, Homo Sapiens; identical to SEQ ID NO: 41971

SEQ ID NO: 685906 - RNA, 64 nt, Homo Sapiens; identical to SEQ ID NO: 41972

SEQ ID NO: 685907 - RNA, 64 nt, Homo Sapiens; identical to SEQ ID NO: 41973

SEQ ID NO: 685908 - RNA, 64 nt, Homo Sapiens; identical to SEQ ID NO: 41974

SEQ ID NO: 685909 - RNA, 64 nt, Homo Sapiens; identical to SEQ ID NO: 41975

SEQ ID NO: 685910 - RNA, 64 nt, Homo Sapiens; identical to SEQ ID NO: 41976

SEQ ID NO: 685911 - RNA, 64 nt, Homo Sapiens; identical to SEQ ID NO: 41977

SEQ ID NO: 685912 - RNA, 64 nt, Homo Sapiens; identical to SEQ ID NO: 41978

SEQ ID NO: 685913 - RNA, 64 nt, Homo Sapiens; identical to SEQ ID NO: 41979

SEQ ID NO: 685914 - RNA, 64 nt, Homo Sapiens; identical to SEQ ID NO: 41980

SEQ ID NO: 685915 - RNA, 64 nt, Homo Sapiens; identical to SEQ ID NO: 41981

SEQ ID NO: 685916 - RNA, 64 nt, Homo Sapiens; identical to SEQ ID NO: 41982

SEQ ID NO: 685917 - RNA, 64 nt, Homo Sapiens; identical to SEQ ID NO: 41983

SEQ ID NO: 685918 - RNA, 64 nt, Homo Sapiens; identical to SEQ ID NO: 41984

SEQ ID NO: 685919 - RNA, 64 nt, Homo Sapiens; identical to SEQ ID NO: 41985

SEQ ID NO: 685920 - RNA, 64 nt, Homo Sapiens; identical to SEQ ID NO: 41986

SEQ ID NO: 685921 - RNA, 64 nt, Homo Sapiens; identical to SEQ ID NO: 41987

SEQ ID NO: 685922 - RNA, 64 nt, Homo Sapiens; identical to SEQ ID NO: 41988

SEQ ID NO: 685923 - RNA, 64 nt, Homo Sapiens; identical to SEQ ID NO: 41989

SEQ ID NO: 685924 - RNA, 64 nt, Homo Sapiens; identical to SEQ ID NO: 41990

SEQ ID NO: 685925 - RNA, 64 nt, Homo Sapiens; identical to SEQ ID NO: 41991

SEQ ID NO: 685926 - RNA, 64 nt, Homo Sapiens; identical to SEQ ID NO: 41992

SEQ ID NO: 685927 - RNA, 64 nt, Homo Sapiens; identical to SEQ ID NO: 41993

SEQ ID NO: 685928 - RNA, 64 nt, Homo Sapiens; identical to SEQ ID NO: 41994

SEQ ID NO: 685929 - RNA, 64 nt, Homo Sapiens; identical to SEQ ID NO: 41995

SEQ ID NO: 685930 - RNA, 64 nt, Homo Sapiens; identical to SEQ ID NO: 41996

SEQ ID NO: 685931 - RNA, 64 nt, Homo Sapiens; identical to SEQ ID NO: 41997

SEQ ID NO: 685932 - RNA, 64 nt, Homo Sapiens; identical to SEQ ID NO: 41998

SEQ ID NO: 685933 - RNA, 64 nt, Homo Sapiens; identical to SEQ ID NO: 41999

SEQ ID NO: 685934 - RNA, 64 nt, Homo Sapiens; identical to SEQ ID NO: 42000

SEQ ID NO: 685935 - RNA, 64 nt, Homo Sapiens; identical to SEQ ID NO: 42001

SEQ ID NO: 685936 - RNA, 64 nt, Homo Sapiens; identical to SEQ ID NO: 42002

SEQ ID NO: 685937 - RNA, 64 nt, Homo Sapiens; identical to SEQ ID NO: 42003

SEQ ID NO: 685938 - RNA, 64 nt, Homo Sapiens; identical to SEQ ID NO: 42004

SEQ ID NO: 685939 - RNA, 64 nt, Homo Sapiens; identical to SEQ ID NO: 42005

SEQ ID NO: 685940 - RNA, 64 nt, Homo Sapiens; identical to SEQ ID NO: 42006

SEQ ID NO: 685941 - RNA, 64 nt, Homo Sapiens; identical to SEQ ID NO: 42007

SEQ ID NO: 685942 - RNA, 64 nt, Homo Sapiens; identical to SEQ ID NO: 42008

SEQ ID NO: 685943 - RNA, 64 nt, Homo Sapiens; identical to SEQ ID NO: 42009

SEQ ID NO: 685944 - RNA, 64 nt, Homo Sapiens; identical to SEQ ID NO: 42010

SEQ ID NO: 685945 - RNA, 64 nt, Homo Sapiens; identical to SEQ ID NO: 42011

SEQ ID NO: 685946 - RNA, 64 nt, Homo Sapiens; identical to SEQ ID NO: 42012

SEQ ID NO: 685947 - RNA, 64 nt, Homo Sapiens; identical to SEQ ID NO: 42013

SEQ ID NO: 685948 - RNA, 64 nt, Homo Sapiens; identical to SEQ ID NO: 42014

SEQ ID NO: 685949 - RNA, 64 nt, Homo Sapiens; identical to SEQ ID NO: 42015

SEQ ID NO: 685950 - RNA, 64 nt, Homo Sapiens; identical to SEQ ID NO: 42016

SEQ ID NO: 685951 - RNA, 64 nt, Homo Sapiens; identical to SEQ ID NO: 42017

SEQ ID NO: 685952 - RNA, 64 nt, Homo Sapiens; identical to SEQ ID NO: 42018

SEQ ID NO: 685953 - RNA, 64 nt, Homo Sapiens; identical to SEQ ID NO: 42019

SEQ ID NO: 685954 - RNA, 64 nt, Homo Sapiens; identical to SEQ ID NO: 42020

SEQ ID NO: 685955 - RNA, 64 nt, Homo Sapiens; identical to SEQ ID NO: 42021

SEQ ID NO: 685956 - RNA, 64 nt, Homo Sapiens; identical to SEQ ID NO: 42022

SEQ ID NO: 685957 - RNA, 64 nt, Homo Sapiens; identical to SEQ ID NO: 42023

SEQ ID NO: 685958 - RNA, 64 nt, Homo Sapiens; identical to SEQ ID NO: 42024

SEQ ID NO: 685959 - RNA, 64 nt, Homo Sapiens; identical to SEQ ID NO: 42025

SEQ ID NO: 685960 - RNA, 64 nt, Homo Sapiens; identical to SEQ ID NO: 42026

SEQ ID NO: 685961 - RNA, 64 nt, Homo Sapiens; identical to SEQ ID NO: 42027

SEQ ID NO: 685962 - RNA, 64 nt, Homo Sapiens; identical to SEQ ID NO: 42028

SEQ ID NO: 685963 - RNA, 64 nt, Homo Sapiens; identical to SEQ ID NO: 42029

SEQ ID NO: 685964 - RNA, 64 nt, Homo Sapiens; identical to SEQ ID NO: 42030

SEQ ID NO: 685965 - RNA, 64 nt, Homo Sapiens; identical to SEQ ID NO: 42031

SEQ ID NO: 685966 - RNA, 64 nt, Homo Sapiens; identical to SEQ ID NO: 42032

SEQ ID NO: 685967 - RNA, 64 nt, Homo Sapiens; identical to SEQ ID NO: 42033

SEQ ID NO: 685968 - RNA, 64 nt, Homo Sapiens; identical to SEQ ID NO: 42034

SEQ ID NO: 685969 - RNA, 64 nt, Homo Sapiens; identical to SEQ ID NO: 42035

SEQ ID NO: 685970 - RNA, 64 nt, Homo Sapiens; identical to SEQ ID NO: 42036

SEQ ID NO: 685971 - RNA, 64 nt, Homo Sapiens; identical to SEQ ID NO: 42037

SEQ ID NO: 685972 - RNA, 64 nt, Homo Sapiens; identical to SEQ ID NO: 42038

SEQ ID NO: 685973 - RNA, 64 nt, Homo Sapiens; identical to SEQ ID NO: 42039

SEQ ID NO: 685974 - RNA, 64 nt, Homo Sapiens; identical to SEQ ID NO: 42040

SEQ ID NO: 685975 - RNA, 64 nt, Homo Sapiens; identical to SEQ ID NO: 42041

SEQ ID NO: 685976 - RNA, 64 nt, Homo Sapiens; identical to SEQ ID NO: 42042

SEQ ID NO: 685977 - RNA, 64 nt, Homo Sapiens; identical to SEQ ID NO: 42043

SEQ ID NO: 685978 - RNA, 64 nt, Homo Sapiens; identical to SEQ ID NO: 42044

SEQ ID NO: 685979 - RNA, 64 nt, Homo Sapiens; identical to SEQ ID NO: 42045

SEQ ID NO: 685980 - RNA, 64 nt, Homo Sapiens; identical to SEQ ID NO: 42046

SEQ ID NO: 685981 - RNA, 64 nt, Homo Sapiens; identical to SEQ ID NO: 42047

SEQ ID NO: 685982 - RNA, 64 nt, Homo Sapiens; identical to SEQ ID NO: 42048

SEQ ID NO: 685983 - RNA, 64 nt, Homo Sapiens; identical to SEQ ID NO: 42049

SEQ ID NO: 685984 - RNA, 64 nt, Homo Sapiens; identical to SEQ ID NO: 42050

SEQ ID NO: 685985 - RNA, 64 nt, Homo Sapiens; identical to SEQ ID NO: 42051

SEQ ID NO: 685986 - RNA, 64 nt, Homo Sapiens; identical to SEQ ID NO: 42052

SEQ ID NO: 685987 - RNA, 64 nt, Homo Sapiens; identical to SEQ ID NO: 42053

SEQ ID NO: 685988 - RNA, 64 nt, Homo Sapiens; identical to SEQ ID NO: 42054

SEQ ID NO: 685989 - RNA, 64 nt, Homo Sapiens; identical to SEQ ID NO: 42055

SEQ ID NO: 685990 - RNA, 64 nt, Homo Sapiens; identical to SEQ ID NO: 42056

SEQ ID NO: 685991 - RNA, 64 nt, Homo Sapiens; identical to SEQ ID NO: 42057

SEQ ID NO: 685992 - RNA, 64 nt, Homo Sapiens; identical to SEQ ID NO: 42058

SEQ ID NO: 685993 - RNA, 64 nt, Homo Sapiens; identical to SEQ ID NO: 42059

SEQ ID NO: 685994 - RNA, 64 nt, Homo Sapiens; identical to SEQ ID NO: 42060

SEQ ID NO: 685995 - RNA, 64 nt, Homo Sapiens; identical to SEQ ID NO: 42061

SEQ ID NO: 685996 - RNA, 64 nt, Homo Sapiens; identical to SEQ ID NO: 42062

SEQ ID NO: 685997 - RNA, 64 nt, Homo Sapiens; identical to SEQ ID NO: 42063

SEQ ID NO: 685998 - RNA, 64 nt, Homo Sapiens; identical to SEQ ID NO: 42064

SEQ ID NO: 685999 - RNA, 64 nt, Homo Sapiens; identical to SEQ ID NO: 42065

SEQ ID NO: 686000 - RNA, 64 nt, Homo Sapiens; identical to SEQ ID NO: 42066

SEQ ID NO: 686001 - RNA, 64 nt, Homo Sapiens; identical to SEQ ID NO: 42067

SEQ ID NO: 686002 - RNA, 64 nt, Homo Sapiens; identical to SEQ ID NO: 42068

SEQ ID NO: 686003 - RNA, 64 nt, Homo Sapiens; identical to SEQ ID NO: 42069

SEQ ID NO: 686004 - RNA, 64 nt, Homo Sapiens; identical to SEQ ID NO: 42070

SEQ ID NO: 686005 - RNA, 64 nt, Homo Sapiens; identical to SEQ ID NO: 42071

SEQ ID NO: 686006 - RNA, 64 nt, Homo Sapiens; identical to SEQ ID NO: 42072

SEQ ID NO: 686007 - RNA, 64 nt, Homo Sapiens; identical to SEQ ID NO: 42073

SEQ ID NO: 686008 - RNA, 64 nt, Homo Sapiens; identical to SEQ ID NO: 42074

SEQ ID NO: 686009 - RNA, 64 nt, Homo Sapiens; identical to SEQ ID NO: 42075

SEQ ID NO: 686010 - RNA, 64 nt, Homo Sapiens; identical to SEQ ID NO: 42076

SEQ ID NO: 686011 - RNA, 64 nt, Homo Sapiens; identical to SEQ ID NO: 42077

SEQ ID NO: 686012 - RNA, 64 nt, Homo Sapiens; identical to SEQ ID NO: 42078

SEQ ID NO: 686013 - RNA, 64 nt, Homo Sapiens; identical to SEQ ID NO: 42079

SEQ ID NO: 686014 - RNA, 64 nt, Homo Sapiens; identical to SEQ ID NO: 42080

SEQ ID NO: 686015 - RNA, 64 nt, Homo Sapiens; identical to SEQ ID NO: 42081

SEQ ID NO: 686016 - RNA, 64 nt, Homo Sapiens; identical to SEQ ID NO: 42082

SEQ ID NO: 686017 - RNA, 64 nt, Homo Sapiens; identical to SEQ ID NO: 42083

SEQ ID NO: 686018 - RNA, 64 nt, Homo Sapiens; identical to SEQ ID NO: 42084

SEQ ID NO: 686019 - RNA, 64 nt, Homo Sapiens; identical to SEQ ID NO: 42085

SEQ ID NO: 686020 - RNA, 64 nt, Homo Sapiens; identical to SEQ ID NO: 42086

SEQ ID NO: 686021 - RNA, 64 nt, Homo Sapiens; identical to SEQ ID NO: 42087

SEQ ID NO: 686022 - RNA, 64 nt, Homo Sapiens; identical to SEQ ID NO: 42088

SEQ ID NO: 686023 - RNA, 64 nt, Homo Sapiens; identical to SEQ ID NO: 42089

SEQ ID NO: 686024 - RNA, 64 nt, Homo Sapiens; identical to SEQ ID NO: 42090

SEQ ID NO: 686025 - RNA, 64 nt, Homo Sapiens; identical to SEQ ID NO: 42091

SEQ ID NO: 686026 - RNA, 64 nt, Homo Sapiens; identical to SEQ ID NO: 42092

SEQ ID NO: 686027 - RNA, 64 nt, Homo Sapiens; identical to SEQ ID NO: 42093

SEQ ID NO: 686028 - RNA, 64 nt, Homo Sapiens; identical to SEQ ID NO: 42094

SEQ ID NO: 686029 - RNA, 64 nt, Homo Sapiens; identical to SEQ ID NO: 42095

SEQ ID NO: 686030 - RNA, 64 nt, Homo Sapiens; identical to SEQ ID NO: 42096

SEQ ID NO: 686031 - RNA, 64 nt, Homo Sapiens; identical to SEQ ID NO: 42097

SEQ ID NO: 686032 - RNA, 64 nt, Homo Sapiens; identical to SEQ ID NO: 42098

SEQ ID NO: 686033 - RNA, 64 nt, Homo Sapiens; identical to SEQ ID NO: 42099

SEQ ID NO: 686034 - RNA, 64 nt, Homo Sapiens; identical to SEQ ID NO: 42100

SEQ ID NO: 686035 - RNA, 64 nt, Homo Sapiens; identical to SEQ ID NO: 42101

SEQ ID NO: 686036 - RNA, 64 nt, Homo Sapiens; identical to SEQ ID NO: 42102

SEQ ID NO: 686037 - RNA, 64 nt, Homo Sapiens; identical to SEQ ID NO: 42103

SEQ ID NO: 686038 - RNA, 64 nt, Homo Sapiens; identical to SEQ ID NO: 42104

SEQ ID NO: 686039 - RNA, 64 nt, Homo Sapiens; identical to SEQ ID NO: 42105

SEQ ID NO: 686040 - RNA, 64 nt, Homo Sapiens; identical to SEQ ID NO: 42106

SEQ ID NO: 686041 - RNA, 64 nt, Homo Sapiens; identical to SEQ ID NO: 42107

SEQ ID NO: 686042 - RNA, 64 nt, Homo Sapiens; identical to SEQ ID NO: 42108

SEQ ID NO: 686043 - RNA, 64 nt, Homo Sapiens; identical to SEQ ID NO: 42109

SEQ ID NO: 686044 - RNA, 64 nt, Homo Sapiens; identical to SEQ ID NO: 42110

SEQ ID NO: 686045 - RNA, 64 nt, Homo Sapiens; identical to SEQ ID NO: 42111

SEQ ID NO: 686046 - RNA, 64 nt, Homo Sapiens; identical to SEQ ID NO: 42112

SEQ ID NO: 686047 - RNA, 64 nt, Homo Sapiens; identical to SEQ ID NO: 42113

SEQ ID NO: 686048 - RNA, 64 nt, Homo Sapiens; identical to SEQ ID NO: 42114

SEQ ID NO: 686049 - RNA, 64 nt, Homo Sapiens; identical to SEQ ID NO: 42115

SEQ ID NO: 686050 - RNA, 64 nt, Homo Sapiens; identical to SEQ ID NO: 42116

SEQ ID NO: 686051 - RNA, 64 nt, Homo Sapiens; identical to SEQ ID NO: 42117

SEQ ID NO: 686052 - RNA, 64 nt, Homo Sapiens; identical to SEQ ID NO: 42118

SEQ ID NO: 686053 - RNA, 64 nt, Homo Sapiens; identical to SEQ ID NO: 42119

SEQ ID NO: 686054 - RNA, 64 nt, Homo Sapiens; identical to SEQ ID NO: 42120

SEQ ID NO: 686055 - RNA, 64 nt, Homo Sapiens; identical to SEQ ID NO: 42121

SEQ ID NO: 686056 - RNA, 64 nt, Homo Sapiens; identical to SEQ ID NO: 42122

SEQ ID NO: 686057 - RNA, 64 nt, Homo Sapiens; identical to SEQ ID NO: 42123

SEQ ID NO: 686058 - RNA, 64 nt, Homo Sapiens; identical to SEQ ID NO: 42124

SEQ ID NO: 686059 - RNA, 64 nt, Homo Sapiens; identical to SEQ ID NO: 42125

SEQ ID NO: 686060 - RNA, 64 nt, Homo Sapiens; identical to SEQ ID NO: 42126

SEQ ID NO: 686061 - RNA, 64 nt, Homo Sapiens; identical to SEQ ID NO: 42127

SEQ ID NO: 686062 - RNA, 64 nt, Homo Sapiens; identical to SEQ ID NO: 42128

SEQ ID NO: 686063 - RNA, 64 nt, Homo Sapiens; identical to SEQ ID NO: 42129

SEQ ID NO: 686064 - RNA, 64 nt, Homo Sapiens; identical to SEQ ID NO: 42130

SEQ ID NO: 686065 - RNA, 64 nt, Homo Sapiens; identical to SEQ ID NO: 42131

SEQ ID NO: 686066 - RNA, 64 nt, Homo Sapiens; identical to SEQ ID NO: 42132

SEQ ID NO: 686067 - RNA, 64 nt, Homo Sapiens; identical to SEQ ID NO: 42133

SEQ ID NO: 686068 - RNA, 64 nt, Homo Sapiens; identical to SEQ ID NO: 42134

SEQ ID NO: 686069 - RNA, 64 nt, Homo Sapiens; identical to SEQ ID NO: 42135

SEQ ID NO: 686070 - RNA, 64 nt, Homo Sapiens; identical to SEQ ID NO: 42136

SEQ ID NO: 686071 - RNA, 64 nt, Homo Sapiens; identical to SEQ ID NO: 42137

SEQ ID NO: 686072 - RNA, 64 nt, Homo Sapiens; identical to SEQ ID NO: 42138

SEQ ID NO: 686073 - RNA, 64 nt, Homo Sapiens; identical to SEQ ID NO: 42139

SEQ ID NO: 686074 - RNA, 64 nt, Homo Sapiens; identical to SEQ ID NO: 42140

SEQ ID NO: 686075 - RNA, 64 nt, Homo Sapiens; identical to SEQ ID NO: 42141

SEQ ID NO: 686076 - RNA, 64 nt, Homo Sapiens; identical to SEQ ID NO: 42142

SEQ ID NO: 686077 - RNA, 64 nt, Homo Sapiens; identical to SEQ ID NO: 42143

SEQ ID NO: 686078 - RNA, 64 nt, Homo Sapiens; identical to SEQ ID NO: 42144

SEQ ID NO: 686079 - RNA, 64 nt, Homo Sapiens; identical to SEQ ID NO: 42145

SEQ ID NO: 686080 - RNA, 64 nt, Homo Sapiens; identical to SEQ ID NO: 42146

SEQ ID NO: 686081 - RNA, 64 nt, Homo Sapiens; identical to SEQ ID NO: 42147

SEQ ID NO: 686082 - RNA, 64 nt, Homo Sapiens; identical to SEQ ID NO: 42148

SEQ ID NO: 686083 - RNA, 64 nt, Homo Sapiens; identical to SEQ ID NO: 42149

SEQ ID NO: 686084 - RNA, 64 nt, Homo Sapiens; identical to SEQ ID NO: 42150

SEQ ID NO: 686085 - RNA, 64 nt, Homo Sapiens; identical to SEQ ID NO: 42151

SEQ ID NO: 686086 - RNA, 64 nt, Homo Sapiens; identical to SEQ ID NO: 42152

SEQ ID NO: 686087 - RNA, 64 nt, Homo Sapiens; identical to SEQ ID NO: 42153

SEQ ID NO: 686088 - RNA, 64 nt, Homo Sapiens; identical to SEQ ID NO: 42154

SEQ ID NO: 686089 - RNA, 64 nt, Homo Sapiens; identical to SEQ ID NO: 42155

SEQ ID NO: 686090 - RNA, 64 nt, Homo Sapiens; identical to SEQ ID NO: 42156

SEQ ID NO: 686091 - RNA, 64 nt, Homo Sapiens; identical to SEQ ID NO: 42157

SEQ ID NO: 686092 - RNA, 64 nt, Homo Sapiens; identical to SEQ ID NO: 42158

SEQ ID NO: 686093 - RNA, 64 nt, Homo Sapiens; identical to SEQ ID NO: 42159

SEQ ID NO: 686094 - RNA, 64 nt, Homo Sapiens; identical to SEQ ID NO: 42160

SEQ ID NO: 686095 - RNA, 64 nt, Homo Sapiens; identical to SEQ ID NO: 42161

SEQ ID NO: 686096 - RNA, 64 nt, Homo Sapiens; identical to SEQ ID NO: 42162

SEQ ID NO: 686097 - RNA, 64 nt, Homo Sapiens; identical to SEQ ID NO: 42163

SEQ ID NO: 686098 - RNA, 64 nt, Homo Sapiens; identical to SEQ ID NO: 42164

SEQ ID NO: 686099 - RNA, 64 nt, Homo Sapiens; identical to SEQ ID NO: 42165

SEQ ID NO: 686100 - RNA, 64 nt, Homo Sapiens; identical to SEQ ID NO: 42166

SEQ ID NO: 686101 - RNA, 64 nt, Homo Sapiens; identical to SEQ ID NO: 42167

SEQ ID NO: 686102 - RNA, 64 nt, Homo Sapiens; identical to SEQ ID NO: 42168

SEQ ID NO: 686103 - RNA, 64 nt, Homo Sapiens; identical to SEQ ID NO: 42169

SEQ ID NO: 686104 - RNA, 64 nt, Homo Sapiens; identical to SEQ ID NO: 42170

SEQ ID NO: 686105 - RNA, 64 nt, Homo Sapiens; identical to SEQ ID NO: 42171

SEQ ID NO: 686106 - RNA, 64 nt, Homo Sapiens; identical to SEQ ID NO: 42172

SEQ ID NO: 686107 - RNA, 64 nt, Homo Sapiens; identical to SEQ ID NO: 42173

SEQ ID NO: 686108 - RNA, 64 nt, Homo Sapiens; identical to SEQ ID NO: 42174

SEQ ID NO: 686109 - RNA, 64 nt, Homo Sapiens; identical to SEQ ID NO: 42175

SEQ ID NO: 686110 - RNA, 64 nt, Homo Sapiens; identical to SEQ ID NO: 42176

SEQ ID NO: 686111 - RNA, 64 nt, Homo Sapiens; identical to SEQ ID NO: 42177

SEQ ID NO: 686112 - RNA, 64 nt, Homo Sapiens; identical to SEQ ID NO: 42178

SEQ ID NO: 686113 - RNA, 64 nt, Homo Sapiens; identical to SEQ ID NO: 42179

SEQ ID NO: 686114 - RNA, 64 nt, Homo Sapiens; identical to SEQ ID NO: 42180

SEQ ID NO: 686115 - RNA, 64 nt, Homo Sapiens; identical to SEQ ID NO: 42181

SEQ ID NO: 686116 - RNA, 64 nt, Homo Sapiens; identical to SEQ ID NO: 42182

SEQ ID NO: 686117 - RNA, 64 nt, Homo Sapiens; identical to SEQ ID NO: 42183

SEQ ID NO: 686118 - RNA, 64 nt, Homo Sapiens; identical to SEQ ID NO: 42184

SEQ ID NO: 686119 - RNA, 64 nt, Homo Sapiens; identical to SEQ ID NO: 42185

SEQ ID NO: 686120 - RNA, 64 nt, Homo Sapiens; identical to SEQ ID NO: 42186

SEQ ID NO: 686121 - RNA, 64 nt, Homo Sapiens; identical to SEQ ID NO: 42187

SEQ ID NO: 686122 - RNA, 64 nt, Homo Sapiens; identical to SEQ ID NO: 42188

SEQ ID NO: 686123 - RNA, 64 nt, Homo Sapiens; identical to SEQ ID NO: 42189

SEQ ID NO: 686124 - RNA, 64 nt, Homo Sapiens; identical to SEQ ID NO: 42190

SEQ ID NO: 686125 - RNA, 64 nt, Homo Sapiens; identical to SEQ ID NO: 42191

SEQ ID NO: 686126 - RNA, 64 nt, Homo Sapiens; identical to SEQ ID NO: 42192

SEQ ID NO: 686127 - RNA, 64 nt, Homo Sapiens; identical to SEQ ID NO: 42193

SEQ ID NO: 686128 - RNA, 64 nt, Homo Sapiens; identical to SEQ ID NO: 42194

SEQ ID NO: 686129 - RNA, 64 nt, Homo Sapiens; identical to SEQ ID NO: 42195

SEQ ID NO: 686130 - RNA, 64 nt, Homo Sapiens; identical to SEQ ID NO: 42196

SEQ ID NO: 686131 - RNA, 64 nt, Homo Sapiens; identical to SEQ ID NO: 42197

SEQ ID NO: 686132 - RNA, 64 nt, Homo Sapiens; identical to SEQ ID NO: 42198

SEQ ID NO: 686133 - RNA, 64 nt, Homo Sapiens; identical to SEQ ID NO: 42199

SEQ ID NO: 686134 - RNA, 64 nt, Homo Sapiens; identical to SEQ ID NO: 42200

SEQ ID NO: 686135 - RNA, 64 nt, Homo Sapiens; identical to SEQ ID NO: 42201

SEQ ID NO: 686136 - RNA, 64 nt, Homo Sapiens; identical to SEQ ID NO: 42202

SEQ ID NO: 686137 - RNA, 64 nt, Homo Sapiens; identical to SEQ ID NO: 42203

SEQ ID NO: 686138 - RNA, 64 nt, Homo Sapiens; identical to SEQ ID NO: 42204

SEQ ID NO: 686139 - RNA, 64 nt, Homo Sapiens; identical to SEQ ID NO: 42205

SEQ ID NO: 686140 - RNA, 64 nt, Homo Sapiens; identical to SEQ ID NO: 42206

SEQ ID NO: 686141 - RNA, 64 nt, Homo Sapiens; identical to SEQ ID NO: 42207

SEQ ID NO: 686142 - RNA, 64 nt, Homo Sapiens; identical to SEQ ID NO: 42208

SEQ ID NO: 686143 - RNA, 64 nt, Homo Sapiens; identical to SEQ ID NO: 42209

SEQ ID NO: 686144 - RNA, 64 nt, Homo Sapiens; identical to SEQ ID NO: 42210

SEQ ID NO: 686145 - RNA, 64 nt, Homo Sapiens; identical to SEQ ID NO: 42211

SEQ ID NO: 686146 - RNA, 64 nt, Homo Sapiens; identical to SEQ ID NO: 42212

SEQ ID NO: 686147 - RNA, 64 nt, Homo Sapiens; identical to SEQ ID NO: 42213

SEQ ID NO: 686148 - RNA, 64 nt, Homo Sapiens; identical to SEQ ID NO: 42214

SEQ ID NO: 686149 - RNA, 64 nt, Homo Sapiens; identical to SEQ ID NO: 42215

SEQ ID NO: 686150 - RNA, 64 nt, Homo Sapiens; identical to SEQ ID NO: 42216

SEQ ID NO: 686151 - RNA, 64 nt, Homo Sapiens; identical to SEQ ID NO: 42217

SEQ ID NO: 686152 - RNA, 64 nt, Homo Sapiens; identical to SEQ ID NO: 42218

SEQ ID NO: 686153 - RNA, 64 nt, Homo Sapiens; identical to SEQ ID NO: 42219

SEQ ID NO: 686154 - RNA, 64 nt, Homo Sapiens; identical to SEQ ID NO: 42220

SEQ ID NO: 686155 - RNA, 64 nt, Homo Sapiens; identical to SEQ ID NO: 42221

SEQ ID NO: 686156 - RNA, 64 nt, Homo Sapiens; identical to SEQ ID NO: 42222

SEQ ID NO: 686157 - RNA, 64 nt, Homo Sapiens; identical to SEQ ID NO: 42223

SEQ ID NO: 686158 - RNA, 64 nt, Homo Sapiens; identical to SEQ ID NO: 42224

SEQ ID NO: 686159 - RNA, 64 nt, Homo Sapiens; identical to SEQ ID NO: 42225

SEQ ID NO: 686160 - RNA, 64 nt, Homo Sapiens; identical to SEQ ID NO: 42226

SEQ ID NO: 686161 - RNA, 64 nt, Homo Sapiens; identical to SEQ ID NO: 42227

SEQ ID NO: 686162 - RNA, 64 nt, Homo Sapiens; identical to SEQ ID NO: 42228

SEQ ID NO: 686163 - RNA, 64 nt, Homo Sapiens; identical to SEQ ID NO: 42229

SEQ ID NO: 686164 - RNA, 64 nt, Homo Sapiens; identical to SEQ ID NO: 42230

SEQ ID NO: 686165 - RNA, 64 nt, Homo Sapiens; identical to SEQ ID NO: 42231

SEQ ID NO: 686166 - RNA, 64 nt, Homo Sapiens; identical to SEQ ID NO: 42232

SEQ ID NO: 686167 - RNA, 64 nt, Homo Sapiens; identical to SEQ ID NO: 42233

SEQ ID NO: 686168 - RNA, 64 nt, Homo Sapiens; identical to SEQ ID NO: 42234

SEQ ID NO: 686169 - RNA, 64 nt, Homo Sapiens; identical to SEQ ID NO: 42235

SEQ ID NO: 686170 - RNA, 64 nt, Homo Sapiens; identical to SEQ ID NO: 421584

SEQ ID NO: 686171 - RNA, 64 nt, Homo Sapiens; identical to SEQ ID NO: 421585

SEQ ID NO: 686172 - RNA, 64 nt, Homo Sapiens; identical to SEQ ID NO: 421586

SEQ ID NO: 686173 - RNA, 64 nt, Homo Sapiens; identical to SEQ ID NO: 421587

SEQ ID NO: 686174 - RNA, 64 nt, Homo Sapiens; identical to SEQ ID NO: 421588

SEQ ID NO: 686175 - RNA, 64 nt, Homo Sapiens; identical to SEQ ID NO: 421589

SEQ ID NO: 686176 - RNA, 51 nt, Homo Sapiens; identical to SEQ ID NO: 421590

SEQ ID NO: 686177 - RNA, 64 nt, Homo Sapiens; identical to SEQ ID NO: 421591

SEQ ID NO: 686178 - RNA, 64 nt, Homo Sapiens; identical to SEQ ID NO: 421592

SEQ ID NO: 686179 - RNA, 64 nt, Homo Sapiens; identical to SEQ ID NO: 421593

SEQ ID NO: 686180 - RNA, 64 nt, Homo Sapiens; identical to SEQ ID NO: 421594

SEQ ID NO: 686181 - RNA, 64 nt, Homo Sapiens; identical to SEQ ID NO: 421595

SEQ ID NO: 686182 - RNA, 64 nt, Homo Sapiens; identical to SEQ ID NO: 421596

SEQ ID NO: 686183 - RNA, 64 nt, Homo Sapiens; identical to SEQ ID NO: 421597

SEQ ID NO: 686184 - RNA, 64 nt, Homo Sapiens; identical to SEQ ID NO: 421598

SEQ ID NO: 686185 - RNA, 64 nt, Homo Sapiens; identical to SEQ ID NO: 421599

SEQ ID NO: 686186 - RNA, 64 nt, Homo Sapiens; identical to SEQ ID NO: 421600

SEQ ID NO: 686187 - RNA, 64 nt, Homo Sapiens; identical to SEQ ID NO: 421601

SEQ ID NO: 686188 - RNA, 64 nt, Homo Sapiens; identical to SEQ ID NO: 421602

SEQ ID NO: 686189 - RNA, 64 nt, Homo Sapiens; identical to SEQ ID NO: 421603

SEQ ID NO: 686190 - RNA, 64 nt, Homo Sapiens; identical to SEQ ID NO: 421604

SEQ ID NO: 686191 - RNA, 64 nt, Homo Sapiens; identical to SEQ ID NO: 421605

SEQ ID NO: 686192 - RNA, 64 nt, Homo Sapiens; identical to SEQ ID NO: 421606

SEQ ID NO: 686193 - RNA, 64 nt, Homo Sapiens; identical to SEQ ID NO: 421607

SEQ ID NO: 686194 - RNA, 64 nt, Homo Sapiens; identical to SEQ ID NO: 421608

SEQ ID NO: 686195 - RNA, 64 nt, Homo Sapiens; identical to SEQ ID NO: 421609

SEQ ID NO: 686196 - RNA, 64 nt, Homo Sapiens; identical to SEQ ID NO: 421610

SEQ ID NO: 686197 - RNA, 64 nt, Homo Sapiens; identical to SEQ ID NO: 421611

SEQ ID NO: 686198 - RNA, 64 nt, Homo Sapiens; identical to SEQ ID NO: 421612

SEQ ID NO: 686199 - RNA, 64 nt, Homo Sapiens; identical to SEQ ID NO: 421613

SEQ ID NO: 686200 - RNA, 64 nt, Homo Sapiens; identical to SEQ ID NO: 421614

SEQ ID NO: 686201 - RNA, 64 nt, Homo Sapiens; identical to SEQ ID NO: 421615

SEQ ID NO: 686202 - RNA, 64 nt, Homo Sapiens; identical to SEQ ID NO: 421616

SEQ ID NO: 686203 - RNA, 64 nt, Homo Sapiens; identical to SEQ ID NO: 421617

SEQ ID NO: 686204 - RNA, 64 nt, Homo Sapiens; identical to SEQ ID NO: 421618

SEQ ID NO: 686205 - RNA, 64 nt, Homo Sapiens; identical to SEQ ID NO: 421619

SEQ ID NO: 686206 - RNA, 64 nt, Homo Sapiens; identical to SEQ ID NO: 421620

SEQ ID NO: 686207 - RNA, 64 nt, Homo Sapiens; identical to SEQ ID NO: 421621

SEQ ID NO: 686208 - RNA, 64 nt, Homo Sapiens; identical to SEQ ID NO: 421622

SEQ ID NO: 686209 - RNA, 59 nt, Homo Sapiens
auagcccacgggaauaucucuguuaaacuacaggcaaacaauaaaauaaugcauaguug

SEQ ID NO: 686210 - RNA, 59 nt, Homo Sapiens
uuguguucucugugcccucaguugaggguacaggcaaccccugaaaagccuugaagggg

SEQ ID NO: 686211 - RNA, 59 nt, Homo Sapiens
accugaagacucauucuucuguacgucugacaggcaaugcuggcuguuggcugggggcc

SEQ ID NO: 686212 - RNA, 59 nt, Homo Sapiens
cccggcugcgugguugaugaucuuugcagacaggcaagcaccuccugccucgaacuggc

SEQ ID NO: 686213 - RNA, 59 nt, Homo Sapiens
gggcuaaaugcuccaauuaaaagacacagacaggcaaauuggauaaauagucaagaccc

SEQ ID NO: 686214 - RNA, 59 nt, Homo Sapiens
cacagcaaaagaaacuaccaucagagucaacaggcaaccuacaaaaugggagaaaauuu

SEQ ID NO: 686215 - RNA, 64 nt, Homo Sapiens; identical to SEQ ID NO: 125921

SEQ ID NO: 686216 - RNA, 64 nt, Homo Sapiens; identical to SEQ ID NO: 125922

SEQ ID NO: 686217 - RNA, 64 nt, Homo Sapiens; identical to SEQ ID NO: 125923

SEQ ID NO: 686218 - RNA, 64 nt, Homo Sapiens; identical to SEQ ID NO: 125924

SEQ ID NO: 686219 - RNA, 64 nt, Homo Sapiens; identical to SEQ ID NO: 125925

SEQ ID NO: 686220 - RNA, 64 nt, Homo Sapiens; identical to SEQ ID NO: 125926

SEQ ID NO: 686221 - RNA, 64 nt, Homo Sapiens; identical to SEQ ID NO: 125927

SEQ ID NO: 686222 - RNA, 64 nt, Homo Sapiens; identical to SEQ ID NO: 125928

SEQ ID NO: 686223 - RNA, 64 nt, Homo Sapiens; identical to SEQ ID NO: 125929

SEQ ID NO: 686224 - RNA, 64 nt, Homo Sapiens; identical to SEQ ID NO: 125930

SEQ ID NO: 686225 - RNA, 64 nt, Homo Sapiens; identical to SEQ ID NO: 125931

SEQ ID NO: 686226 - RNA, 64 nt, Homo Sapiens; identical to SEQ ID NO: 125932

SEQ ID NO: 686227 - RNA, 64 nt, Homo Sapiens
aaaaauuuucaucuaaaguauuaauuuuuucuaaguaagauacaaaauucuuuuaaauaucaac

SEQ ID NO: 686228 - RNA, 64 nt, Homo Sapiens
aaacaguuucuuagagcagagaauauuuaaaauuguaagauaagaaaaguaguuugaguguuau

SEQ ID NO: 686229 - RNA, 64 nt, Homo Sapiens
uagauucuaaucugagugaguuacugagcuuugguccacuaaaacaagcugagcuuugguccac

SEQ ID NO: 686230 - RNA, 64 nt, Homo Sapiens
gagcuuugguccacuaaaacaagcugagcuuugguccacuaaaacaagaugaaaaauacaagag

SEQ ID NO: 686231 - RNA, 64 nt, Homo Sapiens
gucucauaaggaggcagccaaaacuuacuagagcuccacuaacaaucuucuguggugcuuaagg

SEQ ID NO: 686232 - RNA, 64 nt, Homo Sapiens
uggucuucuucaagagagcuaaauuagacauuaauccacuaaacuugucuuuauuacuauaugu

SEQ ID NO: 686233 - RNA, 64 nt, Homo Sapiens
gagaauccuagccccacuaaaucaaagcccucacuccacuaaugugcucuucuagacaacucac

SEQ ID NO: 686234 - RNA, 64 nt, Homo Sapiens
cguccacgggauuaacagaaugacaaacggaagauccacuaaaauccaacguuugccaucugga

SEQ ID NO: 686235 - RNA, 64 nt, Homo Sapiens
uaucugauucuucaccaccguauucucagucacuuccacuaaacagugccaguguuuuaagguu

SEQ ID NO: 686236 - RNA, 64 nt, Homo Sapiens
gcuuaguugauguguguguguguguucugauuacuccacuaacugaugguuccccaucucucuc

SEQ ID NO: 686237 - RNA, 64 nt, Homo Sapiens
uuccuugaagcauuuaaauuugaauuaagccuucauagcguauuuuuaccuuaaauaacugaaa

SEQ ID NO: 686238 - RNA, 64 nt, Homo Sapiens
uuguguuggcuauuagagagaaaaucuuauuuuaauagcguauucauugaaaauuugaaaggua

SEQ ID NO: 686239 - RNA, 64 nt, Homo Sapiens
ugcaucucugcguauuuucaucuuuuuauguaaaauagcguagaccuugcacuuuuugaaucuc

SEQ ID NO: 686240 - RNA, 64 nt, Homo Sapiens
gagaggacggguggauauuucaaauuuuuuuaguauagcguaucgcaaggguuugacacggcug

SEQ ID NO: 686241 - RNA, 64 nt, Homo Sapiens
aagauauaguaaaugcaucuaacucaaaacagauauagcguauaaccagcugcugcagauauau

SEQ ID NO: 686242 - RNA, 64 nt, Homo Sapiens
guaaaguaugauauggaaaugagcccaugaaguaauagcguaaacaaacagaccaaaugcccag

SEQ ID NO: 686243 - RNA, 64 nt, Homo Sapiens
caaaauacauggaugcccaaguccucagcuaaaaauagcguaguauuugcauauaaccuaugca

SEQ ID NO: 686244 - RNA, 64 nt, Homo Sapiens
aacaguguuuguaauuauagagacuucuaauugaauagcguaacaagaacaguguggcaugauc

SEQ ID NO: 686245 - RNA, 64 nt, Homo Sapiens
aaauuaaaaacaguauuugggggagaaacgugcaauagcguaaugguggugucccugccaauuc

SEQ ID NO: 686246 - RNA, 64 nt, Homo Sapiens
uguuuuacucuuuuacacuguauaauuguaagaaauagcguauuauuugugaaugcauggucug

SEQ ID NO: 686247 - RNA, 64 nt, Homo Sapiens
aaaaaaaauaaagggauauggcuguuguagaaagauagcguauuugcauuuacaauaacaguag

SEQ ID NO: 686248 - RNA, 64 nt, Homo Sapiens
cugcuaaauacuguaauguuaauuuguucaguucauagcguagaacuccugauuaaauauuaca

SEQ ID NO: 686249 - RNA, 64 nt, Homo Sapiens
gcuguguuuauuaagccaggauagagucaaaacuauagcguaauaaaagaacauuuagaauucu

SEQ ID NO: 686250 - RNA, 64 nt, Homo Sapiens
uauaggaaggcaggaugguucaggaaccuacugaauagcguagacauguacauaagaauugaca

SEQ ID NO: 686251 - RNA, 64 nt, Homo Sapiens
agacuacacaaugcacugauagagaccucaguuuauagcguaacgcuaaaauaaucuuucauaa

SEQ ID NO: 686252 - RNA, 64 nt, Homo Sapiens
uguuuuaguuuaaugucuccuaagcuuuucucucauagcguagaccuagggaagggaugggaag

SEQ ID NO: 686253 - RNA, 64 nt, Homo Sapiens
aucacuugucaaaucauugaguuuauuuaugaaaauagcguauuacaaauacuggauauuagca

SEQ ID NO: 686254 - RNA, 64 nt, Homo Sapiens
gcacgggucacagccugguaaugguuuaacuguaauagcguacccagccccucuucccucccac

SEQ ID NO: 686255 - RNA, 64 nt, Homo Sapiens
uacuuauuuuuuuuaaaaaccagagcaaaaaaauauagcguaaaaauaaguggucucuuuuuag

SEQ ID NO: 686256 - RNA, 64 nt, Homo Sapiens
ugugugggguugggagcccccucgagauuccaucauagcguaggagaggagucgggagucgaga

SEQ ID NO: 686257 - RNA, 64 nt, Homo Sapiens
uuuggaaaguuuagcaaaaugaaaaaacuucaugauagcguaagguuauagcaauacucaaaug

SEQ ID NO: 686258 - RNA, 64 nt, Homo Sapiens
uucauuacccugggcaauuuaaagaaaucauaucauagcguaguucagauacuaaaauuugaag

SEQ ID NO: 686259 - RNA, 64 nt, Homo Sapiens
cagaagugcuauacgguuaggucuguuugugcucagucaagaacuaagaaauaguaugaauugu

SEQ ID NO: 686260 - RNA, 64 nt, Homo Sapiens
cucagucaagaacuaagaaauaguaugaauuguaagucaagaugggcaacucagauggagcagc

SEQ ID NO: 686261 - RNA, 64 nt, Homo Sapiens
auaaauccuuaggagaaauauucccucaaaaccuagucaagaaagugccacauucccaccuucu

SEQ ID NO: 686262 - RNA, 64 nt, Homo Sapiens
gcuuuaaugcauggaaaaacuucaguuacugaccagucaagagaauuucucaagaaaaauccca

SEQ ID NO: 686263 - RNA, 64 nt, Homo Sapiens
acguuagagacuucguccaccuuuacccuucaguagucaagauuucucuaaccugugggcaagu

SEQ ID NO: 686264 - RNA, 64 nt, Homo Sapiens
cacuaagcagaauuuagaaaagcuugaauugaggagucaagagugaggcagugacuguugaaaa

SEQ ID NO: 686265 - RNA, 64 nt, Homo Sapiens
uaauggaaucaaguuaaguacucuggaggccuguugggugaauuuaucaaagcaguaauaucuu

SEQ ID NO: 686266 - RNA, 64 nt, Homo Sapiens
acuucggcucuggaguuacagcaccacagggaggugggugaagcuuaccucuuuuucuguagag

SEQ ID NO: 686267 - RNA, 64 nt, Homo Sapiens
cagugagccgagauugugcugcugcacuccagccugggugaaaaagacaggcugugucuccaaa

SEQ ID NO: 686268 - RNA, 64 nt, Homo Sapiens
caguguacuugcaacagaggcuugggaugaagggugggugaaguugacaucacgauagaaaaca

SEQ ID NO: 686269 - RNA, 64 nt, Homo Sapiens
cggcagaagggaacugccugggcucccuugugcgugggugaagccgcugcuggguuuuccuccg

SEQ ID NO: 686270 - RNA, 64 nt, Homo Sapiens
gguuuuccuccgggagaggggacggucaauccugugggugaagacagagggaaacacagcagcu

SEQ ID NO: 686271 - RNA, 64 nt, Homo Sapiens
gagacagcuugguucccuuucccuagcucccuggugggugaaugccaccuccugagauccucac

SEQ ID NO: 686272 - RNA, 64 nt, Homo Sapiens
gguguggucagccucucucacacaaggaggaacuugggugaaggcugagugugaggcaccugaa

SEQ ID NO: 686273 - RNA, 64 nt, Homo Sapiens; identical to SEQ ID NO: 332827

SEQ ID NO: 686274 - RNA, 64 nt, Homo Sapiens; identical to SEQ ID NO: 332828

SEQ ID NO: 686275 - RNA, 64 nt, Homo Sapiens; identical to SEQ ID NO: 332829

SEQ ID NO: 686276 - RNA, 64 nt, Homo Sapiens; identical to SEQ ID NO: 332830

SEQ ID NO: 686277 - RNA, 64 nt, Homo Sapiens; identical to SEQ ID NO: 332831

SEQ ID NO: 686278 - RNA, 64 nt, Homo Sapiens; identical to SEQ ID NO: 332832

SEQ ID NO: 686279 - RNA, 64 nt, Homo Sapiens; identical to SEQ ID NO: 229078

SEQ ID NO: 686280 - RNA, 64 nt, Homo Sapiens; identical to SEQ ID NO: 229079

SEQ ID NO: 686281 - RNA, 64 nt, Homo Sapiens; identical to SEQ ID NO: 417262

SEQ ID NO: 686282 - RNA, 64 nt, Homo Sapiens; identical to SEQ ID NO: 417263

SEQ ID NO: 686283 - RNA, 64 nt, Homo Sapiens; identical to SEQ ID NO: 417264

SEQ ID NO: 686284 - RNA, 64 nt, Homo Sapiens; identical to SEQ ID NO: 417265

SEQ ID NO: 686285 - RNA, 64 nt, Homo Sapiens; identical to SEQ ID NO: 417266

SEQ ID NO: 686286 - RNA, 64 nt, Homo Sapiens; identical to SEQ ID NO: 417267

SEQ ID NO: 686287 - RNA, 64 nt, Homo Sapiens; identical to SEQ ID NO: 417268

SEQ ID NO: 686288 - RNA, 64 nt, Homo Sapiens; identical to SEQ ID NO: 417269

SEQ ID NO: 686289 - RNA, 64 nt, Homo Sapiens; identical to SEQ ID NO: 417270

SEQ ID NO: 686290 - RNA, 64 nt, Homo Sapiens; identical to SEQ ID NO: 417271

SEQ ID NO: 686291 - RNA, 64 nt, Homo Sapiens; identical to SEQ ID NO: 417272

SEQ ID NO: 686292 - RNA, 64 nt, Homo Sapiens; identical to SEQ ID NO: 417273

SEQ ID NO: 686293 - RNA, 64 nt, Homo Sapiens
ugucagcccuucugagacaggaccuggcuucaggacuguggacugggcugcuggccugcuugcu

SEQ ID NO: 686294 - RNA, 64 nt, Homo Sapiens
accccaaaaugaaaguuauagaaagcugucuacaacuguggaguugguagcugguaacauuguu

SEQ ID NO: 686295 - RNA, 64 nt, Homo Sapiens
gaaucaguuuugaccuugaugauuuuuuguuuccacuguggaaauaaauguuuguaaauaagug

SEQ ID NO: 686296 - RNA, 64 nt, Homo Sapiens
uacaugcuuauuccuuaagggauguguuagaguuacuguggauuucucuguuuucugucuuaca

SEQ ID NO: 686297 - RNA, 64 nt, Homo Sapiens
ggucauugucucguggccagagggcccagcagccacuguggaccuggggcguucuggggcugca

SEQ ID NO: 686298 - RNA, 64 nt, Homo Sapiens
uggaccuggggcguucuggggcugcagaagacugacuguggaugugccauuugccaggaaggua

SEQ ID NO: 686299 - RNA, 64 nt, Homo Sapiens
gggaagugacgaccgcugggagaacaucaggugcacuguggacgugggucugggggucucaccc

SEQ ID NO: 686300 - RNA, 64 nt, Homo Sapiens
aacuuaaaauuuagucgaggcaguuucaauuguuacuguggaccgaauuaggaucacaauaaac

SEQ ID NO: 686301 - RNA, 64 nt, Homo Sapiens
cuucuacuccugcaguaagcuggaauuugcuagaacuguggaaguggcaguaugaccagaauca

SEQ ID NO: 686302 - RNA, 64 nt, Homo Sapiens
gagcuaggucuacugauauaguuaaccacugauaacuguggaaauauaucccugguaguuuugu

SEQ ID NO: 686303 - RNA, 64 nt, Homo Sapiens
ccuuccccuaggucuucagaagcaucaaguuuuaacuguggacauuggauuugguggaacagca

SEQ ID NO: 686304 - RNA, 64 nt, Homo Sapiens
gguguugcugcguggggagaacuugguauccaugacuguggaggggccaccccccaaagaugua

SEQ ID NO: 686305 - RNA, 64 nt, Homo Sapiens
ccuuccccucaccacgagcucccggccugcccagacuguggacacuggccgugcccaaugagac

SEQ ID NO: 686306 - RNA, 64 nt, Homo Sapiens
cccccucuccugcaccucccuggcccugccggccacuguggacgcccuggggcuuggcacccac

SEQ ID NO: 686307 - RNA, 64 nt, Homo Sapiens
aagcaaaacagacccuaauuuuuuugugccaaaaacuguggacaugcuggcucagcauccucag

SEQ ID NO: 686308 - RNA, 64 nt, Homo Sapiens
gaauuguggaucgugcagccaugguuauuguggaacuguggaaccugcagccauaguuauuuga

SEQ ID NO: 686309 - RNA, 64 nt, Homo Sapiens
agugaccugguccuaagcugcagccacgcccugcacuguggagaaggaccccagagagggcagg

SEQ ID NO: 686310 - RNA, 64 nt, Homo Sapiens
ggggacuuggggagcauuuuagggcugcccaaacacuguggaaaagcgucccggcgccuccguu

SEQ ID NO: 686311 - RNA, 64 nt, Homo Sapiens
aaaacuauuuugagccauggucuuuuaauguuguacuguggagauuauugauacuauuuuuuuu

SEQ ID NO: 686312 - RNA, 64 nt, Homo Sapiens
gcccacaguguaucccaccccuuccaaagagcugacuguggaggggaggggugccuccugacag

SEQ ID NO: 686313 - RNA, 64 nt, Homo Sapiens
guuccggccugcauuucugcccaaccgucccuggacuguggaauaauacauacuuucugaauga

SEQ ID NO: 686314 - RNA, 64 nt, Homo Sapiens
acaucggcuaccagaugcugaggaguucaagcugacuguggagagccugacuacucagaguaca

SEQ ID NO: 686315 - RNA, 64 nt, Homo Sapiens
guucagaaaauuauuuuaaacaaaaggaaauaaaaagccuaaauuauauuguuauuuauuguga

SEQ ID NO: 686316 - RNA, 64 nt, Homo Sapiens
agucucucuuacugaguaaagcuauggccuuuucaagccuaagacugguugaaggugaaagugu

SEQ ID NO: 686317 - RNA, 64 nt, Homo Sapiens
caucaguccuuccuuccuaaucucuaauccccugaagccuaacacaguuccuaauguguuuugc

SEQ ID NO: 686318 - RNA, 64 nt, Homo Sapiens
guagggcugugguuuacuccugucuaaaccccugaagccuaacacaguuccuggcacacaacag

SEQ ID NO: 686319 - RNA, 64 nt, Homo Sapiens
aaccaaagcacucauuuaaacaaaaaccaagucaaagccuaauuuauaauuauacaaguaaugc

SEQ ID NO: 686320 - RNA, 64 nt, Homo Sapiens
uaaaacugccagcaacacaacucaacuuaaaauuaagccuaaccgaugaacauuucaguagguu

SEQ ID NO: 686321 - RNA, 64 nt, Homo Sapiens
cuuagcuuuuagccuggcuggugggaggugagcuagacccaaccugcagacggugugguugggg

SEQ ID NO: 686322 - RNA, 64 nt, Homo Sapiens
caugccccugacagaucuaguugguggcaaccccagacccaaccuucuugucaccccaguuccc

SEQ ID NO: 686323 - RNA, 64 nt, Homo Sapiens
cuccacucuggcuuguuuucagaaccuaaaaagcagacccaaguuuccuuucuccuccgccgca

SEQ ID NO: 686324 - RNA, 64 nt, Homo Sapiens
ugauacacaaccuucucuaaccaacuauauaucaagacccaaaaauugaagaaaaauauuguuu

SEQ ID NO: 686325 - RNA, 64 nt, Homo Sapiens
ggaugacagacagggacgaagcagagaccucuacagacccaagucaccaaguggagccuuuuuu

SEQ ID NO: 686326 - RNA, 64 nt, Homo Sapiens
uuucugacaaaggagccugcacauuugggugagcagacccaagcuguuuacagcucuuucuugu

SEQ ID NO: 686327 - RNA, 64 nt, Homo Sapiens
uucugcucuggaagagaaggaacagggagcagagagacccaacugggagccagagauggaacuu

SEQ ID NO: 686328 - RNA, 64 nt, Homo Sapiens
caggcgaagugucagcccucaauguuggguacuuagacccaaaccaauaaauggugaguuuuga

SEQ ID NO: 686329 - RNA, 64 nt, Homo Sapiens
ugagucuuaucguuguacugaacaaacaaacaaaagacccaauccgagacucugucucaaaaca

SEQ ID NO: 686330 - RNA, 64 nt, Homo Sapiens
ugaggccgggcacgguggcuggaggucaaaauaaagacccaaucucuaaggcaugaauaagagg

SEQ ID NO: 686331 - RNA, 64 nt, Homo Sapiens
uccauaaacagaacugacgucacaccaggaaaacagacccaaaucccuacuucaaguacacuuc

SEQ ID NO: 686332 - RNA, 64 nt, Homo Sapiens
ggauaacucaaguuacugguaucugugagggaaaagacccaauacagaagggcaagagaggugg

SEQ ID NO: 686333 - RNA, 64 nt, Homo Sapiens
aacgcuugguuuuacaugaacaaaaaguggugugcucgaaaaagacauuacugaugccuuuuuu

SEQ ID NO: 686334 - RNA, 64 nt, Homo Sapiens
aucuuuaaugaacuggagaacacuaagauuuaaacucgaaaauucguuguucaaguaaagaaag

SEQ ID NO: 686335 - RNA, 64 nt, Homo Sapiens; identical to SEQ ID NO: 503603

SEQ ID NO: 686336 - RNA, 64 nt, Homo Sapiens; identical to SEQ ID NO: 503604

SEQ ID NO: 686337 - RNA, 64 nt, Homo Sapiens; identical to SEQ ID NO: 503605

SEQ ID NO: 686338 - RNA, 64 nt, Homo Sapiens; identical to SEQ ID NO: 503606

SEQ ID NO: 686339 - RNA, 64 nt, Homo Sapiens; identical to SEQ ID NO: 503607

SEQ ID NO: 686340 - RNA, 64 nt, Homo Sapiens; identical to SEQ ID NO: 503608

SEQ ID NO: 686341 - RNA, 64 nt, Homo Sapiens; identical to SEQ ID NO: 503609

SEQ ID NO: 686342 - RNA, 64 nt, Homo Sapiens; identical to SEQ ID NO: 503610

SEQ ID NO: 686343 - RNA, 64 nt, Homo Sapiens; identical to SEQ ID NO: 503611

SEQ ID NO: 686344 - RNA, 64 nt, Homo Sapiens; identical to SEQ ID NO: 503612

SEQ ID NO: 686345 - RNA, 64 nt, Homo Sapiens; identical to SEQ ID NO: 503613

SEQ ID NO: 686346 - RNA, 64 nt, Homo Sapiens; identical to SEQ ID NO: 503614

SEQ ID NO: 686347 - RNA, 64 nt, Homo Sapiens; identical to SEQ ID NO: 503615

SEQ ID NO: 686348 - RNA, 64 nt, Homo Sapiens; identical to SEQ ID NO: 503616

SEQ ID NO: 686349 - RNA, 64 nt, Homo Sapiens; identical to SEQ ID NO: 503617

SEQ ID NO: 686350 - RNA, 64 nt, Homo Sapiens; identical to SEQ ID NO: 503618

SEQ ID NO: 686351 - RNA, 64 nt, Homo Sapiens; identical to SEQ ID NO: 503619

SEQ ID NO: 686352 - RNA, 64 nt, Homo Sapiens; identical to SEQ ID NO: 503620

SEQ ID NO: 686353 - RNA, 64 nt, Homo Sapiens; identical to SEQ ID NO: 503621

SEQ ID NO: 686354 - RNA, 64 nt, Homo Sapiens; identical to SEQ ID NO: 503622

SEQ ID NO: 686355 - RNA, 64 nt, Homo Sapiens
cuuguuuacucaaaauacaaaaauuggcugggugcggugguacaugccuguagucccagcuacu

SEQ ID NO: 686356 - RNA, 64 nt, Homo Sapiens
uuccuucgcccgcuaacaccacuccucuagaacucggugguaaugacugggaggucuauuccug

SEQ ID NO: 686357 - RNA, 64 nt, Homo Sapiens
caggcugucuauauccuuguaggggcugcucugacggugguaaagcagacaaggaagaaaacuu

SEQ ID NO: 686358 - RNA, 64 nt, Homo Sapiens
auaaugaugaugaugauggugguguugaugguggcggugguaggguggaggggagagaagaaga

SEQ ID NO: 686359 - RNA, 64 nt, Homo Sapiens
cauguacaaugagauuuauaaucaugauacucuucggugguaguuucaaaagacacuacuaaua

SEQ ID NO: 686360 - RNA, 64 nt, Homo Sapiens
gagcguucaccaagcugagccggagccauccuuucggugguaguuggggaaggcuaugcagauu

SEQ ID NO: 686361 - RNA, 64 nt, Homo Sapiens
uuuaucguauauuuuuguccaagcgaugagcugacggugguauugcuucucugcauguuaucag

SEQ ID NO: 686362 - RNA, 64 nt, Homo Sapiens
aguggacccuaagcaggccaagggugcguagggacggugguacccagaugcccaagucuuccag

SEQ ID NO: 686363 - RNA, 64 nt, Homo Sapiens
gggggugcggcagggacaccggaccaagguggcacggugguacuuccuacccccaggguugagg

SEQ ID NO: 686364 - RNA, 60 nt, Homo Sapiens
gucggaaacuagcuggagcuaggaggagaucggugguaagagagaagcgagucuucuuga

SEQ ID NO: 686365 - RNA, 64 nt, Homo Sapiens
uccugauagacauggggcuccacauccaguggagcggugguagacauuuugauggacaaagugg

SEQ ID NO: 686366 - RNA, 64 nt, Homo Sapiens
uaccccagaugccugccucuuuucucguucacaccggugguaucgccagccggcagcccgggcc

SEQ ID NO: 686367 - RNA, 64 nt, Homo Sapiens
gacauuuuucugcugcccauuuguguccuggagacggugguacccugaaggcagaggccagcug

SEQ ID NO: 686368 - RNA, 64 nt, Homo Sapiens
aaccuggggggaggaggggcguugaauuguauugcggugguaucuugagggcauguugcauauu

SEQ ID NO: 686369 - RNA, 64 nt, Homo Sapiens
cugaaggcagaggccagcuguuguguccuggagacggugguaccgacauuuuucugcugcccau

SEQ ID NO: 686370 - RNA, 64 nt, Homo Sapiens
gaaaauggccuuguugccuguguagagcaaguuacggugguacugccacucugcagguggagcg

SEQ ID NO: 686371 - RNA, 64 nt, Homo Sapiens
gagagauaaaagguggaguuugcggagcgggaggcggugguagaccaggguuucucugcagaug

SEQ ID NO: 686372 - RNA, 64 nt, Homo Sapiens
aggaccgaggugaugaguucacauacacuggaagcggugguaaaaaucuugcugguaacaaaag

SEQ ID NO: 686373 - RNA, 64 nt, Homo Sapiens
cucagggcccauuucaucucuggcagugccuuggcggugguauucaaggcaguuuuguagcacc

SEQ ID NO: 686374 - RNA, 64 nt, Homo Sapiens
augcccccucccccgacacagacucucaaucugccggugguaagaaccgguucugagcuggcgu

SEQ ID NO: 686375 - RNA, 64 nt, Homo Sapiens
guaccgcccaggccuuaaucacccccauuccgugcggugguaucucccaggcucuacauucucg

SEQ ID NO: 686376 - RNA, 64 nt, Homo Sapiens
cuucugcugggcuggggccugauggggagggucucggugguaccaggucuccuccaccgccaug

SEQ ID NO: 686377 - RNA, 64 nt, Homo Sapiens
caucugggggcccugguuuucuucuuuagggcuucggugguaauagugggugcaugugggaacu

SEQ ID NO: 686378 - RNA, 64 nt, Homo Sapiens
ucuggaguuucucuaaagucacuagugaacaauucggugguaaaaguaccacacaaacuauggg

SEQ ID NO: 686379 - RNA, 64 nt, Homo Sapiens
uauggcacgauuccuuuggaaaguccgcacaugucggugguauugggguggauucucgaggugg

SEQ ID NO: 686380 - RNA, 64 nt, Homo Sapiens
gaaaguguggguuugguuagggcucugagaaucacggugguaaauggaacauuucuuucuugcu

SEQ ID NO: 686381 - RNA, 64 nt, Homo Sapiens
cagguugugguuuaaauggucaucacgaaagggucggugguaacucagggguuuggccaagaau

SEQ ID NO: 686382 - RNA, 64 nt, Homo Sapiens
aucucagcucacugcaaucucucaggcuggagugcggugguauaggccauaucucacucuguca

SEQ ID NO: 686383 - RNA, 64 nt, Homo Sapiens
ucccuuucuaaggucccuucuggcacggggcacgcggugguagagucaccaaagugcccaacuc

SEQ ID NO: 686384 - RNA, 64 nt, Homo Sapiens
ucggagacaccugucugcaucgaggauaucccagcggugguacuauucaguuuaggcgcuggcc

SEQ ID NO: 686385 - RNA, 64 nt, Homo Sapiens
agggcuggaggccccggcggcuaggaggaggccucggugguaccagaagaggaggggcugaugu

SEQ ID NO: 686386 - RNA, 64 nt, Homo Sapiens
gggacccggggggcuccuccucguccucccccagcggugguaggacagaccauagacggacccc

SEQ ID NO: 686387 - RNA, 64 nt, Homo Sapiens
auuaauggcugugacugaacacacgcggcccugacggugguauccaguuaacucaaaaccaaca

SEQ ID NO: 686388 - RNA, 64 nt, Homo Sapiens
gaucucacuucccuuccgcuccaagcaccaguuccggugguacgggggaauaccagugaaauag

SEQ ID NO: 686389 - RNA, 64 nt, Homo Sapiens
cauggaaaucgggagugaaguugccagagaaaaacggugguagccuuuaaaauucgucucugau

SEQ ID NO: 686390 - RNA, 64 nt, Homo Sapiens
cguucagggcccugaauaaauguguugcauguccacgcaccacccacgcugcugugggcccgag

SEQ ID NO: 686391 - RNA, 64 nt, Homo Sapiens
cgcguccuccaggcaccucggccuggcgcuccccacgcaccauggcgacgacgccaccaucaaa

SEQ ID NO: 686392 - RNA, 64 nt, Homo Sapiens
augaagcccacucacuugccauuccagggccaaaggaccggagguuugcauauccgccccuugu

SEQ ID NO: 686393 - RNA, 64 nt, Homo Sapiens
cccugcagaaggccccgugcugguggaaggcggaggaccggaguagaagcccguccuccuaugc

SEQ ID NO: 686394 - RNA, 64 nt, Homo Sapiens
acgagagagggcuggacaucguacguggaggacgggaccggaagcauccggcaacagucugaaa

SEQ ID NO: 686395 - RNA, 64 nt, Homo Sapiens
ccccuccacagacacccgcgccagugcaguaccuggaccggagccacccagggaugagcagugu

SEQ ID NO: 686396 - RNA, 64 nt, Homo Sapiens
caccaaaugcuggugcugcucacguggcgccuguggaccggaagacagagauaguccuggaaga

SEQ ID NO: 686397 - RNA, 64 nt, Homo Sapiens
ggccgggaacuguccgaggugcugagcuggggcgggaccggaauccucccgguaggguaccagg

SEQ ID NO: 686398 - RNA, 64 nt, Homo Sapiens
ggcguuguggucuuugcauugggggaggggggagggaccggaugggcggggggagggggagggg

SEQ ID NO: 686399 - RNA, 64 nt, Homo Sapiens
aagaaguacauggcaagaagaagaaacucuccaaggaccggaugauaccaagaacauggaggcc

SEQ ID NO: 686400 - RNA, 64 nt, Homo Sapiens
ugucauugccagacagaauuagauggcccauuuuggaccggaacuuuuuuuuuaaaugaucaua

SEQ ID NO: 686401 - RNA, 64 nt, Homo Sapiens
ugaugggagcugcuucucccgcguccuguugcagggaccggagcgguuaauuuuucacuccagu

SEQ ID NO: 686402 - RNA, 64 nt, Homo Sapiens
gcugcugcguggagcacuuaaaguccagccuccaggaccggaugccccuccugucucccgcucc

SEQ ID NO: 686403 - RNA, 64 nt, Homo Sapiens
caugcagggcccccacaggacguguccuauccccggaccggacgaugcagggcccccacaggag

SEQ ID NO: 686404 - RNA, 64 nt, Homo Sapiens
gccuggguccccaccaugcucucaccgccaggggggaccggaauugaacgaggccauugguacc

SEQ ID NO: 686405 - RNA, 64 nt, Homo Sapiens
uaccuucucuucugucaugauucuaucaucucuaggaccggaaccacuccuuuuuuucccauug

SEQ ID NO: 686406 - RNA, 64 nt, Homo Sapiens
cagacaccgcucaucccgaucucuuccugucagaggaccggagaagugugagaaggugccccuu

SEQ ID NO: 686407 - RNA, 64 nt, Homo Sapiens
ggggucaggccagauggggcaggaaggcuccgcaggaccggaccccuagaccacccugccccac

SEQ ID NO: 686408 - RNA, 64 nt, Homo Sapiens
uuucuuauuucucauuuggaaaacgaaucaucagggaccggauacaucgaguugaacaggacuu

SEQ ID NO: 686409 - RNA, 64 nt, Homo Sapiens
uggcucuuccucccagagcagccggcagcuaccuggaccggaaauguccucauccccucccugg

SEQ ID NO: 686410 - RNA, 64 nt, Homo Sapiens
ccacccuggacugaaguucugcaaaguccuccgaggaccggaacacguuucugcgacccggggc

SEQ ID NO: 686411 - RNA, 64 nt, Homo Sapiens
cgugacauccagcacuuggucagacccuagccagggaccggacaccugccccgcccaggcuggg

SEQ ID NO: 686412 - RNA, 64 nt, Homo Sapiens
ugccuggcgggcagccccugcuggaccaaggugcggaccggagcggcugaggacggggcagagc

SEQ ID NO: 686413 - RNA, 64 nt, Homo Sapiens
gccgaggggagcugggaccugcccaacgccucccggaccggaccugggcuccuagcgcucgaaa

SEQ ID NO: 686414 - RNA, 64 nt, Homo Sapiens
aagggggaagccggccagggagcgagcccagaacggaccggacgccugugcacccccagcccug

SEQ ID NO: 686415 - RNA, 64 nt, Homo Sapiens
cuuucuuucagacccugccuaccugcaggcagauggaccggaggguuuucugcuuccuuucaac

SEQ ID NO: 686416 - RNA, 64 nt, Homo Sapiens
auuucugcaaggcccuugugcgggggaggcccagggaccggagcaggagccccgccccuccugc

SEQ ID NO: 686417 - RNA, 64 nt, Homo Sapiens
acaccagaaagagggaugcuugugcccugagcagggaccggauagcguggaccgaggaggucuu

SEQ ID NO: 686418 - RNA, 64 nt, Homo Sapiens
uccugguggcccugaugcagaagaaccggcggaaggaccggaagcuaggggccagucucuucac

SEQ ID NO: 686419 - RNA, 64 nt, Homo Sapiens
ucaaguuuggagccguuuccgugguuguagcagaggaccggagguuggguuccugauuaaacuu

SEQ ID NO: 686420 - RNA, 64 nt, Homo Sapiens
uauggacuuggucugaugcugaaugggccacuugggaccggaagugacuugcuccagacaagag

SEQ ID NO: 686421 - RNA, 64 nt, Homo Sapiens
auuggaacuucagaauaggugaaggguugaggauggaccggagacaaacaggcaugggaaaaug

SEQ ID NO: 686422 - RNA, 64 nt, Homo Sapiens
guggggguggggggucccaaccggcauggacaauggaccggagaccacuucugcacuugcgguu

SEQ ID NO: 686423 - RNA, 64 nt, Homo Sapiens
cuucuuggugcugaagguaaacugaucuguaccgggaccggaaauugucaauagccucuuccuc

SEQ ID NO: 686424 - RNA, 64 nt, Homo Sapiens
ggcgcuccagggagcggagcaaggacaaggaccgggaccggaagcggcgaagcagccggagucg

SEQ ID NO: 686425 - RNA, 64 nt, Homo Sapiens
uaugacaagcuuuccaaauaaguccaucccagagggaccggaguuaggaacacgaagcacgauc

SEQ ID NO: 686426 - RNA, 64 nt, Homo Sapiens
ccuggccucugcagcagccgagcuaaaaucccagggaccggagcuguuucuccuucaggauccg

SEQ ID NO: 686427 - RNA, 64 nt, Homo Sapiens
ugacccacacuacccucccuugaccagcugucugggaccggaaaccagcuuugucuccagguag

SEQ ID NO: 686428 - RNA, 64 nt, Homo Sapiens
uaucuacugagggccuggaggggccuggggcccgggaccggaggcugacgaggcuggacuuccu

SEQ ID NO: 686429 - RNA, 64 nt, Homo Sapiens
ccagaaaccaugggucaagucaaaacugacuacuggaccggagcguaaugccuaaucuauuuau

SEQ ID NO: 686430 - RNA, 64 nt, Homo Sapiens
ccaguccugaacagcuuacucagucucaauaaagggaccggaguggguggacccacuggccugu

SEQ ID NO: 686431 - RNA, 64 nt, Homo Sapiens
gagauggcucaugaggcuugggcucacagggcuuggaccggagaagacguggugugagagggac

SEQ ID NO: 686432 - RNA, 64 nt, Homo Sapiens
cugagggagcucagggcaaaggccaggcuagcgcggaccggaaggggccgaggcugcacgggcc

SEQ ID NO: 686433 - RNA, 64 nt, Homo Sapiens
ggguuaauuuaaaggggggggcuuaguggcauauggaccggaaauuuucucuagguugguaccu

SEQ ID NO: 686434 - RNA, 64 nt, Homo Sapiens
ggggaggggacggggaaggaagaaagaauuuaaaggaccggaaugcgagaguccagguggccuu

SEQ ID NO: 686435 - RNA, 64 nt, Homo Sapiens
gcacggccucaggcccccgagggacagucggccuggaccggaccucuccuuucgcccccacacc

SEQ ID NO: 686436 - RNA, 63 nt, Homo Sapiens; identical to SEQ ID NO: 48774

SEQ ID NO: 686437 - RNA, 63 nt, Homo Sapiens; identical to SEQ ID NO: 48775

SEQ ID NO: 686438 - RNA, 63 nt, Homo Sapiens; identical to SEQ ID NO: 48776

SEQ ID NO: 686439 - RNA, 63 nt, Homo Sapiens; identical to SEQ ID NO: 48777

SEQ ID NO: 686440 - RNA, 63 nt, Homo Sapiens; identical to SEQ ID NO: 48778

SEQ ID NO: 686441 - RNA, 63 nt, Homo Sapiens; identical to SEQ ID NO: 48779

SEQ ID NO: 686442 - RNA, 63 nt, Homo Sapiens; identical to SEQ ID NO: 48780

SEQ ID NO: 686443 - RNA, 63 nt, Homo Sapiens; identical to SEQ ID NO: 48781

SEQ ID NO: 686444 - RNA, 63 nt, Homo Sapiens; identical to SEQ ID NO: 48782

SEQ ID NO: 686445 - RNA, 63 nt, Homo Sapiens; identical to SEQ ID NO: 48783

SEQ ID NO: 686446 - RNA, 63 nt, Homo Sapiens; identical to SEQ ID NO: 48784

SEQ ID NO: 686447 - RNA, 63 nt, Homo Sapiens; identical to SEQ ID NO: 48785

SEQ ID NO: 686448 - RNA, 63 nt, Homo Sapiens; identical to SEQ ID NO: 48786

SEQ ID NO: 686449 - RNA, 63 nt, Homo Sapiens; identical to SEQ ID NO: 48787

SEQ ID NO: 686450 - RNA, 63 nt, Homo Sapiens; identical to SEQ ID NO: 48788

SEQ ID NO: 686451 - RNA, 64 nt, Homo Sapiens
cauuuuagcauguuaaauaguguugaguccaaugugccauaagagaugccucaucagaacaugc

SEQ ID NO: 686452 - RNA, 64 nt, Homo Sapiens
aaaaaacuugaucguuuucuauaguaacccaagaugccauaaaauggauuuugcaugagugagu

SEQ ID NO: 686453 - RNA, 64 nt, Homo Sapiens
aaauacacucuaaaaucuuguuuuauaacucuauugccauaagaaggaaaaucauagguuacca

SEQ ID NO: 686454 - RNA, 64 nt, Homo Sapiens
acacaaauuuaaaaagaaagccccugcccucugcugccauaaucugauaugcuguuaucaccac

SEQ ID NO: 686455 - RNA, 64 nt, Homo Sapiens
aacucaauggaaauauuccuuucugacugcuaguugccauaaauauagucaccugacuaagaaa

SEQ ID NO: 686456 - RNA, 64 nt, Homo Sapiens
cuuuggaaaagauguauuauaauagaaacaagccugccauaaucaaaagagaauauacaugaag

SEQ ID NO: 686457 - RNA, 64 nt, Homo Sapiens
cuucccuugcuuguaucuucuauuugcauugcuuugccauaagucuuuauuauuuguuauuuuu

SEQ ID NO: 686458 - RNA, 64 nt, Homo Sapiens
ccuuuauuauuuguuauuuuguucaagucuaaaaugccauaaccgcaaauguacugaaagggua

SEQ ID NO: 686459 - RNA, 64 nt, Homo Sapiens
cuucacuagucaagaaugccagaaugggccuuucugccauaauugaccauguuugagacucaga

SEQ ID NO: 686460 - RNA, 64 nt, Homo Sapiens
gagauguuugaauuuauuagaaucugaugaacucugccauaauaucaacaauggaucccgcuac

SEQ ID NO: 686461 - RNA, 64 nt, Homo Sapiens
uauuuuuuuaauuuggcaggaaaaacaaacaggcugccauaauaaauaaaaagaaaaaaaaaac

SEQ ID NO: 686462 - RNA, 64 nt, Homo Sapiens
cccaaucaaaugaagaaauauagaggauaugaaaugccauaagaaaaaaaauucugguugaaga

SEQ ID NO: 686463 - RNA, 64 nt, Homo Sapiens
guacaaauuugaguaaaugcaaguuugguuugaaugccauaauaaaaugauauaaacagugcuu

SEQ ID NO: 686464 - RNA, 64 nt, Homo Sapiens
auauuuucuuagagaaugaccaaaucuccuuucuugccauaauuaacauuuaguaauuauguag

SEQ ID NO: 686465 - RNA, 64 nt, Homo Sapiens
ccccaaaguguauuuuucucuaagucgagggcuaugccauaauacaaauggaaauguuaccuuu

SEQ ID NO: 686466 - RNA, 64 nt, Homo Sapiens
aaggaacaaauuuccuuaggauuauaguauuacaugccauaaaauacuaugcuuuauugguccc

SEQ ID NO: 686467 - RNA, 64 nt, Homo Sapiens
accccuguauaucuuagcagcacugaguccagugcgagcacacacccacuauacaagaguggcu

SEQ ID NO: 686468 - RNA, 64 nt, Homo Sapiens
caauauaagugugauugcaagaaugguagaggaccgagcacagaaaucuuagagauuucuuguc

SEQ ID NO: 686469 - RNA, 64 nt, Homo Sapiens
ugcugaccgcagcccgccgcacuccgcugugucccgagcacacgagggaagggcucuggcccug

SEQ ID NO: 686470 - RNA, 64 nt, Homo Sapiens
cccgcccggggagcacaaugagagccacggagcgcgagcacaugcccgcacgcugggcaccaac

SEQ ID NO: 686471 - RNA, 64 nt, Homo Sapiens
cucuucgaacccaauuguggacagaaugcaaacacgagcacacuagggauuaagcuaagaacuu

SEQ ID NO: 686472 - RNA, 64 nt, Homo Sapiens
acccagcugccauaaccaccuuagaacuaccagacgagcacaucagaacccuuugacagccauc

SEQ ID NO: 686473 - RNA, 64 nt, Homo Sapiens
acacuuaagacucccacccugugacacugagucccgagcacagcaccuucccagucuccugugc

SEQ ID NO: 686474 - RNA, 64 nt, Homo Sapiens
accagcuggcccggccacucugaauugcgccuuccgagcacacauaaaagcacaaagacagaga

SEQ ID NO: 686475 - RNA, 64 nt, Homo Sapiens
gauccauguguucagguuuagaucauaugacacucgagcacagaagaauaauuucaaggagguc

SEQ ID NO: 686476 - RNA, 64 nt, Homo Sapiens
ccucagguuacucaggaaaaugcuccagcaugugcgagcacaugaccugagguugcaucauagc

SEQ ID NO: 686477 - RNA, 64 nt, Homo Sapiens
gcaugcguacacaauucccuggccaagccuggcucgagcacaggaagcucaucugcguuuuggc

SEQ ID NO: 686478 - RNA, 64 nt, Homo Sapiens
cagaaagaagacaugaggcucuggaguccuguuacgagcacaucaugacuuccugcucacagcc

SEQ ID NO: 686479 - RNA, 64 nt, Homo Sapiens
uggagaaauucagaaccaggugaccuucagcucacgagcacacccaggaugcacagaaugggca

SEQ ID NO: 686480 - RNA, 64 nt, Homo Sapiens
ccugcaagcgucaggcacacagggacagacauggcgagcacagugcaggcccggggcccacggg

SEQ ID NO: 686481 - RNA, 64 nt, Homo Sapiens
accacagugagagcuuuuucccuuugcuaaccaacgagcacacagaagaucuccagucacccca

SEQ ID NO: 686482 - RNA, 64 nt, Homo Sapiens
gugcagguuaguuacauaugaauuuuaggguacacgagcacaacuucuuuuuuauuacacuucg

SEQ ID NO: 686483 - RNA, 64 nt, Homo Sapiens
acacacaauccuuucuaacucucuagaaacugugcgagcacaacucuaagaugaaagauuuuua

SEQ ID NO: 686484 - RNA, 56 nt, Homo Sapiens
aaugcaaguaagugggcaccaagggccgagcacagcgcguccagcccuaccuauag

SEQ ID NO: 686485 - RNA, 64 nt, Homo Sapiens
aggaagcugagucuuucaccuauuuauuuugcagcgagcacauggauacuagcaucugguauuu

SEQ ID NO: 686486 - RNA, 64 nt, Homo Sapiens
cacacacacacacacgaacaagcacacacacacacgagcacacacacguaaagccucaaaacac

SEQ ID NO: 686487 - RNA, 64 nt, Homo Sapiens
gcugacccggcacagccagcugccccggacaaaacgagcacaguccugcguuugccgagcgcua

SEQ ID NO: 686488 - RNA, 64 nt, Homo Sapiens
uaaagcuuggucggugaccuuugcauaccaucaacgagcacagcuaagaacagagugagagagg

SEQ ID NO: 686489 - RNA, 64 nt, Homo Sapiens
cccagcuuuccgccugcacccgcgaggacgcgcgcgagcacacgcggcgccccgccaggccuua

SEQ ID NO: 686490 - RNA, 64 nt, Homo Sapiens
cuuucuguuucuuaagggcacacacacgugcgugcgagcacacacacacauacgugcacagggu

SEQ ID NO: 686491 - RNA, 64 nt, Homo Sapiens
guggaaaacgugggccggugaagcucaauuaucacgagcacauguauccagaccugccuucugg

SEQ ID NO: 686492 - RNA, 64 nt, Homo Sapiens
gcuacuugggcacacgccuguaguccaggccacucgagcacacaccuguaguaccagcuacucu

SEQ ID NO: 686493 - RNA, 64 nt, Homo Sapiens
augucuucccucccccgaccccagccugucaguccgagcacagugcagguuuggcucugacuug

SEQ ID NO: 686494 - RNA, 64 nt, Homo Sapiens
acccagacuucaugcgcccgaauauucagagacucgagcacagcuucuugucgcuuccuaucaa

SEQ ID NO: 686495 - RNA, 64 nt, Homo Sapiens
gcugaugggacuggagggagcccacccuucagcacgagcacacugcaucucuccugugaguugg

SEQ ID NO: 686496 - RNA, 64 nt, Homo Sapiens
augccacguccauccaccccaccccuuuucgucacgagcacaauggucuuacauuggauuuuug

SEQ ID NO: 686497 - RNA, 64 nt, Homo Sapiens
ccagccagcugguccucugggaacagccagcucccgagcacagccgcacuccuguugacccugg

SEQ ID NO: 686498 - RNA, 64 nt, Homo Sapiens
ggcuccguggaagaugacauugguaccuccuuagcgagcacagucucugcccgacaggcugaag

SEQ ID NO: 686499 - RNA, 64 nt, Homo Sapiens
cagccccgcaucucccacugccaacagcugaagccgagcacagaccucccuuugcacgcuggaa

SEQ ID NO: 686500 - RNA, 64 nt, Homo Sapiens
ccaugugccacacaccuugacaaaggcuauugaccgagcacauaaccagagccguuacuacaca

SEQ ID NO: 686501 - RNA, 64 nt, Homo Sapiens
cauccucucccaggaccaggaguuuaugaccaggcgagcacaaauggcuaaaagccaagcuguc

SEQ ID NO: 686502 - RNA, 64 nt, Homo Sapiens
uucauauagucaauguaaaacuuauuagcagucgcgagcacaugagagauuaaaccaauuauaa

SEQ ID NO: 686503 - RNA, 64 nt, Homo Sapiens
acggauauaaucagucuggccacugacuuguguucgagcacagagcagaugcccacacagccag

SEQ ID NO: 686504 - RNA, 64 nt, Homo Sapiens
gccccugcuuccccacccccuccucaggcuccugcgagcacacccccacccccaaaucccuccc

SEQ ID NO: 686505 - RNA, 64 nt, Homo Sapiens
uuacauuuuauaugugagcgagcaagccggcaagcgagcacaguauuauuucuccauccccucc

SEQ ID NO: 686506 - RNA, 64 nt, Homo Sapiens
ucuauugucuucacuuggauuugaggaagugggacgagcacauuucuuuccagguuuugaggac

SEQ ID NO: 686507 - RNA, 64 nt, Homo Sapiens
gaggaccaaggggaaggggaaucacuggggagaccgagcacaggcaggaugcuuuccaaagcca

SEQ ID NO: 686508 - RNA, 64 nt, Homo Sapiens
gacuccccucuuccucaaggguagaugagaggaacgagcacagagguuggcuguggguccuggg

SEQ ID NO: 686509 - RNA, 64 nt, Homo Sapiens
augaacugacgguggaagacuccacgcaccugaacgagcacagaaggucugcagaaccauagcu

SEQ ID NO: 686510 - RNA, 64 nt, Homo Sapiens
gggccggccaccaguccucggaauugucacacggcgagcacagauggugccaggaaagccacug

SEQ ID NO: 686511 - RNA, 64 nt, Homo Sapiens
uaagaucacccauuagguuuuuuuucuggucacucgagcacaucaaaagcuggauuugauuuuu

SEQ ID NO: 686512 - RNA, 64 nt, Homo Sapiens
acccgcuucccaccugcugcggucaccaugguggcgagcacagcaaccccagguguccagagca

SEQ ID NO: 686513 - RNA, 64 nt, Homo Sapiens
ucaggaugaaccuggaggcccaccucaaggagugcgagcacaucaaaugcccccacuccaagua

SEQ ID NO: 686514 - RNA, 64 nt, Homo Sapiens
gcuaaggccucgcugccagccuucugacggcgggcgagcacacggucucuuccccugccccaac

SEQ ID NO: 686515 - RNA, 64 nt, Homo Sapiens
gugcuggagacacgaguuucuugucuguuggcagcgagcacaucgcggaaacgccgugcaucuc

SEQ ID NO: 686516 - RNA, 64 nt, Homo Sapiens
ggcucccaccuauaauccuauuagugucagaggccgagcacaguauucccuuaacugacauuau

SEQ ID NO: 686517 - RNA, 64 nt, Homo Sapiens
uguucugggaauguuucagcagccaauaagugcccgagcacacugcccccgguugccugccugg

SEQ ID NO: 686518 - RNA, 64 nt, Homo Sapiens
cugggguggaugacuuaugcggccucagaagaagcgagcacaggaaaugggagacuguuucucu

SEQ ID NO: 686519 - RNA, 64 nt, Homo Sapiens
gagcuuuuuaauagcacuaaaaaaaaaauguacccgagcacauacacuggcuuuugccuguaag

SEQ ID NO: 686520 - RNA, 64 nt, Homo Sapiens
caggcgaccagagcuggcuguacaggaauguccacgagcacagcaggugaucuugaggccuugc

SEQ ID NO: 686521 - RNA, 64 nt, Homo Sapiens
gccgggaccgggaucgugaccgugaccgugaccgcgagcacaaacggggggagcggggcaguga

SEQ ID NO: 686522 - RNA, 64 nt, Homo Sapiens
aaaggaaucacacuguacagaccgccauucugcucgagcacaugaugugggaaacccuucauuu

SEQ ID NO: 686523 - RNA, 64 nt, Homo Sapiens
ggcccaugccuauaaucccacggggcucugaggccgagcacaguagagaaggaaaggaaagaga

SEQ ID NO: 686524 - RNA, 64 nt, Homo Sapiens
aauaagaucauguuuuaauugugagaaacagggccgagcacaguggcucacgccuguaauacca

SEQ ID NO: 686525 - RNA, 64 nt, Homo Sapiens
aguggaccaagcaccaguggcuucagcgguggaccgagcacaggagcuggcuucggcgguggac

SEQ ID NO: 686526 - RNA, 64 nt, Homo Sapiens
uugagcuacaguaaacuacauauguuauaugauacgagcacaaccugaagaaagaacuugaacc

SEQ ID NO: 686527 - RNA, 64 nt, Homo Sapiens
ucgggggucagaccugguuccuggccuuuauggacgagcacaaugugccauaauuuggcaaaug

SEQ ID NO: 686528 - RNA, 64 nt, Homo Sapiens
cuaaacaucuuucuugccuuaugugccccauugagcuucacagugucaggcuggacgccgugau

SEQ ID NO: 686529 - RNA, 64 nt, Homo Sapiens
acaaaggggccugcguuaaaaccuaauugcuaaugcuucacaacuaggagagcaugccgucuug

SEQ ID NO: 686530 - RNA, 64 nt, Homo Sapiens
acaaacaacagugaaaaugcagcaucugucuccugcuucacagggucgacugucagggugaccg

SEQ ID NO: 686531 - RNA, 64 nt, Homo Sapiens
uccuugccguucagccacugugaaaccagaaucugcuucacagaaaaaagcaucucaguuagga

SEQ ID NO: 686532 - RNA, 64 nt, Homo Sapiens
aaagcuacucauagcgggggccuaaaaaaaaaaagcuucacaguacccaaacugcuuuuuccaa

SEQ ID NO: 686533 - RNA, 64 nt, Homo Sapiens
auagauaugaaagcugauuuuuuuuaauuaccaugcuucacaauguuaaguuauauggggagca

SEQ ID NO: 686534 - RNA, 64 nt, Homo Sapiens
aacugauaaaaaguagaugagacuucuccaagcugcuucacaagcaaacuaaccgaaaaaccga

SEQ ID NO: 686535 - RNA, 64 nt, Homo Sapiens
gcaaacuaaccgaaaaaccgaaaauauacaaacagcuucacacacacacacacacacacacaca

SEQ ID NO: 686536 - RNA, 64 nt, Homo Sapiens
cagucagaggaggacgugagccaguuugauacccgcuucacacggcagacgccgguggacaguc

SEQ ID NO: 686537 - RNA, 64 nt, Homo Sapiens
gcccucagcgagagugccaaccaggccuuccugggcuucacauacguggcgccgucuguccugg

SEQ ID NO: 686538 - RNA, 64 nt, Homo Sapiens; identical to SEQ ID NO: 85278

SEQ ID NO: 686539 - RNA, 64 nt, Homo Sapiens; identical to SEQ ID NO: 85279

SEQ ID NO: 686540 - RNA, 64 nt, Homo Sapiens; identical to SEQ ID NO: 85280

SEQ ID NO: 686541 - RNA, 64 nt, Homo Sapiens; identical to SEQ ID NO: 85281

SEQ ID NO: 686542 - RNA, 64 nt, Homo Sapiens; identical to SEQ ID NO: 85282

SEQ ID NO: 686543 - RNA, 64 nt, Homo Sapiens; identical to SEQ ID NO: 85283

SEQ ID NO: 686544 - RNA, 64 nt, Homo Sapiens; identical to SEQ ID NO: 85284

SEQ ID NO: 686545 - RNA, 64 nt, Homo Sapiens; identical to SEQ ID NO: 85285

SEQ ID NO: 686546 - RNA, 64 nt, Homo Sapiens; identical to SEQ ID NO: 85286

SEQ ID NO: 686547 - RNA, 64 nt, Homo Sapiens; identical to SEQ ID NO: 85287

SEQ ID NO: 686548 - RNA, 64 nt, Homo Sapiens; identical to SEQ ID NO: 85288

SEQ ID NO: 686549 - RNA, 64 nt, Homo Sapiens; identical to SEQ ID NO: 85289

SEQ ID NO: 686550 - RNA, 64 nt, Homo Sapiens; identical to SEQ ID NO: 85290

SEQ ID NO: 686551 - RNA, 64 nt, Homo Sapiens; identical to SEQ ID NO: 85291

SEQ ID NO: 686552 - RNA, 64 nt, Homo Sapiens; identical to SEQ ID NO: 300578

SEQ ID NO: 686553 - RNA, 64 nt, Homo Sapiens; identical to SEQ ID NO: 300579

SEQ ID NO: 686554 - RNA, 64 nt, Homo Sapiens; identical to SEQ ID NO: 300580

SEQ ID NO: 686555 - RNA, 64 nt, Homo Sapiens; identical to SEQ ID NO: 300581

SEQ ID NO: 686556 - RNA, 64 nt, Homo Sapiens; identical to SEQ ID NO: 300582

SEQ ID NO: 686557 - RNA, 64 nt, Homo Sapiens; identical to SEQ ID NO: 300583

SEQ ID NO: 686558 - RNA, 64 nt, Homo Sapiens; identical to SEQ ID NO: 300584

SEQ ID NO: 686559 - RNA, 64 nt, Homo Sapiens; identical to SEQ ID NO: 300585

SEQ ID NO: 686560 - RNA, 64 nt, Homo Sapiens; identical to SEQ ID NO: 300586

SEQ ID NO: 686561 - RNA, 64 nt, Homo Sapiens; identical to SEQ ID NO: 300587

SEQ ID NO: 686562 - RNA, 64 nt, Homo Sapiens; identical to SEQ ID NO: 300588

SEQ ID NO: 686563 - RNA, 64 nt, Homo Sapiens; identical to SEQ ID NO: 300589

SEQ ID NO: 686564 - RNA, 64 nt, Homo Sapiens; identical to SEQ ID NO: 300590

SEQ ID NO: 686565 - RNA, 64 nt, Homo Sapiens; identical to SEQ ID NO: 300591

SEQ ID NO: 686566 - RNA, 64 nt, Homo Sapiens; identical to SEQ ID NO: 300592

SEQ ID NO: 686567 - RNA, 64 nt, Homo Sapiens; identical to SEQ ID NO: 300593

SEQ ID NO: 686568 - RNA, 64 nt, Homo Sapiens; identical to SEQ ID NO: 124456

SEQ ID NO: 686569 - RNA, 64 nt, Homo Sapiens; identical to SEQ ID NO: 124457

SEQ ID NO: 686570 - RNA, 64 nt, Homo Sapiens; identical to SEQ ID NO: 156518

SEQ ID NO: 686571 - RNA, 64 nt, Homo Sapiens; identical to SEQ ID NO: 156519

SEQ ID NO: 686572 - RNA, 64 nt, Homo Sapiens; identical to SEQ ID NO: 156520

SEQ ID NO: 686573 - RNA, 64 nt, Homo Sapiens; identical to SEQ ID NO: 156521

SEQ ID NO: 686574 - RNA, 64 nt, Homo Sapiens; identical to SEQ ID NO: 236580

SEQ ID NO: 686575 - RNA, 64 nt, Homo Sapiens; identical to SEQ ID NO: 236581

SEQ ID NO: 686576 - RNA, 64 nt, Homo Sapiens; identical to SEQ ID NO: 236582

SEQ ID NO: 686577 - RNA, 64 nt, Homo Sapiens; identical to SEQ ID NO: 236583

SEQ ID NO: 686578 - RNA, 64 nt, Homo Sapiens; identical to SEQ ID NO: 236584

SEQ ID NO: 686579 - RNA, 64 nt, Homo Sapiens; identical to SEQ ID NO: 236585

SEQ ID NO: 686580 - RNA, 64 nt, Homo Sapiens; identical to SEQ ID NO: 236586

SEQ ID NO: 686581 - RNA, 64 nt, Homo Sapiens; identical to SEQ ID NO: 236587

SEQ ID NO: 686582 - RNA, 64 nt, Homo Sapiens; identical to SEQ ID NO: 236588

SEQ ID NO: 686583 - RNA, 64 nt, Homo Sapiens; identical to SEQ ID NO: 236589

SEQ ID NO: 686584 - RNA, 64 nt, Homo Sapiens; identical to SEQ ID NO: 236590

SEQ ID NO: 686585 - RNA, 64 nt, Homo Sapiens; identical to SEQ ID NO: 236591

SEQ ID NO: 686586 - RNA, 64 nt, Homo Sapiens; identical to SEQ ID NO: 236592

SEQ ID NO: 686587 - RNA, 64 nt, Homo Sapiens; identical to SEQ ID NO: 236593

SEQ ID NO: 686588 - RNA, 64 nt, Homo Sapiens; identical to SEQ ID NO: 236594

SEQ ID NO: 686589 - RNA, 64 nt, Homo Sapiens; identical to SEQ ID NO: 236595

SEQ ID NO: 686590 - RNA, 64 nt, Homo Sapiens; identical to SEQ ID NO: 236596

SEQ ID NO: 686591 - RNA, 64 nt, Homo Sapiens; identical to SEQ ID NO: 236597

SEQ ID NO: 686592 - RNA, 64 nt, Homo Sapiens; identical to SEQ ID NO: 236598

SEQ ID NO: 686593 - RNA, 64 nt, Homo Sapiens; identical to SEQ ID NO: 236599

SEQ ID NO: 686594 - RNA, 64 nt, Homo Sapiens; identical to SEQ ID NO: 236600

SEQ ID NO: 686595 - RNA, 64 nt, Homo Sapiens; identical to SEQ ID NO: 236601

SEQ ID NO: 686596 - RNA, 64 nt, Homo Sapiens; identical to SEQ ID NO: 236602

SEQ ID NO: 686597 - RNA, 64 nt, Homo Sapiens; identical to SEQ ID NO: 236603

SEQ ID NO: 686598 - RNA, 64 nt, Homo Sapiens; identical to SEQ ID NO: 236604

SEQ ID NO: 686599 - RNA, 64 nt, Homo Sapiens; identical to SEQ ID NO: 236605

SEQ ID NO: 686600 - RNA, 64 nt, Homo Sapiens; identical to SEQ ID NO: 236606

SEQ ID NO: 686601 - RNA, 64 nt, Homo Sapiens; identical to SEQ ID NO: 236607

SEQ ID NO: 686602 - RNA, 64 nt, Homo Sapiens; identical to SEQ ID NO: 236608

SEQ ID NO: 686603 - RNA, 64 nt, Homo Sapiens; identical to SEQ ID NO: 236609

SEQ ID NO: 686604 - RNA, 64 nt, Homo Sapiens; identical to SEQ ID NO: 236610

SEQ ID NO: 686605 - RNA, 64 nt, Homo Sapiens; identical to SEQ ID NO: 236611

SEQ ID NO: 686606 - RNA, 64 nt, Homo Sapiens; identical to SEQ ID NO: 236612

SEQ ID NO: 686607 - RNA, 64 nt, Homo Sapiens; identical to SEQ ID NO: 236613

SEQ ID NO: 686608 - RNA, 64 nt, Homo Sapiens; identical to SEQ ID NO: 236614

SEQ ID NO: 686609 - RNA, 64 nt, Homo Sapiens; identical to SEQ ID NO: 236615

SEQ ID NO: 686610 - RNA, 64 nt, Homo Sapiens; identical to SEQ ID NO: 236616

SEQ ID NO: 686611 - RNA, 64 nt, Homo Sapiens; identical to SEQ ID NO: 236617

SEQ ID NO: 686612 - RNA, 64 nt, Homo Sapiens; identical to SEQ ID NO: 236618

SEQ ID NO: 686613 - RNA, 64 nt, Homo Sapiens; identical to SEQ ID NO: 236619

SEQ ID NO: 686614 - RNA, 64 nt, Homo Sapiens; identical to SEQ ID NO: 439599

SEQ ID NO: 686615 - RNA, 64 nt, Homo Sapiens; identical to SEQ ID NO: 439600

SEQ ID NO: 686616 - RNA, 64 nt, Homo Sapiens; identical to SEQ ID NO: 439601

SEQ ID NO: 686617 - RNA, 64 nt, Homo Sapiens; identical to SEQ ID NO: 439602

SEQ ID NO: 686618 - RNA, 64 nt, Homo Sapiens; identical to SEQ ID NO: 439603

SEQ ID NO: 686619 - RNA, 64 nt, Homo Sapiens; identical to SEQ ID NO: 439604

SEQ ID NO: 686620 - RNA, 64 nt, Homo Sapiens; identical to SEQ ID NO: 439605

SEQ ID NO: 686621 - RNA, 64 nt, Homo Sapiens; identical to SEQ ID NO: 439606

SEQ ID NO: 686622 - RNA, 64 nt, Homo Sapiens; identical to SEQ ID NO: 439607

SEQ ID NO: 686623 - RNA, 64 nt, Homo Sapiens; identical to SEQ ID NO: 439608

SEQ ID NO: 686624 - RNA, 64 nt, Homo Sapiens; identical to SEQ ID NO: 439609

SEQ ID NO: 686625 - RNA, 64 nt, Homo Sapiens; identical to SEQ ID NO: 439610

SEQ ID NO: 686626 - RNA, 64 nt, Homo Sapiens; identical to SEQ ID NO: 439611

SEQ ID NO: 686627 - RNA, 64 nt, Homo Sapiens; identical to SEQ ID NO: 439612

SEQ ID NO: 686628 - RNA, 64 nt, Homo Sapiens; identical to SEQ ID NO: 439613

SEQ ID NO: 686629 - RNA, 64 nt, Homo Sapiens; identical to SEQ ID NO: 439614

SEQ ID NO: 686630 - RNA, 64 nt, Homo Sapiens; identical to SEQ ID NO: 439615

SEQ ID NO: 686631 - RNA, 64 nt, Homo Sapiens; identical to SEQ ID NO: 439616

SEQ ID NO: 686632 - RNA, 64 nt, Homo Sapiens; identical to SEQ ID NO: 439617

SEQ ID NO: 686633 - RNA, 64 nt, Homo Sapiens; identical to SEQ ID NO: 439618

SEQ ID NO: 686634 - RNA, 64 nt, Homo Sapiens; identical to SEQ ID NO: 439619

SEQ ID NO: 686635 - RNA, 64 nt, Homo Sapiens; identical to SEQ ID NO: 439620

SEQ ID NO: 686636 - RNA, 64 nt, Homo Sapiens; identical to SEQ ID NO: 439621

SEQ ID NO: 686637 - RNA, 64 nt, Homo Sapiens; identical to SEQ ID NO: 439622

SEQ ID NO: 686638 - RNA, 64 nt, Homo Sapiens; identical to SEQ ID NO: 439623

SEQ ID NO: 686639 - RNA, 64 nt, Homo Sapiens; identical to SEQ ID NO: 439624

SEQ ID NO: 686640 - RNA, 64 nt, Homo Sapiens; identical to SEQ ID NO: 439625

SEQ ID NO: 686641 - RNA, 64 nt, Homo Sapiens; identical to SEQ ID NO: 439626

SEQ ID NO: 686642 - RNA, 64 nt, Homo Sapiens; identical to SEQ ID NO: 439627

SEQ ID NO: 686643 - RNA, 64 nt, Homo Sapiens; identical to SEQ ID NO: 439628

SEQ ID NO: 686644 - RNA, 64 nt, Homo Sapiens; identical to SEQ ID NO: 439629

SEQ ID NO: 686645 - RNA, 64 nt, Homo Sapiens; identical to SEQ ID NO: 439630

SEQ ID NO: 686646 - RNA, 64 nt, Homo Sapiens; identical to SEQ ID NO: 439631

SEQ ID NO: 686647 - RNA, 64 nt, Homo Sapiens; identical to SEQ ID NO: 439632

SEQ ID NO: 686648 - RNA, 58 nt, Homo Sapiens; identical to SEQ ID NO: 439633

SEQ ID NO: 686649 - RNA, 64 nt, Homo Sapiens; identical to SEQ ID NO: 439634

SEQ ID NO: 686650 - RNA, 64 nt, Homo Sapiens; identical to SEQ ID NO: 439635

SEQ ID NO: 686651 - RNA, 64 nt, Homo Sapiens; identical to SEQ ID NO: 439636

SEQ ID NO: 686652 - RNA, 64 nt, Homo Sapiens; identical to SEQ ID NO: 439637

SEQ ID NO: 686653 - RNA, 64 nt, Homo Sapiens; identical to SEQ ID NO: 439638

SEQ ID NO: 686654 - RNA, 64 nt, Homo Sapiens; identical to SEQ ID NO: 439639

SEQ ID NO: 686655 - RNA, 64 nt, Homo Sapiens; identical to SEQ ID NO: 439640

SEQ ID NO: 686656 - RNA, 64 nt, Homo Sapiens; identical to SEQ ID NO: 439641

SEQ ID NO: 686657 - RNA, 64 nt, Homo Sapiens; identical to SEQ ID NO: 439642

SEQ ID NO: 686658 - RNA, 64 nt, Homo Sapiens; identical to SEQ ID NO: 439643

SEQ ID NO: 686659 - RNA, 50 nt, Homo Sapiens; identical to SEQ ID NO: 439644

SEQ ID NO: 686660 - RNA, 64 nt, Homo Sapiens; identical to SEQ ID NO: 439645

SEQ ID NO: 686661 - RNA, 64 nt, Homo Sapiens; identical to SEQ ID NO: 439646

SEQ ID NO: 686662 - RNA, 64 nt, Homo Sapiens; identical to SEQ ID NO: 439647

SEQ ID NO: 686663 - RNA, 64 nt, Homo Sapiens; identical to SEQ ID NO: 439648

SEQ ID NO: 686664 - RNA, 64 nt, Homo Sapiens; identical to SEQ ID NO: 439649

SEQ ID NO: 686665 - RNA, 64 nt, Homo Sapiens; identical to SEQ ID NO: 439650

SEQ ID NO: 686666 - RNA, 64 nt, Homo Sapiens; identical to SEQ ID NO: 439651

SEQ ID NO: 686667 - RNA, 64 nt, Homo Sapiens; identical to SEQ ID NO: 439652

SEQ ID NO: 686668 - RNA, 64 nt, Homo Sapiens; identical to SEQ ID NO: 439653

SEQ ID NO: 686669 - RNA, 64 nt, Homo Sapiens; identical to SEQ ID NO: 439654

SEQ ID NO: 686670 - RNA, 64 nt, Homo Sapiens; identical to SEQ ID NO: 439655

SEQ ID NO: 686671 - RNA, 64 nt, Homo Sapiens; identical to SEQ ID NO: 439656

SEQ ID NO: 686672 - RNA, 64 nt, Homo Sapiens; identical to SEQ ID NO: 439657

SEQ ID NO: 686673 - RNA, 64 nt, Homo Sapiens; identical to SEQ ID NO: 439658

SEQ ID NO: 686674 - RNA, 64 nt, Homo Sapiens; identical to SEQ ID NO: 439659

SEQ ID NO: 686675 - RNA, 64 nt, Homo Sapiens; identical to SEQ ID NO: 439660

SEQ ID NO: 686676 - RNA, 57 nt, Homo Sapiens; identical to SEQ ID NO: 439661

SEQ ID NO: 686677 - RNA, 57 nt, Homo Sapiens; identical to SEQ ID NO: 439662

SEQ ID NO: 686678 - RNA, 64 nt, Homo Sapiens; identical to SEQ ID NO: 439663

SEQ ID NO: 686679 - RNA, 64 nt, Homo Sapiens; identical to SEQ ID NO: 47016

SEQ ID NO: 686680 - RNA, 64 nt, Homo Sapiens; identical to SEQ ID NO: 47017

SEQ ID NO: 686681 - RNA, 64 nt, Homo Sapiens; identical to SEQ ID NO: 47018

SEQ ID NO: 686682 - RNA, 64 nt, Homo Sapiens; identical to SEQ ID NO: 47019

SEQ ID NO: 686683 - RNA, 64 nt, Homo Sapiens; identical to SEQ ID NO: 47020

SEQ ID NO: 686684 - RNA, 64 nt, Homo Sapiens; identical to SEQ ID NO: 47021

SEQ ID NO: 686685 - RNA, 64 nt, Homo Sapiens; identical to SEQ ID NO: 47022

SEQ ID NO: 686686 - RNA, 64 nt, Homo Sapiens; identical to SEQ ID NO: 47023

SEQ ID NO: 686687 - RNA, 64 nt, Homo Sapiens; identical to SEQ ID NO: 47024

SEQ ID NO: 686688 - RNA, 64 nt, Homo Sapiens; identical to SEQ ID NO: 47025

SEQ ID NO: 686689 - RNA, 64 nt, Homo Sapiens; identical to SEQ ID NO: 47026

SEQ ID NO: 686690 - RNA, 64 nt, Homo Sapiens; identical to SEQ ID NO: 47027

SEQ ID NO: 686691 - RNA, 64 nt, Homo Sapiens; identical to SEQ ID NO: 47028

SEQ ID NO: 686692 - RNA, 64 nt, Homo Sapiens; identical to SEQ ID NO: 47029

SEQ ID NO: 686693 - RNA, 64 nt, Homo Sapiens; identical to SEQ ID NO: 47030

SEQ ID NO: 686694 - RNA, 64 nt, Homo Sapiens; identical to SEQ ID NO: 47031

SEQ ID NO: 686695 - RNA, 64 nt, Homo Sapiens; identical to SEQ ID NO: 47032

SEQ ID NO: 686696 - RNA, 64 nt, Homo Sapiens; identical to SEQ ID NO: 47033

SEQ ID NO: 686697 - RNA, 64 nt, Homo Sapiens; identical to SEQ ID NO: 47034

SEQ ID NO: 686698 - RNA, 64 nt, Homo Sapiens; identical to SEQ ID NO: 47035

SEQ ID NO: 686699 - RNA, 64 nt, Homo Sapiens; identical to SEQ ID NO: 47036

SEQ ID NO: 686700 - RNA, 64 nt, Homo Sapiens; identical to SEQ ID NO: 47037

SEQ ID NO: 686701 - RNA, 64 nt, Homo Sapiens; identical to SEQ ID NO: 47038

SEQ ID NO: 686702 - RNA, 64 nt, Homo Sapiens; identical to SEQ ID NO: 47039

SEQ ID NO: 686703 - RNA, 64 nt, Homo Sapiens; identical to SEQ ID NO: 47040

SEQ ID NO: 686704 - RNA, 64 nt, Homo Sapiens; identical to SEQ ID NO: 47041

SEQ ID NO: 686705 - RNA, 64 nt, Homo Sapiens; identical to SEQ ID NO: 47042

SEQ ID NO: 686706 - RNA, 64 nt, Homo Sapiens; identical to SEQ ID NO: 47043

SEQ ID NO: 686707 - RNA, 64 nt, Homo Sapiens; identical to SEQ ID NO: 47044

SEQ ID NO: 686708 - RNA, 64 nt, Homo Sapiens; identical to SEQ ID NO: 47045

SEQ ID NO: 686709 - RNA, 64 nt, Homo Sapiens; identical to SEQ ID NO: 47046

SEQ ID NO: 686710 - RNA, 64 nt, Homo Sapiens; identical to SEQ ID NO: 47047

SEQ ID NO: 686711 - RNA, 64 nt, Homo Sapiens; identical to SEQ ID NO: 47048

SEQ ID NO: 686712 - RNA, 64 nt, Homo Sapiens; identical to SEQ ID NO: 47049

SEQ ID NO: 686713 - RNA, 64 nt, Homo Sapiens; identical to SEQ ID NO: 47050

SEQ ID NO: 686714 - RNA, 64 nt, Homo Sapiens; identical to SEQ ID NO: 47051

SEQ ID NO: 686715 - RNA, 64 nt, Homo Sapiens; identical to SEQ ID NO: 47052

SEQ ID NO: 686716 - RNA, 64 nt, Homo Sapiens; identical to SEQ ID NO: 47053

SEQ ID NO: 686717 - RNA, 64 nt, Homo Sapiens; identical to SEQ ID NO: 47054

SEQ ID NO: 686718 - RNA, 51 nt, Homo Sapiens; identical to SEQ ID NO: 47055

SEQ ID NO: 686719 - RNA, 64 nt, Homo Sapiens; identical to SEQ ID NO: 47056

SEQ ID NO: 686720 - RNA, 64 nt, Homo Sapiens; identical to SEQ ID NO: 47057

SEQ ID NO: 686721 - RNA, 64 nt, Homo Sapiens; identical to SEQ ID NO: 47058

SEQ ID NO: 686722 - RNA, 64 nt, Homo Sapiens; identical to SEQ ID NO: 47059

SEQ ID NO: 686723 - RNA, 64 nt, Homo Sapiens; identical to SEQ ID NO: 47060

SEQ ID NO: 686724 - RNA, 64 nt, Homo Sapiens; identical to SEQ ID NO: 47061

SEQ ID NO: 686725 - RNA, 64 nt, Homo Sapiens; identical to SEQ ID NO: 47062

SEQ ID NO: 686726 - RNA, 64 nt, Homo Sapiens; identical to SEQ ID NO: 47063

SEQ ID NO: 686727 - RNA, 64 nt, Homo Sapiens; identical to SEQ ID NO: 47064

SEQ ID NO: 686728 - RNA, 64 nt, Homo Sapiens; identical to SEQ ID NO: 47065

SEQ ID NO: 686729 - RNA, 64 nt, Homo Sapiens; identical to SEQ ID NO: 47066

SEQ ID NO: 686730 - RNA, 64 nt, Homo Sapiens; identical to SEQ ID NO: 47067

SEQ ID NO: 686731 - RNA, 64 nt, Homo Sapiens; identical to SEQ ID NO: 47068

SEQ ID NO: 686732 - RNA, 64 nt, Homo Sapiens; identical to SEQ ID NO: 47069

SEQ ID NO: 686733 - RNA, 64 nt, Homo Sapiens; identical to SEQ ID NO: 47070

SEQ ID NO: 686734 - RNA, 64 nt, Homo Sapiens; identical to SEQ ID NO: 47071

SEQ ID NO: 686735 - RNA, 64 nt, Homo Sapiens; identical to SEQ ID NO: 47072

SEQ ID NO: 686736 - RNA, 64 nt, Homo Sapiens; identical to SEQ ID NO: 47073

SEQ ID NO: 686737 - RNA, 64 nt, Homo Sapiens; identical to SEQ ID NO: 47074

SEQ ID NO: 686738 - RNA, 64 nt, Homo Sapiens; identical to SEQ ID NO: 47075

SEQ ID NO: 686739 - RNA, 64 nt, Homo Sapiens; identical to SEQ ID NO: 47076

SEQ ID NO: 686740 - RNA, 64 nt, Homo Sapiens; identical to SEQ ID NO: 47077

SEQ ID NO: 686741 - RNA, 64 nt, Homo Sapiens; identical to SEQ ID NO: 47078

SEQ ID NO: 686742 - RNA, 64 nt, Homo Sapiens; identical to SEQ ID NO: 47079

SEQ ID NO: 686743 - RNA, 64 nt, Homo Sapiens; identical to SEQ ID NO: 47080

SEQ ID NO: 686744 - RNA, 64 nt, Homo Sapiens; identical to SEQ ID NO: 47081

SEQ ID NO: 686745 - RNA, 64 nt, Homo Sapiens; identical to SEQ ID NO: 47082

SEQ ID NO: 686746 - RNA, 64 nt, Homo Sapiens; identical to SEQ ID NO: 47083

SEQ ID NO: 686747 - RNA, 64 nt, Homo Sapiens; identical to SEQ ID NO: 360611

SEQ ID NO: 686748 - RNA, 64 nt, Homo Sapiens; identical to SEQ ID NO: 360612

SEQ ID NO: 686749 - RNA, 64 nt, Homo Sapiens; identical to SEQ ID NO: 360613

SEQ ID NO: 686750 - RNA, 64 nt, Homo Sapiens; identical to SEQ ID NO: 360614

SEQ ID NO: 686751 - RNA, 64 nt, Homo Sapiens; identical to SEQ ID NO: 360615

SEQ ID NO: 686752 - RNA, 64 nt, Homo Sapiens; identical to SEQ ID NO: 360616

SEQ ID NO: 686753 - RNA, 64 nt, Homo Sapiens; identical to SEQ ID NO: 360617

SEQ ID NO: 686754 - RNA, 64 nt, Homo Sapiens; identical to SEQ ID NO: 360618

SEQ ID NO: 686755 - RNA, 64 nt, Homo Sapiens; identical to SEQ ID NO: 360619

SEQ ID NO: 686756 - RNA, 64 nt, Homo Sapiens; identical to SEQ ID NO: 360620

SEQ ID NO: 686757 - RNA, 64 nt, Homo Sapiens; identical to SEQ ID NO: 360621

SEQ ID NO: 686758 - RNA, 64 nt, Homo Sapiens; identical to SEQ ID NO: 360622

SEQ ID NO: 686759 - RNA, 64 nt, Homo Sapiens; identical to SEQ ID NO: 360623

SEQ ID NO: 686760 - RNA, 64 nt, Homo Sapiens; identical to SEQ ID NO: 360624

SEQ ID NO: 686761 - RNA, 64 nt, Homo Sapiens; identical to SEQ ID NO: 360625

SEQ ID NO: 686762 - RNA, 64 nt, Homo Sapiens; identical to SEQ ID NO: 360626

SEQ ID NO: 686763 - RNA, 64 nt, Homo Sapiens; identical to SEQ ID NO: 360627

SEQ ID NO: 686764 - RNA, 64 nt, Homo Sapiens; identical to SEQ ID NO: 360628

SEQ ID NO: 686765 - RNA, 64 nt, Homo Sapiens; identical to SEQ ID NO: 360629

SEQ ID NO: 686766 - RNA, 64 nt, Homo Sapiens; identical to SEQ ID NO: 360630

SEQ ID NO: 686767 - RNA, 64 nt, Homo Sapiens; identical to SEQ ID NO: 360631

SEQ ID NO: 686768 - RNA, 64 nt, Homo Sapiens; identical to SEQ ID NO: 360632

SEQ ID NO: 686769 - RNA, 64 nt, Homo Sapiens; identical to SEQ ID NO: 360633

SEQ ID NO: 686770 - RNA, 64 nt, Homo Sapiens; identical to SEQ ID NO: 360634

SEQ ID NO: 686771 - RNA, 64 nt, Homo Sapiens; identical to SEQ ID NO: 360635

SEQ ID NO: 686772 - RNA, 64 nt, Homo Sapiens; identical to SEQ ID NO: 360636

SEQ ID NO: 686773 - RNA, 64 nt, Homo Sapiens; identical to SEQ ID NO: 360637

SEQ ID NO: 686774 - RNA, 64 nt, Homo Sapiens; identical to SEQ ID NO: 360638

SEQ ID NO: 686775 - RNA, 64 nt, Homo Sapiens; identical to SEQ ID NO: 159774

SEQ ID NO: 686776 - RNA, 64 nt, Homo Sapiens; identical to SEQ ID NO: 159775

SEQ ID NO: 686777 - RNA, 64 nt, Homo Sapiens; identical to SEQ ID NO: 159776

SEQ ID NO: 686778 - RNA, 64 nt, Homo Sapiens; identical to SEQ ID NO: 159777

SEQ ID NO: 686779 - RNA, 64 nt, Homo Sapiens; identical to SEQ ID NO: 159778

SEQ ID NO: 686780 - RNA, 64 nt, Homo Sapiens; identical to SEQ ID NO: 159779

SEQ ID NO: 686781 - RNA, 64 nt, Homo Sapiens; identical to SEQ ID NO: 159780

SEQ ID NO: 686782 - RNA, 64 nt, Homo Sapiens; identical to SEQ ID NO: 159781

SEQ ID NO: 686783 - RNA, 64 nt, Homo Sapiens; identical to SEQ ID NO: 159782

SEQ ID NO: 686784 - RNA, 64 nt, Homo Sapiens; identical to SEQ ID NO: 159783

SEQ ID NO: 686785 - RNA, 64 nt, Homo Sapiens; identical to SEQ ID NO: 159784

SEQ ID NO: 686786 - RNA, 64 nt, Homo Sapiens; identical to SEQ ID NO: 159785

SEQ ID NO: 686787 - RNA, 64 nt, Homo Sapiens; identical to SEQ ID NO: 159786

SEQ ID NO: 686788 - RNA, 64 nt, Homo Sapiens; identical to SEQ ID NO: 159787

SEQ ID NO: 686789 - RNA, 64 nt, Homo Sapiens; identical to SEQ ID NO: 159788

SEQ ID NO: 686790 - RNA, 64 nt, Homo Sapiens; identical to SEQ ID NO: 159789

SEQ ID NO: 686791 - RNA, 64 nt, Homo Sapiens; identical to SEQ ID NO: 159790

SEQ ID NO: 686792 - RNA, 64 nt, Homo Sapiens; identical to SEQ ID NO: 159791

SEQ ID NO: 686793 - RNA, 64 nt, Homo Sapiens; identical to SEQ ID NO: 159792

SEQ ID NO: 686794 - RNA, 64 nt, Homo Sapiens; identical to SEQ ID NO: 159793

SEQ ID NO: 686795 - RNA, 64 nt, Homo Sapiens; identical to SEQ ID NO: 159794

SEQ ID NO: 686796 - RNA, 64 nt, Homo Sapiens; identical to SEQ ID NO: 159795

SEQ ID NO: 686797 - RNA, 64 nt, Homo Sapiens; identical to SEQ ID NO: 159796

SEQ ID NO: 686798 - RNA, 64 nt, Homo Sapiens; identical to SEQ ID NO: 159797

SEQ ID NO: 686799 - RNA, 64 nt, Homo Sapiens; identical to SEQ ID NO: 159798

SEQ ID NO: 686800 - RNA, 64 nt, Homo Sapiens; identical to SEQ ID NO: 159799

SEQ ID NO: 686801 - RNA, 64 nt, Homo Sapiens; identical to SEQ ID NO: 159800

SEQ ID NO: 686802 - RNA, 64 nt, Homo Sapiens; identical to SEQ ID NO: 159801

SEQ ID NO: 686803 - RNA, 64 nt, Homo Sapiens; identical to SEQ ID NO: 159802

SEQ ID NO: 686804 - RNA, 64 nt, Homo Sapiens; identical to SEQ ID NO: 159803

SEQ ID NO: 686805 - RNA, 64 nt, Homo Sapiens; identical to SEQ ID NO: 159804

SEQ ID NO: 686806 - RNA, 64 nt, Homo Sapiens; identical to SEQ ID NO: 159805

SEQ ID NO: 686807 - RNA, 64 nt, Homo Sapiens; identical to SEQ ID NO: 159806

SEQ ID NO: 686808 - RNA, 64 nt, Homo Sapiens; identical to SEQ ID NO: 159807

SEQ ID NO: 686809 - RNA, 64 nt, Homo Sapiens; identical to SEQ ID NO: 159808

SEQ ID NO: 686810 - RNA, 64 nt, Homo Sapiens; identical to SEQ ID NO: 159809

SEQ ID NO: 686811 - RNA, 64 nt, Homo Sapiens; identical to SEQ ID NO: 159810

SEQ ID NO: 686812 - RNA, 64 nt, Homo Sapiens; identical to SEQ ID NO: 159811

SEQ ID NO: 686813 - RNA, 64 nt, Homo Sapiens; identical to SEQ ID NO: 159812

SEQ ID NO: 686814 - RNA, 64 nt, Homo Sapiens; identical to SEQ ID NO: 585216

SEQ ID NO: 686815 - RNA, 64 nt, Homo Sapiens; identical to SEQ ID NO: 585217

SEQ ID NO: 686816 - RNA, 64 nt, Homo Sapiens; identical to SEQ ID NO: 585218

SEQ ID NO: 686817 - RNA, 64 nt, Homo Sapiens; identical to SEQ ID NO: 585219

SEQ ID NO: 686818 - RNA, 64 nt, Homo Sapiens; identical to SEQ ID NO: 585220

SEQ ID NO: 686819 - RNA, 64 nt, Homo Sapiens; identical to SEQ ID NO: 585221

SEQ ID NO: 686820 - RNA, 64 nt, Homo Sapiens; identical to SEQ ID NO: 585222

SEQ ID NO: 686821 - RNA, 64 nt, Homo Sapiens; identical to SEQ ID NO: 585223

SEQ ID NO: 686822 - RNA, 64 nt, Homo Sapiens; identical to SEQ ID NO: 585224

SEQ ID NO: 686823 - RNA, 64 nt, Homo Sapiens; identical to SEQ ID NO: 585225

SEQ ID NO: 686824 - RNA, 64 nt, Homo Sapiens; identical to SEQ ID NO: 585226

SEQ ID NO: 686825 - RNA, 64 nt, Homo Sapiens; identical to SEQ ID NO: 585227

SEQ ID NO: 686826 - RNA, 64 nt, Homo Sapiens; identical to SEQ ID NO: 585228

SEQ ID NO: 686827 - RNA, 64 nt, Homo Sapiens; identical to SEQ ID NO: 585229

SEQ ID NO: 686828 - RNA, 64 nt, Homo Sapiens; identical to SEQ ID NO: 585230

SEQ ID NO: 686829 - RNA, 64 nt, Homo Sapiens; identical to SEQ ID NO: 585231

SEQ ID NO: 686830 - RNA, 64 nt, Homo Sapiens; identical to SEQ ID NO: 585232

SEQ ID NO: 686831 - RNA, 64 nt, Homo Sapiens; identical to SEQ ID NO: 585233

SEQ ID NO: 686832 - RNA, 64 nt, Homo Sapiens; identical to SEQ ID NO: 585234

SEQ ID NO: 686833 - RNA, 64 nt, Homo Sapiens; identical to SEQ ID NO: 585235

SEQ ID NO: 686834 - RNA, 64 nt, Homo Sapiens; identical to SEQ ID NO: 585236

SEQ ID NO: 686835 - RNA, 64 nt, Homo Sapiens; identical to SEQ ID NO: 585237

SEQ ID NO: 686836 - RNA, 64 nt, Homo Sapiens; identical to SEQ ID NO: 585238

SEQ ID NO: 686837 - RNA, 64 nt, Homo Sapiens; identical to SEQ ID NO: 585239

SEQ ID NO: 686838 - RNA, 64 nt, Homo Sapiens; identical to SEQ ID NO: 585240

SEQ ID NO: 686839 - RNA, 64 nt, Homo Sapiens; identical to SEQ ID NO: 585241

SEQ ID NO: 686840 - RNA, 64 nt, Homo Sapiens; identical to SEQ ID NO: 585242

SEQ ID NO: 686841 - RNA, 64 nt, Homo Sapiens; identical to SEQ ID NO: 585243

SEQ ID NO: 686842 - RNA, 64 nt, Homo Sapiens; identical to SEQ ID NO: 585244

SEQ ID NO: 686843 - RNA, 64 nt, Homo Sapiens; identical to SEQ ID NO: 585245

SEQ ID NO: 686844 - RNA, 64 nt, Homo Sapiens; identical to SEQ ID NO: 585246

SEQ ID NO: 686845 - RNA, 64 nt, Homo Sapiens; identical to SEQ ID NO: 585247

SEQ ID NO: 686846 - RNA, 64 nt, Homo Sapiens; identical to SEQ ID NO: 585248

SEQ ID NO: 686847 - RNA, 64 nt, Homo Sapiens; identical to SEQ ID NO: 585249

SEQ ID NO: 686848 - RNA, 64 nt, Homo Sapiens; identical to SEQ ID NO: 585250

SEQ ID NO: 686849 - RNA, 64 nt, Homo Sapiens; identical to SEQ ID NO: 585251

SEQ ID NO: 686850 - RNA, 64 nt, Homo Sapiens; identical to SEQ ID NO: 585252

SEQ ID NO: 686851 - RNA, 64 nt, Homo Sapiens; identical to SEQ ID NO: 585253

SEQ ID NO: 686852 - RNA, 64 nt, Homo Sapiens; identical to SEQ ID NO: 585254

SEQ ID NO: 686853 - RNA, 64 nt, Homo Sapiens; identical to SEQ ID NO: 585255

SEQ ID NO: 686854 - RNA, 64 nt, Homo Sapiens; identical to SEQ ID NO: 585256

SEQ ID NO: 686855 - RNA, 64 nt, Homo Sapiens; identical to SEQ ID NO: 585257

SEQ ID NO: 686856 - RNA, 64 nt, Homo Sapiens; identical to SEQ ID NO: 585258

SEQ ID NO: 686857 - RNA, 64 nt, Homo Sapiens; identical to SEQ ID NO: 585259

SEQ ID NO: 686858 - RNA, 64 nt, Homo Sapiens; identical to SEQ ID NO: 585260

SEQ ID NO: 686859 - RNA, 64 nt, Homo Sapiens; identical to SEQ ID NO: 585261

SEQ ID NO: 686860 - RNA, 64 nt, Homo Sapiens; identical to SEQ ID NO: 585262

SEQ ID NO: 686861 - RNA, 64 nt, Homo Sapiens; identical to SEQ ID NO: 585263

SEQ ID NO: 686862 - RNA, 63 nt, Homo Sapiens; identical to SEQ ID NO: 87681

SEQ ID NO: 686863 - RNA, 63 nt, Homo Sapiens; identical to SEQ ID NO: 87682

SEQ ID NO: 686864 - RNA, 63 nt, Homo Sapiens; identical to SEQ ID NO: 87683

SEQ ID NO: 686865 - RNA, 63 nt, Homo Sapiens; identical to SEQ ID NO: 87684

SEQ ID NO: 686866 - RNA, 63 nt, Homo Sapiens; identical to SEQ ID NO: 87685

SEQ ID NO: 686867 - RNA, 63 nt, Homo Sapiens; identical to SEQ ID NO: 87686

SEQ ID NO: 686868 - RNA, 63 nt, Homo Sapiens; identical to SEQ ID NO: 87687

SEQ ID NO: 686869 - RNA, 63 nt, Homo Sapiens; identical to SEQ ID NO: 87688

SEQ ID NO: 686870 - RNA, 63 nt, Homo Sapiens; identical to SEQ ID NO: 87689

SEQ ID NO: 686871 - RNA, 63 nt, Homo Sapiens; identical to SEQ ID NO: 87690

SEQ ID NO: 686872 - RNA, 63 nt, Homo Sapiens; identical to SEQ ID NO: 87691

SEQ ID NO: 686873 - RNA, 63 nt, Homo Sapiens; identical to SEQ ID NO: 87692

SEQ ID NO: 686874 - RNA, 63 nt, Homo Sapiens; identical to SEQ ID NO: 87693

SEQ ID NO: 686875 - RNA, 63 nt, Homo Sapiens; identical to SEQ ID NO: 87694

SEQ ID NO: 686876 - RNA, 63 nt, Homo Sapiens; identical to SEQ ID NO: 87695

SEQ ID NO: 686877 - RNA, 63 nt, Homo Sapiens; identical to SEQ ID NO: 87696

SEQ ID NO: 686878 - RNA, 63 nt, Homo Sapiens; identical to SEQ ID NO: 87697

SEQ ID NO: 686879 - RNA, 63 nt, Homo Sapiens; identical to SEQ ID NO: 87698

SEQ ID NO: 686880 - RNA, 63 nt, Homo Sapiens; identical to SEQ ID NO: 87699

SEQ ID NO: 686881 - RNA, 63 nt, Homo Sapiens; identical to SEQ ID NO: 87700

SEQ ID NO: 686882 - RNA, 63 nt, Homo Sapiens; identical to SEQ ID NO: 87701

SEQ ID NO: 686883 - RNA, 63 nt, Homo Sapiens; identical to SEQ ID NO: 87702

SEQ ID NO: 686884 - RNA, 63 nt, Homo Sapiens; identical to SEQ ID NO: 87703

SEQ ID NO: 686885 - RNA, 63 nt, Homo Sapiens; identical to SEQ ID NO: 87702

SEQ ID NO: 686886 - RNA, 63 nt, Homo Sapiens; identical to SEQ ID NO: 87703

SEQ ID NO: 686887 - RNA, 64 nt, Homo Sapiens; identical to SEQ ID NO: 49499

SEQ ID NO: 686888 - RNA, 64 nt, Homo Sapiens; identical to SEQ ID NO: 49500

SEQ ID NO: 686889 - RNA, 64 nt, Homo Sapiens; identical to SEQ ID NO: 49501

SEQ ID NO: 686890 - RNA, 64 nt, Homo Sapiens; identical to SEQ ID NO: 49502

SEQ ID NO: 686891 - RNA, 64 nt, Homo Sapiens; identical to SEQ ID NO: 49503

SEQ ID NO: 686892 - RNA, 64 nt, Homo Sapiens; identical to SEQ ID NO: 49504

SEQ ID NO: 686893 - RNA, 64 nt, Homo Sapiens; identical to SEQ ID NO: 49505

SEQ ID NO: 686894 - RNA, 64 nt, Homo Sapiens; identical to SEQ ID NO: 49506

SEQ ID NO: 686895 - RNA, 64 nt, Homo Sapiens; identical to SEQ ID NO: 49507

SEQ ID NO: 686896 - RNA, 64 nt, Homo Sapiens; identical to SEQ ID NO: 49508

SEQ ID NO: 686897 - RNA, 64 nt, Homo Sapiens; identical to SEQ ID NO: 49509

SEQ ID NO: 686898 - RNA, 64 nt, Homo Sapiens; identical to SEQ ID NO: 49510

SEQ ID NO: 686899 - RNA, 64 nt, Homo Sapiens; identical to SEQ ID NO: 49511

SEQ ID NO: 686900 - RNA, 64 nt, Homo Sapiens; identical to SEQ ID NO: 49512

SEQ ID NO: 686901 - RNA, 64 nt, Homo Sapiens; identical to SEQ ID NO: 49513

SEQ ID NO: 686902 - RNA, 64 nt, Homo Sapiens; identical to SEQ ID NO: 49514

SEQ ID NO: 686903 - RNA, 64 nt, Homo Sapiens; identical to SEQ ID NO: 49515

SEQ ID NO: 686904 - RNA, 64 nt, Homo Sapiens; identical to SEQ ID NO: 49516

SEQ ID NO: 686905 - RNA, 64 nt, Homo Sapiens; identical to SEQ ID NO: 49517

SEQ ID NO: 686906 - RNA, 64 nt, Homo Sapiens; identical to SEQ ID NO: 49518

SEQ ID NO: 686907 - RNA, 55 nt, Homo Sapiens; identical to SEQ ID NO: 49519

SEQ ID NO: 686908 - RNA, 64 nt, Homo Sapiens; identical to SEQ ID NO: 49520

SEQ ID NO: 686909 - RNA, 64 nt, Homo Sapiens; identical to SEQ ID NO: 49521

SEQ ID NO: 686910 - RNA, 64 nt, Homo Sapiens; identical to SEQ ID NO: 49522

SEQ ID NO: 686911 - RNA, 64 nt, Homo Sapiens; identical to SEQ ID NO: 49523

SEQ ID NO: 686912 - RNA, 64 nt, Homo Sapiens; identical to SEQ ID NO: 49524

SEQ ID NO: 686913 - RNA, 64 nt, Homo Sapiens; identical to SEQ ID NO: 49525

SEQ ID NO: 686914 - RNA, 64 nt, Homo Sapiens; identical to SEQ ID NO: 49526

SEQ ID NO: 686915 - RNA, 64 nt, Homo Sapiens; identical to SEQ ID NO: 49527

SEQ ID NO: 686916 - RNA, 64 nt, Homo Sapiens; identical to SEQ ID NO: 49528

SEQ ID NO: 686917 - RNA, 64 nt, Homo Sapiens; identical to SEQ ID NO: 49529

SEQ ID NO: 686918 - RNA, 64 nt, Homo Sapiens; identical to SEQ ID NO: 49530

SEQ ID NO: 686919 - RNA, 64 nt, Homo Sapiens
gaccucccuagccuccuaagcugcccugagccaacgccuucacgcagggcacuccuuaccccug

SEQ ID NO: 686920 - RNA, 64 nt, Homo Sapiens
aucuacgaguuuguccugggagcggcaaccucaucgccuucaucucaucucaggccagaugacc

SEQ ID NO: 686921 - RNA, 64 nt, Homo Sapiens; identical to SEQ ID NO: 55280

SEQ ID NO: 686922 - RNA, 64 nt, Homo Sapiens; identical to SEQ ID NO: 55281

SEQ ID NO: 686923 - RNA, 64 nt, Homo Sapiens; identical to SEQ ID NO: 55282

SEQ ID NO: 686924 - RNA, 64 nt, Homo Sapiens; identical to SEQ ID NO: 55283

SEQ ID NO: 686925 - RNA, 64 nt, Homo Sapiens; identical to SEQ ID NO: 55284

SEQ ID NO: 686926 - RNA, 64 nt, Homo Sapiens; identical to SEQ ID NO: 55285

SEQ ID NO: 686927 - RNA, 64 nt, Homo Sapiens; identical to SEQ ID NO: 55286

SEQ ID NO: 686928 - RNA, 64 nt, Homo Sapiens; identical to SEQ ID NO: 55287

SEQ ID NO: 686929 - RNA, 64 nt, Homo Sapiens; identical to SEQ ID NO: 55288

SEQ ID NO: 686930 - RNA, 64 nt, Homo Sapiens; identical to SEQ ID NO: 55289

SEQ ID NO: 686931 - RNA, 64 nt, Homo Sapiens; identical to SEQ ID NO: 55290

SEQ ID NO: 686932 - RNA, 64 nt, Homo Sapiens; identical to SEQ ID NO: 55291

SEQ ID NO: 686933 - RNA, 64 nt, Homo Sapiens; identical to SEQ ID NO: 55292

SEQ ID NO: 686934 - RNA, 64 nt, Homo Sapiens; identical to SEQ ID NO: 55293

SEQ ID NO: 686935 - RNA, 64 nt, Homo Sapiens; identical to SEQ ID NO: 55294

SEQ ID NO: 686936 - RNA, 64 nt, Homo Sapiens; identical to SEQ ID NO: 55295

SEQ ID NO: 686937 - RNA, 64 nt, Homo Sapiens; identical to SEQ ID NO: 55296

SEQ ID NO: 686938 - RNA, 64 nt, Homo Sapiens; identical to SEQ ID NO: 55297

SEQ ID NO: 686939 - RNA, 64 nt, Homo Sapiens; identical to SEQ ID NO: 55298

SEQ ID NO: 686940 - RNA, 64 nt, Homo Sapiens; identical to SEQ ID NO: 55299

SEQ ID NO: 686941 - RNA, 64 nt, Homo Sapiens; identical to SEQ ID NO: 55300

SEQ ID NO: 686942 - RNA, 64 nt, Homo Sapiens; identical to SEQ ID NO: 55301

SEQ ID NO: 686943 - RNA, 64 nt, Homo Sapiens; identical to SEQ ID NO: 55302

SEQ ID NO: 686944 - RNA, 64 nt, Homo Sapiens; identical to SEQ ID NO: 55303

SEQ ID NO: 686945 - RNA, 64 nt, Homo Sapiens; identical to SEQ ID NO: 55304

SEQ ID NO: 686946 - RNA, 64 nt, Homo Sapiens; identical to SEQ ID NO: 55305

SEQ ID NO: 686947 - RNA, 64 nt, Homo Sapiens; identical to SEQ ID NO: 55306

SEQ ID NO: 686948 - RNA, 64 nt, Homo Sapiens; identical to SEQ ID NO: 55307

SEQ ID NO: 686949 - RNA, 64 nt, Homo Sapiens; identical to SEQ ID NO: 55308

SEQ ID NO: 686950 - RNA, 64 nt, Homo Sapiens; identical to SEQ ID NO: 55309

SEQ ID NO: 686951 - RNA, 64 nt, Homo Sapiens; identical to SEQ ID NO: 55310

SEQ ID NO: 686952 - RNA, 64 nt, Homo Sapiens; identical to SEQ ID NO: 55311

SEQ ID NO: 686953 - RNA, 64 nt, Homo Sapiens; identical to SEQ ID NO: 55312

SEQ ID NO: 686954 - RNA, 64 nt, Homo Sapiens; identical to SEQ ID NO: 55313

SEQ ID NO: 686955 - RNA, 64 nt, Homo Sapiens; identical to SEQ ID NO: 55314

SEQ ID NO: 686956 - RNA, 64 nt, Homo Sapiens; identical to SEQ ID NO: 55315

SEQ ID NO: 686957 - RNA, 64 nt, Homo Sapiens; identical to SEQ ID NO: 55316

SEQ ID NO: 686958 - RNA, 64 nt, Homo Sapiens; identical to SEQ ID NO: 55317

SEQ ID NO: 686959 - RNA, 64 nt, Homo Sapiens; identical to SEQ ID NO: 55318

SEQ ID NO: 686960 - RNA, 64 nt, Homo Sapiens; identical to SEQ ID NO: 55319

SEQ ID NO: 686961 - RNA, 64 nt, Homo Sapiens; identical to SEQ ID NO: 55320

SEQ ID NO: 686962 - RNA, 64 nt, Homo Sapiens; identical to SEQ ID NO: 55321

SEQ ID NO: 686963 - RNA, 64 nt, Homo Sapiens; identical to SEQ ID NO: 55322

SEQ ID NO: 686964 - RNA, 64 nt, Homo Sapiens; identical to SEQ ID NO: 55323

SEQ ID NO: 686965 - RNA, 64 nt, Homo Sapiens; identical to SEQ ID NO: 55324

SEQ ID NO: 686966 - RNA, 64 nt, Homo Sapiens; identical to SEQ ID NO: 55325

SEQ ID NO: 686967 - RNA, 64 nt, Homo Sapiens; identical to SEQ ID NO: 55326

SEQ ID NO: 686968 - RNA, 64 nt, Homo Sapiens; identical to SEQ ID NO: 55327

SEQ ID NO: 686969 - RNA, 64 nt, Homo Sapiens; identical to SEQ ID NO: 55328

SEQ ID NO: 686970 - RNA, 64 nt, Homo Sapiens; identical to SEQ ID NO: 55329

SEQ ID NO: 686971 - RNA, 64 nt, Homo Sapiens; identical to SEQ ID NO: 55330

SEQ ID NO: 686972 - RNA, 64 nt, Homo Sapiens; identical to SEQ ID NO: 55331

SEQ ID NO: 686973 - RNA, 64 nt, Homo Sapiens; identical to SEQ ID NO: 55332

SEQ ID NO: 686974 - RNA, 64 nt, Homo Sapiens; identical to SEQ ID NO: 55333

SEQ ID NO: 686975 - RNA, 64 nt, Homo Sapiens; identical to SEQ ID NO: 55334

SEQ ID NO: 686976 - RNA, 64 nt, Homo Sapiens; identical to SEQ ID NO: 55335

SEQ ID NO: 686977 - RNA, 64 nt, Homo Sapiens
cuggcuauaaaauuauugaaauaaauuauaaauaugacuuuaucaaaaaccuggacagaaaauu

SEQ ID NO: 686978 - RNA, 64 nt, Homo Sapiens
uuuucauuggaagaaaaugcagauaauggcacauugacuuuauuaaacauuuuuauaaguguca

SEQ ID NO: 686979 - RNA, 64 nt, Homo Sapiens
uauuuuauuuguucuuucaucugugacugcuugcugacuuuaucauaauuuucuucaaacaaaa

SEQ ID NO: 686980 - RNA, 64 nt, Homo Sapiens
ucacugguuguuauucuuagguuauucccacacuugacuuuaucauuguuuacuacuaguaaaa

SEQ ID NO: 686981 - RNA, 64 nt, Homo Sapiens
aaaauaauuuccaagauuauaaaaagaaccaaaaugacuuuauuugacuuuaaggaaaaugaag

SEQ ID NO: 686982 - RNA, 64 nt, Homo Sapiens
gaaaaugaagaaaaagaaccaauaccuuuagaggugacuuuaagacauaugauauaaacagaga

SEQ ID NO: 686983 - RNA, 64 nt, Homo Sapiens
aaugggagaucuucucagcccugagguuugaaucugacuuuagccuaccuaacccagaaaaucu

SEQ ID NO: 686984 - RNA, 64 nt, Homo Sapiens
auuuguguaaauuauugaugaaaauaauuuacugugacuuuauuagcagcugacuuucaaagug

SEQ ID NO: 686985 - RNA, 64 nt, Homo Sapiens
gaucuuguguaucaaaccuacagaauauguaaaaugacuuuaagucuuuugaacaacuugguuu

SEQ ID NO: 686986 - RNA, 64 nt, Homo Sapiens
auaugaaaccuaauccuacccaugaaauuucugcugacuuuaauucuggcaacaaauugugaaa

SEQ ID NO: 686987 - RNA, 64 nt, Homo Sapiens
ugguuccaagaggcuguggcguuaacuauuucagugacuuuaucuucaaguauggcuaacaucu

SEQ ID NO: 686988 - RNA, 64 nt, Homo Sapiens
ugcaaagcugugaauaaaacgugauggaagcuggugacuuuauuagggugugaaucuauacaaa

SEQ ID NO: 686989 - RNA, 64 nt, Homo Sapiens
cauaccuuguuuuugaccaacucaauaaaaccagugacuuuacuuucagaacuaguuugagcug

SEQ ID NO: 686990 - RNA, 64 nt, Homo Sapiens
uguguccuaaacauucuucaaauugcucauucugugacuuuauuauucauaggagauguacugg

SEQ ID NO: 686991 - RNA, 64 nt, Homo Sapiens
uugucaccaauugaaaaucuuauuaguuaauaaaugacuuuaaacuauuguagauuuauuuuua

SEQ ID NO: 686992 - RNA, 64 nt, Homo Sapiens
auuguccaguucuggucuuuacagccauucuuccugacuuuaauagugugacuuuucaagugua

SEQ ID NO: 686993 - RNA, 64 nt, Homo Sapiens
aacaaauuuuuuucuuguuuggguguuaaggcagugacuuuagacaugaugaauuacuucuuca

SEQ ID NO: 686994 - RNA, 64 nt, Homo Sapiens
auuuuguuauagaaacugaucuaggaagaaaacaugacuuuaucggcuaucuacugagacauga

SEQ ID NO: 686995 - RNA, 64 nt, Homo Sapiens
gagaugauuuucuucaucucauaauuaaaauaccugacuuuagagagaguaaaaugugccagga

SEQ ID NO: 686996 - RNA, 64 nt, Homo Sapiens
gugccaggagccauaggaauaucuguauguuggaugacuuuaaugcuacauuuuaaaaaaagaa

SEQ ID NO: 686997 - RNA, 64 nt, Homo Sapiens
uuaugugacuauaauaaaaacaacuugauguaacugacuuuauuaauucaccaaugcauuugga

SEQ ID NO: 686998 - RNA, 64 nt, Homo Sapiens
gaaugcuaguagaagauguauuuucaccaaacccugacuuuauuauauaaaaacauuggaaguc

SEQ ID NO: 686999 - RNA, 64 nt, Homo Sapiens
aauauugcagugcuauuuuuguacaguguaaaauugacuuuaaaaaaccauuuguaucuaaugu

SEQ ID NO: 687000 - RNA, 64 nt, Homo Sapiens
uuuuuaauucacaaggaccaucauaugguuuuugugacuuuauuauuuauuuuaauuuguuuug

SEQ ID NO: 687001 - RNA, 64 nt, Homo Sapiens
aauuauauauguccuugggaaauauuaugacaguugacuuuaagaucaaaaggaagggaagacc

SEQ ID NO: 687002 - RNA, 64 nt, Homo Sapiens
cucaaaugugaaugccuugauuuuauuuuuauggugacuuuagcuacagcauuuccuauaccca

SEQ ID NO: 687003 - RNA, 64 nt, Homo Sapiens
uaaguuggccacacuuggggagugaguguggguaugacuuuacccuccugguugguucuuacug

SEQ ID NO: 687004 - RNA, 64 nt, Homo Sapiens
auauguaauaugcuccucuuggcuaauuuucuuuugacuuuaaugugccaauguaacuuccuuu

SEQ ID NO: 687005 - RNA, 64 nt, Homo Sapiens
aauuuauuuugcuuuacaggaguuugucauguauugacuuuaauauuguauuuugguaauaaau

SEQ ID NO: 687006 - RNA, 64 nt, Homo Sapiens
ccacagguuguguucauucuuuuccuggaaaugaugacuuuauugcuuagaaaguuguaaauaa

SEQ ID NO: 687007 - RNA, 64 nt, Homo Sapiens; identical to SEQ ID NO: 209092

SEQ ID NO: 687008 - RNA, 64 nt, Homo Sapiens; identical to SEQ ID NO: 209093

SEQ ID NO: 687009 - RNA, 64 nt, Homo Sapiens; identical to SEQ ID NO: 209094

SEQ ID NO: 687010 - RNA, 64 nt, Homo Sapiens; identical to SEQ ID NO: 209095

SEQ ID NO: 687011 - RNA, 64 nt, Homo Sapiens; identical to SEQ ID NO: 209096

SEQ ID NO: 687012 - RNA, 64 nt, Homo Sapiens; identical to SEQ ID NO: 209097

SEQ ID NO: 687013 - RNA, 64 nt, Homo Sapiens; identical to SEQ ID NO: 209098

SEQ ID NO: 687014 - RNA, 64 nt, Homo Sapiens; identical to SEQ ID NO: 209099

SEQ ID NO: 687015 - RNA, 64 nt, Homo Sapiens; identical to SEQ ID NO: 209100

SEQ ID NO: 687016 - RNA, 64 nt, Homo Sapiens; identical to SEQ ID NO: 209101

SEQ ID NO: 687017 - RNA, 64 nt, Homo Sapiens; identical to SEQ ID NO: 209102

SEQ ID NO: 687018 - RNA, 64 nt, Homo Sapiens; identical to SEQ ID NO: 209103

SEQ ID NO: 687019 - RNA, 64 nt, Homo Sapiens; identical to SEQ ID NO: 209104

SEQ ID NO: 687020 - RNA, 64 nt, Homo Sapiens; identical to SEQ ID NO: 209105

SEQ ID NO: 687021 - RNA, 64 nt, Homo Sapiens; identical to SEQ ID NO: 209106

SEQ ID NO: 687022 - RNA, 64 nt, Homo Sapiens; identical to SEQ ID NO: 209107

SEQ ID NO: 687023 - RNA, 64 nt, Homo Sapiens; identical to SEQ ID NO: 209108

SEQ ID NO: 687024 - RNA, 64 nt, Homo Sapiens; identical to SEQ ID NO: 209109

SEQ ID NO: 687025 - RNA, 64 nt, Homo Sapiens; identical to SEQ ID NO: 209110

SEQ ID NO: 687026 - RNA, 64 nt, Homo Sapiens; identical to SEQ ID NO: 209111

SEQ ID NO: 687027 - RNA, 64 nt, Homo Sapiens; identical to SEQ ID NO: 209112

SEQ ID NO: 687028 - RNA, 64 nt, Homo Sapiens; identical to SEQ ID NO: 209113

SEQ ID NO: 687029 - RNA, 59 nt, Homo Sapiens; identical to SEQ ID NO: 209114

SEQ ID NO: 687030 - RNA, 64 nt, Homo Sapiens; identical to SEQ ID NO: 209115

SEQ ID NO: 687031 - RNA, 64 nt, Homo Sapiens; identical to SEQ ID NO: 209116

SEQ ID NO: 687032 - RNA, 64 nt, Homo Sapiens; identical to SEQ ID NO: 209117

SEQ ID NO: 687033 - RNA, 64 nt, Homo Sapiens; identical to SEQ ID NO: 209118

SEQ ID NO: 687034 - RNA, 64 nt, Homo Sapiens; identical to SEQ ID NO: 209119

SEQ ID NO: 687035 - RNA, 64 nt, Homo Sapiens; identical to SEQ ID NO: 209120

SEQ ID NO: 687036 - RNA, 64 nt, Homo Sapiens; identical to SEQ ID NO: 209121

SEQ ID NO: 687037 - RNA, 64 nt, Homo Sapiens; identical to SEQ ID NO: 209122

SEQ ID NO: 687038 - RNA, 64 nt, Homo Sapiens; identical to SEQ ID NO: 209123

SEQ ID NO: 687039 - RNA, 64 nt, Homo Sapiens; identical to SEQ ID NO: 209124

SEQ ID NO: 687040 - RNA, 64 nt, Homo Sapiens; identical to SEQ ID NO: 209125

SEQ ID NO: 687041 - RNA, 64 nt, Homo Sapiens; identical to SEQ ID NO: 209126

SEQ ID NO: 687042 - RNA, 64 nt, Homo Sapiens; identical to SEQ ID NO: 209127

SEQ ID NO: 687043 - RNA, 64 nt, Homo Sapiens; identical to SEQ ID NO: 209128

SEQ ID NO: 687044 - RNA, 64 nt, Homo Sapiens; identical to SEQ ID NO: 209129

SEQ ID NO: 687045 - RNA, 64 nt, Homo Sapiens; identical to SEQ ID NO: 209130

SEQ ID NO: 687046 - RNA, 64 nt, Homo Sapiens; identical to SEQ ID NO: 209131

SEQ ID NO: 687047 - RNA, 64 nt, Homo Sapiens; identical to SEQ ID NO: 209132

SEQ ID NO: 687048 - RNA, 64 nt, Homo Sapiens; identical to SEQ ID NO: 209133

SEQ ID NO: 687049 - RNA, 64 nt, Homo Sapiens; identical to SEQ ID NO: 209134

SEQ ID NO: 687050 - RNA, 64 nt, Homo Sapiens; identical to SEQ ID NO: 209135

SEQ ID NO: 687051 - RNA, 64 nt, Homo Sapiens; identical to SEQ ID NO: 209136

SEQ ID NO: 687052 - RNA, 64 nt, Homo Sapiens; identical to SEQ ID NO: 209137

SEQ ID NO: 687053 - RNA, 64 nt, Homo Sapiens; identical to SEQ ID NO: 209138

SEQ ID NO: 687054 - RNA, 64 nt, Homo Sapiens; identical to SEQ ID NO: 209139

SEQ ID NO: 687055 - RNA, 64 nt, Homo Sapiens; identical to SEQ ID NO: 209140

SEQ ID NO: 687056 - RNA, 64 nt, Homo Sapiens; identical to SEQ ID NO: 209141

SEQ ID NO: 687057 - RNA, 64 nt, Homo Sapiens; identical to SEQ ID NO: 209142

SEQ ID NO: 687058 - RNA, 64 nt, Homo Sapiens; identical to SEQ ID NO: 209143

SEQ ID NO: 687059 - RNA, 64 nt, Homo Sapiens; identical to SEQ ID NO: 209144

SEQ ID NO: 687060 - RNA, 64 nt, Homo Sapiens; identical to SEQ ID NO: 209145

SEQ ID NO: 687061 - RNA, 64 nt, Homo Sapiens; identical to SEQ ID NO: 235738

SEQ ID NO: 687062 - RNA, 64 nt, Homo Sapiens; identical to SEQ ID NO: 235739

SEQ ID NO: 687063 - RNA, 64 nt, Homo Sapiens
gaacaagaacacccugaacaguccugguugggaugguguccacauucauguucugcgguucuug

SEQ ID NO: 687064 - RNA, 64 nt, Homo Sapiens
gcugggacugauggggacaccggccagcuugucugguguccagcagcccugccggacuuggccu

SEQ ID NO: 687065 - RNA, 64 nt, Homo Sapiens
cccgacugugcacacuuccaggccucccuggagagguguccacuccauccuucccuccguggcg

SEQ ID NO: 687066 - RNA, 64 nt, Homo Sapiens
caggugguggguagacagaggagugaaccccaaagguguccaugccccaguucuaagcccugug

SEQ ID NO: 687067 - RNA, 64 nt, Homo Sapiens
cggaccgugucaagcaucuaggagaggaguccaugguguccaggcaucggggcgucacaccugu

SEQ ID NO: 687068 - RNA, 64 nt, Homo Sapiens
cgggggcugggccgcacaggcuucugcccuucucgguguccaggcuccuugggugaugcuggag

SEQ ID NO: 687069 - RNA, 64 nt, Homo Sapiens
ugcuccaccagacaggaguuuuucuuauacagaugguguccauuucaguuucuugguaucuggc

SEQ ID NO: 687070 - RNA, 64 nt, Homo Sapiens
ugcucaaccagacaggaguuguuuguauacagaugguguccauuugaguuucuugguaucugac

SEQ ID NO: 687071 - RNA, 64 nt, Homo Sapiens
ccuggguugugucuuccccuggggaugaggguuggguguccauggugcccugggcuguguccuc

SEQ ID NO: 687072 - RNA, 64 nt, Homo Sapiens
ccugggcugugugcucuuaugggaaugaggguuggguguccaagaugcccugggcuguguccuu

SEQ ID NO: 687073 - RNA, 64 nt, Homo Sapiens
ccugggcuguguacuccccuaggaaugagggcuggguguccaagauacccugggcuguguccuc

SEQ ID NO: 687074 - RNA, 64 nt, Homo Sapiens
ccugggcuguguccuccccuggggaugaggguuggguguccauggugcccugggcuguguccuc

SEQ ID NO: 687075 - RNA, 64 nt, Homo Sapiens
ccugggcuguguccuccccuggggaugacgguuggguguccauggugcccugggcuguguuucc

SEQ ID NO: 687076 - RNA, 64 nt, Homo Sapiens
ugugcuuuggcccugcagcucugggccaccugcugguguccaccucguccaacagagucguggu

SEQ ID NO: 687077 - RNA, 64 nt, Homo Sapiens
ugcugugucgggccgcaucauccgggagcugcccgguguccacccugagcccugccccuccuug

SEQ ID NO: 687078 - RNA, 64 nt, Homo Sapiens
gugccuucuagagccgggcugggaauggggacacgguguccaccauccccagcugguggcccug

SEQ ID NO: 687079 - RNA, 64 nt, Homo Sapiens
uuuccucuaacucacugccuaggaggcuggccaagguguccaggguccucuagcccacucccug

SEQ ID NO: 687080 - RNA, 64 nt, Homo Sapiens
cauuggccuauacaucucuuaggaccuuuguaaugguguccaugcaccuuuagaggacuucaga

SEQ ID NO: 687081 - RNA, 64 nt, Homo Sapiens
cgggccuccaggauauguuugcgggggugggugugguguccagcuguuaccagcuucugagcua

SEQ ID NO: 687082 - RNA, 64 nt, Homo Sapiens
cuugaguuuuuacugacacgucccugugugcggggguguccauguggcgugugugugagugaga

SEQ ID NO: 687083 - RNA, 64 nt, Homo Sapiens
gcucgcucccacgcuccuccugccccagcccucugguguccacaccugcccacagagaauguaa

SEQ ID NO: 687084 - RNA, 64 nt, Homo Sapiens
aaucaacauggcugcuuugcugcuuccuucuccaaagugacauauggagggaacuuuagcacuu

SEQ ID NO: 687085 - RNA, 64 nt, Homo Sapiens
aguuuacuaacaauugggauaacugagggaagagaagugacaauuccacucagucuauuagagg

SEQ ID NO: 687086 - RNA, 64 nt, Homo Sapiens
cccagggacuaccucaagggcuuuugaugaggacaagugacaguaggaagaugcaagagccuuu

SEQ ID NO: 687087 - RNA, 64 nt, Homo Sapiens
aacaccugggagugcuggaaauguacugugaucgaagugacaaaguguguuuucauucacagug

SEQ ID NO: 687088 - RNA, 64 nt, Homo Sapiens
gccucugggaacacuuggaagguuuuaagcagagaagugacagguuggaaaagaugguuuggau

SEQ ID NO: 687089 - RNA, 64 nt, Homo Sapiens
cccucuucccuuccugcacugaggagauuaacugaagugacagauuagaguuagaaguggccca

SEQ ID NO: 687090 - RNA, 64 nt, Homo Sapiens
cuuauuuacauccuuaccucuaaaagauacuucaaagugacaaaaacguguuccuuccccacuu

SEQ ID NO: 687091 - RNA, 64 nt, Homo Sapiens
ugucucuuucaguuuguucuguaaauauuuagaaaagugacagcugucaaccucagaguaacua

SEQ ID NO: 687092 - RNA, 64 nt, Homo Sapiens
aaguccagggucauacgacgccauugccagaaugaagugacaaauaugaacagaagaaaauggu

SEQ ID NO: 687093 - RNA, 64 nt, Homo Sapiens
cuugcccguuuccuuguccccuaauuauucaaggaagugacaaauauuguccagacaacuuaca

SEQ ID NO: 687094 - RNA, 64 nt, Homo Sapiens
ugccgcguucucuguacuacguggcucauggaaaaagugacaacauggcuuccucuaaaucauu

SEQ ID NO: 687095 - RNA, 64 nt, Homo Sapiens
uauuucaucugcuuccuccccauucucucacuuuaagugacauugaggaagguauucuguccca

SEQ ID NO: 687096 - RNA, 64 nt, Homo Sapiens
uucagucuuucaaauagcugcaaccuuuauuuccaagugacauuuccauuucuguguguucccc

SEQ ID NO: 687097 - RNA, 64 nt, Homo Sapiens
ccauuuucggacgcagccguagcuccacccucccaagugacaggggucaacaggaagacccagc

SEQ ID NO: 687098 - RNA, 64 nt, Homo Sapiens
uuaagucuauauauuaacagacucucuagcaguuaagugacaaaugauaguaacauaguagagu

SEQ ID NO: 687099 - RNA, 64 nt, Homo Sapiens
aaugugggaaguccuucagcuucauuuuacauuaaagugacaugcuuaauaguguauuggaaaa

SEQ ID NO: 687100 - RNA, 64 nt, Homo Sapiens; identical to SEQ ID NO: 578258

SEQ ID NO: 687101 - RNA, 64 nt, Homo Sapiens; identical to SEQ ID NO: 578259

SEQ ID NO: 687102 - RNA, 64 nt, Homo Sapiens; identical to SEQ ID NO: 578260

SEQ ID NO: 687103 - RNA, 64 nt, Homo Sapiens; identical to SEQ ID NO: 578261

SEQ ID NO: 687104 - RNA, 64 nt, Homo Sapiens; identical to SEQ ID NO: 578262

SEQ ID NO: 687105 - RNA, 64 nt, Homo Sapiens; identical to SEQ ID NO: 578263

SEQ ID NO: 687106 - RNA, 64 nt, Homo Sapiens; identical to SEQ ID NO: 578264

SEQ ID NO: 687107 - RNA, 64 nt, Homo Sapiens; identical to SEQ ID NO: 578265

SEQ ID NO: 687108 - RNA, 64 nt, Homo Sapiens; identical to SEQ ID NO: 578266

SEQ ID NO: 687109 - RNA, 64 nt, Homo Sapiens; identical to SEQ ID NO: 578267

SEQ ID NO: 687110 - RNA, 64 nt, Homo Sapiens; identical to SEQ ID NO: 578268

SEQ ID NO: 687111 - RNA, 64 nt, Homo Sapiens; identical to SEQ ID NO: 578269

SEQ ID NO: 687112 - RNA, 64 nt, Homo Sapiens; identical to SEQ ID NO: 578270

SEQ ID NO: 687113 - RNA, 64 nt, Homo Sapiens; identical to SEQ ID NO: 578271

SEQ ID NO: 687114 - RNA, 64 nt, Homo Sapiens; identical to SEQ ID NO: 578272

SEQ ID NO: 687115 - RNA, 64 nt, Homo Sapiens; identical to SEQ ID NO: 578273

SEQ ID NO: 687116 - RNA, 64 nt, Homo Sapiens; identical to SEQ ID NO: 578274

SEQ ID NO: 687117 - RNA, 64 nt, Homo Sapiens; identical to SEQ ID NO: 578275

SEQ ID NO: 687118 - RNA, 64 nt, Homo Sapiens; identical to SEQ ID NO: 578276

SEQ ID NO: 687119 - RNA, 64 nt, Homo Sapiens; identical to SEQ ID NO: 578277

SEQ ID NO: 687120 - RNA, 64 nt, Homo Sapiens; identical to SEQ ID NO: 578278

SEQ ID NO: 687121 - RNA, 64 nt, Homo Sapiens; identical to SEQ ID NO: 578279

SEQ ID NO: 687122 - RNA, 64 nt, Homo Sapiens; identical to SEQ ID NO: 578280

SEQ ID NO: 687123 - RNA, 64 nt, Homo Sapiens; identical to SEQ ID NO: 578281

SEQ ID NO: 687124 - RNA, 64 nt, Homo Sapiens; identical to SEQ ID NO: 578282

SEQ ID NO: 687125 - RNA, 64 nt, Homo Sapiens; identical to SEQ ID NO: 578283

SEQ ID NO: 687126 - RNA, 64 nt, Homo Sapiens; identical to SEQ ID NO: 578283

SEQ ID NO: 687127 - RNA, 64 nt, Homo Sapiens; identical to SEQ ID NO: 578285

SEQ ID NO: 687128 - RNA, 64 nt, Homo Sapiens; identical to SEQ ID NO: 578286

SEQ ID NO: 687129 - RNA, 64 nt, Homo Sapiens; identical to SEQ ID NO: 578287

SEQ ID NO: 687130 - RNA, 64 nt, Homo Sapiens; identical to SEQ ID NO: 578288

SEQ ID NO: 687131 - RNA, 64 nt, Homo Sapiens; identical to SEQ ID NO: 578289

SEQ ID NO: 687132 - RNA, 64 nt, Homo Sapiens; identical to SEQ ID NO: 578290

SEQ ID NO: 687133 - RNA, 64 nt, Homo Sapiens; identical to SEQ ID NO: 578291

SEQ ID NO: 687134 - RNA, 64 nt, Homo Sapiens; identical to SEQ ID NO: 578292

SEQ ID NO: 687135 - RNA, 64 nt, Homo Sapiens; identical to SEQ ID NO: 578293

SEQ ID NO: 687136 - RNA, 64 nt, Homo Sapiens; identical to SEQ ID NO: 578294

SEQ ID NO: 687137 - RNA, 64 nt, Homo Sapiens; identical to SEQ ID NO: 578295

SEQ ID NO: 687138 - RNA, 64 nt, Homo Sapiens; identical to SEQ ID NO: 578296

SEQ ID NO: 687139 - RNA, 64 nt, Homo Sapiens; identical to SEQ ID NO: 578297

SEQ ID NO: 687140 - RNA, 64 nt, Homo Sapiens
gucacaaucuagauuauaaucaauaggugaacuuauuaaauaacuuuucuaaauaaaaaauuua

SEQ ID NO: 687141 - RNA, 64 nt, Homo Sapiens
gauaugauuuauuuaugaaaccuaaugaagcagaauuaaauacuguauuaaaauaaguucgcug

SEQ ID NO: 687142 - RNA, 64 nt, Homo Sapiens
gcuacccuucuuucccuuuagaaaacugugauuaauuaaauaaaaagucuuacuacuauaacaa

SEQ ID NO: 687143 - RNA, 64 nt, Homo Sapiens
gugugcacauauacaaugugcauuauacauauauauuaaauauauccacaaagcagaugggcaa

SEQ ID NO: 687144 - RNA, 64 nt, Homo Sapiens
guuuuguaauggugguguuuuaauauuuuacauaauuaaauauguacauauugauuagaaaaau

SEQ ID NO: 687145 - RNA, 64 nt, Homo Sapiens
aauucaggaagcaggugagaggagucaagccaauauuaaauaugcauucuuuuaaaguaugugc

SEQ ID NO: 687146 - RNA, 64 nt, Homo Sapiens
cuauuuauuauucacucaaguauuaacauucucuauuaaauaagaggagguguuguaaagagcu

SEQ ID NO: 687147 - RNA, 64 nt, Homo Sapiens
cucaucaaagcaaucuuugugauauuacuucgcuauuaaauaaagaaaauuggaugcaagacaa

SEQ ID NO: 687148 - RNA, 64 nt, Homo Sapiens
uauaacuuauaaacaccaacaauuaaacucaaauauuaaauaucaaugcuucaaaaaaauuuuc

SEQ ID NO: 687149 - RNA, 64 nt, Homo Sapiens
aagauaaagaaaaaugcaccgacuuagaugauguauuaaauaccuuuuguuuaacacgguuacu

SEQ ID NO: 687150 - RNA, 64 nt, Homo Sapiens
ugugcaugcuuuucucuugccguguaaaacuuauauuaaauaaaccuuauggagccccucgugu

SEQ ID NO: 687151 - RNA, 64 nt, Homo Sapiens
aguuaauagcuauccuaaauuucuuuauaaaugcauuaaauaaguuauauauuaauaugcaugc

SEQ ID NO: 687152 - RNA, 64 nt, Homo Sapiens
acauggcaauaagugucagaauuaaauaaaaaauauuaaauaaauuuuuuuuaaaaauuaaaag

SEQ ID NO: 687153 - RNA, 64 nt, Homo Sapiens
aaauauuaaauaaaacaugguuaaaaauuaaaagauuaaauaaaguacuguuaauggguuuuuu

SEQ ID NO: 687154 - RNA, 64 nt, Homo Sapiens
ugggguuuugguuuuaaagcucuaauuuuuauuuauuaaauauuggaguagaauggcaacuaau

SEQ ID NO: 687155 - RNA, 64 nt, Homo Sapiens
auuugaugucuagauaacauucaugagauuggucauuaaauacuauuuugcuccuuuucuggug

SEQ ID NO: 687156 - RNA, 64 nt, Homo Sapiens
aauuuaaugucuaggauaauuuuuaaaagaggaaauuaaauaauuuuacaugucucauauuuuc

SEQ ID NO: 687157 - RNA, 64 nt, Homo Sapiens
auuuugcuguugugccaguuaaucauaggaucccauuaaauaagugugcuaacaucgaauauag

SEQ ID NO: 687158 - RNA, 64 nt, Homo Sapiens
cagcuuguuucauaacauguuauuuuccugugucauuaaauaauuacuucaauguuguauuucg

SEQ ID NO: 687159 - RNA, 64 nt, Homo Sapiens
gaauuuggaaacguguguugacuccuggugguaaauuaaauaguuuuuuucaucagaaaaauua

SEQ ID NO: 687160 - RNA, 64 nt, Homo Sapiens
uacaauuaguacuuuauagucacauguuguauauauuaaauagcccaguuuuauucagacuugu

SEQ ID NO: 687161 - RNA, 64 nt, Homo Sapiens
agccaaauuuaucaaagcauagauguuuugguagauuaaauauagauuagaaaaauuccuaaga

SEQ ID NO: 687162 - RNA, 64 nt, Homo Sapiens
cauuucuucagucagaaaacuuuaaaaaauauuuauuaaauaaaaucaauuuuuaggaaguuuu

SEQ ID NO: 687163 - RNA, 64 nt, Homo Sapiens
uugcccuauuuucccuauuaguaauaguuuggccauuaaauaucauuuccuuuccuaagcuuau

SEQ ID NO: 687164 - RNA, 64 nt, Homo Sapiens
acuguacucuuaguugcugucauaaaagggagaaauuaaauauuacguguugucacuggauuau

SEQ ID NO: 687165 - RNA, 64 nt, Homo Sapiens
uuuacuauuuguucaauagccuauauuucuagauauuaaauauuuuuuguaagauauaugcaca

SEQ ID NO: 687166 - RNA, 64 nt, Homo Sapiens
cuggcuucauuuaauaaaaauaaaugauuuugaaauuaaauauaauauagaauucacauuuuau

SEQ ID NO: 687167 - RNA, 64 nt, Homo Sapiens
ucaguggaauagauggcuaucuuucuuggcuaacauuaaauauucuuguaccagagcauggaaa

SEQ ID NO: 687168 - RNA, 64 nt, Homo Sapiens
auaaugcauaugugauuguucuuaaagucaauguauuaaauaagguauuuuuccuuuucccucu

SEQ ID NO: 687169 - RNA, 64 nt, Homo Sapiens
acaaccaugaauaaaaauacaauucucuugcaccauuaaauaguguguuaagugcuacggcagc

SEQ ID NO: 687170 - RNA, 64 nt, Homo Sapiens
aaaguugaaauuuaugagcuuugaagauugcuaaauuaaauaauuuauagcuccaaaaacaaaa

SEQ ID NO: 687171 - RNA, 64 nt, Homo Sapiens
uuuaaaaauugccccaaauacugacauugagugcauuaaauaacaaauuaucuuugauacauua

SEQ ID NO: 687172 - RNA, 64 nt, Homo Sapiens
aauugaauggaggguccuaaagagaugguggucuauuaaauauguuuuuccugaugaaggcaga

SEQ ID NO: 687173 - RNA, 64 nt, Homo Sapiens
auuaaucauaggcagauacucaaaagugcguguaauuaaauacuagcaaggaaguaaacucaaa

SEQ ID NO: 687174 - RNA, 64 nt, Homo Sapiens
uuuguuguuuggauauuucaacuaucuuuauauuauuaaauauauagcuuuuguugauuuuggc

SEQ ID NO: 687175 - RNA, 64 nt, Homo Sapiens
cagguaacaguucugaauucgaacuuaauuuuuuauuaaauauuagagaccuaugauccucaug

SEQ ID NO: 687176 - RNA, 64 nt, Homo Sapiens
uaauuuuauagcucaguuuauauuaauggguagaauuaaauauaagaaaacccucaguccuauu

SEQ ID NO: 687177 - RNA, 64 nt, Homo Sapiens
aguuauaaugaacaguuaaaaaugcucauugaaaauuaaauaaaacaaaaaggcaguuauuuca

SEQ ID NO: 687178 - RNA, 64 nt, Homo Sapiens
guugguacaguaggcuaaagguacgguguuccauauuaaauacagcaauaugaagaaaaauaaa

SEQ ID NO: 687179 - RNA, 64 nt, Homo Sapiens
auguagcagaaccaucugcaaaguguuacaucauauuaaauaaaucacaguuuacuagauuacc

SEQ ID NO: 687180 - RNA, 64 nt, Homo Sapiens
ucuuuguuuuuccuuuuggaagaaaagagaucagauuaaauauuuacugaauuaauuuuuuaaa

SEQ ID NO: 687181 - RNA, 64 nt, Homo Sapiens
ccucuuacuucaggaacaaagcucauguaguggaauuaaauauaauuucauaauacuuuuuugg

SEQ ID NO: 687182 - RNA, 64 nt, Homo Sapiens
cuuuagaauuuucuaagacaacuguuaaaaccuaauuaaauaugguuauauuaaguucucccuu

SEQ ID NO: 687183 - RNA, 64 nt, Homo Sapiens
aagaauauggcaauuagcgaaguaugccuguuauauuaaauaaucacuuuguuuuauauaauaa

SEQ ID NO: 687184 - RNA, 64 nt, Homo Sapiens
uaugaguggugcauuuuuaauuguggcuugcugaauuaaauauuuugauaaaaucaagucuugg

SEQ ID NO: 687185 - RNA, 64 nt, Homo Sapiens
cuuggguucaaccuuugaaucaauuuuaccacugauuaaauaaaugacucaaagacaucuguaa

SEQ ID NO: 687186 - RNA, 64 nt, Homo Sapiens
uuuauauuauguagaaaucuucaaagguagcauuauuaaauagcaaagaauaauuagaacccac

SEQ ID NO: 687187 - RNA, 64 nt, Homo Sapiens
ccuuuacagguaauggaacaugagcuucacccauauuaaauauuuuggccccuuuaaggucaaa

SEQ ID NO: 687188 - RNA, 64 nt, Homo Sapiens
uaagccaaagguucagaaaauuaaacuacagaauauuaaauauuauaaugugcccaaagcucug

SEQ ID NO: 687189 - RNA, 64 nt, Homo Sapiens
auuauaaugugcccaaagcucugaauaguuaaaaauuaaauauuuauuuucuuccccaagcuuu

SEQ ID NO: 687190 - RNA, 64 nt, Homo Sapiens
auuucuguuauagucuucugauuaauuuuaauauauuaaauaugaugugaaagauauuugaagu

SEQ ID NO: 687191 - RNA, 64 nt, Homo Sapiens
gauuaaugcauucuccacauuuuuaaacucauugauuaaauaauuucagaagcuuuugucuauu

SEQ ID NO: 687192 - RNA, 64 nt, Homo Sapiens
ccauuuccgcuuuggcuacagagauguaagaauuauuaaauauuacucagaagacuacauuagu

SEQ ID NO: 687193 - RNA, 64 nt, Homo Sapiens
aauauaaaaauauguacauuggucugcaucucuuauuaaauaaauaaauaaauaaauaaaucug

SEQ ID NO: 687194 - RNA, 64 nt, Homo Sapiens
uaaauaaaucugggucugcaggcuaacauauuuaauuaaauaaaaaaaaaauguggaguuggag

SEQ ID NO: 687195 - RNA, 64 nt, Homo Sapiens
caaaugguuugugguucacaacauucuuuuuucuauuaaauaaauuacuuugcuaauaaucuac

SEQ ID NO: 687196 - RNA, 64 nt, Homo Sapiens
gcauauucuguagacuauaguuuaguuaaugaguauuaaauaguguaaucuucauugacuuuuc

SEQ ID NO: 687197 - RNA, 64 nt, Homo Sapiens
uuuuccccaaaggcaugcaguauugugcauuaaaauuaaauacuuuuguaagcuauaacauauu

SEQ ID NO: 687198 - RNA, 64 nt, Homo Sapiens
uuuuaauuaaaaaaucaaggaaagaacauuuaaaauuaaauaaaauaccuaccucuuccguugg

SEQ ID NO: 687199 - RNA, 64 nt, Homo Sapiens
auaaaauguaacucugccuuaacagaaaagagauauuaaauaccucuauuucuguggaaaaaac

SEQ ID NO: 687200 - RNA, 64 nt, Homo Sapiens
acaacuagcuaaauuuauugaacuuuauuaauguauuaaauauuaauuucuuuguaauauguga

SEQ ID NO: 687201 - RNA, 64 nt, Homo Sapiens
caaagagcaaaucauauuacauaauuacauuuuaauuaaauauagaauauucuacugaauugca

SEQ ID NO: 687202 - RNA, 64 nt, Homo Sapiens
auuaaauauagaauauucuacugaauugcaauuuauuaaauauucuuauccucuuaaauaaaac

SEQ ID NO: 687203 - RNA, 64 nt, Homo Sapiens
uacauuuuauuuuugaaggugugguacaguguaaauuaaauauauucaauauauuucccaccaa

SEQ ID NO: 687204 - RNA, 64 nt, Homo Sapiens
cgcauuuuuguguguugaaauucuugaagguuacauuaaauaaaacaaaaucucuuuauuauaa

SEQ ID NO: 687205 - RNA, 64 nt, Homo Sapiens
uuguccaagugaaacucgacgccaaaacccauguauuaaauaaauauuucauaauaaguggucu

SEQ ID NO: 687206 - RNA, 64 nt, Homo Sapiens
acuccgccaguguaaggguguagauuaguuaccaauuaaauauaguacaacuggagaaucguuc

SEQ ID NO: 687207 - RNA, 64 nt, Homo Sapiens
ggauucauuuuaucgagauguuuuaaaacaacucauuaaauauugaaucugcacgugacuggca

SEQ ID NO: 687208 - RNA, 64 nt, Homo Sapiens
acaauagcaucccagagagaaagaauuccaauuaauuaaauaucagaaauuauucauaagagaa

SEQ ID NO: 687209 - RNA, 64 nt, Homo Sapiens
aacugaaaagacuauguaguaggucauuacugccauuaaauaauuuuacccaagaauccacugg

SEQ ID NO: 687210 - RNA, 64 nt, Homo Sapiens
uagcaauuaccuuucuaaaaucuuuccuucuucuauuaaauauuagaauguuuauuuaucaaag

SEQ ID NO: 687211 - RNA, 64 nt, Homo Sapiens
guuaaauauucuguauuuugguugaguaaaaaauauuaaauauugaaaaacacaaaggcagacu

SEQ ID NO: 687212 - RNA, 64 nt, Homo Sapiens
auuauaauauuuuguuguaauugccaacugucagauuaaauagcccaguuuguuuuucuauugu

SEQ ID NO: 687213 - RNA, 64 nt, Homo Sapiens
gagguagauuugaaaaaaccaugaauaugcuuucauuaaauagguaugcauaguuucauauuua

SEQ ID NO: 687214 - RNA, 64 nt, Homo Sapiens
guuuauuuagguaagcauaacuuauaugccaaauauuaaauauguucuugcucuaucaaauuag

SEQ ID NO: 687215 - RNA, 64 nt, Homo Sapiens
aauacacacauuguuacaacuaacacaaauuccuauuaaauauuaaaaguaguucugguuuauu

SEQ ID NO: 687216 - RNA, 64 nt, Homo Sapiens
cuuaaacaccuauuacaguuaaauuaugcaaaucauuaaauaaaaaucauacaacuuuuggaaa

SEQ ID NO: 687217 - RNA, 64 nt, Homo Sapiens
cuguuaaugccccuuucccacagucuuuuauauaauuaaauauaugucaauacacauuagaauc

SEQ ID NO: 687218 - RNA, 64 nt, Homo Sapiens
uaauauagucacaguucaaaaauguguuuuguuuauuaaauagugcaucuuuuuuucauuuuua

SEQ ID NO: 687219 - RNA, 64 nt, Homo Sapiens
augcacaaaacuuugauucuuauggccuaaauuuauuaaauaaacgauuuaaguuacaauguuu

SEQ ID NO: 687220 - RNA, 64 nt, Homo Sapiens
ugguuaaaggugcuguuagucuaaauaacugaacauuaaauaauaacugcucagggaaauaggg

SEQ ID NO: 687221 - RNA, 64 nt, Homo Sapiens
auucuuagaaguauguccucuuuaguuaaguagcauuaaauaggcuucauuaaauguauacaga

SEQ ID NO: 687222 - RNA, 64 nt, Homo Sapiens
aauagguuuucuugaugggauagcacuuagcacaauuaaauagaaaaccuaaagaguaaaaccu

SEQ ID NO: 687223 - RNA, 64 nt, Homo Sapiens
uguauaacugcaucuucaauacaaguaucaguauauuaaauaggguauugguaaagaaacgguc

SEQ ID NO: 687224 - RNA, 64 nt, Homo Sapiens
acaugugcaucuguacaauaaacuuaaaaugauuauuaaauaaucaaauauaucuacuacauug

SEQ ID NO: 687225 - RNA, 64 nt, Homo Sapiens
aaaaucaugugcuguauuuuuaaaaucuagccaaauuaaauaguacaugagaaauucagaguau

SEQ ID NO: 687226 - RNA, 64 nt, Homo Sapiens
ucaguuguucagaaaaauaaaaauaauuucucauauuaaauacagacgcuccucaacuuaugau

SEQ ID NO: 687227 - RNA, 64 nt, Homo Sapiens
gguguucacagugacuuggauacaccaauuagaaauuaaauaagcaaauauauauauauauaua

SEQ ID NO: 687228 - RNA, 64 nt, Homo Sapiens
uuuuuugagcuuauaugcaaacauaauaaauauuauuaaauaucaggaaagcuaacauuucaua

SEQ ID NO: 687229 - RNA, 64 nt, Homo Sapiens
uuaaaaauugcucugugauauagaacaaaaauguauuaaauauuuaagaaaugcucauucuuug

SEQ ID NO: 687230 - RNA, 64 nt, Homo Sapiens
gcuuugaagauggcgcucuguaaguuaauauuuaauuaaauauuaguuuuugacccaggcagaa

SEQ ID NO: 687231 - RNA, 64 nt, Homo Sapiens
agccuuaaaauucacaauuuaaauguaaucuggaauuaaauauuguauauucuagggucagggg

SEQ ID NO: 687232 - RNA, 64 nt, Homo Sapiens
cuacaacuuuuuaaaaauguccuuuuuuuauauuauuaaauauuucagcuaauaauauaucaga

SEQ ID NO: 687233 - RNA, 64 nt, Homo Sapiens
ucuuuucuaggaugcugaguaucuacauggauacauuaaauauauuuaugcgaguugcaacuau

SEQ ID NO: 687234 - RNA, 64 nt, Homo Sapiens
acaucaaauaucuuguuuaauggggcagauaugcauuaaauaguuuguacaagcagcuuucguu

SEQ ID NO: 687235 - RNA, 64 nt, Homo Sapiens
gggcuugaaacauuauaaaaauugacaaugauuuauuaaauauguuuucucaauuguaacgacu

SEQ ID NO: 687236 - RNA, 64 nt, Homo Sapiens
gcuucaugugcugccugcaagcuucuuuuuucucauuaaauauaaaauauuuuguaaugcugca

SEQ ID NO: 687237 - RNA, 64 nt, Homo Sapiens
aucauaucaauagguacagauuagcaguucaaagauuaaauaugagugcaauccauugcaugca

SEQ ID NO: 687238 - RNA, 64 nt, Homo Sapiens
uugaagcaguaauuaauaacaggcauauauaucuauuaaauaaacauaaaagguagaucucagu

SEQ ID NO: 687239 - RNA, 64 nt, Homo Sapiens
gugugcacaacuuuaucuuaauuuuauuauaugcauuaaauaguuugcuaugaguggccuuugu

SEQ ID NO: 687240 - RNA, 64 nt, Homo Sapiens
acaaauuuguucaguucauauccuaagacuccugauuaaauauucuagguuauauauuagccau

SEQ ID NO: 687241 - RNA, 64 nt, Homo Sapiens
acuggucugacaagccaaaaauguuauaucugauauuaaauacuuaaugcugauuugaagagau

SEQ ID NO: 687242 - RNA, 64 nt, Homo Sapiens
ugcuacaaauaauguugcuguguuaaguauucauauuaaauacaugccuucuauauggaacaug

SEQ ID NO: 687243 - RNA, 64 nt, Homo Sapiens
uuuugaaaaaucauuauucacguauugguucuuuauuaaauaaucugaaaacgcuaaaaguaua

SEQ ID NO: 687244 - RNA, 64 nt, Homo Sapiens
cugaaaacgcuaaaaguauauuuauuguguuacuauuaaauaugucuaauguuaucaaaacuca

SEQ ID NO: 687245 - RNA, 64 nt, Homo Sapiens
uuguaaaaccuacaugagcagaugaaauagaagcauuaaauauuuuuaucuauauccaaaaagg

SEQ ID NO: 687246 - RNA, 64 nt, Homo Sapiens
ccuaccuauuugauuauauguugauugauaacauauuaaauagagaacaaauaagagagguccu

SEQ ID NO: 687247 - RNA, 64 nt, Homo Sapiens
auaauucuuaugaaaaucaucaaauuggcuucuuauuaaauacaauaacuaauuuuaaaucagu

SEQ ID NO: 687248 - RNA, 64 nt, Homo Sapiens
gaauuuguaugaaccuuugcauaggaaaauuguuauuaaauaaacugguacuuggugugguuaa

SEQ ID NO: 687249 - RNA, 64 nt, Homo Sapiens
auuuacuuacauuucuuuaauugcuuacuauuugauuaaauaaagagacaaacaaaaaaaaagu

SEQ ID NO: 687250 - RNA, 64 nt, Homo Sapiens
uuuauuaaaagaauguuucaaaaaugugucuuguauuaaauauuaggaauuuauuaugcacagc

SEQ ID NO: 687251 - RNA, 64 nt, Homo Sapiens
gcaucugauuugcagacucauaauuugauuuuuaauuaaauauauagguugugaugaagugaau

SEQ ID NO: 687252 - RNA, 64 nt, Homo Sapiens
ggcucuuuuuagagcuggaaauguaguggcuuucauuaaauacuugcuguaaagucuuucuaag

SEQ ID NO: 687253 - RNA, 64 nt, Homo Sapiens
cuaagaagcuagugcugcuaucucauauaugaguauuaaauaugguaugcuuaguauauuccaa

SEQ ID NO: 687254 - RNA, 64 nt, Homo Sapiens
gaugccacguugaaucaugugauucuagauuaacauuaaauagauugaaaaagaaacuuugcac

SEQ ID NO: 687255 - RNA, 64 nt, Homo Sapiens
guauaaagacaguagaagauuuuaguaagccuacauuaaauaggagcagaucuugugguauaaa

SEQ ID NO: 687256 - RNA, 64 nt, Homo Sapiens
aaaucauauagacaauuagcuguuugaagugaguauuaaauauuucagaagugugaauuucaug

SEQ ID NO: 687257 - RNA, 64 nt, Homo Sapiens
uucaggguuuuaaacacuaauguuuuuauucuguauuaaauauuaacauguacuuugagcuuau

SEQ ID NO: 687258 - RNA, 64 nt, Homo Sapiens
uauauauauuaguaauuuauaaaaauagucaaaaauuaaauauacuguggaauaaagauggucc

SEQ ID NO: 687259 - RNA, 64 nt, Homo Sapiens
uugauaagugauuauuaugcuugauaaacuuugaauuaaauacaguugucuugaggguaugaua

SEQ ID NO: 687260 - RNA, 64 nt, Homo Sapiens
gaguuuccagaugauacacguucuuuucagcuucauuaaauaggcaacuauguuucuaaauagu

SEQ ID NO: 687261 - RNA, 64 nt, Homo Sapiens
uuaaugguucuaaucuuuuguuuaaaguugaagaauuaaauauuauuuugauuuuauuuaauuu

SEQ ID NO: 687262 - RNA, 64 nt, Homo Sapiens
uuuguuucaaagaaacaucuaucacaugcauaaaauuaaauauuuacauugaauaaggcuguuu

SEQ ID NO: 687263 - RNA, 64 nt, Homo Sapiens
uucaaaugcuaaggugauguuuuaccgggacuuaauuaaauacaacuuuuuccuuucgaaaaag

SEQ ID NO: 687264 - RNA, 64 nt, Homo Sapiens
uagucugcucuauauauugucaauauguucccauauuaaauauuuugcuuuuuagacagcugua

SEQ ID NO: 687265 - RNA, 64 nt, Homo Sapiens
aauaguuuacucgcaacaacaucuaaacuacguuauuaaauagauaauuuuuuucugcaaauaa

SEQ ID NO: 687266 - RNA, 64 nt, Homo Sapiens
aaacugagaagucuaguugcgagacauaaggaaaauuaaauacacagaacguuauuaagccaug

SEQ ID NO: 687267 - RNA, 64 nt, Homo Sapiens
uugcauuauucauaauuuaauuguuugaaauuacauuaaauaaaucaacuaauuaaauacuaaa

SEQ ID NO: 687268 - RNA, 63 nt, Homo Sapiens
uaauuguuugaaauuacauuaaauaaaucaacuaauuaaauacuaaaguuuuguuccuuuuua

SEQ ID NO: 687269 - RNA, 64 nt, Homo Sapiens
uauaaagugaauguucaacaauuuuaaacaaaaaauuaaauaucauaucuugauauuuucacaa

SEQ ID NO: 687270 - RNA, 64 nt, Homo Sapiens
cuauuuuuauaaagauaaauacuauuagauaagaauuaaauauuauaauauacaaaugaauuau

SEQ ID NO: 687271 - RNA, 64 nt, Homo Sapiens
aaguguucauacuaaaauauauuuuugcagauacauuaaauaugaaagauauucaauccaaaau

SEQ ID NO: 687272 - RNA, 64 nt, Homo Sapiens
ugaacuuagcuuuucaauucaacauuuuuaacauauuaaauacuauugugaauucaaugaagug

SEQ ID NO: 687273 - RNA, 64 nt, Homo Sapiens
uuaaaagagcgguuuguguaucauuguucaucuaauuaaauaaaugcugaaaaggaaaacgauu

SEQ ID NO: 687274 - RNA, 64 nt, Homo Sapiens
ucauacacuuuauugcaacuguucguacauucuuauuaaauauuacaauuuauuuugguuauau

SEQ ID NO: 687275 - RNA, 64 nt, Homo Sapiens
cgaaguaauuuuggguggggggaugacuacagacauuaaauaaugggcaagacuuuucuuugaa

SEQ ID NO: 687276 - RNA, 64 nt, Homo Sapiens
auaaccccgggcaagacuuuuauuacauaaauaaauuaaauaaacaugaucgcuuucuacacug

SEQ ID NO: 687277 - RNA, 64 nt, Homo Sapiens
auaugucgcccccgugaugcauauauacacagguauuaaauauaucgcucuauauaauauuaua

SEQ ID NO: 687278 - RNA, 64 nt, Homo Sapiens
guguauuaaaaauuuaagaauaccacacuuuaauauuaaauauucauaaggucuaguaucuuga

SEQ ID NO: 687279 - RNA, 64 nt, Homo Sapiens; identical to SEQ ID NO: 364238

SEQ ID NO: 687280 - RNA, 64 nt, Homo Sapiens; identical to SEQ ID NO: 364239

SEQ ID NO: 687281 - RNA, 64 nt, Homo Sapiens; identical to SEQ ID NO: 364240

SEQ ID NO: 687282 - RNA, 64 nt, Homo Sapiens; identical to SEQ ID NO: 364241

SEQ ID NO: 687283 - RNA, 64 nt, Homo Sapiens; identical to SEQ ID NO: 364242

SEQ ID NO: 687284 - RNA, 64 nt, Homo Sapiens; identical to SEQ ID NO: 364243

SEQ ID NO: 687285 - RNA, 64 nt, Homo Sapiens; identical to SEQ ID NO: 364244

SEQ ID NO: 687286 - RNA, 64 nt, Homo Sapiens; identical to SEQ ID NO: 364245

SEQ ID NO: 687287 - RNA, 64 nt, Homo Sapiens; identical to SEQ ID NO: 364246

SEQ ID NO: 687288 - RNA, 64 nt, Homo Sapiens; identical to SEQ ID NO: 364247

SEQ ID NO: 687289 - RNA, 64 nt, Homo Sapiens; identical to SEQ ID NO: 364248

SEQ ID NO: 687290 - RNA, 64 nt, Homo Sapiens; identical to SEQ ID NO: 364249

SEQ ID NO: 687291 - RNA, 64 nt, Homo Sapiens; identical to SEQ ID NO: 364250

SEQ ID NO: 687292 - RNA, 64 nt, Homo Sapiens; identical to SEQ ID NO: 364251

SEQ ID NO: 687293 - RNA, 64 nt, Homo Sapiens; identical to SEQ ID NO: 364252

SEQ ID NO: 687294 - RNA, 64 nt, Homo Sapiens; identical to SEQ ID NO: 364253

SEQ ID NO: 687295 - RNA, 64 nt, Homo Sapiens
uucauuuccuuaaguuuugaucuccgucuuccugaugaagcaggcagagcucagaggaucuugg

SEQ ID NO: 687296 - RNA, 64 nt, Homo Sapiens
augcuuccugccagcacgugccugaagguuucacaugaagcaugggaagcgcacccugucguuc

SEQ ID NO: 687297 - RNA, 64 nt, Homo Sapiens
guagccuaaaaaaaucuuaauuauuucauggaucaugaagcaaggaugaauaauaucaugucuu

SEQ ID NO: 687298 - RNA, 64 nt, Homo Sapiens
uugucuuuaaagauauaaaaauuaggaugccuuuaugaagcacugauuauaccaaaaaaaaaag

SEQ ID NO: 687299 - RNA, 64 nt, Homo Sapiens
guuucuuuucuucacucaaauuuuugacauggaaaugaagcagguugauuaaaucaaccaccua

SEQ ID NO: 687300 - RNA, 64 nt, Homo Sapiens
auuuugguaaccaggccauucaccaaacuacugaaugaagcagucacauacacccaaacacuua

SEQ ID NO: 687301 - RNA, 64 nt, Homo Sapiens
caaaacuucuucucugggcuaccuaucuuccuucaugaagcaggugcucaggacccggaagaau

SEQ ID NO: 687302 - RNA, 64 nt, Homo Sapiens
acugguuaaguguuuacuaccauuaaagcgaggcaugaagcaaagagcugagugaguccucugc

SEQ ID NO: 687303 - RNA, 64 nt, Homo Sapiens
cuccuaguccuggagugacuagggcucuucacucaugaagcagacagguucaucuuugaaaucu

SEQ ID NO: 687304 - RNA, 64 nt, Homo Sapiens
gugugaauggacaauguugagcccaggccuugcuaugaagcaguuauaagucaaaggaaaauga

SEQ ID NO: 687305 - RNA, 64 nt, Homo Sapiens
aaaaggaugcagagcugugcaaauuguuccucaaaugaagcaguguggaguguauuggggauuu

SEQ ID NO: 687306 - RNA, 64 nt, Homo Sapiens
gugaggugauuuugaaucuuguccauauaggaaaaugaagcacagaauuacucagucuuccaua

SEQ ID NO: 687307 - RNA, 64 nt, Homo Sapiens
gaaaacauuuaacauaaugguugugaaauguaacaugaagcaaacuaacuuuuuuuuuuuuaac

SEQ ID NO: 687308 - RNA, 64 nt, Homo Sapiens
ugaacagacuagaaguauuugugggaggagugacaugaagcaugaguuaucugauuuuuuuugu

SEQ ID NO: 687309 - RNA, 64 nt, Homo Sapiens
uaaguuggaccaagggaagucggggacguaaaaaaugaagcaaaacaaugccagggugucuccc

SEQ ID NO: 687310 - RNA, 64 nt, Homo Sapiens
cuggacuugguacaaaaugucggugugguccuagaugaagcauuggggugggggagggagaggg

SEQ ID NO: 687311 - RNA, 64 nt, Homo Sapiens
uguggauguuacuuaaagagaaaagcauaagagcaugaagcauaucugggaauaucuuuugccu

SEQ ID NO: 687312 - RNA, 64 nt, Homo Sapiens
caauuuguuuuucugaugaauaguguucaguaaaaugaagcagucuuaagagugacuaauaauu

SEQ ID NO: 687313 - RNA, 64 nt, Homo Sapiens
ucagugacugcuggauagucucccagucugaucaaugaagcauucgauuaguuuuugauuuuuu

SEQ ID NO: 687314 - RNA, 64 nt, Homo Sapiens
uaauuugaugacacugucuaucaaaaaagagcaaaugaagcagaugcaaauguuagugagaagu

SEQ ID NO: 687315 - RNA, 64 nt, Homo Sapiens
uuuauuuuugaaacaaacauugaugaagaaauuuaugaagcagacucauaauggaaaaaaagac

SEQ ID NO: 687316 - RNA, 64 nt, Homo Sapiens
agaaacgugagaaggaggguuccagaaccgccgaaugaagcaaagacccaagugaagaucuggu

SEQ ID NO: 687317 - RNA, 64 nt, Homo Sapiens
acaggaauuugguuuucuuucuucccaggagagaaugaagcaaauaacccuuccuuguaucugu

SEQ ID NO: 687318 - RNA, 64 nt, Homo Sapiens
gaauuccaggaaacccaagauggaagaggagagcaugaagcaaaaaacuaccuuagcugcauag

SEQ ID NO: 687319 - RNA, 64 nt, Homo Sapiens
auaauauuguucccauauauaaaagucauagaagaugaagcacucaaagugauauguauuccaa

SEQ ID NO: 687320 - RNA, 64 nt, Homo Sapiens
caaugcucuaaucacaauauuauuuguuuaggucaugaagcaaaaaccuagacuucaaagccag

SEQ ID NO: 687321 - RNA, 64 nt, Homo Sapiens
cacacacacacacacacacaguuugauuagaaaaaugaagcagagcagcuuacaucaguuguuu

SEQ ID NO: 687322 - RNA, 64 nt, Homo Sapiens
uuugcacuggaaccauugcuagacauuugucuucaugaagcagacauugaauuucauauuugag

SEQ ID NO: 687323 - RNA, 64 nt, Homo Sapiens
cuggguaccagcugguguagcgacaucuuauccuaugaagcauauugcugaguggugccugaaa

SEQ ID NO: 687324 - RNA, 64 nt, Homo Sapiens
uaguaaccuuacucugagguuuuacggucugauaaugaagcacuugcaugaguauaguaaguca

SEQ ID NO: 687325 - RNA, 64 nt, Homo Sapiens
cauacuucauuuaauagcucguuaccaagugugaaugaagcaauaugucauaauagaguagcca

SEQ ID NO: 687326 - RNA, 64 nt, Homo Sapiens
agaaggcucaucaggugaucauuaccuagcauccaugaagcaccugaaauuauuugcaaaaugu

SEQ ID NO: 687327 - RNA, 64 nt, Homo Sapiens
aauaaugcuugaagcuuuucauauaacaaaaggaaugaagcagccccgccucgcaguguggaag

SEQ ID NO: 687328 - RNA, 64 nt, Homo Sapiens
ccuucaaaaguucagucuagucuggaaaacaaacaugaagcaaagaaggcacaacaccauaugg

SEQ ID NO: 687329 - RNA, 64 nt, Homo Sapiens
ucucaaagagauucgaaugacgguaaguguucucaugaagcaggaggcccuugucgugggaugg

SEQ ID NO: 687330 - RNA, 64 nt, Homo Sapiens
aacguacgcaagaggacauggauccaaaaugaugaugaagcaucucccauggggaggugauggu

SEQ ID NO: 687331 - RNA, 64 nt, Homo Sapiens
gacaugcauguguguguguguuguguaugugcauaugaagcacaaugaagcaauaauuuuuaaa

SEQ ID NO: 687332 - RNA, 64 nt, Homo Sapiens
aauuuuuaaauuguguaugugcauuaggguaaagaugaagcaauuuaaaugugauuccuuuaug

SEQ ID NO: 687333 - RNA, 64 nt, Homo Sapiens
gugaagaaagacucuauaggcuuuuacacagcacaugaagcaguaauccagaaagaaggaaaug

SEQ ID NO: 687334 - RNA, 64 nt, Homo Sapiens
auaugugaaauauuaugaucugaacuuagcacacaugaagcaacauuucuuugcuacacagagg

SEQ ID NO: 687335 - RNA, 64 nt, Homo Sapiens; identical to SEQ ID NO: 385550

SEQ ID NO: 687336 - RNA, 64 nt, Homo Sapiens; identical to SEQ ID NO: 385551

SEQ ID NO: 687337 - RNA, 64 nt, Homo Sapiens; identical to SEQ ID NO: 385552

SEQ ID NO: 687338 - RNA, 64 nt, Homo Sapiens; identical to SEQ ID NO: 385553

SEQ ID NO: 687339 - RNA, 64 nt, Homo Sapiens; identical to SEQ ID NO: 385554

SEQ ID NO: 687340 - RNA, 64 nt, Homo Sapiens; identical to SEQ ID NO: 385555

SEQ ID NO: 687341 - RNA, 64 nt, Homo Sapiens; identical to SEQ ID NO: 385556

SEQ ID NO: 687342 - RNA, 64 nt, Homo Sapiens; identical to SEQ ID NO: 385557

SEQ ID NO: 687343 - RNA, 64 nt, Homo Sapiens; identical to SEQ ID NO: 385558

SEQ ID NO: 687344 - RNA, 64 nt, Homo Sapiens; identical to SEQ ID NO: 385559

SEQ ID NO: 687345 - RNA, 64 nt, Homo Sapiens; identical to SEQ ID NO: 385560

SEQ ID NO: 687346 - RNA, 64 nt, Homo Sapiens; identical to SEQ ID NO: 385561

SEQ ID NO: 687347 - RNA, 64 nt, Homo Sapiens; identical to SEQ ID NO: 385562

SEQ ID NO: 687348 - RNA, 64 nt, Homo Sapiens; identical to SEQ ID NO: 385563

SEQ ID NO: 687349 - RNA, 64 nt, Homo Sapiens; identical to SEQ ID NO: 385564

SEQ ID NO: 687350 - RNA, 64 nt, Homo Sapiens; identical to SEQ ID NO: 385565

SEQ ID NO: 687351 - RNA, 64 nt, Homo Sapiens; identical to SEQ ID NO: 385566

SEQ ID NO: 687352 - RNA, 64 nt, Homo Sapiens; identical to SEQ ID NO: 385567

SEQ ID NO: 687353 - RNA, 64 nt, Homo Sapiens; identical to SEQ ID NO: 385568

SEQ ID NO: 687354 - RNA, 64 nt, Homo Sapiens; identical to SEQ ID NO: 385569

SEQ ID NO: 687355 - RNA, 64 nt, Homo Sapiens; identical to SEQ ID NO: 385570

SEQ ID NO: 687356 - RNA, 64 nt, Homo Sapiens; identical to SEQ ID NO: 385571

SEQ ID NO: 687357 - RNA, 64 nt, Homo Sapiens; identical to SEQ ID NO: 385572

SEQ ID NO: 687358 - RNA, 64 nt, Homo Sapiens; identical to SEQ ID NO: 385573

SEQ ID NO: 687359 - RNA, 64 nt, Homo Sapiens; identical to SEQ ID NO: 385574

SEQ ID NO: 687360 - RNA, 64 nt, Homo Sapiens; identical to SEQ ID NO: 385575

SEQ ID NO: 687361 - RNA, 64 nt, Homo Sapiens; identical to SEQ ID NO: 385576

SEQ ID NO: 687362 - RNA, 64 nt, Homo Sapiens; identical to SEQ ID NO: 385577

SEQ ID NO: 687363 - RNA, 64 nt, Homo Sapiens; identical to SEQ ID NO: 385578

SEQ ID NO: 687364 - RNA, 64 nt, Homo Sapiens; identical to SEQ ID NO: 385579

SEQ ID NO: 687365 - RNA, 64 nt, Homo Sapiens; identical to SEQ ID NO: 385580

SEQ ID NO: 687366 - RNA, 64 nt, Homo Sapiens; identical to SEQ ID NO: 385581

SEQ ID NO: 687367 - RNA, 64 nt, Homo Sapiens; identical to SEQ ID NO: 385582

SEQ ID NO: 687368 - RNA, 64 nt, Homo Sapiens; identical to SEQ ID NO: 385583

SEQ ID NO: 687369 - RNA, 64 nt, Homo Sapiens; identical to SEQ ID NO: 385584

SEQ ID NO: 687370 - RNA, 64 nt, Homo Sapiens; identical to SEQ ID NO: 385585

SEQ ID NO: 687371 - RNA, 64 nt, Homo Sapiens; identical to SEQ ID NO: 385586

SEQ ID NO: 687372 - RNA, 64 nt, Homo Sapiens; identical to SEQ ID NO: 385587

SEQ ID NO: 687373 - RNA, 64 nt, Homo Sapiens; identical to SEQ ID NO: 385588

SEQ ID NO: 687374 - RNA, 64 nt, Homo Sapiens; identical to SEQ ID NO: 151446

SEQ ID NO: 687375 - RNA, 64 nt, Homo Sapiens; identical to SEQ ID NO: 151447

SEQ ID NO: 687376 - RNA, 64 nt, Homo Sapiens; identical to SEQ ID NO: 151448

SEQ ID NO: 687377 - RNA, 64 nt, Homo Sapiens; identical to SEQ ID NO: 151449

SEQ ID NO: 687378 - RNA, 64 nt, Homo Sapiens; identical to SEQ ID NO: 151450

SEQ ID NO: 687379 - RNA, 64 nt, Homo Sapiens; identical to SEQ ID NO: 151451

SEQ ID NO: 687380 - RNA, 64 nt, Homo Sapiens; identical to SEQ ID NO: 151452

SEQ ID NO: 687381 - RNA, 64 nt, Homo Sapiens; identical to SEQ ID NO: 151453

SEQ ID NO: 687382 - RNA, 64 nt, Homo Sapiens; identical to SEQ ID NO: 151454

SEQ ID NO: 687383 - RNA, 64 nt, Homo Sapiens; identical to SEQ ID NO: 151455

SEQ ID NO: 687384 - RNA, 64 nt, Homo Sapiens; identical to SEQ ID NO: 151456

SEQ ID NO: 687385 - RNA, 64 nt, Homo Sapiens; identical to SEQ ID NO: 151457

SEQ ID NO: 687386 - RNA, 64 nt, Homo Sapiens; identical to SEQ ID NO: 151458

SEQ ID NO: 687387 - RNA, 64 nt, Homo Sapiens; identical to SEQ ID NO: 151459

SEQ ID NO: 687388 - RNA, 64 nt, Homo Sapiens; identical to SEQ ID NO: 151460

SEQ ID NO: 687389 - RNA, 64 nt, Homo Sapiens; identical to SEQ ID NO: 151461

SEQ ID NO: 687390 - RNA, 64 nt, Homo Sapiens; identical to SEQ ID NO: 151462

SEQ ID NO: 687391 - RNA, 64 nt, Homo Sapiens; identical to SEQ ID NO: 151463

SEQ ID NO: 687392 - RNA, 64 nt, Homo Sapiens; identical to SEQ ID NO: 151464

SEQ ID NO: 687393 - RNA, 64 nt, Homo Sapiens; identical to SEQ ID NO: 151465

SEQ ID NO: 687394 - RNA, 64 nt, Homo Sapiens; identical to SEQ ID NO: 151466

SEQ ID NO: 687395 - RNA, 64 nt, Homo Sapiens; identical to SEQ ID NO: 151467

SEQ ID NO: 687396 - RNA, 64 nt, Homo Sapiens; identical to SEQ ID NO: 151468

SEQ ID NO: 687397 - RNA, 64 nt, Homo Sapiens; identical to SEQ ID NO: 151469

SEQ ID NO: 687398 - RNA, 64 nt, Homo Sapiens; identical to SEQ ID NO: 151470

SEQ ID NO: 687399 - RNA, 64 nt, Homo Sapiens; identical to SEQ ID NO: 151471

SEQ ID NO: 687400 - RNA, 64 nt, Homo Sapiens; identical to SEQ ID NO: 53544

SEQ ID NO: 687401 - RNA, 64 nt, Homo Sapiens; identical to SEQ ID NO: 53545

SEQ ID NO: 687402 - RNA, 64 nt, Homo Sapiens; identical to SEQ ID NO: 53546

SEQ ID NO: 687403 - RNA, 64 nt, Homo Sapiens; identical to SEQ ID NO: 53547

SEQ ID NO: 687404 - RNA, 64 nt, Homo Sapiens; identical to SEQ ID NO: 53548

SEQ ID NO: 687405 - RNA, 64 nt, Homo Sapiens; identical to SEQ ID NO: 53549

SEQ ID NO: 687406 - RNA, 64 nt, Homo Sapiens; identical to SEQ ID NO: 53550

SEQ ID NO: 687407 - RNA, 64 nt, Homo Sapiens; identical to SEQ ID NO: 53551

SEQ ID NO: 687408 - RNA, 64 nt, Homo Sapiens; identical to SEQ ID NO: 53552

SEQ ID NO: 687409 - RNA, 64 nt, Homo Sapiens; identical to SEQ ID NO: 53553

SEQ ID NO: 687410 - RNA, 64 nt, Homo Sapiens; identical to SEQ ID NO: 53554

SEQ ID NO: 687411 - RNA, 64 nt, Homo Sapiens; identical to SEQ ID NO: 53555

SEQ ID NO: 687412 - RNA, 64 nt, Homo Sapiens; identical to SEQ ID NO: 53556

SEQ ID NO: 687413 - RNA, 64 nt, Homo Sapiens; identical to SEQ ID NO: 53557

SEQ ID NO: 687414 - RNA, 64 nt, Homo Sapiens; identical to SEQ ID NO: 53558

SEQ ID NO: 687415 - RNA, 64 nt, Homo Sapiens; identical to SEQ ID NO: 53559

SEQ ID NO: 687416 - RNA, 64 nt, Homo Sapiens; identical to SEQ ID NO: 53560

SEQ ID NO: 687417 - RNA, 64 nt, Homo Sapiens; identical to SEQ ID NO: 53561

SEQ ID NO: 687418 - RNA, 64 nt, Homo Sapiens; identical to SEQ ID NO: 53562

SEQ ID NO: 687419 - RNA, 64 nt, Homo Sapiens; identical to SEQ ID NO: 53563

SEQ ID NO: 687420 - RNA, 64 nt, Homo Sapiens; identical to SEQ ID NO: 53564

SEQ ID NO: 687421 - RNA, 64 nt, Homo Sapiens; identical to SEQ ID NO: 53565

SEQ ID NO: 687422 - RNA, 64 nt, Homo Sapiens; identical to SEQ ID NO: 53566

SEQ ID NO: 687423 - RNA, 64 nt, Homo Sapiens; identical to SEQ ID NO: 53567

SEQ ID NO: 687424 - RNA, 64 nt, Homo Sapiens; identical to SEQ ID NO: 53568

SEQ ID NO: 687425 - RNA, 64 nt, Homo Sapiens; identical to SEQ ID NO: 53569

SEQ ID NO: 687426 - RNA, 64 nt, Homo Sapiens; identical to SEQ ID NO: 53570

SEQ ID NO: 687427 - RNA, 64 nt, Homo Sapiens; identical to SEQ ID NO: 53571

SEQ ID NO: 687428 - RNA, 64 nt, Homo Sapiens; identical to SEQ ID NO: 53572

SEQ ID NO: 687429 - RNA, 64 nt, Homo Sapiens; identical to SEQ ID NO: 53573

SEQ ID NO: 687430 - RNA, 64 nt, Homo Sapiens; identical to SEQ ID NO: 53574

SEQ ID NO: 687431 - RNA, 64 nt, Homo Sapiens; identical to SEQ ID NO: 53575

SEQ ID NO: 687432 - RNA, 64 nt, Homo Sapiens; identical to SEQ ID NO: 53576

SEQ ID NO: 687433 - RNA, 64 nt, Homo Sapiens; identical to SEQ ID NO: 53577

SEQ ID NO: 687434 - RNA, 64 nt, Homo Sapiens; identical to SEQ ID NO: 53578

SEQ ID NO: 687435 - RNA, 64 nt, Homo Sapiens; identical to SEQ ID NO: 53579

SEQ ID NO: 687436 - RNA, 64 nt, Homo Sapiens; identical to SEQ ID NO: 53580

SEQ ID NO: 687437 - RNA, 64 nt, Homo Sapiens; identical to SEQ ID NO: 53580

SEQ ID NO: 687438 - RNA, 64 nt, Homo Sapiens; identical to SEQ ID NO: 53582

SEQ ID NO: 687439 - RNA, 64 nt, Homo Sapiens; identical to SEQ ID NO: 53583

SEQ ID NO: 687440 - RNA, 64 nt, Homo Sapiens; identical to SEQ ID NO: 53584

SEQ ID NO: 687441 - RNA, 64 nt, Homo Sapiens; identical to SEQ ID NO: 53585

SEQ ID NO: 687442 - RNA, 64 nt, Homo Sapiens; identical to SEQ ID NO: 53586

SEQ ID NO: 687443 - RNA, 64 nt, Homo Sapiens; identical to SEQ ID NO: 193740

SEQ ID NO: 687444 - RNA, 64 nt, Homo Sapiens; identical to SEQ ID NO: 193741

SEQ ID NO: 687445 - RNA, 64 nt, Homo Sapiens; identical to SEQ ID NO: 193742

SEQ ID NO: 687446 - RNA, 64 nt, Homo Sapiens; identical to SEQ ID NO: 193743

SEQ ID NO: 687447 - RNA, 64 nt, Homo Sapiens; identical to SEQ ID NO: 193744

SEQ ID NO: 687448 - RNA, 64 nt, Homo Sapiens; identical to SEQ ID NO: 193745

SEQ ID NO: 687449 - RNA, 64 nt, Homo Sapiens
cuugucucccuuguuccccucccuggcugcuccgacaggggagaccaauccauuugccccgcaa

SEQ ID NO: 687450 - RNA, 64 nt, Homo Sapiens
ugccugaauggcauccgccaucuuuacugcaaagacaggggacuuaucugaccugccagcaccu

SEQ ID NO: 687451 - RNA, 64 nt, Homo Sapiens
ucccuuaccugggaaagggcuguuauaaucuuucacaggggacaggaugguucccuugaugaag

SEQ ID NO: 687452 - RNA, 64 nt, Homo Sapiens
uaguauuucuaugaaauauuauguuaaaacugggacaggggagaaccuagggugauauuaacca

SEQ ID NO: 687453 - RNA, 64 nt, Homo Sapiens
agggcgcccagcugucaggugcuacagcacagagacaggggagacaucauggaacuccaggacg

SEQ ID NO: 687454 - RNA, 60 nt, Homo Sapiens
ucaucucccgccugaccucgugagaaccgcacaggggacccaggagacaagcuucuuuga

SEQ ID NO: 687455 - RNA, 64 nt, Homo Sapiens
guucuguaaguguucgggggagaguugaggaagaacaggggauaaauccgccacuuucaugacu

SEQ ID NO: 687456 - RNA, 64 nt, Homo Sapiens
cgccccagucugcaggaaggucaccagaggacacacaggggagacggaagucaguccuccucau

SEQ ID NO: 687457 - RNA, 64 nt, Homo Sapiens
agccuuaugucugcagagagaccagaggacacacacaggggagagaagucagaccuccucaguc

SEQ ID NO: 687458 - RNA, 64 nt, Homo Sapiens
cuacucugugccuccugacuuccugguagagaagacaggggauuggacaucuuucaccucaggc

SEQ ID NO: 687459 - RNA, 64 nt, Homo Sapiens
cuucgggaaugcugaacuaacccucugccuccaaacaggggacauccuucaauuccucagcuuc

SEQ ID NO: 687460 - RNA, 64 nt, Homo Sapiens
ccgagcauaaccaggggugaggacacagaaaugcacaggggaggaaugcacaggggacacuuac

SEQ ID NO: 687461 - RNA, 64 nt, Homo Sapiens
cuuacggacacagaaaugcaggacacagaaaugcacaggggacaaggguuuauaguagucuugu

SEQ ID NO: 687462 - RNA, 64 nt, Homo Sapiens
cccagaaacgccacauccccccauaucaaaagacacaggggacacuucuguugaugcuguauuc

SEQ ID NO: 687463 - RNA, 64 nt, Homo Sapiens
gggcaaagggggaggagaagcugugacuuaguggacaggggagguccuaaucacucagagcagu

SEQ ID NO: 687464 - RNA, 64 nt, Homo Sapiens; identical to SEQ ID NO: 133930

SEQ ID NO: 687465 - RNA, 64 nt, Homo Sapiens; identical to SEQ ID NO: 133931

SEQ ID NO: 687466 - RNA, 64 nt, Homo Sapiens; identical to SEQ ID NO: 133932

SEQ ID NO: 687467 - RNA, 64 nt, Homo Sapiens; identical to SEQ ID NO: 133933

SEQ ID NO: 687468 - RNA, 64 nt, Homo Sapiens; identical to SEQ ID NO: 133934

SEQ ID NO: 687469 - RNA, 64 nt, Homo Sapiens; identical to SEQ ID NO: 133935

SEQ ID NO: 687470 - RNA, 64 nt, Homo Sapiens; identical to SEQ ID NO: 133936

SEQ ID NO: 687471 - RNA, 64 nt, Homo Sapiens; identical to SEQ ID NO: 133937

SEQ ID NO: 687472 - RNA, 64 nt, Homo Sapiens; identical to SEQ ID NO: 133938

SEQ ID NO: 687473 - RNA, 64 nt, Homo Sapiens; identical to SEQ ID NO: 133939

SEQ ID NO: 687474 - RNA, 64 nt, Homo Sapiens; identical to SEQ ID NO: 133940

SEQ ID NO: 687475 - RNA, 64 nt, Homo Sapiens; identical to SEQ ID NO: 133941

SEQ ID NO: 687476 - RNA, 64 nt, Homo Sapiens; identical to SEQ ID NO: 133942

SEQ ID NO: 687477 - RNA, 64 nt, Homo Sapiens; identical to SEQ ID NO: 133943

SEQ ID NO: 687478 - RNA, 64 nt, Homo Sapiens; identical to SEQ ID NO: 133944

SEQ ID NO: 687479 - RNA, 64 nt, Homo Sapiens; identical to SEQ ID NO: 133945

SEQ ID NO: 687480 - RNA, 64 nt, Homo Sapiens; identical to SEQ ID NO: 133946

SEQ ID NO: 687481 - RNA, 64 nt, Homo Sapiens; identical to SEQ ID NO: 133947

SEQ ID NO: 687482 - RNA, 64 nt, Homo Sapiens; identical to SEQ ID NO: 133948

SEQ ID NO: 687483 - RNA, 64 nt, Homo Sapiens; identical to SEQ ID NO: 133949

SEQ ID NO: 687484 - RNA, 64 nt, Homo Sapiens; identical to SEQ ID NO: 133950

SEQ ID NO: 687485 - RNA, 64 nt, Homo Sapiens; identical to SEQ ID NO: 133951

SEQ ID NO: 687486 - RNA, 64 nt, Homo Sapiens; identical to SEQ ID NO: 133952

SEQ ID NO: 687487 - RNA, 64 nt, Homo Sapiens; identical to SEQ ID NO: 133953

SEQ ID NO: 687488 - RNA, 64 nt, Homo Sapiens; identical to SEQ ID NO: 133954

SEQ ID NO: 687489 - RNA, 64 nt, Homo Sapiens; identical to SEQ ID NO: 133955

SEQ ID NO: 687490 - RNA, 64 nt, Homo Sapiens; identical to SEQ ID NO: 133956

SEQ ID NO: 687491 - RNA, 64 nt, Homo Sapiens; identical to SEQ ID NO: 133957

SEQ ID NO: 687492 - RNA, 64 nt, Homo Sapiens; identical to SEQ ID NO: 133958

SEQ ID NO: 687493 - RNA, 64 nt, Homo Sapiens; identical to SEQ ID NO: 133959

SEQ ID NO: 687494 - RNA, 64 nt, Homo Sapiens; identical to SEQ ID NO: 133960

SEQ ID NO: 687495 - RNA, 64 nt, Homo Sapiens; identical to SEQ ID NO: 133961

SEQ ID NO: 687496 - RNA, 64 nt, Homo Sapiens; identical to SEQ ID NO: 133962

SEQ ID NO: 687497 - RNA, 64 nt, Homo Sapiens; identical to SEQ ID NO: 133963

SEQ ID NO: 687498 - RNA, 64 nt, Homo Sapiens; identical to SEQ ID NO: 133964

SEQ ID NO: 687499 - RNA, 64 nt, Homo Sapiens; identical to SEQ ID NO: 133965

SEQ ID NO: 687500 - RNA, 64 nt, Homo Sapiens; identical to SEQ ID NO: 133966

SEQ ID NO: 687501 - RNA, 64 nt, Homo Sapiens; identical to SEQ ID NO: 167990

SEQ ID NO: 687502 - RNA, 64 nt, Homo Sapiens; identical to SEQ ID NO: 167991

SEQ ID NO: 687503 - RNA, 64 nt, Homo Sapiens; identical to SEQ ID NO: 167992

SEQ ID NO: 687504 - RNA, 64 nt, Homo Sapiens; identical to SEQ ID NO: 167993

SEQ ID NO: 687505 - RNA, 64 nt, Homo Sapiens; identical to SEQ ID NO: 167994

SEQ ID NO: 687506 - RNA, 64 nt, Homo Sapiens; identical to SEQ ID NO: 167995

SEQ ID NO: 687507 - RNA, 64 nt, Homo Sapiens; identical to SEQ ID NO: 167996

SEQ ID NO: 687508 - RNA, 64 nt, Homo Sapiens; identical to SEQ ID NO: 167997

SEQ ID NO: 687509 - RNA, 64 nt, Homo Sapiens; identical to SEQ ID NO: 167998

SEQ ID NO: 687510 - RNA, 64 nt, Homo Sapiens; identical to SEQ ID NO: 167999

SEQ ID NO: 687511 - RNA, 64 nt, Homo Sapiens; identical to SEQ ID NO: 168000

SEQ ID NO: 687512 - RNA, 64 nt, Homo Sapiens; identical to SEQ ID NO: 168001

SEQ ID NO: 687513 - RNA, 64 nt, Homo Sapiens; identical to SEQ ID NO: 168002

SEQ ID NO: 687514 - RNA, 64 nt, Homo Sapiens; identical to SEQ ID NO: 168003

SEQ ID NO: 687515 - RNA, 64 nt, Homo Sapiens; identical to SEQ ID NO: 168004

SEQ ID NO: 687516 - RNA, 64 nt, Homo Sapiens; identical to SEQ ID NO: 168005

SEQ ID NO: 687517 - RNA, 64 nt, Homo Sapiens; identical to SEQ ID NO: 168006

SEQ ID NO: 687518 - RNA, 64 nt, Homo Sapiens; identical to SEQ ID NO: 168007

SEQ ID NO: 687519 - RNA, 64 nt, Homo Sapiens; identical to SEQ ID NO: 168008

SEQ ID NO: 687520 - RNA, 64 nt, Homo Sapiens; identical to SEQ ID NO: 168009

SEQ ID NO: 687521 - RNA, 64 nt, Homo Sapiens; identical to SEQ ID NO: 168010

SEQ ID NO: 687522 - RNA, 64 nt, Homo Sapiens; identical to SEQ ID NO: 168011

SEQ ID NO: 687523 - RNA, 64 nt, Homo Sapiens; identical to SEQ ID NO: 168012

SEQ ID NO: 687524 - RNA, 64 nt, Homo Sapiens; identical to SEQ ID NO: 168013

SEQ ID NO: 687525 - RNA, 64 nt, Homo Sapiens; identical to SEQ ID NO: 168014

SEQ ID NO: 687526 - RNA, 64 nt, Homo Sapiens; identical to SEQ ID NO: 168015

SEQ ID NO: 687527 - RNA, 64 nt, Homo Sapiens; identical to SEQ ID NO: 168016

SEQ ID NO: 687528 - RNA, 64 nt, Homo Sapiens; identical to SEQ ID NO: 168017

SEQ ID NO: 687529 - RNA, 64 nt, Homo Sapiens; identical to SEQ ID NO: 168018

SEQ ID NO: 687530 - RNA, 64 nt, Homo Sapiens; identical to SEQ ID NO: 168018

SEQ ID NO: 687531 - RNA, 64 nt, Homo Sapiens; identical to SEQ ID NO: 168020

SEQ ID NO: 687532 - RNA, 64 nt, Homo Sapiens; identical to SEQ ID NO: 168021

SEQ ID NO: 687533 - RNA, 64 nt, Homo Sapiens; identical to SEQ ID NO: 168022

SEQ ID NO: 687534 - RNA, 64 nt, Homo Sapiens; identical to SEQ ID NO: 168023

SEQ ID NO: 687535 - RNA, 64 nt, Homo Sapiens; identical to SEQ ID NO: 168024

SEQ ID NO: 687536 - RNA, 64 nt, Homo Sapiens; identical to SEQ ID NO: 168025

SEQ ID NO: 687537 - RNA, 64 nt, Homo Sapiens; identical to SEQ ID NO: 168026

SEQ ID NO: 687538 - RNA, 64 nt, Homo Sapiens; identical to SEQ ID NO: 190819

SEQ ID NO: 687539 - RNA, 64 nt, Homo Sapiens; identical to SEQ ID NO: 190820

SEQ ID NO: 687540 - RNA, 64 nt, Homo Sapiens; identical to SEQ ID NO: 190821

SEQ ID NO: 687541 - RNA, 64 nt, Homo Sapiens; identical to SEQ ID NO: 190822

SEQ ID NO: 687542 - RNA, 64 nt, Homo Sapiens; identical to SEQ ID NO: 190823

SEQ ID NO: 687543 - RNA, 64 nt, Homo Sapiens; identical to SEQ ID NO: 190824

SEQ ID NO: 687544 - RNA, 64 nt, Homo Sapiens; identical to SEQ ID NO: 190825

SEQ ID NO: 687545 - RNA, 64 nt, Homo Sapiens; identical to SEQ ID NO: 190826

SEQ ID NO: 687546 - RNA, 64 nt, Homo Sapiens; identical to SEQ ID NO: 190827

SEQ ID NO: 687547 - RNA, 64 nt, Homo Sapiens; identical to SEQ ID NO: 190828

SEQ ID NO: 687548 - RNA, 64 nt, Homo Sapiens; identical to SEQ ID NO: 190829

SEQ ID NO: 687549 - RNA, 64 nt, Homo Sapiens; identical to SEQ ID NO: 190830

SEQ ID NO: 687550 - RNA, 64 nt, Homo Sapiens; identical to SEQ ID NO: 190831

SEQ ID NO: 687551 - RNA, 64 nt, Homo Sapiens; identical to SEQ ID NO: 190832

SEQ ID NO: 687552 - RNA, 64 nt, Homo Sapiens; identical to SEQ ID NO: 150215

SEQ ID NO: 687553 - RNA, 64 nt, Homo Sapiens; identical to SEQ ID NO: 150216

SEQ ID NO: 687554 - RNA, 64 nt, Homo Sapiens; identical to SEQ ID NO: 150217

SEQ ID NO: 687555 - RNA, 64 nt, Homo Sapiens; identical to SEQ ID NO: 150218

SEQ ID NO: 687556 - RNA, 64 nt, Homo Sapiens; identical to SEQ ID NO: 150219

SEQ ID NO: 687557 - RNA, 64 nt, Homo Sapiens; identical to SEQ ID NO: 150220

SEQ ID NO: 687558 - RNA, 64 nt, Homo Sapiens; identical to SEQ ID NO: 150221

SEQ ID NO: 687559 - RNA, 64 nt, Homo Sapiens; identical to SEQ ID NO: 150222

SEQ ID NO: 687560 - RNA, 64 nt, Homo Sapiens; identical to SEQ ID NO: 150223

SEQ ID NO: 687561 - RNA, 64 nt, Homo Sapiens; identical to SEQ ID NO: 150224

SEQ ID NO: 687562 - RNA, 64 nt, Homo Sapiens; identical to SEQ ID NO: 150225

SEQ ID NO: 687563 - RNA, 64 nt, Homo Sapiens; identical to SEQ ID NO: 150226

SEQ ID NO: 687564 - RNA, 64 nt, Homo Sapiens; identical to SEQ ID NO: 150227

SEQ ID NO: 687565 - RNA, 64 nt, Homo Sapiens; identical to SEQ ID NO: 150228

SEQ ID NO: 687566 - RNA, 64 nt, Homo Sapiens; identical to SEQ ID NO: 150229

SEQ ID NO: 687567 - RNA, 64 nt, Homo Sapiens; identical to SEQ ID NO: 150230

SEQ ID NO: 687568 - RNA, 64 nt, Homo Sapiens; identical to SEQ ID NO: 150231

SEQ ID NO: 687569 - RNA, 64 nt, Homo Sapiens; identical to SEQ ID NO: 150232

SEQ ID NO: 687570 - RNA, 64 nt, Homo Sapiens; identical to SEQ ID NO: 150233

SEQ ID NO: 687571 - RNA, 64 nt, Homo Sapiens; identical to SEQ ID NO: 150234

SEQ ID NO: 687572 - RNA, 64 nt, Homo Sapiens; identical to SEQ ID NO: 150235

SEQ ID NO: 687573 - RNA, 64 nt, Homo Sapiens; identical to SEQ ID NO: 150236

SEQ ID NO: 687574 - RNA, 64 nt, Homo Sapiens; identical to SEQ ID NO: 150237

SEQ ID NO: 687575 - RNA, 64 nt, Homo Sapiens; identical to SEQ ID NO: 150238

SEQ ID NO: 687576 - RNA, 64 nt, Homo Sapiens; identical to SEQ ID NO: 150239

SEQ ID NO: 687577 - RNA, 64 nt, Homo Sapiens; identical to SEQ ID NO: 150240

SEQ ID NO: 687578 - RNA, 64 nt, Homo Sapiens; identical to SEQ ID NO: 150241

SEQ ID NO: 687579 - RNA, 64 nt, Homo Sapiens; identical to SEQ ID NO: 150242

SEQ ID NO: 687580 - RNA, 64 nt, Homo Sapiens; identical to SEQ ID NO: 150243

SEQ ID NO: 687581 - RNA, 64 nt, Homo Sapiens; identical to SEQ ID NO: 150244

SEQ ID NO: 687582 - RNA, 64 nt, Homo Sapiens; identical to SEQ ID NO: 150245

SEQ ID NO: 687583 - RNA, 64 nt, Homo Sapiens; identical to SEQ ID NO: 150246

SEQ ID NO: 687584 - RNA, 64 nt, Homo Sapiens; identical to SEQ ID NO: 150247

SEQ ID NO: 687585 - RNA, 64 nt, Homo Sapiens; identical to SEQ ID NO: 150248

SEQ ID NO: 687586 - RNA, 64 nt, Homo Sapiens; identical to SEQ ID NO: 107849

SEQ ID NO: 687587 - RNA, 64 nt, Homo Sapiens; identical to SEQ ID NO: 107850

SEQ ID NO: 687588 - RNA, 64 nt, Homo Sapiens; identical to SEQ ID NO: 107851

SEQ ID NO: 687589 - RNA, 64 nt, Homo Sapiens; identical to SEQ ID NO: 107852

SEQ ID NO: 687590 - RNA, 64 nt, Homo Sapiens; identical to SEQ ID NO: 107853

SEQ ID NO: 687591 - RNA, 64 nt, Homo Sapiens; identical to SEQ ID NO: 107854

SEQ ID NO: 687592 - RNA, 64 nt, Homo Sapiens; identical to SEQ ID NO: 107855

SEQ ID NO: 687593 - RNA, 64 nt, Homo Sapiens; identical to SEQ ID NO: 107856

SEQ ID NO: 687594 - RNA, 64 nt, Homo Sapiens; identical to SEQ ID NO: 107857

SEQ ID NO: 687595 - RNA, 64 nt, Homo Sapiens; identical to SEQ ID NO: 107858

SEQ ID NO: 687596 - RNA, 64 nt, Homo Sapiens; identical to SEQ ID NO: 107859

SEQ ID NO: 687597 - RNA, 64 nt, Homo Sapiens; identical to SEQ ID NO: 107860

SEQ ID NO: 687598 - RNA, 64 nt, Homo Sapiens; identical to SEQ ID NO: 107861

SEQ ID NO: 687599 - RNA, 64 nt, Homo Sapiens; identical to SEQ ID NO: 107862

SEQ ID NO: 687600 - RNA, 64 nt, Homo Sapiens; identical to SEQ ID NO: 107863

SEQ ID NO: 687601 - RNA, 63 nt, Homo Sapiens; identical to SEQ ID NO: 107864

SEQ ID NO: 687602 - RNA, 64 nt, Homo Sapiens; identical to SEQ ID NO: 107865

SEQ ID NO: 687603 - RNA, 64 nt, Homo Sapiens; identical to SEQ ID NO: 107866

SEQ ID NO: 687604 - RNA, 64 nt, Homo Sapiens; identical to SEQ ID NO: 107867

SEQ ID NO: 687605 - RNA, 64 nt, Homo Sapiens; identical to SEQ ID NO: 107868

SEQ ID NO: 687606 - RNA, 64 nt, Homo Sapiens; identical to SEQ ID NO: 107869

SEQ ID NO: 687607 - RNA, 64 nt, Homo Sapiens; identical to SEQ ID NO: 107870

SEQ ID NO: 687608 - RNA, 64 nt, Homo Sapiens; identical to SEQ ID NO: 107871

SEQ ID NO: 687609 - RNA, 64 nt, Homo Sapiens; identical to SEQ ID NO: 107872

SEQ ID NO: 687610 - RNA, 64 nt, Homo Sapiens; identical to SEQ ID NO: 107873

SEQ ID NO: 687611 - RNA, 64 nt, Homo Sapiens; identical to SEQ ID NO: 107874

SEQ ID NO: 687612 - RNA, 64 nt, Homo Sapiens; identical to SEQ ID NO: 107875

SEQ ID NO: 687613 - RNA, 64 nt, Homo Sapiens; identical to SEQ ID NO: 107876

SEQ ID NO: 687614 - RNA, 64 nt, Homo Sapiens; identical to SEQ ID NO: 107877

SEQ ID NO: 687615 - RNA, 64 nt, Homo Sapiens; identical to SEQ ID NO: 107878

SEQ ID NO: 687616 - RNA, 64 nt, Homo Sapiens; identical to SEQ ID NO: 107879

SEQ ID NO: 687617 - RNA, 64 nt, Homo Sapiens; identical to SEQ ID NO: 107880

SEQ ID NO: 687618 - RNA, 64 nt, Homo Sapiens; identical to SEQ ID NO: 107881

SEQ ID NO: 687619 - RNA, 64 nt, Homo Sapiens; identical to SEQ ID NO: 107882

SEQ ID NO: 687620 - RNA, 64 nt, Homo Sapiens; identical to SEQ ID NO: 107883

SEQ ID NO: 687621 - RNA, 64 nt, Homo Sapiens; identical to SEQ ID NO: 107884

SEQ ID NO: 687622 - RNA, 64 nt, Homo Sapiens; identical to SEQ ID NO: 107885

SEQ ID NO: 687623 - RNA, 64 nt, Homo Sapiens; identical to SEQ ID NO: 107886

SEQ ID NO: 687624 - RNA, 64 nt, Homo Sapiens; identical to SEQ ID NO: 107887

SEQ ID NO: 687625 - RNA, 64 nt, Homo Sapiens; identical to SEQ ID NO: 107888

SEQ ID NO: 687626 - RNA, 64 nt, Homo Sapiens; identical to SEQ ID NO: 107889

SEQ ID NO: 687627 - RNA, 64 nt, Homo Sapiens; identical to SEQ ID NO: 107890

SEQ ID NO: 687628 - RNA, 64 nt, Homo Sapiens; identical to SEQ ID NO: 107891

SEQ ID NO: 687629 - RNA, 64 nt, Homo Sapiens; identical to SEQ ID NO: 107892

SEQ ID NO: 687630 - RNA, 64 nt, Homo Sapiens; identical to SEQ ID NO: 107893

SEQ ID NO: 687631 - RNA, 64 nt, Homo Sapiens; identical to SEQ ID NO: 107894

SEQ ID NO: 687632 - RNA, 64 nt, Homo Sapiens; identical to SEQ ID NO: 107895

SEQ ID NO: 687633 - RNA, 64 nt, Homo Sapiens; identical to SEQ ID NO: 107896

SEQ ID NO: 687634 - RNA, 64 nt, Homo Sapiens; identical to SEQ ID NO: 107897

SEQ ID NO: 687635 - RNA, 64 nt, Homo Sapiens; identical to SEQ ID NO: 107898

SEQ ID NO: 687636 - RNA, 64 nt, Homo Sapiens; identical to SEQ ID NO: 107899

SEQ ID NO: 687637 - RNA, 64 nt, Homo Sapiens; identical to SEQ ID NO: 107900

SEQ ID NO: 687638 - RNA, 64 nt, Homo Sapiens; identical to SEQ ID NO: 107901

SEQ ID NO: 687639 - RNA, 64 nt, Homo Sapiens; identical to SEQ ID NO: 107902

SEQ ID NO: 687640 - RNA, 64 nt, Homo Sapiens; identical to SEQ ID NO: 107903

SEQ ID NO: 687641 - RNA, 64 nt, Homo Sapiens; identical to SEQ ID NO: 107904

SEQ ID NO: 687642 - RNA, 64 nt, Homo Sapiens; identical to SEQ ID NO: 107905

SEQ ID NO: 687643 - RNA, 64 nt, Homo Sapiens; identical to SEQ ID NO: 107906

SEQ ID NO: 687644 - RNA, 64 nt, Homo Sapiens; identical to SEQ ID NO: 107907

SEQ ID NO: 687645 - RNA, 64 nt, Homo Sapiens; identical to SEQ ID NO: 107908

SEQ ID NO: 687646 - RNA, 64 nt, Homo Sapiens; identical to SEQ ID NO: 107909

SEQ ID NO: 687647 - RNA, 64 nt, Homo Sapiens; identical to SEQ ID NO: 107910

SEQ ID NO: 687648 - RNA, 64 nt, Homo Sapiens; identical to SEQ ID NO: 107911

SEQ ID NO: 687649 - RNA, 64 nt, Homo Sapiens; identical to SEQ ID NO: 107912

SEQ ID NO: 687650 - RNA, 64 nt, Homo Sapiens; identical to SEQ ID NO: 107913

SEQ ID NO: 687651 - RNA, 64 nt, Homo Sapiens; identical to SEQ ID NO: 107914

SEQ ID NO: 687652 - RNA, 64 nt, Homo Sapiens; identical to SEQ ID NO: 107915

SEQ ID NO: 687653 - RNA, 64 nt, Homo Sapiens; identical to SEQ ID NO: 107916

SEQ ID NO: 687654 - RNA, 64 nt, Homo Sapiens; identical to SEQ ID NO: 107917

SEQ ID NO: 687655 - RNA, 64 nt, Homo Sapiens; identical to SEQ ID NO: 107918

SEQ ID NO: 687656 - RNA, 64 nt, Homo Sapiens; identical to SEQ ID NO: 107919

SEQ ID NO: 687657 - RNA, 64 nt, Homo Sapiens; identical to SEQ ID NO: 107920

SEQ ID NO: 687658 - RNA, 64 nt, Homo Sapiens; identical to SEQ ID NO: 107921

SEQ ID NO: 687659 - RNA, 64 nt, Homo Sapiens; identical to SEQ ID NO: 107922

SEQ ID NO: 687660 - RNA, 64 nt, Homo Sapiens; identical to SEQ ID NO: 107923

SEQ ID NO: 687661 - RNA, 64 nt, Homo Sapiens; identical to SEQ ID NO: 107924

SEQ ID NO: 687662 - RNA, 64 nt, Homo Sapiens; identical to SEQ ID NO: 107925

SEQ ID NO: 687663 - RNA, 64 nt, Homo Sapiens; identical to SEQ ID NO: 107926

SEQ ID NO: 687664 - RNA, 64 nt, Homo Sapiens; identical to SEQ ID NO: 107927

SEQ ID NO: 687665 - RNA, 64 nt, Homo Sapiens; identical to SEQ ID NO: 107928

SEQ ID NO: 687666 - RNA, 64 nt, Homo Sapiens; identical to SEQ ID NO: 107929

SEQ ID NO: 687667 - RNA, 64 nt, Homo Sapiens; identical to SEQ ID NO: 107930

SEQ ID NO: 687668 - RNA, 64 nt, Homo Sapiens; identical to SEQ ID NO: 107931

SEQ ID NO: 687669 - RNA, 64 nt, Homo Sapiens; identical to SEQ ID NO: 107932

SEQ ID NO: 687670 - RNA, 64 nt, Homo Sapiens; identical to SEQ ID NO: 107933

SEQ ID NO: 687671 - RNA, 64 nt, Homo Sapiens; identical to SEQ ID NO: 434057

SEQ ID NO: 687672 - RNA, 64 nt, Homo Sapiens; identical to SEQ ID NO: 434058

SEQ ID NO: 687673 - RNA, 64 nt, Homo Sapiens; identical to SEQ ID NO: 434059

SEQ ID NO: 687674 - RNA, 64 nt, Homo Sapiens; identical to SEQ ID NO: 434060

SEQ ID NO: 687675 - RNA, 64 nt, Homo Sapiens; identical to SEQ ID NO: 434061

SEQ ID NO: 687676 - RNA, 64 nt, Homo Sapiens; identical to SEQ ID NO: 434062

SEQ ID NO: 687677 - RNA, 64 nt, Homo Sapiens; identical to SEQ ID NO: 434063

SEQ ID NO: 687678 - RNA, 64 nt, Homo Sapiens; identical to SEQ ID NO: 434064

SEQ ID NO: 687679 - RNA, 64 nt, Homo Sapiens; identical to SEQ ID NO: 434065

SEQ ID NO: 687680 - RNA, 64 nt, Homo Sapiens; identical to SEQ ID NO: 434066

SEQ ID NO: 687681 - RNA, 63 nt, Homo Sapiens
ccagguggcagcuugagcauccgugagacgccaccgugagaggccagagcguggacagggcuu

SEQ ID NO: 687682 - RNA, 63 nt, Homo Sapiens
ccaccgugagaggccaggugguggacagggcuuccgugagacgcggagcucaccgcccagagc

SEQ ID NO: 687683 - RNA, 64 nt, Homo Sapiens; identical to SEQ ID NO: 570206

SEQ ID NO: 687684 - RNA, 64 nt, Homo Sapiens; identical to SEQ ID NO: 570207

SEQ ID NO: 687685 - RNA, 64 nt, Homo Sapiens; identical to SEQ ID NO: 570208

SEQ ID NO: 687686 - RNA, 64 nt, Homo Sapiens; identical to SEQ ID NO: 570209

SEQ ID NO: 687687 - RNA, 64 nt, Homo Sapiens; identical to SEQ ID NO: 570210

SEQ ID NO: 687688 - RNA, 64 nt, Homo Sapiens; identical to SEQ ID NO: 570211

SEQ ID NO: 687689 - RNA, 64 nt, Homo Sapiens; identical to SEQ ID NO: 570212

SEQ ID NO: 687690 - RNA, 64 nt, Homo Sapiens; identical to SEQ ID NO: 570213

SEQ ID NO: 687691 - RNA, 64 nt, Homo Sapiens; identical to SEQ ID NO: 570214

SEQ ID NO: 687692 - RNA, 64 nt, Homo Sapiens; identical to SEQ ID NO: 570215

SEQ ID NO: 687693 - RNA, 64 nt, Homo Sapiens; identical to SEQ ID NO: 570216

SEQ ID NO: 687694 - RNA, 64 nt, Homo Sapiens; identical to SEQ ID NO: 570217

SEQ ID NO: 687695 - RNA, 62 nt, Homo Sapiens
agggguguuuguuggauggguuuaaaaauaacuagaaaaacucaggcccauccauuuucuca

SEQ ID NO: 687696 - RNA, 62 nt, Homo Sapiens
cuuaaaaucaguguuuccccuuugugcacuuguagaaaaaaaagaaaaaccuucuagagcug

SEQ ID NO: 687697 - RNA, 62 nt, Homo Sapiens
uuuuuucagaauaaacaacuaaauaacuguauuagaaaaaaaagaaacuuacuaaauaucau

SEQ ID NO: 687698 - RNA, 62 nt, Homo Sapiens
uuuacuguuucuguuauaauaaaaggguauguuagaaaaacaaaaaggaggcugggcauggu

SEQ ID NO: 687699 - RNA, 62 nt, Homo Sapiens
cuguuaacuaaaaaugcugagaccccuuuuuauagaaaaacaaaaagacaucaagucuucuu

SEQ ID NO: 687700 - RNA, 62 nt, Homo Sapiens
guaauuugauuuacaugcauuagagcacacaguagaaaaacuuuagcuucauuaguaauaug

SEQ ID NO: 687701 - RNA, 62 nt, Homo Sapiens
aauaaauauugaggguuuccgaaagccuugacuagaaaaaugaauuuuauuuuaucauccua

SEQ ID NO: 687702 - RNA, 62 nt, Homo Sapiens
ggggugaucuuuccaggaaaauucugggaaauuagaaaaaguagauaaaauacauucuuuua

SEQ ID NO: 687703 - RNA, 62 nt, Homo Sapiens
aaugugauuacagguagaggccaaauugucuuuagaaaaauuugacauuuaucuucaaaaca

SEQ ID NO: 687704 - RNA, 62 nt, Homo Sapiens
gacugaaauuuuaaagacauuuuugaacucaguagaaaaacauagccuccaucuuuuaaacu

SEQ ID NO: 687705 - RNA, 62 nt, Homo Sapiens
uugccuuucuuuuuuuaugaguauaagccacauagaaaaaaguagcuguaacauccgauucu

SEQ ID NO: 687706 - RNA, 62 nt, Homo Sapiens
aacaaccuaacaccagauucauaggagauuuuuagaaaaaucuacauauggauuuuguauau

SEQ ID NO: 687707 - RNA, 62 nt, Homo Sapiens
aaaccaucauuauauucuuucagaguuaaauauagaaaaaugcagauaucauuaggaucaca

SEQ ID NO: 687708 - RNA, 62 nt, Homo Sapiens
aauaaucucuauuuauaacuaaaucauugagauagaaaaagauucccauugacuguagacuu

SEQ ID NO: 687709 - RNA, 62 nt, Homo Sapiens
aauuuuagaucugaucagguaguagcuaaaauuagaaaaaaacaaaauagaugcuuaaagaa

SEQ ID NO: 687710 - RNA, 62 nt, Homo Sapiens
uuucugcccacuuuaccuacggaaauguaaaguagaaaaagaucaaacaaacagcacuuaca

SEQ ID NO: 687711 - RNA, 62 nt, Homo Sapiens
ccggaaaaauacgccaagguugaaaugguccauagaaaaaaaauauucugugugaugggaua

SEQ ID NO: 687712 - RNA, 62 nt, Homo Sapiens
uugaagacauuguauuaccagaaaaauaacuuuagaaaaauauguugucuuauuauuauaua

SEQ ID NO: 687713 - RNA, 62 nt, Homo Sapiens
acuuuagaaaaauauugaagcuuauuauuauauagaaaaauaccuauaugcuaugcuguugu

SEQ ID NO: 687714 - RNA, 62 nt, Homo Sapiens
ggguuuuuuucuuauuguuuucuccccaggguuagaaaaauugguauaaguuccuaauuaaa

SEQ ID NO: 687715 - RNA, 62 nt, Homo Sapiens
uaaagguucugggaagcuaauaauugaauuauuagaaaaacauuucagaauaggaaguaaau

SEQ ID NO: 687716 - RNA, 62 nt, Homo Sapiens
gccagguuuauuuucuccuuuuuugagauuucuagaaaaaaugcugcuugcacauguugguu

SEQ ID NO: 687717 - RNA, 62 nt, Homo Sapiens
gugcaguguguaaauacuuuaaauuauuaugcuagaaaaauaaaguuacauaccuugcugug

SEQ ID NO: 687718 - RNA, 62 nt, Homo Sapiens
uggccaaaaugguugcaaucauucauacuaguuagaaaaauuauguguugaaauaaguggaa

SEQ ID NO: 687719 - RNA, 62 nt, Homo Sapiens
ccagaaauaccugauuuugaaucauucaacaguagaaaaagaggcauauuuucauuacuuga

SEQ ID NO: 687720 - RNA, 62 nt, Homo Sapiens
auguggcauaaauuuggagaaaauaauaugacuagaaaaauuaguguuauauugggugugag

SEQ ID NO: 687721 - RNA, 62 nt, Homo Sapiens
auauacagaauuagccaaaugguauaagacaauagaaaaaggcuguggauucuuugaggaca

SEQ ID NO: 687722 - RNA, 62 nt, Homo Sapiens
cauucuaucuacugauuuggccuauuguaauauagaaaaaaacugaugaaauguuaacaaug

SEQ ID NO: 687723 - RNA, 62 nt, Homo Sapiens
ucacgauucauuuuugaaacuucuuguuaugguagaaaaauugcuaugaagagcuagagaaa

SEQ ID NO: 687724 - RNA, 62 nt, Homo Sapiens
auuuuaauuucacuaaaauguuuuugauugacuagaaaaaucuauuugauauuuuaauuuau

SEQ ID NO: 687725 - RNA, 62 nt, Homo Sapiens
caaauggauugcuucccaaacaaagacggcuauagaaaaacuuguuuucccacauuuaggac

SEQ ID NO: 687726 - RNA, 62 nt, Homo Sapiens
gauccuuauagauacgguaagagccacauucguagaaaaacuucugguguggccagguuuua

SEQ ID NO: 687727 - RNA, 62 nt, Homo Sapiens
aguagcuugucaucaauccccuugucgaaaacuagaaaaaaaggaguugacccauauaaauu

SEQ ID NO: 687728 - RNA, 62 nt, Homo Sapiens
aaauguuaguaucucaauuaucucuaaaacacuagaaaaaagaacucaaauacugugaacua

SEQ ID NO: 687729 - RNA, 62 nt, Homo Sapiens
ggaggauuuuucugcauuguuaaacuggcauauagaaaaaaauacccgugucaauuaacauu

SEQ ID NO: 687730 - RNA, 62 nt, Homo Sapiens
aguuuuuaaaaauaaauuauaaacuuggagauuagaaaaauaaagcaguugcuguagaauag

SEQ ID NO: 687731 - RNA, 62 nt, Homo Sapiens
ugcuuuagaguuaaauauuccuaucuuaaguuuagaaaaauacaaaaaaccauuccaaggau

SEQ ID NO: 687732 - RNA, 62 nt, Homo Sapiens
ucugaagagcuagucuaucaucucugaacugguagaaaaacauggaacuagucauuaaccca

SEQ ID NO: 687733 - RNA, 62 nt, Homo Sapiens
ugaaacaacaaaacaauuacgaggggagacauuagaaaaaaauuaucucaggugagcuggua

SEQ ID NO: 687734 - RNA, 62 nt, Homo Sapiens
uaaugguaguaaagaaacugguuaucuccggcuagaaaaaaagccuuacuuugugauuauac

SEQ ID NO: 687735 - RNA, 62 nt, Homo Sapiens
acucuacaaaaauuuugcagacaguaguccccuagaaaaacauuaaaaacauucauuugaac

SEQ ID NO: 687736 - RNA, 62 nt, Homo Sapiens
guauuuaauuuggaucuggaaauaguuugaaauagaaaaaaauuaucaccuuagcaacuuag

SEQ ID NO: 687737 - RNA, 62 nt, Homo Sapiens
caugaauuuagaaauauucaugaggauggauuuagaaaaaaagaaagaaguauuaaaaagag

SEQ ID NO: 687738 - RNA, 62 nt, Homo Sapiens
auuagaacauucacuuuugugagguaguuggguagaaaaauuaggcguuuuuuggggaugug

SEQ ID NO: 687739 - RNA, 62 nt, Homo Sapiens
acugaagaugaaauauauaucugcacuuuguuuagaaaaaaaucuguagacucuaagauaca

SEQ ID NO: 687740 - RNA, 62 nt, Homo Sapiens
uuuuggucuagccacuaaacuuaacaauggauuagaaaaauauugacacuuuuaauuuucau

SEQ ID NO: 687741 - RNA, 62 nt, Homo Sapiens
auuauuuugcaguuaucugagcagaaauuaucuagaaaaauuacccaaaaaccauuuggcug

SEQ ID NO: 687742 - RNA, 62 nt, Homo Sapiens
agaaauuauuaacuuuauugacauuugaaaaguagaaaaauuuaaaaauagcacauuugagu

SEQ ID NO: 687743 - RNA, 62 nt, Homo Sapiens
uuuagaugucuuuuugugaugaaaaaaagacguagaaaaaugacauagcuguuuuaacaaau

SEQ ID NO: 687744 - RNA, 62 nt, Homo Sapiens
cacccaccaugccgcacauuacccaggacaauuagaaaaauuugagaaggugaacuguuacg

SEQ ID NO: 687745 - RNA, 62 nt, Homo Sapiens
acaaacccaaagguaggaagcguggucaugaauagaaaaaaauuaugggauuggaagaaaca

SEQ ID NO: 687746 - RNA, 62 nt, Homo Sapiens
ucaccuuuuuucuuccucuuuauauuuuacuuuagaaaaauagagcuuucauuuuuaaaaau

SEQ ID NO: 687747 - RNA, 62 nt, Homo Sapiens
gucaggaaaccagcucguggccucaugucagauagaaaaaaaaaucuaggacuuccagcuuc

SEQ ID NO: 687748 - RNA, 62 nt, Homo Sapiens
cuuuagaguucagcucuaacuauucuguuuaguagaaaaauccauaugccuguggaguggaa

SEQ ID NO: 687749 - RNA, 62 nt, Homo Sapiens
ucauccagccauaugccuguaugaaccucacauagaaaaauucuuuagacuuaguaguaauu

SEQ ID NO: 687750 - RNA, 62 nt, Homo Sapiens
uuaaaaaaaagcauaaaaacauuuuaaaaacauagaaaaauucagcaaaccauuuuuaaagu

SEQ ID NO: 687751 - RNA, 62 nt, Homo Sapiens
aaaccauuuuuaaaguagaagaggguuuuagguagaaaaacauauucuugugcuuuuccuga

SEQ ID NO: 687752 - RNA, 62 nt, Homo Sapiens
acuuuuuaaguacuaagucagcacuuugaagauagaaaaaccuuugaauacuuguuucuuua

SEQ ID NO: 687753 - RNA, 62 nt, Homo Sapiens
ugauccaaaauauggauaugaucugaugaauauagaaaaaaagcugugcauuuuaaccaaua

SEQ ID NO: 687754 - RNA, 62 nt, Homo Sapiens
aaguugaccuuugcacuggcauuaaagagucauagaaaaagaaucauggauauuuaugaauu

SEQ ID NO: 687755 - RNA, 62 nt, Homo Sapiens
uuuucuuugcauuugaauaauugucuuguacuuagaaaaaaggcgucuaugaaugaccagug

SEQ ID NO: 687756 - RNA, 62 nt, Homo Sapiens
ccuacuaagucccaacaggaaugaucuagagauagaaaaaucuucuuggcuuuccgaaggcc

SEQ ID NO: 687757 - RNA, 62 nt, Homo Sapiens
ggacacagaccagacuaagggugggguuacuuuagaaaaaguccaacaauggugugcugggg

SEQ ID NO: 687758 - RNA, 62 nt, Homo Sapiens
acauggaauuucaaauauacacaugcauauaauagaaaaaaaguauuauauacaaguguaau

SEQ ID NO: 687759 - RNA, 62 nt, Homo Sapiens
uguucauuuuccucagucucucaaucuguugauagaaaaaauuugaaugcuuauauauuugu

SEQ ID NO: 687760 - RNA, 62 nt, Homo Sapiens
ugcaagcaagcuguuaaagagcauuauguagguagaaaaaaauucuaccagaaauuuccaga

SEQ ID NO: 687761 - RNA, 62 nt, Homo Sapiens
ggaaucaagaaguucgauucuauaugaaggguuagaaaaaccgaaugcauuucguaguucuu

SEQ ID NO: 687762 - RNA, 62 nt, Homo Sapiens
uaacauuuuaauguauauugccaauaucauuauagaaaaaaaaucaaauuauauaaacagua

SEQ ID NO: 687763 - RNA, 62 nt, Homo Sapiens
aaauacaaaaaaaaaaaagaaauuucuuuuucuagaaaaaauuaauaaaauucuauugcaaa

SEQ ID NO: 687764 - RNA, 62 nt, Homo Sapiens
gguguuuuuuuuguuuguuuguuuguuuguuuuagaaaaauugggauuuccccccaccccgc

SEQ ID NO: 687765 - RNA, 62 nt, Homo Sapiens
agcacaagagaauuagagcuucagugagaauuuagaaaaauuauacuaaagugagaugcauu

SEQ ID NO: 687766 - RNA, 62 nt, Homo Sapiens
acucuucugcaaaaauggauauuauuagaaauuagaaaaaaauuacuaauuuuacacauuag

SEQ ID NO: 687767 - RNA, 62 nt, Homo Sapiens
ugugcaaaagcuucaaauuaaaacagcugcauuagaaaaagaggcgcuucuccccuccccua

SEQ ID NO: 687768 - RNA, 62 nt, Homo Sapiens
cccucucucuuuuuuuaacaaaugccuucuuauagaaaaacuuucuaagaggcaacaauuua

SEQ ID NO: 687769 - RNA, 62 nt, Homo Sapiens
uguaacaguuuuaugucaaaugaucugugcuguagaaaaacauuaacccuuguucaaaaaag

SEQ ID NO: 687770 - RNA, 62 nt, Homo Sapiens
uuagauguauagaaaaguaagaaaaucuuacuuagaaaaaagccccuugaaacuugcaggau

SEQ ID NO: 687771 - RNA, 62 nt, Homo Sapiens
aauagcauucuuauucacuuuaugccgguauuuagaaaaaauaaauuauagcaaguaugauu

SEQ ID NO: 687772 - RNA, 62 nt, Homo Sapiens
aaguugauaguuaaagaacagaucccaucucuuagaaaaacacagcuuuggcaacagaacga

SEQ ID NO: 687773 - RNA, 62 nt, Homo Sapiens
auuaggaauugcuagauaguuaauuuuuauaauagaaaaauguggcaauaacuuuugaauuu

SEQ ID NO: 687774 - RNA, 62 nt, Homo Sapiens
aauguuugaaauacgaagguucugguuugguuuagaaaaaguagaggaaaaguugauuaacu

SEQ ID NO: 687775 - RNA, 62 nt, Homo Sapiens
uaggagugauagagaacaaauuuaaaauaguauagaaaaaaguuaauuuacuauuucagauu

SEQ ID NO: 687776 - RNA, 62 nt, Homo Sapiens
uagggugauaggauauucauauccauuucuuuuagaaaaaauuauauuugucacuuuaaaaa

SEQ ID NO: 687777 - RNA, 62 nt, Homo Sapiens
caauacaauuguaauguagaaauauaagaauuuagaaaaaaguaaacuugccauuugguuaa

SEQ ID NO: 687778 - RNA, 62 nt, Homo Sapiens
aaacaaaucuuucuacgcuuaaaugaucaaauuagaaaaaccaauuccuauaauuaauaugc

SEQ ID NO: 687779 - RNA, 62 nt, Homo Sapiens
gauuuauacuuuuaauauugaauauaguuucguagaaaaacauuuuauauguacuauucuua

SEQ ID NO: 687780 - RNA, 62 nt, Homo Sapiens
ucaaguuaccaaauuuuuuguaauccuuuuacuagaaaaaucuuuuuugaagaguuuuucuu

SEQ ID NO: 687781 - RNA, 62 nt, Homo Sapiens
ugugcuugcuucggcagcauauauacugaaauuagaaaaagaaaacuuuucuuuuuuauuau

SEQ ID NO: 687782 - RNA, 62 nt, Homo Sapiens
uuuauuacucaaaguaaaauucauguaugagauagaaaaauuaaagcaacuuauguguucga

SEQ ID NO: 687783 - RNA, 62 nt, Homo Sapiens
aaccauuguuucuucaauuguggucacuugauuagaaaaauaggccuuaugauucagcagcu

SEQ ID NO: 687784 - RNA, 62 nt, Homo Sapiens
gugcuuaauauuguuauugcagaaaaaguauguagaaaaaaaaggggauugcuacaccaugu

SEQ ID NO: 687785 - RNA, 62 nt, Homo Sapiens
auguagaaaaaaagugcuuaugcuacaccauguagaaaaaguuuuggggauucaaaggggau

SEQ ID NO: 687786 - RNA, 62 nt, Homo Sapiens
uucacgcagauccuugguuggagaugguaccuuagaaaaaguuuccgugguugaauauauuu

SEQ ID NO: 687787 - RNA, 62 nt, Homo Sapiens
uacacgcaguuccgugguuggagaugguaccuuagaaaaaguaaucccaggccuugugauuu

SEQ ID NO: 687788 - RNA, 62 nt, Homo Sapiens
augucgauugauaucgcugcuacaucagacucuagaaaaaagggcugagaggaagcaagacg

SEQ ID NO: 687789 - RNA, 62 nt, Homo Sapiens
uugugagcucugguuauuuuucucuuguaccauagaaaaauguauaaaaauuaucaaaaagc

SEQ ID NO: 687790 - RNA, 62 nt, Homo Sapiens
ggagaaaaagaaaacucuggcguuagaggauauagaaaaauauaaguacaauuguuacaaau

SEQ ID NO: 687791 - RNA, 62 nt, Homo Sapiens
ugaacgcccccagaaaauugugccaaagaguuuagaaaaauaaauauacaauaaaaguaaac

SEQ ID NO: 687792 - RNA, 62 nt, Homo Sapiens
gacugcagugcccaaggaauuucugcucugguuagaaaaaggacucugcuucaguccacuuc

SEQ ID NO: 687793 - RNA, 62 nt, Homo Sapiens
aggacucugcuucaguccacuucugcucugguuagaaaaaggacucugcuucaguccacagu

SEQ ID NO: 687794 - RNA, 62 nt, Homo Sapiens
aauguuagaagguuauuuaauuucagagaaaauagaaaaaacugcaaguuuaauuugauuua

SEQ ID NO: 687795 - RNA, 62 nt, Homo Sapiens
uuaaaauuggaagucauuaagucuuagugcuuuagaaaaaagauacauaaucuacaauaagg

SEQ ID NO: 687796 - RNA, 62 nt, Homo Sapiens
uaacuggauuuaggccuacccuggucaacgauuagaaaaauaucagaaagucuuuauaacca

SEQ ID NO: 687797 - RNA, 62 nt, Homo Sapiens
aauuuuucugccuuuuaccacagauuuuccuguagaaaaacuauuuucaaauuauuuagaag

SEQ ID NO: 687798 - RNA, 62 nt, Homo Sapiens
aauucuggcuuuauauuaaaagaaaaaaggaguagaaaaaacaucuuuggucuuaguuuucu

SEQ ID NO: 687799 - RNA, 62 nt, Homo Sapiens
gaguagaaaaaacaauucuggucuuaguuuucuagaaaaaagcacaauuucuucaaucuuug

SEQ ID NO: 687800 - RNA, 62 nt, Homo Sapiens
acugguugcauguaaaauucagaauaaucuaguagaaaaauaaguaccauuggagaguuaac

SEQ ID NO: 687801 - RNA, 62 nt, Homo Sapiens
uuguuuauuuuuuauucuucuuuuugugggaauagaaaaaaaaaaguguuaacuuacgggua

SEQ ID NO: 687802 - RNA, 64 nt, Homo Sapiens
uuuguuacuguauuucuuuugaguugaggcacuuacauaacaaucuucuuugcuuuuuuggcag

SEQ ID NO: 687803 - RNA, 64 nt, Homo Sapiens
cugugcugauaaguaacugauacauauaacauaaacauaacaaaguugccuaguugauguaaca

SEQ ID NO: 687804 - RNA, 64 nt, Homo Sapiens
acuuggaggguugcaguuucuaauaccuaaguaaacauaacauuuaccuaaguaaacauaacau

SEQ ID NO: 687805 - RNA, 64 nt, Homo Sapiens
aauaccuaaguaaacauaacacauaccuaaguaaacauaacauuuggaaauuauugccucugau

SEQ ID NO: 687806 - RNA, 64 nt, Homo Sapiens
gagucugaggguuagaaggaagucauugugucuaacauaacaacagagcaguuugugucacuga

SEQ ID NO: 687807 - RNA, 64 nt, Homo Sapiens
cauauccaguaguaccuuuaaaguaacacuuuguacauaacaaauacucagcaaaugugaaacu

SEQ ID NO: 687808 - RNA, 64 nt, Homo Sapiens
agccccuuauuuuucaacaaaggggauuuuguacacauaacauggguuauuuaguuuaacucug

SEQ ID NO: 687809 - RNA, 64 nt, Homo Sapiens
cuaaaugaaugcaaugugcauaaauauuuuuuaaacauaacagugaacuauugcaccuuuugcu

SEQ ID NO: 687810 - RNA, 64 nt, Homo Sapiens
uaaaauuaguuucuaugagugucauucugaggucacauaacacauugcagagugccauggucau

SEQ ID NO: 687811 - RNA, 64 nt, Homo Sapiens
uagagguaauagauaggugauccuccguauauuuacauaacauacaugcucagauguguagaca

SEQ ID NO: 687812 - RNA, 64 nt, Homo Sapiens
gcuuuucucaugguauuaucuaguaggucugcacacauaacacacaucaguccacccccauugu

SEQ ID NO: 687813 - RNA, 64 nt, Homo Sapiens
ucuuuaugauuucaugauuagacaauguggaauuacauaacaggcauugcacuaaaagugaugu

SEQ ID NO: 687814 - RNA, 64 nt, Homo Sapiens
uuaacauaaagguuauuuucuccugauauagaucacauaacagaaugcaccagucaucagcuau

SEQ ID NO: 687815 - RNA, 64 nt, Homo Sapiens
uaauccguaccuuguguuuuguuuugauuuaauaacauaacaaauaaccaacccuucccugaaa

SEQ ID NO: 687816 - RNA, 64 nt, Homo Sapiens; identical to SEQ ID NO: 270805

SEQ ID NO: 687817 - RNA, 64 nt, Homo Sapiens; identical to SEQ ID NO: 270806

SEQ ID NO: 687818 - RNA, 64 nt, Homo Sapiens; identical to SEQ ID NO: 270807

SEQ ID NO: 687819 - RNA, 64 nt, Homo Sapiens; identical to SEQ ID NO: 270808

SEQ ID NO: 687820 - RNA, 64 nt, Homo Sapiens; identical to SEQ ID NO: 270809

SEQ ID NO: 687821 - RNA, 64 nt, Homo Sapiens; identical to SEQ ID NO: 270810

SEQ ID NO: 687822 - RNA, 64 nt, Homo Sapiens; identical to SEQ ID NO: 270811

SEQ ID NO: 687823 - RNA, 64 nt, Homo Sapiens; identical to SEQ ID NO: 270812

SEQ ID NO: 687824 - RNA, 64 nt, Homo Sapiens; identical to SEQ ID NO: 270813

SEQ ID NO: 687825 - RNA, 64 nt, Homo Sapiens; identical to SEQ ID NO: 270814

SEQ ID NO: 687826 - RNA, 64 nt, Homo Sapiens; identical to SEQ ID NO: 270815

SEQ ID NO: 687827 - RNA, 64 nt, Homo Sapiens; identical to SEQ ID NO: 270816

SEQ ID NO: 687828 - RNA, 64 nt, Homo Sapiens; identical to SEQ ID NO: 188606

SEQ ID NO: 687829 - RNA, 64 nt, Homo Sapiens; identical to SEQ ID NO: 188607

SEQ ID NO: 687830 - RNA, 64 nt, Homo Sapiens; identical to SEQ ID NO: 188608

SEQ ID NO: 687831 - RNA, 64 nt, Homo Sapiens; identical to SEQ ID NO: 188609

SEQ ID NO: 687832 - RNA, 64 nt, Homo Sapiens; identical to SEQ ID NO: 188610

SEQ ID NO: 687833 - RNA, 64 nt, Homo Sapiens; identical to SEQ ID NO: 188611

SEQ ID NO: 687834 - RNA, 64 nt, Homo Sapiens; identical to SEQ ID NO: 188612

SEQ ID NO: 687835 - RNA, 64 nt, Homo Sapiens; identical to SEQ ID NO: 188613

SEQ ID NO: 687836 - RNA, 64 nt, Homo Sapiens; identical to SEQ ID NO: 188614

SEQ ID NO: 687837 - RNA, 64 nt, Homo Sapiens; identical to SEQ ID NO: 188615

SEQ ID NO: 687838 - RNA, 64 nt, Homo Sapiens; identical to SEQ ID NO: 188616

SEQ ID NO: 687839 - RNA, 64 nt, Homo Sapiens; identical to SEQ ID NO: 188617

SEQ ID NO: 687840 - RNA, 64 nt, Homo Sapiens; identical to SEQ ID NO: 188618

SEQ ID NO: 687841 - RNA, 64 nt, Homo Sapiens; identical to SEQ ID NO: 188619

SEQ ID NO: 687842 - RNA, 64 nt, Homo Sapiens; identical to SEQ ID NO: 188620

SEQ ID NO: 687843 - RNA, 64 nt, Homo Sapiens; identical to SEQ ID NO: 188621

SEQ ID NO: 687844 - RNA, 64 nt, Homo Sapiens; identical to SEQ ID NO: 188622

SEQ ID NO: 687845 - RNA, 64 nt, Homo Sapiens; identical to SEQ ID NO: 188623

SEQ ID NO: 687846 - RNA, 64 nt, Homo Sapiens; identical to SEQ ID NO: 188624

SEQ ID NO: 687847 - RNA, 64 nt, Homo Sapiens; identical to SEQ ID NO: 188625

SEQ ID NO: 687848 - RNA, 64 nt, Homo Sapiens; identical to SEQ ID NO: 188626

SEQ ID NO: 687849 - RNA, 64 nt, Homo Sapiens; identical to SEQ ID NO: 188627

SEQ ID NO: 687850 - RNA, 64 nt, Homo Sapiens; identical to SEQ ID NO: 188628

SEQ ID NO: 687851 - RNA, 64 nt, Homo Sapiens; identical to SEQ ID NO: 188629

SEQ ID NO: 687852 - RNA, 64 nt, Homo Sapiens; identical to SEQ ID NO: 188630

SEQ ID NO: 687853 - RNA, 64 nt, Homo Sapiens; identical to SEQ ID NO: 188631

SEQ ID NO: 687854 - RNA, 64 nt, Homo Sapiens; identical to SEQ ID NO: 188632

SEQ ID NO: 687855 - RNA, 64 nt, Homo Sapiens; identical to SEQ ID NO: 188633

SEQ ID NO: 687856 - RNA, 64 nt, Homo Sapiens; identical to SEQ ID NO: 188634

SEQ ID NO: 687857 - RNA, 64 nt, Homo Sapiens; identical to SEQ ID NO: 188635

SEQ ID NO: 687858 - RNA, 64 nt, Homo Sapiens; identical to SEQ ID NO: 188636

SEQ ID NO: 687859 - RNA, 64 nt, Homo Sapiens; identical to SEQ ID NO: 188637

SEQ ID NO: 687860 - RNA, 64 nt, Homo Sapiens; identical to SEQ ID NO: 188638

SEQ ID NO: 687861 - RNA, 64 nt, Homo Sapiens; identical to SEQ ID NO: 188639

SEQ ID NO: 687862 - RNA, 64 nt, Homo Sapiens; identical to SEQ ID NO: 188640

SEQ ID NO: 687863 - RNA, 64 nt, Homo Sapiens; identical to SEQ ID NO: 188641

SEQ ID NO: 687864 - RNA, 64 nt, Homo Sapiens; identical to SEQ ID NO: 188642

SEQ ID NO: 687865 - RNA, 64 nt, Homo Sapiens; identical to SEQ ID NO: 188643

SEQ ID NO: 687866 - RNA, 64 nt, Homo Sapiens; identical to SEQ ID NO: 188644

SEQ ID NO: 687867 - RNA, 64 nt, Homo Sapiens; identical to SEQ ID NO: 188645

SEQ ID NO: 687868 - RNA, 64 nt, Homo Sapiens; identical to SEQ ID NO: 188646

SEQ ID NO: 687869 - RNA, 64 nt, Homo Sapiens; identical to SEQ ID NO: 188647

SEQ ID NO: 687870 - RNA, 64 nt, Homo Sapiens; identical to SEQ ID NO: 188648

SEQ ID NO: 687871 - RNA, 64 nt, Homo Sapiens; identical to SEQ ID NO: 188649

SEQ ID NO: 687872 - RNA, 64 nt, Homo Sapiens; identical to SEQ ID NO: 188650

SEQ ID NO: 687873 - RNA, 64 nt, Homo Sapiens; identical to SEQ ID NO: 188651

SEQ ID NO: 687874 - RNA, 64 nt, Homo Sapiens; identical to SEQ ID NO: 188652

SEQ ID NO: 687875 - RNA, 64 nt, Homo Sapiens; identical to SEQ ID NO: 188653

SEQ ID NO: 687876 - RNA, 64 nt, Homo Sapiens; identical to SEQ ID NO: 188654

SEQ ID NO: 687877 - RNA, 64 nt, Homo Sapiens; identical to SEQ ID NO: 188655

SEQ ID NO: 687878 - RNA, 64 nt, Homo Sapiens; identical to SEQ ID NO: 188656

SEQ ID NO: 687879 - RNA, 64 nt, Homo Sapiens; identical to SEQ ID NO: 188657

SEQ ID NO: 687880 - RNA, 64 nt, Homo Sapiens; identical to SEQ ID NO: 188658

SEQ ID NO: 687881 - RNA, 54 nt, Homo Sapiens; identical to SEQ ID NO: 188659

SEQ ID NO: 687882 - RNA, 64 nt, Homo Sapiens; identical to SEQ ID NO: 76253

SEQ ID NO: 687883 - RNA, 64 nt, Homo Sapiens; identical to SEQ ID NO: 76254

SEQ ID NO: 687884 - RNA, 64 nt, Homo Sapiens; identical to SEQ ID NO: 76255

SEQ ID NO: 687885 - RNA, 64 nt, Homo Sapiens; identical to SEQ ID NO: 76256

SEQ ID NO: 687886 - RNA, 64 nt, Homo Sapiens; identical to SEQ ID NO: 76257

SEQ ID NO: 687887 - RNA, 64 nt, Homo Sapiens; identical to SEQ ID NO: 76258

SEQ ID NO: 687888 - RNA, 64 nt, Homo Sapiens; identical to SEQ ID NO: 76259

SEQ ID NO: 687889 - RNA, 64 nt, Homo Sapiens; identical to SEQ ID NO: 76260

SEQ ID NO: 687890 - RNA, 64 nt, Homo Sapiens; identical to SEQ ID NO: 76261

SEQ ID NO: 687891 - RNA, 64 nt, Homo Sapiens; identical to SEQ ID NO: 76262

SEQ ID NO: 687892 - RNA, 64 nt, Homo Sapiens; identical to SEQ ID NO: 76263

SEQ ID NO: 687893 - RNA, 64 nt, Homo Sapiens; identical to SEQ ID NO: 76264

SEQ ID NO: 687894 - RNA, 64 nt, Homo Sapiens; identical to SEQ ID NO: 76265

SEQ ID NO: 687895 - RNA, 64 nt, Homo Sapiens; identical to SEQ ID NO: 76266

SEQ ID NO: 687896 - RNA, 64 nt, Homo Sapiens; identical to SEQ ID NO: 76267

SEQ ID NO: 687897 - RNA, 64 nt, Homo Sapiens; identical to SEQ ID NO: 76268

SEQ ID NO: 687898 - RNA, 64 nt, Homo Sapiens; identical to SEQ ID NO: 76269

SEQ ID NO: 687899 - RNA, 64 nt, Homo Sapiens; identical to SEQ ID NO: 76270

SEQ ID NO: 687900 - RNA, 64 nt, Homo Sapiens; identical to SEQ ID NO: 76271

SEQ ID NO: 687901 - RNA, 64 nt, Homo Sapiens; identical to SEQ ID NO: 76272

SEQ ID NO: 687902 - RNA, 64 nt, Homo Sapiens; identical to SEQ ID NO: 76273

SEQ ID NO: 687903 - RNA, 64 nt, Homo Sapiens; identical to SEQ ID NO: 76274

SEQ ID NO: 687904 - RNA, 64 nt, Homo Sapiens; identical to SEQ ID NO: 76275

SEQ ID NO: 687905 - RNA, 64 nt, Homo Sapiens; identical to SEQ ID NO: 76276

SEQ ID NO: 687906 - RNA, 64 nt, Homo Sapiens; identical to SEQ ID NO: 76277

SEQ ID NO: 687907 - RNA, 64 nt, Homo Sapiens; identical to SEQ ID NO: 76278

SEQ ID NO: 687908 - RNA, 64 nt, Homo Sapiens; identical to SEQ ID NO: 76279

SEQ ID NO: 687909 - RNA, 64 nt, Homo Sapiens; identical to SEQ ID NO: 76280

SEQ ID NO: 687910 - RNA, 64 nt, Homo Sapiens; identical to SEQ ID NO: 76281

SEQ ID NO: 687911 - RNA, 64 nt, Homo Sapiens; identical to SEQ ID NO: 76282

SEQ ID NO: 687912 - RNA, 64 nt, Homo Sapiens; identical to SEQ ID NO: 76283

SEQ ID NO: 687913 - RNA, 64 nt, Homo Sapiens; identical to SEQ ID NO: 76284

SEQ ID NO: 687914 - RNA, 64 nt, Homo Sapiens; identical to SEQ ID NO: 76285

SEQ ID NO: 687915 - RNA, 64 nt, Homo Sapiens; identical to SEQ ID NO: 76286

SEQ ID NO: 687916 - RNA, 64 nt, Homo Sapiens; identical to SEQ ID NO: 76287

SEQ ID NO: 687917 - RNA, 64 nt, Homo Sapiens; identical to SEQ ID NO: 76288

SEQ ID NO: 687918 - RNA, 64 nt, Homo Sapiens; identical to SEQ ID NO: 76289

SEQ ID NO: 687919 - RNA, 64 nt, Homo Sapiens; identical to SEQ ID NO: 76290

SEQ ID NO: 687920 - RNA, 64 nt, Homo Sapiens; identical to SEQ ID NO: 76291

SEQ ID NO: 687921 - RNA, 64 nt, Homo Sapiens; identical to SEQ ID NO: 76292

SEQ ID NO: 687922 - RNA, 64 nt, Homo Sapiens; identical to SEQ ID NO: 76293

SEQ ID NO: 687923 - RNA, 64 nt, Homo Sapiens; identical to SEQ ID NO: 76294

SEQ ID NO: 687924 - RNA, 64 nt, Homo Sapiens; identical to SEQ ID NO: 76295

SEQ ID NO: 687925 - RNA, 64 nt, Homo Sapiens; identical to SEQ ID NO: 76296

SEQ ID NO: 687926 - RNA, 64 nt, Homo Sapiens; identical to SEQ ID NO: 76297

SEQ ID NO: 687927 - RNA, 64 nt, Homo Sapiens; identical to SEQ ID NO: 76298

SEQ ID NO: 687928 - RNA, 64 nt, Homo Sapiens; identical to SEQ ID NO: 76299

SEQ ID NO: 687929 - RNA, 64 nt, Homo Sapiens; identical to SEQ ID NO: 76300

SEQ ID NO: 687930 - RNA, 64 nt, Homo Sapiens; identical to SEQ ID NO: 76301

SEQ ID NO: 687931 - RNA, 64 nt, Homo Sapiens; identical to SEQ ID NO: 76302

SEQ ID NO: 687932 - RNA, 64 nt, Homo Sapiens; identical to SEQ ID NO: 76303

SEQ ID NO: 687933 - RNA, 64 nt, Homo Sapiens; identical to SEQ ID NO: 76304

SEQ ID NO: 687934 - RNA, 64 nt, Homo Sapiens; identical to SEQ ID NO: 76305

SEQ ID NO: 687935 - RNA, 64 nt, Homo Sapiens; identical to SEQ ID NO: 76306

SEQ ID NO: 687936 - RNA, 64 nt, Homo Sapiens; identical to SEQ ID NO: 76307

SEQ ID NO: 687937 - RNA, 64 nt, Homo Sapiens; identical to SEQ ID NO: 76308

SEQ ID NO: 687938 - RNA, 64 nt, Homo Sapiens; identical to SEQ ID NO: 76309

SEQ ID NO: 687939 - RNA, 64 nt, Homo Sapiens; identical to SEQ ID NO: 76310

SEQ ID NO: 687940 - RNA, 64 nt, Homo Sapiens; identical to SEQ ID NO: 76311

SEQ ID NO: 687941 - RNA, 64 nt, Homo Sapiens; identical to SEQ ID NO: 76312

SEQ ID NO: 687942 - RNA, 64 nt, Homo Sapiens; identical to SEQ ID NO: 76313

SEQ ID NO: 687943 - RNA, 64 nt, Homo Sapiens; identical to SEQ ID NO: 76314

SEQ ID NO: 687944 - RNA, 64 nt, Homo Sapiens; identical to SEQ ID NO: 76315

SEQ ID NO: 687945 - RNA, 64 nt, Homo Sapiens; identical to SEQ ID NO: 76316

SEQ ID NO: 687946 - RNA, 64 nt, Homo Sapiens; identical to SEQ ID NO: 76317

SEQ ID NO: 687947 - RNA, 64 nt, Homo Sapiens; identical to SEQ ID NO: 76318

SEQ ID NO: 687948 - RNA, 64 nt, Homo Sapiens; identical to SEQ ID NO: 76319

SEQ ID NO: 687949 - RNA, 64 nt, Homo Sapiens; identical to SEQ ID NO: 76320

SEQ ID NO: 687950 - RNA, 64 nt, Homo Sapiens; identical to SEQ ID NO: 76321

SEQ ID NO: 687951 - RNA, 64 nt, Homo Sapiens; identical to SEQ ID NO: 76322

SEQ ID NO: 687952 - RNA, 64 nt, Homo Sapiens; identical to SEQ ID NO: 76323

SEQ ID NO: 687953 - RNA, 64 nt, Homo Sapiens; identical to SEQ ID NO: 76324

SEQ ID NO: 687954 - RNA, 64 nt, Homo Sapiens; identical to SEQ ID NO: 76325

SEQ ID NO: 687955 - RNA, 64 nt, Homo Sapiens; identical to SEQ ID NO: 76326

SEQ ID NO: 687956 - RNA, 64 nt, Homo Sapiens; identical to SEQ ID NO: 76327

SEQ ID NO: 687957 - RNA, 64 nt, Homo Sapiens; identical to SEQ ID NO: 76328

SEQ ID NO: 687958 - RNA, 64 nt, Homo Sapiens; identical to SEQ ID NO: 76329

SEQ ID NO: 687959 - RNA, 64 nt, Homo Sapiens; identical to SEQ ID NO: 76330

SEQ ID NO: 687960 - RNA, 64 nt, Homo Sapiens; identical to SEQ ID NO: 76331

SEQ ID NO: 687961 - RNA, 64 nt, Homo Sapiens; identical to SEQ ID NO: 76332

SEQ ID NO: 687962 - RNA, 64 nt, Homo Sapiens; identical to SEQ ID NO: 76333

SEQ ID NO: 687963 - RNA, 64 nt, Homo Sapiens; identical to SEQ ID NO: 76334

SEQ ID NO: 687964 - RNA, 64 nt, Homo Sapiens; identical to SEQ ID NO: 76335

SEQ ID NO: 687965 - RNA, 64 nt, Homo Sapiens; identical to SEQ ID NO: 76336

SEQ ID NO: 687966 - RNA, 64 nt, Homo Sapiens; identical to SEQ ID NO: 76337

SEQ ID NO: 687967 - RNA, 64 nt, Homo Sapiens; identical to SEQ ID NO: 76338

SEQ ID NO: 687968 - RNA, 64 nt, Homo Sapiens; identical to SEQ ID NO: 76339

SEQ ID NO: 687969 - RNA, 64 nt, Homo Sapiens
uguaaaaaggggagauuucaaggggagauuucgguaggcacagguaguaggcacaguuguaaaa

SEQ ID NO: 687970 - RNA, 64 nt, Homo Sapiens
uguaaaaaggggagauuucguaucagcagaguaguaggcacaguuaccaacuguggacuuggaa

SEQ ID NO: 687971 - RNA, 64 nt, Homo Sapiens
gcaaggccuuaguaacagcaagggaagcgcugucuaggcacacgcacaaaacacgggccccagg

SEQ ID NO: 687972 - RNA, 64 nt, Homo Sapiens
aaagagaaaagugugcgcucacuuaaaauuaauauaggcacaggaaaccacagagauuaggggg

SEQ ID NO: 687973 - RNA, 64 nt, Homo Sapiens
gugggucuccuggguaaggggggacuuagagagguaggcacaaggcuuggaaagcacugguuua

SEQ ID NO: 687974 - RNA, 64 nt, Homo Sapiens
gacuccgccgcacgcugacgaccgcucugcuacuuaggcacaggcccggccuguuucaaugacu

SEQ ID NO: 687975 - RNA, 64 nt, Homo Sapiens; identical to SEQ ID NO: 437747

SEQ ID NO: 687976 - RNA, 64 nt, Homo Sapiens; identical to SEQ ID NO: 437748

SEQ ID NO: 687977 - RNA, 64 nt, Homo Sapiens; identical to SEQ ID NO: 437749

SEQ ID NO: 687978 - RNA, 64 nt, Homo Sapiens; identical to SEQ ID NO: 437750

SEQ ID NO: 687979 - RNA, 64 nt, Homo Sapiens; identical to SEQ ID NO: 437751

SEQ ID NO: 687980 - RNA, 64 nt, Homo Sapiens; identical to SEQ ID NO: 437752

SEQ ID NO: 687981 - RNA, 64 nt, Homo Sapiens; identical to SEQ ID NO: 437753

SEQ ID NO: 687982 - RNA, 64 nt, Homo Sapiens; identical to SEQ ID NO: 437754

SEQ ID NO: 687983 - RNA, 64 nt, Homo Sapiens; identical to SEQ ID NO: 437755

SEQ ID NO: 687984 - RNA, 64 nt, Homo Sapiens; identical to SEQ ID NO: 437756

SEQ ID NO: 687985 - RNA, 64 nt, Homo Sapiens; identical to SEQ ID NO: 437757

SEQ ID NO: 687986 - RNA, 64 nt, Homo Sapiens; identical to SEQ ID NO: 437758

SEQ ID NO: 687987 - RNA, 64 nt, Homo Sapiens; identical to SEQ ID NO: 437759

SEQ ID NO: 687988 - RNA, 64 nt, Homo Sapiens; identical to SEQ ID NO: 437760

SEQ ID NO: 687989 - RNA, 64 nt, Homo Sapiens; identical to SEQ ID NO: 437761

SEQ ID NO: 687990 - RNA, 64 nt, Homo Sapiens; identical to SEQ ID NO: 437762

SEQ ID NO: 687991 - RNA, 64 nt, Homo Sapiens; identical to SEQ ID NO: 437763

SEQ ID NO: 687992 - RNA, 64 nt, Homo Sapiens; identical to SEQ ID NO: 437764

SEQ ID NO: 687993 - RNA, 64 nt, Homo Sapiens; identical to SEQ ID NO: 437765

SEQ ID NO: 687994 - RNA, 64 nt, Homo Sapiens; identical to SEQ ID NO: 437766

SEQ ID NO: 687995 - RNA, 64 nt, Homo Sapiens; identical to SEQ ID NO: 437767

SEQ ID NO: 687996 - RNA, 64 nt, Homo Sapiens; identical to SEQ ID NO: 437768

SEQ ID NO: 687997 - RNA, 64 nt, Homo Sapiens; identical to SEQ ID NO: 437769

SEQ ID NO: 687998 - RNA, 64 nt, Homo Sapiens; identical to SEQ ID NO: 437770

SEQ ID NO: 687999 - RNA, 64 nt, Homo Sapiens; identical to SEQ ID NO: 437771

SEQ ID NO: 688000 - RNA, 64 nt, Homo Sapiens; identical to SEQ ID NO: 437772

SEQ ID NO: 688001 - RNA, 64 nt, Homo Sapiens
gaaaaaagcccagcaucacuacaucuguggccaacaauccuaugcagacacuuuucaaaagaag

SEQ ID NO: 688002 - RNA, 64 nt, Homo Sapiens
caaaaagaacaaagcuggaguauugauaguaaggcaauccuaagcuugaguaaaucuaaagaaa

SEQ ID NO: 688003 - RNA, 64 nt, Homo Sapiens
uacuucugcuuuacaggcuuuauuuaaaucugaacaauccuacagggaaaucagaauuaggaaa

SEQ ID NO: 688004 - RNA, 64 nt, Homo Sapiens
uuuaagguacccaguucaugguaauuuguuacagcaauccuaggaagcuaauacucugacagaa

SEQ ID NO: 688005 - RNA, 64 nt, Homo Sapiens
aacgacauccaagcugagagccaaaucaagaaugcaauccuauucacaauugccacaaaaagaa

SEQ ID NO: 688006 - RNA, 64 nt, Homo Sapiens
auuugaaaccaaaaaagagcccaaaaagccaaagcaauccuaagcaaaaagaacaaagcuggag

SEQ ID NO: 688007 - RNA, 64 nt, Homo Sapiens
aauggaaaacaaacaaaaaaagaggcagggguugcaauccuagucucugauaaaacagaauuua

SEQ ID NO: 688008 - RNA, 64 nt, Homo Sapiens
auauggaaccaaaaaagagcccacauugccaagucaauccuaagccaaaugaauaaagccggag

SEQ ID NO: 688009 - RNA, 60 nt, Homo Sapiens
ucuucuacuugccuguggggaggggagugacagguccacacaccacacugggucacccug

SEQ ID NO: 688010 - RNA, 60 nt, Homo Sapiens
gugugagcagggaacucagugugacaccgccagguccagcacccaugggggcgggggaga

SEQ ID NO: 688011 - RNA, 60 nt, Homo Sapiens
cccucggcuguggugccuccucuggccccccagguccacguccuuuaaauuggcccuuug

SEQ ID NO: 688012 - RNA, 60 nt, Homo Sapiens
cagggccaagcgggggcguggcuggccuuucagguccaggccagugggccugguagcaca

SEQ ID NO: 688013 - RNA, 60 nt, Homo Sapiens
ccagaagcaucagugugcaucuacgcagcccagguccaggaccacauccuggccagcugc

SEQ ID NO: 688014 - RNA, 60 nt, Homo Sapiens
agacugagaaagggguguauuuaauuccaucagguccaguacaguacuaggagucauaau

SEQ ID NO: 688015 - RNA, 60 nt, Homo Sapiens
ccacgcccacaauccgacagcccccaggagcagguccagggaugaugcagcccccuucuu

SEQ ID NO: 688016 - RNA, 60 nt, Homo Sapiens
aaauagcuucuccuacagugauucaugucccagguccaggaaauccaauguuggugaagg

SEQ ID NO: 688017 - RNA, 60 nt, Homo Sapiens
gggacaugcagccaggacugugagucugggcagguccaaggccugcaccuucaagaagug

SEQ ID NO: 688018 - RNA, 60 nt, Homo Sapiens
guccucacaggaacaccaggcccgcuccugcagguccagcagcagguggcacugcagcuc

SEQ ID NO: 688019 - RNA, 60 nt, Homo Sapiens
gaaagugccgccagugguccgauuauaaagcagguccaagacaaggcaggacaugauaaa

SEQ ID NO: 688020 - RNA, 60 nt, Homo Sapiens
agggagggagacacacaagcaagcgaaaugcagguccaccuucauuccucugauagaaca

SEQ ID NO: 688021 - RNA, 60 nt, Homo Sapiens
cugucugccauuggucuccuuaccuuccugcagguccaccccaaggucuuuccuucuggc

SEQ ID NO: 688022 - RNA, 60 nt, Homo Sapiens
cugcagauccuaccagguuguuccagaccccagguccagugccuccacucccuucugacu

SEQ ID NO: 688023 - RNA, 60 nt, Homo Sapiens
ucacuuuguauauagaauuuuuugaagcagcagguccagguuaguaagaaaggaucaugu

SEQ ID NO: 688024 - RNA, 60 nt, Homo Sapiens
ggaaagcucugaacuugccagagaggcucacagguccaaguucuccuacuaggccugccu

SEQ ID NO: 688025 - RNA, 60 nt, Homo Sapiens
agaggcccauggagcagucucccguggcaacagguccagguggauggccuccuaaaucuc

SEQ ID NO: 688026 - RNA, 60 nt, Homo Sapiens
aggccuacagucaaacuccaccugaggggccagguccaccccuccuccaggugcugcagg

SEQ ID NO: 688027 - RNA, 60 nt, Homo Sapiens
cacugcaaaagugaccaagcuggccacaggcagguccaguacagugauggaacaugugcu

SEQ ID NO: 688028 - RNA, 60 nt, Homo Sapiens
cugggcuccuccaccagcucaggcgcucaucagguccagcgaguguccgugagcgggccg

SEQ ID NO: 688029 - RNA, 60 nt, Homo Sapiens
uccugggcgaccgcucugucaggcggccggcagguccacggggcgaggaaggcgguccag

SEQ ID NO: 688030 - RNA, 60 nt, Homo Sapiens
aggguuuuaacuuuguuuuauuuucaaaaccagguccaaugagcuuucugaacagcuggu

SEQ ID NO: 688031 - RNA, 60 nt, Homo Sapiens
cugguaaaaggugaugccaggucuugaagacagguccaccuucaaaaucuauucucuuua

SEQ ID NO: 688032 - RNA, 60 nt, Homo Sapiens
ucccauuuauaaacccacuuuuaaaaauaacagguccaaguuagagugauguguguauau

SEQ ID NO: 688033 - RNA, 60 nt, Homo Sapiens
ugucuccccggcccaggucccucccgccuccagguccauccaucccguccggaaaagaag

SEQ ID NO: 688034 - RNA, 60 nt, Homo Sapiens
cucuucuuuuagaauuaaaugaaugcugcacagguccagauguguguugauguagacuug

SEQ ID NO: 688035 - RNA, 60 nt, Homo Sapiens
ucuggaggggagggggauccagccucuccccagguccagccgguuucuccaaacugaagc

SEQ ID NO: 688036 - RNA, 60 nt, Homo Sapiens
ccccuuccucucucccuccugggaccgagccagguccauagcugcccugaucacagagac

SEQ ID NO: 688037 - RNA, 60 nt, Homo Sapiens
ugugcuauaaucuguuuuuauuaugucaaccagguccagagaaccaaucuggaugccuca

SEQ ID NO: 688038 - RNA, 60 nt, Homo Sapiens
gcccagaugguacuugcuguacagacaauucagguccauguuuugcugcccucuaggugc

SEQ ID NO: 688039 - RNA, 60 nt, Homo Sapiens
uggaaaguauaguuggccaguucaguucuccagguccaccgugcagcgcuuuggauuucc

SEQ ID NO: 688040 - RNA, 60 nt, Homo Sapiens
caagacugucaagggaugagggacagacgacagguccaccggggugugggggauaaaaca

SEQ ID NO: 688041 - RNA, 60 nt, Homo Sapiens
auggauccaccagucccaccaugagcccaacagguccacggucuccggacaccacaccac

SEQ ID NO: 688042 - RNA, 60 nt, Homo Sapiens
uaacacccccucccuccccucaaaacuaaccagguccacccugcaaaaacccaaagccuc

SEQ ID NO: 688043 - RNA, 60 nt, Homo Sapiens
cugcaggccacuacggcugcggagcgggcacagguccaugcguggggacccgugucugug

SEQ ID NO: 688044 - RNA, 60 nt, Homo Sapiens
cagcacuucggccucucccuguacuggaaucagguccagggccccccaaaaccccggugg

SEQ ID NO: 688045 - RNA, 60 nt, Homo Sapiens
uuaaaggcagaaaaacuggaaaaccuacugcagguccagagacuucuguuuuacaacugg

SEQ ID NO: 688046 - RNA, 60 nt, Homo Sapiens
cuagcccaccuccccagccacccuccuccacagguccaggugccgcucccucccccacca

SEQ ID NO: 688047 - RNA, 60 nt, Homo Sapiens
ggggacuucaagagccuguggucaggaaaucagguccagccuucccuguagccagacagu

SEQ ID NO: 688048 - RNA, 60 nt, Homo Sapiens
ucaaauucucuucuuuuucuuuuuuauuaccagguccauuuugccugacaauugcaaauc

SEQ ID NO: 688049 - RNA, 60 nt, Homo Sapiens
cauuuggggcccagaccuacacuuggagcccagguccagcguucccccgaccgcuuuccc

SEQ ID NO: 688050 - RNA, 60 nt, Homo Sapiens
gcuugguccugcucuggucacguguacccucagguccagugugggaggauaucuuuuggc

SEQ ID NO: 688051 - RNA, 60 nt, Homo Sapiens
uggacucuacagagugcuuguguuguccuccagguccaaggaggcacguuuggcacaaag

SEQ ID NO: 688052 - RNA, 60 nt, Homo Sapiens
uaguuuuuggauauauuuaaaagcaaaguccagguccauuuuuccauuuaagcaauuugu

SEQ ID NO: 688053 - RNA, 60 nt, Homo Sapiens
ucuucacuagggguacugacacuaacuacccagguccagggcuaaccuugaucucuaagg

SEQ ID NO: 688054 - RNA, 60 nt, Homo Sapiens
uccauuucucucauucacaaaugccuugcccagguccaguuauggaucucuaccaucccc

SEQ ID NO: 688055 - RNA, 60 nt, Homo Sapiens
cuguuuaaaucccuaagaaucuggaaacuccagguccauucaaaggugauuauuuuucuc

SEQ ID NO: 688056 - RNA, 60 nt, Homo Sapiens
cauguuguugcaaaagauaauaauggccuccagguccaucuucuguaucauuacuucacu

SEQ ID NO: 688057 - RNA, 60 nt, Homo Sapiens
ucagcccaggucucucauggcauauggccgcagguccaguaagggcugguuucaggcuga

SEQ ID NO: 688058 - RNA, 60 nt, Homo Sapiens
uuuacuguggcugucuggaugcuggggucucagguccagccagggagaggcugugucccu

SEQ ID NO: 688059 - RNA, 60 nt, Homo Sapiens
ucaacagaagaggcugcuggggggccagcucagguccacugcuagaggguuagccuggcu

SEQ ID NO: 688060 - RNA, 60 nt, Homo Sapiens
uugggcacuagggcagguucaggguggccccagguccauggacccugacccucggccagc

SEQ ID NO: 688061 - RNA, 60 nt, Homo Sapiens
gaucccugacgagaauaaagagcccagaaacagguccauguuuauaugggaacuugauuu

SEQ ID NO: 688062 - RNA, 60 nt, Homo Sapiens
gggcuggaagguccuuugacggguaugaaacagguccagaaaggggagguggccugcuug

SEQ ID NO: 688063 - RNA, 60 nt, Homo Sapiens
gcuuuuccuacgaucugcauuauguaaucacagguccagagagcuuuauggaagcgggag

SEQ ID NO: 688064 - RNA, 60 nt, Homo Sapiens
aagaaaacagaagaagaggaaggaaaacuacagguccauaucccucauuaacacagacac

SEQ ID NO: 688065 - RNA, 60 nt, Homo Sapiens
uuucaugagcugaggcguggcugggcucggcagguccacaucacccucgugugggagccu

SEQ ID NO: 688066 - RNA, 60 nt, Homo Sapiens
ggucugacccuuggacucuggcccacuucacagguccauggacaguucccggaaacgguu

SEQ ID NO: 688067 - RNA, 60 nt, Homo Sapiens
cgaagugcuacccccaguuuuggagucugccagguccacaaccauguaaagcuggcuuuc

SEQ ID NO: 688068 - RNA, 60 nt, Homo Sapiens
cguuaaaaaauaauggucaauagagauucucagguccaggaacuaagccuuuuugaggug

SEQ ID NO: 688069 - RNA, 60 nt, Homo Sapiens
guaggaauucuuuuggggaagugaggaagccagguccacggucuguucuugaagcaguag

SEQ ID NO: 688070 - RNA, 60 nt, Homo Sapiens
ugcagauuuuucuuuacaguauuccauaggcagguccacuggaaaacugcagaaaaaugu

SEQ ID NO: 688071 - RNA, 60 nt, Homo Sapiens
cucuuacucccucccucugcugucucacuucagguccauguauuucacuuuucuuaaaua

SEQ ID NO: 688072 - RNA, 60 nt, Homo Sapiens
ugggaggaagaagggggccugagagagccccagguccauucuacccccagcuucacucag

SEQ ID NO: 688073 - RNA, 60 nt, Homo Sapiens
agucuucaggaggaagagaugcccaugaagcagguccagaacuaagugggaguggaggca

SEQ ID NO: 688074 - RNA, 58 nt, Homo Sapiens
ucaggaaccgcuaccugugaaaagagcgcagguccaccugguggacacgucugauuag

SEQ ID NO: 688075 - RNA, 60 nt, Homo Sapiens
ggagcuugaggcaguaaggguccccgcccacagguccaugagauggaacagggauuuaac

SEQ ID NO: 688076 - RNA, 60 nt, Homo Sapiens
ucuuuugugguuuccugcacauaguagaagcagguccaugaagugcuucauuuucuuuuu

SEQ ID NO: 688077 - RNA, 60 nt, Homo Sapiens
ccagcuucuuggcaugagguauaucauaaccagguccaacaaaaagaacacuuucugcuc

SEQ ID NO: 688078 - RNA, 60 nt, Homo Sapiens
agucugugcucgggacaauaaagcuugugacagguccaggaccccggcaguuggcuuguc

SEQ ID NO: 688079 - RNA, 60 nt, Homo Sapiens
ggauaucugccuuccugcugcaaguggaggcagguccagcagccccucuucagagccccu

SEQ ID NO: 688080 - RNA, 60 nt, Homo Sapiens
ugcagcggggauucuguucuguucugggcucagguccagaguuguucggagaaagccuag

SEQ ID NO: 688081 - RNA, 60 nt, Homo Sapiens
auuccagcaucauuuauucuuaaagauccucagguccagacuguggauuuguucaaauac

SEQ ID NO: 688082 - RNA, 60 nt, Homo Sapiens
ucaaaggucacacguaauagaaggggcgaucagguccaucacuuguagucuaaaaaguaa

SEQ ID NO: 688083 - RNA, 60 nt, Homo Sapiens
ugcagcuccagccaccuuuggugcucccagcagguccaagacacuaggcccaaggugccu

SEQ ID NO: 688084 - RNA, 60 nt, Homo Sapiens
ggucguacuuaauaaccccauauuauuugucagguccaaaauucagaaggaugcuucaac

SEQ ID NO: 688085 - RNA, 60 nt, Homo Sapiens
caggaggggagcgggcccaggagccaggcucagguccagcugguuccucucuggcgccuu

SEQ ID NO: 688086 - RNA, 60 nt, Homo Sapiens
ccucucuggcgccuucugaacccgucucagcagguccacagcaccugggcagaggucaga

SEQ ID NO: 688087 - RNA, 60 nt, Homo Sapiens
auuuuauucuugcuuuuccaugcuucucuacagguccaaauacugaaugucuccuuuacu

SEQ ID NO: 688088 - RNA, 60 nt, Homo Sapiens
gcaaacaucacagaccccacgaugauuuugcagguccaauaaaaugaagaaacagggcug

SEQ ID NO: 688089 - RNA, 60 nt, Homo Sapiens
guaguuucuuucugucugcuacguuguuuucagguccagaauucuaaugauuggcaaguc

SEQ ID NO: 688090 - RNA, 60 nt, Homo Sapiens
guuguucaccagugcuugcuaaugauucaccagguccaauaugcauuuaguggugguaga

SEQ ID NO: 688091 - RNA, 60 nt, Homo Sapiens
cucgggcccuagcucuguaggacgcggacgcagguccaccagagcuuccuuucgugacga

SEQ ID NO: 688092 - RNA, 60 nt, Homo Sapiens
aauaugcuuauaacacuaguuuuucccuaccagguccauucugcagucuucuuccaucac

SEQ ID NO: 688093 - RNA, 60 nt, Homo Sapiens
uuugguugguguagagaccaugagacccaccagguccagucuggcugcguugccauuggc

SEQ ID NO: 688094 - RNA, 60 nt, Homo Sapiens
gagguuggcagacaagugccacagcauuuccagguccagaaaggugggccccguguguuu

SEQ ID NO: 688095 - RNA, 60 nt, Homo Sapiens
ugggcauggaaugcugaugaagucugggaccagguccaggaggcugagggcuuccccgaa

SEQ ID NO: 688096 - RNA, 60 nt, Homo Sapiens
cuugugggccuucuaagaugaagccacccucagguccagggaagguugugcugguauuug

SEQ ID NO: 688097 - RNA, 60 nt, Homo Sapiens
gaaaggacauugcuuucucagccccacccccagguccacaguguccaagguaauggcaca

SEQ ID NO: 688098 - RNA, 60 nt, Homo Sapiens
aucguccgcugaccucuggccacaggaagccagguccaccgcccaccacccuuucaggcc

SEQ ID NO: 688099 - RNA, 60 nt, Homo Sapiens
cugggcucagguuccaagacgcgccuuugccagguccagccaaggcacuccuaccacuga

SEQ ID NO: 688100 - RNA, 60 nt, Homo Sapiens
gagaccgaggagggagaguccacagcaggccagguccagacccugcauggcugagcugcc

SEQ ID NO: 688101 - RNA, 60 nt, Homo Sapiens
ccuucugaaaagcagcuguuacaaggguaccagguccaccgggauugacuugguucccug

SEQ ID NO: 688102 - RNA, 60 nt, Homo Sapiens
gcacaucaggcggacugagcggagacaaggcagguccagcugucaucacggguccccuga

SEQ ID NO: 688103 - RNA, 60 nt, Homo Sapiens
ccuauguccagggcaccagguuugggcagucagguccacaccaaggcugggccagccuuu

SEQ ID NO: 688104 - RNA, 60 nt, Homo Sapiens
cagcauggguggcaggguuugucuccauggcagguccauaugggcagggcuuggaccccc

SEQ ID NO: 688105 - RNA, 60 nt, Homo Sapiens
cggugugggugggcagggcuuccucuguggcagguccacagccaacccugagcgagccug

SEQ ID NO: 688106 - RNA, 60 nt, Homo Sapiens
ggcugggugguccgcacccuggcucuccugcagguccacacaccuuccaggccuguggcc

SEQ ID NO: 688107 - RNA, 60 nt, Homo Sapiens
aaagcaaagugauuuugucugcuccuagagcagguccauaccaaguaauagaggcacuuu

SEQ ID NO: 688108 - RNA, 60 nt, Homo Sapiens
cagaucaccaucuaaguuacaucuuuagcucagguccauccuucucaagaucuccuucuu

SEQ ID NO: 688109 - RNA, 60 nt, Homo Sapiens
cccuuucucuuucucccaggcagggcucugcagguccauaugggcucaaugucaccaccc

SEQ ID NO: 688110 - RNA, 60 nt, Homo Sapiens
caaucuuggcucacugcaaccuccaccucccagguccaagcgauucucuugccucagccu

SEQ ID NO: 688111 - RNA, 60 nt, Homo Sapiens
cccaucuuuugaaauguauuuucuucauugcagguccaccuaaucauccugugaaagugg

SEQ ID NO: 688112 - RNA, 60 nt, Homo Sapiens
gauuucgcgcagccuguuguuuuccuuagacagguccacgucccucuccugaggcugugg

SEQ ID NO: 688113 - RNA, 60 nt, Homo Sapiens
agcccaccuauagcaggaagcggcucagagcagguccaccgcuaggacgggaggcagagc

SEQ ID NO: 688114 - RNA, 60 nt, Homo Sapiens
gcagggcccacaagggggaucccuaaggggcagguccagacagcaaaaugcccccugcuu

SEQ ID NO: 688115 - RNA, 60 nt, Homo Sapiens
guuguuagaucuucuggguuugccacucuacagguccagggcugaguucuggucuguugc

SEQ ID NO: 688116 - RNA, 60 nt, Homo Sapiens
gaaccuggcaugcaauggacgcaaggccaccagguccagaagacaugaguucuggaagga

SEQ ID NO: 688117 - RNA, 54 nt, Homo Sapiens
ccuaagugagacauguuucucuaacagguccaacagaagcugcagaacuauuaa

SEQ ID NO: 688118 - RNA, 60 nt, Homo Sapiens
gaacuacugcagcccagagguggcagccaccagguccacaucucaccggcuccccgagcg

SEQ ID NO: 688119 - RNA, 60 nt, Homo Sapiens
cuguguuuggcuuucagggacaaggggcuucagguccagguccccaucucaggccagagc

SEQ ID NO: 688120 - RNA, 60 nt, Homo Sapiens
gaggccuucaccuuccuggugcccuucagccagguccagaauguggaccuggugcuggcu

SEQ ID NO: 688121 - RNA, 60 nt, Homo Sapiens
ccaugccuauguuccagcuuccugggucugcagguccagccggcuggcacccuccaugua

SEQ ID NO: 688122 - RNA, 60 nt, Homo Sapiens
agcaccaguggaaacacaugaacuucgaugcagguccagagaccauggacacucccacga

SEQ ID NO: 688123 - RNA, 60 nt, Homo Sapiens
agguugggaagguuguucccuucccggugccagguccagauuucccuccaugauuuggga

SEQ ID NO: 688124 - RNA, 60 nt, Homo Sapiens
uuuugccuguuccaaucaaaccaccccauucagguccaucagccucugauuaauauccgu

SEQ ID NO: 688125 - RNA, 60 nt, Homo Sapiens
uuuuguuuuuuguguuuuguucuuuaaagucagguccaauuuguaaaaacagcauugcuu

SEQ ID NO: 688126 - RNA, 60 nt, Homo Sapiens
gauagcaucacaagaaacgagccugaaaaucagguccagccgguccaagcacauggccuc

SEQ ID NO: 688127 - RNA, 60 nt, Homo Sapiens
gggugggacccccugcugcagggcagaguucagguccacugggcugaguguccccuuggg

SEQ ID NO: 688128 - RNA, 60 nt, Homo Sapiens
guggggagaaauaugaaggagaccugugaccagguccaaucagaagcccuguugcucacu

SEQ ID NO: 688129 - RNA, 60 nt, Homo Sapiens
uguuaaacguuuauaaaaccgauuccaucucagguccagacaauaaaaucgaaauucauu

SEQ ID NO: 688130 - RNA, 60 nt, Homo Sapiens
guccaagcccugguggguagcuagcuggggcagguccagagcagucccagaaaccccaac

SEQ ID NO: 688131 - RNA, 60 nt, Homo Sapiens
ggggcuggcaucccagcucccguguucugccagguccaugcccuguggggcugucaagag

SEQ ID NO: 688132 - RNA, 60 nt, Homo Sapiens
uucaacuauucuuaagcaguauggugcucucagguccaagauauacuuagauuucuaagu

SEQ ID NO: 688133 - RNA, 60 nt, Homo Sapiens
acuaacucugaagaaguuaucuacucugaccagguccaguaacaaucauauacugauuag

SEQ ID NO: 688134 - RNA, 60 nt, Homo Sapiens
aggauaguuccaggccauagaaauacugggcagguccaaauuaagcagacagacaauuga

SEQ ID NO: 688135 - RNA, 60 nt, Homo Sapiens
gcuuccucuggggcugacaacaccaucggccagguccagccuggugcuguccucucggcc

SEQ ID NO: 688136 - RNA, 60 nt, Homo Sapiens
ugugacauccuucagcacccaauuaagugacagguccaagaauaucucguguuucauuuu

SEQ ID NO: 688137 - RNA, 60 nt, Homo Sapiens
uguuucuuccccuccuacgaguaccugcgccagguccaugcccacugggagaaggguggc

SEQ ID NO: 688138 - RNA, 60 nt, Homo Sapiens
ccuuaaggcccuccuuuucccuccaugcuccagguccaugcacagguguagcauguccug

SEQ ID NO: 688139 - RNA, 60 nt, Homo Sapiens
auuucuuuuuuuuuuuuaaauaguaagucacagguccacacuguguaaacaugcaucuga

SEQ ID NO: 688140 - RNA, 60 nt, Homo Sapiens
caaucucugcucacugcaacaucugccucccagguccaagcgauucuccugccucagccu

SEQ ID NO: 688141 - RNA, 60 nt, Homo Sapiens
uuucucucugcccucuagagcaaggcccaccagguccauccaggaggcucuccugaccuc

SEQ ID NO: 688142 - RNA, 60 nt, Homo Sapiens
gagaauaagcauuuccuguucuuccagcuccagguccaccuccuguugggaggcgguggg

SEQ ID NO: 688143 - RNA, 60 nt, Homo Sapiens
cugcaccucuuggcucgggucagauagaugcagguccauuggaacagagggugaaaggga

SEQ ID NO: 688144 - RNA, 60 nt, Homo Sapiens
gcaggcaauaaauaugugauaucccaacugcagguccaguucugucuuguucacugcagu

SEQ ID NO: 688145 - RNA, 60 nt, Homo Sapiens
ccugguuccuguguguuuggccagccccagcagguccacugcuuccuauuucauaauccu

SEQ ID NO: 688146 - RNA, 60 nt, Homo Sapiens
ccccugcugaugaugagcaagugccugcugcagguccaaacacagcauccagggcuuugc

SEQ ID NO: 688147 - RNA, 60 nt, Homo Sapiens
cucgucgcauuuguuauaaauguaguaaggcagguccaagcacuuacaaguuuuuuguag

SEQ ID NO: 688148 - RNA, 60 nt, Homo Sapiens
cgccaugacaaaacuauaauauugacuggacagguccacgaaagggcacugaaacacaca

SEQ ID NO: 688149 - RNA, 60 nt, Homo Sapiens
auuucauuuuaauuaauuauugaaauuguacagguccauauccuauccauccauaucuau

SEQ ID NO: 688150 - RNA, 60 nt, Homo Sapiens
gugcuuuggaucagggaagccacuuugggacagguccauaaagugaacugaucuuaccga

SEQ ID NO: 688151 - RNA, 60 nt, Homo Sapiens
cuaauugaaagaaaaccaucugaauuguugcagguccacauuuuugccaaagauacacuc

SEQ ID NO: 688152 - RNA, 60 nt, Homo Sapiens
cugaugcaguccuccugaccguuccuaccgcagguccagggccugggcccgcggacccca

SEQ ID NO: 688153 - RNA, 60 nt, Homo Sapiens
guuccaguggaugagggccaccaggaagcacagguccaaggcuggucccacacuuaucag

SEQ ID NO: 688154 - RNA, 60 nt, Homo Sapiens
agcccaguggcuuaaacaccauuuauaccacagguccagaugaauccugcagggccaagg

SEQ ID NO: 688155 - RNA, 60 nt, Homo Sapiens
uugguauacauuccacccucacugaacuugcagguccagguuaaaucuaauauuguuaau

SEQ ID NO: 688156 - RNA, 60 nt, Homo Sapiens
uauguaaaaucauuucucucuuuuaaguggcagguccagaccugcauucuguacauaaag

SEQ ID NO: 688157 - RNA, 60 nt, Homo Sapiens
gccaccacguggcuggccccugagccgagccagguccaugguggcagcacgucuuccuca

SEQ ID NO: 688158 - RNA, 60 nt, Homo Sapiens
uccuggcaaccgcgggcucacauacuacugcagguccaacuauuuaggccgugagcuucc

SEQ ID NO: 688159 - RNA, 60 nt, Homo Sapiens
agaaagggaggguggagggugaggccaaaucagguccagcaaaagucaguagggacauug

SEQ ID NO: 688160 - RNA, 60 nt, Homo Sapiens
ccauggguguggauggcaguguggggagggcagguccagcucugugggcccuacccuccu

SEQ ID NO: 688161 - RNA, 60 nt, Homo Sapiens
uggaucucugugguuccuucucagccgaaacagguccaguaucccagucauuucuucaaa

SEQ ID NO: 688162 - RNA, 60 nt, Homo Sapiens
aggggucugcaguccaguagggcaggcagucagguccaugugcacugcaaugccaggugg

SEQ ID NO: 688163 - RNA, 60 nt, Homo Sapiens
gcaguaggcuuaggaugcagcuucucccagcagguccauagaaaccaagcuuaugaagau

SEQ ID NO: 688164 - RNA, 60 nt, Homo Sapiens
caguguaggagcagauguuucugggaagcccagguccacagugaaguugugaccaucugg

SEQ ID NO: 688165 - RNA, 60 nt, Homo Sapiens
gagcacugccccaugcccacccuguguacccagguccagaggguccguccaccacagcag

SEQ ID NO: 688166 - RNA, 60 nt, Homo Sapiens
acaguccuugcccuggggccgguucuuacccagguccagagaaaccaacgcgggauguca

SEQ ID NO: 688167 - RNA, 60 nt, Homo Sapiens
acauuauaaaugucucuuuaaugucacaggcagguccaggguuugaguucauacccuguu

SEQ ID NO: 688168 - RNA, 60 nt, Homo Sapiens
uuuuugcugaggguuucugucugggccuaucagguccauacuuagacccugagcaucuuc

SEQ ID NO: 688169 - RNA, 60 nt, Homo Sapiens
ccuuaaagccgagcucaguuaccauagggacagguccaccucuacugggcccucaugcuu

SEQ ID NO: 688170 - RNA, 60 nt, Homo Sapiens
gaucauagaucacguuacaagcacuuggcucagguccagcaaggacagaugaacaaauuc

SEQ ID NO: 688171 - RNA, 60 nt, Homo Sapiens
ugguuugccauaggcccugccaagauacugcagguccauccaggccucugcuaucugcau

SEQ ID NO: 688172 - RNA, 60 nt, Homo Sapiens
ucagucugaaugcugccacaaccagccaggcagguccacagagagggagagcagagaaag

SEQ ID NO: 688173 - RNA, 60 nt, Homo Sapiens
cacgcugggggcuguaaucacggacccacacagguccaccucaacgagggaaccccaaga

SEQ ID NO: 688174 - RNA, 60 nt, Homo Sapiens
gguugggcagccagucugggacucaggccucagguccauggaaagcagcucccaggccuu

SEQ ID NO: 688175 - RNA, 60 nt, Homo Sapiens
gcaggcuugcuuucuuuuauguggggcugacagguccacgggcccaugccgacagauauc

SEQ ID NO: 688176 - RNA, 60 nt, Homo Sapiens
cuggacagaaaggcaggagcucugaguccucagguccacccauuucccucauggggaucc

SEQ ID NO: 688177 - RNA, 60 nt, Homo Sapiens
cuguccccucacccccucuccuguauuucucagguccaguucaaaucuaaaauucuacuu

SEQ ID NO: 688178 - RNA, 60 nt, Homo Sapiens
cacggagggaggcaccaugcaaaugucuuccagguccaaacccuucaacuccuggcuccg

SEQ ID NO: 688179 - RNA, 60 nt, Homo Sapiens
gaccagcacugacagccuagccagugguuccagguccagcccugacuucauccucccuuc

SEQ ID NO: 688180 - RNA, 60 nt, Homo Sapiens
uggaggacuuuggaagaggcgcuccuuggccagguccaaugaguaacaucagacugacag

SEQ ID NO: 688181 - RNA, 60 nt, Homo Sapiens
guuauggugcugguaauaagccucgcagcccagguccagagcccccggcgagccgguccc

SEQ ID NO: 688182 - RNA, 60 nt, Homo Sapiens
gucccaaggaaaacccaaaguggaggugcucagguccaggggaguccagugggcaggacc

SEQ ID NO: 688183 - RNA, 60 nt, Homo Sapiens
ugcugggguccaagaaccaacuggcagacccagguccaacuccugaugucucaggcaacc

SEQ ID NO: 688184 - RNA, 60 nt, Homo Sapiens
gucaccaugaggccacccuggaccagauuccagguccaaacacugcugcccgugcagugg

SEQ ID NO: 688185 - RNA, 60 nt, Homo Sapiens
uuggcccugacuccugcgggauuguaagcacagguccaacggggaaaaggcccgugaguc

SEQ ID NO: 688186 - RNA, 60 nt, Homo Sapiens
gagccccugaccccugucugucuggggaugcagguccaccgacacggaguggcuugagcu

SEQ ID NO: 688187 - RNA, 60 nt, Homo Sapiens
uagcccacuugcaucagggcucugucuagccagguccagggaccuugguccauuugguuu

SEQ ID NO: 688188 - RNA, 60 nt, Homo Sapiens
gcagagauccugaaaagauacuccauucuccagguccaagacgugauaggagcaaagucu

SEQ ID NO: 688189 - RNA, 60 nt, Homo Sapiens
cccaucugucuuguuuccucuuaaucacgccagguccagggauggauccacguuucaucu

SEQ ID NO: 688190 - RNA, 60 nt, Homo Sapiens
gacaccccaccaccuaggcaccccccaacacagguccacacaagucaggguccagaacug

SEQ ID NO: 688191 - RNA, 60 nt, Homo Sapiens
uugugucaagaaccuagugccccuuaaacacagguccacguccuucuagggccaccuguc

SEQ ID NO: 688192 - RNA, 60 nt, Homo Sapiens
gucuccccuccccucauuuguccgagcccccagguccaccggaaaugcccuggucuggcc

SEQ ID NO: 688193 - RNA, 60 nt, Homo Sapiens
ggcgacacacuuaccgcaucaaucuguguucagguccaggguuacauaauugcagaagca

SEQ ID NO: 688194 - RNA, 54 nt, Homo Sapiens
uugccccuggguacugcuagagaacagguccacccuggcucugggacucgcugc

SEQ ID NO: 688195 - RNA, 60 nt, Homo Sapiens
gcccaggcuccacgugcuuacugaggacaucagguccaccucuggaccccuuggcaggcc

SEQ ID NO: 688196 - RNA, 60 nt, Homo Sapiens
aaccacuaggaugugaucugcccuugugggcagguccagcauaguuaggaguuaggcuuu

SEQ ID NO: 688197 - RNA, 60 nt, Homo Sapiens
ugggacguuuuucuucuugggcccgguccacagguccaaggacacccucccuccaggguc

SEQ ID NO: 688198 - RNA, 60 nt, Homo Sapiens
caugcauaucacauaagaccagaaguggcccagguccagggucaguuaauuuagcggcuc

SEQ ID NO: 688199 - RNA, 60 nt, Homo Sapiens
ggccuggcauuucacgcauugcugccaccccagguccaccugucuccacuuucacagccu

SEQ ID NO: 688200 - RNA, 60 nt, Homo Sapiens
ggcucucaucccuugggauaagccccaguccagguccaggaggcucccucccugcccagc

SEQ ID NO: 688201 - RNA, 60 nt, Homo Sapiens
aaacgcccucugcgcccaggcugggaaggacagguccaauugaaccuggacaagcagcgg

SEQ ID NO: 688202 - RNA, 60 nt, Homo Sapiens
uucaagcccaggaccaccacagaguucagacagguccaagaccucagggguuaagagcuc

SEQ ID NO: 688203 - RNA, 60 nt, Homo Sapiens
aacaauaucaaaagugguuuccucagccagcagguccagaaucuucuuggucuacugccu

SEQ ID NO: 688204 - RNA, 60 nt, Homo Sapiens
augggggacggcccagcgugccuuuuagcucagguccaccacggccacgcccacacccgg

SEQ ID NO: 688205 - RNA, 60 nt, Homo Sapiens
ucccugagcgcaccggcccuuccugucacccagguccacccucaguacucaagcugcagu

SEQ ID NO: 688206 - RNA, 60 nt, Homo Sapiens
ucuucuggggacacuugggguccacaaucccagguccauacucuagguuuuggauaccau

SEQ ID NO: 688207 - RNA, 60 nt, Homo Sapiens
cuuuugcauaggaaauacuugauuuaauuacagguccagggaugagcugaugguugcugg

SEQ ID NO: 688208 - RNA, 60 nt, Homo Sapiens
augcagaguuguuuggacuucuuccugugccagguccaagucgggggaccugaagaauca

SEQ ID NO: 688209 - RNA, 60 nt, Homo Sapiens
gaggaaaaacacaguccuagggacaaaagccagguccacagcagucauuuuuaaaauaaa

SEQ ID NO: 688210 - RNA, 60 nt, Homo Sapiens
cuggaucuuggguuccaggcagacaucauccagguccaucuggaacuuucagugauagcu

SEQ ID NO: 688211 - RNA, 60 nt, Homo Sapiens
cucucaaccauuacucacacuuccagcgcccagguccaagucugagccugaccuccccuu

SEQ ID NO: 688212 - RNA, 60 nt, Homo Sapiens
ccagccugggcaacacagcacagaggccagcagguccacaagccgggguaggaggaucac

SEQ ID NO: 688213 - RNA, 60 nt, Homo Sapiens
acucagcuuucugcuucagcaggaacugagcagguccagggguucacuugguuugucauc

SEQ ID NO: 688214 - RNA, 60 nt, Homo Sapiens
gguucuucagcccaugacaggcuugguuuacagguccagucuguggacuuauaccugugu

SEQ ID NO: 688215 - RNA, 60 nt, Homo Sapiens
gagacagacucugaaugggaguggcaggcacagguccaggcccgucugcugaugugacca

SEQ ID NO: 688216 - RNA, 60 nt, Homo Sapiens
agcaugaaguuggccaagccagagccaugacagguccaucgaaggcucccuaagaccuug

SEQ ID NO: 688217 - RNA, 60 nt, Homo Sapiens
aacuugaaagcaagaccuugauugcaccaacagguccagaguaugagugcaagcaaagca

SEQ ID NO: 688218 - RNA, 60 nt, Homo Sapiens
caaguaggugggauuacagguacucaccaccagguccagcuaacuuuuguauuuuuagua

SEQ ID NO: 688219 - RNA, 60 nt, Homo Sapiens
ccguagugauaagcacaccggcacgaacgucagguccauuccucgaagucggagcccuca

SEQ ID NO: 688220 - RNA, 60 nt, Homo Sapiens
gagccacgggaucagcugagucaugagucucagguccagguggagucuguagguugccag

SEQ ID NO: 688221 - RNA, 60 nt, Homo Sapiens
uccagcagcugguccaacagugagggguagcagguccaucucuugugguggggaggcugc

SEQ ID NO: 688222 - RNA, 60 nt, Homo Sapiens
ggcaggacuuccuccaacccguugcuaccucagguccacaugauuaacucuaagaguuua

SEQ ID NO: 688223 - RNA, 60 nt, Homo Sapiens
gaaagguuuggccugacgcugcagguuuuccagguccacguguaaaaagagaagaaagug

SEQ ID NO: 688224 - RNA, 60 nt, Homo Sapiens
ggcugcucucaccguggccuguccacgguccagguccaucucagcagcgugagggugcac

SEQ ID NO: 688225 - RNA, 60 nt, Homo Sapiens
cuuggaggcccccauccaggccagaaggaccagguccacccagcagcuguuugcccagag

SEQ ID NO: 688226 - RNA, 60 nt, Homo Sapiens
ucugugcagcuagggcugcagagcuguauucagguccaagguucugcccuuccuugagug

SEQ ID NO: 688227 - RNA, 57 nt, Homo Sapiens
accagucagagacuugccccacuguggcagguccagaugaucgacauggccaaguga

SEQ ID NO: 688228 - RNA, 60 nt, Homo Sapiens
ggguggaaggcccuggcagggaauuccuaucagguccagacucaggaaaccuugacuucu

SEQ ID NO: 688229 - RNA, 60 nt, Homo Sapiens
gccuccuccacagccucagcgacaccagaccagguccaggcugggcaccugccucugaca

SEQ ID NO: 688230 - RNA, 60 nt, Homo Sapiens
cugccgcugaugagacugcucguggacccccagguccaguccccgggccuucgccuuccc

SEQ ID NO: 688231 - RNA, 60 nt, Homo Sapiens
uguuuggucggguucacagugaccgagagucagguccagcacacaccugggaaagggaug

SEQ ID NO: 688232 - RNA, 60 nt, Homo Sapiens
cucagaagcagcagaacugacauugggacccagguccauuggaggcaucuuuuaguuaug

SEQ ID NO: 688233 - RNA, 60 nt, Homo Sapiens
aggcacugagcagggaucugcccccuaguucagguccaaauucaccuuccccuaaacccc

SEQ ID NO: 688234 - RNA, 60 nt, Homo Sapiens
uaaccuuuguuggaugugggccuuagccuccagguccagacuacuacucuauguucucca

SEQ ID NO: 688235 - RNA, 60 nt, Homo Sapiens
aauccaccuuuuagguaugagaaauguguucagguccagauaugguuucuccuauaauuu

SEQ ID NO: 688236 - RNA, 60 nt, Homo Sapiens
aaacuugugugauuauuaaagccagccaugcagguccaugauagaaacagcaggugauga

SEQ ID NO: 688237 - RNA, 60 nt, Homo Sapiens
agaccaccuggcaacaggcucagugggggucagguccagguccccgaagaggugcuggag

SEQ ID NO: 688238 - RNA, 60 nt, Homo Sapiens
auauucauacuauguguuugaaaccauucacagguccacauaggggaagugagauuuaaa

SEQ ID NO: 688239 - RNA, 60 nt, Homo Sapiens
auagaucauugcagaaagucguggucugcccagguccaugaguauuuuuccugccuuuca

SEQ ID NO: 688240 - RNA, 60 nt, Homo Sapiens
ccuggcgagggcaggucagauccucuucugcagguccagcgcuggguuuaugagucccug

SEQ ID NO: 688241 - RNA, 60 nt, Homo Sapiens
cuaagauuugaacccagggugucugacucccagguccaugcuccagagucagauauagaa

SEQ ID NO: 688242 - RNA, 65 nt, Homo Sapiens
cucgaucuucuacuugccuguggggaggggagugacagguccacacaccacacugggucacccug

SEQ ID NO: 688243 - RNA, 65 nt, Homo Sapiens
gaggugugugagcagggaacucagugugacaccgccagguccagcacccaugggggcgggggaga

SEQ ID NO: 688244 - RNA, 65 nt, Homo Sapiens
ggcuccccucggcuguggugccuccucuggccccccagguccacguccuuuaaauuggcccuuug

SEQ ID NO: 688245 - RNA, 65 nt, Homo Sapiens
caccucagggccaagcgggggcguggcuggccuuucagguccaggccagugggccugguagcaca

SEQ ID NO: 688246 - RNA, 65 nt, Homo Sapiens
augacccagaagcaucagugugcaucuacgcagcccagguccaggaccacauccuggccagcugc

SEQ ID NO: 688247 - RNA, 65 nt, Homo Sapiens
ucuggagacugagaaagggguguauuuaauuccaucagguccaguacaguacuaggagucauaau

SEQ ID NO: 688248 - RNA, 65 nt, Homo Sapiens
agcggccacgcccacaauccgacagcccccaggagcagguccagggaugaugcagcccccuucuu

SEQ ID NO: 688249 - RNA, 65 nt, Homo Sapiens
gaagaaaauagcuucuccuacagugauucaugucccagguccaggaaauccaauguuggugaagg

SEQ ID NO: 688250 - RNA, 65 nt, Homo Sapiens
guccugggacaugcagccaggacugugagucugggcagguccaaggccugcaccuucaagaagug

SEQ ID NO: 688251 - RNA, 65 nt, Homo Sapiens
guccucacaggaacaccaggagcuccccgcuccugcagguccagcuacccagcagguggcacugc

SEQ ID NO: 688252 - RNA, 65 nt, Homo Sapiens
gaaagugccgccagugguccauaaagauuauaaagcagguccaagccaggacaaggcaggacaug

SEQ ID NO: 688253 - RNA, 65 nt, Homo Sapiens
agggagggagacacacaagcgaacaaagcgaaaugcagguccaccucagcuucauuccucugaua

SEQ ID NO: 688254 - RNA, 65 nt, Homo Sapiens
cugucugccauuggucuccucuggcuaccuuccugcagguccaccaaaacccaaggucuuuccuu

SEQ ID NO: 688255 - RNA, 65 nt, Homo Sapiens
cugcagauccuaccagguugugacuuuccagaccccagguccaguugcuugccuccacucccuuc

SEQ ID NO: 688256 - RNA, 65 nt, Homo Sapiens
ucacuuuguauauagaauuucauguuuugaagcagcagguccaggagauauuaguaagaaaggau

SEQ ID NO: 688257 - RNA, 65 nt, Homo Sapiens
ggaaagcucugaacuugccaugccugagaggcucacagguccaagcccccuucuccuacuaggcc

SEQ ID NO: 688258 - RNA, 65 nt, Homo Sapiens
agaggcccauggagcagucuaucuccccguggcaacagguccaggcuccuuggauggccuccuaa

SEQ ID NO: 688259 - RNA, 65 nt, Homo Sapiens
aggccuacagucaaacuccagcaggccugaggggccagguccacccauguccuccuccaggugcu

SEQ ID NO: 688260 - RNA, 65 nt, Homo Sapiens
cacugcaaaagugaccaagcgugcuuggccacaggcagguccagugaguuacagugauggaacau

SEQ ID NO: 688261 - RNA, 65 nt, Homo Sapiens
cugggcuccuccaccagcucggccgaggcgcucaucagguccagccaccugaguguccgugagcg

SEQ ID NO: 688262 - RNA, 65 nt, Homo Sapiens
uccugggcgaccgcucugucuccagaggcggccggcagguccacgguggagggcgaggaaggcgg

SEQ ID NO: 688263 - RNA, 65 nt, Homo Sapiens
cucccaggguuuuaacuuuguuuuauuuucaaaaccagguccaaugagcuuucugaacagcuggu

SEQ ID NO: 688264 - RNA, 65 nt, Homo Sapiens
accagcugguaaaaggugaugccaggucuugaagacagguccaccuucaaaaucuauucucuuua

SEQ ID NO: 688265 - RNA, 65 nt, Homo Sapiens
auaagucccauuuauaaacccacuuuuaaaaauaacagguccaaguuagagugauguguguauau

SEQ ID NO: 688266 - RNA, 65 nt, Homo Sapiens
cuucuugucuccccggcccaggucccucccgccuccagguccauccaucccguccggaaaagaag

SEQ ID NO: 688267 - RNA, 65 nt, Homo Sapiens
uaugccucuucuuuuagaauuaaaugaaugcugcacagguccagauguguguugauguagacuug

SEQ ID NO: 688268 - RNA, 65 nt, Homo Sapiens
ucuggaggggagggggauccgaagcagccucuccccagguccagcugacucgguuucuccaaacu

SEQ ID NO: 688269 - RNA, 65 nt, Homo Sapiens
ccccuuccucucucccuccugagacgggaccgagccagguccauacaucugcugcccugaucaca

SEQ ID NO: 688270 - RNA, 65 nt, Homo Sapiens
ugugcuauaaucuguuuuuaccucauuaugucaaccagguccagaaucaugaaccaaucuggaug

SEQ ID NO: 688271 - RNA, 65 nt, Homo Sapiens
gcccagaugguacuugcuguggugcacagacaauucagguccaugcacaguuuugcugcccucua

SEQ ID NO: 688272 - RNA, 65 nt, Homo Sapiens
uggaaaguauaguuggccaguuuccuucaguucuccagguccacccgauugugcagcgcuuugga

SEQ ID NO: 688273 - RNA, 65 nt, Homo Sapiens
caagacugucaagggaugagaaacaggacagacgacagguccacccuuggggggugugggggaua

SEQ ID NO: 688274 - RNA, 65 nt, Homo Sapiens
auggauccaccagucccaccaccacaugagcccaacagguccacgucacagucuccggacaccac

SEQ ID NO: 688275 - RNA, 65 nt, Homo Sapiens
uaacacccccucccuccccugccuccaaaacuaaccagguccaccggaaacugcaaaaacccaaa

SEQ ID NO: 688276 - RNA, 65 nt, Homo Sapiens
cugcaggccacuacggcugccugugggagcgggcacagguccauguucuccguggggacccgugu

SEQ ID NO: 688277 - RNA, 65 nt, Homo Sapiens
aggagcagcacuucggccucucccuguacuggaaucagguccagggccccccaaaaccccggugg

SEQ ID NO: 688278 - RNA, 65 nt, Homo Sapiens
ugaaauuaaaggcagaaaaacuggaaaaccuacugcagguccagagacuucuguuuuacaacugg

SEQ ID NO: 688279 - RNA, 65 nt, Homo Sapiens
ggcagcuagcccaccuccccagccacccuccuccacagguccaggugccgcucccucccccacca

SEQ ID NO: 688280 - RNA, 65 nt, Homo Sapiens
accauggggacuucaagagccuguggucaggaaaucagguccagccuucccuguagccagacagu

SEQ ID NO: 688281 - RNA, 65 nt, Homo Sapiens
accguucaaauucucuucuuuuucuuuuuuauuaccagguccauuuugccugacaauugcaaauc

SEQ ID NO: 688282 - RNA, 65 nt, Homo Sapiens
uggggcauuuggggcccagaccuacacuuggagcccagguccagcguucccccgaccgcuuuccc

SEQ ID NO: 688283 - RNA, 65 nt, Homo Sapiens
gcuugguccugcucuggucauuggccguguacccucagguccagugccuugugggaggauaucuu

SEQ ID NO: 688284 - RNA, 65 nt, Homo Sapiens
uggacucuacagagugcuugcaaaguguuguccuccagguccaagacaaggaggcacguuuggca

SEQ ID NO: 688285 - RNA, 65 nt, Homo Sapiens
uaguuuuuggauauauuuaauuuguaagcaaaguccagguccauuuuucauuuccauuuaagcaa

SEQ ID NO: 688286 - RNA, 65 nt, Homo Sapiens
ucuucacuagggguacugacuaaggacuaacuacccagguccaggagugagcuaaccuugaucuc

SEQ ID NO: 688287 - RNA, 65 nt, Homo Sapiens
uccauuucucucauucacaauccccaugccuugcccagguccaguauucauauggaucucuacca

SEQ ID NO: 688288 - RNA, 65 nt, Homo Sapiens
cuguuuaaaucccuaagaauuucuccuggaaacuccagguccauuaccuucaaaggugauuauuu

SEQ ID NO: 688289 - RNA, 65 nt, Homo Sapiens
cauguuguugcaaaagauaaucacuuaauggccuccagguccaucugacuuucuguaucauuacu

SEQ ID NO: 688290 - RNA, 65 nt, Homo Sapiens
ucagcccaggucucucaugggcugacauauggccgcagguccaguggggaaagggcugguuucag

SEQ ID NO: 688291 - RNA, 65 nt, Homo Sapiens
uuuacuguggcugucuggauucccugcuggggucucagguccagcggacccagggagaggcugug

SEQ ID NO: 688292 - RNA, 65 nt, Homo Sapiens
ucaacagaagaggcugcugguggcuggggccagcucagguccacuagcuggcuagaggguuagcc

SEQ ID NO: 688293 - RNA, 65 nt, Homo Sapiens
uugggcacuagggcagguucccagcaggguggccccagguccaugcagaggacccugacccucgg

SEQ ID NO: 688294 - RNA, 65 nt, Homo Sapiens
caagggaucccugacgagaauaaagagcccagaaacagguccauguuuauaugggaacuugauuu

SEQ ID NO: 688295 - RNA, 65 nt, Homo Sapiens
ucuuggggcuggaagguccuuugacggguaugaaacagguccagaaaggggagguggccugcuug

SEQ ID NO: 688296 - RNA, 65 nt, Homo Sapiens
aagcagcuuuuccuacgaucugcauuauguaaucacagguccagagagcuuuauggaagcgggag

SEQ ID NO: 688297 - RNA, 65 nt, Homo Sapiens
aggcaaagaaaacagaagaagaggaaggaaaacuacagguccauaucccucauuaacacagacac

SEQ ID NO: 688298 - RNA, 65 nt, Homo Sapiens
uuucaugagcugaggcguggagccucugggcucggcagguccacaccgugucacccucguguggg

SEQ ID NO: 688299 - RNA, 65 nt, Homo Sapiens
ggucugacccuuggacucugcgguugcccacuucacagguccaugcuauggacaguucccggaaa

SEQ ID NO: 688300 - RNA, 65 nt, Homo Sapiens
cgaagugcuacccccaguuucuuucuggagucugccagguccacauuaauaccauguaaagcugg

SEQ ID NO: 688301 - RNA, 65 nt, Homo Sapiens
cguuaaaaaauaauggucaaagguguagagauucucagguccaggaaaacaacuaagccuuuuug

SEQ ID NO: 688302 - RNA, 65 nt, Homo Sapiens
cuucuguaggaauucuuuuggggaagugaggaagccagguccacggucuguucuugaagcaguag

SEQ ID NO: 688303 - RNA, 65 nt, Homo Sapiens
auuuuugcagauuuuucuuuacaguauuccauaggcagguccacuggaaaacugcagaaaaaugu

SEQ ID NO: 688304 - RNA, 65 nt, Homo Sapiens
ggccgcucuuacucccucccucugcugucucacuucagguccauguauuucacuuuucuuaaaua

SEQ ID NO: 688305 - RNA, 65 nt, Homo Sapiens
ggagcugggaggaagaagggggccugagagagccccagguccauucuacccccagcuucacucag

SEQ ID NO: 688306 - RNA, 65 nt, Homo Sapiens
caaccagucuucaggaggaagagaugcccaugaagcagguccagaacuaagugggaguggaggca

SEQ ID NO: 688307 - RNA, 58 nt, Homo Sapiens; identical to SEQ ID NO: 688074

SEQ ID NO: 688308 - RNA, 65 nt, Homo Sapiens
ggagcuugaggcaguaaggguuaacuccccgcccacagguccaugaggcgagauggaacagggau

SEQ ID NO: 688309 - RNA, 65 nt, Homo Sapiens
ucuuuugugguuuccugcacuuuuuauaguagaagcagguccaugcagagaagugcuucauuuuc

SEQ ID NO: 688310 - RNA, 65 nt, Homo Sapiens
ccagcuucuuggcaugagguugcucauaucauaaccagguccaacuuuaaaaaaagaacacuuuc

SEQ ID NO: 688311 - RNA, 65 nt, Homo Sapiens
uggcgagucugugcucgggacaauaaagcuugugacagguccaggaccccggcaguuggcuuguc

SEQ ID NO: 688312 - RNA, 65 nt, Homo Sapiens
uggguggauaucugccuuccugcugcaaguggaggcagguccagcagccccucuucagagccccu

SEQ ID NO: 688313 - RNA, 65 nt, Homo Sapiens
ugcagcggggauucuguucuccuagguucugggcucagguccagauucuaguuguucggagaaag

SEQ ID NO: 688314 - RNA, 65 nt, Homo Sapiens
auuccagcaucauuuauucuaauacuaaagauccucagguccagauuaaucuguggauuuguuca

SEQ ID NO: 688315 - RNA, 65 nt, Homo Sapiens
ucaaaggucacacguaauagaguaaaaggggcgaucagguccaucccugcacuuguagucuaaaa

SEQ ID NO: 688316 - RNA, 65 nt, Homo Sapiens
ugcagcuccagccaccuuugugccugugcucccagcagguccaaggacacacacuaggcccaagg

SEQ ID NO: 688317 - RNA, 65 nt, Homo Sapiens
ggucguacuuaauaaccccaucaacuauuauuugucagguccaaaggaucauucagaaggaugcu

SEQ ID NO: 688318 - RNA, 65 nt, Homo Sapiens
gcagccaggaggggagcgggcccaggagccaggcucagguccagcugguuccucucuggcgccuu

SEQ ID NO: 688319 - RNA, 65 nt, Homo Sapiens
ugguuccucucuggcgccuucugaacccgucucagcagguccacagcaccugggcagaggucaga

SEQ ID NO: 688320 - RNA, 65 nt, Homo Sapiens
aaaguauuuuauucuugcuuuuccaugcuucucuacagguccaaauacugaaugucuccuuuacu

SEQ ID NO: 688321 - RNA, 65 nt, Homo Sapiens
gcaaacaucacagaccccacggcuggaugauuuugcagguccaauccugaaaaaugaagaaacag

SEQ ID NO: 688322 - RNA, 65 nt, Homo Sapiens
guaguuucuuucugucugcuaagucacguuguuuucagguccagaagaaaauucuaaugauuggc

SEQ ID NO: 688323 - RNA, 65 nt, Homo Sapiens
guuguucaccagugcuugcuguagaaaugauucaccagguccaaugacaaaugcauuuaguggug

SEQ ID NO: 688324 - RNA, 65 nt, Homo Sapiens
cucgggcccuagcucuguaggacgagacgcggacgcagguccacccaaaaagagcuuccuuucgu

SEQ ID NO: 688325 - RNA, 65 nt, Homo Sapiens
aauaugcuuauaacacuaguaucacuuuucccuaccagguccauuaugggcugcagucuucuucc

SEQ ID NO: 688326 - RNA, 65 nt, Homo Sapiens
uuugguugguguagagaccauuggcugagacccaccagguccaguaacaucuggcugcguugcca

SEQ ID NO: 688327 - RNA, 65 nt, Homo Sapiens
gagguuggcagacaagugccuguuuacagcauuuccagguccagaggcagaaggugggccccgug

SEQ ID NO: 688328 - RNA, 65 nt, Homo Sapiens
ugggcauggaaugcugaugaccgaaagucugggaccagguccagggccccaggcugagggcuucc

SEQ ID NO: 688329 - RNA, 65 nt, Homo Sapiens
ggauccuugugggccuucuaagaugaagccacccucagguccagggaagguugugcugguauuug

SEQ ID NO: 688330 - RNA, 65 nt, Homo Sapiens
gacuagaaaggacauugcuuucucagccccacccccagguccacaguguccaagguaauggcaca

SEQ ID NO: 688331 - RNA, 65 nt, Homo Sapiens
uuucuaucguccgcugaccucuggccacaggaagccagguccaccgcccaccacccuuucaggcc

SEQ ID NO: 688332 - RNA, 65 nt, Homo Sapiens
cugggcucagguuccaagacacugagcgccuuugccagguccagcugacacaaggcacuccuacc

SEQ ID NO: 688333 - RNA, 65 nt, Homo Sapiens
gagaccgaggagggagaguccugcccacagcaggccagguccagacucuacccugcauggcugag

SEQ ID NO: 688334 - RNA, 65 nt, Homo Sapiens
ccuucugaaaagcagcuguucccugacaaggguaccagguccaccgccaggggauugacuugguu

SEQ ID NO: 688335 - RNA, 65 nt, Homo Sapiens
gcacaucaggcggacugagcccugaggagacaaggcagguccagcgaaagugucaucacgggucc

SEQ ID NO: 688336 - RNA, 65 nt, Homo Sapiens
ccuauguccagggcaccaggccuuuuuugggcagucagguccacauucagccaaggcugggccag

SEQ ID NO: 688337 - RNA, 65 nt, Homo Sapiens
cagcauggguggcaggguuucccccgucuccauggcagguccauagugggugggcagggcuugga

SEQ ID NO: 688338 - RNA, 65 nt, Homo Sapiens
cggugugggugggcagggcugccuguccucuguggcagguccacaaggaagccaacccugagcga

SEQ ID NO: 688339 - RNA, 65 nt, Homo Sapiens
aaguuggcugggugguccgcacccuggcucuccugcagguccacacaccuuccaggccuguggcc

SEQ ID NO: 688340 - RNA, 65 nt, Homo Sapiens
ucaagaaagcaaagugauuuugucugcuccuagagcagguccauaccaaguaauagaggcacuuu

SEQ ID NO: 688341 - RNA, 65 nt, Homo Sapiens
uuuuucagaucaccaucuaaguuacaucuuuagcucagguccauccuucucaagaucuccuucuu

SEQ ID NO: 688342 - RNA, 65 nt, Homo Sapiens
ccaaacccuuucucuuucucccaggcagggcucugcagguccauaugggcucaaugucaccaccc

SEQ ID NO: 688343 - RNA, 65 nt, Homo Sapiens
uggcacaaucuuggcucacugcaaccuccaccucccagguccaagcgauucucuugccucagccu

SEQ ID NO: 688344 - RNA, 65 nt, Homo Sapiens
cugaacccaucuuuugaaauguauuuucuucauugcagguccaccuaaucauccugugaaagugg

SEQ ID NO: 688345 - RNA, 65 nt, Homo Sapiens
gggcugauuucgcgcagccuguuguuuuccuuagacagguccacgucccucuccugaggcugugg

SEQ ID NO: 688346 - RNA, 65 nt, Homo Sapiens
agcccaccuauagcaggaagagagccggcucagagcagguccaccacagugcuaggacgggaggc

SEQ ID NO: 688347 - RNA, 65 nt, Homo Sapiens
gcagggcccacaagggggauugcuucccuaaggggcagguccagacauaccagcaaaaugccccc

SEQ ID NO: 688348 - RNA, 65 nt, Homo Sapiens
guuguuagaucuucuggguuguugcugccacucuacagguccaggauacugcugaguucuggucu

SEQ ID NO: 688349 - RNA, 65 nt, Homo Sapiens
gaaccuggcaugcaauggacaaggagcaaggccaccagguccagaugaagagacaugaguucugg

SEQ ID NO: 688350 - RNA, 54 nt, Homo Sapiens; identical to SEQ ID NO: 688117

SEQ ID NO: 688351 - RNA, 65 nt, Homo Sapiens
gaacuacugcagcccagagggagcguggcagccaccagguccacacagccucucaccggcucccc

SEQ ID NO: 688352 - RNA, 65 nt, Homo Sapiens
cuguguuuggcuuucagggaagagccaaggggcuucagguccagguggauuccccaucucaggcc

SEQ ID NO: 688353 - RNA, 65 nt, Homo Sapiens
ucaaugaggccuucaccuuccuggugcccuucagccagguccagaauguggaccuggugcuggcu

SEQ ID NO: 688354 - RNA, 65 nt, Homo Sapiens
gcucccuaggcgucccaucucgcuuccugggucugcagguccagccggcuggcacccuccaugua

SEQ ID NO: 688355 - RNA, 65 nt, Homo Sapiens
ucuucagcaccaguggaaacacaugaacuucgaugcagguccagagaccauggacacucccacga

SEQ ID NO: 688356 - RNA, 65 nt, Homo Sapiens
aaugaagguugggaagguuguucccuucccggugccagguccagauuucccuccaugauuuggga

SEQ ID NO: 688357 - RNA, 65 nt, Homo Sapiens
agguauuuugccuguuccaaucaaaccaccccauucagguccaucagccucugauuaauauccgu

SEQ ID NO: 688358 - RNA, 65 nt, Homo Sapiens
acucuuuuuguuuuuuguguuuuguucuuuaaagucagguccaauuuguaaaaacagcauugcuu

SEQ ID NO: 688359 - RNA, 65 nt, Homo Sapiens
ugguggauagcaucacaagaaacgagccugaaaaucagguccagccgguccaagcacauggccuc

SEQ ID NO: 688360 - RNA, 65 nt, Homo Sapiens
agggugggugggacccccugcugcagggcagaguucagguccacugggcugaguguccccuuggg

SEQ ID NO: 688361 - RNA, 65 nt, Homo Sapiens
guggggagaaauaugaaggaucacugaccugugaccagguccaaugaccacagaagcccuguugc

SEQ ID NO: 688362 - RNA, 65 nt, Homo Sapiens
uguuaaacguuuauaaaaccucauugauuccaucucagguccagacaacacaauaaaaucgaaau

SEQ ID NO: 688363 - RNA, 65 nt, Homo Sapiens
guccaagcccugguggguagccaaccuagcuggggcagguccagagccaugcagucccagaaacc

SEQ ID NO: 688364 - RNA, 65 nt, Homo Sapiens
ggggcuggcaucccagcuccaagagcguguucugccagguccaugagaagcccuguggggcuguc

SEQ ID NO: 688365 - RNA, 65 nt, Homo Sapiens
uucaacuauucuuaagcaguuaaguauggugcucucagguccaagccuaaauauacuuagauuuc

SEQ ID NO: 688366 - RNA, 65 nt, Homo Sapiens
acuaacucugaagaaguuauauuagcuacucugaccagguccagucauucaacaaucauauacug

SEQ ID NO: 688367 - RNA, 65 nt, Homo Sapiens
aggauaguuccaggccauagauugaaaauacugggcagguccaaaucagguuaagcagacagaca

SEQ ID NO: 688368 - RNA, 65 nt, Homo Sapiens
gcuuccucuggggcugacaacggcccaccaucggccagguccagcccagccuggugcuguccucu

SEQ ID NO: 688369 - RNA, 65 nt, Homo Sapiens
ugugacauccuucagcacccauuuuaauuaagugacagguccaaguagucaauaucucguguuuc

SEQ ID NO: 688370 - RNA, 65 nt, Homo Sapiens
uggucuguuucuuccccuccuacgaguaccugcgccagguccaugcccacugggagaaggguggc

SEQ ID NO: 688371 - RNA, 65 nt, Homo Sapiens
cagccccuuaaggcccuccuuuucccuccaugcuccagguccaugcacagguguagcauguccug

SEQ ID NO: 688372 - RNA, 65 nt, Homo Sapiens
ucuuuauuucuuuuuuuuuuuuaaauaguaagucacagguccacacuguguaaacaugcaucuga

SEQ ID NO: 688373 - RNA, 65 nt, Homo Sapiens
uggugcaaucucugcucacugcaacaucugccucccagguccaagcgauucuccugccucagccu

SEQ ID NO: 688374 - RNA, 65 nt, Homo Sapiens
gccuguuucucucugcccucuagagcaaggcccaccagguccauccaggaggcucuccugaccuc

SEQ ID NO: 688375 - RNA, 65 nt, Homo Sapiens
ucuaagagaauaagcauuuccuguucuuccagcuccagguccaccuccuguugggaggcgguggg

SEQ ID NO: 688376 - RNA, 65 nt, Homo Sapiens
cugcaccucuuggcucggguagggacagauagaugcagguccauugggcaggaacagagggugaa

SEQ ID NO: 688377 - RNA, 65 nt, Homo Sapiens
gcaggcaauaaauaugugaugcaguaucccaacugcagguccaguuggacucugucuuguucacu

SEQ ID NO: 688378 - RNA, 65 nt, Homo Sapiens
ccugguuccuguguguuuggauccuccagccccagcagguccacuucccugcuuccuauuucaua

SEQ ID NO: 688379 - RNA, 65 nt, Homo Sapiens
agccaccccugcugaugaugagcaagugccugcugcagguccaaacacagcauccagggcuuugc

SEQ ID NO: 688380 - RNA, 65 nt, Homo Sapiens
cggagcucgucgcauuuguuauaaauguaguaaggcagguccaagcacuuacaaguuuuuuguag

SEQ ID NO: 688381 - RNA, 65 nt, Homo Sapiens
cgccaugacaaaacuauaauacacaauugacuggacagguccacguuaccaaagggcacugaaac

SEQ ID NO: 688382 - RNA, 65 nt, Homo Sapiens
auuucauuuuaauuaauuauucuauugaaauuguacagguccauauauuauccuauccauccaua

SEQ ID NO: 688383 - RNA, 65 nt, Homo Sapiens
aguuggugcuuuggaucagggaagccacuuugggacagguccauaaagugaacugaucuuaccga

SEQ ID NO: 688384 - RNA, 65 nt, Homo Sapiens
ugaaccuaauugaaagaaaaccaucugaauuguugcagguccacauuuuugccaaagauacacuc

SEQ ID NO: 688385 - RNA, 62 nt, Homo Sapiens
gccugaugcaguccuccugaccguuccuaccgcagguccagggccugggcccgcggacccca

SEQ ID NO: 688386 - RNA, 65 nt, Homo Sapiens
gggauguuccaguggaugagggccaccaggaagcacagguccaaggcuggucccacacuuaucag

SEQ ID NO: 688387 - RNA, 65 nt, Homo Sapiens
ugcacagcccaguggcuuaaacaccauuuauaccacagguccagaugaauccugcagggccaagg

SEQ ID NO: 688388 - RNA, 65 nt, Homo Sapiens
uugguauacauuccacccucuuaauacugaacuugcagguccaggcuaaguuaaaucuaauauug

SEQ ID NO: 688389 - RNA, 65 nt, Homo Sapiens
uauguaaaaucauuucucucuaaaguuuuaaguggcagguccagauuuuuccugcauucuguaca

SEQ ID NO: 688390 - RNA, 65 nt, Homo Sapiens
gccaccacguggcuggccccccucaugagccgagccagguccauguggcaguggcagcacgucuu

SEQ ID NO: 688391 - RNA, 65 nt, Homo Sapiens
uccuggcaaccgcgggcucacuucccauacuacugcagguccaacgucgguauuuaggccgugag

SEQ ID NO: 688392 - RNA, 65 nt, Homo Sapiens
gagugagaaagggaggguggagggugaggccaaaucagguccagcaaaagucaguagggacauug

SEQ ID NO: 688393 - RNA, 65 nt, Homo Sapiens
gguuaccauggguguggauggcaguguggggagggcagguccagcucugugggcccuacccuccu

SEQ ID NO: 688394 - RNA, 65 nt, Homo Sapiens
uuaucuggaucucugugguuccuucucagccgaaacagguccaguaucccagucauuucuucaaa

SEQ ID NO: 688395 - RNA, 65 nt, Homo Sapiens
gcuugaggggucugcaguccaguagggcaggcagucagguccaugugcacugcaaugccaggugg

SEQ ID NO: 688396 - RNA, 65 nt, Homo Sapiens
gcaguaggcuuaggaugcagaagaucuucucccagcagguccauauaucagaaaccaagcuuaug

SEQ ID NO: 688397 - RNA, 65 nt, Homo Sapiens
caguguaggagcagauguuuucuggcugggaagcccagguccacaacuaggugaaguugugacca

SEQ ID NO: 688398 - RNA, 65 nt, Homo Sapiens
guccagagcacugccccaugcccacccuguguacccagguccagaggguccguccaccacagcag

SEQ ID NO: 688399 - RNA, 65 nt, Homo Sapiens
gcaaaacaguccuugcccuggggccgguucuuacccagguccagagaaaccaacgcgggauguca

SEQ ID NO: 688400 - RNA, 65 nt, Homo Sapiens
ucacuacauuauaaaugucucuuuaaugucacaggcagguccaggguuugaguucauacccuguu

SEQ ID NO: 688401 - RNA, 65 nt, Homo Sapiens
caguuuuuuugcugaggguuucugucugggccuaucagguccauacuuagacccugagcaucuuc

SEQ ID NO: 688402 - RNA, 65 nt, Homo Sapiens
ccuggccuuaaagccgagcucaguuaccauagggacagguccaccucuacugggcccucaugcuu

SEQ ID NO: 688403 - RNA, 65 nt, Homo Sapiens
agauagaucauagaucacguuacaagcacuuggcucagguccagcaaggacagaugaacaaauuc

SEQ ID NO: 688404 - RNA, 65 nt, Homo Sapiens
cuuucugguuugccauaggcccugccaagauacugcagguccauccaggccucugcuaucugcau

SEQ ID NO: 688405 - RNA, 65 nt, Homo Sapiens
cccguucagucugaaugcugccacaaccagccaggcagguccacagagagggagagcagagaaag

SEQ ID NO: 688406 - RNA, 65 nt, Homo Sapiens
cacgcugggggcuguaaucacaagacggacccacacagguccacccauguucaacgagggaaccc

SEQ ID NO: 688407 - RNA, 65 nt, Homo Sapiens
gguugggcagccagucuggggccuuacucaggccucagguccauggaggggaaagcagcucccag

SEQ ID NO: 688408 - RNA, 65 nt, Homo Sapiens
gcaggcuugcuuucuuuuauauaucguggggcugacagguccacggcuguggcccaugccgacag

SEQ ID NO: 688409 - RNA, 65 nt, Homo Sapiens
ccauccuggacagaaaggcaggagcucugaguccucagguccacccauuucccucauggggaucc

SEQ ID NO: 688410 - RNA, 65 nt, Homo Sapiens
agaugcuguccccucacccccucuccuguauuucucagguccaguucaaaucuaaaauucuacuu

SEQ ID NO: 688411 - RNA, 65 nt, Homo Sapiens
ccagccacggagggaggcaccaugcaaaugucuuccagguccaaacccuucaacuccuggcuccg

SEQ ID NO: 688412 - RNA, 65 nt, Homo Sapiens
uucuggaccagcacugacagccuagccagugguuccagguccagcccugacuucauccucccuuc

SEQ ID NO: 688413 - RNA, 65 nt, Homo Sapiens
uaggauggaggacuuuggaagaggcgcuccuuggccagguccaaugaguaacaucagacugacag

SEQ ID NO: 688414 - RNA, 65 nt, Homo Sapiens
uggcuguuauggugcugguaauaagccucgcagcccagguccagagcccccggcgagccgguccc

SEQ ID NO: 688415 - RNA, 65 nt, Homo Sapiens
agugugucccaaggaaaacccaaaguggaggugcucagguccaggggaguccagugggcaggacc

SEQ ID NO: 688416 - RNA, 65 nt, Homo Sapiens
ugcugggguccaagaaccaacaacccuggcagacccagguccaaccucauuccugaugucucagg

SEQ ID NO: 688417 - RNA, 65 nt, Homo Sapiens
gucaccaugaggccacccugagugggaccagauuccagguccaaaguccacacugcugcccgugc

SEQ ID NO: 688418 - RNA, 65 nt, Homo Sapiens
uuggcccugacuccugcggggagucauuguaagcacagguccaaccagguggggaaaaggcccgu

SEQ ID NO: 688419 - RNA, 65 nt, Homo Sapiens
gagccccugaccccugucuggagcuucuggggaugcagguccacccaggugacacggaguggcuu

SEQ ID NO: 688420 - RNA, 65 nt, Homo Sapiens
uagcccacuugcaucagggcgguuuucugucuagccagguccagguccuugaccuugguccauuu

SEQ ID NO: 688421 - RNA, 65 nt, Homo Sapiens
gcagagauccugaaaagauaagucucuccauucuccagguccaaguugggacgugauaggagcaa

SEQ ID NO: 688422 - RNA, 65 nt, Homo Sapiens
cccaucugucuuguuuccuccaucuuuaaucacgccagguccagggcgaagauggauccacguuu

SEQ ID NO: 688423 - RNA, 65 nt, Homo Sapiens
gacaccccaccaccuaggcaaacugccccccaacacagguccacagugcccaagucaggguccag

SEQ ID NO: 688424 - RNA, 65 nt, Homo Sapiens
uugugucaagaaccuagugccuguccccuuaaacacagguccacgucuguuccuucuagggccac

SEQ ID NO: 688425 - RNA, 65 nt, Homo Sapiens
gucuccccuccccucauuuguggccuccgagcccccagguccaccuggagggaaaugcccugguc

SEQ ID NO: 688426 - RNA, 65 nt, Homo Sapiens
gggcuggcgacacacuuaccgcaucaaucuguguucagguccaggguuacauaauugcagaagca

SEQ ID NO: 688427 - RNA, 54 nt, Homo Sapiens; identical to SEQ ID NO: 688194

SEQ ID NO: 688428 - RNA, 65 nt, Homo Sapiens
cgguggcccaggcuccacgugcuuacugaggacaucagguccaccucuggaccccuuggcaggcc

SEQ ID NO: 688429 - RNA, 65 nt, Homo Sapiens
cugugaaccacuaggaugugaucugcccuugugggcagguccagcauaguuaggaguuaggcuuu

SEQ ID NO: 688430 - RNA, 65 nt, Homo Sapiens
uaggaugggacguuuuucuucuugggcccgguccacagguccaaggacacccucccuccaggguc

SEQ ID NO: 688431 - RNA, 65 nt, Homo Sapiens
auaaucaugcauaucacauaagaccagaaguggcccagguccagggucaguuaauuuagcggcuc

SEQ ID NO: 688432 - RNA, 65 nt, Homo Sapiens
ggcacggccuggcauuucacgcauugcugccaccccagguccaccugucuccacuuucacagccu

SEQ ID NO: 688433 - RNA, 65 nt, Homo Sapiens
cuaucggcucucaucccuugggauaagccccaguccagguccaggaggcucccucccugcccagc

SEQ ID NO: 688434 - RNA, 65 nt, Homo Sapiens
aaacgcccucugcgcccaggagcggcugggaaggacagguccaauagcgcugaaccuggacaagc

SEQ ID NO: 688435 - RNA, 65 nt, Homo Sapiens
uucaagcccaggaccaccacagcucagaguucagacagguccaaguucucaccucagggguuaag

SEQ ID NO: 688436 - RNA, 65 nt, Homo Sapiens
aacaauaucaaaagugguuuugccuccucagccagcagguccagaucuucaucuucuuggucuac

SEQ ID NO: 688437 - RNA, 65 nt, Homo Sapiens
augggggacggcccagcgugcccggccuuuuagcucagguccacccgcagacggccacgcccaca

SEQ ID NO: 688438 - RNA, 65 nt, Homo Sapiens
gcuccucccugagcgcaccggcccuuccugucacccagguccacccucaguacucaagcugcagu

SEQ ID NO: 688439 - RNA, 65 nt, Homo Sapiens
gggacucuucuggggacacuugggguccacaaucccagguccauacucuagguuuuggauaccau

SEQ ID NO: 688440 - RNA, 65 nt, Homo Sapiens
uuuuacuuuugcauaggaaauacuugauuuaauuacagguccagggaugagcugaugguugcugg

SEQ ID NO: 688441 - RNA, 65 nt, Homo Sapiens
uaacuaugcagaguuguuuggacuucuuccugugccagguccaagucgggggaccugaagaauca

SEQ ID NO: 688442 - RNA, 65 nt, Homo Sapiens
uucaggaggaaaaacacaguccuagggacaaaagccagguccacagcagucauuuuuaaaauaaa

SEQ ID NO: 688443 - RNA, 65 nt, Homo Sapiens
agaugcuggaucuuggguuccaggcagacaucauccagguccaucuggaacuuucagugauagcu

SEQ ID NO: 688444 - RNA, 65 nt, Homo Sapiens
accaccucucaaccauuacucacacuuccagcgcccagguccaagucugagccugaccuccccuu

SEQ ID NO: 688445 - RNA, 65 nt, Homo Sapiens
ccagccugggcaacacagcaaucaccagaggccagcagguccacaugggaagccgggguaggagg

SEQ ID NO: 688446 - RNA, 65 nt, Homo Sapiens
acucagcuuucugcuucagcucaucaggaacugagcagguccagggucuagguucacuugguuug

SEQ ID NO: 688447 - RNA, 65 nt, Homo Sapiens
gguucuucagcccaugacagugugugcuugguuuacagguccagucuggucuguggacuuauacc

SEQ ID NO: 688448 - RNA, 65 nt, Homo Sapiens
gagacagacucugaaugggagaccaguggcaggcacagguccaggugcugcccgucugcugaugu

SEQ ID NO: 688449 - RNA, 65 nt, Homo Sapiens
agcaugaaguuggccaagccccuugagagccaugacagguccaucccagagaaggcucccuaaga

SEQ ID NO: 688450 - RNA, 65 nt, Homo Sapiens
uuguaaacuugaaagcaagaccuugauugcaccaacagguccagaguaugagugcaagcaaagca

SEQ ID NO: 688451 - RNA, 65 nt, Homo Sapiens
ccucccaaguaggugggauuacagguacucaccaccagguccagcuaacuuuuguauuuuuagua

SEQ ID NO: 688452 - RNA, 65 nt, Homo Sapiens
ggcgcccguagugauaagcacaccggcacgaacgucagguccauuccucgaagucggagcccuca

SEQ ID NO: 688453 - RNA, 65 nt, Homo Sapiens
gcguggagccacgggaucagcugagucaugagucucagguccagguggagucuguagguugccag

SEQ ID NO: 688454 - RNA, 65 nt, Homo Sapiens
uccagcagcugguccaacaggcugcugagggguagcagguccaucacuugucuugugguggggag

SEQ ID NO: 688455 - RNA, 65 nt, Homo Sapiens
ggcaggacuuccuccaacccguuuaguugcuaccucagguccacauuuuuugauuaacucuaaga

SEQ ID NO: 688456 - RNA, 65 nt, Homo Sapiens
gaaagguuuggccugacgcuaaguggcagguuuuccagguccacgugcauuguaaaaagagaaga

SEQ ID NO: 688457 - RNA, 65 nt, Homo Sapiens
ccucaggcugcucucaccguggccuguccacgguccagguccaucucagcagcgugagggugcac

SEQ ID NO: 688458 - RNA, 65 nt, Homo Sapiens
aguuccuuggaggcccccauccaggccagaaggaccagguccacccagcagcuguuugcccagag

SEQ ID NO: 688459 - RNA, 65 nt, Homo Sapiens
ugucuucugugcagcuagggcugcagagcuguauucagguccaagguucugcccuuccuugagug

SEQ ID NO: 688460 - RNA, 57 nt, Homo Sapiens; identical to SEQ ID NO: 688227

SEQ ID NO: 688461 - RNA, 65 nt, Homo Sapiens
ggguggaaggcccuggcaggcuucugaauuccuaucagguccagaccccacucaggaaaccuuga

SEQ ID NO: 688462 - RNA, 65 nt, Homo Sapiens
gccuccuccacagccucagcugacagacaccagaccagguccaggaaggacugggcaccugccuc

SEQ ID NO: 688463 - RNA, 65 nt, Homo Sapiens
cugccgcugaugagacugcuuuccccguggacccccagguccaguugcuuccccgggccuucgcc

SEQ ID NO: 688464 - RNA, 65 nt, Homo Sapiens
uagaguguuuggucggguucacagugaccgagagucagguccagcacacaccugggaaagggaug

SEQ ID NO: 688465 - RNA, 65 nt, Homo Sapiens
cacagcucagaagcagcagaacugacauugggacccagguccauuggaggcaucuuuuaguuaug

SEQ ID NO: 688466 - RNA, 65 nt, Homo Sapiens
ugucuaggcacugagcagggaucugcccccuaguucagguccaaauucaccuuccccuaaacccc

SEQ ID NO: 688467 - RNA, 65 nt, Homo Sapiens
gaagguaaccuuuguuggaugugggccuuagccuccagguccagacuacuacucuauguucucca

SEQ ID NO: 688468 - RNA, 65 nt, Homo Sapiens
gcuagaauccaccuuuuagguaugagaaauguguucagguccagauaugguuucuccuauaauuu

SEQ ID NO: 688469 - RNA, 65 nt, Homo Sapiens
gaugcaaacuugugugauuauuaaagccagccaugcagguccaugauagaaacagcaggugauga

SEQ ID NO: 688470 - RNA, 65 nt, Homo Sapiens
aaccaagaccaccuggcaacaggcucagugggggucagguccagguccccgaagaggugcuggag

SEQ ID NO: 688471 - RNA, 65 nt, Homo Sapiens
auauucauacuauguguuuguuaaaaaaccauucacagguccacaauuuuuaggggaagugagau

SEQ ID NO: 688472 - RNA, 65 nt, Homo Sapiens
auagaucauugcagaaagucuuucaguggucugcccagguccaugugcaaaguauuuuuccugcc

SEQ ID NO: 688473 - RNA, 65 nt, Homo Sapiens
ccuggcgagggcaggucagacccuguccucuucugcagguccagccagaagcuggguuuaugagu

SEQ ID NO: 688474 - RNA, 65 nt, Homo Sapiens
uagagcuaagauuugaacccagggugucugacucccagguccaugcuccagagucagauauagaa

SEQ ID NO: 688475 - RNA, 64 nt, Homo Sapiens; identical to SEQ ID NO: 108382

SEQ ID NO: 688476 - RNA, 64 nt, Homo Sapiens; identical to SEQ ID NO: 108383

SEQ ID NO: 688477 - RNA, 64 nt, Homo Sapiens; identical to SEQ ID NO: 108384

SEQ ID NO: 688478 - RNA, 64 nt, Homo Sapiens; identical to SEQ ID NO: 108385

SEQ ID NO: 688479 - RNA, 64 nt, Homo Sapiens; identical to SEQ ID NO: 108386

SEQ ID NO: 688480 - RNA, 64 nt, Homo Sapiens; identical to SEQ ID NO: 108387

SEQ ID NO: 688481 - RNA, 64 nt, Homo Sapiens; identical to SEQ ID NO: 108388

SEQ ID NO: 688482 - RNA, 64 nt, Homo Sapiens; identical to SEQ ID NO: 108389

SEQ ID NO: 688483 - RNA, 64 nt, Homo Sapiens; identical to SEQ ID NO: 108390

SEQ ID NO: 688484 - RNA, 64 nt, Homo Sapiens; identical to SEQ ID NO: 108391

SEQ ID NO: 688485 - RNA, 64 nt, Homo Sapiens; identical to SEQ ID NO: 108392

SEQ ID NO: 688486 - RNA, 64 nt, Homo Sapiens; identical to SEQ ID NO: 108393

SEQ ID NO: 688487 - RNA, 64 nt, Homo Sapiens; identical to SEQ ID NO: 108394

SEQ ID NO: 688488 - RNA, 64 nt, Homo Sapiens; identical to SEQ ID NO: 108395

SEQ ID NO: 688489 - RNA, 64 nt, Homo Sapiens; identical to SEQ ID NO: 73453

SEQ ID NO: 688490 - RNA, 64 nt, Homo Sapiens; identical to SEQ ID NO: 73454

SEQ ID NO: 688491 - RNA, 64 nt, Homo Sapiens; identical to SEQ ID NO: 73455

SEQ ID NO: 688492 - RNA, 64 nt, Homo Sapiens; identical to SEQ ID NO: 73456

SEQ ID NO: 688493 - RNA, 64 nt, Homo Sapiens; identical to SEQ ID NO: 73457

SEQ ID NO: 688494 - RNA, 64 nt, Homo Sapiens; identical to SEQ ID NO: 73458

SEQ ID NO: 688495 - RNA, 64 nt, Homo Sapiens; identical to SEQ ID NO: 73459

SEQ ID NO: 688496 - RNA, 64 nt, Homo Sapiens; identical to SEQ ID NO: 73460

SEQ ID NO: 688497 - RNA, 64 nt, Homo Sapiens; identical to SEQ ID NO: 73461

SEQ ID NO: 688498 - RNA, 64 nt, Homo Sapiens; identical to SEQ ID NO: 73462

SEQ ID NO: 688499 - RNA, 64 nt, Homo Sapiens; identical to SEQ ID NO: 73463

SEQ ID NO: 688500 - RNA, 64 nt, Homo Sapiens; identical to SEQ ID NO: 73464

SEQ ID NO: 688501 - RNA, 64 nt, Homo Sapiens; identical to SEQ ID NO: 73465

SEQ ID NO: 688502 - RNA, 64 nt, Homo Sapiens; identical to SEQ ID NO: 73466

SEQ ID NO: 688503 - RNA, 64 nt, Homo Sapiens; identical to SEQ ID NO: 73467

SEQ ID NO: 688504 - RNA, 64 nt, Homo Sapiens; identical to SEQ ID NO: 73468

SEQ ID NO: 688505 - RNA, 64 nt, Homo Sapiens; identical to SEQ ID NO: 73469

SEQ ID NO: 688506 - RNA, 64 nt, Homo Sapiens; identical to SEQ ID NO: 73470

SEQ ID NO: 688507 - RNA, 64 nt, Homo Sapiens; identical to SEQ ID NO: 73471

SEQ ID NO: 688508 - RNA, 64 nt, Homo Sapiens; identical to SEQ ID NO: 73472

SEQ ID NO: 688509 - RNA, 64 nt, Homo Sapiens; identical to SEQ ID NO: 73473

SEQ ID NO: 688510 - RNA, 64 nt, Homo Sapiens; identical to SEQ ID NO: 73474

SEQ ID NO: 688511 - RNA, 64 nt, Homo Sapiens; identical to SEQ ID NO: 73475

SEQ ID NO: 688512 - RNA, 64 nt, Homo Sapiens; identical to SEQ ID NO: 73476

SEQ ID NO: 688513 - RNA, 64 nt, Homo Sapiens; identical to SEQ ID NO: 73477

SEQ ID NO: 688514 - RNA, 64 nt, Homo Sapiens; identical to SEQ ID NO: 73478

SEQ ID NO: 688515 - RNA, 64 nt, Homo Sapiens; identical to SEQ ID NO: 73479

SEQ ID NO: 688516 - RNA, 64 nt, Homo Sapiens; identical to SEQ ID NO: 73480

SEQ ID NO: 688517 - RNA, 64 nt, Homo Sapiens; identical to SEQ ID NO: 73481

SEQ ID NO: 688518 - RNA, 64 nt, Homo Sapiens; identical to SEQ ID NO: 73482

SEQ ID NO: 688519 - RNA, 64 nt, Homo Sapiens; identical to SEQ ID NO: 73483

SEQ ID NO: 688520 - RNA, 64 nt, Homo Sapiens; identical to SEQ ID NO: 73484

SEQ ID NO: 688521 - RNA, 64 nt, Homo Sapiens; identical to SEQ ID NO: 73485

SEQ ID NO: 688522 - RNA, 64 nt, Homo Sapiens; identical to SEQ ID NO: 73486

SEQ ID NO: 688523 - RNA, 64 nt, Homo Sapiens; identical to SEQ ID NO: 73487

SEQ ID NO: 688524 - RNA, 64 nt, Homo Sapiens; identical to SEQ ID NO: 73488

SEQ ID NO: 688525 - RNA, 64 nt, Homo Sapiens; identical to SEQ ID NO: 73489

SEQ ID NO: 688526 - RNA, 64 nt, Homo Sapiens; identical to SEQ ID NO: 73490

SEQ ID NO: 688527 - RNA, 64 nt, Homo Sapiens; identical to SEQ ID NO: 73491

SEQ ID NO: 688528 - RNA, 64 nt, Homo Sapiens; identical to SEQ ID NO: 73492

SEQ ID NO: 688529 - RNA, 64 nt, Homo Sapiens; identical to SEQ ID NO: 73493

SEQ ID NO: 688530 - RNA, 64 nt, Homo Sapiens; identical to SEQ ID NO: 73494

SEQ ID NO: 688531 - RNA, 64 nt, Homo Sapiens; identical to SEQ ID NO: 73495

SEQ ID NO: 688532 - RNA, 64 nt, Homo Sapiens; identical to SEQ ID NO: 73496

SEQ ID NO: 688533 - RNA, 64 nt, Homo Sapiens; identical to SEQ ID NO: 73497

SEQ ID NO: 688534 - RNA, 64 nt, Homo Sapiens; identical to SEQ ID NO: 73498

SEQ ID NO: 688535 - RNA, 64 nt, Homo Sapiens; identical to SEQ ID NO: 73499

SEQ ID NO: 688536 - RNA, 64 nt, Homo Sapiens; identical to SEQ ID NO: 73500

SEQ ID NO: 688537 - RNA, 64 nt, Homo Sapiens; identical to SEQ ID NO: 73501

SEQ ID NO: 688538 - RNA, 64 nt, Homo Sapiens; identical to SEQ ID NO: 73502

SEQ ID NO: 688539 - RNA, 64 nt, Homo Sapiens; identical to SEQ ID NO: 73503

SEQ ID NO: 688540 - RNA, 64 nt, Homo Sapiens; identical to SEQ ID NO: 73504

SEQ ID NO: 688541 - RNA, 64 nt, Homo Sapiens; identical to SEQ ID NO: 73505

SEQ ID NO: 688542 - RNA, 64 nt, Homo Sapiens; identical to SEQ ID NO: 73506

SEQ ID NO: 688543 - RNA, 64 nt, Homo Sapiens; identical to SEQ ID NO: 73507

SEQ ID NO: 688544 - RNA, 64 nt, Homo Sapiens; identical to SEQ ID NO: 73508

SEQ ID NO: 688545 - RNA, 64 nt, Homo Sapiens; identical to SEQ ID NO: 73509

SEQ ID NO: 688546 - RNA, 64 nt, Homo Sapiens; identical to SEQ ID NO: 73510

SEQ ID NO: 688547 - RNA, 64 nt, Homo Sapiens; identical to SEQ ID NO: 73511

SEQ ID NO: 688548 - RNA, 64 nt, Homo Sapiens; identical to SEQ ID NO: 73512

SEQ ID NO: 688549 - RNA, 64 nt, Homo Sapiens; identical to SEQ ID NO: 73513

SEQ ID NO: 688550 - RNA, 64 nt, Homo Sapiens; identical to SEQ ID NO: 211561

SEQ ID NO: 688551 - RNA, 64 nt, Homo Sapiens; identical to SEQ ID NO: 211562

SEQ ID NO: 688552 - RNA, 64 nt, Homo Sapiens; identical to SEQ ID NO: 76474

SEQ ID NO: 688553 - RNA, 64 nt, Homo Sapiens; identical to SEQ ID NO: 76475

SEQ ID NO: 688554 - RNA, 64 nt, Homo Sapiens; identical to SEQ ID NO: 76476

SEQ ID NO: 688555 - RNA, 64 nt, Homo Sapiens; identical to SEQ ID NO: 76477

SEQ ID NO: 688556 - RNA, 64 nt, Homo Sapiens; identical to SEQ ID NO: 76478

SEQ ID NO: 688557 - RNA, 64 nt, Homo Sapiens; identical to SEQ ID NO: 76479

SEQ ID NO: 688558 - RNA, 64 nt, Homo Sapiens; identical to SEQ ID NO: 76480

SEQ ID NO: 688559 - RNA, 64 nt, Homo Sapiens; identical to SEQ ID NO: 76481

SEQ ID NO: 688560 - RNA, 64 nt, Homo Sapiens; identical to SEQ ID NO: 76482

SEQ ID NO: 688561 - RNA, 64 nt, Homo Sapiens; identical to SEQ ID NO: 76483

SEQ ID NO: 688562 - RNA, 64 nt, Homo Sapiens; identical to SEQ ID NO: 574716

SEQ ID NO: 688563 - RNA, 64 nt, Homo Sapiens; identical to SEQ ID NO: 574717

SEQ ID NO: 688564 - RNA, 64 nt, Homo Sapiens; identical to SEQ ID NO: 296599

SEQ ID NO: 688565 - RNA, 64 nt, Homo Sapiens; identical to SEQ ID NO: 296600

SEQ ID NO: 688566 - RNA, 64 nt, Homo Sapiens; identical to SEQ ID NO: 296601

SEQ ID NO: 688567 - RNA, 64 nt, Homo Sapiens; identical to SEQ ID NO: 296602

SEQ ID NO: 688568 - RNA, 64 nt, Homo Sapiens; identical to SEQ ID NO: 138992

SEQ ID NO: 688569 - RNA, 64 nt, Homo Sapiens; identical to SEQ ID NO: 138993

SEQ ID NO: 688570 - RNA, 64 nt, Homo Sapiens; identical to SEQ ID NO: 138994

SEQ ID NO: 688571 - RNA, 64 nt, Homo Sapiens; identical to SEQ ID NO: 138995

SEQ ID NO: 688572 - RNA, 64 nt, Homo Sapiens; identical to SEQ ID NO: 138996

SEQ ID NO: 688573 - RNA, 64 nt, Homo Sapiens; identical to SEQ ID NO: 138997

SEQ ID NO: 688574 - RNA, 64 nt, Homo Sapiens; identical to SEQ ID NO: 138998

SEQ ID NO: 688575 - RNA, 64 nt, Homo Sapiens; identical to SEQ ID NO: 138999

SEQ ID NO: 688576 - RNA, 64 nt, Homo Sapiens; identical to SEQ ID NO: 139000

SEQ ID NO: 688577 - RNA, 64 nt, Homo Sapiens; identical to SEQ ID NO: 139001

SEQ ID NO: 688578 - RNA, 64 nt, Homo Sapiens; identical to SEQ ID NO: 139002

SEQ ID NO: 688579 - RNA, 64 nt, Homo Sapiens; identical to SEQ ID NO: 139003

SEQ ID NO: 688580 - RNA, 64 nt, Homo Sapiens; identical to SEQ ID NO: 139004

SEQ ID NO: 688581 - RNA, 64 nt, Homo Sapiens; identical to SEQ ID NO: 139005

SEQ ID NO: 688582 - RNA, 64 nt, Homo Sapiens; identical to SEQ ID NO: 139006

SEQ ID NO: 688583 - RNA, 64 nt, Homo Sapiens; identical to SEQ ID NO: 139007

SEQ ID NO: 688584 - RNA, 64 nt, Homo Sapiens; identical to SEQ ID NO: 139008

SEQ ID NO: 688585 - RNA, 64 nt, Homo Sapiens; identical to SEQ ID NO: 139009

SEQ ID NO: 688586 - RNA, 64 nt, Homo Sapiens; identical to SEQ ID NO: 139010

SEQ ID NO: 688587 - RNA, 64 nt, Homo Sapiens; identical to SEQ ID NO: 139011

SEQ ID NO: 688588 - RNA, 64 nt, Homo Sapiens; identical to SEQ ID NO: 139012

SEQ ID NO: 688589 - RNA, 64 nt, Homo Sapiens; identical to SEQ ID NO: 139013

SEQ ID NO: 688590 - RNA, 64 nt, Homo Sapiens; identical to SEQ ID NO: 139014

SEQ ID NO: 688591 - RNA, 64 nt, Homo Sapiens; identical to SEQ ID NO: 139015

SEQ ID NO: 688592 - RNA, 64 nt, Homo Sapiens; identical to SEQ ID NO: 139016

SEQ ID NO: 688593 - RNA, 64 nt, Homo Sapiens; identical to SEQ ID NO: 139017

SEQ ID NO: 688594 - RNA, 64 nt, Homo Sapiens; identical to SEQ ID NO: 139018

SEQ ID NO: 688595 - RNA, 64 nt, Homo Sapiens; identical to SEQ ID NO: 139019

SEQ ID NO: 688596 - RNA, 64 nt, Homo Sapiens; identical to SEQ ID NO: 139020

SEQ ID NO: 688597 - RNA, 64 nt, Homo Sapiens; identical to SEQ ID NO: 139021

SEQ ID NO: 688598 - RNA, 64 nt, Homo Sapiens; identical to SEQ ID NO: 139022

SEQ ID NO: 688599 - RNA, 64 nt, Homo Sapiens; identical to SEQ ID NO: 139023

SEQ ID NO: 688600 - RNA, 64 nt, Homo Sapiens; identical to SEQ ID NO: 139024

SEQ ID NO: 688601 - RNA, 64 nt, Homo Sapiens; identical to SEQ ID NO: 139025

SEQ ID NO: 688602 - RNA, 64 nt, Homo Sapiens; identical to SEQ ID NO: 139026

SEQ ID NO: 688603 - RNA, 64 nt, Homo Sapiens; identical to SEQ ID NO: 139027

SEQ ID NO: 688604 - RNA, 64 nt, Homo Sapiens; identical to SEQ ID NO: 139028

SEQ ID NO: 688605 - RNA, 61 nt, Homo Sapiens
gcuggacuagagaguacaguagcucuguggaccaagacaaauccaagacacagugaguagg

SEQ ID NO: 688606 - RNA, 61 nt, Homo Sapiens
gugaguaggagcucuguggauauugguugguccaagacacacccuucauucuguagacgug

SEQ ID NO: 688607 - RNA, 61 nt, Homo Sapiens
gguacaaggugacccuuaauaagcuguauuuccaagacaguacaucuuauuuggugucuca

SEQ ID NO: 688608 - RNA, 61 nt, Homo Sapiens
gauggcuucugacaucuuaugucaccuucugccaagacauuuuucauucuucucucuuccu

SEQ ID NO: 688609 - RNA, 61 nt, Homo Sapiens
gccacuacacuccagccugggcugcagugagccaagacaaucuugaaccugggaggcagag

SEQ ID NO: 688610 - RNA, 61 nt, Homo Sapiens
ccccuccccuucccucuguccacuucugaccccaagacagcucuccccuggaaaaccugcu

SEQ ID NO: 688611 - RNA, 64 nt, Homo Sapiens
guccuaaacugucauuuucugacuuucugugauucauaccaacaugugauucauaccaacagag

SEQ ID NO: 688612 - RNA, 64 nt, Homo Sapiens
gaggacuuucugugauucauuacuuucugugauucauaccaacauuuucacuguauauaaacgg

SEQ ID NO: 688613 - RNA, 64 nt, Homo Sapiens
gaaacagaagaaauuaaucuuuuaguuaguugaacauaccaaagcagaggacuggaaucuguuu

SEQ ID NO: 688614 - RNA, 64 nt, Homo Sapiens
acuugaauaguaggauuuuaaagggcauugauagcauaccaaacaaaaggcaaaauaaagugac

SEQ ID NO: 688615 - RNA, 64 nt, Homo Sapiens; identical to SEQ ID NO: 388850

SEQ ID NO: 688616 - RNA, 64 nt, Homo Sapiens; identical to SEQ ID NO: 388851

SEQ ID NO: 688617 - RNA, 64 nt, Homo Sapiens; identical to SEQ ID NO: 388852

SEQ ID NO: 688618 - RNA, 64 nt, Homo Sapiens; identical to SEQ ID NO: 388853

SEQ ID NO: 688619 - RNA, 64 nt, Homo Sapiens; identical to SEQ ID NO: 388854

SEQ ID NO: 688620 - RNA, 64 nt, Homo Sapiens; identical to SEQ ID NO: 388855

SEQ ID NO: 688621 - RNA, 64 nt, Homo Sapiens; identical to SEQ ID NO: 388856

SEQ ID NO: 688622 - RNA, 64 nt, Homo Sapiens; identical to SEQ ID NO: 388857

SEQ ID NO: 688623 - RNA, 64 nt, Homo Sapiens; identical to SEQ ID NO: 388858

SEQ ID NO: 688624 - RNA, 64 nt, Homo Sapiens; identical to SEQ ID NO: 388859

SEQ ID NO: 688625 - RNA, 64 nt, Homo Sapiens; identical to SEQ ID NO: 388860

SEQ ID NO: 688626 - RNA, 64 nt, Homo Sapiens; identical to SEQ ID NO: 388861

SEQ ID NO: 688627 - RNA, 64 nt, Homo Sapiens; identical to SEQ ID NO: 388862

SEQ ID NO: 688628 - RNA, 64 nt, Homo Sapiens; identical to SEQ ID NO: 175595

SEQ ID NO: 688629 - RNA, 64 nt, Homo Sapiens; identical to SEQ ID NO: 175596

SEQ ID NO: 688630 - RNA, 64 nt, Homo Sapiens; identical to SEQ ID NO: 175597

SEQ ID NO: 688631 - RNA, 64 nt, Homo Sapiens; identical to SEQ ID NO: 175598

SEQ ID NO: 688632 - RNA, 64 nt, Homo Sapiens; identical to SEQ ID NO: 175599

SEQ ID NO: 688633 - RNA, 64 nt, Homo Sapiens; identical to SEQ ID NO: 175600

SEQ ID NO: 688634 - RNA, 64 nt, Homo Sapiens; identical to SEQ ID NO: 175601

SEQ ID NO: 688635 - RNA, 64 nt, Homo Sapiens; identical to SEQ ID NO: 175602

SEQ ID NO: 688636 - RNA, 64 nt, Homo Sapiens; identical to SEQ ID NO: 175603

SEQ ID NO: 688637 - RNA, 64 nt, Homo Sapiens; identical to SEQ ID NO: 175604

SEQ ID NO: 688638 - RNA, 64 nt, Homo Sapiens; identical to SEQ ID NO: 175605

SEQ ID NO: 688639 - RNA, 64 nt, Homo Sapiens; identical to SEQ ID NO: 175606

SEQ ID NO: 688640 - RNA, 64 nt, Homo Sapiens; identical to SEQ ID NO: 175607

SEQ ID NO: 688641 - RNA, 64 nt, Homo Sapiens; identical to SEQ ID NO: 175608

SEQ ID NO: 688642 - RNA, 64 nt, Homo Sapiens; identical to SEQ ID NO: 175609

SEQ ID NO: 688643 - RNA, 64 nt, Homo Sapiens; identical to SEQ ID NO: 175610

SEQ ID NO: 688644 - RNA, 64 nt, Homo Sapiens; identical to SEQ ID NO: 175611

SEQ ID NO: 688645 - RNA, 64 nt, Homo Sapiens; identical to SEQ ID NO: 175612

SEQ ID NO: 688646 - RNA, 64 nt, Homo Sapiens; identical to SEQ ID NO: 175613

SEQ ID NO: 688647 - RNA, 64 nt, Homo Sapiens; identical to SEQ ID NO: 175614

SEQ ID NO: 688648 - RNA, 64 nt, Homo Sapiens; identical to SEQ ID NO: 175615

SEQ ID NO: 688649 - RNA, 64 nt, Homo Sapiens; identical to SEQ ID NO: 175616

SEQ ID NO: 688650 - RNA, 64 nt, Homo Sapiens; identical to SEQ ID NO: 175617

SEQ ID NO: 688651 - RNA, 64 nt, Homo Sapiens; identical to SEQ ID NO: 175618

SEQ ID NO: 688652 - RNA, 64 nt, Homo Sapiens; identical to SEQ ID NO: 58312

SEQ ID NO: 688653 - RNA, 64 nt, Homo Sapiens; identical to SEQ ID NO: 58313

SEQ ID NO: 688654 - RNA, 64 nt, Homo Sapiens; identical to SEQ ID NO: 58314

SEQ ID NO: 688655 - RNA, 64 nt, Homo Sapiens; identical to SEQ ID NO: 58315

SEQ ID NO: 688656 - RNA, 64 nt, Homo Sapiens; identical to SEQ ID NO: 58316

SEQ ID NO: 688657 - RNA, 64 nt, Homo Sapiens; identical to SEQ ID NO: 58317

SEQ ID NO: 688658 - RNA, 64 nt, Homo Sapiens; identical to SEQ ID NO: 58318

SEQ ID NO: 688659 - RNA, 64 nt, Homo Sapiens; identical to SEQ ID NO: 58319

SEQ ID NO: 688660 - RNA, 64 nt, Homo Sapiens; identical to SEQ ID NO: 58320

SEQ ID NO: 688661 - RNA, 64 nt, Homo Sapiens; identical to SEQ ID NO: 58321

SEQ ID NO: 688662 - RNA, 64 nt, Homo Sapiens; identical to SEQ ID NO: 58322

SEQ ID NO: 688663 - RNA, 64 nt, Homo Sapiens; identical to SEQ ID NO: 58323

SEQ ID NO: 688664 - RNA, 64 nt, Homo Sapiens; identical to SEQ ID NO: 58324

SEQ ID NO: 688665 - RNA, 64 nt, Homo Sapiens; identical to SEQ ID NO: 58325

SEQ ID NO: 688666 - RNA, 64 nt, Homo Sapiens; identical to SEQ ID NO: 58326

SEQ ID NO: 688667 - RNA, 64 nt, Homo Sapiens; identical to SEQ ID NO: 58327

SEQ ID NO: 688668 - RNA, 64 nt, Homo Sapiens; identical to SEQ ID NO: 58328

SEQ ID NO: 688669 - RNA, 64 nt, Homo Sapiens; identical to SEQ ID NO: 58329

SEQ ID NO: 688670 - RNA, 64 nt, Homo Sapiens; identical to SEQ ID NO: 58330

SEQ ID NO: 688671 - RNA, 64 nt, Homo Sapiens; identical to SEQ ID NO: 58331

SEQ ID NO: 688672 - RNA, 64 nt, Homo Sapiens; identical to SEQ ID NO: 58332

SEQ ID NO: 688673 - RNA, 64 nt, Homo Sapiens; identical to SEQ ID NO: 58333

SEQ ID NO: 688674 - RNA, 64 nt, Homo Sapiens; identical to SEQ ID NO: 58334

SEQ ID NO: 688675 - RNA, 64 nt, Homo Sapiens; identical to SEQ ID NO: 58335

SEQ ID NO: 688676 - RNA, 64 nt, Homo Sapiens; identical to SEQ ID NO: 58336

SEQ ID NO: 688677 - RNA, 64 nt, Homo Sapiens; identical to SEQ ID NO: 58337

SEQ ID NO: 688678 - RNA, 64 nt, Homo Sapiens; identical to SEQ ID NO: 58338

SEQ ID NO: 688679 - RNA, 64 nt, Homo Sapiens; identical to SEQ ID NO: 58339

SEQ ID NO: 688680 - RNA, 64 nt, Homo Sapiens; identical to SEQ ID NO: 58340

SEQ ID NO: 688681 - RNA, 64 nt, Homo Sapiens; identical to SEQ ID NO: 58341

SEQ ID NO: 688682 - RNA, 64 nt, Homo Sapiens; identical to SEQ ID NO: 58342

SEQ ID NO: 688683 - RNA, 64 nt, Homo Sapiens; identical to SEQ ID NO: 58343

SEQ ID NO: 688684 - RNA, 64 nt, Homo Sapiens; identical to SEQ ID NO: 58344

SEQ ID NO: 688685 - RNA, 64 nt, Homo Sapiens; identical to SEQ ID NO: 58345

SEQ ID NO: 688686 - RNA, 64 nt, Homo Sapiens; identical to SEQ ID NO: 58346

SEQ ID NO: 688687 - RNA, 64 nt, Homo Sapiens; identical to SEQ ID NO: 58347

SEQ ID NO: 688688 - RNA, 64 nt, Homo Sapiens; identical to SEQ ID NO: 58348

SEQ ID NO: 688689 - RNA, 64 nt, Homo Sapiens; identical to SEQ ID NO: 58349

SEQ ID NO: 688690 - RNA, 64 nt, Homo Sapiens; identical to SEQ ID NO: 58350

SEQ ID NO: 688691 - RNA, 64 nt, Homo Sapiens; identical to SEQ ID NO: 58351

SEQ ID NO: 688692 - RNA, 64 nt, Homo Sapiens; identical to SEQ ID NO: 58352

SEQ ID NO: 688693 - RNA, 64 nt, Homo Sapiens; identical to SEQ ID NO: 58353

SEQ ID NO: 688694 - RNA, 64 nt, Homo Sapiens; identical to SEQ ID NO: 58354

SEQ ID NO: 688695 - RNA, 64 nt, Homo Sapiens; identical to SEQ ID NO: 58355

SEQ ID NO: 688696 - RNA, 64 nt, Homo Sapiens; identical to SEQ ID NO: 58356

SEQ ID NO: 688697 - RNA, 64 nt, Homo Sapiens; identical to SEQ ID NO: 58357

SEQ ID NO: 688698 - RNA, 64 nt, Homo Sapiens; identical to SEQ ID NO: 58358

SEQ ID NO: 688699 - RNA, 64 nt, Homo Sapiens; identical to SEQ ID NO: 58359

SEQ ID NO: 688700 - RNA, 64 nt, Homo Sapiens; identical to SEQ ID NO: 58360

SEQ ID NO: 688701 - RNA, 64 nt, Homo Sapiens; identical to SEQ ID NO: 58361

SEQ ID NO: 688702 - RNA, 64 nt, Homo Sapiens; identical to SEQ ID NO: 58362

SEQ ID NO: 688703 - RNA, 64 nt, Homo Sapiens; identical to SEQ ID NO: 58363

SEQ ID NO: 688704 - RNA, 64 nt, Homo Sapiens; identical to SEQ ID NO: 58364

SEQ ID NO: 688705 - RNA, 64 nt, Homo Sapiens; identical to SEQ ID NO: 58365

SEQ ID NO: 688706 - RNA, 64 nt, Homo Sapiens; identical to SEQ ID NO: 58366

SEQ ID NO: 688707 - RNA, 64 nt, Homo Sapiens; identical to SEQ ID NO: 58367

SEQ ID NO: 688708 - RNA, 64 nt, Homo Sapiens; identical to SEQ ID NO: 58368

SEQ ID NO: 688709 - RNA, 64 nt, Homo Sapiens; identical to SEQ ID NO: 58369

SEQ ID NO: 688710 - RNA, 64 nt, Homo Sapiens; identical to SEQ ID NO: 58370

SEQ ID NO: 688711 - RNA, 64 nt, Homo Sapiens; identical to SEQ ID NO: 58371

SEQ ID NO: 688712 - RNA, 64 nt, Homo Sapiens; identical to SEQ ID NO: 58372

SEQ ID NO: 688713 - RNA, 64 nt, Homo Sapiens; identical to SEQ ID NO: 58373

SEQ ID NO: 688714 - RNA, 64 nt, Homo Sapiens; identical to SEQ ID NO: 58374

SEQ ID NO: 688715 - RNA, 64 nt, Homo Sapiens; identical to SEQ ID NO: 58375

SEQ ID NO: 688716 - RNA, 64 nt, Homo Sapiens; identical to SEQ ID NO: 58376

SEQ ID NO: 688717 - RNA, 64 nt, Homo Sapiens; identical to SEQ ID NO: 58377

SEQ ID NO: 688718 - RNA, 64 nt, Homo Sapiens; identical to SEQ ID NO: 58378

SEQ ID NO: 688719 - RNA, 64 nt, Homo Sapiens; identical to SEQ ID NO: 58379

SEQ ID NO: 688720 - RNA, 64 nt, Homo Sapiens; identical to SEQ ID NO: 58380

SEQ ID NO: 688721 - RNA, 64 nt, Homo Sapiens; identical to SEQ ID NO: 58381

SEQ ID NO: 688722 - RNA, 64 nt, Homo Sapiens; identical to SEQ ID NO: 58382

SEQ ID NO: 688723 - RNA, 64 nt, Homo Sapiens; identical to SEQ ID NO: 58383

SEQ ID NO: 688724 - RNA, 64 nt, Homo Sapiens; identical to SEQ ID NO: 58384

SEQ ID NO: 688725 - RNA, 64 nt, Homo Sapiens; identical to SEQ ID NO: 58385

SEQ ID NO: 688726 - RNA, 64 nt, Homo Sapiens; identical to SEQ ID NO: 58386

SEQ ID NO: 688727 - RNA, 64 nt, Homo Sapiens; identical to SEQ ID NO: 58387

SEQ ID NO: 688728 - RNA, 64 nt, Homo Sapiens; identical to SEQ ID NO: 58388

SEQ ID NO: 688729 - RNA, 64 nt, Homo Sapiens; identical to SEQ ID NO: 58389

SEQ ID NO: 688730 - RNA, 64 nt, Homo Sapiens; identical to SEQ ID NO: 58390

SEQ ID NO: 688731 - RNA, 64 nt, Homo Sapiens; identical to SEQ ID NO: 58391

SEQ ID NO: 688732 - RNA, 64 nt, Homo Sapiens; identical to SEQ ID NO: 58392

SEQ ID NO: 688733 - RNA, 64 nt, Homo Sapiens; identical to SEQ ID NO: 58393

SEQ ID NO: 688734 - RNA, 64 nt, Homo Sapiens; identical to SEQ ID NO: 58394

SEQ ID NO: 688735 - RNA, 64 nt, Homo Sapiens; identical to SEQ ID NO: 58395

SEQ ID NO: 688736 - RNA, 64 nt, Homo Sapiens; identical to SEQ ID NO: 58396

SEQ ID NO: 688737 - RNA, 64 nt, Homo Sapiens; identical to SEQ ID NO: 58397

SEQ ID NO: 688738 - RNA, 64 nt, Homo Sapiens; identical to SEQ ID NO: 58398

SEQ ID NO: 688739 - RNA, 64 nt, Homo Sapiens; identical to SEQ ID NO: 58399

SEQ ID NO: 688740 - RNA, 64 nt, Homo Sapiens; identical to SEQ ID NO: 58400

SEQ ID NO: 688741 - RNA, 64 nt, Homo Sapiens; identical to SEQ ID NO: 58401

SEQ ID NO: 688742 - RNA, 64 nt, Homo Sapiens; identical to SEQ ID NO: 58402

SEQ ID NO: 688743 - RNA, 64 nt, Homo Sapiens; identical to SEQ ID NO: 58403

SEQ ID NO: 688744 - RNA, 64 nt, Homo Sapiens; identical to SEQ ID NO: 58404

SEQ ID NO: 688745 - RNA, 64 nt, Homo Sapiens; identical to SEQ ID NO: 58405

SEQ ID NO: 688746 - RNA, 64 nt, Homo Sapiens; identical to SEQ ID NO: 58406

SEQ ID NO: 688747 - RNA, 64 nt, Homo Sapiens; identical to SEQ ID NO: 58407

SEQ ID NO: 688748 - RNA, 64 nt, Homo Sapiens; identical to SEQ ID NO: 58408

SEQ ID NO: 688749 - RNA, 64 nt, Homo Sapiens; identical to SEQ ID NO: 58409

SEQ ID NO: 688750 - RNA, 64 nt, Homo Sapiens; identical to SEQ ID NO: 58410

SEQ ID NO: 688751 - RNA, 64 nt, Homo Sapiens; identical to SEQ ID NO: 58411

SEQ ID NO: 688752 - RNA, 64 nt, Homo Sapiens; identical to SEQ ID NO: 58412

SEQ ID NO: 688753 - RNA, 64 nt, Homo Sapiens; identical to SEQ ID NO: 58413

SEQ ID NO: 688754 - RNA, 64 nt, Homo Sapiens; identical to SEQ ID NO: 58414

SEQ ID NO: 688755 - RNA, 64 nt, Homo Sapiens; identical to SEQ ID NO: 58415

SEQ ID NO: 688756 - RNA, 64 nt, Homo Sapiens; identical to SEQ ID NO: 58416

SEQ ID NO: 688757 - RNA, 64 nt, Homo Sapiens; identical to SEQ ID NO: 58417

SEQ ID NO: 688758 - RNA, 64 nt, Homo Sapiens; identical to SEQ ID NO: 58418

SEQ ID NO: 688759 - RNA, 64 nt, Homo Sapiens; identical to SEQ ID NO: 58419

SEQ ID NO: 688760 - RNA, 64 nt, Homo Sapiens; identical to SEQ ID NO: 58420

SEQ ID NO: 688761 - RNA, 64 nt, Homo Sapiens; identical to SEQ ID NO: 58421

SEQ ID NO: 688762 - RNA, 64 nt, Homo Sapiens; identical to SEQ ID NO: 58422

SEQ ID NO: 688763 - RNA, 64 nt, Homo Sapiens; identical to SEQ ID NO: 58423

SEQ ID NO: 688764 - RNA, 64 nt, Homo Sapiens; identical to SEQ ID NO: 58424

SEQ ID NO: 688765 - RNA, 64 nt, Homo Sapiens; identical to SEQ ID NO: 58425

SEQ ID NO: 688766 - RNA, 64 nt, Homo Sapiens; identical to SEQ ID NO: 58426

SEQ ID NO: 688767 - RNA, 64 nt, Homo Sapiens; identical to SEQ ID NO: 58427

SEQ ID NO: 688768 - RNA, 64 nt, Homo Sapiens; identical to SEQ ID NO: 58428

SEQ ID NO: 688769 - RNA, 64 nt, Homo Sapiens; identical to SEQ ID NO: 58429

SEQ ID NO: 688770 - RNA, 64 nt, Homo Sapiens; identical to SEQ ID NO: 58430

SEQ ID NO: 688771 - RNA, 64 nt, Homo Sapiens; identical to SEQ ID NO: 58431

SEQ ID NO: 688772 - RNA, 64 nt, Homo Sapiens; identical to SEQ ID NO: 58432

SEQ ID NO: 688773 - RNA, 64 nt, Homo Sapiens; identical to SEQ ID NO: 58433

SEQ ID NO: 688774 - RNA, 64 nt, Homo Sapiens; identical to SEQ ID NO: 58434

SEQ ID NO: 688775 - RNA, 64 nt, Homo Sapiens; identical to SEQ ID NO: 58435

SEQ ID NO: 688776 - RNA, 50 nt, Homo Sapiens; identical to SEQ ID NO: 58436

SEQ ID NO: 688777 - RNA, 64 nt, Homo Sapiens; identical to SEQ ID NO: 58437

SEQ ID NO: 688778 - RNA, 64 nt, Homo Sapiens; identical to SEQ ID NO: 58438

SEQ ID NO: 688779 - RNA, 64 nt, Homo Sapiens; identical to SEQ ID NO: 58439

SEQ ID NO: 688780 - RNA, 64 nt, Homo Sapiens; identical to SEQ ID NO: 58440

SEQ ID NO: 688781 - RNA, 64 nt, Homo Sapiens; identical to SEQ ID NO: 58441

SEQ ID NO: 688782 - RNA, 64 nt, Homo Sapiens; identical to SEQ ID NO: 58442

SEQ ID NO: 688783 - RNA, 64 nt, Homo Sapiens; identical to SEQ ID NO: 58443

SEQ ID NO: 688784 - RNA, 64 nt, Homo Sapiens; identical to SEQ ID NO: 58444

SEQ ID NO: 688785 - RNA, 64 nt, Homo Sapiens; identical to SEQ ID NO: 58445

SEQ ID NO: 688786 - RNA, 64 nt, Homo Sapiens; identical to SEQ ID NO: 58446

SEQ ID NO: 688787 - RNA, 64 nt, Homo Sapiens; identical to SEQ ID NO: 58447

SEQ ID NO: 688788 - RNA, 64 nt, Homo Sapiens; identical to SEQ ID NO: 58448

SEQ ID NO: 688789 - RNA, 64 nt, Homo Sapiens; identical to SEQ ID NO: 58449

SEQ ID NO: 688790 - RNA, 64 nt, Homo Sapiens; identical to SEQ ID NO: 58450

SEQ ID NO: 688791 - RNA, 64 nt, Homo Sapiens; identical to SEQ ID NO: 58451

SEQ ID NO: 688792 - RNA, 64 nt, Homo Sapiens; identical to SEQ ID NO: 58452

SEQ ID NO: 688793 - RNA, 64 nt, Homo Sapiens; identical to SEQ ID NO: 58453

SEQ ID NO: 688794 - RNA, 64 nt, Homo Sapiens; identical to SEQ ID NO: 58454

SEQ ID NO: 688795 - RNA, 64 nt, Homo Sapiens; identical to SEQ ID NO: 58455

SEQ ID NO: 688796 - RNA, 64 nt, Homo Sapiens; identical to SEQ ID NO: 58456

SEQ ID NO: 688797 - RNA, 64 nt, Homo Sapiens; identical to SEQ ID NO: 58457

SEQ ID NO: 688798 - RNA, 64 nt, Homo Sapiens; identical to SEQ ID NO: 58458

SEQ ID NO: 688799 - RNA, 64 nt, Homo Sapiens; identical to SEQ ID NO: 58459

SEQ ID NO: 688800 - RNA, 64 nt, Homo Sapiens; identical to SEQ ID NO: 58460

SEQ ID NO: 688801 - RNA, 64 nt, Homo Sapiens; identical to SEQ ID NO: 58461

SEQ ID NO: 688802 - RNA, 64 nt, Homo Sapiens; identical to SEQ ID NO: 58462

SEQ ID NO: 688803 - RNA, 64 nt, Homo Sapiens; identical to SEQ ID NO: 58463

SEQ ID NO: 688804 - RNA, 64 nt, Homo Sapiens; identical to SEQ ID NO: 58464

SEQ ID NO: 688805 - RNA, 64 nt, Homo Sapiens; identical to SEQ ID NO: 58465

SEQ ID NO: 688806 - RNA, 64 nt, Homo Sapiens; identical to SEQ ID NO: 58466

SEQ ID NO: 688807 - RNA, 64 nt, Homo Sapiens; identical to SEQ ID NO: 58467

SEQ ID NO: 688808 - RNA, 64 nt, Homo Sapiens; identical to SEQ ID NO: 175573

SEQ ID NO: 688809 - RNA, 64 nt, Homo Sapiens; identical to SEQ ID NO: 175574

SEQ ID NO: 688810 - RNA, 64 nt, Homo Sapiens; identical to SEQ ID NO: 476783

SEQ ID NO: 688811 - RNA, 64 nt, Homo Sapiens; identical to SEQ ID NO: 476784

SEQ ID NO: 688812 - RNA, 64 nt, Homo Sapiens; identical to SEQ ID NO: 476785

SEQ ID NO: 688813 - RNA, 64 nt, Homo Sapiens; identical to SEQ ID NO: 476786

SEQ ID NO: 688814 - RNA, 64 nt, Homo Sapiens; identical to SEQ ID NO: 476787

SEQ ID NO: 688815 - RNA, 64 nt, Homo Sapiens; identical to SEQ ID NO: 476788

SEQ ID NO: 688816 - RNA, 64 nt, Homo Sapiens; identical to SEQ ID NO: 476789

SEQ ID NO: 688817 - RNA, 64 nt, Homo Sapiens; identical to SEQ ID NO: 476789

SEQ ID NO: 688818 - RNA, 64 nt, Homo Sapiens; identical to SEQ ID NO: 354586

SEQ ID NO: 688819 - RNA, 64 nt, Homo Sapiens; identical to SEQ ID NO: 354587

SEQ ID NO: 688820 - RNA, 64 nt, Homo Sapiens; identical to SEQ ID NO: 354588

SEQ ID NO: 688821 - RNA, 64 nt, Homo Sapiens; identical to SEQ ID NO: 354589

SEQ ID NO: 688822 - RNA, 64 nt, Homo Sapiens; identical to SEQ ID NO: 354590

SEQ ID NO: 688823 - RNA, 64 nt, Homo Sapiens; identical to SEQ ID NO: 354591

SEQ ID NO: 688824 - RNA, 61 nt, Homo Sapiens; identical to SEQ ID NO: 354592

SEQ ID NO: 688825 - RNA, 64 nt, Homo Sapiens; identical to SEQ ID NO: 354593

SEQ ID NO: 688826 - RNA, 64 nt, Homo Sapiens; identical to SEQ ID NO: 354594

SEQ ID NO: 688827 - RNA, 64 nt, Homo Sapiens; identical to SEQ ID NO: 354595

SEQ ID NO: 688828 - RNA, 64 nt, Homo Sapiens; identical to SEQ ID NO: 354596

SEQ ID NO: 688829 - RNA, 64 nt, Homo Sapiens; identical to SEQ ID NO: 354597

SEQ ID NO: 688830 - RNA, 64 nt, Homo Sapiens; identical to SEQ ID NO: 354598

SEQ ID NO: 688831 - RNA, 64 nt, Homo Sapiens; identical to SEQ ID NO: 354599

SEQ ID NO: 688832 - RNA, 64 nt, Homo Sapiens; identical to SEQ ID NO: 354600

SEQ ID NO: 688833 - RNA, 64 nt, Homo Sapiens; identical to SEQ ID NO: 354601

SEQ ID NO: 688834 - RNA, 64 nt, Homo Sapiens; identical to SEQ ID NO: 354602

SEQ ID NO: 688835 - RNA, 64 nt, Homo Sapiens; identical to SEQ ID NO: 354603

SEQ ID NO: 688836 - RNA, 64 nt, Homo Sapiens; identical to SEQ ID NO: 354604

SEQ ID NO: 688837 - RNA, 64 nt, Homo Sapiens; identical to SEQ ID NO: 354605

SEQ ID NO: 688838 - RNA, 64 nt, Homo Sapiens; identical to SEQ ID NO: 354606

SEQ ID NO: 688839 - RNA, 64 nt, Homo Sapiens; identical to SEQ ID NO: 354607

SEQ ID NO: 688840 - RNA, 64 nt, Homo Sapiens; identical to SEQ ID NO: 354608

SEQ ID NO: 688841 - RNA, 64 nt, Homo Sapiens; identical to SEQ ID NO: 354609

SEQ ID NO: 688842 - RNA, 64 nt, Homo Sapiens; identical to SEQ ID NO: 354610

SEQ ID NO: 688843 - RNA, 64 nt, Homo Sapiens; identical to SEQ ID NO: 354611

SEQ ID NO: 688844 - RNA, 64 nt, Homo Sapiens; identical to SEQ ID NO: 354612

SEQ ID NO: 688845 - RNA, 64 nt, Homo Sapiens; identical to SEQ ID NO: 354613

SEQ ID NO: 688846 - RNA, 64 nt, Homo Sapiens; identical to SEQ ID NO: 354614

SEQ ID NO: 688847 - RNA, 64 nt, Homo Sapiens; identical to SEQ ID NO: 354615

SEQ ID NO: 688848 - RNA, 64 nt, Homo Sapiens; identical to SEQ ID NO: 354616

SEQ ID NO: 688849 - RNA, 64 nt, Homo Sapiens; identical to SEQ ID NO: 354617

SEQ ID NO: 688850 - RNA, 64 nt, Homo Sapiens; identical to SEQ ID NO: 354618

SEQ ID NO: 688851 - RNA, 64 nt, Homo Sapiens; identical to SEQ ID NO: 354619

SEQ ID NO: 688852 - RNA, 64 nt, Homo Sapiens; identical to SEQ ID NO: 354620

SEQ ID NO: 688853 - RNA, 64 nt, Homo Sapiens; identical to SEQ ID NO: 354621

SEQ ID NO: 688854 - RNA, 64 nt, Homo Sapiens; identical to SEQ ID NO: 354622

SEQ ID NO: 688855 - RNA, 64 nt, Homo Sapiens; identical to SEQ ID NO: 354623

SEQ ID NO: 688856 - RNA, 64 nt, Homo Sapiens; identical to SEQ ID NO: 354624

SEQ ID NO: 688857 - RNA, 64 nt, Homo Sapiens; identical to SEQ ID NO: 354625

SEQ ID NO: 688858 - RNA, 64 nt, Homo Sapiens; identical to SEQ ID NO: 244872

SEQ ID NO: 688859 - RNA, 64 nt, Homo Sapiens; identical to SEQ ID NO: 244873

SEQ ID NO: 688860 - RNA, 64 nt, Homo Sapiens; identical to SEQ ID NO: 244874

SEQ ID NO: 688861 - RNA, 64 nt, Homo Sapiens; identical to SEQ ID NO: 244875

SEQ ID NO: 688862 - RNA, 64 nt, Homo Sapiens; identical to SEQ ID NO: 244876

SEQ ID NO: 688863 - RNA, 64 nt, Homo Sapiens; identical to SEQ ID NO: 244877

SEQ ID NO: 688864 - RNA, 64 nt, Homo Sapiens; identical to SEQ ID NO: 244878

SEQ ID NO: 688865 - RNA, 64 nt, Homo Sapiens; identical to SEQ ID NO: 244879

SEQ ID NO: 688866 - RNA, 64 nt, Homo Sapiens; identical to SEQ ID NO: 244880

SEQ ID NO: 688867 - RNA, 64 nt, Homo Sapiens; identical to SEQ ID NO: 244881

SEQ ID NO: 688868 - RNA, 64 nt, Homo Sapiens; identical to SEQ ID NO: 244882

SEQ ID NO: 688869 - RNA, 64 nt, Homo Sapiens; identical to SEQ ID NO: 244883

SEQ ID NO: 688870 - RNA, 64 nt, Homo Sapiens; identical to SEQ ID NO: 244884

SEQ ID NO: 688871 - RNA, 64 nt, Homo Sapiens; identical to SEQ ID NO: 244885

SEQ ID NO: 688872 - RNA, 64 nt, Homo Sapiens; identical to SEQ ID NO: 244886

SEQ ID NO: 688873 - RNA, 64 nt, Homo Sapiens; identical to SEQ ID NO: 244887

SEQ ID NO: 688874 - RNA, 64 nt, Homo Sapiens; identical to SEQ ID NO: 244888

SEQ ID NO: 688875 - RNA, 64 nt, Homo Sapiens; identical to SEQ ID NO: 244889

SEQ ID NO: 688876 - RNA, 64 nt, Homo Sapiens; identical to SEQ ID NO: 244890

SEQ ID NO: 688877 - RNA, 64 nt, Homo Sapiens; identical to SEQ ID NO: 244891

SEQ ID NO: 688878 - RNA, 64 nt, Homo Sapiens; identical to SEQ ID NO: 244892

SEQ ID NO: 688879 - RNA, 64 nt, Homo Sapiens; identical to SEQ ID NO: 244893

SEQ ID NO: 688880 - RNA, 64 nt, Homo Sapiens; identical to SEQ ID NO: 244894

SEQ ID NO: 688881 - RNA, 64 nt, Homo Sapiens; identical to SEQ ID NO: 244895

SEQ ID NO: 688882 - RNA, 64 nt, Homo Sapiens; identical to SEQ ID NO: 244896

SEQ ID NO: 688883 - RNA, 64 nt, Homo Sapiens; identical to SEQ ID NO: 244897

SEQ ID NO: 688884 - RNA, 64 nt, Homo Sapiens; identical to SEQ ID NO: 244898

SEQ ID NO: 688885 - RNA, 64 nt, Homo Sapiens; identical to SEQ ID NO: 244899

SEQ ID NO: 688886 - RNA, 64 nt, Homo Sapiens; identical to SEQ ID NO: 244900

SEQ ID NO: 688887 - RNA, 64 nt, Homo Sapiens; identical to SEQ ID NO: 244901

SEQ ID NO: 688888 - RNA, 64 nt, Homo Sapiens; identical to SEQ ID NO: 244902

SEQ ID NO: 688889 - RNA, 64 nt, Homo Sapiens; identical to SEQ ID NO: 244903

SEQ ID NO: 688890 - RNA, 64 nt, Homo Sapiens; identical to SEQ ID NO: 244904

SEQ ID NO: 688891 - RNA, 64 nt, Homo Sapiens; identical to SEQ ID NO: 244905

SEQ ID NO: 688892 - RNA, 64 nt, Homo Sapiens; identical to SEQ ID NO: 244906

SEQ ID NO: 688893 - RNA, 64 nt, Homo Sapiens; identical to SEQ ID NO: 244907

SEQ ID NO: 688894 - RNA, 64 nt, Homo Sapiens; identical to SEQ ID NO: 244908

SEQ ID NO: 688895 - RNA, 64 nt, Homo Sapiens
uucaucaauaaucauauaauuucacuauagacauuacuugcauuaucuccuaucaguccuucua

SEQ ID NO: 688896 - RNA, 64 nt, Homo Sapiens
auauaugguagcuauuguuuaaaaaugauugauuuacuugcagauuuuucagaggauguuaugu

SEQ ID NO: 688897 - RNA, 64 nt, Homo Sapiens
ugauuauuuccuuuuuuuuuggaacuacuucagcuacuugcauuuguuugccaucuguugauca

SEQ ID NO: 688898 - RNA, 64 nt, Homo Sapiens
uuauaguucauagcaauuaauaauuuaugaauuuuacuugcaccugcuacacuggauaaaaauc

SEQ ID NO: 688899 - RNA, 64 nt, Homo Sapiens
ccuuucauuaggcaaaguacaaaauugccuauaauacuugcaacuaaggacaaauuagcaugca

SEQ ID NO: 688900 - RNA, 64 nt, Homo Sapiens
ugagaaaaaaaaaaugaaucuauuuaaucauuucuacuugcaguacugcuaugugcuaagcuua

SEQ ID NO: 688901 - RNA, 64 nt, Homo Sapiens; identical to SEQ ID NO: 452644

SEQ ID NO: 688902 - RNA, 64 nt, Homo Sapiens; identical to SEQ ID NO: 452645

SEQ ID NO: 688903 - RNA, 64 nt, Homo Sapiens; identical to SEQ ID NO: 452646

SEQ ID NO: 688904 - RNA, 64 nt, Homo Sapiens; identical to SEQ ID NO: 452647

SEQ ID NO: 688905 - RNA, 64 nt, Homo Sapiens; identical to SEQ ID NO: 452648

SEQ ID NO: 688906 - RNA, 64 nt, Homo Sapiens; identical to SEQ ID NO: 452649

SEQ ID NO: 688907 - RNA, 64 nt, Homo Sapiens; identical to SEQ ID NO: 452650

SEQ ID NO: 688908 - RNA, 64 nt, Homo Sapiens; identical to SEQ ID NO: 452651

SEQ ID NO: 688909 - RNA, 64 nt, Homo Sapiens; identical to SEQ ID NO: 452652

SEQ ID NO: 688910 - RNA, 64 nt, Homo Sapiens; identical to SEQ ID NO: 452653

SEQ ID NO: 688911 - RNA, 64 nt, Homo Sapiens; identical to SEQ ID NO: 452654

SEQ ID NO: 688912 - RNA, 62 nt, Homo Sapiens; identical to SEQ ID NO: 452655

SEQ ID NO: 688913 - RNA, 64 nt, Homo Sapiens; identical to SEQ ID NO: 452656

SEQ ID NO: 688914 - RNA, 64 nt, Homo Sapiens; identical to SEQ ID NO: 452657

SEQ ID NO: 688915 - RNA, 64 nt, Homo Sapiens; identical to SEQ ID NO: 452658

SEQ ID NO: 688916 - RNA, 64 nt, Homo Sapiens; identical to SEQ ID NO: 452659

SEQ ID NO: 688917 - RNA, 64 nt, Homo Sapiens; identical to SEQ ID NO: 452660

SEQ ID NO: 688918 - RNA, 64 nt, Homo Sapiens; identical to SEQ ID NO: 452661

SEQ ID NO: 688919 - RNA, 64 nt, Homo Sapiens; identical to SEQ ID NO: 452662

SEQ ID NO: 688920 - RNA, 64 nt, Homo Sapiens; identical to SEQ ID NO: 452663

SEQ ID NO: 688921 - RNA, 64 nt, Homo Sapiens; identical to SEQ ID NO: 452663

SEQ ID NO: 688922 - RNA, 64 nt, Homo Sapiens; identical to SEQ ID NO: 452665

SEQ ID NO: 688923 - RNA, 64 nt, Homo Sapiens; identical to SEQ ID NO: 452666

SEQ ID NO: 688924 - RNA, 64 nt, Homo Sapiens; identical to SEQ ID NO: 247175

SEQ ID NO: 688925 - RNA, 64 nt, Homo Sapiens; identical to SEQ ID NO: 247176

SEQ ID NO: 688926 - RNA, 64 nt, Homo Sapiens; identical to SEQ ID NO: 247177

SEQ ID NO: 688927 - RNA, 64 nt, Homo Sapiens; identical to SEQ ID NO: 247178

SEQ ID NO: 688928 - RNA, 64 nt, Homo Sapiens; identical to SEQ ID NO: 247179

SEQ ID NO: 688929 - RNA, 64 nt, Homo Sapiens; identical to SEQ ID NO: 247180

SEQ ID NO: 688930 - RNA, 64 nt, Homo Sapiens; identical to SEQ ID NO: 247181

SEQ ID NO: 688931 - RNA, 64 nt, Homo Sapiens; identical to SEQ ID NO: 247182

SEQ ID NO: 688932 - RNA, 64 nt, Homo Sapiens; identical to SEQ ID NO: 247183

SEQ ID NO: 688933 - RNA, 64 nt, Homo Sapiens; identical to SEQ ID NO: 247184

SEQ ID NO: 688934 - RNA, 64 nt, Homo Sapiens; identical to SEQ ID NO: 247185

SEQ ID NO: 688935 - RNA, 64 nt, Homo Sapiens; identical to SEQ ID NO: 247186

SEQ ID NO: 688936 - RNA, 64 nt, Homo Sapiens; identical to SEQ ID NO: 247187

SEQ ID NO: 688937 - RNA, 64 nt, Homo Sapiens; identical to SEQ ID NO: 247188

SEQ ID NO: 688938 - RNA, 64 nt, Homo Sapiens; identical to SEQ ID NO: 247189

SEQ ID NO: 688939 - RNA, 64 nt, Homo Sapiens; identical to SEQ ID NO: 247190

SEQ ID NO: 688940 - RNA, 64 nt, Homo Sapiens; identical to SEQ ID NO: 247191

SEQ ID NO: 688941 - RNA, 64 nt, Homo Sapiens; identical to SEQ ID NO: 247192

SEQ ID NO: 688942 - RNA, 64 nt, Homo Sapiens; identical to SEQ ID NO: 247193

SEQ ID NO: 688943 - RNA, 64 nt, Homo Sapiens; identical to SEQ ID NO: 247194

SEQ ID NO: 688944 - RNA, 64 nt, Homo Sapiens; identical to SEQ ID NO: 247195

SEQ ID NO: 688945 - RNA, 64 nt, Homo Sapiens; identical to SEQ ID NO: 247196

SEQ ID NO: 688946 - RNA, 64 nt, Homo Sapiens; identical to SEQ ID NO: 247197

SEQ ID NO: 688947 - RNA, 64 nt, Homo Sapiens; identical to SEQ ID NO: 247198

SEQ ID NO: 688948 - RNA, 64 nt, Homo Sapiens; identical to SEQ ID NO: 247199

SEQ ID NO: 688949 - RNA, 64 nt, Homo Sapiens; identical to SEQ ID NO: 247200

SEQ ID NO: 688950 - RNA, 64 nt, Homo Sapiens; identical to SEQ ID NO: 247201

SEQ ID NO: 688951 - RNA, 61 nt, Homo Sapiens; identical to SEQ ID NO: 247202

SEQ ID NO: 688952 - RNA, 64 nt, Homo Sapiens; identical to SEQ ID NO: 247203

SEQ ID NO: 688953 - RNA, 64 nt, Homo Sapiens; identical to SEQ ID NO: 247204

SEQ ID NO: 688954 - RNA, 64 nt, Homo Sapiens; identical to SEQ ID NO: 247205

SEQ ID NO: 688955 - RNA, 64 nt, Homo Sapiens; identical to SEQ ID NO: 247206

SEQ ID NO: 688956 - RNA, 64 nt, Homo Sapiens; identical to SEQ ID NO: 247207

SEQ ID NO: 688957 - RNA, 64 nt, Homo Sapiens; identical to SEQ ID NO: 247208

SEQ ID NO: 688958 - RNA, 64 nt, Homo Sapiens; identical to SEQ ID NO: 247209

SEQ ID NO: 688959 - RNA, 64 nt, Homo Sapiens; identical to SEQ ID NO: 247210

SEQ ID NO: 688960 - RNA, 64 nt, Homo Sapiens; identical to SEQ ID NO: 247211

SEQ ID NO: 688961 - RNA, 64 nt, Homo Sapiens; identical to SEQ ID NO: 247212

SEQ ID NO: 688962 - RNA, 64 nt, Homo Sapiens; identical to SEQ ID NO: 247213

SEQ ID NO: 688963 - RNA, 64 nt, Homo Sapiens; identical to SEQ ID NO: 247214

SEQ ID NO: 688964 - RNA, 64 nt, Homo Sapiens; identical to SEQ ID NO: 247215

SEQ ID NO: 688965 - RNA, 64 nt, Homo Sapiens; identical to SEQ ID NO: 247216

SEQ ID NO: 688966 - RNA, 64 nt, Homo Sapiens; identical to SEQ ID NO: 247217

SEQ ID NO: 688967 - RNA, 64 nt, Homo Sapiens; identical to SEQ ID NO: 247218

SEQ ID NO: 688968 - RNA, 64 nt, Homo Sapiens; identical to SEQ ID NO: 247219

SEQ ID NO: 688969 - RNA, 64 nt, Homo Sapiens; identical to SEQ ID NO: 247220

SEQ ID NO: 688970 - RNA, 64 nt, Homo Sapiens; identical to SEQ ID NO: 247221

SEQ ID NO: 688971 - RNA, 64 nt, Homo Sapiens; identical to SEQ ID NO: 247222

SEQ ID NO: 688972 - RNA, 64 nt, Homo Sapiens; identical to SEQ ID NO: 247223

SEQ ID NO: 688973 - RNA, 64 nt, Homo Sapiens; identical to SEQ ID NO: 247224

SEQ ID NO: 688974 - RNA, 64 nt, Homo Sapiens; identical to SEQ ID NO: 247225

SEQ ID NO: 688975 - RNA, 64 nt, Homo Sapiens; identical to SEQ ID NO: 247226

SEQ ID NO: 688976 - RNA, 64 nt, Homo Sapiens; identical to SEQ ID NO: 247227

SEQ ID NO: 688977 - RNA, 64 nt, Homo Sapiens; identical to SEQ ID NO: 247228

SEQ ID NO: 688978 - RNA, 64 nt, Homo Sapiens; identical to SEQ ID NO: 247229

SEQ ID NO: 688979 - RNA, 64 nt, Homo Sapiens; identical to SEQ ID NO: 247230

SEQ ID NO: 688980 - RNA, 64 nt, Homo Sapiens; identical to SEQ ID NO: 247231

SEQ ID NO: 688981 - RNA, 64 nt, Homo Sapiens; identical to SEQ ID NO: 247232

SEQ ID NO: 688982 - RNA, 64 nt, Homo Sapiens; identical to SEQ ID NO: 247233

SEQ ID NO: 688983 - RNA, 64 nt, Homo Sapiens; identical to SEQ ID NO: 247234

SEQ ID NO: 688984 - RNA, 64 nt, Homo Sapiens; identical to SEQ ID NO: 247235

SEQ ID NO: 688985 - RNA, 64 nt, Homo Sapiens; identical to SEQ ID NO: 247236

SEQ ID NO: 688986 - RNA, 64 nt, Homo Sapiens; identical to SEQ ID NO: 247237

SEQ ID NO: 688987 - RNA, 64 nt, Homo Sapiens; identical to SEQ ID NO: 247238

SEQ ID NO: 688988 - RNA, 64 nt, Homo Sapiens; identical to SEQ ID NO: 247239

SEQ ID NO: 688989 - RNA, 64 nt, Homo Sapiens; identical to SEQ ID NO: 247240

SEQ ID NO: 688990 - RNA, 64 nt, Homo Sapiens; identical to SEQ ID NO: 247241

SEQ ID NO: 688991 - RNA, 64 nt, Homo Sapiens; identical to SEQ ID NO: 247242

SEQ ID NO: 688992 - RNA, 64 nt, Homo Sapiens; identical to SEQ ID NO: 247243

SEQ ID NO: 688993 - RNA, 64 nt, Homo Sapiens; identical to SEQ ID NO: 247244

SEQ ID NO: 688994 - RNA, 64 nt, Homo Sapiens; identical to SEQ ID NO: 247245

SEQ ID NO: 688995 - RNA, 64 nt, Homo Sapiens; identical to SEQ ID NO: 247246

SEQ ID NO: 688996 - RNA, 64 nt, Homo Sapiens; identical to SEQ ID NO: 247247

SEQ ID NO: 688997 - RNA, 64 nt, Homo Sapiens; identical to SEQ ID NO: 247248

SEQ ID NO: 688998 - RNA, 64 nt, Homo Sapiens; identical to SEQ ID NO: 247249

SEQ ID NO: 688999 - RNA, 64 nt, Homo Sapiens; identical to SEQ ID NO: 247250

SEQ ID NO: 689000 - RNA, 64 nt, Homo Sapiens; identical to SEQ ID NO: 247251

SEQ ID NO: 689001 - RNA, 64 nt, Homo Sapiens; identical to SEQ ID NO: 247252

SEQ ID NO: 689002 - RNA, 64 nt, Homo Sapiens
augaucuauauuaauguuuaguuauuuuugguugagugcuaaauauuucagaaggcuacuuaac

SEQ ID NO: 689003 - RNA, 64 nt, Homo Sapiens
cauuucacuucagaagcacuuguaggucuuuacuagugcuaaguauuauggugagcuaucauua

SEQ ID NO: 689004 - RNA, 64 nt, Homo Sapiens
uaggaagggauucggcuuucccaggauacuuggaagugcuaaaaccccucgccccuauauucau

SEQ ID NO: 689005 - RNA, 64 nt, Homo Sapiens
acuuugagcaaggcugccuuucuuuacacaugcgagugcuaaccgucuucagaacucuuggaaa

SEQ ID NO: 689006 - RNA, 64 nt, Homo Sapiens
caguuauuauuagaguugcagaauagaaacuugaagugcuaaauggaauaauccaaaggaaauu

SEQ ID NO: 689007 - RNA, 64 nt, Homo Sapiens
guauaucaccaaauuuuuaaaaagugauagucacagugcuaaguuaucuaguuggcuacuauua

SEQ ID NO: 689008 - RNA, 64 nt, Homo Sapiens; identical to SEQ ID NO: 168425

SEQ ID NO: 689009 - RNA, 64 nt, Homo Sapiens; identical to SEQ ID NO: 168426

SEQ ID NO: 689010 - RNA, 64 nt, Homo Sapiens; identical to SEQ ID NO: 168427

SEQ ID NO: 689011 - RNA, 64 nt, Homo Sapiens; identical to SEQ ID NO: 168428

SEQ ID NO: 689012 - RNA, 64 nt, Homo Sapiens; identical to SEQ ID NO: 168429

SEQ ID NO: 689013 - RNA, 64 nt, Homo Sapiens; identical to SEQ ID NO: 168430

SEQ ID NO: 689014 - RNA, 64 nt, Homo Sapiens; identical to SEQ ID NO: 168431

SEQ ID NO: 689015 - RNA, 64 nt, Homo Sapiens; identical to SEQ ID NO: 168432

SEQ ID NO: 689016 - RNA, 64 nt, Homo Sapiens; identical to SEQ ID NO: 168433

SEQ ID NO: 689017 - RNA, 64 nt, Homo Sapiens; identical to SEQ ID NO: 168434

SEQ ID NO: 689018 - RNA, 64 nt, Homo Sapiens; identical to SEQ ID NO: 168435

SEQ ID NO: 689019 - RNA, 64 nt, Homo Sapiens; identical to SEQ ID NO: 168436

SEQ ID NO: 689020 - RNA, 64 nt, Homo Sapiens; identical to SEQ ID NO: 168437

SEQ ID NO: 689021 - RNA, 64 nt, Homo Sapiens; identical to SEQ ID NO: 168438

SEQ ID NO: 689022 - RNA, 64 nt, Homo Sapiens; identical to SEQ ID NO: 168439

SEQ ID NO: 689023 - RNA, 64 nt, Homo Sapiens; identical to SEQ ID NO: 168440

SEQ ID NO: 689024 - RNA, 64 nt, Homo Sapiens; identical to SEQ ID NO: 168441

SEQ ID NO: 689025 - RNA, 64 nt, Homo Sapiens; identical to SEQ ID NO: 168442

SEQ ID NO: 689026 - RNA, 64 nt, Homo Sapiens; identical to SEQ ID NO: 168443

SEQ ID NO: 689027 - RNA, 64 nt, Homo Sapiens; identical to SEQ ID NO: 168444

SEQ ID NO: 689028 - RNA, 64 nt, Homo Sapiens; identical to SEQ ID NO: 168445

SEQ ID NO: 689029 - RNA, 64 nt, Homo Sapiens; identical to SEQ ID NO: 168446

SEQ ID NO: 689030 - RNA, 64 nt, Homo Sapiens; identical to SEQ ID NO: 395904

SEQ ID NO: 689031 - RNA, 64 nt, Homo Sapiens; identical to SEQ ID NO: 395905

SEQ ID NO: 689032 - RNA, 64 nt, Homo Sapiens; identical to SEQ ID NO: 395906

SEQ ID NO: 689033 - RNA, 64 nt, Homo Sapiens; identical to SEQ ID NO: 395907

SEQ ID NO: 689034 - RNA, 64 nt, Homo Sapiens; identical to SEQ ID NO: 395908

SEQ ID NO: 689035 - RNA, 64 nt, Homo Sapiens; identical to SEQ ID NO: 395909

SEQ ID NO: 689036 - RNA, 64 nt, Homo Sapiens
cagaauuagguaaacaucugaagguuuaguauauuagaaacacccaaaccaguaauaugcuaac

SEQ ID NO: 689037 - RNA, 64 nt, Homo Sapiens
ugucugucaacaaauacaccaaaaccauuuuuuauagaaacaguauuuaauggucacucaauag

SEQ ID NO: 689038 - RNA, 64 nt, Homo Sapiens
cuuaaaauuugggguauagaacuacauugugaguuagaaacaaacauuuauaacguuguuuaug

SEQ ID NO: 689039 - RNA, 64 nt, Homo Sapiens
gacucccaaguuuuaaacacguugaaguaaggauuagaaacauaugaacacuuuauuuauugau

SEQ ID NO: 689040 - RNA, 64 nt, Homo Sapiens
ucuguucaaaggagcaagaacuuucauauaggaauagaaacaugcuggccgaagauuucaucca

SEQ ID NO: 689041 - RNA, 64 nt, Homo Sapiens
uccaguccuuuuaaaauuguacaugaacauguuuuagaaacaauauggaggaugaugcauacau

SEQ ID NO: 689042 - RNA, 64 nt, Homo Sapiens
agucucuguucuucaucugcuauuaaccuugccuuagaaacacauaaauuaugagauuuuuuuu

SEQ ID NO: 689043 - RNA, 64 nt, Homo Sapiens
cuuuuauaauaaugaaugugcacucauacauauguagaaacauuuagauuuagaguuuuuuuuu

SEQ ID NO: 689044 - RNA, 64 nt, Homo Sapiens
caaggccauuuaauccgucacauucaucucauaauagaaacacguucauauuccaguggucaau

SEQ ID NO: 689045 - RNA, 64 nt, Homo Sapiens
auauauuuuaucucuuauaccuguaucucccaacuagaaacagcuccaguguuuuuaagagaau

SEQ ID NO: 689046 - RNA, 64 nt, Homo Sapiens
gugcaauuuagcuuaaauggguguaugaauggucuagaaacauuucuauuuuuuuuuuaaacca

SEQ ID NO: 689047 - RNA, 64 nt, Homo Sapiens
auuuaaaucuugcaagaauauuuugugcuuucuuuagaaacacaagaguauagauuuuucucac

SEQ ID NO: 689048 - RNA, 64 nt, Homo Sapiens
uuauucgaaaagaggcuuuuaaaaugugcauguuuagaaacaaaauuucuucauggaaaucaua

SEQ ID NO: 689049 - RNA, 64 nt, Homo Sapiens
uacaauugagauuugcccauagguuaaacaugguuagaaacaacugaaagcauaaaagaaaaau

SEQ ID NO: 689050 - RNA, 64 nt, Homo Sapiens
auuaucuuuguucuccuaaugcucugaaaggauguagaaacaauauuuaaccaaagaacguaau

SEQ ID NO: 689051 - RNA, 64 nt, Homo Sapiens
uaaaguugagagacaguaacacaauuaaaugacuuagaaacaauguuugcuuuucacuggcaua

SEQ ID NO: 689052 - RNA, 64 nt, Homo Sapiens
aaaguuauuguuuucuaaguugccaucuacuuucuagaaacacuauguaacuauuuuuuagaaa

SEQ ID NO: 689053 - RNA, 64 nt, Homo Sapiens
auucucuaguacucauccagaguagaaaaauggauagaaacaaauaucuugaaaguugaacuca

SEQ ID NO: 689054 - RNA, 64 nt, Homo Sapiens
ugggguugucaacaugaguagagaaggcaaaagcuagaaacacuaaauauaggugaggauucag

SEQ ID NO: 689055 - RNA, 64 nt, Homo Sapiens
ccugcauucaaccaacuguaaaaaaugugcugccuagaaacagaagaugaacaacuuugccuuc

SEQ ID NO: 689056 - RNA, 64 nt, Homo Sapiens
gauucuaccugaacugaaaguuggucaaaugaccuagaaacaagcuaaggagccugggaugaug

SEQ ID NO: 689057 - RNA, 64 nt, Homo Sapiens
cuccauuacucugauuuuugcaauaagugugugguagaaacaaaaaugaacuguaguacaugga

SEQ ID NO: 689058 - RNA, 64 nt, Homo Sapiens
ccugccauaauccuuuggaaauauacaugaagaauagaaacaagaaaaaagagugaaaaagaga

SEQ ID NO: 689059 - RNA, 64 nt, Homo Sapiens
gaagaauuggcuuguauaguuauaacaaccacaguagaaacauuucuacuuugagagaauuuca

SEQ ID NO: 689060 - RNA, 64 nt, Homo Sapiens
gauucuuaaggcaggccugaaaggccauuacuaauagaaacacagccuuuccaauccucuggaa

SEQ ID NO: 689061 - RNA, 64 nt, Homo Sapiens
cuuuucucuaaaacauuuaugcccuugcuuuggcuagaaacacauuaacugguuuacucauuga

SEQ ID NO: 689062 - RNA, 64 nt, Homo Sapiens
gccccauucuucauaucaauuuuguauaaauauauagaaacacacacacagccucagacuuaca

SEQ ID NO: 689063 - RNA, 64 nt, Homo Sapiens
gaauguaagauacuuuagaaagcauguaaaguacuagaaacaaugagguggcuucaauuagugc

SEQ ID NO: 689064 - RNA, 64 nt, Homo Sapiens
ucauucugagaccuaaauuuaaagggucaggcauuagaaacaaaaguguuucuucauaucuagg

SEQ ID NO: 689065 - RNA, 64 nt, Homo Sapiens
uagcucucccccaauaaaaauaccacuaucagaguagaaacaagguagacauuucuaaaacaua

SEQ ID NO: 689066 - RNA, 64 nt, Homo Sapiens
uaaucccauuuaggucuguacuaaagaggauggguagaaacacauauguauauaccuuuucuuu

SEQ ID NO: 689067 - RNA, 64 nt, Homo Sapiens
gggccaaaauugaaugcuaucaagcagaacuagguagaaacagaguuccagugaugaaaacauu

SEQ ID NO: 689068 - RNA, 64 nt, Homo Sapiens
uaaagugucuaauaaugcugaaaagaagagaaacuagaaacaguccuagccuuccaagagaaga

SEQ ID NO: 689069 - RNA, 64 nt, Homo Sapiens
cugauaugguuuggcucuguggggggggggguuguagaaacaguaaucccccaucagugggggc

SEQ ID NO: 689070 - RNA, 64 nt, Homo Sapiens
aaaucccccaucaguggggguagcaguauuaaaauagaaacaucugcuauuucacccugcaggu

SEQ ID NO: 689071 - RNA, 64 nt, Homo Sapiens
uuuccaccuuucuaaaaccaccaaugggacaguguagaaacaaguuuguguggguugauagcua

SEQ ID NO: 689072 - RNA, 64 nt, Homo Sapiens
ugcuaaguguaccguauauaugaaauguuuucuauagaaacaagacaucauaaagaacuugauu

SEQ ID NO: 689073 - RNA, 64 nt, Homo Sapiens
ugccagugucaaggauuccaguccucucuguucauagaaacaccgauucaggaagacaggcaca

SEQ ID NO: 689074 - RNA, 64 nt, Homo Sapiens
ucaaaaacaagagaaaagacccuguauuuaaaaauagaaacauaugccauuuuaaggaaaacua

SEQ ID NO: 689075 - RNA, 64 nt, Homo Sapiens
acaguuuugaccuaacauacugaaacuaaagcaauagaaacaaccccacuaaugcaaacuggga

SEQ ID NO: 689076 - RNA, 64 nt, Homo Sapiens
gcaacacuggucugcuguucgaaaagcuuagcuuuagaaacaguguaguaccaaaauaaauaag

SEQ ID NO: 689077 - RNA, 64 nt, Homo Sapiens
auacaauuuuuuugguaaaaagguuucaaggaaguagaaacaaauaaaaauuaaauuggaaagc

SEQ ID NO: 689078 - RNA, 64 nt, Homo Sapiens
auuuaagaugagcuauuuggagcuuauguaauaauggcauaaagccaacuagaggauguuguau

SEQ ID NO: 689079 - RNA, 64 nt, Homo Sapiens
uuauguaaauauguaugauuaugauuuuuauaaauggcauaacaugaguguacuaacuaccuuc

SEQ ID NO: 689080 - RNA, 64 nt, Homo Sapiens
aaaauuuuugucuuucauggaaugcaauuugacuuggcauaauugugaguuaauuugauaaaga

SEQ ID NO: 689081 - RNA, 64 nt, Homo Sapiens
uuacaguucacacugcagagcuagguuguccuauuggcauaaaacaaaccagcaacuuuucuca

SEQ ID NO: 689082 - RNA, 64 nt, Homo Sapiens; identical to SEQ ID NO: 98023

SEQ ID NO: 689083 - RNA, 64 nt, Homo Sapiens; identical to SEQ ID NO: 98024

SEQ ID NO: 689084 - RNA, 64 nt, Homo Sapiens
cagccuggggucugacaauaccucgagccacaaccgaccagaugccagggacccacggagcccu

SEQ ID NO: 689085 - RNA, 64 nt, Homo Sapiens
caaucagauuagacacuauguguuagaguccccccgaccagauccuuuuccaucccacuccacu

SEQ ID NO: 689086 - RNA, 64 nt, Homo Sapiens
ugcugucuagaucaggaauuucuaucuguuauaucgaccagaauguugugauuuaaagagaacu

SEQ ID NO: 689087 - RNA, 64 nt, Homo Sapiens
gcgagccugcuccucucgccggcgcgcggcccgacgaccagagggugacccggcgggaccugcg

SEQ ID NO: 689088 - RNA, 64 nt, Homo Sapiens
cuggaggugacccuugcccuugcacagacagcugcgaccagagaaccaggacgucagccagcac

SEQ ID NO: 689089 - RNA, 64 nt, Homo Sapiens
accauuaauguuuaauuuaaucuuaauaccaaaacgaccagauugaaguuugacuuuuauuguc

SEQ ID NO: 689090 - RNA, 64 nt, Homo Sapiens
aagugcugggauuacaggugugagccacuauacccgaccagaucaaaucuuuuuuugacauuuu

SEQ ID NO: 689091 - RNA, 64 nt, Homo Sapiens
aguuuuuuaugugugaagucauuaaauuauuacacgaccagaacuaaaaugcaauauacaguua

SEQ ID NO: 689092 - RNA, 64 nt, Homo Sapiens
agugcuggagcuccagcagccgcgugucaacagacgaccagaggugggaaucccacggaccucu

SEQ ID NO: 689093 - RNA, 64 nt, Homo Sapiens
acgugaugcuaugcaugucugaccgacgaucccucgaccagaaucagauucaggagcucaguuu

SEQ ID NO: 689094 - RNA, 64 nt, Homo Sapiens
cuggcaucugacacugacaguccuccauguccaccgaccagaccccucgucugucaaugacauc

SEQ ID NO: 689095 - RNA, 64 nt, Homo Sapiens
auuguuuauuggggaaugcuguucucccccaagacgaccagaaaaacaucuccccccaggcgau

SEQ ID NO: 689096 - RNA, 64 nt, Homo Sapiens
uucuguauuuauguauuuguacgaauguauauagcgaccagagcauucuuaauucccgccgcag

SEQ ID NO: 689097 - RNA, 64 nt, Homo Sapiens
cagaaggcagggaaaggcucugaaagccagcugccgaccagagccccacacggaggcaucugca

SEQ ID NO: 689098 - RNA, 64 nt, Homo Sapiens
cucuagcuacacuauugcauuguucagaaacugucgaccagaguuagaacggagcccucgguga

SEQ ID NO: 689099 - RNA, 64 nt, Homo Sapiens
agaaucaccaguggguauuccccucguuaugccacgaccagauauuuuaucauuuuuuaagauu

SEQ ID NO: 689100 - RNA, 64 nt, Homo Sapiens
acgauugcugaagccugagcaggucucugugggccgaccagaggggggcuucgagguggucccu

SEQ ID NO: 689101 - RNA, 64 nt, Homo Sapiens
agccuuuuuaaaacacauguguggaugccagggccgaccagaggcgggcgucugugugcgcucu

SEQ ID NO: 689102 - RNA, 64 nt, Homo Sapiens
aggagccccucucugcuggggagggcaggaggggcgaccagauaccccauuccugggccuuucu

SEQ ID NO: 689103 - RNA, 64 nt, Homo Sapiens
gcguagacccggggcccagguucaggaaguguggcgaccagaaauguuguggguguugccgugc

SEQ ID NO: 689104 - RNA, 64 nt, Homo Sapiens
ucucccagcauauagauauauccuccuuuaacuccgaccagaacccuucuuccuguggcacucc

SEQ ID NO: 689105 - RNA, 64 nt, Homo Sapiens
auuuucuacccagagaccugcauguucucuccaacgaccagaauauucuacccaaaugucagga

SEQ ID NO: 689106 - RNA, 64 nt, Homo Sapiens
aggguugcuuggaggaccugggguggcagccccccgaccagaagcacccuauuuuauagauagc

SEQ ID NO: 689107 - RNA, 64 nt, Homo Sapiens
ccugccacgccuuccauccaagaagcuccgccggcgaccagacuaugugaccggaugcgcuccc

SEQ ID NO: 689108 - RNA, 64 nt, Homo Sapiens
aggauuucagcaaaccaccaacgcucaagccuuacgaccagagacugaacaaacaaaaaacaaa

SEQ ID NO: 689109 - RNA, 64 nt, Homo Sapiens
uucccucugcuuccuggacacagaggaggucuaacgaccagaguauugcccugccaccacuauc

SEQ ID NO: 689110 - RNA, 64 nt, Homo Sapiens
cucuguggccaagcuccagccaaaaaggagggcacgaccagaaaggaacucccuuugcacggag

SEQ ID NO: 689111 - RNA, 64 nt, Homo Sapiens
uuugcccuugcuuggcugcccucuacccauuccccgaccagagccgagccuggggcugcccuac

SEQ ID NO: 689112 - RNA, 64 nt, Homo Sapiens
ggccacagagaaaguacuucuccacccugcucuccgaccagacaccuugacagggcacaccggg

SEQ ID NO: 689113 - RNA, 64 nt, Homo Sapiens
cacacagccugucuucagauccugcugccgcgugcgaccagaggugggaggccccugguggcau

SEQ ID NO: 689114 - RNA, 64 nt, Homo Sapiens
ugauaggacaucuggcuugccacaaaggucuguucgaccagacauauccuagcuaagggauguc

SEQ ID NO: 689115 - RNA, 64 nt, Homo Sapiens
uccagauggucaccugcccuggagaccaucaccucgaccagaacuagaggccaccaugguguga

SEQ ID NO: 689116 - RNA, 64 nt, Homo Sapiens
cccuuacacuuaacucacuuuauugguccacccccgaccagauuagcguucggaugagucuggu

SEQ ID NO: 689117 - RNA, 64 nt, Homo Sapiens
ccuuuucaagcacaauuaaugccugcagccuuugcgaccagagcgcagugccaggaccacccuu

SEQ ID NO: 689118 - RNA, 64 nt, Homo Sapiens
gccguccucuuugauaucuugccaagccgugagccgaccagaagaaaaagacaaaaaaaaaaaa

SEQ ID NO: 689119 - RNA, 64 nt, Homo Sapiens
cacuuuguuacugguaccugaugcacacggauugcgaccagagcaugaugccuccaucaagugg

SEQ ID NO: 689120 - RNA, 64 nt, Homo Sapiens
ugggugugccuggccugggacugagggguccaggcgaccagagcuggcuguacaggaaugucca

SEQ ID NO: 689121 - RNA, 64 nt, Homo Sapiens
cccucauucaugaggguggugaggacacagacugcgaccagaacagaaauaugaaaaugugaau

SEQ ID NO: 689122 - RNA, 64 nt, Homo Sapiens
acccucugccaccaccguuuucaggcccaggcuucgaccagaggccacguguaugaugggguuc

SEQ ID NO: 689123 - RNA, 64 nt, Homo Sapiens
ggagacuccggcaaccuucagcaacauauauccucgaccagaugcagugcuauaagaacagaac

SEQ ID NO: 689124 - RNA, 64 nt, Homo Sapiens
uaagcucucggcuucucugcguugucucuggaaacgaccagagucaucccaagacagccagcag

SEQ ID NO: 689125 - RNA, 64 nt, Homo Sapiens
gcgucucauuggccaaagauguuauggagcgcuccgaccagacaacucccuccccauuggccga

SEQ ID NO: 689126 - RNA, 64 nt, Homo Sapiens
auucuucccggaaggcauuccgcgagggcuccggcgaccagaggaucgcugguuuccucugcag

SEQ ID NO: 689127 - RNA, 64 nt, Homo Sapiens; identical to SEQ ID NO: 87425

SEQ ID NO: 689128 - RNA, 64 nt, Homo Sapiens; identical to SEQ ID NO: 87426

SEQ ID NO: 689129 - RNA, 64 nt, Homo Sapiens; identical to SEQ ID NO: 87427

SEQ ID NO: 689130 - RNA, 64 nt, Homo Sapiens; identical to SEQ ID NO: 87428

SEQ ID NO: 689131 - RNA, 64 nt, Homo Sapiens; identical to SEQ ID NO: 87429

SEQ ID NO: 689132 - RNA, 64 nt, Homo Sapiens; identical to SEQ ID NO: 87430

SEQ ID NO: 689133 - RNA, 55 nt, Homo Sapiens; identical to SEQ ID NO: 194635

SEQ ID NO: 689134 - RNA, 62 nt, Homo Sapiens
cccagcugcccagcccugcccccccuccccauagccagcacagcuaucccgcggggacacca

SEQ ID NO: 689135 - RNA, 62 nt, Homo Sapiens
gcacagacagcugcgaccaggaccaggacgucagccagcacuagcacugcacagacagcugc

SEQ ID NO: 689136 - RNA, 62 nt, Homo Sapiens
gcacagacagcugcgaccagagcguggacaucagccagcacuuucccugugaggccgugguu

SEQ ID NO: 689137 - RNA, 62 nt, Homo Sapiens
cugggccuuguacugucuguagggguuucaccagccagcaacguggaggagggacgagggac

SEQ ID NO: 689138 - RNA, 62 nt, Homo Sapiens
auggacagcuggaccccugagucuccuccucuagccagcaguccaggaccucucccggaucu

SEQ ID NO: 689139 - RNA, 62 nt, Homo Sapiens
ugccuccccuucacucccacgagccaaucaguagccagcaucugacuccacucugaguccca

SEQ ID NO: 689140 - RNA, 62 nt, Homo Sapiens
cuggcucucccagccagguuccaggcacacugagccagcagcaaauaagcaggcgugaccug

SEQ ID NO: 689141 - RNA, 62 nt, Homo Sapiens
ucaccugccaggcuuccuuuugcuggugguggagccagcauccugagacaagcagggcuuga

SEQ ID NO: 689142 - RNA, 62 nt, Homo Sapiens
uggcccuccaccaucuucacggccacccugccagccagcagcggaagcaggauacccuggcg

SEQ ID NO: 689143 - RNA, 62 nt, Homo Sapiens
cauuguaaguucccucuuuggcugcccugggcagccagcauuagucccagauacacucaugg

SEQ ID NO: 689144 - RNA, 62 nt, Homo Sapiens
uagaggaaaagacacacauaaguaccagccacagccagcagaguuacuuugggauagguugc

SEQ ID NO: 689145 - RNA, 62 nt, Homo Sapiens
ugagaacauagcacaggcccggugcucuuaaaagccagcagccuugcccucccugccucuuu

SEQ ID NO: 689146 - RNA, 62 nt, Homo Sapiens
uaagugugcaguuucuagugcugggaagucuuagccagcaccagagcgccaggccucucccu

SEQ ID NO: 689147 - RNA, 62 nt, Homo Sapiens
uaauccaggcuucagcaacacuccucuuucccagccagcaaaggcugugaauuugaauucuu

SEQ ID NO: 689148 - RNA, 62 nt, Homo Sapiens
acuaacagcugggagaggggagccagcuguccagccagcauguuccuguuguacagcccggu

SEQ ID NO: 689149 - RNA, 62 nt, Homo Sapiens
ccugggccccauccuugagggccuucccagccagccagcaggagaggcaagaacugggggaa

SEQ ID NO: 689150 - RNA, 62 nt, Homo Sapiens
gcuccuccucuggcucuucaccauccugggccagccagcagggcuuucccucccuccuugcc

SEQ ID NO: 689151 - RNA, 62 nt, Homo Sapiens
caggucuuguugccaauuuagggccucagggcagccagcaggcucugugggagcagacccgu

SEQ ID NO: 689152 - RNA, 62 nt, Homo Sapiens
uucucuccugugagcucccccaggccuggcccagccagcagggccuccggcccugccccaca

SEQ ID NO: 689153 - RNA, 62 nt, Homo Sapiens
gcgggccaggagaaagaaggcaggaagucaggagccagcaggacuccuuguuugccuuuagg

SEQ ID NO: 689154 - RNA, 62 nt, Homo Sapiens
gcaggaggggugggaccaggcugggaggacagagccagcagcugccaugcccuccugcuccc

SEQ ID NO: 689155 - RNA, 62 nt, Homo Sapiens
aauacuggccaaggucaggaggagcaaaaaugagccagcaccagcgccuuggcuuuguguua

SEQ ID NO: 689156 - RNA, 62 nt, Homo Sapiens
ugccagggagccacccgcccccccaagcacugagccagcagggguccaccucucauugcaag

SEQ ID NO: 689157 - RNA, 62 nt, Homo Sapiens
gcugcucccuggagcccgggcuccuuccccuaagccagcacuauuuagcccugcacagcggu

SEQ ID NO: 689158 - RNA, 62 nt, Homo Sapiens
gguucuggagaaagaaacuguggcuaugggagagccagcaggagggcucugcuccacccacu

SEQ ID NO: 689159 - RNA, 62 nt, Homo Sapiens
uccuccggaucacugugguucaccagccaugcagccagcaggcggcucuccucccagcauca

SEQ ID NO: 689160 - RNA, 62 nt, Homo Sapiens
ggccgaggggcggaggcacagcugcuuccagcagccagcauucaguggccuugucaccaagc

SEQ ID NO: 689161 - RNA, 62 nt, Homo Sapiens
cuucuguggcaggacuggcccagggaggaggaagccagcagcacaccuggggaauggggucc

SEQ ID NO: 689162 - RNA, 62 nt, Homo Sapiens
guaagcccugcuuagcucaucuuagagcaaagagccagcacccugaugucccugggguggcu

SEQ ID NO: 689163 - RNA, 62 nt, Homo Sapiens
ggaaugcugcccgcucugcagacugcugcuagagccagcaacuccacuaagguggauuuuca

SEQ ID NO: 689164 - RNA, 62 nt, Homo Sapiens
gagaaaggaaaaggcaugaaguucuauaccucagccagcagcugccuucguuuggaacugaa

SEQ ID NO: 689165 - RNA, 62 nt, Homo Sapiens
ccagcagcugccuucguuuggaacugaaguccagccagcagacucucuagcuccaucucccc

SEQ ID NO: 689166 - RNA, 62 nt, Homo Sapiens
acagucucuauggugcugagggccagcagcccagccagcagcuuggccccaagguugccccg

SEQ ID NO: 689167 - RNA, 62 nt, Homo Sapiens
guggaugcaaggggccucuacagggacaggagagccagcagggaggaggacaugguggagac

SEQ ID NO: 689168 - RNA, 62 nt, Homo Sapiens
ccgggccaagugaagaaucuuuuauagaugugagccagcacauggccucccagaaugcuggg

SEQ ID NO: 689169 - RNA, 62 nt, Homo Sapiens
acguggcuucagaggccuggugaucuuucuagagccagcaguggagacuuucugaaguagcc

SEQ ID NO: 689170 - RNA, 62 nt, Homo Sapiens
caucauuucuauuauaccuugccaccaugccuagccagcaagugcugggauuacaggcauga

SEQ ID NO: 689171 - RNA, 62 nt, Homo Sapiens
aucucuuuggggaccacuccccucccugucccagccagcauccaccucucaccuccaccacc

SEQ ID NO: 689172 - RNA, 62 nt, Homo Sapiens
cccaucucaugccccuggcugggacguggcucagccagcacuuguccagcugagcgccagga

SEQ ID NO: 689173 - RNA, 62 nt, Homo Sapiens
aaagaggcugaggcuggcacaggacaugcgguagccagcacacagggcagugagggagggcu

SEQ ID NO: 689174 - RNA, 64 nt, Homo Sapiens
auggcuggggcucuccgugguguucuggacccagccccuggagacaccauucacuuuuacugcu

SEQ ID NO: 689175 - RNA, 64 nt, Homo Sapiens
gccuccauggcuggucaugagagcaaaccguaguccccuggagacagcgacuccagagaaccuc

SEQ ID NO: 689176 - RNA, 64 nt, Homo Sapiens
gugcacaccugcaaguaggcaccggccgcggcucccccuggacggggcgggcccugccugaggg

SEQ ID NO: 689177 - RNA, 64 nt, Homo Sapiens
ggcucugcguuggcuucucccuggggacggggcuccccuggacagaggcggggcuacagauugg

SEQ ID NO: 689178 - RNA, 64 nt, Homo Sapiens
uggcugagggcucaggacacaccagacaccgcacccccuggauccugcucuuggaguggacaug

SEQ ID NO: 689179 - RNA, 64 nt, Homo Sapiens
cccagcaggguccccccgaaucucccaggagcagccccuggaugcagcccagaagagauggacc

SEQ ID NO: 689180 - RNA, 64 nt, Homo Sapiens
gagcaacuuuucugugcccuuucuucacauauucccccuggaagcuucgugcuugggguagauc

SEQ ID NO: 689181 - RNA, 64 nt, Homo Sapiens
ugcacaucugccucgcugcuaauggaaugcuggcccccuggaucugacuuguugaaagugcaga

SEQ ID NO: 689182 - RNA, 64 nt, Homo Sapiens
aucagggucauccuacagccuccaagcgggcuuuccccuggacaaaugccacugcaacauuuau

SEQ ID NO: 689183 - RNA, 64 nt, Homo Sapiens
guucgggagaauggggccggggcuggccuggccuccccuggauauacucuauagugcaccaaaa

SEQ ID NO: 689184 - RNA, 64 nt, Homo Sapiens
uggcaacucugaucugacgccucugugcucagggccccuggaggaggggcuacugccccuuggc

SEQ ID NO: 689185 - RNA, 64 nt, Homo Sapiens
gcuugucccaggcuacugggcuguggucucugacccccuggaggccuccccacgccucacagaa

SEQ ID NO: 689186 - RNA, 64 nt, Homo Sapiens
cugggagacagaugaggagacuggcucagcaaggccccuggaggucaagcuuggccuuugccuc

SEQ ID NO: 689187 - RNA, 64 nt, Homo Sapiens
cagagugccugaggcuuccugcuugagaaccugcccccuggaucuuggacacuuacagauugag

SEQ ID NO: 689188 - RNA, 64 nt, Homo Sapiens
gcuggucccccacaccgcguccugcugagccugcccccuggauuggcuguaauuugccucgaag

SEQ ID NO: 689189 - RNA, 64 nt, Homo Sapiens
ggagggagccacugagcacagcaaggcaccaaagccccuggagaaaccgccagggcgaggugcg

SEQ ID NO: 689190 - RNA, 64 nt, Homo Sapiens
ggcccagggggcuuccugaggggagacagagcaaccccuggaccccagccucaaauccaggacc

SEQ ID NO: 689191 - RNA, 64 nt, Homo Sapiens
cauggggucucucacagacaggaccccugcaguuccccuggaagcagugcccagguggcugugg

SEQ ID NO: 689192 - RNA, 64 nt, Homo Sapiens
gaggaggaggcacacggagaccuggggcucggggccccuggauuccugcaucugcauaugcgua

SEQ ID NO: 689193 - RNA, 64 nt, Homo Sapiens
ggcggggcgggggucugccggccucugggcaaggccccuggagcaucucgcccaggcuuuuuau

SEQ ID NO: 689194 - RNA, 64 nt, Homo Sapiens
agcacccuuccugcuggcgugaccgugucuaacuccccuggagugacgaccaccgccccaccac

SEQ ID NO: 689195 - RNA, 64 nt, Homo Sapiens
cuuugcaaucaaggccaaagaaaaugaucugcuuccccuggaaaaaaaucguguuaagcuagau

SEQ ID NO: 689196 - RNA, 64 nt, Homo Sapiens
caaauuaagugcaauauuuuggagacaucaggucccccuggauuugaguguacguuuucuucca

SEQ ID NO: 689197 - RNA, 64 nt, Homo Sapiens
auaugauucacuuuaugugagauugugauaagccccccuggagggcuguuuuuuggcaaaucuu

SEQ ID NO: 689198 - RNA, 64 nt, Homo Sapiens
aacaccugcagcucauuguggauuaagaaccucaccccuggagggguggaguuucuaccccuga

SEQ ID NO: 689199 - RNA, 64 nt, Homo Sapiens
ugcagacaucuauuacauggaggcaguagaaggaccccuggagccagaggguuuucuaaaugag

SEQ ID NO: 689200 - RNA, 64 nt, Homo Sapiens
gcgugaacuaacaaaccugugaacuguaaauaggccccuggaagcacgugcuuaagcccuuuug

SEQ ID NO: 689201 - RNA, 64 nt, Homo Sapiens
agcuaggaucugcauuuucagguuccgagccugaccccuggaacugaccagcgcucgauuguca

SEQ ID NO: 689202 - RNA, 64 nt, Homo Sapiens
cuguagcagugagaaaaagcuccuguccucccauccccuggacugggagguagauagguaaaua

SEQ ID NO: 689203 - RNA, 64 nt, Homo Sapiens
gcacagcggccccugcauccccuuggcugugaggccccuggacaagcagagguggccagagcug

SEQ ID NO: 689204 - RNA, 64 nt, Homo Sapiens
uuccugcuccacgggaaagaggucgauggauuuaccccuggacccauaagucuguucauccugc

SEQ ID NO: 689205 - RNA, 64 nt, Homo Sapiens
guccuucuguuuggugcuacccuugucuacucugccccuggauggugcggggugcuuucuccac

SEQ ID NO: 689206 - RNA, 64 nt, Homo Sapiens
agcagcuuugauaccaugggacauuuccacccugccccuggagcaccugcugggccagucccac

SEQ ID NO: 689207 - RNA, 64 nt, Homo Sapiens
uccugacauagaugguguguccccucuuccccuuccccuggauuagcccugcggagccacucca

SEQ ID NO: 689208 - RNA, 64 nt, Homo Sapiens
cucacucccacacaugcccacgcuucugaaacucccccuggagucugauggaaggcgggauucc

SEQ ID NO: 689209 - RNA, 64 nt, Homo Sapiens
auugaggaugcccauccccuagcgucucgagaggccccuggacacaccguccccagagcagguc

SEQ ID NO: 689210 - RNA, 64 nt, Homo Sapiens; identical to SEQ ID NO: 686259

SEQ ID NO: 689211 - RNA, 64 nt, Homo Sapiens; identical to SEQ ID NO: 686260

SEQ ID NO: 689212 - RNA, 64 nt, Homo Sapiens; identical to SEQ ID NO: 686261

SEQ ID NO: 689213 - RNA, 64 nt, Homo Sapiens; identical to SEQ ID NO: 686262

SEQ ID NO: 689214 - RNA, 64 nt, Homo Sapiens; identical to SEQ ID NO: 686263

SEQ ID NO: 689215 - RNA, 64 nt, Homo Sapiens; identical to SEQ ID NO: 686264

SEQ ID NO: 689216 - RNA, 60 nt, Homo Sapiens; identical to SEQ ID NO: 614236

SEQ ID NO: 689217 - RNA, 60 nt, Homo Sapiens; identical to SEQ ID NO: 614237

SEQ ID NO: 689218 - RNA, 60 nt, Homo Sapiens; identical to SEQ ID NO: 614238

SEQ ID NO: 689219 - RNA, 60 nt, Homo Sapiens; identical to SEQ ID NO: 614239

SEQ ID NO: 689220 - RNA, 60 nt, Homo Sapiens; identical to SEQ ID NO: 614240

SEQ ID NO: 689221 - RNA, 60 nt, Homo Sapiens; identical to SEQ ID NO: 614241

SEQ ID NO: 689222 - RNA, 60 nt, Homo Sapiens; identical to SEQ ID NO: 614242

SEQ ID NO: 689223 - RNA, 60 nt, Homo Sapiens; identical to SEQ ID NO: 614243

SEQ ID NO: 689224 - RNA, 60 nt, Homo Sapiens; identical to SEQ ID NO: 614244

SEQ ID NO: 689225 - RNA, 60 nt, Homo Sapiens; identical to SEQ ID NO: 614245

SEQ ID NO: 689226 - RNA, 60 nt, Homo Sapiens; identical to SEQ ID NO: 614246

SEQ ID NO: 689227 - RNA, 60 nt, Homo Sapiens; identical to SEQ ID NO: 614247

SEQ ID NO: 689228 - RNA, 60 nt, Homo Sapiens; identical to SEQ ID NO: 614248

SEQ ID NO: 689229 - RNA, 60 nt, Homo Sapiens; identical to SEQ ID NO: 614249

SEQ ID NO: 689230 - RNA, 60 nt, Homo Sapiens; identical to SEQ ID NO: 614250

SEQ ID NO: 689231 - RNA, 60 nt, Homo Sapiens; identical to SEQ ID NO: 614251

SEQ ID NO: 689232 - RNA, 60 nt, Homo Sapiens; identical to SEQ ID NO: 614252

SEQ ID NO: 689233 - RNA, 60 nt, Homo Sapiens; identical to SEQ ID NO: 614253

SEQ ID NO: 689234 - RNA, 60 nt, Homo Sapiens; identical to SEQ ID NO: 614254

SEQ ID NO: 689235 - RNA, 60 nt, Homo Sapiens; identical to SEQ ID NO: 614255

SEQ ID NO: 689236 - RNA, 60 nt, Homo Sapiens; identical to SEQ ID NO: 614256

SEQ ID NO: 689237 - RNA, 60 nt, Homo Sapiens; identical to SEQ ID NO: 614257

SEQ ID NO: 689238 - RNA, 60 nt, Homo Sapiens; identical to SEQ ID NO: 614258

SEQ ID NO: 689239 - RNA, 60 nt, Homo Sapiens; identical to SEQ ID NO: 614259

SEQ ID NO: 689240 - RNA, 60 nt, Homo Sapiens; identical to SEQ ID NO: 614260

SEQ ID NO: 689241 - RNA, 60 nt, Homo Sapiens; identical to SEQ ID NO: 614261

SEQ ID NO: 689242 - RNA, 60 nt, Homo Sapiens; identical to SEQ ID NO: 614262

SEQ ID NO: 689243 - RNA, 60 nt, Homo Sapiens; identical to SEQ ID NO: 614263

SEQ ID NO: 689244 - RNA, 60 nt, Homo Sapiens; identical to SEQ ID NO: 614264

SEQ ID NO: 689245 - RNA, 60 nt, Homo Sapiens; identical to SEQ ID NO: 614265

SEQ ID NO: 689246 - RNA, 60 nt, Homo Sapiens; identical to SEQ ID NO: 614266

SEQ ID NO: 689247 - RNA, 60 nt, Homo Sapiens; identical to SEQ ID NO: 614267

SEQ ID NO: 689248 - RNA, 60 nt, Homo Sapiens; identical to SEQ ID NO: 614268

SEQ ID NO: 689249 - RNA, 60 nt, Homo Sapiens; identical to SEQ ID NO: 614269

SEQ ID NO: 689250 - RNA, 60 nt, Homo Sapiens; identical to SEQ ID NO: 614270

SEQ ID NO: 689251 - RNA, 60 nt, Homo Sapiens; identical to SEQ ID NO: 614271

SEQ ID NO: 689252 - RNA, 60 nt, Homo Sapiens; identical to SEQ ID NO: 614272

SEQ ID NO: 689253 - RNA, 60 nt, Homo Sapiens; identical to SEQ ID NO: 614273

SEQ ID NO: 689254 - RNA, 60 nt, Homo Sapiens; identical to SEQ ID NO: 614274

SEQ ID NO: 689255 - RNA, 60 nt, Homo Sapiens; identical to SEQ ID NO: 614275

SEQ ID NO: 689256 - RNA, 60 nt, Homo Sapiens; identical to SEQ ID NO: 614276

SEQ ID NO: 689257 - RNA, 60 nt, Homo Sapiens; identical to SEQ ID NO: 614277

SEQ ID NO: 689258 - RNA, 60 nt, Homo Sapiens; identical to SEQ ID NO: 614278

SEQ ID NO: 689259 - RNA, 60 nt, Homo Sapiens; identical to SEQ ID NO: 614279

SEQ ID NO: 689260 - RNA, 60 nt, Homo Sapiens; identical to SEQ ID NO: 614280

SEQ ID NO: 689261 - RNA, 60 nt, Homo Sapiens; identical to SEQ ID NO: 614281

SEQ ID NO: 689262 - RNA, 60 nt, Homo Sapiens; identical to SEQ ID NO: 614282

SEQ ID NO: 689263 - RNA, 60 nt, Homo Sapiens; identical to SEQ ID NO: 614283

SEQ ID NO: 689264 - RNA, 60 nt, Homo Sapiens; identical to SEQ ID NO: 614284

SEQ ID NO: 689265 - RNA, 60 nt, Homo Sapiens; identical to SEQ ID NO: 614285

SEQ ID NO: 689266 - RNA, 60 nt, Homo Sapiens; identical to SEQ ID NO: 614286

SEQ ID NO: 689267 - RNA, 60 nt, Homo Sapiens; identical to SEQ ID NO: 614287

SEQ ID NO: 689268 - RNA, 60 nt, Homo Sapiens; identical to SEQ ID NO: 614288

SEQ ID NO: 689269 - RNA, 60 nt, Homo Sapiens; identical to SEQ ID NO: 614289

SEQ ID NO: 689270 - RNA, 60 nt, Homo Sapiens; identical to SEQ ID NO: 614290

SEQ ID NO: 689271 - RNA, 60 nt, Homo Sapiens; identical to SEQ ID NO: 614291

SEQ ID NO: 689272 - RNA, 60 nt, Homo Sapiens; identical to SEQ ID NO: 614292

SEQ ID NO: 689273 - RNA, 60 nt, Homo Sapiens; identical to SEQ ID NO: 614293

SEQ ID NO: 689274 - RNA, 60 nt, Homo Sapiens; identical to SEQ ID NO: 614294

SEQ ID NO: 689275 - RNA, 60 nt, Homo Sapiens; identical to SEQ ID NO: 614295

SEQ ID NO: 689276 - RNA, 60 nt, Homo Sapiens; identical to SEQ ID NO: 614296

SEQ ID NO: 689277 - RNA, 60 nt, Homo Sapiens; identical to SEQ ID NO: 614297

SEQ ID NO: 689278 - RNA, 60 nt, Homo Sapiens; identical to SEQ ID NO: 614298

SEQ ID NO: 689279 - RNA, 60 nt, Homo Sapiens; identical to SEQ ID NO: 614299

SEQ ID NO: 689280 - RNA, 60 nt, Homo Sapiens; identical to SEQ ID NO: 614300

SEQ ID NO: 689281 - RNA, 60 nt, Homo Sapiens; identical to SEQ ID NO: 614301

SEQ ID NO: 689282 - RNA, 60 nt, Homo Sapiens; identical to SEQ ID NO: 614302

SEQ ID NO: 689283 - RNA, 60 nt, Homo Sapiens; identical to SEQ ID NO: 614303

SEQ ID NO: 689284 - RNA, 60 nt, Homo Sapiens; identical to SEQ ID NO: 614304

SEQ ID NO: 689285 - RNA, 60 nt, Homo Sapiens; identical to SEQ ID NO: 614305

SEQ ID NO: 689286 - RNA, 60 nt, Homo Sapiens; identical to SEQ ID NO: 614306

SEQ ID NO: 689287 - RNA, 60 nt, Homo Sapiens; identical to SEQ ID NO: 614307

SEQ ID NO: 689288 - RNA, 60 nt, Homo Sapiens; identical to SEQ ID NO: 614308

SEQ ID NO: 689289 - RNA, 60 nt, Homo Sapiens; identical to SEQ ID NO: 614309

SEQ ID NO: 689290 - RNA, 60 nt, Homo Sapiens; identical to SEQ ID NO: 614310

SEQ ID NO: 689291 - RNA, 60 nt, Homo Sapiens; identical to SEQ ID NO: 614311

SEQ ID NO: 689292 - RNA, 60 nt, Homo Sapiens; identical to SEQ ID NO: 614312

SEQ ID NO: 689293 - RNA, 60 nt, Homo Sapiens; identical to SEQ ID NO: 614313

SEQ ID NO: 689294 - RNA, 60 nt, Homo Sapiens; identical to SEQ ID NO: 614314

SEQ ID NO: 689295 - RNA, 60 nt, Homo Sapiens; identical to SEQ ID NO: 614315

SEQ ID NO: 689296 - RNA, 60 nt, Homo Sapiens; identical to SEQ ID NO: 614316

SEQ ID NO: 689297 - RNA, 60 nt, Homo Sapiens; identical to SEQ ID NO: 614317

SEQ ID NO: 689298 - RNA, 60 nt, Homo Sapiens; identical to SEQ ID NO: 614318

SEQ ID NO: 689299 - RNA, 60 nt, Homo Sapiens; identical to SEQ ID NO: 614319

SEQ ID NO: 689300 - RNA, 60 nt, Homo Sapiens; identical to SEQ ID NO: 614320

SEQ ID NO: 689301 - RNA, 60 nt, Homo Sapiens; identical to SEQ ID NO: 614321

SEQ ID NO: 689302 - RNA, 58 nt, Homo Sapiens; identical to SEQ ID NO: 502655

SEQ ID NO: 689303 - RNA, 60 nt, Homo Sapiens; identical to SEQ ID NO: 614323

SEQ ID NO: 689304 - RNA, 60 nt, Homo Sapiens; identical to SEQ ID NO: 614324

SEQ ID NO: 689305 - RNA, 60 nt, Homo Sapiens; identical to SEQ ID NO: 614325

SEQ ID NO: 689306 - RNA, 60 nt, Homo Sapiens; identical to SEQ ID NO: 614326

SEQ ID NO: 689307 - RNA, 60 nt, Homo Sapiens; identical to SEQ ID NO: 614327

SEQ ID NO: 689308 - RNA, 60 nt, Homo Sapiens; identical to SEQ ID NO: 614328

SEQ ID NO: 689309 - RNA, 60 nt, Homo Sapiens; identical to SEQ ID NO: 614329

SEQ ID NO: 689310 - RNA, 60 nt, Homo Sapiens; identical to SEQ ID NO: 614330

SEQ ID NO: 689311 - RNA, 60 nt, Homo Sapiens; identical to SEQ ID NO: 614331

SEQ ID NO: 689312 - RNA, 60 nt, Homo Sapiens; identical to SEQ ID NO: 614332

SEQ ID NO: 689313 - RNA, 60 nt, Homo Sapiens; identical to SEQ ID NO: 614333

SEQ ID NO: 689314 - RNA, 60 nt, Homo Sapiens; identical to SEQ ID NO: 614334

SEQ ID NO: 689315 - RNA, 60 nt, Homo Sapiens; identical to SEQ ID NO: 614335

SEQ ID NO: 689316 - RNA, 60 nt, Homo Sapiens; identical to SEQ ID NO: 614336

SEQ ID NO: 689317 - RNA, 60 nt, Homo Sapiens; identical to SEQ ID NO: 614337

SEQ ID NO: 689318 - RNA, 60 nt, Homo Sapiens; identical to SEQ ID NO: 614338

SEQ ID NO: 689319 - RNA, 60 nt, Homo Sapiens; identical to SEQ ID NO: 614339

SEQ ID NO: 689320 - RNA, 60 nt, Homo Sapiens; identical to SEQ ID NO: 614340

SEQ ID NO: 689321 - RNA, 60 nt, Homo Sapiens; identical to SEQ ID NO: 614341

SEQ ID NO: 689322 - RNA, 60 nt, Homo Sapiens; identical to SEQ ID NO: 614342

SEQ ID NO: 689323 - RNA, 60 nt, Homo Sapiens; identical to SEQ ID NO: 614343

SEQ ID NO: 689324 - RNA, 60 nt, Homo Sapiens; identical to SEQ ID NO: 614344

SEQ ID NO: 689325 - RNA, 60 nt, Homo Sapiens; identical to SEQ ID NO: 614345

SEQ ID NO: 689326 - RNA, 60 nt, Homo Sapiens; identical to SEQ ID NO: 614346

SEQ ID NO: 689327 - RNA, 60 nt, Homo Sapiens; identical to SEQ ID NO: 614347

SEQ ID NO: 689328 - RNA, 60 nt, Homo Sapiens; identical to SEQ ID NO: 614348

SEQ ID NO: 689329 - RNA, 60 nt, Homo Sapiens; identical to SEQ ID NO: 614349

SEQ ID NO: 689330 - RNA, 60 nt, Homo Sapiens; identical to SEQ ID NO: 614350

SEQ ID NO: 689331 - RNA, 60 nt, Homo Sapiens; identical to SEQ ID NO: 614351

SEQ ID NO: 689332 - RNA, 60 nt, Homo Sapiens; identical to SEQ ID NO: 614352

SEQ ID NO: 689333 - RNA, 60 nt, Homo Sapiens; identical to SEQ ID NO: 614353

SEQ ID NO: 689334 - RNA, 60 nt, Homo Sapiens; identical to SEQ ID NO: 614354

SEQ ID NO: 689335 - RNA, 60 nt, Homo Sapiens; identical to SEQ ID NO: 614355

SEQ ID NO: 689336 - RNA, 60 nt, Homo Sapiens; identical to SEQ ID NO: 614356

SEQ ID NO: 689337 - RNA, 60 nt, Homo Sapiens; identical to SEQ ID NO: 614357

SEQ ID NO: 689338 - RNA, 60 nt, Homo Sapiens; identical to SEQ ID NO: 614358

SEQ ID NO: 689339 - RNA, 60 nt, Homo Sapiens; identical to SEQ ID NO: 614359

SEQ ID NO: 689340 - RNA, 60 nt, Homo Sapiens; identical to SEQ ID NO: 614360

SEQ ID NO: 689341 - RNA, 60 nt, Homo Sapiens; identical to SEQ ID NO: 614361

SEQ ID NO: 689342 - RNA, 60 nt, Homo Sapiens; identical to SEQ ID NO: 614362

SEQ ID NO: 689343 - RNA, 60 nt, Homo Sapiens; identical to SEQ ID NO: 614363

SEQ ID NO: 689344 - RNA, 60 nt, Homo Sapiens; identical to SEQ ID NO: 614364

SEQ ID NO: 689345 - RNA, 60 nt, Homo Sapiens; identical to SEQ ID NO: 614365

SEQ ID NO: 689346 - RNA, 60 nt, Homo Sapiens; identical to SEQ ID NO: 614366

SEQ ID NO: 689347 - RNA, 60 nt, Homo Sapiens; identical to SEQ ID NO: 614367

SEQ ID NO: 689348 - RNA, 60 nt, Homo Sapiens; identical to SEQ ID NO: 614368

SEQ ID NO: 689349 - RNA, 60 nt, Homo Sapiens; identical to SEQ ID NO: 614369

SEQ ID NO: 689350 - RNA, 60 nt, Homo Sapiens; identical to SEQ ID NO: 614370

SEQ ID NO: 689351 - RNA, 60 nt, Homo Sapiens; identical to SEQ ID NO: 614371

SEQ ID NO: 689352 - RNA, 60 nt, Homo Sapiens; identical to SEQ ID NO: 614372

SEQ ID NO: 689353 - RNA, 60 nt, Homo Sapiens; identical to SEQ ID NO: 614373

SEQ ID NO: 689354 - RNA, 60 nt, Homo Sapiens; identical to SEQ ID NO: 614374

SEQ ID NO: 689355 - RNA, 60 nt, Homo Sapiens; identical to SEQ ID NO: 614375

SEQ ID NO: 689356 - RNA, 60 nt, Homo Sapiens; identical to SEQ ID NO: 614376

SEQ ID NO: 689357 - RNA, 60 nt, Homo Sapiens; identical to SEQ ID NO: 614377

SEQ ID NO: 689358 - RNA, 60 nt, Homo Sapiens; identical to SEQ ID NO: 614378

SEQ ID NO: 689359 - RNA, 60 nt, Homo Sapiens; identical to SEQ ID NO: 614379

SEQ ID NO: 689360 - RNA, 60 nt, Homo Sapiens; identical to SEQ ID NO: 614380

SEQ ID NO: 689361 - RNA, 60 nt, Homo Sapiens; identical to SEQ ID NO: 614381

SEQ ID NO: 689362 - RNA, 60 nt, Homo Sapiens; identical to SEQ ID NO: 614382

SEQ ID NO: 689363 - RNA, 60 nt, Homo Sapiens; identical to SEQ ID NO: 614383

SEQ ID NO: 689364 - RNA, 60 nt, Homo Sapiens; identical to SEQ ID NO: 614384

SEQ ID NO: 689365 - RNA, 60 nt, Homo Sapiens; identical to SEQ ID NO: 614385

SEQ ID NO: 689366 - RNA, 60 nt, Homo Sapiens; identical to SEQ ID NO: 614386

SEQ ID NO: 689367 - RNA, 60 nt, Homo Sapiens; identical to SEQ ID NO: 614387

SEQ ID NO: 689368 - RNA, 60 nt, Homo Sapiens; identical to SEQ ID NO: 614388

SEQ ID NO: 689369 - RNA, 60 nt, Homo Sapiens; identical to SEQ ID NO: 614389

SEQ ID NO: 689370 - RNA, 60 nt, Homo Sapiens; identical to SEQ ID NO: 614390

SEQ ID NO: 689371 - RNA, 60 nt, Homo Sapiens; identical to SEQ ID NO: 614391

SEQ ID NO: 689372 - RNA, 60 nt, Homo Sapiens; identical to SEQ ID NO: 614392

SEQ ID NO: 689373 - RNA, 60 nt, Homo Sapiens; identical to SEQ ID NO: 614393

SEQ ID NO: 689374 - RNA, 60 nt, Homo Sapiens; identical to SEQ ID NO: 614394

SEQ ID NO: 689375 - RNA, 60 nt, Homo Sapiens; identical to SEQ ID NO: 614395

SEQ ID NO: 689376 - RNA, 60 nt, Homo Sapiens; identical to SEQ ID NO: 614396

SEQ ID NO: 689377 - RNA, 60 nt, Homo Sapiens; identical to SEQ ID NO: 614397

SEQ ID NO: 689378 - RNA, 60 nt, Homo Sapiens; identical to SEQ ID NO: 614398

SEQ ID NO: 689379 - RNA, 60 nt, Homo Sapiens; identical to SEQ ID NO: 614399

SEQ ID NO: 689380 - RNA, 60 nt, Homo Sapiens; identical to SEQ ID NO: 614400

SEQ ID NO: 689381 - RNA, 60 nt, Homo Sapiens; identical to SEQ ID NO: 614401

SEQ ID NO: 689382 - RNA, 60 nt, Homo Sapiens; identical to SEQ ID NO: 614402

SEQ ID NO: 689383 - RNA, 60 nt, Homo Sapiens; identical to SEQ ID NO: 614403

SEQ ID NO: 689384 - RNA, 60 nt, Homo Sapiens; identical to SEQ ID NO: 614404

SEQ ID NO: 689385 - RNA, 60 nt, Homo Sapiens; identical to SEQ ID NO: 614405

SEQ ID NO: 689386 - RNA, 60 nt, Homo Sapiens; identical to SEQ ID NO: 614406

SEQ ID NO: 689387 - RNA, 60 nt, Homo Sapiens; identical to SEQ ID NO: 614407

SEQ ID NO: 689388 - RNA, 60 nt, Homo Sapiens; identical to SEQ ID NO: 614408

SEQ ID NO: 689389 - RNA, 60 nt, Homo Sapiens; identical to SEQ ID NO: 614409

SEQ ID NO: 689390 - RNA, 60 nt, Homo Sapiens; identical to SEQ ID NO: 614410

SEQ ID NO: 689391 - RNA, 60 nt, Homo Sapiens; identical to SEQ ID NO: 614411

SEQ ID NO: 689392 - RNA, 60 nt, Homo Sapiens; identical to SEQ ID NO: 614412

SEQ ID NO: 689393 - RNA, 60 nt, Homo Sapiens; identical to SEQ ID NO: 614413

SEQ ID NO: 689394 - RNA, 60 nt, Homo Sapiens; identical to SEQ ID NO: 614414

SEQ ID NO: 689395 - RNA, 60 nt, Homo Sapiens; identical to SEQ ID NO: 614415

SEQ ID NO: 689396 - RNA, 60 nt, Homo Sapiens; identical to SEQ ID NO: 614416

SEQ ID NO: 689397 - RNA, 60 nt, Homo Sapiens; identical to SEQ ID NO: 614417

SEQ ID NO: 689398 - RNA, 60 nt, Homo Sapiens; identical to SEQ ID NO: 614418

SEQ ID NO: 689399 - RNA, 60 nt, Homo Sapiens; identical to SEQ ID NO: 614419

SEQ ID NO: 689400 - RNA, 60 nt, Homo Sapiens; identical to SEQ ID NO: 614420

SEQ ID NO: 689401 - RNA, 60 nt, Homo Sapiens; identical to SEQ ID NO: 614421

SEQ ID NO: 689402 - RNA, 60 nt, Homo Sapiens; identical to SEQ ID NO: 614422

SEQ ID NO: 689403 - RNA, 60 nt, Homo Sapiens; identical to SEQ ID NO: 614423

SEQ ID NO: 689404 - RNA, 60 nt, Homo Sapiens; identical to SEQ ID NO: 614424

SEQ ID NO: 689405 - RNA, 60 nt, Homo Sapiens; identical to SEQ ID NO: 614425

SEQ ID NO: 689406 - RNA, 60 nt, Homo Sapiens; identical to SEQ ID NO: 614426

SEQ ID NO: 689407 - RNA, 60 nt, Homo Sapiens; identical to SEQ ID NO: 614427

SEQ ID NO: 689408 - RNA, 60 nt, Homo Sapiens; identical to SEQ ID NO: 614428

SEQ ID NO: 689409 - RNA, 60 nt, Homo Sapiens; identical to SEQ ID NO: 614429

SEQ ID NO: 689410 - RNA, 60 nt, Homo Sapiens; identical to SEQ ID NO: 614430

SEQ ID NO: 689411 - RNA, 60 nt, Homo Sapiens; identical to SEQ ID NO: 614431

SEQ ID NO: 689412 - RNA, 60 nt, Homo Sapiens; identical to SEQ ID NO: 614432

SEQ ID NO: 689413 - RNA, 60 nt, Homo Sapiens; identical to SEQ ID NO: 614433

SEQ ID NO: 689414 - RNA, 60 nt, Homo Sapiens; identical to SEQ ID NO: 614434

SEQ ID NO: 689415 - RNA, 60 nt, Homo Sapiens; identical to SEQ ID NO: 614435

SEQ ID NO: 689416 - RNA, 60 nt, Homo Sapiens; identical to SEQ ID NO: 614436

SEQ ID NO: 689417 - RNA, 60 nt, Homo Sapiens; identical to SEQ ID NO: 614437

SEQ ID NO: 689418 - RNA, 60 nt, Homo Sapiens; identical to SEQ ID NO: 614438

SEQ ID NO: 689419 - RNA, 60 nt, Homo Sapiens; identical to SEQ ID NO: 614439

SEQ ID NO: 689420 - RNA, 60 nt, Homo Sapiens; identical to SEQ ID NO: 614440

SEQ ID NO: 689421 - RNA, 60 nt, Homo Sapiens; identical to SEQ ID NO: 614441

SEQ ID NO: 689422 - RNA, 60 nt, Homo Sapiens; identical to SEQ ID NO: 614442

SEQ ID NO: 689423 - RNA, 60 nt, Homo Sapiens; identical to SEQ ID NO: 614443

SEQ ID NO: 689424 - RNA, 60 nt, Homo Sapiens; identical to SEQ ID NO: 614444

SEQ ID NO: 689425 - RNA, 60 nt, Homo Sapiens; identical to SEQ ID NO: 614445

SEQ ID NO: 689426 - RNA, 60 nt, Homo Sapiens; identical to SEQ ID NO: 614446

SEQ ID NO: 689427 - RNA, 60 nt, Homo Sapiens; identical to SEQ ID NO: 614447

SEQ ID NO: 689428 - RNA, 60 nt, Homo Sapiens; identical to SEQ ID NO: 614448

SEQ ID NO: 689429 - RNA, 60 nt, Homo Sapiens; identical to SEQ ID NO: 614449

SEQ ID NO: 689430 - RNA, 60 nt, Homo Sapiens; identical to SEQ ID NO: 614450

SEQ ID NO: 689431 - RNA, 60 nt, Homo Sapiens; identical to SEQ ID NO: 614451

SEQ ID NO: 689432 - RNA, 60 nt, Homo Sapiens; identical to SEQ ID NO: 614452

SEQ ID NO: 689433 - RNA, 60 nt, Homo Sapiens; identical to SEQ ID NO: 614453

SEQ ID NO: 689434 - RNA, 60 nt, Homo Sapiens; identical to SEQ ID NO: 614454

SEQ ID NO: 689435 - RNA, 60 nt, Homo Sapiens; identical to SEQ ID NO: 614455

SEQ ID NO: 689436 - RNA, 60 nt, Homo Sapiens; identical to SEQ ID NO: 614456

SEQ ID NO: 689437 - RNA, 60 nt, Homo Sapiens; identical to SEQ ID NO: 614457

SEQ ID NO: 689438 - RNA, 60 nt, Homo Sapiens; identical to SEQ ID NO: 614458

SEQ ID NO: 689439 - RNA, 60 nt, Homo Sapiens; identical to SEQ ID NO: 614459

SEQ ID NO: 689440 - RNA, 60 nt, Homo Sapiens; identical to SEQ ID NO: 614460

SEQ ID NO: 689441 - RNA, 60 nt, Homo Sapiens; identical to SEQ ID NO: 614461

SEQ ID NO: 689442 - RNA, 60 nt, Homo Sapiens; identical to SEQ ID NO: 614462

SEQ ID NO: 689443 - RNA, 60 nt, Homo Sapiens; identical to SEQ ID NO: 614463

SEQ ID NO: 689444 - RNA, 60 nt, Homo Sapiens; identical to SEQ ID NO: 614464

SEQ ID NO: 689445 - RNA, 60 nt, Homo Sapiens; identical to SEQ ID NO: 614465

SEQ ID NO: 689446 - RNA, 60 nt, Homo Sapiens; identical to SEQ ID NO: 614466

SEQ ID NO: 689447 - RNA, 60 nt, Homo Sapiens; identical to SEQ ID NO: 614467

SEQ ID NO: 689448 - RNA, 60 nt, Homo Sapiens; identical to SEQ ID NO: 614468

SEQ ID NO: 689449 - RNA, 60 nt, Homo Sapiens; identical to SEQ ID NO: 614469

SEQ ID NO: 689450 - RNA, 60 nt, Homo Sapiens; identical to SEQ ID NO: 614470

SEQ ID NO: 689451 - RNA, 60 nt, Homo Sapiens; identical to SEQ ID NO: 614471

SEQ ID NO: 689452 - RNA, 60 nt, Homo Sapiens; identical to SEQ ID NO: 614472

SEQ ID NO: 689453 - RNA, 60 nt, Homo Sapiens; identical to SEQ ID NO: 614473

SEQ ID NO: 689454 - RNA, 60 nt, Homo Sapiens; identical to SEQ ID NO: 614474

SEQ ID NO: 689455 - RNA, 60 nt, Homo Sapiens; identical to SEQ ID NO: 614475

SEQ ID NO: 689456 - RNA, 60 nt, Homo Sapiens; identical to SEQ ID NO: 614476

SEQ ID NO: 689457 - RNA, 60 nt, Homo Sapiens; identical to SEQ ID NO: 614477

SEQ ID NO: 689458 - RNA, 60 nt, Homo Sapiens; identical to SEQ ID NO: 614478

SEQ ID NO: 689459 - RNA, 60 nt, Homo Sapiens; identical to SEQ ID NO: 614479

SEQ ID NO: 689460 - RNA, 60 nt, Homo Sapiens; identical to SEQ ID NO: 614480

SEQ ID NO: 689461 - RNA, 60 nt, Homo Sapiens; identical to SEQ ID NO: 614481

SEQ ID NO: 689462 - RNA, 60 nt, Homo Sapiens; identical to SEQ ID NO: 614482

SEQ ID NO: 689463 - RNA, 60 nt, Homo Sapiens; identical to SEQ ID NO: 614483

SEQ ID NO: 689464 - RNA, 60 nt, Homo Sapiens; identical to SEQ ID NO: 614484

SEQ ID NO: 689465 - RNA, 60 nt, Homo Sapiens; identical to SEQ ID NO: 614485

SEQ ID NO: 689466 - RNA, 60 nt, Homo Sapiens; identical to SEQ ID NO: 614486

SEQ ID NO: 689467 - RNA, 60 nt, Homo Sapiens; identical to SEQ ID NO: 614487

SEQ ID NO: 689468 - RNA, 60 nt, Homo Sapiens; identical to SEQ ID NO: 614488

SEQ ID NO: 689469 - RNA, 60 nt, Homo Sapiens; identical to SEQ ID NO: 614489

SEQ ID NO: 689470 - RNA, 60 nt, Homo Sapiens; identical to SEQ ID NO: 614490

SEQ ID NO: 689471 - RNA, 60 nt, Homo Sapiens; identical to SEQ ID NO: 614491

SEQ ID NO: 689472 - RNA, 60 nt, Homo Sapiens; identical to SEQ ID NO: 614492

SEQ ID NO: 689473 - RNA, 60 nt, Homo Sapiens; identical to SEQ ID NO: 614493

SEQ ID NO: 689474 - RNA, 60 nt, Homo Sapiens; identical to SEQ ID NO: 614494

SEQ ID NO: 689475 - RNA, 60 nt, Homo Sapiens; identical to SEQ ID NO: 614495

SEQ ID NO: 689476 - RNA, 60 nt, Homo Sapiens; identical to SEQ ID NO: 614496

SEQ ID NO: 689477 - RNA, 60 nt, Homo Sapiens; identical to SEQ ID NO: 614497

SEQ ID NO: 689478 - RNA, 60 nt, Homo Sapiens; identical to SEQ ID NO: 614498

SEQ ID NO: 689479 - RNA, 60 nt, Homo Sapiens; identical to SEQ ID NO: 614499

SEQ ID NO: 689480 - RNA, 60 nt, Homo Sapiens; identical to SEQ ID NO: 614500

SEQ ID NO: 689481 - RNA, 60 nt, Homo Sapiens; identical to SEQ ID NO: 614501

SEQ ID NO: 689482 - RNA, 60 nt, Homo Sapiens; identical to SEQ ID NO: 614502

SEQ ID NO: 689483 - RNA, 60 nt, Homo Sapiens; identical to SEQ ID NO: 614503

SEQ ID NO: 689484 - RNA, 60 nt, Homo Sapiens; identical to SEQ ID NO: 614504

SEQ ID NO: 689485 - RNA, 60 nt, Homo Sapiens; identical to SEQ ID NO: 614505

SEQ ID NO: 689486 - RNA, 60 nt, Homo Sapiens; identical to SEQ ID NO: 614506

SEQ ID NO: 689487 - RNA, 60 nt, Homo Sapiens; identical to SEQ ID NO: 614507

SEQ ID NO: 689488 - RNA, 60 nt, Homo Sapiens; identical to SEQ ID NO: 614508

SEQ ID NO: 689489 - RNA, 60 nt, Homo Sapiens; identical to SEQ ID NO: 614509

SEQ ID NO: 689490 - RNA, 60 nt, Homo Sapiens; identical to SEQ ID NO: 614510

SEQ ID NO: 689491 - RNA, 60 nt, Homo Sapiens; identical to SEQ ID NO: 614511

SEQ ID NO: 689492 - RNA, 60 nt, Homo Sapiens; identical to SEQ ID NO: 614512

SEQ ID NO: 689493 - RNA, 60 nt, Homo Sapiens; identical to SEQ ID NO: 614513

SEQ ID NO: 689494 - RNA, 60 nt, Homo Sapiens; identical to SEQ ID NO: 614514

SEQ ID NO: 689495 - RNA, 60 nt, Homo Sapiens; identical to SEQ ID NO: 614515

SEQ ID NO: 689496 - RNA, 60 nt, Homo Sapiens; identical to SEQ ID NO: 614516

SEQ ID NO: 689497 - RNA, 60 nt, Homo Sapiens; identical to SEQ ID NO: 614517

SEQ ID NO: 689498 - RNA, 60 nt, Homo Sapiens; identical to SEQ ID NO: 614518

SEQ ID NO: 689499 - RNA, 60 nt, Homo Sapiens; identical to SEQ ID NO: 614519

SEQ ID NO: 689500 - RNA, 60 nt, Homo Sapiens; identical to SEQ ID NO: 614520

SEQ ID NO: 689501 - RNA, 60 nt, Homo Sapiens; identical to SEQ ID NO: 614521

SEQ ID NO: 689502 - RNA, 60 nt, Homo Sapiens; identical to SEQ ID NO: 614522

SEQ ID NO: 689503 - RNA, 60 nt, Homo Sapiens; identical to SEQ ID NO: 614523

SEQ ID NO: 689504 - RNA, 60 nt, Homo Sapiens; identical to SEQ ID NO: 614524

SEQ ID NO: 689505 - RNA, 61 nt, Homo Sapiens
cuuauuuauaaauauuguaaguuugugucgaugaguguaaguuggcagugcgcacgucucg

SEQ ID NO: 689506 - RNA, 61 nt, Homo Sapiens
cuuuuguaaugccauuuucuaaacuuauuucugaguguagucucagcuuaaaguuguguaa

SEQ ID NO: 689507 - RNA, 61 nt, Homo Sapiens
augaaccagcccuuucucagagccagugaugugaguguaucagaaugccagggagggcacc

SEQ ID NO: 689508 - RNA, 61 nt, Homo Sapiens
gaaaacaaaauguuauuuuuauaccauaacuugaguguauugccaaaauuuggaaauccuu

SEQ ID NO: 689509 - RNA, 61 nt, Homo Sapiens
aggauuacaggcaugagccacugcgcccggcugaguguacuaguaguuaagagaauaaacu

SEQ ID NO: 689510 - RNA, 61 nt, Homo Sapiens
caggccacaggagacuccgcuuuuacuucccugaguguaggucuuccugaaacucucaagc

SEQ ID NO: 689511 - RNA, 52 nt, Homo Sapiens
uauuuuauaagaaauuauagagugaguguauuuuccuuguguauauauuaaa

SEQ ID NO: 689512 - RNA, 61 nt, Homo Sapiens
acucuuaaaaaaaccaaacaaaacucguaucugaguguaacuuugccaauauuuuaaaagc

SEQ ID NO: 689513 - RNA, 61 nt, Homo Sapiens
cccaguguuuuguuagaauaauguaguuaggugaguguaaauaaauuuauauaaagugaga

SEQ ID NO: 689514 - RNA, 61 nt, Homo Sapiens
auauagaugucuguguauacauauguaugugugaguguauguauacacacacacacacaca

SEQ ID NO: 689515 - RNA, 61 nt, Homo Sapiens
uggguagcucuugcuuuaauauucuguuuggugaguguaagggauucugcaagggacaggg

SEQ ID NO: 689516 - RNA, 61 nt, Homo Sapiens
gguagccauccaucagugcuuuuaguuauuaugaguguaggacacugagccauccgugggu

SEQ ID NO: 689517 - RNA, 61 nt, Homo Sapiens
gaaauauaauucuagguauuugauaggguauugaguguauuuuguguguguguggaugugu

SEQ ID NO: 689518 - RNA, 61 nt, Homo Sapiens
agacaucuccagugugccagacaaauaggagugaguguaugugugugugugugugugugug

SEQ ID NO: 689519 - RNA, 61 nt, Homo Sapiens
uaguuuucagugaucagaagcagcaguuauuugaguguaugaauggaaugaugaucacugu

SEQ ID NO: 689520 - RNA, 61 nt, Homo Sapiens
uugauauuugaaauucuucuguaagccugucugaguguauguggaaacgauugucaaaucu

SEQ ID NO: 689521 - RNA, 61 nt, Homo Sapiens
ugucagacagacacacuuuugaagguaaacuugaguguaauuauaauaaaaauguuaacca

SEQ ID NO: 689522 - RNA, 61 nt, Homo Sapiens
ugugugugugauuuuuuuuuaugggucugugugaguguaugggaugaauggguuucuauau

SEQ ID NO: 689523 - RNA, 61 nt, Homo Sapiens
uacuacuuacucguaggauuuacacagucugugaguguagaguaucaacacuuacaagcuc

SEQ ID NO: 689524 - RNA, 61 nt, Homo Sapiens
uccccauagugggccccuuguuucauccucuugaguguaugugauucugaagcuaaagagc

SEQ ID NO: 689525 - RNA, 61 nt, Homo Sapiens
uuuguauuuaugugugugugguuuaugugucugaguguagcuguucaugagggcaucuggu

SEQ ID NO: 689526 - RNA, 61 nt, Homo Sapiens
aauuugucacauguaucaccuacaaauuauaugaguguaugaacuacgcugauuugaucuu

SEQ ID NO: 689527 - RNA, 61 nt, Homo Sapiens
cauaacuuauaugcacuggggugcaucgacuugaguguaaacuccagauuuucuucuuuau

SEQ ID NO: 689528 - RNA, 61 nt, Homo Sapiens
uaggaacgauaccagcacaucccugucagggugaguguaauucauuacaucaaggagcugc

SEQ ID NO: 689529 - RNA, 61 nt, Homo Sapiens
cuguauuaacacaucacuugcuguuuccuacugaguguaccacugccuucccuucuagccc

SEQ ID NO: 689530 - RNA, 61 nt, Homo Sapiens
ucuugguuaaaaggccacugguagagucaucugaguguagagaaugucccuucacugcugg

SEQ ID NO: 689531 - RNA, 61 nt, Homo Sapiens
aaaacuugacuggaacaugccucugcauuucugaguguagaaauuaaaugaagccacucac

SEQ ID NO: 689532 - RNA, 61 nt, Homo Sapiens
uguagcuauuuuuuguugcuuggcuuuugaaugaguguaaauuguuuucuuuuguguauuu

SEQ ID NO: 689533 - RNA, 61 nt, Homo Sapiens
uaccauuccaggagugucuaaagccgagcuuugaguguacaugauugauaggacuugaaga

SEQ ID NO: 689534 - RNA, 61 nt, Homo Sapiens
ccagauauuacugagaagaguguauugacucugaguguaagagaguauguguuuuuuuguu

SEQ ID NO: 689535 - RNA, 61 nt, Homo Sapiens
aauuuuuacccuaaugucuucauaaaguacuugaguguaauguuuguuaccuccaacagaa

SEQ ID NO: 689536 - RNA, 61 nt, Homo Sapiens
gggacccuccauuucucccccucacccaugcugaguguagagccggggccuggguggcggg

SEQ ID NO: 689537 - RNA, 61 nt, Homo Sapiens
cuagcauuuuaauacagugugccuugauguuugaguguaauuugcucuuuuguguuucauu

SEQ ID NO: 689538 - RNA, 61 nt, Homo Sapiens
cugugcaauuuuuuucucaguaccuauuuaaugaguguauugauuuaaucaccauaaacca

SEQ ID NO: 689539 - RNA, 61 nt, Homo Sapiens
cuuucuuuucucucaucucuaagugccagagugaguguacacucccuuccugaaccuaaug

SEQ ID NO: 689540 - RNA, 61 nt, Homo Sapiens
uguuuaaaggaaacaaaauggagagagugagugaguguauguuggugugcuaccuauucuu

SEQ ID NO: 689541 - RNA, 61 nt, Homo Sapiens
aucugcuuacuucacuauugugcagugauagugaguguaaauauauggcucuuucuaucca

SEQ ID NO: 689542 - RNA, 61 nt, Homo Sapiens
acagcuuucauuaggaaaacaccuuugagcaugaguguaucuuuuuuccuaaggauaaagu

SEQ ID NO: 689543 - RNA, 61 nt, Homo Sapiens
gguggugaugcuaccauuacuaacuucagagugaguguaggagggcuguugauuuaugcuu

SEQ ID NO: 689544 - RNA, 61 nt, Homo Sapiens
gagacuagacuacuguuguccagggucaauuugaguguaaagaaaauguagacaaggaauu

SEQ ID NO: 689545 - RNA, 61 nt, Homo Sapiens
ggggcuagcccuaccugauacccugugucaaugaguguaccuuggagagcuauccacucag

SEQ ID NO: 689546 - RNA, 61 nt, Homo Sapiens
uuccaguuuggccuuaugcuucaugcagacuugaguguaugcaggauuucauuaucugccu

SEQ ID NO: 689547 - RNA, 61 nt, Homo Sapiens
ucugugaaacccuuggguccuggaagcagugugaguguaaauguguaguguuugguuucau

SEQ ID NO: 689548 - RNA, 61 nt, Homo Sapiens
cuauucuuugagucauuguuacugaggcaguugaguguaaggagcuggcugcaguuuauuc

SEQ ID NO: 689549 - RNA, 61 nt, Homo Sapiens
aaaaauggaugucaagauguuauguaaaagaugaguguaauugugaaauguucuauacacu

SEQ ID NO: 689550 - RNA, 61 nt, Homo Sapiens
uuuuagaauugcccagugcugccagagugagugaguguaauucuccuuucagguaaagaua

SEQ ID NO: 689551 - RNA, 61 nt, Homo Sapiens
gcuggaaccaccaaggaguguggaauguccuugaguguauuauuuaugcaagucacaguca

SEQ ID NO: 689552 - RNA, 61 nt, Homo Sapiens
ucccuuuaauguguucauguuaaaaccuauuugaguguaagacuugcccuuucuaacaaua

SEQ ID NO: 689553 - RNA, 61 nt, Homo Sapiens
ggcuuaccuccucauggcagccuacucuccuugaguguaugaguagccaggguaaggggua

SEQ ID NO: 689554 - RNA, 61 nt, Homo Sapiens
uucuuuuaguuuguuuuuugcugugugcuuuugaguguauuccaaagacaaaaugugccca

SEQ ID NO: 689555 - RNA, 61 nt, Homo Sapiens
auacuuaauauguaggauguaaauucugauaugaguguaauagaacaaaaaaagaguuaaa

SEQ ID NO: 689556 - RNA, 61 nt, Homo Sapiens
cauuaaggacauuaugcuucucaacuugucaugaguguaagccugccaguuuugcugacuc

SEQ ID NO: 689557 - RNA, 61 nt, Homo Sapiens
auggaaaaagcaaacagccuaucaggaaaguugaguguaagaaagcuccuguucugcaggc

SEQ ID NO: 689558 - RNA, 61 nt, Homo Sapiens
ggaucucuaaggauuucuuaauuugaaguauugaguguaugugaaagaaguucagauuggc

SEQ ID NO: 689559 - RNA, 61 nt, Homo Sapiens
gccccaucuugugguaacuucuguucuuucuugaguguauaagagaaacuucgcuaaccaa

SEQ ID NO: 689560 - RNA, 61 nt, Homo Sapiens
uccauguggauaucaguuacuucaugaugugugaguguaauuuuugccacauacauagauc

SEQ ID NO: 689561 - RNA, 61 nt, Homo Sapiens
gaaacaaggugaaaauauagcacaauuaaaaugaguguaauuuuuuggauucagggcuccu

SEQ ID NO: 689562 - RNA, 61 nt, Homo Sapiens
aaucugaauuuuuaaaagagucccguuaaacugaguguagauaccuaagugugaaugucuc

SEQ ID NO: 689563 - RNA, 61 nt, Homo Sapiens
ggcuuuugugcucccauacgcccccugguggugaguguaaagaagacuuugccucucacaa

SEQ ID NO: 689564 - RNA, 61 nt, Homo Sapiens
auguagguaaaaauauauacaaacacaauugugaguguauguuuugcaucagcauagaugu

SEQ ID NO: 689565 - RNA, 61 nt, Homo Sapiens
ucaaguuguucauuucuuaguaaaaaaaaaaugaguguauauaucauuaaagauguaugua

SEQ ID NO: 689566 - RNA, 61 nt, Homo Sapiens
cuaagguagacuacuuugggagugcuaccuuugaguguaaaucugucauguaguuucaaca

SEQ ID NO: 689567 - RNA, 61 nt, Homo Sapiens
gcaagggacucauuuuuugcgccagagaucuugaguguaguuauuccacagaaggccucua

SEQ ID NO: 689568 - RNA, 61 nt, Homo Sapiens
agcaaaauaauuaauugagaguauuuuuuagugaguguaauguauaauguacguaugcaaa

SEQ ID NO: 689569 - RNA, 61 nt, Homo Sapiens
aguuugaaggcugcacacugacauaauguagugaguguagacuggccaugcaagugguuug

SEQ ID NO: 689570 - RNA, 61 nt, Homo Sapiens
cauuaugcgcuguggccacuccaauaggugcugaguguacagaguggaauaagacagagac

SEQ ID NO: 689571 - RNA, 61 nt, Homo Sapiens
aguuauucuuauaaaagcaaacaggcaaacaugaguguaaauuaaagacaaaaagaaaacu

SEQ ID NO: 689572 - RNA, 61 nt, Homo Sapiens
aguauaaggauuuuuuugcauuucuuuacacugaguguaaaacucuacaaagaguuauagu

SEQ ID NO: 689573 - RNA, 61 nt, Homo Sapiens
acuauacuaggcuaagcccucuuaauagccaugaguguaaaauuuaguuuacucauuuuuc

SEQ ID NO: 689574 - RNA, 61 nt, Homo Sapiens
ugagacuuccugaguugauuagaaagcuguaugaguguaccuacccuagucucagaagcau

SEQ ID NO: 689575 - RNA, 61 nt, Homo Sapiens
aacauguuuguaauuuuaagcucccugcacaugaguguaaaccaaaugauaaaaaaaacug

SEQ ID NO: 689576 - RNA, 61 nt, Homo Sapiens
uccgucuaacugguacauugaaagcacauagugaguguaugauuugagcaaguaaaauagu

SEQ ID NO: 689577 - RNA, 61 nt, Homo Sapiens
gaaagaauaaaucaaaguucuuguguuuucuugaguguaaauugaucuguguuuuacuuua

SEQ ID NO: 689578 - RNA, 61 nt, Homo Sapiens
uguguuauguuauccacccaacucagaauaaugaguguaaacagccuguuaauuauaagaa

SEQ ID NO: 689579 - RNA, 61 nt, Homo Sapiens
uaaugcagcauuagcaauauuguuuugguuuugaguguauaauuuuauacaguauuuguuu

SEQ ID NO: 689580 - RNA, 61 nt, Homo Sapiens
uguuuuccuguuugaugcugucuauuugcauugaguguaagucauuugaacuaaugguaua

SEQ ID NO: 689581 - RNA, 61 nt, Homo Sapiens
guguguauguauauguacauauacauauauaugaguguauaauucuaaauuucuaaaaacu

SEQ ID NO: 689582 - RNA, 61 nt, Homo Sapiens
auguguguuguugauguucuauguuuuguuuugaguguagccugacuguuuuauaauuugg

SEQ ID NO: 689583 - RNA, 61 nt, Homo Sapiens
uguaauaaugaugucaauuucaugaaaagccugaguguauugcaucucuugauuuaaucau

SEQ ID NO: 689584 - RNA, 61 nt, Homo Sapiens
accgguuuggcuggcuuguuugauuucaacaugaguguauuuuuuaaaauugauuuuucuc

SEQ ID NO: 689585 - RNA, 61 nt, Homo Sapiens
uaugcuccacacuacgucugaggcacuguagugaguguauacaugaauguauguagugugu

SEQ ID NO: 689586 - RNA, 61 nt, Homo Sapiens
uuuuggauucuuaugagccacaugcacugccugaguguauaacugaauuacgcauaagaag

SEQ ID NO: 689587 - RNA, 61 nt, Homo Sapiens
accaggaaauuuauauuggagaaaaacccuaugaguguaaugaauuuggaaaaauauuuuu

SEQ ID NO: 689588 - RNA, 61 nt, Homo Sapiens
gcugggcccagccccuccacgugauuuccagugaguguaaauaauuuuaaauaaccucugg

SEQ ID NO: 689589 - RNA, 61 nt, Homo Sapiens
ucuggccccauccaggcaaccaaauaaaguuugaguguaccaggaacagaauccuggggcu

SEQ ID NO: 689590 - RNA, 61 nt, Homo Sapiens
agugcgcaaaacacauccuuucauccucuaaugaguguaaaaucuuccuugggauauaugg

SEQ ID NO: 689591 - RNA, 61 nt, Homo Sapiens
uaaaacggggcuguggcuuggugcuuugggaugaguguaaaucguccuucagccccaucau

SEQ ID NO: 689592 - RNA, 61 nt, Homo Sapiens
gucuuugcacacacauauaggagguauaugaugaguguauucaucauaaaggaaccuaagu

SEQ ID NO: 689593 - RNA, 61 nt, Homo Sapiens
acuugaugcaugcacacacauucuguucacuugaguguaaugaaaugcaaacuuaaacaua

SEQ ID NO: 689594 - RNA, 61 nt, Homo Sapiens
uuaggaacaaaagacaaaauugauuuucuagugaguguaugaucugaauuguauagauaua

SEQ ID NO: 689595 - RNA, 61 nt, Homo Sapiens
guauguuuguuaacaguuacauauguuuguaugaguguauauauauaucugugugugugua

SEQ ID NO: 689596 - RNA, 61 nt, Homo Sapiens
aaacauauaaaauuuaccaucuuaaucacuuugaguguacaguucaucaguguuaacugua

SEQ ID NO: 689597 - RNA, 61 nt, Homo Sapiens
uugccuauaauauauauuuaccgauaagcagugaguguaaaauuguuguagcuugaauaag

SEQ ID NO: 689598 - RNA, 61 nt, Homo Sapiens
aggcucagcccugcuccugcagcuuugccgcugaguguaggaaaaacaggcaugacagacc

SEQ ID NO: 689599 - RNA, 61 nt, Homo Sapiens
uauauacacauauacacaucacauauacaugugaguguacaauagaugcacacauaucugu

SEQ ID NO: 689600 - RNA, 61 nt, Homo Sapiens
gugccugguuugauuuuuuucacaccaguuuugaguguacuuaucauuuuagggguguuga

SEQ ID NO: 689601 - RNA, 61 nt, Homo Sapiens
gaaaacaaaguuguuuuaacguaaaaauauaugaguguauucagcuauauuguauuacaaa

SEQ ID NO: 689602 - RNA, 61 nt, Homo Sapiens
ggagaagaaguucauacaggcugcuugacugugaguguacacagauuguguuacucaugau

SEQ ID NO: 689603 - RNA, 61 nt, Homo Sapiens
auguggagcauaaaacagcaauucucccaacugaguguaguuucaacaauugcacaucuuc

SEQ ID NO: 689604 - RNA, 61 nt, Homo Sapiens
uuuuuuuuuuuuaacaaauugaguuuagaagugaguguaauccagcaauacaguuuacugg

SEQ ID NO: 689605 - RNA, 61 nt, Homo Sapiens
caguuauauccuccuuuuaaaccauuguuguugaguguaagauguccuucauguuuucuua

SEQ ID NO: 689606 - RNA, 61 nt, Homo Sapiens
gcugagcgggcucugaguucuguacuggaauugaguguaaagaugggaagagaacugggcu

SEQ ID NO: 689607 - RNA, 61 nt, Homo Sapiens
cuggugcuugcugugagacugagcugggcucugaguguaaacuacaugguagguugugaag

SEQ ID NO: 689608 - RNA, 61 nt, Homo Sapiens
auuucuauuaacaguaauuuguuaaagaaagugaguguaucuuuaaauauagaaauaucau

SEQ ID NO: 689609 - RNA, 61 nt, Homo Sapiens
gaagugcaucuuaugaaacaaccucauuagcugaguguagagaacaacugcugauugaaac

SEQ ID NO: 689610 - RNA, 61 nt, Homo Sapiens
cuguagcugaaagaguaugucaaauauuuuuugaguguaugcuuaaucucacuucaucaau

SEQ ID NO: 689611 - RNA, 61 nt, Homo Sapiens
ucuuugcacaaggggucaugcaucuuaaagcugaguguauuaagagaugugucuaaaacag

SEQ ID NO: 689612 - RNA, 61 nt, Homo Sapiens
ucguauuucgaagcaaucuagacuguugugaugaguguaugucugaaccuguaauucuuaa

SEQ ID NO: 689613 - RNA, 61 nt, Homo Sapiens
uguguauguuugcacacuugugugugggcugugaguguaagugugaguaagagcugguguc

SEQ ID NO: 689614 - RNA, 61 nt, Homo Sapiens
ccaaaggucucucucuuucucucucuuuuuuugaguguagauuauuuuaaagcacuaauug

SEQ ID NO: 689615 - RNA, 61 nt, Homo Sapiens
ccacccccuuacuacacccuagcagaucagcugaguguacuuuauuccaagaacuuacugg

SEQ ID NO: 689616 - RNA, 61 nt, Homo Sapiens
ggauggcccugagcccagcggcuccucccgcugaguguauuucuucccaccacucagcgca

SEQ ID NO: 689617 - RNA, 61 nt, Homo Sapiens
ugucuuccccaaauucauauaugccuuggauugaguguauauuaacuuuuggcuaaacgac

SEQ ID NO: 689618 - RNA, 61 nt, Homo Sapiens
uaaugccacugcaacuguaugcacaacagugugaguguacugguggauggggaggaugguu

SEQ ID NO: 689619 - RNA, 61 nt, Homo Sapiens
ugcaaaucaguggaaggagcagagaacgucaugaguguaaguacacagaguacccaaguga

SEQ ID NO: 689620 - RNA, 61 nt, Homo Sapiens
gauggcacgauaccagggcaguugguuccggugaguguagggucacugagugauaagcaug

SEQ ID NO: 689621 - RNA, 61 nt, Homo Sapiens
uccuuuguaccuguuuggggaaaaaguauaaugaguguacuaccaaucuaacuaagauuau

SEQ ID NO: 689622 - RNA, 61 nt, Homo Sapiens
gggggugugcacgugccucuguguguguggcugaguguauucugcgcguguguguggaggg

SEQ ID NO: 689623 - RNA, 61 nt, Homo Sapiens
uauaauagaggaaguauuguuaucccuagcaugaguguaauggugauaugaaaaacuuugu

SEQ ID NO: 689624 - RNA, 61 nt, Homo Sapiens
ggaccuuuucuagauaugacuccaggacccuugaguguaaugcaaaaauuuggagaccagc

SEQ ID NO: 689625 - RNA, 61 nt, Homo Sapiens
ccgucccgcccugaggcuggcuucucccuggugaguguaaaccccagggugccagugacua

SEQ ID NO: 689626 - RNA, 61 nt, Homo Sapiens
uuaccaugguggcagcuuaguuuaaaaucccugaguguaaguuuuuaaauauuuguugccu

SEQ ID NO: 689627 - RNA, 61 nt, Homo Sapiens
ucuggccuagcagcacccucugggcuuggggugaguguagucugcuuugggguuccugggg

SEQ ID NO: 689628 - RNA, 61 nt, Homo Sapiens
aaaaggugaaggugggagcacaugaaaggaaugaguguauggugguucaucauggugacag

SEQ ID NO: 689629 - RNA, 50 nt, Homo Sapiens
agauaacuguauauaggcuaugaguguaggacaugcccaaacguguguag

SEQ ID NO: 689630 - RNA, 61 nt, Homo Sapiens
cacaccuaacuuuaagaaaaaaauuuuuaauugaguguaaagagcugcuuucaauaucuag

SEQ ID NO: 689631 - RNA, 61 nt, Homo Sapiens
gaaugggauauugacagaauaucccuuaaacugaguguaggaguagguguuaaaaacucau

SEQ ID NO: 689632 - RNA, 61 nt, Homo Sapiens
gacgcaugcccucaaucccaaaaaaauuagcugaguguagucucaucucuacuaaaaauac

SEQ ID NO: 689633 - RNA, 61 nt, Homo Sapiens
cugugacuguuuuucucuguuucacguucguugaguguaagcaaugaaaaugucccaaaua

SEQ ID NO: 689634 - RNA, 61 nt, Homo Sapiens
aguguuuagcuucaagacuggaaagggaauaugaguguaaguuuacuauauauaaagcuaa

SEQ ID NO: 689635 - RNA, 61 nt, Homo Sapiens
aagagucuagagugguuuuugcagcauggguugaguguacaaagccuacugugcgugagau

SEQ ID NO: 689636 - RNA, 61 nt, Homo Sapiens
guagucuaacagaagaaaauguaaaauuauuugaguguaaauaauagaugucaguauuuau

SEQ ID NO: 689637 - RNA, 61 nt, Homo Sapiens
cagagaggagagagaccaaccauauuugggaugaguguaaaagcuuucagaaauaaguuac

SEQ ID NO: 689638 - RNA, 61 nt, Homo Sapiens
aaggaagagaaaugaugcuagccugacagaaugaguguagggcaguguguaaaaagaaaga

SEQ ID NO: 689639 - RNA, 61 nt, Homo Sapiens
gcuaauauugauauuuaugaauauugcuacuugaguguaagauuuauagaaacaucauucg

SEQ ID NO: 689640 - RNA, 61 nt, Homo Sapiens
uuacacuccuaaaucaagcugggcugagugcugaguguaacgugggcaucagacucagcgu

SEQ ID NO: 689641 - RNA, 61 nt, Homo Sapiens
uuuucuuccaggagacaucaaggaaggcaugugaguguacgucccgccaucugcugcaggc

SEQ ID NO: 689642 - RNA, 61 nt, Homo Sapiens
uuugagauauuuuccacuugauacuucguuaugaguguauugcaaaauuuuaaggcuuuug

SEQ ID NO: 689643 - RNA, 61 nt, Homo Sapiens
auccucagagguaggcaaguuccccauccacugaguguagcuucaccagugacagaugguu

SEQ ID NO: 689644 - RNA, 61 nt, Homo Sapiens
guaucuaacuaucaaauuguguuuaguaacuugaguguaugcacaaguuugaucaacagca

SEQ ID NO: 689645 - RNA, 61 nt, Homo Sapiens
aauuuagaauggauauuuugacgaaucggcaugaguguaacagugauaaccugaucuguuu

SEQ ID NO: 689646 - RNA, 61 nt, Homo Sapiens
aaagugccacauuuggcaguacaaaugagucugaguguaauagcccagagauuuauauaua

SEQ ID NO: 689647 - RNA, 61 nt, Homo Sapiens
aauaaagaccuuggagcauaugugcaacuuaugaguguaucaguuguugcauguaauuuuu

SEQ ID NO: 689648 - RNA, 61 nt, Homo Sapiens
uuuaugugugaagcaaauuucaaucaucuauugaguguacaaaccauucugcuugguucca

SEQ ID NO: 689649 - RNA, 61 nt, Homo Sapiens
uauauaggggaacaucacccuauauauaauuugaguguauauauauuuauauauaugaugu

SEQ ID NO: 689650 - RNA, 61 nt, Homo Sapiens
cuacugaauaaguguaggaguuguuuuccauugaguguacauagcuguuauuaaugccuuu

SEQ ID NO: 689651 - RNA, 61 nt, Homo Sapiens
ccauuuaaagaauuuuuuuuauuaguuucuaugaguguauagaggucacauaacacauaaa

SEQ ID NO: 689652 - RNA, 61 nt, Homo Sapiens
cuuauauuaagaauaucuuaaccaaacuuggugaguguauuucuagagacucuaaaaacua

SEQ ID NO: 689653 - RNA, 61 nt, Homo Sapiens
uuacuauuugggcucugaaauucauuuugccugaguguauuggaagaauagccuauugucu

SEQ ID NO: 689654 - RNA, 61 nt, Homo Sapiens
cuuaguuguugaguauauauuuuuccuccccugaguguauguauuuuguuuuugauuuuuu

SEQ ID NO: 689655 - RNA, 61 nt, Homo Sapiens
cuaacuugauugauaaagauccugccucugcugaguguaccugacaguagucuaagaugag

SEQ ID NO: 689656 - RNA, 61 nt, Homo Sapiens
aguagcgcuguuggccaggaggugucaggugugaguguauucugccagcuuuucaugcugu

SEQ ID NO: 689657 - RNA, 61 nt, Homo Sapiens
caggcuauugcuauccuaauguaugucucuaugaguguauuuagccacacaucugcccuug

SEQ ID NO: 689658 - RNA, 61 nt, Homo Sapiens
ugugugcaugucuguauguguguuggggcggugaguguaaggaugcagugggagcauggau

SEQ ID NO: 689659 - RNA, 61 nt, Homo Sapiens
cucugagccccugaucugaagccagaagggcugaguguauuguaaacuuauucuugcaugu

SEQ ID NO: 689660 - RNA, 61 nt, Homo Sapiens
uuuugccuucauuuuugaaaguaguuuuugcugaguguauacauuuuuggcuuuacaguuu

SEQ ID NO: 689661 - RNA, 61 nt, Homo Sapiens
guauuuucucccaauaguaaguuccaagcaaugaguguaauauauauaaguauuauucaug

SEQ ID NO: 689662 - RNA, 61 nt, Homo Sapiens
uacaacauacucaagcgggauaauuucucucugaguguacauuuuguguuuuaauuuuuuu

SEQ ID NO: 689663 - RNA, 61 nt, Homo Sapiens
ugagugcugaguaguauugcuauugcuccccugaguguauaaauaagcuauguguccaggg

SEQ ID NO: 689664 - RNA, 61 nt, Homo Sapiens
gaguaucauucauuguuucucugcaggaggcugaguguaaagcaagagcugucuguccucc

SEQ ID NO: 689665 - RNA, 61 nt, Homo Sapiens
ugaagcucagccuguuaaucagaccagcccaugaguguauaacaaacagaauuggaggcug

SEQ ID NO: 689666 - RNA, 61 nt, Homo Sapiens
cuuuuauaccgcugcauaguauuccauugugugaguguaccauaauguauuuaaccagucu

SEQ ID NO: 689667 - RNA, 61 nt, Homo Sapiens
uaguucuguguagagaaugucacuguaguuuugaguguauacaugugugggugcugauaau

SEQ ID NO: 689668 - RNA, 61 nt, Homo Sapiens
guacuuguaaacagaaauuugcguauaaaugugaguguauuauaaaguuugagauguugau

SEQ ID NO: 689669 - RNA, 61 nt, Homo Sapiens
uaccuuuuuauguuuuuuaagcaguuacucuugaguguauucuguucagaacuguuuaaua

SEQ ID NO: 689670 - RNA, 61 nt, Homo Sapiens
uaugauuaugauuuuuauaaauggcauaacaugaguguacuaacuaccuucuaugcuggcc

SEQ ID NO: 689671 - RNA, 61 nt, Homo Sapiens
auucaguggacaaucaggagaagcuucuguaugaguguaccaucucugccuccucuccuuu

SEQ ID NO: 689672 - RNA, 61 nt, Homo Sapiens
gccaauggcuggcuuuuucuacacccucuuuugaguguaguuugguauuuuguaauugaga

SEQ ID NO: 689673 - RNA, 61 nt, Homo Sapiens
aguugucccacugccauucaaagucagcccuugaguguauuuguucucaguccuaacccug

SEQ ID NO: 689674 - RNA, 61 nt, Homo Sapiens
guauguuggauauugugguguuuuagaucacugaguguacagaagagagaaauucaaacaa

SEQ ID NO: 689675 - RNA, 61 nt, Homo Sapiens
gacucacaggugaccugcuaucuauuuccuuugaguguaaaucaguucccuucccugcugu

SEQ ID NO: 689676 - RNA, 61 nt, Homo Sapiens
uauguaucuggguucuaaccuucucuuucucugaguguaguucccaagcccagggacuggc

SEQ ID NO: 689677 - RNA, 61 nt, Homo Sapiens
guguaacuaacuacacuugguuguguuaagcugaguguaguucaaugucagauaccaagag

SEQ ID NO: 689678 - RNA, 61 nt, Homo Sapiens
uucauguaggagaguguauggugcgcaggugugaguguaagcucugacccaccggcagcga

SEQ ID NO: 689679 - RNA, 61 nt, Homo Sapiens
uguagcugaggcuuaacugggacuaauguagugaguguagcuguauggggcaggacagaca

SEQ ID NO: 689680 - RNA, 61 nt, Homo Sapiens
uguggcccgugacccucguuauuguuacagcugaguguauguuuuuguucuguggagaaug

SEQ ID NO: 689681 - RNA, 61 nt, Homo Sapiens
ugaccuuugucaguguccuuuuuaagacaagugaguguaagggucaaugugcuugcuugga

SEQ ID NO: 689682 - RNA, 61 nt, Homo Sapiens
aucauucaauaacccugaagaauuugguuccugaguguacaaacucagagcccggaagcca

SEQ ID NO: 689683 - RNA, 61 nt, Homo Sapiens
aaagucgcaucgcuaaugauauuugccaaguugaguguacacaaaguuucucauauccugu

SEQ ID NO: 689684 - RNA, 61 nt, Homo Sapiens
ucuauauccugaaauuuauucucaaauagcaugaguguaugcaaugguaggaaaaaaggau

SEQ ID NO: 689685 - RNA, 61 nt, Homo Sapiens
uaacuuuuuauagcaagaugauacaaugguaugaguguaaucuaaacuuccuugugguauu

SEQ ID NO: 689686 - RNA, 61 nt, Homo Sapiens
guggcuuuuuuccaacuccgugugacguuucugaguguagugugguaggaccccggcgggu

SEQ ID NO: 689687 - RNA, 61 nt, Homo Sapiens
gaaacucugggagcuucuagaagaaaucuacugaguguauuucuguuuuuuguuuaauucc

SEQ ID NO: 689688 - RNA, 61 nt, Homo Sapiens
augaaaaaucuuacacuggagagaaacccuaugaguguaagcaaugugggaaagccuuugu

SEQ ID NO: 689689 - RNA, 61 nt, Homo Sapiens
augaaaggacucacacuggagagaaccccuaugaguguaagcaauuugggaaagccuucag

SEQ ID NO: 689690 - RNA, 61 nt, Homo Sapiens
augaaaggacucacaugggagagaaacccuaugaguguaugccaagugggaaagccuucau

SEQ ID NO: 689691 - RNA, 61 nt, Homo Sapiens
cuaaaaggacucacaguggagaaaaacucuaugaguguaagcaaugugggaaagucuucag

SEQ ID NO: 689692 - RNA, 61 nt, Homo Sapiens
augaaaggacucacacuggagagaaacccuaugaguguaagcaaugugggaaagccuucag

SEQ ID NO: 689693 - RNA, 61 nt, Homo Sapiens
gcaugguaggacucacuggagagaaacccuaugaguguaaggaaugugggaaagccuucag

SEQ ID NO: 689694 - RNA, 61 nt, Homo Sapiens; identical to SEQ ID NO: 689692

SEQ ID NO: 689695 - RNA, 61 nt, Homo Sapiens
augguagaacucacacuggagagaaacccuaugaguguaaggaaugugggaaagccuucag

SEQ ID NO: 689696 - RNA, 61 nt, Homo Sapiens
cugaaaaaucuuacacuggagagaaacccuaugaguguaagcaaugugggaaagccuuuau

SEQ ID NO: 689697 - RNA, 61 nt, Homo Sapiens
augaaaggacucacacuggagagaaacccuaugaguguaagcaauguggaaaaaccuucag

SEQ ID NO: 689698 - RNA, 61 nt, Homo Sapiens
gcugauugaagcaggccuugaugagggugcaugaguguauguuugcauucacaugaaggaa

SEQ ID NO: 689699 - RNA, 61 nt, Homo Sapiens
cuggucauuucuagagacagcaaucaauauuugaguguaaggaaacugucuggggugauuc

SEQ ID NO: 689700 - RNA, 61 nt, Homo Sapiens
uuugccuauugaaauaaugcugcuaugaagaugaguguacaagugucuauucaagauucua

SEQ ID NO: 689701 - RNA, 61 nt, Homo Sapiens
aucagagaauucacacuggugaaaggccuuaugaguguagugaaugugggaaauucuuuag

SEQ ID NO: 689702 - RNA, 61 nt, Homo Sapiens
aguggaauaaaguuaucaaguacugaggaauugaguguaaguuagaggcagcagacagaau

SEQ ID NO: 689703 - RNA, 61 nt, Homo Sapiens
gcaaaucaauguuuuccugcgagaugcccuuugaguguacaaggcgguggacugaaggcau

SEQ ID NO: 689704 - RNA, 61 nt, Homo Sapiens
aaauguggaaaagcauuuaggauaaacccuuugaguguaaaaugaaaguacucacacugga

SEQ ID NO: 689705 - RNA, 61 nt, Homo Sapiens
auauguagggaagccuucaggaaaaacucugugaguguaaaauaaaacaacucacagagca

SEQ ID NO: 689706 - RNA, 61 nt, Homo Sapiens
ccaccucagauucauauguuaauguuuuggcugaguguaugauuuugggggccagaggugu

SEQ ID NO: 689707 - RNA, 61 nt, Homo Sapiens
gcccauauccccauagagucgugggucccuaugaguguagacagcuggaggcuuggaacau

SEQ ID NO: 689708 - RNA, 57 nt, Homo Sapiens
ggauaaagauaagccuuuauaaagccuugaguguaagacagaauucauacugguuag

SEQ ID NO: 689709 - RNA, 61 nt, Homo Sapiens
cggcucaacacccuccaccucccauuccaacugaguguagugcacuacgacuugcaggcca

SEQ ID NO: 689710 - RNA, 61 nt, Homo Sapiens
acuguaccacugggccaaguugaccaucuaaugaguguaaauauagcguuuaggcauuucu

SEQ ID NO: 689711 - RNA, 61 nt, Homo Sapiens
cugugguugggccugaggccuguggaggaggugaguguagccagcagcggccgucuacucc

SEQ ID NO: 689712 - RNA, 61 nt, Homo Sapiens
ucauguaagugcauauacacauacacacacaugaguguagacauguguuuauuaauugaca

SEQ ID NO: 689713 - RNA, 61 nt, Homo Sapiens
ugcuguaggugauuauccaaacaaguaaauuugaguguauaauuuaauuuuuaaccuguua

SEQ ID NO: 689714 - RNA, 61 nt, Homo Sapiens
aaauuggacaauggcucuuuagagaguuaucugaguguaaguaaauuaauguucucauuua

SEQ ID NO: 689715 - RNA, 61 nt, Homo Sapiens
ugcaggccgguggguccacuccaacucccccugaguguagcagcacacuuuccauacacca

SEQ ID NO: 689716 - RNA, 61 nt, Homo Sapiens
ucuggcgaaaccuucguuugagggacugaugugaguguauguccaccucacugguggcacc

SEQ ID NO: 689717 - RNA, 61 nt, Homo Sapiens
uggagguucuguauuuuaagaaacagugcguugaguguacagauuuuauuuaugcguaauu

SEQ ID NO: 689718 - RNA, 61 nt, Homo Sapiens
aacugggagauuccuuuuccgugaagaggcgugaguguaaggauggcgguaggagagaaaa

SEQ ID NO: 689719 - RNA, 61 nt, Homo Sapiens
cccaguaaugggauugcugguuauauuccuuugaguguauauaucuuuauaaaagaaugau

SEQ ID NO: 689720 - RNA, 61 nt, Homo Sapiens
aucucuggaugugcacugucucugugucugaugaguguagauugauaccuuugcggucaug

SEQ ID NO: 689721 - RNA, 61 nt, Homo Sapiens
cugccuggggaggggcuacauuugacccugcugaguguaaguucugucucuggucuuucuc

SEQ ID NO: 689722 - RNA, 61 nt, Homo Sapiens
auuuauaucucacauagagaauguacauagaugaguguaacuuucuccacgacauagcauu

SEQ ID NO: 689723 - RNA, 61 nt, Homo Sapiens
uaggacaaaaaacaaagcuaaauugaaaaucugaguguagucucugauuuaugcugucaca

SEQ ID NO: 689724 - RNA, 61 nt, Homo Sapiens
uuucagguggucuuuuuugugucuggcuugcugaguguaaaaguuguuaucuggacgaucu

SEQ ID NO: 689725 - RNA, 61 nt, Homo Sapiens
aguguggcuacaccguggcuuggucauagggugaguguaaacacccacaggacacuggggg

SEQ ID NO: 689726 - RNA, 61 nt, Homo Sapiens
aagauuuuaaagagucccaaguuauuuaaguugaguguaauugucauuuaaggaaggcaaa

SEQ ID NO: 689727 - RNA, 61 nt, Homo Sapiens
aaaccaccuuaaaacauuagugcuaugguuaugaguguaugugccaguacuuaccagucaa

SEQ ID NO: 689728 - RNA, 61 nt, Homo Sapiens
acuguacaucuaaaaauauuacaguagaaucugaguguaauauguguaaccaaaaugagaa

SEQ ID NO: 689729 - RNA, 61 nt, Homo Sapiens
uggcacauuuucuucaaaugcuaacauuuacugaguguacauugaaguucugugcauacag

SEQ ID NO: 689730 - RNA, 61 nt, Homo Sapiens
uugcacagacacacacauauaucaauucucaugaguguauuauaaucucuggugggggcaa

SEQ ID NO: 689731 - RNA, 61 nt, Homo Sapiens
cuggagguaaacaaagacuuugauccauguaugaguguauguguuuauguaacuuccugug

SEQ ID NO: 689732 - RNA, 61 nt, Homo Sapiens
ccuuuuuauuucaguuuagccauguauuguaugaguguauuagucuaagcagugagaaucu

SEQ ID NO: 689733 - RNA, 61 nt, Homo Sapiens
agcuuuuugguuuaauauccuguaaggcacgugaguguacacuuuuuuuuuuuuuaaggau

SEQ ID NO: 689734 - RNA, 61 nt, Homo Sapiens
uuugccaccaacuggcccucuucuuacuugaugaguguaacaagaaaggagagucuugcag

SEQ ID NO: 689735 - RNA, 61 nt, Homo Sapiens
uacgggcuaagguaggguagaguggguguagugaguguauauaaugugauuuggcccugug

SEQ ID NO: 689736 - RNA, 61 nt, Homo Sapiens
ggcaagaggauucucugucaucucuggugacugaguguaaaauaugugccaagucugcagc

SEQ ID NO: 689737 - RNA, 61 nt, Homo Sapiens
cucagcuacucaggaggcugaugguggcacgugaguguaguuacaaaaaaauuagccgggc

SEQ ID NO: 689738 - RNA, 61 nt, Homo Sapiens
gaaaucucaccagaaguguccacaggcuucaugaguguaauuauuuaggggacugagaaag

SEQ ID NO: 689739 - RNA, 61 nt, Homo Sapiens
aacuucuugcacuuauuuaauaugcaauuccugaguguagaguugaggaaagauaaaaaug

SEQ ID NO: 689740 - RNA, 64 nt, Homo Sapiens
guaguggcuuucuggaugguaauuccaucuuaaggugucagaacuauuuucaaaugcugccuuu

SEQ ID NO: 689741 - RNA, 64 nt, Homo Sapiens
ggugaugccccgucccagguugcacugcaaccaagugucagagucggggcuccggccuccugcc

SEQ ID NO: 689742 - RNA, 64 nt, Homo Sapiens
ggauacuuugucauuaugaugaaguaaguguuaagugucagauaaauagcacacagaauaguuc

SEQ ID NO: 689743 - RNA, 64 nt, Homo Sapiens
cuuucucuuugaaagcuggucaggaaugggagaagugucagacacuagagagccccuucugguc

SEQ ID NO: 689744 - RNA, 64 nt, Homo Sapiens
uccccugggcugcccccugccccauccccuuugagugucagaagcacucugagccaaggggaca

SEQ ID NO: 689745 - RNA, 64 nt, Homo Sapiens
ugcugcugccccauuugaucaagagaccauggaagugucagagauucagaauccaagauugucu

SEQ ID NO: 689746 - RNA, 64 nt, Homo Sapiens
gcacccuuacagaucaaacaaugcuuagugaugugugucagaccucugagcccaagcaaagcca

SEQ ID NO: 689747 - RNA, 64 nt, Homo Sapiens
uuggcaaaaggugcuuuaccuugagccauuauuugugucagagaacaaaagaaacagaaucaau

SEQ ID NO: 689748 - RNA, 64 nt, Homo Sapiens
uuccagggcacaccuagacaaacaagggagaagagugucagaaucagaaucauggagaaaaugg

SEQ ID NO: 689749 - RNA, 64 nt, Homo Sapiens
ucacucucagccauagcacuuuguucacuguccugugucagagcacugagcuccacccuuuucu

SEQ ID NO: 689750 - RNA, 64 nt, Homo Sapiens
uaaauuugguacaaaaccacucgccagagcuguggugucagaaaaauaaaauauauuguuucuu

SEQ ID NO: 689751 - RNA, 64 nt, Homo Sapiens
aacuugaggagaaaaccuuuacaauuuccuaugggugucagaaguacucucagcgaaaacugau

SEQ ID NO: 689752 - RNA, 64 nt, Homo Sapiens
gaacucauucccugaacugauguaaaucuucauagugucagacauacugaccaaaaccacaauc

SEQ ID NO: 689753 - RNA, 64 nt, Homo Sapiens
gaccgggguucaaaucccagacuguacgguuuuagugucagacacuggucuuuggagucauggc

SEQ ID NO: 689754 - RNA, 64 nt, Homo Sapiens
auggccaguaguuggcagccccugaccucaggaagugucagagcgugucucccuccagcccagc

SEQ ID NO: 689755 - RNA, 64 nt, Homo Sapiens
ggucagugcugaccccugggcuuggacggggccugugucagaguucggucuguccucagcgugg

SEQ ID NO: 689756 - RNA, 64 nt, Homo Sapiens
uccccaaaggccugugcgucccgauggggcccuggugucagaacaggaugcucugguggagcug

SEQ ID NO: 689757 - RNA, 59 nt, Homo Sapiens
ccagggaaaacccuugucuugccccucuggugucagaaacuguggaugaagaagccuaa

SEQ ID NO: 689758 - RNA, 64 nt, Homo Sapiens
acauguuaauccacaaaacgguagaguaguccuugugucagaacugcucauguuucuuaaggaa

SEQ ID NO: 689759 - RNA, 64 nt, Homo Sapiens
uuaccuaaaacacauacguucagacuuuaccagagugucagacacuuuaagcucaugugucagg

SEQ ID NO: 689760 - RNA, 64 nt, Homo Sapiens
auuaggaauugagaagggggaaacauggcaauaagugucagacuuaaauaaaaaauauuaaaua

SEQ ID NO: 689761 - RNA, 64 nt, Homo Sapiens
gcacaucccugcgcccccaugcuggaaacgagccgugucagaucucccugaauuccacgcaucu

SEQ ID NO: 689762 - RNA, 64 nt, Homo Sapiens
ugggaguagcauggacucuggugggcuuggccuugugucagagcaccucguuugggaguguucu

SEQ ID NO: 689763 - RNA, 64 nt, Homo Sapiens
gugucaggcugucacggacagcccacacggcucggugucagauggcuucaaaaagugucccaga

SEQ ID NO: 689764 - RNA, 64 nt, Homo Sapiens
agcagugacgggcgugcggcccucgcagcaaagugugucagacgcaugggccuggacgacacgg

SEQ ID NO: 689765 - RNA, 64 nt, Homo Sapiens
ccuuuacauucaacuuuucuuuguagaugcuaacgugucagaaugggaauuucaaugcguuuug

SEQ ID NO: 689766 - RNA, 64 nt, Homo Sapiens
cuggcagaagggauugguuugugcucugacagacgugucagauggcccaugucgggaaggaugu

SEQ ID NO: 689767 - RNA, 64 nt, Homo Sapiens
gguauuuuguaaacguuagcagacuuuccugccagugucagaaaauccuauuuaugaauccugu

SEQ ID NO: 689768 - RNA, 64 nt, Homo Sapiens
uucccuguuuuaaauuauaagaugucauccccuugugucagagacagaccccuuggcuuuugcu

SEQ ID NO: 689769 - RNA, 64 nt, Homo Sapiens
aaguaacugguaugucacugaguaacuugacucggugucagagcauuuuaacuagccacucaga

SEQ ID NO: 689770 - RNA, 64 nt, Homo Sapiens
aauauguuuuacuugaauguuacauuagauauuggugucagaauuuuaaaaccaaauuacugcu

SEQ ID NO: 689771 - RNA, 64 nt, Homo Sapiens
ugcuccucuggcccaaggcaugaggagagaggcugugucagaaacugaagcuguucucaggauc

SEQ ID NO: 689772 - RNA, 64 nt, Homo Sapiens
guagccuuuuagguggaagaagugagggugcagcgugucagacacaacauucauguuacucuua

SEQ ID NO: 689773 - RNA, 64 nt, Homo Sapiens
ugaggcugcgcugcccgggaggccuuacugcuuggugucagacugcccagcucagagugcccgu

SEQ ID NO: 689774 - RNA, 64 nt, Homo Sapiens
agugccaccuccugucucagaccuucaaaggauggugucagagcaagcccugagaugcucuguc

SEQ ID NO: 689775 - RNA, 64 nt, Homo Sapiens; identical to SEQ ID NO: 414348

SEQ ID NO: 689776 - RNA, 64 nt, Homo Sapiens; identical to SEQ ID NO: 414349

SEQ ID NO: 689777 - RNA, 64 nt, Homo Sapiens
uggguuuuuguggagguucacgucugucuugcgugugucagaaccccaagugaaauuguuauau

SEQ ID NO: 689778 - RNA, 64 nt, Homo Sapiens
caacgaguguaauggagaggguuugcuauucugugugucagaacgcaucacguaaauugguuuu

SEQ ID NO: 689779 - RNA, 64 nt, Homo Sapiens
gggagugaggcuggugcaggggagcccugggguagugucagagcagagggugggggaccuggcg

SEQ ID NO: 689780 - RNA, 64 nt, Homo Sapiens
uuuagaugagaugaaaaacuuaauuaaaucugaagugucagaggcgcuuaguaagccuuaguaa

SEQ ID NO: 689781 - RNA, 64 nt, Homo Sapiens
auuuuagguauuuucauuauaugaaagcuaccaugugucagagaugauuuaaucuauuuaagug

SEQ ID NO: 689782 - RNA, 64 nt, Homo Sapiens
uucaguuucauucaaauguuaccuaaaauuuauggugucagaauaaagggagaucauagugagu

SEQ ID NO: 689783 - RNA, 64 nt, Homo Sapiens
auaguaaguggugagaacuacucagggaaugaaggugucagaauaauaagaggugcuacugacu

SEQ ID NO: 689784 - RNA, 64 nt, Homo Sapiens
gauaagcuuguauugaccuaauuugguuuaugaugugucagagcuaauucauguucagggugag

SEQ ID NO: 689785 - RNA, 64 nt, Homo Sapiens
aucuuuuuuaaagcaguugaagcagaauguauaggugucagagaagaaaccuagucagccagac

SEQ ID NO: 689786 - RNA, 64 nt, Homo Sapiens
gcuggugacuuugcuucuuuauguguguguaugugugucagagaaagagagagagagagagaga

SEQ ID NO: 689787 - RNA, 64 nt, Homo Sapiens
gaaucugcuccaaaaagcuggccacaucucugaggugucagaauuaagcugccucaguaacugc

SEQ ID NO: 689788 - RNA, 64 nt, Homo Sapiens
uggaacuaaacaggcaaggacuacuaauuauacugugucagauuaauuuuuucuuuuccugguu

SEQ ID NO: 689789 - RNA, 64 nt, Homo Sapiens
cuggaauuuauucugaccaagauuaauggaauuggugucagaugacuuauucaagcuugucugu

SEQ ID NO: 689790 - RNA, 64 nt, Homo Sapiens
uauaauuuauuccauuucucuacauugucccugagugucagaacuaauuuugcaucauaauuuc

SEQ ID NO: 689791 - RNA, 64 nt, Homo Sapiens
auggggagacaggcaggaccuuauacugagccaugugucagaggccaggccgcauguggcuuca

SEQ ID NO: 689792 - RNA, 64 nt, Homo Sapiens
aggcuacccagucgaguccugcuuucacguaccugugucagacccagcuuugaagcaauacucu

SEQ ID NO: 689793 - RNA, 64 nt, Homo Sapiens
uuuguugcuugggcggcugugacaguuucaaguagugucagauucguagaggauccuggccaca

SEQ ID NO: 689794 - RNA, 64 nt, Homo Sapiens
caguccugcccugugaauuagggagcucuuuccugugucagaaccuacucacucugcagcucug

SEQ ID NO: 689795 - RNA, 64 nt, Homo Sapiens
aucagaacaauuuuguuaccagaaucuuggccaugugucagauuaugccuuuaauucuugucug

SEQ ID NO: 689796 - RNA, 64 nt, Homo Sapiens
cuguuagaguuggcaauuuccuaucacuauuucagugucagaacaaacugaaaauaauggcucg

SEQ ID NO: 689797 - RNA, 64 nt, Homo Sapiens
agaagccuuaauuauuuaaaucaauucagugacugugucagaccuuaguuuuaaaucuugauau

SEQ ID NO: 689798 - RNA, 64 nt, Homo Sapiens
gugcggguaugggugggauuccugguggacaggggugucagaucugucugaggagccccaguca

SEQ ID NO: 689799 - RNA, 64 nt, Homo Sapiens
uuucuuucagguuuacuugauaguggauacauuggugucagaggaccuugacuggguucauuuu

SEQ ID NO: 689800 - RNA, 64 nt, Homo Sapiens
uaggacuaauuggggcuaagaugaauuaauguaagugucagauacuaggcagguguuagggaug

SEQ ID NO: 689801 - RNA, 64 nt, Homo Sapiens
cuagggcugggcucucgggguucccacuucgcaggugucagaaccaggugggugguuaaggucc

SEQ ID NO: 689802 - RNA, 64 nt, Homo Sapiens
cccuggucuccguggcacuuauccuccacauccugugucagaaagcacuagguugcagagaagc

SEQ ID NO: 689803 - RNA, 64 nt, Homo Sapiens
uagggugggggugcccgauuuccaccccuccugugugucagagcuggguuuucaggcccucugc

SEQ ID NO: 689804 - RNA, 64 nt, Homo Sapiens
uaacugaucuggagcuuuuguucuucaugguggggugucagacagauagaugagaaaguucuaa

SEQ ID NO: 689805 - RNA, 64 nt, Homo Sapiens
uuccuauugugcaauguaaauauuuuaaagaauugugucagacuguuuaguagcagugauuguc

SEQ ID NO: 689806 - RNA, 64 nt, Homo Sapiens
uggcuggcccagaguuuacauucuaauuugcauugugucagaaacaugaaaugcuuccaagcau

SEQ ID NO: 689807 - RNA, 64 nt, Homo Sapiens
uuaaggaagacgucaaucaaaaugucaaauaugugugucagaauauaaauaauuuuucacauug

SEQ ID NO: 689808 - RNA, 64 nt, Homo Sapiens
uuuugaaacagcagucccaguauucucagagcaugugucagaguguuguuccguuaaccuuuuu

SEQ ID NO: 689809 - RNA, 64 nt, Homo Sapiens
uuuucuuucucuuucagcuauuuuauuuaauauugugucagauauuuuacaagguaugaccuaa

SEQ ID NO: 689810 - RNA, 64 nt, Homo Sapiens
ugauuuuacacuacagcagcaggauggaguaguugugucagagacuauguaucccacaaagcau

SEQ ID NO: 689811 - RNA, 64 nt, Homo Sapiens
ggguaaacauccucugcuaaucgacagguagcaggugucagaggaggcauaauauuaauagcgc

SEQ ID NO: 689812 - RNA, 64 nt, Homo Sapiens
aagaaugggaaggagaccauuggguaacccucaagugucagaaguuguuucuaaaguaacuaua

SEQ ID NO: 689813 - RNA, 64 nt, Homo Sapiens
acuacaggucccgguaccugaggaaccaguguaggugucagaaauacuccuagagccucaaggu

SEQ ID NO: 689814 - RNA, 64 nt, Homo Sapiens
caagcauaaucauugcuguguuggcuugguuccagugucagaagcauagcaguguuccauagac

SEQ ID NO: 689815 - RNA, 64 nt, Homo Sapiens
auaguuaacauucaaaaaacacaguaacuccaaagugucagaaauaauggaaaugggaagagca

SEQ ID NO: 689816 - RNA, 64 nt, Homo Sapiens
ugcuucccucaaaccuuguugguuucaugcucaugugucagauaguccauaagcauggugauuu

SEQ ID NO: 689817 - RNA, 64 nt, Homo Sapiens
uuuuguuuuuugaugggguuaucuugguuacacagugucagagcgcaucacagcaacgcugcgg

SEQ ID NO: 689818 - RNA, 64 nt, Homo Sapiens
uguacuaaaaggcagaaaggucaucacaacuuuagugucagaaucuauagugguggcaaaguua

SEQ ID NO: 689819 - RNA, 64 nt, Homo Sapiens
uugaacuguaguaccuuucucuaugucaaguuuugugucagacaugggaaaucauguauuuguu

SEQ ID NO: 689820 - RNA, 64 nt, Homo Sapiens
gcccugggcuggccggcgccguacugccugcguugugucagagaauaggaaaagcagcuuuguu

SEQ ID NO: 689821 - RNA, 64 nt, Homo Sapiens
ugcaaggacuccagugugaacucaggaggggcaggugucagaacugggcaccaggacuggagcc

SEQ ID NO: 689822 - RNA, 64 nt, Homo Sapiens
gugggccagcauaggggggagggucuuuuacccugugucagagccuaccuucaccaccuauauc

SEQ ID NO: 689823 - RNA, 64 nt, Homo Sapiens
aaaauuguuuuaugcuuuauuauaucgcaaaugagugucagauuuuugaguaccaaugaucaug

SEQ ID NO: 689824 - RNA, 64 nt, Homo Sapiens
uuuuuuucugaauaagucucucauaaugagugcagugucagacugugccuacucugaugguaug

SEQ ID NO: 689825 - RNA, 64 nt, Homo Sapiens
ugugacuuguauggucuccugguuaaagggaauggugucagaauauuugcauaaaauuauuuuu

SEQ ID NO: 689826 - RNA, 64 nt, Homo Sapiens
cugcugggucacaacauucuccucucccugacuggugucagauucaucaaacaaaaaauaaauc

SEQ ID NO: 689827 - RNA, 64 nt, Homo Sapiens
aucuuggugccccgguguuuacaagagccagauggugucagaggaguacgcaguuguaugcagu

SEQ ID NO: 689828 - RNA, 64 nt, Homo Sapiens
uauaagucucccacaaucuuccaguucuuacccagugucagauaauuaauuacuaauuacuuuc

SEQ ID NO: 689829 - RNA, 64 nt, Homo Sapiens
ugugugugugugugugugugugaguggaguugaggugucagagaaaaugaauuuuuuccagauu

SEQ ID NO: 689830 - RNA, 64 nt, Homo Sapiens
aaacaaaaggcucuuuucagguaaaaagacuucugugucagaaaguaacuuaagguugucauug

SEQ ID NO: 689831 - RNA, 64 nt, Homo Sapiens
cuucugggaaauuuuguuauuaaaggaauauauagugucagacggaaguuauaaucaucuugga

SEQ ID NO: 689832 - RNA, 64 nt, Homo Sapiens
ugaauugugagaauucaguugugauuuuuaacaugugucagauauauauacuaacacgucuaau

SEQ ID NO: 689833 - RNA, 64 nt, Homo Sapiens
acuuguaagaccugccagaaugcuagucccgagagugucagacaaggaagaagucccugggccu

SEQ ID NO: 689834 - RNA, 64 nt, Homo Sapiens
aucuccaaccuccuaggucaaauuugagcugauugugucagaggccuccuaccugcgcagucua

SEQ ID NO: 689835 - RNA, 64 nt, Homo Sapiens
gaaguuauaaucaucuuggauaaaagaauauauagugucagacgcuucugggaaauuuuguuau

SEQ ID NO: 689836 - RNA, 64 nt, Homo Sapiens
ccagcccaggaguuugaggcaaaaaaaagauucugugucagagcgagugagacccugucucaaa

SEQ ID NO: 689837 - RNA, 64 nt, Homo Sapiens
cuuaaacgugugugaaugcuggcugcaugucagggugucagaucagacuccuaaggcacccacu

SEQ ID NO: 689838 - RNA, 64 nt, Homo Sapiens
cccuaguuaaucauguaauuggaaagggcaaaaugugucagauguuugagauagaugauuuuug

SEQ ID NO: 689839 - RNA, 64 nt, Homo Sapiens
accagcauuuuccugccaugaucaaaagauauuggugucagaauauuuuaggccucuuguucac

SEQ ID NO: 689840 - RNA, 64 nt, Homo Sapiens
uugcuugaagggaauuaccaagauaacacaucaggugucagaacacuuacaauuuuuuaacaug

SEQ ID NO: 689841 - RNA, 64 nt, Homo Sapiens
aauucagguuuacaagaugaaagcguguggagaagugucagauggcaguggaagcauguguguu

SEQ ID NO: 689842 - RNA, 64 nt, Homo Sapiens
uaaacuuuaacuuccacuuuguauaaauuuuuaagugucagacuauccauuuuacacuugcuuu

SEQ ID NO: 689843 - RNA, 64 nt, Homo Sapiens
ccauauuuucccccuguuuuuagagcuuccaaaugugucagaauaggaaaacauugcaauaaau

SEQ ID NO: 689844 - RNA, 64 nt, Homo Sapiens
cucagccuagugggugucauggauggaucugggggugucagacaggcuacccugugccagggag

SEQ ID NO: 689845 - RNA, 64 nt, Homo Sapiens
ggaaggaucaccgaccugaaaagucaagcguaacgugucagagauacuucuccaaucacugcca

SEQ ID NO: 689846 - RNA, 64 nt, Homo Sapiens
gauggucccagagcuaggugugccuuucugcuaggugucagauaaaccugggaaguguucuucc

SEQ ID NO: 689847 - RNA, 64 nt, Homo Sapiens
gacuucgccaggguuuugggucuaccucacagcagugucagaaguagccauggaauggcuccga

SEQ ID NO: 689848 - RNA, 64 nt, Homo Sapiens
aaggaaaccacagugagccucugugccugccuuugugucagaaaaagacauguggaggggcagc

SEQ ID NO: 689849 - RNA, 64 nt, Homo Sapiens
ggagaucacggugugaguuugauggcgcagaugugugucagaagguuuauuuuauguuggaaga

SEQ ID NO: 689850 - RNA, 64 nt, Homo Sapiens
agaauuuuuaagaguuaucuaaauguuuauacaggugucagauccuuacaaucguggaaaucag

SEQ ID NO: 689851 - RNA, 64 nt, Homo Sapiens
cauuaagcgggaucccagcaccucugugcagacagugucagagucccucucgcccuggccaggg

SEQ ID NO: 689852 - RNA, 64 nt, Homo Sapiens
uuugggggccgggccccuccggugucugucuuuggugucagaaccugucugcagcugccugucu

SEQ ID NO: 689853 - RNA, 64 nt, Homo Sapiens
uacugucuuguacugacacauccaaagcaugagugugucagaaaucccuugucuauuccugucu

SEQ ID NO: 689854 - RNA, 64 nt, Homo Sapiens
gggagccacuuggcagaagggugcagggcugcuggugucagagcaagagggcuacagggaaagg

SEQ ID NO: 689855 - RNA, 64 nt, Homo Sapiens
ccccuccaggaagaugcugacauccaggugggaggugucagagcccagcucaugcacaucagcu

SEQ ID NO: 689856 - RNA, 64 nt, Homo Sapiens
guuggucuuuauuuuaaaguugugcauuaccuuagugucagaauucugaguacuguauuuuuuc

SEQ ID NO: 689857 - RNA, 64 nt, Homo Sapiens
ugcuuggcuuccaagaagggccaguauuuccuaugugucagaucucuuggggaagccaggaaag

SEQ ID NO: 689858 - RNA, 64 nt, Homo Sapiens
guaagggcugagcuuucuguuuguuuguuucugugugucagacuucuugggucauuuggauguu

SEQ ID NO: 689859 - RNA, 64 nt, Homo Sapiens
uaccuuacucucugcuacugaaacagauggcauagugucagaugggugccagugucuuuuacaa

SEQ ID NO: 689860 - RNA, 64 nt, Homo Sapiens
cuccaucccugaaauuucucugugaacccuagcugugucagaauuuuaggauguaaagguauau

SEQ ID NO: 689861 - RNA, 64 nt, Homo Sapiens
ucgggaggcagacgggaccagcucccagggggaggugucagacccuugccugucuuuuccugcu

SEQ ID NO: 689862 - RNA, 64 nt, Homo Sapiens
cucauaggcacugagaucuagaagagaggaacaggugucagauauuaagccucccuaagagacu

SEQ ID NO: 689863 - RNA, 64 nt, Homo Sapiens
acauguuucuucacuuccaugagaauggugccaagugucagacucuaaugagcccucagcucag

SEQ ID NO: 689864 - RNA, 64 nt, Homo Sapiens
ucuguuaaaaugcagaggugcuauaacauucaaagugucagauuccuugggaguauggaaaacc

SEQ ID NO: 689865 - RNA, 64 nt, Homo Sapiens
ggguuccaagaguggguaguguguguaugugugugugucagagggagaccuggcaggcaccucu

SEQ ID NO: 689866 - RNA, 64 nt, Homo Sapiens
uagguaacuagcugcagugaaggcugugggaagggugucagauccugugaagaauggcaaaaca

SEQ ID NO: 689867 - RNA, 64 nt, Homo Sapiens
ccagugucuguggccuggcaaguggccacgcccugugucagaccaucugggaauuaagcuccag

SEQ ID NO: 689868 - RNA, 64 nt, Homo Sapiens
uggaccuuuuuuuuuuuaauggcaauaggacauugugucagauuaccaguuauaggaacaauuc

SEQ ID NO: 689869 - RNA, 64 nt, Homo Sapiens
gccuugcaguugcuuccucccaugagccaagguggugucagagggcaacuggaugacucgcagu

SEQ ID NO: 689870 - RNA, 64 nt, Homo Sapiens
aauaaaacaguuucgcuucuuuagcucaucuguggugucagaauccuuggagcugaagagagaa

SEQ ID NO: 689871 - RNA, 64 nt, Homo Sapiens; identical to SEQ ID NO: 414350

SEQ ID NO: 689872 - RNA, 64 nt, Homo Sapiens; identical to SEQ ID NO: 414351

SEQ ID NO: 689873 - RNA, 64 nt, Homo Sapiens; identical to SEQ ID NO: 414352

SEQ ID NO: 689874 - RNA, 64 nt, Homo Sapiens; identical to SEQ ID NO: 414353

SEQ ID NO: 689875 - RNA, 64 nt, Homo Sapiens
ugaccgccuggggcaggaaguauucagguuggcugugucagaugcuaaugugcugaaucaacag

SEQ ID NO: 689876 - RNA, 64 nt, Homo Sapiens
guaauaucuauuuguuuuguagucauggguugaggugucagauaauaucaggagauuuagggua

SEQ ID NO: 689877 - RNA, 64 nt, Homo Sapiens
agagccauucucuccuccugcagucgauccuagagugucagaacucuguugaccuguaaggaag

SEQ ID NO: 689878 - RNA, 64 nt, Homo Sapiens
cacaugggacagaacccuacgguauuuuguaaaugugucagagagaccaaaauuuuaaaaaacu

SEQ ID NO: 689879 - RNA, 64 nt, Homo Sapiens
uguggacccacccagcuuucuuccucccuguugugugucagauuaugccuugcacuugggaaag

SEQ ID NO: 689880 - RNA, 64 nt, Homo Sapiens
caggccccacgcccucuccucccccuccuagggggugucagaagcugggaacguguguccaggc

SEQ ID NO: 689881 - RNA, 64 nt, Homo Sapiens
cuuuuuaaauggcauauuaacaagccagcaaagugugucagaccauggcgugguauuuauugug

SEQ ID NO: 689882 - RNA, 64 nt, Homo Sapiens
ggcagaagaauaugacagaugucagcuucucccugugucagaugauauguccuugaagcuggca

SEQ ID NO: 689883 - RNA, 64 nt, Homo Sapiens
auccagauaguuagcugugagccagcacucagcugugucagauuugauuaauauuguauuaauc

SEQ ID NO: 689884 - RNA, 64 nt, Homo Sapiens
acacaccccuucagaaggugcccuggguugccgagugucagaauauacucaggacuccagaggu

SEQ ID NO: 689885 - RNA, 64 nt, Homo Sapiens
ggaggcacauuggugaguccgaggcucagcugcugugucagagccacaggagaagucacugcuu

SEQ ID NO: 689886 - RNA, 64 nt, Homo Sapiens
cucucaggagggugcccagcaggguggccucugggugucagauguuggagugggcaucacagcc

SEQ ID NO: 689887 - RNA, 64 nt, Homo Sapiens
auaaauaugaaacauuaaguuuguuuuaauguuggugucagaaaauuguggaaugagcauucuc

SEQ ID NO: 689888 - RNA, 64 nt, Homo Sapiens
uggagaaaaugccguguaguuuucuauuaaaaaggugucagaacuuguuuccuaaaaacaguga

SEQ ID NO: 689889 - RNA, 64 nt, Homo Sapiens
cucaacuccuccaucuaaccggcagaaccuggaggugucagaggcugcggaggaacccuuggca

SEQ ID NO: 689890 - RNA, 64 nt, Homo Sapiens
gagccaagccugaagcacuuagggcccuucuuaggugucagaauucuucccaaccguggccuag

SEQ ID NO: 689891 - RNA, 64 nt, Homo Sapiens
caggagugggggaucagggaacuuagggagguuggugucagaggugauggagggcagaggaagu

SEQ ID NO: 689892 - RNA, 64 nt, Homo Sapiens
caacugugucuugggggggauguggucuuccuaugugucagaaaggcguuugcauuuguaaacu

SEQ ID NO: 689893 - RNA, 64 nt, Homo Sapiens
guguaugagaauuaaaugugcuggaguugaguuggugucagauaucugucaccaccuucagcau

SEQ ID NO: 689894 - RNA, 64 nt, Homo Sapiens
gacgauggcucaugucacaggccuaccugauacggugucagagaaagugguggggaaaggaucu

SEQ ID NO: 689895 - RNA, 63 nt, Homo Sapiens
gcuugagcaauaaaguggaaacaauaaaaccugggugucagacaacccuuucuguucagccuu

SEQ ID NO: 689896 - RNA, 64 nt, Homo Sapiens
acuaacuugguguuaccuguaagugaaaacucaagugucagaugaagggagguggaguuauccu

SEQ ID NO: 689897 - RNA, 64 nt, Homo Sapiens
ggcacucccccagccguucucaugcaaaauaccugugucagaauacuccuuucauccaucacuc

SEQ ID NO: 689898 - RNA, 64 nt, Homo Sapiens
gggauggaggucuacccuggacacuaagccaagugugucagagacagaagggagcuggggauug

SEQ ID NO: 689899 - RNA, 64 nt, Homo Sapiens
ggcacuuucuguuugaaccccugucaugaucacagugucagagacgcguccucuuucuugggga

SEQ ID NO: 689900 - RNA, 64 nt, Homo Sapiens
ucugccccagccccacacuugcucugaaaaccaagugucagagccccuuccccuuguuuuuauu

SEQ ID NO: 689901 - RNA, 64 nt, Homo Sapiens; identical to SEQ ID NO: 414354

SEQ ID NO: 689902 - RNA, 64 nt, Homo Sapiens; identical to SEQ ID NO: 414355

SEQ ID NO: 689903 - RNA, 64 nt, Homo Sapiens
aacauuugaaaggugugauuaacugcuguuuacagugucagauugcccauguaaaugagaacuc

SEQ ID NO: 689904 - RNA, 64 nt, Homo Sapiens
uacucuggucugagucaacuccucuuggcaacuugugucagaguagcaaaugaaguauuuuuuc

SEQ ID NO: 689905 - RNA, 64 nt, Homo Sapiens
ucaaaacuauuauauaugacggagaaagaugauggugucagaggaaccucuugaggguggacag

SEQ ID NO: 689906 - RNA, 64 nt, Homo Sapiens
ucucugcuccuguuggcaaaucaucugagaucuggugucagaguccccgcgcauuuccuuggcc

SEQ ID NO: 689907 - RNA, 64 nt, Homo Sapiens
aagaugugaaagcugcaagaugccuucacaagaggugucagauucagcuuuuaacacaguuccc

SEQ ID NO: 689908 - RNA, 64 nt, Homo Sapiens
cuugggaugggaagaacaguacccaaagcccccagugucagagagaccaucuccuuaagguuuc

SEQ ID NO: 689909 - RNA, 64 nt, Homo Sapiens
uuuucauucaaaaacauuucacuuuugggguugcgugucagauuuggcaguauaaauucuggcu

SEQ ID NO: 689910 - RNA, 64 nt, Homo Sapiens
aaauuuugaguuguauuaauaguuaaaaacauuugugucagaugacagggugggcuuuuacugu

SEQ ID NO: 689911 - RNA, 64 nt, Homo Sapiens
ucuacaggaaagaaacaacuggucucucuacucagugucagacaucuugugcuuggugagugag

SEQ ID NO: 689912 - RNA, 64 nt, Homo Sapiens
auaugcucccaaugguggaauuccuucuuagagagugucagagaggaggagaggggguacagac

SEQ ID NO: 689913 - RNA, 64 nt, Homo Sapiens
uaauuucuuacacuuaaaaguguccaucaacagugugucagauggucuuuauauauuuuuucug

SEQ ID NO: 689914 - RNA, 64 nt, Homo Sapiens
gcuacagaugugcugacaaggcacuucauguaaagugucagaaggagcuacaaaaccuacccuc

SEQ ID NO: 689915 - RNA, 64 nt, Homo Sapiens
auacgauggaauacuagauggucauuaaaauuaugugucagaagaaggcuuaaucucaugggaa

SEQ ID NO: 689916 - RNA, 64 nt, Homo Sapiens
aacaaauuucauagccugcugaacugaacugagugugucagaagugcugguuaaugacgagaag

SEQ ID NO: 689917 - RNA, 64 nt, Homo Sapiens
aacuuucuaacaaacauuuaccagaguucacugugugucagaacuuuuuaugcaggagaaaagc

SEQ ID NO: 689918 - RNA, 64 nt, Homo Sapiens
uggggucccgcaccuauaucuuuugugacacauggugucagauaccaaauuuaagcuccucacu

SEQ ID NO: 689919 - RNA, 64 nt, Homo Sapiens
ucagagcucaggagccaaaauuuuuauucuuugugugucagaguguuacucugccuuuuugacg

SEQ ID NO: 689920 - RNA, 64 nt, Homo Sapiens
uaugccuuaguuuuugaauagauaagacauucaagugucagaaaguaaaagucaguucaggacu

SEQ ID NO: 689921 - RNA, 64 nt, Homo Sapiens
ccuaccccauggugcuaggaagaggagugggguggugucagacccuggaggccccaacccuguc

SEQ ID NO: 689922 - RNA, 64 nt, Homo Sapiens
cuuacaucagacuuucuaacuaguaucaagaucagugucagauauuguugagggaaguaauuuu

SEQ ID NO: 689923 - RNA, 64 nt, Homo Sapiens
gggaggcacagagcagagguucaggucucagcaggugucagaggugauuacagcccuucccauc

SEQ ID NO: 689924 - RNA, 64 nt, Homo Sapiens
ggcuggugaggggcccggaggagccuuugcccgcgugucagacuccaucccuccucugccgcca

SEQ ID NO: 689925 - RNA, 64 nt, Homo Sapiens
cucugaaaacauuuuuuagauacagcuuuaaguugugucagauuuuucucccaggaaaucuuug

SEQ ID NO: 689926 - RNA, 64 nt, Homo Sapiens
uuuuuauuuuaguauuuccucaauuuguauggcagugucagauagggauacaaaaaggaacuaa

SEQ ID NO: 689927 - RNA, 64 nt, Homo Sapiens
cagccaggagcucuguccgcaaaaccaaaucugggugucagaggccaagacccuggggugggau

SEQ ID NO: 689928 - RNA, 64 nt, Homo Sapiens
cucugcaggugugggacacauguaccaccuacaagugucagaagacacuggagggccaugaugg

SEQ ID NO: 689929 - RNA, 64 nt, Homo Sapiens
gccacuuuaaaaaucuuuugucagaauagaugaugugucagaucucuuuaggaugacuguauuu

SEQ ID NO: 689930 - RNA, 64 nt, Homo Sapiens
aaaaggaaaaccggaggagcaauuggggauccaggugucagagguaggggaaccaggggcaagc

SEQ ID NO: 689931 - RNA, 64 nt, Homo Sapiens
ugaggaaguauuuaauaaaaaaugaagucuaaaugugucagagaauuuaugugagaaaggacua

SEQ ID NO: 689932 - RNA, 64 nt, Homo Sapiens
aagaggagagggcagcauaacuuccugaccaccggugucagauaucagagcauucuggacuccu

SEQ ID NO: 689933 - RNA, 64 nt, Homo Sapiens
aaagucgaugaaaaguaaccacugccacugucuugugucagaacuuuuacaguacagaaaauaa

SEQ ID NO: 689934 - RNA, 64 nt, Homo Sapiens
ccgagcacaguggcucccacacugacauuauuuagugucagaggcccuuuuucucauucccuua

SEQ ID NO: 689935 - RNA, 64 nt, Homo Sapiens
acgaccaaucuuagggaauuuguauuuagaucgggugucagaggccaucauggcucucucuggu

SEQ ID NO: 689936 - RNA, 64 nt, Homo Sapiens
aggaacaccacuaucuuaauuuguugcuuguacagugucagauguaacuggaagugaagagguu

SEQ ID NO: 689937 - RNA, 64 nt, Homo Sapiens
ucgccuagugggcaucucuguagauuggagcuuggugucagaacucgauuuauugccaaaaccc

SEQ ID NO: 689938 - RNA, 64 nt, Homo Sapiens
cuccgucccccucuuugaagcuguccccaucucagugucagaccagccuucuccucagcugacc

SEQ ID NO: 689939 - RNA, 64 nt, Homo Sapiens
uaccauggucucucucugcaguuauuuaaugccugugucagaucuacuguaaaaagaggauuaa

SEQ ID NO: 689940 - RNA, 64 nt, Homo Sapiens
gccucauacgaaauguauuugguuuuguuggagagugucagacugaucuggaagugaaacacag

SEQ ID NO: 689941 - RNA, 64 nt, Homo Sapiens
uccaaggaaguuaaaaggcuugguauggauguuggugucagauaggucugacuaaccucuccgu

SEQ ID NO: 689942 - RNA, 64 nt, Homo Sapiens
cacccaauuggcccaacacugucugccccucggggugucagaaauucuagcgcaaggcacuuuu

SEQ ID NO: 689943 - RNA, 64 nt, Homo Sapiens
ucuucugaucagucugucuggauugaguccuacagugucagauagggcggcaaaugccaaagca

SEQ ID NO: 689944 - RNA, 64 nt, Homo Sapiens
ccccuccauccccaucggcccuguccccuggagugugucagagcccaggggagaaugcagccca

SEQ ID NO: 689945 - RNA, 64 nt, Homo Sapiens
ggccgcccgguggggcuaucguuucccacaugcagugucagagggucuuggguugggcuggggg

SEQ ID NO: 689946 - RNA, 64 nt, Homo Sapiens
cgcucggcuccccaccuggauuacaaguggcuuugugucagacauccuuguauguggguguuua

SEQ ID NO: 689947 - RNA, 64 nt, Homo Sapiens
gugaucgauuucacuagauggauugucagugugugugucagacucauuucaaaugauuccauau

SEQ ID NO: 689948 - RNA, 64 nt, Homo Sapiens
auucagaagaagucugaagauuugugcauucuaugugucagaaccaacuuuguuucaauuuugu

SEQ ID NO: 689949 - RNA, 64 nt, Homo Sapiens
uuccagaaaguuccagauuugugugugugugugugugucagaggcugugugugugugugugugu

SEQ ID NO: 689950 - RNA, 64 nt, Homo Sapiens
ccauaggcaucacucuucagacgaggauuugugggugucagagcggaggggcuucccguuaucc

SEQ ID NO: 689951 - RNA, 64 nt, Homo Sapiens
auguucaagaucagcaucauaggguaccuacugugugucagaaguucauucaacaaauauuugu

SEQ ID NO: 689952 - RNA, 64 nt, Homo Sapiens
gugggcuagggccuccugcagaacaguccccugggugucagaagaccagcaagggccacaguug

SEQ ID NO: 689953 - RNA, 64 nt, Homo Sapiens
caccuccauaauggucaguacuaugcccaggaaugugucagaguagauaucucugagggccaag

SEQ ID NO: 689954 - RNA, 64 nt, Homo Sapiens
ccagccuggggagcucuggcaucagcuccugggugugucagagguggagcuacacacaggaggg

SEQ ID NO: 689955 - RNA, 64 nt, Homo Sapiens
guuuaguuuacaagguugggaauuuugugcauuugugucagaauaaaauuaauguugccaacuu

SEQ ID NO: 689956 - RNA, 64 nt, Homo Sapiens
gagaagauauucuggugacugaaaguauggucgggugucagauauaaaugugcaaaugccuucu

SEQ ID NO: 689957 - RNA, 64 nt, Homo Sapiens
agcacgcagcaggcgugcccaggagcgugugcaugugucagagccauuugguccaucaucuccu

SEQ ID NO: 689958 - RNA, 64 nt, Homo Sapiens
guuaagugacaugccugaggcaccccccuaacaggugucagagcugaaauucaaaccccaucca

SEQ ID NO: 689959 - RNA, 64 nt, Homo Sapiens
aaggcuuaaaggcauuucauucagaucaaaagcugugucagacacaaaacuuauuuaauaauua

SEQ ID NO: 689960 - RNA, 64 nt, Homo Sapiens
uuccucagauuagaugugccuagguccguccggugugucagauucucaaaugcuagaagcuguc

SEQ ID NO: 689961 - RNA, 64 nt, Homo Sapiens
ugucaacacaggacuuucuggaucauuccagaaagugucagacguuuucucauugucuuguagu

SEQ ID NO: 689962 - RNA, 64 nt, Homo Sapiens
aucccgggccccugcagggaaaagcgcugggugugugucagaggcgcaggguggguggggcugc

SEQ ID NO: 689963 - RNA, 64 nt, Homo Sapiens
uuuaugugcuuguauguacauuuauugcuauccagugucagaacaguuaguuuaggaaaaguau

SEQ ID NO: 689964 - RNA, 64 nt, Homo Sapiens
uuuauuuuucuguguaugcauucacugcugcccagugucagaacaguuauacaaacgagggcuu

SEQ ID NO: 689965 - RNA, 64 nt, Homo Sapiens
auaauauccucaaaguucauucauuuuuuagcaugugucagaaauuuuaaggcugagcaauauu

SEQ ID NO: 689966 - RNA, 64 nt, Homo Sapiens
auaaggucuucacgguucacccauguuguauaaugugucagaauauccuuccuuuuuaggugaa

SEQ ID NO: 689967 - RNA, 64 nt, Homo Sapiens; identical to SEQ ID NO: 414356

SEQ ID NO: 689968 - RNA, 64 nt, Homo Sapiens; identical to SEQ ID NO: 414357

SEQ ID NO: 689969 - RNA, 64 nt, Homo Sapiens; identical to SEQ ID NO: 414358

SEQ ID NO: 689970 - RNA, 64 nt, Homo Sapiens; identical to SEQ ID NO: 414359

SEQ ID NO: 689971 - RNA, 64 nt, Homo Sapiens; identical to SEQ ID NO: 414360

SEQ ID NO: 689972 - RNA, 64 nt, Homo Sapiens
ugucaucucaaccucagacuaggguaacaacagagugucagauaauguaguauaggagcuucug

SEQ ID NO: 689973 - RNA, 64 nt, Homo Sapiens
ugucaucucaaccucaaacuaggguaacaacagagugucagauauucacauguaguagcuucug

SEQ ID NO: 689974 - RNA, 64 nt, Homo Sapiens
agggccuuggugggagaugaauuuuaauccccaugugucagaggcccacccaaaucccaucuca

SEQ ID NO: 689975 - RNA, 64 nt, Homo Sapiens
aaacauguacaaaacauuuguuacuucauguuuugugucagagaguuguuuauuuagugaucag

SEQ ID NO: 689976 - RNA, 64 nt, Homo Sapiens; identical to SEQ ID NO: 414361

SEQ ID NO: 689977 - RNA, 64 nt, Homo Sapiens; identical to SEQ ID NO: 414362

SEQ ID NO: 689978 - RNA, 64 nt, Homo Sapiens
gcuauuacuuugaaaacccugcugauucugaaaagugucagaaguuaccauuugauuugaaaaa

SEQ ID NO: 689979 - RNA, 64 nt, Homo Sapiens
uguuaagcugaggauacaaccaggaaaugcaacggugucagauuguguucaaaaugucuagaaa

SEQ ID NO: 689980 - RNA, 64 nt, Homo Sapiens
cacaaucaaaauacaacauucaauacuuccaggugugucagacuugggaugggacgcugauaua

SEQ ID NO: 689981 - RNA, 64 nt, Homo Sapiens
gcuuuguaauaacauaagaccauugugguuguuggugucagauaccuucccauccugagcucuc

SEQ ID NO: 689982 - RNA, 64 nt, Homo Sapiens
acuucucgaguagaggucugcaucagcuacugcggugucagaucugcuuuagucacuggacgag

SEQ ID NO: 689983 - RNA, 64 nt, Homo Sapiens
ccuccaagccugccucccagcugucugaacucaugugucagaaggguggagucgcagaccagag

SEQ ID NO: 689984 - RNA, 64 nt, Homo Sapiens
caguaccgagucccaccccccugggugcauuuccgugucagaaauucccuucagccaggagcuc

SEQ ID NO: 689985 - RNA, 64 nt, Homo Sapiens
agcuaugugguugagcucaggccucucgugccuggugucagagaaggcagagcccacaguaggu

SEQ ID NO: 689986 - RNA, 64 nt, Homo Sapiens
uucagacacugaugagaagucaagaggauauuaugugucagaauugagacauauuuaagaauuc

SEQ ID NO: 689987 - RNA, 64 nt, Homo Sapiens
uuguuuguuuguuuguuuugagacuccagucugggugucagaaugagaccccaucucaaaaaaa

SEQ ID NO: 689988 - RNA, 64 nt, Homo Sapiens
ccgugguaaacaucugcccauccucccagcuccugugucagagccugggggacgagucacccag

SEQ ID NO: 689989 - RNA, 64 nt, Homo Sapiens
gaggauuucgcuuccccucccauaggcagagcgggugucagacuucugugcgcggcgcuguuuc

SEQ ID NO: 689990 - RNA, 64 nt, Homo Sapiens
cuuaagagcugagaggccgggcuuccccaagagagugucagaauguccccuugagucaucacca

SEQ ID NO: 689991 - RNA, 64 nt, Homo Sapiens
uuuugcauucuggcuugugcaguuuuuauugucugugucagacguacagccagacauguucucu

SEQ ID NO: 689992 - RNA, 64 nt, Homo Sapiens
guguuuaaaaguaaaugauuugggaacugacaaugugucagaaaauauauguucauuuaucauu

SEQ ID NO: 689993 - RNA, 64 nt, Homo Sapiens
gagggccacaggugagggacacuaccacuggaucgugucagaaggugcugcugaggauagacug

SEQ ID NO: 689994 - RNA, 64 nt, Homo Sapiens
uugaaauggacucugagauggcagcguggugccagugucagacauccugugugugaugauaugc

SEQ ID NO: 689995 - RNA, 64 nt, Homo Sapiens
gacugcuuuauucuuuuccaauaaagaagugcacgugucagagcuggagcgccugcauugugag

SEQ ID NO: 689996 - RNA, 64 nt, Homo Sapiens
uguaaguagugcauauuuaauuuuaaaaagaaucgugucagaacaacuugauaacuagccgugu

SEQ ID NO: 689997 - RNA, 64 nt, Homo Sapiens
uucauuccuuucuauggcugccauguuguagcaugugucagaauauggcguuugcaagguuuac

SEQ ID NO: 689998 - RNA, 64 nt, Homo Sapiens
aaggugacggcaaggacaugaaauuaauuuuaaagugucagaaaauugcuuuugcaauuucuac

SEQ ID NO: 689999 - RNA, 64 nt, Homo Sapiens
acaggaguaccagugggagaggagacaucuugaagugucagauuuuuaaagauccuugagcaga

SEQ ID NO: 690000 - RNA, 64 nt, Homo Sapiens
aaaguaaggcauauggcucagggaacauccugaagugucagagagugcacagcugauaccagga

SEQ ID NO: 690001 - RNA, 64 nt, Homo Sapiens
uucuuugucagaacaaauauagugagcaauuuuugugucagaaauucucugagauucugugugc

SEQ ID NO: 690002 - RNA, 64 nt, Homo Sapiens
uugugcuugaaagauucucaaucauguauuuaaugugucagauaugguacgcugucuuuuuaaa

SEQ ID NO: 690003 - RNA, 64 nt, Homo Sapiens
gcacuucugaaagcagauauauagucaguuugcugugucagaaaucuagggccccugucuacug

SEQ ID NO: 690004 - RNA, 64 nt, Homo Sapiens
ugggacugggcguaggccuugacucagcaaggcagugucagagcaagcguuagggcugaugggu

SEQ ID NO: 690005 - RNA, 64 nt, Homo Sapiens
gcaaaggaacuaccugccuucccaagaacucggggugucagaggaggcaguguucugccgagac

SEQ ID NO: 690006 - RNA, 64 nt, Homo Sapiens
acaaaauacacuguggcuucuucuuugaucucucuuugaccauacugacacugggaaaagccca

SEQ ID NO: 690007 - RNA, 64 nt, Homo Sapiens
caagucuucagauaauugcaacuucaguugaucuuuugaccaagaccucaagagagccagaacu

SEQ ID NO: 690008 - RNA, 64 nt, Homo Sapiens
aaucuaaucacuagaguuauuauauucuguuauguuugaccagaauuauaugacaagaacuggu

SEQ ID NO: 690009 - RNA, 64 nt, Homo Sapiens
cggggauucuaauguuuguaagugcuuugagaucuuugaccaacaggugcuauuggagugcaaa

SEQ ID NO: 690010 - RNA, 64 nt, Homo Sapiens
uuucuuaaugaauagacacauacagacuuucuaauuugaccagaggcaaaaugaacgcuuauuu

SEQ ID NO: 690011 - RNA, 64 nt, Homo Sapiens
uucaucgcuauuuaaaaccuagguuagaccggcuuuugaccauaagcguuucauacaggucagc

SEQ ID NO: 690012 - RNA, 64 nt, Homo Sapiens
uuuggaugaagcagcuguaacugcccuaguguaguuugaccaggacauugucgugcuccuucca

SEQ ID NO: 690013 - RNA, 64 nt, Homo Sapiens
aacauugccuuuuggacauguaaaauauuuaggauuugaccacacaauggcuaugaaaaugcaa

SEQ ID NO: 690014 - RNA, 64 nt, Homo Sapiens
ugagcgggucuaguggaaagauugugucuggucguuugaccacacaccgcccugauuugcuguu

SEQ ID NO: 690015 - RNA, 64 nt, Homo Sapiens
ugguuuuuuagugcaauuucuucuguagcuauucuuugaccaaacuguggguauuguuaauauu

SEQ ID NO: 690016 - RNA, 64 nt, Homo Sapiens
ucucuuauuaauagagaaguugaccauaaauuaauuugaccaucaguuuuugccauuauaauuu

SEQ ID NO: 690017 - RNA, 64 nt, Homo Sapiens
aauuaauuugaccaucucucuuugccauuauaauuuugaccauacacguauuuauuuauaaguu

SEQ ID NO: 690018 - RNA, 64 nt, Homo Sapiens
aaauauauaacuuuguuaacacuuuuguuagcucuuugaccauaaaauaaugacaauaagcugu

SEQ ID NO: 690019 - RNA, 64 nt, Homo Sapiens
cuuuucauaauuuuuccuacguauacacaaacauuuugaccaaaaauccacacuauauguacug

SEQ ID NO: 690020 - RNA, 64 nt, Homo Sapiens; identical to SEQ ID NO: 154250

SEQ ID NO: 690021 - RNA, 64 nt, Homo Sapiens; identical to SEQ ID NO: 154251

SEQ ID NO: 690022 - RNA, 64 nt, Homo Sapiens; identical to SEQ ID NO: 154252

SEQ ID NO: 690023 - RNA, 64 nt, Homo Sapiens; identical to SEQ ID NO: 154253

SEQ ID NO: 690024 - RNA, 64 nt, Homo Sapiens; identical to SEQ ID NO: 154254

SEQ ID NO: 690025 - RNA, 64 nt, Homo Sapiens; identical to SEQ ID NO: 154255

SEQ ID NO: 690026 - RNA, 64 nt, Homo Sapiens; identical to SEQ ID NO: 154256

SEQ ID NO: 690027 - RNA, 64 nt, Homo Sapiens; identical to SEQ ID NO: 154257

SEQ ID NO: 690028 - RNA, 64 nt, Homo Sapiens; identical to SEQ ID NO: 154258

SEQ ID NO: 690029 - RNA, 64 nt, Homo Sapiens; identical to SEQ ID NO: 154259

SEQ ID NO: 690030 - RNA, 64 nt, Homo Sapiens; identical to SEQ ID NO: 154260

SEQ ID NO: 690031 - RNA, 64 nt, Homo Sapiens; identical to SEQ ID NO: 154261

SEQ ID NO: 690032 - RNA, 64 nt, Homo Sapiens; identical to SEQ ID NO: 154262

SEQ ID NO: 690033 - RNA, 64 nt, Homo Sapiens; identical to SEQ ID NO: 154263

SEQ ID NO: 690034 - RNA, 64 nt, Homo Sapiens; identical to SEQ ID NO: 154264

SEQ ID NO: 690035 - RNA, 64 nt, Homo Sapiens; identical to SEQ ID NO: 154265

SEQ ID NO: 690036 - RNA, 64 nt, Homo Sapiens; identical to SEQ ID NO: 154266

SEQ ID NO: 690037 - RNA, 64 nt, Homo Sapiens; identical to SEQ ID NO: 154267

SEQ ID NO: 690038 - RNA, 64 nt, Homo Sapiens; identical to SEQ ID NO: 154268

SEQ ID NO: 690039 - RNA, 64 nt, Homo Sapiens; identical to SEQ ID NO: 154269

SEQ ID NO: 690040 - RNA, 64 nt, Homo Sapiens; identical to SEQ ID NO: 154270

SEQ ID NO: 690041 - RNA, 64 nt, Homo Sapiens; identical to SEQ ID NO: 154271

SEQ ID NO: 690042 - RNA, 64 nt, Homo Sapiens; identical to SEQ ID NO: 154272

SEQ ID NO: 690043 - RNA, 64 nt, Homo Sapiens; identical to SEQ ID NO: 154273

SEQ ID NO: 690044 - RNA, 64 nt, Homo Sapiens; identical to SEQ ID NO: 154274

SEQ ID NO: 690045 - RNA, 64 nt, Homo Sapiens; identical to SEQ ID NO: 154275

SEQ ID NO: 690046 - RNA, 64 nt, Homo Sapiens; identical to SEQ ID NO: 154276

SEQ ID NO: 690047 - RNA, 64 nt, Homo Sapiens; identical to SEQ ID NO: 154277

SEQ ID NO: 690048 - RNA, 64 nt, Homo Sapiens; identical to SEQ ID NO: 154278

SEQ ID NO: 690049 - RNA, 64 nt, Homo Sapiens; identical to SEQ ID NO: 132416

SEQ ID NO: 690050 - RNA, 64 nt, Homo Sapiens; identical to SEQ ID NO: 132417

SEQ ID NO: 690051 - RNA, 64 nt, Homo Sapiens; identical to SEQ ID NO: 132418

SEQ ID NO: 690052 - RNA, 64 nt, Homo Sapiens; identical to SEQ ID NO: 132419

SEQ ID NO: 690053 - RNA, 64 nt, Homo Sapiens; identical to SEQ ID NO: 132420

SEQ ID NO: 690054 - RNA, 64 nt, Homo Sapiens; identical to SEQ ID NO: 132421

SEQ ID NO: 690055 - RNA, 64 nt, Homo Sapiens; identical to SEQ ID NO: 132422

SEQ ID NO: 690056 - RNA, 64 nt, Homo Sapiens; identical to SEQ ID NO: 132423

SEQ ID NO: 690057 - RNA, 64 nt, Homo Sapiens; identical to SEQ ID NO: 132424

SEQ ID NO: 690058 - RNA, 64 nt, Homo Sapiens; identical to SEQ ID NO: 132425

SEQ ID NO: 690059 - RNA, 64 nt, Homo Sapiens; identical to SEQ ID NO: 132426

SEQ ID NO: 690060 - RNA, 64 nt, Homo Sapiens; identical to SEQ ID NO: 132427

SEQ ID NO: 690061 - RNA, 64 nt, Homo Sapiens; identical to SEQ ID NO: 132428

SEQ ID NO: 690062 - RNA, 64 nt, Homo Sapiens; identical to SEQ ID NO: 132429

SEQ ID NO: 690063 - RNA, 64 nt, Homo Sapiens; identical to SEQ ID NO: 132430

SEQ ID NO: 690064 - RNA, 64 nt, Homo Sapiens; identical to SEQ ID NO: 132431

SEQ ID NO: 690065 - RNA, 64 nt, Homo Sapiens; identical to SEQ ID NO: 132432

SEQ ID NO: 690066 - RNA, 64 nt, Homo Sapiens; identical to SEQ ID NO: 132433

SEQ ID NO: 690067 - RNA, 64 nt, Homo Sapiens; identical to SEQ ID NO: 132434

SEQ ID NO: 690068 - RNA, 64 nt, Homo Sapiens; identical to SEQ ID NO: 132435

SEQ ID NO: 690069 - RNA, 64 nt, Homo Sapiens; identical to SEQ ID NO: 132436

SEQ ID NO: 690070 - RNA, 64 nt, Homo Sapiens; identical to SEQ ID NO: 132437

SEQ ID NO: 690071 - RNA, 64 nt, Homo Sapiens; identical to SEQ ID NO: 132438

SEQ ID NO: 690072 - RNA, 64 nt, Homo Sapiens; identical to SEQ ID NO: 132439

SEQ ID NO: 690073 - RNA, 64 nt, Homo Sapiens; identical to SEQ ID NO: 132440

SEQ ID NO: 690074 - RNA, 64 nt, Homo Sapiens; identical to SEQ ID NO: 132441

SEQ ID NO: 690075 - RNA, 64 nt, Homo Sapiens; identical to SEQ ID NO: 132442

SEQ ID NO: 690076 - RNA, 64 nt, Homo Sapiens; identical to SEQ ID NO: 132443

SEQ ID NO: 690077 - RNA, 64 nt, Homo Sapiens; identical to SEQ ID NO: 132444

SEQ ID NO: 690078 - RNA, 64 nt, Homo Sapiens; identical to SEQ ID NO: 132445

SEQ ID NO: 690079 - RNA, 64 nt, Homo Sapiens; identical to SEQ ID NO: 132446

SEQ ID NO: 690080 - RNA, 64 nt, Homo Sapiens; identical to SEQ ID NO: 132447

SEQ ID NO: 690081 - RNA, 64 nt, Homo Sapiens; identical to SEQ ID NO: 132448

SEQ ID NO: 690082 - RNA, 64 nt, Homo Sapiens; identical to SEQ ID NO: 132449

SEQ ID NO: 690083 - RNA, 64 nt, Homo Sapiens; identical to SEQ ID NO: 132450

SEQ ID NO: 690084 - RNA, 64 nt, Homo Sapiens; identical to SEQ ID NO: 132451

SEQ ID NO: 690085 - RNA, 64 nt, Homo Sapiens; identical to SEQ ID NO: 132452

SEQ ID NO: 690086 - RNA, 64 nt, Homo Sapiens; identical to SEQ ID NO: 132453

SEQ ID NO: 690087 - RNA, 64 nt, Homo Sapiens; identical to SEQ ID NO: 132454

SEQ ID NO: 690088 - RNA, 64 nt, Homo Sapiens; identical to SEQ ID NO: 132455

SEQ ID NO: 690089 - RNA, 64 nt, Homo Sapiens; identical to SEQ ID NO: 132456

SEQ ID NO: 690090 - RNA, 64 nt, Homo Sapiens; identical to SEQ ID NO: 132457

SEQ ID NO: 690091 - RNA, 64 nt, Homo Sapiens; identical to SEQ ID NO: 132458

SEQ ID NO: 690092 - RNA, 64 nt, Homo Sapiens; identical to SEQ ID NO: 132459

SEQ ID NO: 690093 - RNA, 64 nt, Homo Sapiens; identical to SEQ ID NO: 132460

SEQ ID NO: 690094 - RNA, 64 nt, Homo Sapiens; identical to SEQ ID NO: 132461

SEQ ID NO: 690095 - RNA, 64 nt, Homo Sapiens; identical to SEQ ID NO: 132462

SEQ ID NO: 690096 - RNA, 64 nt, Homo Sapiens; identical to SEQ ID NO: 132463

SEQ ID NO: 690097 - RNA, 64 nt, Homo Sapiens; identical to SEQ ID NO: 132464

SEQ ID NO: 690098 - RNA, 64 nt, Homo Sapiens; identical to SEQ ID NO: 132465

SEQ ID NO: 690099 - RNA, 64 nt, Homo Sapiens; identical to SEQ ID NO: 132466

SEQ ID NO: 690100 - RNA, 64 nt, Homo Sapiens; identical to SEQ ID NO: 132467

SEQ ID NO: 690101 - RNA, 64 nt, Homo Sapiens; identical to SEQ ID NO: 132468

SEQ ID NO: 690102 - RNA, 64 nt, Homo Sapiens; identical to SEQ ID NO: 132469

SEQ ID NO: 690103 - RNA, 64 nt, Homo Sapiens; identical to SEQ ID NO: 132470

SEQ ID NO: 690104 - RNA, 64 nt, Homo Sapiens; identical to SEQ ID NO: 132471

SEQ ID NO: 690105 - RNA, 64 nt, Homo Sapiens; identical to SEQ ID NO: 132472

SEQ ID NO: 690106 - RNA, 64 nt, Homo Sapiens; identical to SEQ ID NO: 132473

SEQ ID NO: 690107 - RNA, 64 nt, Homo Sapiens; identical to SEQ ID NO: 132474

SEQ ID NO: 690108 - RNA, 64 nt, Homo Sapiens; identical to SEQ ID NO: 132475

SEQ ID NO: 690109 - RNA, 64 nt, Homo Sapiens; identical to SEQ ID NO: 132476

SEQ ID NO: 690110 - RNA, 64 nt, Homo Sapiens; identical to SEQ ID NO: 265328

SEQ ID NO: 690111 - RNA, 64 nt, Homo Sapiens; identical to SEQ ID NO: 265329

SEQ ID NO: 690112 - RNA, 64 nt, Homo Sapiens; identical to SEQ ID NO: 265330

SEQ ID NO: 690113 - RNA, 64 nt, Homo Sapiens; identical to SEQ ID NO: 265331

SEQ ID NO: 690114 - RNA, 64 nt, Homo Sapiens; identical to SEQ ID NO: 265332

SEQ ID NO: 690115 - RNA, 64 nt, Homo Sapiens; identical to SEQ ID NO: 265333

SEQ ID NO: 690116 - RNA, 64 nt, Homo Sapiens; identical to SEQ ID NO: 265334

SEQ ID NO: 690117 - RNA, 64 nt, Homo Sapiens; identical to SEQ ID NO: 265335

SEQ ID NO: 690118 - RNA, 64 nt, Homo Sapiens; identical to SEQ ID NO: 265336

SEQ ID NO: 690119 - RNA, 64 nt, Homo Sapiens; identical to SEQ ID NO: 265337

SEQ ID NO: 690120 - RNA, 64 nt, Homo Sapiens; identical to SEQ ID NO: 265338

SEQ ID NO: 690121 - RNA, 64 nt, Homo Sapiens; identical to SEQ ID NO: 265339

SEQ ID NO: 690122 - RNA, 64 nt, Homo Sapiens; identical to SEQ ID NO: 265340

SEQ ID NO: 690123 - RNA, 64 nt, Homo Sapiens; identical to SEQ ID NO: 265341

SEQ ID NO: 690124 - RNA, 64 nt, Homo Sapiens; identical to SEQ ID NO: 265342

SEQ ID NO: 690125 - RNA, 64 nt, Homo Sapiens; identical to SEQ ID NO: 265343

SEQ ID NO: 690126 - RNA, 64 nt, Homo Sapiens; identical to SEQ ID NO: 265344

SEQ ID NO: 690127 - RNA, 64 nt, Homo Sapiens; identical to SEQ ID NO: 265345

SEQ ID NO: 690128 - RNA, 64 nt, Homo Sapiens; identical to SEQ ID NO: 265346

SEQ ID NO: 690129 - RNA, 64 nt, Homo Sapiens; identical to SEQ ID NO: 265347

SEQ ID NO: 690130 - RNA, 64 nt, Homo Sapiens; identical to SEQ ID NO: 265348

SEQ ID NO: 690131 - RNA, 64 nt, Homo Sapiens; identical to SEQ ID NO: 265349

SEQ ID NO: 690132 - RNA, 64 nt, Homo Sapiens; identical to SEQ ID NO: 265350

SEQ ID NO: 690133 - RNA, 64 nt, Homo Sapiens; identical to SEQ ID NO: 265351

SEQ ID NO: 690134 - RNA, 64 nt, Homo Sapiens; identical to SEQ ID NO: 265352

SEQ ID NO: 690135 - RNA, 64 nt, Homo Sapiens; identical to SEQ ID NO: 265353

SEQ ID NO: 690136 - RNA, 64 nt, Homo Sapiens; identical to SEQ ID NO: 265354

SEQ ID NO: 690137 - RNA, 64 nt, Homo Sapiens; identical to SEQ ID NO: 265355

SEQ ID NO: 690138 - RNA, 64 nt, Homo Sapiens; identical to SEQ ID NO: 265356

SEQ ID NO: 690139 - RNA, 64 nt, Homo Sapiens; identical to SEQ ID NO: 265357

SEQ ID NO: 690140 - RNA, 64 nt, Homo Sapiens; identical to SEQ ID NO: 265358

SEQ ID NO: 690141 - RNA, 64 nt, Homo Sapiens; identical to SEQ ID NO: 265359

SEQ ID NO: 690142 - RNA, 64 nt, Homo Sapiens; identical to SEQ ID NO: 265360

SEQ ID NO: 690143 - RNA, 64 nt, Homo Sapiens; identical to SEQ ID NO: 265361

SEQ ID NO: 690144 - RNA, 64 nt, Homo Sapiens; identical to SEQ ID NO: 265362

SEQ ID NO: 690145 - RNA, 64 nt, Homo Sapiens; identical to SEQ ID NO: 265363

SEQ ID NO: 690146 - RNA, 64 nt, Homo Sapiens; identical to SEQ ID NO: 265364

SEQ ID NO: 690147 - RNA, 64 nt, Homo Sapiens; identical to SEQ ID NO: 265365

SEQ ID NO: 690148 - RNA, 64 nt, Homo Sapiens; identical to SEQ ID NO: 265366

SEQ ID NO: 690149 - RNA, 64 nt, Homo Sapiens; identical to SEQ ID NO: 265367

SEQ ID NO: 690150 - RNA, 64 nt, Homo Sapiens; identical to SEQ ID NO: 265368

SEQ ID NO: 690151 - RNA, 64 nt, Homo Sapiens; identical to SEQ ID NO: 265369

SEQ ID NO: 690152 - RNA, 64 nt, Homo Sapiens; identical to SEQ ID NO: 265370

SEQ ID NO: 690153 - RNA, 64 nt, Homo Sapiens; identical to SEQ ID NO: 265371

SEQ ID NO: 690154 - RNA, 64 nt, Homo Sapiens; identical to SEQ ID NO: 265372

SEQ ID NO: 690155 - RNA, 64 nt, Homo Sapiens; identical to SEQ ID NO: 265373

SEQ ID NO: 690156 - RNA, 64 nt, Homo Sapiens; identical to SEQ ID NO: 265374

SEQ ID NO: 690157 - RNA, 64 nt, Homo Sapiens; identical to SEQ ID NO: 265375

SEQ ID NO: 690158 - RNA, 64 nt, Homo Sapiens; identical to SEQ ID NO: 265376

SEQ ID NO: 690159 - RNA, 64 nt, Homo Sapiens; identical to SEQ ID NO: 265377

SEQ ID NO: 690160 - RNA, 64 nt, Homo Sapiens; identical to SEQ ID NO: 265378

SEQ ID NO: 690161 - RNA, 64 nt, Homo Sapiens; identical to SEQ ID NO: 265379

SEQ ID NO: 690162 - RNA, 64 nt, Homo Sapiens; identical to SEQ ID NO: 265380

SEQ ID NO: 690163 - RNA, 64 nt, Homo Sapiens; identical to SEQ ID NO: 265381

SEQ ID NO: 690164 - RNA, 64 nt, Homo Sapiens; identical to SEQ ID NO: 265382

SEQ ID NO: 690165 - RNA, 64 nt, Homo Sapiens; identical to SEQ ID NO: 265383

SEQ ID NO: 690166 - RNA, 64 nt, Homo Sapiens; identical to SEQ ID NO: 265384

SEQ ID NO: 690167 - RNA, 64 nt, Homo Sapiens; identical to SEQ ID NO: 265385

SEQ ID NO: 690168 - RNA, 64 nt, Homo Sapiens; identical to SEQ ID NO: 265386

SEQ ID NO: 690169 - RNA, 64 nt, Homo Sapiens; identical to SEQ ID NO: 265387

SEQ ID NO: 690170 - RNA, 64 nt, Homo Sapiens; identical to SEQ ID NO: 265388

SEQ ID NO: 690171 - RNA, 64 nt, Homo Sapiens; identical to SEQ ID NO: 265389

SEQ ID NO: 690172 - RNA, 64 nt, Homo Sapiens; identical to SEQ ID NO: 265390

SEQ ID NO: 690173 - RNA, 64 nt, Homo Sapiens; identical to SEQ ID NO: 265391

SEQ ID NO: 690174 - RNA, 64 nt, Homo Sapiens; identical to SEQ ID NO: 265392

SEQ ID NO: 690175 - RNA, 64 nt, Homo Sapiens; identical to SEQ ID NO: 265393

SEQ ID NO: 690176 - RNA, 64 nt, Homo Sapiens; identical to SEQ ID NO: 265394

SEQ ID NO: 690177 - RNA, 64 nt, Homo Sapiens; identical to SEQ ID NO: 265395

SEQ ID NO: 690178 - RNA, 64 nt, Homo Sapiens; identical to SEQ ID NO: 265396

SEQ ID NO: 690179 - RNA, 64 nt, Homo Sapiens; identical to SEQ ID NO: 265397

SEQ ID NO: 690180 - RNA, 64 nt, Homo Sapiens; identical to SEQ ID NO: 265398

SEQ ID NO: 690181 - RNA, 64 nt, Homo Sapiens; identical to SEQ ID NO: 265399

SEQ ID NO: 690182 - RNA, 64 nt, Homo Sapiens; identical to SEQ ID NO: 265400

SEQ ID NO: 690183 - RNA, 64 nt, Homo Sapiens; identical to SEQ ID NO: 265401

SEQ ID NO: 690184 - RNA, 64 nt, Homo Sapiens; identical to SEQ ID NO: 265402

SEQ ID NO: 690185 - RNA, 64 nt, Homo Sapiens; identical to SEQ ID NO: 265403

SEQ ID NO: 690186 - RNA, 64 nt, Homo Sapiens; identical to SEQ ID NO: 265404

SEQ ID NO: 690187 - RNA, 64 nt, Homo Sapiens; identical to SEQ ID NO: 265405

SEQ ID NO: 690188 - RNA, 64 nt, Homo Sapiens; identical to SEQ ID NO: 265406

SEQ ID NO: 690189 - RNA, 64 nt, Homo Sapiens; identical to SEQ ID NO: 265407

SEQ ID NO: 690190 - RNA, 64 nt, Homo Sapiens; identical to SEQ ID NO: 265408

SEQ ID NO: 690191 - RNA, 64 nt, Homo Sapiens; identical to SEQ ID NO: 265409

SEQ ID NO: 690192 - RNA, 64 nt, Homo Sapiens; identical to SEQ ID NO: 265410

SEQ ID NO: 690193 - RNA, 64 nt, Homo Sapiens; identical to SEQ ID NO: 265411

SEQ ID NO: 690194 - RNA, 64 nt, Homo Sapiens; identical to SEQ ID NO: 265412

SEQ ID NO: 690195 - RNA, 64 nt, Homo Sapiens; identical to SEQ ID NO: 265413

SEQ ID NO: 690196 - RNA, 64 nt, Homo Sapiens; identical to SEQ ID NO: 265414

SEQ ID NO: 690197 - RNA, 64 nt, Homo Sapiens; identical to SEQ ID NO: 265415

SEQ ID NO: 690198 - RNA, 64 nt, Homo Sapiens; identical to SEQ ID NO: 265416

SEQ ID NO: 690199 - RNA, 64 nt, Homo Sapiens; identical to SEQ ID NO: 265417

SEQ ID NO: 690200 - RNA, 64 nt, Homo Sapiens; identical to SEQ ID NO: 265418

SEQ ID NO: 690201 - RNA, 64 nt, Homo Sapiens; identical to SEQ ID NO: 265419

SEQ ID NO: 690202 - RNA, 63 nt, Homo Sapiens; identical to SEQ ID NO: 265420

SEQ ID NO: 690203 - RNA, 64 nt, Homo Sapiens; identical to SEQ ID NO: 265421

SEQ ID NO: 690204 - RNA, 64 nt, Homo Sapiens; identical to SEQ ID NO: 265422

SEQ ID NO: 690205 - RNA, 64 nt, Homo Sapiens; identical to SEQ ID NO: 265423

SEQ ID NO: 690206 - RNA, 64 nt, Homo Sapiens; identical to SEQ ID NO: 265424

SEQ ID NO: 690207 - RNA, 64 nt, Homo Sapiens; identical to SEQ ID NO: 265425

SEQ ID NO: 690208 - RNA, 64 nt, Homo Sapiens; identical to SEQ ID NO: 265426

SEQ ID NO: 690209 - RNA, 64 nt, Homo Sapiens; identical to SEQ ID NO: 265427

SEQ ID NO: 690210 - RNA, 64 nt, Homo Sapiens; identical to SEQ ID NO: 265428

SEQ ID NO: 690211 - RNA, 64 nt, Homo Sapiens; identical to SEQ ID NO: 265429

SEQ ID NO: 690212 - RNA, 64 nt, Homo Sapiens; identical to SEQ ID NO: 265430

SEQ ID NO: 690213 - RNA, 64 nt, Homo Sapiens; identical to SEQ ID NO: 265431

SEQ ID NO: 690214 - RNA, 64 nt, Homo Sapiens; identical to SEQ ID NO: 265432

SEQ ID NO: 690215 - RNA, 64 nt, Homo Sapiens; identical to SEQ ID NO: 265433

SEQ ID NO: 690216 - RNA, 64 nt, Homo Sapiens; identical to SEQ ID NO: 265434

SEQ ID NO: 690217 - RNA, 64 nt, Homo Sapiens; identical to SEQ ID NO: 265435

SEQ ID NO: 690218 - RNA, 64 nt, Homo Sapiens; identical to SEQ ID NO: 265436

SEQ ID NO: 690219 - RNA, 64 nt, Homo Sapiens; identical to SEQ ID NO: 265437

SEQ ID NO: 690220 - RNA, 64 nt, Homo Sapiens; identical to SEQ ID NO: 265438

SEQ ID NO: 690221 - RNA, 64 nt, Homo Sapiens; identical to SEQ ID NO: 265439

SEQ ID NO: 690222 - RNA, 64 nt, Homo Sapiens; identical to SEQ ID NO: 265440

SEQ ID NO: 690223 - RNA, 64 nt, Homo Sapiens; identical to SEQ ID NO: 265441

SEQ ID NO: 690224 - RNA, 64 nt, Homo Sapiens; identical to SEQ ID NO: 265442

SEQ ID NO: 690225 - RNA, 64 nt, Homo Sapiens; identical to SEQ ID NO: 265443

SEQ ID NO: 690226 - RNA, 64 nt, Homo Sapiens; identical to SEQ ID NO: 265444

SEQ ID NO: 690227 - RNA, 64 nt, Homo Sapiens; identical to SEQ ID NO: 265445

SEQ ID NO: 690228 - RNA, 64 nt, Homo Sapiens; identical to SEQ ID NO: 265446

SEQ ID NO: 690229 - RNA, 64 nt, Homo Sapiens; identical to SEQ ID NO: 265447

SEQ ID NO: 690230 - RNA, 64 nt, Homo Sapiens; identical to SEQ ID NO: 265448

SEQ ID NO: 690231 - RNA, 64 nt, Homo Sapiens; identical to SEQ ID NO: 265449

SEQ ID NO: 690232 - RNA, 64 nt, Homo Sapiens; identical to SEQ ID NO: 265450

SEQ ID NO: 690233 - RNA, 50 nt, Homo Sapiens; identical to SEQ ID NO: 265451

SEQ ID NO: 690234 - RNA, 64 nt, Homo Sapiens; identical to SEQ ID NO: 265452

SEQ ID NO: 690235 - RNA, 64 nt, Homo Sapiens; identical to SEQ ID NO: 265453

SEQ ID NO: 690236 - RNA, 64 nt, Homo Sapiens; identical to SEQ ID NO: 265454

SEQ ID NO: 690237 - RNA, 64 nt, Homo Sapiens; identical to SEQ ID NO: 265455

SEQ ID NO: 690238 - RNA, 64 nt, Homo Sapiens; identical to SEQ ID NO: 265456

SEQ ID NO: 690239 - RNA, 64 nt, Homo Sapiens; identical to SEQ ID NO: 265457

SEQ ID NO: 690240 - RNA, 64 nt, Homo Sapiens; identical to SEQ ID NO: 265458

SEQ ID NO: 690241 - RNA, 64 nt, Homo Sapiens; identical to SEQ ID NO: 265459

SEQ ID NO: 690242 - RNA, 64 nt, Homo Sapiens; identical to SEQ ID NO: 265460

SEQ ID NO: 690243 - RNA, 64 nt, Homo Sapiens; identical to SEQ ID NO: 265461

SEQ ID NO: 690244 - RNA, 64 nt, Homo Sapiens; identical to SEQ ID NO: 265462

SEQ ID NO: 690245 - RNA, 64 nt, Homo Sapiens; identical to SEQ ID NO: 265463

SEQ ID NO: 690246 - RNA, 64 nt, Homo Sapiens; identical to SEQ ID NO: 265464

SEQ ID NO: 690247 - RNA, 64 nt, Homo Sapiens; identical to SEQ ID NO: 298158

SEQ ID NO: 690248 - RNA, 64 nt, Homo Sapiens; identical to SEQ ID NO: 298159

SEQ ID NO: 690249 - RNA, 64 nt, Homo Sapiens; identical to SEQ ID NO: 298160

SEQ ID NO: 690250 - RNA, 64 nt, Homo Sapiens; identical to SEQ ID NO: 298161

SEQ ID NO: 690251 - RNA, 64 nt, Homo Sapiens; identical to SEQ ID NO: 298162

SEQ ID NO: 690252 - RNA, 64 nt, Homo Sapiens; identical to SEQ ID NO: 298163

SEQ ID NO: 690253 - RNA, 64 nt, Homo Sapiens; identical to SEQ ID NO: 298164

SEQ ID NO: 690254 - RNA, 64 nt, Homo Sapiens; identical to SEQ ID NO: 298165

SEQ ID NO: 690255 - RNA, 64 nt, Homo Sapiens; identical to SEQ ID NO: 298166

SEQ ID NO: 690256 - RNA, 64 nt, Homo Sapiens; identical to SEQ ID NO: 298167

SEQ ID NO: 690257 - RNA, 64 nt, Homo Sapiens; identical to SEQ ID NO: 298168

SEQ ID NO: 690258 - RNA, 64 nt, Homo Sapiens; identical to SEQ ID NO: 298169

SEQ ID NO: 690259 - RNA, 64 nt, Homo Sapiens; identical to SEQ ID NO: 298170

SEQ ID NO: 690260 - RNA, 64 nt, Homo Sapiens; identical to SEQ ID NO: 298171

SEQ ID NO: 690261 - RNA, 64 nt, Homo Sapiens; identical to SEQ ID NO: 298172

SEQ ID NO: 690262 - RNA, 64 nt, Homo Sapiens; identical to SEQ ID NO: 298173

SEQ ID NO: 690263 - RNA, 64 nt, Homo Sapiens; identical to SEQ ID NO: 298174

SEQ ID NO: 690264 - RNA, 64 nt, Homo Sapiens; identical to SEQ ID NO: 298175

SEQ ID NO: 690265 - RNA, 64 nt, Homo Sapiens; identical to SEQ ID NO: 298176

SEQ ID NO: 690266 - RNA, 64 nt, Homo Sapiens; identical to SEQ ID NO: 298177

SEQ ID NO: 690267 - RNA, 64 nt, Homo Sapiens; identical to SEQ ID NO: 298178

SEQ ID NO: 690268 - RNA, 64 nt, Homo Sapiens; identical to SEQ ID NO: 298179

SEQ ID NO: 690269 - RNA, 64 nt, Homo Sapiens; identical to SEQ ID NO: 298180

SEQ ID NO: 690270 - RNA, 64 nt, Homo Sapiens; identical to SEQ ID NO: 298181

SEQ ID NO: 690271 - RNA, 64 nt, Homo Sapiens; identical to SEQ ID NO: 298182

SEQ ID NO: 690272 - RNA, 64 nt, Homo Sapiens; identical to SEQ ID NO: 298183

SEQ ID NO: 690273 - RNA, 64 nt, Homo Sapiens; identical to SEQ ID NO: 298184

SEQ ID NO: 690274 - RNA, 64 nt, Homo Sapiens; identical to SEQ ID NO: 298185

SEQ ID NO: 690275 - RNA, 64 nt, Homo Sapiens; identical to SEQ ID NO: 298186

SEQ ID NO: 690276 - RNA, 64 nt, Homo Sapiens; identical to SEQ ID NO: 298187

SEQ ID NO: 690277 - RNA, 64 nt, Homo Sapiens; identical to SEQ ID NO: 298188

SEQ ID NO: 690278 - RNA, 64 nt, Homo Sapiens; identical to SEQ ID NO: 298189

SEQ ID NO: 690279 - RNA, 64 nt, Homo Sapiens; identical to SEQ ID NO: 298190

SEQ ID NO: 690280 - RNA, 64 nt, Homo Sapiens; identical to SEQ ID NO: 298191

SEQ ID NO: 690281 - RNA, 64 nt, Homo Sapiens; identical to SEQ ID NO: 298192

SEQ ID NO: 690282 - RNA, 64 nt, Homo Sapiens; identical to SEQ ID NO: 298193

SEQ ID NO: 690283 - RNA, 64 nt, Homo Sapiens; identical to SEQ ID NO: 298194

SEQ ID NO: 690284 - RNA, 64 nt, Homo Sapiens; identical to SEQ ID NO: 298195

SEQ ID NO: 690285 - RNA, 64 nt, Homo Sapiens; identical to SEQ ID NO: 298196

SEQ ID NO: 690286 - RNA, 64 nt, Homo Sapiens; identical to SEQ ID NO: 298197

SEQ ID NO: 690287 - RNA, 64 nt, Homo Sapiens; identical to SEQ ID NO: 298198

SEQ ID NO: 690288 - RNA, 64 nt, Homo Sapiens; identical to SEQ ID NO: 298199

SEQ ID NO: 690289 - RNA, 64 nt, Homo Sapiens; identical to SEQ ID NO: 298200

SEQ ID NO: 690290 - RNA, 64 nt, Homo Sapiens; identical to SEQ ID NO: 298201

SEQ ID NO: 690291 - RNA, 64 nt, Homo Sapiens; identical to SEQ ID NO: 298202

SEQ ID NO: 690292 - RNA, 64 nt, Homo Sapiens; identical to SEQ ID NO: 298203

SEQ ID NO: 690293 - RNA, 64 nt, Homo Sapiens; identical to SEQ ID NO: 298204

SEQ ID NO: 690294 - RNA, 64 nt, Homo Sapiens; identical to SEQ ID NO: 298205

SEQ ID NO: 690295 - RNA, 64 nt, Homo Sapiens; identical to SEQ ID NO: 298206

SEQ ID NO: 690296 - RNA, 64 nt, Homo Sapiens; identical to SEQ ID NO: 298207

SEQ ID NO: 690297 - RNA, 64 nt, Homo Sapiens; identical to SEQ ID NO: 298208

SEQ ID NO: 690298 - RNA, 64 nt, Homo Sapiens; identical to SEQ ID NO: 298209

SEQ ID NO: 690299 - RNA, 64 nt, Homo Sapiens; identical to SEQ ID NO: 298210

SEQ ID NO: 690300 - RNA, 64 nt, Homo Sapiens; identical to SEQ ID NO: 298211

SEQ ID NO: 690301 - RNA, 64 nt, Homo Sapiens; identical to SEQ ID NO: 298212

SEQ ID NO: 690302 - RNA, 64 nt, Homo Sapiens; identical to SEQ ID NO: 298213

SEQ ID NO: 690303 - RNA, 64 nt, Homo Sapiens; identical to SEQ ID NO: 298214

SEQ ID NO: 690304 - RNA, 64 nt, Homo Sapiens; identical to SEQ ID NO: 298215

SEQ ID NO: 690305 - RNA, 64 nt, Homo Sapiens; identical to SEQ ID NO: 298216

SEQ ID NO: 690306 - RNA, 64 nt, Homo Sapiens; identical to SEQ ID NO: 298217

SEQ ID NO: 690307 - RNA, 64 nt, Homo Sapiens; identical to SEQ ID NO: 298218

SEQ ID NO: 690308 - RNA, 64 nt, Homo Sapiens; identical to SEQ ID NO: 298219

SEQ ID NO: 690309 - RNA, 64 nt, Homo Sapiens; identical to SEQ ID NO: 298220

SEQ ID NO: 690310 - RNA, 64 nt, Homo Sapiens; identical to SEQ ID NO: 298221

SEQ ID NO: 690311 - RNA, 64 nt, Homo Sapiens; identical to SEQ ID NO: 298222

SEQ ID NO: 690312 - RNA, 64 nt, Homo Sapiens; identical to SEQ ID NO: 298223

SEQ ID NO: 690313 - RNA, 64 nt, Homo Sapiens; identical to SEQ ID NO: 298224

SEQ ID NO: 690314 - RNA, 64 nt, Homo Sapiens; identical to SEQ ID NO: 298225

SEQ ID NO: 690315 - RNA, 64 nt, Homo Sapiens; identical to SEQ ID NO: 298226

SEQ ID NO: 690316 - RNA, 64 nt, Homo Sapiens; identical to SEQ ID NO: 298227

SEQ ID NO: 690317 - RNA, 64 nt, Homo Sapiens; identical to SEQ ID NO: 298228

SEQ ID NO: 690318 - RNA, 64 nt, Homo Sapiens; identical to SEQ ID NO: 298229

SEQ ID NO: 690319 - RNA, 56 nt, Homo Sapiens; identical to SEQ ID NO: 298230

SEQ ID NO: 690320 - RNA, 64 nt, Homo Sapiens; identical to SEQ ID NO: 298231

SEQ ID NO: 690321 - RNA, 64 nt, Homo Sapiens; identical to SEQ ID NO: 298232

SEQ ID NO: 690322 - RNA, 64 nt, Homo Sapiens; identical to SEQ ID NO: 298233

SEQ ID NO: 690323 - RNA, 64 nt, Homo Sapiens; identical to SEQ ID NO: 298234

SEQ ID NO: 690324 - RNA, 64 nt, Homo Sapiens; identical to SEQ ID NO: 298235

SEQ ID NO: 690325 - RNA, 64 nt, Homo Sapiens; identical to SEQ ID NO: 298236

SEQ ID NO: 690326 - RNA, 64 nt, Homo Sapiens; identical to SEQ ID NO: 298237

SEQ ID NO: 690327 - RNA, 64 nt, Homo Sapiens; identical to SEQ ID NO: 298238

SEQ ID NO: 690328 - RNA, 63 nt, Homo Sapiens; identical to SEQ ID NO: 298239

SEQ ID NO: 690329 - RNA, 64 nt, Homo Sapiens; identical to SEQ ID NO: 298240

SEQ ID NO: 690330 - RNA, 64 nt, Homo Sapiens; identical to SEQ ID NO: 298241

SEQ ID NO: 690331 - RNA, 64 nt, Homo Sapiens; identical to SEQ ID NO: 298242

SEQ ID NO: 690332 - RNA, 64 nt, Homo Sapiens; identical to SEQ ID NO: 298243

SEQ ID NO: 690333 - RNA, 64 nt, Homo Sapiens; identical to SEQ ID NO: 298244

SEQ ID NO: 690334 - RNA, 64 nt, Homo Sapiens; identical to SEQ ID NO: 298245

SEQ ID NO: 690335 - RNA, 64 nt, Homo Sapiens; identical to SEQ ID NO: 298246

SEQ ID NO: 690336 - RNA, 64 nt, Homo Sapiens; identical to SEQ ID NO: 298247

SEQ ID NO: 690337 - RNA, 64 nt, Homo Sapiens; identical to SEQ ID NO: 298248

SEQ ID NO: 690338 - RNA, 64 nt, Homo Sapiens; identical to SEQ ID NO: 298249

SEQ ID NO: 690339 - RNA, 64 nt, Homo Sapiens; identical to SEQ ID NO: 226834

SEQ ID NO: 690340 - RNA, 64 nt, Homo Sapiens; identical to SEQ ID NO: 226835

SEQ ID NO: 690341 - RNA, 64 nt, Homo Sapiens; identical to SEQ ID NO: 226836

SEQ ID NO: 690342 - RNA, 64 nt, Homo Sapiens; identical to SEQ ID NO: 226837

SEQ ID NO: 690343 - RNA, 64 nt, Homo Sapiens; identical to SEQ ID NO: 226838

SEQ ID NO: 690344 - RNA, 64 nt, Homo Sapiens; identical to SEQ ID NO: 226839

SEQ ID NO: 690345 - RNA, 64 nt, Homo Sapiens; identical to SEQ ID NO: 226840

SEQ ID NO: 690346 - RNA, 64 nt, Homo Sapiens; identical to SEQ ID NO: 226841

SEQ ID NO: 690347 - RNA, 64 nt, Homo Sapiens; identical to SEQ ID NO: 226842

SEQ ID NO: 690348 - RNA, 64 nt, Homo Sapiens; identical to SEQ ID NO: 226843

SEQ ID NO: 690349 - RNA, 64 nt, Homo Sapiens; identical to SEQ ID NO: 226844

SEQ ID NO: 690350 - RNA, 64 nt, Homo Sapiens; identical to SEQ ID NO: 226845

SEQ ID NO: 690351 - RNA, 64 nt, Homo Sapiens; identical to SEQ ID NO: 226846

SEQ ID NO: 690352 - RNA, 64 nt, Homo Sapiens; identical to SEQ ID NO: 226847

SEQ ID NO: 690353 - RNA, 64 nt, Homo Sapiens; identical to SEQ ID NO: 226848

SEQ ID NO: 690354 - RNA, 64 nt, Homo Sapiens; identical to SEQ ID NO: 226849

SEQ ID NO: 690355 - RNA, 64 nt, Homo Sapiens; identical to SEQ ID NO: 226850

SEQ ID NO: 690356 - RNA, 64 nt, Homo Sapiens; identical to SEQ ID NO: 226851

SEQ ID NO: 690357 - RNA, 64 nt, Homo Sapiens; identical to SEQ ID NO: 226852

SEQ ID NO: 690358 - RNA, 64 nt, Homo Sapiens; identical to SEQ ID NO: 226853

SEQ ID NO: 690359 - RNA, 64 nt, Homo Sapiens; identical to SEQ ID NO: 226854

SEQ ID NO: 690360 - RNA, 64 nt, Homo Sapiens; identical to SEQ ID NO: 226855

SEQ ID NO: 690361 - RNA, 64 nt, Homo Sapiens; identical to SEQ ID NO: 226856

SEQ ID NO: 690362 - RNA, 64 nt, Homo Sapiens; identical to SEQ ID NO: 226857

SEQ ID NO: 690363 - RNA, 64 nt, Homo Sapiens; identical to SEQ ID NO: 226858

SEQ ID NO: 690364 - RNA, 64 nt, Homo Sapiens; identical to SEQ ID NO: 226859

SEQ ID NO: 690365 - RNA, 64 nt, Homo Sapiens; identical to SEQ ID NO: 226860

SEQ ID NO: 690366 - RNA, 64 nt, Homo Sapiens; identical to SEQ ID NO: 226861

SEQ ID NO: 690367 - RNA, 64 nt, Homo Sapiens; identical to SEQ ID NO: 226862

SEQ ID NO: 690368 - RNA, 64 nt, Homo Sapiens; identical to SEQ ID NO: 226863

SEQ ID NO: 690369 - RNA, 64 nt, Homo Sapiens; identical to SEQ ID NO: 226864

SEQ ID NO: 690370 - RNA, 64 nt, Homo Sapiens; identical to SEQ ID NO: 226865

SEQ ID NO: 690371 - RNA, 64 nt, Homo Sapiens; identical to SEQ ID NO: 226866

SEQ ID NO: 690372 - RNA, 64 nt, Homo Sapiens; identical to SEQ ID NO: 226867

SEQ ID NO: 690373 - RNA, 64 nt, Homo Sapiens; identical to SEQ ID NO: 226868

SEQ ID NO: 690374 - RNA, 64 nt, Homo Sapiens; identical to SEQ ID NO: 226869

SEQ ID NO: 690375 - RNA, 64 nt, Homo Sapiens; identical to SEQ ID NO: 226870

SEQ ID NO: 690376 - RNA, 64 nt, Homo Sapiens; identical to SEQ ID NO: 226871

SEQ ID NO: 690377 - RNA, 64 nt, Homo Sapiens; identical to SEQ ID NO: 226872

SEQ ID NO: 690378 - RNA, 64 nt, Homo Sapiens; identical to SEQ ID NO: 226873

SEQ ID NO: 690379 - RNA, 64 nt, Homo Sapiens; identical to SEQ ID NO: 226874

SEQ ID NO: 690380 - RNA, 64 nt, Homo Sapiens; identical to SEQ ID NO: 226875

SEQ ID NO: 690381 - RNA, 64 nt, Homo Sapiens; identical to SEQ ID NO: 226876

SEQ ID NO: 690382 - RNA, 64 nt, Homo Sapiens; identical to SEQ ID NO: 226877

SEQ ID NO: 690383 - RNA, 64 nt, Homo Sapiens; identical to SEQ ID NO: 226878

SEQ ID NO: 690384 - RNA, 64 nt, Homo Sapiens; identical to SEQ ID NO: 226879

SEQ ID NO: 690385 - RNA, 64 nt, Homo Sapiens; identical to SEQ ID NO: 226880

SEQ ID NO: 690386 - RNA, 64 nt, Homo Sapiens; identical to SEQ ID NO: 226881

SEQ ID NO: 690387 - RNA, 64 nt, Homo Sapiens; identical to SEQ ID NO: 226882

SEQ ID NO: 690388 - RNA, 64 nt, Homo Sapiens; identical to SEQ ID NO: 226883

SEQ ID NO: 690389 - RNA, 64 nt, Homo Sapiens; identical to SEQ ID NO: 226884

SEQ ID NO: 690390 - RNA, 64 nt, Homo Sapiens; identical to SEQ ID NO: 226885

SEQ ID NO: 690391 - RNA, 64 nt, Homo Sapiens; identical to SEQ ID NO: 226886

SEQ ID NO: 690392 - RNA, 64 nt, Homo Sapiens; identical to SEQ ID NO: 226887

SEQ ID NO: 690393 - RNA, 64 nt, Homo Sapiens; identical to SEQ ID NO: 226888

SEQ ID NO: 690394 - RNA, 64 nt, Homo Sapiens; identical to SEQ ID NO: 226889

SEQ ID NO: 690395 - RNA, 64 nt, Homo Sapiens; identical to SEQ ID NO: 226890

SEQ ID NO: 690396 - RNA, 64 nt, Homo Sapiens; identical to SEQ ID NO: 265328

SEQ ID NO: 690397 - RNA, 64 nt, Homo Sapiens; identical to SEQ ID NO: 265329

SEQ ID NO: 690398 - RNA, 64 nt, Homo Sapiens; identical to SEQ ID NO: 265330

SEQ ID NO: 690399 - RNA, 64 nt, Homo Sapiens; identical to SEQ ID NO: 265331

SEQ ID NO: 690400 - RNA, 64 nt, Homo Sapiens; identical to SEQ ID NO: 265332

SEQ ID NO: 690401 - RNA, 64 nt, Homo Sapiens; identical to SEQ ID NO: 265333

SEQ ID NO: 690402 - RNA, 64 nt, Homo Sapiens; identical to SEQ ID NO: 265334

SEQ ID NO: 690403 - RNA, 64 nt, Homo Sapiens; identical to SEQ ID NO: 265335

SEQ ID NO: 690404 - RNA, 64 nt, Homo Sapiens; identical to SEQ ID NO: 265336

SEQ ID NO: 690405 - RNA, 64 nt, Homo Sapiens; identical to SEQ ID NO: 265337

SEQ ID NO: 690406 - RNA, 64 nt, Homo Sapiens; identical to SEQ ID NO: 265338

SEQ ID NO: 690407 - RNA, 64 nt, Homo Sapiens; identical to SEQ ID NO: 265339

SEQ ID NO: 690408 - RNA, 64 nt, Homo Sapiens; identical to SEQ ID NO: 265340

SEQ ID NO: 690409 - RNA, 64 nt, Homo Sapiens; identical to SEQ ID NO: 265341

SEQ ID NO: 690410 - RNA, 64 nt, Homo Sapiens; identical to SEQ ID NO: 265342

SEQ ID NO: 690411 - RNA, 64 nt, Homo Sapiens; identical to SEQ ID NO: 265343

SEQ ID NO: 690412 - RNA, 64 nt, Homo Sapiens; identical to SEQ ID NO: 265344

SEQ ID NO: 690413 - RNA, 64 nt, Homo Sapiens; identical to SEQ ID NO: 265345

SEQ ID NO: 690414 - RNA, 64 nt, Homo Sapiens; identical to SEQ ID NO: 265346

SEQ ID NO: 690415 - RNA, 64 nt, Homo Sapiens; identical to SEQ ID NO: 265347

SEQ ID NO: 690416 - RNA, 64 nt, Homo Sapiens; identical to SEQ ID NO: 265348

SEQ ID NO: 690417 - RNA, 64 nt, Homo Sapiens; identical to SEQ ID NO: 265349

SEQ ID NO: 690418 - RNA, 64 nt, Homo Sapiens; identical to SEQ ID NO: 265350

SEQ ID NO: 690419 - RNA, 64 nt, Homo Sapiens; identical to SEQ ID NO: 265351

SEQ ID NO: 690420 - RNA, 64 nt, Homo Sapiens; identical to SEQ ID NO: 265352

SEQ ID NO: 690421 - RNA, 64 nt, Homo Sapiens; identical to SEQ ID NO: 265353

SEQ ID NO: 690422 - RNA, 64 nt, Homo Sapiens; identical to SEQ ID NO: 265354

SEQ ID NO: 690423 - RNA, 64 nt, Homo Sapiens; identical to SEQ ID NO: 265355

SEQ ID NO: 690424 - RNA, 64 nt, Homo Sapiens; identical to SEQ ID NO: 265356

SEQ ID NO: 690425 - RNA, 64 nt, Homo Sapiens; identical to SEQ ID NO: 265357

SEQ ID NO: 690426 - RNA, 64 nt, Homo Sapiens; identical to SEQ ID NO: 265358

SEQ ID NO: 690427 - RNA, 64 nt, Homo Sapiens; identical to SEQ ID NO: 265359

SEQ ID NO: 690428 - RNA, 64 nt, Homo Sapiens; identical to SEQ ID NO: 265360

SEQ ID NO: 690429 - RNA, 64 nt, Homo Sapiens; identical to SEQ ID NO: 265361

SEQ ID NO: 690430 - RNA, 64 nt, Homo Sapiens; identical to SEQ ID NO: 265362

SEQ ID NO: 690431 - RNA, 64 nt, Homo Sapiens; identical to SEQ ID NO: 265363

SEQ ID NO: 690432 - RNA, 64 nt, Homo Sapiens; identical to SEQ ID NO: 265364

SEQ ID NO: 690433 - RNA, 64 nt, Homo Sapiens; identical to SEQ ID NO: 265365

SEQ ID NO: 690434 - RNA, 64 nt, Homo Sapiens; identical to SEQ ID NO: 265366

SEQ ID NO: 690435 - RNA, 64 nt, Homo Sapiens; identical to SEQ ID NO: 265367

SEQ ID NO: 690436 - RNA, 64 nt, Homo Sapiens; identical to SEQ ID NO: 265368

SEQ ID NO: 690437 - RNA, 64 nt, Homo Sapiens; identical to SEQ ID NO: 265369

SEQ ID NO: 690438 - RNA, 64 nt, Homo Sapiens; identical to SEQ ID NO: 265370

SEQ ID NO: 690439 - RNA, 64 nt, Homo Sapiens; identical to SEQ ID NO: 265371

SEQ ID NO: 690440 - RNA, 64 nt, Homo Sapiens; identical to SEQ ID NO: 265372

SEQ ID NO: 690441 - RNA, 64 nt, Homo Sapiens; identical to SEQ ID NO: 265373

SEQ ID NO: 690442 - RNA, 64 nt, Homo Sapiens; identical to SEQ ID NO: 265374

SEQ ID NO: 690443 - RNA, 64 nt, Homo Sapiens; identical to SEQ ID NO: 265375

SEQ ID NO: 690444 - RNA, 64 nt, Homo Sapiens; identical to SEQ ID NO: 265376

SEQ ID NO: 690445 - RNA, 64 nt, Homo Sapiens; identical to SEQ ID NO: 265377

SEQ ID NO: 690446 - RNA, 64 nt, Homo Sapiens; identical to SEQ ID NO: 265378

SEQ ID NO: 690447 - RNA, 64 nt, Homo Sapiens; identical to SEQ ID NO: 265379

SEQ ID NO: 690448 - RNA, 64 nt, Homo Sapiens; identical to SEQ ID NO: 265380

SEQ ID NO: 690449 - RNA, 64 nt, Homo Sapiens; identical to SEQ ID NO: 265381

SEQ ID NO: 690450 - RNA, 64 nt, Homo Sapiens; identical to SEQ ID NO: 265382

SEQ ID NO: 690451 - RNA, 64 nt, Homo Sapiens; identical to SEQ ID NO: 265383

SEQ ID NO: 690452 - RNA, 64 nt, Homo Sapiens; identical to SEQ ID NO: 265384

SEQ ID NO: 690453 - RNA, 64 nt, Homo Sapiens; identical to SEQ ID NO: 265385

SEQ ID NO: 690454 - RNA, 64 nt, Homo Sapiens; identical to SEQ ID NO: 265386

SEQ ID NO: 690455 - RNA, 64 nt, Homo Sapiens; identical to SEQ ID NO: 265387

SEQ ID NO: 690456 - RNA, 64 nt, Homo Sapiens; identical to SEQ ID NO: 265388

SEQ ID NO: 690457 - RNA, 64 nt, Homo Sapiens; identical to SEQ ID NO: 265389

SEQ ID NO: 690458 - RNA, 64 nt, Homo Sapiens; identical to SEQ ID NO: 265390

SEQ ID NO: 690459 - RNA, 64 nt, Homo Sapiens; identical to SEQ ID NO: 265391

SEQ ID NO: 690460 - RNA, 64 nt, Homo Sapiens; identical to SEQ ID NO: 265392

SEQ ID NO: 690461 - RNA, 64 nt, Homo Sapiens; identical to SEQ ID NO: 265393

SEQ ID NO: 690462 - RNA, 64 nt, Homo Sapiens; identical to SEQ ID NO: 265394

SEQ ID NO: 690463 - RNA, 64 nt, Homo Sapiens; identical to SEQ ID NO: 265395

SEQ ID NO: 690464 - RNA, 64 nt, Homo Sapiens; identical to SEQ ID NO: 265396

SEQ ID NO: 690465 - RNA, 64 nt, Homo Sapiens; identical to SEQ ID NO: 265397

SEQ ID NO: 690466 - RNA, 64 nt, Homo Sapiens; identical to SEQ ID NO: 265398

SEQ ID NO: 690467 - RNA, 64 nt, Homo Sapiens; identical to SEQ ID NO: 265399

SEQ ID NO: 690468 - RNA, 64 nt, Homo Sapiens; identical to SEQ ID NO: 265400

SEQ ID NO: 690469 - RNA, 64 nt, Homo Sapiens; identical to SEQ ID NO: 265401

SEQ ID NO: 690470 - RNA, 64 nt, Homo Sapiens; identical to SEQ ID NO: 265402

SEQ ID NO: 690471 - RNA, 64 nt, Homo Sapiens; identical to SEQ ID NO: 265403

SEQ ID NO: 690472 - RNA, 64 nt, Homo Sapiens; identical to SEQ ID NO: 265404

SEQ ID NO: 690473 - RNA, 64 nt, Homo Sapiens; identical to SEQ ID NO: 265405

SEQ ID NO: 690474 - RNA, 64 nt, Homo Sapiens; identical to SEQ ID NO: 265406

SEQ ID NO: 690475 - RNA, 64 nt, Homo Sapiens; identical to SEQ ID NO: 265407

SEQ ID NO: 690476 - RNA, 64 nt, Homo Sapiens; identical to SEQ ID NO: 265408

SEQ ID NO: 690477 - RNA, 64 nt, Homo Sapiens; identical to SEQ ID NO: 265409

SEQ ID NO: 690478 - RNA, 64 nt, Homo Sapiens; identical to SEQ ID NO: 265410

SEQ ID NO: 690479 - RNA, 64 nt, Homo Sapiens; identical to SEQ ID NO: 265411

SEQ ID NO: 690480 - RNA, 64 nt, Homo Sapiens; identical to SEQ ID NO: 265412

SEQ ID NO: 690481 - RNA, 64 nt, Homo Sapiens; identical to SEQ ID NO: 265413

SEQ ID NO: 690482 - RNA, 64 nt, Homo Sapiens; identical to SEQ ID NO: 265414

SEQ ID NO: 690483 - RNA, 64 nt, Homo Sapiens; identical to SEQ ID NO: 265415

SEQ ID NO: 690484 - RNA, 64 nt, Homo Sapiens; identical to SEQ ID NO: 265416

SEQ ID NO: 690485 - RNA, 64 nt, Homo Sapiens; identical to SEQ ID NO: 265417

SEQ ID NO: 690486 - RNA, 64 nt, Homo Sapiens; identical to SEQ ID NO: 265418

SEQ ID NO: 690487 - RNA, 64 nt, Homo Sapiens; identical to SEQ ID NO: 265419

SEQ ID NO: 690488 - RNA, 63 nt, Homo Sapiens; identical to SEQ ID NO: 265420

SEQ ID NO: 690489 - RNA, 64 nt, Homo Sapiens; identical to SEQ ID NO: 265421

SEQ ID NO: 690490 - RNA, 64 nt, Homo Sapiens; identical to SEQ ID NO: 265422

SEQ ID NO: 690491 - RNA, 64 nt, Homo Sapiens; identical to SEQ ID NO: 265423

SEQ ID NO: 690492 - RNA, 64 nt, Homo Sapiens; identical to SEQ ID NO: 265424

SEQ ID NO: 690493 - RNA, 64 nt, Homo Sapiens; identical to SEQ ID NO: 265425

SEQ ID NO: 690494 - RNA, 64 nt, Homo Sapiens; identical to SEQ ID NO: 265426

SEQ ID NO: 690495 - RNA, 64 nt, Homo Sapiens; identical to SEQ ID NO: 265427

SEQ ID NO: 690496 - RNA, 64 nt, Homo Sapiens; identical to SEQ ID NO: 265428

SEQ ID NO: 690497 - RNA, 64 nt, Homo Sapiens; identical to SEQ ID NO: 265429

SEQ ID NO: 690498 - RNA, 64 nt, Homo Sapiens; identical to SEQ ID NO: 265430

SEQ ID NO: 690499 - RNA, 64 nt, Homo Sapiens; identical to SEQ ID NO: 265431

SEQ ID NO: 690500 - RNA, 64 nt, Homo Sapiens; identical to SEQ ID NO: 265432

SEQ ID NO: 690501 - RNA, 64 nt, Homo Sapiens; identical to SEQ ID NO: 265433

SEQ ID NO: 690502 - RNA, 64 nt, Homo Sapiens; identical to SEQ ID NO: 265434

SEQ ID NO: 690503 - RNA, 64 nt, Homo Sapiens; identical to SEQ ID NO: 265435

SEQ ID NO: 690504 - RNA, 64 nt, Homo Sapiens; identical to SEQ ID NO: 265436

SEQ ID NO: 690505 - RNA, 64 nt, Homo Sapiens; identical to SEQ ID NO: 265437

SEQ ID NO: 690506 - RNA, 64 nt, Homo Sapiens; identical to SEQ ID NO: 265438

SEQ ID NO: 690507 - RNA, 64 nt, Homo Sapiens; identical to SEQ ID NO: 265439

SEQ ID NO: 690508 - RNA, 64 nt, Homo Sapiens; identical to SEQ ID NO: 265440

SEQ ID NO: 690509 - RNA, 64 nt, Homo Sapiens; identical to SEQ ID NO: 265441

SEQ ID NO: 690510 - RNA, 64 nt, Homo Sapiens; identical to SEQ ID NO: 265442

SEQ ID NO: 690511 - RNA, 64 nt, Homo Sapiens; identical to SEQ ID NO: 265443

SEQ ID NO: 690512 - RNA, 64 nt, Homo Sapiens; identical to SEQ ID NO: 265444

SEQ ID NO: 690513 - RNA, 64 nt, Homo Sapiens; identical to SEQ ID NO: 265445

SEQ ID NO: 690514 - RNA, 64 nt, Homo Sapiens; identical to SEQ ID NO: 265446

SEQ ID NO: 690515 - RNA, 64 nt, Homo Sapiens; identical to SEQ ID NO: 265447

SEQ ID NO: 690516 - RNA, 64 nt, Homo Sapiens; identical to SEQ ID NO: 265448

SEQ ID NO: 690517 - RNA, 64 nt, Homo Sapiens; identical to SEQ ID NO: 265449

SEQ ID NO: 690518 - RNA, 64 nt, Homo Sapiens; identical to SEQ ID NO: 265450

SEQ ID NO: 690519 - RNA, 50 nt, Homo Sapiens; identical to SEQ ID NO: 265451

SEQ ID NO: 690520 - RNA, 64 nt, Homo Sapiens; identical to SEQ ID NO: 265452

SEQ ID NO: 690521 - RNA, 64 nt, Homo Sapiens; identical to SEQ ID NO: 265453

SEQ ID NO: 690522 - RNA, 64 nt, Homo Sapiens; identical to SEQ ID NO: 265454

SEQ ID NO: 690523 - RNA, 64 nt, Homo Sapiens; identical to SEQ ID NO: 265455

SEQ ID NO: 690524 - RNA, 64 nt, Homo Sapiens; identical to SEQ ID NO: 265456

SEQ ID NO: 690525 - RNA, 64 nt, Homo Sapiens; identical to SEQ ID NO: 265457

SEQ ID NO: 690526 - RNA, 64 nt, Homo Sapiens; identical to SEQ ID NO: 265458

SEQ ID NO: 690527 - RNA, 64 nt, Homo Sapiens; identical to SEQ ID NO: 265459

SEQ ID NO: 690528 - RNA, 64 nt, Homo Sapiens; identical to SEQ ID NO: 265460

SEQ ID NO: 690529 - RNA, 64 nt, Homo Sapiens; identical to SEQ ID NO: 265461

SEQ ID NO: 690530 - RNA, 64 nt, Homo Sapiens; identical to SEQ ID NO: 265462

SEQ ID NO: 690531 - RNA, 64 nt, Homo Sapiens; identical to SEQ ID NO: 265463

SEQ ID NO: 690532 - RNA, 64 nt, Homo Sapiens; identical to SEQ ID NO: 265464

SEQ ID NO: 690533 - RNA, 64 nt, Homo Sapiens; identical to SEQ ID NO: 91465

SEQ ID NO: 690534 - RNA, 64 nt, Homo Sapiens; identical to SEQ ID NO: 91466

SEQ ID NO: 690535 - RNA, 64 nt, Homo Sapiens; identical to SEQ ID NO: 91467

SEQ ID NO: 690536 - RNA, 64 nt, Homo Sapiens; identical to SEQ ID NO: 91468

SEQ ID NO: 690537 - RNA, 64 nt, Homo Sapiens; identical to SEQ ID NO: 91469

SEQ ID NO: 690538 - RNA, 64 nt, Homo Sapiens; identical to SEQ ID NO: 91470

SEQ ID NO: 690539 - RNA, 64 nt, Homo Sapiens; identical to SEQ ID NO: 91471

SEQ ID NO: 690540 - RNA, 64 nt, Homo Sapiens; identical to SEQ ID NO: 91472

SEQ ID NO: 690541 - RNA, 64 nt, Homo Sapiens; identical to SEQ ID NO: 91473

SEQ ID NO: 690542 - RNA, 64 nt, Homo Sapiens; identical to SEQ ID NO: 91474

SEQ ID NO: 690543 - RNA, 64 nt, Homo Sapiens; identical to SEQ ID NO: 91475

SEQ ID NO: 690544 - RNA, 64 nt, Homo Sapiens; identical to SEQ ID NO: 91476

SEQ ID NO: 690545 - RNA, 64 nt, Homo Sapiens; identical to SEQ ID NO: 91477

SEQ ID NO: 690546 - RNA, 64 nt, Homo Sapiens; identical to SEQ ID NO: 91478

SEQ ID NO: 690547 - RNA, 64 nt, Homo Sapiens; identical to SEQ ID NO: 91479

SEQ ID NO: 690548 - RNA, 64 nt, Homo Sapiens; identical to SEQ ID NO: 91480

SEQ ID NO: 690549 - RNA, 64 nt, Homo Sapiens; identical to SEQ ID NO: 91481

SEQ ID NO: 690550 - RNA, 64 nt, Homo Sapiens; identical to SEQ ID NO: 91482

SEQ ID NO: 690551 - RNA, 64 nt, Homo Sapiens; identical to SEQ ID NO: 91483

SEQ ID NO: 690552 - RNA, 64 nt, Homo Sapiens; identical to SEQ ID NO: 91484

SEQ ID NO: 690553 - RNA, 64 nt, Homo Sapiens; identical to SEQ ID NO: 51723

SEQ ID NO: 690554 - RNA, 64 nt, Homo Sapiens; identical to SEQ ID NO: 51724

SEQ ID NO: 690555 - RNA, 64 nt, Homo Sapiens; identical to SEQ ID NO: 51725

SEQ ID NO: 690556 - RNA, 64 nt, Homo Sapiens; identical to SEQ ID NO: 51726

SEQ ID NO: 690557 - RNA, 64 nt, Homo Sapiens; identical to SEQ ID NO: 51727

SEQ ID NO: 690558 - RNA, 64 nt, Homo Sapiens; identical to SEQ ID NO: 51728

SEQ ID NO: 690559 - RNA, 64 nt, Homo Sapiens; identical to SEQ ID NO: 51729

SEQ ID NO: 690560 - RNA, 64 nt, Homo Sapiens; identical to SEQ ID NO: 51730

SEQ ID NO: 690561 - RNA, 64 nt, Homo Sapiens; identical to SEQ ID NO: 51731

SEQ ID NO: 690562 - RNA, 64 nt, Homo Sapiens; identical to SEQ ID NO: 51732

SEQ ID NO: 690563 - RNA, 64 nt, Homo Sapiens; identical to SEQ ID NO: 51733

SEQ ID NO: 690564 - RNA, 64 nt, Homo Sapiens; identical to SEQ ID NO: 51734

SEQ ID NO: 690565 - RNA, 64 nt, Homo Sapiens; identical to SEQ ID NO: 51735

SEQ ID NO: 690566 - RNA, 64 nt, Homo Sapiens; identical to SEQ ID NO: 51736

SEQ ID NO: 690567 - RNA, 64 nt, Homo Sapiens; identical to SEQ ID NO: 51737

SEQ ID NO: 690568 - RNA, 64 nt, Homo Sapiens; identical to SEQ ID NO: 51738

SEQ ID NO: 690569 - RNA, 64 nt, Homo Sapiens; identical to SEQ ID NO: 51739

SEQ ID NO: 690570 - RNA, 64 nt, Homo Sapiens; identical to SEQ ID NO: 51740

SEQ ID NO: 690571 - RNA, 64 nt, Homo Sapiens; identical to SEQ ID NO: 51741

SEQ ID NO: 690572 - RNA, 64 nt, Homo Sapiens; identical to SEQ ID NO: 51742

SEQ ID NO: 690573 - RNA, 64 nt, Homo Sapiens; identical to SEQ ID NO: 51743

SEQ ID NO: 690574 - RNA, 64 nt, Homo Sapiens; identical to SEQ ID NO: 51744

SEQ ID NO: 690575 - RNA, 64 nt, Homo Sapiens; identical to SEQ ID NO: 51745

SEQ ID NO: 690576 - RNA, 64 nt, Homo Sapiens; identical to SEQ ID NO: 51746

SEQ ID NO: 690577 - RNA, 64 nt, Homo Sapiens; identical to SEQ ID NO: 51747

SEQ ID NO: 690578 - RNA, 64 nt, Homo Sapiens; identical to SEQ ID NO: 51748

SEQ ID NO: 690579 - RNA, 64 nt, Homo Sapiens
gcaaaugucucugcuaccauuuccuuaagguguugagcuuuaacucuaugcugacucagugaga

SEQ ID NO: 690580 - RNA, 64 nt, Homo Sapiens
aauguuuguccuaaauuuucaggacccuagaggagagcuuuauacaauuaccgaugugaauuuc

SEQ ID NO: 690581 - RNA, 64 nt, Homo Sapiens
agcagccaggucuggugagauuaggcaauaggccgagcuuuagacucugaccugaaauccucuu

SEQ ID NO: 690582 - RNA, 64 nt, Homo Sapiens
caaagccccaaaucccuagagcauauaggcaccagagcuuuaucgugguaagggucagggaagg

SEQ ID NO: 690583 - RNA, 64 nt, Homo Sapiens
uuucugagauuuuguauaguagcaugcucuguaagagcuuuacaccagcuguuacacaagcaca

SEQ ID NO: 690584 - RNA, 64 nt, Homo Sapiens
gguauuccuuauuccaguaagacauuggauauuagagcuuuaauaagauuuuaauauaaaacuu

SEQ ID NO: 690585 - RNA, 64 nt, Homo Sapiens
ccuacgaucugcauuauguaaucacagguccagagagcuuuauggaagcgggagaggaggagca

SEQ ID NO: 690586 - RNA, 64 nt, Homo Sapiens
gaacuagagugcacuuguuagaugcuaaagguuugagcuuuacacaaaaugucuucaucuguau

SEQ ID NO: 690587 - RNA, 64 nt, Homo Sapiens
aaauugauaccuggguccuaauauuagccuggcagagcuuuaaaugauucucaaucuuagcuac

SEQ ID NO: 690588 - RNA, 64 nt, Homo Sapiens
uauuaaagagagguauugguagguauuuguuguagagcuuuauauuuaauuguaaaauuauuag

SEQ ID NO: 690589 - RNA, 64 nt, Homo Sapiens
cucuacuugcuauaaccgugcuagguaagccaaugagcuuuaauaucuuuccucucuugguguu

SEQ ID NO: 690590 - RNA, 64 nt, Homo Sapiens
cugccugaccaaagaacaaaggacuucuuucagagagcuuuauacauacuauaaccagguaaag

SEQ ID NO: 690591 - RNA, 64 nt, Homo Sapiens; identical to SEQ ID NO: 325461

SEQ ID NO: 690592 - RNA, 64 nt, Homo Sapiens; identical to SEQ ID NO: 325462

SEQ ID NO: 690593 - RNA, 64 nt, Homo Sapiens; identical to SEQ ID NO: 325463

SEQ ID NO: 690594 - RNA, 64 nt, Homo Sapiens; identical to SEQ ID NO: 325464

SEQ ID NO: 690595 - RNA, 64 nt, Homo Sapiens; identical to SEQ ID NO: 367670

SEQ ID NO: 690596 - RNA, 64 nt, Homo Sapiens; identical to SEQ ID NO: 367671

SEQ ID NO: 690597 - RNA, 64 nt, Homo Sapiens; identical to SEQ ID NO: 367672

SEQ ID NO: 690598 - RNA, 64 nt, Homo Sapiens; identical to SEQ ID NO: 367673

SEQ ID NO: 690599 - RNA, 64 nt, Homo Sapiens; identical to SEQ ID NO: 367674

SEQ ID NO: 690600 - RNA, 64 nt, Homo Sapiens; identical to SEQ ID NO: 367675

SEQ ID NO: 690601 - RNA, 64 nt, Homo Sapiens; identical to SEQ ID NO: 367676

SEQ ID NO: 690602 - RNA, 64 nt, Homo Sapiens; identical to SEQ ID NO: 367677

SEQ ID NO: 690603 - RNA, 64 nt, Homo Sapiens; identical to SEQ ID NO: 367678

SEQ ID NO: 690604 - RNA, 64 nt, Homo Sapiens; identical to SEQ ID NO: 367679

SEQ ID NO: 690605 - RNA, 64 nt, Homo Sapiens; identical to SEQ ID NO: 367680

SEQ ID NO: 690606 - RNA, 64 nt, Homo Sapiens; identical to SEQ ID NO: 367681

SEQ ID NO: 690607 - RNA, 64 nt, Homo Sapiens; identical to SEQ ID NO: 367682

SEQ ID NO: 690608 - RNA, 64 nt, Homo Sapiens; identical to SEQ ID NO: 367683

SEQ ID NO: 690609 - RNA, 64 nt, Homo Sapiens; identical to SEQ ID NO: 367684

SEQ ID NO: 690610 - RNA, 64 nt, Homo Sapiens; identical to SEQ ID NO: 367685

SEQ ID NO: 690611 - RNA, 64 nt, Homo Sapiens; identical to SEQ ID NO: 367686

SEQ ID NO: 690612 - RNA, 64 nt, Homo Sapiens; identical to SEQ ID NO: 367687

SEQ ID NO: 690613 - RNA, 64 nt, Homo Sapiens; identical to SEQ ID NO: 367688

SEQ ID NO: 690614 - RNA, 64 nt, Homo Sapiens; identical to SEQ ID NO: 367689

SEQ ID NO: 690615 - RNA, 64 nt, Homo Sapiens
aaacaaugguggaugcuacgcaacuauuaaaccuacauuguaauaucugagcugaguggaaggc

SEQ ID NO: 690616 - RNA, 64 nt, Homo Sapiens
aaauaucgaagacacuaccaauuuaaaauacuacacauuguacaugcauggucacuucuuuacu

SEQ ID NO: 690617 - RNA, 64 nt, Homo Sapiens
uacauauacaaaauuucauuuuagaaguucuacaacauuguaugguuaaaaauguuuaauuugg

SEQ ID NO: 690618 - RNA, 64 nt, Homo Sapiens
agaaaauuccaaaagaaagauuaagcacuucuuaacauuguagcgaagugguaguauggguaag

SEQ ID NO: 690619 - RNA, 64 nt, Homo Sapiens
caccagugaguuagcagcacguguucccgacauaacauuguacuguaauggagugagcguagca

SEQ ID NO: 690620 - RNA, 64 nt, Homo Sapiens
uauuuugacaaaauacgaaguggagauuuacacuacauuguacaaggaaugaaagugucacggg

SEQ ID NO: 690621 - RNA, 64 nt, Homo Sapiens
cacuggacacuggaggccuuaaaggggaccaucaacauuguagauauuaaaacuugacugaaca

SEQ ID NO: 690622 - RNA, 64 nt, Homo Sapiens
aucagcuccugcacuugaucaaguuagagagaaaacauuguaugggguuaaaguucagguaagu

SEQ ID NO: 690623 - RNA, 64 nt, Homo Sapiens
gaaggguguaaagauucuuuugaaagguuuauucacauuguagaacagcaaaugacauuuuuac

SEQ ID NO: 690624 - RNA, 64 nt, Homo Sapiens
ugugccuugaauuugguauauguguauuagugaaacauuguaaaggugaacuucuaccucugua

SEQ ID NO: 690625 - RNA, 64 nt, Homo Sapiens
guuuguacauuccaucacacccagcaauagcuguacauuguagucagcaaccauuuuacuuugu

SEQ ID NO: 690626 - RNA, 64 nt, Homo Sapiens
gauauaaaaugauggcuaucaaaugauuuuccauacauuguacugaucaaguuauacacccagg

SEQ ID NO: 690627 - RNA, 64 nt, Homo Sapiens
agggaguguguaccccuuacagaaaaaguuugugacauuguaguaaccaauaggaacaacaaaa

SEQ ID NO: 690628 - RNA, 64 nt, Homo Sapiens
uuuuuuuacuuuggcaacaaggacuauguaaaccacauuguacuggcauuuuccacuaguuuuu

SEQ ID NO: 690629 - RNA, 64 nt, Homo Sapiens
acucuucaaaaauggucacagaaugccuuuuaaaacauuguauauaaucuucacuguuucacca

SEQ ID NO: 690630 - RNA, 64 nt, Homo Sapiens
uguaagacuaggcuuuacugucuuaugcuuauggacauuguauauuuguauuuuaugaccaagu

SEQ ID NO: 690631 - RNA, 64 nt, Homo Sapiens
auggauauguuaauuagcuugauuuaauccuuccacauuguauacauguaucagaacaucacau

SEQ ID NO: 690632 - RNA, 64 nt, Homo Sapiens
auccuuccacauuguauacauguaucagaacaucacauuguacuccaucaauauaauacaauua

SEQ ID NO: 690633 - RNA, 64 nt, Homo Sapiens
caaaacaaaacaaaacaaaacuauacuugaacaaaagggucagaggaccuguauuuaagcaaau

SEQ ID NO: 690634 - RNA, 64 nt, Homo Sapiens
gcacaaaaugaaugaggucugggcuagguagaaaaagggucaaugcuauuuuuguuuuuagaau

SEQ ID NO: 690635 - RNA, 64 nt, Homo Sapiens
ucagggcuaggaaaaaccauccugaagggucaccaagggucagccaaggucuuugacuucauuu

SEQ ID NO: 690636 - RNA, 64 nt, Homo Sapiens
aagggucagcucagggcuaggacuucauuuccugaagggucaccacuuugcccccaaggucuuu

SEQ ID NO: 690637 - RNA, 64 nt, Homo Sapiens
ucaggaaagguggucaggaaaacucuggcuggacaagggucagucuucggggucagcagcgaga

SEQ ID NO: 690638 - RNA, 64 nt, Homo Sapiens
auucaucugcggagccaaaacccagccaucggggaagggucagggcuucuguggaacuuggaac

SEQ ID NO: 690639 - RNA, 64 nt, Homo Sapiens; identical to SEQ ID NO: 520126

SEQ ID NO: 690640 - RNA, 64 nt, Homo Sapiens; identical to SEQ ID NO: 520127

SEQ ID NO: 690641 - RNA, 64 nt, Homo Sapiens; identical to SEQ ID NO: 520128

SEQ ID NO: 690642 - RNA, 64 nt, Homo Sapiens; identical to SEQ ID NO: 520129

SEQ ID NO: 690643 - RNA, 64 nt, Homo Sapiens; identical to SEQ ID NO: 520130

SEQ ID NO: 690644 - RNA, 64 nt, Homo Sapiens; identical to SEQ ID NO: 520131

SEQ ID NO: 690645 - RNA, 64 nt, Homo Sapiens; identical to SEQ ID NO: 361510

SEQ ID NO: 690646 - RNA, 64 nt, Homo Sapiens; identical to SEQ ID NO: 361511

SEQ ID NO: 690647 - RNA, 64 nt, Homo Sapiens; identical to SEQ ID NO: 361512

SEQ ID NO: 690648 - RNA, 64 nt, Homo Sapiens; identical to SEQ ID NO: 361513

SEQ ID NO: 690649 - RNA, 64 nt, Homo Sapiens; identical to SEQ ID NO: 361514

SEQ ID NO: 690650 - RNA, 64 nt, Homo Sapiens; identical to SEQ ID NO: 361515

SEQ ID NO: 690651 - RNA, 64 nt, Homo Sapiens; identical to SEQ ID NO: 361516

SEQ ID NO: 690652 - RNA, 64 nt, Homo Sapiens; identical to SEQ ID NO: 361517

SEQ ID NO: 690653 - RNA, 64 nt, Homo Sapiens; identical to SEQ ID NO: 111860

SEQ ID NO: 690654 - RNA, 64 nt, Homo Sapiens; identical to SEQ ID NO: 111861

SEQ ID NO: 690655 - RNA, 64 nt, Homo Sapiens; identical to SEQ ID NO: 111862

SEQ ID NO: 690656 - RNA, 64 nt, Homo Sapiens; identical to SEQ ID NO: 111863

SEQ ID NO: 690657 - RNA, 64 nt, Homo Sapiens; identical to SEQ ID NO: 111864

SEQ ID NO: 690658 - RNA, 64 nt, Homo Sapiens; identical to SEQ ID NO: 111865

SEQ ID NO: 690659 - RNA, 64 nt, Homo Sapiens; identical to SEQ ID NO: 111866

SEQ ID NO: 690660 - RNA, 64 nt, Homo Sapiens; identical to SEQ ID NO: 111867

SEQ ID NO: 690661 - RNA, 64 nt, Homo Sapiens; identical to SEQ ID NO: 111868

SEQ ID NO: 690662 - RNA, 64 nt, Homo Sapiens; identical to SEQ ID NO: 111869

SEQ ID NO: 690663 - RNA, 64 nt, Homo Sapiens; identical to SEQ ID NO: 111870

SEQ ID NO: 690664 - RNA, 64 nt, Homo Sapiens; identical to SEQ ID NO: 111871

SEQ ID NO: 690665 - RNA, 64 nt, Homo Sapiens; identical to SEQ ID NO: 111872

SEQ ID NO: 690666 - RNA, 64 nt, Homo Sapiens; identical to SEQ ID NO: 111873

SEQ ID NO: 690667 - RNA, 64 nt, Homo Sapiens; identical to SEQ ID NO: 111874

SEQ ID NO: 690668 - RNA, 64 nt, Homo Sapiens; identical to SEQ ID NO: 111875

SEQ ID NO: 690669 - RNA, 64 nt, Homo Sapiens; identical to SEQ ID NO: 74448

SEQ ID NO: 690670 - RNA, 64 nt, Homo Sapiens; identical to SEQ ID NO: 74449

SEQ ID NO: 690671 - RNA, 64 nt, Homo Sapiens; identical to SEQ ID NO: 74450

SEQ ID NO: 690672 - RNA, 64 nt, Homo Sapiens; identical to SEQ ID NO: 74451

SEQ ID NO: 690673 - RNA, 64 nt, Homo Sapiens; identical to SEQ ID NO: 74452

SEQ ID NO: 690674 - RNA, 64 nt, Homo Sapiens; identical to SEQ ID NO: 74453

SEQ ID NO: 690675 - RNA, 64 nt, Homo Sapiens; identical to SEQ ID NO: 74454

SEQ ID NO: 690676 - RNA, 64 nt, Homo Sapiens; identical to SEQ ID NO: 74455

SEQ ID NO: 690677 - RNA, 64 nt, Homo Sapiens; identical to SEQ ID NO: 74456

SEQ ID NO: 690678 - RNA, 64 nt, Homo Sapiens; identical to SEQ ID NO: 74457

SEQ ID NO: 690679 - RNA, 64 nt, Homo Sapiens; identical to SEQ ID NO: 74458

SEQ ID NO: 690680 - RNA, 64 nt, Homo Sapiens; identical to SEQ ID NO: 74459

SEQ ID NO: 690681 - RNA, 64 nt, Homo Sapiens
ggcaaaauuagauaaccuuugggaugagauuugacaccaauaugcucuuuuuuggcagggagug

SEQ ID NO: 690682 - RNA, 64 nt, Homo Sapiens
gccaaaaagauauugccuaaagcaggcuuguuuccaccaauaguuagggguuggaggugggaca

SEQ ID NO: 690683 - RNA, 64 nt, Homo Sapiens
uuuucaggauauacuuuugagaugucagugauugcaccaauacuuugugcuucuaguggcuuug

SEQ ID NO: 690684 - RNA, 64 nt, Homo Sapiens
uugugcuucuaguggcuuugccauaauucagugucaccaauaaggcacagcccaguuagcagcu

SEQ ID NO: 690685 - RNA, 64 nt, Homo Sapiens; identical to SEQ ID NO: 164717

SEQ ID NO: 690686 - RNA, 64 nt, Homo Sapiens; identical to SEQ ID NO: 164718

SEQ ID NO: 690687 - RNA, 64 nt, Homo Sapiens; identical to SEQ ID NO: 164719

SEQ ID NO: 690688 - RNA, 64 nt, Homo Sapiens; identical to SEQ ID NO: 164720

SEQ ID NO: 690689 - RNA, 64 nt, Homo Sapiens; identical to SEQ ID NO: 164721

SEQ ID NO: 690690 - RNA, 64 nt, Homo Sapiens; identical to SEQ ID NO: 164722

SEQ ID NO: 690691 - RNA, 64 nt, Homo Sapiens; identical to SEQ ID NO: 164723

SEQ ID NO: 690692 - RNA, 64 nt, Homo Sapiens; identical to SEQ ID NO: 164724

SEQ ID NO: 690693 - RNA, 64 nt, Homo Sapiens; identical to SEQ ID NO: 164725

SEQ ID NO: 690694 - RNA, 64 nt, Homo Sapiens; identical to SEQ ID NO: 164726

SEQ ID NO: 690695 - RNA, 64 nt, Homo Sapiens; identical to SEQ ID NO: 228970

SEQ ID NO: 690696 - RNA, 64 nt, Homo Sapiens; identical to SEQ ID NO: 228971

SEQ ID NO: 690697 - RNA, 64 nt, Homo Sapiens; identical to SEQ ID NO: 228972

SEQ ID NO: 690698 - RNA, 64 nt, Homo Sapiens; identical to SEQ ID NO: 228973

SEQ ID NO: 690699 - RNA, 64 nt, Homo Sapiens; identical to SEQ ID NO: 228974

SEQ ID NO: 690700 - RNA, 64 nt, Homo Sapiens; identical to SEQ ID NO: 228975

SEQ ID NO: 690701 - RNA, 64 nt, Homo Sapiens; identical to SEQ ID NO: 228976

SEQ ID NO: 690702 - RNA, 64 nt, Homo Sapiens; identical to SEQ ID NO: 228977

SEQ ID NO: 690703 - RNA, 64 nt, Homo Sapiens; identical to SEQ ID NO: 228978

SEQ ID NO: 690704 - RNA, 64 nt, Homo Sapiens; identical to SEQ ID NO: 228979

SEQ ID NO: 690705 - RNA, 64 nt, Homo Sapiens
ccuagaggauccuuccaaacucugacuguuaucccgguuccaaggaagggacugcagucgugcc

SEQ ID NO: 690706 - RNA, 64 nt, Homo Sapiens
acgagaggauacuuccaaacucugacuauuaucccgguuccaagaauagggcuguggccgcgcc

SEQ ID NO: 690707 - RNA, 64 nt, Homo Sapiens
ucuguaucagucagcuacugagcaaugugacuuucgguuccaaacucuauagcaacaugacucu

SEQ ID NO: 690708 - RNA, 64 nt, Homo Sapiens
cgcaccucucuccucugucuugugcccacuccuccgguuccagagcccgucgugaccucugauc

SEQ ID NO: 690709 - RNA, 64 nt, Homo Sapiens; identical to SEQ ID NO: 53673

SEQ ID NO: 690710 - RNA, 64 nt, Homo Sapiens; identical to SEQ ID NO: 53674

SEQ ID NO: 690711 - RNA, 64 nt, Homo Sapiens; identical to SEQ ID NO: 53675

SEQ ID NO: 690712 - RNA, 64 nt, Homo Sapiens; identical to SEQ ID NO: 53676

SEQ ID NO: 690713 - RNA, 64 nt, Homo Sapiens; identical to SEQ ID NO: 53677

SEQ ID NO: 690714 - RNA, 64 nt, Homo Sapiens; identical to SEQ ID NO: 53678

SEQ ID NO: 690715 - RNA, 64 nt, Homo Sapiens; identical to SEQ ID NO: 53679

SEQ ID NO: 690716 - RNA, 64 nt, Homo Sapiens; identical to SEQ ID NO: 53680

SEQ ID NO: 690717 - RNA, 64 nt, Homo Sapiens; identical to SEQ ID NO: 53681

SEQ ID NO: 690718 - RNA, 64 nt, Homo Sapiens; identical to SEQ ID NO: 53682

SEQ ID NO: 690719 - RNA, 64 nt, Homo Sapiens; identical to SEQ ID NO: 53683

SEQ ID NO: 690720 - RNA, 64 nt, Homo Sapiens; identical to SEQ ID NO: 53684

SEQ ID NO: 690721 - RNA, 64 nt, Homo Sapiens; identical to SEQ ID NO: 452736

SEQ ID NO: 690722 - RNA, 64 nt, Homo Sapiens; identical to SEQ ID NO: 452737

SEQ ID NO: 690723 - RNA, 64 nt, Homo Sapiens; identical to SEQ ID NO: 452738

SEQ ID NO: 690724 - RNA, 64 nt, Homo Sapiens; identical to SEQ ID NO: 452739

SEQ ID NO: 690725 - RNA, 64 nt, Homo Sapiens; identical to SEQ ID NO: 452740

SEQ ID NO: 690726 - RNA, 64 nt, Homo Sapiens; identical to SEQ ID NO: 452740

SEQ ID NO: 690727 - RNA, 64 nt, Homo Sapiens; identical to SEQ ID NO: 345901

SEQ ID NO: 690728 - RNA, 64 nt, Homo Sapiens; identical to SEQ ID NO: 345902

SEQ ID NO: 690729 - RNA, 64 nt, Homo Sapiens; identical to SEQ ID NO: 345903

SEQ ID NO: 690730 - RNA, 64 nt, Homo Sapiens; identical to SEQ ID NO: 345904

SEQ ID NO: 690731 - RNA, 64 nt, Homo Sapiens; identical to SEQ ID NO: 345905

SEQ ID NO: 690732 - RNA, 64 nt, Homo Sapiens; identical to SEQ ID NO: 345906

SEQ ID NO: 690733 - RNA, 64 nt, Homo Sapiens; identical to SEQ ID NO: 345907

SEQ ID NO: 690734 - RNA, 64 nt, Homo Sapiens; identical to SEQ ID NO: 345908

SEQ ID NO: 690735 - RNA, 64 nt, Homo Sapiens; identical to SEQ ID NO: 345909

SEQ ID NO: 690736 - RNA, 64 nt, Homo Sapiens; identical to SEQ ID NO: 345910

SEQ ID NO: 690737 - RNA, 64 nt, Homo Sapiens; identical to SEQ ID NO: 345911

SEQ ID NO: 690738 - RNA, 64 nt, Homo Sapiens; identical to SEQ ID NO: 345912

SEQ ID NO: 690739 - RNA, 64 nt, Homo Sapiens; identical to SEQ ID NO: 345913

SEQ ID NO: 690740 - RNA, 64 nt, Homo Sapiens; identical to SEQ ID NO: 345914

SEQ ID NO: 690741 - RNA, 64 nt, Homo Sapiens; identical to SEQ ID NO: 345915

SEQ ID NO: 690742 - RNA, 64 nt, Homo Sapiens; identical to SEQ ID NO: 345916

SEQ ID NO: 690743 - RNA, 64 nt, Homo Sapiens; identical to SEQ ID NO: 345917

SEQ ID NO: 690744 - RNA, 64 nt, Homo Sapiens; identical to SEQ ID NO: 345918

SEQ ID NO: 690745 - RNA, 64 nt, Homo Sapiens; identical to SEQ ID NO: 345919

SEQ ID NO: 690746 - RNA, 64 nt, Homo Sapiens; identical to SEQ ID NO: 345920

SEQ ID NO: 690747 - RNA, 64 nt, Homo Sapiens; identical to SEQ ID NO: 345921

SEQ ID NO: 690748 - RNA, 64 nt, Homo Sapiens; identical to SEQ ID NO: 345922

SEQ ID NO: 690749 - RNA, 64 nt, Homo Sapiens; identical to SEQ ID NO: 345923

SEQ ID NO: 690750 - RNA, 64 nt, Homo Sapiens; identical to SEQ ID NO: 345924

SEQ ID NO: 690751 - RNA, 64 nt, Homo Sapiens; identical to SEQ ID NO: 345925

SEQ ID NO: 690752 - RNA, 64 nt, Homo Sapiens; identical to SEQ ID NO: 345926

SEQ ID NO: 690753 - RNA, 64 nt, Homo Sapiens; identical to SEQ ID NO: 345927

SEQ ID NO: 690754 - RNA, 64 nt, Homo Sapiens; identical to SEQ ID NO: 345928

SEQ ID NO: 690755 - RNA, 64 nt, Homo Sapiens; identical to SEQ ID NO: 345929

SEQ ID NO: 690756 - RNA, 64 nt, Homo Sapiens; identical to SEQ ID NO: 345930

SEQ ID NO: 690757 - RNA, 64 nt, Homo Sapiens; identical to SEQ ID NO: 345931

SEQ ID NO: 690758 - RNA, 64 nt, Homo Sapiens; identical to SEQ ID NO: 345932

SEQ ID NO: 690759 - RNA, 64 nt, Homo Sapiens; identical to SEQ ID NO: 345933

SEQ ID NO: 690760 - RNA, 64 nt, Homo Sapiens; identical to SEQ ID NO: 345934

SEQ ID NO: 690761 - RNA, 64 nt, Homo Sapiens; identical to SEQ ID NO: 345935

SEQ ID NO: 690762 - RNA, 64 nt, Homo Sapiens; identical to SEQ ID NO: 345936

SEQ ID NO: 690763 - RNA, 64 nt, Homo Sapiens; identical to SEQ ID NO: 345937

SEQ ID NO: 690764 - RNA, 64 nt, Homo Sapiens; identical to SEQ ID NO: 345938

SEQ ID NO: 690765 - RNA, 64 nt, Homo Sapiens; identical to SEQ ID NO: 345939

SEQ ID NO: 690766 - RNA, 64 nt, Homo Sapiens; identical to SEQ ID NO: 345940

SEQ ID NO: 690767 - RNA, 64 nt, Homo Sapiens; identical to SEQ ID NO: 345941

SEQ ID NO: 690768 - RNA, 64 nt, Homo Sapiens; identical to SEQ ID NO: 345942

SEQ ID NO: 690769 - RNA, 64 nt, Homo Sapiens; identical to SEQ ID NO: 345943

SEQ ID NO: 690770 - RNA, 64 nt, Homo Sapiens; identical to SEQ ID NO: 345944

SEQ ID NO: 690771 - RNA, 64 nt, Homo Sapiens; identical to SEQ ID NO: 345945

SEQ ID NO: 690772 - RNA, 64 nt, Homo Sapiens; identical to SEQ ID NO: 345946

SEQ ID NO: 690773 - RNA, 64 nt, Homo Sapiens; identical to SEQ ID NO: 345947

SEQ ID NO: 690774 - RNA, 64 nt, Homo Sapiens; identical to SEQ ID NO: 345948

SEQ ID NO: 690775 - RNA, 64 nt, Homo Sapiens; identical to SEQ ID NO: 345949

SEQ ID NO: 690776 - RNA, 64 nt, Homo Sapiens; identical to SEQ ID NO: 345950

SEQ ID NO: 690777 - RNA, 64 nt, Homo Sapiens; identical to SEQ ID NO: 345951

SEQ ID NO: 690778 - RNA, 64 nt, Homo Sapiens; identical to SEQ ID NO: 345952

SEQ ID NO: 690779 - RNA, 64 nt, Homo Sapiens; identical to SEQ ID NO: 345953

SEQ ID NO: 690780 - RNA, 64 nt, Homo Sapiens; identical to SEQ ID NO: 345954

SEQ ID NO: 690781 - RNA, 64 nt, Homo Sapiens; identical to SEQ ID NO: 345955

SEQ ID NO: 690782 - RNA, 64 nt, Homo Sapiens; identical to SEQ ID NO: 345956

SEQ ID NO: 690783 - RNA, 64 nt, Homo Sapiens; identical to SEQ ID NO: 345957

SEQ ID NO: 690784 - RNA, 64 nt, Homo Sapiens; identical to SEQ ID NO: 345958

SEQ ID NO: 690785 - RNA, 64 nt, Homo Sapiens; identical to SEQ ID NO: 345959

SEQ ID NO: 690786 - RNA, 64 nt, Homo Sapiens; identical to SEQ ID NO: 345960

SEQ ID NO: 690787 - RNA, 64 nt, Homo Sapiens; identical to SEQ ID NO: 345961

SEQ ID NO: 690788 - RNA, 64 nt, Homo Sapiens; identical to SEQ ID NO: 345962

SEQ ID NO: 690789 - RNA, 64 nt, Homo Sapiens; identical to SEQ ID NO: 345963

SEQ ID NO: 690790 - RNA, 64 nt, Homo Sapiens; identical to SEQ ID NO: 345964

SEQ ID NO: 690791 - RNA, 64 nt, Homo Sapiens; identical to SEQ ID NO: 345965

SEQ ID NO: 690792 - RNA, 64 nt, Homo Sapiens; identical to SEQ ID NO: 345966

SEQ ID NO: 690793 - RNA, 64 nt, Homo Sapiens; identical to SEQ ID NO: 345967

SEQ ID NO: 690794 - RNA, 50 nt, Homo Sapiens; identical to SEQ ID NO: 345968

SEQ ID NO: 690795 - RNA, 64 nt, Homo Sapiens; identical to SEQ ID NO: 345969

SEQ ID NO: 690796 - RNA, 64 nt, Homo Sapiens; identical to SEQ ID NO: 345970

SEQ ID NO: 690797 - RNA, 64 nt, Homo Sapiens; identical to SEQ ID NO: 345971

SEQ ID NO: 690798 - RNA, 64 nt, Homo Sapiens; identical to SEQ ID NO: 345972

SEQ ID NO: 690799 - RNA, 64 nt, Homo Sapiens; identical to SEQ ID NO: 345973

SEQ ID NO: 690800 - RNA, 64 nt, Homo Sapiens; identical to SEQ ID NO: 345974

SEQ ID NO: 690801 - RNA, 64 nt, Homo Sapiens; identical to SEQ ID NO: 345975

SEQ ID NO: 690802 - RNA, 64 nt, Homo Sapiens; identical to SEQ ID NO: 345976

SEQ ID NO: 690803 - RNA, 64 nt, Homo Sapiens; identical to SEQ ID NO: 345977

SEQ ID NO: 690804 - RNA, 64 nt, Homo Sapiens; identical to SEQ ID NO: 345978

SEQ ID NO: 690805 - RNA, 64 nt, Homo Sapiens; identical to SEQ ID NO: 345979

SEQ ID NO: 690806 - RNA, 64 nt, Homo Sapiens; identical to SEQ ID NO: 345980

SEQ ID NO: 690807 - RNA, 64 nt, Homo Sapiens; identical to SEQ ID NO: 345981

SEQ ID NO: 690808 - RNA, 64 nt, Homo Sapiens; identical to SEQ ID NO: 345982

SEQ ID NO: 690809 - RNA, 64 nt, Homo Sapiens; identical to SEQ ID NO: 345983

SEQ ID NO: 690810 - RNA, 64 nt, Homo Sapiens; identical to SEQ ID NO: 345984

SEQ ID NO: 690811 - RNA, 64 nt, Homo Sapiens; identical to SEQ ID NO: 345985

SEQ ID NO: 690812 - RNA, 64 nt, Homo Sapiens; identical to SEQ ID NO: 345986

SEQ ID NO: 690813 - RNA, 64 nt, Homo Sapiens; identical to SEQ ID NO: 345987

SEQ ID NO: 690814 - RNA, 64 nt, Homo Sapiens; identical to SEQ ID NO: 345988

SEQ ID NO: 690815 - RNA, 64 nt, Homo Sapiens; identical to SEQ ID NO: 345989

SEQ ID NO: 690816 - RNA, 64 nt, Homo Sapiens; identical to SEQ ID NO: 345990

SEQ ID NO: 690817 - RNA, 64 nt, Homo Sapiens; identical to SEQ ID NO: 345991

SEQ ID NO: 690818 - RNA, 64 nt, Homo Sapiens; identical to SEQ ID NO: 345992

SEQ ID NO: 690819 - RNA, 51 nt, Homo Sapiens; identical to SEQ ID NO: 345993

SEQ ID NO: 690820 - RNA, 64 nt, Homo Sapiens; identical to SEQ ID NO: 345994

SEQ ID NO: 690821 - RNA, 64 nt, Homo Sapiens; identical to SEQ ID NO: 345995

SEQ ID NO: 690822 - RNA, 64 nt, Homo Sapiens; identical to SEQ ID NO: 345996

SEQ ID NO: 690823 - RNA, 64 nt, Homo Sapiens; identical to SEQ ID NO: 345997

SEQ ID NO: 690824 - RNA, 64 nt, Homo Sapiens; identical to SEQ ID NO: 345998

SEQ ID NO: 690825 - RNA, 64 nt, Homo Sapiens; identical to SEQ ID NO: 345999

SEQ ID NO: 690826 - RNA, 64 nt, Homo Sapiens; identical to SEQ ID NO: 346000

SEQ ID NO: 690827 - RNA, 64 nt, Homo Sapiens; identical to SEQ ID NO: 346001

SEQ ID NO: 690828 - RNA, 64 nt, Homo Sapiens; identical to SEQ ID NO: 346002

SEQ ID NO: 690829 - RNA, 64 nt, Homo Sapiens; identical to SEQ ID NO: 346003

SEQ ID NO: 690830 - RNA, 64 nt, Homo Sapiens; identical to SEQ ID NO: 346004

SEQ ID NO: 690831 - RNA, 64 nt, Homo Sapiens; identical to SEQ ID NO: 346005

SEQ ID NO: 690832 - RNA, 64 nt, Homo Sapiens; identical to SEQ ID NO: 346006

SEQ ID NO: 690833 - RNA, 64 nt, Homo Sapiens; identical to SEQ ID NO: 346007

SEQ ID NO: 690834 - RNA, 64 nt, Homo Sapiens; identical to SEQ ID NO: 346008

SEQ ID NO: 690835 - RNA, 64 nt, Homo Sapiens; identical to SEQ ID NO: 346009

SEQ ID NO: 690836 - RNA, 64 nt, Homo Sapiens; identical to SEQ ID NO: 346010

SEQ ID NO: 690837 - RNA, 64 nt, Homo Sapiens; identical to SEQ ID NO: 346011

SEQ ID NO: 690838 - RNA, 64 nt, Homo Sapiens; identical to SEQ ID NO: 346012

SEQ ID NO: 690839 - RNA, 64 nt, Homo Sapiens; identical to SEQ ID NO: 346013

SEQ ID NO: 690840 - RNA, 64 nt, Homo Sapiens; identical to SEQ ID NO: 346014

SEQ ID NO: 690841 - RNA, 64 nt, Homo Sapiens; identical to SEQ ID NO: 346015

SEQ ID NO: 690842 - RNA, 64 nt, Homo Sapiens; identical to SEQ ID NO: 346016

SEQ ID NO: 690843 - RNA, 64 nt, Homo Sapiens; identical to SEQ ID NO: 346017

SEQ ID NO: 690844 - RNA, 64 nt, Homo Sapiens; identical to SEQ ID NO: 346018

SEQ ID NO: 690845 - RNA, 64 nt, Homo Sapiens; identical to SEQ ID NO: 346019

SEQ ID NO: 690846 - RNA, 64 nt, Homo Sapiens; identical to SEQ ID NO: 346020

SEQ ID NO: 690847 - RNA, 64 nt, Homo Sapiens; identical to SEQ ID NO: 346021

SEQ ID NO: 690848 - RNA, 64 nt, Homo Sapiens; identical to SEQ ID NO: 346022

SEQ ID NO: 690849 - RNA, 64 nt, Homo Sapiens; identical to SEQ ID NO: 346023

SEQ ID NO: 690850 - RNA, 64 nt, Homo Sapiens; identical to SEQ ID NO: 346024

SEQ ID NO: 690851 - RNA, 64 nt, Homo Sapiens; identical to SEQ ID NO: 346025

SEQ ID NO: 690852 - RNA, 64 nt, Homo Sapiens; identical to SEQ ID NO: 346026

SEQ ID NO: 690853 - RNA, 64 nt, Homo Sapiens; identical to SEQ ID NO: 346027

SEQ ID NO: 690854 - RNA, 64 nt, Homo Sapiens; identical to SEQ ID NO: 346028

SEQ ID NO: 690855 - RNA, 64 nt, Homo Sapiens; identical to SEQ ID NO: 346029

SEQ ID NO: 690856 - RNA, 64 nt, Homo Sapiens; identical to SEQ ID NO: 346030

SEQ ID NO: 690857 - RNA, 64 nt, Homo Sapiens; identical to SEQ ID NO: 346031

SEQ ID NO: 690858 - RNA, 64 nt, Homo Sapiens; identical to SEQ ID NO: 346032

SEQ ID NO: 690859 - RNA, 64 nt, Homo Sapiens; identical to SEQ ID NO: 346033

SEQ ID NO: 690860 - RNA, 64 nt, Homo Sapiens; identical to SEQ ID NO: 346034

SEQ ID NO: 690861 - RNA, 64 nt, Homo Sapiens; identical to SEQ ID NO: 346035

SEQ ID NO: 690862 - RNA, 64 nt, Homo Sapiens; identical to SEQ ID NO: 346036

SEQ ID NO: 690863 - RNA, 64 nt, Homo Sapiens; identical to SEQ ID NO: 346037

SEQ ID NO: 690864 - RNA, 64 nt, Homo Sapiens; identical to SEQ ID NO: 346038

SEQ ID NO: 690865 - RNA, 64 nt, Homo Sapiens; identical to SEQ ID NO: 346039

SEQ ID NO: 690866 - RNA, 64 nt, Homo Sapiens; identical to SEQ ID NO: 346040

SEQ ID NO: 690867 - RNA, 64 nt, Homo Sapiens; identical to SEQ ID NO: 346041

SEQ ID NO: 690868 - RNA, 64 nt, Homo Sapiens; identical to SEQ ID NO: 346042

SEQ ID NO: 690869 - RNA, 64 nt, Homo Sapiens; identical to SEQ ID NO: 346043

SEQ ID NO: 690870 - RNA, 64 nt, Homo Sapiens; identical to SEQ ID NO: 346044

SEQ ID NO: 690871 - RNA, 64 nt, Homo Sapiens; identical to SEQ ID NO: 346045

SEQ ID NO: 690872 - RNA, 64 nt, Homo Sapiens; identical to SEQ ID NO: 346046

SEQ ID NO: 690873 - RNA, 64 nt, Homo Sapiens; identical to SEQ ID NO: 346047

SEQ ID NO: 690874 - RNA, 64 nt, Homo Sapiens; identical to SEQ ID NO: 346048

SEQ ID NO: 690875 - RNA, 64 nt, Homo Sapiens; identical to SEQ ID NO: 346049

SEQ ID NO: 690876 - RNA, 64 nt, Homo Sapiens; identical to SEQ ID NO: 346050

SEQ ID NO: 690877 - RNA, 64 nt, Homo Sapiens; identical to SEQ ID NO: 346051

SEQ ID NO: 690878 - RNA, 64 nt, Homo Sapiens; identical to SEQ ID NO: 346052

SEQ ID NO: 690879 - RNA, 64 nt, Homo Sapiens; identical to SEQ ID NO: 346053

SEQ ID NO: 690880 - RNA, 64 nt, Homo Sapiens; identical to SEQ ID NO: 346054

SEQ ID NO: 690881 - RNA, 64 nt, Homo Sapiens; identical to SEQ ID NO: 346055

SEQ ID NO: 690882 - RNA, 64 nt, Homo Sapiens; identical to SEQ ID NO: 346056

SEQ ID NO: 690883 - RNA, 64 nt, Homo Sapiens; identical to SEQ ID NO: 346057

SEQ ID NO: 690884 - RNA, 64 nt, Homo Sapiens; identical to SEQ ID NO: 346058

SEQ ID NO: 690885 - RNA, 64 nt, Homo Sapiens; identical to SEQ ID NO: 346059

SEQ ID NO: 690886 - RNA, 64 nt, Homo Sapiens; identical to SEQ ID NO: 346060

SEQ ID NO: 690887 - RNA, 64 nt, Homo Sapiens; identical to SEQ ID NO: 346061

SEQ ID NO: 690888 - RNA, 64 nt, Homo Sapiens; identical to SEQ ID NO: 346062

SEQ ID NO: 690889 - RNA, 64 nt, Homo Sapiens; identical to SEQ ID NO: 346063

SEQ ID NO: 690890 - RNA, 64 nt, Homo Sapiens; identical to SEQ ID NO: 346064

SEQ ID NO: 690891 - RNA, 64 nt, Homo Sapiens; identical to SEQ ID NO: 346065

SEQ ID NO: 690892 - RNA, 64 nt, Homo Sapiens; identical to SEQ ID NO: 346066

SEQ ID NO: 690893 - RNA, 64 nt, Homo Sapiens; identical to SEQ ID NO: 346067

SEQ ID NO: 690894 - RNA, 64 nt, Homo Sapiens; identical to SEQ ID NO: 346068

SEQ ID NO: 690895 - RNA, 64 nt, Homo Sapiens; identical to SEQ ID NO: 346069

SEQ ID NO: 690896 - RNA, 64 nt, Homo Sapiens; identical to SEQ ID NO: 346070

SEQ ID NO: 690897 - RNA, 64 nt, Homo Sapiens; identical to SEQ ID NO: 346071

SEQ ID NO: 690898 - RNA, 64 nt, Homo Sapiens; identical to SEQ ID NO: 346072

SEQ ID NO: 690899 - RNA, 64 nt, Homo Sapiens; identical to SEQ ID NO: 346073

SEQ ID NO: 690900 - RNA, 64 nt, Homo Sapiens; identical to SEQ ID NO: 346074

SEQ ID NO: 690901 - RNA, 64 nt, Homo Sapiens; identical to SEQ ID NO: 346075

SEQ ID NO: 690902 - RNA, 64 nt, Homo Sapiens; identical to SEQ ID NO: 346076

SEQ ID NO: 690903 - RNA, 64 nt, Homo Sapiens; identical to SEQ ID NO: 346077

SEQ ID NO: 690904 - RNA, 64 nt, Homo Sapiens; identical to SEQ ID NO: 346078

SEQ ID NO: 690905 - RNA, 64 nt, Homo Sapiens; identical to SEQ ID NO: 346079

SEQ ID NO: 690906 - RNA, 64 nt, Homo Sapiens; identical to SEQ ID NO: 346080

SEQ ID NO: 690907 - RNA, 64 nt, Homo Sapiens; identical to SEQ ID NO: 346081

SEQ ID NO: 690908 - RNA, 64 nt, Homo Sapiens; identical to SEQ ID NO: 346082

SEQ ID NO: 690909 - RNA, 64 nt, Homo Sapiens; identical to SEQ ID NO: 346083

SEQ ID NO: 690910 - RNA, 64 nt, Homo Sapiens; identical to SEQ ID NO: 346084

SEQ ID NO: 690911 - RNA, 64 nt, Homo Sapiens; identical to SEQ ID NO: 346085

SEQ ID NO: 690912 - RNA, 64 nt, Homo Sapiens; identical to SEQ ID NO: 346086

SEQ ID NO: 690913 - RNA, 64 nt, Homo Sapiens; identical to SEQ ID NO: 346087

SEQ ID NO: 690914 - RNA, 64 nt, Homo Sapiens; identical to SEQ ID NO: 346088

SEQ ID NO: 690915 - RNA, 64 nt, Homo Sapiens; identical to SEQ ID NO: 346089

SEQ ID NO: 690916 - RNA, 64 nt, Homo Sapiens; identical to SEQ ID NO: 346090

SEQ ID NO: 690917 - RNA, 64 nt, Homo Sapiens; identical to SEQ ID NO: 346091

SEQ ID NO: 690918 - RNA, 64 nt, Homo Sapiens; identical to SEQ ID NO: 346092

SEQ ID NO: 690919 - RNA, 64 nt, Homo Sapiens; identical to SEQ ID NO: 346093

SEQ ID NO: 690920 - RNA, 64 nt, Homo Sapiens; identical to SEQ ID NO: 346094

SEQ ID NO: 690921 - RNA, 64 nt, Homo Sapiens; identical to SEQ ID NO: 346095

SEQ ID NO: 690922 - RNA, 59 nt, Homo Sapiens; identical to SEQ ID NO: 346096

SEQ ID NO: 690923 - RNA, 64 nt, Homo Sapiens; identical to SEQ ID NO: 346097

SEQ ID NO: 690924 - RNA, 64 nt, Homo Sapiens; identical to SEQ ID NO: 346098

SEQ ID NO: 690925 - RNA, 64 nt, Homo Sapiens; identical to SEQ ID NO: 346099

SEQ ID NO: 690926 - RNA, 64 nt, Homo Sapiens; identical to SEQ ID NO: 346100

SEQ ID NO: 690927 - RNA, 64 nt, Homo Sapiens; identical to SEQ ID NO: 346101

SEQ ID NO: 690928 - RNA, 64 nt, Homo Sapiens; identical to SEQ ID NO: 346102

SEQ ID NO: 690929 - RNA, 64 nt, Homo Sapiens; identical to SEQ ID NO: 346103

SEQ ID NO: 690930 - RNA, 64 nt, Homo Sapiens; identical to SEQ ID NO: 346104

SEQ ID NO: 690931 - RNA, 64 nt, Homo Sapiens; identical to SEQ ID NO: 346105

SEQ ID NO: 690932 - RNA, 64 nt, Homo Sapiens; identical to SEQ ID NO: 346106

SEQ ID NO: 690933 - RNA, 64 nt, Homo Sapiens; identical to SEQ ID NO: 346107

SEQ ID NO: 690934 - RNA, 64 nt, Homo Sapiens; identical to SEQ ID NO: 346108

SEQ ID NO: 690935 - RNA, 64 nt, Homo Sapiens; identical to SEQ ID NO: 346109

SEQ ID NO: 690936 - RNA, 64 nt, Homo Sapiens; identical to SEQ ID NO: 346110

SEQ ID NO: 690937 - RNA, 64 nt, Homo Sapiens; identical to SEQ ID NO: 346111

SEQ ID NO: 690938 - RNA, 64 nt, Homo Sapiens; identical to SEQ ID NO: 346112

SEQ ID NO: 690939 - RNA, 64 nt, Homo Sapiens; identical to SEQ ID NO: 346113

SEQ ID NO: 690940 - RNA, 64 nt, Homo Sapiens; identical to SEQ ID NO: 346114

SEQ ID NO: 690941 - RNA, 64 nt, Homo Sapiens; identical to SEQ ID NO: 346115

SEQ ID NO: 690942 - RNA, 64 nt, Homo Sapiens; identical to SEQ ID NO: 346116

SEQ ID NO: 690943 - RNA, 64 nt, Homo Sapiens; identical to SEQ ID NO: 127496

SEQ ID NO: 690944 - RNA, 64 nt, Homo Sapiens; identical to SEQ ID NO: 127497

SEQ ID NO: 690945 - RNA, 64 nt, Homo Sapiens; identical to SEQ ID NO: 127498

SEQ ID NO: 690946 - RNA, 64 nt, Homo Sapiens; identical to SEQ ID NO: 127499

SEQ ID NO: 690947 - RNA, 64 nt, Homo Sapiens; identical to SEQ ID NO: 127500

SEQ ID NO: 690948 - RNA, 64 nt, Homo Sapiens; identical to SEQ ID NO: 127501

SEQ ID NO: 690949 - RNA, 64 nt, Homo Sapiens; identical to SEQ ID NO: 127502

SEQ ID NO: 690950 - RNA, 64 nt, Homo Sapiens; identical to SEQ ID NO: 127503

SEQ ID NO: 690951 - RNA, 64 nt, Homo Sapiens; identical to SEQ ID NO: 112922

SEQ ID NO: 690952 - RNA, 64 nt, Homo Sapiens; identical to SEQ ID NO: 112923

SEQ ID NO: 690953 - RNA, 64 nt, Homo Sapiens; identical to SEQ ID NO: 112924

SEQ ID NO: 690954 - RNA, 64 nt, Homo Sapiens; identical to SEQ ID NO: 112925

SEQ ID NO: 690955 - RNA, 64 nt, Homo Sapiens; identical to SEQ ID NO: 112926

SEQ ID NO: 690956 - RNA, 64 nt, Homo Sapiens; identical to SEQ ID NO: 112927

SEQ ID NO: 690957 - RNA, 64 nt, Homo Sapiens; identical to SEQ ID NO: 112928

SEQ ID NO: 690958 - RNA, 64 nt, Homo Sapiens; identical to SEQ ID NO: 112929

SEQ ID NO: 690959 - RNA, 64 nt, Homo Sapiens; identical to SEQ ID NO: 112930

SEQ ID NO: 690960 - RNA, 64 nt, Homo Sapiens; identical to SEQ ID NO: 112931

SEQ ID NO: 690961 - RNA, 64 nt, Homo Sapiens; identical to SEQ ID NO: 112932

SEQ ID NO: 690962 - RNA, 64 nt, Homo Sapiens; identical to SEQ ID NO: 112933

SEQ ID NO: 690963 - RNA, 64 nt, Homo Sapiens; identical to SEQ ID NO: 112934

SEQ ID NO: 690964 - RNA, 64 nt, Homo Sapiens; identical to SEQ ID NO: 112935

SEQ ID NO: 690965 - RNA, 64 nt, Homo Sapiens; identical to SEQ ID NO: 112936

SEQ ID NO: 690966 - RNA, 64 nt, Homo Sapiens; identical to SEQ ID NO: 112937

SEQ ID NO: 690967 - RNA, 64 nt, Homo Sapiens; identical to SEQ ID NO: 112938

SEQ ID NO: 690968 - RNA, 64 nt, Homo Sapiens; identical to SEQ ID NO: 112939

SEQ ID NO: 690969 - RNA, 64 nt, Homo Sapiens; identical to SEQ ID NO: 112940

SEQ ID NO: 690970 - RNA, 64 nt, Homo Sapiens; identical to SEQ ID NO: 112941

SEQ ID NO: 690971 - RNA, 64 nt, Homo Sapiens; identical to SEQ ID NO: 112942

SEQ ID NO: 690972 - RNA, 64 nt, Homo Sapiens; identical to SEQ ID NO: 112943

SEQ ID NO: 690973 - RNA, 64 nt, Homo Sapiens; identical to SEQ ID NO: 112944

SEQ ID NO: 690974 - RNA, 64 nt, Homo Sapiens; identical to SEQ ID NO: 112945

SEQ ID NO: 690975 - RNA, 64 nt, Homo Sapiens; identical to SEQ ID NO: 112946

SEQ ID NO: 690976 - RNA, 64 nt, Homo Sapiens; identical to SEQ ID NO: 112947

SEQ ID NO: 690977 - RNA, 64 nt, Homo Sapiens; identical to SEQ ID NO: 112948

SEQ ID NO: 690978 - RNA, 64 nt, Homo Sapiens; identical to SEQ ID NO: 112949

SEQ ID NO: 690979 - RNA, 64 nt, Homo Sapiens; identical to SEQ ID NO: 112950

SEQ ID NO: 690980 - RNA, 64 nt, Homo Sapiens; identical to SEQ ID NO: 112951

SEQ ID NO: 690981 - RNA, 64 nt, Homo Sapiens; identical to SEQ ID NO: 112952

SEQ ID NO: 690982 - RNA, 64 nt, Homo Sapiens; identical to SEQ ID NO: 112953

SEQ ID NO: 690983 - RNA, 64 nt, Homo Sapiens; identical to SEQ ID NO: 112954

SEQ ID NO: 690984 - RNA, 50 nt, Homo Sapiens; identical to SEQ ID NO: 112955

SEQ ID NO: 690985 - RNA, 64 nt, Homo Sapiens; identical to SEQ ID NO: 112956

SEQ ID NO: 690986 - RNA, 64 nt, Homo Sapiens; identical to SEQ ID NO: 112957

SEQ ID NO: 690987 - RNA, 64 nt, Homo Sapiens; identical to SEQ ID NO: 112958

SEQ ID NO: 690988 - RNA, 64 nt, Homo Sapiens; identical to SEQ ID NO: 112959

SEQ ID NO: 690989 - RNA, 64 nt, Homo Sapiens; identical to SEQ ID NO: 112960

SEQ ID NO: 690990 - RNA, 64 nt, Homo Sapiens; identical to SEQ ID NO: 112961

SEQ ID NO: 690991 - RNA, 64 nt, Homo Sapiens
ucuccugucccuuuuccuggaucaaacauuuucagucccugaucguacacauuccaucuaccua

SEQ ID NO: 690992 - RNA, 64 nt, Homo Sapiens
uuuuuuuuuuaauucuaugguauuuuuuguguuugucccugauuacuauuuuugaauuccuauu

SEQ ID NO: 690993 - RNA, 64 nt, Homo Sapiens
ugcaccauucuuucuugguggggaagaugaaaccgucccugagugacaaacaccuuauuugucg

SEQ ID NO: 690994 - RNA, 64 nt, Homo Sapiens
ucuugcauugaauuuagucagauucuaaacagaugucccugaaguucuuugcugcuguggaaag

SEQ ID NO: 690995 - RNA, 64 nt, Homo Sapiens
uuucacuuucucuuuuguuuuaaaugacucauaggucccugacauuuaguugauuauuuucugc

SEQ ID NO: 690996 - RNA, 64 nt, Homo Sapiens
cugccuuguuucaccuuccaugucaggccagccugucccugaaagagaagauggccaugcccuc

SEQ ID NO: 690997 - RNA, 64 nt, Homo Sapiens
gacaaguggaggccucuugcuccuuccuuggagcgucccugacgccuguccgggggcggcuuuu

SEQ ID NO: 690998 - RNA, 64 nt, Homo Sapiens
ccuccauucuguacuggggggggguuaggcugcugucccugagugguucccuucaagugcacga

SEQ ID NO: 690999 - RNA, 64 nt, Homo Sapiens
cccccagaccuggcucagccaugaggacacagaagucccugagggggcagggcuuuuguggguu

SEQ ID NO: 691000 - RNA, 64 nt, Homo Sapiens
acagcacagaggcgggacuccccuucucuagggugucccugaggaaagcagcccccaagcaagu

SEQ ID NO: 691001 - RNA, 64 nt, Homo Sapiens
gagcuuggugagagugacgcugccaugggguugggucccugaggccuuccucggagcauugggu

SEQ ID NO: 691002 - RNA, 64 nt, Homo Sapiens
caggugggaguggacaccaggcuucccaguggacgucccugagcagcuccgcaugcuugguucu

SEQ ID NO: 691003 - RNA, 64 nt, Homo Sapiens
ugaagaggcccuugguccugugggagggacugaggucccugaggugugggaagguucaggaugg

SEQ ID NO: 691004 - RNA, 64 nt, Homo Sapiens
aagcaccuggcuaagggcugcccagcucuacuuggucccugaaaagaagugccuguggucaggc

SEQ ID NO: 691005 - RNA, 64 nt, Homo Sapiens
gauuucagccauuuuccuaguuggagaguugaaagucccugacuggggugguuauuuuuccaga

SEQ ID NO: 691006 - RNA, 64 nt, Homo Sapiens
ugcugcgggcccagucagugcuucagaugucagggucccugaacgcuucuguaaccagggcugu

SEQ ID NO: 691007 - RNA, 64 nt, Homo Sapiens
ugaagcucccagagauaaaaucugugaaaugaaagucccugacaagaggugcagcugcccaaag

SEQ ID NO: 691008 - RNA, 64 nt, Homo Sapiens
ugaagcuuccaaaggugccuugccagagaugaaagucccugagaagaggugcagcugccgaaag

SEQ ID NO: 691009 - RNA, 64 nt, Homo Sapiens
uugccuaucugccacaggaggacugggcccccacgucccugacuaggccggcucccccagacuc

SEQ ID NO: 691010 - RNA, 64 nt, Homo Sapiens
uguccucagcaaggcucgguccuggacauucuaggucccugacucgccagaugcaucaugucca

SEQ ID NO: 691011 - RNA, 64 nt, Homo Sapiens; identical to SEQ ID NO: 240065

SEQ ID NO: 691012 - RNA, 64 nt, Homo Sapiens; identical to SEQ ID NO: 240066

SEQ ID NO: 691013 - RNA, 64 nt, Homo Sapiens; identical to SEQ ID NO: 240067

SEQ ID NO: 691014 - RNA, 64 nt, Homo Sapiens; identical to SEQ ID NO: 240068

SEQ ID NO: 691015 - RNA, 64 nt, Homo Sapiens; identical to SEQ ID NO: 240069

SEQ ID NO: 691016 - RNA, 64 nt, Homo Sapiens; identical to SEQ ID NO: 240070

SEQ ID NO: 691017 - RNA, 61 nt, Homo Sapiens; identical to SEQ ID NO: 240071

SEQ ID NO: 691018 - RNA, 64 nt, Homo Sapiens; identical to SEQ ID NO: 240072

SEQ ID NO: 691019 - RNA, 64 nt, Homo Sapiens; identical to SEQ ID NO: 240073

SEQ ID NO: 691020 - RNA, 64 nt, Homo Sapiens; identical to SEQ ID NO: 240074

SEQ ID NO: 691021 - RNA, 64 nt, Homo Sapiens; identical to SEQ ID NO: 240075

SEQ ID NO: 691022 - RNA, 64 nt, Homo Sapiens; identical to SEQ ID NO: 240076

SEQ ID NO: 691023 - RNA, 64 nt, Homo Sapiens; identical to SEQ ID NO: 240077

SEQ ID NO: 691024 - RNA, 64 nt, Homo Sapiens; identical to SEQ ID NO: 240078

SEQ ID NO: 691025 - RNA, 64 nt, Homo Sapiens; identical to SEQ ID NO: 240079

SEQ ID NO: 691026 - RNA, 64 nt, Homo Sapiens; identical to SEQ ID NO: 240080

SEQ ID NO: 691027 - RNA, 64 nt, Homo Sapiens; identical to SEQ ID NO: 240081

SEQ ID NO: 691028 - RNA, 64 nt, Homo Sapiens; identical to SEQ ID NO: 240082

SEQ ID NO: 691029 - RNA, 64 nt, Homo Sapiens; identical to SEQ ID NO: 240083

SEQ ID NO: 691030 - RNA, 64 nt, Homo Sapiens; identical to SEQ ID NO: 240084

SEQ ID NO: 691031 - RNA, 64 nt, Homo Sapiens; identical to SEQ ID NO: 240085

SEQ ID NO: 691032 - RNA, 64 nt, Homo Sapiens; identical to SEQ ID NO: 240086

SEQ ID NO: 691033 - RNA, 64 nt, Homo Sapiens
uauuuucucuacggcuuaggcuaugugagggcaaaacacaaaucccuuugcuaaaaagaaccau

SEQ ID NO: 691034 - RNA, 64 nt, Homo Sapiens
gugaaauuaucuugagucuacacauuauuuuuaaaacacaaaaauuguucggcuggaacugacc

SEQ ID NO: 691035 - RNA, 64 nt, Homo Sapiens
ucuaguuucuagugucacugugauugauguacagaacacaaauguguguuggugcuuuagcgau

SEQ ID NO: 691036 - RNA, 51 nt, Homo Sapiens
cagauaccccccuacuuaauaaacacaaaaaacgcaccaagccgaaaguaa

SEQ ID NO: 691037 - RNA, 64 nt, Homo Sapiens
agccuugacaaauuuuaccuuaaaaccaaaaugaaacacaaaaauuaauccuuaauaaugauag

SEQ ID NO: 691038 - RNA, 64 nt, Homo Sapiens
uguuucucuaagauuuccuuugguuguauuuagaaacacaaauaguuuuauaaucaggauugca

SEQ ID NO: 691039 - RNA, 50 nt, Homo Sapiens
uucugcaggagagaugcugaaacacaaacagguauaagacucagucucca

SEQ ID NO: 691040 - RNA, 64 nt, Homo Sapiens
aacaaaacaacaacagcaaaaaacaacaaaacaaaacacaaauacucucacagggcauggaggu

SEQ ID NO: 691041 - RNA, 64 nt, Homo Sapiens
gaaagcaaaguaauaaaaucacaaauguuuggaaaacacaaaaguaacuuguuuaucucagucu

SEQ ID NO: 691042 - RNA, 64 nt, Homo Sapiens
ccuggccagcuuaaccuggucugaggugagacuaaacacaaaaacaguagauaaaucucucccu

SEQ ID NO: 691043 - RNA, 64 nt, Homo Sapiens
gcuguucugaauuuauccacaguaauauagucugaacacaaauaguuuacuuaacuuauccuug

SEQ ID NO: 691044 - RNA, 64 nt, Homo Sapiens
auuaagaaagaugaaguauuagauuuuacaucauaacacaaaguccagcagcuacaucugugga

SEQ ID NO: 691045 - RNA, 64 nt, Homo Sapiens
agaagcuaccuaugauccugccaacacaaaacauaacacaaaaaaucaaggcacaacacaaaaa

SEQ ID NO: 691046 - RNA, 64 nt, Homo Sapiens
auaacacaaaaaagaagcuaacaacacaaaaaccaacacaaaacgaguacuacagcaucaaggc

SEQ ID NO: 691047 - RNA, 64 nt, Homo Sapiens
ccaacacaaaacauaacacacagcaucaaggcacaacacaaaaacauaaagcaaaggaguacua

SEQ ID NO: 691048 - RNA, 64 nt, Homo Sapiens
acauaccaaaaaauaacaccaaaaccucugucagaacacaaaggaaugugcauaauggagagaa

SEQ ID NO: 691049 - RNA, 64 nt, Homo Sapiens
auuauuuccacuugcaggccagcuuaaccucugaaacacaaaugaucuugagaccacuuuagug

SEQ ID NO: 691050 - RNA, 64 nt, Homo Sapiens
auuauucuauaugaauauuaguaauaaaaaacauaacacaaauaacucucuuaagguucaauau

SEQ ID NO: 691051 - RNA, 64 nt, Homo Sapiens
uuggagcauguuuacauacaaucugggaaugauuaacacaaaugguaagguaaugaaucucucc

SEQ ID NO: 691052 - RNA, 64 nt, Homo Sapiens
guuuucccauuaauaugaaauuaaugcauaaaucaacacaaaagcaaacacacacauuuaucau

SEQ ID NO: 691053 - RNA, 64 nt, Homo Sapiens
agacauaagacuucagucaaccaaauguggaaagaacacaaagaaugagaaucuguucaccaaa

SEQ ID NO: 691054 - RNA, 64 nt, Homo Sapiens
cuuauacaucuauucuauaacagugaugaauauuaacacaaaggaaauauggagaacuguuaua

SEQ ID NO: 691055 - RNA, 64 nt, Homo Sapiens
uaaaaugaaguaguauauaugaaaaugcuuuuuaaacacaaaagcuuuauacaaaauauuguug

SEQ ID NO: 691056 - RNA, 64 nt, Homo Sapiens
aagggcagcaagaaaugcuggguccaccuaauuuaacacaaaaugaaguugagauucggcaguu

SEQ ID NO: 691057 - RNA, 64 nt, Homo Sapiens
ccaacugaaggcaguaaccauuacuucuaaccguaacacaaacacagcaaguuuuaaccuuuua

SEQ ID NO: 691058 - RNA, 64 nt, Homo Sapiens
ccaaaaaggaaaaaaaauccaccaaaccaugauaaacacaaaaugcagcuuccugaugcuuaga

SEQ ID NO: 691059 - RNA, 64 nt, Homo Sapiens
uugaccuuaucuuaauggaaaacgguuaacuccaaacacaaaagacucuacuggaaaguguagg

SEQ ID NO: 691060 - RNA, 64 nt, Homo Sapiens
cugaccaauauggagaaacccugucucuacuaagaacacaaaauuagcugggcaugguggugca

SEQ ID NO: 691061 - RNA, 64 nt, Homo Sapiens
ggaaagauaucuaugaaauauggugguuuuuuaaaacacaaaaauuauagaauaugggaucccg

SEQ ID NO: 691062 - RNA, 64 nt, Homo Sapiens
uaagaacuggucuucuacaccuagggagggcaugaacacaaacacaguuguuacccuagcaagg

SEQ ID NO: 691063 - RNA, 64 nt, Homo Sapiens
uaugucuauuccccaauauauggcaucucaggggaacacaaagcgguucucuugcaguuucugg

SEQ ID NO: 691064 - RNA, 64 nt, Homo Sapiens
auguuuuggauccaauacacacauuguuacaacuaacacaaauuccuauuaaauauuaaaagua

SEQ ID NO: 691065 - RNA, 64 nt, Homo Sapiens
aaacuuuucaaaaucuuuguuaaaccaaacauucaacacaaaauaaacuagaaggccagaggau

SEQ ID NO: 691066 - RNA, 64 nt, Homo Sapiens
ggaaaacuagaauauauauauuaaaaaaaaaaauaacacaaagacauuuuucauuugugcuuuu

SEQ ID NO: 691067 - RNA, 64 nt, Homo Sapiens
aauuauucuuccuaucugaucaaccaacaaauacaacacaaagcucuaaaagugaaacaaaaac

SEQ ID NO: 691068 - RNA, 64 nt, Homo Sapiens
aacaaaaaaccuucaacugcaacaaaacaaaacaaacacaaacaggugcugauugaaagaacaa

SEQ ID NO: 691069 - RNA, 64 nt, Homo Sapiens
cucuauggaagaaaugccucaaaaaaacaguuugaacacaaaggaaggaaaaaaagaaaaaagg

SEQ ID NO: 691070 - RNA, 64 nt, Homo Sapiens
cagaaaggaaagaaacugaaagacuggacaaaacaacacaaaggaaaaaaaaaggaaaagagga

SEQ ID NO: 691071 - RNA, 64 nt, Homo Sapiens
uagaauguucaugucaggcaauaaagcuuagugaaacacaaaauuaaauagaagaaauauauuu

SEQ ID NO: 691072 - RNA, 64 nt, Homo Sapiens
gggcauugguuucuuaggaggagugaacaacagcaacacaaaacuuaaaaaugcagcagcauag

SEQ ID NO: 691073 - RNA, 64 nt, Homo Sapiens
ucagaagccuucagauagagugaggcucaaaaaaaacacaaagacucuguucuuucaacuccuu

SEQ ID NO: 691074 - RNA, 64 nt, Homo Sapiens
gacaguucuguguugaaacaaggugagcccugaaaacacaaaagcaguucaauaaugaggaaac

SEQ ID NO: 691075 - RNA, 64 nt, Homo Sapiens
uaaauacagccauuccaaaugggagaaauuggccaacacaaaaggguaacagggcccaugcaag

SEQ ID NO: 691076 - RNA, 64 nt, Homo Sapiens
ugccaaguuaguauuguuagagauuucauuuuacaacacaaaaauaagccugugucaaagauuu

SEQ ID NO: 691077 - RNA, 64 nt, Homo Sapiens
ucuuaauaugcgaagugugccucugcaagauacuaacacaaagcucauguuaagaaaacaguug

SEQ ID NO: 691078 - RNA, 64 nt, Homo Sapiens
gccugggcugguccagugcuaugccuggaggcucaacacaaaacuucccauccaaacauucaga

SEQ ID NO: 691079 - RNA, 64 nt, Homo Sapiens
ccuucaucuaauauuuguugagauuuuaucuguaaacacaaagcacaguauacugcaacacaaa

SEQ ID NO: 691080 - RNA, 64 nt, Homo Sapiens
auuuuaucuguaaacacaaacuacaguauacugcaacacaaaagcuuuuccaauuuugcaaaca

SEQ ID NO: 691081 - RNA, 64 nt, Homo Sapiens
gaauauugcaaaugcauuuagcacugccucuuagaacacaaacauagaauaaaauguugauaag

SEQ ID NO: 691082 - RNA, 64 nt, Homo Sapiens
cuguaugaaugacuuuguaagaagucaguaaaaaaacacaaaaauuugaauauucccaauuuuc

SEQ ID NO: 691083 - RNA, 64 nt, Homo Sapiens
acacacacucgcacacacacuacaagaaaacaacaacacaaacccgaccagcagagcuuuuuaa

SEQ ID NO: 691084 - RNA, 64 nt, Homo Sapiens
ugcuuuuuagcucaguacacugaaaccauaugauaacacaaauucacauauaauuggggguuag

SEQ ID NO: 691085 - RNA, 64 nt, Homo Sapiens
aaugcacugccauucauaauugccaauugaggacaacacaaaugggauugguacuuuauaguaa

SEQ ID NO: 691086 - RNA, 64 nt, Homo Sapiens
cguaaacuuucuuaaaacauuuugaaugcagcccaacacaaauucgcauacggcccaggauggc

SEQ ID NO: 691087 - RNA, 64 nt, Homo Sapiens
cacugugagauaugugaagaaggacacacuuauaaacacaaaugaaauccugcaugugcuauuc

SEQ ID NO: 691088 - RNA, 64 nt, Homo Sapiens
cacaggaagaaugggcugcaauuagagguuugucaacacaaagaucaacacaaagacauggaag

SEQ ID NO: 691089 - RNA, 64 nt, Homo Sapiens
cauggaagauuagagguuugagguuagguuugucaacacaaagaugucaacaaaaagacaugga

SEQ ID NO: 691090 - RNA, 64 nt, Homo Sapiens
cauggaagguuagagguuuguggagagguuugucaacacaaagaagggucagaugcaccaccca

SEQ ID NO: 691091 - RNA, 64 nt, Homo Sapiens
ucuuaggaaguuaauaaguauuuuccagauuggaaacacaaauccaacucauauguuaagacca

SEQ ID NO: 691092 - RNA, 64 nt, Homo Sapiens
uauuauauguuauuucuaggaucuuacauguaauaacacaaagcucaucgacuuaagagaaaaa

SEQ ID NO: 691093 - RNA, 64 nt, Homo Sapiens
uguguuuacugaaagccgaacccacaccaaugccaacacaaaacaucucgccaaagaaaccacg

SEQ ID NO: 691094 - RNA, 64 nt, Homo Sapiens
gaugagucccaccccccacuaacuuaaaaaaacaaacacaaaaaacuuucuuguuuugucucaa

SEQ ID NO: 691095 - RNA, 64 nt, Homo Sapiens
aaaguuauuaauggucauuggggcagcuuuccucaacacaaaaaggacaaaacaaucuuaaguu

SEQ ID NO: 691096 - RNA, 64 nt, Homo Sapiens
ugaaaucaugggcugacugaaccaaugcaacaagaacacaaauguuuucaucaagcaacagagg

SEQ ID NO: 691097 - RNA, 64 nt, Homo Sapiens
cugugguaggauaacaguaucuuagggauacuugaacacaaacauaaucauccuuaauccuuau

SEQ ID NO: 691098 - RNA, 64 nt, Homo Sapiens
uuacucugaagucagaagagagcuaggaaugagcaacacaaauuuguauuuauucacuuuugga

SEQ ID NO: 691099 - RNA, 64 nt, Homo Sapiens
ucagcccagccaggcccccuacuucuuuuucuaaaacacaaaacacccccaagacugggagggg

SEQ ID NO: 691100 - RNA, 64 nt, Homo Sapiens
gaagaggaaaaaaaagcaacaaaagcgacaaaaaaacacaaacaacaaaaaagaaaaaaaucaa

SEQ ID NO: 691101 - RNA, 64 nt, Homo Sapiens
ccacccaggaacacgcagacccaggucacggagaaacacaaacauuggacaucaaauuuggaca

SEQ ID NO: 691102 - RNA, 64 nt, Homo Sapiens
aagacaaaaaaaaaaaaagaacuugaaaaaaaaaaacacaaaaauuuuuacuggggauucuuga

SEQ ID NO: 691103 - RNA, 64 nt, Homo Sapiens
cauuaucuuacaguucuggauaauggcuuaaaacaacacaaaaugcaccaaacuaacacaaauu

SEQ ID NO: 691104 - RNA, 64 nt, Homo Sapiens
uaauggcuuaaaacaacacauguugcaccaaacuaacacaaauuuuguguuaguuuuuuaugag

SEQ ID NO: 691105 - RNA, 64 nt, Homo Sapiens
uucccaagagagcugucaguuuucagcugucaguaacacaaaugaguuuaugguaacacaaaug

SEQ ID NO: 691106 - RNA, 64 nt, Homo Sapiens
uuucagcugucaguaacacaaaugaguuuaugguaacacaaaugaguuuugcuaucucucugag

SEQ ID NO: 691107 - RNA, 64 nt, Homo Sapiens
gaccuucccuggguuaaucaauuucccucuagacaacacaaacugcaggcaugugacuaacuuu

SEQ ID NO: 691108 - RNA, 64 nt, Homo Sapiens
uguuaguguuuaugauguuuaaaagugaauuauaaacacaaaaucuauaccauccugauuuuug

SEQ ID NO: 691109 - RNA, 64 nt, Homo Sapiens
ccaaaacugcauuuugguuuuguauaguguaaugaacacaaauaaaaacauggaaacuuagacu

SEQ ID NO: 691110 - RNA, 64 nt, Homo Sapiens
ugauuuuacauuuccuauaucacuaaaauacuuaaacacaaaaauaaaauuccacuccuuuauu

SEQ ID NO: 691111 - RNA, 64 nt, Homo Sapiens
agucuagguaaagaaaaaaaaaaaaaggucaugaaacacaaauguccucaacugucaucauucu

SEQ ID NO: 691112 - RNA, 64 nt, Homo Sapiens; identical to SEQ ID NO: 96702

SEQ ID NO: 691113 - RNA, 64 nt, Homo Sapiens; identical to SEQ ID NO: 96703

SEQ ID NO: 691114 - RNA, 64 nt, Homo Sapiens; identical to SEQ ID NO: 96704

SEQ ID NO: 691115 - RNA, 64 nt, Homo Sapiens; identical to SEQ ID NO: 96705

SEQ ID NO: 691116 - RNA, 64 nt, Homo Sapiens; identical to SEQ ID NO: 96706

SEQ ID NO: 691117 - RNA, 59 nt, Homo Sapiens; identical to SEQ ID NO: 96707

SEQ ID NO: 691118 - RNA, 64 nt, Homo Sapiens; identical to SEQ ID NO: 96708

SEQ ID NO: 691119 - RNA, 64 nt, Homo Sapiens; identical to SEQ ID NO: 96709

SEQ ID NO: 691120 - RNA, 64 nt, Homo Sapiens; identical to SEQ ID NO: 96710

SEQ ID NO: 691121 - RNA, 64 nt, Homo Sapiens; identical to SEQ ID NO: 96711

SEQ ID NO: 691122 - RNA, 64 nt, Homo Sapiens; identical to SEQ ID NO: 96712

SEQ ID NO: 691123 - RNA, 64 nt, Homo Sapiens; identical to SEQ ID NO: 96713

SEQ ID NO: 691124 - RNA, 64 nt, Homo Sapiens; identical to SEQ ID NO: 96714

SEQ ID NO: 691125 - RNA, 64 nt, Homo Sapiens; identical to SEQ ID NO: 96715

SEQ ID NO: 691126 - RNA, 64 nt, Homo Sapiens; identical to SEQ ID NO: 96716

SEQ ID NO: 691127 - RNA, 64 nt, Homo Sapiens; identical to SEQ ID NO: 96717

SEQ ID NO: 691128 - RNA, 64 nt, Homo Sapiens; identical to SEQ ID NO: 96718

SEQ ID NO: 691129 - RNA, 64 nt, Homo Sapiens; identical to SEQ ID NO: 96719

SEQ ID NO: 691130 - RNA, 64 nt, Homo Sapiens; identical to SEQ ID NO: 96720

SEQ ID NO: 691131 - RNA, 64 nt, Homo Sapiens; identical to SEQ ID NO: 96721

SEQ ID NO: 691132 - RNA, 64 nt, Homo Sapiens
gugaauucuaucuauuuaauuggauauuggacucugcucauauaagcuacagacaaaagccaaa

SEQ ID NO: 691133 - RNA, 64 nt, Homo Sapiens
ggugauguauuugcuugaguuacuccuguaucauugcucauaauauuggaaacuaaaauaaaac

SEQ ID NO: 691134 - RNA, 64 nt, Homo Sapiens
ccagccuuguuugcuuuuuuaacagauaacagugugcucauagaaacugcuuugacaugacugc

SEQ ID NO: 691135 - RNA, 64 nt, Homo Sapiens
gauguuagccauaguggacaagguuccauucacaugcucauauguuuauaaacuguguuuugua

SEQ ID NO: 691136 - RNA, 64 nt, Homo Sapiens
aaggggugggggugugcagucugcccuguccuucugcucauaaccugacaaaaugccaaacuag

SEQ ID NO: 691137 - RNA, 64 nt, Homo Sapiens
acacuuuugcaagagugaugggaaagacccuaggugcucauaacuagaguauguguauguacuu

SEQ ID NO: 691138 - RNA, 64 nt, Homo Sapiens
cauaggcaaggacaacaugugcuuuuuggugagcugcucauaauuccugaaauguguggugcca

SEQ ID NO: 691139 - RNA, 64 nt, Homo Sapiens
gcaggucugagcuaagccccugaaagcaggguaaugcucauaaaaggacuguucccgcggcccc

SEQ ID NO: 691140 - RNA, 64 nt, Homo Sapiens
gaugucaucuugugccuuucauguaaguuaaauuugcucauacagcuugaacguuguauuugca

SEQ ID NO: 691141 - RNA, 64 nt, Homo Sapiens
ugagcccuucugcguuguuaugccacuucccuacugcucauaugcacgcuggcuccccugggca

SEQ ID NO: 691142 - RNA, 64 nt, Homo Sapiens
caucuugaucuguugaauguucauucuuucuuuuugcucauacugcuguaggcuauaauucccc

SEQ ID NO: 691143 - RNA, 64 nt, Homo Sapiens
uccuaucuuuuuucuucuuuguucuguuuacuuuugcucauaucaucauucccgcuaucuuucu

SEQ ID NO: 691144 - RNA, 64 nt, Homo Sapiens
ugauuuaccauuccuacaaaugaauuaaaauacuugcucauaguccuuuuuuuucccuuaaugu

SEQ ID NO: 691145 - RNA, 64 nt, Homo Sapiens
agccaauaaguaaaaacaacuuucacauuaucauugcucauaauaaaaaaacuuggguaugaga

SEQ ID NO: 691146 - RNA, 64 nt, Homo Sapiens
ucugcuucccagaguuuugcggacaggaaucuauugcucauacuagcaccuaccuuacuuucag

SEQ ID NO: 691147 - RNA, 64 nt, Homo Sapiens
aggccuuuaugaagaaaaacaaauacauaaaauaugcucauaaacagacauuaagcaaacucac

SEQ ID NO: 691148 - RNA, 64 nt, Homo Sapiens
uuuugucuugauccugagaagauaaguuuuugcuugcucauauuuagauaccuuuuugcuugau

SEQ ID NO: 691149 - RNA, 64 nt, Homo Sapiens
cucauaguaugcaaccaaaggguaaacuaaaaccugcucauaaccugaucauauuaaaaaucug

SEQ ID NO: 691150 - RNA, 50 nt, Homo Sapiens
uguucuucagcagccugucaugcucauaucugcacaaaauggccucuuga

SEQ ID NO: 691151 - RNA, 64 nt, Homo Sapiens
uuuaucuaauucagauggauaaccaauacuccacugcucauauuugagccaaccagaauaaaau

SEQ ID NO: 691152 - RNA, 64 nt, Homo Sapiens
uguccuugccuuuccagcuucuugacuacaguugugcucauaaucuuuuuugaggucuucucaa

SEQ ID NO: 691153 - RNA, 64 nt, Homo Sapiens
cgcacauccaaaagccuguguuucuguguacguuugcucauacagugagguguggguguggcgg

SEQ ID NO: 691154 - RNA, 64 nt, Homo Sapiens
acacuccauccucucuguaguuaagacucuguacugcucauauuagugguccucaugaauugca

SEQ ID NO: 691155 - RNA, 64 nt, Homo Sapiens
gucacaagugaaccacuucucaguugccaaucuuugcucauauuaaaaacaacuuacaaauacu

SEQ ID NO: 691156 - RNA, 64 nt, Homo Sapiens
agcuggaacacagaagagaggagguugugucucuugcucauagcaagccuguggguagaggaaa

SEQ ID NO: 691157 - RNA, 64 nt, Homo Sapiens
uucuuuuucucccucuuucauaacuggaugcagcugcucauacucaaucccauauucagcaagu

SEQ ID NO: 691158 - RNA, 64 nt, Homo Sapiens
aagggcauuaggaguguuucauuugauaugugaaugcucauaaaaaaaugucaaggaaugaaga

SEQ ID NO: 691159 - RNA, 64 nt, Homo Sapiens
cugcuuuaaaacaugcuuuggacauauauuuuagugcucauacuguuacuaauaaaaaaauaac

SEQ ID NO: 691160 - RNA, 64 nt, Homo Sapiens
uaccuaauacugaguuuuugcaaaaaacaaugaaugcucauauguaauugaaauacuucagauc

SEQ ID NO: 691161 - RNA, 64 nt, Homo Sapiens
gagcauauuguuaagugggucuugggagucaaacugcucauauuacacucaggccugaccuagg

SEQ ID NO: 691162 - RNA, 64 nt, Homo Sapiens
agaugucaguuuucauuuaaagacuaauaauauaugcucauauccuucaaaacugugcuugaau

SEQ ID NO: 691163 - RNA, 64 nt, Homo Sapiens
cuccagucuguguucucucguuagagauguuuagugcucauaauuccuuuucagaauuaaaauu

SEQ ID NO: 691164 - RNA, 64 nt, Homo Sapiens
uggacaguuagggaaggguuccaguggcaguguaugcucauacuuuuaauuggaguaucuaaag

SEQ ID NO: 691165 - RNA, 64 nt, Homo Sapiens
ucuggcaaggguuccccucuccccagaucccugcugcucauacuaguagcuuugacauuaagcu

SEQ ID NO: 691166 - RNA, 64 nt, Homo Sapiens
aaucuuaaaucaaagaauaauuagccagguacucugcucauagagugcugugauuuucaaauuu

SEQ ID NO: 691167 - RNA, 64 nt, Homo Sapiens
uuauaaguaauucuaugcaaacugugaugugaaaugcucauacucuauuauacuaaaagcuccu

SEQ ID NO: 691168 - RNA, 64 nt, Homo Sapiens
uacuugugucauccagaaugucagguacugugucugcucauaagauuugccuugugguguugga

SEQ ID NO: 691169 - RNA, 64 nt, Homo Sapiens
caagugaggagugccagcucaaguuggaguugacugcucauacccaggugaguaaggcaaugua

SEQ ID NO: 691170 - RNA, 64 nt, Homo Sapiens
cgaccuuugaguuaagcugucuuuauaagcaggaugcucauagugguuucccggagccaguagu

SEQ ID NO: 691171 - RNA, 64 nt, Homo Sapiens
uucgaguguuucagugcuucgcagauguccuugaugcucauauuguucccuauuuugccagugg

SEQ ID NO: 691172 - RNA, 64 nt, Homo Sapiens
cuaacacugucucuuuugugaaaaucuggaaaagugcucauauucacagguggcuggugcuagu

SEQ ID NO: 691173 - RNA, 64 nt, Homo Sapiens
gugcauugcuaugcaagcucacucuuuuuagcucugcucauauuauugucuguucuuauugguc

SEQ ID NO: 691174 - RNA, 64 nt, Homo Sapiens
uuccaauagucugcacuucucccaaggugugcacugcucauaaacuugccagugugugauucau

SEQ ID NO: 691175 - RNA, 64 nt, Homo Sapiens
cauauuugcaaucauugcagcuucuucuuucuucugcucauaaaaggaggaacacuuuagauag

SEQ ID NO: 691176 - RNA, 64 nt, Homo Sapiens
uauuagaaaaugacacauaacacgggcagcugguugcucauaggguccuucucuagggagaaac

SEQ ID NO: 691177 - RNA, 64 nt, Homo Sapiens
uucuuucuuugggaauauuugaaucuugucucaaugcucauaacggaucagaaauacagauuuu

SEQ ID NO: 691178 - RNA, 64 nt, Homo Sapiens
gacagugcuauuuugugcccacugucucuccugaugcucauaucaauccuauaaggcacaggga

SEQ ID NO: 691179 - RNA, 64 nt, Homo Sapiens
gccccuccugguggauguguuccucaugggggcuugcucauaccgaaacagggguccucugacu

SEQ ID NO: 691180 - RNA, 64 nt, Homo Sapiens
auucccauuuucucagccucccugguuucagacaugcucauacccagccagucagguuggcuuu

SEQ ID NO: 691181 - RNA, 64 nt, Homo Sapiens
gauugaugauaccaccaguaaaaauuaaucuuucugcucauaauauuccuuuguucuguuauac

SEQ ID NO: 691182 - RNA, 64 nt, Homo Sapiens
auuuuucuucuucaaugugucuuaacuauugagaugcucauaucuagauuuuauccauuuuuau

SEQ ID NO: 691183 - RNA, 64 nt, Homo Sapiens
acacacgucuaacagccuagacaaucucgucagaugcucauacuggaccaucagccuccccauu

SEQ ID NO: 691184 - RNA, 64 nt, Homo Sapiens
accagucauccagaauuuccuuccugaaucuccaugcucauaugcaaugucuacaucaaggucu

SEQ ID NO: 691185 - RNA, 64 nt, Homo Sapiens
agcuggcauguugauucaaaccaugggcugaauuugcucauaggcugugcaucagacaaaagcu

SEQ ID NO: 691186 - RNA, 64 nt, Homo Sapiens
guagaaugcccgcugaugcauuguuuauuuuuuuugcucauaauauaaauaucagauuauguuu

SEQ ID NO: 691187 - RNA, 64 nt, Homo Sapiens
uugguagcguauauaaagaguugacagugaauagugcucauaaaucaaaagacaagaaaugaaa

SEQ ID NO: 691188 - RNA, 64 nt, Homo Sapiens
cuucuggaaaaaaauaagcauuuuuuuuuucacuugcucauaaauguguucccagcuaacucua

SEQ ID NO: 691189 - RNA, 64 nt, Homo Sapiens
aauaaaagaaauuuuaaaagauuacuauacauugugcucauaugcaaugccuugggcuucucua

SEQ ID NO: 691190 - RNA, 64 nt, Homo Sapiens
ugauguggcuggagaauuggcaugauaugcuuuaugcucauaaccuguuagagauuugagguua

SEQ ID NO: 691191 - RNA, 64 nt, Homo Sapiens
cacauauguaaaccagaacauuuuuuuuuuuuuuugcucauauuaaucguauaaaaucuggauu

SEQ ID NO: 691192 - RNA, 64 nt, Homo Sapiens
gauuuauuuuuauaugauguauacccauaaagaaugcucauauuaauguacuuaaauuacacau

SEQ ID NO: 691193 - RNA, 64 nt, Homo Sapiens
aaaauuucaacagcacuuaaacugaaguuuggguugcucauacaauaaacagauugaaaaaacu

SEQ ID NO: 691194 - RNA, 64 nt, Homo Sapiens
uacaagggucacccaaauagcugagugcaguccuugcucauauuuccuucaucuuaaccccgca

SEQ ID NO: 691195 - RNA, 64 nt, Homo Sapiens
uuuuuacuaaucccuaauuuuuuuuccaguguauugcucauauuaucagaaggaaaaguuauuu

SEQ ID NO: 691196 - RNA, 64 nt, Homo Sapiens
ucuuuccauaucuguaacauaugucaauuuuaaaugcucauaggcaaauuuaagaaugucagca

SEQ ID NO: 691197 - RNA, 64 nt, Homo Sapiens
gacuuacaggcuaaaauuagacaaaaguuacuauugcucauaauaucagacaagaugaggaggu

SEQ ID NO: 691198 - RNA, 64 nt, Homo Sapiens
auaaucacaugagccaaucuccuuaauaaaugccugcucauagaucuguaucuacaucuauauc

SEQ ID NO: 691199 - RNA, 64 nt, Homo Sapiens
ccccaacucaaggccaaggacugggcguaucggaugcucauaacaccccuggccuggccccuuu

SEQ ID NO: 691200 - RNA, 64 nt, Homo Sapiens
agguugauaaaucauuuuaugucaagggcagcuuugcucauauuucccaugauuucauguacug

SEQ ID NO: 691201 - RNA, 64 nt, Homo Sapiens
cuuuuguuacuuuucauuugccucuaauuuugcuugcucauauuucuggccaauguacagccuc

SEQ ID NO: 691202 - RNA, 64 nt, Homo Sapiens
uguuaguuugucuuguuuugcuuuccagagaucuugcucauacaaugaaucacgcaaccacuaa

SEQ ID NO: 691203 - RNA, 64 nt, Homo Sapiens
ugcacugagaacaccgcgcagcgugacugugaguugcucauaccgugcugcuaucugggcagcg

SEQ ID NO: 691204 - RNA, 64 nt, Homo Sapiens
ugaaaacacucauguugguccugagaaauaaaacugcucauaagaacaauuuauaugucuuaca

SEQ ID NO: 691205 - RNA, 64 nt, Homo Sapiens
agccaagggcaaacucgaaacaggagucaagaugugcucauaggacaagcacacaguucuuuug

SEQ ID NO: 691206 - RNA, 64 nt, Homo Sapiens
auaaccagguccaacccagcaaaagaacacuuucugcucauaucaccucuccucuucuuuuaaa

SEQ ID NO: 691207 - RNA, 64 nt, Homo Sapiens
ucugauaggcaacaguagcuuuaaggcauuuucaugcucauaaaguagauagaugguauagagc

SEQ ID NO: 691208 - RNA, 64 nt, Homo Sapiens
gggcgcugccagccccgccacaagggcagaggggugcucauagcuguaacagccaggccaggac

SEQ ID NO: 691209 - RNA, 64 nt, Homo Sapiens
aaauuguauaaagaauggaaaagucauuaauaucugcucauaucuuaacaucagcgaguuggua

SEQ ID NO: 691210 - RNA, 64 nt, Homo Sapiens
cucccugggcagggucuugaggcagccacugugaugcucauaccuuaccuugccuccuacccuc

SEQ ID NO: 691211 - RNA, 64 nt, Homo Sapiens
aucuaaauauuuacauauacccaaaauuaacuuaugcucauauauuaggaugugagaauaucau

SEQ ID NO: 691212 - RNA, 64 nt, Homo Sapiens
cugccugguauauccaaaagcuuuuuauuccuccugcucauauugugauucugccuuuggggac

SEQ ID NO: 691213 - RNA, 64 nt, Homo Sapiens
uaucucuguauccccaaggcuuugcacagugccuugcucauaguagguuuucaauaaaugauua

SEQ ID NO: 691214 - RNA, 64 nt, Homo Sapiens
caggauuuuguauugccaucgggugccaaauaaaugcucauauuuauuacugaugugugcucaa

SEQ ID NO: 691215 - RNA, 64 nt, Homo Sapiens
aacccuauagccuagacuagucuaucuuggaauuugcucauacacacuaaccuagucuaucuuu

SEQ ID NO: 691216 - RNA, 64 nt, Homo Sapiens
gaacaauucugcuggugcuggacagcucuugaauugcucauacaugaaauaucuuuuugccuca

SEQ ID NO: 691217 - RNA, 64 nt, Homo Sapiens
cacuugcaauuucauuguaacauuuaaguuaaagugcucauaauaaguuagcuuauagguuaua

SEQ ID NO: 691218 - RNA, 64 nt, Homo Sapiens
auguacauguacugauuacuuaauuuugaaaaacugcucauaugagccccucuccuggaagugc

SEQ ID NO: 691219 - RNA, 64 nt, Homo Sapiens
uaaaugucuucauguugaugacaagugacuuauuugcucauaagucccacacugugaacuaaug

SEQ ID NO: 691220 - RNA, 64 nt, Homo Sapiens
acaggcucggguauuuugguagggacuguaggcaugcucauaaauccuugcuguugucacagua

SEQ ID NO: 691221 - RNA, 64 nt, Homo Sapiens
gauguuaaauggaauucgugaugcaugucuuaaaugcucauaaagauaaggaaacuuuauuuaa

SEQ ID NO: 691222 - RNA, 64 nt, Homo Sapiens
uaucugcucauuuugacaaaacucaagaguucagugcucauacggucuuaguucugguugauuc

SEQ ID NO: 691223 - RNA, 64 nt, Homo Sapiens
aagggaauuguacaucaugcagauuaauuuuaccugcucauaugugguuugguuucuaucauau

SEQ ID NO: 691224 - RNA, 64 nt, Homo Sapiens
uuuaaagagagaugcacuuaagaauagagugaacugcucauaugcuuauuuaagcuuggacagu

SEQ ID NO: 691225 - RNA, 64 nt, Homo Sapiens
agaggaaucacuuaaaagguaggcauaucuaagaugcucauagaagaggaagaaugggacaugg

SEQ ID NO: 691226 - RNA, 64 nt, Homo Sapiens
acugguuuaguugguggguuaauuaaaaaaaauuugcucauaugaacuuucauuuuauauguuu

SEQ ID NO: 691227 - RNA, 64 nt, Homo Sapiens
augggaaguugugacguugcagcuccaaccgacgugcucauagugaucagcugugcaggagcca

SEQ ID NO: 691228 - RNA, 64 nt, Homo Sapiens
aacauuuuagggggaaagggccuucccaccauacugcucauaaugacucugcuuugacaucgcc

SEQ ID NO: 691229 - RNA, 64 nt, Homo Sapiens
caauaccagcaauucauaaaauguuuguaauaauugcucauaagacagggguucccuucucuca

SEQ ID NO: 691230 - RNA, 64 nt, Homo Sapiens
gaggaucagaccuucuuuccgaagcaggaagaaaugcucauaaaauuucacaacauauucuuug

SEQ ID NO: 691231 - RNA, 64 nt, Homo Sapiens
aaaagucgcugagucguuucaagaccucgacauuugcucauagauuccucgaacuaaagcaguu

SEQ ID NO: 691232 - RNA, 64 nt, Homo Sapiens
ugcuuuuggaagucaccuacgugaggcagguuucugcucauaagauuggcucugcagggcaggg

SEQ ID NO: 691233 - RNA, 64 nt, Homo Sapiens
auacucuguaacaguugcauugacugucacauaaugcucauacuuaucuaauguugaguuauua

SEQ ID NO: 691234 - RNA, 64 nt, Homo Sapiens
auuggagaugccauccucuuucucuuuucuaguuugcucauacuacauugaguagacacauuua

SEQ ID NO: 691235 - RNA, 64 nt, Homo Sapiens
gaauggcugggcccacggaaaggacugcccucggugcucauaggaccaccuccgggucggcacc

SEQ ID NO: 691236 - RNA, 64 nt, Homo Sapiens
gacuaaaaguugaccuguuaaacuucgugaaaacugcucauaaaauuuuuuaaaugucgaguaa

SEQ ID NO: 691237 - RNA, 64 nt, Homo Sapiens
aggccccagucggggguauuuuagagguggauggugcucauaaaggggguaaaugcuugccgcu

SEQ ID NO: 691238 - RNA, 64 nt, Homo Sapiens
aacaagugccauugaguuucguguugaaggcuuuugcucauauagaaacuuggccagaaaacug

SEQ ID NO: 691239 - RNA, 64 nt, Homo Sapiens
acauagccgcuaguaaaacuagccucaaacaggaugcucauagcuuaauaauaaaagcugugca

SEQ ID NO: 691240 - RNA, 64 nt, Homo Sapiens
uuaugguauauuuuauguaacauuuuaauguuuaugcucauaaaacuuagugaacacacugugu

SEQ ID NO: 691241 - RNA, 64 nt, Homo Sapiens
uacuauccgagguaauuuugaaguuuaauauaaaugcucauaucaaaugaauauagaacuaaua

SEQ ID NO: 691242 - RNA, 64 nt, Homo Sapiens
uguagugggguucuaggcaucucuguacuuugcuugcucauaugcauguagucacuuuauaagu

SEQ ID NO: 691243 - RNA, 64 nt, Homo Sapiens
uaccuuuuuauuuuuuguuuuagauguaagagcaugcucauauguuagguacuuacauaaauug

SEQ ID NO: 691244 - RNA, 64 nt, Homo Sapiens
accacuguuucuggaguaucugucauccagugacugcucauauuguggcauuaugcaguguuac

SEQ ID NO: 691245 - RNA, 64 nt, Homo Sapiens
gcaaaaugaagacucuuuuacucagcucugguauugcucauaacuuaccaagaggcuaauacua

SEQ ID NO: 691246 - RNA, 64 nt, Homo Sapiens
uccagacuucccacagcauucccccaaccucuccugcucauaaaugccagcagcucccucccgu

SEQ ID NO: 691247 - RNA, 64 nt, Homo Sapiens
uuuaaaauaaaguuuuaaaaacuuuuaaaauagaugcucauauuuaauggcaauaauuaucaaa

SEQ ID NO: 691248 - RNA, 64 nt, Homo Sapiens
guggagcguuucuuaucgaagguuaaauggacucugcucauaaaccucuuacugagaugcuucc

SEQ ID NO: 691249 - RNA, 64 nt, Homo Sapiens
cccucugaucgccgaucaccucugagacccaccuugcucauaaacaaaaugcccauguuggucc

SEQ ID NO: 691250 - RNA, 64 nt, Homo Sapiens
gauagauuguauaauauauaguuuaauguaaucaugcucauauuuuuuaaauaaauaaaacacu

SEQ ID NO: 691251 - RNA, 63 nt, Homo Sapiens
uaaaaaugcaaauaaagacugcuuccuuagagggugcucauacaaaauuccagucuuugaguc

SEQ ID NO: 691252 - RNA, 64 nt, Homo Sapiens
aucuucuagaagaagagaaaucggagcaacauaaugcucauagaaguagugagguuacuuuuga

SEQ ID NO: 691253 - RNA, 58 nt, Homo Sapiens
uuuaguuauuuaaacaaacuuuuucagcugcucauauaaugcuucugauguggaauaa

SEQ ID NO: 691254 - RNA, 64 nt, Homo Sapiens
augaucuuucucuaguuucauuaaagccaaaugcugcucauagagggguuauuguuccuuuggc

SEQ ID NO: 691255 - RNA, 64 nt, Homo Sapiens
gccuuuucuggugggauauuacuccuacuuaucuugcucauaaauguguugggggggagacacu

SEQ ID NO: 691256 - RNA, 64 nt, Homo Sapiens
agaauaccuuuuuaaacuauuauacugggaaugaugcucauauacaaaaaguuaugaaaauuuu

SEQ ID NO: 691257 - RNA, 64 nt, Homo Sapiens
ugaauuuuuaaugcagcaauaacacuagcuguucugcucauauauaaaauaacuacccucagca

SEQ ID NO: 691258 - RNA, 64 nt, Homo Sapiens
uaaacugaccuaaauauguuauaaauuuaccaguugcucauauucaccucuaugcuagcugagg

SEQ ID NO: 691259 - RNA, 64 nt, Homo Sapiens
uuuuaaucuaaagucaucccuucugagugaaauuugcucauaaagcauuuggauacuaagccau

SEQ ID NO: 691260 - RNA, 64 nt, Homo Sapiens
aagagaucuugauccagacagagcagcauaucuuugcucauacaaacuagaagaaccagcugau

SEQ ID NO: 691261 - RNA, 64 nt, Homo Sapiens
ggauauuuuacuuaaucuaaaaguuaauuuauguugcucauauauuacucaaguauuuaaauuu

SEQ ID NO: 691262 - RNA, 64 nt, Homo Sapiens
auauuccaauuuuuauuggaugagcaauuggcagugcucauaauucuguuaauaucagacaaaa

SEQ ID NO: 691263 - RNA, 64 nt, Homo Sapiens
uuuacgauggagagaugccagagggcaggcccugugcucauagccugcauguagaugauuaaau

SEQ ID NO: 691264 - RNA, 64 nt, Homo Sapiens
caguaaacuugugauagaaaacauuucaaaucagugcucauauauguuuuuauuaugccauuug

SEQ ID NO: 691265 - RNA, 64 nt, Homo Sapiens
ucuauaggaaugaggacgggcuucuaaagagaccugcucauacuugcuaccuccuuccaguggg

SEQ ID NO: 691266 - RNA, 64 nt, Homo Sapiens
cauaagaguugacugaguuaaucccaauugguugugcucauaugccaccuuuuaaaccaaugga

SEQ ID NO: 691267 - RNA, 64 nt, Homo Sapiens
guuuaacauaacaacauuuaugaaccuuuagauuugcucauaauaaauauguaaguuuuuuggu

SEQ ID NO: 691268 - RNA, 64 nt, Homo Sapiens
cugucccagcaaccaugcgagggguugccccaguugcucauacaaacagaucagcaugaggaca

SEQ ID NO: 691269 - RNA, 63 nt, Homo Sapiens
cccgccugcacucaggugaaauaaacagccauguugcucauacaaagccuguuugguggccuc

SEQ ID NO: 691270 - RNA, 64 nt, Homo Sapiens
acaaaagcacauaauucugcuguuacggguacuuugcucauacgagcuuucauguucagcaugc

SEQ ID NO: 691271 - RNA, 64 nt, Homo Sapiens
gcgcguggcccagauaagaauagguguuccuuugugcucauaaaacagaaugcggcgaugguug

SEQ ID NO: 691272 - RNA, 64 nt, Homo Sapiens
uuuuuguacaacauuaaagauuuacuuucgguucugcucauacuaacaaaugugauaauguuua

SEQ ID NO: 691273 - RNA, 64 nt, Homo Sapiens
accugcauccuuccuggggagacuucacagcgucugcucauaggcuucccgcugcacauggaca

SEQ ID NO: 691274 - RNA, 64 nt, Homo Sapiens
agacagugcgucaugccacucaccaacaaagcacugcucauacuuacagugcccaaaauaaucu

SEQ ID NO: 691275 - RNA, 64 nt, Homo Sapiens
aguccccaccuggggaauaaacuccagccucuccugcucauacagaagggacugguuggguuug

SEQ ID NO: 691276 - RNA, 64 nt, Homo Sapiens
uggugcaaugcucugguggcuagggauguacucaugcucauaugugugcacgcuuggacaccca

SEQ ID NO: 691277 - RNA, 64 nt, Homo Sapiens
guauaccauacauuaucauucaaaacaaccauccugcucauaacaucuuugaaaagaaaaauau

SEQ ID NO: 691278 - RNA, 64 nt, Homo Sapiens
auugcaccauuuucaauuuggagcauuaacuaaaugcucauacacaguuaaauaaauagaaaga

SEQ ID NO: 691279 - RNA, 64 nt, Homo Sapiens
gcgcagggagguggccagcgcccccgggcacugcugcucauagguaccuuuccacugccuccuc

SEQ ID NO: 691280 - RNA, 64 nt, Homo Sapiens
gguugacccccacagggucaauuugcugaccgaaugcucauagaguccggcuggccgacguggc

SEQ ID NO: 691281 - RNA, 64 nt, Homo Sapiens
agcgcguuaugaacucaccccuaaauaauaggauugcucauaccgcaaaacaacuggaaggacg

SEQ ID NO: 691282 - RNA, 64 nt, Homo Sapiens
cuucugaauacaguagauguggucaaguccuuccugcucauacaucucucaucguucuuucagg

SEQ ID NO: 691283 - RNA, 64 nt, Homo Sapiens
agguaucauuaacugccacuuagaaauaaugauuugcucauaacuuuggcugaaacuuuauaca

SEQ ID NO: 691284 - RNA, 64 nt, Homo Sapiens
uuuaaucagcuacaguuaugccuaaagcguuaacugcucauaauguuuccauuaacaaaaccau

SEQ ID NO: 691285 - RNA, 64 nt, Homo Sapiens
uucacuaugcaaacuuaccccagaauugaaaaggugcucauaaugagagaugaaauuuagugaa

SEQ ID NO: 691286 - RNA, 64 nt, Homo Sapiens
ugcugaaguuauaaguuuaaaacucaauuucagaugcucauaaaaguuacuuagcuaaaauuuu

SEQ ID NO: 691287 - RNA, 64 nt, Homo Sapiens
acaggauaucagcauauuuggagaauaauuuacaugcucauaauucuguauuucuuuaaacccu

SEQ ID NO: 691288 - RNA, 64 nt, Homo Sapiens
acuuuaaaaauaauacuuuuuuuuauuauucccuugcucauauaaaagacacgugaaaugauac

SEQ ID NO: 691289 - RNA, 64 nt, Homo Sapiens
agaacacaguauaauucagcaucguauaaaaaucugcucauauuugggggaagaaauuggcaau

SEQ ID NO: 691290 - RNA, 64 nt, Homo Sapiens
caguucaugagugacaagugagaauuuggucuuaugcucauaagcccgacuucuuugcuuuggg

SEQ ID NO: 691291 - RNA, 64 nt, Homo Sapiens
agugcucaauuauauuuucuuucaaugaucgauaugcucauaaauaggcgaugcagacucgcga

SEQ ID NO: 691292 - RNA, 64 nt, Homo Sapiens
uuacucaacaucagagagucaagccauuaauaugugcucauaucuauacacaaagaauguggaa

SEQ ID NO: 691293 - RNA, 64 nt, Homo Sapiens
ucugaaaaguauacagagauugagcaauaauuucugcucauaugauauuaauguggagauguuu

SEQ ID NO: 691294 - RNA, 64 nt, Homo Sapiens
accauucuugcaaccaaaaggacuuagagcaguuugcucauaaagacauccuuuauuauaaaag

SEQ ID NO: 691295 - RNA, 64 nt, Homo Sapiens
ucagcauuuacuuuguuucuuuugcuuaggaaauugcucauaaucugguuauaauuuuggucca

SEQ ID NO: 691296 - RNA, 64 nt, Homo Sapiens
gucccaggacaaagcugagacugacgggugauguugcucauaggcuccagcucugcauaagacc

SEQ ID NO: 691297 - RNA, 64 nt, Homo Sapiens
gauaacuggcuuaugacaccuugaaaaguucaagugcucauauaacacaccacacugaaccccc

SEQ ID NO: 691298 - RNA, 64 nt, Homo Sapiens
uaaggguuaggguucaauaucagagcuugggcugugcucauagcuaaaugagacuugacagcug

SEQ ID NO: 691299 - RNA, 64 nt, Homo Sapiens
ccaaucucgucaggcugccagagaaaguuggugcugcucauacuggucucacagucuaaguaag

SEQ ID NO: 691300 - RNA, 64 nt, Homo Sapiens
aggaaaauggauguuauggaauguuuauuuccucugcucauaauaaggaaaccaagccaucugc

SEQ ID NO: 691301 - RNA, 64 nt, Homo Sapiens
uaguagacaaagagccagaaaguaaaagucucguugcucauauagaguaucugagaaccaacca

SEQ ID NO: 691302 - RNA, 64 nt, Homo Sapiens
uucgugguuugucuuacucaguucagucuuuuuuugcucauaaauuuaaaaguuacauaccugg

SEQ ID NO: 691303 - RNA, 64 nt, Homo Sapiens
gucagaguugaauuugucaggcacgccugaaaugugcucauagccaaaacauuuuacucucucc

SEQ ID NO: 691304 - RNA, 64 nt, Homo Sapiens
agggggcagcugucugccaggagucuggcucuuuugcucauagcgaccccucccuugguucugg

SEQ ID NO: 691305 - RNA, 64 nt, Homo Sapiens
guaaagggauccuuucagcuacugcuuuuccacuugcucauauaagcguugaaaauugaaaguu

SEQ ID NO: 691306 - RNA, 64 nt, Homo Sapiens
uuggccucuguaugcaguacgcauuaguacuuugugcucauaaacuugccagugccaauugagg

SEQ ID NO: 691307 - RNA, 64 nt, Homo Sapiens
uauauagauguauauuuuuuaugcacuuguuucuugcucauauaaaaaauauugggaccaaaaa

SEQ ID NO: 691308 - RNA, 64 nt, Homo Sapiens
ccacuagcaugcugaguaggauaguaaaucaggaugcucauaacuuuguaugucugacccaagu

SEQ ID NO: 691309 - RNA, 64 nt, Homo Sapiens; identical to SEQ ID NO: 457937

SEQ ID NO: 691310 - RNA, 64 nt, Homo Sapiens; identical to SEQ ID NO: 457938

SEQ ID NO: 691311 - RNA, 64 nt, Homo Sapiens; identical to SEQ ID NO: 457939

SEQ ID NO: 691312 - RNA, 64 nt, Homo Sapiens; identical to SEQ ID NO: 457940

SEQ ID NO: 691313 - RNA, 64 nt, Homo Sapiens; identical to SEQ ID NO: 457941

SEQ ID NO: 691314 - RNA, 64 nt, Homo Sapiens; identical to SEQ ID NO: 457942

SEQ ID NO: 691315 - RNA, 64 nt, Homo Sapiens; identical to SEQ ID NO: 457943

SEQ ID NO: 691316 - RNA, 64 nt, Homo Sapiens; identical to SEQ ID NO: 457944

SEQ ID NO: 691317 - RNA, 64 nt, Homo Sapiens; identical to SEQ ID NO: 457945

SEQ ID NO: 691318 - RNA, 64 nt, Homo Sapiens; identical to SEQ ID NO: 457946

SEQ ID NO: 691319 - RNA, 64 nt, Homo Sapiens; identical to SEQ ID NO: 457947

SEQ ID NO: 691320 - RNA, 64 nt, Homo Sapiens; identical to SEQ ID NO: 457948

SEQ ID NO: 691321 - RNA, 64 nt, Homo Sapiens; identical to SEQ ID NO: 457949

SEQ ID NO: 691322 - RNA, 64 nt, Homo Sapiens; identical to SEQ ID NO: 457950

SEQ ID NO: 691323 - RNA, 64 nt, Homo Sapiens; identical to SEQ ID NO: 457951

SEQ ID NO: 691324 - RNA, 64 nt, Homo Sapiens; identical to SEQ ID NO: 457952

SEQ ID NO: 691325 - RNA, 64 nt, Homo Sapiens; identical to SEQ ID NO: 457953

SEQ ID NO: 691326 - RNA, 64 nt, Homo Sapiens; identical to SEQ ID NO: 457954

SEQ ID NO: 691327 - RNA, 64 nt, Homo Sapiens; identical to SEQ ID NO: 457955

SEQ ID NO: 691328 - RNA, 64 nt, Homo Sapiens; identical to SEQ ID NO: 457956

SEQ ID NO: 691329 - RNA, 64 nt, Homo Sapiens; identical to SEQ ID NO: 457957

SEQ ID NO: 691330 - RNA, 64 nt, Homo Sapiens; identical to SEQ ID NO: 457958

SEQ ID NO: 691331 - RNA, 64 nt, Homo Sapiens; identical to SEQ ID NO: 457959

SEQ ID NO: 691332 - RNA, 64 nt, Homo Sapiens; identical to SEQ ID NO: 457960

SEQ ID NO: 691333 - RNA, 64 nt, Homo Sapiens; identical to SEQ ID NO: 457961

SEQ ID NO: 691334 - RNA, 64 nt, Homo Sapiens; identical to SEQ ID NO: 457962

SEQ ID NO: 691335 - RNA, 64 nt, Homo Sapiens; identical to SEQ ID NO: 457963

SEQ ID NO: 691336 - RNA, 64 nt, Homo Sapiens; identical to SEQ ID NO: 457964

SEQ ID NO: 691337 - RNA, 64 nt, Homo Sapiens; identical to SEQ ID NO: 457965

SEQ ID NO: 691338 - RNA, 64 nt, Homo Sapiens; identical to SEQ ID NO: 457966

SEQ ID NO: 691339 - RNA, 64 nt, Homo Sapiens; identical to SEQ ID NO: 457967

SEQ ID NO: 691340 - RNA, 64 nt, Homo Sapiens; identical to SEQ ID NO: 457968

SEQ ID NO: 691341 - RNA, 64 nt, Homo Sapiens; identical to SEQ ID NO: 457969

SEQ ID NO: 691342 - RNA, 64 nt, Homo Sapiens; identical to SEQ ID NO: 457970

SEQ ID NO: 691343 - RNA, 64 nt, Homo Sapiens; identical to SEQ ID NO: 457971

SEQ ID NO: 691344 - RNA, 64 nt, Homo Sapiens; identical to SEQ ID NO: 457972

SEQ ID NO: 691345 - RNA, 64 nt, Homo Sapiens; identical to SEQ ID NO: 457973

SEQ ID NO: 691346 - RNA, 64 nt, Homo Sapiens; identical to SEQ ID NO: 457974

SEQ ID NO: 691347 - RNA, 64 nt, Homo Sapiens; identical to SEQ ID NO: 457975

SEQ ID NO: 691348 - RNA, 64 nt, Homo Sapiens; identical to SEQ ID NO: 457976

SEQ ID NO: 691349 - RNA, 64 nt, Homo Sapiens; identical to SEQ ID NO: 457977

SEQ ID NO: 691350 - RNA, 64 nt, Homo Sapiens; identical to SEQ ID NO: 457978

SEQ ID NO: 691351 - RNA, 64 nt, Homo Sapiens; identical to SEQ ID NO: 457979

SEQ ID NO: 691352 - RNA, 64 nt, Homo Sapiens; identical to SEQ ID NO: 457980

SEQ ID NO: 691353 - RNA, 64 nt, Homo Sapiens; identical to SEQ ID NO: 457981

SEQ ID NO: 691354 - RNA, 64 nt, Homo Sapiens; identical to SEQ ID NO: 457982

SEQ ID NO: 691355 - RNA, 64 nt, Homo Sapiens; identical to SEQ ID NO: 457983

SEQ ID NO: 691356 - RNA, 64 nt, Homo Sapiens; identical to SEQ ID NO: 457984

SEQ ID NO: 691357 - RNA, 64 nt, Homo Sapiens; identical to SEQ ID NO: 457985

SEQ ID NO: 691358 - RNA, 64 nt, Homo Sapiens; identical to SEQ ID NO: 457986

SEQ ID NO: 691359 - RNA, 64 nt, Homo Sapiens; identical to SEQ ID NO: 457987

SEQ ID NO: 691360 - RNA, 64 nt, Homo Sapiens; identical to SEQ ID NO: 457988

SEQ ID NO: 691361 - RNA, 64 nt, Homo Sapiens; identical to SEQ ID NO: 457989

SEQ ID NO: 691362 - RNA, 64 nt, Homo Sapiens; identical to SEQ ID NO: 457990

SEQ ID NO: 691363 - RNA, 64 nt, Homo Sapiens; identical to SEQ ID NO: 457991

SEQ ID NO: 691364 - RNA, 64 nt, Homo Sapiens; identical to SEQ ID NO: 457992

SEQ ID NO: 691365 - RNA, 64 nt, Homo Sapiens; identical to SEQ ID NO: 457993

SEQ ID NO: 691366 - RNA, 64 nt, Homo Sapiens; identical to SEQ ID NO: 457994

SEQ ID NO: 691367 - RNA, 64 nt, Homo Sapiens; identical to SEQ ID NO: 457995

SEQ ID NO: 691368 - RNA, 64 nt, Homo Sapiens; identical to SEQ ID NO: 457996

SEQ ID NO: 691369 - RNA, 64 nt, Homo Sapiens; identical to SEQ ID NO: 457997

SEQ ID NO: 691370 - RNA, 64 nt, Homo Sapiens; identical to SEQ ID NO: 457998

SEQ ID NO: 691371 - RNA, 64 nt, Homo Sapiens; identical to SEQ ID NO: 457999

SEQ ID NO: 691372 - RNA, 64 nt, Homo Sapiens; identical to SEQ ID NO: 458000

SEQ ID NO: 691373 - RNA, 64 nt, Homo Sapiens; identical to SEQ ID NO: 458001

SEQ ID NO: 691374 - RNA, 64 nt, Homo Sapiens; identical to SEQ ID NO: 458002

SEQ ID NO: 691375 - RNA, 64 nt, Homo Sapiens; identical to SEQ ID NO: 458003

SEQ ID NO: 691376 - RNA, 64 nt, Homo Sapiens; identical to SEQ ID NO: 458004

SEQ ID NO: 691377 - RNA, 64 nt, Homo Sapiens; identical to SEQ ID NO: 458005

SEQ ID NO: 691378 - RNA, 64 nt, Homo Sapiens; identical to SEQ ID NO: 458006

SEQ ID NO: 691379 - RNA, 64 nt, Homo Sapiens; identical to SEQ ID NO: 458007

SEQ ID NO: 691380 - RNA, 64 nt, Homo Sapiens; identical to SEQ ID NO: 458008

SEQ ID NO: 691381 - RNA, 64 nt, Homo Sapiens; identical to SEQ ID NO: 458009

SEQ ID NO: 691382 - RNA, 64 nt, Homo Sapiens; identical to SEQ ID NO: 458010

SEQ ID NO: 691383 - RNA, 64 nt, Homo Sapiens; identical to SEQ ID NO: 458011

SEQ ID NO: 691384 - RNA, 64 nt, Homo Sapiens; identical to SEQ ID NO: 458012

SEQ ID NO: 691385 - RNA, 64 nt, Homo Sapiens; identical to SEQ ID NO: 458013

SEQ ID NO: 691386 - RNA, 64 nt, Homo Sapiens; identical to SEQ ID NO: 458014

SEQ ID NO: 691387 - RNA, 64 nt, Homo Sapiens; identical to SEQ ID NO: 458015

SEQ ID NO: 691388 - RNA, 64 nt, Homo Sapiens; identical to SEQ ID NO: 458016

SEQ ID NO: 691389 - RNA, 64 nt, Homo Sapiens; identical to SEQ ID NO: 458017

SEQ ID NO: 691390 - RNA, 64 nt, Homo Sapiens; identical to SEQ ID NO: 458018

SEQ ID NO: 691391 - RNA, 64 nt, Homo Sapiens; identical to SEQ ID NO: 458019

SEQ ID NO: 691392 - RNA, 64 nt, Homo Sapiens; identical to SEQ ID NO: 458020

SEQ ID NO: 691393 - RNA, 64 nt, Homo Sapiens; identical to SEQ ID NO: 458021

SEQ ID NO: 691394 - RNA, 64 nt, Homo Sapiens; identical to SEQ ID NO: 458022

SEQ ID NO: 691395 - RNA, 64 nt, Homo Sapiens; identical to SEQ ID NO: 458023

SEQ ID NO: 691396 - RNA, 64 nt, Homo Sapiens; identical to SEQ ID NO: 458024

SEQ ID NO: 691397 - RNA, 64 nt, Homo Sapiens; identical to SEQ ID NO: 458025

SEQ ID NO: 691398 - RNA, 64 nt, Homo Sapiens; identical to SEQ ID NO: 458026

SEQ ID NO: 691399 - RNA, 64 nt, Homo Sapiens; identical to SEQ ID NO: 458027

SEQ ID NO: 691400 - RNA, 64 nt, Homo Sapiens; identical to SEQ ID NO: 458028

SEQ ID NO: 691401 - RNA, 64 nt, Homo Sapiens; identical to SEQ ID NO: 458029

SEQ ID NO: 691402 - RNA, 64 nt, Homo Sapiens; identical to SEQ ID NO: 458030

SEQ ID NO: 691403 - RNA, 64 nt, Homo Sapiens; identical to SEQ ID NO: 458031

SEQ ID NO: 691404 - RNA, 64 nt, Homo Sapiens; identical to SEQ ID NO: 458032

SEQ ID NO: 691405 - RNA, 64 nt, Homo Sapiens; identical to SEQ ID NO: 458033

SEQ ID NO: 691406 - RNA, 64 nt, Homo Sapiens; identical to SEQ ID NO: 458034

SEQ ID NO: 691407 - RNA, 64 nt, Homo Sapiens; identical to SEQ ID NO: 458035

SEQ ID NO: 691408 - RNA, 64 nt, Homo Sapiens; identical to SEQ ID NO: 458036

SEQ ID NO: 691409 - RNA, 64 nt, Homo Sapiens; identical to SEQ ID NO: 458037

SEQ ID NO: 691410 - RNA, 64 nt, Homo Sapiens; identical to SEQ ID NO: 458038

SEQ ID NO: 691411 - RNA, 64 nt, Homo Sapiens; identical to SEQ ID NO: 458039

SEQ ID NO: 691412 - RNA, 64 nt, Homo Sapiens; identical to SEQ ID NO: 458040

SEQ ID NO: 691413 - RNA, 64 nt, Homo Sapiens; identical to SEQ ID NO: 458041

SEQ ID NO: 691414 - RNA, 64 nt, Homo Sapiens; identical to SEQ ID NO: 458042

SEQ ID NO: 691415 - RNA, 64 nt, Homo Sapiens; identical to SEQ ID NO: 458043

SEQ ID NO: 691416 - RNA, 64 nt, Homo Sapiens; identical to SEQ ID NO: 458044

SEQ ID NO: 691417 - RNA, 64 nt, Homo Sapiens; identical to SEQ ID NO: 458045

SEQ ID NO: 691418 - RNA, 64 nt, Homo Sapiens; identical to SEQ ID NO: 458046

SEQ ID NO: 691419 - RNA, 64 nt, Homo Sapiens; identical to SEQ ID NO: 458047

SEQ ID NO: 691420 - RNA, 64 nt, Homo Sapiens; identical to SEQ ID NO: 458048

SEQ ID NO: 691421 - RNA, 64 nt, Homo Sapiens; identical to SEQ ID NO: 458049

SEQ ID NO: 691422 - RNA, 64 nt, Homo Sapiens; identical to SEQ ID NO: 458050

SEQ ID NO: 691423 - RNA, 64 nt, Homo Sapiens; identical to SEQ ID NO: 458051

SEQ ID NO: 691424 - RNA, 64 nt, Homo Sapiens; identical to SEQ ID NO: 458052

SEQ ID NO: 691425 - RNA, 64 nt, Homo Sapiens; identical to SEQ ID NO: 458053

SEQ ID NO: 691426 - RNA, 64 nt, Homo Sapiens; identical to SEQ ID NO: 458054

SEQ ID NO: 691427 - RNA, 64 nt, Homo Sapiens; identical to SEQ ID NO: 458055

SEQ ID NO: 691428 - RNA, 64 nt, Homo Sapiens; identical to SEQ ID NO: 458056

SEQ ID NO: 691429 - RNA, 64 nt, Homo Sapiens; identical to SEQ ID NO: 458057

SEQ ID NO: 691430 - RNA, 64 nt, Homo Sapiens; identical to SEQ ID NO: 458058

SEQ ID NO: 691431 - RNA, 64 nt, Homo Sapiens; identical to SEQ ID NO: 458059

SEQ ID NO: 691432 - RNA, 64 nt, Homo Sapiens; identical to SEQ ID NO: 458060

SEQ ID NO: 691433 - RNA, 64 nt, Homo Sapiens; identical to SEQ ID NO: 458061

SEQ ID NO: 691434 - RNA, 64 nt, Homo Sapiens; identical to SEQ ID NO: 458062

SEQ ID NO: 691435 - RNA, 64 nt, Homo Sapiens; identical to SEQ ID NO: 458063

SEQ ID NO: 691436 - RNA, 64 nt, Homo Sapiens; identical to SEQ ID NO: 458064

SEQ ID NO: 691437 - RNA, 64 nt, Homo Sapiens; identical to SEQ ID NO: 458065

SEQ ID NO: 691438 - RNA, 64 nt, Homo Sapiens; identical to SEQ ID NO: 458066

SEQ ID NO: 691439 - RNA, 64 nt, Homo Sapiens; identical to SEQ ID NO: 458067

SEQ ID NO: 691440 - RNA, 64 nt, Homo Sapiens; identical to SEQ ID NO: 458068

SEQ ID NO: 691441 - RNA, 64 nt, Homo Sapiens; identical to SEQ ID NO: 458069

SEQ ID NO: 691442 - RNA, 64 nt, Homo Sapiens; identical to SEQ ID NO: 458070

SEQ ID NO: 691443 - RNA, 64 nt, Homo Sapiens; identical to SEQ ID NO: 458071

SEQ ID NO: 691444 - RNA, 64 nt, Homo Sapiens; identical to SEQ ID NO: 458072

SEQ ID NO: 691445 - RNA, 64 nt, Homo Sapiens; identical to SEQ ID NO: 458073

SEQ ID NO: 691446 - RNA, 64 nt, Homo Sapiens; identical to SEQ ID NO: 458074

SEQ ID NO: 691447 - RNA, 64 nt, Homo Sapiens; identical to SEQ ID NO: 458075

SEQ ID NO: 691448 - RNA, 64 nt, Homo Sapiens; identical to SEQ ID NO: 458076

SEQ ID NO: 691449 - RNA, 64 nt, Homo Sapiens; identical to SEQ ID NO: 458077

SEQ ID NO: 691450 - RNA, 64 nt, Homo Sapiens; identical to SEQ ID NO: 458078

SEQ ID NO: 691451 - RNA, 64 nt, Homo Sapiens; identical to SEQ ID NO: 458079

SEQ ID NO: 691452 - RNA, 64 nt, Homo Sapiens; identical to SEQ ID NO: 458080

SEQ ID NO: 691453 - RNA, 64 nt, Homo Sapiens; identical to SEQ ID NO: 458081

SEQ ID NO: 691454 - RNA, 64 nt, Homo Sapiens; identical to SEQ ID NO: 458082

SEQ ID NO: 691455 - RNA, 64 nt, Homo Sapiens; identical to SEQ ID NO: 458083

SEQ ID NO: 691456 - RNA, 64 nt, Homo Sapiens; identical to SEQ ID NO: 458084

SEQ ID NO: 691457 - RNA, 64 nt, Homo Sapiens; identical to SEQ ID NO: 458085

SEQ ID NO: 691458 - RNA, 64 nt, Homo Sapiens; identical to SEQ ID NO: 458086

SEQ ID NO: 691459 - RNA, 64 nt, Homo Sapiens; identical to SEQ ID NO: 458087

SEQ ID NO: 691460 - RNA, 64 nt, Homo Sapiens; identical to SEQ ID NO: 458088

SEQ ID NO: 691461 - RNA, 64 nt, Homo Sapiens; identical to SEQ ID NO: 458089

SEQ ID NO: 691462 - RNA, 64 nt, Homo Sapiens; identical to SEQ ID NO: 458090

SEQ ID NO: 691463 - RNA, 64 nt, Homo Sapiens; identical to SEQ ID NO: 458091

SEQ ID NO: 691464 - RNA, 64 nt, Homo Sapiens; identical to SEQ ID NO: 458092

SEQ ID NO: 691465 - RNA, 64 nt, Homo Sapiens; identical to SEQ ID NO: 458093

SEQ ID NO: 691466 - RNA, 64 nt, Homo Sapiens; identical to SEQ ID NO: 458094

SEQ ID NO: 691467 - RNA, 64 nt, Homo Sapiens; identical to SEQ ID NO: 458095

SEQ ID NO: 691468 - RNA, 64 nt, Homo Sapiens; identical to SEQ ID NO: 458096

SEQ ID NO: 691469 - RNA, 64 nt, Homo Sapiens; identical to SEQ ID NO: 458097

SEQ ID NO: 691470 - RNA, 64 nt, Homo Sapiens; identical to SEQ ID NO: 458098

SEQ ID NO: 691471 - RNA, 64 nt, Homo Sapiens; identical to SEQ ID NO: 458099

SEQ ID NO: 691472 - RNA, 64 nt, Homo Sapiens; identical to SEQ ID NO: 458100

SEQ ID NO: 691473 - RNA, 64 nt, Homo Sapiens; identical to SEQ ID NO: 458101

SEQ ID NO: 691474 - RNA, 64 nt, Homo Sapiens; identical to SEQ ID NO: 458102

SEQ ID NO: 691475 - RNA, 64 nt, Homo Sapiens; identical to SEQ ID NO: 458103

SEQ ID NO: 691476 - RNA, 64 nt, Homo Sapiens; identical to SEQ ID NO: 458104

SEQ ID NO: 691477 - RNA, 64 nt, Homo Sapiens; identical to SEQ ID NO: 458105

SEQ ID NO: 691478 - RNA, 64 nt, Homo Sapiens; identical to SEQ ID NO: 458106

SEQ ID NO: 691479 - RNA, 64 nt, Homo Sapiens; identical to SEQ ID NO: 458107

SEQ ID NO: 691480 - RNA, 64 nt, Homo Sapiens; identical to SEQ ID NO: 458108

SEQ ID NO: 691481 - RNA, 64 nt, Homo Sapiens; identical to SEQ ID NO: 458109

SEQ ID NO: 691482 - RNA, 64 nt, Homo Sapiens; identical to SEQ ID NO: 458110

SEQ ID NO: 691483 - RNA, 64 nt, Homo Sapiens; identical to SEQ ID NO: 458111

SEQ ID NO: 691484 - RNA, 64 nt, Homo Sapiens; identical to SEQ ID NO: 458112

SEQ ID NO: 691485 - RNA, 64 nt, Homo Sapiens; identical to SEQ ID NO: 458113

SEQ ID NO: 691486 - RNA, 64 nt, Homo Sapiens; identical to SEQ ID NO: 458114

SEQ ID NO: 691487 - RNA, 64 nt, Homo Sapiens; identical to SEQ ID NO: 458115

SEQ ID NO: 691488 - RNA, 64 nt, Homo Sapiens; identical to SEQ ID NO: 458116

SEQ ID NO: 691489 - RNA, 64 nt, Homo Sapiens; identical to SEQ ID NO: 458117

SEQ ID NO: 691490 - RNA, 64 nt, Homo Sapiens; identical to SEQ ID NO: 458118

SEQ ID NO: 691491 - RNA, 64 nt, Homo Sapiens; identical to SEQ ID NO: 458119

SEQ ID NO: 691492 - RNA, 64 nt, Homo Sapiens; identical to SEQ ID NO: 458120

SEQ ID NO: 691493 - RNA, 64 nt, Homo Sapiens; identical to SEQ ID NO: 458121

SEQ ID NO: 691494 - RNA, 64 nt, Homo Sapiens; identical to SEQ ID NO: 458122

SEQ ID NO: 691495 - RNA, 64 nt, Homo Sapiens; identical to SEQ ID NO: 458123

SEQ ID NO: 691496 - RNA, 64 nt, Homo Sapiens; identical to SEQ ID NO: 458124

SEQ ID NO: 691497 - RNA, 64 nt, Homo Sapiens; identical to SEQ ID NO: 458125

SEQ ID NO: 691498 - RNA, 64 nt, Homo Sapiens; identical to SEQ ID NO: 458126

SEQ ID NO: 691499 - RNA, 64 nt, Homo Sapiens; identical to SEQ ID NO: 458127

SEQ ID NO: 691500 - RNA, 64 nt, Homo Sapiens; identical to SEQ ID NO: 458128

SEQ ID NO: 691501 - RNA, 64 nt, Homo Sapiens; identical to SEQ ID NO: 458129

SEQ ID NO: 691502 - RNA, 64 nt, Homo Sapiens; identical to SEQ ID NO: 458130

SEQ ID NO: 691503 - RNA, 64 nt, Homo Sapiens; identical to SEQ ID NO: 458131

SEQ ID NO: 691504 - RNA, 64 nt, Homo Sapiens; identical to SEQ ID NO: 458132

SEQ ID NO: 691505 - RNA, 64 nt, Homo Sapiens; identical to SEQ ID NO: 458133

SEQ ID NO: 691506 - RNA, 64 nt, Homo Sapiens; identical to SEQ ID NO: 458134

SEQ ID NO: 691507 - RNA, 64 nt, Homo Sapiens; identical to SEQ ID NO: 458135

SEQ ID NO: 691508 - RNA, 64 nt, Homo Sapiens; identical to SEQ ID NO: 458136

SEQ ID NO: 691509 - RNA, 64 nt, Homo Sapiens; identical to SEQ ID NO: 458137

SEQ ID NO: 691510 - RNA, 64 nt, Homo Sapiens; identical to SEQ ID NO: 458138

SEQ ID NO: 691511 - RNA, 64 nt, Homo Sapiens; identical to SEQ ID NO: 458139

SEQ ID NO: 691512 - RNA, 64 nt, Homo Sapiens; identical to SEQ ID NO: 458140

SEQ ID NO: 691513 - RNA, 64 nt, Homo Sapiens; identical to SEQ ID NO: 458141

SEQ ID NO: 691514 - RNA, 64 nt, Homo Sapiens; identical to SEQ ID NO: 458142

SEQ ID NO: 691515 - RNA, 64 nt, Homo Sapiens; identical to SEQ ID NO: 458143

SEQ ID NO: 691516 - RNA, 64 nt, Homo Sapiens; identical to SEQ ID NO: 458144

SEQ ID NO: 691517 - RNA, 64 nt, Homo Sapiens; identical to SEQ ID NO: 458145

SEQ ID NO: 691518 - RNA, 64 nt, Homo Sapiens; identical to SEQ ID NO: 458146

SEQ ID NO: 691519 - RNA, 64 nt, Homo Sapiens; identical to SEQ ID NO: 458147

SEQ ID NO: 691520 - RNA, 64 nt, Homo Sapiens; identical to SEQ ID NO: 458148

SEQ ID NO: 691521 - RNA, 64 nt, Homo Sapiens; identical to SEQ ID NO: 458149

SEQ ID NO: 691522 - RNA, 64 nt, Homo Sapiens; identical to SEQ ID NO: 458150

SEQ ID NO: 691523 - RNA, 64 nt, Homo Sapiens; identical to SEQ ID NO: 458151

SEQ ID NO: 691524 - RNA, 64 nt, Homo Sapiens; identical to SEQ ID NO: 458152

SEQ ID NO: 691525 - RNA, 64 nt, Homo Sapiens; identical to SEQ ID NO: 458153

SEQ ID NO: 691526 - RNA, 64 nt, Homo Sapiens; identical to SEQ ID NO: 458154

SEQ ID NO: 691527 - RNA, 64 nt, Homo Sapiens; identical to SEQ ID NO: 458155

SEQ ID NO: 691528 - RNA, 64 nt, Homo Sapiens; identical to SEQ ID NO: 458156

SEQ ID NO: 691529 - RNA, 64 nt, Homo Sapiens; identical to SEQ ID NO: 458157

SEQ ID NO: 691530 - RNA, 64 nt, Homo Sapiens; identical to SEQ ID NO: 458158

SEQ ID NO: 691531 - RNA, 64 nt, Homo Sapiens; identical to SEQ ID NO: 458159

SEQ ID NO: 691532 - RNA, 64 nt, Homo Sapiens; identical to SEQ ID NO: 458160

SEQ ID NO: 691533 - RNA, 64 nt, Homo Sapiens; identical to SEQ ID NO: 458161

SEQ ID NO: 691534 - RNA, 64 nt, Homo Sapiens; identical to SEQ ID NO: 458162

SEQ ID NO: 691535 - RNA, 64 nt, Homo Sapiens; identical to SEQ ID NO: 458163

SEQ ID NO: 691536 - RNA, 64 nt, Homo Sapiens; identical to SEQ ID NO: 458164

SEQ ID NO: 691537 - RNA, 64 nt, Homo Sapiens; identical to SEQ ID NO: 458165

SEQ ID NO: 691538 - RNA, 64 nt, Homo Sapiens; identical to SEQ ID NO: 458166

SEQ ID NO: 691539 - RNA, 64 nt, Homo Sapiens; identical to SEQ ID NO: 458167

SEQ ID NO: 691540 - RNA, 64 nt, Homo Sapiens; identical to SEQ ID NO: 458168

SEQ ID NO: 691541 - RNA, 64 nt, Homo Sapiens; identical to SEQ ID NO: 458169

SEQ ID NO: 691542 - RNA, 64 nt, Homo Sapiens; identical to SEQ ID NO: 458170

SEQ ID NO: 691543 - RNA, 64 nt, Homo Sapiens; identical to SEQ ID NO: 458171

SEQ ID NO: 691544 - RNA, 64 nt, Homo Sapiens; identical to SEQ ID NO: 458172

SEQ ID NO: 691545 - RNA, 64 nt, Homo Sapiens; identical to SEQ ID NO: 458173

SEQ ID NO: 691546 - RNA, 64 nt, Homo Sapiens; identical to SEQ ID NO: 458174

SEQ ID NO: 691547 - RNA, 64 nt, Homo Sapiens; identical to SEQ ID NO: 458175

SEQ ID NO: 691548 - RNA, 64 nt, Homo Sapiens; identical to SEQ ID NO: 458176

SEQ ID NO: 691549 - RNA, 64 nt, Homo Sapiens; identical to SEQ ID NO: 458177

SEQ ID NO: 691550 - RNA, 64 nt, Homo Sapiens; identical to SEQ ID NO: 458178

SEQ ID NO: 691551 - RNA, 64 nt, Homo Sapiens; identical to SEQ ID NO: 458179

SEQ ID NO: 691552 - RNA, 64 nt, Homo Sapiens; identical to SEQ ID NO: 458180

SEQ ID NO: 691553 - RNA, 64 nt, Homo Sapiens; identical to SEQ ID NO: 458181

SEQ ID NO: 691554 - RNA, 64 nt, Homo Sapiens; identical to SEQ ID NO: 458182

SEQ ID NO: 691555 - RNA, 64 nt, Homo Sapiens; identical to SEQ ID NO: 458183

SEQ ID NO: 691556 - RNA, 64 nt, Homo Sapiens; identical to SEQ ID NO: 458184

SEQ ID NO: 691557 - RNA, 64 nt, Homo Sapiens; identical to SEQ ID NO: 458185

SEQ ID NO: 691558 - RNA, 64 nt, Homo Sapiens; identical to SEQ ID NO: 458186

SEQ ID NO: 691559 - RNA, 64 nt, Homo Sapiens; identical to SEQ ID NO: 458187

SEQ ID NO: 691560 - RNA, 64 nt, Homo Sapiens; identical to SEQ ID NO: 458188

SEQ ID NO: 691561 - RNA, 64 nt, Homo Sapiens; identical to SEQ ID NO: 458189

SEQ ID NO: 691562 - RNA, 64 nt, Homo Sapiens; identical to SEQ ID NO: 458190

SEQ ID NO: 691563 - RNA, 64 nt, Homo Sapiens; identical to SEQ ID NO: 458191

SEQ ID NO: 691564 - RNA, 64 nt, Homo Sapiens; identical to SEQ ID NO: 458192

SEQ ID NO: 691565 - RNA, 64 nt, Homo Sapiens; identical to SEQ ID NO: 458193

SEQ ID NO: 691566 - RNA, 64 nt, Homo Sapiens; identical to SEQ ID NO: 458194

SEQ ID NO: 691567 - RNA, 64 nt, Homo Sapiens; identical to SEQ ID NO: 458195

SEQ ID NO: 691568 - RNA, 64 nt, Homo Sapiens; identical to SEQ ID NO: 458196

SEQ ID NO: 691569 - RNA, 64 nt, Homo Sapiens; identical to SEQ ID NO: 458197

SEQ ID NO: 691570 - RNA, 64 nt, Homo Sapiens; identical to SEQ ID NO: 458198

SEQ ID NO: 691571 - RNA, 64 nt, Homo Sapiens; identical to SEQ ID NO: 458199

SEQ ID NO: 691572 - RNA, 64 nt, Homo Sapiens; identical to SEQ ID NO: 458200

SEQ ID NO: 691573 - RNA, 64 nt, Homo Sapiens; identical to SEQ ID NO: 458201

SEQ ID NO: 691574 - RNA, 64 nt, Homo Sapiens; identical to SEQ ID NO: 458202

SEQ ID NO: 691575 - RNA, 64 nt, Homo Sapiens; identical to SEQ ID NO: 458203

SEQ ID NO: 691576 - RNA, 64 nt, Homo Sapiens; identical to SEQ ID NO: 458204

SEQ ID NO: 691577 - RNA, 64 nt, Homo Sapiens; identical to SEQ ID NO: 458205

SEQ ID NO: 691578 - RNA, 64 nt, Homo Sapiens; identical to SEQ ID NO: 458206

SEQ ID NO: 691579 - RNA, 64 nt, Homo Sapiens; identical to SEQ ID NO: 458207

SEQ ID NO: 691580 - RNA, 64 nt, Homo Sapiens; identical to SEQ ID NO: 458208

SEQ ID NO: 691581 - RNA, 64 nt, Homo Sapiens; identical to SEQ ID NO: 458209

SEQ ID NO: 691582 - RNA, 64 nt, Homo Sapiens; identical to SEQ ID NO: 458210

SEQ ID NO: 691583 - RNA, 64 nt, Homo Sapiens; identical to SEQ ID NO: 458211

SEQ ID NO: 691584 - RNA, 64 nt, Homo Sapiens; identical to SEQ ID NO: 458212

SEQ ID NO: 691585 - RNA, 64 nt, Homo Sapiens; identical to SEQ ID NO: 458213

SEQ ID NO: 691586 - RNA, 64 nt, Homo Sapiens; identical to SEQ ID NO: 458214

SEQ ID NO: 691587 - RNA, 64 nt, Homo Sapiens; identical to SEQ ID NO: 458215

SEQ ID NO: 691588 - RNA, 64 nt, Homo Sapiens; identical to SEQ ID NO: 458216

SEQ ID NO: 691589 - RNA, 64 nt, Homo Sapiens; identical to SEQ ID NO: 458217

SEQ ID NO: 691590 - RNA, 64 nt, Homo Sapiens; identical to SEQ ID NO: 458218

SEQ ID NO: 691591 - RNA, 64 nt, Homo Sapiens; identical to SEQ ID NO: 458219

SEQ ID NO: 691592 - RNA, 64 nt, Homo Sapiens; identical to SEQ ID NO: 458220

SEQ ID NO: 691593 - RNA, 64 nt, Homo Sapiens; identical to SEQ ID NO: 458221

SEQ ID NO: 691594 - RNA, 64 nt, Homo Sapiens; identical to SEQ ID NO: 458222

SEQ ID NO: 691595 - RNA, 64 nt, Homo Sapiens; identical to SEQ ID NO: 458223

SEQ ID NO: 691596 - RNA, 64 nt, Homo Sapiens; identical to SEQ ID NO: 458224

SEQ ID NO: 691597 - RNA, 64 nt, Homo Sapiens; identical to SEQ ID NO: 458225

SEQ ID NO: 691598 - RNA, 64 nt, Homo Sapiens; identical to SEQ ID NO: 458226

SEQ ID NO: 691599 - RNA, 64 nt, Homo Sapiens; identical to SEQ ID NO: 458227

SEQ ID NO: 691600 - RNA, 64 nt, Homo Sapiens; identical to SEQ ID NO: 458228

SEQ ID NO: 691601 - RNA, 64 nt, Homo Sapiens; identical to SEQ ID NO: 458229

SEQ ID NO: 691602 - RNA, 64 nt, Homo Sapiens; identical to SEQ ID NO: 458230

SEQ ID NO: 691603 - RNA, 64 nt, Homo Sapiens; identical to SEQ ID NO: 458231

SEQ ID NO: 691604 - RNA, 64 nt, Homo Sapiens; identical to SEQ ID NO: 458232

SEQ ID NO: 691605 - RNA, 64 nt, Homo Sapiens; identical to SEQ ID NO: 458233

SEQ ID NO: 691606 - RNA, 64 nt, Homo Sapiens; identical to SEQ ID NO: 458234

SEQ ID NO: 691607 - RNA, 64 nt, Homo Sapiens; identical to SEQ ID NO: 458235

SEQ ID NO: 691608 - RNA, 64 nt, Homo Sapiens; identical to SEQ ID NO: 458236

SEQ ID NO: 691609 - RNA, 64 nt, Homo Sapiens; identical to SEQ ID NO: 458237

SEQ ID NO: 691610 - RNA, 64 nt, Homo Sapiens; identical to SEQ ID NO: 458238

SEQ ID NO: 691611 - RNA, 64 nt, Homo Sapiens; identical to SEQ ID NO: 458239

SEQ ID NO: 691612 - RNA, 64 nt, Homo Sapiens; identical to SEQ ID NO: 458240

SEQ ID NO: 691613 - RNA, 64 nt, Homo Sapiens; identical to SEQ ID NO: 458241

SEQ ID NO: 691614 - RNA, 64 nt, Homo Sapiens; identical to SEQ ID NO: 458242

SEQ ID NO: 691615 - RNA, 64 nt, Homo Sapiens; identical to SEQ ID NO: 458243

SEQ ID NO: 691616 - RNA, 64 nt, Homo Sapiens; identical to SEQ ID NO: 458244

SEQ ID NO: 691617 - RNA, 64 nt, Homo Sapiens; identical to SEQ ID NO: 458245

SEQ ID NO: 691618 - RNA, 64 nt, Homo Sapiens; identical to SEQ ID NO: 458246

SEQ ID NO: 691619 - RNA, 64 nt, Homo Sapiens; identical to SEQ ID NO: 458247

SEQ ID NO: 691620 - RNA, 64 nt, Homo Sapiens; identical to SEQ ID NO: 458248

SEQ ID NO: 691621 - RNA, 64 nt, Homo Sapiens; identical to SEQ ID NO: 458249

SEQ ID NO: 691622 - RNA, 64 nt, Homo Sapiens; identical to SEQ ID NO: 458250

SEQ ID NO: 691623 - RNA, 64 nt, Homo Sapiens; identical to SEQ ID NO: 458251

SEQ ID NO: 691624 - RNA, 64 nt, Homo Sapiens; identical to SEQ ID NO: 458252

SEQ ID NO: 691625 - RNA, 64 nt, Homo Sapiens; identical to SEQ ID NO: 458253

SEQ ID NO: 691626 - RNA, 64 nt, Homo Sapiens; identical to SEQ ID NO: 458254

SEQ ID NO: 691627 - RNA, 64 nt, Homo Sapiens; identical to SEQ ID NO: 458255

SEQ ID NO: 691628 - RNA, 64 nt, Homo Sapiens; identical to SEQ ID NO: 458256

SEQ ID NO: 691629 - RNA, 64 nt, Homo Sapiens; identical to SEQ ID NO: 458257

SEQ ID NO: 691630 - RNA, 64 nt, Homo Sapiens; identical to SEQ ID NO: 458258

SEQ ID NO: 691631 - RNA, 64 nt, Homo Sapiens; identical to SEQ ID NO: 458259

SEQ ID NO: 691632 - RNA, 64 nt, Homo Sapiens; identical to SEQ ID NO: 458260

SEQ ID NO: 691633 - RNA, 64 nt, Homo Sapiens; identical to SEQ ID NO: 458261

SEQ ID NO: 691634 - RNA, 64 nt, Homo Sapiens; identical to SEQ ID NO: 458262

SEQ ID NO: 691635 - RNA, 64 nt, Homo Sapiens; identical to SEQ ID NO: 458263

SEQ ID NO: 691636 - RNA, 64 nt, Homo Sapiens; identical to SEQ ID NO: 458264

SEQ ID NO: 691637 - RNA, 64 nt, Homo Sapiens; identical to SEQ ID NO: 458265

SEQ ID NO: 691638 - RNA, 64 nt, Homo Sapiens; identical to SEQ ID NO: 458266

SEQ ID NO: 691639 - RNA, 64 nt, Homo Sapiens; identical to SEQ ID NO: 458267

SEQ ID NO: 691640 - RNA, 64 nt, Homo Sapiens; identical to SEQ ID NO: 458268

SEQ ID NO: 691641 - RNA, 64 nt, Homo Sapiens; identical to SEQ ID NO: 458269

SEQ ID NO: 691642 - RNA, 64 nt, Homo Sapiens; identical to SEQ ID NO: 458270

SEQ ID NO: 691643 - RNA, 64 nt, Homo Sapiens; identical to SEQ ID NO: 458271

SEQ ID NO: 691644 - RNA, 64 nt, Homo Sapiens; identical to SEQ ID NO: 458272

SEQ ID NO: 691645 - RNA, 64 nt, Homo Sapiens; identical to SEQ ID NO: 458273

SEQ ID NO: 691646 - RNA, 64 nt, Homo Sapiens; identical to SEQ ID NO: 458274

SEQ ID NO: 691647 - RNA, 64 nt, Homo Sapiens; identical to SEQ ID NO: 458275

SEQ ID NO: 691648 - RNA, 64 nt, Homo Sapiens; identical to SEQ ID NO: 458276

SEQ ID NO: 691649 - RNA, 64 nt, Homo Sapiens; identical to SEQ ID NO: 458277

SEQ ID NO: 691650 - RNA, 64 nt, Homo Sapiens; identical to SEQ ID NO: 458278

SEQ ID NO: 691651 - RNA, 64 nt, Homo Sapiens; identical to SEQ ID NO: 458279

SEQ ID NO: 691652 - RNA, 64 nt, Homo Sapiens; identical to SEQ ID NO: 458280

SEQ ID NO: 691653 - RNA, 64 nt, Homo Sapiens; identical to SEQ ID NO: 458281

SEQ ID NO: 691654 - RNA, 64 nt, Homo Sapiens; identical to SEQ ID NO: 458282

SEQ ID NO: 691655 - RNA, 64 nt, Homo Sapiens; identical to SEQ ID NO: 458283

SEQ ID NO: 691656 - RNA, 64 nt, Homo Sapiens; identical to SEQ ID NO: 458284

SEQ ID NO: 691657 - RNA, 64 nt, Homo Sapiens; identical to SEQ ID NO: 458285

SEQ ID NO: 691658 - RNA, 64 nt, Homo Sapiens; identical to SEQ ID NO: 458286

SEQ ID NO: 691659 - RNA, 64 nt, Homo Sapiens; identical to SEQ ID NO: 458287

SEQ ID NO: 691660 - RNA, 64 nt, Homo Sapiens; identical to SEQ ID NO: 458288

SEQ ID NO: 691661 - RNA, 64 nt, Homo Sapiens; identical to SEQ ID NO: 458289

SEQ ID NO: 691662 - RNA, 64 nt, Homo Sapiens; identical to SEQ ID NO: 458290

SEQ ID NO: 691663 - RNA, 64 nt, Homo Sapiens; identical to SEQ ID NO: 458291

SEQ ID NO: 691664 - RNA, 64 nt, Homo Sapiens; identical to SEQ ID NO: 458292

SEQ ID NO: 691665 - RNA, 64 nt, Homo Sapiens; identical to SEQ ID NO: 458293

SEQ ID NO: 691666 - RNA, 64 nt, Homo Sapiens; identical to SEQ ID NO: 458294

SEQ ID NO: 691667 - RNA, 64 nt, Homo Sapiens; identical to SEQ ID NO: 458295

SEQ ID NO: 691668 - RNA, 64 nt, Homo Sapiens; identical to SEQ ID NO: 458296

SEQ ID NO: 691669 - RNA, 64 nt, Homo Sapiens; identical to SEQ ID NO: 458297

SEQ ID NO: 691670 - RNA, 64 nt, Homo Sapiens; identical to SEQ ID NO: 458298

SEQ ID NO: 691671 - RNA, 64 nt, Homo Sapiens; identical to SEQ ID NO: 458299

SEQ ID NO: 691672 - RNA, 64 nt, Homo Sapiens; identical to SEQ ID NO: 458300

SEQ ID NO: 691673 - RNA, 64 nt, Homo Sapiens; identical to SEQ ID NO: 458301

SEQ ID NO: 691674 - RNA, 64 nt, Homo Sapiens; identical to SEQ ID NO: 458302

SEQ ID NO: 691675 - RNA, 64 nt, Homo Sapiens; identical to SEQ ID NO: 458303

SEQ ID NO: 691676 - RNA, 64 nt, Homo Sapiens; identical to SEQ ID NO: 458304

SEQ ID NO: 691677 - RNA, 64 nt, Homo Sapiens; identical to SEQ ID NO: 458305

SEQ ID NO: 691678 - RNA, 64 nt, Homo Sapiens; identical to SEQ ID NO: 458306

SEQ ID NO: 691679 - RNA, 64 nt, Homo Sapiens; identical to SEQ ID NO: 458307

SEQ ID NO: 691680 - RNA, 64 nt, Homo Sapiens; identical to SEQ ID NO: 458308

SEQ ID NO: 691681 - RNA, 64 nt, Homo Sapiens; identical to SEQ ID NO: 458309

SEQ ID NO: 691682 - RNA, 64 nt, Homo Sapiens; identical to SEQ ID NO: 458310

SEQ ID NO: 691683 - RNA, 64 nt, Homo Sapiens; identical to SEQ ID NO: 458311

SEQ ID NO: 691684 - RNA, 64 nt, Homo Sapiens; identical to SEQ ID NO: 458312

SEQ ID NO: 691685 - RNA, 64 nt, Homo Sapiens; identical to SEQ ID NO: 458313

SEQ ID NO: 691686 - RNA, 64 nt, Homo Sapiens; identical to SEQ ID NO: 458314

SEQ ID NO: 691687 - RNA, 64 nt, Homo Sapiens; identical to SEQ ID NO: 458315

SEQ ID NO: 691688 - RNA, 64 nt, Homo Sapiens; identical to SEQ ID NO: 458316

SEQ ID NO: 691689 - RNA, 64 nt, Homo Sapiens; identical to SEQ ID NO: 458317

SEQ ID NO: 691690 - RNA, 64 nt, Homo Sapiens; identical to SEQ ID NO: 458318

SEQ ID NO: 691691 - RNA, 64 nt, Homo Sapiens; identical to SEQ ID NO: 458319

SEQ ID NO: 691692 - RNA, 64 nt, Homo Sapiens; identical to SEQ ID NO: 458320

SEQ ID NO: 691693 - RNA, 64 nt, Homo Sapiens; identical to SEQ ID NO: 458321

SEQ ID NO: 691694 - RNA, 64 nt, Homo Sapiens; identical to SEQ ID NO: 458322

SEQ ID NO: 691695 - RNA, 64 nt, Homo Sapiens; identical to SEQ ID NO: 458323

SEQ ID NO: 691696 - RNA, 64 nt, Homo Sapiens; identical to SEQ ID NO: 458324

SEQ ID NO: 691697 - RNA, 64 nt, Homo Sapiens; identical to SEQ ID NO: 458325

SEQ ID NO: 691698 - RNA, 64 nt, Homo Sapiens; identical to SEQ ID NO: 458326

SEQ ID NO: 691699 - RNA, 64 nt, Homo Sapiens; identical to SEQ ID NO: 458327

SEQ ID NO: 691700 - RNA, 64 nt, Homo Sapiens; identical to SEQ ID NO: 458328

SEQ ID NO: 691701 - RNA, 64 nt, Homo Sapiens; identical to SEQ ID NO: 458329

SEQ ID NO: 691702 - RNA, 64 nt, Homo Sapiens; identical to SEQ ID NO: 458330

SEQ ID NO: 691703 - RNA, 64 nt, Homo Sapiens; identical to SEQ ID NO: 458331

SEQ ID NO: 691704 - RNA, 64 nt, Homo Sapiens; identical to SEQ ID NO: 458332

SEQ ID NO: 691705 - RNA, 64 nt, Homo Sapiens; identical to SEQ ID NO: 458333

SEQ ID NO: 691706 - RNA, 64 nt, Homo Sapiens; identical to SEQ ID NO: 458334

SEQ ID NO: 691707 - RNA, 64 nt, Homo Sapiens; identical to SEQ ID NO: 458335

SEQ ID NO: 691708 - RNA, 64 nt, Homo Sapiens; identical to SEQ ID NO: 458336

SEQ ID NO: 691709 - RNA, 64 nt, Homo Sapiens; identical to SEQ ID NO: 458337

SEQ ID NO: 691710 - RNA, 64 nt, Homo Sapiens; identical to SEQ ID NO: 458338

SEQ ID NO: 691711 - RNA, 64 nt, Homo Sapiens; identical to SEQ ID NO: 458339

SEQ ID NO: 691712 - RNA, 64 nt, Homo Sapiens; identical to SEQ ID NO: 458340

SEQ ID NO: 691713 - RNA, 64 nt, Homo Sapiens; identical to SEQ ID NO: 458341

SEQ ID NO: 691714 - RNA, 64 nt, Homo Sapiens; identical to SEQ ID NO: 458342

SEQ ID NO: 691715 - RNA, 64 nt, Homo Sapiens; identical to SEQ ID NO: 458343

SEQ ID NO: 691716 - RNA, 64 nt, Homo Sapiens; identical to SEQ ID NO: 458344

SEQ ID NO: 691717 - RNA, 64 nt, Homo Sapiens; identical to SEQ ID NO: 458345

SEQ ID NO: 691718 - RNA, 64 nt, Homo Sapiens; identical to SEQ ID NO: 458346

SEQ ID NO: 691719 - RNA, 64 nt, Homo Sapiens; identical to SEQ ID NO: 458347

SEQ ID NO: 691720 - RNA, 64 nt, Homo Sapiens; identical to SEQ ID NO: 458348

SEQ ID NO: 691721 - RNA, 64 nt, Homo Sapiens; identical to SEQ ID NO: 458349

SEQ ID NO: 691722 - RNA, 64 nt, Homo Sapiens; identical to SEQ ID NO: 458350

SEQ ID NO: 691723 - RNA, 64 nt, Homo Sapiens; identical to SEQ ID NO: 458351

SEQ ID NO: 691724 - RNA, 64 nt, Homo Sapiens; identical to SEQ ID NO: 458352

SEQ ID NO: 691725 - RNA, 64 nt, Homo Sapiens; identical to SEQ ID NO: 458353

SEQ ID NO: 691726 - RNA, 64 nt, Homo Sapiens; identical to SEQ ID NO: 458354

SEQ ID NO: 691727 - RNA, 64 nt, Homo Sapiens; identical to SEQ ID NO: 458355

SEQ ID NO: 691728 - RNA, 64 nt, Homo Sapiens; identical to SEQ ID NO: 458356

SEQ ID NO: 691729 - RNA, 64 nt, Homo Sapiens; identical to SEQ ID NO: 458357

SEQ ID NO: 691730 - RNA, 64 nt, Homo Sapiens; identical to SEQ ID NO: 458358

SEQ ID NO: 691731 - RNA, 64 nt, Homo Sapiens; identical to SEQ ID NO: 458359

SEQ ID NO: 691732 - RNA, 64 nt, Homo Sapiens; identical to SEQ ID NO: 458360

SEQ ID NO: 691733 - RNA, 64 nt, Homo Sapiens; identical to SEQ ID NO: 458361

SEQ ID NO: 691734 - RNA, 64 nt, Homo Sapiens; identical to SEQ ID NO: 458362

SEQ ID NO: 691735 - RNA, 64 nt, Homo Sapiens; identical to SEQ ID NO: 458363

SEQ ID NO: 691736 - RNA, 64 nt, Homo Sapiens; identical to SEQ ID NO: 458364

SEQ ID NO: 691737 - RNA, 64 nt, Homo Sapiens; identical to SEQ ID NO: 458365

SEQ ID NO: 691738 - RNA, 64 nt, Homo Sapiens; identical to SEQ ID NO: 458366

SEQ ID NO: 691739 - RNA, 64 nt, Homo Sapiens; identical to SEQ ID NO: 458367

SEQ ID NO: 691740 - RNA, 64 nt, Homo Sapiens; identical to SEQ ID NO: 458368

SEQ ID NO: 691741 - RNA, 64 nt, Homo Sapiens; identical to SEQ ID NO: 458369

SEQ ID NO: 691742 - RNA, 64 nt, Homo Sapiens; identical to SEQ ID NO: 458370

SEQ ID NO: 691743 - RNA, 64 nt, Homo Sapiens; identical to SEQ ID NO: 458371

SEQ ID NO: 691744 - RNA, 64 nt, Homo Sapiens; identical to SEQ ID NO: 458372

SEQ ID NO: 691745 - RNA, 64 nt, Homo Sapiens; identical to SEQ ID NO: 458373

SEQ ID NO: 691746 - RNA, 64 nt, Homo Sapiens; identical to SEQ ID NO: 458374

SEQ ID NO: 691747 - RNA, 64 nt, Homo Sapiens; identical to SEQ ID NO: 458375

SEQ ID NO: 691748 - RNA, 64 nt, Homo Sapiens; identical to SEQ ID NO: 458376

SEQ ID NO: 691749 - RNA, 64 nt, Homo Sapiens; identical to SEQ ID NO: 458377

SEQ ID NO: 691750 - RNA, 64 nt, Homo Sapiens; identical to SEQ ID NO: 458378

SEQ ID NO: 691751 - RNA, 64 nt, Homo Sapiens; identical to SEQ ID NO: 458379

SEQ ID NO: 691752 - RNA, 64 nt, Homo Sapiens; identical to SEQ ID NO: 458380

SEQ ID NO: 691753 - RNA, 64 nt, Homo Sapiens; identical to SEQ ID NO: 458381

SEQ ID NO: 691754 - RNA, 64 nt, Homo Sapiens; identical to SEQ ID NO: 458382

SEQ ID NO: 691755 - RNA, 64 nt, Homo Sapiens; identical to SEQ ID NO: 458383

SEQ ID NO: 691756 - RNA, 64 nt, Homo Sapiens; identical to SEQ ID NO: 458384

SEQ ID NO: 691757 - RNA, 64 nt, Homo Sapiens; identical to SEQ ID NO: 458385

SEQ ID NO: 691758 - RNA, 64 nt, Homo Sapiens; identical to SEQ ID NO: 458386

SEQ ID NO: 691759 - RNA, 64 nt, Homo Sapiens; identical to SEQ ID NO: 458387

SEQ ID NO: 691760 - RNA, 64 nt, Homo Sapiens; identical to SEQ ID NO: 458388

SEQ ID NO: 691761 - RNA, 64 nt, Homo Sapiens; identical to SEQ ID NO: 458389

SEQ ID NO: 691762 - RNA, 64 nt, Homo Sapiens; identical to SEQ ID NO: 458390

SEQ ID NO: 691763 - RNA, 64 nt, Homo Sapiens; identical to SEQ ID NO: 458391

SEQ ID NO: 691764 - RNA, 64 nt, Homo Sapiens; identical to SEQ ID NO: 458392

SEQ ID NO: 691765 - RNA, 64 nt, Homo Sapiens; identical to SEQ ID NO: 458393

SEQ ID NO: 691766 - RNA, 64 nt, Homo Sapiens; identical to SEQ ID NO: 458394

SEQ ID NO: 691767 - RNA, 64 nt, Homo Sapiens; identical to SEQ ID NO: 458395

SEQ ID NO: 691768 - RNA, 64 nt, Homo Sapiens; identical to SEQ ID NO: 458396

SEQ ID NO: 691769 - RNA, 64 nt, Homo Sapiens; identical to SEQ ID NO: 458397

SEQ ID NO: 691770 - RNA, 64 nt, Homo Sapiens; identical to SEQ ID NO: 458398

SEQ ID NO: 691771 - RNA, 64 nt, Homo Sapiens; identical to SEQ ID NO: 458399

SEQ ID NO: 691772 - RNA, 64 nt, Homo Sapiens; identical to SEQ ID NO: 458400

SEQ ID NO: 691773 - RNA, 64 nt, Homo Sapiens; identical to SEQ ID NO: 458401

SEQ ID NO: 691774 - RNA, 64 nt, Homo Sapiens; identical to SEQ ID NO: 458402

SEQ ID NO: 691775 - RNA, 64 nt, Homo Sapiens; identical to SEQ ID NO: 458403

SEQ ID NO: 691776 - RNA, 64 nt, Homo Sapiens; identical to SEQ ID NO: 458404

SEQ ID NO: 691777 - RNA, 64 nt, Homo Sapiens; identical to SEQ ID NO: 458405

SEQ ID NO: 691778 - RNA, 64 nt, Homo Sapiens; identical to SEQ ID NO: 458406

SEQ ID NO: 691779 - RNA, 64 nt, Homo Sapiens; identical to SEQ ID NO: 458407

SEQ ID NO: 691780 - RNA, 64 nt, Homo Sapiens; identical to SEQ ID NO: 458408

SEQ ID NO: 691781 - RNA, 64 nt, Homo Sapiens; identical to SEQ ID NO: 458409

SEQ ID NO: 691782 - RNA, 64 nt, Homo Sapiens; identical to SEQ ID NO: 458410

SEQ ID NO: 691783 - RNA, 64 nt, Homo Sapiens; identical to SEQ ID NO: 458411

SEQ ID NO: 691784 - RNA, 64 nt, Homo Sapiens; identical to SEQ ID NO: 458412

SEQ ID NO: 691785 - RNA, 64 nt, Homo Sapiens; identical to SEQ ID NO: 458413

SEQ ID NO: 691786 - RNA, 64 nt, Homo Sapiens; identical to SEQ ID NO: 458414

SEQ ID NO: 691787 - RNA, 64 nt, Homo Sapiens; identical to SEQ ID NO: 458415

SEQ ID NO: 691788 - RNA, 64 nt, Homo Sapiens; identical to SEQ ID NO: 458416

SEQ ID NO: 691789 - RNA, 64 nt, Homo Sapiens; identical to SEQ ID NO: 458417

SEQ ID NO: 691790 - RNA, 64 nt, Homo Sapiens; identical to SEQ ID NO: 458418

SEQ ID NO: 691791 - RNA, 64 nt, Homo Sapiens; identical to SEQ ID NO: 458419

SEQ ID NO: 691792 - RNA, 64 nt, Homo Sapiens; identical to SEQ ID NO: 458420

SEQ ID NO: 691793 - RNA, 64 nt, Homo Sapiens; identical to SEQ ID NO: 458421

SEQ ID NO: 691794 - RNA, 64 nt, Homo Sapiens; identical to SEQ ID NO: 458422

SEQ ID NO: 691795 - RNA, 64 nt, Homo Sapiens; identical to SEQ ID NO: 458423

SEQ ID NO: 691796 - RNA, 64 nt, Homo Sapiens; identical to SEQ ID NO: 458424

SEQ ID NO: 691797 - RNA, 64 nt, Homo Sapiens; identical to SEQ ID NO: 458425

SEQ ID NO: 691798 - RNA, 64 nt, Homo Sapiens; identical to SEQ ID NO: 458426

SEQ ID NO: 691799 - RNA, 64 nt, Homo Sapiens; identical to SEQ ID NO: 458427

SEQ ID NO: 691800 - RNA, 64 nt, Homo Sapiens; identical to SEQ ID NO: 458428

SEQ ID NO: 691801 - RNA, 64 nt, Homo Sapiens; identical to SEQ ID NO: 458429

SEQ ID NO: 691802 - RNA, 64 nt, Homo Sapiens; identical to SEQ ID NO: 458430

SEQ ID NO: 691803 - RNA, 64 nt, Homo Sapiens; identical to SEQ ID NO: 458431

SEQ ID NO: 691804 - RNA, 64 nt, Homo Sapiens; identical to SEQ ID NO: 458432

SEQ ID NO: 691805 - RNA, 64 nt, Homo Sapiens; identical to SEQ ID NO: 458433

SEQ ID NO: 691806 - RNA, 64 nt, Homo Sapiens; identical to SEQ ID NO: 458434

SEQ ID NO: 691807 - RNA, 64 nt, Homo Sapiens; identical to SEQ ID NO: 458435

SEQ ID NO: 691808 - RNA, 64 nt, Homo Sapiens; identical to SEQ ID NO: 458436

SEQ ID NO: 691809 - RNA, 64 nt, Homo Sapiens; identical to SEQ ID NO: 458437

SEQ ID NO: 691810 - RNA, 64 nt, Homo Sapiens; identical to SEQ ID NO: 458438

SEQ ID NO: 691811 - RNA, 64 nt, Homo Sapiens; identical to SEQ ID NO: 458439

SEQ ID NO: 691812 - RNA, 64 nt, Homo Sapiens; identical to SEQ ID NO: 458440

SEQ ID NO: 691813 - RNA, 64 nt, Homo Sapiens; identical to SEQ ID NO: 458441

SEQ ID NO: 691814 - RNA, 64 nt, Homo Sapiens; identical to SEQ ID NO: 458442

SEQ ID NO: 691815 - RNA, 64 nt, Homo Sapiens; identical to SEQ ID NO: 458443

SEQ ID NO: 691816 - RNA, 64 nt, Homo Sapiens; identical to SEQ ID NO: 458444

SEQ ID NO: 691817 - RNA, 64 nt, Homo Sapiens; identical to SEQ ID NO: 458445

SEQ ID NO: 691818 - RNA, 64 nt, Homo Sapiens; identical to SEQ ID NO: 458446

SEQ ID NO: 691819 - RNA, 64 nt, Homo Sapiens; identical to SEQ ID NO: 458447

SEQ ID NO: 691820 - RNA, 64 nt, Homo Sapiens; identical to SEQ ID NO: 458448

SEQ ID NO: 691821 - RNA, 64 nt, Homo Sapiens; identical to SEQ ID NO: 458449

SEQ ID NO: 691822 - RNA, 64 nt, Homo Sapiens; identical to SEQ ID NO: 458450

SEQ ID NO: 691823 - RNA, 64 nt, Homo Sapiens; identical to SEQ ID NO: 458451

SEQ ID NO: 691824 - RNA, 64 nt, Homo Sapiens; identical to SEQ ID NO: 458452

SEQ ID NO: 691825 - RNA, 64 nt, Homo Sapiens; identical to SEQ ID NO: 458453

SEQ ID NO: 691826 - RNA, 64 nt, Homo Sapiens; identical to SEQ ID NO: 458454

SEQ ID NO: 691827 - RNA, 64 nt, Homo Sapiens; identical to SEQ ID NO: 458455

SEQ ID NO: 691828 - RNA, 64 nt, Homo Sapiens; identical to SEQ ID NO: 458456

SEQ ID NO: 691829 - RNA, 64 nt, Homo Sapiens; identical to SEQ ID NO: 458457

SEQ ID NO: 691830 - RNA, 64 nt, Homo Sapiens; identical to SEQ ID NO: 458458

SEQ ID NO: 691831 - RNA, 64 nt, Homo Sapiens; identical to SEQ ID NO: 458459

SEQ ID NO: 691832 - RNA, 64 nt, Homo Sapiens; identical to SEQ ID NO: 458460

SEQ ID NO: 691833 - RNA, 64 nt, Homo Sapiens; identical to SEQ ID NO: 458461

SEQ ID NO: 691834 - RNA, 64 nt, Homo Sapiens; identical to SEQ ID NO: 458462

SEQ ID NO: 691835 - RNA, 64 nt, Homo Sapiens; identical to SEQ ID NO: 458463

SEQ ID NO: 691836 - RNA, 64 nt, Homo Sapiens; identical to SEQ ID NO: 458464

SEQ ID NO: 691837 - RNA, 64 nt, Homo Sapiens; identical to SEQ ID NO: 458465

SEQ ID NO: 691838 - RNA, 64 nt, Homo Sapiens; identical to SEQ ID NO: 458466

SEQ ID NO: 691839 - RNA, 64 nt, Homo Sapiens; identical to SEQ ID NO: 458467

SEQ ID NO: 691840 - RNA, 64 nt, Homo Sapiens; identical to SEQ ID NO: 458468

SEQ ID NO: 691841 - RNA, 64 nt, Homo Sapiens; identical to SEQ ID NO: 458469

SEQ ID NO: 691842 - RNA, 64 nt, Homo Sapiens; identical to SEQ ID NO: 458470

SEQ ID NO: 691843 - RNA, 64 nt, Homo Sapiens; identical to SEQ ID NO: 458471

SEQ ID NO: 691844 - RNA, 64 nt, Homo Sapiens; identical to SEQ ID NO: 458472

SEQ ID NO: 691845 - RNA, 64 nt, Homo Sapiens; identical to SEQ ID NO: 458473

SEQ ID NO: 691846 - RNA, 64 nt, Homo Sapiens; identical to SEQ ID NO: 458474

SEQ ID NO: 691847 - RNA, 64 nt, Homo Sapiens; identical to SEQ ID NO: 458475

SEQ ID NO: 691848 - RNA, 64 nt, Homo Sapiens; identical to SEQ ID NO: 458476

SEQ ID NO: 691849 - RNA, 64 nt, Homo Sapiens; identical to SEQ ID NO: 458477

SEQ ID NO: 691850 - RNA, 64 nt, Homo Sapiens; identical to SEQ ID NO: 458478

SEQ ID NO: 691851 - RNA, 64 nt, Homo Sapiens; identical to SEQ ID NO: 458479

SEQ ID NO: 691852 - RNA, 64 nt, Homo Sapiens; identical to SEQ ID NO: 458480

SEQ ID NO: 691853 - RNA, 64 nt, Homo Sapiens; identical to SEQ ID NO: 458481

SEQ ID NO: 691854 - RNA, 64 nt, Homo Sapiens; identical to SEQ ID NO: 458482

SEQ ID NO: 691855 - RNA, 64 nt, Homo Sapiens; identical to SEQ ID NO: 458483

SEQ ID NO: 691856 - RNA, 64 nt, Homo Sapiens; identical to SEQ ID NO: 458484

SEQ ID NO: 691857 - RNA, 64 nt, Homo Sapiens; identical to SEQ ID NO: 458485

SEQ ID NO: 691858 - RNA, 64 nt, Homo Sapiens; identical to SEQ ID NO: 458486

SEQ ID NO: 691859 - RNA, 64 nt, Homo Sapiens; identical to SEQ ID NO: 458487

SEQ ID NO: 691860 - RNA, 64 nt, Homo Sapiens; identical to SEQ ID NO: 458488

SEQ ID NO: 691861 - RNA, 64 nt, Homo Sapiens; identical to SEQ ID NO: 458489

SEQ ID NO: 691862 - RNA, 64 nt, Homo Sapiens; identical to SEQ ID NO: 458490

SEQ ID NO: 691863 - RNA, 64 nt, Homo Sapiens; identical to SEQ ID NO: 458491

SEQ ID NO: 691864 - RNA, 64 nt, Homo Sapiens; identical to SEQ ID NO: 458492

SEQ ID NO: 691865 - RNA, 64 nt, Homo Sapiens; identical to SEQ ID NO: 458493

SEQ ID NO: 691866 - RNA, 64 nt, Homo Sapiens; identical to SEQ ID NO: 458494

SEQ ID NO: 691867 - RNA, 64 nt, Homo Sapiens; identical to SEQ ID NO: 458495

SEQ ID NO: 691868 - RNA, 64 nt, Homo Sapiens; identical to SEQ ID NO: 458496

SEQ ID NO: 691869 - RNA, 64 nt, Homo Sapiens; identical to SEQ ID NO: 458497

SEQ ID NO: 691870 - RNA, 64 nt, Homo Sapiens; identical to SEQ ID NO: 458498

SEQ ID NO: 691871 - RNA, 64 nt, Homo Sapiens; identical to SEQ ID NO: 458499

SEQ ID NO: 691872 - RNA, 64 nt, Homo Sapiens; identical to SEQ ID NO: 458500

SEQ ID NO: 691873 - RNA, 64 nt, Homo Sapiens; identical to SEQ ID NO: 458501

SEQ ID NO: 691874 - RNA, 64 nt, Homo Sapiens; identical to SEQ ID NO: 458502

SEQ ID NO: 691875 - RNA, 64 nt, Homo Sapiens; identical to SEQ ID NO: 458503

SEQ ID NO: 691876 - RNA, 64 nt, Homo Sapiens; identical to SEQ ID NO: 458504

SEQ ID NO: 691877 - RNA, 64 nt, Homo Sapiens; identical to SEQ ID NO: 458505

SEQ ID NO: 691878 - RNA, 64 nt, Homo Sapiens; identical to SEQ ID NO: 458506

SEQ ID NO: 691879 - RNA, 64 nt, Homo Sapiens; identical to SEQ ID NO: 458507

SEQ ID NO: 691880 - RNA, 64 nt, Homo Sapiens; identical to SEQ ID NO: 458508

SEQ ID NO: 691881 - RNA, 64 nt, Homo Sapiens; identical to SEQ ID NO: 458509

SEQ ID NO: 691882 - RNA, 64 nt, Homo Sapiens; identical to SEQ ID NO: 458510

SEQ ID NO: 691883 - RNA, 64 nt, Homo Sapiens; identical to SEQ ID NO: 458511

SEQ ID NO: 691884 - RNA, 64 nt, Homo Sapiens; identical to SEQ ID NO: 458512

SEQ ID NO: 691885 - RNA, 64 nt, Homo Sapiens; identical to SEQ ID NO: 458513

SEQ ID NO: 691886 - RNA, 64 nt, Homo Sapiens; identical to SEQ ID NO: 458514

SEQ ID NO: 691887 - RNA, 64 nt, Homo Sapiens; identical to SEQ ID NO: 458515

SEQ ID NO: 691888 - RNA, 64 nt, Homo Sapiens; identical to SEQ ID NO: 458516

SEQ ID NO: 691889 - RNA, 64 nt, Homo Sapiens; identical to SEQ ID NO: 458517

SEQ ID NO: 691890 - RNA, 64 nt, Homo Sapiens; identical to SEQ ID NO: 458518

SEQ ID NO: 691891 - RNA, 64 nt, Homo Sapiens; identical to SEQ ID NO: 458519

SEQ ID NO: 691892 - RNA, 64 nt, Homo Sapiens; identical to SEQ ID NO: 458520

SEQ ID NO: 691893 - RNA, 64 nt, Homo Sapiens; identical to SEQ ID NO: 458521

SEQ ID NO: 691894 - RNA, 64 nt, Homo Sapiens; identical to SEQ ID NO: 458522

SEQ ID NO: 691895 - RNA, 64 nt, Homo Sapiens; identical to SEQ ID NO: 458523

SEQ ID NO: 691896 - RNA, 64 nt, Homo Sapiens; identical to SEQ ID NO: 458524

SEQ ID NO: 691897 - RNA, 64 nt, Homo Sapiens; identical to SEQ ID NO: 458525

SEQ ID NO: 691898 - RNA, 64 nt, Homo Sapiens; identical to SEQ ID NO: 458526

SEQ ID NO: 691899 - RNA, 64 nt, Homo Sapiens; identical to SEQ ID NO: 458527

SEQ ID NO: 691900 - RNA, 64 nt, Homo Sapiens; identical to SEQ ID NO: 458528

SEQ ID NO: 691901 - RNA, 64 nt, Homo Sapiens; identical to SEQ ID NO: 458529

SEQ ID NO: 691902 - RNA, 64 nt, Homo Sapiens; identical to SEQ ID NO: 458530

SEQ ID NO: 691903 - RNA, 64 nt, Homo Sapiens; identical to SEQ ID NO: 458531

SEQ ID NO: 691904 - RNA, 64 nt, Homo Sapiens; identical to SEQ ID NO: 458532

SEQ ID NO: 691905 - RNA, 64 nt, Homo Sapiens; identical to SEQ ID NO: 458533

SEQ ID NO: 691906 - RNA, 64 nt, Homo Sapiens; identical to SEQ ID NO: 458534

SEQ ID NO: 691907 - RNA, 64 nt, Homo Sapiens; identical to SEQ ID NO: 458512

SEQ ID NO: 691908 - RNA, 64 nt, Homo Sapiens; identical to SEQ ID NO: 458536

SEQ ID NO: 691909 - RNA, 64 nt, Homo Sapiens; identical to SEQ ID NO: 458537

SEQ ID NO: 691910 - RNA, 64 nt, Homo Sapiens; identical to SEQ ID NO: 458538

SEQ ID NO: 691911 - RNA, 64 nt, Homo Sapiens; identical to SEQ ID NO: 458539

SEQ ID NO: 691912 - RNA, 64 nt, Homo Sapiens
aaaaaucucaaguaaaaugaaaagcaaauaugggcuacugaauuaagaaacuggcauucuagua

SEQ ID NO: 691913 - RNA, 64 nt, Homo Sapiens
agaccauccuggccaacauggugaaaccccaucucuacugaauacacaaaaauuggcuggacau

SEQ ID NO: 691914 - RNA, 64 nt, Homo Sapiens
aaacacuuuuuaaaaaauuguuugcuugaaaauacuacugaauauaaauaagaaugugcacagu

SEQ ID NO: 691915 - RNA, 64 nt, Homo Sapiens
gaacucuucaaaaugggcucuucuaaugaggucacuacugaacaaaauuguucccucuucuguu

SEQ ID NO: 691916 - RNA, 64 nt, Homo Sapiens
uccgagugaugauguugugagggggcgagugaaacuacugaaaacacguuagcuacugaauccu

SEQ ID NO: 691917 - RNA, 64 nt, Homo Sapiens
cugggggcgagugaaacuacaacugucacguuagcuacugaaucucuaggcaaaaggacaugga

SEQ ID NO: 691918 - RNA, 64 nt, Homo Sapiens
ucuagcauccuuagauuggcuuuuuuccacugaccuacugaauaaccacagugagaaccacuga

SEQ ID NO: 691919 - RNA, 64 nt, Homo Sapiens
acgggcccccuacggagauggagcagggccauuccuacugaaggcaagugagccaagaaccuag

SEQ ID NO: 691920 - RNA, 64 nt, Homo Sapiens
aauagacauaaauuguaauuugggaacauaaaaacuacugaauaaaucauguggccuaauauug

SEQ ID NO: 691921 - RNA, 64 nt, Homo Sapiens
gauugauuuaccuuuggaauugugcuccaaaugucuacugaagcuuaaccgaagaacuaauaaa

SEQ ID NO: 691922 - RNA, 64 nt, Homo Sapiens
aaagaaggggguaugcaccccauccuuauggaagcuacugaauagauauaacuuccguaaguua

SEQ ID NO: 691923 - RNA, 64 nt, Homo Sapiens
ccuuuacuguuaaauuuuuucuuauacugaauaacuacugaaucggaguuuuugaauuccaaac

SEQ ID NO: 691924 - RNA, 64 nt, Homo Sapiens
agaccagccuagccaacaugacgaaaccccaucucuacugaaaauagaaaaaaaaaauuagcca

SEQ ID NO: 691925 - RNA, 64 nt, Homo Sapiens
aacaaugauuguauggguacucaaaguauaauuucuacugaaugcauaucacuugugcacuguu

SEQ ID NO: 691926 - RNA, 64 nt, Homo Sapiens
uaauuuuauacuguccaccuaucuauauauucuucuacugaaaugauuuugauaucuuuggcuu

SEQ ID NO: 691927 - RNA, 64 nt, Homo Sapiens
cuguuuugcaaaguuuguauaagaacacauaacacuacugaauuauaaaaauucaaucauaaaa

SEQ ID NO: 691928 - RNA, 64 nt, Homo Sapiens
cagccaggcagagguuuuaaugucuguuuauuaacuacugaauaaugcuaccaggaugcuaaag

SEQ ID NO: 691929 - RNA, 64 nt, Homo Sapiens
acucccucugcagaaucccuuugcaccugagacccuacugaaguggcugguagaaaaaggggcc

SEQ ID NO: 691930 - RNA, 64 nt, Homo Sapiens
uguauugcuuucccaucaucgcgaaguaugguuucuacugaaugcagaaugguuguauggauau

SEQ ID NO: 691931 - RNA, 64 nt, Homo Sapiens
ucguagcuuagccaagccuaugaauacacccaaccuacugaacaauuggaaguugaaaaugcau

SEQ ID NO: 691932 - RNA, 64 nt, Homo Sapiens
cacuauaaugcacauugaagauuugagugugaaucuacugaaauaaauguaugacacugaaaag

SEQ ID NO: 691933 - RNA, 64 nt, Homo Sapiens
gcguagauauaggaaggcagauugacacaggaaccuacugaauaugcuccacauguacauaaga

SEQ ID NO: 691934 - RNA, 64 nt, Homo Sapiens
ggcuuuagaaauuacaacauaucagguuccccuacuacugaaguagccuuccgugagaacacac

SEQ ID NO: 691935 - RNA, 64 nt, Homo Sapiens
agaagugcuuaggguugaaaauugauuucauuugcuacugaauuugguaaauccuggguaacuu

SEQ ID NO: 691936 - RNA, 64 nt, Homo Sapiens
uuaucaaauaccuuuuaagcacuacugaaaaugacuacugaauuuuuccuauccauuuauagcu

SEQ ID NO: 691937 - RNA, 64 nt, Homo Sapiens
ugacuacugaauuuuaucaauccauuuauagcuacuacugaaaacuuuuuaagccuauuuccua

SEQ ID NO: 691938 - RNA, 64 nt, Homo Sapiens
guaggcaagggaaucuguuuacucccucuucccucuacugaauaauuuucccucuacugaauaa

SEQ ID NO: 691939 - RNA, 64 nt, Homo Sapiens
uacucccucuucccucuacugaauaauuuucccucuacugaauaauuuucccucuaagaauugc

SEQ ID NO: 691940 - RNA, 57 nt, Homo Sapiens; identical to SEQ ID NO: 458759

SEQ ID NO: 691941 - RNA, 64 nt, Homo Sapiens; identical to SEQ ID NO: 458760

SEQ ID NO: 691942 - RNA, 64 nt, Homo Sapiens; identical to SEQ ID NO: 458761

SEQ ID NO: 691943 - RNA, 64 nt, Homo Sapiens; identical to SEQ ID NO: 458762

SEQ ID NO: 691944 - RNA, 64 nt, Homo Sapiens; identical to SEQ ID NO: 458763

SEQ ID NO: 691945 - RNA, 64 nt, Homo Sapiens; identical to SEQ ID NO: 458764

SEQ ID NO: 691946 - RNA, 64 nt, Homo Sapiens; identical to SEQ ID NO: 458765

SEQ ID NO: 691947 - RNA, 64 nt, Homo Sapiens; identical to SEQ ID NO: 458766

SEQ ID NO: 691948 - RNA, 64 nt, Homo Sapiens; identical to SEQ ID NO: 458767

SEQ ID NO: 691949 - RNA, 64 nt, Homo Sapiens; identical to SEQ ID NO: 458768

SEQ ID NO: 691950 - RNA, 64 nt, Homo Sapiens; identical to SEQ ID NO: 458769

SEQ ID NO: 691951 - RNA, 64 nt, Homo Sapiens; identical to SEQ ID NO: 458770

SEQ ID NO: 691952 - RNA, 64 nt, Homo Sapiens; identical to SEQ ID NO: 458771

SEQ ID NO: 691953 - RNA, 64 nt, Homo Sapiens; identical to SEQ ID NO: 458772

SEQ ID NO: 691954 - RNA, 64 nt, Homo Sapiens; identical to SEQ ID NO: 458773

SEQ ID NO: 691955 - RNA, 64 nt, Homo Sapiens; identical to SEQ ID NO: 458774

SEQ ID NO: 691956 - RNA, 64 nt, Homo Sapiens; identical to SEQ ID NO: 77130

SEQ ID NO: 691957 - RNA, 64 nt, Homo Sapiens; identical to SEQ ID NO: 77131

SEQ ID NO: 691958 - RNA, 64 nt, Homo Sapiens; identical to SEQ ID NO: 77132

SEQ ID NO: 691959 - RNA, 64 nt, Homo Sapiens; identical to SEQ ID NO: 77133

SEQ ID NO: 691960 - RNA, 64 nt, Homo Sapiens; identical to SEQ ID NO: 77134

SEQ ID NO: 691961 - RNA, 64 nt, Homo Sapiens; identical to SEQ ID NO: 77135

SEQ ID NO: 691962 - RNA, 64 nt, Homo Sapiens; identical to SEQ ID NO: 77136

SEQ ID NO: 691963 - RNA, 62 nt, Homo Sapiens; identical to SEQ ID NO: 77137

SEQ ID NO: 691964 - RNA, 64 nt, Homo Sapiens; identical to SEQ ID NO: 77138

SEQ ID NO: 691965 - RNA, 64 nt, Homo Sapiens; identical to SEQ ID NO: 77139

SEQ ID NO: 691966 - RNA, 64 nt, Homo Sapiens; identical to SEQ ID NO: 77140

SEQ ID NO: 691967 - RNA, 64 nt, Homo Sapiens; identical to SEQ ID NO: 77141

SEQ ID NO: 691968 - RNA, 64 nt, Homo Sapiens; identical to SEQ ID NO: 77142

SEQ ID NO: 691969 - RNA, 64 nt, Homo Sapiens; identical to SEQ ID NO: 77143

SEQ ID NO: 691970 - RNA, 64 nt, Homo Sapiens; identical to SEQ ID NO: 77144

SEQ ID NO: 691971 - RNA, 64 nt, Homo Sapiens; identical to SEQ ID NO: 77145

SEQ ID NO: 691972 - RNA, 64 nt, Homo Sapiens; identical to SEQ ID NO: 77146

SEQ ID NO: 691973 - RNA, 64 nt, Homo Sapiens; identical to SEQ ID NO: 77147

SEQ ID NO: 691974 - RNA, 64 nt, Homo Sapiens; identical to SEQ ID NO: 77148

SEQ ID NO: 691975 - RNA, 64 nt, Homo Sapiens; identical to SEQ ID NO: 77149

SEQ ID NO: 691976 - RNA, 64 nt, Homo Sapiens; identical to SEQ ID NO: 77150

SEQ ID NO: 691977 - RNA, 64 nt, Homo Sapiens; identical to SEQ ID NO: 77151

SEQ ID NO: 691978 - RNA, 64 nt, Homo Sapiens; identical to SEQ ID NO: 77152

SEQ ID NO: 691979 - RNA, 64 nt, Homo Sapiens; identical to SEQ ID NO: 77153

SEQ ID NO: 691980 - RNA, 64 nt, Homo Sapiens; identical to SEQ ID NO: 77154

SEQ ID NO: 691981 - RNA, 64 nt, Homo Sapiens; identical to SEQ ID NO: 77155

SEQ ID NO: 691982 - RNA, 64 nt, Homo Sapiens; identical to SEQ ID NO: 77156

SEQ ID NO: 691983 - RNA, 64 nt, Homo Sapiens; identical to SEQ ID NO: 77157

SEQ ID NO: 691984 - RNA, 64 nt, Homo Sapiens; identical to SEQ ID NO: 77158

SEQ ID NO: 691985 - RNA, 64 nt, Homo Sapiens; identical to SEQ ID NO: 77159

SEQ ID NO: 691986 - RNA, 64 nt, Homo Sapiens; identical to SEQ ID NO: 77160

SEQ ID NO: 691987 - RNA, 64 nt, Homo Sapiens; identical to SEQ ID NO: 284841

SEQ ID NO: 691988 - RNA, 64 nt, Homo Sapiens; identical to SEQ ID NO: 284842

SEQ ID NO: 691989 - RNA, 64 nt, Homo Sapiens; identical to SEQ ID NO: 284843

SEQ ID NO: 691990 - RNA, 64 nt, Homo Sapiens; identical to SEQ ID NO: 284844

SEQ ID NO: 691991 - RNA, 64 nt, Homo Sapiens; identical to SEQ ID NO: 284845

SEQ ID NO: 691992 - RNA, 64 nt, Homo Sapiens; identical to SEQ ID NO: 284846

SEQ ID NO: 691993 - RNA, 64 nt, Homo Sapiens; identical to SEQ ID NO: 283021

SEQ ID NO: 691994 - RNA, 64 nt, Homo Sapiens; identical to SEQ ID NO: 283022

SEQ ID NO: 691995 - RNA, 64 nt, Homo Sapiens; identical to SEQ ID NO: 283023

SEQ ID NO: 691996 - RNA, 64 nt, Homo Sapiens; identical to SEQ ID NO: 283024

SEQ ID NO: 691997 - RNA, 64 nt, Homo Sapiens; identical to SEQ ID NO: 283025

SEQ ID NO: 691998 - RNA, 64 nt, Homo Sapiens; identical to SEQ ID NO: 283026

SEQ ID NO: 691999 - RNA, 64 nt, Homo Sapiens; identical to SEQ ID NO: 283027

SEQ ID NO: 692000 - RNA, 64 nt, Homo Sapiens; identical to SEQ ID NO: 283028

SEQ ID NO: 692001 - RNA, 64 nt, Homo Sapiens; identical to SEQ ID NO: 283029

SEQ ID NO: 692002 - RNA, 64 nt, Homo Sapiens; identical to SEQ ID NO: 283030

SEQ ID NO: 692003 - RNA, 64 nt, Homo Sapiens; identical to SEQ ID NO: 283031

SEQ ID NO: 692004 - RNA, 64 nt, Homo Sapiens; identical to SEQ ID NO: 283032

SEQ ID NO: 692005 - RNA, 64 nt, Homo Sapiens; identical to SEQ ID NO: 283033

SEQ ID NO: 692006 - RNA, 64 nt, Homo Sapiens; identical to SEQ ID NO: 283034

SEQ ID NO: 692007 - RNA, 64 nt, Homo Sapiens; identical to SEQ ID NO: 283035

SEQ ID NO: 692008 - RNA, 64 nt, Homo Sapiens; identical to SEQ ID NO: 283036

SEQ ID NO: 692009 - RNA, 64 nt, Homo Sapiens; identical to SEQ ID NO: 283037

SEQ ID NO: 692010 - RNA, 64 nt, Homo Sapiens; identical to SEQ ID NO: 283038

SEQ ID NO: 692011 - RNA, 64 nt, Homo Sapiens; identical to SEQ ID NO: 283039

SEQ ID NO: 692012 - RNA, 64 nt, Homo Sapiens; identical to SEQ ID NO: 283040

SEQ ID NO: 692013 - RNA, 64 nt, Homo Sapiens; identical to SEQ ID NO: 283041

SEQ ID NO: 692014 - RNA, 64 nt, Homo Sapiens; identical to SEQ ID NO: 283042

SEQ ID NO: 692015 - RNA, 64 nt, Homo Sapiens; identical to SEQ ID NO: 283043

SEQ ID NO: 692016 - RNA, 64 nt, Homo Sapiens; identical to SEQ ID NO: 283044

SEQ ID NO: 692017 - RNA, 62 nt, Homo Sapiens; identical to SEQ ID NO: 283045

SEQ ID NO: 692018 - RNA, 64 nt, Homo Sapiens
ucuaguuuugaauaagucugggugaccgcaccuaaaaugguaagcaguacccuccggcuuuuuc

SEQ ID NO: 692019 - RNA, 64 nt, Homo Sapiens
cuauuacucagcagcaguaacaugguaacacuuaaaaugguacucggggaccuccaaagacuaa

SEQ ID NO: 692020 - RNA, 64 nt, Homo Sapiens
guaaaacuuugaauaucccagcgaagaaauggauaaaugguacagugccuguggauaguacagu

SEQ ID NO: 692021 - RNA, 64 nt, Homo Sapiens
gcaucuacucaagguauuuuacagauuaccauggaaaugguagauacaguuuaaaagugcuuac

SEQ ID NO: 692022 - RNA, 64 nt, Homo Sapiens
auaaagaaauuauuuucaauuaaagcaaaaggacaaaugguaauauuccuagaaaagauuuaag

SEQ ID NO: 692023 - RNA, 64 nt, Homo Sapiens
acgcuguugcucauuuuaaagguuucuuuuguuaaaaugguauaguaagaaaauuauaagcuga

SEQ ID NO: 692024 - RNA, 64 nt, Homo Sapiens
uuauaggguggguauagaugaaacccauuucugaaaaugguacaccccuuagaaagucuucugc

SEQ ID NO: 692025 - RNA, 64 nt, Homo Sapiens
uuuuguuauguauauuuuaucauaaaaaugguuaaaaugguaaauaaugccacuaaauuguacc

SEQ ID NO: 692026 - RNA, 64 nt, Homo Sapiens
uaauagucaguuuucuagaaccuacuuuuaggguaaaugguacauuauuuaauauuauauuaaa

SEQ ID NO: 692027 - RNA, 64 nt, Homo Sapiens
uaaaccuccuauagcguggauuguagaccaaaggaaaugguacaauuucugagaauauauguug

SEQ ID NO: 692028 - RNA, 64 nt, Homo Sapiens
uaucgccaaugcaggaugcuccuuagaaaagaaaaaaugguaaagaauggcauuuaacgauuca

SEQ ID NO: 692029 - RNA, 64 nt, Homo Sapiens
cucccaacaacugcacuuuagaauaccagcagugaaaugguauuacuguuucccucugagugaa

SEQ ID NO: 692030 - RNA, 64 nt, Homo Sapiens
aaaaaaaacaaagauauucaaacugcuuggguucaaaugguauacaauuugccagcuguuacug

SEQ ID NO: 692031 - RNA, 64 nt, Homo Sapiens
cauauuguuggugagauaauauuuaauagguauaaaaugguaaaauaccuaguuuucuauuuag

SEQ ID NO: 692032 - RNA, 64 nt, Homo Sapiens
caaaacaaagauggacuuguucugggaaaagguaaaaugguaaucaaauagauuguguuccagg

SEQ ID NO: 692033 - RNA, 64 nt, Homo Sapiens
caugggcuguccaguccugauuauagagaggaagaaaugguaacaguauggcagauaagaauua

SEQ ID NO: 692034 - RNA, 64 nt, Homo Sapiens
uaaguuuuucauauuucauggacaacaaaagagaaaaugguaugaacacuguacaaacuuugau

SEQ ID NO: 692035 - RNA, 64 nt, Homo Sapiens
aauggaaagaagaacaaaauuauugcaauauuugaaaugguaaacagugguuuauggugggcaa

SEQ ID NO: 692036 - RNA, 64 nt, Homo Sapiens
uggagcuccugauucaaauuagacucaccuuuuuaaaugguacuaaaacacugaugguuuuuaa

SEQ ID NO: 692037 - RNA, 64 nt, Homo Sapiens
gauuuuuuuuucaaacacagauuacucagcuaaaaaaugguagaaggcacagaaagguuaaaug

SEQ ID NO: 692038 - RNA, 64 nt, Homo Sapiens
gaugauaacuaacauuuuuuuuuuagaaggauaaaaaugguaaugaacaaaguaaaugauucua

SEQ ID NO: 692039 - RNA, 64 nt, Homo Sapiens
uagcaacuagggcuagucuuggggcaauaggguuaaaugguaguccuacagugcuguguacccu

SEQ ID NO: 692040 - RNA, 64 nt, Homo Sapiens
aucaauaaaggacaggcuggaaaagaguccagguaaaugguaugcuuagauuguguuccugaag

SEQ ID NO: 692041 - RNA, 64 nt, Homo Sapiens
guugaaaaagaguuucauuguggagagaaaaagcaaaugguaugccacaagaucacucugauuu

SEQ ID NO: 692042 - RNA, 64 nt, Homo Sapiens
gcaauggaaaugcuauacguuuuugacauuuauuaaaugguaccaauaaaguauuuuauuacca

SEQ ID NO: 692043 - RNA, 64 nt, Homo Sapiens
agcguccucuuaaaagaugcggacuucccaagauaaaugguacccgucaacgcaacgucuaacu

SEQ ID NO: 692044 - RNA, 64 nt, Homo Sapiens
acguuaauuuauuaauaaauuuugcuuucagggaaaaugguauaagcagagguggaaaaauacu

SEQ ID NO: 692045 - RNA, 64 nt, Homo Sapiens
cuucccugcaguccaaagaugauuuuuucaccacaaaugguaagggaugcccaccuacuuuuau

SEQ ID NO: 692046 - RNA, 64 nt, Homo Sapiens
uccaggugccaacugcuaagcagauauauuccaaaaaugguaacugucaugugcacacuguugg

SEQ ID NO: 692047 - RNA, 64 nt, Homo Sapiens
gugugauuagugccuaggggucuccauuuagcagaaaugguaaugacagugauauaaugccugg

SEQ ID NO: 692048 - RNA, 64 nt, Homo Sapiens
uguuguuguuuuuuuaagcuucccuugagagaauaaaugguaauggagagaacuauuuaacaag

SEQ ID NO: 692049 - RNA, 64 nt, Homo Sapiens
ccacauauuucagugaggguacaugguuuccaaaaaaugguacugaauauugccauuaugcuug

SEQ ID NO: 692050 - RNA, 64 nt, Homo Sapiens
ucauucgcuacuaugauuuaagauuguaauauguaaaugguaugucccccuguuucagaggcuc

SEQ ID NO: 692051 - RNA, 64 nt, Homo Sapiens
agugggucaaauauuauaaaauaggcaaacaccaaaaugguauuaaauauugaacuccugaccu

SEQ ID NO: 692052 - RNA, 64 nt, Homo Sapiens
acagaaauggaacacuguaucuuuauauuccuaaaaaugguacuuuuggcauaauuaagaaauu

SEQ ID NO: 692053 - RNA, 64 nt, Homo Sapiens
ucccuuuuaaaccuguuaacuugaaggagaacagaaaugguauuacuucaauagugguagauuu

SEQ ID NO: 692054 - RNA, 64 nt, Homo Sapiens
acuaacuauaaauguaaugaauuauaauaauuauaaaugguauaaaugcauucuacaaugugau

SEQ ID NO: 692055 - RNA, 64 nt, Homo Sapiens
ucugaucauaucuacauguaccucuucccccuaaaaaugguaaagauaaauacaccuuuuuuuc

SEQ ID NO: 692056 - RNA, 64 nt, Homo Sapiens
cugaacccaaauuuguauaauuaccuucagaucuaaaugguaauuguaaauuuguauauguuau

SEQ ID NO: 692057 - RNA, 52 nt, Homo Sapiens; identical to SEQ ID NO: 475095

SEQ ID NO: 692058 - RNA, 64 nt, Homo Sapiens
uaucugcuaaacaggacuucagguaagugaggugaaaugguagccagugacccguuaggagcuc

SEQ ID NO: 692059 - RNA, 64 nt, Homo Sapiens
cgguguuucauacagaaugucuucauaucaucugaaaugguauggcugaaguucauuuguuuac

SEQ ID NO: 692060 - RNA, 64 nt, Homo Sapiens
guaucaaaagaaagugguuuucuucaaauguauacuauuuuacuuccugaaugugccaacuuug

SEQ ID NO: 692061 - RNA, 64 nt, Homo Sapiens
uugauuaauuuuuugaaguuauagauauguucuccuauuuuaaaagcaaaaauaacaauugaca

SEQ ID NO: 692062 - RNA, 64 nt, Homo Sapiens
acuucuccugggagacguauuaagacuggaaguccuauuuuauuuaaucaguaucaguaaaaag

SEQ ID NO: 692063 - RNA, 64 nt, Homo Sapiens
cacacacacuuauauauaaacacauguaauuuuacuauuuuauugucuuuccuuuaaucgauga

SEQ ID NO: 692064 - RNA, 64 nt, Homo Sapiens
aucaguuugaauuuucuuucucugacucucaucccuauuuuaccuauuuccauuuucgucuauc

SEQ ID NO: 692065 - RNA, 64 nt, Homo Sapiens
ccaagguguuagguuucacauauauauucaucaacuauuuuagaagauuuaauucuaucaaauc

SEQ ID NO: 692066 - RNA, 64 nt, Homo Sapiens
uuuuaaauagcaagccaauaacgagcuuugaaggcuauuuuaccauuccuguucacaaaagguu

SEQ ID NO: 692067 - RNA, 64 nt, Homo Sapiens
agauagauaccuuuuugcuuugggaaauaucuagcuauuuuaaugauauccuaggagggguguu

SEQ ID NO: 692068 - RNA, 64 nt, Homo Sapiens
aauuuguagaaauuauuuacaguguagacaacuccuauuuuacacuguagaauucuccaguuua

SEQ ID NO: 692069 - RNA, 64 nt, Homo Sapiens
uuaauaaaucuuuuugacaauauuugaaguacuucuauuuuaaguggaaaguugauuuugucug

SEQ ID NO: 692070 - RNA, 64 nt, Homo Sapiens
acccuauuuuuaagggaauugauacaaauuucaucuauuuuauucuaguaucaccaaauugagu

SEQ ID NO: 692071 - RNA, 64 nt, Homo Sapiens
ucauaauuuuguauuuagugacugggcagguccccuauuuuaagcauaauuuguucuuaaguau

SEQ ID NO: 692072 - RNA, 64 nt, Homo Sapiens
cuguuaugaaggaagguaaaauauucccaucccucuauuuuaauucuuaaguacaccuucaacu

SEQ ID NO: 692073 - RNA, 64 nt, Homo Sapiens
gacuuaaagaaauaauccaucugcaucccaaguccuauuuuauaaggauauucauaaaaauucc

SEQ ID NO: 692074 - RNA, 64 nt, Homo Sapiens
gguaucaaagaauagccacaauuagcugaaaaggcuauuuuaaaaacuuuuccaacugcguauc

SEQ ID NO: 692075 - RNA, 64 nt, Homo Sapiens
uauuaaaaagaaaucugauauauaaaaauauguacuauuuuaaggaaaaauuuccaagaaguuc

SEQ ID NO: 692076 - RNA, 64 nt, Homo Sapiens
agugauugguugaccuaaaccacuuugaauguuucuauuuuaugaaaugaaguuucucuucuua

SEQ ID NO: 692077 - RNA, 64 nt, Homo Sapiens
augguacguuacugaauguguuuuuaauggaacccuauuuuauaaauacaacugccaguaugua

SEQ ID NO: 692078 - RNA, 64 nt, Homo Sapiens
ggaagagagagaaaaacaccugggugucauaggucuauuuuaagauuugcaaacccuacaacuc

SEQ ID NO: 692079 - RNA, 64 nt, Homo Sapiens
auaucaaagggguuuacuauuuauuucaccagaacuauuuuaauaagguuuguuuauguuacau

SEQ ID NO: 692080 - RNA, 64 nt, Homo Sapiens
aauauuguuuccauuacacuuauagccacaacaucuauuuuacccuaauauaaagggagaugcu

SEQ ID NO: 692081 - RNA, 64 nt, Homo Sapiens
ugugguccacuuuccuacauuucuagaacuccaucuauuuuaccuuuuuaggcaguuaaaauac

SEQ ID NO: 692082 - RNA, 64 nt, Homo Sapiens
gugaagaauuuuuugucucugcauaguaugacuucuauuuuaauucauagugaguacgcucuau

SEQ ID NO: 692083 - RNA, 64 nt, Homo Sapiens
aacuuguuaaaagauaucuacagaaaaguccccacuauuuuacuauuuaauuacaauuuuuagc

SEQ ID NO: 692084 - RNA, 64 nt, Homo Sapiens
ucuuuguuggauauuuuaguaagcugggcaaugccuauuuuauuacuaguugagacauuaaagg

SEQ ID NO: 692085 - RNA, 64 nt, Homo Sapiens
aaaaaggccuaaugcauuauuuugucauaaaaugcuauuuuaaaauucauggaacuuucauacg

SEQ ID NO: 692086 - RNA, 64 nt, Homo Sapiens
guugcucucuguucaagucauuccacacauuucccuauuuuaggcuauuauaauauagaaagaa

SEQ ID NO: 692087 - RNA, 64 nt, Homo Sapiens
aaucauauuuuaggauuauugagcuauauuuuuucuauuuuaagaucauuuucccauugcaaca

SEQ ID NO: 692088 - RNA, 64 nt, Homo Sapiens
uuuaguguacacagggcuuuuacuugauuuuuggcuauuuuauaugaauuauaggucucaggcu

SEQ ID NO: 692089 - RNA, 64 nt, Homo Sapiens
auauuuuccucaccuauauauacguuaccuccaucuauuuuaggauaugugcuguaacaucaug

SEQ ID NO: 692090 - RNA, 64 nt, Homo Sapiens
aguaagccaagugcugucuauuucuuuuacgaagcuauuuuaaagcauuucuuuauaugauaua

SEQ ID NO: 692091 - RNA, 64 nt, Homo Sapiens
ggggguccauuuacaucaaauuuaagguguauagcuauuuuaaaaacuguuuauuauagauaau

SEQ ID NO: 692092 - RNA, 64 nt, Homo Sapiens
aguauuuauuuuagaaagucuuuauuuugaagcucuauuuuaaugguuuucuuuguauagaaua

SEQ ID NO: 692093 - RNA, 64 nt, Homo Sapiens
guuaggaagccccagcaggggaugaaaaaagagucuauuuuaguuuuaauguaaauagagagau

SEQ ID NO: 692094 - RNA, 64 nt, Homo Sapiens
auuuauauucagauuuguuugagaauaacucccacuauuuuaaauagaaaucccugggaauugc

SEQ ID NO: 692095 - RNA, 64 nt, Homo Sapiens
gcucuuguagugcuuuucuuaauagggaagcuugcuauuuuaaaaaaagacuauuuccccuuag

SEQ ID NO: 692096 - RNA, 64 nt, Homo Sapiens
acucuuaagcuuugagaaauuuucacauugaugacuauuuuaaaaucaaauaaaacuauuuuac

SEQ ID NO: 692097 - RNA, 64 nt, Homo Sapiens
uucacauugaugacuauuuuaaaaucaaauaaaacuauuuuacugguauggccuaacuugucuu

SEQ ID NO: 692098 - RNA, 64 nt, Homo Sapiens
agagcacaaaugagagugugagagaaaguaccuucuauuuuaauaauaauauuauuauaaaaau

SEQ ID NO: 692099 - RNA, 64 nt, Homo Sapiens
ggggacaagaaaaguagagguaggaaagaagacacuauuuuagcuaaugggguuucuugggacu

SEQ ID NO: 692100 - RNA, 64 nt, Homo Sapiens
ggaaaugggagugggagauaauauugggagguaucuauuuuaagucaggggcuuuacuagccga

SEQ ID NO: 692101 - RNA, 64 nt, Homo Sapiens
aauuccugucacuuucuguuuuccauuuaaauuucuauuuuacaaauuuuucagggaaucauau

SEQ ID NO: 692102 - RNA, 64 nt, Homo Sapiens
uaaauugaauuguaugagacuuuaucuauucuugcuauuuuauacugcuuucugucucuaugga

SEQ ID NO: 692103 - RNA, 64 nt, Homo Sapiens
gugagaaguucagugccacuuaacauaaaauuaacuauuuuaaauuauugagguaaacuucaca

SEQ ID NO: 692104 - RNA, 64 nt, Homo Sapiens
gauuuccuggugcuuagccugcuagauauugcuacuauuuuauaccucagugguaauaaauggu

SEQ ID NO: 692105 - RNA, 64 nt, Homo Sapiens
ggaaguaugaguugaaaaaaucuuuuggucagugcuauuuuaaacaugaagcucauguuaacuu

SEQ ID NO: 692106 - RNA, 64 nt, Homo Sapiens
uugcuuuuuuaaaaacucagcaccuuauuacaugcuauuuuauuuguguguguuuaauaggcuu

SEQ ID NO: 692107 - RNA, 64 nt, Homo Sapiens
agaaauguagucuuguaguaaauuuauaauucugcuauuuuaaagugguuagcaaucaauuuug

SEQ ID NO: 692108 - RNA, 64 nt, Homo Sapiens
aaauuugccuuaaaauaauguuccucaccacugacuauuuuaucuccacaaacacacuauauac

SEQ ID NO: 692109 - RNA, 64 nt, Homo Sapiens
acucauuccaaaauucaguaccaaaucacauuaucuauuuuagccugcuucagugucuuaauga

SEQ ID NO: 692110 - RNA, 64 nt, Homo Sapiens
ucucagagugauccugcugaguucaccuauaauccuauuuuaaaauucugcagucuuugcaaua

SEQ ID NO: 692111 - RNA, 64 nt, Homo Sapiens
auucguuuuccucaugggucuuccaagaaaugagcuauuuuauugaugccauuaaaaagcaagu

SEQ ID NO: 692112 - RNA, 64 nt, Homo Sapiens
uagauaugcuuauaccuaauuuuuaguuuuuaaacuauuuuaaaauauacuaugauuuuauaug

SEQ ID NO: 692113 - RNA, 64 nt, Homo Sapiens
guaaacuuuuaauauggcaaagcaaccuuaagcucuauuuuagccaaaugaaacauaaucugaa

SEQ ID NO: 692114 - RNA, 64 nt, Homo Sapiens
auaaaauaaagacuuucuuaaaggaaaauugcaccuauuuuaccuuuuuaagaguaagccauga

SEQ ID NO: 692115 - RNA, 64 nt, Homo Sapiens
uaaggaaagaauggagaaucuuaaacaaacuacucuauuuuaaaucucuaacugaauccacuuc

SEQ ID NO: 692116 - RNA, 64 nt, Homo Sapiens
uuauucugcaaaucuguaucagauugguauugcacuauuuuauuacagaagaguguuuauccug

SEQ ID NO: 692117 - RNA, 64 nt, Homo Sapiens
aauguguaguucauguaaauaauacauuauauuucuauuuuauuaugaagaaggugaauagcca

SEQ ID NO: 692118 - RNA, 64 nt, Homo Sapiens
aaaugucuuuaaugcaauauacuggaaagcuuuucuauuuuaauaaaaauaauuuuuauaugau

SEQ ID NO: 692119 - RNA, 64 nt, Homo Sapiens
agugacaucuuucuguauauaaacucuuuaacugcuauuuuagggaccuugcaguuugcacaua

SEQ ID NO: 692120 - RNA, 64 nt, Homo Sapiens
cauucauguguuauuuaauuuacacugaucucugcuauuuuaaccccccaaauaaguuauuugu

SEQ ID NO: 692121 - RNA, 64 nt, Homo Sapiens
uauuuuugguacugaugggauauggguggggaggcuauuuuagauauucuuuuagcaguguaga

SEQ ID NO: 692122 - RNA, 64 nt, Homo Sapiens
uuagguugaaccauauguaauugccaagauuuuacuauuuuaacuuagaaaaaccaucguuuca

SEQ ID NO: 692123 - RNA, 64 nt, Homo Sapiens
uuagaggcgcuguuuauuuacuguauacgucgaccuauuuuagaugcgcaucaguaugaaauug

SEQ ID NO: 692124 - RNA, 64 nt, Homo Sapiens
aaacuggcgauuuuaugaaaugucggcaaaaugacuauuuuauuguuugaagcgaguuaauauu

SEQ ID NO: 692125 - RNA, 64 nt, Homo Sapiens
augugccuaauguuaauuugauauucugacauugcuauuuuaccagaacuaagaacauauugag

SEQ ID NO: 692126 - RNA, 64 nt, Homo Sapiens
agugaugcaagcaucaugauuagagagacugcuccuauuuuaaauuaauccacugcaaggcacc

SEQ ID NO: 692127 - RNA, 64 nt, Homo Sapiens
ccauauagcaacgauauuuuagacacuauuuuugcuauuuuauaauguuuagaagaauauugga

SEQ ID NO: 692128 - RNA, 64 nt, Homo Sapiens
aagcccucccagugauuguggugggcccagccaccuauuuuaacuucucuguugcuaagugaca

SEQ ID NO: 692129 - RNA, 64 nt, Homo Sapiens
auuaaaggcugauggguggaucuagauuuaucagcuauuuuagcuuuuuggaaauauucuuggc

SEQ ID NO: 692130 - RNA, 64 nt, Homo Sapiens
ggaaaacacuccccucucccaguguacaggugcucuauuuuaaugagaacaugucuggaggggc

SEQ ID NO: 692131 - RNA, 64 nt, Homo Sapiens
uuaugggggaaaugcuucuuuuuguuugugauagcuauuuuaucauuuccuucauauuuuucuc

SEQ ID NO: 692132 - RNA, 64 nt, Homo Sapiens
ugaaacaagaaauucucuucauuuuaucccagugcuauuuuauugauuaauuacuaaaaaguau

SEQ ID NO: 692133 - RNA, 64 nt, Homo Sapiens
uggaugaguggacuucauauuaugacuagcuuuacuauuuuaauucaccuugcauaacuacuga

SEQ ID NO: 692134 - RNA, 64 nt, Homo Sapiens
cuauguguucagacugaaacuggagaaauuaugacuauuuuauuuauaguaguaguuaaaucug

SEQ ID NO: 692135 - RNA, 64 nt, Homo Sapiens
aaaaggcagcuauuaguguguccacuggaugucacuauuuuacuuuugagaaauauuucauuug

SEQ ID NO: 692136 - RNA, 64 nt, Homo Sapiens
aucauuuaugguuccagagacauuuuauaaaugccuauuuuaacuaucaugaaauucuccuugu

SEQ ID NO: 692137 - RNA, 64 nt, Homo Sapiens
cacuugggagaaggcuuagacaggguuucuguuacuauuuuaugcaucucaugcucuguggcuc

SEQ ID NO: 692138 - RNA, 64 nt, Homo Sapiens
uuuuaaugaauuaaaacuagauuauaccaauucacuauuuuauuaaauaaauugaaaauaacuc

SEQ ID NO: 692139 - RNA, 64 nt, Homo Sapiens
agcaauacguuugugcagaaucucuauguauauucuauuuuauuaaauuaauugaaucuaguau

SEQ ID NO: 692140 - RNA, 64 nt, Homo Sapiens
gaauauuuuugaggcgaaggcgucugucucuuggcuauuuuaaccuaaaauaacagucuaguua

SEQ ID NO: 692141 - RNA, 64 nt, Homo Sapiens
gcaccuggagggaaaggaauugcuuuuagcuucccuauuuuaguguaggcauaccccccaaguc

SEQ ID NO: 692142 - RNA, 64 nt, Homo Sapiens
aacacugucuucuuucgucuaauugaaguauaaacuauuuuauaucagguuucuacugcuaggc

SEQ ID NO: 692143 - RNA, 64 nt, Homo Sapiens
aguaucuuccauaauuuuuaagucugacacauuucuauuuuauucuaacauaaaaaaacuucca

SEQ ID NO: 692144 - RNA, 64 nt, Homo Sapiens
uauuuaauucacuuaacucugucuuuauaaguuccuauuuuagauggaauaagagaaacaaauu

SEQ ID NO: 692145 - RNA, 64 nt, Homo Sapiens
aauugcuacuguacuugcuuugaaagauuaccuacuauuuuaugauaaaauguaguugucucca

SEQ ID NO: 692146 - RNA, 64 nt, Homo Sapiens
uuucuguauauugcauagcauuacacauuuaugccuauuuuaacauuaacuucuaaagaaguuu

SEQ ID NO: 692147 - RNA, 64 nt, Homo Sapiens
uuuguauauugcauauucacaugaucauuguucacuauuuuaugaacuggccuucucaauguuu

SEQ ID NO: 692148 - RNA, 64 nt, Homo Sapiens
gagcccucagacaucuccagugugccagacaaauaggagugaguguaugugugugugugugugu

SEQ ID NO: 692149 - RNA, 64 nt, Homo Sapiens
ccugucucuauuagcuggguuccgggaggcagagaggagugaccgggcacuggcacugcgauca

SEQ ID NO: 692150 - RNA, 64 nt, Homo Sapiens
uugcuaaagcaugugaguaauuacuuaaaggcaaaggagugauaaagcaaaaagcaagaaucaa

SEQ ID NO: 692151 - RNA, 64 nt, Homo Sapiens
ugguuugaaucugaauuauaacaauuuugaguugaggagugauggggaggcagggagcuuuugg

SEQ ID NO: 692152 - RNA, 64 nt, Homo Sapiens
aaaagucauugagcauaagguguugauagcauguaggagugagacccuggggcacuccuccuua

SEQ ID NO: 692153 - RNA, 64 nt, Homo Sapiens
gggguuccuggagucucuagagucccgaaagcccaggagugaagaaagaggccccacgcuguag

SEQ ID NO: 692154 - RNA, 64 nt, Homo Sapiens
ggggcuaaucacuuagaguucuucaguuuauuagaggagugacuacagguuuucuuuacaacca

SEQ ID NO: 692155 - RNA, 64 nt, Homo Sapiens
aaugaaggcuauuugccaucccugccuuagacagaggagugaaagaauuaaguggguagacacc

SEQ ID NO: 692156 - RNA, 64 nt, Homo Sapiens
ugcaccuugcaaaaauggucccaacauugucuuuaggagugauugaaauacacaaguaaacauu

SEQ ID NO: 692157 - RNA, 63 nt, Homo Sapiens
agugacaugccaccgcaggagaagacccuccugaggagugaagacaagaacuacaggauguag

SEQ ID NO: 692158 - RNA, 64 nt, Homo Sapiens
agaaaguuaauggaguauuuagcagcguguaaauaggagugacgaccgcgaaugcaucagcuaa

SEQ ID NO: 692159 - RNA, 64 nt, Homo Sapiens
gagaacaaaaauacucuuauguauagaaaaaaguaggagugauauauuucagauuuuuaaaaua

SEQ ID NO: 692160 - RNA, 64 nt, Homo Sapiens
uaccccacccucagcaccccuuccauguggagaaaggagugaaaccuuuagggcagcuugcccc

SEQ ID NO: 692161 - RNA, 64 nt, Homo Sapiens
ggcccugaggugugggggcugcagcauguugcugaggagugaggaauaguugagccccaagucc

SEQ ID NO: 692162 - RNA, 64 nt, Homo Sapiens
gggagaacacguaacuguugaaaaacuaccugggaggagugaguuccuccaguuaaauguggcu

SEQ ID NO: 692163 - RNA, 64 nt, Homo Sapiens
caccaggccucuccaaggagacaguucauuauuuaggagugaauguguuccucuugcaauauua

SEQ ID NO: 692164 - RNA, 61 nt, Homo Sapiens
uuccaaagcuucgucuugugcccuccaauucccccuuaaacucucuuucccccacccuacu

SEQ ID NO: 692165 - RNA, 61 nt, Homo Sapiens
aaaauugcaugaaacuaggcuauuuucuaucccccuuaaaggauuuuuuuaaaguaguucc

SEQ ID NO: 692166 - RNA, 61 nt, Homo Sapiens
gccucaugccaacccugggcuauugcugcugccccuuaaacacaggcuguccuuaacccac

SEQ ID NO: 692167 - RNA, 61 nt, Homo Sapiens
uucuaauccuuuuccuuauuugccuucuacuccccuuaaucuaaucuaaaagcucuguucc

SEQ ID NO: 692168 - RNA, 61 nt, Homo Sapiens
gucuuugaacuuucucuuuuuauuuaacacuccccuuaacucauuuccccccagucagcau

SEQ ID NO: 692169 - RNA, 61 nt, Homo Sapiens
aacuugaagugauaugcagcguuuuuuuuuuccccuuaaaaugaugcauuuauuuuuaggu

SEQ ID NO: 692170 - RNA, 64 nt, Homo Sapiens; identical to SEQ ID NO: 657833

SEQ ID NO: 692171 - RNA, 64 nt, Homo Sapiens; identical to SEQ ID NO: 657834

SEQ ID NO: 692172 - RNA, 64 nt, Homo Sapiens; identical to SEQ ID NO: 657835

SEQ ID NO: 692173 - RNA, 64 nt, Homo Sapiens; identical to SEQ ID NO: 657836

SEQ ID NO: 692174 - RNA, 64 nt, Homo Sapiens
accaucuaaguagccauuuucgaacaauucaccaggcauguaaacucaucugcagaaaauguaa

SEQ ID NO: 692175 - RNA, 64 nt, Homo Sapiens
uuucuauuaagaaaaauguccugcugggcacaguggcauguaccuguugucucagcuauguggg

SEQ ID NO: 692176 - RNA, 64 nt, Homo Sapiens
ggauggcaaggggugggcauuggggugccaggcaggcauguacagacucuauaucucuauauau

SEQ ID NO: 692177 - RNA, 64 nt, Homo Sapiens
aaugcuucauuaaacugagugaaacugguuaaguggcauguaauaguaagugcucaauuaacau

SEQ ID NO: 692178 - RNA, 64 nt, Homo Sapiens
uacauagccacauuuacaguuuuaaccauuuuaaggcauguaauucagugggguuagguacauu

SEQ ID NO: 692179 - RNA, 64 nt, Homo Sapiens
agugucuguccugccaguccuccugcccuuggagggcauguagccagucgcuccuuaccgugac

SEQ ID NO: 692180 - RNA, 64 nt, Homo Sapiens
gacugccaggcccucccagguugccugccuuauaggcauguagagugagcacagcugcuugcca

SEQ ID NO: 692181 - RNA, 64 nt, Homo Sapiens
auucauuuacucauaguuugcauggucauuuuuaggcauguaucuggccacugauaguauaaac

SEQ ID NO: 692182 - RNA, 64 nt, Homo Sapiens
cagccucuuuuugauacugguccauugucguauaggcauguaaaaauaaaaaucucuuuuccac

SEQ ID NO: 692183 - RNA, 64 nt, Homo Sapiens
gcaauugucccaaugccacuacagguaagcuguaggcauguagauuggcagcccccuguaguug

SEQ ID NO: 692184 - RNA, 64 nt, Homo Sapiens
caauguuuccugcccacacuuugaaauaaaaauuggcauguagcuauuugugcaacauuacucu

SEQ ID NO: 692185 - RNA, 64 nt, Homo Sapiens
uugaaaaauaucuguuacaauuaaguuguuugaaggcauguauuagaaugaaugauuuuugcau

SEQ ID NO: 692186 - RNA, 64 nt, Homo Sapiens
caaaccucaucuuucuccuuucucacugaaagggggcauguauggucccccagauuccaacauu

SEQ ID NO: 692187 - RNA, 64 nt, Homo Sapiens
auguuacuugaaucugugcuucauaauaguguguggcauguaugugcagacucuuggaugcuuu

SEQ ID NO: 692188 - RNA, 64 nt, Homo Sapiens
gacugcucugggccggggguagagcuagcauccgggcauguacgagggaagagggaggcaggcc

SEQ ID NO: 692189 - RNA, 64 nt, Homo Sapiens
ugcugaauaugcaauuuguuauucuuuuauuaauggcauguaauauucugagcacgggcaaaga

SEQ ID NO: 692190 - RNA, 64 nt, Homo Sapiens
acggagggaggacaucauaaggaaguuauuaacgggcauguauuaucacaucaagcaugcaaua

SEQ ID NO: 692191 - RNA, 64 nt, Homo Sapiens
cuggcuaggcccacaccagggccuggcugggaguggcauguaugacgugacuggccugcuggau

SEQ ID NO: 692192 - RNA, 64 nt, Homo Sapiens
uaaccacuaauguuagaauugauuuccaagaaucggcauguauacuuaauacugaauuucuuug

SEQ ID NO: 692193 - RNA, 64 nt, Homo Sapiens
ccaagugaugagaagugaaucugaccuuagguucggcauguagaauacucaucuuuuuggaauc

SEQ ID NO: 692194 - RNA, 64 nt, Homo Sapiens
uuaaauucaaaucuacaguuggguaccacagauaggcauguaccaaaguuuuacauacuuaagu

SEQ ID NO: 692195 - RNA, 64 nt, Homo Sapiens
aagaauugaaaggaguugaacugccuuauguuugggcauguaacuccaaaauacuagguaguau

SEQ ID NO: 692196 - RNA, 64 nt, Homo Sapiens
uugaaaagcauuuugucauagcagucucaccucaggcauguauuuaccacaugcaaacauacaa

SEQ ID NO: 692197 - RNA, 64 nt, Homo Sapiens
acccugcaggggguggacaacaagggcucucuuaggcauguagguagcaagcuggccucuacca

SEQ ID NO: 692198 - RNA, 64 nt, Homo Sapiens
ggagguguuuuugccaucacacgcguucugccugggcauguaggguaaggcucggauggcaagg

SEQ ID NO: 692199 - RNA, 64 nt, Homo Sapiens
agccagucauuguaaccucgggaaacuaccagugggcauguauuaaauaaaacuaaggaacccu

SEQ ID NO: 692200 - RNA, 64 nt, Homo Sapiens
aaaccaaacaggcuaggggaauguuaucauaaguggcauguaucccugccuucuuucuccuuuu

SEQ ID NO: 692201 - RNA, 64 nt, Homo Sapiens
guagucacucaguauuuguaacuuaucuuaccucggcauguacugugauauucucccagaaugu

SEQ ID NO: 692202 - RNA, 64 nt, Homo Sapiens
uucauuugcuuagcuauuugaaagaagaaagacuggcauguaccacuuuugucuguuguguaua

SEQ ID NO: 692203 - RNA, 64 nt, Homo Sapiens
cagacaguacuaaauacuuauauuuuauuuuugaggcauguaauuuuaaaacugcaguagguua

SEQ ID NO: 692204 - RNA, 64 nt, Homo Sapiens
cuucugccucccacuccauaccccgccaaggaaaggcauguacaaaaauuaugcaauucagugu

SEQ ID NO: 692205 - RNA, 64 nt, Homo Sapiens
augagaugagcugaguuauagagagaaagggagaggcauguacgguguggggaaguggaagaga

SEQ ID NO: 692206 - RNA, 64 nt, Homo Sapiens
cauggugauaacacuaauugaauauaucuaugagggcauguauuaguuaauggaaaaaaaaaua

SEQ ID NO: 692207 - RNA, 64 nt, Homo Sapiens
cuauuuagcucuuaguaccacuaaucaaaaguucggcauguagcucaugaucuaugcuguuucu

SEQ ID NO: 692208 - RNA, 64 nt, Homo Sapiens
accugauucuggaggaacauaacaaaauaacgaaggcauguaagcagguuuuuaauuuugugau

SEQ ID NO: 692209 - RNA, 64 nt, Homo Sapiens
gcuaugccuggcuaauuuuucagcugggacuacaggcauguacuucaugccucagccucccaag

SEQ ID NO: 692210 - RNA, 64 nt, Homo Sapiens
auaagagguguucuccagaauggaggaacuacuuggcauguaagaaauagcgucaguguccuaa

SEQ ID NO: 692211 - RNA, 64 nt, Homo Sapiens
auaagagguguucuccagaauggaagaacgacuuggcauguaagaaauagcgucaguguccuaa

SEQ ID NO: 692212 - RNA, 64 nt, Homo Sapiens
gugacugcuuuaugaaaauaauagugucuucuauggcauguaauggauaccuaauaccgaugag

SEQ ID NO: 692213 - RNA, 64 nt, Homo Sapiens
acuuguguuucccugauaauguguacauuuuuuaggcauguacuuaauaguucacaauguucua

SEQ ID NO: 692214 - RNA, 64 nt, Homo Sapiens
caccauucaugaauaauaauaaauauguacugcuggcauguaaugcuuaguuuucuuguauuua

SEQ ID NO: 692215 - RNA, 64 nt, Homo Sapiens
cuucaaggcccugucaccacacuuaagggaagccggcauguaccuuugguuucccaucuaauca

SEQ ID NO: 692216 - RNA, 64 nt, Homo Sapiens
uaaauguuuuccuguagucauccauuuuguagagggcauguaaauaguuacuauguuuuguaaa

SEQ ID NO: 692217 - RNA, 64 nt, Homo Sapiens
agucagaguaagcaagagggacugagauuugauaggcauguagauuaagcaugaaaaugagaac

SEQ ID NO: 692218 - RNA, 64 nt, Homo Sapiens
uuuuuaugguacagauaguuauuaauguuuucguggcauguaaacuguauauuuaaaauuauaa

SEQ ID NO: 692219 - RNA, 64 nt, Homo Sapiens
guauuauguuuauacuuuaaccuagggaaaaaaaggcauguagauuguuuuauucccuugauga

SEQ ID NO: 692220 - RNA, 64 nt, Homo Sapiens
agggaggugggugggucaggaggggcugggguagggcauguagggagcaagguggagggugcag
